United States Patent 10,706,955 (BIOINFORMATIC PROCESSES FOR DETERMINATION OF PEPTIDE BINDING) - sequence listing, part 24

SEQ ID NO: 922416 - protein, 6 aa, Mycobacterium
WTGAGG

SEQ ID NO: 922417 - protein, 8 aa, Mycobacterium
WTGRGPRP

SEQ ID NO: 922418 - protein, 15 aa, Mycobacterium
WTGTPDPVRRGTRGP

SEQ ID NO: 922419 - protein, 20 aa, Mycobacterium
WTHSGTSQAPCPNGASAPVT

SEQ ID NO: 922420 - protein, 18 aa, Mycobacterium
WTPGGGREGDARSAYPRF

SEQ ID NO: 922421 - protein, 17 aa, Mycobacterium
WTSGEGDWAVTGGAAQL

SEQ ID NO: 922422 - protein, 13 aa, Mycobacterium
WTTPRREALQDAA

SEQ ID NO: 922423 - protein, 11 aa, Mycobacterium
WTTPTDGDLRR

SEQ ID NO: 922424 - protein, 14 aa, Mycobacterium
WTTPTSYDSRRGET

SEQ ID NO: 922425 - protein, 11 aa, Mycobacterium
WTTTANPANPA

SEQ ID NO: 922426 - protein, 13 aa, Mycobacterium
WYSTGTDFKRPSP

SEQ ID NO: 922427 - protein, 8 aa, Mycobacterium
YAAAGGRN

SEQ ID NO: 922428 - protein, 61 aa, Mycobacterium
YAAGADAESAAAEQDDTGETTPADAAAPALAAESATPPAPRRHRGADEEPRGQHANGQSAA

SEQ ID NO: 922429 - protein, 8 aa, Mycobacterium
YAAGPALR

SEQ ID NO: 922430 - protein, 25 aa, Mycobacterium
YAAGPDPASPATISAAGPAPAGPGC

SEQ ID NO: 922431 - protein, 4 aa, Mycobacterium
YAAQ

SEQ ID NO: 922432 - protein, 4 aa, Mycobacterium
YAAS

SEQ ID NO: 922433 - protein, 5 aa, Mycobacterium
YAASK

SEQ ID NO: 922434 - protein, 5 aa, Mycobacterium
YAATG

SEQ ID NO: 922435 - protein, 8 aa, Mycobacterium
YAATPSVT

SEQ ID NO: 922436 - protein, 16 aa, Mycobacterium
YADAANSSSTPTRGAD

SEQ ID NO: 922437 - protein, 7 aa, Mycobacterium
YADAAPD

SEQ ID NO: 922438 - protein, 12 aa, Mycobacterium
YADDPTSPGAEP

SEQ ID NO: 922439 - protein, 8 aa, Mycobacterium
YADPGGAQ

SEQ ID NO: 922440 - protein, 18 aa, Mycobacterium
YADPGTARDYNPDSNESL

SEQ ID NO: 922441 - protein, 6 aa, Mycobacterium
YADPNT

SEQ ID NO: 922442 - protein, 16 aa, Mycobacterium
YADRGDAFAAAVRAAI

SEQ ID NO: 922443 - protein, 5 aa, Mycobacterium
YADSG

SEQ ID NO: 922444 - protein, 11 aa, Mycobacterium
YAEDGSNDPAV

SEQ ID NO: 922445 - protein, 18 aa, Mycobacterium
YAEPGSARVYDPETDESI

SEQ ID NO: 922446 - protein, 19 aa, Mycobacterium
YAEPGTAKPYDPEGDESLA

SEQ ID NO: 922447 - protein, 18 aa, Mycobacterium
YAEPGTARDYNPDSNESL

SEQ ID NO: 922448 - protein, 9 aa, Mycobacterium
YAEPTTPGV

SEQ ID NO: 922449 - protein, 11 aa, Mycobacterium
YAEQAEAQAED

SEQ ID NO: 922450 - protein, 22 aa, Mycobacterium
YAESVGGVNGVPPHDKRHRTRV

SEQ ID NO: 922451 - protein, 8 aa, Mycobacterium
YAGAPPAD

SEQ ID NO: 922452 - protein, 8 aa, Mycobacterium
YAGGADAG

SEQ ID NO: 922453 - protein, 13 aa, Mycobacterium
YAGNRASLDGLPE

SEQ ID NO: 922454 - protein, 9 aa, Mycobacterium
YAGPGAGSL

SEQ ID NO: 922455 - protein, 9 aa, Mycobacterium
YAGPGTAHT

SEQ ID NO: 922456 - protein, 5 aa, Mycobacterium
YAGPP

SEQ ID NO: 922457 - protein, 9 aa, Mycobacterium
YAGSAGIDP

SEQ ID NO: 922458 - protein, 11 aa, Mycobacterium
YAGSRESLAGV

SEQ ID NO: 922459 - protein, 10 aa, Mycobacterium
YAGSRESLAP

SEQ ID NO: 922460 - protein, 10 aa, Mycobacterium
YAGSSESLAP

SEQ ID NO: 922461 - protein, 9 aa, Mycobacterium
YAKGRPADQ

SEQ ID NO: 922462 - protein, 9 aa, Mycobacterium
YAKQDPLSE

SEQ ID NO: 922463 - protein, 9 aa, Mycobacterium
YANDRTYQN

SEQ ID NO: 922464 - protein, 18 aa, Mycobacterium
YANPGTARDYNPDSNESL

SEQ ID NO: 922465 - protein, 10 aa, Mycobacterium
YAPAAADDKA

SEQ ID NO: 922466 - protein, 7 aa, Mycobacterium
YAPGSEA

SEQ ID NO: 922467 - protein, 7 aa, Mycobacterium
YAPGTKV

SEQ ID NO: 922468 - protein, 12 aa, Mycobacterium
YAPNEFKDPEGK

SEQ ID NO: 922469 - protein, 9 aa, Mycobacterium
YAPPDKTAY

SEQ ID NO: 922470 - protein, 17 aa, Mycobacterium
YAPSTRGPQNVGLSPAT

SEQ ID NO: 922471 - protein, 8 aa, Mycobacterium
YAPTADGD

SEQ ID NO: 922472 - protein, 19 aa, Mycobacterium
YAQPGSASAYTDNPDESIA

SEQ ID NO: 922473 - protein, 10 aa, Mycobacterium
YARNTPGYDE

SEQ ID NO: 922474 - protein, 9 aa, Mycobacterium
YARSASQPW

SEQ ID NO: 922475 - protein, 9 aa, Mycobacterium
YASAAEEES

SEQ ID NO: 922476 - protein, 8 aa, Mycobacterium
YASATGPV

SEQ ID NO: 922477 - protein, 13 aa, Mycobacterium
YASDGDGDGKADV

SEQ ID NO: 922478 - protein, 15 aa, Mycobacterium
YASDGDSDGVPDPQN

SEQ ID NO: 922479 - protein, 9 aa, Mycobacterium
YASGAPAVG

SEQ ID NO: 922480 - protein, 7 aa, Mycobacterium
YASGTYD

SEQ ID NO: 922481 - protein, 12 aa, Mycobacterium
YASNGGQNPEAG

SEQ ID NO: 922482 - protein, 6 aa, Mycobacterium
YASTRH

SEQ ID NO: 922483 - protein, 7 aa, Mycobacterium
YATDGGL

SEQ ID NO: 922484 - protein, 11 aa, Mycobacterium
YATGGNGGDGG

SEQ ID NO: 922485 - protein, 14 aa, Mycobacterium
YATSAPGAFDSNED

SEQ ID NO: 922486 - protein, 8 aa, Mycobacterium
YAVSASKT

SEQ ID NO: 922487 - protein, 4 aa, Mycobacterium
YDAA

SEQ ID NO: 922488 - protein, 14 aa, Mycobacterium
YDAATGQVTVTPAT

SEQ ID NO: 922489 - protein, 18 aa, Mycobacterium
YDAGGEVPVQQSTQRLSE

SEQ ID NO: 922490 - protein, 7 aa, Mycobacterium
YDANASR

SEQ ID NO: 922491 - protein, 10 aa, Mycobacterium
YDAPAPNWHP

SEQ ID NO: 922492 - protein, 9 aa, Mycobacterium
YDDAGLDTA

SEQ ID NO: 922493 - protein, 6 aa, Mycobacterium
YDDPDL

SEQ ID NO: 922494 - protein, 6 aa, Mycobacterium
YDDPEF

SEQ ID NO: 922495 - protein, 13 aa, Mycobacterium
YDDPPEPGQTSNT

SEQ ID NO: 922496 - protein, 9 aa, Mycobacterium
YDEDRDETT

SEQ ID NO: 922497 - protein, 7 aa, Mycobacterium
YDEGNAE

SEQ ID NO: 922498 - protein, 5 aa, Mycobacterium
YDESA

SEQ ID NO: 922499 - protein, 8 aa, Mycobacterium
YDEYTNAA

SEQ ID NO: 922500 - protein, 8 aa, Mycobacterium
YDGDTAYT

SEQ ID NO: 922501 - protein, 7 aa, Mycobacterium
YDGGGFG

SEQ ID NO: 922502 - protein, 4 aa, Mycobacterium
YDGI

SEQ ID NO: 922503 - protein, 8 aa, Mycobacterium
YDGKSSAD

SEQ ID NO: 922504 - protein, 7 aa, Mycobacterium
YDGYSAT

SEQ ID NO: 922505 - protein, 17 aa, Mycobacterium
YDKSWADGRGAAPADRR

SEQ ID NO: 922506 - protein, 18 aa, Mycobacterium
YDNNDSSPPTDQIGGAPD

SEQ ID NO: 922507 - protein, 8 aa, Mycobacterium
YDNNSCTA

SEQ ID NO: 922508 - protein, 9 aa, Mycobacterium
YDNPAAGQA

SEQ ID NO: 922509 - protein, 4 aa, Mycobacterium
YDPA

SEQ ID NO: 922510 - protein, 6 aa, Mycobacterium
YDPDND

SEQ ID NO: 922511 - protein, 4 aa, Mycobacterium
YDPN

SEQ ID NO: 922512 - protein, 8 aa, Mycobacterium
YDPNGDPL

SEQ ID NO: 922513 - protein, 25 aa, Mycobacterium
YDPPSSRGRPGPLSGPDLADPAHPL

SEQ ID NO: 922514 - protein, 6 aa, Mycobacterium
YDQGKQ

SEQ ID NO: 922515 - protein, 7 aa, Mycobacterium
YDQPGLG

SEQ ID NO: 922516 - protein, 5 aa, Mycobacterium
YDRGP

SEQ ID NO: 922517 - protein, 27 aa, Mycobacterium
YDRGPARKPGQLSWGTGSTPTYFGPTG

SEQ ID NO: 922518 - protein, 9 aa, Mycobacterium
YDSDDPSSP

SEQ ID NO: 922519 - protein, 15 aa, Mycobacterium
YDSDLDPVNGGGGSL

SEQ ID NO: 922520 - protein, 9 aa, Mycobacterium
YDSEPADVA

SEQ ID NO: 922521 - protein, 9 aa, Mycobacterium
YDSEPDDVA

SEQ ID NO: 922522 - protein, 9 aa, Mycobacterium
YDSNDPGSP

SEQ ID NO: 922523 - protein, 9 aa, Mycobacterium
YDSNDPNSP

SEQ ID NO: 922524 - protein, 10 aa, Mycobacterium
YDVDDRNQNP

SEQ ID NO: 922525 - protein, 11 aa, Mycobacterium
YEAASDTPQGL

SEQ ID NO: 922526 - protein, 26 aa, Mycobacterium
YEAEGPAAFEPRSRRPHTNPRAVAGD

SEQ ID NO: 922527 - protein, 11 aa, Mycobacterium
YEANSDNPSGM

SEQ ID NO: 922528 - protein, 10 aa, Mycobacterium
YEASDGVDGR

SEQ ID NO: 922529 - protein, 39 aa, Mycobacterium
YEASPYGNGGNGGNGVNGGSGGKGGSAGQVGGTPGQNGS

SEQ ID NO: 922530 - protein, 11 aa, Mycobacterium
YEASSDNPSGL

SEQ ID NO: 922531 - protein, 8 aa, Mycobacterium
YEATQNRA

SEQ ID NO: 922532 - protein, 4 aa, Mycobacterium
YEEA

SEQ ID NO: 922533 - protein, 4 aa, Mycobacterium
YEES

SEQ ID NO: 922534 - protein, 20 aa, Mycobacterium
YEGGGLQSGPGSAEGSTANN

SEQ ID NO: 922535 - protein, 7 aa, Mycobacterium
YEGQPEA

SEQ ID NO: 922536 - protein, 16 aa, Mycobacterium
YEGQSAVKTAKTIDQA

SEQ ID NO: 922537 - protein, 13 aa, Mycobacterium
YEGQSAVKTARTI

SEQ ID NO: 922538 - protein, 15 aa, Mycobacterium
YEGQSAVKTSKTIDR

SEQ ID NO: 922539 - protein, 16 aa, Mycobacterium
YEGRDRGGHYTNDQDA

SEQ ID NO: 922540 - protein, 7 aa, Mycobacterium
YEGTEDT

SEQ ID NO: 922541 - protein, 7 aa, Mycobacterium
YEKDTPI

SEQ ID NO: 922542 - protein, 11 aa, Mycobacterium
YEKGAGGSFDG

SEQ ID NO: 922543 - protein, 13 aa, Mycobacterium
YEPDTRVNGQLTR

SEQ ID NO: 922544 - protein, 5 aa, Mycobacterium
YEPGP

SEQ ID NO: 922545 - protein, 12 aa, Mycobacterium
YEPTPGDIRKAA

SEQ ID NO: 922546 - protein, 8 aa, Mycobacterium
YEQERKPH

SEQ ID NO: 922547 - protein, 19 aa, Mycobacterium
YEQGAHQPTYEGANPHVPL

SEQ ID NO: 922548 - protein, 15 aa, Mycobacterium
YERGPLGLPTSAEIQ

SEQ ID NO: 922549 - protein, 7 aa, Mycobacterium
YERPPLS

SEQ ID NO: 922550 - protein, 7 aa, Mycobacterium
YESERRP

SEQ ID NO: 922551 - protein, 6 aa, Mycobacterium
YESPAY

SEQ ID NO: 922552 - protein, 7 aa, Mycobacterium
YESRDPK

SEQ ID NO: 922553 - protein, 6 aa, Mycobacterium
YESSTL

SEQ ID NO: 922554 - protein, 26 aa, Mycobacterium
YETAAPDPAGAAHPAGVAEGPRGTDP

SEQ ID NO: 922555 - protein, 9 aa, Mycobacterium
YETDRTPVE

SEQ ID NO: 922556 - protein, 7 aa, Mycobacterium
YEVDGPP

SEQ ID NO: 922557 - protein, 13 aa, Mycobacterium
YEVTGAGSDTFEG

SEQ ID NO: 922558 - protein, 9 aa, Mycobacterium
YGAEVSDTI

SEQ ID NO: 922559 - protein, 9 aa, Mycobacterium
YGAGPCSGQ

SEQ ID NO: 922560 - protein, 8 aa, Mycobacterium
YGAPPFNG

SEQ ID NO: 922561 - protein, 6 aa, Mycobacterium
YGAQDE

SEQ ID NO: 922562 - protein, 5 aa, Mycobacterium
YGARQ

SEQ ID NO: 922563 - protein, 4 aa, Mycobacterium
YGAS

SEQ ID NO: 922564 - protein, 18 aa, Mycobacterium
YGASGDQSRGVLDGKPAD

SEQ ID NO: 922565 - protein, 18 aa, Mycobacterium
YGASGDQSRGVVDGKPAD

SEQ ID NO: 922566 - protein, 9 aa, Mycobacterium
YGDAYDPGA

SEQ ID NO: 922567 - protein, 37 aa, Mycobacterium
YGDKNAAQTQFTTASDEVKACDGKTYNFTDPDGNKVP

SEQ ID NO: 922568 - protein, 4 aa, Mycobacterium
YGDP

SEQ ID NO: 922569 - protein, 6 aa, Mycobacterium
YGDSPA

SEQ ID NO: 922570 - protein, 7 aa, Mycobacterium
YGDTDRT

SEQ ID NO: 922571 - protein, 9 aa, Mycobacterium
YGDTPEGRR

SEQ ID NO: 922572 - protein, 12 aa, Mycobacterium
YGEADKARNVTR

SEQ ID NO: 922573 - protein, 4 aa, Mycobacterium
YGED

SEQ ID NO: 922574 - protein, 11 aa, Mycobacterium
YGEGDLPRNVT

SEQ ID NO: 922575 - protein, 6 aa, Mycobacterium
YGEGPD

SEQ ID NO: 922576 - protein, 20 aa, Mycobacterium
YGEPVSVTTETCEQAVPEGL

SEQ ID NO: 922577 - protein, 5 aa, Mycobacterium
YGEQY

SEQ ID NO: 922578 - protein, 9 aa, Mycobacterium
YGGAPQGSR

SEQ ID NO: 922579 - protein, 12 aa, Mycobacterium
YGGATDSRGTAV

SEQ ID NO: 922580 - protein, 10 aa, Mycobacterium
YGGDDAASRL

SEQ ID NO: 922581 - protein, 24 aa, Mycobacterium
YGGGNTDGPTTSTDTAPAAPEANT

SEQ ID NO: 922582 - protein, 16 aa, Mycobacterium
YGGGPAAADPAAPDNL

SEQ ID NO: 922583 - protein, 7 aa, Mycobacterium
YGGRPGH

SEQ ID NO: 922584 - protein, 10 aa, Mycobacterium
YGGSAAPLSV

SEQ ID NO: 922585 - protein, 5 aa, Mycobacterium
YGGTA

SEQ ID NO: 922586 - protein, 14 aa, Mycobacterium
YGGTGYPAGKGGVN

SEQ ID NO: 922587 - protein, 5 aa, Mycobacterium
YGGTP

SEQ ID NO: 922588 - protein, 19 aa, Mycobacterium
YGGTPSTNCPNCNGASRRN

SEQ ID NO: 922589 - protein, 8 aa, Mycobacterium
YGGVDGNG

SEQ ID NO: 922590 - protein, 8 aa, Mycobacterium
YGHPDTAA

SEQ ID NO: 922591 - protein, 16 aa, Mycobacterium
YGHRGDTFAAAVRAAL

SEQ ID NO: 922592 - protein, 10 aa, Mycobacterium
YGIGEATARR

SEQ ID NO: 922593 - protein, 21 aa, Mycobacterium
YGIGNSNPNKVVTTDFKIVAD

SEQ ID NO: 922594 - protein, 21 aa, Mycobacterium
YGINSSNPNKVVTTEFKIVAE

SEQ ID NO: 922595 - protein, 15 aa, Mycobacterium
YGIPRRSMKVQAYWM

SEQ ID NO: 922596 - protein, 13 aa, Mycobacterium
YGKDTAQIQPSRF

SEQ ID NO: 922597 - protein, 15 aa, Mycobacterium
YGKPGGSAPSDFTRG

SEQ ID NO: 922598 - protein, 25 aa, Mycobacterium
YGKPGGTAPSDFRRGAAGGVADAKT

SEQ ID NO: 922599 - protein, 13 aa, Mycobacterium
YGKPGGTAPSDFT

SEQ ID NO: 922600 - protein, 4 aa, Mycobacterium
YGKT

SEQ ID NO: 922601 - protein, 5 aa, Mycobacterium
YGLPY

SEQ ID NO: 922602 - protein, 9 aa, Mycobacterium
YGNGTQAER

SEQ ID NO: 922603 - protein, 5 aa, Mycobacterium
YGNNG

SEQ ID NO: 922604 - protein, 9 aa, Mycobacterium
YGNPSERTT

SEQ ID NO: 922605 - protein, 5 aa, Mycobacterium
YGNPV

SEQ ID NO: 922606 - protein, 6 aa, Mycobacterium
YGNSPA

SEQ ID NO: 922607 - protein, 36 aa, Mycobacterium
YGPGPAGGLPPSEIGNKNPATVNPANPTPGLAATTE

SEQ ID NO: 922608 - protein, 10 aa, Mycobacterium
YGPGQSLTNA

SEQ ID NO: 922609 - protein, 11 aa, Mycobacterium
YGPGQSLTNSY

SEQ ID NO: 922610 - protein, 9 aa, Mycobacterium
YGPPGMPAG

SEQ ID NO: 922611 - protein, 5 aa, Mycobacterium
YGPQD

SEQ ID NO: 922612 - protein, 6 aa, Mycobacterium
YGPQGQ

SEQ ID NO: 922613 - protein, 15 aa, Mycobacterium
YGPQTAEFRTDGRIA

SEQ ID NO: 922614 - protein, 11 aa, Mycobacterium
YGPRQDPHGEA

SEQ ID NO: 922615 - protein, 5 aa, Mycobacterium
YGPSG

SEQ ID NO: 922616 - protein, 11 aa, Mycobacterium
YGPSGTTGSVS

SEQ ID NO: 922617 - protein, 4 aa, Mycobacterium
YGPT

SEQ ID NO: 922618 - protein, 15 aa, Mycobacterium
YGPTADGEPGNDDLG

SEQ ID NO: 922619 - protein, 6 aa, Mycobacterium
YGPTEA

SEQ ID NO: 922620 - protein, 7 aa, Mycobacterium
YGPTEAT

SEQ ID NO: 922621 - protein, 6 aa, Mycobacterium
YGPTES

SEQ ID NO: 922622 - protein, 5 aa, Mycobacterium
YGPVQ

SEQ ID NO: 922623 - protein, 10 aa, Mycobacterium
YGQPRPEAAA

SEQ ID NO: 922624 - protein, 12 aa, Mycobacterium
YGQPRPEAASSL

SEQ ID NO: 922625 - protein, 5 aa, Mycobacterium
YGRAT

SEQ ID NO: 922626 - protein, 5 aa, Mycobacterium
YGRGA

SEQ ID NO: 922627 - protein, 7 aa, Mycobacterium
YGRNDSA

SEQ ID NO: 922628 - protein, 9 aa, Mycobacterium
YGRPAEDSL

SEQ ID NO: 922629 - protein, 10 aa, Mycobacterium
YGRPPETRST

SEQ ID NO: 922630 - protein, 11 aa, Mycobacterium
YGSAAATEHWE

SEQ ID NO: 922631 - protein, 7 aa, Mycobacterium
YGSAQSE

SEQ ID NO: 922632 - protein, 24 aa, Mycobacterium
YGSCSNSSSQTSAQTEGTAQWSPL

SEQ ID NO: 922633 - protein, 4 aa, Mycobacterium
YGSG

SEQ ID NO: 922634 - protein, 11 aa, Mycobacterium
YGSPKGNCDTT

SEQ ID NO: 922635 - protein, 6 aa, Mycobacterium
YGSTTV

SEQ ID NO: 922636 - protein, 9 aa, Mycobacterium
YGTKEAGAY

SEQ ID NO: 922637 - protein, 18 aa, Mycobacterium
YGTSADVDVESETHTGTQ

SEQ ID NO: 922638 - protein, 4 aa, Mycobacterium
YGTT

SEQ ID NO: 922639 - protein, 4 aa, Mycobacterium
YGVP

SEQ ID NO: 922640 - protein, 16 aa, Mycobacterium
YGVSGGDEIRRSDAPR

SEQ ID NO: 922641 - protein, 4 aa, Mycobacterium
YGYG

SEQ ID NO: 922642 - protein, 10 aa, Mycobacterium
YHEAEPPGNH

SEQ ID NO: 922643 - protein, 13 aa, Mycobacterium
YHGPDGQTVADRD

SEQ ID NO: 922644 - protein, 5 aa, Mycobacterium
YHPSA

SEQ ID NO: 922645 - protein, 6 aa, Mycobacterium
YHPSAT

SEQ ID NO: 922646 - protein, 5 aa, Mycobacterium
YIPNS

SEQ ID NO: 922647 - protein, 17 aa, Mycobacterium
YITPGGTGGSGATGGSQ

SEQ ID NO: 922648 - protein, 13 aa, Mycobacterium
YKDPNSPNRQQHG

SEQ ID NO: 922649 - protein, 28 aa, Mycobacterium
YKDTDEEPEPPQGREARPNRSQREEELS

SEQ ID NO: 922650 - protein, 8 aa, Mycobacterium
YKEASAAF

SEQ ID NO: 922651 - protein, 7 aa, Mycobacterium
YKEATRA

SEQ ID NO: 922652 - protein, 7 aa, Mycobacterium
YKGDASR

SEQ ID NO: 922653 - protein, 13 aa, Mycobacterium
YKGPSSPAEERGA

SEQ ID NO: 922654 - protein, 7 aa, Mycobacterium
YKGQAGG

SEQ ID NO: 922655 - protein, 5 aa, Mycobacterium
YKGRN

SEQ ID NO: 922656 - protein, 9 aa, Mycobacterium
YKGRSDEQV

SEQ ID NO: 922657 - protein, 20 aa, Mycobacterium
YKNPNPQAWATSDDDGILGR

SEQ ID NO: 922658 - protein, 12 aa, Mycobacterium
YKPRATDAPDAL

SEQ ID NO: 922659 - protein, 8 aa, Mycobacterium
YKPTQAGA

SEQ ID NO: 922660 - protein, 29 aa, Mycobacterium
YKRNDPGRVTVTTTEETVVEDESEITQTA

SEQ ID NO: 922661 - protein, 12 aa, Mycobacterium
YKTDPDAELERP

SEQ ID NO: 922662 - protein, 23 aa, Mycobacterium
YKVEGNGSGSPAPTPANPGPPEV

SEQ ID NO: 922663 - protein, 9 aa, Mycobacterium
YLSGEGGLK

SEQ ID NO: 922664 - protein, 13 aa, Mycobacterium
YLSPRNADGAFPL

SEQ ID NO: 922665 - protein, 10 aa, Mycobacterium
YMGGSTSTIS

SEQ ID NO: 922666 - protein, 8 aa, Mycobacterium
YMNGPSRA

SEQ ID NO: 922667 - protein, 12 aa, Mycobacterium
YNDADGARRGAM

SEQ ID NO: 922668 - protein, 11 aa, Mycobacterium
YNESPYTVSPE

SEQ ID NO: 922669 - protein, 6 aa, Mycobacterium
YNNPNL

SEQ ID NO: 922670 - protein, 24 aa, Mycobacterium
YNPGPPPPPPFTGRPPGTPPPGAA

SEQ ID NO: 922671 - protein, 5 aa, Mycobacterium
YNPGW

SEQ ID NO: 922672 - protein, 5 aa, Mycobacterium
YNQER

SEQ ID NO: 922673 - protein, 8 aa, Mycobacterium
YNRAPNDA

SEQ ID NO: 922674 - protein, 19 aa, Mycobacterium
YNRDDRITGTTIDAPEKSW

SEQ ID NO: 922675 - protein, 6 aa, Mycobacterium
YNSGHR

SEQ ID NO: 922676 - protein, 13 aa, Mycobacterium
YNSPPRPSGTGRN

SEQ ID NO: 922677 - protein, 5 aa, Mycobacterium
YNTER

SEQ ID NO: 922678 - protein, 8 aa, Mycobacterium
YNTGDGPR

SEQ ID NO: 922679 - protein, 36 aa, Mycobacterium
YNTLSPGQRAQLAAPAPVPPPPAAEPGEAGDAPEPL

SEQ ID NO: 922680 - protein, 10 aa, Mycobacterium
YNTYPGKDHR

SEQ ID NO: 922681 - protein, 4 aa, Mycobacterium
YPAA

SEQ ID NO: 922682 - protein, 7 aa, Mycobacterium
YPADTEV

SEQ ID NO: 922683 - protein, 9 aa, Mycobacterium
YPAGAVSAA

SEQ ID NO: 922684 - protein, 7 aa, Mycobacterium
YPAGTTV

SEQ ID NO: 922685 - protein, 7 aa, Mycobacterium
YPANGQP

SEQ ID NO: 922686 - protein, 7 aa, Mycobacterium
YPAPAEH

SEQ ID NO: 922687 - protein, 8 aa, Mycobacterium
YPAQRADA

SEQ ID NO: 922688 - protein, 22 aa, Mycobacterium
YPASDDYHASASIGSDDAAAHI

SEQ ID NO: 922689 - protein, 10 aa, Mycobacterium
YPASDNFTGG

SEQ ID NO: 922690 - protein, 8 aa, Mycobacterium
YPASGDFG

SEQ ID NO: 922691 - protein, 7 aa, Mycobacterium
YPATASA

SEQ ID NO: 922692 - protein, 9 aa, Mycobacterium
YPDADTATA

SEQ ID NO: 922693 - protein, 7 aa, Mycobacterium
YPDADVA

SEQ ID NO: 922694 - protein, 9 aa, Mycobacterium
YPDAPTGAA

SEQ ID NO: 922695 - protein, 9 aa, Mycobacterium
YPDAPTGTA

SEQ ID NO: 922696 - protein, 5 aa, Mycobacterium
YPDAQ

SEQ ID NO: 922697 - protein, 6 aa, Mycobacterium
YPDEKS

SEQ ID NO: 922698 - protein, 8 aa, Mycobacterium
YPDGPHNA

SEQ ID NO: 922699 - protein, 7 aa, Mycobacterium
YPDGTEA

SEQ ID NO: 922700 - protein, 10 aa, Mycobacterium
YPDGVPPTDS

SEQ ID NO: 922701 - protein, 8 aa, Mycobacterium
YPDPQVGT

SEQ ID NO: 922702 - protein, 7 aa, Mycobacterium
YPDQKSI

SEQ ID NO: 922703 - protein, 6 aa, Mycobacterium
YPDQQA

SEQ ID NO: 922704 - protein, 11 aa, Mycobacterium
YPDQSQYSPLY

SEQ ID NO: 922705 - protein, 10 aa, Mycobacterium
YPDSADRDRD

SEQ ID NO: 922706 - protein, 8 aa, Mycobacterium
YPDSGVGA

SEQ ID NO: 922707 - protein, 7 aa, Mycobacterium
YPDSQVA

SEQ ID NO: 922708 - protein, 7 aa, Mycobacterium
YPDSQVG

SEQ ID NO: 922709 - protein, 10 aa, Mycobacterium
YPEGVPPTDR

SEQ ID NO: 922710 - protein, 10 aa, Mycobacterium
YPEGVPPTDS

SEQ ID NO: 922711 - protein, 14 aa, Mycobacterium
YPEPEAAAEPVAHG

SEQ ID NO: 922712 - protein, 11 aa, Mycobacterium
YPERPAPGRGT

SEQ ID NO: 922713 - protein, 5 aa, Mycobacterium
YPETV

SEQ ID NO: 922714 - protein, 11 aa, Mycobacterium
YPGADEAVRSD

SEQ ID NO: 922715 - protein, 8 aa, Mycobacterium
YPGANTAA

SEQ ID NO: 922716 - protein, 8 aa, Mycobacterium
YPGGAGFA

SEQ ID NO: 922717 - protein, 6 aa, Mycobacterium
YPGGHA

SEQ ID NO: 922718 - protein, 8 aa, Mycobacterium
YPGKARGV

SEQ ID NO: 922719 - protein, 9 aa, Mycobacterium
YPGRTDTDM

SEQ ID NO: 922720 - protein, 19 aa, Mycobacterium
YPGSPSGGSGGSPGGPGGS

SEQ ID NO: 922721 - protein, 12 aa, Mycobacterium
YPGVDSGAGGPL

SEQ ID NO: 922722 - protein, 12 aa, Mycobacterium
YPGVDSGSGGPL

SEQ ID NO: 922723 - protein, 8 aa, Mycobacterium
YPKTGVQK

SEQ ID NO: 922724 - protein, 15 aa, Mycobacterium
YPLTGRGRVGPARQA

SEQ ID NO: 922725 - protein, 8 aa, Mycobacterium
YPNPPYPL

SEQ ID NO: 922726 - protein, 19 aa, Mycobacterium
YPNRETADSEADIQLPLRT

SEQ ID NO: 922727 - protein, 7 aa, Mycobacterium
YPPALPD

SEQ ID NO: 922728 - protein, 27 aa, Mycobacterium
YPPDKSKDEIDEANTADFKNSEDSAEY

SEQ ID NO: 922729 - protein, 16 aa, Mycobacterium
YPPDRSKDQVDKENDL

SEQ ID NO: 922730 - protein, 28 aa, Mycobacterium
YPPGKSREEVDKANNADFKNSEDSAEYA

SEQ ID NO: 922731 - protein, 6 aa, Mycobacterium
YPPGSL

SEQ ID NO: 922732 - protein, 6 aa, Mycobacterium
YPPNQP

SEQ ID NO: 922733 - protein, 7 aa, Mycobacterium
YPPRRVT

SEQ ID NO: 922734 - protein, 8 aa, Mycobacterium
YPPVSAED

SEQ ID NO: 922735 - protein, 8 aa, Mycobacterium
YPQLNSST

SEQ ID NO: 922736 - protein, 20 aa, Mycobacterium
YPQPSGPATTATERSARGAA

SEQ ID NO: 922737 - protein, 4 aa, Mycobacterium
YPQS

SEQ ID NO: 922738 - protein, 7 aa, Mycobacterium
YPRDGRP

SEQ ID NO: 922739 - protein, 9 aa, Mycobacterium
YPRDGRPAS

SEQ ID NO: 922740 - protein, 5 aa, Mycobacterium
YPRGA

SEQ ID NO: 922741 - protein, 8 aa, Mycobacterium
YPRPRDDE

SEQ ID NO: 922742 - protein, 5 aa, Mycobacterium
YPRPV

SEQ ID NO: 922743 - protein, 12 aa, Mycobacterium
YPRTGQGGEPRL

SEQ ID NO: 922744 - protein, 5 aa, Mycobacterium
YPSPA

SEQ ID NO: 922745 - protein, 8 aa, Mycobacterium
YPSPEEER

SEQ ID NO: 922746 - protein, 8 aa, Mycobacterium
YPSTPGTA

SEQ ID NO: 922747 - protein, 5 aa, Mycobacterium
YPTDP

SEQ ID NO: 922748 - protein, 19 aa, Mycobacterium
YPTGEDAPTDPASPYAAGK

SEQ ID NO: 922749 - protein, 12 aa, Mycobacterium
YPTKAAAEATAV

SEQ ID NO: 922750 - protein, 19 aa, Mycobacterium
YPTPSARELSSQPDGAALA

SEQ ID NO: 922751 - protein, 23 aa, Mycobacterium
YPTPSGRAASRDPGSSAADADEA

SEQ ID NO: 922752 - protein, 26 aa, Mycobacterium
YPTPVNSSATRGSVVGTTPSGRTIPG

SEQ ID NO: 922753 - protein, 11 aa, Mycobacterium
YPTSGQDHRPE

SEQ ID NO: 922754 - protein, 5 aa, Mycobacterium
YPTTV

SEQ ID NO: 922755 - protein, 4 aa, Mycobacterium
YPTV

SEQ ID NO: 922756 - protein, 10 aa, Mycobacterium
YQATKSATQV

SEQ ID NO: 922757 - protein, 19 aa, Mycobacterium
YQDASGKPRTVDVTLGKAK

SEQ ID NO: 922758 - protein, 12 aa, Mycobacterium
YQDGPATDENHT

SEQ ID NO: 922759 - protein, 12 aa, Mycobacterium
YQERDDHGRYDN

SEQ ID NO: 922760 - protein, 13 aa, Mycobacterium
YQGDGSGARPRAH

SEQ ID NO: 922761 - protein, 16 aa, Mycobacterium
YQGEPDPAFDEATGYS

SEQ ID NO: 922762 - protein, 16 aa, Mycobacterium
YQGQPDVPFRTKDDNI

SEQ ID NO: 922763 - protein, 9 aa, Mycobacterium
YQGRDDQVS

SEQ ID NO: 922764 - protein, 35 aa, Mycobacterium
YQGTNSPTQVQATKDGKGYTITGTGQATTPGQSGV

SEQ ID NO: 922765 - protein, 8 aa, Mycobacterium
YQNSDPAR

SEQ ID NO: 922766 - protein, 8 aa, Mycobacterium
YQPATVPG

SEQ ID NO: 922767 - protein, 12 aa, Mycobacterium
YQPPQKSINPDT

SEQ ID NO: 922768 - protein, 8 aa, Mycobacterium
YQRPAEQS

SEQ ID NO: 922769 - protein, 16 aa, Mycobacterium
YQRRDRDGHYSNQQDA

SEQ ID NO: 922770 - protein, 6 aa, Mycobacterium
YQRRNP

SEQ ID NO: 922771 - protein, 6 aa, Mycobacterium
YQRSGD

SEQ ID NO: 922772 - protein, 9 aa, Mycobacterium
YQSAGGSNG

SEQ ID NO: 922773 - protein, 12 aa, Mycobacterium
YQSGDVKNAARE

SEQ ID NO: 922774 - protein, 28 aa, Mycobacterium
YQSGTGSNDGKVEKDDKTYKISGTATGV

SEQ ID NO: 922775 - protein, 5 aa, Mycobacterium
YQSLS

SEQ ID NO: 922776 - protein, 4 aa, Mycobacterium
YQSQ

SEQ ID NO: 922777 - protein, 11 aa, Mycobacterium
YQTGASGGQVS

SEQ ID NO: 922778 - protein, 6 aa, Mycobacterium
YQVPAD

SEQ ID NO: 922779 - protein, 9 aa, Mycobacterium
YRADGGSLA

SEQ ID NO: 922780 - protein, 16 aa, Mycobacterium
YRAEGDKIQGANPTMV

SEQ ID NO: 922781 - protein, 5 aa, Mycobacterium
YRASQ

SEQ ID NO: 922782 - protein, 10 aa, Mycobacterium
YRDDGDGGPF

SEQ ID NO: 922783 - protein, 7 aa, Mycobacterium
YRDDGTA

SEQ ID NO: 922784 - protein, 10 aa, Mycobacterium
YRDDSAARGG

SEQ ID NO: 922785 - protein, 11 aa, Mycobacterium
YRDESAKRGGP

SEQ ID NO: 922786 - protein, 12 aa, Mycobacterium
YRDGGRGGSQMA

SEQ ID NO: 922787 - protein, 14 aa, Mycobacterium
YRDRETANNESRIP

SEQ ID NO: 922788 - protein, 12 aa, Mycobacterium
YREDGEEGLETA

SEQ ID NO: 922789 - protein, 12 aa, Mycobacterium
YREESRDANGTR

SEQ ID NO: 922790 - protein, 7 aa, Mycobacterium
YREGDGV

SEQ ID NO: 922791 - protein, 6 aa, Mycobacterium
YREGGP

SEQ ID NO: 922792 - protein, 5 aa, Mycobacterium
YRGPV

SEQ ID NO: 922793 - protein, 5 aa, Mycobacterium
YRKGD

SEQ ID NO: 922794 - protein, 6 aa, Mycobacterium
YRNTPE

SEQ ID NO: 922795 - protein, 14 aa, Mycobacterium
YRPGDERTVAVCVS

SEQ ID NO: 922796 - protein, 12 aa, Mycobacterium
YRPNTGFTGQDS

SEQ ID NO: 922797 - protein, 8 aa, Mycobacterium
YRPTQDGA

SEQ ID NO: 922798 - protein, 10 aa, Mycobacterium
YRQGGDTELG

SEQ ID NO: 922799 - protein, 8 aa, Mycobacterium
YRRQDEVG

SEQ ID NO: 922800 - protein, 9 aa, Mycobacterium
YRRSDGGWG

SEQ ID NO: 922801 - protein, 9 aa, Mycobacterium
YRRSDGQWG

SEQ ID NO: 922802 - protein, 6 aa, Mycobacterium
YRRTAD

SEQ ID NO: 922803 - protein, 8 aa, Mycobacterium
YRRTDGQW

SEQ ID NO: 922804 - protein, 5 aa, Mycobacterium
YRSAD

SEQ ID NO: 922805 - protein, 10 aa, Mycobacterium
YRSERTEESP

SEQ ID NO: 922806 - protein, 10 aa, Mycobacterium
YRSSGGLSDS

SEQ ID NO: 922807 - protein, 4 aa, Mycobacterium
YRTG

SEQ ID NO: 922808 - protein, 11 aa, Mycobacterium
YRTGKGEKAVK

SEQ ID NO: 922809 - protein, 10 aa, Mycobacterium
YRTGTVGGPK

SEQ ID NO: 922810 - protein, 7 aa, Mycobacterium
YRTHDQE

SEQ ID NO: 922811 - protein, 6 aa, Mycobacterium
YRTVTA

SEQ ID NO: 922812 - protein, 23 aa, Mycobacterium
YRVEPNSSASPAPTPANTGPPEV

SEQ ID NO: 922813 - protein, 4 aa, Mycobacterium
YRYP

SEQ ID NO: 922814 - protein, 6 aa, Mycobacterium
YRYPDN

SEQ ID NO: 922815 - protein, 10 aa, Mycobacterium
YSADQPASKE

SEQ ID NO: 922816 - protein, 5 aa, Mycobacterium
YSAED

SEQ ID NO: 922817 - protein, 8 aa, Mycobacterium
YSDGDGEQ

SEQ ID NO: 922818 - protein, 6 aa, Mycobacterium
YSDGTA

SEQ ID NO: 922819 - protein, 7 aa, Mycobacterium
YSDGTAA

SEQ ID NO: 922820 - protein, 5 aa, Mycobacterium
YSDNA

SEQ ID NO: 922821 - protein, 7 aa, Mycobacterium
YSDNTGA

SEQ ID NO: 922822 - protein, 8 aa, Mycobacterium
YSDVPAGV

SEQ ID NO: 922823 - protein, 15 aa, Mycobacterium
YSEPESRQKGNTDVD

SEQ ID NO: 922824 - protein, 9 aa, Mycobacterium
YSGDGSWGR

SEQ ID NO: 922825 - protein, 5 aa, Mycobacterium
YSGGA

SEQ ID NO: 922826 - protein, 6 aa, Mycobacterium
YSGPDN

SEQ ID NO: 922827 - protein, 6 aa, Mycobacterium
YSGSQY

SEQ ID NO: 922828 - protein, 8 aa, Mycobacterium
YSGTGTAT

SEQ ID NO: 922829 - protein, 14 aa, Mycobacterium
YSIPGSISGKEFND

SEQ ID NO: 922830 - protein, 8 aa, Mycobacterium
YSKPDGDV

SEQ ID NO: 922831 - protein, 6 aa, Mycobacterium
YSKPKD

SEQ ID NO: 922832 - protein, 7 aa, Mycobacterium
YSKTVSG

SEQ ID NO: 922833 - protein, 9 aa, Mycobacterium
YSLTPEQLD

SEQ ID NO: 922834 - protein, 4 aa, Mycobacterium
YSPA

SEQ ID NO: 922835 - protein, 4 aa, Mycobacterium
YSPE

SEQ ID NO: 922836 - protein, 8 aa, Mycobacterium
YSPGGRVE

SEQ ID NO: 922837 - protein, 15 aa, Mycobacterium
YSPPTNCMLNRQYRC

SEQ ID NO: 922838 - protein, 9 aa, Mycobacterium
YSPQGSPVS

SEQ ID NO: 922839 - protein, 20 aa, Mycobacterium
YSPQTKFSSTSVSHPTNGCN

SEQ ID NO: 922840 - protein, 16 aa, Mycobacterium
YSPRDRIPNTSAAYPA

SEQ ID NO: 922841 - protein, 13 aa, Mycobacterium
YSPSADGQQGWSD

SEQ ID NO: 922842 - protein, 6 aa, Mycobacterium
YSQGAA

SEQ ID NO: 922843 - protein, 20 aa, Mycobacterium
YSQGAAVAGYTTSGAVPAGY

SEQ ID NO: 922844 - protein, 21 aa, Mycobacterium
YSQGAAVAGYTTTSSLPAGYT

SEQ ID NO: 922845 - protein, 6 aa, Mycobacterium
YSQGAG

SEQ ID NO: 922846 - protein, 6 aa, Mycobacterium
YSQGAS

SEQ ID NO: 922847 - protein, 6 aa, Mycobacterium
YSQGST

SEQ ID NO: 922848 - protein, 8 aa, Mycobacterium
YSQKDSAA

SEQ ID NO: 922849 - protein, 10 aa, Mycobacterium
YSQPTGTTAM

SEQ ID NO: 922850 - protein, 8 aa, Mycobacterium
YSRPSQAG

SEQ ID NO: 922851 - protein, 5 aa, Mycobacterium
YSRQK

SEQ ID NO: 922852 - protein, 4 aa, Mycobacterium
YSSA

SEQ ID NO: 922853 - protein, 7 aa, Mycobacterium
YSSGQHN

SEQ ID NO: 922854 - protein, 9 aa, Mycobacterium
YSSGQLDSA

SEQ ID NO: 922855 - protein, 8 aa, Mycobacterium
YSSNGSWG

SEQ ID NO: 922856 - protein, 8 aa, Mycobacterium
YSSPALDK

SEQ ID NO: 922857 - protein, 10 aa, Mycobacterium
YSSPGSPVSI

SEQ ID NO: 922858 - protein, 10 aa, Mycobacterium
YSSPTSDQSV

SEQ ID NO: 922859 - protein, 9 aa, Mycobacterium
YSSRENAAD

SEQ ID NO: 922860 - protein, 5 aa, Mycobacterium
YSSTI

SEQ ID NO: 922861 - protein, 8 aa, Mycobacterium
YSTATADV

SEQ ID NO: 922862 - protein, 7 aa, Mycobacterium
YSTGNGV

SEQ ID NO: 922863 - protein, 9 aa, Mycobacterium
YSTNLPASQ

SEQ ID NO: 922864 - protein, 11 aa, Mycobacterium
YSTPGQAGDGT

SEQ ID NO: 922865 - protein, 22 aa, Mycobacterium
YSTPSGKQESQNQAGDSTKQAQ

SEQ ID NO: 922866 - protein, 11 aa, Mycobacterium
YSWGGSGPNAF

SEQ ID NO: 922867 - protein, 43 aa, Mycobacterium
YTANGSGAGISEFNGNQTDFGGSDSPLAANEYAAAQQRCGSPA

SEQ ID NO: 922868 - protein, 30 aa, Mycobacterium
YTANGSGAGISEFNGNQTDFGGSDSPLVPK

SEQ ID NO: 922869 - protein, 10 aa, Mycobacterium
YTANGSSAGI

SEQ ID NO: 922870 - protein, 16 aa, Mycobacterium
YTATAPLSATGREFST

SEQ ID NO: 922871 - protein, 15 aa, Mycobacterium
YTATAPLSATGREFT

SEQ ID NO: 922872 - protein, 13 aa, Mycobacterium
YTATDGRSAGTAT

SEQ ID NO: 922873 - protein, 9 aa, Mycobacterium
YTATGDSIA

SEQ ID NO: 922874 - protein, 14 aa, Mycobacterium
YTDAVRNEDGTWTR

SEQ ID NO: 922875 - protein, 4 aa, Mycobacterium
YTDP

SEQ ID NO: 922876 - protein, 7 aa, Mycobacterium
YTDPDRA

SEQ ID NO: 922877 - protein, 8 aa, Mycobacterium
YTGEGTAE

SEQ ID NO: 922878 - protein, 9 aa, Mycobacterium
YTGGAAGGY

SEQ ID NO: 922879 - protein, 9 aa, Mycobacterium
YTGHPSSGD

SEQ ID NO: 922880 - protein, 21 aa, Mycobacterium
YTGLPGDPVGPPGAVPPARIP

SEQ ID NO: 922881 - protein, 24 aa, Mycobacterium
YTGLPGDTPDYPPPPGPPARIPGA

SEQ ID NO: 922882 - protein, 22 aa, Mycobacterium
YTGLPGDTPEAPPPPPPPARIP

SEQ ID NO: 922883 - protein, 4 aa, Mycobacterium
YTGM

SEQ ID NO: 922884 - protein, 10 aa, Mycobacterium
YTGRHSDAAA

SEQ ID NO: 922885 - protein, 9 aa, Mycobacterium
YTKPDGAKA

SEQ ID NO: 922886 - protein, 10 aa, Mycobacterium
YTKRASETAP

SEQ ID NO: 922887 - protein, 18 aa, Mycobacterium
YTPADKAIQTPNADTPYS

SEQ ID NO: 922888 - protein, 11 aa, Mycobacterium
YTPAGPQASGY

SEQ ID NO: 922889 - protein, 6 aa, Mycobacterium
YTPAQV

SEQ ID NO: 922890 - protein, 18 aa, Mycobacterium
YTPEDKAIQTPNSDTPYS

SEQ ID NO: 922891 - protein, 12 aa, Mycobacterium
YTPGGAQSGGYG

SEQ ID NO: 922892 - protein, 32 aa, Mycobacterium
YTPGVPGGSAEATKDGNKYTIKGSATGADMAN

SEQ ID NO: 922893 - protein, 4 aa, Mycobacterium
YTPI

SEQ ID NO: 922894 - protein, 20 aa, Mycobacterium
YTPNPNDAPGGPLVERADRQ

SEQ ID NO: 922895 - protein, 9 aa, Mycobacterium
YTPPEAEEG

SEQ ID NO: 922896 - protein, 13 aa, Mycobacterium
YTPSGARKGSYGH

SEQ ID NO: 922897 - protein, 11 aa, Mycobacterium
YTPSGPQASGY

SEQ ID NO: 922898 - protein, 15 aa, Mycobacterium
YTRGETALALKERAL

SEQ ID NO: 922899 - protein, 16 aa, Mycobacterium
YTRTTRPAACSQEQSY

SEQ ID NO: 922900 - protein, 7 aa, Mycobacterium
YTSASRK

SEQ ID NO: 922901 - protein, 17 aa, Mycobacterium
YTSDGESNFGKIGSPEI

SEQ ID NO: 922902 - protein, 10 aa, Mycobacterium
YTSGRNGQGA

SEQ ID NO: 922903 - protein, 9 aa, Mycobacterium
YTSGSTKDF

SEQ ID NO: 922904 - protein, 28 aa, Mycobacterium
YTSGTGQGKAEASKSGNTYKITGTATGV

SEQ ID NO: 922905 - protein, 28 aa, Mycobacterium
YTSGTGQGNASAEKNGNTYKITGTATGV

SEQ ID NO: 922906 - protein, 28 aa, Mycobacterium
YTSGTGQGNATASKDGNSYKISGTATGV

SEQ ID NO: 922907 - protein, 5 aa, Mycobacterium
YTSIP

SEQ ID NO: 922908 - protein, 4 aa, Mycobacterium
YTSL

SEQ ID NO: 922909 - protein, 11 aa, Mycobacterium
YTSNGSGAGVS

SEQ ID NO: 922910 - protein, 25 aa, Mycobacterium
YVPPPAEYAPLPEDYPPPPPPPPNV

SEQ ID NO: 922911 - protein, 24 aa, Mycobacterium
YVPPPSEYAPLPEDYPPPPPPAPN

SEQ ID NO: 922912 - protein, 16 aa, Mycobacterium
YVSGATSQLRQDLGPE

SEQ ID NO: 922913 - protein, 25 aa, Mycobacterium
YVSSGHDTNITGGELPAPENVGDAK

SEQ ID NO: 922914 - protein, 11 aa, Mycobacterium
YVSTDTPSAGI

SEQ ID NO: 922915 - protein, 8 aa, Mycobacterium
YWGPPAKP

SEQ ID NO: 922916 - protein, 9 aa, Mycobacterium
YYGDTRNRV

SEQ ID NO: 922917 - protein, 7 aa, Mycobacterium
YYGRPNA

SEQ ID NO: 922918 - protein, 9 aa, Mycobacterium
YYPAGTTVN

SEQ ID NO: 922919 - protein, 4 aa, Mycobacterium
YYRT

SEQ ID NO: 922920 - protein, 6 aa, Mycobacterium
YYTDPR

SEQ ID NO: 922921 - protein, 19 aa, Mycobacterium
NALIEVGQALAANLVGGFS

SEQ ID NO: 922922 - protein, 18 aa, Mycobacterium
YEGLPVDGYTAWLQNMAA

SEQ ID NO: 922923 - protein, 24 aa, Mycobacterium
AVRRRPYTVILFDEIEKAHPDVFD

SEQ ID NO: 922924 - protein, 17 aa, Mycobacterium
ELAKALAEFLFDDERAM

SEQ ID NO: 922925 - protein, 27 aa, Mycobacterium
GNMIKPMLARGELRLVGATTLDEYRKY

SEQ ID NO: 922926 - protein, 20 aa, Mycobacterium
KALAEFLFDDERAMVRIDMS

SEQ ID NO: 922927 - protein, 21 aa, Mycobacterium
PADAKAVIVAQNLVAARYVQL

SEQ ID NO: 922928 - protein, 23 aa, Mycobacterium
PYQHVEKFIPRQITNVLTGRRPK

SEQ ID NO: 922929 - protein, 30 aa, Mycobacterium; identical to SEQ ID NO: 143350

SEQ ID NO: 922930 - protein, 17 aa, Mycobacterium
VDGYTAWLQNMAADDRI

SEQ ID NO: 922931 - protein, 25 aa, Mycobacterium
AAGGVLLRPFARLIASTGDSVTTYG

SEQ ID NO: 922932 - protein, 25 aa, Mycobacterium
AGNPEIRPAHLLMALLTQADGIAAP

SEQ ID NO: 922933 - protein, 18 aa, Mycobacterium
AGVVGWWVNPQAPGIDAC

SEQ ID NO: 922934 - protein, 20 aa, Mycobacterium
ARSSLGRKLGRRWHQETVYG

SEQ ID NO: 922935 - protein, 25 aa, Mycobacterium
AVDMLEMLPTPWGLVRSGVAPDHPK

SEQ ID NO: 922936 - protein, 25 aa, Mycobacterium
DAQSGSIGLGFAIPVDQAKRIADEL

SEQ ID NO: 922937 - protein, 20 aa, Mycobacterium
DVPGGFAAGLARALPVTGGQ

SEQ ID NO: 922938 - protein, 20 aa, Mycobacterium
DVRTARIVTPRVMQLTLRAN

SEQ ID NO: 922939 - protein, 18 aa, Mycobacterium
FATIPVLDGAGWSDDGMQ

SEQ ID NO: 922940 - protein, 17 aa, Mycobacterium
FGRRLADFFTGRDPRGG

SEQ ID NO: 922941 - protein, 22 aa, Mycobacterium
FLSSELPDWLAANKGLAPGGHA

SEQ ID NO: 922942 - protein, 17 aa, Mycobacterium
GADEFEGTLELGYQIGF

SEQ ID NO: 922943 - protein, 25 aa, Mycobacterium
GPIELVKTSGGWRIDRLPNGVFLDW

SEQ ID NO: 922944 - protein, 18 aa, Mycobacterium
LGDMVAELIELSRLQGAE

SEQ ID NO: 922945 - protein, 17 aa, Mycobacterium
LPVDGYTAWLQNMAADD

SEQ ID NO: 922946 - protein, 21 aa, Mycobacterium
MDPDVLLREFLKATADPANRH

SEQ ID NO: 922947 - protein, 20 aa, Mycobacterium
NRLTREWFHSGRAKYIVAGP

SEQ ID NO: 922948 - protein, 17 aa, Mycobacterium
NSGLPLPGLGLLGLANH

SEQ ID NO: 922949 - protein, 26 aa, Mycobacterium
PARKLREIRMALTLDKTFTKPEILTR

SEQ ID NO: 922950 - protein, 24 aa, Mycobacterium
PIAADDFWYLWRQMVSQPGVVDPA

SEQ ID NO: 922951 - protein, 18 aa, Mycobacterium
RDPETMIPDVRYTPNPND

SEQ ID NO: 922952 - protein, 25 aa, Mycobacterium
SAASNPDLFWALRGGGGGNFGVTTS

SEQ ID NO: 922953 - protein, 21 aa, Mycobacterium
SEGWWPTLIGLAMNDSGGYNA

SEQ ID NO: 922954 - protein, 26 aa, Mycobacterium
SGAGITGFDCSGLVLYSFAGVGIKLP

SEQ ID NO: 922955 - protein, 18 aa, Mycobacterium
SLILRGGGIPNLEVLQNE

SEQ ID NO: 922956 - protein, 26 aa, Mycobacterium
SSLRLWPDRRLSRRGVEIVARRAPRG

SEQ ID NO: 922957 - protein, 24 aa, Mycobacterium
TLARADIRGPYVINADGAPLDDRF

SEQ ID NO: 922958 - protein, 24 aa, Mycobacterium
TTITGWATSGGFCGKNNTYTVYFA

SEQ ID NO: 922959 - protein, 18 aa, Mycobacterium
VLDGAGWSDDGMQSVVRV

SEQ ID NO: 922960 - protein, 17 aa, Mycobacterium
VRRLEIEEMALAKEEDE

SEQ ID NO: 922961 - protein, 24 aa, Mycobacterium
AACGDAGQSPGTWKQNGQTGGQIA

SEQ ID NO: 922962 - protein, 17 aa, Mycobacterium
AAPIGRAVIQAALQGGP

SEQ ID NO: 922963 - protein, 17 aa, Mycobacterium
AAQCVAVNCALGPDPKG

SEQ ID NO: 922964 - protein, 17 aa, Mycobacterium
ADFVKRQNIGSFTLGPI

SEQ ID NO: 922965 - protein, 26 aa, Mycobacterium
ADNFPGDVLAAVGLDRPAAQRFTDKP

SEQ ID NO: 922966 - protein, 18 aa, Mycobacterium
AFKRWTGRSPRHFRKTRD

SEQ ID NO: 922967 - protein, 26 aa, Mycobacterium
AGADEISAAIAQLFGTHAQIYQRISA

SEQ ID NO: 922968 - protein, 24 aa, Mycobacterium
AGAFSRPGLPVEYLMVPSPSMGRD

SEQ ID NO: 922969 - protein, 20 aa, Mycobacterium
AGAGIKLPRSSGEMYKVGQK

SEQ ID NO: 922970 - protein, 18 aa, Mycobacterium
AGDGGRGGDGYTSTDPTL

SEQ ID NO: 922971 - protein, 19 aa, Mycobacterium
AGGNWAINTGNGFYGGVQF

SEQ ID NO: 922972 - protein, 22 aa, Mycobacterium
AGSRPDKVARLILDSPVALGVS

SEQ ID NO: 922973 - protein, 24 aa, Mycobacterium
AIASCPPGRVEVVANYTAFLQLQR

SEQ ID NO: 922974 - protein, 22 aa, Mycobacterium
AISETYPPGSTFKVITTAAALQ

SEQ ID NO: 922975 - protein, 23 aa, Mycobacterium
AKAAELRYGRIPEVEKKLDAALP

SEQ ID NO: 922976 - protein, 23 aa, Mycobacterium
ALAAGASARWASRVTGRGAGAMI

SEQ ID NO: 922977 - protein, 25 aa, Mycobacterium
ALKRTDGSITYNEWSYAVGHQLNMA

SEQ ID NO: 922978 - protein, 27 aa, Mycobacterium
AMQQGCGGPCKGAVVALEPSTGKILAL

SEQ ID NO: 922979 - protein, 19 aa, Mycobacterium
APGAQSLRAEWSRSAKGEV

SEQ ID NO: 922980 - protein, 17 aa, Mycobacterium
APVLVGLNYRPGQKPLL

SEQ ID NO: 922981 - protein, 33 aa, Mycobacterium
AQPETWYKSFNYDLVKRAPITFDTLFKPGSRPL

SEQ ID NO: 922982 - protein, 23 aa, Mycobacterium
ARYNVPWQPAYVFYRADGSSTFV

SEQ ID NO: 922983 - protein, 27 aa, Mycobacterium
AVIGSGVQTAGAWAAGPTTALAGALGA

SEQ ID NO: 922984 - protein, 20 aa, Mycobacterium
AVLPGYGWIFPLGNGEVNIG

SEQ ID NO: 922985 - protein, 25 aa, Mycobacterium
AWLYSQRRFEVPSDKIANTMKLAIV

SEQ ID NO: 922986 - protein, 17 aa, Mycobacterium
AYGAGPCSGQLTDIEHI

SEQ ID NO: 922987 - protein, 29 aa, Mycobacterium
DAALAAAGYLCWRGKDLATPRGWITALRA

SEQ ID NO: 922988 - protein, 18 aa, Mycobacterium
DGTPITWRDIASQIHATS

SEQ ID NO: 922989 - protein, 24 aa, Mycobacterium
DIAEVVSAWTGIPAGRMLEGETAK

SEQ ID NO: 922990 - protein, 28 aa, Mycobacterium
DKADAVLKGDAWRKLSANRDNRVFVVNN

SEQ ID NO: 922991 - protein, 23 aa, Mycobacterium
DMRRRATMYLTYWTAGDTRNRGR

SEQ ID NO: 922992 - protein, 22 aa, Mycobacterium
DNLPAKFLEGFVRTSNLKFQDA

SEQ ID NO: 922993 - protein, 18 aa, Mycobacterium
DNLVGIGPLHFNSADLAG

SEQ ID NO: 922994 - protein, 22 aa, Mycobacterium
DQGTRLGFAFAEHAKLTSFGAL

SEQ ID NO: 922995 - protein, 24 aa, Mycobacterium
DQLDALCALGLQSRIVAAALPDGS

SEQ ID NO: 922996 - protein, 25 aa, Mycobacterium
DQLDALCALGLQSRVVGAALPDGSS

SEQ ID NO: 922997 - protein, 20 aa, Mycobacterium
DRADVFAAIAPIAGTLGVGV

SEQ ID NO: 922998 - protein, 19 aa, Mycobacterium
DVQKAMAFAAAHNLKVAPR

SEQ ID NO: 922999 - protein, 33 aa, Mycobacterium
EGTLELGYQIGFPWSLGVGINFSYTTPNILIDD

SEQ ID NO: 923000 - protein, 21 aa, Mycobacterium
EKAYGAGPCSGHLTDIEHIVL

SEQ ID NO: 923001 - protein, 22 aa, Mycobacterium
ELRKRLTGLLGAFRAFSYGSLY

SEQ ID NO: 923002 - protein, 24 aa, Mycobacterium
EQLAHTWAPYLTMAESLKLAAQAY

SEQ ID NO: 923003 - protein, 18 aa, Mycobacterium
ERLFGRRLADFFTGRDPR

SEQ ID NO: 923004 - protein, 20 aa, Mycobacterium
ERLFGRRLADFFTGRDPRGG

SEQ ID NO: 923005 - protein, 19 aa, Mycobacterium
FADHNGVDWKGTLTGLAGY

SEQ ID NO: 923006 - protein, 26 aa, Mycobacterium
FALTYPRRLGFGLGTSVVSLSWRTGD

SEQ ID NO: 923007 - protein, 19 aa, Mycobacterium
FANGYATVTVEAGPNQVLS

SEQ ID NO: 923008 - protein, 19 aa, Mycobacterium
FAPNPRWSKTYANQPEILA

SEQ ID NO: 923009 - protein, 17 aa, Mycobacterium
FDAVCFTSSSTVRNLVG

SEQ ID NO: 923010 - protein, 17 aa, Mycobacterium
FEVLSRHKVELRNVEQV

SEQ ID NO: 923011 - protein, 27 aa, Mycobacterium
FFQDLGGAHPFTWYKAFNYNLGTKQPI

SEQ ID NO: 923012 - protein, 20 aa, Mycobacterium
FNALIEVGQALAANLVGGFS

SEQ ID NO: 923013 - protein, 17 aa, Mycobacterium
FRAFSYGSLYPALRRMQ

SEQ ID NO: 923014 - protein, 23 aa, Mycobacterium
FYGPEGTQSVAMYLGNGQMLEVG

SEQ ID NO: 923015 - protein, 18 aa, Mycobacterium
GAAAAQAAVIGSGVQTAG

SEQ ID NO: 923016 - protein, 26 aa, Mycobacterium
GADEVSVAVAQLFDGHGQAYQAISAQ

SEQ ID NO: 923017 - protein, 26 aa, Mycobacterium
GDAGLNCLAVTYGGLALLRLLDMLAG

SEQ ID NO: 923018 - protein, 19 aa, Mycobacterium
GEKYVDLAAHYGWDVVEGD

SEQ ID NO: 923019 - protein, 19 aa, Mycobacterium
GFDASGLIQYAYAGAGIKL

SEQ ID NO: 923020 - protein, 19 aa, Mycobacterium
GFFEKTFAPLGLKRIQGEV

SEQ ID NO: 923021 - protein, 29 aa, Mycobacterium
GGAGGAGGRGGWLFSAGGNGGAGGAGGAG

SEQ ID NO: 923022 - protein, 25 aa, Mycobacterium
GGGGGHGGNGGWVAGDGGAGGAGGT

SEQ ID NO: 923023 - protein, 31 aa, Mycobacterium
GGSGGGAGRGGWVFGDGGAGGAGGDGATGAA

SEQ ID NO: 923024 - protein, 24 aa, Mycobacterium
GGTGSRTGAHGLAGTTPTTNAGDG

SEQ ID NO: 923025 - protein, 20 aa, Mycobacterium
GKAKALRDFAQQVGVPMEQT

SEQ ID NO: 923026 - protein, 21 aa, Mycobacterium
GLGGLECLSGIPGSAGATPVQ

SEQ ID NO: 923027 - protein, 19 aa, Mycobacterium
GNTIAWLYSQRRFEVPSDK

SEQ ID NO: 923028 - protein, 25 aa, Mycobacterium
GPKTAETAAEFGLRVDVQPETAAVG

SEQ ID NO: 923029 - protein, 23 aa, Mycobacterium
GQHGVNIMEFCKAYNAATESQRG

SEQ ID NO: 923030 - protein, 21 aa, Mycobacterium
GRPITAEAFGVVARAVADLGV

SEQ ID NO: 923031 - protein, 19 aa, Mycobacterium
GRQYMSWITLEDEVRALLF

SEQ ID NO: 923032 - protein, 20 aa, Mycobacterium
GSAPWAPPVDGLADTGSLTS

SEQ ID NO: 923033 - protein, 25 aa, Mycobacterium
GSVAEVVELLAYLPVITTALSPSFH

SEQ ID NO: 923034 - protein, 35 aa, Mycobacterium
GTHAQIYQRISAQAMAFHDQFARSLSAASGSYANA

SEQ ID NO: 923035 - protein, 20 aa, Mycobacterium
GTPGAAWRDTLRAVGAATGR

SEQ ID NO: 923036 - protein, 20 aa, Mycobacterium
GVASDAAGVVGWWVNPQAPG

SEQ ID NO: 923037 - protein, 21 aa, Mycobacterium
GVASDAAGVVGWWVNPQAPGI

SEQ ID NO: 923038 - protein, 19 aa, Mycobacterium
GVVSGGFRQVIEPLAHELM

SEQ ID NO: 923039 - protein, 19 aa, Mycobacterium
GVYANDYWGPATVTERDGQ

SEQ ID NO: 923040 - protein, 18 aa, Mycobacterium
HRAAQYWVLKPTYHNSYW

SEQ ID NO: 923041 - protein, 19 aa, Mycobacterium
HTYESVAYPNIFAPGIAFA

SEQ ID NO: 923042 - protein, 18 aa, Mycobacterium
IAAMQWEKLICNVAYSAP

SEQ ID NO: 923043 - protein, 17 aa, Mycobacterium
IAFGLVNVPVKVYSATE

SEQ ID NO: 923044 - protein, 24 aa, Mycobacterium
IAGFAVWRIRGIFGSHQLPTYAGS

SEQ ID NO: 923045 - protein, 28 aa, Mycobacterium
IANGIDAPALWPGLPVRPVKGEVLRLRW

SEQ ID NO: 923046 - protein, 18 aa, Mycobacterium
IDGYRVLTDPVWSDRCSP

SEQ ID NO: 923047 - protein, 27 aa, Mycobacterium
IGAKAGGLPGDLTFSWYAEDKTGQPWV

SEQ ID NO: 923048 - protein, 21 aa, Mycobacterium
IGATDLCEFVEFPTELLQVCG

SEQ ID NO: 923049 - protein, 20 aa, Mycobacterium
INVHGYPNLFVMTGPNSGPG

SEQ ID NO: 923050 - protein, 26 aa, Mycobacterium
IQSTFVGAICRWQAANPAGLIDITRF

SEQ ID NO: 923051 - protein, 21 aa, Mycobacterium
ISETYPPGSTFKVITTAAALQ

SEQ ID NO: 923052 - protein, 20 aa, Mycobacterium
ISLAAVFLALAIGVALGSGL

SEQ ID NO: 923053 - protein, 18 aa, Mycobacterium
ISRAEWGADESLRCGSPQ

SEQ ID NO: 923054 - protein, 19 aa, Mycobacterium
IVSVVNWADCLVAMQQREI

SEQ ID NO: 923055 - protein, 20 aa, Mycobacterium
IYDPAMRTLIAFGGKYPTTV

SEQ ID NO: 923056 - protein, 31 aa, Mycobacterium; identical to SEQ ID NO: 99027

SEQ ID NO: 923057 - protein, 20 aa, Mycobacterium
KDVGFPYRSALVPRRNAELD

SEQ ID NO: 923058 - protein, 19 aa, Mycobacterium
KHVLYEIFGPPGTIADINY

SEQ ID NO: 923059 - protein, 18 aa, Mycobacterium
KLGRRWHQETVYGVAARG

SEQ ID NO: 923060 - protein, 18 aa, Mycobacterium
KTVISLDLGSMVAGAKYR

SEQ ID NO: 923061 - protein, 20 aa, Mycobacterium
KYPDGSFWHQWMRTYMTGPQ

SEQ ID NO: 923062 - protein, 24 aa, Mycobacterium
LAKAAELRYGRIPEVEKKLDAALP

SEQ ID NO: 923063 - protein, 25 aa, Mycobacterium
LANAKRWGINHVIWRQKIYPGVGGG

SEQ ID NO: 923064 - protein, 19 aa, Mycobacterium
LATEIARAAGKLVSATSET

SEQ ID NO: 923065 - protein, 25 aa, Mycobacterium
LDEHRPEVVFHLAAQIDVRHSVADP

SEQ ID NO: 923066 - protein, 24 aa, Mycobacterium
LDRQHRVAAVFLRELLAEDLQPVV

SEQ ID NO: 923067 - protein, 20 aa, Mycobacterium
LDRSHRVAAVFLRALLAEDL

SEQ ID NO: 923068 - protein, 18 aa, Mycobacterium
LDVPYTRIHEFRHFHPER

SEQ ID NO: 923069 - protein, 20 aa, Mycobacterium
LEGETAKLLRMEDELGKRVI

SEQ ID NO: 923070 - protein, 20 aa, Mycobacterium
LGAGMARAFAAKGRDLALCA

SEQ ID NO: 923071 - protein, 18 aa, Mycobacterium
LNVVVPFLALQPLVENAV

SEQ ID NO: 923072 - protein, 18 aa, Mycobacterium
LPESMIVLGGGYVGLEQA

SEQ ID NO: 923073 - protein, 24 aa, Mycobacterium
LPIVNASGGPNCRGLPDIPTKQTG

SEQ ID NO: 923074 - protein, 23 aa, Mycobacterium
LPRGCIAAGDRAFFCDYVQEYLS

SEQ ID NO: 923075 - protein, 19 aa, Mycobacterium
LRKRLTGLLGAFRAFSYGS

SEQ ID NO: 923076 - protein, 18 aa, Mycobacterium
LRQLGCSTGTLQDFGPDF

SEQ ID NO: 923077 - protein, 20 aa, Mycobacterium
LRQSFLQERAILRILDRSVS

SEQ ID NO: 923078 - protein, 17 aa, Mycobacterium
LRTADRNSWALADATVD

SEQ ID NO: 923079 - protein, 18 aa, Mycobacterium
LVSIMKWLRPGAVIAITK

SEQ ID NO: 923080 - protein, 19 aa, Mycobacterium
MDRMLRPGGVVDLLTAPGG

SEQ ID NO: 923081 - protein, 26 aa, Mycobacterium
MGPHFSFSWYRGSPIGRERKTEELSR

SEQ ID NO: 923082 - protein, 23 aa, Mycobacterium
MVQIPRLVANNTRIWVYCGNGTP

SEQ ID NO: 923083 - protein, 17 aa, Mycobacterium
NADGLGCRITANDEKKD

SEQ ID NO: 923084 - protein, 20 aa, Mycobacterium
NAQSAGGCSLMVWEADNNGR

SEQ ID NO: 923085 - protein, 18 aa, Mycobacterium
NGSGGRGGDGYTSTDPTL

SEQ ID NO: 923086 - protein, 17 aa, Mycobacterium
NLAGGFSLPTLAAQISA

SEQ ID NO: 923087 - protein, 20 aa, Mycobacterium
NNFPGASVPFGMVQYSPDTT

SEQ ID NO: 923088 - protein, 22 aa, Mycobacterium
NNFPGATVPFGMVQYSPDTVGN

SEQ ID NO: 923089 - protein, 24 aa, Mycobacterium
NPACGKAGCTTYKWETFLTSELPQ

SEQ ID NO: 923090 - protein, 18 aa, Mycobacterium
NVGCVPSKALLAAADALH

SEQ ID NO: 923091 - protein, 25 aa, Mycobacterium
PDNLSDAGISWKVYQNKLLGALNNT

SEQ ID NO: 923092 - protein, 24 aa, Mycobacterium
PDQPALRPLLDLLPIAGGSGTLGE

SEQ ID NO: 923093 - protein, 20 aa, Mycobacterium
PEATGWPVGVSIGHDGRVVT

SEQ ID NO: 923094 - protein, 27 aa, Mycobacterium
PGAMLSFPPTQWIRWRKPVIGMPTTPR

SEQ ID NO: 923095 - protein, 17 aa, Mycobacterium
PNPEVYAPVTGFYSLRY

SEQ ID NO: 923096 - protein, 19 aa, Mycobacterium
PRNEWLFTDAWGVDVAVST

SEQ ID NO: 923097 - protein, 18 aa, Mycobacterium
PTGSFMFLGPTGVGKTEL

SEQ ID NO: 923098 - protein, 19 aa, Mycobacterium
PTGSFMFLGPTGVGKTELA

SEQ ID NO: 923099 - protein, 26 aa, Mycobacterium
PTITARLNFQLAFGARVGQRLAEARD

SEQ ID NO: 923100 - protein, 26 aa, Mycobacterium
PTITARLNFQLAFGARVGQRLAEARE

SEQ ID NO: 923101 - protein, 18 aa, Mycobacterium
PTQSGAYPIVLATYEIVC

SEQ ID NO: 923102 - protein, 18 aa, Mycobacterium
PVIEKAYGAGPCSGHLTD

SEQ ID NO: 923103 - protein, 17 aa, Mycobacterium
PVIEKAYGAGPCSGQLT

SEQ ID NO: 923104 - protein, 31 aa, Mycobacterium
QAISAQAAVFHGRFVAALNAAADSYAGAEAA

SEQ ID NO: 923105 - protein, 23 aa, Mycobacterium
QEHLDCYAAVPSMGAVLHTLNLR

SEQ ID NO: 923106 - protein, 19 aa, Mycobacterium
QPGAEAPVLVGLNYRPGQK

SEQ ID NO: 923107 - protein, 25 aa, Mycobacterium
QRHELPRGDLDRVVRQQAVMASLAH

SEQ ID NO: 923108 - protein, 25 aa, Mycobacterium
QSAKLCVQYLAPIIKNRQYNFPPLG

SEQ ID NO: 923109 - protein, 19 aa, Mycobacterium
QSLRAEWSRSAKGEVGAQV

SEQ ID NO: 923110 - protein, 19 aa, Mycobacterium
RAFAAKGRDLALCARRTDR

SEQ ID NO: 923111 - protein, 17 aa, Mycobacterium
RAIDPQFFAARKLPDGL

SEQ ID NO: 923112 - protein, 23 aa, Mycobacterium
RATAIRFAKLGAHVVVSDIDLDA

SEQ ID NO: 923113 - protein, 18 aa, Mycobacterium
RAVWEKFGEFGLDARAFS

SEQ ID NO: 923114 - protein, 25 aa, Mycobacterium
RDAQVPLRWFREIYSDFDCDQGTRL

SEQ ID NO: 923115 - protein, 17 aa, Mycobacterium
RDLKLVYDLQLDREISA

SEQ ID NO: 923116 - protein, 21 aa, Mycobacterium
REIEASPAPSPRTPNYYPGGR

SEQ ID NO: 923117 - protein, 19 aa, Mycobacterium
RGEIVWTRDDVAPLTTSSR

SEQ ID NO: 923118 - protein, 17 aa, Mycobacterium
RGGDGYTSTDPTLNGGK

SEQ ID NO: 923119 - protein, 21 aa, Mycobacterium
RGGGPVQRWRRGTPFDLHLMM

SEQ ID NO: 923120 - protein, 17 aa, Mycobacterium
RGTQRLALHAEQLLVAT

SEQ ID NO: 923121 - protein, 19 aa, Mycobacterium
RLAALSAEINRLGGDCTET

SEQ ID NO: 923122 - protein, 17 aa, Mycobacterium
RLGSGRQYMSWITLEDE

SEQ ID NO: 923123 - protein, 20 aa, Mycobacterium
RLGYYCGVVSGGFRQVIEPL

SEQ ID NO: 923124 - protein, 26 aa, Mycobacterium
RLLSEEDRRFAVVFAHDQSDYARMEA

SEQ ID NO: 923125 - protein, 27 aa, Mycobacterium
RLVQGGGWSGPLFDGFDNVYVGQPGAM

SEQ ID NO: 923126 - protein, 17 aa, Mycobacterium
RPGKAKALRDFAQQVGV

SEQ ID NO: 923127 - protein, 24 aa, Mycobacterium
RQLTPDFRPGCKRMLVSSDYYPAL

SEQ ID NO: 923128 - protein, 20 aa, Mycobacterium
RQRWCTRLVQGGGWSGPLFD

SEQ ID NO: 923129 - protein, 21 aa, Mycobacterium
RSGGALAAFAAVAAESAGAAV

SEQ ID NO: 923130 - protein, 20 aa, Mycobacterium
SDPVAYRIAVTDLQRTLDQR

SEQ ID NO: 923131 - protein, 24 aa, Mycobacterium
SGGGESWSALTTMILPSGGAPYVV

SEQ ID NO: 923132 - protein, 24 aa, Mycobacterium
SIYDPPMRTMIALGARYPTTVIPS

SEQ ID NO: 923133 - protein, 19 aa, Mycobacterium
SKYRGEFEERLKAVLDDIK

SEQ ID NO: 923134 - protein, 24 aa, Mycobacterium
SLGAPCDNYERFIFGRGTSGQAEA

SEQ ID NO: 923135 - protein, 24 aa, Mycobacterium
SLSHPYLDTVLFILGITRGEIEAA

SEQ ID NO: 923136 - protein, 23 aa, Mycobacterium
SMQVCQKAQCPFNTAESENLQIP

SEQ ID NO: 923137 - protein, 25 aa, Mycobacterium
SNLLPGPAIQPFLDYALGFRRGVNA

SEQ ID NO: 923138 - protein, 17 aa, Mycobacterium
SPPRTGMPSGIMAKTVA

SEQ ID NO: 923139 - protein, 19 aa, Mycobacterium
SPTAEAFSRMFERDKNELR

SEQ ID NO: 923140 - protein, 21 aa, Mycobacterium
SRQLLAAQIIWTLARADIRGP

SEQ ID NO: 923141 - protein, 24 aa, Mycobacterium
SRTVSGQLTLLVPFIDRVRARVDL

SEQ ID NO: 923142 - protein, 24 aa, Mycobacterium
SSDCVAAVFGGWTSSSRKAMLPVF

SEQ ID NO: 923143 - protein, 18 aa, Mycobacterium
STLDELRIFVSQWDTRAR

SEQ ID NO: 923144 - protein, 17 aa, Mycobacterium
STPRMLASLVEEAVAVG

SEQ ID NO: 923145 - protein, 22 aa, Mycobacterium
SVARLVGAPPGYIGYDQGGQLT

SEQ ID NO: 923146 - protein, 26 aa, Mycobacterium
SVATDSRFRFLRVYPNPEVYAPVTGF

SEQ ID NO: 923147 - protein, 18 aa, Mycobacterium
TAAFEWFYQSGISVVMPV

SEQ ID NO: 923148 - protein, 24 aa, Mycobacterium
TAGAFSRPGLPVEYLQVPSAGMGR

SEQ ID NO: 923149 - protein, 17 aa, Mycobacterium
TIPLQYVTRAIVNRDTR

SEQ ID NO: 923150 - protein, 17 aa, Mycobacterium
TLLALADMYMRRDAHGH

SEQ ID NO: 923151 - protein, 24 aa, Mycobacterium
TLSRRAKRLIVFDVDSTLIQGEVI

SEQ ID NO: 923152 - protein, 18 aa, Mycobacterium
TPAFEWFYQSGLSTIMPV

SEQ ID NO: 923153 - protein, 24 aa, Mycobacterium
TSAPRCVGNTLLLNGRTYSPPYVI

SEQ ID NO: 923154 - protein, 19 aa, Mycobacterium
TTFRELRQSFLQERAILRI

SEQ ID NO: 923155 - protein, 20 aa, Mycobacterium
TVVPDPRYVAVSDHDQLATE

SEQ ID NO: 923156 - protein, 17 aa, Mycobacterium
VAANWQASGGWTDGAHR

SEQ ID NO: 923157 - protein, 26 aa, Mycobacterium
VAVKQGWMCCIGSDWMHLSTGVIGAD

SEQ ID NO: 923158 - protein, 22 aa, Mycobacterium
VEPRLWNMSTVLPILQDTTIVA

SEQ ID NO: 923159 - protein, 20 aa, Mycobacterium
VGARFKHIIMDSSTYGVPVN

SEQ ID NO: 923160 - protein, 19 aa, Mycobacterium
VGGTWYWNRYPGARCDVES

SEQ ID NO: 923161 - protein, 18 aa, Mycobacterium
VGLLCMYKVHQFSEPEPV

SEQ ID NO: 923162 - protein, 17 aa, Mycobacterium
VGQIGGITHKMVAAHAA

SEQ ID NO: 923163 - protein, 22 aa, Mycobacterium
VPPEAMGAVAVAFRANAQLNSN

SEQ ID NO: 923164 - protein, 23 aa, Mycobacterium
VRAFGDFLSYCLVAEGAVDIAAE

SEQ ID NO: 923165 - protein, 18 aa, Mycobacterium
VTEGDKLVAFWRGTATAR

SEQ ID NO: 923166 - protein, 18 aa, Mycobacterium
VYAPVTGFYSLRYSSTGL

SEQ ID NO: 923167 - protein, 19 aa, Mycobacterium
WPDKPGVAGCAAMDGTVLV

SEQ ID NO: 923168 - protein, 26 aa, Mycobacterium
WQASELYAPLQAWQRMGQPTIAINAN

SEQ ID NO: 923169 - protein, 18 aa, Mycobacterium
WQASGGWTDGAHRLGTSP

SEQ ID NO: 923170 - protein, 27 aa, Mycobacterium
WRFGVPLVCLLAGLLLAATHGVSGGAE

SEQ ID NO: 923171 - protein, 31 aa, Mycobacterium
WSGVARHVLIPAGWCGYSGPRARGMASSADM

SEQ ID NO: 923172 - protein, 24 aa, Mycobacterium
YAGAEAAGVSVLQSAGADVMGALN

SEQ ID NO: 923173 - protein, 26 aa, Mycobacterium
YALTYPRRLGFGLGNSVVSLSWRTGD

SEQ ID NO: 923174 - protein, 18 aa, Mycobacterium
YITARFLPDKAIDLVDEA

SEQ ID NO: 923175 - protein, 24 aa, Mycobacterium
YLSEARGPLHTDLQALQCPLKELG

SEQ ID NO: 923176 - protein, 19 aa, Mycobacterium
YPAAFPVGMLPTNQNDTGL

SEQ ID NO: 923177 - protein, 17 aa, Mycobacterium
YPPDLLIEVPRTVCRSL

SEQ ID NO: 923178 - protein, 20 aa, Mycobacterium
YRPGQKPLLTQAWTSDAAGR

SEQ ID NO: 923179 - protein, 18 aa, Mycobacterium
YTPGADFHGTDTFTYTLN

SEQ ID NO: 923180 - protein, 18 aa, Mycobacterium
AAAAARTSVLIMGGSGDP

SEQ ID NO: 923181 - protein, 20 aa, Mycobacterium
AAAACAPVQVVFARGRNESP

SEQ ID NO: 923182 - protein, 23 aa, Mycobacterium
AAAACPDVQVVFARGTGEPPGLG

SEQ ID NO: 923183 - protein, 18 aa, Mycobacterium
AAAAFDRWTDLIAQRFIA

SEQ ID NO: 923184 - protein, 19 aa, Mycobacterium
AAAAIPTTAIATAAADDVS

SEQ ID NO: 923185 - protein, 19 aa, Mycobacterium
AAAAKYWRYQKYDDCLIMA

SEQ ID NO: 923186 - protein, 19 aa, Mycobacterium
AAAALVVALTCTIRATADA

SEQ ID NO: 923187 - protein, 20 aa, Mycobacterium
AAAALWRAAGITNPIDEIDA

SEQ ID NO: 923188 - protein, 27 aa, Mycobacterium
AAAAMFLGFGAVAAWAEPTPPPPVPGS

SEQ ID NO: 923189 - protein, 23 aa, Mycobacterium
AAAANAMRPDAIVSIHADGGPPS

SEQ ID NO: 923190 - protein, 17 aa, Mycobacterium
AAAAPGFGPDAPVTQEF

SEQ ID NO: 923191 - protein, 29 aa, Mycobacterium
AAAAPSGEVALCFDGDVRVSAWQASQADA

SEQ ID NO: 923192 - protein, 17 aa, Mycobacterium
AAAARRIRVASAAVVAL

SEQ ID NO: 923193 - protein, 25 aa, Mycobacterium
AAAAVGFPVLHIGNIGFANLSVGNI

SEQ ID NO: 923194 - protein, 29 aa, Mycobacterium
AAAAVTLAWLAIRNIRVVRQYERGVVFRF

SEQ ID NO: 923195 - protein, 21 aa, Mycobacterium
AAACAALLVSGCTAQVSGMPP

SEQ ID NO: 923196 - protein, 17 aa, Mycobacterium
AAACGAGGDCGRCRRTL

SEQ ID NO: 923197 - protein, 33 aa, Mycobacterium
AAADEISVAMASVFSDHALSYQQVAARMAAFHD

SEQ ID NO: 923198 - protein, 20 aa, Mycobacterium
AAADMLVRAWVRSYGVRATI

SEQ ID NO: 923199 - protein, 23 aa, Mycobacterium
AAADPAPPIPFIPAVPAPLPAVP

SEQ ID NO: 923200 - protein, 17 aa, Mycobacterium
AAADRNTWGLVDMSVSA

SEQ ID NO: 923201 - protein, 18 aa, Mycobacterium
AAAEEAWAEVLALAPEAD

SEQ ID NO: 923202 - protein, 22 aa, Mycobacterium
AAAELPARWVSVGTGAADATFG

SEQ ID NO: 923203 - protein, 20 aa, Mycobacterium
AAAFSRPGLPVEYLQIPSPS

SEQ ID NO: 923204 - protein, 17 aa, Mycobacterium
AAAGALPAALVLLAAAI

SEQ ID NO: 923205 - protein, 25 aa, Mycobacterium
AAAGCPPVQVVFARGRMETPGPGAL

SEQ ID NO: 923206 - protein, 20 aa, Mycobacterium
AAAGHWRDFAAALNGVQGAL

SEQ ID NO: 923207 - protein, 27 aa, Mycobacterium
AAAGYVVRLPEKFVLVGHSAGGSLVTS

SEQ ID NO: 923208 - protein, 18 aa, Mycobacterium
AAAHRAGVPVAEVSETMP

SEQ ID NO: 923209 - protein, 23 aa, Mycobacterium
AAAKAAILASIAFHTKVSADDVY

SEQ ID NO: 923210 - protein, 23 aa, Mycobacterium
AAAKAAILASIAFHTRVTADDVY

SEQ ID NO: 923211 - protein, 26 aa, Mycobacterium
AAAKELAYLGVRVNAIAPGLIRSAMT

SEQ ID NO: 923212 - protein, 20 aa, Mycobacterium
AAALCGWAGTAPVVRAEPSS

SEQ ID NO: 923213 - protein, 18 aa, Mycobacterium
AAALCVLAAAAIVITAPG

SEQ ID NO: 923214 - protein, 22 aa, Mycobacterium
AAALFRDFARQWRDCDGTTVII

SEQ ID NO: 923215 - protein, 22 aa, Mycobacterium
AAALKGDCKDIVMVQDQDGHYP

SEQ ID NO: 923216 - protein, 22 aa, Mycobacterium
AAALLPARWIVVGVGERDDVLG

SEQ ID NO: 923217 - protein, 22 aa, Mycobacterium
AAALLPERWVIIGTGPADEEFG

SEQ ID NO: 923218 - protein, 20 aa, Mycobacterium
AAALRSMAHAFGLDTPPSAI

SEQ ID NO: 923219 - protein, 25 aa, Mycobacterium
AAAMRNLLLMLGFPANRIIVEDRAN

SEQ ID NO: 923220 - protein, 23 aa, Mycobacterium
AAANAMRPDVIVSIHADGGPASG

SEQ ID NO: 923221 - protein, 23 aa, Mycobacterium
AAAPDIPGRFVVAAATVRHLLTD

SEQ ID NO: 923222 - protein, 18 aa, Mycobacterium
AAAPRICADPAAVPAAMP

SEQ ID NO: 923223 - protein, 20 aa, Mycobacterium
AAAQKLWAQAGFRPVDPAVA

SEQ ID NO: 923224 - protein, 24 aa, Mycobacterium
AAAQKLWAQSGFRPVDPAVAADFR

SEQ ID NO: 923225 - protein, 33 aa, Mycobacterium
AAAQQRCGSPAWNLPVVFGPIAITYNVKGLSSL

SEQ ID NO: 923226 - protein, 17 aa, Mycobacterium
AAAQRCPDRPGIIDELG

SEQ ID NO: 923227 - protein, 23 aa, Mycobacterium
AAAQRDGRRLVIAMMYGLVKEGG

SEQ ID NO: 923228 - protein, 17 aa, Mycobacterium
AAARARRLAAVCGGATS

SEQ ID NO: 923229 - protein, 17 aa, Mycobacterium
AAAREWNAALLRIAVAG

SEQ ID NO: 923230 - protein, 17 aa, Mycobacterium
AAARIKKALGLSSGVEG

SEQ ID NO: 923231 - protein, 19 aa, Mycobacterium
AAARIKRRWDDFVVGGLGI

SEQ ID NO: 923232 - protein, 24 aa, Mycobacterium
AAARVRMLPKIVGIDEVFAQWEQR

SEQ ID NO: 923233 - protein, 23 aa, Mycobacterium
AAARYLCSGGLNLRDQSQVMTAI

SEQ ID NO: 923234 - protein, 19 aa, Mycobacterium
AAASEFIEFVTGPQGRDVL

SEQ ID NO: 923235 - protein, 19 aa, Mycobacterium
AAASLKSTFTELGSRFETD

SEQ ID NO: 923236 - protein, 24 aa, Mycobacterium
AAASLKSVFTELGKRFEDANPGAT

SEQ ID NO: 923237 - protein, 20 aa, Mycobacterium
AAASLKTAFTQIGERFKTAN

SEQ ID NO: 923238 - protein, 17 aa, Mycobacterium
AAATAFETAFAVVVPPP

SEQ ID NO: 923239 - protein, 20 aa, Mycobacterium
AAATMPRQLAVAAMGAALMS

SEQ ID NO: 923240 - protein, 18 aa, Mycobacterium
AAAVIMIALTVAGLSGCG

SEQ ID NO: 923241 - protein, 19 aa, Mycobacterium
AAAVSEVLSAKGFGTGSVG

SEQ ID NO: 923242 - protein, 17 aa, Mycobacterium
AAAYPGCGVSWNLLAGI

SEQ ID NO: 923243 - protein, 18 aa, Mycobacterium
AAAYRDPSLLSFHLDDVG

SEQ ID NO: 923244 - protein, 21 aa, Mycobacterium
AACAGYLQWRSSSMRAAQAAN

SEQ ID NO: 923245 - protein, 28 aa, Mycobacterium
AADAARARRATGPARTGCAAGSADTAAT

SEQ ID NO: 923246 - protein, 27 aa, Mycobacterium
AADAGWQVTDAVAWPASRLPQAIAALV

SEQ ID NO: 923247 - protein, 19 aa, Mycobacterium
AADALSWGLVTAVYPADDF

SEQ ID NO: 923248 - protein, 24 aa, Mycobacterium
AADCAKDPKCPLGPDPSQAVKRFH

SEQ ID NO: 923249 - protein, 18 aa, Mycobacterium
AADCALFVIAANEGVDEP

SEQ ID NO: 923250 - protein, 18 aa, Mycobacterium
AADCGKLVGCPLGNDPAQ

SEQ ID NO: 923251 - protein, 17 aa, Mycobacterium
AADDDRLDWPLRPPPAV

SEQ ID NO: 923252 - protein, 17 aa, Mycobacterium
AADDFNAQMAPRILQES

SEQ ID NO: 923253 - protein, 53 aa, Mycobacterium
AADDVSAAIAALFNAHAEQYQALSVRVAELHESFTRALTAGSTAYATAEAANA

SEQ ID NO: 923254 - protein, 23 aa, Mycobacterium
AADEAFLKLEFTNGAQNAGEGDY

SEQ ID NO: 923255 - protein, 30 aa, Mycobacterium
AADEVSTAIAALFGWHAQTYQSLSAQATSF

SEQ ID NO: 923256 - protein, 28 aa, Mycobacterium
AADEVSTAIAMLFSRHAQAYQQLSAQAA

SEQ ID NO: 923257 - protein, 24 aa, Mycobacterium
AADGCVRLPLNLSRNDVRASGAQV

SEQ ID NO: 923258 - protein, 18 aa, Mycobacterium
AADGKPTLDLGVVSDKFA

SEQ ID NO: 923259 - protein, 18 aa, Mycobacterium
AADIGFAAGKAAFDAGPV

SEQ ID NO: 923260 - protein, 20 aa, Mycobacterium
AADLKIPVISYDRLIKGTPN

SEQ ID NO: 923261 - protein, 23 aa, Mycobacterium
AADLNWAQASLLAGMVRSTSLLD

SEQ ID NO: 923262 - protein, 31 aa, Mycobacterium
AADPAILTGGARAARGVRAHPPLPGDARTAG

SEQ ID NO: 923263 - protein, 24 aa, Mycobacterium
AADPCSDVSVVFARGTHQEPGLGN

SEQ ID NO: 923264 - protein, 23 aa, Mycobacterium
AADPDHRTAVIAWMGYDAPDRPS

SEQ ID NO: 923265 - protein, 24 aa, Mycobacterium
AADPKPYLLLGILPSERVEATPAA

SEQ ID NO: 923266 - protein, 22 aa, Mycobacterium
AADRLGERVPPPTVVDPTPAAT

SEQ ID NO: 923267 - protein, 28 aa, Mycobacterium
AADTGLRLPFGEILRTVFDEALAGGHAN

SEQ ID NO: 923268 - protein, 17 aa, Mycobacterium
AADTLLRPLGMGVTSYR

SEQ ID NO: 923269 - protein, 23 aa, Mycobacterium
AADVKAVVVAQNLVSARFVALTP

SEQ ID NO: 923270 - protein, 24 aa, Mycobacterium
AAEAATAAALWRFTAGAVDQPNPV

SEQ ID NO: 923271 - protein, 19 aa, Mycobacterium
AAEAPRVDIVAVYPGCDAV

SEQ ID NO: 923272 - protein, 22 aa, Mycobacterium
AAEAVAAAAGRSWEDLARDVLY

SEQ ID NO: 923273 - protein, 19 aa, Mycobacterium
AAEAWNHYYNHWFPNAVID

SEQ ID NO: 923274 - protein, 22 aa, Mycobacterium
AAEKLRSGPFFIGVKVVNSART

SEQ ID NO: 923275 - protein, 23 aa, Mycobacterium
AAELAGRGAEVWIADRQIGPARE

SEQ ID NO: 923276 - protein, 20 aa, Mycobacterium
AAELGGWVMRSACAEFSQWR

SEQ ID NO: 923277 - protein, 23 aa, Mycobacterium
AAELIRLTSDFGIRESTVRVALT

SEQ ID NO: 923278 - protein, 27 aa, Mycobacterium
AAELPFNRILAVGGFRCNVQQASGISC

SEQ ID NO: 923279 - protein, 17 aa, Mycobacterium
AAEPRRIAVVFGAGGDR

SEQ ID NO: 923280 - protein, 22 aa, Mycobacterium
AAEQKLPLNVTWVNLTTGKSGS

SEQ ID NO: 923281 - protein, 19 aa, Mycobacterium
AAERFAQLGARVIVSDINE

SEQ ID NO: 923282 - protein, 19 aa, Mycobacterium
AAERGRWLNHLPYQDLPPM

SEQ ID NO: 923283 - protein, 17 aa, Mycobacterium
AAERLHMTQPPLSRQIQ

SEQ ID NO: 923284 - protein, 24 aa, Mycobacterium
AAERLPAGVTVRWADLTNAEQTSR

SEQ ID NO: 923285 - protein, 17 aa, Mycobacterium
AAERSRMAAAVPEQRPH

SEQ ID NO: 923286 - protein, 23 aa, Mycobacterium
AAFEINWPFVMASMMENAIKGGV

SEQ ID NO: 923287 - protein, 20 aa, Mycobacterium
AAFQQEFTRTLAVAAGAYAQ

SEQ ID NO: 923288 - protein, 17 aa, Mycobacterium
AAFTGGLNGLVRAGQTL

SEQ ID NO: 923289 - protein, 23 aa, Mycobacterium
AAFVPDKRIGIVMLANKNFPNAA

SEQ ID NO: 923290 - protein, 17 aa, Mycobacterium
AAGAALVAAFVASSAPS

SEQ ID NO: 923291 - protein, 17 aa, Mycobacterium
AAGAARYVTFAKGAMYW

SEQ ID NO: 923292 - protein, 24 aa, Mycobacterium
AAGAGGPLVTPGHAGNTGTGGTGG

SEQ ID NO: 923293 - protein, 18 aa, Mycobacterium
AAGALAMAVVGLGAAQGL

SEQ ID NO: 923294 - protein, 19 aa, Mycobacterium
AAGALPVAVALSGAANAEP

SEQ ID NO: 923295 - protein, 18 aa, Mycobacterium
AAGATVFLVPAKNCYEAA

SEQ ID NO: 923296 - protein, 27 aa, Mycobacterium
AAGAVVESGCVRFSAVAAIAPGAPGAA

SEQ ID NO: 923297 - protein, 17 aa, Mycobacterium
AAGCGWGPSSAPPPPPD

SEQ ID NO: 923298 - protein, 21 aa, Mycobacterium
AAGCPDVDVSFARGTNDSPGL

SEQ ID NO: 923299 - protein, 30 aa, Mycobacterium
AAGDEVSAAIAALFSDHALQYQAVSAEAVA

SEQ ID NO: 923300 - protein, 22 aa, Mycobacterium
AAGEIPHALALQSNNACPNFRP

SEQ ID NO: 923301 - protein, 19 aa, Mycobacterium
AAGELMFYGQGAGGAPTAS

SEQ ID NO: 923302 - protein, 23 aa, Mycobacterium
AAGESLRAGSARGGGVDPIASVA

SEQ ID NO: 923303 - protein, 30 aa, Mycobacterium
AAGGPGGAGGWLWGGGGAGGLGGAASGAGN

SEQ ID NO: 923304 - protein, 17 aa, Mycobacterium
AAGGQGWAIAKRLRAQG

SEQ ID NO: 923305 - protein, 24 aa, Mycobacterium
AAGGVLLRPFARLISSTGDSVSTY

SEQ ID NO: 923306 - protein, 18 aa, Mycobacterium
AAGGWFYWDRVETTGERI

SEQ ID NO: 923307 - protein, 25 aa, Mycobacterium
AAGHGRSGFLLAPWTAKTIGAVLDG

SEQ ID NO: 923308 - protein, 24 aa, Mycobacterium
AAGIRIKVPGLPPVTVGPRTPAIY

SEQ ID NO: 923309 - protein, 17 aa, Mycobacterium
AAGKMSAMMSGRVDGLI

SEQ ID NO: 923310 - protein, 22 aa, Mycobacterium
AAGKRIGFLDIRDPANPVGLGT

SEQ ID NO: 923311 - protein, 17 aa, Mycobacterium
AAGLLGVLGTTPAARAT

SEQ ID NO: 923312 - protein, 19 aa, Mycobacterium
AAGLLRQGKLLGMYPEGTR

SEQ ID NO: 923313 - protein, 24 aa, Mycobacterium
AAGLPWETGLTWDPRVHDVVRGAI

SEQ ID NO: 923314 - protein, 18 aa, Mycobacterium
AAGLRARIAALDGGDGAA

SEQ ID NO: 923315 - protein, 21 aa, Mycobacterium
AAGLTRSFMAFLIDAYTEDQA

SEQ ID NO: 923316 - protein, 19 aa, Mycobacterium
AAGNGWRVSGLLRIDEVAI

SEQ ID NO: 923317 - protein, 21 aa, Mycobacterium
AAGNPIAWFYQQRRWIVPSER

SEQ ID NO: 923318 - protein, 25 aa, Mycobacterium
AAGPNMPGASWAPSSLRDSALFIRD

SEQ ID NO: 923319 - protein, 22 aa, Mycobacterium
AAGRHCCFAVLNPDAPWTRLVS

SEQ ID NO: 923320 - protein, 19 aa, Mycobacterium
AAGSADAFFLLGVTDDEAL

SEQ ID NO: 923321 - protein, 24 aa, Mycobacterium
AAGSADLFFLLGVSESDALAWVDH

SEQ ID NO: 923322 - protein, 21 aa, Mycobacterium
AAGSSCDRPGTSVFAMSTSSD

SEQ ID NO: 923323 - protein, 30 aa, Mycobacterium
AAGSVGVAGRLCLSAGPAVTAVAAGPTGRA

SEQ ID NO: 923324 - protein, 19 aa, Mycobacterium
AAGTARPNAPAIAAGPTSA

SEQ ID NO: 923325 - protein, 24 aa, Mycobacterium
AAGTMPILALYGIPNRDCGSLAAG

SEQ ID NO: 923326 - protein, 25 aa, Mycobacterium
AAGTPLRLVSLVALDPAFGHLRSDD

SEQ ID NO: 923327 - protein, 27 aa, Mycobacterium
AAGTTLLGRDGRFSGAAHLADTADVAV

SEQ ID NO: 923328 - protein, 17 aa, Mycobacterium
AAGTVQWVLGNLGAIPT

SEQ ID NO: 923329 - protein, 23 aa, Mycobacterium
AAGVRRLVLASSMVVYGQGRYDC

SEQ ID NO: 923330 - protein, 23 aa, Mycobacterium
AAGVRRLVLASSMVVYGQGRYHC

SEQ ID NO: 923331 - protein, 23 aa, Mycobacterium
AAGVRRLVLASSMVVYGQGRYRC

SEQ ID NO: 923332 - protein, 20 aa, Mycobacterium
AAGWAAFCASTGAVRTTDLT

SEQ ID NO: 923333 - protein, 24 aa, Mycobacterium
AAGYFADRHRAFVESMKPYEDTVA

SEQ ID NO: 923334 - protein, 20 aa, Mycobacterium
AAHELDRVHVVAYFDNSNGV

SEQ ID NO: 923335 - protein, 26 aa, Mycobacterium
AAHKVCRKLDGGMPVDDIVDGLRNDA

SEQ ID NO: 923336 - protein, 24 aa, Mycobacterium
AAHPELSEIFALLNPRLTNDTMLA

SEQ ID NO: 923337 - protein, 17 aa, Mycobacterium
AAHSIYCPGNVCDAPTL

SEQ ID NO: 923338 - protein, 18 aa, Mycobacterium
AAHWLLGDACELSLLESV

SEQ ID NO: 923339 - protein, 21 aa, Mycobacterium
AAHWRLGDACEITMLESVRLE

SEQ ID NO: 923340 - protein, 17 aa, Mycobacterium
AAIAAFAFAFAAAPVIG

SEQ ID NO: 923341 - protein, 24 aa, Mycobacterium
AAIADQAPFPWGVAMLPIGPKGRV

SEQ ID NO: 923342 - protein, 19 aa, Mycobacterium
AAIGNRPATIFLEAAHESD

SEQ ID NO: 923343 - protein, 21 aa, Mycobacterium
AAIIDRVVKRYGLTSTRRPTD

SEQ ID NO: 923344 - protein, 26 aa, Mycobacterium
AAIIPPFCYMRRELARKVNVDATESL

SEQ ID NO: 923345 - protein, 20 aa, Mycobacterium
AAIIRLEPSIGMPVGDIAGR

SEQ ID NO: 923346 - protein, 17 aa, Mycobacterium
AAILRYNNSMPYAQNVL

SEQ ID NO: 923347 - protein, 17 aa, Mycobacterium
AAILRYNNSMSYAQNVL

SEQ ID NO: 923348 - protein, 18 aa, Mycobacterium
AAIPKRRAVTALKPDDVE

SEQ ID NO: 923349 - protein, 18 aa, Mycobacterium
AAIPYAAPPVGPRRFAEP

SEQ ID NO: 923350 - protein, 23 aa, Mycobacterium
AAIRARLAALAFEGAVVATVPLP

SEQ ID NO: 923351 - protein, 22 aa, Mycobacterium
AAIRKRGRLVVGLDIGSNLFSF

SEQ ID NO: 923352 - protein, 17 aa, Mycobacterium
AAITFGIGTLDAADEAL

SEQ ID NO: 923353 - protein, 17 aa, Mycobacterium
AAIVQRDADRFGLALPP

SEQ ID NO: 923354 - protein, 18 aa, Mycobacterium
AAKARLATFQIAVNKVAA

SEQ ID NO: 923355 - protein, 18 aa, Mycobacterium
AAKFTLDVYPRYLSLIPS

SEQ ID NO: 923356 - protein, 29 aa, Mycobacterium
AAKILEFAPGELKNLPGYEGSNNGSASTL

SEQ ID NO: 923357 - protein, 20 aa, Mycobacterium
AAKLRDLYLAVCGPGHTDVP

SEQ ID NO: 923358 - protein, 24 aa, Mycobacterium
AAKNGDLPLSFDVTNIQPAAPGTA

SEQ ID NO: 923359 - protein, 24 aa, Mycobacterium
AAKNGDLPLSFDVTNIQPTAAGSA

SEQ ID NO: 923360 - protein, 19 aa, Mycobacterium
AAKRKWDKLLLKVGFPDKN

SEQ ID NO: 923361 - protein, 23 aa, Mycobacterium
AAKRLWEYACQRHDDILGAYGAY

SEQ ID NO: 923362 - protein, 19 aa, Mycobacterium
AALAAFALTSCQAKEEAPA

SEQ ID NO: 923363 - protein, 30 aa, Mycobacterium
AALAAGAAGCSWGGAVVGAVAAGAALASGS

SEQ ID NO: 923364 - protein, 29 aa, Mycobacterium
AALAAGAAGCSWGGAVVGAVAAGAALASR

SEQ ID NO: 923365 - protein, 29 aa, Mycobacterium
AALAAGAAGCSWGGAVVGAVAAGSSGASG

SEQ ID NO: 923366 - protein, 29 aa, Mycobacterium
AALAAGAAGCSWGGAVVGAVASGSALASG

SEQ ID NO: 923367 - protein, 28 aa, Mycobacterium
AALAAGLRDLRRVGAVGAGAADTARASG

SEQ ID NO: 923368 - protein, 17 aa, Mycobacterium
AALAAVIALAGGCSTVV

SEQ ID NO: 923369 - protein, 20 aa, Mycobacterium
AALAGCSRGPVQTGNVFVIA

SEQ ID NO: 923370 - protein, 21 aa, Mycobacterium
AALAGGCHQAHKPAPPSPPTT

SEQ ID NO: 923371 - protein, 25 aa, Mycobacterium
AALAILPVKLIGDLVYIAVNIPAQI

SEQ ID NO: 923372 - protein, 23 aa, Mycobacterium
AALAKELKRIPGAAATVRSTPST

SEQ ID NO: 923373 - protein, 22 aa, Mycobacterium
AALALARDGWWVDLLECSSDIL

SEQ ID NO: 923374 - protein, 21 aa, Mycobacterium
AALARLPGQILGRVAFQVLAG

SEQ ID NO: 923375 - protein, 19 aa, Mycobacterium
AALASRAGDHVDFLAFDRV

SEQ ID NO: 923376 - protein, 25 aa, Mycobacterium
AALAVPPWAVEPFTELGRDHRRIEG

SEQ ID NO: 923377 - protein, 17 aa, Mycobacterium
AALCHSGSFMATGDIDR

SEQ ID NO: 923378 - protein, 19 aa, Mycobacterium
AALDPRFLTAQKLPPGLTF

SEQ ID NO: 923379 - protein, 17 aa, Mycobacterium
AALDQIWANISAVARQL

SEQ ID NO: 923380 - protein, 23 aa, Mycobacterium
AALELNWPYVFASMLENAVKGGV

SEQ ID NO: 923381 - protein, 23 aa, Mycobacterium
AALEVNWPYVFASLLENAVKGGV

SEQ ID NO: 923382 - protein, 23 aa, Mycobacterium
AALEVNWPYVLPSLLENAVKGGV

SEQ ID NO: 923383 - protein, 24 aa, Mycobacterium
AALHRHGDVWAFIDAMCRNALRLT

SEQ ID NO: 923384 - protein, 24 aa, Mycobacterium
AALIAEAGGDPWAINKSLQAGSPG

SEQ ID NO: 923385 - protein, 20 aa, Mycobacterium
AALIAEAGGDPWAVNQSLQA

SEQ ID NO: 923386 - protein, 30 aa, Mycobacterium
AALKADAAALGFPIRLPVLPDGWKANSGGR

SEQ ID NO: 923387 - protein, 24 aa, Mycobacterium
AALKDLKVRQAVNYSLNRADVVRG

SEQ ID NO: 923388 - protein, 17 aa, Mycobacterium
AALKDPRWDDLLDPRFR

SEQ ID NO: 923389 - protein, 17 aa, Mycobacterium
AALKRIALPLGPASGPM

SEQ ID NO: 923390 - protein, 18 aa, Mycobacterium
AALLAFRPDPADDRAEVV

SEQ ID NO: 923391 - protein, 24 aa, Mycobacterium
AALLVLAGGFAYLGAAVVARHRSQ

SEQ ID NO: 923392 - protein, 17 aa, Mycobacterium
AALNALGVRTAMSRGND

SEQ ID NO: 923393 - protein, 19 aa, Mycobacterium
AALNEAWAGLQATGLQAQI

SEQ ID NO: 923394 - protein, 19 aa, Mycobacterium
AALNRLAATPFPVQLNDIT

SEQ ID NO: 923395 - protein, 24 aa, Mycobacterium
AALPGDLNQGVLINTNLGYLQFGA

SEQ ID NO: 923396 - protein, 19 aa, Mycobacterium
AALPMLLPAGVCAAASNTA

SEQ ID NO: 923397 - protein, 17 aa, Mycobacterium
AALPPWSGAPHDAPAAL

SEQ ID NO: 923398 - protein, 18 aa, Mycobacterium
AALQPGFATREVSEVSPL

SEQ ID NO: 923399 - protein, 17 aa, Mycobacterium
AALRAREPMAAAMDYVA

SEQ ID NO: 923400 - protein, 18 aa, Mycobacterium
AALRDRFAGMGWLVPEVL

SEQ ID NO: 923401 - protein, 24 aa, Mycobacterium
AALRVADHRALRIVHRAPANSEEL

SEQ ID NO: 923402 - protein, 17 aa, Mycobacterium
AALRYVDAMIWTPSQAP

SEQ ID NO: 923403 - protein, 25 aa, Mycobacterium
AALSAQYRRAFAMAIPTFALPDIHL

SEQ ID NO: 923404 - protein, 17 aa, Mycobacterium
AALSFLKYPMAVTVQNV

SEQ ID NO: 923405 - protein, 17 aa, Mycobacterium
AALSRIVGIELQASRTL

SEQ ID NO: 923406 - protein, 19 aa, Mycobacterium
AALTARLAAAHAVAAPAIT

SEQ ID NO: 923407 - protein, 18 aa, Mycobacterium
AALTSLDYYHAFLGLLGN

SEQ ID NO: 923408 - protein, 27 aa, Mycobacterium
AALTTLVYYHAFLGLLGPDDVKGQRPT

SEQ ID NO: 923409 - protein, 25 aa, Mycobacterium
AALYDSGMEYAVFQPALFFQNYAAG

SEQ ID NO: 923410 - protein, 19 aa, Mycobacterium
AAMGTRLAERLGLGERERG

SEQ ID NO: 923411 - protein, 21 aa, Mycobacterium
AAMKAFFVYDEPFWRADGLNG

SEQ ID NO: 923412 - protein, 18 aa, Mycobacterium
AAMMKAVQPMSSLKKPEP

SEQ ID NO: 923413 - protein, 19 aa, Mycobacterium
AAMRLPGAWATPPAPQAPP

SEQ ID NO: 923414 - protein, 20 aa, Mycobacterium
AAMRLPGAWATPSAPQAPPS

SEQ ID NO: 923415 - protein, 20 aa, Mycobacterium
AAMTADWARWVADGIRARQK

SEQ ID NO: 923416 - protein, 25 aa, Mycobacterium
AAMTVAAGRYVGWLRTSALHAAGAA

SEQ ID NO: 923417 - protein, 17 aa, Mycobacterium
AANARLATLGGGQFLLS

SEQ ID NO: 923418 - protein, 18 aa, Mycobacterium
AANARVALFDGGQYLLAK

SEQ ID NO: 923419 - protein, 25 aa, Mycobacterium
AANGENYRVLFQVATPQGVNPSTLA

SEQ ID NO: 923420 - protein, 24 aa, Mycobacterium
AANITRLPVRYTFDNRYFSDTYEG

SEQ ID NO: 923421 - protein, 24 aa, Mycobacterium
AANLKRADVDAVLPRILIESPVPG

SEQ ID NO: 923422 - protein, 24 aa, Mycobacterium
AANYRAGQRVRLRMVNAGGDTAFR

SEQ ID NO: 923423 - protein, 17 aa, Mycobacterium
AAPDVGGTWYWNRYPGA

SEQ ID NO: 923424 - protein, 25 aa, Mycobacterium
AAPGFATPAVYDWLMPIPAPSPDAR

SEQ ID NO: 923425 - protein, 20 aa, Mycobacterium
AAPGFRGVDCNGVTDADIDK

SEQ ID NO: 923426 - protein, 17 aa, Mycobacterium
AAPIGRATIAAALRGAS

SEQ ID NO: 923427 - protein, 17 aa, Mycobacterium
AAPIGRAVIEAALQGEP

SEQ ID NO: 923428 - protein, 17 aa, Mycobacterium
AAPIGRAVIEAALQGGP

SEQ ID NO: 923429 - protein, 27 aa, Mycobacterium
AAPILNQRRAVVFSESLGGVTTSLAYR

SEQ ID NO: 923430 - protein, 26 aa, Mycobacterium
AAPLLGVLCSIYWQRPVPTVHVHAEP

SEQ ID NO: 923431 - protein, 22 aa, Mycobacterium
AAPPGPCDIVANGTPVSSDGGR

SEQ ID NO: 923432 - protein, 19 aa, Mycobacterium
AAPQPAGRAVVVVSGGNAT

SEQ ID NO: 923433 - protein, 23 aa, Mycobacterium
AAPRGASAAELFANPNSGLTTGK

SEQ ID NO: 923434 - protein, 17 aa, Mycobacterium
AAPTMSVLAAGADEVSA

SEQ ID NO: 923435 - protein, 28 aa, Mycobacterium
AAPWWRWPRAPARWRPRRRRRRRRYCSA

SEQ ID NO: 923436 - protein, 18 aa, Mycobacterium
AAPYAEWLSAAAEQARQT

SEQ ID NO: 923437 - protein, 19 aa, Mycobacterium
AAPYAGWLSAAATRALGAA

SEQ ID NO: 923438 - protein, 19 aa, Mycobacterium
AAQAAIAWVATRGDDVVPL

SEQ ID NO: 923439 - protein, 23 aa, Mycobacterium
AAQARFDKFAAAMYVRGPSSSYL

SEQ ID NO: 923440 - protein, 28 aa, Mycobacterium
AAQEVFDKLAGVGIDLTDVFVVLEKEGV

SEQ ID NO: 923441 - protein, 17 aa, Mycobacterium
AAQGWNIDTVKESLHVL

SEQ ID NO: 923442 - protein, 20 aa, Mycobacterium
AAQLAPWQQALRTLQNRVAG

SEQ ID NO: 923443 - protein, 21 aa, Mycobacterium
AAQLNGWKLEFDLPAGESITN

SEQ ID NO: 923444 - protein, 32 aa, Mycobacterium
AAQQRCGSPAWNLPVVFGPIAITYNVTGLNSL

SEQ ID NO: 923445 - protein, 25 aa, Mycobacterium
AAQSQRCEQEGKPAVNVTATDSDTQ

SEQ ID NO: 923446 - protein, 23 aa, Mycobacterium
AAQVCGELGIPHLVLARPAWDPG

SEQ ID NO: 923447 - protein, 23 aa, Mycobacterium
AARAAGAAPVYEGDPGYAPHLDR

SEQ ID NO: 923448 - protein, 28 aa, Mycobacterium
AARAPRVSTVIKVDWRQGAVDAMTQKVA

SEQ ID NO: 923449 - protein, 19 aa, Mycobacterium
AARCQRLALDALKIGEADS

SEQ ID NO: 923450 - protein, 18 aa, Mycobacterium
AARDGGYLPMNFAANDLA

SEQ ID NO: 923451 - protein, 18 aa, Mycobacterium
AAREFGKHGARVGLLARG

SEQ ID NO: 923452 - protein, 21 aa, Mycobacterium
AARGSRLATVLSRCSYLCDGV

SEQ ID NO: 923453 - protein, 17 aa, Mycobacterium
AARIGAPLEIRGIGVRR

SEQ ID NO: 923454 - protein, 17 aa, Mycobacterium
AARIGAPLELRGVGVRR

SEQ ID NO: 923455 - protein, 19 aa, Mycobacterium
AARIMARLAARPSTHTRRV

SEQ ID NO: 923456 - protein, 21 aa, Mycobacterium
AARLFPPTTLTAIFANANAIY

SEQ ID NO: 923457 - protein, 25 aa, Mycobacterium
AARQPRPATVWIASDGSHRLVRATI

SEQ ID NO: 923458 - protein, 24 aa, Mycobacterium
AARSLGFNTMRVFLHDQLWAQDRQ

SEQ ID NO: 923459 - protein, 23 aa, Mycobacterium
AARVAADFSDGVWYVDLAPITIP

SEQ ID NO: 923460 - protein, 18 aa, Mycobacterium
AARVFRLALEDAPAGSRW

SEQ ID NO: 923461 - protein, 20 aa, Mycobacterium
AARVLSDFFHRVTLIERDEL

SEQ ID NO: 923462 - protein, 21 aa, Mycobacterium
AARVPATFYLTGRELEAAPDL

SEQ ID NO: 923463 - protein, 20 aa, Mycobacterium
AARWIAPFLTVAAVAGFAVA

SEQ ID NO: 923464 - protein, 23 aa, Mycobacterium
AARYLCSGGLNLRDPGQVMAAIL

SEQ ID NO: 923465 - protein, 21 aa, Mycobacterium
AARYLCSGGLNLRNQADVMAA

SEQ ID NO: 923466 - protein, 18 aa, Mycobacterium
AASATGWTTGTKTYNGAL

SEQ ID NO: 923467 - protein, 20 aa, Mycobacterium
AASLPRQVAVSVYRADTGPA

SEQ ID NO: 923468 - protein, 21 aa, Mycobacterium
AASLSKGYGLNNCTAQSITTG

SEQ ID NO: 923469 - protein, 17 aa, Mycobacterium
AASPAVWLNPLRWSPMM

SEQ ID NO: 923470 - protein, 23 aa, Mycobacterium
AASPSGLDGPGWESLTTPHDLAV

SEQ ID NO: 923471 - protein, 18 aa, Mycobacterium
AASREWNAALSRISVAGR

SEQ ID NO: 923472 - protein, 18 aa, Mycobacterium
AASWAFLGWRHLRTGQAR

SEQ ID NO: 923473 - protein, 19 aa, Mycobacterium
AATAAALMGSFAYLGIGIG

SEQ ID NO: 923474 - protein, 18 aa, Mycobacterium
AATATHLSSLRTTLVAAN

SEQ ID NO: 923475 - protein, 17 aa, Mycobacterium
AATDCPDAEVIFARGTS

SEQ ID NO: 923476 - protein, 20 aa, Mycobacterium
AATEALYGQMWAQDAAAMYG

SEQ ID NO: 923477 - protein, 17 aa, Mycobacterium
AATELKKFPSIAGTDSS

SEQ ID NO: 923478 - protein, 26 aa, Mycobacterium
AATGLQLPGAHSFFVGNPRIGKTFFD

SEQ ID NO: 923479 - protein, 19 aa, Mycobacterium
AATIEWYRTHEDWWTPAKE

SEQ ID NO: 923480 - protein, 18 aa, Mycobacterium
AATLLRDMLNGIYDPVQW

SEQ ID NO: 923481 - protein, 23 aa, Mycobacterium
AATLSALSAAACVALVSACSSPQ

SEQ ID NO: 923482 - protein, 18 aa, Mycobacterium
AATLTWAKTSIKVVDESH

SEQ ID NO: 923483 - protein, 19 aa, Mycobacterium
AATPWTAPHAAEWDAITAG

SEQ ID NO: 923484 - protein, 24 aa, Mycobacterium
AATSWPDKFLVGAALVAHGVAAAN

SEQ ID NO: 923485 - protein, 21 aa, Mycobacterium
AATTMIWTASTIKLAMVVDLL

SEQ ID NO: 923486 - protein, 21 aa, Mycobacterium
AATVKALRIIKSVATAPGADP

SEQ ID NO: 923487 - protein, 27 aa, Mycobacterium
AAVAAGETFSTLTAGTAVHTGTYAVAA

SEQ ID NO: 923488 - protein, 23 aa, Mycobacterium
AAVADLFAAFGMLPVGYYDLRCA

SEQ ID NO: 923489 - protein, 25 aa, Mycobacterium
AAVAEFPGFAFFEIQLRLPIDGRWE

SEQ ID NO: 923490 - protein, 24 aa, Mycobacterium
AAVAEFPGFAFFEIQLRLPVDGRW

SEQ ID NO: 923491 - protein, 17 aa, Mycobacterium
AAVAGTVGWHGASASPA

SEQ ID NO: 923492 - protein, 17 aa, Mycobacterium
AAVALLARRADRLAELK

SEQ ID NO: 923493 - protein, 19 aa, Mycobacterium
AAVALLEWLQTTHPDPKVS

SEQ ID NO: 923494 - protein, 23 aa, Mycobacterium
AAVARGRVVAYLGTPVADGAGNT

SEQ ID NO: 923495 - protein, 18 aa, Mycobacterium
AAVAVLLSPGFLAVGCGS

SEQ ID NO: 923496 - protein, 19 aa, Mycobacterium
AAVCGAVSAMTRALAVELA

SEQ ID NO: 923497 - protein, 24 aa, Mycobacterium
AAVDFRAVTTLRIRHDVTLTAGST

SEQ ID NO: 923498 - protein, 18 aa, Mycobacterium
AAVEEFGRVTGRTVRGGA

SEQ ID NO: 923499 - protein, 18 aa, Mycobacterium
AAVEGLILGSYRFTDFRS

SEQ ID NO: 923500 - protein, 18 aa, Mycobacterium
AAVFDRWSDLIAQRFVSD

SEQ ID NO: 923501 - protein, 17 aa, Mycobacterium
AAVFGGVVGAVLAVGIG

SEQ ID NO: 923502 - protein, 17 aa, Mycobacterium
AAVGALPFIPRPSTLPT

SEQ ID NO: 923503 - protein, 21 aa, Mycobacterium
AAVGIYGRYDWEDRSTAERAR

SEQ ID NO: 923504 - protein, 17 aa, Mycobacterium
AAVGLTHTVLLRSDGTA

SEQ ID NO: 923505 - protein, 20 aa, Mycobacterium
AAVGVTAYPGLEIHQGSVVC

SEQ ID NO: 923506 - protein, 18 aa, Mycobacterium
AAVIDVIAAVPFPAVGFD

SEQ ID NO: 923507 - protein, 19 aa, Mycobacterium
AAVIVGLFEGMWGSAPAME

SEQ ID NO: 923508 - protein, 17 aa, Mycobacterium
AAVKSFLTVAANEGQAN

SEQ ID NO: 923509 - protein, 19 aa, Mycobacterium
AAVMACSKMSNAMAYAATN

SEQ ID NO: 923510 - protein, 18 aa, Mycobacterium
AAVMCLLSGCVTVVGGTA

SEQ ID NO: 923511 - protein, 18 aa, Mycobacterium
AAVPAGWTVADKTGGGFK

SEQ ID NO: 923512 - protein, 19 aa, Mycobacterium
AAVPLPVMAAGGLATPAAV

SEQ ID NO: 923513 - protein, 17 aa, Mycobacterium
AAVPRWGTPEEMAELFA

SEQ ID NO: 923514 - protein, 24 aa, Mycobacterium
AAVPVAACGPALVTTRPRLTHGVA

SEQ ID NO: 923515 - protein, 18 aa, Mycobacterium
AAVRAARGLAAPGDAILL

SEQ ID NO: 923516 - protein, 30 aa, Mycobacterium
AAVRLASDMGEFFMPFPGTRVNQQTVQLNA

SEQ ID NO: 923517 - protein, 18 aa, Mycobacterium
AAVRPFWQAITDYVDHTV

SEQ ID NO: 923518 - protein, 20 aa, Mycobacterium
AAVRVVVTAIQRVVRVGLSL

SEQ ID NO: 923519 - protein, 19 aa, Mycobacterium
AAVSDFARHDIDALRADVA

SEQ ID NO: 923520 - protein, 18 aa, Mycobacterium
AAVSGGLNPAVNIDPVLD

SEQ ID NO: 923521 - protein, 17 aa, Mycobacterium
AAVTACRNRLVAEGFHL

SEQ ID NO: 923522 - protein, 25 aa, Mycobacterium
AAVVAEWPRSTWWNWNSTFDAIEVD

SEQ ID NO: 923523 - protein, 28 aa, Mycobacterium
AAWERGDIDAAYTWLPTLNELRKTGKDL

SEQ ID NO: 923524 - protein, 22 aa, Mycobacterium
AAWKDIPSWYFISTGDEIITPT

SEQ ID NO: 923525 - protein, 25 aa, Mycobacterium
AAWQGLKTLFSREALQGLSADNVLP

SEQ ID NO: 923526 - protein, 20 aa, Mycobacterium
AAWWVVVLALTAATMMAAAL

SEQ ID NO: 923527 - protein, 18 aa, Mycobacterium
AAYAAAVTRGIVAFLSAK

SEQ ID NO: 923528 - protein, 25 aa, Mycobacterium
AAYAMAFAWHREFLHRIDTLVTRCV

SEQ ID NO: 923529 - protein, 20 aa, Mycobacterium
AAYLARRGGYLRLDIASGEV

SEQ ID NO: 923530 - protein, 17 aa, Mycobacterium
ACAAPALAEQGSPIPPA

SEQ ID NO: 923531 - protein, 19 aa, Mycobacterium
ACAGRRWAGDLAETAPVYF

SEQ ID NO: 923532 - protein, 17 aa, Mycobacterium
ACANRRFVDHPPGQPET

SEQ ID NO: 923533 - protein, 17 aa, Mycobacterium
ACARALADRGRLLLVDM

SEQ ID NO: 923534 - protein, 21 aa, Mycobacterium
ACATYGASVLILPDASRDAVH

SEQ ID NO: 923535 - protein, 26 aa, Mycobacterium
ACDDGTLTTVGFQWQGDHVQMLDPPP

SEQ ID NO: 923536 - protein, 24 aa, Mycobacterium
ACDIPSLLYSYGFEQNPDWSRAYS

SEQ ID NO: 923537 - protein, 24 aa, Mycobacterium
ACDNKGIETWMWGTAENGVLKLAD

SEQ ID NO: 923538 - protein, 19 aa, Mycobacterium
ACECPRGCPSCVQSPKCGN

SEQ ID NO: 923539 - protein, 25 aa, Mycobacterium
ACELPDRLRRLFAGAGVVPRVVLVD

SEQ ID NO: 923540 - protein, 19 aa, Mycobacterium
ACGCHAARHGAAPTTTSTT

SEQ ID NO: 923541 - protein, 20 aa, Mycobacterium
ACGDSGQSPTNWHQGSNSAN

SEQ ID NO: 923542 - protein, 19 aa, Mycobacterium
ACGNNAPLYVEQPFRLDKI

SEQ ID NO: 923543 - protein, 20 aa, Mycobacterium
ACGSGHFVVAAARRIAAALA

SEQ ID NO: 923544 - protein, 19 aa, Mycobacterium
ACGTYRNAAEIIWTNDAKN

SEQ ID NO: 923545 - protein, 18 aa, Mycobacterium
ACHHFDIATEMPLRTRLY

SEQ ID NO: 923546 - protein, 22 aa, Mycobacterium
ACIVLAGMLGMCSFQGSGPGAG

SEQ ID NO: 923547 - protein, 20 aa, Mycobacterium
ACLAAVLAVLAVLGGVVVTA

SEQ ID NO: 923548 - protein, 21 aa, Mycobacterium
ACLAITFAFMLGGLDAPAHSV

SEQ ID NO: 923549 - protein, 18 aa, Mycobacterium
ACLALCLAGCSSTNPAAA

SEQ ID NO: 923550 - protein, 18 aa, Mycobacterium
ACPDMIAAGRGWVVNITS

SEQ ID NO: 923551 - protein, 19 aa, Mycobacterium
ACRSGNSGLVIGFYTPSAD

SEQ ID NO: 923552 - protein, 19 aa, Mycobacterium
ACRTLAADPGWYGDNRDRI

SEQ ID NO: 923553 - protein, 20 aa, Mycobacterium
ACSFKPGKGVHHPVASVIDT

SEQ ID NO: 923554 - protein, 18 aa, Mycobacterium
ACTDGRVSSAVFACGAPT

SEQ ID NO: 923555 - protein, 18 aa, Mycobacterium
ADAAELGPRVSLTGEALA

SEQ ID NO: 923556 - protein, 24 aa, Mycobacterium
ADADGRWLVNPMFIDPLPAHPPYP

SEQ ID NO: 923557 - protein, 24 aa, Mycobacterium
ADAEARVLLARRFHNDAVRDTLAL

SEQ ID NO: 923558 - protein, 24 aa, Mycobacterium
ADAEARVLLARRFHNDAVRDTLVL

SEQ ID NO: 923559 - protein, 25 aa, Mycobacterium
ADAGSRITKLWWPATGAPKLSLTTW

SEQ ID NO: 923560 - protein, 19 aa, Mycobacterium
ADAGVLTPLILKGLGDAHA

SEQ ID NO: 923561 - protein, 17 aa, Mycobacterium
ADAIGILDAIRDVSYSI

SEQ ID NO: 923562 - protein, 20 aa, Mycobacterium
ADAKAAILSPQLVTGRAIQL

SEQ ID NO: 923563 - protein, 20 aa, Mycobacterium
ADAKAAILSPTLVTSRAIQL

SEQ ID NO: 923564 - protein, 18 aa, Mycobacterium
ADAKAIIVAQNLVSARYV

SEQ ID NO: 923565 - protein, 23 aa, Mycobacterium
ADAKAVILSPSLVTARAIQLTPA

SEQ ID NO: 923566 - protein, 22 aa, Mycobacterium
ADAKAVILSPSLVTARVIQLTP

SEQ ID NO: 923567 - protein, 23 aa, Mycobacterium
ADALALGIRFARTLGAELEICIV

SEQ ID NO: 923568 - protein, 17 aa, Mycobacterium
ADALFPPAAIATVQLLE

SEQ ID NO: 923569 - protein, 21 aa, Mycobacterium
ADALNALGWAHAVNYGVADTA

SEQ ID NO: 923570 - protein, 30 aa, Mycobacterium
ADALSAFKQGRVDVWAVWDPYTAQAEKELP

SEQ ID NO: 923571 - protein, 23 aa, Mycobacterium
ADAPAPCWSDQIAVTAAPTQAAV

SEQ ID NO: 923572 - protein, 25 aa, Mycobacterium
ADAPTAAAFDCPDVEVIFARGTNEP

SEQ ID NO: 923573 - protein, 17 aa, Mycobacterium
ADAPVWFTEGVADYVAR

SEQ ID NO: 923574 - protein, 21 aa, Mycobacterium
ADAQGPIALTGLYPPGSTFKT

SEQ ID NO: 923575 - protein, 24 aa, Mycobacterium
ADARRVADMLGIPFYVWDFADRFK

SEQ ID NO: 923576 - protein, 17 aa, Mycobacterium
ADASAVILNPALVASRV

SEQ ID NO: 923577 - protein, 17 aa, Mycobacterium
ADATISAVAGMRAATAA

SEQ ID NO: 923578 - protein, 25 aa, Mycobacterium
ADAVLGMACDGGWWVLGVHDAAAAA

SEQ ID NO: 923579 - protein, 24 aa, Mycobacterium
ADAVLRYLAEREMLIVLDNCEHLL

SEQ ID NO: 923580 - protein, 18 aa, Mycobacterium
ADAVLWAVGRVRPNTGWL

SEQ ID NO: 923581 - protein, 22 aa, Mycobacterium
ADAWLNRQLSGYANWAVANNSL

SEQ ID NO: 923582 - protein, 21 aa, Mycobacterium
ADAYFPAIVASAFTGRDRKDC

SEQ ID NO: 923583 - protein, 19 aa, Mycobacterium
ADAYKGWIDGVAAAIGAGP

SEQ ID NO: 923584 - protein, 27 aa, Mycobacterium
ADAYSAAALRRVWRYTHFSWWMTTMLH

SEQ ID NO: 923585 - protein, 24 aa, Mycobacterium
ADCFAGSYLRWVTQGDSPRFTLNT

SEQ ID NO: 923586 - protein, 23 aa, Mycobacterium
ADCFSGAYMRWVAEDSSQRFSLS

SEQ ID NO: 923587 - protein, 24 aa, Mycobacterium
ADCRRTAPGSAMWVADLADTSALR

SEQ ID NO: 923588 - protein, 20 aa, Mycobacterium
ADDAWARIIAGASLLQGYTG

SEQ ID NO: 923589 - protein, 24 aa, Mycobacterium
ADDHPDLFWALRGGGGGNFGVTTS

SEQ ID NO: 923590 - protein, 17 aa, Mycobacterium
ADDNFALAVFQDLTEQL

SEQ ID NO: 923591 - protein, 18 aa, Mycobacterium
ADDPRFATNPGRCANRDV

SEQ ID NO: 923592 - protein, 22 aa, Mycobacterium
ADDRFYFFFDVVEPEGLPFEKG

SEQ ID NO: 923593 - protein, 20 aa, Mycobacterium
ADDSFAMCSTFKAYLAARIL

SEQ ID NO: 923594 - protein, 20 aa, Mycobacterium
ADEAWECPLHGSRFAPDGTL

SEQ ID NO: 923595 - protein, 21 aa, Mycobacterium
ADEECSMFELLIGYRYGADTV

SEQ ID NO: 923596 - protein, 32 aa, Mycobacterium
ADEIGDRFGALRCRLSLAFAQLWQGEVAEAVA

SEQ ID NO: 923597 - protein, 24 aa, Mycobacterium
ADEISAAMASLFTAHAQAYQGLSV

SEQ ID NO: 923598 - protein, 24 aa, Mycobacterium
ADELHRRLPIYADFDGVAVLDERG

SEQ ID NO: 923599 - protein, 18 aa, Mycobacterium
ADELRRMADDAGLPGPVA

SEQ ID NO: 923600 - protein, 24 aa, Mycobacterium
ADEQACSVLRAYGYPAPAEHRAVP

SEQ ID NO: 923601 - protein, 23 aa, Mycobacterium
ADEVPGVLLARGVAEQFGQRIRL

SEQ ID NO: 923602 - protein, 23 aa, Mycobacterium
ADEVPGVRIARGLAEQTGKRIRL

SEQ ID NO: 923603 - protein, 23 aa, Mycobacterium
ADEVSAAIAALFTSHGQDYQALS

SEQ ID NO: 923604 - protein, 20 aa, Mycobacterium
ADFLCFSIYSANLAFGKAYK

SEQ ID NO: 923605 - protein, 19 aa, Mycobacterium
ADFPDRPDNLLALANTLVG

SEQ ID NO: 923606 - protein, 20 aa, Mycobacterium
ADFPRYPLNLVSTLNALAGA

SEQ ID NO: 923607 - protein, 19 aa, Mycobacterium
ADFRGQFPVPAKLWTIADL

SEQ ID NO: 923608 - protein, 17 aa, Mycobacterium
ADFVARPQAPVPADALP

SEQ ID NO: 923609 - protein, 17 aa, Mycobacterium
ADFVKRQNIGSFTLGPF

SEQ ID NO: 923610 - protein, 17 aa, Mycobacterium
ADFVPRVLAGLSSLGVG

SEQ ID NO: 923611 - protein, 26 aa, Mycobacterium
ADGAPGRNGGDGGLLWGDGGNGGAGT

SEQ ID NO: 923612 - protein, 28 aa, Mycobacterium
ADGATVCGRVVVAACPPVYVPWTPDFAG

SEQ ID NO: 923613 - protein, 23 aa, Mycobacterium
ADGEISWNWGDGNEWALGDEVSS

SEQ ID NO: 923614 - protein, 18 aa, Mycobacterium
ADGIGGVWRENTYPGAAC

SEQ ID NO: 923615 - protein, 17 aa, Mycobacterium
ADGKGLVDNDLMVILKS

SEQ ID NO: 923616 - protein, 18 aa, Mycobacterium
ADGKRCWANQVIFGVDGP

SEQ ID NO: 923617 - protein, 17 aa, Mycobacterium
ADGKWLITPMFIDPDPQ

SEQ ID NO: 923618 - protein, 17 aa, Mycobacterium
ADGLLDFTGTTVSGAPF

SEQ ID NO: 923619 - protein, 20 aa, Mycobacterium
ADGLPMLQPLRDFGGQFGNA

SEQ ID NO: 923620 - protein, 25 aa, Mycobacterium
ADGNFVYRPMNAMAAVGGTDEFTVA

SEQ ID NO: 923621 - protein, 21 aa, Mycobacterium
ADGPAPWWYRPVGALFDQFLG

SEQ ID NO: 923622 - protein, 21 aa, Mycobacterium
ADGPDGPAWEHNVKIDLKPNP

SEQ ID NO: 923623 - protein, 20 aa, Mycobacterium
ADGPQRFRYSITATIGGEPD

SEQ ID NO: 923624 - protein, 18 aa, Mycobacterium
ADGPVLRNASSLPGDDRV

SEQ ID NO: 923625 - protein, 21 aa, Mycobacterium
ADGQLPNMRAIVGFAAETGDA

SEQ ID NO: 923626 - protein, 18 aa, Mycobacterium
ADGQQGWSDVPGLTIPGA

SEQ ID NO: 923627 - protein, 20 aa, Mycobacterium
ADGRARQALRAGEGATTLAA

SEQ ID NO: 923628 - protein, 22 aa, Mycobacterium
ADGRSVFTNGQWSSVNDPKLTG

SEQ ID NO: 923629 - protein, 18 aa, Mycobacterium
ADGSLWRQFGVPWQPAYL

SEQ ID NO: 923630 - protein, 28 aa, Mycobacterium
ADGTLEHSGSWAGFVTEFRVSSDRRTSV

SEQ ID NO: 923631 - protein, 24 aa, Mycobacterium
ADGTNYRALFQVATPQGVNPSTIP

SEQ ID NO: 923632 - protein, 25 aa, Mycobacterium
ADGTYRKVLQRWGLEDEAVAKSEIN

SEQ ID NO: 923633 - protein, 21 aa, Mycobacterium
ADGVRRPSRSGAELTAAAGAD

SEQ ID NO: 923634 - protein, 21 aa, Mycobacterium
ADGVWEKGIGKTFNGGVGEGA

SEQ ID NO: 923635 - protein, 24 aa, Mycobacterium
ADGWSCQHALSLVSNVTVEAWACG

SEQ ID NO: 923636 - protein, 19 aa, Mycobacterium
ADHDLRKAYRNGNFPEQFN

SEQ ID NO: 923637 - protein, 22 aa, Mycobacterium
ADHDLRPGAALTPADVRLEKRL

SEQ ID NO: 923638 - protein, 19 aa, Mycobacterium
ADHELRKAYRNGNFPETFA

SEQ ID NO: 923639 - protein, 26 aa, Mycobacterium
ADIAARCGYPNAIGLDMGGTSTDISL

SEQ ID NO: 923640 - protein, 18 aa, Mycobacterium
ADIAICGGVETKIEAVPI

SEQ ID NO: 923641 - protein, 17 aa, Mycobacterium
ADIALYVRSFPANVIAQ

SEQ ID NO: 923642 - protein, 23 aa, Mycobacterium
ADIDLGGPVARTLAYNNIVPGPL

SEQ ID NO: 923643 - protein, 19 aa, Mycobacterium
ADIDPRRIGMWGISQGGWV

SEQ ID NO: 923644 - protein, 21 aa, Mycobacterium
ADIGARCELLRGARVWPGVTI

SEQ ID NO: 923645 - protein, 25 aa, Mycobacterium
ADIGPDLDAAIAYAPTFPFTQGFID

SEQ ID NO: 923646 - protein, 17 aa, Mycobacterium
ADIKATTVFGGKYVSLT

SEQ ID NO: 923647 - protein, 19 aa, Mycobacterium
ADIKHRCGFTPTDPDGPDF

SEQ ID NO: 923648 - protein, 19 aa, Mycobacterium
ADIPAKAWIQKDGNHALTK

SEQ ID NO: 923649 - protein, 20 aa, Mycobacterium
ADIPTVEFPSAVPPVTLPGP

SEQ ID NO: 923650 - protein, 18 aa, Mycobacterium
ADKALRVAVSKGIDRQTI

SEQ ID NO: 923651 - protein, 29 aa, Mycobacterium
ADKGYHLALCDGMKPWTLQSFPSAIAYAS

SEQ ID NO: 923652 - protein, 22 aa, Mycobacterium
ADLDRLCALSFEVFTTPERLRT

SEQ ID NO: 923653 - protein, 22 aa, Mycobacterium
ADLEPGQKWTGFHRLEKDLWVT

SEQ ID NO: 923654 - protein, 22 aa, Mycobacterium
ADLEPGQKWTGYHRLEKDLWVT

SEQ ID NO: 923655 - protein, 20 aa, Mycobacterium
ADLKNPMAGMISKDFNIKVT

SEQ ID NO: 923656 - protein, 24 aa, Mycobacterium
ADLLASFRGVLGLVMGSAQAELAG

SEQ ID NO: 923657 - protein, 22 aa, Mycobacterium
ADLLPQVFRWARAVDPAQPLTS

SEQ ID NO: 923658 - protein, 19 aa, Mycobacterium
ADLLVRYSKAVKWAHDNRD

SEQ ID NO: 923659 - protein, 26 aa, Mycobacterium
ADLPLCALVAAWVRGQVRPEASAQAR

SEQ ID NO: 923660 - protein, 27 aa, Mycobacterium
ADLPPRPLRGADIARVLPGVDELSEIL

SEQ ID NO: 923661 - protein, 18 aa, Mycobacterium
ADLRGKRVATPFASTAHY

SEQ ID NO: 923662 - protein, 17 aa, Mycobacterium
ADLRTVVRHELFHYAAR

SEQ ID NO: 923663 - protein, 17 aa, Mycobacterium
ADLRVGQDVVAIGSPLG

SEQ ID NO: 923664 - protein, 22 aa, Mycobacterium
ADLSIPGAVVGFWGPDVTYVRA

SEQ ID NO: 923665 - protein, 26 aa, Mycobacterium
ADLTKTEALKHLWHGYQNGQYRGGFV

SEQ ID NO: 923666 - protein, 22 aa, Mycobacterium
ADNAKWFYDFSVPGDVVEVRNS

SEQ ID NO: 923667 - protein, 18 aa, Mycobacterium
ADNPGVWMMHCHNTYHQE

SEQ ID NO: 923668 - protein, 20 aa, Mycobacterium
ADNYLSGSFFGPDRLAAPEP

SEQ ID NO: 923669 - protein, 21 aa, Mycobacterium
ADNYLSGSFFGPERLQAPELR

SEQ ID NO: 923670 - protein, 18 aa, Mycobacterium
ADPCPAVEVVFARGTGQA

SEQ ID NO: 923671 - protein, 22 aa, Mycobacterium
ADPCSDVAVVFARGTHQAPGLG

SEQ ID NO: 923672 - protein, 23 aa, Mycobacterium
ADPCSDVAVVFARGTHQEPGLGN

SEQ ID NO: 923673 - protein, 17 aa, Mycobacterium
ADPGRIAVVTGPNLASE

SEQ ID NO: 923674 - protein, 18 aa, Mycobacterium
ADPHFWTDPQRMILAVDA

SEQ ID NO: 923675 - protein, 18 aa, Mycobacterium
ADPHPGNIMLLPDGRVGF

SEQ ID NO: 923676 - protein, 19 aa, Mycobacterium
ADPLIYPGMEIIQRPPGKE

SEQ ID NO: 923677 - protein, 18 aa, Mycobacterium
ADPLYELNDALAPPPPPP

SEQ ID NO: 923678 - protein, 17 aa, Mycobacterium
ADPMLNINRLVANRTAL

SEQ ID NO: 923679 - protein, 26 aa, Mycobacterium
ADPNLGRLGARVTDAMTGKELWQVAA

SEQ ID NO: 923680 - protein, 18 aa, Mycobacterium
ADPPRPAAPRSRSLQFVR

SEQ ID NO: 923681 - protein, 28 aa, Mycobacterium
ADPQGAIAFSGLYPPGSTFKTITTAAAL

SEQ ID NO: 923682 - protein, 23 aa, Mycobacterium
ADQFCCGRALLVGDSAHTMPPFK

SEQ ID NO: 923683 - protein, 19 aa, Mycobacterium
ADQLAAFVMLAPDDDGTID

SEQ ID NO: 923684 - protein, 17 aa, Mycobacterium
ADQLREWSTPRAEKTGI

SEQ ID NO: 923685 - protein, 17 aa, Mycobacterium
ADQPRRTTGPAGTAGAT

SEQ ID NO: 923686 - protein, 25 aa, Mycobacterium
ADQYRFPQNLPIVGAKGGPGGKPGC

SEQ ID NO: 923687 - protein, 19 aa, Mycobacterium
ADQYVDWLIEAGYPIRRIA

SEQ ID NO: 923688 - protein, 18 aa, Mycobacterium
ADREIAWAHANELRDPTP

SEQ ID NO: 923689 - protein, 22 aa, Mycobacterium
ADRIVLCAGAIATAQLLMVSGV

SEQ ID NO: 923690 - protein, 26 aa, Mycobacterium
ADRIVLCAGAIESAHLLMLSGVGDEA

SEQ ID NO: 923691 - protein, 20 aa, Mycobacterium
ADRLGGKGNIVILQGPLGGS

SEQ ID NO: 923692 - protein, 20 aa, Mycobacterium
ADRLGGKGNIVILQGPLGQS

SEQ ID NO: 923693 - protein, 20 aa, Mycobacterium
ADRLGIPLAQIGQFSGPGAQ

SEQ ID NO: 923694 - protein, 18 aa, Mycobacterium
ADRMAIVHFTLRNKTRLA

SEQ ID NO: 923695 - protein, 17 aa, Mycobacterium
ADRNTWGIVDLMVGSAP

SEQ ID NO: 923696 - protein, 17 aa, Mycobacterium
ADRNTWGLVDMSVSASQ

SEQ ID NO: 923697 - protein, 23 aa, Mycobacterium
ADRRDIRLMVGREFDPTGFDTFT

SEQ ID NO: 923698 - protein, 25 aa, Mycobacterium
ADRRSRAAVPFLAYGQFTGFAPRDV

SEQ ID NO: 923699 - protein, 21 aa, Mycobacterium
ADRVLPPGGFIPLSRTAPALD

SEQ ID NO: 923700 - protein, 19 aa, Mycobacterium
ADSIPALYETFAFNGSQFA

SEQ ID NO: 923701 - protein, 19 aa, Mycobacterium
ADSPPLRDGDVIRPDRVSV

SEQ ID NO: 923702 - protein, 24 aa, Mycobacterium
ADSPRGVADLVTISSTAGWVARPN

SEQ ID NO: 923703 - protein, 25 aa, Mycobacterium
ADSPRGVADLVTISSTAGWVARPNT

SEQ ID NO: 923704 - protein, 24 aa, Mycobacterium
ADSYKRYVNSQVEALVPAVEAFVA

SEQ ID NO: 923705 - protein, 26 aa, Mycobacterium
ADTAGKPSLAWRGRRAASRLSEAVSS

SEQ ID NO: 923706 - protein, 19 aa, Mycobacterium
ADTDAKVWALYDVTHQPAF

SEQ ID NO: 923707 - protein, 34 aa, Mycobacterium
ADTLPRRPQFALLKGRRNYLCLNKIHNGGAEADE

SEQ ID NO: 923708 - protein, 20 aa, Mycobacterium
ADTPSGCTLMEWEDNRAARQ

SEQ ID NO: 923709 - protein, 18 aa, Mycobacterium
ADTQVRKAILGLLDIDLL

SEQ ID NO: 923710 - protein, 17 aa, Mycobacterium
ADTRVRRVLVEHDAAVG

SEQ ID NO: 923711 - protein, 17 aa, Mycobacterium
ADTTWKLLLDSQSGIRK

SEQ ID NO: 923712 - protein, 20 aa, Mycobacterium
ADTVRRAAGVAARSLGSTAA

SEQ ID NO: 923713 - protein, 26 aa, Mycobacterium
ADVAEMRLPFSWRGVSLHAAGAAGLR

SEQ ID NO: 923714 - protein, 25 aa, Mycobacterium
ADVALSARLSGSMASYDWTINGRPF

SEQ ID NO: 923715 - protein, 19 aa, Mycobacterium
ADVEIPWPGPSFPATSSAV

SEQ ID NO: 923716 - protein, 20 aa, Mycobacterium
ADVLRTHPIVAIDRRGMGMS

SEQ ID NO: 923717 - protein, 21 aa, Mycobacterium
ADVRAALQVSIDRARAVHADQ

SEQ ID NO: 923718 - protein, 17 aa, Mycobacterium
ADVRFGAPSAFANRPSG

SEQ ID NO: 923719 - protein, 20 aa, Mycobacterium
ADVRQAAAFQQAFDDYAADC

SEQ ID NO: 923720 - protein, 17 aa, Mycobacterium
ADVRSCAAAAAAGSWIA

SEQ ID NO: 923721 - protein, 20 aa, Mycobacterium
ADVTGLRFDNTVPLTYPFAL

SEQ ID NO: 923722 - protein, 22 aa, Mycobacterium
ADVVSAWTGIPAGRLLEGETAK

SEQ ID NO: 923723 - protein, 21 aa, Mycobacterium
ADVVSAWTGIPAGRMLEGETA

SEQ ID NO: 923724 - protein, 26 aa, Mycobacterium
ADWDRHLRPMLARRYEIATGQRQAKD

SEQ ID NO: 923725 - protein, 21 aa, Mycobacterium
ADYAEMWAQDAAVMYQYAEAS

SEQ ID NO: 923726 - protein, 21 aa, Mycobacterium
ADYDALEAFIAKCEDDAVRAT

SEQ ID NO: 923727 - protein, 19 aa, Mycobacterium
ADYLDAYVLEWTLHHLDLI

SEQ ID NO: 923728 - protein, 17 aa, Mycobacterium
ADYLRWVARQLDHLVRY

SEQ ID NO: 923729 - protein, 17 aa, Mycobacterium
ADYSGKPYDEWSAEDWP

SEQ ID NO: 923730 - protein, 17 aa, Mycobacterium
ADYSGKPYDEWTAEDWP

SEQ ID NO: 923731 - protein, 24 aa, Mycobacterium
ADYSPEFGCLFAGIERGIKEFAPL

SEQ ID NO: 923732 - protein, 25 aa, Mycobacterium
ADYVRMWIQAAGVMGVYQACSTAAL

SEQ ID NO: 923733 - protein, 26 aa, Mycobacterium
AEAAGRGRIAAAGYEAARAATVHPML

SEQ ID NO: 923734 - protein, 28 aa, Mycobacterium
AEAANAGPLQPLLDLINAPTQALLARPL

SEQ ID NO: 923735 - protein, 33 aa, Mycobacterium
AEAAVPRWGRPEEMAELLAFCASDKAGYLTGTD

SEQ ID NO: 923736 - protein, 22 aa, Mycobacterium
AEADMFYTDFVERVARGRNLRT

SEQ ID NO: 923737 - protein, 20 aa, Mycobacterium
AEADVAAGLHAGVNQLRQSC

SEQ ID NO: 923738 - protein, 23 aa, Mycobacterium
AEAEPVAAMPGMPGMAAAAKGAG

SEQ ID NO: 923739 - protein, 21 aa, Mycobacterium
AEAFEAIRCLRSLQHQKYVSI

SEQ ID NO: 923740 - protein, 17 aa, Mycobacterium
AEAGAVWDEVVVAAIER

SEQ ID NO: 923741 - protein, 23 aa, Mycobacterium
AEAGLRAAGRVAGLIGTVGVRID

SEQ ID NO: 923742 - protein, 18 aa, Mycobacterium
AEAGRLRAAGQPTWIAVQ

SEQ ID NO: 923743 - protein, 18 aa, Mycobacterium
AEAHSGETMCRISMQPLI

SEQ ID NO: 923744 - protein, 18 aa, Mycobacterium
AEAHWPRRRTLRHRRHPS

SEQ ID NO: 923745 - protein, 28 aa, Mycobacterium
AEAIAYDAGRRLLYWTSEGYIHDDASGK

SEQ ID NO: 923746 - protein, 23 aa, Mycobacterium
AEAKGTLYFGVPTVWSRVVNNLD

SEQ ID NO: 923747 - protein, 24 aa, Mycobacterium
AEALADRGADVAISYVASDAKAQA

SEQ ID NO: 923748 - protein, 20 aa, Mycobacterium
AEALEYGTAHGFTVTEMSVG

SEQ ID NO: 923749 - protein, 17 aa, Mycobacterium
AEALSGIDVELTRRASL

SEQ ID NO: 923750 - protein, 19 aa, Mycobacterium
AEAPEAPAIDEAPAPEEAP

SEQ ID NO: 923751 - protein, 20 aa, Mycobacterium
AEAPRYGFRPTVMVHPPAAG

SEQ ID NO: 923752 - protein, 20 aa, Mycobacterium
AEAPVPQMAVLPTADPGIAA

SEQ ID NO: 923753 - protein, 21 aa, Mycobacterium
AEAPWSAIAREYLDLADTVTP

SEQ ID NO: 923754 - protein, 27 aa, Mycobacterium
AEAQYLRYLGFHFAAFVFDASDMDDTA

SEQ ID NO: 923755 - protein, 25 aa, Mycobacterium
AEATIDFTGGFATVTVETVDGATLS

SEQ ID NO: 923756 - protein, 19 aa, Mycobacterium
AEAYAAFRSAGRLLMDGPV

SEQ ID NO: 923757 - protein, 17 aa, Mycobacterium
AECPDAEVVFARGTDEP

SEQ ID NO: 923758 - protein, 17 aa, Mycobacterium
AECPGIHGETVVEGETV

SEQ ID NO: 923759 - protein, 32 aa, Mycobacterium
AEDASRLVATVSGYRAGLLASIAASCTASYTV

SEQ ID NO: 923760 - protein, 19 aa, Mycobacterium
AEDHLDWHGSMAAYAADKA

SEQ ID NO: 923761 - protein, 24 aa, Mycobacterium
AEDLPGFLHGLAIGPDGTAYIANW

SEQ ID NO: 923762 - protein, 23 aa, Mycobacterium
AEDPRFRFFGNILVGEHVSPVEL

SEQ ID NO: 923763 - protein, 19 aa, Mycobacterium
AEDRWRTAEIIDTLLDADD

SEQ ID NO: 923764 - protein, 29 aa, Mycobacterium
AEDTGTVGYRFAWHLPKNRVWSYDGQLRM

SEQ ID NO: 923765 - protein, 17 aa, Mycobacterium
AEDWPHTYESVAYPNIF

SEQ ID NO: 923766 - protein, 23 aa, Mycobacterium
AEDYAVAVADELEHPAHRRERFT

SEQ ID NO: 923767 - protein, 17 aa, Mycobacterium
AEEKLRYLAEHDDLTGL

SEQ ID NO: 923768 - protein, 24 aa, Mycobacterium
AEELGIELLLGWRATRVDLACNEV

SEQ ID NO: 923769 - protein, 21 aa, Mycobacterium
AEELSCRILVNGAVKDQRSVS

SEQ ID NO: 923770 - protein, 19 aa, Mycobacterium
AEERIREIVADPAVAADLI

SEQ ID NO: 923771 - protein, 20 aa, Mycobacterium
AEERLRYLADHDHLTGLYNR

SEQ ID NO: 923772 - protein, 27 aa, Mycobacterium
AEEVAESFGGIGLRCDVTDPDQVDATF

SEQ ID NO: 923773 - protein, 23 aa, Mycobacterium
AEEVPGVRIARGLAEQTGKRIRL

SEQ ID NO: 923774 - protein, 25 aa, Mycobacterium
AEEVRRYFGSKVLRTVIPRSVKVSE

SEQ ID NO: 923775 - protein, 19 aa, Mycobacterium
AEFASSFPVPSKLWTIKDL

SEQ ID NO: 923776 - protein, 20 aa, Mycobacterium
AEFDGVDAFHVRAIDLGLHV

SEQ ID NO: 923777 - protein, 29 aa, Mycobacterium
AEFLQAATLRPGNPITIAGIEVGHVTSMK

SEQ ID NO: 923778 - protein, 20 aa, Mycobacterium
AEGAAVALLARRADRLAELK

SEQ ID NO: 923779 - protein, 18 aa, Mycobacterium
AEGARFWLDYTDGAQPYF

SEQ ID NO: 923780 - protein, 22 aa, Mycobacterium
AEGFPETITLAAIPAENSSDLK

SEQ ID NO: 923781 - protein, 25 aa, Mycobacterium
AEGISVNVTLIFSVDRHRGVMDAYL

SEQ ID NO: 923782 - protein, 25 aa, Mycobacterium
AEGISVNVTLIFSVERHRLVMDAYL

SEQ ID NO: 923783 - protein, 25 aa, Mycobacterium
AEGISVNVTLIFSVERHRQVMDAYL

SEQ ID NO: 923784 - protein, 29 aa, Mycobacterium
AEGISVNVTLIFSVERYRAVMDAYLAGME

SEQ ID NO: 923785 - protein, 25 aa, Mycobacterium
AEGISVNVTLIFSVERYREVVDAYL

SEQ ID NO: 923786 - protein, 29 aa, Mycobacterium
AEGITMTVTSGWRSPAFQQTLLDNAVQTY

SEQ ID NO: 923787 - protein, 22 aa, Mycobacterium
AEGLNRFAGILAGSKDSLGRTL

SEQ ID NO: 923788 - protein, 23 aa, Mycobacterium
AEGLPRRPGVYLFRGPSGEVLYV

SEQ ID NO: 923789 - protein, 21 aa, Mycobacterium
AEGPDGPAWEHNVRIDLRPNP

SEQ ID NO: 923790 - protein, 17 aa, Mycobacterium
AEGQNEMLVCVSRAKSD

SEQ ID NO: 923791 - protein, 17 aa, Mycobacterium
AEGRILAAVAAVLAVAV

SEQ ID NO: 923792 - protein, 21 aa, Mycobacterium
AEGSLRERLVAVVLDQAEAVA

SEQ ID NO: 923793 - protein, 18 aa, Mycobacterium
AEGVLCPDGSTAPSTETY

SEQ ID NO: 923794 - protein, 18 aa, Mycobacterium
AEGVLVWSMGRSDWNCDY

SEQ ID NO: 923795 - protein, 22 aa, Mycobacterium
AEGYDLGTILLKGIDSGAITRP

SEQ ID NO: 923796 - protein, 23 aa, Mycobacterium
AEGYKLDVYWATRLSNSGIFVHA

SEQ ID NO: 923797 - protein, 23 aa, Mycobacterium
AEHIKAAGYAGVINYVSTSRPGS

SEQ ID NO: 923798 - protein, 24 aa, Mycobacterium
AEHRPAAAGLDFAVRVDKGDFVGR

SEQ ID NO: 923799 - protein, 25 aa, Mycobacterium
AEIAGEVPLAYALAAGSFRDGTRVA

SEQ ID NO: 923800 - protein, 19 aa, Mycobacterium
AEIARRVIPGSGLAVERIG

SEQ ID NO: 923801 - protein, 19 aa, Mycobacterium
AEIATVRNLLGIPIDHFVE

SEQ ID NO: 923802 - protein, 17 aa, Mycobacterium
AEISGSWYPDGPPRHQR

SEQ ID NO: 923803 - protein, 24 aa, Mycobacterium
AEIVDCAGEHRFEVAESVDMGTFP

SEQ ID NO: 923804 - protein, 19 aa, Mycobacterium
AEIYAKFAADHADQDFSAV

SEQ ID NO: 923805 - protein, 17 aa, Mycobacterium
AEKRPSYADTKAADSKP

SEQ ID NO: 923806 - protein, 21 aa, Mycobacterium
AELAGQSWHGPAAAAMAAAAT

SEQ ID NO: 923807 - protein, 19 aa, Mycobacterium
AELARRGRNLPVYFGNRNW

SEQ ID NO: 923808 - protein, 26 aa, Mycobacterium
AELGATWRPGCPAGPEELRLVELDHW

SEQ ID NO: 923809 - protein, 17 aa, Mycobacterium
AELHEFNRLLSKFLTDI

SEQ ID NO: 923810 - protein, 20 aa, Mycobacterium
AELISRVVGRPIRPRRVDPD

SEQ ID NO: 923811 - protein, 17 aa, Mycobacterium
AELKAKIDAAYSRNDVV

SEQ ID NO: 923812 - protein, 17 aa, Mycobacterium
AELKGNMAALTATGAGN

SEQ ID NO: 923813 - protein, 19 aa, Mycobacterium
AELKTVLDAVSAKLTTEAL

SEQ ID NO: 923814 - protein, 18 aa, Mycobacterium
AELLARRGAEPVAQTVSV

SEQ ID NO: 923815 - protein, 17 aa, Mycobacterium
AELLGANPGIKVAVRAL

SEQ ID NO: 923816 - protein, 20 aa, Mycobacterium
AELNAMLGMERAKREIKLIK

SEQ ID NO: 923817 - protein, 27 aa, Mycobacterium
AELPAAVINRLPVRYTFDNRYFSDTYE

SEQ ID NO: 923818 - protein, 17 aa, Mycobacterium
AELPEGFPVTSTIVSGT

SEQ ID NO: 923819 - protein, 17 aa, Mycobacterium
AELPFTLCSGGHLEADV

SEQ ID NO: 923820 - protein, 21 aa, Mycobacterium
AELRAAKATPLGVLPRPDPLP

SEQ ID NO: 923821 - protein, 17 aa, Mycobacterium
AELREGVWVRPDNLDPQ

SEQ ID NO: 923822 - protein, 20 aa, Mycobacterium
AELRRAFAEDRWRTAEIIDT

SEQ ID NO: 923823 - protein, 19 aa, Mycobacterium
AELRRPSGEPIYQDNDVRS

SEQ ID NO: 923824 - protein, 26 aa, Mycobacterium
AELTGAYSPPANCLVNGQPCTTGSTP

SEQ ID NO: 923825 - protein, 26 aa, Mycobacterium
AELTSSPWLGPASRSMMSAVAPYVTW

SEQ ID NO: 923826 - protein, 19 aa, Mycobacterium
AELTTRWQNEKSAIDVVRE

SEQ ID NO: 923827 - protein, 18 aa, Mycobacterium
AELVRHFGDRAARPSHYI

SEQ ID NO: 923828 - protein, 19 aa, Mycobacterium
AEMEDAFGFTETVDQLTAI

SEQ ID NO: 923829 - protein, 18 aa, Mycobacterium
AEMGRVAVELGHAAREVL

SEQ ID NO: 923830 - protein, 25 aa, Mycobacterium
AENFARSEGPSWIALQGKQYEGLVV

SEQ ID NO: 923831 - protein, 24 aa, Mycobacterium
AENIRYKAWLAEAALVCAEAAAAL

SEQ ID NO: 923832 - protein, 25 aa, Mycobacterium
AENLREHRKGLLVDVLTDITIGTDT

SEQ ID NO: 923833 - protein, 19 aa, Mycobacterium
AEPAGRGRPTTTAATAGPP

SEQ ID NO: 923834 - protein, 21 aa, Mycobacterium
AEPGDVLAIHINRIRLANYAT

SEQ ID NO: 923835 - protein, 22 aa, Mycobacterium
AEPKLGQPIQWSPCRSSNPNVK

SEQ ID NO: 923836 - protein, 20 aa, Mycobacterium
AEPKTSVAKADMHHTDTAAS

SEQ ID NO: 923837 - protein, 24 aa, Mycobacterium
AEPLGVLMVSWRRPVTVTDEQVDL

SEQ ID NO: 923838 - protein, 26 aa, Mycobacterium
AEPLPSLKPAVAVPDSLTQLWAARSG

SEQ ID NO: 923839 - protein, 34 aa, Mycobacterium
AEPLSGRGDARWPWRLPLRLAWVHAELAMVSGDG

SEQ ID NO: 923840 - protein, 23 aa, Mycobacterium
AEPPRAPMGQLMRMREYPNAAFR

SEQ ID NO: 923841 - protein, 21 aa, Mycobacterium
AEPSWTMPNLIGMDLQGAQDA

SEQ ID NO: 923842 - protein, 19 aa, Mycobacterium
AEPTVSLSVAFAKSCNTAF

SEQ ID NO: 923843 - protein, 17 aa, Mycobacterium
AEPVERLLAAAEPEQVN

SEQ ID NO: 923844 - protein, 32 aa, Mycobacterium
AEPVSLKLDNCWLERWRRTAIDDGARALLNLQ

SEQ ID NO: 923845 - protein, 17 aa, Mycobacterium
AEPYINVIVARAEEKDN

SEQ ID NO: 923846 - protein, 26 aa, Mycobacterium
AEQDFIAAINRLRAPVKVAHDYSPEF

SEQ ID NO: 923847 - protein, 17 aa, Mycobacterium
AEQEVMSSAGTADPTNT

SEQ ID NO: 923848 - protein, 20 aa, Mycobacterium
AEQGWVCLSIDYRVAPHHRW

SEQ ID NO: 923849 - protein, 31 aa, Mycobacterium
AEQRCGGSPAWNLPVVFGPIAVTYNISGVSS

SEQ ID NO: 923850 - protein, 17 aa, Mycobacterium
AEQRKAAVTAYMDANPQ

SEQ ID NO: 923851 - protein, 24 aa, Mycobacterium
AEQSGAFPRWPLANSSTGMMTGDN

SEQ ID NO: 923852 - protein, 24 aa, Mycobacterium
AERFPLPASAWFLYGTVARPQSRG

SEQ ID NO: 923853 - protein, 24 aa, Mycobacterium
AERIPLPGRRPRSSSRSVRSQRII

SEQ ID NO: 923854 - protein, 20 aa, Mycobacterium
AERLQARLAGLMPELDVLFG

SEQ ID NO: 923855 - protein, 21 aa, Mycobacterium
AERPLVFLVDAHGAGVTVEPL

SEQ ID NO: 923856 - protein, 25 aa, Mycobacterium
AERSHGRPALRFAQISDSHIGFTGA

SEQ ID NO: 923857 - protein, 18 aa, Mycobacterium
AERYRELRDLGVHDEFVI

SEQ ID NO: 923858 - protein, 21 aa, Mycobacterium
AERYRYPVNLPKVAATGGPQC

SEQ ID NO: 923859 - protein, 18 aa, Mycobacterium
AESAIHISSIPPVPGKFY

SEQ ID NO: 923860 - protein, 32 aa, Mycobacterium
AESDPVLAEWFLRRFSLLDSLYMVPSARLIGR

SEQ ID NO: 923861 - protein, 18 aa, Mycobacterium
AESGWRTANTESIKSAAE

SEQ ID NO: 923862 - protein, 30 aa, Mycobacterium
AESIVRASSLEWIVLRLGGVLSVDPKAIPF

SEQ ID NO: 923863 - protein, 22 aa, Mycobacterium
AESQADHILGWIQRWRRGEFDT

SEQ ID NO: 923864 - protein, 22 aa, Mycobacterium
AESQADHILRWIQRWRSGEFDT

SEQ ID NO: 923865 - protein, 23 aa, Mycobacterium
AESRRLGNMVTELIALSRLQGAE

SEQ ID NO: 923866 - protein, 19 aa, Mycobacterium
AETARWSPERAHRWHRAQG

SEQ ID NO: 923867 - protein, 29 aa, Mycobacterium
AETEAAYLLNFVKELVKVFGGATTDGGGT

SEQ ID NO: 923868 - protein, 17 aa, Mycobacterium
AETEAGFGEAQDLVAPT

SEQ ID NO: 923869 - protein, 25 aa, Mycobacterium
AETGVGWNYLAAINLIETRFGSING

SEQ ID NO: 923870 - protein, 17 aa, Mycobacterium
AETIGRGLGLPAVSVPP

SEQ ID NO: 923871 - protein, 22 aa, Mycobacterium
AETKAFVQRCVDKMGTEFLANV

SEQ ID NO: 923872 - protein, 24 aa, Mycobacterium
AETLPPGPERDAWLTFAVAGGGPT

SEQ ID NO: 923873 - protein, 25 aa, Mycobacterium
AETREMIKTGGFDAVCFTSSSTVRN

SEQ ID NO: 923874 - protein, 20 aa, Mycobacterium
AETYPPGSTFKVITTAAALQ

SEQ ID NO: 923875 - protein, 17 aa, Mycobacterium
AEVAAAIGTGAPAATTT

SEQ ID NO: 923876 - protein, 29 aa, Mycobacterium
AEVGCPAGPDMARCLRALSVDALRDSPQF

SEQ ID NO: 923877 - protein, 19 aa, Mycobacterium
AEVLRRLYRRVGDKLVLIS

SEQ ID NO: 923878 - protein, 24 aa, Mycobacterium
AEVVRRALRQASQFVIASMSTPVE

SEQ ID NO: 923879 - protein, 23 aa, Mycobacterium
AEYAEMWAQDAAVMYQYSAASEA

SEQ ID NO: 923880 - protein, 20 aa, Mycobacterium
AEYFGAALAFLIRILGKLVA

SEQ ID NO: 923881 - protein, 21 aa, Mycobacterium
AFAGPKHKVFFGGDTGYTKAF

SEQ ID NO: 923882 - protein, 17 aa, Mycobacterium
AFALGGAGLIALAVAGC

SEQ ID NO: 923883 - protein, 24 aa, Mycobacterium
AFALSRTVGIFGFSERGWDPAPHA

SEQ ID NO: 923884 - protein, 31 aa, Mycobacterium
AFANRPSGLPGLRQKYGLDIRPGNFVAIDDG

SEQ ID NO: 923885 - protein, 17 aa, Mycobacterium
AFAYFRAMHTHLGAIPV

SEQ ID NO: 923886 - protein, 19 aa, Mycobacterium
AFDAGVMGMVRCVRAALPL

SEQ ID NO: 923887 - protein, 27 aa, Mycobacterium
AFDAYGQCLIEHGMPAPPAGFGPPPGH

SEQ ID NO: 923888 - protein, 28 aa, Mycobacterium
AFDFRVMTPTAWWRVPMQTVVGGLPTDA

SEQ ID NO: 923889 - protein, 24 aa, Mycobacterium
AFDQARSRFDAAWNHQNGDHPING

SEQ ID NO: 923890 - protein, 27 aa, Mycobacterium
AFDRGDVDAVYTWLPTVDQVRKNGRDL

SEQ ID NO: 923891 - protein, 19 aa, Mycobacterium
AFEAVRCLRDPQSQKRLAI

SEQ ID NO: 923892 - protein, 22 aa, Mycobacterium
AFEAVRCLRSLQSQKYVSMEGG

SEQ ID NO: 923893 - protein, 19 aa, Mycobacterium
AFEKIRSWHLIPGPQNVAR

SEQ ID NO: 923894 - protein, 25 aa, Mycobacterium
AFEQARTRFDAAWNHQAGDHPINDS

SEQ ID NO: 923895 - protein, 25 aa, Mycobacterium
AFFDRLIAVNARGVFLGIKHGAAAM

SEQ ID NO: 923896 - protein, 23 aa, Mycobacterium
AFFPNYRGSTFGAIADTMRDNGI

SEQ ID NO: 923897 - protein, 22 aa, Mycobacterium
AFFREYRSAGLTAEEMPVMSMC

SEQ ID NO: 923898 - protein, 22 aa, Mycobacterium
AFFSLAVVREYERGVVFRMGHA

SEQ ID NO: 923899 - protein, 19 aa, Mycobacterium
AFGGIPFGSVVTLVVRKGN

SEQ ID NO: 923900 - protein, 23 aa, Mycobacterium
AFGRPAPDLPIGVTDYATAVRVH

SEQ ID NO: 923901 - protein, 20 aa, Mycobacterium
AFGSFHMVDGFLLNNQLTDF

SEQ ID NO: 923902 - protein, 19 aa, Mycobacterium
AFGSIVTFAVRPGNPKNIR

SEQ ID NO: 923903 - protein, 19 aa, Mycobacterium
AFGSNPLDPACRIPSARAG

SEQ ID NO: 923904 - protein, 23 aa, Mycobacterium
AFGVYRLHGVFGSTNINQAVGIK

SEQ ID NO: 923905 - protein, 21 aa, Mycobacterium
AFHFQRARLAEQWGDQVRMVF

SEQ ID NO: 923906 - protein, 25 aa, Mycobacterium
AFHPDRFGFAGSMSGFLYPSNTTTN

SEQ ID NO: 923907 - protein, 19 aa, Mycobacterium
AFHPGMFRFAGSLSGFLTP

SEQ ID NO: 923908 - protein, 19 aa, Mycobacterium
AFHTVFLRSDGSVVGAGQN

SEQ ID NO: 923909 - protein, 23 aa, Mycobacterium
AFHYLDPRGGYVNDRGWMVFDSI

SEQ ID NO: 923910 - protein, 25 aa, Mycobacterium
AFINVYMCDLNLTGFFPGLNDVIPI

SEQ ID NO: 923911 - protein, 17 aa, Mycobacterium
AFLAMLAVVFAASLWVG

SEQ ID NO: 923912 - protein, 26 aa, Mycobacterium
AFLDLWDRGLAEWRQHRDDMIERYPQ

SEQ ID NO: 923913 - protein, 27 aa, Mycobacterium
AFLEILRSWPSVHKWGNATWPQFEAYV

SEQ ID NO: 923914 - protein, 17 aa, Mycobacterium
AFLGARIGVRPGAVVDG

SEQ ID NO: 923915 - protein, 20 aa, Mycobacterium
AFLGWRHLRTGQARTGALRG

SEQ ID NO: 923916 - protein, 20 aa, Mycobacterium
AFNAIRCVDAPTPKDAASWV

SEQ ID NO: 923917 - protein, 24 aa, Mycobacterium
AFPCIPNGGDVFGCQPCSAPDRSL

SEQ ID NO: 923918 - protein, 23 aa, Mycobacterium
AFPEQWSGNFLFYNRGLFADGGV

SEQ ID NO: 923919 - protein, 20 aa, Mycobacterium
AFPNDLDPRIDLREADLQPG

SEQ ID NO: 923920 - protein, 28 aa, Mycobacterium
AFQGLRAVWRRGRDVFAEVGLPNDEGLD

SEQ ID NO: 923921 - protein, 19 aa, Mycobacterium
AFRAFSYGSLYPALRRMQA

SEQ ID NO: 923922 - protein, 25 aa, Mycobacterium
AFRDAALFKVCYGFGLRRREVAMLD

SEQ ID NO: 923923 - protein, 25 aa, Mycobacterium
AFRHRRYLHRGGVHYGNSPAQVLDV

SEQ ID NO: 923924 - protein, 19 aa, Mycobacterium
AFRSRELSPLDVLDAQISQ

SEQ ID NO: 923925 - protein, 18 aa, Mycobacterium
AFSAACLHRPADSQPGNP

SEQ ID NO: 923926 - protein, 18 aa, Mycobacterium
AFSDLLGVETFRVATLIF

SEQ ID NO: 923927 - protein, 20 aa, Mycobacterium
AFSTALGRRDQLIGDAITNL

SEQ ID NO: 923928 - protein, 20 aa, Mycobacterium
AFSVSRVHGFFGSQKPELYT

SEQ ID NO: 923929 - protein, 23 aa, Mycobacterium
AFTAGHCRGGEGVVTDRGGAVIG

SEQ ID NO: 923930 - protein, 24 aa, Mycobacterium
AFTAIRCVDAVFPTDPAVWADADR

SEQ ID NO: 923931 - protein, 19 aa, Mycobacterium
AFTAIRCVDDVYPTDPAVW

SEQ ID NO: 923932 - protein, 18 aa, Mycobacterium
AFTGAVLGGGGLGMAGQA

SEQ ID NO: 923933 - protein, 19 aa, Mycobacterium
AFTGLPVDPALGIDPVTGE

SEQ ID NO: 923934 - protein, 24 aa, Mycobacterium
AFTRMLLSLVLTGIAPRSFYQGDG

SEQ ID NO: 923935 - protein, 28 aa, Mycobacterium
AFTYDYGRIPWLPINLVEPYDAGGEVPV

SEQ ID NO: 923936 - protein, 17 aa, Mycobacterium
AFWSDGTPITWRDIASQ

SEQ ID NO: 923937 - protein, 28 aa, Mycobacterium
AFYTTSVQRWPACANRQFTTPAGQDTPE

SEQ ID NO: 923938 - protein, 17 aa, Mycobacterium
AGAAAAVMCLLSGCVTV

SEQ ID NO: 923939 - protein, 19 aa, Mycobacterium
AGAAARWASRVTGRGAGAM

SEQ ID NO: 923940 - protein, 18 aa, Mycobacterium
AGAAHGGLVRDLAGELPV

SEQ ID NO: 923941 - protein, 29 aa, Mycobacterium
AGAAVGARAPWGDRGQPACSVDTVTAVAA

SEQ ID NO: 923942 - protein, 20 aa, Mycobacterium
AGADFPSDWGYSLTGRLRRA

SEQ ID NO: 923943 - protein, 20 aa, Mycobacterium
AGADMLVRAWVRSYGVAATI

SEQ ID NO: 923944 - protein, 20 aa, Mycobacterium
AGADMLVRAWVRSYGVRATI

SEQ ID NO: 923945 - protein, 26 aa, Mycobacterium
AGADQLFAQIGMKLWADGSPWQGNIF

SEQ ID NO: 923946 - protein, 22 aa, Mycobacterium
AGADRGGVVGACAAIAAESSGA

SEQ ID NO: 923947 - protein, 22 aa, Mycobacterium
AGADRGGVVGACAAVAAESSGA

SEQ ID NO: 923948 - protein, 17 aa, Mycobacterium
AGADRYASAEAANAGQQ

SEQ ID NO: 923949 - protein, 17 aa, Mycobacterium
AGADVGQLESMIARNYT

SEQ ID NO: 923950 - protein, 19 aa, Mycobacterium
AGAEALRLGRTAHSQEGPF

SEQ ID NO: 923951 - protein, 21 aa, Mycobacterium
AGAFSRPGLPVEYLQIPSAAM

SEQ ID NO: 923952 - protein, 22 aa, Mycobacterium
AGAFSRPGLPVEYLQVPSASMG

SEQ ID NO: 923953 - protein, 25 aa, Mycobacterium
AGAGGDGGRGGWLHGDGGDGGAGGD

SEQ ID NO: 923954 - protein, 21 aa, Mycobacterium
AGAGIPRSSFYPNRETADSEA

SEQ ID NO: 923955 - protein, 21 aa, Mycobacterium
AGAGKRPAELVVGSRPDTESM

SEQ ID NO: 923956 - protein, 25 aa, Mycobacterium
AGAGLPWTVAIGMVVPLALAALPRF

SEQ ID NO: 923957 - protein, 27 aa, Mycobacterium
AGAGSEPMLLAARGWSELSAELQSAAA

SEQ ID NO: 923958 - protein, 45 aa, Mycobacterium
AGAGVKLPRSSGAIYRVGQKILPQQARKGDLIFYGPDGTQSVAMY

SEQ ID NO: 923959 - protein, 19 aa, Mycobacterium
AGAIALRNVHLAVTQTTDY

SEQ ID NO: 923960 - protein, 25 aa, Mycobacterium
AGAIARLPAIFTHRDVGNTDCPGNA

SEQ ID NO: 923961 - protein, 19 aa, Mycobacterium
AGAIMTWVAMNVDNPDLGL

SEQ ID NO: 923962 - protein, 18 aa, Mycobacterium
AGAIRVVEDGVLRTDPLI

SEQ ID NO: 923963 - protein, 24 aa, Mycobacterium
AGAISEVVTAFFAPRETPSPATPL

SEQ ID NO: 923964 - protein, 24 aa, Mycobacterium
AGAKRPGDGYGRPGAPITVLRLRP

SEQ ID NO: 923965 - protein, 21 aa, Mycobacterium
AGAKYRGEFEERLKAVLDDIK

SEQ ID NO: 923966 - protein, 23 aa, Mycobacterium
AGALCAGVALAAPAAADSQSSVG

SEQ ID NO: 923967 - protein, 17 aa, Mycobacterium
AGALLIAPARARARALR

SEQ ID NO: 923968 - protein, 21 aa, Mycobacterium
AGALNRLLADRGIDHDGAVAA

SEQ ID NO: 923969 - protein, 17 aa, Mycobacterium
AGALVWNTPLTSLVALL

SEQ ID NO: 923970 - protein, 17 aa, Mycobacterium
AGANLAIVGGIGAGAKA

SEQ ID NO: 923971 - protein, 21 aa, Mycobacterium
AGANLPLLLKGVARTTQEGAF

SEQ ID NO: 923972 - protein, 17 aa, Mycobacterium
AGAPAALADSVRNGDTQ

SEQ ID NO: 923973 - protein, 18 aa, Mycobacterium
AGAPAALADSVRNGDTQV

SEQ ID NO: 923974 - protein, 19 aa, Mycobacterium
AGAPRGSCDTMAVLCDSRE

SEQ ID NO: 923975 - protein, 30 aa, Mycobacterium
AGAPRLAQDLIRLGLFVGYDPVAIANSNQA

SEQ ID NO: 923976 - protein, 19 aa, Mycobacterium
AGATPRYVQYVTQVHTMLV

SEQ ID NO: 923977 - protein, 21 aa, Mycobacterium
AGATPSFLGYHGYPASICVSV

SEQ ID NO: 923978 - protein, 18 aa, Mycobacterium
AGAVALAIALPFAATACG

SEQ ID NO: 923979 - protein, 17 aa, Mycobacterium
AGAVVGADGVYLATFVE

SEQ ID NO: 923980 - protein, 19 aa, Mycobacterium
AGAWACQRALTTTNNVVVD

SEQ ID NO: 923981 - protein, 24 aa, Mycobacterium
AGAWSSIRTFGWETRRLGVTELQF

SEQ ID NO: 923982 - protein, 26 aa, Mycobacterium
AGCQELDGRTALGFVRTRATARADLD

SEQ ID NO: 923983 - protein, 17 aa, Mycobacterium
AGDALRGLLAQKFPTVP

SEQ ID NO: 923984 - protein, 20 aa, Mycobacterium
AGDGWTCQRALTVRNNVAID

SEQ ID NO: 923985 - protein, 20 aa, Mycobacterium
AGDILAEFGRGVGAEYTDVV

SEQ ID NO: 923986 - protein, 18 aa, Mycobacterium
AGDLGCLCFLSRGGKRAR

SEQ ID NO: 923987 - protein, 26 aa, Mycobacterium
AGDLKNPRLLAAFAAGAAAAGRDPAN

SEQ ID NO: 923988 - protein, 26 aa, Mycobacterium
AGDPALRATVMYPRGTVIMATDGPNT

SEQ ID NO: 923989 - protein, 25 aa, Mycobacterium
AGDTAFPWRNQAAVLQWYVEPSSSQ

SEQ ID NO: 923990 - protein, 25 aa, Mycobacterium
AGEACARAIAWYLAMARRSQGNEDA

SEQ ID NO: 923991 - protein, 20 aa, Mycobacterium
AGEAVSILDVRWRLDEPDGR

SEQ ID NO: 923992 - protein, 19 aa, Mycobacterium
AGEGWGLCYDGNRLVKSDG

SEQ ID NO: 923993 - protein, 19 aa, Mycobacterium
AGELAELPTLLAEKAKAPS

SEQ ID NO: 923994 - protein, 17 aa, Mycobacterium
AGERMLLPIVGKGCTDI

SEQ ID NO: 923995 - protein, 23 aa, Mycobacterium
AGFEQQPYIPIAFKYQTADHLYD

SEQ ID NO: 923996 - protein, 23 aa, Mycobacterium
AGFGIYRLHGIFGSHDNTTANSG

SEQ ID NO: 923997 - protein, 22 aa, Mycobacterium
AGFGVYRLHGIFGSQDDTSAAG

SEQ ID NO: 923998 - protein, 17 aa, Mycobacterium
AGFPRLSETTALNQVSK

SEQ ID NO: 923999 - protein, 20 aa, Mycobacterium
AGGAAGLWGAGGNGGQGGSG

SEQ ID NO: 924000 - protein, 19 aa, Mycobacterium
AGGAAGRGGAAGAGGPLVT

SEQ ID NO: 924001 - protein, 20 aa, Mycobacterium
AGGACLHWGAMWGPASGAHY

SEQ ID NO: 924002 - protein, 25 aa, Mycobacterium
AGGAGGATGWFGSTGTTGAGGNGGT

SEQ ID NO: 924003 - protein, 28 aa, Mycobacterium
AGGAGGSGGWLWGAGGTGGDGGAGSTVA

SEQ ID NO: 924004 - protein, 24 aa, Mycobacterium
AGGAGGSGGWLYGSGGNGGSGGNA

SEQ ID NO: 924005 - protein, 18 aa, Mycobacterium
AGGAIAFMDVLRILLSNP

SEQ ID NO: 924006 - protein, 26 aa, Mycobacterium
AGGALRPMRPAFSVGLGARLGSGRQY

SEQ ID NO: 924007 - protein, 26 aa, Mycobacterium
AGGCVLACACDRRLIGPEAQIGAAEV

SEQ ID NO: 924008 - protein, 24 aa, Mycobacterium
AGGGFLAQLCVDWEAATLPAQYAG

SEQ ID NO: 924009 - protein, 26 aa, Mycobacterium
AGGHTLRPMAVIPVSRTSSPYSLSEA

SEQ ID NO: 924010 - protein, 18 aa, Mycobacterium
AGGIEFKLGTQVASSLTA

SEQ ID NO: 924011 - protein, 24 aa, Mycobacterium
AGGIGGRGGSLFGSGGAGGDGGAG

SEQ ID NO: 924012 - protein, 17 aa, Mycobacterium
AGGLPAAAIGGGVSVGE

SEQ ID NO: 924013 - protein, 20 aa, Mycobacterium
AGGLPVRTGAGGDGGIGGDG

SEQ ID NO: 924014 - protein, 30 aa, Mycobacterium
AGGNGGDGYADFDQPFGGNGGDGGIGGPGT

SEQ ID NO: 924015 - protein, 18 aa, Mycobacterium
AGGPAILRDCVKRFPDGL

SEQ ID NO: 924016 - protein, 18 aa, Mycobacterium
AGGRGGSGGLLFGNGGLG

SEQ ID NO: 924017 - protein, 26 aa, Mycobacterium
AGGTPEVLDAWLATVEEIRTKGTVPD

SEQ ID NO: 924018 - protein, 20 aa, Mycobacterium
AGGTSGRLLGSAGDGGGGGD

SEQ ID NO: 924019 - protein, 18 aa, Mycobacterium
AGGVLLRPYARLISSAGD

SEQ ID NO: 924020 - protein, 19 aa, Mycobacterium
AGGVLLRPYARLISSAGDS

SEQ ID NO: 924021 - protein, 21 aa, Mycobacterium
AGGVYLPGLPVVARTVTYIPS

SEQ ID NO: 924022 - protein, 22 aa, Mycobacterium
AGHAPSYERVVFRGDVPGREFV

SEQ ID NO: 924023 - protein, 19 aa, Mycobacterium
AGHDLRYAIDPTPLRDELG

SEQ ID NO: 924024 - protein, 24 aa, Mycobacterium
AGHGGLFTRAPWVIAVDDHVDPQV

SEQ ID NO: 924025 - protein, 24 aa, Mycobacterium
AGHGRSGFLLAPWTVEKIAAELEG

SEQ ID NO: 924026 - protein, 27 aa, Mycobacterium
AGHWIKLLLHYLFIYKAKARPFWWLIP

SEQ ID NO: 924027 - protein, 24 aa, Mycobacterium
AGIGRPNTALSLDGRAKAGQSIGQ

SEQ ID NO: 924028 - protein, 21 aa, Mycobacterium
AGIPSGGLFAGAEVKKTDEQA

SEQ ID NO: 924029 - protein, 17 aa, Mycobacterium
AGIRIAGVILNRVGSAR

SEQ ID NO: 924030 - protein, 18 aa, Mycobacterium
AGIRVNAIAPGFVHTPLT

SEQ ID NO: 924031 - protein, 25 aa, Mycobacterium
AGISRARRLTWMSAAALLVLLVALS

SEQ ID NO: 924032 - protein, 22 aa, Mycobacterium
AGISRLQLVERDLLGVINAPSQ

SEQ ID NO: 924033 - protein, 25 aa, Mycobacterium
AGIVDPRTAFSLAEVHDCFTPTEIV

SEQ ID NO: 924034 - protein, 18 aa, Mycobacterium
AGKADYRWAREQALSETS

SEQ ID NO: 924035 - protein, 18 aa, Mycobacterium
AGKARAAGYESLMVPSAA

SEQ ID NO: 924036 - protein, 18 aa, Mycobacterium
AGKDARIVPVPLADAATV

SEQ ID NO: 924037 - protein, 18 aa, Mycobacterium
AGKFGSIPPNALMPHHGG

SEQ ID NO: 924038 - protein, 27 aa, Mycobacterium
AGKPDYVHLWAGTGFRQATAEPATDIL

SEQ ID NO: 924039 - protein, 20 aa, Mycobacterium
AGKPIAWLYEQRRWEVPSER

SEQ ID NO: 924040 - protein, 25 aa, Mycobacterium
AGKRLIDCSMELGGKNALLVLDDAD

SEQ ID NO: 924041 - protein, 21 aa, Mycobacterium
AGKWKNCAGKTVTVTNQGKTY

SEQ ID NO: 924042 - protein, 17 aa, Mycobacterium
AGLAAALGEHFVPGARV

SEQ ID NO: 924043 - protein, 19 aa, Mycobacterium
AGLAITLVALVVVGAAVAV

SEQ ID NO: 924044 - protein, 32 aa, Mycobacterium
AGLAYLLAPVAWLLGLRVVPMLAPGSADPNGY

SEQ ID NO: 924045 - protein, 24 aa, Mycobacterium
AGLDGLRPAQAVLLVPLAAGSLHA

SEQ ID NO: 924046 - protein, 17 aa, Mycobacterium
AGLDTFAGPSFHSAQWR

SEQ ID NO: 924047 - protein, 17 aa, Mycobacterium
AGLGEKLALAAVDISFV

SEQ ID NO: 924048 - protein, 17 aa, Mycobacterium
AGLGRAASVGSLSVPQS

SEQ ID NO: 924049 - protein, 30 aa, Mycobacterium
AGLGTARFVGAMSVPAAWQGSMPAYVPAPA

SEQ ID NO: 924050 - protein, 18 aa, Mycobacterium
AGLGVAMGNAHPDARAAA

SEQ ID NO: 924051 - protein, 25 aa, Mycobacterium
AGLHVHGLLGWLQFVPILGSFLNPG

SEQ ID NO: 924052 - protein, 18 aa, Mycobacterium
AGLIFGFGGAGGTGGSGI

SEQ ID NO: 924053 - protein, 20 aa, Mycobacterium
AGLKGKRVGTPFASTAHYSL

SEQ ID NO: 924054 - protein, 23 aa, Mycobacterium
AGLKPDDVHLVFLQPADALSGFR

SEQ ID NO: 924055 - protein, 20 aa, Mycobacterium
AGLLRFDLDLLAAIAKPFES

SEQ ID NO: 924056 - protein, 19 aa, Mycobacterium
AGLLSGAVAVSWRDLQHAA

SEQ ID NO: 924057 - protein, 24 aa, Mycobacterium
AGLNICQQISWGAPPAQLEGLALQ

SEQ ID NO: 924058 - protein, 18 aa, Mycobacterium
AGLPELATQLSAALSASL

SEQ ID NO: 924059 - protein, 27 aa, Mycobacterium
AGLQRLDAAQALAFVRQRHGLDNGDLD

SEQ ID NO: 924060 - protein, 23 aa, Mycobacterium
AGLRPMTPDGLPVVERVDERTVV

SEQ ID NO: 924061 - protein, 25 aa, Mycobacterium
AGLSAGCLLGGLAIGIAGAPAAAAA

SEQ ID NO: 924062 - protein, 28 aa, Mycobacterium
AGLSGCGFRGLNSFRLPGTQGQGQGSYT

SEQ ID NO: 924063 - protein, 26 aa, Mycobacterium
AGLSRLTKRNAVVVCPGRIQSPGPWR

SEQ ID NO: 924064 - protein, 21 aa, Mycobacterium
AGMALCGAGCMGFVNTVTGVR

SEQ ID NO: 924065 - protein, 17 aa, Mycobacterium
AGMARTFAARGRDLALC

SEQ ID NO: 924066 - protein, 24 aa, Mycobacterium
AGNASAVAHCYIYEALRAAWEQTG

SEQ ID NO: 924067 - protein, 25 aa, Mycobacterium
AGNDLPLTAGMAFSIEPGIYFPGRW

SEQ ID NO: 924068 - protein, 25 aa, Mycobacterium
AGNPEIRPAHLLMALLTQADGIAGP

SEQ ID NO: 924069 - protein, 19 aa, Mycobacterium
AGNPREGSVVVNADGTYTY

SEQ ID NO: 924070 - protein, 22 aa, Mycobacterium
AGNRDADWFVWYEHGGVGYFWQ

SEQ ID NO: 924071 - protein, 18 aa, Mycobacterium
AGNSRAAIEIGTDNTTIT

SEQ ID NO: 924072 - protein, 20 aa, Mycobacterium
AGPARSWQGLLVAARKGLLR

SEQ ID NO: 924073 - protein, 17 aa, Mycobacterium
AGPAVGARAPRSNRGQP

SEQ ID NO: 924074 - protein, 18 aa, Mycobacterium
AGPDLRQLFLGSEGALGI

SEQ ID NO: 924075 - protein, 22 aa, Mycobacterium
AGPELSRAAALTVHSPSDAVAV

SEQ ID NO: 924076 - protein, 32 aa, Mycobacterium
AGPFFKTYVANLLPGQFLQPFIDVAFSDLGLD

SEQ ID NO: 924077 - protein, 25 aa, Mycobacterium
AGPLVMAGCRFLDVMLGAGPNYRRA

SEQ ID NO: 924078 - protein, 26 aa, Mycobacterium
AGPPEHLDWIAQWGIFDALRAKPDVV

SEQ ID NO: 924079 - protein, 26 aa, Mycobacterium
AGPPEHLEWIGQWGIFDALRASDGVV

SEQ ID NO: 924080 - protein, 27 aa, Mycobacterium
AGPPEHLEWLAQWGIFDALRASSEVVR

SEQ ID NO: 924081 - protein, 27 aa, Mycobacterium
AGPQRLSGPEALSFVRQRHELPRGDLD

SEQ ID NO: 924082 - protein, 18 aa, Mycobacterium
AGPVARVSVTNGIAAAGN

SEQ ID NO: 924083 - protein, 27 aa, Mycobacterium
AGQAIDLLKGMVLPAITQAIQSGAQAA

SEQ ID NO: 924084 - protein, 24 aa, Mycobacterium
AGQGRGAWPVCGRGLSGSTPRTAP

SEQ ID NO: 924085 - protein, 20 aa, Mycobacterium
AGQQCDRLASVLIPKPPGEP

SEQ ID NO: 924086 - protein, 25 aa, Mycobacterium
AGRALDLAKSWARERETFGRPLTGR

SEQ ID NO: 924087 - protein, 28 aa, Mycobacterium
AGRGHPRLDDLVGIFVNIMLLRTEVTGD

SEQ ID NO: 924088 - protein, 24 aa, Mycobacterium
AGRNLAITVHRVFSAPEVQVKRSV

SEQ ID NO: 924089 - protein, 19 aa, Mycobacterium
AGRQRFVAELGVPQLDAAL

SEQ ID NO: 924090 - protein, 24 aa, Mycobacterium
AGRTVVPDPRYVAVNDPDLLATEL

SEQ ID NO: 924091 - protein, 24 aa, Mycobacterium
AGRVMPARLALGVLSVELVVHGWD

SEQ ID NO: 924092 - protein, 17 aa, Mycobacterium
AGRVVVVNVWGQWCGPC

SEQ ID NO: 924093 - protein, 20 aa, Mycobacterium
AGSADIFFLLGVTDHEALRW

SEQ ID NO: 924094 - protein, 23 aa, Mycobacterium
AGSADVFFLLGIGSENQDEALRW

SEQ ID NO: 924095 - protein, 22 aa, Mycobacterium
AGSAKLTLTRTVDVAGELAPSP

SEQ ID NO: 924096 - protein, 18 aa, Mycobacterium
AGSAPRVDIVAAYLGSDA

SEQ ID NO: 924097 - protein, 45 aa, Mycobacterium
AGSARYLPVILVHGTWGSTAREFAPTLLPALAAAGIQAFTYDYGR

SEQ ID NO: 924098 - protein, 26 aa, Mycobacterium
AGSDARRLEGSYAWGNALSAGYSAEE

SEQ ID NO: 924099 - protein, 17 aa, Mycobacterium
AGSGRGAMDPGYDYTSF

SEQ ID NO: 924100 - protein, 19 aa, Mycobacterium
AGSIEVRRSAFVLYNDWIQ

SEQ ID NO: 924101 - protein, 25 aa, Mycobacterium
AGSIGPMSVPASWAAPTSTHISPLE

SEQ ID NO: 924102 - protein, 23 aa, Mycobacterium
AGSIGVSFAILFATRGFPVAVFD

SEQ ID NO: 924103 - protein, 25 aa, Mycobacterium
AGSMGRATLVGSLSVPQGWATAAPV

SEQ ID NO: 924104 - protein, 18 aa, Mycobacterium
AGSPNCRDGVFVNLEPAS

SEQ ID NO: 924105 - protein, 23 aa, Mycobacterium
AGSRFAADHLPTWTPLQLEAERS

SEQ ID NO: 924106 - protein, 23 aa, Mycobacterium
AGSSKLALKWTRSVKGSLAAGPA

SEQ ID NO: 924107 - protein, 24 aa, Mycobacterium
AGSTTLGTGIGWGQNVGAAASDFI

SEQ ID NO: 924108 - protein, 18 aa, Mycobacterium
AGSVDLFVGAPWVVSVDD

SEQ ID NO: 924109 - protein, 17 aa, Mycobacterium
AGSVGWDLPMSGKTGTT

SEQ ID NO: 924110 - protein, 20 aa, Mycobacterium
AGSVLEVRTAISYVSIDGAR

SEQ ID NO: 924111 - protein, 18 aa, Mycobacterium
AGSYGRLIVTPDMEPPDA

SEQ ID NO: 924112 - protein, 18 aa, Mycobacterium
AGTARLAFEQGKAALELN

SEQ ID NO: 924113 - protein, 17 aa, Mycobacterium
AGTAVVFMRVDNGGHTW

SEQ ID NO: 924114 - protein, 19 aa, Mycobacterium
AGTGGRGFVGPVNGDGGNG

SEQ ID NO: 924115 - protein, 21 aa, Mycobacterium
AGTGYPLGPLARFIARGKEVG

SEQ ID NO: 924116 - protein, 18 aa, Mycobacterium
AGTHWVRHGTTLLIESDG

SEQ ID NO: 924117 - protein, 27 aa, Mycobacterium
AGTPFPIASVVKLFIADDVLLRESRGE

SEQ ID NO: 924118 - protein, 25 aa, Mycobacterium
AGTRRWSGPEIFVFIDREETLASWD

SEQ ID NO: 924119 - protein, 30 aa, Mycobacterium
AGTTTKVIWYCGGHGACLSDFNDGEFVIDR

SEQ ID NO: 924120 - protein, 18 aa, Mycobacterium
AGTTVVFDAKLRRCDFSL

SEQ ID NO: 924121 - protein, 20 aa, Mycobacterium
AGTVARWKLQATKSRVRDVQ

SEQ ID NO: 924122 - protein, 30 aa, Mycobacterium
AGTVGFDCSGLMRYAFAGVGVLIPRFSGDQ

SEQ ID NO: 924123 - protein, 19 aa, Mycobacterium
AGVAQGKWVKAALGNTPPQ

SEQ ID NO: 924124 - protein, 17 aa, Mycobacterium
AGVAVDWPVALRQSVAR

SEQ ID NO: 924125 - protein, 23 aa, Mycobacterium
AGVFGAVAAVLAFSACGSQPAGE

SEQ ID NO: 924126 - protein, 20 aa, Mycobacterium
AGVGCTRLAIHAMTANGQEL

SEQ ID NO: 924127 - protein, 25 aa, Mycobacterium
AGVGPTLAAAAAWDGLAADLASAAQ

SEQ ID NO: 924128 - protein, 17 aa, Mycobacterium
AGVITVRYNSRLHHIGL

SEQ ID NO: 924129 - protein, 24 aa, Mycobacterium
AGVKVAALPLQWFGTETARRDRIV

SEQ ID NO: 924130 - protein, 17 aa, Mycobacterium
AGVLPAILGAAAVLPAP

SEQ ID NO: 924131 - protein, 18 aa, Mycobacterium
AGVPRTVTINVVDDSGLS

SEQ ID NO: 924132 - protein, 18 aa, Mycobacterium
AGVRDLAEVIYLTNEYEL

SEQ ID NO: 924133 - protein, 25 aa, Mycobacterium
AGVTFRFIPEPSTALSALQAGEVDW

SEQ ID NO: 924134 - protein, 17 aa, Mycobacterium
AGVVGWWVNPQAPGIDA

SEQ ID NO: 924135 - protein, 18 aa, Mycobacterium
AGVVGWWVNPQTPGMDAC

SEQ ID NO: 924136 - protein, 19 aa, Mycobacterium
AGVWRAYADHRMAMAGAIV

SEQ ID NO: 924137 - protein, 17 aa, Mycobacterium
AGWAQSWGIDGRLLTPS

SEQ ID NO: 924138 - protein, 19 aa, Mycobacterium
AGWYGLARDRGPIVVTAQF

SEQ ID NO: 924139 - protein, 20 aa, Mycobacterium
AGYAGLFAEAPWVVSVDDHV

SEQ ID NO: 924140 - protein, 17 aa, Mycobacterium
AGYEFASPLGPDVPVDM

SEQ ID NO: 924141 - protein, 23 aa, Mycobacterium
AHAMGGHYPVLWQVATDQGLPAT

SEQ ID NO: 924142 - protein, 17 aa, Mycobacterium
AHAMGVNTFRFGLEWSR

SEQ ID NO: 924143 - protein, 23 aa, Mycobacterium
AHATRLVAEWPPRPVDAATDPIA

SEQ ID NO: 924144 - protein, 25 aa, Mycobacterium
AHAVPRTVTYRVWAEYGPLVAATIG

SEQ ID NO: 924145 - protein, 17 aa, Mycobacterium
AHCRAAKAFLHCSSAAV

SEQ ID NO: 924146 - protein, 22 aa, Mycobacterium
AHCTAEAGDVCEVVAGTRNGCA

SEQ ID NO: 924147 - protein, 27 aa, Mycobacterium
AHDETRKSFGIAGARVVDSIKLSVPFK

SEQ ID NO: 924148 - protein, 22 aa, Mycobacterium
AHGDRPLFPSVRGGLAGGAPIT

SEQ ID NO: 924149 - protein, 17 aa, Mycobacterium
AHGTKAFLPHLIESGDG

SEQ ID NO: 924150 - protein, 23 aa, Mycobacterium
AHIRLEKLGFLFQEYNLLNALTS

SEQ ID NO: 924151 - protein, 26 aa, Mycobacterium
AHKRREFLTDLSLLGGLIIASADTAG

SEQ ID NO: 924152 - protein, 17 aa, Mycobacterium
AHLARRLNASPVTIGSC

SEQ ID NO: 924153 - protein, 22 aa, Mycobacterium
AHLDGPRGGPGINDDGSGVAAV

SEQ ID NO: 924154 - protein, 19 aa, Mycobacterium
AHLDRRAGLGPGLPLNATG

SEQ ID NO: 924155 - protein, 18 aa, Mycobacterium
AHLPRAGLPSEIGPVAAF

SEQ ID NO: 924156 - protein, 26 aa, Mycobacterium
AHLRGWGVSPARVIELDWDQSHQLGK

SEQ ID NO: 924157 - protein, 18 aa, Mycobacterium
AHLTPPFVGQGMGAGIRD

SEQ ID NO: 924158 - protein, 21 aa, Mycobacterium
AHLVSCAGLLPVMTLATQTGL

SEQ ID NO: 924159 - protein, 25 aa, Mycobacterium
AHMTDRFAAIPAQRRKLVTNHHVLG

SEQ ID NO: 924160 - protein, 26 aa, Mycobacterium
AHPEDARLGPPLRVVVTAVRSLLQPM

SEQ ID NO: 924161 - protein, 24 aa, Mycobacterium
AHPRAGADLARRLDQLQAFGQLDE

SEQ ID NO: 924162 - protein, 25 aa, Mycobacterium
AHRRPALCRLALTARTGWQRWESEF

SEQ ID NO: 924163 - protein, 18 aa, Mycobacterium
AHRRQRVSTEWTGITVAQ

SEQ ID NO: 924164 - protein, 19 aa, Mycobacterium
AHSFVDAWNYGALATNAQL

SEQ ID NO: 924165 - protein, 19 aa, Mycobacterium
AHSFVDAWNYGALSTNAQL

SEQ ID NO: 924166 - protein, 19 aa, Mycobacterium
AHSFVDAWNYGALSTNGQL

SEQ ID NO: 924167 - protein, 30 aa, Mycobacterium
AHSGWAAGHPGLFTRAPWVVSVDDHVDPAV

SEQ ID NO: 924168 - protein, 18 aa, Mycobacterium
AHVGKPFLAYAQKTKAVA

SEQ ID NO: 924169 - protein, 28 aa, Mycobacterium
AHVPATGAVPGFEAHLPAGVDPRHVLGP

SEQ ID NO: 924170 - protein, 21 aa, Mycobacterium
AHVPDRLAVVRVEAGESLQDV

SEQ ID NO: 924171 - protein, 17 aa, Mycobacterium
AHVVRCHQSGWSWFIET

SEQ ID NO: 924172 - protein, 19 aa, Mycobacterium
AHWRPREYYAPGTKVTVDA

SEQ ID NO: 924173 - protein, 17 aa, Mycobacterium
AHYCPKYITGEDRGPKP

SEQ ID NO: 924174 - protein, 23 aa, Mycobacterium
AIAACLLSGCGHDTTGTATWPGA

SEQ ID NO: 924175 - protein, 25 aa, Mycobacterium
AIAAFKRPREVLFVDELPLTGNGKI

SEQ ID NO: 924176 - protein, 46 aa, Mycobacterium
AIAAFSAVKPSVAWAETYPGTLSYYLASAFREIWLQPSGSVGLIGF

SEQ ID NO: 924177 - protein, 23 aa, Mycobacterium
AIADFGLPYARALVDQLRRHIDD

SEQ ID NO: 924178 - protein, 19 aa, Mycobacterium
AIAELRALIAAQRETTDVN

SEQ ID NO: 924179 - protein, 27 aa, Mycobacterium
AIAFRSGPRTGFLSGLGLITPPDLETY

SEQ ID NO: 924180 - protein, 18 aa, Mycobacterium
AIAGIALIHGATQFELTA

SEQ ID NO: 924181 - protein, 20 aa, Mycobacterium
AIAGLRAYAGSKLCNLLTAR

SEQ ID NO: 924182 - protein, 23 aa, Mycobacterium
AIAKACAPAGITVQDAGSETAGP

SEQ ID NO: 924183 - protein, 23 aa, Mycobacterium
AIAKSCGPAGISVSDVTLDTAGP

SEQ ID NO: 924184 - protein, 19 aa, Mycobacterium
AIALVLFMGVPRAAADDNP

SEQ ID NO: 924185 - protein, 19 aa, Mycobacterium
AIANAIAGIALIHGATQFE

SEQ ID NO: 924186 - protein, 24 aa, Mycobacterium
AIANGDCDAGFAFDTMVDKTMIDK

SEQ ID NO: 924187 - protein, 18 aa, Mycobacterium
AIAPLVGVSPEIMKSAFE

SEQ ID NO: 924188 - protein, 23 aa, Mycobacterium
AIAPVLAGMGFDGIYVSSMLRTQ

SEQ ID NO: 924189 - protein, 25 aa, Mycobacterium
AIAQGDSACAIGFIDTRRRIAYSAG

SEQ ID NO: 924190 - protein, 23 aa, Mycobacterium
AIARTEHRLGWEYAVLDVPALQS

SEQ ID NO: 924191 - protein, 22 aa, Mycobacterium
AIAYRVNGRPSLALDGSTAARI

SEQ ID NO: 924192 - protein, 30 aa, Mycobacterium
AIDATALRDELGWRPAHSDFEAGLRDTIDW

SEQ ID NO: 924193 - protein, 19 aa, Mycobacterium
AIDEWPIQFPTTMTNPIDD

SEQ ID NO: 924194 - protein, 19 aa, Mycobacterium
AIDHPRAGELVAIAEPAAW

SEQ ID NO: 924195 - protein, 21 aa, Mycobacterium
AIEAGMKFGTPQSIQISSLRG

SEQ ID NO: 924196 - protein, 17 aa, Mycobacterium
AIEIVPFDGQDAATNAV

SEQ ID NO: 924197 - protein, 18 aa, Mycobacterium
AIENAKKLHLIVVRSDGT

SEQ ID NO: 924198 - protein, 23 aa, Mycobacterium
AIEPRLWNMSTVLPILQDTTIVA

SEQ ID NO: 924199 - protein, 20 aa, Mycobacterium
AIEQFVYAYIHACPGHTLDY

SEQ ID NO: 924200 - protein, 25 aa, Mycobacterium
AIEQFVYAYIRACPGYTLDYNANGS

SEQ ID NO: 924201 - protein, 25 aa, Mycobacterium
AIERWEYGQKLVLHRNERYWGAAPD

SEQ ID NO: 924202 - protein, 17 aa, Mycobacterium
AIETTPARKLREIRMAL

SEQ ID NO: 924203 - protein, 20 aa, Mycobacterium
AIEYIRAVSSWHLVDGSLRM

SEQ ID NO: 924204 - protein, 19 aa, Mycobacterium
AIEYVIRRAGSQMGVPYSW

SEQ ID NO: 924205 - protein, 24 aa, Mycobacterium
AIGPDGTAYIANWEAVSSSGELLD

SEQ ID NO: 924206 - protein, 17 aa, Mycobacterium
AIGQSFDIVGFDPRGVG

SEQ ID NO: 924207 - protein, 19 aa, Mycobacterium
AIGRWKALIVASGAVEMIE

SEQ ID NO: 924208 - protein, 27 aa, Mycobacterium
AIGWSFLSDRLDAITVTAQFDSAAGLY

SEQ ID NO: 924209 - protein, 22 aa, Mycobacterium
AIHRHCDVFAFVEAMCRNALRL

SEQ ID NO: 924210 - protein, 20 aa, Mycobacterium
AIIDRGRELGMMNFIDRVPG

SEQ ID NO: 924211 - protein, 18 aa, Mycobacterium
AIIGKSGGLFGFTKPGYT

SEQ ID NO: 924212 - protein, 22 aa, Mycobacterium
AIKKVREVTCAIGQRQGADRLL

SEQ ID NO: 924213 - protein, 30 aa, Mycobacterium
AILTGGARAARGVRAHPPLPGDPGTAGTAG

SEQ ID NO: 924214 - protein, 19 aa, Mycobacterium
AILVLFAALLAFRPDPADD

SEQ ID NO: 924215 - protein, 24 aa, Mycobacterium
AIMRDCKYTAIGVWSENSLDRTVV

SEQ ID NO: 924216 - protein, 17 aa, Mycobacterium
AINGAVNTAAWFVMATI

SEQ ID NO: 924217 - protein, 18 aa, Mycobacterium
AINRLRAPLKVAADYSPE

SEQ ID NO: 924218 - protein, 20 aa, Mycobacterium
AIPARWTLDNGATFQAVDPG

SEQ ID NO: 924219 - protein, 18 aa, Mycobacterium
AIPCVALNKFADAVAAEC

SEQ ID NO: 924220 - protein, 23 aa, Mycobacterium
AIPDGRVDAIVGWHQAGGDLATA

SEQ ID NO: 924221 - protein, 27 aa, Mycobacterium
AIPEGNPWFTSYDRYRFDLDESKRLLD

SEQ ID NO: 924222 - protein, 23 aa, Mycobacterium
AIPGDIPEALPVGVANETGLQPA

SEQ ID NO: 924223 - protein, 18 aa, Mycobacterium
AIPLHEWMSANIDMLHAL

SEQ ID NO: 924224 - protein, 23 aa, Mycobacterium
AIPLPPDQNGYVFIETKSGVTRC

SEQ ID NO: 924225 - protein, 17 aa, Mycobacterium
AIPYRVPYPQIMPTQES

SEQ ID NO: 924226 - protein, 17 aa, Mycobacterium
AIQQALCDQWIAPRRAA

SEQ ID NO: 924227 - protein, 17 aa, Mycobacterium
AIQQTWHPPASVTSETP

SEQ ID NO: 924228 - protein, 27 aa, Mycobacterium
AIQVPRLRRTLAWHIVRRPGGTIAGAT

SEQ ID NO: 924229 - protein, 21 aa, Mycobacterium
AIRGDFVNGFFVLDLTNARLR

SEQ ID NO: 924230 - protein, 24 aa, Mycobacterium
AIRTGRPGTAIGLSEGAFVVDGVQ

SEQ ID NO: 924231 - protein, 25 aa, Mycobacterium
AISGPKFAGPVQKHLVFVNQGGNWI

SEQ ID NO: 924232 - protein, 28 aa, Mycobacterium
AISPWGGRYRIAYNADSGHQEWVDAVAN

SEQ ID NO: 924233 - protein, 19 aa, Mycobacterium
AISTLSVGAVDGFETYHVM

SEQ ID NO: 924234 - protein, 22 aa, Mycobacterium
AISVQPWRGAERIAHDDSEVGV

SEQ ID NO: 924235 - protein, 25 aa, Mycobacterium
AITAGYDEAVGWTRDNPQQAAAIWA

SEQ ID NO: 924236 - protein, 26 aa, Mycobacterium
AITEIGGRPVALVASERSNFVAVYDV

SEQ ID NO: 924237 - protein, 20 aa, Mycobacterium
AITGCLIAGVTVVPVPADVG

SEQ ID NO: 924238 - protein, 18 aa, Mycobacterium
AITGYRATNAITVKIHPP

SEQ ID NO: 924239 - protein, 19 aa, Mycobacterium
AITSLGLSSSEGFRSYDVM

SEQ ID NO: 924240 - protein, 18 aa, Mycobacterium
AIVAFPVTQWTRWRQPVI

SEQ ID NO: 924241 - protein, 20 aa, Mycobacterium
AIVDEAFAPIHTVITSATQS

SEQ ID NO: 924242 - protein, 20 aa, Mycobacterium
AIVFAALMVTAGCAAPGASL

SEQ ID NO: 924243 - protein, 20 aa, Mycobacterium
AIVSTSGWVANKFPSGMTKN

SEQ ID NO: 924244 - protein, 19 aa, Mycobacterium
AIVYSRGGIVTIINGSGSV

SEQ ID NO: 924245 - protein, 17 aa, Mycobacterium
AIWVYCGNGAPSDLDAA

SEQ ID NO: 924246 - protein, 20 aa, Mycobacterium
AIYDARTWAKIRGQVRTQTQ

SEQ ID NO: 924247 - protein, 23 aa, Mycobacterium
AIYDAWASLSYERGPLGLPTSAE

SEQ ID NO: 924248 - protein, 24 aa, Mycobacterium
AKAAARICALNALAAVDSLVGLDS

SEQ ID NO: 924249 - protein, 18 aa, Mycobacterium
AKAASLWTGREGIIAGQS

SEQ ID NO: 924250 - protein, 24 aa, Mycobacterium
AKAEGAKVDARRALQAAAGTDPGS

SEQ ID NO: 924251 - protein, 29 aa, Mycobacterium
AKAPWRKATVVATAWGIRVAREAERKAGR

SEQ ID NO: 924252 - protein, 21 aa, Mycobacterium
AKARGANILGRLMGASVTSDG

SEQ ID NO: 924253 - protein, 25 aa, Mycobacterium
AKATACAAWDRAARSTALASKSSAE

SEQ ID NO: 924254 - protein, 24 aa, Mycobacterium
AKAVARWLVLSLRRPGGQAQFAAP

SEQ ID NO: 924255 - protein, 23 aa, Mycobacterium
AKAVEVYHSLVWPLVDEPAETSD

SEQ ID NO: 924256 - protein, 24 aa, Mycobacterium
AKAVGNIEQVEWEKLAQIALAAAW

SEQ ID NO: 924257 - protein, 19 aa, Mycobacterium
AKDPLKTAADFLVAIPTGW

SEQ ID NO: 924258 - protein, 22 aa, Mycobacterium
AKDSKGCWQLSITESTDVSSAI

SEQ ID NO: 924259 - protein, 25 aa, Mycobacterium
AKDTLPAWRVQPPVPADELISDYHA

SEQ ID NO: 924260 - protein, 23 aa, Mycobacterium
AKDTRIAAIFPDGPQRYFDTIYN

SEQ ID NO: 924261 - protein, 22 aa, Mycobacterium
AKDWCAMGADVTFWTNELPPLF

SEQ ID NO: 924262 - protein, 21 aa, Mycobacterium
AKFINYYSWGAITVEELTVEL

SEQ ID NO: 924263 - protein, 25 aa, Mycobacterium
AKFLEGLTIRTNRTFQEEYIAAGGK

SEQ ID NO: 924264 - protein, 21 aa, Mycobacterium
AKFPVGVTCVHPGGIKTNIAS

SEQ ID NO: 924265 - protein, 27 aa, Mycobacterium
AKGDPAFNYGGIGAVIGHEFTHAFDDE

SEQ ID NO: 924266 - protein, 26 aa, Mycobacterium
AKGETYPTAMLIVFELNGDFDVAQAL

SEQ ID NO: 924267 - protein, 17 aa, Mycobacterium
AKGGIVFHVQRELGVPV

SEQ ID NO: 924268 - protein, 30 aa, Mycobacterium
AKGGVIVMDSRGRFTYTPAEAARHAAAAAE

SEQ ID NO: 924269 - protein, 19 aa, Mycobacterium
AKGIPLVPVNAALDSKDIA

SEQ ID NO: 924270 - protein, 19 aa, Mycobacterium
AKGIPVVAFNAGMDSWKAM

SEQ ID NO: 924271 - protein, 30 aa, Mycobacterium
AKGLGSGGARGCPPATWCVQNAGNYRGTMS

SEQ ID NO: 924272 - protein, 25 aa, Mycobacterium
AKGPSRWGAHMQLHVSAGMGTSPFA

SEQ ID NO: 924273 - protein, 21 aa, Mycobacterium
AKGPSRWGVRTQLHVSAGIGT

SEQ ID NO: 924274 - protein, 20 aa, Mycobacterium
AKGQYGWLIPADGSEDTVWH

SEQ ID NO: 924275 - protein, 21 aa, Mycobacterium
AKGTANIIFLGQRLNDVEFVV

SEQ ID NO: 924276 - protein, 18 aa, Mycobacterium
AKGTCWAVTVMGSSNTVV

SEQ ID NO: 924277 - protein, 18 aa, Mycobacterium
AKIAFSGAGVRGGIEVVE

SEQ ID NO: 924278 - protein, 18 aa, Mycobacterium
AKIATEFGRLDVLINNAG

SEQ ID NO: 924279 - protein, 25 aa, Mycobacterium
AKIPDAVRYSVRFGKPVLLPATAGL

SEQ ID NO: 924280 - protein, 17 aa, Mycobacterium
AKISCERLERGVDHTAY

SEQ ID NO: 924281 - protein, 17 aa, Mycobacterium
AKKAPITFDTLFKPGSE

SEQ ID NO: 924282 - protein, 29 aa, Mycobacterium
AKKQGLADINWDVIPFDWANDSNTDATRA

SEQ ID NO: 924283 - protein, 25 aa, Mycobacterium
AKLANYSYWKPGGMRIDTSRPSEHE

SEQ ID NO: 924284 - protein, 18 aa, Mycobacterium
AKLASVWEGGAGHTWEAR

SEQ ID NO: 924285 - protein, 32 aa, Mycobacterium
AKLCSQYLGPALRLVNFGNLPFPINPYLRPAI

SEQ ID NO: 924286 - protein, 17 aa, Mycobacterium
AKLKADGARVQRPLWAS

SEQ ID NO: 924287 - protein, 25 aa, Mycobacterium
AKLLAARGASVFGIARDADRMAEVF

SEQ ID NO: 924288 - protein, 18 aa, Mycobacterium
AKLLAGVYVAALRSYGFA

SEQ ID NO: 924289 - protein, 37 aa, Mycobacterium
AKLTPDYPAGCKRPLMSRDWYPTFALPNVSLETAAIA

SEQ ID NO: 924290 - protein, 17 aa, Mycobacterium
AKMAYFMAGFSGPIPDD

SEQ ID NO: 924291 - protein, 18 aa, Mycobacterium
AKMAYLMVVFSGPIPDDK

SEQ ID NO: 924292 - protein, 17 aa, Mycobacterium
AKPAPNLKLRPLSGATV

SEQ ID NO: 924293 - protein, 24 aa, Mycobacterium
AKPHLAVAAGRVGALAGLTPEHLA

SEQ ID NO: 924294 - protein, 23 aa, Mycobacterium
AKPTGWCSWQGLATVPEIADSDA

SEQ ID NO: 924295 - protein, 20 aa, Mycobacterium
AKRAAGRSGLSVHGQARLLS

SEQ ID NO: 924296 - protein, 25 aa, Mycobacterium
AKRSPRPGHRRIVLRFMTSPIEIKG

SEQ ID NO: 924297 - protein, 21 aa, Mycobacterium
AKSELPPRFGGPEKLQEAFGR

SEQ ID NO: 924298 - protein, 20 aa, Mycobacterium
AKSLAFAHPGDGRWIEITSE

SEQ ID NO: 924299 - protein, 17 aa, Mycobacterium
AKSLPLLEPTYLAVDVI

SEQ ID NO: 924300 - protein, 27 aa, Mycobacterium
AKSPEFRRGWADHRVFELSHGIKRLHH

SEQ ID NO: 924301 - protein, 18 aa, Mycobacterium
AKSTRRTALRAAVALTLA

SEQ ID NO: 924302 - protein, 20 aa, Mycobacterium
AKSTWPVWTMNAIGDLTMHG

SEQ ID NO: 924303 - protein, 25 aa, Mycobacterium
AKTLRRWRCGIDGPLGGYEIHHGRI

SEQ ID NO: 924304 - protein, 24 aa, Mycobacterium
AKTTWMSGCRSWYLTKEGFNGSMF

SEQ ID NO: 924305 - protein, 24 aa, Mycobacterium
AKTVPRSLAGLGDLVKVIEKLEPI

SEQ ID NO: 924306 - protein, 26 aa, Mycobacterium
AKVAFSGPQLRGGIEVVDAPQIDGTH

SEQ ID NO: 924307 - protein, 18 aa, Mycobacterium
AKVAQGQPVAWIHATALR

SEQ ID NO: 924308 - protein, 20 aa, Mycobacterium
AKVDNGRCAPVAGTNTGESL

SEQ ID NO: 924309 - protein, 25 aa, Mycobacterium
AKVFAGCAIALGAALAGCGTNNDGG

SEQ ID NO: 924310 - protein, 25 aa, Mycobacterium
AKVRARLLELFELFDPADPAVIAGR

SEQ ID NO: 924311 - protein, 23 aa, Mycobacterium
AKVRLPLPIAQLVERDHQRLGMQ

SEQ ID NO: 924312 - protein, 18 aa, Mycobacterium
AKYPMYRIIRQQLTEAAV

SEQ ID NO: 924313 - protein, 18 aa, Mycobacterium
ALAAAKCSVGWVAWPAPG

SEQ ID NO: 924314 - protein, 19 aa, Mycobacterium
ALAAATRRTTIANIAAGPA

SEQ ID NO: 924315 - protein, 26 aa, Mycobacterium
ALAAECERLGVRWAPPARDLTVDGDA

SEQ ID NO: 924316 - protein, 28 aa, Mycobacterium
ALAAGAAGCSWGGAVVGAVSACAALASG

SEQ ID NO: 924317 - protein, 24 aa, Mycobacterium
ALAAGLAGEGWVGAVGAGAADTAR

SEQ ID NO: 924318 - protein, 24 aa, Mycobacterium
ALAAGLAGEGWVGAVGAVASGSAL

SEQ ID NO: 924319 - protein, 18 aa, Mycobacterium
ALAAGVAVGARLSQRLVR

SEQ ID NO: 924320 - protein, 24 aa, Mycobacterium
ALAATVMLLPWAISGIPDGDEKPT

SEQ ID NO: 924321 - protein, 21 aa, Mycobacterium
ALADEAWRQVLALSPDADIAG

SEQ ID NO: 924322 - protein, 20 aa, Mycobacterium
ALAERLPAYMVPAAVVVLDS

SEQ ID NO: 924323 - protein, 25 aa, Mycobacterium
ALAESEVIVSLAFPKPPELLRAAYV

SEQ ID NO: 924324 - protein, 17 aa, Mycobacterium
ALAGLPLTPMSLADSAL

SEQ ID NO: 924325 - protein, 19 aa, Mycobacterium
ALAGRAGRYTVVIRSTVLP

SEQ ID NO: 924326 - protein, 21 aa, Mycobacterium
ALAGRGEMTCHVGVGRLAAIY

SEQ ID NO: 924327 - protein, 18 aa, Mycobacterium
ALAIIIAVLIVINSRGDN

SEQ ID NO: 924328 - protein, 19 aa, Mycobacterium
ALALRDAWRANGADVDYWA

SEQ ID NO: 924329 - protein, 23 aa, Mycobacterium
ALAQGRVDGIGFAVGGFTNLSRD

SEQ ID NO: 924330 - protein, 18 aa, Mycobacterium
ALASELWLDGADATQTVA

SEQ ID NO: 924331 - protein, 18 aa, Mycobacterium
ALASRAGDHVDFLAHDRV

SEQ ID NO: 924332 - protein, 20 aa, Mycobacterium
ALATRISWRRPYEVTDAREL

SEQ ID NO: 924333 - protein, 22 aa, Mycobacterium
ALAVALTAPWLFPGTANAEPVA

SEQ ID NO: 924334 - protein, 26 aa, Mycobacterium
ALAVASPCAYFLVYESTTETKPTEHH

SEQ ID NO: 924335 - protein, 17 aa, Mycobacterium
ALAVCSSAVLLTVGVVG

SEQ ID NO: 924336 - protein, 21 aa, Mycobacterium
ALCALVAAVILVWQTDPVAGT

SEQ ID NO: 924337 - protein, 19 aa, Mycobacterium
ALCTPRDAISRDAGVPIAN

SEQ ID NO: 924338 - protein, 22 aa, Mycobacterium
ALDAGFDLASFTKRASALTDAP

SEQ ID NO: 924339 - protein, 19 aa, Mycobacterium
ALDAGRINVAWSRTADPEI

SEQ ID NO: 924340 - protein, 19 aa, Mycobacterium
ALDGRLCRVMRPDLEKVLL

SEQ ID NO: 924341 - protein, 18 aa, Mycobacterium
ALDIGGTISQGWTYNGQM

SEQ ID NO: 924342 - protein, 18 aa, Mycobacterium
ALDLDALVGGFRPLFRSL

SEQ ID NO: 924343 - protein, 18 aa, Mycobacterium
ALDPKWVQWYNPNLGGLD

SEQ ID NO: 924344 - protein, 18 aa, Mycobacterium
ALDRGRIAVLVAAVPFKC

SEQ ID NO: 924345 - protein, 18 aa, Mycobacterium
ALDSSVMVNLVFNQTTVV

SEQ ID NO: 924346 - protein, 19 aa, Mycobacterium
ALEDPEWCASAIARHGERV

SEQ ID NO: 924347 - protein, 21 aa, Mycobacterium
ALEGLKAVALLANGADTYAPD

SEQ ID NO: 924348 - protein, 18 aa, Mycobacterium
ALEGQGRIGMVCQNHNVR

SEQ ID NO: 924349 - protein, 24 aa, Mycobacterium
ALEHPAELTTLLAQEAKISQSVAE

SEQ ID NO: 924350 - protein, 18 aa, Mycobacterium
ALELARRGARVVVNDLGS

SEQ ID NO: 924351 - protein, 32 aa, Mycobacterium
ALERARPVLEPMAGKVIHCGAAGAGQAAKVCN

SEQ ID NO: 924352 - protein, 26 aa, Mycobacterium
ALESLRPCGVEEVVILGRRGPLQTAF

SEQ ID NO: 924353 - protein, 25 aa, Mycobacterium
ALFDRIKPTLPIVLANLISVGEVAV

SEQ ID NO: 924354 - protein, 39 aa, Mycobacterium
ALFETHFFGSVAMIKAVLPGMRARRSGSIVNISSITVQL

SEQ ID NO: 924355 - protein, 20 aa, Mycobacterium
ALFETHFFGTVAMIKAVLPG

SEQ ID NO: 924356 - protein, 26 aa, Mycobacterium
ALFGEPSSGFSTMLWGGQPLPTINPA

SEQ ID NO: 924357 - protein, 20 aa, Mycobacterium
ALFIAMMTFAPAFAGADPAD

SEQ ID NO: 924358 - protein, 18 aa, Mycobacterium
ALFILKLRASDIPDEAAG

SEQ ID NO: 924359 - protein, 19 aa, Mycobacterium
ALFLAPAERVHVWVFALLR

SEQ ID NO: 924360 - protein, 24 aa, Mycobacterium
ALFLESRPKFGWHDDMLIEGSSMQ

SEQ ID NO: 924361 - protein, 25 aa, Mycobacterium
ALFPNYRGSALEAFISTMHDYGLWV

SEQ ID NO: 924362 - protein, 20 aa, Mycobacterium
ALFQTGGTVLTNFGSALPEF

SEQ ID NO: 924363 - protein, 19 aa, Mycobacterium
ALGARPGVVLSVGTGSVAV

SEQ ID NO: 924364 - protein, 17 aa, Mycobacterium
ALGGHWRYQTYLRAEDL

SEQ ID NO: 924365 - protein, 18 aa, Mycobacterium
ALGGSGWTVPEEAAPVSG

SEQ ID NO: 924366 - protein, 21 aa, Mycobacterium
ALGGVDVCLNGPVYEPLSGAD

SEQ ID NO: 924367 - protein, 24 aa, Mycobacterium
ALGKTYCRLGGFLDGADRFDAGFF

SEQ ID NO: 924368 - protein, 17 aa, Mycobacterium
ALGLMGSGVGFAVGSYA

SEQ ID NO: 924369 - protein, 24 aa, Mycobacterium
ALGNPRAIASFADLAGPGVQLVVC

SEQ ID NO: 924370 - protein, 17 aa, Mycobacterium
ALGNWLMSRGVAVSPTA

SEQ ID NO: 924371 - protein, 17 aa, Mycobacterium
ALGPYYLATTALQNSAM

SEQ ID NO: 924372 - protein, 17 aa, Mycobacterium
ALGRAAVGVTAYPGLEI

SEQ ID NO: 924373 - protein, 23 aa, Mycobacterium
ALGRDVQRLTAWASTTESGDRDD

SEQ ID NO: 924374 - protein, 29 aa, Mycobacterium
ALGSLDLDAGNALTCPRYQVSSRTADEKL

SEQ ID NO: 924375 - protein, 17 aa, Mycobacterium
ALGYLKYPSAVTVAKVP

SEQ ID NO: 924376 - protein, 22 aa, Mycobacterium
ALHLRRWLARKHEIVVISPNAD

SEQ ID NO: 924377 - protein, 17 aa, Mycobacterium
ALHPGPDPLRFSGITMF

SEQ ID NO: 924378 - protein, 34 aa, Mycobacterium
ALIEAGTTTKVVWYCGGHGACLSSVNNGDLVVDR

SEQ ID NO: 924379 - protein, 20 aa, Mycobacterium
ALIEHGALLVAQRARPPELA

SEQ ID NO: 924380 - protein, 18 aa, Mycobacterium
ALIFLVGCTRSISGTAVK

SEQ ID NO: 924381 - protein, 19 aa, Mycobacterium
ALIGCTEPSPARATISQCN

SEQ ID NO: 924382 - protein, 26 aa, Mycobacterium
ALILLGGPGWLCWVAAAVAGGSLTAF

SEQ ID NO: 924383 - protein, 24 aa, Mycobacterium
ALIWEISEFFGLALTKVAPLARVI

SEQ ID NO: 924384 - protein, 24 aa, Mycobacterium
ALKADGPVPGTAWITEDDHTLLQA

SEQ ID NO: 924385 - protein, 24 aa, Mycobacterium
ALKEAGRTGVPIVGIDGIEDGLNA

SEQ ID NO: 924386 - protein, 24 aa, Mycobacterium
ALKESGRTGVPIVGIDGIEDGLNA

SEQ ID NO: 924387 - protein, 33 aa, Mycobacterium
ALKIIGRAGGIYGDFFNFYACDLTLKLNGLQPG

SEQ ID NO: 924388 - protein, 27 aa, Mycobacterium
ALKLSADGNVWGGSINKDFGTATDTED

SEQ ID NO: 924389 - protein, 26 aa, Mycobacterium
ALKPPRPAVPDAPLLRDGDTIGLDAT

SEQ ID NO: 924390 - protein, 24 aa, Mycobacterium
ALKVFNPLMYFNFNYFPIPINPIL

SEQ ID NO: 924391 - protein, 20 aa, Mycobacterium
ALLAALAMAMTLSGCGRSAE

SEQ ID NO: 924392 - protein, 20 aa, Mycobacterium
ALLAGFSLAGCQAKESATSG

SEQ ID NO: 924393 - protein, 18 aa, Mycobacterium
ALLGHFCDPTVALVAPRI

SEQ ID NO: 924394 - protein, 17 aa, Mycobacterium
ALLHKAINYLQALQQPL

SEQ ID NO: 924395 - protein, 20 aa, Mycobacterium
ALLLFALACPLMMMFMMGGM

SEQ ID NO: 924396 - protein, 18 aa, Mycobacterium
ALLLGLAFAGGYAVSAAK

SEQ ID NO: 924397 - protein, 17 aa, Mycobacterium
ALLMCAPSGVAQAAPAE

SEQ ID NO: 924398 - protein, 21 aa, Mycobacterium
ALLPVLRPGEHVLLTDQLAQG

SEQ ID NO: 924399 - protein, 25 aa, Mycobacterium
ALLQRARQDWQGCANRRYGFHSSNG

SEQ ID NO: 924400 - protein, 17 aa, Mycobacterium
ALLSGRSTKVFGDGGNT

SEQ ID NO: 924401 - protein, 25 aa, Mycobacterium
ALLTGMRLALFASFDPATTPLAIAA

SEQ ID NO: 924402 - protein, 23 aa, Mycobacterium
ALMFPFAGGLGLMSNRASEVVAN

SEQ ID NO: 924403 - protein, 17 aa, Mycobacterium
ALMGIVGCTSVTNGTAT

SEQ ID NO: 924404 - protein, 23 aa, Mycobacterium
ALMPLWLGAIALSLAIPAVAAAA

SEQ ID NO: 924405 - protein, 24 aa, Mycobacterium
ALMQPRARGRITLVSSDPDVAPGI

SEQ ID NO: 924406 - protein, 21 aa, Mycobacterium
ALNCAFAGLVQITHGAPLSEP

SEQ ID NO: 924407 - protein, 19 aa, Mycobacterium
ALNDGRVDAIVGWHQAGGN

SEQ ID NO: 924408 - protein, 24 aa, Mycobacterium
ALNDNRIDAIVGWHQAGGNLATLL

SEQ ID NO: 924409 - protein, 17 aa, Mycobacterium
ALNEKLSAADDFNAQMA

SEQ ID NO: 924410 - protein, 23 aa, Mycobacterium
ALNMVKCVHWPTGSPPPSPKTLK

SEQ ID NO: 924411 - protein, 20 aa, Mycobacterium
ALNNGVPWSTPRMNPTHLNF

SEQ ID NO: 924412 - protein, 30 aa, Mycobacterium
ALNRLMPPIIKIMAGSAFAARVSIDKLALG

SEQ ID NO: 924413 - protein, 19 aa, Mycobacterium
ALNTLKSAELVGVLDIDAR

SEQ ID NO: 924414 - protein, 24 aa, Mycobacterium
ALNWDRILCSAGKRGWDVSLDPRD

SEQ ID NO: 924415 - protein, 24 aa, Mycobacterium
ALPELRGAGVVVSFAGAVFEALGV

SEQ ID NO: 924416 - protein, 18 aa, Mycobacterium
ALPKVPGLGGALGAIGSA

SEQ ID NO: 924417 - protein, 33 aa, Mycobacterium
ALPNIPAVPDIVGIYGVGPIFWAADLLGLTPTG

SEQ ID NO: 924418 - protein, 21 aa, Mycobacterium
ALPRRALLLAMATCVPLAGCA

SEQ ID NO: 924419 - protein, 25 aa, Mycobacterium
ALQAAQFSAYGAWYQQVSAQAKAIH

SEQ ID NO: 924420 - protein, 26 aa, Mycobacterium
ALQDYDQRISVNWPAEARPYTGEDDM

SEQ ID NO: 924421 - protein, 19 aa, Mycobacterium
ALQIPRVAAATGLSQARVK

SEQ ID NO: 924422 - protein, 24 aa, Mycobacterium
ALQLILSLRPLWLRGGRVQEALAG

SEQ ID NO: 924423 - protein, 17 aa, Mycobacterium
ALQLPLWGGVGEQDRLR

SEQ ID NO: 924424 - protein, 24 aa, Mycobacterium
ALQRDNCKLIDWPIATLSPAGIRT

SEQ ID NO: 924425 - protein, 25 aa, Mycobacterium
ALQRLRAPATLLGRYSPEIPCTLQA

SEQ ID NO: 924426 - protein, 25 aa, Mycobacterium
ALQRTPWRCFFDFRNKNNVLFGAYL

SEQ ID NO: 924427 - protein, 19 aa, Mycobacterium
ALQTTEVWEPTIPANTPAA

SEQ ID NO: 924428 - protein, 23 aa, Mycobacterium
ALRAELGIELYAVIAAPVAGLAG

SEQ ID NO: 924429 - protein, 18 aa, Mycobacterium
ALRDCLRGGDADLAQRFF

SEQ ID NO: 924430 - protein, 20 aa, Mycobacterium
ALRERPAVRMLKLGGRAALP

SEQ ID NO: 924431 - protein, 18 aa, Mycobacterium
ALRLARQRSPLPLLAFAH

SEQ ID NO: 924432 - protein, 40 aa, Mycobacterium
ALRNKTRLAALRVKDFSKRDVMVIHTLLWPDEIRDPDFPV

SEQ ID NO: 924433 - protein, 32 aa, Mycobacterium
ALRRLFVIGCCVMLAVTGCAFNGLNSLPLPGA

SEQ ID NO: 924434 - protein, 18 aa, Mycobacterium
ALRTSRPGVFAVGNLLHP

SEQ ID NO: 924435 - protein, 19 aa, Mycobacterium
ALSACSFSIGGLDYDKLES

SEQ ID NO: 924436 - protein, 19 aa, Mycobacterium
ALSAFSLTATTGWRSVCQA

SEQ ID NO: 924437 - protein, 17 aa, Mycobacterium
ALSARITSYTGKVTAAV

SEQ ID NO: 924438 - protein, 24 aa, Mycobacterium
ALSDLQPGDVLTFYSDASHAGIYI

SEQ ID NO: 924439 - protein, 18 aa, Mycobacterium
ALSDPALGMFTGRVTDAL

SEQ ID NO: 924440 - protein, 19 aa, Mycobacterium
ALSGCATNGLGDLPLPAPG

SEQ ID NO: 924441 - protein, 30 aa, Mycobacterium
ALSTRAADVHARFVQALAAGADRYASAEAA

SEQ ID NO: 924442 - protein, 24 aa, Mycobacterium
ALTACGHPSCNVLSVFTRCGAIAH

SEQ ID NO: 924443 - protein, 18 aa, Mycobacterium
ALTAQRFGIHGERYQQVS

SEQ ID NO: 924444 - protein, 19 aa, Mycobacterium
ALTDILARLADPNVPGINK

SEQ ID NO: 924445 - protein, 17 aa, Mycobacterium
ALTDMAKDFGIGVDFMV

SEQ ID NO: 924446 - protein, 19 aa, Mycobacterium
ALTGRPLIGNGADGAAGTG

SEQ ID NO: 924447 - protein, 17 aa, Mycobacterium
ALTPDFRIGCKRILLTN

SEQ ID NO: 924448 - protein, 37 aa, Mycobacterium
ALTQIGTPYAWGGAGPGGFDCSGLVMWAFQQAGIALP

SEQ ID NO: 924449 - protein, 37 aa, Mycobacterium
ALTQVGTPYAWGGAAPGGFDCSGLVMWAFQQAGIALP

SEQ ID NO: 924450 - protein, 21 aa, Mycobacterium
ALTRLRIRDGVQLPRGSTAEL

SEQ ID NO: 924451 - protein, 27 aa, Mycobacterium
ALTYPRRLGYGLGENALSLSWRTGDDI

SEQ ID NO: 924452 - protein, 19 aa, Mycobacterium
ALVAEAGGDPWAINRGLQT

SEQ ID NO: 924453 - protein, 20 aa, Mycobacterium
ALVALKAPYLQAALGPLVER

SEQ ID NO: 924454 - protein, 17 aa, Mycobacterium
ALVAVVAVIALCVAMCG

SEQ ID NO: 924455 - protein, 33 aa, Mycobacterium
ALVGALSVPHSWAMAAPEIRLAVESLPSAGGLS

SEQ ID NO: 924456 - protein, 18 aa, Mycobacterium
ALVGGLSVPHGWTMAAPE

SEQ ID NO: 924457 - protein, 18 aa, Mycobacterium
ALVLLLAPRIMRRRGMGG

SEQ ID NO: 924458 - protein, 24 aa, Mycobacterium
ALVNNRVDAVVGWRQAGGDLATVL

SEQ ID NO: 924459 - protein, 19 aa, Mycobacterium
ALVPVVAFGVLLSVVQVPF

SEQ ID NO: 924460 - protein, 21 aa, Mycobacterium
ALVRYRFDLANQIPLRTELFS

SEQ ID NO: 924461 - protein, 20 aa, Mycobacterium
ALVSRCPRFSSAAAGSYAVN

SEQ ID NO: 924462 - protein, 28 aa, Mycobacterium
ALWDETTWYPGSPWLGGVDPAIVSDPID

SEQ ID NO: 924463 - protein, 23 aa, Mycobacterium
ALYEDLTNLGIIFGVQDRARDLI

SEQ ID NO: 924464 - protein, 17 aa, Mycobacterium
ALYKDDRNFVALNKDLA

SEQ ID NO: 924465 - protein, 26 aa, Mycobacterium
ALYRPNGHALGGIVTVNWPRALIMGR

SEQ ID NO: 924466 - protein, 20 aa, Mycobacterium
AMAAVPAGPTAGRVCVTTRA

SEQ ID NO: 924467 - protein, 22 aa, Mycobacterium
AMACACALSFPAAAHADDKTVT

SEQ ID NO: 924468 - protein, 17 aa, Mycobacterium
AMAEIRSLGLAVAAALV

SEQ ID NO: 924469 - protein, 19 aa, Mycobacterium
AMAGKVWLACSNYFRHPSG

SEQ ID NO: 924470 - protein, 26 aa, Mycobacterium
AMANAARFGLQDVIWRGTYYTPAGPQ

SEQ ID NO: 924471 - protein, 20 aa, Mycobacterium
AMARFAKDFERACPGQSVTY

SEQ ID NO: 924472 - protein, 24 aa, Mycobacterium
AMASAAAPYAGWLAAAAAQSAGAA

SEQ ID NO: 924473 - protein, 19 aa, Mycobacterium
AMCEGNCDQLVPAVDRVIE

SEQ ID NO: 924474 - protein, 20 aa, Mycobacterium
AMCIAAAPVIAACGEQAPPA

SEQ ID NO: 924475 - protein, 31 aa, Mycobacterium
AMEQAVAAPMCTRVLADFGARIIKVENPNGG

SEQ ID NO: 924476 - protein, 21 aa, Mycobacterium
AMEQFVYAYIHACPGHTLDYN

SEQ ID NO: 924477 - protein, 27 aa, Mycobacterium
AMGPMQFIPETWRLYGVDANNDGDVSV

SEQ ID NO: 924478 - protein, 28 aa, Mycobacterium
AMGVNTFRFGLEWSRVMPEPGKWDEKEL

SEQ ID NO: 924479 - protein, 24 aa, Mycobacterium
AMHTFDGSQKWSLPLGFNATTPPS

SEQ ID NO: 924480 - protein, 28 aa, Mycobacterium
AMKYMQRWPFRFFAERKWFTIAESIELP

SEQ ID NO: 924481 - protein, 27 aa, Mycobacterium
AMLESAGRRAVLCGNIGDPVLTLLEQP

SEQ ID NO: 924482 - protein, 28 aa, Mycobacterium
AMLLRCARPRLTPIVGLLTPDGLVTNDA

SEQ ID NO: 924483 - protein, 22 aa, Mycobacterium
AMLRTTCVPTKIEGGHANNALP

SEQ ID NO: 924484 - protein, 28 aa, Mycobacterium
AMMALRLGCQSDLFAAIAPVAGTLLTDC

SEQ ID NO: 924485 - protein, 18 aa, Mycobacterium
AMPSMLPFTEEDFAPAWH

SEQ ID NO: 924486 - protein, 29 aa, Mycobacterium
AMQFLVELMLFDWPTHVAQIIQALSQSPQ

SEQ ID NO: 924487 - protein, 18 aa, Mycobacterium
AMRDFVTKYGLTFIQLAD

SEQ ID NO: 924488 - protein, 20 aa, Mycobacterium
AMRQLVCAKLDALIVDSVTV

SEQ ID NO: 924489 - protein, 18 aa, Mycobacterium
AMRTCAGSAVGVPSVTVA

SEQ ID NO: 924490 - protein, 18 aa, Mycobacterium
AMTDCGVNLFGFDQLLPE

SEQ ID NO: 924491 - protein, 24 aa, Mycobacterium
AMTKRAVAAISVLLGLTGCGSAQP

SEQ ID NO: 924492 - protein, 27 aa, Mycobacterium
AMTRALSLLATYPFPKETIGKWARGDY

SEQ ID NO: 924493 - protein, 17 aa, Mycobacterium
AMTTCLSVTSCATEGLS

SEQ ID NO: 924494 - protein, 20 aa, Mycobacterium
AMVGFITWRVRGHQEERPEI

SEQ ID NO: 924495 - protein, 18 aa, Mycobacterium
AMVLRLSSVLGVPQRDQN

SEQ ID NO: 924496 - protein, 28 aa, Mycobacterium
AMYGDYFSFYLCDLILKLNGKGGQPVYV

SEQ ID NO: 924497 - protein, 17 aa, Mycobacterium
ANAAIAAAQARFDKFAA

SEQ ID NO: 924498 - protein, 21 aa, Mycobacterium
ANAAIPWSLTIVTTLTSVVAH

SEQ ID NO: 924499 - protein, 21 aa, Mycobacterium
ANADGKWMVNPVFINPLPVSP

SEQ ID NO: 924500 - protein, 23 aa, Mycobacterium
ANAFSRPGLPVEYLQVPSAAMNT

SEQ ID NO: 924501 - protein, 20 aa, Mycobacterium
ANAIMVWTLMNTRNGKESLM

SEQ ID NO: 924502 - protein, 24 aa, Mycobacterium
ANAKRFGIQDAIWRGTYYTPGGAQ

SEQ ID NO: 924503 - protein, 25 aa, Mycobacterium
ANAPEMSSRLAGGIVAKAADEIAAG

SEQ ID NO: 924504 - protein, 26 aa, Mycobacterium
ANARYFIVPVTDLWTVTGDYWHQQTS

SEQ ID NO: 924505 - protein, 24 aa, Mycobacterium
ANDLDRLIWAEGFSLPLTQSPGDV

SEQ ID NO: 924506 - protein, 22 aa, Mycobacterium
ANFPDIRGLHSYAGHKIHSARW

SEQ ID NO: 924507 - protein, 20 aa, Mycobacterium
ANFTFPMEFAPFQGGWQLSR

SEQ ID NO: 924508 - protein, 19 aa, Mycobacterium
ANGDSLSFGDYRCRADQAG

SEQ ID NO: 924509 - protein, 27 aa, Mycobacterium
ANGIDAPALWPGLPVRPVKGEVLRLRW

SEQ ID NO: 924510 - protein, 31 aa, Mycobacterium
ANGNRPNGGFLARGPKGVTIPLGTPGGGVTF

SEQ ID NO: 924511 - protein, 18 aa, Mycobacterium
ANGRQAIEYVIRRAGSQM

SEQ ID NO: 924512 - protein, 19 aa, Mycobacterium
ANGVAAVFDAARAAIVHPL

SEQ ID NO: 924513 - protein, 17 aa, Mycobacterium
ANGYRMVTVSELLGPRA

SEQ ID NO: 924514 - protein, 23 aa, Mycobacterium
ANHAKGVAVSGYFDSNGNGQEIS

SEQ ID NO: 924515 - protein, 18 aa, Mycobacterium
ANHSIWFHRQVNFNDWVL

SEQ ID NO: 924516 - protein, 21 aa, Mycobacterium
ANHSTPFWWSADSRIGDSTVI

SEQ ID NO: 924517 - protein, 24 aa, Mycobacterium
ANIAPEYTGTGWINYLGHENPIKG

SEQ ID NO: 924518 - protein, 23 aa, Mycobacterium
ANIKARGRLIVGLDIGSNLFSFR

SEQ ID NO: 924519 - protein, 25 aa, Mycobacterium
ANIPYYSVAGTNRFANAMRASGSWW

SEQ ID NO: 924520 - protein, 23 aa, Mycobacterium
ANIRARGRLIVGLDIGSNLFSFR

SEQ ID NO: 924521 - protein, 23 aa, Mycobacterium
ANKCADIATVLRDTRAGQEQLIR

SEQ ID NO: 924522 - protein, 19 aa, Mycobacterium
ANLEILFDADLAHRPALET

SEQ ID NO: 924523 - protein, 26 aa, Mycobacterium
ANLSERFSPSVLYGVPTFLARVADTC

SEQ ID NO: 924524 - protein, 20 aa, Mycobacterium
ANLSKGYGLNNCKPQELTES

SEQ ID NO: 924525 - protein, 18 aa, Mycobacterium
ANNDFKPGFATALMNKDL

SEQ ID NO: 924526 - protein, 23 aa, Mycobacterium
ANPEVWAKTVFILNYDENDGLFD

SEQ ID NO: 924527 - protein, 24 aa, Mycobacterium
ANPPEVKSVGLGNVNGVTLGYTSG

SEQ ID NO: 924528 - protein, 21 aa, Mycobacterium
ANPRPRYSIVLSSDPAEIEAA

SEQ ID NO: 924529 - protein, 25 aa, Mycobacterium
ANPRRRSTICAIQLDNADVVTFHCY

SEQ ID NO: 924530 - protein, 20 aa, Mycobacterium
ANQQWGVWGAGAAMIPGNKN

SEQ ID NO: 924531 - protein, 21 aa, Mycobacterium
ANRLPQVSWLIPNFLESEHPA

SEQ ID NO: 924532 - protein, 20 aa, Mycobacterium
ANRNAFVQLVMSNLFGQNAP

SEQ ID NO: 924533 - protein, 18 aa, Mycobacterium
ANSIRPNAVVSIHGDGGP

SEQ ID NO: 924534 - protein, 17 aa, Mycobacterium
ANSKWAGEVLLREAHDI

SEQ ID NO: 924535 - protein, 22 aa, Mycobacterium
ANSQLRPGRVIGAAFDDDTDTW

SEQ ID NO: 924536 - protein, 24 aa, Mycobacterium
ANSTLCLDVDWVLGSCMSVDPDHK

SEQ ID NO: 924537 - protein, 24 aa, Mycobacterium
ANSVVRCVGNTLLLNGRTYSPPYI

SEQ ID NO: 924538 - protein, 25 aa, Mycobacterium
ANVARATLYRHFPSGNDLLAAAFNS

SEQ ID NO: 924539 - protein, 17 aa, Mycobacterium
ANVGWGNLGSHNFGFGN

SEQ ID NO: 924540 - protein, 24 aa, Mycobacterium
ANWIGACYMVRCSECHHLTFASKN

SEQ ID NO: 924541 - protein, 17 aa, Mycobacterium
ANYAAAVTRGIVAYLNG

SEQ ID NO: 924542 - protein, 32 aa, Mycobacterium
APAAGGEHLVSWVKAVIYAAAERWTDVIDEVR

SEQ ID NO: 924543 - protein, 26 aa, Mycobacterium
APAAVKVGFRLGAPGPGEFGVRDGAL

SEQ ID NO: 924544 - protein, 17 aa, Mycobacterium
APAEIPPAVSAYTGAGD

SEQ ID NO: 924545 - protein, 19 aa, Mycobacterium
APAGLGWLGTAFVDSLRAK

SEQ ID NO: 924546 - protein, 25 aa, Mycobacterium
APAGTAGSWNARWADLTPARQAAVI

SEQ ID NO: 924547 - protein, 20 aa, Mycobacterium
APALQALLALMVERGVDTVV

SEQ ID NO: 924548 - protein, 18 aa, Mycobacterium
APAPARLAPGPVTSVPQA

SEQ ID NO: 924549 - protein, 24 aa, Mycobacterium
APAPEVPGLPFLQQLAANPAAATQ

SEQ ID NO: 924550 - protein, 19 aa, Mycobacterium
APAPPNCTAADLAGVSAGV

SEQ ID NO: 924551 - protein, 27 aa, Mycobacterium
APAPPVLGGLCADVGKVAYDPTNNEQI

SEQ ID NO: 924552 - protein, 27 aa, Mycobacterium
APAPTYYWCPGQPFDPAWGPNWDPTTC

SEQ ID NO: 924553 - protein, 18 aa, Mycobacterium
APARHFSGRFLQRNTTLW

SEQ ID NO: 924554 - protein, 27 aa, Mycobacterium
APARYFGPNLARLTAIRQRYDPGQLMY

SEQ ID NO: 924555 - protein, 25 aa, Mycobacterium
APATGEARVSGMIASVAGNSIQVTK

SEQ ID NO: 924556 - protein, 20 aa, Mycobacterium
APCDNYERFIFGRGPSGQAE

SEQ ID NO: 924557 - protein, 17 aa, Mycobacterium
APDCPLTDVTSVKRAVL

SEQ ID NO: 924558 - protein, 26 aa, Mycobacterium
APDDFRWPFNIPGYWMTPMFTLAVGG

SEQ ID NO: 924559 - protein, 17 aa, Mycobacterium
APDEPRAGAGECTLQDR

SEQ ID NO: 924560 - protein, 20 aa, Mycobacterium
APDFRLFWDNAYAVHTLTHD

SEQ ID NO: 924561 - protein, 18 aa, Mycobacterium
APDFVFHNGRVYTVTESA

SEQ ID NO: 924562 - protein, 21 aa, Mycobacterium
APDHLPVVLEFAATVAPGAGR

SEQ ID NO: 924563 - protein, 22 aa, Mycobacterium
APDIEWTRDRELLLLNVHGGQD

SEQ ID NO: 924564 - protein, 18 aa, Mycobacterium
APDLGSADPVDWAQDTCQ

SEQ ID NO: 924565 - protein, 20 aa, Mycobacterium
APDPGWRGLDVGSPFDHAKA

SEQ ID NO: 924566 - protein, 19 aa, Mycobacterium
APDSNWRRYVERSAGKPVH

SEQ ID NO: 924567 - protein, 19 aa, Mycobacterium
APDTSVYPYNLWQGRTNDE

SEQ ID NO: 924568 - protein, 23 aa, Mycobacterium
APDTVPMVIDFGGGVLGALQRYA

SEQ ID NO: 924569 - protein, 24 aa, Mycobacterium
APDTWVPRRVDFDVDAARAAGLDT

SEQ ID NO: 924570 - protein, 18 aa, Mycobacterium
APDVMVWSVAAPLREPVW

SEQ ID NO: 924571 - protein, 46 aa, Mycobacterium
APDYYRRAELCRERLGPVLRRLTANYPPFLFHPLNTITAYKGQIIY

SEQ ID NO: 924572 - protein, 19 aa, Mycobacterium
APEAPRLIFRPTDAAGDVL

SEQ ID NO: 924573 - protein, 24 aa, Mycobacterium
APEDLRFGLYGALVHPLEADGLGS

SEQ ID NO: 924574 - protein, 26 aa, Mycobacterium
APEKLWTVDDLGGWDAVDPSLFDKDN

SEQ ID NO: 924575 - protein, 26 aa, Mycobacterium
APELGFRPGAHFEYSNSNYLLLGEIV

SEQ ID NO: 924576 - protein, 20 aa, Mycobacterium
APEVLIPIQCEYYALEGVSQ

SEQ ID NO: 924577 - protein, 18 aa, Mycobacterium
APGACVVVNPCLSGGSLE

SEQ ID NO: 924578 - protein, 24 aa, Mycobacterium
APGASWDMEMPWLASADDAQGAWV

SEQ ID NO: 924579 - protein, 28 aa, Mycobacterium
APGATAFPWRRQSALVQWYVETGDPAAA

SEQ ID NO: 924580 - protein, 28 aa, Mycobacterium
APGATAFPWRRQYALVQWYVETGDVAAA

SEQ ID NO: 924581 - protein, 27 aa, Mycobacterium
APGCRQLDSALPWYGDVRQRLQAAIDA

SEQ ID NO: 924582 - protein, 33 aa, Mycobacterium
APGDGGATVDEYGFNPGPPYGADGQAGAMGATG

SEQ ID NO: 924583 - protein, 17 aa, Mycobacterium
APGDNLVVFGYSQSAAI

SEQ ID NO: 924584 - protein, 19 aa, Mycobacterium
APGDWLYFVTIDSQGTTLF

SEQ ID NO: 924585 - protein, 24 aa, Mycobacterium
APGHYTLRARVEWQQHKPAASHVV

SEQ ID NO: 924586 - protein, 26 aa, Mycobacterium
APGHYTLRASVEWRQHKPGASHVVNY

SEQ ID NO: 924587 - protein, 19 aa, Mycobacterium
APGIFLAVADDIGMFITTY

SEQ ID NO: 924588 - protein, 20 aa, Mycobacterium
APGLRTATVPGRLESIDLGQ

SEQ ID NO: 924589 - protein, 20 aa, Mycobacterium
APGQAGGDGGLLYGNGGNGG

SEQ ID NO: 924590 - protein, 36 aa, Mycobacterium
APGRAGFSLRGHVRRLSDADTRWVVIYVDDDSEHVR

SEQ ID NO: 924591 - protein, 20 aa, Mycobacterium
APGTGRDGGPGGLLYGNGGD

SEQ ID NO: 924592 - protein, 22 aa, Mycobacterium
APGTQVPLRFRIVDASGAAVTE

SEQ ID NO: 924593 - protein, 18 aa, Mycobacterium
APHAAEWDAITAGAWYDA

SEQ ID NO: 924594 - protein, 26 aa, Mycobacterium
APHPAAARLWQEFLFSDEGQNLYAAG

SEQ ID NO: 924595 - protein, 18 aa, Mycobacterium
APIGAFGFDSPLPPGVDQ

SEQ ID NO: 924596 - protein, 25 aa, Mycobacterium
APIGRPLPGTALFVLDPWLRQVPIG

SEQ ID NO: 924597 - protein, 24 aa, Mycobacterium
APILDIPEALPMGVAVEAGLQPNA

SEQ ID NO: 924598 - protein, 17 aa, Mycobacterium
APIPVYGPGPAGGLPPS

SEQ ID NO: 924599 - protein, 19 aa, Mycobacterium
APKGEPPQAGWPIVSVGHG

SEQ ID NO: 924600 - protein, 21 aa, Mycobacterium
APKLPSFAPKHVVYMVFGESA

SEQ ID NO: 924601 - protein, 18 aa, Mycobacterium
APKVPAGAFSWVDNATVR

SEQ ID NO: 924602 - protein, 20 aa, Mycobacterium
APLDDARLLFLFRTQEELQY

SEQ ID NO: 924603 - protein, 20 aa, Mycobacterium
APLGCALGTAAAQNDGSDQN

SEQ ID NO: 924604 - protein, 20 aa, Mycobacterium
APLGRPIICTEYLARSQGSS

SEQ ID NO: 924605 - protein, 19 aa, Mycobacterium
APLLGTWVGQGAGKYPTIP

SEQ ID NO: 924606 - protein, 25 aa, Mycobacterium
APLNIPYKVAFVLDVAGDNEALVAR

SEQ ID NO: 924607 - protein, 24 aa, Mycobacterium
APLNIPYRVAFVLDVAGDNEALVA

SEQ ID NO: 924608 - protein, 23 aa, Mycobacterium
APLPAPLPIDGLQAPGLPAVQSL

SEQ ID NO: 924609 - protein, 17 aa, Mycobacterium
APLPVPVFEQLTKLTGQ

SEQ ID NO: 924610 - protein, 18 aa, Mycobacterium
APLPWSTEFTSFGGQVFV

SEQ ID NO: 924611 - protein, 19 aa, Mycobacterium
APLVFADHVSFPFRIGFTR

SEQ ID NO: 924612 - protein, 19 aa, Mycobacterium
APLVQRLSEMMDHSDNVLA

SEQ ID NO: 924613 - protein, 17 aa, Mycobacterium
APMGLLSGMALAGLAGR

SEQ ID NO: 924614 - protein, 37 aa, Mycobacterium
APMPGTTRWLDGRSVQWEPAEFYPAHTPITVSVGGFS

SEQ ID NO: 924615 - protein, 23 aa, Mycobacterium
APMRFFCRPEATLLTLVPARTSG

SEQ ID NO: 924616 - protein, 20 aa, Mycobacterium
APPADAFRPTYVGADKEIFR

SEQ ID NO: 924617 - protein, 24 aa, Mycobacterium
APPAPPRAATPVPIEPGQQTVSFS

SEQ ID NO: 924618 - protein, 19 aa, Mycobacterium
APPDAARFEERWSAPVALP

SEQ ID NO: 924619 - protein, 21 aa, Mycobacterium
APPEPPRWIPPWEQPPRQPEC

SEQ ID NO: 924620 - protein, 32 aa, Mycobacterium
APPMGRGWEAVVGNEVWDWAGELAELPTLLAE

SEQ ID NO: 924621 - protein, 22 aa, Mycobacterium
APPPAGVLFPLAQNGSPSQLIG

SEQ ID NO: 924622 - protein, 19 aa, Mycobacterium
APPPPPAQILIPPAPIAAT

SEQ ID NO: 924623 - protein, 31 aa, Mycobacterium
APPTDVRPAGKLRAGSLIPLTSAGAYPSTEQ

SEQ ID NO: 924624 - protein, 26 aa, Mycobacterium
APPVLLPVVVAPVIVPPALAAPQPDG

SEQ ID NO: 924625 - protein, 26 aa, Mycobacterium
APRASAAPGQWPVERANAWYQAQGWL

SEQ ID NO: 924626 - protein, 19 aa, Mycobacterium
APRCSDIELVFARGTDEPP

SEQ ID NO: 924627 - protein, 23 aa, Mycobacterium
APRDLCALWPVPATSTPHVASPA

SEQ ID NO: 924628 - protein, 23 aa, Mycobacterium
APRDLRQRMAKAIVEYPPNQPYI

SEQ ID NO: 924629 - protein, 18 aa, Mycobacterium
APSAWAYDPAINGTYTAT

SEQ ID NO: 924630 - protein, 22 aa, Mycobacterium
APSDPRVAAQITDGVRLPIGAA

SEQ ID NO: 924631 - protein, 27 aa, Mycobacterium
APSGEIWQWALGKSMLTDPTLRDYLNS

SEQ ID NO: 924632 - protein, 18 aa, Mycobacterium
APSGRAVRRVAVFGLGYV

SEQ ID NO: 924633 - protein, 22 aa, Mycobacterium
APSLRPPQARVLLMAALATGAP

SEQ ID NO: 924634 - protein, 19 aa, Mycobacterium
APSNGRWDVTLSTSGDLVR

SEQ ID NO: 924635 - protein, 17 aa, Mycobacterium
APSNIAGMVVFIDPGHN

SEQ ID NO: 924636 - protein, 18 aa, Mycobacterium
APSPATAVTPSIPGVNAP

SEQ ID NO: 924637 - protein, 29 aa, Mycobacterium
APSPVADAVLAWVRRLITHTFFNKTPVVR

SEQ ID NO: 924638 - protein, 18 aa, Mycobacterium
APSQVWVAGPGRGGGGLN

SEQ ID NO: 924639 - protein, 24 aa, Mycobacterium
APSSAAQVLTGWQTWLAAADRNTW

SEQ ID NO: 924640 - protein, 27 aa, Mycobacterium
APSSLRDSALFIRDPWRQDVLEDLPDD

SEQ ID NO: 924641 - protein, 22 aa, Mycobacterium
APSSVRYNSFFSGNRNFQQSAF

SEQ ID NO: 924642 - protein, 27 aa, Mycobacterium
APTALPLCALICGWLRGQARPDARVEA

SEQ ID NO: 924643 - protein, 25 aa, Mycobacterium
APTATVRSSVSWLSAKVLGTITARD

SEQ ID NO: 924644 - protein, 19 aa, Mycobacterium
APTAVTLSSILSSLLTPTD

SEQ ID NO: 924645 - protein, 18 aa, Mycobacterium
APTDAFAACDIGRTTLYT

SEQ ID NO: 924646 - protein, 24 aa, Mycobacterium
APTEALFGRPLIGDGADGQTVNGV

SEQ ID NO: 924647 - protein, 18 aa, Mycobacterium
APTGYRVLGDEGLLVTAI

SEQ ID NO: 924648 - protein, 21 aa, Mycobacterium
APTHKRWADYLTWVANTVDMK

SEQ ID NO: 924649 - protein, 17 aa, Mycobacterium
APTLARIRDGGAGDDEV

SEQ ID NO: 924650 - protein, 24 aa, Mycobacterium
APTNEAFAALPPEQLEILRTDPAA

SEQ ID NO: 924651 - protein, 20 aa, Mycobacterium
APVAACTRGTLARIEAALEE

SEQ ID NO: 924652 - protein, 24 aa, Mycobacterium
APVFATAMGVGFAGPAAAVAPPAD

SEQ ID NO: 924653 - protein, 19 aa, Mycobacterium
APVIAWYLAMARRSQGNEE

SEQ ID NO: 924654 - protein, 18 aa, Mycobacterium
APVPAPWPILAALPQGPE

SEQ ID NO: 924655 - protein, 28 aa, Mycobacterium
APVPPAPMPNLPVVNQLAGVPGAAPQLL

SEQ ID NO: 924656 - protein, 22 aa, Mycobacterium
APVREILSAVAGIQLDRNVWPY

SEQ ID NO: 924657 - protein, 20 aa, Mycobacterium
APVSVPPLRVVFTPDSRAVV

SEQ ID NO: 924658 - protein, 21 aa, Mycobacterium
APVYAYEFADPVAPVEQQYRD

SEQ ID NO: 924659 - protein, 19 aa, Mycobacterium
APWCGPCDRVRRVVTQVCD

SEQ ID NO: 924660 - protein, 19 aa, Mycobacterium
APYLQAALGPLVERGLVDT

SEQ ID NO: 924661 - protein, 19 aa, Mycobacterium
APYLRSWESVIGHQRTGVY

SEQ ID NO: 924662 - protein, 24 aa, Mycobacterium
AQADAISAWSGRYAIAYNADAGHQ

SEQ ID NO: 924663 - protein, 24 aa, Mycobacterium
AQAFARTLAGFSYHGPDGQTVADR

SEQ ID NO: 924664 - protein, 18 aa, Mycobacterium
AQAFGRIDIPAGVQVLKV

SEQ ID NO: 924665 - protein, 25 aa, Mycobacterium
AQAFNRVLTGFGFHGPDGQVIADHD

SEQ ID NO: 924666 - protein, 17 aa, Mycobacterium
AQAGGLVVRCRNAIPHS

SEQ ID NO: 924667 - protein, 20 aa, Mycobacterium
AQAGKYAFFEPWKDQAKAIG

SEQ ID NO: 924668 - protein, 23 aa, Mycobacterium
AQAGLTDRVTWIGSGKLGLPANA

SEQ ID NO: 924669 - protein, 20 aa, Mycobacterium
AQAGNLGWYPGPAGPDGNYK

SEQ ID NO: 924670 - protein, 17 aa, Mycobacterium
AQALIVSPNLVAARFIQ

SEQ ID NO: 924671 - protein, 27 aa, Mycobacterium
AQAYQRLGAQVAMFHQQFVQSLNVGAE

SEQ ID NO: 924672 - protein, 17 aa, Mycobacterium
AQCGGEPSIPFNEGKRC

SEQ ID NO: 924673 - protein, 23 aa, Mycobacterium
AQDEVYAGTGWTAMRGQRMDDSV

SEQ ID NO: 924674 - protein, 19 aa, Mycobacterium
AQDGKLSLDDPVAKYVPGV

SEQ ID NO: 924675 - protein, 24 aa, Mycobacterium
AQDLIRLGLPVPFDARAIAANNLP

SEQ ID NO: 924676 - protein, 22 aa, Mycobacterium
AQDPRFRFFGNVSVGEHVQASE

SEQ ID NO: 924677 - protein, 20 aa, Mycobacterium
AQDRMHFCAFDVTTDSREDV

SEQ ID NO: 924678 - protein, 26 aa, Mycobacterium
AQERRHAYDFARRELEGLVVLPATTQ

SEQ ID NO: 924679 - protein, 18 aa, Mycobacterium
AQEVLQFQHYSWQDMLAE

SEQ ID NO: 924680 - protein, 18 aa, Mycobacterium
AQEVLTFQHHSWPQLLAD

SEQ ID NO: 924681 - protein, 17 aa, Mycobacterium
AQFEWVDQNGLWHSDDS

SEQ ID NO: 924682 - protein, 30 aa, Mycobacterium
AQFYNEFDPPAAVLNWKGNQEILFQEPSGS

SEQ ID NO: 924683 - protein, 23 aa, Mycobacterium
AQGAGTLAAMSARDRAGPARPAS

SEQ ID NO: 924684 - protein, 27 aa, Mycobacterium
AQGARLGESLALLGWNMSVSNLRWDGD

SEQ ID NO: 924685 - protein, 23 aa, Mycobacterium
AQGRGILPAQVFFQPYRPGATYT

SEQ ID NO: 924686 - protein, 22 aa, Mycobacterium
AQGVGPLRCRILLDGNVVADAQ

SEQ ID NO: 924687 - protein, 19 aa, Mycobacterium
AQLAFRRRIQPVFQNPYSS

SEQ ID NO: 924688 - protein, 25 aa, Mycobacterium
AQLAGLRLGKVLSISEATEPPAPGP

SEQ ID NO: 924689 - protein, 19 aa, Mycobacterium
AQLGDRFASGAVRIDTFTP

SEQ ID NO: 924690 - protein, 28 aa, Mycobacterium
AQLHAAAAGGAWLCYPLAAATPPGQART

SEQ ID NO: 924691 - protein, 17 aa, Mycobacterium
AQLLMAAAQAFAANKTE

SEQ ID NO: 924692 - protein, 20 aa, Mycobacterium
AQLPDSMDVLLNGQRVILCN

SEQ ID NO: 924693 - protein, 17 aa, Mycobacterium
AQLRTATPLGDVFVAIT

SEQ ID NO: 924694 - protein, 17 aa, Mycobacterium
AQLSAVIVKANTNAANP

SEQ ID NO: 924695 - protein, 18 aa, Mycobacterium
AQLVDAFTALRSFAEVAS

SEQ ID NO: 924696 - protein, 17 aa, Mycobacterium
AQMLQRIVTLMPLGVAV

SEQ ID NO: 924697 - protein, 18 aa, Mycobacterium
AQMSWGMTSPYWLYIVTS

SEQ ID NO: 924698 - protein, 20 aa, Mycobacterium
AQNARIYLIDTVLDPNNPPE

SEQ ID NO: 924699 - protein, 24 aa, Mycobacterium
AQNGGLPWSRATVVRAITTALAYP

SEQ ID NO: 924700 - protein, 29 aa, Mycobacterium
AQPAPPPCFNADGTPCTALGTAGPGGAAG

SEQ ID NO: 924701 - protein, 20 aa, Mycobacterium
AQPGGGAWDPLLPMRPSAGA

SEQ ID NO: 924702 - protein, 27 aa, Mycobacterium
AQPGPPVAVRAVWAARVAPPATAAPAA

SEQ ID NO: 924703 - protein, 19 aa, Mycobacterium
AQPLQRWFPTRLLSAEDYL

SEQ ID NO: 924704 - protein, 17 aa, Mycobacterium
AQPLYARYWLHNRGPAP

SEQ ID NO: 924705 - protein, 26 aa, Mycobacterium
AQPPRATAVAGRWSAERANTWYQTQG

SEQ ID NO: 924706 - protein, 29 aa, Mycobacterium
AQPSGCAGWLVRDLVCHLIIDAQDVLITL

SEQ ID NO: 924707 - protein, 23 aa, Mycobacterium
AQQEIEWAKWVIAGLDQRSGVAP

SEQ ID NO: 924708 - protein, 18 aa, Mycobacterium
AQRAAALAREFMKDAKQV

SEQ ID NO: 924709 - protein, 24 aa, Mycobacterium
AQRAADGLARMDVPFLGYHSAPGI

SEQ ID NO: 924710 - protein, 25 aa, Mycobacterium
AQRARFGQALPVLGWNMRVSNLRWS

SEQ ID NO: 924711 - protein, 22 aa, Mycobacterium
AQRCNRELGGRFTILQVSLPKR

SEQ ID NO: 924712 - protein, 21 aa, Mycobacterium
AQRESCQWFNAQYDTLMAQAF

SEQ ID NO: 924713 - protein, 20 aa, Mycobacterium
AQRGRVVGVLADLQGPKIRL

SEQ ID NO: 924714 - protein, 25 aa, Mycobacterium
AQRLARSCVDKLLFGHLQRGNPASG

SEQ ID NO: 924715 - protein, 23 aa, Mycobacterium
AQRLPGLLPPLSHKDALEVTAIH

SEQ ID NO: 924716 - protein, 24 aa, Mycobacterium
AQRSSYQFALSIAVVRHLQRDPLL

SEQ ID NO: 924717 - protein, 26 aa, Mycobacterium
AQSFFDVIGARTWRLGDAPRQANVVK

SEQ ID NO: 924718 - protein, 18 aa, Mycobacterium
AQSRYSGGYVEFPAGSVL

SEQ ID NO: 924719 - protein, 23 aa, Mycobacterium
AQTEGGCSLMVWEVDNRARQRWC

SEQ ID NO: 924720 - protein, 19 aa, Mycobacterium
AQTIPRKAAHLTIDGYTRT

SEQ ID NO: 924721 - protein, 18 aa, Mycobacterium
AQTLPWGIEVRVVEIKDV

SEQ ID NO: 924722 - protein, 25 aa, Mycobacterium
AQVAPPHTWYRQSVSGSRILYDNPD

SEQ ID NO: 924723 - protein, 23 aa, Mycobacterium
AQVCAELGLPHLVLARPAWSPGD

SEQ ID NO: 924724 - protein, 29 aa, Mycobacterium
AQVDCGLAGTVLRFVPPLAALAESIVEFD

SEQ ID NO: 924725 - protein, 18 aa, Mycobacterium
AQVPAPMQVPAATAAPVP

SEQ ID NO: 924726 - protein, 19 aa, Mycobacterium
AQWDVPALALLGVGSGARV

SEQ ID NO: 924727 - protein, 23 aa, Mycobacterium
ARAAADAAAGWDGLASSIGGTVV

SEQ ID NO: 924728 - protein, 19 aa, Mycobacterium
ARAAGYESLMVPSAAMGRD

SEQ ID NO: 924729 - protein, 27 aa, Mycobacterium
ARACGVGLRAFELAVRYAQQRHTFGKP

SEQ ID NO: 924730 - protein, 18 aa, Mycobacterium
ARADAGVTPGIKVGYDNN

SEQ ID NO: 924731 - protein, 18 aa, Mycobacterium
ARADLVIYNGLGLEESMQ

SEQ ID NO: 924732 - protein, 20 aa, Mycobacterium
ARADVGIMLTRSGHAGVKVA

SEQ ID NO: 924733 - protein, 17 aa, Mycobacterium
ARADVPTVLPGVDVLAG

SEQ ID NO: 924734 - protein, 19 aa, Mycobacterium
ARAFFLFRTPEPLDYHHRD

SEQ ID NO: 924735 - protein, 19 aa, Mycobacterium
ARAFSGVKIACVGESTADR

SEQ ID NO: 924736 - protein, 20 aa, Mycobacterium
ARAGLVLDPGAKVTYNGVPV

SEQ ID NO: 924737 - protein, 20 aa, Mycobacterium
ARAGRLPAVSWLIMTSTASE

SEQ ID NO: 924738 - protein, 31 aa, Mycobacterium
ARAGSAMGTPYSWGGGSYNGPTRGIDSGAGT

SEQ ID NO: 924739 - protein, 21 aa, Mycobacterium
ARAHEVLGFRAAIDPRDGLRE

SEQ ID NO: 924740 - protein, 27 aa, Mycobacterium
ARALGCTIKLLAICERLTSDEGKDRVS

SEQ ID NO: 924741 - protein, 17 aa, Mycobacterium
ARALLALEGGPEAQEEL

SEQ ID NO: 924742 - protein, 19 aa, Mycobacterium
ARALPRMFAALTRHHHLHG

SEQ ID NO: 924743 - protein, 19 aa, Mycobacterium
ARALRFWEVMYPSPPPGLA

SEQ ID NO: 924744 - protein, 18 aa, Mycobacterium
ARALSQRGVPFAYGGGGA

SEQ ID NO: 924745 - protein, 29 aa, Mycobacterium
ARANLPMNEGCTGFPPCDNPAGITDQMFK

SEQ ID NO: 924746 - protein, 18 aa, Mycobacterium
ARAPLYLAAQIARTTGDN

SEQ ID NO: 924747 - protein, 18 aa, Mycobacterium
ARAPVCADPAAVPAALGI

SEQ ID NO: 924748 - protein, 21 aa, Mycobacterium
ARASELVRLTSDFGIKETTLR

SEQ ID NO: 924749 - protein, 17 aa, Mycobacterium
ARASWLITRDAKLAVHK

SEQ ID NO: 924750 - protein, 25 aa, Mycobacterium
ARATAAPNPTGWEGLSTAIGGQVLL

SEQ ID NO: 924751 - protein, 18 aa, Mycobacterium
ARATIKLETDTSVEAVRA

SEQ ID NO: 924752 - protein, 21 aa, Mycobacterium
ARATLAAGEYVVFPQERHELT

SEQ ID NO: 924753 - protein, 27 aa, Mycobacterium
ARATPPRFVLASSVAVYGTRNPHRITD

SEQ ID NO: 924754 - protein, 20 aa, Mycobacterium
ARAVALLGIGLLGTGCTNTV

SEQ ID NO: 924755 - protein, 23 aa, Mycobacterium
ARAYGDFLSYCLVAEGAVDIAAE

SEQ ID NO: 924756 - protein, 22 aa, Mycobacterium
ARDCARPKVAPSGRIVLLTSGT

SEQ ID NO: 924757 - protein, 26 aa, Mycobacterium
ARDEVSELIASLFRAYGQECQAVMTQ

SEQ ID NO: 924758 - protein, 23 aa, Mycobacterium
ARDFASTEMDMWLKCSKHTVHDS

SEQ ID NO: 924759 - protein, 19 aa, Mycobacterium
ARDGEPLTLVLGVAANDPT

SEQ ID NO: 924760 - protein, 24 aa, Mycobacterium
ARDGKRSTISLPYVAAVTNGAPHV

SEQ ID NO: 924761 - protein, 18 aa, Mycobacterium
ARDLPEFGPDRLQERWSG

SEQ ID NO: 924762 - protein, 19 aa, Mycobacterium
ARDRVPVAIFAKDPSAALV

SEQ ID NO: 924763 - protein, 23 aa, Mycobacterium
ARECVGVARCPFGSECFSERARG

SEQ ID NO: 924764 - protein, 20 aa, Mycobacterium
AREFVAFWLDPESRVLAGMN

SEQ ID NO: 924765 - protein, 25 aa, Mycobacterium
AREHPLHGFRRAWAHLKHDQGVLVN

SEQ ID NO: 924766 - protein, 24 aa, Mycobacterium
ARELLQRLDNFVGVLAEQREDIVA

SEQ ID NO: 924767 - protein, 24 aa, Mycobacterium
AREMPASMGKPKFPTPTGSFTALS

SEQ ID NO: 924768 - protein, 25 aa, Mycobacterium
AREPDLPTAFARFATLRRRRVTRMV

SEQ ID NO: 924769 - protein, 31 aa, Mycobacterium
ARESLPLASIFKLYVLHALAGAIKNGTVSWD

SEQ ID NO: 924770 - protein, 24 aa, Mycobacterium
ARETIRNPVEWDKPFNMGRYVTDQ

SEQ ID NO: 924771 - protein, 18 aa, Mycobacterium
AREVWCLQTAAQFDDTHA

SEQ ID NO: 924772 - protein, 19 aa, Mycobacterium
ARFEERWSAPVALPQAGPR

SEQ ID NO: 924773 - protein, 24 aa, Mycobacterium
ARFPHGMKAVADFVHARGLLFGIY

SEQ ID NO: 924774 - protein, 20 aa, Mycobacterium
ARFVDFLERVVVKRSIKRHP

SEQ ID NO: 924775 - protein, 17 aa, Mycobacterium
ARGFRPSWSGGPGMGTW

SEQ ID NO: 924776 - protein, 18 aa, Mycobacterium
ARGFSLNTANFFTTDEEI

SEQ ID NO: 924777 - protein, 17 aa, Mycobacterium
ARGFSLNTANFFTTEES

SEQ ID NO: 924778 - protein, 17 aa, Mycobacterium
ARGGDFFESVPPADLYT

SEQ ID NO: 924779 - protein, 18 aa, Mycobacterium
ARGGYLVVDLSAGRIAQV

SEQ ID NO: 924780 - protein, 25 aa, Mycobacterium
ARGHAKKCRLYWVQVIPTIASESTG

SEQ ID NO: 924781 - protein, 20 aa, Mycobacterium
ARGHTKNCRLYWVQIIPTIA

SEQ ID NO: 924782 - protein, 23 aa, Mycobacterium
ARGKEVGLHLVVSRRIAQWGRTL

SEQ ID NO: 924783 - protein, 18 aa, Mycobacterium
ARGLRNAFIDAHEAEAPP

SEQ ID NO: 924784 - protein, 23 aa, Mycobacterium
ARGRGFGVIGARVVKALETTPIS

SEQ ID NO: 924785 - protein, 23 aa, Mycobacterium
ARGSTLWAQSWQAVMRQLYIDAR

SEQ ID NO: 924786 - protein, 20 aa, Mycobacterium
ARGTDPFVLGRWQRSNDPKL

SEQ ID NO: 924787 - protein, 20 aa, Mycobacterium
ARGWIGHSGSIPGYQTLAIY

SEQ ID NO: 924788 - protein, 21 aa, Mycobacterium
ARHDARIGLYAADLDSGATLA

SEQ ID NO: 924789 - protein, 18 aa, Mycobacterium
ARHEGAGVAVDWPVALRQ

SEQ ID NO: 924790 - protein, 23 aa, Mycobacterium
ARHPHVYRDASPIARVHNNAPPF

SEQ ID NO: 924791 - protein, 20 aa, Mycobacterium
ARHPVQLSIPSAISRAPWVL

SEQ ID NO: 924792 - protein, 17 aa, Mycobacterium
ARHRIKPLFVFFDSCWD

SEQ ID NO: 924793 - protein, 19 aa, Mycobacterium
ARHSSGLSVQTFLRGIHVV

SEQ ID NO: 924794 - protein, 19 aa, Mycobacterium
ARHTPEFFAARAKDLFTPG

SEQ ID NO: 924795 - protein, 18 aa, Mycobacterium
ARIALRYPGEVFVMELAR

SEQ ID NO: 924796 - protein, 25 aa, Mycobacterium
ARIGEIRPDGLIYTVWESPAPIEPD

SEQ ID NO: 924797 - protein, 28 aa, Mycobacterium
ARIKLDCLFPGLWPSFWGVNEDPLPDGE

SEQ ID NO: 924798 - protein, 23 aa, Mycobacterium
ARIMSRLAARPSTHARRVQQLLG

SEQ ID NO: 924799 - protein, 24 aa, Mycobacterium
ARKAELAASFAQFKRTFLNQAPTL

SEQ ID NO: 924800 - protein, 20 aa, Mycobacterium
ARKKPPFGIGQIGKSFRNEI

SEQ ID NO: 924801 - protein, 18 aa, Mycobacterium
ARKLGWAPPLAWDEDSID

SEQ ID NO: 924802 - protein, 19 aa, Mycobacterium
ARKLLAYLLSVPVQRTIPR

SEQ ID NO: 924803 - protein, 24 aa, Mycobacterium
ARKLREIRAALAMDKLLSKTEILT

SEQ ID NO: 924804 - protein, 27 aa, Mycobacterium
ARKLREIRMALRLDQTFTKQEILTRYL

SEQ ID NO: 924805 - protein, 19 aa, Mycobacterium
ARKRELVVQINIVGVGVEA

SEQ ID NO: 924806 - protein, 24 aa, Mycobacterium
ARKYGGSGTIWGRQWPTSPYQVID

SEQ ID NO: 924807 - protein, 19 aa, Mycobacterium
ARLAEQWGDQVRMVFYDQR

SEQ ID NO: 924808 - protein, 17 aa, Mycobacterium
ARLARLLVELTPQGLDT

SEQ ID NO: 924809 - protein, 21 aa, Mycobacterium
ARLASYQGAVNKLAAATYMGG

SEQ ID NO: 924810 - protein, 20 aa, Mycobacterium
ARLGPAVSVDAMVPAGVEVS

SEQ ID NO: 924811 - protein, 24 aa, Mycobacterium
ARLGSGRQYMSWISLEDEVRALLF

SEQ ID NO: 924812 - protein, 20 aa, Mycobacterium
ARLKIFARVDALATQGDTAV

SEQ ID NO: 924813 - protein, 18 aa, Mycobacterium
ARLLFLFRTQEELQYHYR

SEQ ID NO: 924814 - protein, 19 aa, Mycobacterium
ARLLNSLASFVVVNVSSPN

SEQ ID NO: 924815 - protein, 23 aa, Mycobacterium
ARLPKARAGTYGYGFNVSVNSSG

SEQ ID NO: 924816 - protein, 19 aa, Mycobacterium
ARLPSGYAPPAPPPRNSLG

SEQ ID NO: 924817 - protein, 17 aa, Mycobacterium
ARLPVASAAECPDAEVV

SEQ ID NO: 924818 - protein, 21 aa, Mycobacterium
ARLQQPLYVMPTKGIFTSNFG

SEQ ID NO: 924819 - protein, 20 aa, Mycobacterium
ARLQTWTVPYTAQFHNPFAN

SEQ ID NO: 924820 - protein, 17 aa, Mycobacterium
ARLRQARLLDEAPAPAQ

SEQ ID NO: 924821 - protein, 26 aa, Mycobacterium
ARLRRARDRCSLFGSRPAAPGFATPA

SEQ ID NO: 924822 - protein, 20 aa, Mycobacterium
ARLSDFVHRRVGALEEHDTD

SEQ ID NO: 924823 - protein, 18 aa, Mycobacterium
ARLSLPVFDNSAMDGYAV

SEQ ID NO: 924824 - protein, 21 aa, Mycobacterium
ARLTHWDGDVFTFRFVSENAP

SEQ ID NO: 924825 - protein, 21 aa, Mycobacterium
ARLVVLAAGAAVFALSACSSS

SEQ ID NO: 924826 - protein, 17 aa, Mycobacterium
ARMGWTVPDTEVISLVT

SEQ ID NO: 924827 - protein, 18 aa, Mycobacterium
ARMSCSRLLARVRNTATD

SEQ ID NO: 924828 - protein, 23 aa, Mycobacterium
ARNPLPCLRVVISSGDRLDPSLA

SEQ ID NO: 924829 - protein, 19 aa, Mycobacterium
ARNPLRFAAPVPGRHGWHV

SEQ ID NO: 924830 - protein, 30 aa, Mycobacterium
ARNPLRFAPPCRDRHGWRAPPQAAPPLPDV

SEQ ID NO: 924831 - protein, 21 aa, Mycobacterium
ARPAVVGGLLTRASARIPASV

SEQ ID NO: 924832 - protein, 19 aa, Mycobacterium
ARPAWDPGSAIVVESDSKA

SEQ ID NO: 924833 - protein, 24 aa, Mycobacterium
ARPKKLNVLGCASVAVALQDMSWN

SEQ ID NO: 924834 - protein, 21 aa, Mycobacterium
ARPPECTAAVLFKGSPLRPPG

SEQ ID NO: 924835 - protein, 20 aa, Mycobacterium
ARPPLKRPGLVSRPLLHEQL

SEQ ID NO: 924836 - protein, 25 aa, Mycobacterium
ARPTMAGAVPTIWTDVLHYLRDNPG

SEQ ID NO: 924837 - protein, 20 aa, Mycobacterium
ARPTVLTTFTVLADIAANVA

SEQ ID NO: 924838 - protein, 17 aa, Mycobacterium
ARQALFWGHEASATALV

SEQ ID NO: 924839 - protein, 30 aa, Mycobacterium
ARQAWYWTHEAAAVGMVWDTPVTTLIQWIA

SEQ ID NO: 924840 - protein, 21 aa, Mycobacterium
ARQCVSRMGTAFLANVGTASV

SEQ ID NO: 924841 - protein, 22 aa, Mycobacterium
ARQFPGRYGRRIVGAALISSAA

SEQ ID NO: 924842 - protein, 21 aa, Mycobacterium
ARQLLDALLLVSGNDAANTLA

SEQ ID NO: 924843 - protein, 31 aa, Mycobacterium
ARQRCGSPAWNLPVVFGPIAITYHVAGVTSL

SEQ ID NO: 924844 - protein, 24 aa, Mycobacterium
ARQSAAARYGRWGFEAAAVTSVAL

SEQ ID NO: 924845 - protein, 21 aa, Mycobacterium
ARQYRKGRVFLVGDAAHQFPP

SEQ ID NO: 924846 - protein, 19 aa, Mycobacterium
ARRAALVRLAPGYEHPGDP

SEQ ID NO: 924847 - protein, 18 aa, Mycobacterium
ARRAAVCRELTKVHEEVV

SEQ ID NO: 924848 - protein, 21 aa, Mycobacterium
ARRAGSPDLPMSWRNLSGPLF

SEQ ID NO: 924849 - protein, 17 aa, Mycobacterium
ARRDFFEALVIADYDIA

SEQ ID NO: 924850 - protein, 24 aa, Mycobacterium
ARRLGDGIEGWSLRRGPIAERSVL

SEQ ID NO: 924851 - protein, 22 aa, Mycobacterium
ARRPNDIRVRMGVHTGKSVLRG

SEQ ID NO: 924852 - protein, 22 aa, Mycobacterium
ARRPPVFAGSIWVQQGSQPLAE

SEQ ID NO: 924853 - protein, 33 aa, Mycobacterium
ARRPRKPRVVGLAALCAAAAFATLSVGTAHADV

SEQ ID NO: 924854 - protein, 19 aa, Mycobacterium
ARRQRRAAYAAGMTVSQML

SEQ ID NO: 924855 - protein, 20 aa, Mycobacterium
ARRRGKHVVASMGAVAASGG

SEQ ID NO: 924856 - protein, 19 aa, Mycobacterium
ARRRGLAVLGVIAGSAVNQ

SEQ ID NO: 924857 - protein, 20 aa, Mycobacterium
ARRTGVERDGPTLFLPLTSL

SEQ ID NO: 924858 - protein, 17 aa, Mycobacterium
ARRTPGISIRRAPSPSW

SEQ ID NO: 924859 - protein, 22 aa, Mycobacterium
ARRVADVLGIPFYVWDFAEKFN

SEQ ID NO: 924860 - protein, 24 aa, Mycobacterium
ARSASQPWTWPLYQLLMPTVTNPA

SEQ ID NO: 924861 - protein, 21 aa, Mycobacterium
ARSASSLGFALDVPWNADQLV

SEQ ID NO: 924862 - protein, 24 aa, Mycobacterium
ARSDGGLVTPMVNDFIARGPNGQN

SEQ ID NO: 924863 - protein, 19 aa, Mycobacterium
ARSGADVVRLVAGDPMSVD

SEQ ID NO: 924864 - protein, 24 aa, Mycobacterium
ARSRRPGTFGVIFALIAVLASACQ

SEQ ID NO: 924865 - protein, 19 aa, Mycobacterium
ARTAVPVEWDDLRQDLEKL

SEQ ID NO: 924866 - protein, 18 aa, Mycobacterium
ARTAWQLHTAAGGGQGAP

SEQ ID NO: 924867 - protein, 23 aa, Mycobacterium
ARTELGHGPLLVPVQAILLNATQ

SEQ ID NO: 924868 - protein, 17 aa, Mycobacterium
ARTGADVVRLVAGDPLT

SEQ ID NO: 924869 - protein, 18 aa, Mycobacterium
ARTIALWEPALRADLLGE

SEQ ID NO: 924870 - protein, 19 aa, Mycobacterium
ARTLLIWTSVAAVALLVAG

SEQ ID NO: 924871 - protein, 18 aa, Mycobacterium
ARVAAPYRVIQFAVNPFK

SEQ ID NO: 924872 - protein, 19 aa, Mycobacterium
ARVAGGWELTDLGREALAA

SEQ ID NO: 924873 - protein, 29 aa, Mycobacterium
ARVDCGLAGTVLRFVPPLAALAEAVVEFD

SEQ ID NO: 924874 - protein, 19 aa, Mycobacterium
ARVDLYFEAAVAGAIPVIR

SEQ ID NO: 924875 - protein, 17 aa, Mycobacterium
ARVGRANTFAGLTVTTT

SEQ ID NO: 924876 - protein, 22 aa, Mycobacterium
ARVKDGKWAIWHAVGSNPKLSR

SEQ ID NO: 924877 - protein, 24 aa, Mycobacterium
ARVKSGEVGLAFIYFDDRTPPPPP

SEQ ID NO: 924878 - protein, 26 aa, Mycobacterium
ARVNDLRNEWLFTEAWGIDVAVSTPR

SEQ ID NO: 924879 - protein, 19 aa, Mycobacterium
ARVPGRPGSNPGPTDQATG

SEQ ID NO: 924880 - protein, 24 aa, Mycobacterium
ARVPQRFVPDLTKYQYWNGDSNSW

SEQ ID NO: 924881 - protein, 30 aa, Mycobacterium
ARVQGLRTAPPFAVHRLWLDRPVTADRPAF

SEQ ID NO: 924882 - protein, 20 aa, Mycobacterium
ARVQRPLWASTGVKNPDYAD

SEQ ID NO: 924883 - protein, 21 aa, Mycobacterium
ARVQRPLWASTGVKNPDYSDT

SEQ ID NO: 924884 - protein, 20 aa, Mycobacterium
ARVQRPLWASTGVKNPEYSD

SEQ ID NO: 924885 - protein, 30 aa, Mycobacterium
ARVRLEKVFDCGDPLLLNRFRQLSTNRLQV

SEQ ID NO: 924886 - protein, 20 aa, Mycobacterium
ARVVCQSGLLGQMGESAQCD

SEQ ID NO: 924887 - protein, 17 aa, Mycobacterium
ARVVFLFRRREEPDYDH

SEQ ID NO: 924888 - protein, 19 aa, Mycobacterium
ARWDHGYDFAGKRVAVIGT

SEQ ID NO: 924889 - protein, 20 aa, Mycobacterium
ARYEALRDAVPWNQSDDDDF

SEQ ID NO: 924890 - protein, 20 aa, Mycobacterium
ARYVPDRVVEHLSQRIITAA

SEQ ID NO: 924891 - protein, 17 aa, Mycobacterium
ASAACPNVEVSFARGRS

SEQ ID NO: 924892 - protein, 18 aa, Mycobacterium
ASAADCPDAEVVFARGTS

SEQ ID NO: 924893 - protein, 18 aa, Mycobacterium
ASAAECPDAEVVFARGTD

SEQ ID NO: 924894 - protein, 18 aa, Mycobacterium
ASAALAATLGDLVAEDRG

SEQ ID NO: 924895 - protein, 30 aa, Mycobacterium
ASAAPSTFALDRFADYPSLPLDPSALVGQV

SEQ ID NO: 924896 - protein, 18 aa, Mycobacterium
ASAEGKNALARAILSTGA

SEQ ID NO: 924897 - protein, 21 aa, Mycobacterium
ASAFSRPGLPVEYLQVPSAAM

SEQ ID NO: 924898 - protein, 22 aa, Mycobacterium
ASAFSRPGLPVEYLQVPSAAMG

SEQ ID NO: 924899 - protein, 26 aa, Mycobacterium
ASAHAFKGWCAAIAERLHADGWAAPD

SEQ ID NO: 924900 - protein, 28 aa, Mycobacterium
ASALAPWKQVLRNLGIDIGKNGQINLGF

SEQ ID NO: 924901 - protein, 21 aa, Mycobacterium
ASAPDFSQWVDRRFADQLSPL

SEQ ID NO: 924902 - protein, 18 aa, Mycobacterium
ASAPRVDIVAAYPGANTA

SEQ ID NO: 924903 - protein, 24 aa, Mycobacterium
ASATEVPRRLSLYESLRRDRTSRV

SEQ ID NO: 924904 - protein, 19 aa, Mycobacterium
ASAVGGLSVPAGWNAAAPA

SEQ ID NO: 924905 - protein, 19 aa, Mycobacterium
ASAVGKLAVPASWSSAAPA

SEQ ID NO: 924906 - protein, 24 aa, Mycobacterium
ASCAVPGAWPPVTIAGRRYMDGGV

SEQ ID NO: 924907 - protein, 19 aa, Mycobacterium
ASDIERLRTLWDVPAVALV

SEQ ID NO: 924908 - protein, 23 aa, Mycobacterium
ASDIPSELSALINVTPTMLQGLA

SEQ ID NO: 924909 - protein, 18 aa, Mycobacterium
ASDMLVRAWVRSYRLTAT

SEQ ID NO: 924910 - protein, 25 aa, Mycobacterium
ASDNFTGGTVFKLNIVEGVRDEANH

SEQ ID NO: 924911 - protein, 17 aa, Mycobacterium
ASEAVAVQTIWARSVVR

SEQ ID NO: 924912 - protein, 22 aa, Mycobacterium
ASEDWPEVSWEAVAARDPDVLV

SEQ ID NO: 924913 - protein, 23 aa, Mycobacterium
ASELIRLTADFGIKETALRVALT

SEQ ID NO: 924914 - protein, 22 aa, Mycobacterium
ASELRAVVATIHIVGNIDRMAG

SEQ ID NO: 924915 - protein, 21 aa, Mycobacterium
ASELVRLTADFGIKETALRVA

SEQ ID NO: 924916 - protein, 17 aa, Mycobacterium
ASEWRSFADTSLQPLPT

SEQ ID NO: 924917 - protein, 17 aa, Mycobacterium
ASFAEWIDRGRPAPPHR

SEQ ID NO: 924918 - protein, 17 aa, Mycobacterium
ASFAEWIDRGRPAPTHR

SEQ ID NO: 924919 - protein, 32 aa, Mycobacterium
ASFYDPIAAGWFVGRPDLIGGDGIHPTDAGHA

SEQ ID NO: 924920 - protein, 19 aa, Mycobacterium
ASFYSNWYRPAVGNGGTWT

SEQ ID NO: 924921 - protein, 22 aa, Mycobacterium
ASGALGRAVCDVFSARHWNVLR

SEQ ID NO: 924922 - protein, 23 aa, Mycobacterium
ASGDEPPPLLGLTVATKEKHGIA

SEQ ID NO: 924923 - protein, 17 aa, Mycobacterium
ASGDGPSAPVLEVGAVR

SEQ ID NO: 924924 - protein, 20 aa, Mycobacterium
ASGDSLAFGDYRCRADRTGL

SEQ ID NO: 924925 - protein, 18 aa, Mycobacterium
ASGELGCHNGLPVSVVVS

SEQ ID NO: 924926 - protein, 19 aa, Mycobacterium
ASGHARAPLYLAAQIARTT

SEQ ID NO: 924927 - protein, 22 aa, Mycobacterium
ASGIGLAIARRLRADGIDVATL

SEQ ID NO: 924928 - protein, 17 aa, Mycobacterium
ASGIGWAGAKALAADGC

SEQ ID NO: 924929 - protein, 20 aa, Mycobacterium
ASGNHSWPYWGQQLQALKGD

SEQ ID NO: 924930 - protein, 23 aa, Mycobacterium
ASGPTPGFGMWVKILAADGTVTL

SEQ ID NO: 924931 - protein, 19 aa, Mycobacterium
ASGQHDWGSWAPQLAYMSG

SEQ ID NO: 924932 - protein, 20 aa, Mycobacterium
ASGYFAWVACDTRTTRHVAR

SEQ ID NO: 924933 - protein, 19 aa, Mycobacterium
ASGYSRFPVVQGDLDETFG

SEQ ID NO: 924934 - protein, 17 aa, Mycobacterium
ASHGSELGYLFDLSRTM

SEQ ID NO: 924935 - protein, 19 aa, Mycobacterium
ASIAAAVHRGELGPQAADL

SEQ ID NO: 924936 - protein, 26 aa, Mycobacterium
ASIREDRSNFSIFIPAARDGKRSTIS

SEQ ID NO: 924937 - protein, 18 aa, Mycobacterium
ASISAQFLGTPYGANTLI

SEQ ID NO: 924938 - protein, 22 aa, Mycobacterium
ASIYSSCAVPPLIGYLNDGKLP

SEQ ID NO: 924939 - protein, 25 aa, Mycobacterium
ASIYSSCAVPPLIGYVNSGKLPGTD

SEQ ID NO: 924940 - protein, 21 aa, Mycobacterium
ASKCGLTPQYAALEKLASDYA

SEQ ID NO: 924941 - protein, 18 aa, Mycobacterium
ASKRVMWQGIGHGASIYS

SEQ ID NO: 924942 - protein, 23 aa, Mycobacterium
ASLAGLMPWHPDPVYSLGKHGVV

SEQ ID NO: 924943 - protein, 22 aa, Mycobacterium
ASLCAPGSRLVFDYLDTDVVAG

SEQ ID NO: 924944 - protein, 24 aa, Mycobacterium
ASLCTRINTITCQEIFDYSTYDQP

SEQ ID NO: 924945 - protein, 25 aa, Mycobacterium
ASLDCFGGGCGRHGASSKAPGPAQI

SEQ ID NO: 924946 - protein, 20 aa, Mycobacterium
ASLDFPFPAIGTVHLENHIT

SEQ ID NO: 924947 - protein, 21 aa, Mycobacterium
ASLKAFGGVGGLGGNGGAAGL

SEQ ID NO: 924948 - protein, 17 aa, Mycobacterium
ASLMRRSLQFGTLTAEE

SEQ ID NO: 924949 - protein, 21 aa, Mycobacterium
ASLRSRLEHVGAMTPAQFQRA

SEQ ID NO: 924950 - protein, 20 aa, Mycobacterium
ASLSKGYGLNNCKPQELTET

SEQ ID NO: 924951 - protein, 26 aa, Mycobacterium
ASMASAVTFDESWARAADSGMTAVFG

SEQ ID NO: 924952 - protein, 24 aa, Mycobacterium
ASNITRLPVRYTFDNRYFNDTYEG

SEQ ID NO: 924953 - protein, 22 aa, Mycobacterium
ASNQGPAGWLRAKTGSLTAVNA

SEQ ID NO: 924954 - protein, 19 aa, Mycobacterium
ASNTHRWFGPYGVTKSAID

SEQ ID NO: 924955 - protein, 25 aa, Mycobacterium
ASPAEPASTGWIGRWLDATGDDPLR

SEQ ID NO: 924956 - protein, 23 aa, Mycobacterium
ASPEGRAAIQQAKEEAAQQKQQA

SEQ ID NO: 924957 - protein, 19 aa, Mycobacterium
ASPIAQGWLHSFLASPPPR

SEQ ID NO: 924958 - protein, 24 aa, Mycobacterium
ASPLRARRVVVCVDDEAGRAMAMR

SEQ ID NO: 924959 - protein, 25 aa, Mycobacterium
ASPLRRMAGDIAIGARHAAFNAAVG

SEQ ID NO: 924960 - protein, 22 aa, Mycobacterium
ASPRFGAGLRRSITLVTYTGRR

SEQ ID NO: 924961 - protein, 25 aa, Mycobacterium
ASPRIAFSAPYALVCDFYGGPAPAP

SEQ ID NO: 924962 - protein, 34 aa, Mycobacterium
ASPSGDRDLLGWGNEVWDPLPWGTYGFGSLSMGR

SEQ ID NO: 924963 - protein, 19 aa, Mycobacterium
ASPVAQGWLHSFLASPPPR

SEQ ID NO: 924964 - protein, 24 aa, Mycobacterium
ASQPAMRSGFYGYGFNVGTTSAAR

SEQ ID NO: 924965 - protein, 27 aa, Mycobacterium
ASQPPRTDVPAAYPRTSPAIQAPASSV

SEQ ID NO: 924966 - protein, 21 aa, Mycobacterium
ASQVAAGVCDGDIGQITTLAE

SEQ ID NO: 924967 - protein, 18 aa, Mycobacterium
ASRAGAPSVVAWADEVHA

SEQ ID NO: 924968 - protein, 23 aa, Mycobacterium
ASRDLPLRLVHAVTATGDGRVDA

SEQ ID NO: 924969 - protein, 26 aa, Mycobacterium
ASRFVACPFGTPGQRMYRTGDLVRWD

SEQ ID NO: 924970 - protein, 17 aa, Mycobacterium
ASRRPPAARAWVTDEPE

SEQ ID NO: 924971 - protein, 24 aa, Mycobacterium
ASRTDWDLATALPAGADFPSDWGY

SEQ ID NO: 924972 - protein, 19 aa, Mycobacterium
ASRTTGWEPVRLARTRRRT

SEQ ID NO: 924973 - protein, 19 aa, Mycobacterium
ASSGIGWATARALAAEGAT

SEQ ID NO: 924974 - protein, 20 aa, Mycobacterium
ASSVRRLRARGAAVVVGTCP

SEQ ID NO: 924975 - protein, 25 aa, Mycobacterium
ASSVVRCVGNTLLLNGRTYSPPYTI

SEQ ID NO: 924976 - protein, 23 aa, Mycobacterium
ASTEILLSLGLADRMVGTSTWFD

SEQ ID NO: 924977 - protein, 20 aa, Mycobacterium
ASTIKVLLALVALDELDLNS

SEQ ID NO: 924978 - protein, 18 aa, Mycobacterium
ASTIKVLLALVTLDQVSL

SEQ ID NO: 924979 - protein, 18 aa, Mycobacterium
ASVAFDRSGRFQGGSGPD

SEQ ID NO: 924980 - protein, 20 aa, Mycobacterium
ASVARFAAALAPHGSGTVLA

SEQ ID NO: 924981 - protein, 24 aa, Mycobacterium
ASVARFAAALAPHGSGTVLAGRDG

SEQ ID NO: 924982 - protein, 18 aa, Mycobacterium
ASVGKLSVPTSWTTSPAI

SEQ ID NO: 924983 - protein, 19 aa, Mycobacterium
ASVVSALTLESWLGPASAS

SEQ ID NO: 924984 - protein, 20 aa, Mycobacterium
ASWQAFVTGLRVIRGDDGAE

SEQ ID NO: 924985 - protein, 22 aa, Mycobacterium
ASWQSFVTGLRVIRGDDGARQW

SEQ ID NO: 924986 - protein, 20 aa, Mycobacterium
ASYAVRVTWSGVYVHSAPWS

SEQ ID NO: 924987 - protein, 22 aa, Mycobacterium
ASYGCSGPLPGAPDGANLVSGS

SEQ ID NO: 924988 - protein, 19 aa, Mycobacterium
ASYGGALWDLLWAAGAGHQ

SEQ ID NO: 924989 - protein, 17 aa, Mycobacterium
ASYSTAFGSMFDQSSIG

SEQ ID NO: 924990 - protein, 22 aa, Mycobacterium
ATAERLATEGARVAIGDNNIAG

SEQ ID NO: 924991 - protein, 19 aa, Mycobacterium
ATAETWPQVRTLRADAAEA

SEQ ID NO: 924992 - protein, 25 aa, Mycobacterium
ATAGAWSRPGLPVEYLEVPSAAMGR

SEQ ID NO: 924993 - protein, 22 aa, Mycobacterium
ATALVYHATFAPRIAEIRDELP

SEQ ID NO: 924994 - protein, 17 aa, Mycobacterium
ATAMCLYLNQGHTEAEA

SEQ ID NO: 924995 - protein, 24 aa, Mycobacterium
ATANALLGIIYVHGRYEDKVDGWD

SEQ ID NO: 924996 - protein, 27 aa, Mycobacterium
ATANEGDWKGGTRGWTIFDATTGDVVW

SEQ ID NO: 924997 - protein, 17 aa, Mycobacterium
ATAPASRADSMQPVGSV

SEQ ID NO: 924998 - protein, 18 aa, Mycobacterium
ATAQRCAQFRAFFDPSDE

SEQ ID NO: 924999 - protein, 24 aa, Mycobacterium
ATARASLYAATKFGIRGFALCLRD

SEQ ID NO: 925000 - protein, 18 aa, Mycobacterium
ATARPIAHRLFGDDASPV

SEQ ID NO: 925001 - protein, 19 aa, Mycobacterium
ATATPGYYKRPDVTAEVFD

SEQ ID NO: 925002 - protein, 17 aa, Mycobacterium
ATATSYRTAAINQLAIP

SEQ ID NO: 925003 - protein, 20 aa, Mycobacterium
ATAYARPDVHFEPDEIDEAD

SEQ ID NO: 925004 - protein, 25 aa, Mycobacterium
ATAYGEWKGGWVDFDGVKLQVGASR

SEQ ID NO: 925005 - protein, 33 aa, Mycobacterium
ATDSYKMSGGQGFAIPIGRAMGVANQIRSGAGS

SEQ ID NO: 925006 - protein, 17 aa, Mycobacterium
ATDTIRAAPQWPELEAG

SEQ ID NO: 925007 - protein, 35 aa, Mycobacterium; identical to SEQ ID NO: 94531

SEQ ID NO: 925008 - protein, 25 aa, Mycobacterium
ATEAEYAEMWARDAAAMYGYAAASA

SEQ ID NO: 925009 - protein, 20 aa, Mycobacterium
ATEAWKEALVTNGWSDAFMT

SEQ ID NO: 925010 - protein, 17 aa, Mycobacterium
ATEGLYEEMWAADVAVM

SEQ ID NO: 925011 - protein, 19 aa, Mycobacterium
ATELADWKLEFDLPAEESV

SEQ ID NO: 925012 - protein, 20 aa, Mycobacterium
ATELARRGVSVVIGDLDDDG

SEQ ID NO: 925013 - protein, 18 aa, Mycobacterium
ATELGYTVPVLWSGSLSD

SEQ ID NO: 925014 - protein, 18 aa, Mycobacterium
ATEMPLRTRLYRLADDQH

SEQ ID NO: 925015 - protein, 24 aa, Mycobacterium
ATEQPRIEPYLAMVQASESGVAGT

SEQ ID NO: 925016 - protein, 17 aa, Mycobacterium
ATERFNAKLRAAMPDTV

SEQ ID NO: 925017 - protein, 26 aa, Mycobacterium
ATFHPDRYRFAGSLSGFLTPSATAMN

SEQ ID NO: 925018 - protein, 21 aa, Mycobacterium
ATFIACSVIQVVRGGSNVTTP

SEQ ID NO: 925019 - protein, 17 aa, Mycobacterium
ATFPWDVAMMPAGPQGR

SEQ ID NO: 925020 - protein, 20 aa, Mycobacterium
ATFWIVVIANSFKDRGDSRK

SEQ ID NO: 925021 - protein, 17 aa, Mycobacterium
ATGCARVNLGTAALEDP

SEQ ID NO: 925022 - protein, 18 aa, Mycobacterium
ATGCFGLGIATADDSPDG

SEQ ID NO: 925023 - protein, 17 aa, Mycobacterium
ATGIGIPADHVMGVRTD

SEQ ID NO: 925024 - protein, 17 aa, Mycobacterium
ATGLLNRTPPSFAAAIE

SEQ ID NO: 925025 - protein, 18 aa, Mycobacterium
ATGVFRTAPATARDVRLI

SEQ ID NO: 925026 - protein, 27 aa, Mycobacterium
ATGVPELPRLGSFEVMNRVIDIAQSAL

SEQ ID NO: 925027 - protein, 17 aa, Mycobacterium
ATHARGADRAALFFDDK

SEQ ID NO: 925028 - protein, 18 aa, Mycobacterium
ATIALGRPAVILPMGRAV

SEQ ID NO: 925029 - protein, 20 aa, Mycobacterium
ATICAALLSAPLIIASASAA

SEQ ID NO: 925030 - protein, 19 aa, Mycobacterium
ATIDWYRRNEEWWRPIKDN

SEQ ID NO: 925031 - protein, 24 aa, Mycobacterium
ATIELRLTGPLAFEDGEATFRFPL

SEQ ID NO: 925032 - protein, 30 aa, Mycobacterium
ATIENGARLNLPWRRDFNALVYALSGSGCV

SEQ ID NO: 925033 - protein, 21 aa, Mycobacterium
ATIETLGFVGLLLANPDRARL

SEQ ID NO: 925034 - protein, 37 aa, Mycobacterium
ATIGKPGGAPALWLPDSSLWLARQMRATGAALDSASQ

SEQ ID NO: 925035 - protein, 27 aa, Mycobacterium
ATIPGGKQVLGSWSWAIPANSATPDAA

SEQ ID NO: 925036 - protein, 28 aa, Mycobacterium
ATIPLARTRPALDLDELIGGFRPLFKAL

SEQ ID NO: 925037 - protein, 19 aa, Mycobacterium
ATIPRSEIASMLALEPVPV

SEQ ID NO: 925038 - protein, 18 aa, Mycobacterium
ATITGLLEHGHRADAPTA

SEQ ID NO: 925039 - protein, 25 aa, Mycobacterium
ATKAVKSVHLVLSIQGKIQGLPIKT

SEQ ID NO: 925040 - protein, 21 aa, Mycobacterium
ATKLMQCVVNGPGYANATPTL

SEQ ID NO: 925041 - protein, 21 aa, Mycobacterium
ATKRAGERLMLDFVERGLDVV

SEQ ID NO: 925042 - protein, 18 aa, Mycobacterium
ATLAGWLGPDRVIGASTI

SEQ ID NO: 925043 - protein, 21 aa, Mycobacterium
ATLEVPGRFQAKGMGSGGAKG

SEQ ID NO: 925044 - protein, 22 aa, Mycobacterium
ATLEVPGRFQAKGMGSGGAKGC

SEQ ID NO: 925045 - protein, 23 aa, Mycobacterium
ATLLKDPRIRAVMGENAPTEIPT

SEQ ID NO: 925046 - protein, 28 aa, Mycobacterium
ATLNRMVGSIPWMYVASVAGVSEREYYQ

SEQ ID NO: 925047 - protein, 17 aa, Mycobacterium
ATLRTWLVEGFSAAATG

SEQ ID NO: 925048 - protein, 26 aa, Mycobacterium
ATMAGWRTDFLNEMGLVISEGIKPFA

SEQ ID NO: 925049 - protein, 20 aa, Mycobacterium
ATNGLASLPLPAPGLGSGGY

SEQ ID NO: 925050 - protein, 23 aa, Mycobacterium
ATNLKVTYARDVAVAQHLLNPPG

SEQ ID NO: 925051 - protein, 17 aa, Mycobacterium
ATPDIPAGQDFTYRFSV

SEQ ID NO: 925052 - protein, 23 aa, Mycobacterium
ATPDTKVAPAYRQSVSASVSASS

SEQ ID NO: 925053 - protein, 22 aa, Mycobacterium
ATPEPRPYINVVNNGEDTVTVN

SEQ ID NO: 925054 - protein, 18 aa, Mycobacterium
ATPLRAGVWRAYADHRMA

SEQ ID NO: 925055 - protein, 17 aa, Mycobacterium
ATPPRRQTLLSVLGAVV

SEQ ID NO: 925056 - protein, 17 aa, Mycobacterium
ATPRAGPATTDRASAAT

SEQ ID NO: 925057 - protein, 24 aa, Mycobacterium
ATPRASLYAATKFGIRGFALCLRD

SEQ ID NO: 925058 - protein, 30 aa, Mycobacterium
ATPRIGDVEVWRFITDIRHPIHVHLNPFQV

SEQ ID NO: 925059 - protein, 26 aa, Mycobacterium
ATPVDEWPDALLLLGDQVYADELTPE

SEQ ID NO: 925060 - protein, 18 aa, Mycobacterium
ATQLLMAAAQAFAHNPAA

SEQ ID NO: 925061 - protein, 19 aa, Mycobacterium
ATQRVPSTVWIQESGDHQL

SEQ ID NO: 925062 - protein, 17 aa, Mycobacterium
ATQWGFVNMWFSYYSAG

SEQ ID NO: 925063 - protein, 24 aa, Mycobacterium
ATRAPRPGHRRIVLRFLTSPIEIK

SEQ ID NO: 925064 - protein, 23 aa, Mycobacterium
ATRGIPFESVVTLVVREGNPKNI

SEQ ID NO: 925065 - protein, 19 aa, Mycobacterium
ATRKDMFVFVASDKHDAMK

SEQ ID NO: 925066 - protein, 24 aa, Mycobacterium
ATRRLLRACATLGLVTSADGEHFA

SEQ ID NO: 925067 - protein, 25 aa, Mycobacterium
ATSALKRKFALVTERADADADADAD

SEQ ID NO: 925068 - protein, 19 aa, Mycobacterium
ATSEAFAAAAADPEAAVQA

SEQ ID NO: 925069 - protein, 21 aa, Mycobacterium
ATSGHPWWTLSQLSDESAVEL

SEQ ID NO: 925070 - protein, 17 aa, Mycobacterium
ATSGLIMGSDGKTALVA

SEQ ID NO: 925071 - protein, 20 aa, Mycobacterium
ATSGWGVSTAIVIGGIGTPS

SEQ ID NO: 925072 - protein, 19 aa, Mycobacterium
ATSIRPSWFNTVPGVPFVW

SEQ ID NO: 925073 - protein, 17 aa, Mycobacterium
ATSKWTGVAARTTVFAY

SEQ ID NO: 925074 - protein, 23 aa, Mycobacterium
ATSNEATVFITITPVDDAPVAVN

SEQ ID NO: 925075 - protein, 17 aa, Mycobacterium
ATSRLLPAIAIAAESIS

SEQ ID NO: 925076 - protein, 23 aa, Mycobacterium
ATSSAWSRRGLPIEYLMVPSPSM

SEQ ID NO: 925077 - protein, 25 aa, Mycobacterium
ATSVPRCVGNTLLLNGRTYSPPYTI

SEQ ID NO: 925078 - protein, 17 aa, Mycobacterium
ATSYRTAAINQLAIPEG

SEQ ID NO: 925079 - protein, 24 aa, Mycobacterium
ATTFMAVPMRWLHGDRSARIPGSL

SEQ ID NO: 925080 - protein, 18 aa, Mycobacterium
ATTGGFCGKNNTYTVYFA

SEQ ID NO: 925081 - protein, 17 aa, Mycobacterium
ATTLFSAKYVDLVYPRH

SEQ ID NO: 925082 - protein, 17 aa, Mycobacterium
ATTMFAAAGAVSAAVAL

SEQ ID NO: 925083 - protein, 23 aa, Mycobacterium
ATTRPRIPAELAEVYDRNVDARR

SEQ ID NO: 925084 - protein, 17 aa, Mycobacterium
ATTSLAEWVTGPDSPNK

SEQ ID NO: 925085 - protein, 19 aa, Mycobacterium
ATVAVFGRRLARLEELVDV

SEQ ID NO: 925086 - protein, 17 aa, Mycobacterium
ATVEEIRTKGTVPDDLP

SEQ ID NO: 925087 - protein, 18 aa, Mycobacterium
ATVHPELVLANRNQLVSL

SEQ ID NO: 925088 - protein, 18 aa, Mycobacterium
ATVHPMLVAANRSRLVSL

SEQ ID NO: 925089 - protein, 27 aa, Mycobacterium
ATVPLTITRLPGGAIQVDIDPTWARAH

SEQ ID NO: 925090 - protein, 19 aa, Mycobacterium
ATVPPALVIANRDQLATLM

SEQ ID NO: 925091 - protein, 17 aa, Mycobacterium
ATVPWPADRRVIDAGTL

SEQ ID NO: 925092 - protein, 20 aa, Mycobacterium
ATVRVAVRIPKPGSNQSPRL

SEQ ID NO: 925093 - protein, 17 aa, Mycobacterium
ATVSIWMGILLTEKLRG

SEQ ID NO: 925094 - protein, 24 aa, Mycobacterium
ATVSPEYTGNGWINYLGNEKPIPD

SEQ ID NO: 925095 - protein, 18 aa, Mycobacterium
ATWRGKPVELARTVVDLT

SEQ ID NO: 925096 - protein, 22 aa, Mycobacterium
ATWSAACAIALATGALAGAAPA

SEQ ID NO: 925097 - protein, 18 aa, Mycobacterium
ATWYPQQFIFAGALSGFL

SEQ ID NO: 925098 - protein, 17 aa, Mycobacterium
ATYGEVFEGDFTPVREL

SEQ ID NO: 925099 - protein, 18 aa, Mycobacterium
ATYGSSVLILPDASLDAV

SEQ ID NO: 925100 - protein, 32 aa, Mycobacterium
AVAAECRRVGIADAHCALPLAHKVTQAARDAY

SEQ ID NO: 925101 - protein, 25 aa, Mycobacterium
AVAAPRLPGAVVEIGHAGKIVFRQA

SEQ ID NO: 925102 - protein, 24 aa, Mycobacterium
AVAARRWPLIAALGHAVTLTIRGG

SEQ ID NO: 925103 - protein, 17 aa, Mycobacterium
AVAAVAAGETFSTLTAG

SEQ ID NO: 925104 - protein, 17 aa, Mycobacterium
AVAAVAVASPVALIAAT

SEQ ID NO: 925105 - protein, 18 aa, Mycobacterium
AVACAAGDVFPAQLEMST

SEQ ID NO: 925106 - protein, 20 aa, Mycobacterium
AVADPGWDPTLPATISAGAP

SEQ ID NO: 925107 - protein, 27 aa, Mycobacterium
AVADSFYLPLVVRRRITFLAKAEYFTG

SEQ ID NO: 925108 - protein, 19 aa, Mycobacterium
AVAEDGFGVVAGFDTAPAK

SEQ ID NO: 925109 - protein, 24 aa, Mycobacterium
AVAEGRAEVGLTYSSYATSDEPRV

SEQ ID NO: 925110 - protein, 25 aa, Mycobacterium
AVAFAHGATIMFWVMMNVDNPDLLL

SEQ ID NO: 925111 - protein, 22 aa, Mycobacterium
AVAGACARRGLATAVLDPGPDR

SEQ ID NO: 925112 - protein, 19 aa, Mycobacterium
AVAGMPRRLGVAAAGAALL

SEQ ID NO: 925113 - protein, 19 aa, Mycobacterium
AVAHLHPPAVVAADLADIT

SEQ ID NO: 925114 - protein, 18 aa, Mycobacterium
AVAIMVLIVLLLANATVT

SEQ ID NO: 925115 - protein, 25 aa, Mycobacterium
AVAKETRPAVVVAISGSTGGILAAA

SEQ ID NO: 925116 - protein, 17 aa, Mycobacterium
AVALFTVSGCSVWDKAE

SEQ ID NO: 925117 - protein, 21 aa, Mycobacterium
AVALGRWDIGPARASARAGPV

SEQ ID NO: 925118 - protein, 25 aa, Mycobacterium
AVALREWLGYAWVCLAEDPPSFEDD

SEQ ID NO: 925119 - protein, 26 aa, Mycobacterium
AVALVLTSCGQWRGIANVPLPGGPGT

SEQ ID NO: 925120 - protein, 26 aa, Mycobacterium
AVANARGVPFLGIRGISDGPGDPLNL

SEQ ID NO: 925121 - protein, 27 aa, Mycobacterium
AVARPDGTLVVFSRRFISTTVSTVSSD

SEQ ID NO: 925122 - protein, 25 aa, Mycobacterium
AVASGPFFKGYVVNLLPGQFVQPFI

SEQ ID NO: 925123 - protein, 23 aa, Mycobacterium
AVASPFAIALATNMTQAAAPAPS

SEQ ID NO: 925124 - protein, 24 aa, Mycobacterium
AVAVDLREDWPAALRQAGFDPTER

SEQ ID NO: 925125 - protein, 21 aa, Mycobacterium
AVAVHELMHSFGFLSSLGKPG

SEQ ID NO: 925126 - protein, 18 aa, Mycobacterium
AVCGVVLAGCGRGEVPSE

SEQ ID NO: 925127 - protein, 18 aa, Mycobacterium
AVCPLFMRQVGWRLRSKQ

SEQ ID NO: 925128 - protein, 19 aa, Mycobacterium
AVCSTFKTYAAGAVLQRVQ

SEQ ID NO: 925129 - protein, 18 aa, Mycobacterium
AVDARHPVQLSIPSAISR

SEQ ID NO: 925130 - protein, 18 aa, Mycobacterium
AVDCERRGVTWAGPVADL

SEQ ID NO: 925131 - protein, 18 aa, Mycobacterium
AVDFVGWYNAHPNFEEAT

SEQ ID NO: 925132 - protein, 21 aa, Mycobacterium
AVDGDAVWVALQRELKSDPTG

SEQ ID NO: 925133 - protein, 25 aa, Mycobacterium
AVDGLNRFAGILARDKDNLGRALDT

SEQ ID NO: 925134 - protein, 26 aa, Mycobacterium
AVDGLNRFSAILARDKDNLGRALDTL

SEQ ID NO: 925135 - protein, 26 aa, Mycobacterium
AVDGLNRFSGALARDKDNLGRALDTL

SEQ ID NO: 925136 - protein, 17 aa, Mycobacterium
AVDVVGWYNANPTYQKV

SEQ ID NO: 925137 - protein, 18 aa, Mycobacterium
AVDYGSSIYAEYRLSGSV

SEQ ID NO: 925138 - protein, 18 aa, Mycobacterium
AVDYVAVVQLRIREGVRL

SEQ ID NO: 925139 - protein, 18 aa, Mycobacterium
AVEAVVWRTYEDSLPADG

SEQ ID NO: 925140 - protein, 27 aa, Mycobacterium
AVEFEKYAAYLAWKYGDQVDNWATLNE

SEQ ID NO: 925141 - protein, 24 aa, Mycobacterium
AVELRNRLKAASGLSLSPTLIFDY

SEQ ID NO: 925142 - protein, 30 aa, Mycobacterium
AVELWKIVDRPNLFIKIPATEAGIPAITAV

SEQ ID NO: 925143 - protein, 30 aa, Mycobacterium
AVELWKIVDRPNLFIKIPATKAGIPAITAV

SEQ ID NO: 925144 - protein, 30 aa, Mycobacterium
AVELWKIVDRPNLFIKIPATKAGLPAITAV

SEQ ID NO: 925145 - protein, 29 aa, Mycobacterium
AVELWKIVDRPNLLIKIPATKAGLPAIAA

SEQ ID NO: 925146 - protein, 19 aa, Mycobacterium
AVEPIIWRTYEASLPADAV

SEQ ID NO: 925147 - protein, 22 aa, Mycobacterium
AVEPSVIVLLNLSRDQLDRVGE

SEQ ID NO: 925148 - protein, 20 aa, Mycobacterium
AVEPSVVVLLNLSRDQLDRV

SEQ ID NO: 925149 - protein, 25 aa, Mycobacterium
AVESPEPPGFLLLGPDALALYRYIA

SEQ ID NO: 925150 - protein, 17 aa, Mycobacterium
AVFCANDLLAIGVLQAL

SEQ ID NO: 925151 - protein, 25 aa, Mycobacterium
AVFLRKYRRQWDIHRHRMPPQSAAQ

SEQ ID NO: 925152 - protein, 19 aa, Mycobacterium
AVFNIPWVSELHGPLNMEA

SEQ ID NO: 925153 - protein, 27 aa, Mycobacterium
AVFVLDSWLRPVPPGVAGEVYVAGGGV

SEQ ID NO: 925154 - protein, 23 aa, Mycobacterium
AVGAELFLRHLAGSKVASAVACE

SEQ ID NO: 925155 - protein, 18 aa, Mycobacterium
AVGATVVLMSRFRPESFA

SEQ ID NO: 925156 - protein, 17 aa, Mycobacterium
AVGELTPSVAALAALAA

SEQ ID NO: 925157 - protein, 25 aa, Mycobacterium
AVGGNGGAGGWLFGNGGAGGAGGAT

SEQ ID NO: 925158 - protein, 24 aa, Mycobacterium
AVGHGRNGFLLAPWTAERVAAELE

SEQ ID NO: 925159 - protein, 25 aa, Mycobacterium
AVGPDGTAYIGTWEGSNAYGDLLNG

SEQ ID NO: 925160 - protein, 17 aa, Mycobacterium
AVGPTYMLNMAFPADYP

SEQ ID NO: 925161 - protein, 25 aa, Mycobacterium
AVGTDFGAAIYAEYRLARSVRTAAN

SEQ ID NO: 925162 - protein, 31 aa, Mycobacterium
AVGVDFGASIYAEYRLSTSVRKAANLGSDPF

SEQ ID NO: 925163 - protein, 20 aa, Mycobacterium
AVGVPVVAPLPVGMSCTDHP

SEQ ID NO: 925164 - protein, 26 aa, Mycobacterium
AVGYARRSALTASRFVACPFGTPGQR

SEQ ID NO: 925165 - protein, 17 aa, Mycobacterium
AVHRVDAARVFRLALED

SEQ ID NO: 925166 - protein, 26 aa, Mycobacterium
AVIAERELQTWIDWLVRNGGLEEGKL

SEQ ID NO: 925167 - protein, 18 aa, Mycobacterium
AVILELTALGGRQAVAEL

SEQ ID NO: 925168 - protein, 17 aa, Mycobacterium
AVINLGPNFTYALLNGA

SEQ ID NO: 925169 - protein, 22 aa, Mycobacterium
AVIPRQRTAVPVEWDDVRAQLA

SEQ ID NO: 925170 - protein, 17 aa, Mycobacterium
AVIRLNGVFPGPGLPKP

SEQ ID NO: 925171 - protein, 24 aa, Mycobacterium
AVIVCPLGFVADHIEVVWDLDNEL

SEQ ID NO: 925172 - protein, 24 aa, Mycobacterium
AVKVRGGVVLGEFATLVDPERSIP

SEQ ID NO: 925173 - protein, 22 aa, Mycobacterium
AVLALGIAVFALIRTFDAEPDY

SEQ ID NO: 925174 - protein, 26 aa, Mycobacterium
AVLALPSRMLAVLDVSGSMKFSAGPT

SEQ ID NO: 925175 - protein, 23 aa, Mycobacterium
AVLDAPWAPFVVDFNLANIGGPS

SEQ ID NO: 925176 - protein, 17 aa, Mycobacterium
AVLFALTLLTASCTRVV

SEQ ID NO: 925177 - protein, 19 aa, Mycobacterium
AVLGRPLIGNGANGAPGTG

SEQ ID NO: 925178 - protein, 19 aa, Mycobacterium
AVLKAGAAYLPIDPDHPRS

SEQ ID NO: 925179 - protein, 18 aa, Mycobacterium
AVLLAFPLVPKAAAACPD

SEQ ID NO: 925180 - protein, 29 aa, Mycobacterium
AVLLAKIRPGFLARKGYEPTGAPSTVPSA

SEQ ID NO: 925181 - protein, 17 aa, Mycobacterium
AVLLGGTALACAPANAD

SEQ ID NO: 925182 - protein, 25 aa, Mycobacterium
AVLPDMRARRSGAIVNISSIAVALT

SEQ ID NO: 925183 - protein, 24 aa, Mycobacterium
AVLPHMRAQGWGRILAIGSSGVQA

SEQ ID NO: 925184 - protein, 20 aa, Mycobacterium
AVLRLCRPSQIVHLAAETGT

SEQ ID NO: 925185 - protein, 17 aa, Mycobacterium
AVLRNWRTAAVDDRVRA

SEQ ID NO: 925186 - protein, 19 aa, Mycobacterium
AVLSGCGGHPAHPHASAVV

SEQ ID NO: 925187 - protein, 23 aa, Mycobacterium
AVLTAPWAPFVVDFNLANVGGPS

SEQ ID NO: 925188 - protein, 26 aa, Mycobacterium
AVLTEADFPSGVVFERITRDPADGDD

SEQ ID NO: 925189 - protein, 22 aa, Mycobacterium
AVLTEFPPLIKHFADTRDLFGD

SEQ ID NO: 925190 - protein, 20 aa, Mycobacterium
AVLTQVRPGAVVLLHDTVAA

SEQ ID NO: 925191 - protein, 21 aa, Mycobacterium
AVMTAMSWLALGRDLDEWPEP

SEQ ID NO: 925192 - protein, 29 aa, Mycobacterium
AVMTFAKPYAEWRGMFAGNGMLLPKSMTA

SEQ ID NO: 925193 - protein, 25 aa, Mycobacterium
AVMVPRLPPSQARVLLMAALAAGLP

SEQ ID NO: 925194 - protein, 24 aa, Mycobacterium
AVNKMKNWISSFGPQIDGVVAQND

SEQ ID NO: 925195 - protein, 25 aa, Mycobacterium
AVNNLTWLPPAPMNNTYAFAIREAE

SEQ ID NO: 925196 - protein, 32 aa, Mycobacterium
AVNRPTPDRVRELFVAWGKLYPQFGTVAALNM

SEQ ID NO: 925197 - protein, 26 aa, Mycobacterium
AVPAGPAAGRVCVTAVTASPGQPAGP

SEQ ID NO: 925198 - protein, 25 aa, Mycobacterium
AVPEGKKGFAQLILRSGDTPVRGRA

SEQ ID NO: 925199 - protein, 17 aa, Mycobacterium
AVPELPAAAAAPAAAAP

SEQ ID NO: 925200 - protein, 18 aa, Mycobacterium
AVPEPGWSKIIPAFTATD

SEQ ID NO: 925201 - protein, 30 aa, Mycobacterium
AVPFPKECPAPGVMQGCLDSTSGLIMGADS

SEQ ID NO: 925202 - protein, 21 aa, Mycobacterium
AVPMPALGLMLGHIRAAAANC

SEQ ID NO: 925203 - protein, 25 aa, Mycobacterium
AVPMWPEMPMSMGMAAWQEEDGRQV

SEQ ID NO: 925204 - protein, 17 aa, Mycobacterium
AVPPLLGYLNDGKLPGT

SEQ ID NO: 925205 - protein, 24 aa, Mycobacterium
AVPPSRYPFHGVHQSGILVPPPAE

SEQ ID NO: 925206 - protein, 18 aa, Mycobacterium
AVPVSGAFTTLVPTAKVN

SEQ ID NO: 925207 - protein, 17 aa, Mycobacterium
AVQFAKAVCESMGNGEY

SEQ ID NO: 925208 - protein, 24 aa, Mycobacterium
AVQTARPDLVFAGWNYGFSETSGL

SEQ ID NO: 925209 - protein, 21 aa, Mycobacterium
AVQVLRRLQHRVGDRLVLISV

SEQ ID NO: 925210 - protein, 22 aa, Mycobacterium
AVRAREAGVDMLAVQAAAAGGH

SEQ ID NO: 925211 - protein, 18 aa, Mycobacterium
AVRARRGAEVWHVAPDPE

SEQ ID NO: 925212 - protein, 26 aa, Mycobacterium
AVREAVLALRARKGMVLDPADHDTWS

SEQ ID NO: 925213 - protein, 26 aa, Mycobacterium
AVRGDLQMRWRIEGYNSPPRPSGTGR

SEQ ID NO: 925214 - protein, 18 aa, Mycobacterium
AVRLLEWLQASHPTPEVA

SEQ ID NO: 925215 - protein, 25 aa, Mycobacterium
AVRPEPFGALLYHFGTRKLSFLKNR

SEQ ID NO: 925216 - protein, 25 aa, Mycobacterium
AVRTFARRRIDTILGDLTIGAPQDD

SEQ ID NO: 925217 - protein, 20 aa, Mycobacterium
AVRTHFFDSYFIDAVAAGIR

SEQ ID NO: 925218 - protein, 17 aa, Mycobacterium
AVRTSLYSDSQFQAKYP

SEQ ID NO: 925219 - protein, 19 aa, Mycobacterium
AVSACGWSPPAPAPTSTAA

SEQ ID NO: 925220 - protein, 30 aa, Mycobacterium
AVSAEAVAFHGRFVQALTGGVQMYAAAETA

SEQ ID NO: 925221 - protein, 24 aa, Mycobacterium
AVSDALRPLILVVREARMAAASAI

SEQ ID NO: 925222 - protein, 23 aa, Mycobacterium
AVSGPKLTAPVTENVTFVNQGGW

SEQ ID NO: 925223 - protein, 18 aa, Mycobacterium
AVSLRLAAALSPVTKIDP

SEQ ID NO: 925224 - protein, 23 aa, Mycobacterium
AVSLSWRTGDDIVVSRTDPEHPV

SEQ ID NO: 925225 - protein, 22 aa, Mycobacterium
AVSPSVIVLLNLSRDQLDRVGE

SEQ ID NO: 925226 - protein, 18 aa, Mycobacterium
AVSSRYPGPISDLQLSRD

SEQ ID NO: 925227 - protein, 20 aa, Mycobacterium
AVSTTRLMAAAGDEVSAAIA

SEQ ID NO: 925228 - protein, 18 aa, Mycobacterium
AVTECERLGLGDWLDSRV

SEQ ID NO: 925229 - protein, 25 aa, Mycobacterium
AVTGAPVFHCEVYVDGALATQADGE

SEQ ID NO: 925230 - protein, 19 aa, Mycobacterium
AVTKGLKDTTAFINDPITP

SEQ ID NO: 925231 - protein, 19 aa, Mycobacterium
AVTLCLATRPFVESHVHRR

SEQ ID NO: 925232 - protein, 34 aa, Mycobacterium
AVTNWFGDQPFAVWPWAQPKLGAAQPVVLNLDNG

SEQ ID NO: 925233 - protein, 19 aa, Mycobacterium
AVTRARFQALDLRVDTKPD

SEQ ID NO: 925234 - protein, 20 aa, Mycobacterium
AVTRGSAWDALAQCEAGGNW

SEQ ID NO: 925235 - protein, 21 aa, Mycobacterium
AVTVLPGFTGQLLVALDPGAS

SEQ ID NO: 925236 - protein, 20 aa, Mycobacterium
AVTYPAHWASPVVEALGTAL

SEQ ID NO: 925237 - protein, 25 aa, Mycobacterium
AVVAFLVVGCVRWSTQTQTQPQPAT

SEQ ID NO: 925238 - protein, 17 aa, Mycobacterium
AVVALLLARSVPATVAI

SEQ ID NO: 925239 - protein, 18 aa, Mycobacterium
AVVAQAFASLAILGPGRV

SEQ ID NO: 925240 - protein, 20 aa, Mycobacterium
AVVDPRCRVYGIDNLWVIDG

SEQ ID NO: 925241 - protein, 17 aa, Mycobacterium
AVVGRSGTFEGLIPRLA

SEQ ID NO: 925242 - protein, 17 aa, Mycobacterium
AVVKANFDQHGFGDESL

SEQ ID NO: 925243 - protein, 18 aa, Mycobacterium
AVVKFRDNALWGATNAVR

SEQ ID NO: 925244 - protein, 24 aa, Mycobacterium
AVVLVDRGTCPFAQKEDAAAQRGA

SEQ ID NO: 925245 - protein, 21 aa, Mycobacterium
AVVMCVIVGGCGRTDDQAQHT

SEQ ID NO: 925246 - protein, 18 aa, Mycobacterium
AVVPAMDYRIPPPVESQY

SEQ ID NO: 925247 - protein, 26 aa, Mycobacterium
AVVPGWYRMMALLARAFIAMAQDEPE

SEQ ID NO: 925248 - protein, 25 aa, Mycobacterium
AVVSFPPTQWIRWRKPVIGAPTTPK

SEQ ID NO: 925249 - protein, 24 aa, Mycobacterium
AVVSPPYYRLVLGMPPLDDRAIDG

SEQ ID NO: 925250 - protein, 19 aa, Mycobacterium
AWDGTKWVEHFDFQWDCYL

SEQ ID NO: 925251 - protein, 17 aa, Mycobacterium
AWDLARLGWALHGPTAT

SEQ ID NO: 925252 - protein, 26 aa, Mycobacterium
AWEDAFAMTVSDGFGGTATQTVKVPI

SEQ ID NO: 925253 - protein, 26 aa, Mycobacterium
AWFSTPRGLNCAIWIDGSFGCNGSFP

SEQ ID NO: 925254 - protein, 25 aa, Mycobacterium
AWHRLTAAMRPDWTRTVAARRAAAA

SEQ ID NO: 925255 - protein, 17 aa, Mycobacterium
AWLRADPMLNINRLVAN

SEQ ID NO: 925256 - protein, 24 aa, Mycobacterium
AWLYSQRRFEVPSDQIANTMKLAI

SEQ ID NO: 925257 - protein, 20 aa, Mycobacterium
AWNDHLKKFVMLYTNTTSSV

SEQ ID NO: 925258 - protein, 23 aa, Mycobacterium
AWQLRALFAAGLSAMYAAEVPAY

SEQ ID NO: 925259 - protein, 18 aa, Mycobacterium
AWQTRSWSKGKIHPAAVL

SEQ ID NO: 925260 - protein, 17 aa, Mycobacterium
AWRYGRTLAGVVAAVAV

SEQ ID NO: 925261 - protein, 17 aa, Mycobacterium
AWSAEGLLVYLPEDAQD

SEQ ID NO: 925262 - protein, 24 aa, Mycobacterium
AWSFGPGLWKAWRQPTAEVLRSAV

SEQ ID NO: 925263 - protein, 25 aa, Mycobacterium
AWYPGMEAFLGVAVHGFPNYFFLCG

SEQ ID NO: 925264 - protein, 18 aa, Mycobacterium
AYDFKGTQPLATKELQPP

SEQ ID NO: 925265 - protein, 21 aa, Mycobacterium
AYFRVTRPVTLTFEVEGSDNA

SEQ ID NO: 925266 - protein, 19 aa, Mycobacterium
AYFSFEVLENVFDTLVEPD

SEQ ID NO: 925267 - protein, 20 aa, Mycobacterium
AYGTGPRYGFKPIVMPKQVV

SEQ ID NO: 925268 - protein, 23 aa, Mycobacterium
AYGTPEFDARIEAAGELTGEQRQ

SEQ ID NO: 925269 - protein, 23 aa, Mycobacterium
AYHPDRFIYAGSMSGFLNPSEGW

SEQ ID NO: 925270 - protein, 18 aa, Mycobacterium
AYIASTFGLIGADQELAK

SEQ ID NO: 925271 - protein, 17 aa, Mycobacterium
AYKAWALTPDELIIYMP

SEQ ID NO: 925272 - protein, 18 aa, Mycobacterium
AYLAGHLPGAVYVSLEEE

SEQ ID NO: 925273 - protein, 18 aa, Mycobacterium
AYLFTRPAVNEFFTSLFA

SEQ ID NO: 925274 - protein, 26 aa, Mycobacterium
AYNTLRSAGILPDLSVPISSVTNMLL

SEQ ID NO: 925275 - protein, 25 aa, Mycobacterium
AYPDKRWGTSEADAPPSFGAGSSAL

SEQ ID NO: 925276 - protein, 17 aa, Mycobacterium
AYPGCGVSWNLLAGIGR

SEQ ID NO: 925277 - protein, 27 aa, Mycobacterium
AYPLFVWCVAQLPGLREHAEGSILTAD

SEQ ID NO: 925278 - protein, 17 aa, Mycobacterium
AYPLVLATYEIVCSKGS

SEQ ID NO: 925279 - protein, 17 aa, Mycobacterium
AYPLVLATYEIVCSKGY

SEQ ID NO: 925280 - protein, 24 aa, Mycobacterium
AYQFPMGLGLVSQFFGRYFSPAEA

SEQ ID NO: 925281 - protein, 24 aa, Mycobacterium
AYQGEFALPPSFMFTGDQTAGPRP

SEQ ID NO: 925282 - protein, 19 aa, Mycobacterium
AYQKVPYNAGFRPFSHGGF

SEQ ID NO: 925283 - protein, 21 aa, Mycobacterium
AYRGAEFRPAGPADDYAQLVV

SEQ ID NO: 925284 - protein, 19 aa, Mycobacterium
AYRNGNFPEQFNVTNIAPA

SEQ ID NO: 925285 - protein, 17 aa, Mycobacterium
AYRRVLRDYVIGVISQF

SEQ ID NO: 925286 - protein, 18 aa, Mycobacterium
AYRSSFHNAAREVLSGVT

SEQ ID NO: 925287 - protein, 25 aa, Mycobacterium
AYSEPRLQPPPGFKDTTVPGIWAPD

SEQ ID NO: 925288 - protein, 20 aa, Mycobacterium
AYSGDGSWGRASHYPTRAAA

SEQ ID NO: 925289 - protein, 23 aa, Mycobacterium
AYSGPCPPPGTGTHHYRFTLYQL

SEQ ID NO: 925290 - protein, 19 aa, Mycobacterium
AYSLLISRYMVARQHERGL

SEQ ID NO: 925291 - protein, 25 aa, Mycobacterium
AYSQGARVSAAWIREHGGTEGVPTA

SEQ ID NO: 925292 - protein, 19 aa, Mycobacterium
AYSSNGSWGRSWAYPTKAA

SEQ ID NO: 925293 - protein, 19 aa, Mycobacterium
AYSSVGWDTLRYTNMVTAA

SEQ ID NO: 925294 - protein, 21 aa, Mycobacterium
AYTGIVALFARLAREGQSLEV

SEQ ID NO: 925295 - protein, 17 aa, Mycobacterium
AYVGYGEIVRWFKQAAD

SEQ ID NO: 925296 - protein, 19 aa, Mycobacterium
AYWLSRYGFDVTVVERAPQ

SEQ ID NO: 925297 - protein, 21 aa, Mycobacterium
CAAAADLVLIGRFYERFADHA

SEQ ID NO: 925298 - protein, 18 aa, Mycobacterium
CAAGDVFPAQLEMSTDKQ

SEQ ID NO: 925299 - protein, 21 aa, Mycobacterium
CAALTRLPSGVLGRVAYQVLA

SEQ ID NO: 925300 - protein, 19 aa, Mycobacterium
CAAPAKFSVAELVQPWLDR

SEQ ID NO: 925301 - protein, 30 aa, Mycobacterium
CAELGLPEMPAEFVPPMIVGDVGANPAQYG

SEQ ID NO: 925302 - protein, 22 aa, Mycobacterium
CAGQIPSWEPLPIQYIDFALWQ

SEQ ID NO: 925303 - protein, 20 aa, Mycobacterium
CAIERGDPLFARQMEQEDGR

SEQ ID NO: 925304 - protein, 17 aa, Mycobacterium
CALLAGCSLDFGPTDVE

SEQ ID NO: 925305 - protein, 19 aa, Mycobacterium
CALVLVTSGCARFNDAQSQ

SEQ ID NO: 925306 - protein, 19 aa, Mycobacterium
CANDLLAIGVLQALSLTGD

SEQ ID NO: 925307 - protein, 20 aa, Mycobacterium
CANRMGLDFLANAGTASAAR

SEQ ID NO: 925308 - protein, 17 aa, Mycobacterium
CAPNFVEVLAELPDSQR

SEQ ID NO: 925309 - protein, 19 aa, Mycobacterium
CATLDRYPTLAGVDGLLDA

SEQ ID NO: 925310 - protein, 21 aa, Mycobacterium
CATNGLASLPLPAPGIGGGGY

SEQ ID NO: 925311 - protein, 18 aa, Mycobacterium
CAVATVLLALAGIPSCGR

SEQ ID NO: 925312 - protein, 17 aa, Mycobacterium
CAVVAGEAPAIRIYEDD

SEQ ID NO: 925313 - protein, 27 aa, Mycobacterium
CCASGVPWKLLQRSAVHAVSVDVDTLS

SEQ ID NO: 925314 - protein, 17 aa, Mycobacterium
CDAPDWLDAALGNAPQG

SEQ ID NO: 925315 - protein, 23 aa, Mycobacterium
CDDAFCTPGIRPAVVLGAPCADT

SEQ ID NO: 925316 - protein, 25 aa, Mycobacterium
CDDHGTAYLAARGGYLVVDLSAGRI

SEQ ID NO: 925317 - protein, 20 aa, Mycobacterium
CDHFLPAHTLTGLRELFDVL

SEQ ID NO: 925318 - protein, 24 aa, Mycobacterium
CDIPSLLYSYSFEPNPDWSRAYSG

SEQ ID NO: 925319 - protein, 19 aa, Mycobacterium
CDIPSLLYSYSFEQNPQWS

SEQ ID NO: 925320 - protein, 25 aa, Mycobacterium
CDLSIRWNGLQAGGPVRTVRIWQQP

SEQ ID NO: 925321 - protein, 19 aa, Mycobacterium
CDNPAGITDQMFKVQLWDF

SEQ ID NO: 925322 - protein, 17 aa, Mycobacterium
CDPACRAFDLNGIVTDN

SEQ ID NO: 925323 - protein, 19 aa, Mycobacterium
CDPPPGFGYTREGTYKGFP

SEQ ID NO: 925324 - protein, 24 aa, Mycobacterium
CDPPTEGGWAWLPDEAQGSRVHWR

SEQ ID NO: 925325 - protein, 25 aa, Mycobacterium
CDSGPGWNGCGGWNPVQGGWGHGCI

SEQ ID NO: 925326 - protein, 24 aa, Mycobacterium
CDVPSLLYSYSFVKNPAWSRTYSP

SEQ ID NO: 925327 - protein, 17 aa, Mycobacterium
CDVPTSLYSFSFAPSAK

SEQ ID NO: 925328 - protein, 22 aa, Mycobacterium
CDYPACTPGIMPHQVLGAPCDN

SEQ ID NO: 925329 - protein, 25 aa, Mycobacterium
CEDIPFDVVQRLGLGFTPPEHEDGL

SEQ ID NO: 925330 - protein, 17 aa, Mycobacterium
CEKAGATAIPFELDVAD

SEQ ID NO: 925331 - protein, 26 aa, Mycobacterium
CELPARLAKLFAHSAVVPRVVLVDHN

SEQ ID NO: 925332 - protein, 24 aa, Mycobacterium
CEMPSRLRALFVGRSVTPQVVLVD

SEQ ID NO: 925333 - protein, 23 aa, Mycobacterium
CENDMYLVLGGGVGGQAPPADVA

SEQ ID NO: 925334 - protein, 18 aa, Mycobacterium
CEVFPGLINAGGTLISLF

SEQ ID NO: 925335 - protein, 23 aa, Mycobacterium
CGAACGEPGWLLRVAGDTIGNDA

SEQ ID NO: 925336 - protein, 17 aa, Mycobacterium
CGAALALSACSFSIGGL

SEQ ID NO: 925337 - protein, 24 aa, Mycobacterium
CGAARLAGGALFWTDFIYDDHGAT

SEQ ID NO: 925338 - protein, 17 aa, Mycobacterium
CGAASGLPIGWYSHPAQ

SEQ ID NO: 925339 - protein, 17 aa, Mycobacterium
CGAEPTVSLSVAFAKSC

SEQ ID NO: 925340 - protein, 33 aa, Mycobacterium
CGAGSLPVPLWWAKICDAWWCTDTSLPSNARDQ

SEQ ID NO: 925341 - protein, 18 aa, Mycobacterium
CGAIAGFGNGWFLVDGVP

SEQ ID NO: 925342 - protein, 20 aa, Mycobacterium
CGAMAIELLAACPQLTILAT

SEQ ID NO: 925343 - protein, 25 aa, Mycobacterium
CGDLDRVTLFRAWYSRRNFGRLAGS

SEQ ID NO: 925344 - protein, 23 aa, Mycobacterium
CGDSGQSPTTWRQGSAGATAGQV

SEQ ID NO: 925345 - protein, 19 aa, Mycobacterium
CGESPRAGAALSQKTKKIT

SEQ ID NO: 925346 - protein, 18 aa, Mycobacterium
CGFDHPDIATAVRTSLGA

SEQ ID NO: 925347 - protein, 18 aa, Mycobacterium
CGFPESVPGIVMTNMAAN

SEQ ID NO: 925348 - protein, 29 aa, Mycobacterium
CGGCGAASTRWCPRCAAELTVRDDEPHLV

SEQ ID NO: 925349 - protein, 28 aa, Mycobacterium
CGGNEAWNLPVVFGPIALAYNLPGVDKL

SEQ ID NO: 925350 - protein, 27 aa, Mycobacterium
CGGNPAWNLPLVFGPVAMAYNLEGVDK

SEQ ID NO: 925351 - protein, 17 aa, Mycobacterium
CGIHPVVVHGGGPQISA

SEQ ID NO: 925352 - protein, 21 aa, Mycobacterium
CGKNGCLTYNWETFLTQELPA

SEQ ID NO: 925353 - protein, 42 aa, Mycobacterium
CGLNTFALVNAAYCKPDRTIGWDRGVLLPSLRKQNGDMGVVM

SEQ ID NO: 925354 - protein, 25 aa, Mycobacterium
CGMITRGVSGLQLLTDIRDNNPALT

SEQ ID NO: 925355 - protein, 18 aa, Mycobacterium
CGPGDSLLIAWLLTFHYR

SEQ ID NO: 925356 - protein, 18 aa, Mycobacterium
CGPHHIVGTAITLEEGPR

SEQ ID NO: 925357 - protein, 19 aa, Mycobacterium
CGQDFLALVDYAHKPGALR

SEQ ID NO: 925358 - protein, 22 aa, Mycobacterium
CGRAAWVVGVASFFPVVRTASI

SEQ ID NO: 925359 - protein, 20 aa, Mycobacterium
CGSVPSGLVITFFTPATDSA

SEQ ID NO: 925360 - protein, 17 aa, Mycobacterium
CGVEPTVSLKRAFALSC

SEQ ID NO: 925361 - protein, 32 aa, Mycobacterium
CGVGALWPTQHRRYITVTAQFDSAAGLYPGST

SEQ ID NO: 925362 - protein, 21 aa, Mycobacterium
CGVIGTALWLDGRLHHVDALK

SEQ ID NO: 925363 - protein, 18 aa, Mycobacterium
CHDWPDRALRVTAIDVST

SEQ ID NO: 925364 - protein, 17 aa, Mycobacterium
CHLALRARAGWLRWQDE

SEQ ID NO: 925365 - protein, 24 aa, Mycobacterium
CHLTDRPAFRAALIRTAGNQHRFV

SEQ ID NO: 925366 - protein, 23 aa, Mycobacterium
CHRAQGFLLSRPVPGNAMEALLS

SEQ ID NO: 925367 - protein, 27 aa, Mycobacterium
CHSTGFDFSVWEIWSALLHGGRLVVVP

SEQ ID NO: 925368 - protein, 22 aa, Mycobacterium
CIDRSAPLWTVKVGQLGTPGEH

SEQ ID NO: 925369 - protein, 19 aa, Mycobacterium
CINLSLGDAESYFRTAIYG

SEQ ID NO: 925370 - protein, 17 aa, Mycobacterium
CINLSPENARWFYEQFG

SEQ ID NO: 925371 - protein, 19 aa, Mycobacterium
CINLSPTNAKWFYDNFGSG

SEQ ID NO: 925372 - protein, 23 aa, Mycobacterium
CIVTNAWNAPTFEHTGGVVMVSL

SEQ ID NO: 925373 - protein, 18 aa, Mycobacterium
CKRQIMAGHFYRSVQQPG

SEQ ID NO: 925374 - protein, 25 aa, Mycobacterium
CLAEAGWPVQVWTAAMPQDTTSAVA

SEQ ID NO: 925375 - protein, 19 aa, Mycobacterium
CLAPGGAGCVIAEDHGAGE

SEQ ID NO: 925376 - protein, 18 aa, Mycobacterium
CLATRPFVESHVHRRVAN

SEQ ID NO: 925377 - protein, 19 aa, Mycobacterium
CLDIGSAAEVLGWRPKVEL

SEQ ID NO: 925378 - protein, 26 aa, Mycobacterium
CLSERGSWRIDWRLPLAAVCTHHGTF

SEQ ID NO: 925379 - protein, 23 aa, Mycobacterium
CLTDGCWPAWWLLNDNPERGGEI

SEQ ID NO: 925380 - protein, 22 aa, Mycobacterium
CLWGGLALLLSCCGRPTSQAPS

SEQ ID NO: 925381 - protein, 17 aa, Mycobacterium
CMGLPHIGFGQRSKYLV

SEQ ID NO: 925382 - protein, 18 aa, Mycobacterium
CMLVGAKIALDTGYLDAT

SEQ ID NO: 925383 - protein, 17 aa, Mycobacterium
CMVTFKTSYGVIQQSLY

SEQ ID NO: 925384 - protein, 20 aa, Mycobacterium
CNCVGIKPGRTYTARQLLDG

SEQ ID NO: 925385 - protein, 25 aa, Mycobacterium
CNDIPIDVIERIGLAWTPPMPEDGL

SEQ ID NO: 925386 - protein, 18 aa, Mycobacterium
CNEKIKFAALADRAVALG

SEQ ID NO: 925387 - protein, 22 aa, Mycobacterium
CNLTELELQWGRTIGQLPSPCT

SEQ ID NO: 925388 - protein, 18 aa, Mycobacterium
CNNWSDIGLDEVYADPDL

SEQ ID NO: 925389 - protein, 19 aa, Mycobacterium
CPAAPFEAAFLMAAQLGDR

SEQ ID NO: 925390 - protein, 19 aa, Mycobacterium
CPACAVGLVICGGDVNGVT

SEQ ID NO: 925391 - protein, 21 aa, Mycobacterium
CPAMCDRIPNTAWIDQRAVPL

SEQ ID NO: 925392 - protein, 20 aa, Mycobacterium
CPANARFYSDLTIAYPHDVP

SEQ ID NO: 925393 - protein, 24 aa, Mycobacterium
CPCAPPDPRDCVCGAAERRRYRTK

SEQ ID NO: 925394 - protein, 18 aa, Mycobacterium
CPDCGTKGQWTEPREFNM

SEQ ID NO: 925395 - protein, 19 aa, Mycobacterium
CPDVEVVFARGTFEPPGVG

SEQ ID NO: 925396 - protein, 18 aa, Mycobacterium
CPDVLPTVRAFLGGGSAT

SEQ ID NO: 925397 - protein, 18 aa, Mycobacterium
CPEPNFPGVPQAELGANY

SEQ ID NO: 925398 - protein, 26 aa, Mycobacterium
CPGEAAYRLIPRLRDIAAGAANGEPP

SEQ ID NO: 925399 - protein, 18 aa, Mycobacterium
CPGPITTVRYEWKGDHVA

SEQ ID NO: 925400 - protein, 21 aa, Mycobacterium
CPQVEVVFARGRFESPGPGVL

SEQ ID NO: 925401 - protein, 25 aa, Mycobacterium
CQIVTWRCWAEELGIAVDDITAHAE

SEQ ID NO: 925402 - protein, 17 aa, Mycobacterium
CQLNINGFFPGLNDLVP

SEQ ID NO: 925403 - protein, 24 aa, Mycobacterium
CQQGFCGTCKVKVLAGEVDRRGRA

SEQ ID NO: 925404 - protein, 17 aa, Mycobacterium
CQYAMQFIAVLRGYALP

SEQ ID NO: 925405 - protein, 19 aa, Mycobacterium
CRAAIAVVFVLVSVETPAL

SEQ ID NO: 925406 - protein, 19 aa, Mycobacterium
CRAAKAFLHCSSAAVYDPP

SEQ ID NO: 925407 - protein, 26 aa, Mycobacterium
CRASLREVRDPELRRALTPDYTPMCK

SEQ ID NO: 925408 - protein, 26 aa, Mycobacterium
CREYCDLESALALTSWLQPLWLSRGR

SEQ ID NO: 925409 - protein, 30 aa, Mycobacterium
CRHHNCWPRPGWGGGHGGGWGHGSWGGHGG

SEQ ID NO: 925410 - protein, 18 aa, Mycobacterium
CRIADQIVRAMRTTLGEC

SEQ ID NO: 925411 - protein, 17 aa, Mycobacterium
CRITVNGVVRAERTADA

SEQ ID NO: 925412 - protein, 18 aa, Mycobacterium
CRIVAADPGWYGDNRERI

SEQ ID NO: 925413 - protein, 17 aa, Mycobacterium
CRKTSPQSVMWVADLCD

SEQ ID NO: 925414 - protein, 19 aa, Mycobacterium
CRLDAEWRLGVAAVGVDLA

SEQ ID NO: 925415 - protein, 17 aa, Mycobacterium
CRLSTKHALALTNRGGA

SEQ ID NO: 925416 - protein, 17 aa, Mycobacterium
CRLYWVQIIPTIASEST

SEQ ID NO: 925417 - protein, 17 aa, Mycobacterium
CRNGRNFVAAAFAAGLV

SEQ ID NO: 925418 - protein, 17 aa, Mycobacterium
CRPARLDPAVPIEETVG

SEQ ID NO: 925419 - protein, 21 aa, Mycobacterium
CRRLDGMPLALELAAARVRSL

SEQ ID NO: 925420 - protein, 17 aa, Mycobacterium
CRRLFSRCGAYRAEGRI

SEQ ID NO: 925421 - protein, 21 aa, Mycobacterium
CRRTSPQSAMWAADLGDTSAA

SEQ ID NO: 925422 - protein, 17 aa, Mycobacterium
CRSAPGCTAVAFERDEQ

SEQ ID NO: 925423 - protein, 19 aa, Mycobacterium
CRVRRILIAALSAVLLVLV

SEQ ID NO: 925424 - protein, 23 aa, Mycobacterium
CSAAVKRYLGARFDPNSRFSVSM

SEQ ID NO: 925425 - protein, 19 aa, Mycobacterium
CSADEVFNPLGVYGKGPLA

SEQ ID NO: 925426 - protein, 18 aa, Mycobacterium
CSAVRPGAVLGILDLRRL

SEQ ID NO: 925427 - protein, 20 aa, Mycobacterium
CSFSIGGLDYDKLESGITEQ

SEQ ID NO: 925428 - protein, 17 aa, Mycobacterium
CSGHLSDIEHIVLFMQE

SEQ ID NO: 925429 - protein, 20 aa, Mycobacterium
CSLLPHLDGFSSYRRSNPGA

SEQ ID NO: 925430 - protein, 19 aa, Mycobacterium
CSQEQFLYGSHRTRTPGSI

SEQ ID NO: 925431 - protein, 19 aa, Mycobacterium
CSSPLRHCGEGDLYGGNEP

SEQ ID NO: 925432 - protein, 21 aa, Mycobacterium
CSSPLRHCSDGNLYGGNEPAR

SEQ ID NO: 925433 - protein, 20 aa, Mycobacterium
CTAERVAVCHLTDRPAFRAA

SEQ ID NO: 925434 - protein, 25 aa, Mycobacterium
CTDLPRVPFEKHPPFVITDVNANPA

SEQ ID NO: 925435 - protein, 21 aa, Mycobacterium
CTDPGRWGNWVLPADAMTTPP

SEQ ID NO: 925436 - protein, 24 aa, Mycobacterium
CTSELRIDPRLQLAAEWHTNDVLG

SEQ ID NO: 925437 - protein, 26 aa, Mycobacterium
CVAPGRAAWCSRRWARGTPVPRWSTR

SEQ ID NO: 925438 - protein, 27 aa, Mycobacterium
CVAVYRIMLADAIGYHSALRFGIEHGK

SEQ ID NO: 925439 - protein, 24 aa, Mycobacterium
CVDAPTPKDAASWVSADQRIRQAA

SEQ ID NO: 925440 - protein, 25 aa, Mycobacterium
CVDEGKPAIEIIPFDSQDAATNAVV

SEQ ID NO: 925441 - protein, 17 aa, Mycobacterium
CVDRSYLMAQTMLAELV

SEQ ID NO: 925442 - protein, 26 aa, Mycobacterium
CVELHPLLDRAGILGGFHTPSDGLAS

SEQ ID NO: 925443 - protein, 25 aa, Mycobacterium
CVFFESPRRLAACLRDAVEQLGGSR

SEQ ID NO: 925444 - protein, 20 aa, Mycobacterium
CVGALRANPFASTYRVTVKL

SEQ ID NO: 925445 - protein, 37 aa, Mycobacterium
CVGGCEPPIAVPYIAQFWPIPLPGWGGLEGAKWNVSV

SEQ ID NO: 925446 - protein, 18 aa, Mycobacterium
CVGLPKLPFNTAPPQLIA

SEQ ID NO: 925447 - protein, 20 aa, Mycobacterium
CVLALILATFWIVVIANSFK

SEQ ID NO: 925448 - protein, 34 aa, Mycobacterium
CVLPEAHDGLGWLAQRGYVPLGYKGDAAKTAATF

SEQ ID NO: 925449 - protein, 20 aa, Mycobacterium
CVNYPHRSAIRMSEELEVYG

SEQ ID NO: 925450 - protein, 19 aa, Mycobacterium
CVRILKTCRAALQDGGRIV

SEQ ID NO: 925451 - protein, 20 aa, Mycobacterium
CVTAGALGFGGTNCYLLNVN

SEQ ID NO: 925452 - protein, 17 aa, Mycobacterium
CVTRPGKRAPTVKMCES

SEQ ID NO: 925453 - protein, 25 aa, Mycobacterium
CVVTVCSVAACGSSDPFGTTGCDVN

SEQ ID NO: 925454 - protein, 17 aa, Mycobacterium
CWSVVSAIALVASGCTS

SEQ ID NO: 925455 - protein, 17 aa, Mycobacterium
CWVLPRLDAATPPAVQN

SEQ ID NO: 925456 - protein, 17 aa, Mycobacterium
CWVLPRLDVATPPAVQA

SEQ ID NO: 925457 - protein, 24 aa, Mycobacterium
DAAARKVLQCLVFDDPAAAALGKE

SEQ ID NO: 925458 - protein, 18 aa, Mycobacterium
DAAARRIDVPDPTATPDA

SEQ ID NO: 925459 - protein, 19 aa, Mycobacterium
DAAASLGWQAAPIPRNAPG

SEQ ID NO: 925460 - protein, 22 aa, Mycobacterium
DAAIRRGGPGAAIGLSEGSLVV

SEQ ID NO: 925461 - protein, 18 aa, Mycobacterium
DAALARTETRGCHHRSDH

SEQ ID NO: 925462 - protein, 18 aa, Mycobacterium
DAALMSWVRAAARGARRV

SEQ ID NO: 925463 - protein, 29 aa, Mycobacterium
DAALSAAGYLCWRGKDLATPRGWITALRA

SEQ ID NO: 925464 - protein, 29 aa, Mycobacterium
DAALSAAGYLCWRGKDLSKPRGWMEALRA

SEQ ID NO: 925465 - protein, 26 aa, Mycobacterium
DAANPSAWVPIHLVGAGIDLDTKTPS

SEQ ID NO: 925466 - protein, 24 aa, Mycobacterium
DAAPGRITAILALHDLINGGRPAH

SEQ ID NO: 925467 - protein, 24 aa, Mycobacterium
DAAPGRITTILALHDLINGGHPGQ

SEQ ID NO: 925468 - protein, 18 aa, Mycobacterium
DAARAAGFVDVRAVVPDA

SEQ ID NO: 925469 - protein, 19 aa, Mycobacterium
DAARAAGFVDVRTVVPDAV

SEQ ID NO: 925470 - protein, 19 aa, Mycobacterium
DAARAAGFVDVRTVVSDAI

SEQ ID NO: 925471 - protein, 17 aa, Mycobacterium
DAARARIKEAGFQVADQ

SEQ ID NO: 925472 - protein, 19 aa, Mycobacterium
DAARPGFPVLQIGMDTPQV

SEQ ID NO: 925473 - protein, 17 aa, Mycobacterium
DAARPTVLTTFTVLADI

SEQ ID NO: 925474 - protein, 21 aa, Mycobacterium
DAARRAFHRLVDRTVGCSGQT

SEQ ID NO: 925475 - protein, 18 aa, Mycobacterium
DAARRARALPRMFAALTR

SEQ ID NO: 925476 - protein, 19 aa, Mycobacterium
DAARRTLNRPGFGLTDSLH

SEQ ID NO: 925477 - protein, 17 aa, Mycobacterium
DAASISAQFLGTPYGAN

SEQ ID NO: 925478 - protein, 29 aa, Mycobacterium
DAATPFAAPPVWGGCAQWVADPARIPTAQ

SEQ ID NO: 925479 - protein, 22 aa, Mycobacterium
DAAVPPAAGVRLDCGNYDADLD

SEQ ID NO: 925480 - protein, 20 aa, Mycobacterium
DADFAAKIAYWTTPQTKCVD

SEQ ID NO: 925481 - protein, 31 aa, Mycobacterium
DADGAIWARYNVPWQPAWVFYRADGSSTFVN

SEQ ID NO: 925482 - protein, 31 aa, Mycobacterium
DADGSIWARYNVPWQPAWVFYRADGSSTFVN

SEQ ID NO: 925483 - protein, 24 aa, Mycobacterium
DADIVVCAAGFWGAQLARQVGLVL

SEQ ID NO: 925484 - protein, 20 aa, Mycobacterium
DADVPYTRIHEFRHFHPERD

SEQ ID NO: 925485 - protein, 20 aa, Mycobacterium
DADVPYTRIHEFRHFHTERD

SEQ ID NO: 925486 - protein, 18 aa, Mycobacterium
DAEARVVLARRFHNDAVR

SEQ ID NO: 925487 - protein, 19 aa, Mycobacterium
DAEIAEWNEKAGLNDIVDE

SEQ ID NO: 925488 - protein, 25 aa, Mycobacterium
DAELGTRWFADKAFWVKDGQNYLPF

SEQ ID NO: 925489 - protein, 24 aa, Mycobacterium
DAEPIVAVPPTLAVTGRLLPYLVG

SEQ ID NO: 925490 - protein, 17 aa, Mycobacterium
DAESTWKKLLDGQSGIR

SEQ ID NO: 925491 - protein, 27 aa, Mycobacterium
DAFGAECRRVGIADAHCVLPLAHKVTQ

SEQ ID NO: 925492 - protein, 17 aa, Mycobacterium
DAFPRGAGRMLAIMHAL

SEQ ID NO: 925493 - protein, 19 aa, Mycobacterium
DAFQRLGARLSKTVGAADQ

SEQ ID NO: 925494 - protein, 20 aa, Mycobacterium
DAFSLCCLNQIYTTDADSNF

SEQ ID NO: 925495 - protein, 24 aa, Mycobacterium
DAGAPPASFRAGYTDYLRTAEVFD

SEQ ID NO: 925496 - protein, 26 aa, Mycobacterium
DAGATLKYTWTWGEGRDFGYDTTATA

SEQ ID NO: 925497 - protein, 17 aa, Mycobacterium
DAGFRWDYDAMENIPWD

SEQ ID NO: 925498 - protein, 24 aa, Mycobacterium
DAGHSRWVPADVMAGRLNQVGIAK

SEQ ID NO: 925499 - protein, 24 aa, Mycobacterium
DAGNRGVSVARFAAAMAPHGSGTL

SEQ ID NO: 925500 - protein, 23 aa, Mycobacterium
DAGRDFRYEFVLPEPGTYWYHSH

SEQ ID NO: 925501 - protein, 19 aa, Mycobacterium
DAGRMLAIMHALDGTLASV

SEQ ID NO: 925502 - protein, 17 aa, Mycobacterium
DAGSALLIDRVVFVETR

SEQ ID NO: 925503 - protein, 25 aa, Mycobacterium
DAGTLPARHELLLSRGPYDYEGELA

SEQ ID NO: 925504 - protein, 31 aa, Mycobacterium
DAGVPIWGDVELAWRLDRSGRFGPPRQWLVV

SEQ ID NO: 925505 - protein, 23 aa, Mycobacterium
DAGWECNEILAALDNVDDLYFDV

SEQ ID NO: 925506 - protein, 24 aa, Mycobacterium
DAHEARAPLGYPALHHLTSPLRKA

SEQ ID NO: 925507 - protein, 23 aa, Mycobacterium
DAIARPRVPPELVNLYDRNLDAR

SEQ ID NO: 925508 - protein, 37 aa, Mycobacterium
DAIIVVPAWWKAFWYLERLSPALSMRAAKAMLRHARG

SEQ ID NO: 925509 - protein, 19 aa, Mycobacterium
DAIPVLGSFVTSQVTTNPG

SEQ ID NO: 925510 - protein, 19 aa, Mycobacterium
DAISLPMATIFVDADEWDA

SEQ ID NO: 925511 - protein, 19 aa, Mycobacterium
DAITVFLALVVVTSVSMVF

SEQ ID NO: 925512 - protein, 21 aa, Mycobacterium
DAKAAVCAAFETVRTGVATNT

SEQ ID NO: 925513 - protein, 18 aa, Mycobacterium
DAKGCLVGLINTQETINF

SEQ ID NO: 925514 - protein, 20 aa, Mycobacterium
DAKPSALLDHEARRLSEIDV

SEQ ID NO: 925515 - protein, 21 aa, Mycobacterium
DAKTGRRGPARTSYADRHVTL

SEQ ID NO: 925516 - protein, 31 aa, Mycobacterium
DALAHACSDAGYRLAFGWQRAFADRLDDVVG

SEQ ID NO: 925517 - protein, 17 aa, Mycobacterium
DALKACIKSGWRRATAG

SEQ ID NO: 925518 - protein, 21 aa, Mycobacterium
DALLFSFEPYRVAAYAEGPMQ

SEQ ID NO: 925519 - protein, 17 aa, Mycobacterium
DALNGWVDAARGVATAI

SEQ ID NO: 925520 - protein, 17 aa, Mycobacterium
DALREAMSLAASPSPPT

SEQ ID NO: 925521 - protein, 17 aa, Mycobacterium
DALRLWASGSEQLVPRD

SEQ ID NO: 925522 - protein, 22 aa, Mycobacterium
DALTGRELWQQGSTVPMVPAST

SEQ ID NO: 925523 - protein, 21 aa, Mycobacterium
DALYWCNPSGRALGTPPTTAT

SEQ ID NO: 925524 - protein, 28 aa, Mycobacterium
DAMQQGCGGPPCKGAVVALEPSTGKILA

SEQ ID NO: 925525 - protein, 35 aa, Mycobacterium
DANDLPFWDGHSMDITRMYNWECWIYGSDTTANAG

SEQ ID NO: 925526 - protein, 21 aa, Mycobacterium
DANGVPWSWSTEASCIKDGPD

SEQ ID NO: 925527 - protein, 20 aa, Mycobacterium
DANTIAAAWNDVVLSPDTSL

SEQ ID NO: 925528 - protein, 22 aa, Mycobacterium
DAPAAAVWPWLVQMGQDRGGFY

SEQ ID NO: 925529 - protein, 36 aa, Mycobacterium
DAPDARVRTTASWFGPEVYGTVVARDQDRDGLTFTA

SEQ ID NO: 925530 - protein, 18 aa, Mycobacterium
DAPFMRDVGGEFGHADGE

SEQ ID NO: 925531 - protein, 26 aa, Mycobacterium
DAPHPAAARLWQEFLYSDEGQNLYAQ

SEQ ID NO: 925532 - protein, 23 aa, Mycobacterium
DAPIVGPLIRRSMVVIRYTGRRS

SEQ ID NO: 925533 - protein, 21 aa, Mycobacterium
DAPLDDWAWTLGINLWGPIHG

SEQ ID NO: 925534 - protein, 19 aa, Mycobacterium
DAPLTLVFVHGFCLRMGAF

SEQ ID NO: 925535 - protein, 19 aa, Mycobacterium
DAPPAQWMPPNTAFACQYA

SEQ ID NO: 925536 - protein, 18 aa, Mycobacterium
DAPPSLLAAGGLPYFLGG

SEQ ID NO: 925537 - protein, 19 aa, Mycobacterium
DAPWAPFDIEFNLANIGGP

SEQ ID NO: 925538 - protein, 18 aa, Mycobacterium
DAPWVFETTLADPQWAIF

SEQ ID NO: 925539 - protein, 24 aa, Mycobacterium
DAQFLAVVAELGLRFDTPQEATEA

SEQ ID NO: 925540 - protein, 20 aa, Mycobacterium
DAQPSWSLDGDTLVLKTDNA

SEQ ID NO: 925541 - protein, 29 aa, Mycobacterium
DAQRLFASFVKQWQRCEGTTITMYTHDSS

SEQ ID NO: 925542 - protein, 18 aa, Mycobacterium
DAQVGIAVRAFLQSVIDA

SEQ ID NO: 925543 - protein, 21 aa, Mycobacterium
DARFNISRVALLTVALTARPD

SEQ ID NO: 925544 - protein, 19 aa, Mycobacterium
DARFNLSRAALLVVALSER

SEQ ID NO: 925545 - protein, 18 aa, Mycobacterium
DARFRLGGGWIETWACNN

SEQ ID NO: 925546 - protein, 20 aa, Mycobacterium
DARMCLRDPAPLFRTNVEGL

SEQ ID NO: 925547 - protein, 21 aa, Mycobacterium
DARPELAYTAGDVVQLDAQLG

SEQ ID NO: 925548 - protein, 23 aa, Mycobacterium
DARRVADILGIPFYVWDFADRFK

SEQ ID NO: 925549 - protein, 19 aa, Mycobacterium
DARTRAALRTTLQDKRFGE

SEQ ID NO: 925550 - protein, 20 aa, Mycobacterium
DASAARRCADRGLPRRDRVL

SEQ ID NO: 925551 - protein, 26 aa, Mycobacterium
DASAVPTARCGTVAVPVDYADPGGAQ

SEQ ID NO: 925552 - protein, 21 aa, Mycobacterium
DATGLVLGNLVTPIPVTLNGR

SEQ ID NO: 925553 - protein, 24 aa, Mycobacterium
DATLRGGVVLACPDGWSATPAELP

SEQ ID NO: 925554 - protein, 21 aa, Mycobacterium
DATMAPRMVKDALADRKVVLI

SEQ ID NO: 925555 - protein, 29 aa, Mycobacterium
DATQIGGFYTRDGVTRMLAQKTTVIPTDG

SEQ ID NO: 925556 - protein, 23 aa, Mycobacterium
DATRAILMSQIKPGSVVLFHDTY

SEQ ID NO: 925557 - protein, 17 aa, Mycobacterium
DATTFAAVAQRCSERAA

SEQ ID NO: 925558 - protein, 20 aa, Mycobacterium
DAVAADWRDALLDEWSVILG

SEQ ID NO: 925559 - protein, 23 aa, Mycobacterium
DAVAEGMTVHWLNRITTALAAQP

SEQ ID NO: 925560 - protein, 18 aa, Mycobacterium
DAVHKVLAWMGSTDGNSF

SEQ ID NO: 925561 - protein, 17 aa, Mycobacterium
DAVHSMTAFGLAAVDRR

SEQ ID NO: 925562 - protein, 22 aa, Mycobacterium
DAVLPQSFTLVGHSLGAGVAAG

SEQ ID NO: 925563 - protein, 18 aa, Mycobacterium
DAVQAWAAHLADLSRGVQ

SEQ ID NO: 925564 - protein, 18 aa, Mycobacterium
DAVRHIWEIRGGDREPTT

SEQ ID NO: 925565 - protein, 22 aa, Mycobacterium
DAVRYDVKFGKPVLLPAAVGVW

SEQ ID NO: 925566 - protein, 24 aa, Mycobacterium
DAVTRARFGALDLHVDTKPDLTPV

SEQ ID NO: 925567 - protein, 19 aa, Mycobacterium
DAVWEMPPFDGWYSGPADI

SEQ ID NO: 925568 - protein, 21 aa, Mycobacterium
DAWPPSACAQPRVHPLDAAAA

SEQ ID NO: 925569 - protein, 18 aa, Mycobacterium
DAYAKDNNIELIWNSANL

SEQ ID NO: 925570 - protein, 28 aa, Mycobacterium
DAYHLATMVLDCRIGRWTGGDKTVACMV

SEQ ID NO: 925571 - protein, 21 aa, Mycobacterium
DAYQIGGMYVRDGQQRLIAQK

SEQ ID NO: 925572 - protein, 17 aa, Mycobacterium
DCEFDILICDAPPGRRH

SEQ ID NO: 925573 - protein, 23 aa, Mycobacterium
DCERRGTWVYYWVVPEALQQLSS

SEQ ID NO: 925574 - protein, 24 aa, Mycobacterium
DCPDARPSPPTSYCPATNTIVVDL

SEQ ID NO: 925575 - protein, 21 aa, Mycobacterium
DCPDVQALIIPGTWESSRTDD

SEQ ID NO: 925576 - protein, 18 aa, Mycobacterium
DCRDHYERTEMRDQSQFQ

SEQ ID NO: 925577 - protein, 17 aa, Mycobacterium
DCRQARPECPIAAAPAY

SEQ ID NO: 925578 - protein, 25 aa, Mycobacterium
DDAEGLPHIPVRLHARSWHRYAEPP

SEQ ID NO: 925579 - protein, 18 aa, Mycobacterium
DDAFLKYWYCLQHDDGLW

SEQ ID NO: 925580 - protein, 24 aa, Mycobacterium
DDALLRQALQDAIAMYGYPDIGTN

SEQ ID NO: 925581 - protein, 21 aa, Mycobacterium
DDARFNISRAALLVVALTQRP

SEQ ID NO: 925582 - protein, 19 aa, Mycobacterium
DDDDAWFVTDWMDTTRAQE

SEQ ID NO: 925583 - protein, 28 aa, Mycobacterium
DDDRLDWPLRPPPAVTRAFDAPVQDWHP

SEQ ID NO: 925584 - protein, 29 aa, Mycobacterium
DDEVSVAIAAGFRAYGQAYQALSTRAADV

SEQ ID NO: 925585 - protein, 23 aa, Mycobacterium
DDFAADFKDLFPVIKALNDNADY

SEQ ID NO: 925586 - protein, 19 aa, Mycobacterium
DDFERGIGLSTEIPAATKL

SEQ ID NO: 925587 - protein, 21 aa, Mycobacterium
DDFSEGLTRLHRLVTELSAER

SEQ ID NO: 925588 - protein, 25 aa, Mycobacterium
DDFYGRAALEFGLRQAAMTADWARW

SEQ ID NO: 925589 - protein, 18 aa, Mycobacterium
DDGAEQWLRAFKAQDPQA

SEQ ID NO: 925590 - protein, 24 aa, Mycobacterium
DDGYPEHAFTWAVVALISESLNQM

SEQ ID NO: 925591 - protein, 25 aa, Mycobacterium
DDHLWAHRPLLMFAPGETDPRLVET

SEQ ID NO: 925592 - protein, 20 aa, Mycobacterium
DDHSRLAIASTAYRTVTAPD

SEQ ID NO: 925593 - protein, 19 aa, Mycobacterium
DDIAPWRSATKSVIDKYGE

SEQ ID NO: 925594 - protein, 18 aa, Mycobacterium
DDIWWFHFALSGVISPLD

SEQ ID NO: 925595 - protein, 24 aa, Mycobacterium
DDLGALAAWYVWAALGVYPATPGT

SEQ ID NO: 925596 - protein, 24 aa, Mycobacterium
DDLGALASWYVWAALGLYPSTPGT

SEQ ID NO: 925597 - protein, 24 aa, Mycobacterium
DDLGALSSWYVWAALGLYPITAGT

SEQ ID NO: 925598 - protein, 18 aa, Mycobacterium
DDLIGIGALNSGAGNLGF

SEQ ID NO: 925599 - protein, 24 aa, Mycobacterium
DDLKPGVPDRSWAQVSVSSRECIG

SEQ ID NO: 925600 - protein, 23 aa, Mycobacterium
DDLKPGVPDRSWSQVSVSARECV

SEQ ID NO: 925601 - protein, 19 aa, Mycobacterium
DDLLRPGVEVITPSPLSSG

SEQ ID NO: 925602 - protein, 19 aa, Mycobacterium
DDLVLAWAAESGRYAGFDA

SEQ ID NO: 925603 - protein, 19 aa, Mycobacterium
DDLVLAWAAQSGRYPEFDA

SEQ ID NO: 925604 - protein, 25 aa, Mycobacterium
DDLWLRFRQGALYAYVAPLITAGMG

SEQ ID NO: 925605 - protein, 25 aa, Mycobacterium
DDLWLRFRQGALYAYVAPLITTGMG

SEQ ID NO: 925606 - protein, 21 aa, Mycobacterium
DDLYWCNPSGRALGVRPTTDT

SEQ ID NO: 925607 - protein, 24 aa, Mycobacterium
DDNISVKLFDDWTNLGSVSELAAS

SEQ ID NO: 925608 - protein, 22 aa, Mycobacterium
DDPDCLAAAFGAQERVYAGTGW

SEQ ID NO: 925609 - protein, 25 aa, Mycobacterium
DDPFGLRCGDIYYGPTIPTHDVYTW

SEQ ID NO: 925610 - protein, 24 aa, Mycobacterium
DDPICSGGGNIIAHVSYIDAGMTA

SEQ ID NO: 925611 - protein, 21 aa, Mycobacterium
DDPKFTFPAGNLVPLVNAQKK

SEQ ID NO: 925612 - protein, 22 aa, Mycobacterium
DDPLSLPLLISFNENADGRGYQ

SEQ ID NO: 925613 - protein, 17 aa, Mycobacterium
DDPPWPFVGYHWCPGQP

SEQ ID NO: 925614 - protein, 25 aa, Mycobacterium
DDPQRMVPWLAMPGCEFEVLEPDEV

SEQ ID NO: 925615 - protein, 21 aa, Mycobacterium
DDPRWFKADDVVGDLTELAIA

SEQ ID NO: 925616 - protein, 26 aa, Mycobacterium
DDPRYRPVLRDYVVGVMSQFRNDQRV

SEQ ID NO: 925617 - protein, 18 aa, Mycobacterium
DDQLALILWDEVQVHAAA

SEQ ID NO: 925618 - protein, 17 aa, Mycobacterium
DDQRGINLTGWLNSGSG

SEQ ID NO: 925619 - protein, 20 aa, Mycobacterium
DDRIRLTLRSDRAGEPSETV

SEQ ID NO: 925620 - protein, 18 aa, Mycobacterium
DDRRFAVVYIDDQSEHAR

SEQ ID NO: 925621 - protein, 25 aa, Mycobacterium
DDRVDAIVPVIAWNSLTRALYPTKA

SEQ ID NO: 925622 - protein, 24 aa, Mycobacterium
DDRWSLCQTLAYLAVTNCYAGEPI

SEQ ID NO: 925623 - protein, 21 aa, Mycobacterium
DDSPYAVTWLIDSRQDRTGAD

SEQ ID NO: 925624 - protein, 23 aa, Mycobacterium
DDSVCSGAPLAALAALAALTAAV

SEQ ID NO: 925625 - protein, 24 aa, Mycobacterium
DDTAMSVVMSRYVLAVQHERGLKL

SEQ ID NO: 925626 - protein, 29 aa, Mycobacterium
DDVRLEWPLRPPPAIARGFDAPSPDWHPG

SEQ ID NO: 925627 - protein, 18 aa, Mycobacterium
DDWTVDWDPAAVAPGLDR

SEQ ID NO: 925628 - protein, 26 aa, Mycobacterium
DDYFQACRAARAWMDQQGGDPRSQIE

SEQ ID NO: 925629 - protein, 20 aa, Mycobacterium
DDYLAILDIRPFTRGHTLVL

SEQ ID NO: 925630 - protein, 18 aa, Mycobacterium
DDYLRVAGVPEIFAAGDV

SEQ ID NO: 925631 - protein, 21 aa, Mycobacterium
DEAFPRLAVVRAPRHDRAVGP

SEQ ID NO: 925632 - protein, 29 aa, Mycobacterium
DEALQDFFGRLSGFWDWYKANPDEVTQTL

SEQ ID NO: 925633 - protein, 17 aa, Mycobacterium
DEARGSTLWAQSWQAVM

SEQ ID NO: 925634 - protein, 25 aa, Mycobacterium
DEDHSAIAPAVWAGAVAQYCILASW

SEQ ID NO: 925635 - protein, 17 aa, Mycobacterium
DEELATYLTALRDAASA

SEQ ID NO: 925636 - protein, 18 aa, Mycobacterium
DEFARAAVELALVDAAVV

SEQ ID NO: 925637 - protein, 17 aa, Mycobacterium
DEFTERFVAATTAIKLS

SEQ ID NO: 925638 - protein, 19 aa, Mycobacterium
DEGWQHWGVWLNGVFVPTY

SEQ ID NO: 925639 - protein, 18 aa, Mycobacterium
DEIARHPLIVPVRGNALR

SEQ ID NO: 925640 - protein, 17 aa, Mycobacterium
DEIGCRVTVNGIVREEK

SEQ ID NO: 925641 - protein, 17 aa, Mycobacterium
DEILIARNDRYWGPPAK

SEQ ID NO: 925642 - protein, 18 aa, Mycobacterium
DEILIARNDRYWGPPAKP

SEQ ID NO: 925643 - protein, 22 aa, Mycobacterium
DELADPGFFQWLAERRYASAAE

SEQ ID NO: 925644 - protein, 19 aa, Mycobacterium
DELDVWLISWVPDRSTELH

SEQ ID NO: 925645 - protein, 21 aa, Mycobacterium
DELKSAGIDKIEYSFFQSGSD

SEQ ID NO: 925646 - protein, 19 aa, Mycobacterium
DELLPMLSTMGFDTSRVGF

SEQ ID NO: 925647 - protein, 17 aa, Mycobacterium
DELRAAKAQPLGVLPRP

SEQ ID NO: 925648 - protein, 26 aa, Mycobacterium
DELSGQGFQVMWQSRPFLLAAGNGMC

SEQ ID NO: 925649 - protein, 19 aa, Mycobacterium
DELTGLIEFAAPVRAGDSG

SEQ ID NO: 925650 - protein, 26 aa, Mycobacterium
DELWERYRLGAVYAYTAPVITAGLGG

SEQ ID NO: 925651 - protein, 24 aa, Mycobacterium
DEPEPPAHLVLGSDALRLVGAARA

SEQ ID NO: 925652 - protein, 19 aa, Mycobacterium
DEPHWYLAVIGSDPVVRGG

SEQ ID NO: 925653 - protein, 21 aa, Mycobacterium
DEPILCKSVDAAASSSGAAIT

SEQ ID NO: 925654 - protein, 24 aa, Mycobacterium
DEQFRIAYQASQKVFGFAPYPGVA

SEQ ID NO: 925655 - protein, 23 aa, Mycobacterium
DEQFRIAYQASQKVLGFAPYPGV

SEQ ID NO: 925656 - protein, 24 aa, Mycobacterium
DEQFRLAYDASQQVFGFAPYPGVA

SEQ ID NO: 925657 - protein, 24 aa, Mycobacterium
DEQIPLDTFVKAWATSHDFMTVTQ

SEQ ID NO: 925658 - protein, 18 aa, Mycobacterium
DERLLHWAQTEIDNLRAA

SEQ ID NO: 925659 - protein, 20 aa, Mycobacterium
DERRAPTFAGTIWVQQGSRP

SEQ ID NO: 925660 - protein, 19 aa, Mycobacterium
DERSGAVAFDSNQAEIARS

SEQ ID NO: 925661 - protein, 18 aa, Mycobacterium
DERSRLAFFMVKPDPTLL

SEQ ID NO: 925662 - protein, 24 aa, Mycobacterium
DESACDAWVGRIRCGDLDRVTLFR

SEQ ID NO: 925663 - protein, 20 aa, Mycobacterium
DESEPGRWALTREGGHSRRR

SEQ ID NO: 925664 - protein, 20 aa, Mycobacterium
DETKQFVGRCVDKMGKGFLA

SEQ ID NO: 925665 - protein, 28 aa, Mycobacterium
DETRLAILRRLACGEARVVDLTGELGLA

SEQ ID NO: 925666 - protein, 21 aa, Mycobacterium
DETWQLEGYEVMLASVDGQPV

SEQ ID NO: 925667 - protein, 20 aa, Mycobacterium
DEVGKPCGARIVVVTHSATD

SEQ ID NO: 925668 - protein, 21 aa, Mycobacterium
DEVLYRPLGMTSTSSRFADFL

SEQ ID NO: 925669 - protein, 20 aa, Mycobacterium
DEVQARLAYDPAAPPPDSLS

SEQ ID NO: 925670 - protein, 23 aa, Mycobacterium
DEVSTAIAGMFAAHAQAYQALST

SEQ ID NO: 925671 - protein, 17 aa, Mycobacterium
DEVSVLVAAQFATHAQM

SEQ ID NO: 925672 - protein, 19 aa, Mycobacterium
DEWTLFVALQHLRDGKDYA

SEQ ID NO: 925673 - protein, 26 aa, Mycobacterium
DEYGRRLGAGWFPGLKREIVNYPAGQ

SEQ ID NO: 925674 - protein, 18 aa, Mycobacterium
DFAADMKDLYSVVKTLND

SEQ ID NO: 925675 - protein, 28 aa, Mycobacterium
DFDLTIPRLKKGLFLGTHWGQLDMPVPP

SEQ ID NO: 925676 - protein, 24 aa, Mycobacterium
DFEAGLRDTIDWYSANESWWGPIK

SEQ ID NO: 925677 - protein, 33 aa, Mycobacterium
DFEEGLRETIDWYRANESWWRPLKDASEARYEE

SEQ ID NO: 925678 - protein, 33 aa, Mycobacterium
DFEEGLRTTIDWYRANESWWRPLKDAAEARYQE

SEQ ID NO: 925679 - protein, 18 aa, Mycobacterium
DFEHGLAATIEWYRTHED

SEQ ID NO: 925680 - protein, 20 aa, Mycobacterium
DFFNLHFDFDLTIPRLKKGL

SEQ ID NO: 925681 - protein, 25 aa, Mycobacterium
DFGKREVMVVHTLLWPDEIRDPDFP

SEQ ID NO: 925682 - protein, 18 aa, Mycobacterium
DFGPDFGLTYILDGLAAM

SEQ ID NO: 925683 - protein, 18 aa, Mycobacterium
DFGSALQGFTKLLGAPGD

SEQ ID NO: 925684 - protein, 29 aa, Mycobacterium
DFGTVAALNLVKCVHWPTGSPPAPPKSLK

SEQ ID NO: 925685 - protein, 23 aa, Mycobacterium
DFIEEGRRAGQWVADQYASATGP

SEQ ID NO: 925686 - protein, 23 aa, Mycobacterium
DFPHPSGRVDIVRVADRTRVHSI

SEQ ID NO: 925687 - protein, 23 aa, Mycobacterium
DFPPESFAQVLLGWQQWLRTADR

SEQ ID NO: 925688 - protein, 19 aa, Mycobacterium
DFQFADGFATVTIETTTPG

SEQ ID NO: 925689 - protein, 19 aa, Mycobacterium
DFRAGCPVAAVSVEAGEPS

SEQ ID NO: 925690 - protein, 19 aa, Mycobacterium
DFRPGCKRMLVSSDYYPAL

SEQ ID NO: 925691 - protein, 23 aa, Mycobacterium
DFSHPQWVRTAFRRLPRVQNVGR

SEQ ID NO: 925692 - protein, 22 aa, Mycobacterium
DFSILDGIFAMYATVGVTQDVE

SEQ ID NO: 925693 - protein, 19 aa, Mycobacterium
DFSSIRPDVSMDLAKQAAD

SEQ ID NO: 925694 - protein, 24 aa, Mycobacterium
DFTRYSFRAAGQFTTLSDELRNID

SEQ ID NO: 925695 - protein, 20 aa, Mycobacterium
DFTRYSFRAAGQYTTLADEL

SEQ ID NO: 925696 - protein, 20 aa, Mycobacterium
DFTVVPAFTGEVLRALQPSA

SEQ ID NO: 925697 - protein, 17 aa, Mycobacterium
DFVDLKCPFTLGHSRAV

SEQ ID NO: 925698 - protein, 29 aa, Mycobacterium
DFVEAHSGLRFEVATGFPDYRPELPGGQP

SEQ ID NO: 925699 - protein, 26 aa, Mycobacterium
DFVSSLQLLLTFPFPNFGIKQAVRGD

SEQ ID NO: 925700 - protein, 34 aa, Mycobacterium
DGAADFPRYPINVLADLNAFMGIQSLHGQYATLT

SEQ ID NO: 925701 - protein, 19 aa, Mycobacterium
DGAARTCLWRMVSSGELTG

SEQ ID NO: 925702 - protein, 21 aa, Mycobacterium
DGACRGAPSAGTFVAQYAIDL

SEQ ID NO: 925703 - protein, 24 aa, Mycobacterium
DGAGAKELGCAQFTVTAKPSATTA

SEQ ID NO: 925704 - protein, 25 aa, Mycobacterium
DGAKGVWRYADPVLERLGMHAAVFL

SEQ ID NO: 925705 - protein, 17 aa, Mycobacterium
DGALARRNVVLDTMIEN

SEQ ID NO: 925706 - protein, 17 aa, Mycobacterium
DGAPAPAAIFIGGGVTG

SEQ ID NO: 925707 - protein, 26 aa, Mycobacterium
DGARGGYVYACPRYAESFAAGAAIGA

SEQ ID NO: 925708 - protein, 18 aa, Mycobacterium
DGAVTRIVAMKGPSPRCG

SEQ ID NO: 925709 - protein, 21 aa, Mycobacterium
DGDCWPHLVELADRADYEVDG

SEQ ID NO: 925710 - protein, 20 aa, Mycobacterium
DGDLARVDFRVETEQPLYGN

SEQ ID NO: 925711 - protein, 17 aa, Mycobacterium
DGDRLRYVITRAPATGT

SEQ ID NO: 925712 - protein, 26 aa, Mycobacterium
DGEATFRFPLVVAHRYTTGTPVPGDQ

SEQ ID NO: 925713 - protein, 19 aa, Mycobacterium
DGEELWTREEVAPLTTSSL

SEQ ID NO: 925714 - protein, 17 aa, Mycobacterium
DGEPAWTAGGTYMVVRL

SEQ ID NO: 925715 - protein, 22 aa, Mycobacterium
DGEPKRKPTVVVIQQPPPAGGT

SEQ ID NO: 925716 - protein, 23 aa, Mycobacterium
DGEWGSRQWTRGCYNANCGPLVW

SEQ ID NO: 925717 - protein, 25 aa, Mycobacterium
DGFDVSARLAAAIAAAAPKLALDDD

SEQ ID NO: 925718 - protein, 22 aa, Mycobacterium
DGFKVVPLVLSWSADPAKVTDI

SEQ ID NO: 925719 - protein, 17 aa, Mycobacterium
DGFTAVNVCSGRPISIL

SEQ ID NO: 925720 - protein, 18 aa, Mycobacterium
DGFVGWRAETLPTDPESE

SEQ ID NO: 925721 - protein, 20 aa, Mycobacterium
DGFVPMLHAYGLDLEDLAKI

SEQ ID NO: 925722 - protein, 20 aa, Mycobacterium
DGGAGGQAWSESGSATGGAG

SEQ ID NO: 925723 - protein, 22 aa, Mycobacterium
DGGDGGYGWGGVPDEEGDPVGT

SEQ ID NO: 925724 - protein, 27 aa, Mycobacterium
DGGGVPSFLGYHGFPATICASVNDRVV

SEQ ID NO: 925725 - protein, 18 aa, Mycobacterium
DGGLLWGNGGSGAAGDAA

SEQ ID NO: 925726 - protein, 18 aa, Mycobacterium
DGGLNYYGDGGVAGAGGD

SEQ ID NO: 925727 - protein, 25 aa, Mycobacterium
DGGTGGLGGWLWGQAGAAGTGTPLP

SEQ ID NO: 925728 - protein, 18 aa, Mycobacterium
DGHSGRYGLGPGATSITV

SEQ ID NO: 925729 - protein, 17 aa, Mycobacterium
DGIARLVTDVANVNQQL

SEQ ID NO: 925730 - protein, 30 aa, Mycobacterium
DGIDLSLPDGFKWGVAHSGFQAEGGPGSPV

SEQ ID NO: 925731 - protein, 25 aa, Mycobacterium
DGIPIVGYNYWSLVDNYEWGSYRPR

SEQ ID NO: 925732 - protein, 17 aa, Mycobacterium
DGISVDTFVDWLMEDGH

SEQ ID NO: 925733 - protein, 33 aa, Mycobacterium
DGKASTLGGFQAWQIGGTYQRDGKTRMIAQKTV

SEQ ID NO: 925734 - protein, 17 aa, Mycobacterium
DGKEKKVEGAIACSTAA

SEQ ID NO: 925735 - protein, 18 aa, Mycobacterium
DGKPMVWHDPVIDPAKCS

SEQ ID NO: 925736 - protein, 18 aa, Mycobacterium
DGKRLVVSMMYGLVHEGG

SEQ ID NO: 925737 - protein, 22 aa, Mycobacterium
DGKTPIGYEVDLAKAIAAKLGV

SEQ ID NO: 925738 - protein, 19 aa, Mycobacterium
DGKTVVRYQGWAGQVEFQE

SEQ ID NO: 925739 - protein, 24 aa, Mycobacterium
DGKVWKPATALGYGRTYTMNVVAR

SEQ ID NO: 925740 - protein, 31 aa, Mycobacterium
DGLARFGGLDIRNMWGLPQLGRWKWHDPDVH

SEQ ID NO: 925741 - protein, 27 aa, Mycobacterium
DGLDVKGAVVLVDRGSCPFADKERVAA

SEQ ID NO: 925742 - protein, 18 aa, Mycobacterium
DGLGGYIPNSSNWVRPRS

SEQ ID NO: 925743 - protein, 20 aa, Mycobacterium
DGLRALLDWIAERPEAAGSN

SEQ ID NO: 925744 - protein, 18 aa, Mycobacterium
DGLRDCVSSALSVQNTVE

SEQ ID NO: 925745 - protein, 23 aa, Mycobacterium
DGLSLPMRLTLPGAVNRGNAAQA

SEQ ID NO: 925746 - protein, 21 aa, Mycobacterium
DGLTTTWNPFVPKSYVWNPDM

SEQ ID NO: 925747 - protein, 23 aa, Mycobacterium
DGMADFPDRFNLTAISNAMAGSV

SEQ ID NO: 925748 - protein, 27 aa, Mycobacterium
DGMADFPDRLNLLAIVNAVAGGIFVHI

SEQ ID NO: 925749 - protein, 28 aa, Mycobacterium
DGMQQGCGGPPCKGAVVALEPSTGKILA

SEQ ID NO: 925750 - protein, 26 aa, Mycobacterium
DGNMPVRWSGPPAVRHGYLQPAAKCT

SEQ ID NO: 925751 - protein, 22 aa, Mycobacterium
DGPAVPRWWFTVGGEVRNGEQL

SEQ ID NO: 925752 - protein, 18 aa, Mycobacterium
DGPVHICTGAVLHSTSGD

SEQ ID NO: 925753 - protein, 20 aa, Mycobacterium
DGPVNLRDALTLAADATARD

SEQ ID NO: 925754 - protein, 19 aa, Mycobacterium
DGPYCNLSIESDRKATRDI

SEQ ID NO: 925755 - protein, 28 aa, Mycobacterium
DGQLNIPRLPAGVTYTRIAAGNYGTVLL

SEQ ID NO: 925756 - protein, 18 aa, Mycobacterium
DGQQGWAEVPGLMVAGAA

SEQ ID NO: 925757 - protein, 26 aa, Mycobacterium
DGRARPWWRLPVHRRLVVHVSLIPTE

SEQ ID NO: 925758 - protein, 20 aa, Mycobacterium
DGRDGSVFDNSYERGAPVDF

SEQ ID NO: 925759 - protein, 25 aa, Mycobacterium
DGRIAGASITLEWSVDDFTISRFAT

SEQ ID NO: 925760 - protein, 20 aa, Mycobacterium
DGRIPALDLRVLDDDRKFFP

SEQ ID NO: 925761 - protein, 27 aa, Mycobacterium
DGRLEWPMRPRPAVVRAFDAPAPNWQR

SEQ ID NO: 925762 - protein, 23 aa, Mycobacterium
DGRPRRAGVSSFGISGTNAHVIV

SEQ ID NO: 925763 - protein, 19 aa, Mycobacterium
DGSEKWSVPLGYLAQTPPS

SEQ ID NO: 925764 - protein, 21 aa, Mycobacterium
DGSEYFLGLGYATLAIAAFAG

SEQ ID NO: 925765 - protein, 21 aa, Mycobacterium
DGSGADALWFTSLFGQDVLDL

SEQ ID NO: 925766 - protein, 24 aa, Mycobacterium
DGSGADPLWFLPLLDQDAVDMLEL

SEQ ID NO: 925767 - protein, 21 aa, Mycobacterium
DGSGADSLWFAPLFSQDALDL

SEQ ID NO: 925768 - protein, 24 aa, Mycobacterium
DGSKGCPKDNWCVKNVGNYRSPMS

SEQ ID NO: 925769 - protein, 23 aa, Mycobacterium
DGSLRMTPDIARRSVADAVLPSS

SEQ ID NO: 925770 - protein, 18 aa, Mycobacterium
DGSLWPVSGTAFAVTPKL

SEQ ID NO: 925771 - protein, 17 aa, Mycobacterium
DGSRSLGSMGVIPLTRT

SEQ ID NO: 925772 - protein, 17 aa, Mycobacterium
DGSWGPWYQTEYETAAP

SEQ ID NO: 925773 - protein, 26 aa, Mycobacterium
DGTARLRWARRPGWGGVEVDAAVVGT

SEQ ID NO: 925774 - protein, 20 aa, Mycobacterium
DGTFQRCVTAGALGFGGTNC

SEQ ID NO: 925775 - protein, 24 aa, Mycobacterium
DGTFSNTFTLVWPRGSGTVREFPE

SEQ ID NO: 925776 - protein, 20 aa, Mycobacterium
DGTGGLPLDRAGFIVNDLAR

SEQ ID NO: 925777 - protein, 24 aa, Mycobacterium
DGTHCATDFALMYDGVVDFPAYPL

SEQ ID NO: 925778 - protein, 23 aa, Mycobacterium
DGTHPELQWKVRQVSNANGVLST

SEQ ID NO: 925779 - protein, 24 aa, Mycobacterium
DGTPFRLTPGIGEVGPRVLGARSA

SEQ ID NO: 925780 - protein, 25 aa, Mycobacterium
DGTQRPSTMWAQYGLAGVLEYEHFV

SEQ ID NO: 925781 - protein, 25 aa, Mycobacterium
DGTRCLLRNGGAWGGRDDGYVGVYG

SEQ ID NO: 925782 - protein, 19 aa, Mycobacterium
DGVALAIWAGLPVGDLEFI

SEQ ID NO: 925783 - protein, 21 aa, Mycobacterium
DGVDLRASVATLHLTSSYGAR

SEQ ID NO: 925784 - protein, 18 aa, Mycobacterium
DGVGALGLPSAWGTAAEL

SEQ ID NO: 925785 - protein, 27 aa, Mycobacterium
DGVLGLSLLWVLRGWRRPDEVRFRASP

SEQ ID NO: 925786 - protein, 20 aa, Mycobacterium
DGVSSLPLPGTVGRGDGATA

SEQ ID NO: 925787 - protein, 24 aa, Mycobacterium
DGVTWSSAEPLGYNKQYTLQAHAQ

SEQ ID NO: 925788 - protein, 23 aa, Mycobacterium
DGWFVDRPELIGADGVHPTDAGH

SEQ ID NO: 925789 - protein, 19 aa, Mycobacterium
DGWTLVIRIDHETINSVPN

SEQ ID NO: 925790 - protein, 22 aa, Mycobacterium
DGYPQRFGIPDGLRGEPVAVKQ

SEQ ID NO: 925791 - protein, 24 aa, Mycobacterium
DGYPQRFGIPDGLYAEPVAVKQGW

SEQ ID NO: 925792 - protein, 23 aa, Mycobacterium
DGYRVPNELPIHVETMLANPAYR

SEQ ID NO: 925793 - protein, 20 aa, Mycobacterium
DGYSGGAIATVWAAQEQPTY

SEQ ID NO: 925794 - protein, 18 aa, Mycobacterium
DHEARRLSEIDVINGAVP

SEQ ID NO: 925795 - protein, 24 aa, Mycobacterium
DHEIRASVLVAEWPPRRDVADPDP

SEQ ID NO: 925796 - protein, 22 aa, Mycobacterium
DHESGRCTAGFAAQGADGSYYL

SEQ ID NO: 925797 - protein, 23 aa, Mycobacterium
DHEWLKGGTLLVLRRITMNLDGW

SEQ ID NO: 925798 - protein, 17 aa, Mycobacterium
DHGEQLAAWLASRQPQL

SEQ ID NO: 925799 - protein, 25 aa, Mycobacterium
DHGETGWPTFLYVIPLGGGQVLVEE

SEQ ID NO: 925800 - protein, 24 aa, Mycobacterium
DHGSWKLPSAAIKVKPGLVGDRDA

SEQ ID NO: 925801 - protein, 26 aa, Mycobacterium
DHGVLVCLAGRVLQPLGLRKAVTDDL

SEQ ID NO: 925802 - protein, 20 aa, Mycobacterium
DHLGELIAGVVKLARTVDAD

SEQ ID NO: 925803 - protein, 25 aa, Mycobacterium
DHLGYGMRDLHRFISGPAYARRLTT

SEQ ID NO: 925804 - protein, 17 aa, Mycobacterium
DHLRAFAAYELQMREPV

SEQ ID NO: 925805 - protein, 20 aa, Mycobacterium
DHPIVRRSAAELLVSAKESR

SEQ ID NO: 925806 - protein, 20 aa, Mycobacterium
DHPTSVHWHGIALRNDIDGA

SEQ ID NO: 925807 - protein, 26 aa, Mycobacterium
DHRNGAVVLLMWAGILAYLDHAGYDH

SEQ ID NO: 925808 - protein, 19 aa, Mycobacterium
DHRRIEGLIAPGTFNVDPA

SEQ ID NO: 925809 - protein, 24 aa, Mycobacterium
DHRVDALVPTIAWNNLVDVLFPRD

SEQ ID NO: 925810 - protein, 28 aa, Mycobacterium
DHSRRLWTLLIFMLWHAIFIERSITPQI

SEQ ID NO: 925811 - protein, 27 aa, Mycobacterium
DHSRRLWTVLIFMLWHAIFVEHSVTPQ

SEQ ID NO: 925812 - protein, 25 aa, Mycobacterium
DHTLKMRLSQPFSEFLRMLAQGGNG

SEQ ID NO: 925813 - protein, 24 aa, Mycobacterium
DHTLPGSGFSAVATVAADPTGPTG

SEQ ID NO: 925814 - protein, 22 aa, Mycobacterium
DHVEKPWVYRHIVQDIRSPDEV

SEQ ID NO: 925815 - protein, 20 aa, Mycobacterium
DIAFDASKKVFGFAPYPGVN

SEQ ID NO: 925816 - protein, 24 aa, Mycobacterium
DIAVLQLRGAAGLPTAAIGGEARV

SEQ ID NO: 925817 - protein, 24 aa, Mycobacterium
DIAYEFTGNAWINYLGHEKPIPDT

SEQ ID NO: 925818 - protein, 17 aa, Mycobacterium
DICRLHAALQRSAVGEA

SEQ ID NO: 925819 - protein, 21 aa, Mycobacterium
DICRRHDVLLIFDEIATGFGR

SEQ ID NO: 925820 - protein, 21 aa, Mycobacterium
DIDKSCVWKMTMPTFSLPEPA

SEQ ID NO: 925821 - protein, 25 aa, Mycobacterium
DIDPTWARAHPGAQLPVTVTVTDAE

SEQ ID NO: 925822 - protein, 24 aa, Mycobacterium
DIDVGSAFNGAVVKLNAAGAPITS

SEQ ID NO: 925823 - protein, 23 aa, Mycobacterium
DIDYGVQVMPTFAGSSGAHQTIS

SEQ ID NO: 925824 - protein, 32 aa, Mycobacterium
DIFEGLRTSTRWDFELGNPLGTGGQWAIPWGF

SEQ ID NO: 925825 - protein, 22 aa, Mycobacterium
DIGDPVLDRAIHRLRRRPMDPT

SEQ ID NO: 925826 - protein, 17 aa, Mycobacterium
DIIARYLRRQLTALEDF

SEQ ID NO: 925827 - protein, 23 aa, Mycobacterium
DIIKAAKPSPGFADSTFRSLMAF

SEQ ID NO: 925828 - protein, 22 aa, Mycobacterium
DIKELSDTFGYFRYHVSDEGLG

SEQ ID NO: 925829 - protein, 18 aa, Mycobacterium
DIKVLAKDTANWKRDEAV

SEQ ID NO: 925830 - protein, 26 aa, Mycobacterium
DILARHGHRAFHEWQPLEAREAVDGR

SEQ ID NO: 925831 - protein, 21 aa, Mycobacterium
DILDCLAALAVGHDSHREAAR

SEQ ID NO: 925832 - protein, 18 aa, Mycobacterium
DILKERKDDVAVGLTEVG

SEQ ID NO: 925833 - protein, 20 aa, Mycobacterium
DIPFHFALAEAFTVCDNFHS

SEQ ID NO: 925834 - protein, 24 aa, Mycobacterium
DIPGQESFAGPVFHSAEWDHSVTL

SEQ ID NO: 925835 - protein, 22 aa, Mycobacterium
DIQALRPPPVISDFEQPMGAIP

SEQ ID NO: 925836 - protein, 17 aa, Mycobacterium
DIRALLINRDLLAIDQD

SEQ ID NO: 925837 - protein, 21 aa, Mycobacterium
DIRARGRLIVGLDIGSNLFSF

SEQ ID NO: 925838 - protein, 22 aa, Mycobacterium
DIRARGRLIVGLDIGSNLFSFR

SEQ ID NO: 925839 - protein, 28 aa, Mycobacterium
DIRKAARADLILDNGLNLEAWFARFVDG

SEQ ID NO: 925840 - protein, 23 aa, Mycobacterium
DIRVCGAIGVIECERPVDLTVAT

SEQ ID NO: 925841 - protein, 26 aa, Mycobacterium
DISFVLGEVSWQWEGAGAESYVAENI

SEQ ID NO: 925842 - protein, 26 aa, Mycobacterium
DISRKRNLVEFGFRLPSAVDNRPLQW

SEQ ID NO: 925843 - protein, 19 aa, Mycobacterium
DITAYGWDETVFFHNGDPF

SEQ ID NO: 925844 - protein, 17 aa, Mycobacterium
DITGYRATNAVAVKIHP

SEQ ID NO: 925845 - protein, 18 aa, Mycobacterium
DITLGIYSRHPVLVRDDD

SEQ ID NO: 925846 - protein, 30 aa, Mycobacterium
DITYPRLKKTLLLGTRWGDENAKLIPAPGD

SEQ ID NO: 925847 - protein, 26 aa, Mycobacterium
DIVAAIWPDRVTALVAVSGYIIVNLE

SEQ ID NO: 925848 - protein, 28 aa, Mycobacterium
DIVPEEARSGIAYAVSKSFVKWYSQSQA

SEQ ID NO: 925849 - protein, 32 aa, Mycobacterium
DKAAARCGSEAWDLPVVFGPIAVTYNINGVST

SEQ ID NO: 925850 - protein, 26 aa, Mycobacterium
DKAFKTSGCQPWQLTPDATPPPQAPP

SEQ ID NO: 925851 - protein, 23 aa, Mycobacterium
DKALAVFMFRSPWIDYDYHDLAA

SEQ ID NO: 925852 - protein, 32 aa, Mycobacterium
DKAVQRCGSPAWNLPVVFGPLAVTYNLAGVDA

SEQ ID NO: 925853 - protein, 19 aa, Mycobacterium
DKAWECPLHGSRFAPDGTL

SEQ ID NO: 925854 - protein, 30 aa, Mycobacterium
DKFDFRAVAIHELLHAFGFTSGTEEPGDRD

SEQ ID NO: 925855 - protein, 17 aa, Mycobacterium
DKFPRAVLPRTFDYGFA

SEQ ID NO: 925856 - protein, 17 aa, Mycobacterium
DKGGHTWPGGKQYLPAA

SEQ ID NO: 925857 - protein, 22 aa, Mycobacterium
DKHYAVLHAFAGRLPDQRLPFG

SEQ ID NO: 925858 - protein, 18 aa, Mycobacterium
DKISLTFQDPAGGSRTVP

SEQ ID NO: 925859 - protein, 21 aa, Mycobacterium
DKLIPLSVFGPERIDYLPEVP

SEQ ID NO: 925860 - protein, 19 aa, Mycobacterium
DKLIWAEGFSLPLTQSPGT

SEQ ID NO: 925861 - protein, 17 aa, Mycobacterium
DKLPRMHLARYAGTARP

SEQ ID NO: 925862 - protein, 20 aa, Mycobacterium
DKLVWAEGFSLPLTQSPGTI

SEQ ID NO: 925863 - protein, 24 aa, Mycobacterium
DKNVEALLRMARRSAASGTALAHG

SEQ ID NO: 925864 - protein, 24 aa, Mycobacterium
DKRFGELREGVWLRPDNLDLELPP

SEQ ID NO: 925865 - protein, 20 aa, Mycobacterium
DKRVRPRPLRKLVDRVTKAL

SEQ ID NO: 925866 - protein, 35 aa, Mycobacterium
DKTILQAIELWKIVDRPNLLIKIPATMAGLPAISA

SEQ ID NO: 925867 - protein, 18 aa, Mycobacterium
DKYKVPADVKAAILSPSL

SEQ ID NO: 925868 - protein, 23 aa, Mycobacterium
DLAARLWDLPGWARTGELLLEAM

SEQ ID NO: 925869 - protein, 27 aa, Mycobacterium
DLADGLTYRFTFTFEKAGEVTVAVPID

SEQ ID NO: 925870 - protein, 23 aa, Mycobacterium
DLAEILDLAPLVADNGYNAIDRA

SEQ ID NO: 925871 - protein, 19 aa, Mycobacterium
DLAETLGGVEVCLNHAVSD

SEQ ID NO: 925872 - protein, 18 aa, Mycobacterium
DLAGKVASYRAGYLAEDR

SEQ ID NO: 925873 - protein, 25 aa, Mycobacterium
DLAKGLEMVGAFLPSLNESIASGPF

SEQ ID NO: 925874 - protein, 26 aa, Mycobacterium
DLAKGWLTPLLRTGRRSPGADEGGVV

SEQ ID NO: 925875 - protein, 22 aa, Mycobacterium
DLALDCRVRPAVDGERAPAGRL

SEQ ID NO: 925876 - protein, 30 aa, Mycobacterium
DLAQRFFLMAARGIRPTWAMNQANDRNRSS

SEQ ID NO: 925877 - protein, 22 aa, Mycobacterium
DLATVRLVWTLTVRDSAGAVLE

SEQ ID NO: 925878 - protein, 30 aa, Mycobacterium
DLCGLDDPFCSSGLNFPAHFSYIKNGMVEE

SEQ ID NO: 925879 - protein, 17 aa, Mycobacterium
DLDAALIHLAEAVGEVQ

SEQ ID NO: 925880 - protein, 27 aa, Mycobacterium
DLDALGWKLNGKFREKNGRQLVVRLLF

SEQ ID NO: 925881 - protein, 25 aa, Mycobacterium
DLDGMRLHSWNRIVIPTGPPPDHKR

SEQ ID NO: 925882 - protein, 25 aa, Mycobacterium
DLDGRRTALIASERSNFVAVYDVTD

SEQ ID NO: 925883 - protein, 24 aa, Mycobacterium
DLDPAEAISHGFVDSQNLLAWRTT

SEQ ID NO: 925884 - protein, 27 aa, Mycobacterium
DLDSMDWLNFLLGIHKRMHVDIPESDY

SEQ ID NO: 925885 - protein, 19 aa, Mycobacterium
DLEARCAGVRETFPATEVL

SEQ ID NO: 925886 - protein, 26 aa, Mycobacterium
DLEEGLRATIDWYRDNEAWWRPLKDA

SEQ ID NO: 925887 - protein, 19 aa, Mycobacterium
DLFAACLTAGMAVSTAAAA

SEQ ID NO: 925888 - protein, 22 aa, Mycobacterium
DLGAMSSWYVWAALGLYPSTPG

SEQ ID NO: 925889 - protein, 17 aa, Mycobacterium
DLGYRPATKELPFGQNI

SEQ ID NO: 925890 - protein, 26 aa, Mycobacterium
DLHKHYRPGVWLPHCSLAPRATLAQL

SEQ ID NO: 925891 - protein, 18 aa, Mycobacterium
DLIGPLFRHGSRNADIAV

SEQ ID NO: 925892 - protein, 18 aa, Mycobacterium
DLIPPGAIDDLTRMVLLN

SEQ ID NO: 925893 - protein, 19 aa, Mycobacterium
DLIPRRPTAITVVPNSVDA

SEQ ID NO: 925894 - protein, 26 aa, Mycobacterium
DLLARYTRAAVWAREHPQEWAAQYAG

SEQ ID NO: 925895 - protein, 18 aa, Mycobacterium
DLLDRFGSVSGLWNQVMA

SEQ ID NO: 925896 - protein, 18 aa, Mycobacterium
DLLDVCAGIQDVRNLAPA

SEQ ID NO: 925897 - protein, 21 aa, Mycobacterium
DLLGLLGSGMEDWIGLSGADL

SEQ ID NO: 925898 - protein, 33 aa, Mycobacterium
DLLGMVNAPAAAVLGRPLIGNGTNGAPGSGDAG

SEQ ID NO: 925899 - protein, 17 aa, Mycobacterium
DLLTACAHWSETAGNTV

SEQ ID NO: 925900 - protein, 18 aa, Mycobacterium
DLLVRAWIRSFGISATIS

SEQ ID NO: 925901 - protein, 27 aa, Mycobacterium
DLPAGCQRLDGRQALGYVRTRDTPRAD

SEQ ID NO: 925902 - protein, 24 aa, Mycobacterium
DLPESYGAADFVSWYDGHPDVPRD

SEQ ID NO: 925903 - protein, 21 aa, Mycobacterium
DLPGEVMGAVQQMTSQFGVQI

SEQ ID NO: 925904 - protein, 23 aa, Mycobacterium
DLPLHPGFAASWQRLREVTATIP

SEQ ID NO: 925905 - protein, 20 aa, Mycobacterium
DLPNQCWQADVTHWQLADHT

SEQ ID NO: 925906 - protein, 28 aa, Mycobacterium
DLPSSAQLPVWLSRAGADVLAAHPIVAV

SEQ ID NO: 925907 - protein, 27 aa, Mycobacterium
DLPSSTQLPVWLSHAGADILRSHPIVA

SEQ ID NO: 925908 - protein, 27 aa, Mycobacterium
DLPSSTQLPVWLSHAGADVLRTHPIVA

SEQ ID NO: 925909 - protein, 20 aa, Mycobacterium
DLPTELMTALSQGLSSFGIN

SEQ ID NO: 925910 - protein, 22 aa, Mycobacterium
DLPVCNNWADIGLPEVFNDPDL

SEQ ID NO: 925911 - protein, 21 aa, Mycobacterium
DLPVCNNWADIGLPEVYNDPD

SEQ ID NO: 925912 - protein, 20 aa, Mycobacterium
DLQGMIRLGAVYNEGGGITS

SEQ ID NO: 925913 - protein, 18 aa, Mycobacterium
DLQMKPALAESWEVSPDQ

SEQ ID NO: 925914 - protein, 19 aa, Mycobacterium
DLRDDWAGALIAAGFDPDR

SEQ ID NO: 925915 - protein, 23 aa, Mycobacterium
DLRDKRVATPFASTAHYSLLAAL

SEQ ID NO: 925916 - protein, 22 aa, Mycobacterium
DLREIRAAIKRALVRHHDEPDE

SEQ ID NO: 925917 - protein, 19 aa, Mycobacterium
DLRQLFLGSEGALGIITEV

SEQ ID NO: 925918 - protein, 24 aa, Mycobacterium
DLRRRVEAFLARRRLFDPALLAGA

SEQ ID NO: 925919 - protein, 21 aa, Mycobacterium
DLRRTEVYYILLAGTAADFCT

SEQ ID NO: 925920 - protein, 21 aa, Mycobacterium
DLRYAIDPTKLREELGWQPGY

SEQ ID NO: 925921 - protein, 25 aa, Mycobacterium
DLSLPLASIFKLYVLLAVADAVKAG

SEQ ID NO: 925922 - protein, 26 aa, Mycobacterium
DLSLPLASIFKLYVLLAVSDAIKEGT

SEQ ID NO: 925923 - protein, 18 aa, Mycobacterium
DLSRLYVRAGRYELQRAG

SEQ ID NO: 925924 - protein, 24 aa, Mycobacterium
DLSSLKMVACGGSAVPRSLMTAYD

SEQ ID NO: 925925 - protein, 23 aa, Mycobacterium
DLTDYLLEMGIRVRYLHSEVDTL

SEQ ID NO: 925926 - protein, 24 aa, Mycobacterium
DLTLGRFKRGLLAGTSFGDENAPL

SEQ ID NO: 925927 - protein, 33 aa, Mycobacterium
DLTNARLRKGLLLGTHWGRLGAELVPAPGDPSY

SEQ ID NO: 925928 - protein, 24 aa, Mycobacterium
DLVAEDRGTWALARVNVDTNPQIA

SEQ ID NO: 925929 - protein, 25 aa, Mycobacterium
DLVAELRAGLPPNLAVTGSYLDGIG

SEQ ID NO: 925930 - protein, 24 aa, Mycobacterium
DLVARAAVRAVRFDLAVVPVRTEA

SEQ ID NO: 925931 - protein, 25 aa, Mycobacterium
DLVARAVVRAVRFDLAVVPVRTEAW

SEQ ID NO: 925932 - protein, 20 aa, Mycobacterium
DLVPLPAIIGHDISGVIEEV

SEQ ID NO: 925933 - protein, 18 aa, Mycobacterium
DLYCRVPQDSAFNVRGAR

SEQ ID NO: 925934 - protein, 28 aa, Mycobacterium
DLYDREPARCWARGPVVLAGDAAHPMRP

SEQ ID NO: 925935 - protein, 21 aa, Mycobacterium
DLYDYPDWHLSEHSSHDDAER

SEQ ID NO: 925936 - protein, 17 aa, Mycobacterium
DMAIKLGLRSYAEPGTA

SEQ ID NO: 925937 - protein, 18 aa, Mycobacterium
DMASGRRLQLADITKPGV

SEQ ID NO: 925938 - protein, 18 aa, Mycobacterium
DMASGRRVQLADLTTSNP

SEQ ID NO: 925939 - protein, 20 aa, Mycobacterium
DMFWSMAPLVLVCIVLAGVL

SEQ ID NO: 925940 - protein, 18 aa, Mycobacterium
DMGASDWPAARRLRFAND

SEQ ID NO: 925941 - protein, 25 aa, Mycobacterium
DMIGRAGGLLVDIWIDTVPRGYRIA

SEQ ID NO: 925942 - protein, 22 aa, Mycobacterium
DMLPALRKLLADNRDGLTHDIN

SEQ ID NO: 925943 - protein, 18 aa, Mycobacterium
DMPPRADGVYTRGGGPVQ

SEQ ID NO: 925944 - protein, 26 aa, Mycobacterium
DMSRFWSKFAGHLMVRSSIPDPASLT

SEQ ID NO: 925945 - protein, 24 aa, Mycobacterium
DMSSAAAFNAQWVGVRTRFFDEFF

SEQ ID NO: 925946 - protein, 18 aa, Mycobacterium
DMSSGRRVQLSDLTTSDP

SEQ ID NO: 925947 - protein, 25 aa, Mycobacterium
DNAKLSTFFCDKFRGVVASKTADDQ

SEQ ID NO: 925948 - protein, 24 aa, Mycobacterium
DNDFRQLWFGWADPAQILVEYAQL

SEQ ID NO: 925949 - protein, 17 aa, Mycobacterium
DNEGFKAFDDSACSIYV

SEQ ID NO: 925950 - protein, 25 aa, Mycobacterium
DNEGHSMFPWLTLALVGNATGRISF

SEQ ID NO: 925951 - protein, 20 aa, Mycobacterium
DNGLHTWQYWGAQLQAMLPD

SEQ ID NO: 925952 - protein, 25 aa, Mycobacterium
DNGRIRYKRVCEVCGEVVEYGDLAR

SEQ ID NO: 925953 - protein, 25 aa, Mycobacterium
DNGRIRYKRVCEVCGEVVEYRDINK

SEQ ID NO: 925954 - protein, 25 aa, Mycobacterium
DNGRIRYKRVCEVCGEVVEYSDLAR

SEQ ID NO: 925955 - protein, 23 aa, Mycobacterium
DNGRIRYNRVCEVCGEVVEYRDI

SEQ ID NO: 925956 - protein, 22 aa, Mycobacterium
DNGRIRYQRVCEVDGEVVEYRD

SEQ ID NO: 925957 - protein, 23 aa, Mycobacterium
DNGRQRWCVRLVQGGGFAGPLFD

SEQ ID NO: 925958 - protein, 17 aa, Mycobacterium
DNIARYAPPPAVYAPLP

SEQ ID NO: 925959 - protein, 23 aa, Mycobacterium
DNILRPIIDSAYVRNDKPGDSRP

SEQ ID NO: 925960 - protein, 22 aa, Mycobacterium
DNLPAKFLEGFVRTSNLKFQTA

SEQ ID NO: 925961 - protein, 22 aa, Mycobacterium
DNLPAKFLEGFVRTSNMKFQAA

SEQ ID NO: 925962 - protein, 20 aa, Mycobacterium
DNLPTCVIKYIPLHTPAVVQ

SEQ ID NO: 925963 - protein, 24 aa, Mycobacterium
DNNGVHSWGYWGAQLAAMKPDMQR

SEQ ID NO: 925964 - protein, 18 aa, Mycobacterium
DNNIELIWNSANLDVSTQ

SEQ ID NO: 925965 - protein, 24 aa, Mycobacterium
DNNVVKANSFGAENIGTVATAGGS

SEQ ID NO: 925966 - protein, 18 aa, Mycobacterium
DNNWIAMAISDSTGHINI

SEQ ID NO: 925967 - protein, 21 aa, Mycobacterium
DNPAVGWGIHIDRVEIKDVVL

SEQ ID NO: 925968 - protein, 23 aa, Mycobacterium
DNPDLFWALRGGGGGNFGVTTSM

SEQ ID NO: 925969 - protein, 34 aa, Mycobacterium
DNPGRANGGLFARAYPLFRLMGIDTVTPDTQVQS

SEQ ID NO: 925970 - protein, 19 aa, Mycobacterium
DNPGVWMLHCHNTYHQEAG

SEQ ID NO: 925971 - protein, 23 aa, Mycobacterium
DNPHAPALFDYRWNGDRWESSAD

SEQ ID NO: 925972 - protein, 22 aa, Mycobacterium
DNPSGLRLVKVETLSQAVDALH

SEQ ID NO: 925973 - protein, 25 aa, Mycobacterium
DNQGHSMFPWLTLALVGSATSRISF

SEQ ID NO: 925974 - protein, 24 aa, Mycobacterium
DNQLDILIANAFAGSPAVWLPDLG

SEQ ID NO: 925975 - protein, 22 aa, Mycobacterium
DNVGALLAALGLDLSNPLNLSG

SEQ ID NO: 925976 - protein, 26 aa, Mycobacterium
DNVNYRILLKPGWRFTDGSPVTAHSF

SEQ ID NO: 925977 - protein, 18 aa, Mycobacterium
DPAFGEVACKLGRSTGYS

SEQ ID NO: 925978 - protein, 26 aa, Mycobacterium
DPAKAGMQVSIPWPYSGNVHCEIDVD

SEQ ID NO: 925979 - protein, 18 aa, Mycobacterium
DPALMTWFREAAEHARRI

SEQ ID NO: 925980 - protein, 18 aa, Mycobacterium
DPANCAKAALGPQMPSGV

SEQ ID NO: 925981 - protein, 27 aa, Mycobacterium
DPAQAGMRIVLHFPYSANVHCEIDVDD

SEQ ID NO: 925982 - protein, 23 aa, Mycobacterium
DPARAADVLGFRAAVAPVEGLRD

SEQ ID NO: 925983 - protein, 17 aa, Mycobacterium
DPARIRAAIVDSLLTDG

SEQ ID NO: 925984 - protein, 20 aa, Mycobacterium
DPATTVAVLRNWRTAAVDDR

SEQ ID NO: 925985 - protein, 19 aa, Mycobacterium
DPCAVNLASPVIAKVVSEL

SEQ ID NO: 925986 - protein, 24 aa, Mycobacterium
DPDALRTAMRINLEPGTPVGSVTD

SEQ ID NO: 925987 - protein, 24 aa, Mycobacterium
DPDARLSALSNLYAPFVKLTAGTS

SEQ ID NO: 925988 - protein, 22 aa, Mycobacterium
DPDLVGVFAANLFTAEGSATGI

SEQ ID NO: 925989 - protein, 18 aa, Mycobacterium
DPDPRVGAIFLDDGPVHI

SEQ ID NO: 925990 - protein, 24 aa, Mycobacterium
DPDRARELILEFADFTRYSFRAAG

SEQ ID NO: 925991 - protein, 23 aa, Mycobacterium
DPDRVPGRFSRFVEARCDRTGDV

SEQ ID NO: 925992 - protein, 20 aa, Mycobacterium
DPDVLLREFLKATADPANRH

SEQ ID NO: 925993 - protein, 19 aa, Mycobacterium
DPDVLLREFLKATADPSNR

SEQ ID NO: 925994 - protein, 25 aa, Mycobacterium
DPEAYPAPENLTFVVIGNPARKYGG

SEQ ID NO: 925995 - protein, 20 aa, Mycobacterium
DPEGRPLTYEVITTDKGSVT

SEQ ID NO: 925996 - protein, 24 aa, Mycobacterium
DPEGYKLTVYYAVRVTWGGVYVHS

SEQ ID NO: 925997 - protein, 24 aa, Mycobacterium
DPESVKVVRDFAGEFRAFADEEGE

SEQ ID NO: 925998 - protein, 17 aa, Mycobacterium
DPEVYAPVTGFYSLNYS

SEQ ID NO: 925999 - protein, 21 aa, Mycobacterium
DPEYLQFKFGAPIPPGPPPAD

SEQ ID NO: 926000 - protein, 22 aa, Mycobacterium
DPFPILSQVAANQWAYGTKFLS

SEQ ID NO: 926001 - protein, 21 aa, Mycobacterium
DPGEEVIRTYAPIRSTMWTDY

SEQ ID NO: 926002 - protein, 25 aa, Mycobacterium
DPGSALPVLPPRFAADLLAKTVSTL

SEQ ID NO: 926003 - protein, 25 aa, Mycobacterium
DPGSFLRPETVAGLVASAVNTPRDG

SEQ ID NO: 926004 - protein, 25 aa, Mycobacterium
DPGSMLPPLPPRFAADLLVKTVSTL

SEQ ID NO: 926005 - protein, 18 aa, Mycobacterium
DPHRGRLAGIVVQLLTLA

SEQ ID NO: 926006 - protein, 19 aa, Mycobacterium
DPHYLLWQLRARRFDSPLM

SEQ ID NO: 926007 - protein, 25 aa, Mycobacterium
DPIGQEWLRVAAVRLPRISNSTDIE

SEQ ID NO: 926008 - protein, 24 aa, Mycobacterium
DPKFFPPPMVERMVAAGDLGRKTG

SEQ ID NO: 926009 - protein, 21 aa, Mycobacterium
DPKIGINLCEVGIQFGDDFIE

SEQ ID NO: 926010 - protein, 25 aa, Mycobacterium
DPLNLPGFPFQFLLYKQIAAENAAL

SEQ ID NO: 926011 - protein, 19 aa, Mycobacterium
DPLNLPWLSVGAVGFVSVI

SEQ ID NO: 926012 - protein, 19 aa, Mycobacterium
DPLPPHSVLVTFDDGAKGV

SEQ ID NO: 926013 - protein, 28 aa, Mycobacterium
DPLWTQDSPKGWVYIVSDGFDRSHPAVL

SEQ ID NO: 926014 - protein, 19 aa, Mycobacterium
DPNGLRAGHAMSRAIQLAG

SEQ ID NO: 926015 - protein, 28 aa, Mycobacterium
DPNIQPQGRFSWRTMPDNLEDAGVSWKI

SEQ ID NO: 926016 - protein, 28 aa, Mycobacterium
DPNIQPQGRFSWRTMPDNLSDAGISWKV

SEQ ID NO: 926017 - protein, 21 aa, Mycobacterium
DPNLGRLGGRITDALTGKELW

SEQ ID NO: 926018 - protein, 20 aa, Mycobacterium
DPNLGRLGGRVTDALTGQEL

SEQ ID NO: 926019 - protein, 21 aa, Mycobacterium
DPNPFGGLGCDCRDSPSTRGT

SEQ ID NO: 926020 - protein, 22 aa, Mycobacterium
DPNVPNAFAVIADRTSKDLYTP

SEQ ID NO: 926021 - protein, 33 aa, Mycobacterium
DPPNQARALFVLRAAGLIALKGGRVTPSTADID

SEQ ID NO: 926022 - protein, 23 aa, Mycobacterium
DPPPPPVCYANRPSVNAIEQTPC

SEQ ID NO: 926023 - protein, 18 aa, Mycobacterium
DPPPSRWKIDQVYFDPRW

SEQ ID NO: 926024 - protein, 27 aa, Mycobacterium
DPPRELPPEFEVMYLLCGCDELQIADL

SEQ ID NO: 926025 - protein, 19 aa, Mycobacterium
DPPTISALVSKLTGNVDPA

SEQ ID NO: 926026 - protein, 26 aa, Mycobacterium
DPPTRLFRPSVLWRVAEHSQRRRRRV

SEQ ID NO: 926027 - protein, 20 aa, Mycobacterium
DPPTVSALFSKFTGDVDPAK

SEQ ID NO: 926028 - protein, 36 aa, Mycobacterium
DPQGPDCGPFKEAVPEWKGLANLPVSTALASIPEIS

SEQ ID NO: 926029 - protein, 17 aa, Mycobacterium
DPQGPGCDDFKKAVPSW

SEQ ID NO: 926030 - protein, 30 aa, Mycobacterium
DPQPDGSLVLWDWWPMPFANSTRVTLVNTT

SEQ ID NO: 926031 - protein, 25 aa, Mycobacterium
DPQVAGGWVSWRINRQIFEPLVDED

SEQ ID NO: 926032 - protein, 20 aa, Mycobacterium
DPRADYAIARVSGDGSLQAR

SEQ ID NO: 926033 - protein, 22 aa, Mycobacterium
DPRAPLSALLPMGGAVSRVAGP

SEQ ID NO: 926034 - protein, 17 aa, Mycobacterium
DPRIDLREADLEPGQKW

SEQ ID NO: 926035 - protein, 17 aa, Mycobacterium
DPRIDLREADLQPGEKW

SEQ ID NO: 926036 - protein, 29 aa, Mycobacterium
DPRLPRLDYDPTLWRAFVERARYRADGGS

SEQ ID NO: 926037 - protein, 18 aa, Mycobacterium
DPRLRIFHASRLHLVSFN

SEQ ID NO: 926038 - protein, 22 aa, Mycobacterium
DPRLRLWRGEWVTLIVTSVGND

SEQ ID NO: 926039 - protein, 22 aa, Mycobacterium
DPRNEWLFDESWGVDVAVSTPR

SEQ ID NO: 926040 - protein, 18 aa, Mycobacterium
DPRRSLFTALGFQTQDVV

SEQ ID NO: 926041 - protein, 26 aa, Mycobacterium
DPRSNLARYGIAPGYPVDFAADVKAN

SEQ ID NO: 926042 - protein, 17 aa, Mycobacterium
DPRVHALYITNYPDQSQ

SEQ ID NO: 926043 - protein, 19 aa, Mycobacterium
DPRYRDVRVRQAISMAIDR

SEQ ID NO: 926044 - protein, 23 aa, Mycobacterium
DPSDPPTIVAILSKLTGNVEAAK

SEQ ID NO: 926045 - protein, 24 aa, Mycobacterium
DPSDVVVLLAQFGIKGAITNASTE

SEQ ID NO: 926046 - protein, 17 aa, Mycobacterium
DPSRPAVVVDHIVPIAA

SEQ ID NO: 926047 - protein, 22 aa, Mycobacterium
DPSRPVDCIVRVRAKDGSESGR

SEQ ID NO: 926048 - protein, 28 aa, Mycobacterium
DPSSNFTYRFSAPHPGTYWAHPHTGLDA

SEQ ID NO: 926049 - protein, 35 aa, Mycobacterium
DPTGPNGILRWIPFRIPIIGLTPVRPPDTPYETTI

SEQ ID NO: 926050 - protein, 19 aa, Mycobacterium
DPTLPFRRLIRAGNRDADW

SEQ ID NO: 926051 - protein, 17 aa, Mycobacterium
DPTLPKLISAGAPGDPL

SEQ ID NO: 926052 - protein, 25 aa, Mycobacterium
DPTLPWPPDRRQIDAGTLVLGHAIP

SEQ ID NO: 926053 - protein, 17 aa, Mycobacterium
DPTPGLYTELDWQVGGP

SEQ ID NO: 926054 - protein, 21 aa, Mycobacterium
DPVCFPGGLDRAAHSSYKSNG

SEQ ID NO: 926055 - protein, 25 aa, Mycobacterium
DPVLARPLIQLGLPVAAAGWLSTET

SEQ ID NO: 926056 - protein, 19 aa, Mycobacterium
DPVMAWRYMDLREDDRPPE

SEQ ID NO: 926057 - protein, 27 aa, Mycobacterium
DPVRLHVLAAASLRKAFTEIGRSFEST

SEQ ID NO: 926058 - protein, 23 aa, Mycobacterium
DPVTWAFQCALNIASTTPQQITR

SEQ ID NO: 926059 - protein, 19 aa, Mycobacterium
DPVVWAFNCALNVVSATPN

SEQ ID NO: 926060 - protein, 25 aa, Mycobacterium
DPWHVTAIYLDPRWLADQDEQADFA

SEQ ID NO: 926061 - protein, 21 aa, Mycobacterium
DPWLRQVPIGVVGEIYVAGSQ

SEQ ID NO: 926062 - protein, 22 aa, Mycobacterium
DPYRYPDHRPINAAKGGEGGKP

SEQ ID NO: 926063 - protein, 19 aa, Mycobacterium
DQALARLVAAYGDTDRTLL

SEQ ID NO: 926064 - protein, 25 aa, Mycobacterium
DQATAHFGWLGGFFAVDANLGSALT

SEQ ID NO: 926065 - protein, 33 aa, Mycobacterium
DQATGIWSMPWMWKAAGTYRVFADFQPAQAGSA

SEQ ID NO: 926066 - protein, 22 aa, Mycobacterium
DQDFVLPFGVVPVSAREFSENY

SEQ ID NO: 926067 - protein, 19 aa, Mycobacterium
DQFGCGRVFLVGDAPHTMP

SEQ ID NO: 926068 - protein, 18 aa, Mycobacterium
DQGFTTVTGLEWGNWGPF

SEQ ID NO: 926069 - protein, 24 aa, Mycobacterium
DQHRPEVVFHLAAQIDVRHSVADP

SEQ ID NO: 926070 - protein, 26 aa, Mycobacterium
DQHYPGDVVDLTWRDRGGFDRNGKAT

SEQ ID NO: 926071 - protein, 24 aa, Mycobacterium
DQIAGLKPDLIVAVNAGVDADTYQ

SEQ ID NO: 926072 - protein, 27 aa, Mycobacterium
DQIATLRWDGGLAQSRMDNLLSQAYTS

SEQ ID NO: 926073 - protein, 23 aa, Mycobacterium
DQIVLAEGYELGGFNPVNGYAES

SEQ ID NO: 926074 - protein, 24 aa, Mycobacterium
DQKEKLAELTARWQNEKNAIEIVR

SEQ ID NO: 926075 - protein, 17 aa, Mycobacterium
DQLAWLAKISCERLERG

SEQ ID NO: 926076 - protein, 26 aa, Mycobacterium
DQLDALCALGLQSRVVGAAFPDGSNS

SEQ ID NO: 926077 - protein, 18 aa, Mycobacterium
DQLRRWLDSILDAVAGKL

SEQ ID NO: 926078 - protein, 28 aa, Mycobacterium
DQLTWTFRLRPGVTFHDGTPLAAEDVVF

SEQ ID NO: 926079 - protein, 32 aa, Mycobacterium
DQLYADFRLLFLILHASRFAPRLDEHAAKVAA

SEQ ID NO: 926080 - protein, 24 aa, Mycobacterium
DQNWRSTLVAVFAPRSLYAPGYLE

SEQ ID NO: 926081 - protein, 18 aa, Mycobacterium
DQPFAVKVSCGFGGSMDE

SEQ ID NO: 926082 - protein, 18 aa, Mycobacterium
DQPHKGEVFAVMQMPDGD

SEQ ID NO: 926083 - protein, 18 aa, Mycobacterium
DQPPLRALLDLLPIAAGS

SEQ ID NO: 926084 - protein, 19 aa, Mycobacterium
DQPSLRALLDLLPIAAGSG

SEQ ID NO: 926085 - protein, 27 aa, Mycobacterium
DQRAVPLDAVYHWPALAGQAVQTTGSA

SEQ ID NO: 926086 - protein, 18 aa, Mycobacterium
DQRLRIDLSALRAIGDGL

SEQ ID NO: 926087 - protein, 24 aa, Mycobacterium
DQRVRRALQLGIDRQAVVDTVLSP

SEQ ID NO: 926088 - protein, 24 aa, Mycobacterium
DQSPRRTVAAWALDHVGTRTHRIQ

SEQ ID NO: 926089 - protein, 23 aa, Mycobacterium
DQSVRWRATVVQMDGRRIDLLEL

SEQ ID NO: 926090 - protein, 19 aa, Mycobacterium
DQVDFGWADTPAVLTNIDK

SEQ ID NO: 926091 - protein, 25 aa, Mycobacterium
DQVIAVHLRGHFLLTRNAAAYWRAK

SEQ ID NO: 926092 - protein, 26 aa, Mycobacterium
DQVIGVHLRGHFLLTRNAATYWRQKA

SEQ ID NO: 926093 - protein, 18 aa, Mycobacterium
DQWICEFTMIAKANVISQ

SEQ ID NO: 926094 - protein, 17 aa, Mycobacterium
DQYRALLRGEFDFGVTV

SEQ ID NO: 926095 - protein, 32 aa, Mycobacterium
DRAAARCGSPAWDLPTVFGPIAVTYNVNGVSK

SEQ ID NO: 926096 - protein, 32 aa, Mycobacterium
DRAAQRCGSQAWDLPTVFGPIAVTYHLTGVSG

SEQ ID NO: 926097 - protein, 23 aa, Mycobacterium
DRADGTISWNFADHEWALDGEVT

SEQ ID NO: 926098 - protein, 25 aa, Mycobacterium
DRAGKGFLAQLCEDWEAATLPAQYG

SEQ ID NO: 926099 - protein, 19 aa, Mycobacterium
DRAGTFGGYGVDIRVALSP

SEQ ID NO: 926100 - protein, 25 aa, Mycobacterium
DRALARSAFPVFVVSPYYGGTLGRG

SEQ ID NO: 926101 - protein, 22 aa, Mycobacterium
DRALRVNLEIPVQMTRELIPAF

SEQ ID NO: 926102 - protein, 23 aa, Mycobacterium
DRAPRVAGPFGQMPGQTGAALSR

SEQ ID NO: 926103 - protein, 17 aa, Mycobacterium
DRARLSDFVHRRVGALE

SEQ ID NO: 926104 - protein, 29 aa, Mycobacterium
DRARNLLDDAGWRPGAGQIREKDGARASF

SEQ ID NO: 926105 - protein, 23 aa, Mycobacterium
DRDFDGRITLFAEEERLPYERPP

SEQ ID NO: 926106 - protein, 23 aa, Mycobacterium
DRDGFVFGEAGALMVLETEEHAK

SEQ ID NO: 926107 - protein, 17 aa, Mycobacterium
DRDGLTFTASDTAKGGV

SEQ ID NO: 926108 - protein, 17 aa, Mycobacterium
DRDRLVVIIAGYSNDID

SEQ ID NO: 926109 - protein, 18 aa, Mycobacterium
DRDRLVVIIAGYSNDIDR

SEQ ID NO: 926110 - protein, 23 aa, Mycobacterium
DREESRLPPIYPGTTVSIPPSTT

SEQ ID NO: 926111 - protein, 19 aa, Mycobacterium
DREKHTVVRVIDGVPQELP

SEQ ID NO: 926112 - protein, 21 aa, Mycobacterium
DRELFAGTVIDGVRDAGNRVL

SEQ ID NO: 926113 - protein, 18 aa, Mycobacterium
DRFARWRAAAGLPTELSV

SEQ ID NO: 926114 - protein, 20 aa, Mycobacterium
DRGAFLRVLEYLAHLDDPQF

SEQ ID NO: 926115 - protein, 25 aa, Mycobacterium
DRGCTRPGCTANGYRCQAHHATTDY

SEQ ID NO: 926116 - protein, 18 aa, Mycobacterium
DRGRPAPPHRRWSQYLSW

SEQ ID NO: 926117 - protein, 20 aa, Mycobacterium
DRGSCPFADKERVAAERGAV

SEQ ID NO: 926118 - protein, 26 aa, Mycobacterium
DRIVLCGGAIETAHLLMLSGIGDPDA

SEQ ID NO: 926119 - protein, 23 aa, Mycobacterium
DRIYKVGELMPIHHLCHCTIAAV

SEQ ID NO: 926120 - protein, 20 aa, Mycobacterium
DRLANMVGELIELSRLQGGE

SEQ ID NO: 926121 - protein, 20 aa, Mycobacterium
DRLDSLMAVARKDLVLSGGW

SEQ ID NO: 926122 - protein, 24 aa, Mycobacterium
DRLGFARAVLRDRVGITPACGLAG

SEQ ID NO: 926123 - protein, 25 aa, Mycobacterium
DRLPRDGRGPLGWLYTPSGDVTSLL

SEQ ID NO: 926124 - protein, 28 aa, Mycobacterium
DRLRQLPLAQFRTSYAYTNFGLTAGAEA

SEQ ID NO: 926125 - protein, 22 aa, Mycobacterium
DRLRYVITRAPATGTVKINVDG

SEQ ID NO: 926126 - protein, 22 aa, Mycobacterium
DRMGALALHVAKIARRRHPQHA

SEQ ID NO: 926127 - protein, 20 aa, Mycobacterium
DRMHFCAFDVMPNATRGEVQ

SEQ ID NO: 926128 - protein, 21 aa, Mycobacterium
DRNEIALGLGVSRVPIQEALV

SEQ ID NO: 926129 - protein, 18 aa, Mycobacterium
DRPDNLLALANTLVGEAT

SEQ ID NO: 926130 - protein, 17 aa, Mycobacterium
DRPITAITWRDSLGHMR

SEQ ID NO: 926131 - protein, 17 aa, Mycobacterium
DRQGVQLLFPLPLGISM

SEQ ID NO: 926132 - protein, 26 aa, Mycobacterium
DRRAAIEHAVAWARPGDVVLVAGKGH

SEQ ID NO: 926133 - protein, 23 aa, Mycobacterium
DRRDIRVMVGREFDPSGFDKFMA

SEQ ID NO: 926134 - protein, 23 aa, Mycobacterium
DRREWPSPMLPALPTLFDDFGGD

SEQ ID NO: 926135 - protein, 23 aa, Mycobacterium
DRRLRAFLNICRHRGALLCTEPE

SEQ ID NO: 926136 - protein, 22 aa, Mycobacterium
DRRSLCQIFSYQATAAVMRGEP

SEQ ID NO: 926137 - protein, 24 aa, Mycobacterium
DRRTALKLPLLLAAGTAVATAGRA

SEQ ID NO: 926138 - protein, 26 aa, Mycobacterium
DRRYRVKTVEGFRCGIFVQGATESTH

SEQ ID NO: 926139 - protein, 21 aa, Mycobacterium
DRSGSMGGWKMVAARRAAGRI

SEQ ID NO: 926140 - protein, 22 aa, Mycobacterium
DRVLICAGVRTPALFGPLGVDF

SEQ ID NO: 926141 - protein, 23 aa, Mycobacterium
DRVRYDLPPGYEVSGLDGRVDPV

SEQ ID NO: 926142 - protein, 19 aa, Mycobacterium
DRWSHGRVVLVGDAGYCCS

SEQ ID NO: 926143 - protein, 17 aa, Mycobacterium
DRYEVHHGVRITDSALV

SEQ ID NO: 926144 - protein, 17 aa, Mycobacterium
DRYEVHHGVRITDSSLV

SEQ ID NO: 926145 - protein, 17 aa, Mycobacterium
DRYRYPADLPRVAATGG

SEQ ID NO: 926146 - protein, 24 aa, Mycobacterium
DSAAVSSRFPGAITDLQLSRDGTR

SEQ ID NO: 926147 - protein, 18 aa, Mycobacterium
DSAECGMLSVPVDYSKPD

SEQ ID NO: 926148 - protein, 23 aa, Mycobacterium
DSAEVPFAVVVPMAGHAPFESIP

SEQ ID NO: 926149 - protein, 22 aa, Mycobacterium
DSAKRGGPLMLLASPTLPGAGL

SEQ ID NO: 926150 - protein, 31 aa, Mycobacterium
DSASLSFSSLSGWAQLGLRNRFIELTDAVWR

SEQ ID NO: 926151 - protein, 18 aa, Mycobacterium
DSDGRWSTNYSAIAVSPD

SEQ ID NO: 926152 - protein, 25 aa, Mycobacterium
DSEPLLRIPVPDGWERNTMMDNDVI

SEQ ID NO: 926153 - protein, 27 aa, Mycobacterium
DSFDPYRLALMFFGEVKAPITVRTTGG

SEQ ID NO: 926154 - protein, 26 aa, Mycobacterium
DSFGLKMTGPRPGGFGELNDRTNQIC

SEQ ID NO: 926155 - protein, 21 aa, Mycobacterium
DSFRYYPGFAGPALNTLRDNQ

SEQ ID NO: 926156 - protein, 21 aa, Mycobacterium
DSFTRRDPVVLYRATPQTFTD

SEQ ID NO: 926157 - protein, 19 aa, Mycobacterium
DSFVKRWRTALHVTLLALM

SEQ ID NO: 926158 - protein, 23 aa, Mycobacterium
DSGGSGWDGGGWDGGGGDFGGDF

SEQ ID NO: 926159 - protein, 18 aa, Mycobacterium
DSGIAIAMGHRVCKGFDN

SEQ ID NO: 926160 - protein, 23 aa, Mycobacterium
DSGLRRLLKEHLLFRRLEDAPIP

SEQ ID NO: 926161 - protein, 30 aa, Mycobacterium
DSGNLPLLEPFRVMPHLLNLIPGTNIPTPL

SEQ ID NO: 926162 - protein, 17 aa, Mycobacterium
DSGPILVRRTHEMTGTT

SEQ ID NO: 926163 - protein, 17 aa, Mycobacterium
DSHPVLAMASNRTYGLN

SEQ ID NO: 926164 - protein, 26 aa, Mycobacterium
DSIMAAGRFLAANGFANDPAHAVFGY

SEQ ID NO: 926165 - protein, 18 aa, Mycobacterium
DSIYRLWYQFTQISDKIK

SEQ ID NO: 926166 - protein, 23 aa, Mycobacterium
DSKGFGAGRVRQWGYNAANDPQG

SEQ ID NO: 926167 - protein, 28 aa, Mycobacterium
DSKIASWTDPKGGYFISLDVLPGTAKRT

SEQ ID NO: 926168 - protein, 21 aa, Mycobacterium
DSLRIFPATHYVAGPERMAQA

SEQ ID NO: 926169 - protein, 21 aa, Mycobacterium
DSNGMVVLTLWEPGADKPVLV

SEQ ID NO: 926170 - protein, 18 aa, Mycobacterium
DSNVAFFREYKNVGLTPQ

SEQ ID NO: 926171 - protein, 25 aa, Mycobacterium
DSPASSSLLWFLGAAGRRQTDQQAG

SEQ ID NO: 926172 - protein, 25 aa, Mycobacterium
DSPEFPEPYRAEALAHAAALDTLEQ

SEQ ID NO: 926173 - protein, 19 aa, Mycobacterium
DSPPAQWMPPNAAFACQYA

SEQ ID NO: 926174 - protein, 26 aa, Mycobacterium
DSQFGKEVCNLMGLRQLGCSTGTLQD

SEQ ID NO: 926175 - protein, 21 aa, Mycobacterium
DSQKLLGWRTTDMAMGDFYGF

SEQ ID NO: 926176 - protein, 17 aa, Mycobacterium
DSRPYLYNGEIRRNVET

SEQ ID NO: 926177 - protein, 17 aa, Mycobacterium
DSRRGGTGLTVLASTRL

SEQ ID NO: 926178 - protein, 23 aa, Mycobacterium
DSRSCPVRINLELVRERRGDIDA

SEQ ID NO: 926179 - protein, 22 aa, Mycobacterium
DSRVMPIIPALFGSGPNPLIVT

SEQ ID NO: 926180 - protein, 26 aa, Mycobacterium
DSSGGLLIRCAIRFDITVSTAQAANF

SEQ ID NO: 926181 - protein, 24 aa, Mycobacterium
DSSHRPALGVSRVEWSPVPDAGSA

SEQ ID NO: 926182 - protein, 22 aa, Mycobacterium
DSTAAWRTFCANNFRADDPRPP

SEQ ID NO: 926183 - protein, 17 aa, Mycobacterium
DSTDWNPSWASWAGAMI

SEQ ID NO: 926184 - protein, 20 aa, Mycobacterium
DSTLADWRKTLDVNVLAPVA

SEQ ID NO: 926185 - protein, 22 aa, Mycobacterium
DSTNRLLVYVGRRSDVLDRVLT

SEQ ID NO: 926186 - protein, 20 aa, Mycobacterium
DSVAKLGYYSQFRDQSITKA

SEQ ID NO: 926187 - protein, 19 aa, Mycobacterium
DSVPANFVLPDGITGPMPD

SEQ ID NO: 926188 - protein, 24 aa, Mycobacterium
DSVSCPRSGEVIVRERGHWFSTGA

SEQ ID NO: 926189 - protein, 24 aa, Mycobacterium
DSYLRCLQVLMAGSGYPMVASHDP

SEQ ID NO: 926190 - protein, 23 aa, Mycobacterium
DTAALLARFTGLRTCTARLGRTV

SEQ ID NO: 926191 - protein, 17 aa, Mycobacterium
DTAEKWANFPGDTAQKW

SEQ ID NO: 926192 - protein, 27 aa, Mycobacterium
DTAHPDARLRFMLHDAKPVAAVTTSAL

SEQ ID NO: 926193 - protein, 24 aa, Mycobacterium
DTAPGRITAVLGLHDLVNGGHAGQ

SEQ ID NO: 926194 - protein, 24 aa, Mycobacterium
DTAWIPVCYPAAIPTPVPGSPMPK

SEQ ID NO: 926195 - protein, 29 aa, Mycobacterium
DTDVIGAPGTEVWTFTALKPGTTTITTGY

SEQ ID NO: 926196 - protein, 20 aa, Mycobacterium
DTFAGPSFHSAAWDRSVDLT

SEQ ID NO: 926197 - protein, 22 aa, Mycobacterium
DTGGPRGSFAMNNFANPVAVIC

SEQ ID NO: 926198 - protein, 19 aa, Mycobacterium
DTGGPRGSFAMNNFSNPVT

SEQ ID NO: 926199 - protein, 23 aa, Mycobacterium
DTGLLRRIFTVAGIFDRYELLLI

SEQ ID NO: 926200 - protein, 19 aa, Mycobacterium
DTGLYLPVIVDDPTEGDYD

SEQ ID NO: 926201 - protein, 26 aa, Mycobacterium
DTIDWYRANESWWRPLKDTVEAKYQE

SEQ ID NO: 926202 - protein, 32 aa, Mycobacterium
DTIRAAPQWPELEAGALRRIRGPRVGAPSDVA

SEQ ID NO: 926203 - protein, 19 aa, Mycobacterium
DTIVLKRSRPLDISVDGQD

SEQ ID NO: 926204 - protein, 18 aa, Mycobacterium
DTIVLRRSRPLEVSLDGE

SEQ ID NO: 926205 - protein, 23 aa, Mycobacterium
DTLTADVGIEFTAPDVTAAMNQT

SEQ ID NO: 926206 - protein, 22 aa, Mycobacterium
DTLTTNVAMEFIAADVSSALNQ

SEQ ID NO: 926207 - protein, 27 aa, Mycobacterium
DTLVTRCVADFGLPYTRGVVERLRRYI

SEQ ID NO: 926208 - protein, 18 aa, Mycobacterium
DTMYAMFAHAALITGDGA

SEQ ID NO: 926209 - protein, 18 aa, Mycobacterium
DTNGRPLIYTLLDGPDQG

SEQ ID NO: 926210 - protein, 24 aa, Mycobacterium
DTNYDGAVVWQVALVHRDGSTLQI

SEQ ID NO: 926211 - protein, 18 aa, Mycobacterium
DTPDRLVSITSDVGSVAL

SEQ ID NO: 926212 - protein, 19 aa, Mycobacterium
DTPLPCSRGRAQLPDSMDV

SEQ ID NO: 926213 - protein, 18 aa, Mycobacterium
DTPTPLFAQKGWNPRTQA

SEQ ID NO: 926214 - protein, 28 aa, Mycobacterium
DTPVVAKLPWFELGDAYVTSHVTIADLY

SEQ ID NO: 926215 - protein, 21 aa, Mycobacterium
DTPVVSRLPWFALSDPTTTQM

SEQ ID NO: 926216 - protein, 24 aa, Mycobacterium
DTQHPSARIGFMLTDASPKAAITT

SEQ ID NO: 926217 - protein, 18 aa, Mycobacterium
DTQIPPGQLMTERIINGV

SEQ ID NO: 926218 - protein, 17 aa, Mycobacterium
DTQIVLGGYSQGAAVAG

SEQ ID NO: 926219 - protein, 18 aa, Mycobacterium
DTRHQWYVDLGINPENLR

SEQ ID NO: 926220 - protein, 24 aa, Mycobacterium
DTRPYRLWWPPGTTVFEIDRPEVL

SEQ ID NO: 926221 - protein, 20 aa, Mycobacterium
DTSKKWAIHGSAFERVSAFQ

SEQ ID NO: 926222 - protein, 26 aa, Mycobacterium
DTSPDDFDAVFALNVRAPYFLVGALA

SEQ ID NO: 926223 - protein, 17 aa, Mycobacterium
DTSVLLGRLDLKLFAGA

SEQ ID NO: 926224 - protein, 17 aa, Mycobacterium
DTTYGLVNAGYCYADRT

SEQ ID NO: 926225 - protein, 24 aa, Mycobacterium
DTVEKLRPLIAVWTGASAISELTL

SEQ ID NO: 926226 - protein, 23 aa, Mycobacterium
DTVIKLSQAFSVLGDHSSDIFGT

SEQ ID NO: 926227 - protein, 24 aa, Mycobacterium
DTVLPRRHQLVLSRGPYRYDDELG

SEQ ID NO: 926228 - protein, 17 aa, Mycobacterium
DTVRTIALFDFNPAFDE

SEQ ID NO: 926229 - protein, 17 aa, Mycobacterium
DTWLRRQLTPNFRAGCK

SEQ ID NO: 926230 - protein, 25 aa, Mycobacterium
DTYAKANNIELVWNSANNDVSTQAS

SEQ ID NO: 926231 - protein, 26 aa, Mycobacterium
DTYFPRIAATLVEHGWAEGLRPNNHA

SEQ ID NO: 926232 - protein, 18 aa, Mycobacterium
DVAANWKLIVENFMECYH

SEQ ID NO: 926233 - protein, 18 aa, Mycobacterium
DVADRPRRAEIASTATPW

SEQ ID NO: 926234 - protein, 24 aa, Mycobacterium
DVAFSVPVGGLLSPLQPFTLTLTP

SEQ ID NO: 926235 - protein, 20 aa, Mycobacterium
DVAKSVAFAIAERMSAIDPA

SEQ ID NO: 926236 - protein, 20 aa, Mycobacterium
DVASAVKSFLTVAVNQGQKG

SEQ ID NO: 926237 - protein, 24 aa, Mycobacterium
DVASRIRGIATFGNIDRRGGGMTG

SEQ ID NO: 926238 - protein, 20 aa, Mycobacterium
DVDVSFARGRKEPVGLGRVG

SEQ ID NO: 926239 - protein, 22 aa, Mycobacterium
DVEPKVAAFLGGNGYSQNSHTQ

SEQ ID NO: 926240 - protein, 17 aa, Mycobacterium
DVFPTNLSVGFLGFIGQ

SEQ ID NO: 926241 - protein, 24 aa, Mycobacterium
DVFSHAALDYGLRMHTMQAQWARD

SEQ ID NO: 926242 - protein, 18 aa, Mycobacterium
DVFTFRFVSENAPPGTIS

SEQ ID NO: 926243 - protein, 22 aa, Mycobacterium
DVGDPGFAVFGLRDGALVGAAS

SEQ ID NO: 926244 - protein, 24 aa, Mycobacterium
DVGLRSSYVASWYAAPLLVAGGRG

SEQ ID NO: 926245 - protein, 24 aa, Mycobacterium
DVGPDLDAAIAYATLFPYTQNFVD

SEQ ID NO: 926246 - protein, 18 aa, Mycobacterium
DVGPELDAALAYAPTYPF

SEQ ID NO: 926247 - protein, 19 aa, Mycobacterium
DVILTGKIKECIVRTDKSG

SEQ ID NO: 926248 - protein, 19 aa, Mycobacterium
DVINELRAAGAEAMEIRGR

SEQ ID NO: 926249 - protein, 17 aa, Mycobacterium
DVLAPAWQEATGGTLDV

SEQ ID NO: 926250 - protein, 26 aa, Mycobacterium
DVLASEVPPGWGWNGSPRWRAQGSPW

SEQ ID NO: 926251 - protein, 18 aa, Mycobacterium
DVLDWPGNRALEQSMGAL

SEQ ID NO: 926252 - protein, 18 aa, Mycobacterium
DVLGALVVVTASTPGPGM

SEQ ID NO: 926253 - protein, 18 aa, Mycobacterium
DVLRPSLVEMGRAVVRQD

SEQ ID NO: 926254 - protein, 26 aa, Mycobacterium
DVLTSRLAVCGGEPSIPFNEGKRCRV

SEQ ID NO: 926255 - protein, 17 aa, Mycobacterium
DVMRKVTGMHLSLAVQG

SEQ ID NO: 926256 - protein, 25 aa, Mycobacterium
DVPDGLRCGNVYYGPVIATRDVYSW

SEQ ID NO: 926257 - protein, 20 aa, Mycobacterium
DVPGGFAAGLARTLPVTGGQ

SEQ ID NO: 926258 - protein, 25 aa, Mycobacterium
DVPGVEVLAGFFWGQDRYRYPADLP

SEQ ID NO: 926259 - protein, 22 aa, Mycobacterium
DVPKGGSFPLYTAIDVNMTAQG

SEQ ID NO: 926260 - protein, 18 aa, Mycobacterium
DVPTVLPGVDVLAGIAVV

SEQ ID NO: 926261 - protein, 18 aa, Mycobacterium
DVRDGTVVRRFVSAACAA

SEQ ID NO: 926262 - protein, 21 aa, Mycobacterium
DVRTARIVTPRVMALTLRARQ

SEQ ID NO: 926263 - protein, 19 aa, Mycobacterium
DVRTARIVTPRVMQLTLRA

SEQ ID NO: 926264 - protein, 20 aa, Mycobacterium
DVRTARIVTPRVMQLTLRAQ

SEQ ID NO: 926265 - protein, 21 aa, Mycobacterium
DVRWRGVDVGSPFQHAKAGIL

SEQ ID NO: 926266 - protein, 22 aa, Mycobacterium
DVSFKNTVNGFGIYQPQDQLAW

SEQ ID NO: 926267 - protein, 22 aa, Mycobacterium
DVTARLAMNVGIDRDALVRDVL

SEQ ID NO: 926268 - protein, 27 aa, Mycobacterium
DVTDGRFRRRNCCLFYQVPGGGYCGDC

SEQ ID NO: 926269 - protein, 17 aa, Mycobacterium
DVTDPKLLAAFGSGAQA

SEQ ID NO: 926270 - protein, 18 aa, Mycobacterium
DVTGEAPTTVVYNDGERD

SEQ ID NO: 926271 - protein, 22 aa, Mycobacterium
DVTKPESWAGFLDQVRAESGPV

SEQ ID NO: 926272 - protein, 23 aa, Mycobacterium
DVTLKERRRLVLVAREAPLSEIH

SEQ ID NO: 926273 - protein, 24 aa, Mycobacterium
DVTLKERRRLVLVPRETPLSEIHL

SEQ ID NO: 926274 - protein, 19 aa, Mycobacterium
DVTLSNWRGLYGPPGMPAG

SEQ ID NO: 926275 - protein, 17 aa, Mycobacterium
DVTRAAQGWNIDTVKES

SEQ ID NO: 926276 - protein, 21 aa, Mycobacterium
DVVAGCAQWTMSDGHTSAAIR

SEQ ID NO: 926277 - protein, 17 aa, Mycobacterium
DVVGQGWGINKQGGMSI

SEQ ID NO: 926278 - protein, 19 aa, Mycobacterium
DVVGTTWRFAEVMGAATPT

SEQ ID NO: 926279 - protein, 23 aa, Mycobacterium
DVVHLLMPMAIQLRQVLGHGVRV

SEQ ID NO: 926280 - protein, 20 aa, Mycobacterium
DVVPALRARGYHLVTVSQLL

SEQ ID NO: 926281 - protein, 17 aa, Mycobacterium
DVVRTGASFEVISPHDP

SEQ ID NO: 926282 - protein, 25 aa, Mycobacterium
DVWRRKELPTHPAPVLLFVPGGAWI

SEQ ID NO: 926283 - protein, 21 aa, Mycobacterium
DWDALSELTCVQFREQAANPG

SEQ ID NO: 926284 - protein, 26 aa, Mycobacterium
DWFIRLFAQRLRGCVGGQSMIARLGG

SEQ ID NO: 926285 - protein, 19 aa, Mycobacterium
DWKRDPFTLAEDNGYFYAR

SEQ ID NO: 926286 - protein, 19 aa, Mycobacterium
DWNDRWWTTCMIAFDTSYG

SEQ ID NO: 926287 - protein, 26 aa, Mycobacterium
DWNNQWWVSCMITFKTSYGVVQQSLY

SEQ ID NO: 926288 - protein, 17 aa, Mycobacterium
DWNPSWASWAGAMISTL

SEQ ID NO: 926289 - protein, 20 aa, Mycobacterium
DWPDRPDNWISVANAIVGLA

SEQ ID NO: 926290 - protein, 20 aa, Mycobacterium
DWPDRPDNWLSVANAIVGLA

SEQ ID NO: 926291 - protein, 17 aa, Mycobacterium
DWPQARLTLALSPATLP

SEQ ID NO: 926292 - protein, 23 aa, Mycobacterium
DYAEGRLGWRTLDFEVEVLGDCG

SEQ ID NO: 926293 - protein, 17 aa, Mycobacterium
DYAPGMEPFFSVPANSL

SEQ ID NO: 926294 - protein, 18 aa, Mycobacterium
DYFAEVNLAGFYDLAETL

SEQ ID NO: 926295 - protein, 33 aa, Mycobacterium
DYFIKDLEFLPTFPFHYKYLRNAVRGDYLNVYT

SEQ ID NO: 926296 - protein, 25 aa, Mycobacterium
DYHVGGIFIGSWTDLSIFKGPLADI

SEQ ID NO: 926297 - protein, 17 aa, Mycobacterium
DYLNCMRQARAGGTGAE

SEQ ID NO: 926298 - protein, 22 aa, Mycobacterium
DYLRTAEVFDIVAVAVPGTAGL

SEQ ID NO: 926299 - protein, 26 aa, Mycobacterium
DYNGWDINTPVFDWFDQSGLSVVMPT

SEQ ID NO: 926300 - protein, 19 aa, Mycobacterium
DYQALSAKMAAFHDQFVRT

SEQ ID NO: 926301 - protein, 18 aa, Mycobacterium
DYRAMIFCTIRNYHDVAP

SEQ ID NO: 926302 - protein, 23 aa, Mycobacterium
DYRASAATFGRRADAIAGTEHGI

SEQ ID NO: 926303 - protein, 19 aa, Mycobacterium
DYSAFSVIVSRYALAAQKA

SEQ ID NO: 926304 - protein, 50 aa, Mycobacterium
DYSEDLAVYRAHWLVARTAEHIGGWAARPLPLPDMCYGAVLSGDTELSDM

SEQ ID NO: 926305 - protein, 25 aa, Mycobacterium
DYSRDVLKLIPVMWDNVPPPGAPDT

SEQ ID NO: 926306 - protein, 25 aa, Mycobacterium
DYTLPAECKYALHAALAPVYADSGY

SEQ ID NO: 926307 - protein, 17 aa, Mycobacterium
DYVQEYLSRAGISKEQV

SEQ ID NO: 926308 - protein, 24 aa, Mycobacterium
DYWRSSGLPVPGAVIAERELQTWI

SEQ ID NO: 926309 - protein, 19 aa, Mycobacterium
DYYHAFLGLLGNDDVKGQR

SEQ ID NO: 926310 - protein, 20 aa, Mycobacterium
EAAAAQLAGIGSSISTASAT

SEQ ID NO: 926311 - protein, 26 aa, Mycobacterium
EAAAVFPAEGWVDIALLLTTLTAAIA

SEQ ID NO: 926312 - protein, 25 aa, Mycobacterium
EAADIPGQFALAAAMVRHLLSDPML

SEQ ID NO: 926313 - protein, 20 aa, Mycobacterium
EAAGRLMFYGQGAGGAPTAS

SEQ ID NO: 926314 - protein, 22 aa, Mycobacterium
EAAIRWARGRADIDPRRIGMWG

SEQ ID NO: 926315 - protein, 28 aa, Mycobacterium
EAALEMFKKAGGGHLVLISSVLGNTGVP

SEQ ID NO: 926316 - protein, 20 aa, Mycobacterium
EAALQRLRSQTAFEDASARA

SEQ ID NO: 926317 - protein, 29 aa, Mycobacterium
EAALRAAASFELLHVFALLQDDVMDGSAE

SEQ ID NO: 926318 - protein, 19 aa, Mycobacterium
EAAMRALRRTFFNQAPTVD

SEQ ID NO: 926319 - protein, 21 aa, Mycobacterium
EAARRAGVRKVVHTSSGGSIY

SEQ ID NO: 926320 - protein, 17 aa, Mycobacterium
EAARRGLAVAAKPDSHD

SEQ ID NO: 926321 - protein, 18 aa, Mycobacterium
EAASANFAAAVHDGTPGR

SEQ ID NO: 926322 - protein, 17 aa, Mycobacterium
EAAVRLLEWLQASHPTP

SEQ ID NO: 926323 - protein, 28 aa, Mycobacterium
EACPADLVQRWAPGRVMLNAYGPTEATV

SEQ ID NO: 926324 - protein, 20 aa, Mycobacterium
EADARIRVVDAFGRSHPDIK

SEQ ID NO: 926325 - protein, 20 aa, Mycobacterium
EADARMRIVEEFCRRHPDIK

SEQ ID NO: 926326 - protein, 22 aa, Mycobacterium
EADISAAMSPIFAGGHDSSALA

SEQ ID NO: 926327 - protein, 23 aa, Mycobacterium
EADQRTAAVIARNAKALGLAGAT

SEQ ID NO: 926328 - protein, 18 aa, Mycobacterium
EADRGHFLVAYPDGLNRA

SEQ ID NO: 926329 - protein, 29 aa, Mycobacterium
EADSPWATGLRRLGLWSLRLPGIRQLVAR

SEQ ID NO: 926330 - protein, 23 aa, Mycobacterium
EADYVRMWIQAAVTMSTYQALSG

SEQ ID NO: 926331 - protein, 25 aa, Mycobacterium
EAEAKLQAARLVAWSSAGAEGPPPG

SEQ ID NO: 926332 - protein, 18 aa, Mycobacterium
EAEHVLDSFPVVRKYEER

SEQ ID NO: 926333 - protein, 18 aa, Mycobacterium
EAEVTGFVTAARQENLDA

SEQ ID NO: 926334 - protein, 24 aa, Mycobacterium
EAEYAEMWAQDAVAMYAYAASSAA

SEQ ID NO: 926335 - protein, 17 aa, Mycobacterium
EAFPGLGVDGPSIGESV

SEQ ID NO: 926336 - protein, 23 aa, Mycobacterium
EAGFPSFPCEGLVDGTSGAPWVS

SEQ ID NO: 926337 - protein, 21 aa, Mycobacterium
EAGGRFVRRTVTGFVDDAGTV

SEQ ID NO: 926338 - protein, 17 aa, Mycobacterium
EAGLLDWQAVRRGHPGR

SEQ ID NO: 926339 - protein, 27 aa, Mycobacterium
EAGYQIGCGISLAWVKLNGGANITPAI

SEQ ID NO: 926340 - protein, 20 aa, Mycobacterium
EAGYRLAERLQARQLRQDEA

SEQ ID NO: 926341 - protein, 24 aa, Mycobacterium
EAHLICYDLTWGWTPQQIADDVHA

SEQ ID NO: 926342 - protein, 31 aa, Mycobacterium
EAHLISPWGTWEWMGPAALGAVLPAGGTVGL

SEQ ID NO: 926343 - protein, 18 aa, Mycobacterium
EAIARAWQAIVFGEADVA

SEQ ID NO: 926344 - protein, 19 aa, Mycobacterium
EAIMSRFGPEEAQLTLIDP

SEQ ID NO: 926345 - protein, 24 aa, Mycobacterium
EAKMSSEEAELWGGEADQPFDPNY

SEQ ID NO: 926346 - protein, 30 aa, Mycobacterium
EAKRWPDQPGRYFTVRAGSLVAWNSDGPDG

SEQ ID NO: 926347 - protein, 19 aa, Mycobacterium
EALAARGTKVAMFDIAAEA

SEQ ID NO: 926348 - protein, 23 aa, Mycobacterium
EALIEVCGVLGYDARRDSDPVGA

SEQ ID NO: 926349 - protein, 23 aa, Mycobacterium
EALLQRYREGDGFVTYDKVTEPE

SEQ ID NO: 926350 - protein, 18 aa, Mycobacterium
EALMAAASMLEALGSSMD

SEQ ID NO: 926351 - protein, 17 aa, Mycobacterium
EALRAGDELLFVFASGV

SEQ ID NO: 926352 - protein, 25 aa, Mycobacterium
EALTARIAAAPAPILSNIVRNQVNS

SEQ ID NO: 926353 - protein, 17 aa, Mycobacterium
EALTGICAHVRSGGGGW

SEQ ID NO: 926354 - protein, 19 aa, Mycobacterium
EALTPYFAEMFLGRRDVAG

SEQ ID NO: 926355 - protein, 19 aa, Mycobacterium
EAMRRFPAGLLVLGDAICS

SEQ ID NO: 926356 - protein, 20 aa, Mycobacterium
EANAAVVAREAALQADVRPF

SEQ ID NO: 926357 - protein, 25 aa, Mycobacterium
EANGGLRYAPRADLATREEQIAVAE

SEQ ID NO: 926358 - protein, 26 aa, Mycobacterium
EANPRITALMCTADVLALSAMDHLRA

SEQ ID NO: 926359 - protein, 25 aa, Mycobacterium
EANRLYREGGPSWIAVQGKQYEGMV

SEQ ID NO: 926360 - protein, 23 aa, Mycobacterium
EAPVAPRVPALIEQPPGVVVLVT

SEQ ID NO: 926361 - protein, 23 aa, Mycobacterium
EAPVYRASVSASIEASSLTSAAR

SEQ ID NO: 926362 - protein, 26 aa, Mycobacterium
EAQARLQAARLVAWSSAGGQGTPAEM

SEQ ID NO: 926363 - protein, 28 aa, Mycobacterium
EAQGILCGSIVSGLRMRPGNWAGAYACW

SEQ ID NO: 926364 - protein, 24 aa, Mycobacterium
EAQSWPAVMRQVYLDSRSVDSTQP

SEQ ID NO: 926365 - protein, 20 aa, Mycobacterium
EARAMLGFMDPELRIDYRDT

SEQ ID NO: 926366 - protein, 17 aa, Mycobacterium
EARGNIVVINRVGSGPM

SEQ ID NO: 926367 - protein, 30 aa, Mycobacterium
EARIKLDCLFPGLWPSFWGVNEDPLPDGEV

SEQ ID NO: 926368 - protein, 19 aa, Mycobacterium
EASVRGYQAGGVRAVVKHF

SEQ ID NO: 926369 - protein, 24 aa, Mycobacterium
EATELARSYLLRKVADPELRAKLT

SEQ ID NO: 926370 - protein, 25 aa, Mycobacterium
EATMHSVGLGDSWLIPPDATLTVAK

SEQ ID NO: 926371 - protein, 20 aa, Mycobacterium
EATPTLAGVANWADQVRPSR

SEQ ID NO: 926372 - protein, 23 aa, Mycobacterium
EATRHQMHWFYGLGVADRRAYSE

SEQ ID NO: 926373 - protein, 17 aa, Mycobacterium
EATRVAVVREILSQEGN

SEQ ID NO: 926374 - protein, 26 aa, Mycobacterium
EAVAGRAGSLGGLSVPATWTAGASGE

SEQ ID NO: 926375 - protein, 29 aa, Mycobacterium
EAVDGRLYRKVSYGPLLDVFVLDMRTYKN

SEQ ID NO: 926376 - protein, 17 aa, Mycobacterium
EAVEYGAAHGFSVTAMT

SEQ ID NO: 926377 - protein, 20 aa, Mycobacterium
EAVGLARLGAVVVVNDIGAA

SEQ ID NO: 926378 - protein, 17 aa, Mycobacterium
EAVKTFLDDGCIYLDMP

SEQ ID NO: 926379 - protein, 29 aa, Mycobacterium
EAVLKSIKAGVDWALWVSTEKVGSVLDRL

SEQ ID NO: 926380 - protein, 26 aa, Mycobacterium
EAVNKMKNWISGFGPQIDGVVAQNDD

SEQ ID NO: 926381 - protein, 24 aa, Mycobacterium
EAVNNGFYYYGFASNLLPGPAIQP

SEQ ID NO: 926382 - protein, 22 aa, Mycobacterium
EAVPPPAPMPFGLMPPPPAPAA

SEQ ID NO: 926383 - protein, 17 aa, Mycobacterium
EAVRSMFTVWLRAVDPD

SEQ ID NO: 926384 - protein, 25 aa, Mycobacterium
EAYDRAWEFASYVAGVYGEDTLRAL

SEQ ID NO: 926385 - protein, 25 aa, Mycobacterium
EAYDRMAYAIAHGGKGWKPFADPPA

SEQ ID NO: 926386 - protein, 20 aa, Mycobacterium
EAYYRAGRDHVEYLFGDSIT

SEQ ID NO: 926387 - protein, 17 aa, Mycobacterium
ECAQLSAVVIRANTNGD

SEQ ID NO: 926388 - protein, 22 aa, Mycobacterium
ECNCVGIKPGRTYTARQLLDAL

SEQ ID NO: 926389 - protein, 23 aa, Mycobacterium
ECSGVVKSSLGWEGTARLDDFWF

SEQ ID NO: 926390 - protein, 20 aa, Mycobacterium
EDAATFTLSATWKFGPQKTT

SEQ ID NO: 926391 - protein, 23 aa, Mycobacterium
EDANPGATVEFNFAGSSDLATQL

SEQ ID NO: 926392 - protein, 18 aa, Mycobacterium
EDAPAGAPHRLVDPAALP

SEQ ID NO: 926393 - protein, 21 aa, Mycobacterium
EDCACPIAATGVEHIATGSQT

SEQ ID NO: 926394 - protein, 21 aa, Mycobacterium
EDERIGVLSFPLGKQQRPATK

SEQ ID NO: 926395 - protein, 25 aa, Mycobacterium
EDFEGKVRWALGLNKQRCPQVSTLT

SEQ ID NO: 926396 - protein, 22 aa, Mycobacterium
EDFPKKGVLGKFVNGNEQYDYA

SEQ ID NO: 926397 - protein, 17 aa, Mycobacterium
EDGQWDPTLPKLISAGA

SEQ ID NO: 926398 - protein, 21 aa, Mycobacterium
EDGSHVIKDTIQVFADPGAAT

SEQ ID NO: 926399 - protein, 25 aa, Mycobacterium
EDGVLRTDPLITIAVRTESERGIGG

SEQ ID NO: 926400 - protein, 20 aa, Mycobacterium
EDGWRCQRALTARNNIVIDV

SEQ ID NO: 926401 - protein, 26 aa, Mycobacterium
EDGWVRAQLLHYMRSAPDFYFDEMAQ

SEQ ID NO: 926402 - protein, 17 aa, Mycobacterium
EDHWPREWAHAYVDFAA

SEQ ID NO: 926403 - protein, 20 aa, Mycobacterium
EDIADAVLFMVTRDRRVAVN

SEQ ID NO: 926404 - protein, 18 aa, Mycobacterium
EDLVAFDLAFAAVFGALD

SEQ ID NO: 926405 - protein, 21 aa, Mycobacterium
EDMSLDFSVGRRQVVYADAQS

SEQ ID NO: 926406 - protein, 27 aa, Mycobacterium
EDPEERFDWVTVDAYSADGVPYSLRMG

SEQ ID NO: 926407 - protein, 21 aa, Mycobacterium
EDPRADLLIIERADEVGGTWR

SEQ ID NO: 926408 - protein, 19 aa, Mycobacterium
EDPRFRFFGNVTVGQHVEA

SEQ ID NO: 926409 - protein, 22 aa, Mycobacterium
EDPRFRFFGNVVVGEHVQTAEL

SEQ ID NO: 926410 - protein, 17 aa, Mycobacterium
EDPRVAGMIARVQLPPS

SEQ ID NO: 926411 - protein, 25 aa, Mycobacterium
EDPTASKIAGRWGAVSLPVGGANTT

SEQ ID NO: 926412 - protein, 20 aa, Mycobacterium
EDRFGAVLTTVDFDAIEVEV

SEQ ID NO: 926413 - protein, 28 aa, Mycobacterium
EDTGSITYRYTWHLPKDRTWTYDGQLNL

SEQ ID NO: 926414 - protein, 17 aa, Mycobacterium
EDTRGSMRPVLRVAPLS

SEQ ID NO: 926415 - protein, 18 aa, Mycobacterium
EDVPHWFDGLPVNFQTPD

SEQ ID NO: 926416 - protein, 17 aa, Mycobacterium
EDYRAGKFGSIPPNALM

SEQ ID NO: 926417 - protein, 23 aa, Mycobacterium
EEAAEAFAVPKFRRVLRSAYVAL

SEQ ID NO: 926418 - protein, 21 aa, Mycobacterium
EEAGRWPADRANRWYQAQGFL

SEQ ID NO: 926419 - protein, 25 aa, Mycobacterium
EEALPDHNIKWVKFDSGADVNTAFV

SEQ ID NO: 926420 - protein, 17 aa, Mycobacterium
EEFWSATYGEVFEGDFT

SEQ ID NO: 926421 - protein, 27 aa, Mycobacterium
EEGPRTGELYNYVATFGNFIVIVTANP

SEQ ID NO: 926422 - protein, 28 aa, Mycobacterium
EEGYLIKGEYGVRVTWGGVYVHSAPWSV

SEQ ID NO: 926423 - protein, 17 aa, Mycobacterium
EELAWRLVDEDTALRPR

SEQ ID NO: 926424 - protein, 21 aa, Mycobacterium
EELHFGRAAERLHMTQPPLSR

SEQ ID NO: 926425 - protein, 20 aa, Mycobacterium
EELPRGTAWLDTGTFDSLLD

SEQ ID NO: 926426 - protein, 20 aa, Mycobacterium
EELPVQLVVRSVGYRGVPTP

SEQ ID NO: 926427 - protein, 21 aa, Mycobacterium
EELRMLPMLLLAFGRHLSRGR

SEQ ID NO: 926428 - protein, 19 aa, Mycobacterium
EELRSARTPQELVSLVRSS

SEQ ID NO: 926429 - protein, 17 aa, Mycobacterium
EEPVAAPPYPAGPVTMT

SEQ ID NO: 926430 - protein, 25 aa, Mycobacterium
EEQGYRLRVKMARDEDGLYKVARLD

SEQ ID NO: 926431 - protein, 24 aa, Mycobacterium
EERGSLPMAVAVWAGDGTQVTRNY

SEQ ID NO: 926432 - protein, 20 aa, Mycobacterium
EERKKWVIDPQWHVNSVWSG

SEQ ID NO: 926433 - protein, 19 aa, Mycobacterium
EERLAAALSECAGLPAEAV

SEQ ID NO: 926434 - protein, 27 aa, Mycobacterium
EERSRCAHLLLEFSISSPYRCGLLHAD

SEQ ID NO: 926435 - protein, 19 aa, Mycobacterium
EESWEEVEDTLLIADLGTA

SEQ ID NO: 926436 - protein, 26 aa, Mycobacterium
EETAVPRALVGVALEEPVVTVVTAAT

SEQ ID NO: 926437 - protein, 19 aa, Mycobacterium
EEVDPMLFDRSYFLEPDSK

SEQ ID NO: 926438 - protein, 29 aa, Mycobacterium
EEWTPPLEWLQRIPVLGPLLVTAIVGFIH

SEQ ID NO: 926439 - protein, 20 aa, Mycobacterium
EFARKYWGDIADKLNSAAAT

SEQ ID NO: 926440 - protein, 26 aa, Mycobacterium
EFARLLGEAGPILWADMPTLPLYRQQ

SEQ ID NO: 926441 - protein, 23 aa, Mycobacterium
EFEGHPLPLLLPGVDYAFDNSHC

SEQ ID NO: 926442 - protein, 19 aa, Mycobacterium
EFGLMQPIVVREVEPKGDI

SEQ ID NO: 926443 - protein, 24 aa, Mycobacterium
EFINRLDDVIIFHGLEPGELVSIV

SEQ ID NO: 926444 - protein, 19 aa, Mycobacterium
EFMDVEVSPDWDLPQDEEP

SEQ ID NO: 926445 - protein, 22 aa, Mycobacterium
EFNLPNGLAIDSWMCAISGRAK

SEQ ID NO: 926446 - protein, 20 aa, Mycobacterium
EFPEGLWYVDLAPITIPEVA

SEQ ID NO: 926447 - protein, 18 aa, Mycobacterium
EFPKGGIHNWTYWGNQLR

SEQ ID NO: 926448 - protein, 23 aa, Mycobacterium
EFQVPADATAAILSPQLVTGRAI

SEQ ID NO: 926449 - protein, 18 aa, Mycobacterium
EFVAFWLDGDHRVLAGMN

SEQ ID NO: 926450 - protein, 24 aa, Mycobacterium
EFVGRRGAAIPAVLAAQPVYHEYW

SEQ ID NO: 926451 - protein, 20 aa, Mycobacterium
EFVLRPAALISDRLQAGALT

SEQ ID NO: 926452 - protein, 24 aa, Mycobacterium
EGADGWECQRAMSVANNVIVDINA

SEQ ID NO: 926453 - protein, 19 aa, Mycobacterium
EGALARRNLVLDTMIENIP

SEQ ID NO: 926454 - protein, 21 aa, Mycobacterium
EGAPAEVADPALVPAGVQPTT

SEQ ID NO: 926455 - protein, 22 aa, Mycobacterium
EGARELTLEWSRNTKGQIRSAA

SEQ ID NO: 926456 - protein, 24 aa, Mycobacterium
EGDGGDGGNAFLIGNGGNGGAAAA

SEQ ID NO: 926457 - protein, 23 aa, Mycobacterium
EGDPRKAYADKIVFDTTVASADA

SEQ ID NO: 926458 - protein, 26 aa, Mycobacterium
EGFAPRKGAARRAWLASLADEQRTCV

SEQ ID NO: 926459 - protein, 18 aa, Mycobacterium
EGFLERRRAALFQIISRA

SEQ ID NO: 926460 - protein, 24 aa, Mycobacterium
EGGAFRLGFVQPWAMGTIATTAAK

SEQ ID NO: 926461 - protein, 19 aa, Mycobacterium
EGGAPRWWFTVGGEVGKGE

SEQ ID NO: 926462 - protein, 22 aa, Mycobacterium
EGIPEFGHQINMYFHADLSEWT

SEQ ID NO: 926463 - protein, 23 aa, Mycobacterium
EGKLQPAAECARLHLAQPPCATV

SEQ ID NO: 926464 - protein, 19 aa, Mycobacterium
EGKPCPTYTDLLVNPPGTT

SEQ ID NO: 926465 - protein, 24 aa, Mycobacterium
EGLAARPDGGFVLAVEGEEGPENE

SEQ ID NO: 926466 - protein, 38 aa, Mycobacterium
EGLGRLGYALAPVTWMLGARFVPVPGGEDGNAFDARVD

SEQ ID NO: 926467 - protein, 18 aa, Mycobacterium
EGLMVWFNTVLSSVGGQV

SEQ ID NO: 926468 - protein, 23 aa, Mycobacterium
EGLRAIPQDNLRTVVDEAYEAVG

SEQ ID NO: 926469 - protein, 21 aa, Mycobacterium
EGLSSALGGKVLRPDDGPQFA

SEQ ID NO: 926470 - protein, 19 aa, Mycobacterium
EGNGPSFLDKVHFQPLPAE

SEQ ID NO: 926471 - protein, 33 aa, Mycobacterium
EGNMGIPEQMAINFQQVVSLVFDRNSIVNEMTK

SEQ ID NO: 926472 - protein, 23 aa, Mycobacterium
EGNPHVWYRPSAVTEVVDAVTAE

SEQ ID NO: 926473 - protein, 24 aa, Mycobacterium
EGPFSVAAYCFDGNNLLSEADAFA

SEQ ID NO: 926474 - protein, 18 aa, Mycobacterium
EGPGSVQGMAMDPVATAA

SEQ ID NO: 926475 - protein, 17 aa, Mycobacterium
EGPLARDDYRIDYEGIA

SEQ ID NO: 926476 - protein, 21 aa, Mycobacterium
EGPMTPGALAIRERVRPPSMT

SEQ ID NO: 926477 - protein, 23 aa, Mycobacterium
EGPRMAYSAGVMAAHAVLDAVRG

SEQ ID NO: 926478 - protein, 24 aa, Mycobacterium
EGPYETIGGLVLRQLGHIPVAGET

SEQ ID NO: 926479 - protein, 19 aa, Mycobacterium
EGQKIWAEAGFRPVDPAVA

SEQ ID NO: 926480 - protein, 24 aa, Mycobacterium
EGQPEALAGFTYYEAPTRWLQGDR

SEQ ID NO: 926481 - protein, 21 aa, Mycobacterium
EGRAGGMTRPVEGAHTGGFNH

SEQ ID NO: 926482 - protein, 23 aa, Mycobacterium
EGRDMSHIISFLATLPEVALDAE

SEQ ID NO: 926483 - protein, 23 aa, Mycobacterium
EGRRVPLRIGLAAGPVVAGVVGA

SEQ ID NO: 926484 - protein, 24 aa, Mycobacterium
EGSDRIMRPGGFIPLSRTSPALDL

SEQ ID NO: 926485 - protein, 21 aa, Mycobacterium
EGSITYNEWSFAQAQKLSMAK

SEQ ID NO: 926486 - protein, 25 aa, Mycobacterium
EGSPLKDRNGCVVGSAIIGVDPQAS

SEQ ID NO: 926487 - protein, 17 aa, Mycobacterium
EGSSGAHLDDWTFNDGD

SEQ ID NO: 926488 - protein, 33 aa, Mycobacterium
EGTLELGYQVGFPWSLGVGINFSYTTPNIAFDG

SEQ ID NO: 926489 - protein, 24 aa, Mycobacterium
EGTRARITMHVDHGVPIPADAKAV

SEQ ID NO: 926490 - protein, 23 aa, Mycobacterium
EGVAARPDGGFVLAVEGEEGPGN

SEQ ID NO: 926491 - protein, 19 aa, Mycobacterium
EGVAGRTADQLKEAGFNVT

SEQ ID NO: 926492 - protein, 17 aa, Mycobacterium
EGVALDGDAVWVAVQRE

SEQ ID NO: 926493 - protein, 17 aa, Mycobacterium
EGVRLPVGTTAQLRTAT

SEQ ID NO: 926494 - protein, 17 aa, Mycobacterium
EGYDLQFGLYGSDPDTP

SEQ ID NO: 926495 - protein, 24 aa, Mycobacterium
EHADEAWVGVGYVLPNDRPTTAAT

SEQ ID NO: 926496 - protein, 21 aa, Mycobacterium
EHDVDCIVFATGFDVCKAGTP

SEQ ID NO: 926497 - protein, 22 aa, Mycobacterium
EHEVDCIVFATGFDVCKAGTPF

SEQ ID NO: 926498 - protein, 20 aa, Mycobacterium
EHGVRFHLGASVTRIDPVTT

SEQ ID NO: 926499 - protein, 19 aa, Mycobacterium
EHHLDCIVFATGYDVHLTG

SEQ ID NO: 926500 - protein, 22 aa, Mycobacterium
EHNFRAGNIVPLLNSQKKSDRI

SEQ ID NO: 926501 - protein, 24 aa, Mycobacterium
EHPDYRPADGAAYIASKIDAIAAN

SEQ ID NO: 926502 - protein, 38 aa, Mycobacterium
EHQSGAVLRYGRAVGVTTPIHWCIYASQLPAEIAARKP

SEQ ID NO: 926503 - protein, 20 aa, Mycobacterium
EHRLDCIVFATGYDVHLTGP

SEQ ID NO: 926504 - protein, 18 aa, Mycobacterium
EHVSRQALLEIAEREGQV

SEQ ID NO: 926505 - protein, 30 aa, Mycobacterium
EHWAAAMPVVRARLGPVTVLHSNAADVSIF

SEQ ID NO: 926506 - protein, 20 aa, Mycobacterium
EHYLGCLVAAAVVDGYRPRD

SEQ ID NO: 926507 - protein, 20 aa, Mycobacterium
EIAANWGLEEGMIDKPVING

SEQ ID NO: 926508 - protein, 19 aa, Mycobacterium
EIAESGSPYSIVRATQFFE

SEQ ID NO: 926509 - protein, 28 aa, Mycobacterium
EIAPEEARSGIAYALSKSFVRWYSVAQA

SEQ ID NO: 926510 - protein, 20 aa, Mycobacterium
EIAPPPVIVSVVNWADCLVA

SEQ ID NO: 926511 - protein, 22 aa, Mycobacterium
EIAPTGVFDYEFAVPHAGTYWF

SEQ ID NO: 926512 - protein, 30 aa, Mycobacterium
EIDAAEIYVPFSWFEPMWLENLGFVAEGEG

SEQ ID NO: 926513 - protein, 19 aa, Mycobacterium
EIDGLLPTLIRGQGTEFDS

SEQ ID NO: 926514 - protein, 17 aa, Mycobacterium
EIEALYYLHPLTGDVVR

SEQ ID NO: 926515 - protein, 19 aa, Mycobacterium
EIFLISPLAALAILPVKLI

SEQ ID NO: 926516 - protein, 20 aa, Mycobacterium
EIGERLGLSAAGVRRHLDAL

SEQ ID NO: 926517 - protein, 25 aa, Mycobacterium
EIGRMYRPTLPRAFFIKPDGEMTVN

SEQ ID NO: 926518 - protein, 31 aa, Mycobacterium
EIGVEAGFWGPEWFPQAYPWIPSINPGLHFY

SEQ ID NO: 926519 - protein, 19 aa, Mycobacterium
EIHEPLWIKQNFQHGTLNF

SEQ ID NO: 926520 - protein, 37 aa, Mycobacterium
EIHQGSVVCVIGFVEPQMRIAFSAGRCNGDPMVTDRY

SEQ ID NO: 926521 - protein, 24 aa, Mycobacterium
EILDPSFAKYRLFSSSLEKVATGL

SEQ ID NO: 926522 - protein, 25 aa, Mycobacterium
EILKNPALEAFRFTARSAPKLMHRG

SEQ ID NO: 926523 - protein, 21 aa, Mycobacterium
EILNFALRYAPVLPQEQALRD

SEQ ID NO: 926524 - protein, 34 aa, Mycobacterium
EILNLLPDVVALRIPIVVGFQLGAFAAGAAYQQV

SEQ ID NO: 926525 - protein, 20 aa, Mycobacterium
EILTRYLNLVSFGNGSFGVQ

SEQ ID NO: 926526 - protein, 20 aa, Mycobacterium
EILTRYLNLVSFGNNAFGVQ

SEQ ID NO: 926527 - protein, 18 aa, Mycobacterium
EILTRYLNLVSFGNNSFG

SEQ ID NO: 926528 - protein, 20 aa, Mycobacterium
EILTRYLNLVSFGNNSFGVQ

SEQ ID NO: 926529 - protein, 21 aa, Mycobacterium
EILTRYLNLVSFGNNSFGVQD

SEQ ID NO: 926530 - protein, 29 aa, Mycobacterium
EINGGPEWTCFFPHPQRVVCGGISIPDRW

SEQ ID NO: 926531 - protein, 19 aa, Mycobacterium
EINSALMLAGAGSAPMLEA

SEQ ID NO: 926532 - protein, 20 aa, Mycobacterium
EIRQDWAALYGKAFADMDKP

SEQ ID NO: 926533 - protein, 26 aa, Mycobacterium
EIRTTKRWQVEYGFPICFPSIEVLTI

SEQ ID NO: 926534 - protein, 18 aa, Mycobacterium
EISVKHGVVIPANVIASV

SEQ ID NO: 926535 - protein, 25 aa, Mycobacterium
EITDGRTVRADWYYPDGDEPPQRLI

SEQ ID NO: 926536 - protein, 27 aa, Mycobacterium
EITIHTELRWSPPVPTLVELSAEAELV

SEQ ID NO: 926537 - protein, 19 aa, Mycobacterium
EIVGFLALFAYVAIHPGVA

SEQ ID NO: 926538 - protein, 28 aa, Mycobacterium
EIVPEEARSGIAYALSKSFVRWYSSSQA

SEQ ID NO: 926539 - protein, 18 aa, Mycobacterium
EKAGEVFDSAPYGWPVAK

SEQ ID NO: 926540 - protein, 26 aa, Mycobacterium
EKAKAELDALGWTLKPGAQFREKDGK

SEQ ID NO: 926541 - protein, 22 aa, Mycobacterium
EKDGRPLVIRDLFYDAQGSRQF

SEQ ID NO: 926542 - protein, 17 aa, Mycobacterium
EKGRWYLVGHDRDRGAT

SEQ ID NO: 926543 - protein, 24 aa, Mycobacterium
EKGVKSLYLVGSDYVFPQTANRII

SEQ ID NO: 926544 - protein, 20 aa, Mycobacterium
EKKPPAAPHLTFRPADAADD

SEQ ID NO: 926545 - protein, 19 aa, Mycobacterium
EKKVEGAIACSTAAGQVNI

SEQ ID NO: 926546 - protein, 33 aa, Mycobacterium
EKLARRRRRTALQDCGFRYEFLDPEPSSDAAPA

SEQ ID NO: 926547 - protein, 19 aa, Mycobacterium
EKLGLPAQSLFDVITGATG

SEQ ID NO: 926548 - protein, 21 aa, Mycobacterium
EKLPDLEVVDVDFVVSEALSR

SEQ ID NO: 926549 - protein, 19 aa, Mycobacterium
EKLSLKFVVHVGEVADQKV

SEQ ID NO: 926550 - protein, 24 aa, Mycobacterium
EKNVRSAVEISMYTPEVHPMPSAG

SEQ ID NO: 926551 - protein, 35 aa, Mycobacterium
EKPEWKGRWGAPPVKPDFQAIVAAMLELTGERATG

SEQ ID NO: 926552 - protein, 21 aa, Mycobacterium
EKRLSEALGEQTWRESGLGAR

SEQ ID NO: 926553 - protein, 30 aa, Mycobacterium
EKRSWLRARGLQTFPLVGWAERGGYDALGH

SEQ ID NO: 926554 - protein, 22 aa, Mycobacterium
EKVDPPGCYEFISEGDGDYDRA

SEQ ID NO: 926555 - protein, 19 aa, Mycobacterium
ELAAFDVLLAIARTGSLGA

SEQ ID NO: 926556 - protein, 18 aa, Mycobacterium
ELAAQAWQGPASKAMLAA

SEQ ID NO: 926557 - protein, 19 aa, Mycobacterium
ELAAQLWDLPAWAQAGHRL

SEQ ID NO: 926558 - protein, 24 aa, Mycobacterium
ELAELRWDPDPEVDTLRPMLHRLT

SEQ ID NO: 926559 - protein, 19 aa, Mycobacterium
ELAGELALMRNHRTDVLIT

SEQ ID NO: 926560 - protein, 20 aa, Mycobacterium
ELAHRLRAALLSHRDGARIL

SEQ ID NO: 926561 - protein, 17 aa, Mycobacterium
ELAKALADFLFDDERAM

SEQ ID NO: 926562 - protein, 21 aa, Mycobacterium
ELAMVDAVWLQRGLSVRAPFL

SEQ ID NO: 926563 - protein, 21 aa, Mycobacterium
ELAMVDAVWLQRGLTVRAPFL

SEQ ID NO: 926564 - protein, 25 aa, Mycobacterium
ELAPFGIRVNAVFPGPIATPMLDDA

SEQ ID NO: 926565 - protein, 23 aa, Mycobacterium
ELARAAGVRRFVFSSVIHPSLGL

SEQ ID NO: 926566 - protein, 19 aa, Mycobacterium
ELARLAAMSPRHFTRVFTA

SEQ ID NO: 926567 - protein, 19 aa, Mycobacterium
ELASFEIFLAIAQTGSLGG

SEQ ID NO: 926568 - protein, 22 aa, Mycobacterium
ELASKLIRWTGFSAAKVARVCL

SEQ ID NO: 926569 - protein, 25 aa, Mycobacterium
ELASWAKVHWPGAIQTHYWSAQDYT

SEQ ID NO: 926570 - protein, 25 aa, Mycobacterium
ELDKLIWEEVFSLPLFQSPGNVAVR

SEQ ID NO: 926571 - protein, 18 aa, Mycobacterium
ELDLPVTVVDRGRAPLEN

SEQ ID NO: 926572 - protein, 24 aa, Mycobacterium
ELDPKTAVLTWRGDQYVLFVQLSG

SEQ ID NO: 926573 - protein, 29 aa, Mycobacterium
ELDSVLPDRPGFFFAIDGHSMWANSKALE

SEQ ID NO: 926574 - protein, 19 aa, Mycobacterium
ELECVDGQVWANVWPSNEI

SEQ ID NO: 926575 - protein, 22 aa, Mycobacterium
ELERRYIHGARWCGATEIAKLI

SEQ ID NO: 926576 - protein, 19 aa, Mycobacterium
ELEVLPIGDFQGTPVMNYN

SEQ ID NO: 926577 - protein, 17 aa, Mycobacterium
ELGCPRISAAIQGMPLV

SEQ ID NO: 926578 - protein, 26 aa, Mycobacterium
ELGEAAEAFSSVTSGLASGSWQGPAA

SEQ ID NO: 926579 - protein, 24 aa, Mycobacterium
ELGGFRTAVRRAKVLAGLDEDTEV

SEQ ID NO: 926580 - protein, 19 aa, Mycobacterium
ELGRLRCLVHTAGVSPEMA

SEQ ID NO: 926581 - protein, 20 aa, Mycobacterium
ELGSPIFVDYVWGRQIGEPT

SEQ ID NO: 926582 - protein, 19 aa, Mycobacterium
ELHPNSATVLVFIDQTTAS

SEQ ID NO: 926583 - protein, 19 aa, Mycobacterium
ELIAAPAPEAPVVDEAPAP

SEQ ID NO: 926584 - protein, 18 aa, Mycobacterium
ELIGGFRPLFKALDPDQV

SEQ ID NO: 926585 - protein, 18 aa, Mycobacterium
ELISRFTALPADKFPQTR

SEQ ID NO: 926586 - protein, 18 aa, Mycobacterium
ELIVNAGLVAGVRGSILE

SEQ ID NO: 926587 - protein, 25 aa, Mycobacterium
ELKACQAVGLPAVWDDDADVPFPYH

SEQ ID NO: 926588 - protein, 19 aa, Mycobacterium
ELKNIALYLNFDMLASPNP

SEQ ID NO: 926589 - protein, 22 aa, Mycobacterium
ELKVSIRGTGFYGNLSNKKYWA

SEQ ID NO: 926590 - protein, 20 aa, Mycobacterium
ELLAACPQLTILATSREPLG

SEQ ID NO: 926591 - protein, 24 aa, Mycobacterium
ELLAHCYRMTGSLHDAEDLVQETY

SEQ ID NO: 926592 - protein, 20 aa, Mycobacterium
ELLARVHAAFWGRLPERSGR

SEQ ID NO: 926593 - protein, 18 aa, Mycobacterium
ELLDAALLESGNDAANTL

SEQ ID NO: 926594 - protein, 21 aa, Mycobacterium
ELLEAATVVWCAGMRANSLAE

SEQ ID NO: 926595 - protein, 17 aa, Mycobacterium
ELLIVILPLAGATVAAV

SEQ ID NO: 926596 - protein, 19 aa, Mycobacterium
ELLPQVFGWARSVDPVQPL

SEQ ID NO: 926597 - protein, 24 aa, Mycobacterium
ELLRAHGLRPVIRGTASRVRRTVE

SEQ ID NO: 926598 - protein, 23 aa, Mycobacterium
ELLVKYPNLKGFQGAASTDVPGI

SEQ ID NO: 926599 - protein, 20 aa, Mycobacterium
ELLVLLIVGLVVLGPERLPG

SEQ ID NO: 926600 - protein, 19 aa, Mycobacterium
ELNALLVRERVTVLCQTPS

SEQ ID NO: 926601 - protein, 26 aa, Mycobacterium
ELNLIRPGANYGWPEAEGRGGIEGMV

SEQ ID NO: 926602 - protein, 23 aa, Mycobacterium
ELNLPTLHGVVVRRSYASAHPEV

SEQ ID NO: 926603 - protein, 17 aa, Mycobacterium
ELNRRVGTVEMFTATTP

SEQ ID NO: 926604 - protein, 24 aa, Mycobacterium
ELPARRVDEALVRVAKMKGPGPTC

SEQ ID NO: 926605 - protein, 23 aa, Mycobacterium
ELPDTYRLLGRTPRRMVPLRPAP

SEQ ID NO: 926606 - protein, 20 aa, Mycobacterium
ELPEGATGGSVFYSPDGAAF

SEQ ID NO: 926607 - protein, 19 aa, Mycobacterium
ELPGQKLPFGIAPTTEGAR

SEQ ID NO: 926608 - protein, 21 aa, Mycobacterium
ELPGSIAAVDFVGWYNAHPNF

SEQ ID NO: 926609 - protein, 29 aa, Mycobacterium
ELPMLFHSLLPRPSRRVINKDATTHESGL

SEQ ID NO: 926610 - protein, 26 aa, Mycobacterium
ELPRDPRSGQGWNPEPLAGNYSECAQ

SEQ ID NO: 926611 - protein, 24 aa, Mycobacterium
ELPRGCIAAGDRAFFCDYVQEYLS

SEQ ID NO: 926612 - protein, 18 aa, Mycobacterium
ELPSGWVASAVGFLPAPA

SEQ ID NO: 926613 - protein, 20 aa, Mycobacterium
ELQADLGLAYLFISHDLAVV

SEQ ID NO: 926614 - protein, 17 aa, Mycobacterium
ELQLAVIVWDIMRGEQA

SEQ ID NO: 926615 - protein, 24 aa, Mycobacterium
ELQRLRGMTPRAALTKHLLDGDDS

SEQ ID NO: 926616 - protein, 20 aa, Mycobacterium
ELRADVVIDAGGRWRPLAAG

SEQ ID NO: 926617 - protein, 19 aa, Mycobacterium
ELRDGVWMRPANVEVQLGA

SEQ ID NO: 926618 - protein, 19 aa, Mycobacterium
ELRDWPETVGRPVAGCPVR

SEQ ID NO: 926619 - protein, 23 aa, Mycobacterium
ELRGGVFDLPHVVADAVEAAHRD

SEQ ID NO: 926620 - protein, 19 aa, Mycobacterium
ELRGREPVFTAGRPPSGLV

SEQ ID NO: 926621 - protein, 30 aa, Mycobacterium
ELRIEAKPGSGFFTDWIIPGNFDIAQFSWV

SEQ ID NO: 926622 - protein, 23 aa, Mycobacterium
ELRKRLTGLLGAFRAFSYGSLYP

SEQ ID NO: 926623 - protein, 32 aa, Mycobacterium
ELRNRLAAVTGLRLPETVGWDYGSISRLAAHL

SEQ ID NO: 926624 - protein, 18 aa, Mycobacterium
ELRRALISRLHDLYPETV

SEQ ID NO: 926625 - protein, 24 aa, Mycobacterium
ELRTMTGWLAARGHPVTEIANARD

SEQ ID NO: 926626 - protein, 21 aa, Mycobacterium
ELSFLDCLYYSAVTLSTTGYG

SEQ ID NO: 926627 - protein, 22 aa, Mycobacterium
ELSKALRLSSERGVTTREQLTT

SEQ ID NO: 926628 - protein, 23 aa, Mycobacterium
ELSPLGRPVVCTEYLARTRGSTV

SEQ ID NO: 926629 - protein, 21 aa, Mycobacterium
ELSSAAAMRAAVLAGAGPAAM

SEQ ID NO: 926630 - protein, 25 aa, Mycobacterium
ELTAKGWCQAVLDSGPLSAKHYDGV

SEQ ID NO: 926631 - protein, 34 aa, Mycobacterium
ELTEFLRARVAKWWLPERWAFVADVPLTSTGKFD

SEQ ID NO: 926632 - protein, 33 aa, Mycobacterium
ELTEFLRARVAKWWLPERWAFVTDIPLTSTGKF

SEQ ID NO: 926633 - protein, 18 aa, Mycobacterium
ELTESGELAELLCGQSPD

SEQ ID NO: 926634 - protein, 19 aa, Mycobacterium
ELTPPYRGGAVMHDNETIG

SEQ ID NO: 926635 - protein, 20 aa, Mycobacterium
ELTPPYRGGPTLQNNATIGL

SEQ ID NO: 926636 - protein, 18 aa, Mycobacterium
ELTSEGIVIPLPDHIGVL

SEQ ID NO: 926637 - protein, 19 aa, Mycobacterium
ELTSLVAALHQAHISVTLS

SEQ ID NO: 926638 - protein, 25 aa, Mycobacterium
ELVAVCAAARGWGITVIPLPSASMA

SEQ ID NO: 926639 - protein, 23 aa, Mycobacterium
ELVDLLWRMGIRTIGQFAELSRS

SEQ ID NO: 926640 - protein, 25 aa, Mycobacterium
ELVFCSVGLRVGRVVVTRADHVDVL

SEQ ID NO: 926641 - protein, 21 aa, Mycobacterium
ELVSKLLAGPRPEMAHSVRNL

SEQ ID NO: 926642 - protein, 17 aa, Mycobacterium
ELVSWSAVLTLRESGCA

SEQ ID NO: 926643 - protein, 18 aa, Mycobacterium
ELYRRLPGDLSVLTPSPA

SEQ ID NO: 926644 - protein, 19 aa, Mycobacterium
EMFNKSGSGHLVLISSVLG

SEQ ID NO: 926645 - protein, 17 aa, Mycobacterium
EMSVAWNDHLKKFVMLY

SEQ ID NO: 926646 - protein, 25 aa, Mycobacterium
ENALSLSWRTGDDIVVTRTDPQHPV

SEQ ID NO: 926647 - protein, 22 aa, Mycobacterium
ENAQIGLWAFSIDKGGPGQDWK

SEQ ID NO: 926648 - protein, 25 aa, Mycobacterium
ENARARLAALSILIGSIAATGPGVI

SEQ ID NO: 926649 - protein, 20 aa, Mycobacterium
ENASAFPTTERVLASIASIL

SEQ ID NO: 926650 - protein, 26 aa, Mycobacterium
ENAWRVNCFGAFLGIHVALEHLRAAG

SEQ ID NO: 926651 - protein, 19 aa, Mycobacterium
ENIVLRRSRPLEISLDGHD

SEQ ID NO: 926652 - protein, 18 aa, Mycobacterium
ENIVPLYRRNELDERQIR

SEQ ID NO: 926653 - protein, 19 aa, Mycobacterium
ENLREHRKGLMVDLVTDIN

SEQ ID NO: 926654 - protein, 19 aa, Mycobacterium
ENLTSAIVKPEYFDAGYRL

SEQ ID NO: 926655 - protein, 19 aa, Mycobacterium
ENMREHRRGLLVDILTDVR

SEQ ID NO: 926656 - protein, 30 aa, Mycobacterium
ENNPYRTVLAFGRDGTAYVTLYFTPDDPGV

SEQ ID NO: 926657 - protein, 21 aa, Mycobacterium
ENRPDCIYFAAAGHALGTGHT

SEQ ID NO: 926658 - protein, 21 aa, Mycobacterium
ENSSFGFGVWNLRSQQWDLLK

SEQ ID NO: 926659 - protein, 23 aa, Mycobacterium
ENTARLALEQGKAALEVNWPYVL

SEQ ID NO: 926660 - protein, 25 aa, Mycobacterium
ENTPPEILQYWFPADGKGLVDNDLM

SEQ ID NO: 926661 - protein, 23 aa, Mycobacterium
ENVRALDLLTKWGDVPAAPPAQP

SEQ ID NO: 926662 - protein, 17 aa, Mycobacterium
ENVWPVFTNPWYDKEWR

SEQ ID NO: 926663 - protein, 24 aa, Mycobacterium
EPAPDRPSAPVPRPSSGGPTGGPS

SEQ ID NO: 926664 - protein, 18 aa, Mycobacterium
EPCPDVEVVFARGSGEPP

SEQ ID NO: 926665 - protein, 24 aa, Mycobacterium
EPDERWALLPLVPLIPERVMRRLI

SEQ ID NO: 926666 - protein, 17 aa, Mycobacterium
EPDEWQSPMPNLHVQGD

SEQ ID NO: 926667 - protein, 25 aa, Mycobacterium
EPDFGVPWLYNYIGQPWKTQETVNR

SEQ ID NO: 926668 - protein, 18 aa, Mycobacterium
EPDPIVARWWRLERSRMY

SEQ ID NO: 926669 - protein, 25 aa, Mycobacterium
EPDRVRITFWLNDKYKVPADVKAAI

SEQ ID NO: 926670 - protein, 25 aa, Mycobacterium
EPEARDVLKKAGFRVADQASSVNST

SEQ ID NO: 926671 - protein, 17 aa, Mycobacterium
EPECQPSPGWDWAEISG

SEQ ID NO: 926672 - protein, 26 aa, Mycobacterium
EPERILLRRLGVFVGGFDLDAALAVA

SEQ ID NO: 926673 - protein, 19 aa, Mycobacterium
EPFARAMGPMQFIPETWRL

SEQ ID NO: 926674 - protein, 19 aa, Mycobacterium
EPFPCVVVTRGWWILQTNA

SEQ ID NO: 926675 - protein, 17 aa, Mycobacterium
EPFPPRGVDQLQAAYEF

SEQ ID NO: 926676 - protein, 20 aa, Mycobacterium
EPFSEERYGIGLKKDDAELR

SEQ ID NO: 926677 - protein, 23 aa, Mycobacterium
EPFSEPEVFDFPDGIGPVECVNV

SEQ ID NO: 926678 - protein, 19 aa, Mycobacterium
EPGCDTLLLPGGIGVSAVQ

SEQ ID NO: 926679 - protein, 17 aa, Mycobacterium
EPGELVSIVDIQLAQLQ

SEQ ID NO: 926680 - protein, 25 aa, Mycobacterium
EPGFGVPWIYNYLGAPWKTQRTVNR

SEQ ID NO: 926681 - protein, 25 aa, Mycobacterium
EPGFGVPWLYNYIGQPWKTQRTVDR

SEQ ID NO: 926682 - protein, 25 aa, Mycobacterium
EPGFGVPWLYNYLGQPWKTQRTVDR

SEQ ID NO: 926683 - protein, 20 aa, Mycobacterium
EPGKISWNLEPWRPVVDDEQ

SEQ ID NO: 926684 - protein, 24 aa, Mycobacterium
EPGKRPRSTMAPTLIFDTSGPDRR

SEQ ID NO: 926685 - protein, 34 aa, Mycobacterium
EPGQIWAAAVGKGKDRWFIVWLGTAASPVDKGVA

SEQ ID NO: 926686 - protein, 23 aa, Mycobacterium
EPGVKPKPGMKVCQLGPATGSSC

SEQ ID NO: 926687 - protein, 17 aa, Mycobacterium
EPGYKLVDFSGAVVRSL

SEQ ID NO: 926688 - protein, 18 aa, Mycobacterium
EPHPEFHLICFIPDPRTT

SEQ ID NO: 926689 - protein, 24 aa, Mycobacterium
EPILRIPQPQGWTRNTMLDSELIR

SEQ ID NO: 926690 - protein, 20 aa, Mycobacterium
EPIPEEAFERIVNSLELEDY

SEQ ID NO: 926691 - protein, 19 aa, Mycobacterium
EPLDPVRFIGNRSSGKQGY

SEQ ID NO: 926692 - protein, 24 aa, Mycobacterium
EPLNIPYQVAFILDVAGDNEALVA

SEQ ID NO: 926693 - protein, 25 aa, Mycobacterium
EPLPEGSGFEFLDKVVGGAVPRQFI

SEQ ID NO: 926694 - protein, 24 aa, Mycobacterium
EPLPRPHQRRLFTVANQKGGVGKT

SEQ ID NO: 926695 - protein, 19 aa, Mycobacterium
EPLTEAWVAAARQQLVEAR

SEQ ID NO: 926696 - protein, 21 aa, Mycobacterium
EPLTRYGFTLAAYESPTLSRP

SEQ ID NO: 926697 - protein, 19 aa, Mycobacterium
EPPQAGWPIVSVGHGTTGL

SEQ ID NO: 926698 - protein, 38 aa, Mycobacterium
EPPQRLIYLQHGYLGIGPMYSYTASWLAERTNSIVVAP

SEQ ID NO: 926699 - protein, 24 aa, Mycobacterium
EPQLWKMATVLPIMQDTTIAAAGP

SEQ ID NO: 926700 - protein, 25 aa, Mycobacterium
EPQPERVKITFSYDAKYQVPADAKA

SEQ ID NO: 926701 - protein, 24 aa, Mycobacterium
EPRLWEMSTVLPILQDTTIVAAGP

SEQ ID NO: 926702 - protein, 19 aa, Mycobacterium
EPRRPAATPTLKFQTPATG

SEQ ID NO: 926703 - protein, 20 aa, Mycobacterium
EPRVSGVTFRFISEPATALS

SEQ ID NO: 926704 - protein, 19 aa, Mycobacterium
EPSCVPGITPNVVLGAPCA

SEQ ID NO: 926705 - protein, 24 aa, Mycobacterium
EPSELEIPTLLLGVANDPIVGNEG

SEQ ID NO: 926706 - protein, 25 aa, Mycobacterium
EPSFGVPWLYNYIGQPWKTQRTVDR

SEQ ID NO: 926707 - protein, 18 aa, Mycobacterium
EPSIPFNEGKRCRVNEQV

SEQ ID NO: 926708 - protein, 23 aa, Mycobacterium
EPSLPAFRHDLAVLPVVSNAYAD

SEQ ID NO: 926709 - protein, 29 aa, Mycobacterium
EPSLQAAGSYWAVLRAKQGITDENMRDTI

SEQ ID NO: 926710 - protein, 22 aa, Mycobacterium
EPSLRVTSVFPGRTDSDMQREL

SEQ ID NO: 926711 - protein, 26 aa, Mycobacterium
EPSVPWTGRGPRPLLAYATLPYGMGE

SEQ ID NO: 926712 - protein, 22 aa, Mycobacterium
EPSVRFNPILLKPGSDRTSQLV

SEQ ID NO: 926713 - protein, 21 aa, Mycobacterium
EPSVRFNPVLLKPGSDRTSQL

SEQ ID NO: 926714 - protein, 26 aa, Mycobacterium
EPTESWWDTLVRDVRYTFFNKAPTLS

SEQ ID NO: 926715 - protein, 19 aa, Mycobacterium
EPTIGFNYLGRVGADHLGD

SEQ ID NO: 926716 - protein, 21 aa, Mycobacterium
EPTPCRAERIAVTASPTQAAV

SEQ ID NO: 926717 - protein, 20 aa, Mycobacterium
EPVCPAGTYWNPAVVQCLPY

SEQ ID NO: 926718 - protein, 23 aa, Mycobacterium
EPVDCQREKCVALTFDDGPSPFT

SEQ ID NO: 926719 - protein, 20 aa, Mycobacterium
EPVFTAGRPPSGLVECAVQV

SEQ ID NO: 926720 - protein, 18 aa, Mycobacterium
EPVLKLLVNTSYTDAVRN

SEQ ID NO: 926721 - protein, 22 aa, Mycobacterium
EPVYGGSLAFYDPVEYNAWTPV

SEQ ID NO: 926722 - protein, 21 aa, Mycobacterium
EPYTAAAVWDSCTTVLADASA

SEQ ID NO: 926723 - protein, 17 aa, Mycobacterium
EQACLDLAEAHILAPQQ

SEQ ID NO: 926724 - protein, 25 aa, Mycobacterium
EQAPWIKGDDFQPVTDTVLLNLNCS

SEQ ID NO: 926725 - protein, 27 aa, Mycobacterium
EQARLCWKVVDATAWTPDRLREVVAAQ

SEQ ID NO: 926726 - protein, 31 aa, Mycobacterium
EQAVQRSVVLSSGWDIMDFVKQMQSLSGGNV

SEQ ID NO: 926727 - protein, 28 aa, Mycobacterium
EQAVQRSVVLSSGWNIIDFVQQLQQLTG

SEQ ID NO: 926728 - protein, 24 aa, Mycobacterium
EQDKRLREVAPFMSYGEFTGDAPL

SEQ ID NO: 926729 - protein, 19 aa, Mycobacterium
EQFHRCLLATGGHANAWRT

SEQ ID NO: 926730 - protein, 25 aa, Mycobacterium
EQFIKRLGTFAAIFTVPNFLELDYW

SEQ ID NO: 926731 - protein, 25 aa, Mycobacterium
EQFIKRLGTYAAIFTVPNFLELDYW

SEQ ID NO: 926732 - protein, 25 aa, Mycobacterium
EQFQQRLFGPLGMRNTLLPSPAEAS

SEQ ID NO: 926733 - protein, 22 aa, Mycobacterium
EQFRIAYLASQKVFGFAPYPAV

SEQ ID NO: 926734 - protein, 20 aa, Mycobacterium
EQHRPEVIFHLAAQIDVRHS

SEQ ID NO: 926735 - protein, 23 aa, Mycobacterium
EQIATDCLFALSCPPEKKAQFSA

SEQ ID NO: 926736 - protein, 17 aa, Mycobacterium
EQIRDAYDWAEDDDSFF

SEQ ID NO: 926737 - protein, 17 aa, Mycobacterium
EQIRRAAEQSGVPVVEV

SEQ ID NO: 926738 - protein, 17 aa, Mycobacterium
EQIRVAENVLRSQGIGA

SEQ ID NO: 926739 - protein, 19 aa, Mycobacterium
EQLAALPGVQLRPQTRLLA

SEQ ID NO: 926740 - protein, 20 aa, Mycobacterium
EQLLTLGLESLRLWHEQFLG

SEQ ID NO: 926741 - protein, 20 aa, Mycobacterium
EQLRKAQGVDAARQFLDGMI

SEQ ID NO: 926742 - protein, 20 aa, Mycobacterium
EQRADGSFYAAVKLALNKNV

SEQ ID NO: 926743 - protein, 23 aa, Mycobacterium
EQRRGDLPNALRVDFSTGAPETG

SEQ ID NO: 926744 - protein, 25 aa, Mycobacterium
EQTEPSFDIGMLLHGFEPLFSVLDP

SEQ ID NO: 926745 - protein, 26 aa, Mycobacterium
EQVATRWGNWAKLFFNNKGVVAHATD

SEQ ID NO: 926746 - protein, 25 aa, Mycobacterium
EQVGRRFGQESVLTFEYLPAGDARV

SEQ ID NO: 926747 - protein, 19 aa, Mycobacterium
EQVPMALFMQAWATSQDFM

SEQ ID NO: 926748 - protein, 18 aa, Mycobacterium
EQWLSFPSPLLTPPSNFT

SEQ ID NO: 926749 - protein, 21 aa, Mycobacterium
EQYLWWVPHNVAGLVTALGGR

SEQ ID NO: 926750 - protein, 21 aa, Mycobacterium
ERAGLPPGLVHYHFASLNDLL

SEQ ID NO: 926751 - protein, 18 aa, Mycobacterium
ERALAFYERLWRPVVEDK

SEQ ID NO: 926752 - protein, 24 aa, Mycobacterium
ERARRANGVSIRRAPAPNWYHLTF

SEQ ID NO: 926753 - protein, 30 aa, Mycobacterium
ERDGPTLFLPLTSLRGLRRHSKKRSGLRAQ

SEQ ID NO: 926754 - protein, 27 aa, Mycobacterium
ERDIAEFDALFAAAGLRRTEVGRAGQF

SEQ ID NO: 926755 - protein, 17 aa, Mycobacterium
ERFEVVVDFGRYPRGAR

SEQ ID NO: 926756 - protein, 20 aa, Mycobacterium
ERFGYELGLAFQIVDDLIGI

SEQ ID NO: 926757 - protein, 17 aa, Mycobacterium
ERFKPVAELISWDANGF

SEQ ID NO: 926758 - protein, 24 aa, Mycobacterium
ERGIKEFAPLLGVRKAGLFTSSSF

SEQ ID NO: 926759 - protein, 17 aa, Mycobacterium
ERHARAGVMTPVSACAS

SEQ ID NO: 926760 - protein, 22 aa, Mycobacterium
ERHPALYPGAPVPPATSPPPAS

SEQ ID NO: 926761 - protein, 24 aa, Mycobacterium
ERHYRDCRILGIGGGTNEIMNEII

SEQ ID NO: 926762 - protein, 18 aa, Mycobacterium
ERIAHAWTEAGFDAAAVT

SEQ ID NO: 926763 - protein, 17 aa, Mycobacterium
ERIKVQGSRQVELLRTQ

SEQ ID NO: 926764 - protein, 22 aa, Mycobacterium
ERIWKTQAAQWFRGINSVLGIR

SEQ ID NO: 926765 - protein, 20 aa, Mycobacterium
ERKRNALRFIEYITNPVNTA

SEQ ID NO: 926766 - protein, 19 aa, Mycobacterium
ERLAIDINAIFAGLDALSP

SEQ ID NO: 926767 - protein, 19 aa, Mycobacterium
ERLASALVITEWCQLPEGT

SEQ ID NO: 926768 - protein, 20 aa, Mycobacterium
ERLFGRRLADFFTGRDPRGA

SEQ ID NO: 926769 - protein, 20 aa, Mycobacterium
ERLLTWGVVVAPVIVVPAPT

SEQ ID NO: 926770 - protein, 23 aa, Mycobacterium
ERLPGAIRWSSGALRQARDYLSG

SEQ ID NO: 926771 - protein, 18 aa, Mycobacterium
ERLRMLARLETARRLQAV

SEQ ID NO: 926772 - protein, 20 aa, Mycobacterium
ERLTGPRNSLFSQLGGFAIP

SEQ ID NO: 926773 - protein, 19 aa, Mycobacterium
ERPDAEVLVSAPNIVPTSA

SEQ ID NO: 926774 - protein, 21 aa, Mycobacterium
ERPRIVTALDKLRVFSDTAAR

SEQ ID NO: 926775 - protein, 27 aa, Mycobacterium
ERRGRPSAHLRFARWHRERGLSGSSRR

SEQ ID NO: 926776 - protein, 35 aa, Mycobacterium
ERRLNRLAPVYAYRRLKLYLGYDLRQIRSSHARSD

SEQ ID NO: 926777 - protein, 22 aa, Mycobacterium
ERRRGDLPTGLRVDSSGNQETG

SEQ ID NO: 926778 - protein, 24 aa, Mycobacterium
ERRTAWPAAPGRIYRAPWSLVSDA

SEQ ID NO: 926779 - protein, 26 aa, Mycobacterium
ERSREIEVLEFVPAADLDPLMYDRSY

SEQ ID NO: 926780 - protein, 20 aa, Mycobacterium
ERSSLPSAFREYARRRRSRT

SEQ ID NO: 926781 - protein, 17 aa, Mycobacterium
ERTAVPVEWDDLRTQLD

SEQ ID NO: 926782 - protein, 25 aa, Mycobacterium
ERTEALKFVVHFVGDIHQPMHDAYA

SEQ ID NO: 926783 - protein, 17 aa, Mycobacterium
ERTEPALDLDALVGGFR

SEQ ID NO: 926784 - protein, 18 aa, Mycobacterium
ERTEPSFDVGALLNGFEP

SEQ ID NO: 926785 - protein, 19 aa, Mycobacterium
ERTLAGYVNLAGKRPADMP

SEQ ID NO: 926786 - protein, 25 aa, Mycobacterium
ERTLVSYLRLSGKIAQDTSFDGRSD

SEQ ID NO: 926787 - protein, 21 aa, Mycobacterium
ERTQLPVDRGRFIADNYRAVA

SEQ ID NO: 926788 - protein, 28 aa, Mycobacterium
ERVIQRGGTQLGVPYSWGGGTVRGPSGG

SEQ ID NO: 926789 - protein, 23 aa, Mycobacterium
ERVLFRRLAVFAGGFDLDAAQAV

SEQ ID NO: 926790 - protein, 19 aa, Mycobacterium
ERVLGWRPRVELAEGVRRT

SEQ ID NO: 926791 - protein, 20 aa, Mycobacterium
ERVRARLAATGWPLDDARED

SEQ ID NO: 926792 - protein, 33 aa, Mycobacterium
ERVRLLAEGAPVLWDEMPTLPLYRQERTLLMSK

SEQ ID NO: 926793 - protein, 26 aa, Mycobacterium
ERVRLLGEAAPILWGDMPTLPLYRQQ

SEQ ID NO: 926794 - protein, 25 aa, Mycobacterium
ERVTVPALMRGYLRLGAQVCGEPAH

SEQ ID NO: 926795 - protein, 18 aa, Mycobacterium
ERYGIGLKKDDAELRTKI

SEQ ID NO: 926796 - protein, 20 aa, Mycobacterium
ERYLPDRPFHGVNITTGAHG

SEQ ID NO: 926797 - protein, 20 aa, Mycobacterium
ERYQALKAHGARVQRPLWAS

SEQ ID NO: 926798 - protein, 26 aa, Mycobacterium
ESAEPVPDWREWQALIRGHYGNDIHV

SEQ ID NO: 926799 - protein, 25 aa, Mycobacterium
ESAKLCVQYLAPIIKNRQVNFPPLG

SEQ ID NO: 926800 - protein, 25 aa, Mycobacterium
ESAKLCVQYLAPIIKNRQYNFPPLG

SEQ ID NO: 926801 - protein, 21 aa, Mycobacterium
ESAQVLLEWLQANFPEPKVTA

SEQ ID NO: 926802 - protein, 20 aa, Mycobacterium
ESARAVSGWMLSPSSSQLSI

SEQ ID NO: 926803 - protein, 28 aa, Mycobacterium
ESAYAAVLLWKATVEKANSFAVPDIQEA

SEQ ID NO: 926804 - protein, 18 aa, Mycobacterium
ESCDEPSCVPGITPNVVL

SEQ ID NO: 926805 - protein, 20 aa, Mycobacterium
ESCRALMVPLTIDIGDKWTT

SEQ ID NO: 926806 - protein, 20 aa, Mycobacterium
ESDRAIATAAAVAGEPAGPA

SEQ ID NO: 926807 - protein, 19 aa, Mycobacterium
ESFPRSDISTVTIGEPRWR

SEQ ID NO: 926808 - protein, 20 aa, Mycobacterium
ESFRRLPHTPPWNALWFALR

SEQ ID NO: 926809 - protein, 19 aa, Mycobacterium
ESGCAPRIFAYPNGRPQDF

SEQ ID NO: 926810 - protein, 17 aa, Mycobacterium
ESGCATAAMVTSHPRAE

SEQ ID NO: 926811 - protein, 18 aa, Mycobacterium
ESGGAIAGLRAYAGSKLC

SEQ ID NO: 926812 - protein, 18 aa, Mycobacterium
ESGPELPDDAVIPIERTA

SEQ ID NO: 926813 - protein, 22 aa, Mycobacterium
ESGQAAPARTSAKPDSTRSDRT

SEQ ID NO: 926814 - protein, 19 aa, Mycobacterium
ESHPTLIHVGGTGGGAETK

SEQ ID NO: 926815 - protein, 19 aa, Mycobacterium
ESIARAWTQAGFDTAAVTD

SEQ ID NO: 926816 - protein, 18 aa, Mycobacterium
ESIIRTGGDVAFSLAAKP

SEQ ID NO: 926817 - protein, 17 aa, Mycobacterium
ESLGALAQAFSGRGPQL

SEQ ID NO: 926818 - protein, 22 aa, Mycobacterium
ESLLPGWQFVVIDVPSGAEDGP

SEQ ID NO: 926819 - protein, 25 aa, Mycobacterium
ESLPDGRASIQLAMDPSYMGIIPSD

SEQ ID NO: 926820 - protein, 29 aa, Mycobacterium
ESLPLASIFKLYVLHALAGAIRDGTASWD

SEQ ID NO: 926821 - protein, 18 aa, Mycobacterium
ESLQGPQFDTLWLETMLG

SEQ ID NO: 926822 - protein, 17 aa, Mycobacterium
ESLTAVLNSAAVSYASV

SEQ ID NO: 926823 - protein, 29 aa, Mycobacterium
ESNPKIVPAIGMPVCRSGVTTGEACGVIL

SEQ ID NO: 926824 - protein, 19 aa, Mycobacterium
ESPDVYQFVVLYPSPEQAN

SEQ ID NO: 926825 - protein, 17 aa, Mycobacterium
ESPMLRLVVGALLLGLA

SEQ ID NO: 926826 - protein, 26 aa, Mycobacterium
ESPNVWKNQPAFTYGVIPAVDTTAAR

SEQ ID NO: 926827 - protein, 18 aa, Mycobacterium
ESPPKPPAVEELLGPLDQ

SEQ ID NO: 926828 - protein, 23 aa, Mycobacterium
ESQIICGATAPALSAASHDAAML

SEQ ID NO: 926829 - protein, 20 aa, Mycobacterium
ESQKLPAWRTTDASLAEFGG

SEQ ID NO: 926830 - protein, 20 aa, Mycobacterium
ESQRGTVIPVEITVYEDRSF

SEQ ID NO: 926831 - protein, 21 aa, Mycobacterium
ESQSAMIASLVMRSLNPTNSG

SEQ ID NO: 926832 - protein, 26 aa, Mycobacterium
ESRAQLALWAEWGSPLIAGNDLTHMP

SEQ ID NO: 926833 - protein, 25 aa, Mycobacterium
ESRGELPFRVVASYSVKSPPVDDAV

SEQ ID NO: 926834 - protein, 19 aa, Mycobacterium
ESSKAGFTPVIPATSSDHS

SEQ ID NO: 926835 - protein, 25 aa, Mycobacterium
ESSLRAMFELNFFAVLSVTRAVLPG

SEQ ID NO: 926836 - protein, 28 aa, Mycobacterium
ESSLRPGRLPGVIAYPGLDFQHTPAVEH

SEQ ID NO: 926837 - protein, 20 aa, Mycobacterium
ESSVAFQAAHARFVEVAAKV

SEQ ID NO: 926838 - protein, 26 aa, Mycobacterium
ESTFLKAGPGSAVFNVEEHSLPGAKP

SEQ ID NO: 926839 - protein, 17 aa, Mycobacterium
ESTRRFGKTVSYPLTGR

SEQ ID NO: 926840 - protein, 20 aa, Mycobacterium
ESTVDFLICATGVLHHPRLP

SEQ ID NO: 926841 - protein, 21 aa, Mycobacterium
ESVKVSFWYDSKYKVPADAKA

SEQ ID NO: 926842 - protein, 20 aa, Mycobacterium
ESWDHPYTAIPKVWFHDLLR

SEQ ID NO: 926843 - protein, 20 aa, Mycobacterium
ESYIPLNDGYNWKGDPNATL

SEQ ID NO: 926844 - protein, 19 aa, Mycobacterium
ESYVSYGVPVYAVADGTVA

SEQ ID NO: 926845 - protein, 18 aa, Mycobacterium
ETAFAVVVPPPLIAANRS

SEQ ID NO: 926846 - protein, 22 aa, Mycobacterium
ETAPRWRGLPARNERNTNKNGN

SEQ ID NO: 926847 - protein, 18 aa, Mycobacterium
ETARRLQAVISHDVIAGL

SEQ ID NO: 926848 - protein, 28 aa, Mycobacterium
ETATGLVWGRTTVRLTRPELEALIDDAV

SEQ ID NO: 926849 - protein, 21 aa, Mycobacterium
ETAWACAVEDVLGRYERLDIL

SEQ ID NO: 926850 - protein, 19 aa, Mycobacterium
ETDHPGTQVVFNFAGSTDL

SEQ ID NO: 926851 - protein, 17 aa, Mycobacterium
ETESVDIIARYLRRQLT

SEQ ID NO: 926852 - protein, 23 aa, Mycobacterium
ETFLTDELPLWLATNKAVSTSGN

SEQ ID NO: 926853 - protein, 24 aa, Mycobacterium
ETFLTQEMPLWLQANKQVSPTGNA

SEQ ID NO: 926854 - protein, 25 aa, Mycobacterium
ETFLTRELPAWLAANRNVSTTGNGV

SEQ ID NO: 926855 - protein, 24 aa, Mycobacterium
ETFLTREMPAWLQANKGVSPTGNA

SEQ ID NO: 926856 - protein, 24 aa, Mycobacterium
ETFLTSELPEWLAANRDVAATGNA

SEQ ID NO: 926857 - protein, 24 aa, Mycobacterium
ETGKLCSLFIGPGLRQTSWNNSPL

SEQ ID NO: 926858 - protein, 18 aa, Mycobacterium
ETIARAWTDAGFDAAAVT

SEQ ID NO: 926859 - protein, 25 aa, Mycobacterium
ETIATWRAAVEEIRTKGTVPDTLPD

SEQ ID NO: 926860 - protein, 17 aa, Mycobacterium
ETLDCAGGKSLNIGGSK

SEQ ID NO: 926861 - protein, 25 aa, Mycobacterium
ETLPDGRAALHLDMDPGQLRLIPGN

SEQ ID NO: 926862 - protein, 27 aa, Mycobacterium
ETLPFGKVLAVAGFRCNVQEETGVSCV

SEQ ID NO: 926863 - protein, 29 aa, Mycobacterium
ETLRGGAIHAKWESLGGMNSYLGRPTSPE

SEQ ID NO: 926864 - protein, 18 aa, Mycobacterium
ETLTAEFADLVQFGEVRQ

SEQ ID NO: 926865 - protein, 18 aa, Mycobacterium
ETNSRTAILPVFAQEGIR

SEQ ID NO: 926866 - protein, 20 aa, Mycobacterium
ETPMLLWRSGLGGHPRLGRN

SEQ ID NO: 926867 - protein, 24 aa, Mycobacterium
ETRPPECLYAPFSKSFSRTPDGSD

SEQ ID NO: 926868 - protein, 23 aa, Mycobacterium
ETRSHVTPAAWVRGVAYHGVLCA

SEQ ID NO: 926869 - protein, 19 aa, Mycobacterium
ETSLGRFIDTTAAAMDGNG

SEQ ID NO: 926870 - protein, 25 aa, Mycobacterium
ETSRQALKIQRWRSRVRNHTVVIGY

SEQ ID NO: 926871 - protein, 24 aa, Mycobacterium
ETTGRPVADLDLFERALTELKKNT

SEQ ID NO: 926872 - protein, 21 aa, Mycobacterium
ETTLADWTRPYVLELSYTSWR

SEQ ID NO: 926873 - protein, 17 aa, Mycobacterium
ETVGEVFATLHREHGVD

SEQ ID NO: 926874 - protein, 18 aa, Mycobacterium
ETVIRDAITLAVEQVNAG

SEQ ID NO: 926875 - protein, 17 aa, Mycobacterium
ETVRKGFQLMAITRPDS

SEQ ID NO: 926876 - protein, 19 aa, Mycobacterium
ETVRVPRELLSQALENLDA

SEQ ID NO: 926877 - protein, 20 aa, Mycobacterium
ETWNAVVAEAGRLRAAGQPT

SEQ ID NO: 926878 - protein, 19 aa, Mycobacterium
ETYGVGMVIVARFDQAITD

SEQ ID NO: 926879 - protein, 25 aa, Mycobacterium
ETYLRAWKSYDRFEGKSSVRTWLYR

SEQ ID NO: 926880 - protein, 20 aa, Mycobacterium
EVAEAFARRLSTMLCDRLTI

SEQ ID NO: 926881 - protein, 24 aa, Mycobacterium
EVAPGITQNGSWVFDVAPDRLEAV

SEQ ID NO: 926882 - protein, 18 aa, Mycobacterium
EVAPLGISVIVVEPGAFR

SEQ ID NO: 926883 - protein, 26 aa, Mycobacterium
EVATAKFEFGNGFATVTIVTTGTGHL

SEQ ID NO: 926884 - protein, 30 aa, Mycobacterium
EVDGDKGLRFSFRWDLGRSRLIMVDSRNAR

SEQ ID NO: 926885 - protein, 18 aa, Mycobacterium
EVELGVLEDLGYYVVNPE

SEQ ID NO: 926886 - protein, 23 aa, Mycobacterium
EVFTRPGAQYTQRLLEAIPGGPV

SEQ ID NO: 926887 - protein, 28 aa, Mycobacterium
EVGYQIGCGISLNVVKLNGSAGFTPSIN

SEQ ID NO: 926888 - protein, 30 aa, Mycobacterium
EVIDQVRGAERWPDKFLAAAAGVAHGVAAA

SEQ ID NO: 926889 - protein, 22 aa, Mycobacterium
EVIDRLPKGRVLSVEREVFPAL

SEQ ID NO: 926890 - protein, 21 aa, Mycobacterium
EVLDIARMVLFGQVGRELVGL

SEQ ID NO: 926891 - protein, 20 aa, Mycobacterium
EVLEVAASYGKPLWVTENGI

SEQ ID NO: 926892 - protein, 18 aa, Mycobacterium
EVLQWKAAEVGEVIGAST

SEQ ID NO: 926893 - protein, 21 aa, Mycobacterium
EVLRGAAVLGARIMTRLASRP

SEQ ID NO: 926894 - protein, 19 aa, Mycobacterium
EVLSALGVVVNKGNVGALE

SEQ ID NO: 926895 - protein, 17 aa, Mycobacterium
EVLTPQFDRLYAVSPGK

SEQ ID NO: 926896 - protein, 22 aa, Mycobacterium
EVMGGSGIPMPSRRYVQLANSL

SEQ ID NO: 926897 - protein, 30 aa, Mycobacterium
EVMKGADLLPMMPFSERFSSTTITMCAGCG

SEQ ID NO: 926898 - protein, 27 aa, Mycobacterium
EVNFPEVNGYFRLPDTQIPPGQLMTER

SEQ ID NO: 926899 - protein, 23 aa, Mycobacterium
EVNGLGIPVSREFEVNPKGTTPL

SEQ ID NO: 926900 - protein, 25 aa, Mycobacterium
EVNGLKFMYYELLKKDGESATLTKD

SEQ ID NO: 926901 - protein, 20 aa, Mycobacterium
EVNSALMFTGAGSAPTLAAA

SEQ ID NO: 926902 - protein, 23 aa, Mycobacterium
EVPADGDLLGWGGFMSSVDTGVA

SEQ ID NO: 926903 - protein, 18 aa, Mycobacterium
EVPGAKVLGAPRGRRHAF

SEQ ID NO: 926904 - protein, 26 aa, Mycobacterium
EVPLDDWQWVLGINLWGPIHGCHVFT

SEQ ID NO: 926905 - protein, 17 aa, Mycobacterium
EVPPVSNGHTWDALAQC

SEQ ID NO: 926906 - protein, 19 aa, Mycobacterium
EVQARLAYDPAAPPPDQLS

SEQ ID NO: 926907 - protein, 24 aa, Mycobacterium
EVQGPRWGAGDVVAYLESSPGKPL

SEQ ID NO: 926908 - protein, 19 aa, Mycobacterium
EVQNLPGYEGSGDGKASTL

SEQ ID NO: 926909 - protein, 20 aa, Mycobacterium
EVQSAPLIERLRQMMNESDN

SEQ ID NO: 926910 - protein, 24 aa, Mycobacterium
EVRRFARERSRWLFSNPDMIHLSI

SEQ ID NO: 926911 - protein, 31 aa, Mycobacterium
EVRSSPEIIDRGGAVGGLLFDGTNNFHVLAN

SEQ ID NO: 926912 - protein, 22 aa, Mycobacterium
EVSAAIAALFGTFGQEYQAVSA

SEQ ID NO: 926913 - protein, 22 aa, Mycobacterium
EVSALQAALFTAYGTYYQQVSA

SEQ ID NO: 926914 - protein, 25 aa, Mycobacterium
EVSEAIADLLSGYARQYQALSTSMA

SEQ ID NO: 926915 - protein, 26 aa, Mycobacterium
EVTTFYTCLYRSLLHPNIFNDADGRY

SEQ ID NO: 926916 - protein, 23 aa, Mycobacterium
EVVDLRTLVPLDIETIVDSVRRT

SEQ ID NO: 926917 - protein, 22 aa, Mycobacterium
EVVGRGGVRLDDVWGQRPFAYL

SEQ ID NO: 926918 - protein, 20 aa, Mycobacterium
EVYADVGWELPRMLAEVDAT

SEQ ID NO: 926919 - protein, 26 aa, Mycobacterium
EVYEDGRIVRDFVYIDAVVDALFAAV

SEQ ID NO: 926920 - protein, 21 aa, Mycobacterium
EVYEDGRIVRDFVYIDDVVEA

SEQ ID NO: 926921 - protein, 24 aa, Mycobacterium
EVYVPLNEGYIWKGDPNATLSGQA

SEQ ID NO: 926922 - protein, 38 aa, Mycobacterium
EWTPPLEWLQTIPLFGRFVMTPLVGLLHNIPLIGDILH

SEQ ID NO: 926923 - protein, 22 aa, Mycobacterium
EYAFAHSCNTAFVQLGIDTGAD

SEQ ID NO: 926924 - protein, 24 aa, Mycobacterium
EYAPGELQNLPGYQGSGNGSASTL

SEQ ID NO: 926925 - protein, 26 aa, Mycobacterium
EYAPIWTGPGYFGLGVEALREALTGN

SEQ ID NO: 926926 - protein, 28 aa, Mycobacterium
EYDGWADFPDRPWNLIATANALLGIIYV

SEQ ID NO: 926927 - protein, 19 aa, Mycobacterium
EYEKIAANWGLEDGTIDKP

SEQ ID NO: 926928 - protein, 19 aa, Mycobacterium
EYGHQCVVWQTAINPVVAL

SEQ ID NO: 926929 - protein, 19 aa, Mycobacterium
EYHPRTWRRIRARLSELGV

SEQ ID NO: 926930 - protein, 26 aa, Mycobacterium
EYLAILRRCGIAAVLSGAGPSVLGLS

SEQ ID NO: 926931 - protein, 17 aa, Mycobacterium
EYLDMFYNLGIAGRAMR

SEQ ID NO: 926932 - protein, 18 aa, Mycobacterium
EYLILGACNPPLAHRAVN

SEQ ID NO: 926933 - protein, 19 aa, Mycobacterium
EYLSRAGISKEQVARGGYL

SEQ ID NO: 926934 - protein, 31 aa, Mycobacterium
EYTNAAQPIWWLVRALEFSQDFQTFAKELFT

SEQ ID NO: 926935 - protein, 24 aa, Mycobacterium
EYVGHAPSFERVVFRGDVAGREFV

SEQ ID NO: 926936 - protein, 29 aa, Mycobacterium
EYVIKRMGSQMGVPYSWGGGSLDGPSKGV

SEQ ID NO: 926937 - protein, 17 aa, Mycobacterium
FAAAFGVGSVWADEPDA

SEQ ID NO: 926938 - protein, 18 aa, Mycobacterium
FAAAKLRAGSGRSVPGYG

SEQ ID NO: 926939 - protein, 19 aa, Mycobacterium
FAAALAPHGSGTVLAGRDG

SEQ ID NO: 926940 - protein, 20 aa, Mycobacterium
FAAASLKPAFTQIAGRFKDE

SEQ ID NO: 926941 - protein, 17 aa, Mycobacterium
FAAASWLGSLRSRGGTE

SEQ ID NO: 926942 - protein, 22 aa, Mycobacterium
FAACAAGFGRLDLAFLNAGVTI

SEQ ID NO: 926943 - protein, 19 aa, Mycobacterium
FAAGLAPHGSGTVLVGRDG

SEQ ID NO: 926944 - protein, 23 aa, Mycobacterium
FAAGLFLPARQAIPFDEVLVEYA

SEQ ID NO: 926945 - protein, 17 aa, Mycobacterium
FAAKGYAATSVADIQRA

SEQ ID NO: 926946 - protein, 21 aa, Mycobacterium
FAALADRAVALGFDAVATGHY

SEQ ID NO: 926947 - protein, 17 aa, Mycobacterium
FAALFAAVALLAGCSSS

SEQ ID NO: 926948 - protein, 21 aa, Mycobacterium
FAALGYLKYPAAVTVLTISDD

SEQ ID NO: 926949 - protein, 17 aa, Mycobacterium
FAALKKLAMVTSHVLSK

SEQ ID NO: 926950 - protein, 22 aa, Mycobacterium
FAALQHPGGWAFNPVGGLEVAT

SEQ ID NO: 926951 - protein, 24 aa, Mycobacterium
FAALRRGEVAVAWTSTANPALPAD

SEQ ID NO: 926952 - protein, 17 aa, Mycobacterium
FAAPEPAASWPGERDAT

SEQ ID NO: 926953 - protein, 24 aa, Mycobacterium
FAAQCIAVNCALGPDPKGAVSALL

SEQ ID NO: 926954 - protein, 24 aa, Mycobacterium
FAAQCVAVHCALGSDPKGAVAALL

SEQ ID NO: 926955 - protein, 22 aa, Mycobacterium
FAARSLRTIAHMTRLRGADTVI

SEQ ID NO: 926956 - protein, 18 aa, Mycobacterium
FAATACGGGDSGGDSDTI

SEQ ID NO: 926957 - protein, 26 aa, Mycobacterium
FAATEKWKAAGLLALVGIGVEPGLSD

SEQ ID NO: 926958 - protein, 21 aa, Mycobacterium
FAAVGIRLRHYTGYQYNSGRK

SEQ ID NO: 926959 - protein, 17 aa, Mycobacterium
FACPPGLGPKEYWGQAL

SEQ ID NO: 926960 - protein, 24 aa, Mycobacterium
FADDPPMIIALMSRLTGDVDPAKI

SEQ ID NO: 926961 - protein, 26 aa, Mycobacterium
FADGWDRLNRSFVYALNIGSPLYSAF

SEQ ID NO: 926962 - protein, 18 aa, Mycobacterium
FADHKWALGDVVSAAEYD

SEQ ID NO: 926963 - protein, 20 aa, Mycobacterium
FADPDVRLVFSLGLRATDRS

SEQ ID NO: 926964 - protein, 21 aa, Mycobacterium
FADPFPITGAILRNQGVAVAD

SEQ ID NO: 926965 - protein, 17 aa, Mycobacterium
FADPVAPVEQQYRDAPL

SEQ ID NO: 926966 - protein, 21 aa, Mycobacterium
FADSDAWFLIRAVTRPDAAAL

SEQ ID NO: 926967 - protein, 24 aa, Mycobacterium
FADSTFRSLMAFYFVDDKGVRTPV

SEQ ID NO: 926968 - protein, 18 aa, Mycobacterium
FAEAGGLTAGNEVKVSGV

SEQ ID NO: 926969 - protein, 18 aa, Mycobacterium
FAEGLPAVGSPVCSAGKY

SEQ ID NO: 926970 - protein, 18 aa, Mycobacterium
FAEGLPTVGSPVCTAGKY

SEQ ID NO: 926971 - protein, 24 aa, Mycobacterium
FAERGFRRARTWLGATAAAIEACE

SEQ ID NO: 926972 - protein, 27 aa, Mycobacterium
FAFAKPRAEMAFTYLVDLINVDRVAPS

SEQ ID NO: 926973 - protein, 20 aa, Mycobacterium
FAFANPAAVQAFRYLVGLIN

SEQ ID NO: 926974 - protein, 17 aa, Mycobacterium
FAGALALGLAVPADAAT

SEQ ID NO: 926975 - protein, 25 aa, Mycobacterium
FAGGFAVSACKTVTLTVDGIAMRVT

SEQ ID NO: 926976 - protein, 20 aa, Mycobacterium
FAGPQLRGGVQVVEAPRIDS

SEQ ID NO: 926977 - protein, 18 aa, Mycobacterium
FAGPYLITGQSLLVRADN

SEQ ID NO: 926978 - protein, 17 aa, Mycobacterium
FAGQGVGLGGWYSPIAL

SEQ ID NO: 926979 - protein, 21 aa, Mycobacterium
FAGRHLFVYEPLRGYDLQPTG

SEQ ID NO: 926980 - protein, 33 aa, Mycobacterium
FAGSPAVWLPDLGRVLGLFVLTAIPGYSYTDSL

SEQ ID NO: 926981 - protein, 17 aa, Mycobacterium
FAGVGIKLDHYSGSQYN

SEQ ID NO: 926982 - protein, 18 aa, Mycobacterium
FAGVPGYNHIKIKEAYGL

SEQ ID NO: 926983 - protein, 24 aa, Mycobacterium
FAIDAKSGATLGTYTLSGAKASDW

SEQ ID NO: 926984 - protein, 18 aa, Mycobacterium
FAIDYVQLGTDGRIYTGN

SEQ ID NO: 926985 - protein, 18 aa, Mycobacterium
FALCGWSESIAVDLAGSG

SEQ ID NO: 926986 - protein, 19 aa, Mycobacterium
FALIAVFAQLRFEREQRYT

SEQ ID NO: 926987 - protein, 21 aa, Mycobacterium
FALQDCIWRDTYYTPSGARKG

SEQ ID NO: 926988 - protein, 18 aa, Mycobacterium
FAMTACGGGGDSGGGGGA

SEQ ID NO: 926989 - protein, 23 aa, Mycobacterium
FANAMRASGSWWVYTPTNVLGWD

SEQ ID NO: 926990 - protein, 24 aa, Mycobacterium
FANSLAPLRPTIVVTAVPPTHTIG

SEQ ID NO: 926991 - protein, 19 aa, Mycobacterium
FAPAGIQPFGCLKSVPPPD

SEQ ID NO: 926992 - protein, 25 aa, Mycobacterium
FAPASTIKILLAMVVLDELPLDATV

SEQ ID NO: 926993 - protein, 21 aa, Mycobacterium
FAPDQLPPVNAFWSLTIYELP

SEQ ID NO: 926994 - protein, 20 aa, Mycobacterium
FAPGEMLPAFSGPVQAEVPR

SEQ ID NO: 926995 - protein, 17 aa, Mycobacterium
FAPGGTWNGVTYHNPQL

SEQ ID NO: 926996 - protein, 28 aa, Mycobacterium
FAPPADLGANCQYPSAPDTIVKPVSPPP

SEQ ID NO: 926997 - protein, 25 aa, Mycobacterium
FAPPTLHAMGIRVATSFPSFSRRTF

SEQ ID NO: 926998 - protein, 17 aa, Mycobacterium
FAPSFSIWTTIEECLNP

SEQ ID NO: 926999 - protein, 19 aa, Mycobacterium
FAQAQKLNMAKIITSAGPD

SEQ ID NO: 927000 - protein, 17 aa, Mycobacterium
FAQEGIRVRTGKPGELL

SEQ ID NO: 927001 - protein, 29 aa, Mycobacterium
FAQPYPAWRELFDNLLPAHIVKDVPGGFA

SEQ ID NO: 927002 - protein, 30 aa, Mycobacterium
FAQPYPSWKELFSNILPAHIVKDVPGGFAA

SEQ ID NO: 927003 - protein, 19 aa, Mycobacterium
FAREQHLDMAKIITSAGPA

SEQ ID NO: 927004 - protein, 18 aa, Mycobacterium
FARGMSRVFAGAIAAGAA

SEQ ID NO: 927005 - protein, 19 aa, Mycobacterium
FARGRKEPVGLGRVGDEFV

SEQ ID NO: 927006 - protein, 23 aa, Mycobacterium
FARTLLVWTAFAAVALLLAGCVR

SEQ ID NO: 927007 - protein, 18 aa, Mycobacterium
FARVLTRSAIGTLAGFTV

SEQ ID NO: 927008 - protein, 18 aa, Mycobacterium
FARVVGGTFARIQFTPDL

SEQ ID NO: 927009 - protein, 19 aa, Mycobacterium
FASHCYLVVVQDVRGQGTS

SEQ ID NO: 927010 - protein, 22 aa, Mycobacterium
FASPLVRKADEYGYGVDVVHLA

SEQ ID NO: 927011 - protein, 17 aa, Mycobacterium
FASPPGLLSPSIPHRVT

SEQ ID NO: 927012 - protein, 30 aa, Mycobacterium
FATFGDPIGRHAFGQSFLTAMFPVGSVVPA

SEQ ID NO: 927013 - protein, 18 aa, Mycobacterium
FATIPVLDGSGWSDDGMQ

SEQ ID NO: 927014 - protein, 18 aa, Mycobacterium
FAVARVKSFFGAHDTGIL

SEQ ID NO: 927015 - protein, 20 aa, Mycobacterium
FAVGPDRLARFVLVVLTQSE

SEQ ID NO: 927016 - protein, 20 aa, Mycobacterium
FAVGPDRLARFVLVVLTQSN

SEQ ID NO: 927017 - protein, 21 aa, Mycobacterium
FAVKVSCGFGGSMDETPMMLL

SEQ ID NO: 927018 - protein, 18 aa, Mycobacterium
FAVLAVLALATGCGGGGD

SEQ ID NO: 927019 - protein, 17 aa, Mycobacterium
FAVVRRGRSTWPPLRLV

SEQ ID NO: 927020 - protein, 21 aa, Mycobacterium
FAVVVPPPLIAANRSQVASLV

SEQ ID NO: 927021 - protein, 24 aa, Mycobacterium
FCAESPGLIAWLKAQGVEFRGGPV

SEQ ID NO: 927022 - protein, 28 aa, Mycobacterium
FCAGGKCPDVLMAWELSYAGLADRGVLL

SEQ ID NO: 927023 - protein, 17 aa, Mycobacterium
FDAARAAIVHPLQVAAN

SEQ ID NO: 927024 - protein, 25 aa, Mycobacterium
FDAKLRRCDFSLVSFAVQVPHPSLG

SEQ ID NO: 927025 - protein, 17 aa, Mycobacterium
FDASGLIVYAFAGAGVK

SEQ ID NO: 927026 - protein, 17 aa, Mycobacterium
FDASGLMQYAYAGAGIK

SEQ ID NO: 927027 - protein, 18 aa, Mycobacterium
FDASGLMQYAYAGAGVKL

SEQ ID NO: 927028 - protein, 26 aa, Mycobacterium
FDCLTAGCWPAWWLGNQDRGEIDIIE

SEQ ID NO: 927029 - protein, 17 aa, Mycobacterium
FDDAGAIGRRYRRQDEV

SEQ ID NO: 927030 - protein, 25 aa, Mycobacterium
FDDCGWGWHLADLAAVVSWLEDTPE

SEQ ID NO: 927031 - protein, 19 aa, Mycobacterium
FDDGSSLPVQAQVRDFPGG

SEQ ID NO: 927032 - protein, 17 aa, Mycobacterium
FDDSACSIYVAKGGDVI

SEQ ID NO: 927033 - protein, 19 aa, Mycobacterium
FDEKIALLLDDPVPLVSFT

SEQ ID NO: 927034 - protein, 26 aa, Mycobacterium
FDEVRAAALAQWNAALARITVAGTDS

SEQ ID NO: 927035 - protein, 17 aa, Mycobacterium
FDFPASGQHDWGSWAPQ

SEQ ID NO: 927036 - protein, 18 aa, Mycobacterium
FDGEFCGDTTYGLVNAGY

SEQ ID NO: 927037 - protein, 20 aa, Mycobacterium
FDGEFCGLNTFALVNAAYCK

SEQ ID NO: 927038 - protein, 27 aa, Mycobacterium
FDGQMAKEICNLMGLRQLGCSTGTLQD

SEQ ID NO: 927039 - protein, 20 aa, Mycobacterium
FDGSYSDLWTLRFTDPDTIA

SEQ ID NO: 927040 - protein, 22 aa, Mycobacterium
FDHQIRAVARWIASRTEPGDRV

SEQ ID NO: 927041 - protein, 17 aa, Mycobacterium
FDIGIGTMTTVRNPEQL

SEQ ID NO: 927042 - protein, 24 aa, Mycobacterium
FDIPRRRQLQLADLFCGGTDPGKV

SEQ ID NO: 927043 - protein, 18 aa, Mycobacterium
FDITTLFNGLQPVIATLS

SEQ ID NO: 927044 - protein, 18 aa, Mycobacterium
FDKARLQTWTVPYTAQFH

SEQ ID NO: 927045 - protein, 27 aa, Mycobacterium
FDKDRNGFVFGEAGALMVIETEEHAKA

SEQ ID NO: 927046 - protein, 17 aa, Mycobacterium
FDKDTRDSFVIVADNGA

SEQ ID NO: 927047 - protein, 27 aa, Mycobacterium
FDKLAAIGIDLPDVFRVLEDEGVEKFE

SEQ ID NO: 927048 - protein, 19 aa, Mycobacterium
FDKNGRGLAAWGALGFGYA

SEQ ID NO: 927049 - protein, 19 aa, Mycobacterium
FDKVLCSAGKRGLDIVLAP

SEQ ID NO: 927050 - protein, 17 aa, Mycobacterium
FDLDLLAAIAKPFESEL

SEQ ID NO: 927051 - protein, 19 aa, Mycobacterium
FDLDMVRQHFVTWEHDKED

SEQ ID NO: 927052 - protein, 20 aa, Mycobacterium
FDLPAGESISHAWNSTVAQS

SEQ ID NO: 927053 - protein, 26 aa, Mycobacterium
FDNTVPLTYPFALTFPTVMQLITGFD

SEQ ID NO: 927054 - protein, 20 aa, Mycobacterium
FDPAARCRLSTKHALALTNR

SEQ ID NO: 927055 - protein, 20 aa, Mycobacterium
FDPAHCAKSAMGPEMPPDLQ

SEQ ID NO: 927056 - protein, 21 aa, Mycobacterium
FDPEKRKAAIQAIEDHIFSEG

SEQ ID NO: 927057 - protein, 19 aa, Mycobacterium
FDPKVRLTLLTARAGLVLD

SEQ ID NO: 927058 - protein, 18 aa, Mycobacterium
FDPLLIISGGGRPMALRD

SEQ ID NO: 927059 - protein, 26 aa, Mycobacterium
FDPNSRFSVSMLWSGDKAWRQSGERR

SEQ ID NO: 927060 - protein, 25 aa, Mycobacterium
FDPTRPSLVVWLGVTAYLTREALDA

SEQ ID NO: 927061 - protein, 17 aa, Mycobacterium
FDPVYRHALEYATHSYC

SEQ ID NO: 927062 - protein, 20 aa, Mycobacterium
FDQAFEIDRSPVFGGPAELF

SEQ ID NO: 927063 - protein, 18 aa, Mycobacterium
FDQTRLRENVLLQAKVCQ

SEQ ID NO: 927064 - protein, 20 aa, Mycobacterium
FDRYKVEPPTTWDEYDEVAA

SEQ ID NO: 927065 - protein, 21 aa, Mycobacterium
FDSAPYGWPVEKGSPLAQSLL

SEQ ID NO: 927066 - protein, 18 aa, Mycobacterium
FDSRRPELVNSVGSLAQT

SEQ ID NO: 927067 - protein, 24 aa, Mycobacterium
FDTFTGLVSRCLRFSSAAVGSYEV

SEQ ID NO: 927068 - protein, 31 aa, Mycobacterium
FDTRRACLHDFWNRWERRATILQELVDTNLH

SEQ ID NO: 927069 - protein, 20 aa, Mycobacterium
FDVCKAGTPFPIAGLDGRKL

SEQ ID NO: 927070 - protein, 20 aa, Mycobacterium
FDVCKAGTPFPIRGAHGREL

SEQ ID NO: 927071 - protein, 18 aa, Mycobacterium
FDVCKAGTPFPITGVDGR

SEQ ID NO: 927072 - protein, 19 aa, Mycobacterium
FDVGTALRYMVRGATEGGV

SEQ ID NO: 927073 - protein, 22 aa, Mycobacterium
FDVKGEAPDSVVYSDVGSDEVI

SEQ ID NO: 927074 - protein, 19 aa, Mycobacterium
FDVPVPNLTAWRDGVVGDM

SEQ ID NO: 927075 - protein, 24 aa, Mycobacterium
FDYAEGRLGWRTLDFDVEVLPIGD

SEQ ID NO: 927076 - protein, 25 aa, Mycobacterium
FDYAEGRLGWRTLDFELEVLPIGDF

SEQ ID NO: 927077 - protein, 25 aa, Mycobacterium
FDYAEGRLGWRTLDFELEVLQTGDF

SEQ ID NO: 927078 - protein, 25 aa, Mycobacterium
FDYAEGRLGWRTLDFEVEVLPIGDF

SEQ ID NO: 927079 - protein, 18 aa, Mycobacterium
FEAALAATVHPVAVAANR

SEQ ID NO: 927080 - protein, 19 aa, Mycobacterium
FEDHIAWILQDKFNDPIAH

SEQ ID NO: 927081 - protein, 20 aa, Mycobacterium
FEEACAVLTGLLSQPSTTFD

SEQ ID NO: 927082 - protein, 34 aa, Mycobacterium
FEGTLELGYQIGFPWSLGVGINFSYTTPNILIDD

SEQ ID NO: 927083 - protein, 22 aa, Mycobacterium
FEGVMMPELFMADAMGATGKPL

SEQ ID NO: 927084 - protein, 23 aa, Mycobacterium
FEIDKRQVGGIGVDLNDILKPNF

SEQ ID NO: 927085 - protein, 25 aa, Mycobacterium
FEIQLRLPIDGRWELVASSDTGSVT

SEQ ID NO: 927086 - protein, 23 aa, Mycobacterium
FEKAPALGGTWWYNRYPGAEVDL

SEQ ID NO: 927087 - protein, 29 aa, Mycobacterium
FEKTAAHPRFRFFGNIEVGAKITAEELAS

SEQ ID NO: 927088 - protein, 17 aa, Mycobacterium
FELPAYSSVGWDTLRYT

SEQ ID NO: 927089 - protein, 23 aa, Mycobacterium
FENHGNFGSGFLNAGSFSSGFRN

SEQ ID NO: 927090 - protein, 19 aa, Mycobacterium
FEPADCAKFAEGQQFPPGL

SEQ ID NO: 927091 - protein, 26 aa, Mycobacterium
FEPAWRECVRLLPALGDTKVDEGFNG

SEQ ID NO: 927092 - protein, 17 aa, Mycobacterium
FEPNPDWSRAYSGSSEI

SEQ ID NO: 927093 - protein, 26 aa, Mycobacterium
FEQARNRFNAAWNRRDGGHPINDSAE

SEQ ID NO: 927094 - protein, 27 aa, Mycobacterium
FEQLAWMWPNWAKLFFNNKGVAANTTD

SEQ ID NO: 927095 - protein, 25 aa, Mycobacterium
FERARQRFDAAWTRQVGDHPINDSA

SEQ ID NO: 927096 - protein, 19 aa, Mycobacterium
FERISGWTLVCRGETAPSS

SEQ ID NO: 927097 - protein, 30 aa, Mycobacterium
FESEPSMSSMLSWQPSVYVAHAVVDDRPLA

SEQ ID NO: 927098 - protein, 17 aa, Mycobacterium
FESMWFCVVRAADLNEP

SEQ ID NO: 927099 - protein, 17 aa, Mycobacterium
FESRKHFFTDWSASSPA

SEQ ID NO: 927100 - protein, 17 aa, Mycobacterium
FEVGRRMGIGSRETYIP

SEQ ID NO: 927101 - protein, 21 aa, Mycobacterium
FEVGSVKQFFSIGLVNTKAQY

SEQ ID NO: 927102 - protein, 17 aa, Mycobacterium
FEVPEAAVAEFPGFAFF

SEQ ID NO: 927103 - protein, 17 aa, Mycobacterium
FFAARKLPDGLSFDPAN

SEQ ID NO: 927104 - protein, 20 aa, Mycobacterium
FFDQSRETWRGCVGTLTTYD

SEQ ID NO: 927105 - protein, 25 aa, Mycobacterium
FFEGRDVQAIISWVAGRPETELDAP

SEQ ID NO: 927106 - protein, 17 aa, Mycobacterium
FFEKTFAPLGLKKIQGE

SEQ ID NO: 927107 - protein, 18 aa, Mycobacterium
FFGPERLQAPELRSHQLP

SEQ ID NO: 927108 - protein, 20 aa, Mycobacterium
FFGTVAMIKAVLPGMRGRRR

SEQ ID NO: 927109 - protein, 19 aa, Mycobacterium
FFPVGAVVPAMDYRIPPPV

SEQ ID NO: 927110 - protein, 18 aa, Mycobacterium
FFSKDGKDRFGIADQQPA

SEQ ID NO: 927111 - protein, 25 aa, Mycobacterium
FFSRNCRAWLSTALMIQGNLDHAAK

SEQ ID NO: 927112 - protein, 21 aa, Mycobacterium
FFYYLFEPMVQSGLFNTLDWL

SEQ ID NO: 927113 - protein, 19 aa, Mycobacterium
FGAAIAASFVFPFTQNFVD

SEQ ID NO: 927114 - protein, 17 aa, Mycobacterium
FGAARLAPGHVHHNAMK

SEQ ID NO: 927115 - protein, 17 aa, Mycobacterium
FGAARSRLVAGGIVAGA

SEQ ID NO: 927116 - protein, 19 aa, Mycobacterium
FGAGACIALGAGHGVAAAD

SEQ ID NO: 927117 - protein, 24 aa, Mycobacterium
FGAGMGISTWWYRGSDMDTERTLE

SEQ ID NO: 927118 - protein, 23 aa, Mycobacterium
FGAKDFDVHTALRYMVNAATRGG

SEQ ID NO: 927119 - protein, 17 aa, Mycobacterium
FGALAAFLCSSAASYIT

SEQ ID NO: 927120 - protein, 20 aa, Mycobacterium
FGAPTTLPAIFTHRDVGNTE

SEQ ID NO: 927121 - protein, 22 aa, Mycobacterium
FGATLAGPVRRGEMLTDVRVLG

SEQ ID NO: 927122 - protein, 17 aa, Mycobacterium
FGAYAAFVPDKRIGIVM

SEQ ID NO: 927123 - protein, 25 aa, Mycobacterium
FGCRMGICQSCVVGLVEGHVRDLRT

SEQ ID NO: 927124 - protein, 20 aa, Mycobacterium
FGDADGFWAAVLHRTAERRA

SEQ ID NO: 927125 - protein, 21 aa, Mycobacterium
FGDLINRTNLLLGKLNARSEQ

SEQ ID NO: 927126 - protein, 24 aa, Mycobacterium
FGDLTRPGLDVVVCAPQVPCGAAT

SEQ ID NO: 927127 - protein, 18 aa, Mycobacterium
FGDTFGYCAVREHQWRYN

SEQ ID NO: 927128 - protein, 24 aa, Mycobacterium
FGDYRCRADQAGLYCVNYAHQSAA

SEQ ID NO: 927129 - protein, 20 aa, Mycobacterium
FGDYRCRADRTGLYCVNYAH

SEQ ID NO: 927130 - protein, 24 aa, Mycobacterium
FGEMAMASVAGRALAGAGVRTVSN

SEQ ID NO: 927131 - protein, 26 aa, Mycobacterium
FGEPLLALRIPWYVTVLDLGPAGAVY

SEQ ID NO: 927132 - protein, 17 aa, Mycobacterium
FGEYVVAGFSLRRNVDA

SEQ ID NO: 927133 - protein, 34 aa, Mycobacterium
FGGEPRYSAVPVRLHPDIRLFPAVPQQRSSTAET

SEQ ID NO: 927134 - protein, 27 aa, Mycobacterium
FGGHPLHFPMSFTRPLVSYLCSRPFLE

SEQ ID NO: 927135 - protein, 17 aa, Mycobacterium
FGGLFFVNSPEQRRLGI

SEQ ID NO: 927136 - protein, 17 aa, Mycobacterium
FGGRPHPTILAAAALLG

SEQ ID NO: 927137 - protein, 19 aa, Mycobacterium
FGGVDVLVNNAGYGYRSAV

SEQ ID NO: 927138 - protein, 23 aa, Mycobacterium
FGHLDAGLFFIAFVRNPQTQFIP

SEQ ID NO: 927139 - protein, 23 aa, Mycobacterium
FGHLDAGLFFIAFVRSPEKQFIP

SEQ ID NO: 927140 - protein, 18 aa, Mycobacterium
FGIHGERYQQVSAQALAT

SEQ ID NO: 927141 - protein, 23 aa, Mycobacterium
FGIRGFALCLRDDLRPAGVGVSV

SEQ ID NO: 927142 - protein, 24 aa, Mycobacterium
FGIRGFALCLRDDLRPAGVGVSVI

SEQ ID NO: 927143 - protein, 18 aa, Mycobacterium
FGIVEGYGGHGIGRHMHM

SEQ ID NO: 927144 - protein, 20 aa, Mycobacterium
FGLENIATMATSWGDGNGTV

SEQ ID NO: 927145 - protein, 23 aa, Mycobacterium
FGLPRGSVCLEITESVVVQDIET

SEQ ID NO: 927146 - protein, 23 aa, Mycobacterium
FGLRDRIRFGTEITDARFENGRW

SEQ ID NO: 927147 - protein, 25 aa, Mycobacterium
FGLTGDHQFGFGGFNSGSGNVGIGN

SEQ ID NO: 927148 - protein, 21 aa, Mycobacterium
FGNEDFAAWAPGMKTLDDALS

SEQ ID NO: 927149 - protein, 23 aa, Mycobacterium
FGNPSARIGRPLTLLSPDFGSRT

SEQ ID NO: 927150 - protein, 30 aa, Mycobacterium
FGNPVGRHAFGQSFLTSFFPVGAVVPAMDY

SEQ ID NO: 927151 - protein, 17 aa, Mycobacterium
FGPAGQRLLLAVMTRSA

SEQ ID NO: 927152 - protein, 26 aa, Mycobacterium
FGPEQRFLRHLGFYVALADLPGYTPS

SEQ ID NO: 927153 - protein, 19 aa, Mycobacterium
FGPEVKRRIMIGTYALSAG

SEQ ID NO: 927154 - protein, 19 aa, Mycobacterium
FGPLLGELLARAVLDDEVP

SEQ ID NO: 927155 - protein, 29 aa, Mycobacterium
FGQKIADAKFVIADGNLYAALTPGDPLSN

SEQ ID NO: 927156 - protein, 17 aa, Mycobacterium
FGRGAAIELARRGHQVV

SEQ ID NO: 927157 - protein, 18 aa, Mycobacterium
FGRRGGRVLQAIAFGLSH

SEQ ID NO: 927158 - protein, 35 aa, Mycobacterium
FGSGNRLGSLNFGFGNAVGDANFGWGNAGSSNLGL

SEQ ID NO: 927159 - protein, 17 aa, Mycobacterium
FGSVVSLVVRQGNPKGI

SEQ ID NO: 927160 - protein, 17 aa, Mycobacterium
FGVHFPGPLGLAAGFDK

SEQ ID NO: 927161 - protein, 25 aa, Mycobacterium
FGVLPLLMAMAVLGSRVSGADPGAA

SEQ ID NO: 927162 - protein, 23 aa, Mycobacterium
FGVLSRFTAFVAIDPEHTEAGPL

SEQ ID NO: 927163 - protein, 17 aa, Mycobacterium
FGVQMAKTLGLITQPAA

SEQ ID NO: 927164 - protein, 19 aa, Mycobacterium
FGVTTSMTFSTFATTSNDV

SEQ ID NO: 927165 - protein, 19 aa, Mycobacterium
FHAFFRQYYNLRGILSRID

SEQ ID NO: 927166 - protein, 18 aa, Mycobacterium
FHDMPVVPLWNYISVLGW

SEQ ID NO: 927167 - protein, 18 aa, Mycobacterium
FHGPKRYDWAKFVGTIKY

SEQ ID NO: 927168 - protein, 29 aa, Mycobacterium
FHGPKRYDWAKLVGSFKYTLWRLQERVVG

SEQ ID NO: 927169 - protein, 28 aa, Mycobacterium
FHGPMRRDWNYMIGSIKYVLWRLQERVV

SEQ ID NO: 927170 - protein, 23 aa, Mycobacterium
FHHVWASDHIQPWQDNQGHSMFP

SEQ ID NO: 927171 - protein, 17 aa, Mycobacterium
FHLQPHWEDRVRLLTRT

SEQ ID NO: 927172 - protein, 18 aa, Mycobacterium
FHPAQFRFAGSLSGFLNP

SEQ ID NO: 927173 - protein, 17 aa, Mycobacterium
FHSAEWDHSVTLRDKRV

SEQ ID NO: 927174 - protein, 18 aa, Mycobacterium
FHSPGMGTGATFAHTFSA

SEQ ID NO: 927175 - protein, 19 aa, Mycobacterium
FHTATHICMSLGPNSTPAD

SEQ ID NO: 927176 - protein, 19 aa, Mycobacterium
FHWHLEFPGIFTVPDDGSA

SEQ ID NO: 927177 - protein, 18 aa, Mycobacterium
FHYGRPDLMRHLPQQLLF

SEQ ID NO: 927178 - protein, 19 aa, Mycobacterium
FIAAGGFVGEFARPTPGFL

SEQ ID NO: 927179 - protein, 18 aa, Mycobacterium
FIASLRAAGITFADSDKA

SEQ ID NO: 927180 - protein, 17 aa, Mycobacterium
FIDAMCRNALRLTPDDV

SEQ ID NO: 927181 - protein, 24 aa, Mycobacterium
FIDGEAELGVAFVELARAAGVRRF

SEQ ID NO: 927182 - protein, 17 aa, Mycobacterium
FIDRLFTAGSMILFGID

SEQ ID NO: 927183 - protein, 24 aa, Mycobacterium
FIDTHEIRGFKALDDKTLQLTLTE

SEQ ID NO: 927184 - protein, 18 aa, Mycobacterium
FIGANFVHLALREARTSS

SEQ ID NO: 927185 - protein, 19 aa, Mycobacterium
FIGEMFRRQPVEGVGNLTN

SEQ ID NO: 927186 - protein, 25 aa, Mycobacterium
FIPEQHLPLVMGFKYLGVPEETLNR

SEQ ID NO: 927187 - protein, 25 aa, Mycobacterium
FIRNSELPLARALVDGAGMPPEAVG

SEQ ID NO: 927188 - protein, 35 aa, Mycobacterium
FISEARGGIPTGWKIARPPGVDWPVRPVIMLHGRD

SEQ ID NO: 927189 - protein, 22 aa, Mycobacterium
FISPRDRMGFFPDGPGFTEIPE

SEQ ID NO: 927190 - protein, 22 aa, Mycobacterium
FIVEGFGTSGVRLVQGALTAPL

SEQ ID NO: 927191 - protein, 17 aa, Mycobacterium
FIVPARETIRNPVEWDK

SEQ ID NO: 927192 - protein, 20 aa, Mycobacterium
FIWDRGRELGMVNRLQRVGP

SEQ ID NO: 927193 - protein, 18 aa, Mycobacterium
FKERYEVDLPKALVTGHA

SEQ ID NO: 927194 - protein, 24 aa, Mycobacterium
FKFMFRHLRGYFTKDLDQLVREEP

SEQ ID NO: 927195 - protein, 19 aa, Mycobacterium
FKGDPEFYVPSVIASSPKV

SEQ ID NO: 927196 - protein, 18 aa, Mycobacterium
FKGGSSVLHVDDLTFTGD

SEQ ID NO: 927197 - protein, 25 aa, Mycobacterium
FKIWHCATVGGNICLSFPAGAMISL

SEQ ID NO: 927198 - protein, 17 aa, Mycobacterium
FKKRGIDPENFWRSAGL

SEQ ID NO: 927199 - protein, 19 aa, Mycobacterium
FKNATGLKNGQFVRAAGVE

SEQ ID NO: 927200 - protein, 22 aa, Mycobacterium
FKRFSNITFEDWQRVIDVNLNG

SEQ ID NO: 927201 - protein, 18 aa, Mycobacterium
FKSSIAVTVLSDRAGLVM

SEQ ID NO: 927202 - protein, 17 aa, Mycobacterium
FKTSGCQPWQSTPDADV

SEQ ID NO: 927203 - protein, 25 aa, Mycobacterium
FKVVACAGLCGAAIALSPQAAAVPL

SEQ ID NO: 927204 - protein, 19 aa, Mycobacterium
FKYSLYRLQERVVGQGPNP

SEQ ID NO: 927205 - protein, 19 aa, Mycobacterium
FLAALKKHGIVFANRDAAI

SEQ ID NO: 927206 - protein, 18 aa, Mycobacterium
FLADFELEAVVGQVISSN

SEQ ID NO: 927207 - protein, 17 aa, Mycobacterium
FLAHCAAAALPVEPVDH

SEQ ID NO: 927208 - protein, 21 aa, Mycobacterium
FLAQMHKLGFTWPAGDDSDIV

SEQ ID NO: 927209 - protein, 20 aa, Mycobacterium
FLATLCQDWEAATAQAVAAG

SEQ ID NO: 927210 - protein, 17 aa, Mycobacterium
FLAVVLLSAGCSTGGLA

SEQ ID NO: 927211 - protein, 30 aa, Mycobacterium
FLAYGQFTGFAPRDVCAMWPVPPTSVVGAA

SEQ ID NO: 927212 - protein, 22 aa, Mycobacterium
FLCGAIQAASRLGWDQSAKLCV

SEQ ID NO: 927213 - protein, 22 aa, Mycobacterium
FLCGAIQAASRLGYEQSAKLCV

SEQ ID NO: 927214 - protein, 23 aa, Mycobacterium
FLCGAIQSASRLGGEQAAKLCVQ

SEQ ID NO: 927215 - protein, 21 aa, Mycobacterium
FLCGAVQAASRLNNEQSAKLC

SEQ ID NO: 927216 - protein, 24 aa, Mycobacterium
FLDFQCPFCQRFEAQYGEDITTYV

SEQ ID NO: 927217 - protein, 17 aa, Mycobacterium
FLDPRVHALYITNYPDQ

SEQ ID NO: 927218 - protein, 17 aa, Mycobacterium
FLDRLNTFGAPWGIQER

SEQ ID NO: 927219 - protein, 18 aa, Mycobacterium
FLDSHFRVGNALLGTTPE

SEQ ID NO: 927220 - protein, 25 aa, Mycobacterium
FLDSLRAAGVFIHKDAEPYVIQAGH

SEQ ID NO: 927221 - protein, 22 aa, Mycobacterium
FLEGLTIRTNRTFQDNYLAAGG

SEQ ID NO: 927222 - protein, 19 aa, Mycobacterium
FLELLSAYGAPWGLQEVPA

SEQ ID NO: 927223 - protein, 17 aa, Mycobacterium
FLEMTIRRRVFGIPNVK

SEQ ID NO: 927224 - protein, 17 aa, Mycobacterium
FLFQEYNLLNALTSAEN

SEQ ID NO: 927225 - protein, 25 aa, Mycobacterium
FLGPGLRVANPLLLFNFNYLPIPLN

SEQ ID NO: 927226 - protein, 19 aa, Mycobacterium
FLHRIDTLVTRCVADFGLP

SEQ ID NO: 927227 - protein, 25 aa, Mycobacterium
FLKYWYCLQHDDGLWYLHNTDSPSE

SEQ ID NO: 927228 - protein, 23 aa, Mycobacterium
FLLAAGCSWQLGGRNPLPQGVPP

SEQ ID NO: 927229 - protein, 17 aa, Mycobacterium
FLLLLWLFIWSVLRILR

SEQ ID NO: 927230 - protein, 17 aa, Mycobacterium
FLLTLAMAMALATATAW

SEQ ID NO: 927231 - protein, 25 aa, Mycobacterium
FLMYRKDLFEQAGIEMPRTPTWQQV

SEQ ID NO: 927232 - protein, 25 aa, Mycobacterium
FLNPSEGWWPFLINISMGDAGGYKA

SEQ ID NO: 927233 - protein, 22 aa, Mycobacterium
FLPSGHSFRFPSWSVERVVMPW

SEQ ID NO: 927234 - protein, 18 aa, Mycobacterium
FLQGKGVKFEPQRSQGFK

SEQ ID NO: 927235 - protein, 17 aa, Mycobacterium
FLQSKGVKLEAQKPQNF

SEQ ID NO: 927236 - protein, 25 aa, Mycobacterium
FLRRLGATMKLEFNTLPFTLGMREP

SEQ ID NO: 927237 - protein, 23 aa, Mycobacterium
FLSSELPNWLAANKGLAPGGHAA

SEQ ID NO: 927238 - protein, 24 aa, Mycobacterium
FLTQELPAWLEANRGVSRTGNAVV

SEQ ID NO: 927239 - protein, 22 aa, Mycobacterium
FLTSELPQWLSANRSVKPTGSA

SEQ ID NO: 927240 - protein, 17 aa, Mycobacterium
FLTSLQWLADQSRKETQ

SEQ ID NO: 927241 - protein, 18 aa, Mycobacterium
FLVGALAPTMAKRGRGSI

SEQ ID NO: 927242 - protein, 20 aa, Mycobacterium
FMAAGLVGGLVMSPSASADP

SEQ ID NO: 927243 - protein, 17 aa, Mycobacterium
FMASPAFLLRCATVAQV

SEQ ID NO: 927244 - protein, 18 aa, Mycobacterium
FMDALKIPSAILGGFDWG

SEQ ID NO: 927245 - protein, 24 aa, Mycobacterium
FMRLRARMSAEWARTIMSVAVQDY

SEQ ID NO: 927246 - protein, 20 aa, Mycobacterium
FMSGLLHRAASPAVWLNPLR

SEQ ID NO: 927247 - protein, 18 aa, Mycobacterium
FMSVTRWGQSGRWSTNYS

SEQ ID NO: 927248 - protein, 17 aa, Mycobacterium
FMVNWPYVLAAARSAAE

SEQ ID NO: 927249 - protein, 17 aa, Mycobacterium
FMVPGLTTVTGRVPNAD

SEQ ID NO: 927250 - protein, 20 aa, Mycobacterium
FNAGAGFGVTGFFNSGSGAL

SEQ ID NO: 927251 - protein, 17 aa, Mycobacterium
FNAGMDSWKAMGVKEYF

SEQ ID NO: 927252 - protein, 25 aa, Mycobacterium
FNCLAPGMWPAWWLSNDDPGRSGEI

SEQ ID NO: 927253 - protein, 18 aa, Mycobacterium
FNDAVRSGARLAVCAPEL

SEQ ID NO: 927254 - protein, 18 aa, Mycobacterium
FNEALFLLTQRPLDPGTP

SEQ ID NO: 927255 - protein, 24 aa, Mycobacterium
FNFPNNGTHNWAYWGRELQAMKPD

SEQ ID NO: 927256 - protein, 24 aa, Mycobacterium
FNFPNNGTHNWAYWGRELQAMVPD

SEQ ID NO: 927257 - protein, 25 aa, Mycobacterium
FNFPPNGTHSWGYWGAQLQAMKPDI

SEQ ID NO: 927258 - protein, 25 aa, Mycobacterium
FNFPTNGTHSWPYWNQQLVAMKGDI

SEQ ID NO: 927259 - protein, 25 aa, Mycobacterium
FNFPTNGTHSWPYWNQQLVAMKPDM

SEQ ID NO: 927260 - protein, 24 aa, Mycobacterium
FNFPTSGTHSWGYWGQQLQQMKPD

SEQ ID NO: 927261 - protein, 17 aa, Mycobacterium
FNGPGYTVYPVFNLAVA

SEQ ID NO: 927262 - protein, 18 aa, Mycobacterium
FNGRHYALPYARSTPLFY

SEQ ID NO: 927263 - protein, 18 aa, Mycobacterium
FNHRRMQPADAWAAQLLA

SEQ ID NO: 927264 - protein, 17 aa, Mycobacterium
FNIGTGIETSDRQLHSA

SEQ ID NO: 927265 - protein, 21 aa, Mycobacterium
FNPDVWAGLQNAIRQPVANTL

SEQ ID NO: 927266 - protein, 18 aa, Mycobacterium
FNPERARQLWAQANAISP

SEQ ID NO: 927267 - protein, 31 aa, Mycobacterium
FNPGDCIGNANAVCNVGPYGPNSMSNPANPA

SEQ ID NO: 927268 - protein, 21 aa, Mycobacterium
FNPQGKPIGFIRLPERCANLT

SEQ ID NO: 927269 - protein, 26 aa, Mycobacterium
FNQGIHWSPWLDLMVNYEETFVATMV

SEQ ID NO: 927270 - protein, 21 aa, Mycobacterium
FNSLRIEKGYRSWGTDMTAEH

SEQ ID NO: 927271 - protein, 24 aa, Mycobacterium
FPAGSELRRALAMVKTLDELDRLL

SEQ ID NO: 927272 - protein, 18 aa, Mycobacterium
FPAHFSYIKNGMVEEATN

SEQ ID NO: 927273 - protein, 20 aa, Mycobacterium
FPAIPYRVPYPQSMPGQEST

SEQ ID NO: 927274 - protein, 21 aa, Mycobacterium
FPAKMAELGVQAVVKFAEDGT

SEQ ID NO: 927275 - protein, 22 aa, Mycobacterium
FPANGTHDWPYWGQQLQQMKPD

SEQ ID NO: 927276 - protein, 18 aa, Mycobacterium
FPASVLSAVGVDRPAAQR

SEQ ID NO: 927277 - protein, 17 aa, Mycobacterium
FPDDLDPRIDLREADLE

SEQ ID NO: 927278 - protein, 17 aa, Mycobacterium
FPDEFAKRARALGESVG

SEQ ID NO: 927279 - protein, 24 aa, Mycobacterium
FPDYRPELPGGQPGGGRSLSAGPF

SEQ ID NO: 927280 - protein, 19 aa, Mycobacterium
FPFLRGFPIRCSAEETTCS

SEQ ID NO: 927281 - protein, 20 aa, Mycobacterium
FPGAIPKALFTPEQFWPVTP

SEQ ID NO: 927282 - protein, 17 aa, Mycobacterium
FPGEFPEQVTSYYLDTD

SEQ ID NO: 927283 - protein, 17 aa, Mycobacterium
FPGHLAGIAAYNDKALA

SEQ ID NO: 927284 - protein, 18 aa, Mycobacterium
FPGRRVVQLDIDGIAAGG

SEQ ID NO: 927285 - protein, 20 aa, Mycobacterium
FPGYANYFPVTRAVPEPPSI

SEQ ID NO: 927286 - protein, 17 aa, Mycobacterium
FPHTRLVTTALNPEIVR

SEQ ID NO: 927287 - protein, 24 aa, Mycobacterium
FPILKRPAMRMVLVGAAVIIGCLV

SEQ ID NO: 927288 - protein, 23 aa, Mycobacterium
FPINPYLRPAISPDRLIYTDPKL

SEQ ID NO: 927289 - protein, 21 aa, Mycobacterium
FPIPINPILAPAFDLQNVVYT

SEQ ID NO: 927290 - protein, 27 aa, Mycobacterium
FPKECPAPGVMQGCLDSTSGLIMGLDS

SEQ ID NO: 927291 - protein, 27 aa, Mycobacterium
FPKECPAPGVMQGCLESTSGLIMLPDS

SEQ ID NO: 927292 - protein, 19 aa, Mycobacterium
FPKETIGKWARGDYANLTA

SEQ ID NO: 927293 - protein, 17 aa, Mycobacterium
FPKETLTNWMRGDYANL

SEQ ID NO: 927294 - protein, 23 aa, Mycobacterium
FPPAGNHAWPYWGAQLSALKPDL

SEQ ID NO: 927295 - protein, 25 aa, Mycobacterium
FPPASATQVLVGWQSWLSAADRNTW

SEQ ID NO: 927296 - protein, 20 aa, Mycobacterium
FPPGWGPDARGQACIYWSSE

SEQ ID NO: 927297 - protein, 19 aa, Mycobacterium
FPQRYPARIVGAALISSAA

SEQ ID NO: 927298 - protein, 24 aa, Mycobacterium
FPQSFRFASIGGFAATRSSGQASS

SEQ ID NO: 927299 - protein, 19 aa, Mycobacterium
FPSGQQWRTAMLSLPVFPD

SEQ ID NO: 927300 - protein, 20 aa, Mycobacterium
FPSMIEFLAPLYGTGAGSND

SEQ ID NO: 927301 - protein, 20 aa, Mycobacterium
FPSVMSLVASLDFPFPAIGT

SEQ ID NO: 927302 - protein, 20 aa, Mycobacterium
FPTNLSVGFLGFIGQRQSLV

SEQ ID NO: 927303 - protein, 17 aa, Mycobacterium
FPVVIIGAGPTGVTAAT

SEQ ID NO: 927304 - protein, 21 aa, Mycobacterium
FQAAHARFVEVAAKVNALLDI

SEQ ID NO: 927305 - protein, 17 aa, Mycobacterium
FQAELTGAYSPPANCLV

SEQ ID NO: 927306 - protein, 19 aa, Mycobacterium
FQAPPGRAPIPVYGPGPAG

SEQ ID NO: 927307 - protein, 21 aa, Mycobacterium
FQGRLAQFVAIAARHGIKPLF

SEQ ID NO: 927308 - protein, 17 aa, Mycobacterium
FQHPDWAQRVFGSSPAV

SEQ ID NO: 927309 - protein, 17 aa, Mycobacterium
FQHSAAKLLDRVWQMAA

SEQ ID NO: 927310 - protein, 17 aa, Mycobacterium
FQNAIPVLGPFVSNTVT

SEQ ID NO: 927311 - protein, 23 aa, Mycobacterium
FQPQLRVLVDLGYADYGPNYANV

SEQ ID NO: 927312 - protein, 24 aa, Mycobacterium
FQQSVELMLALGLGESVVATVYPD

SEQ ID NO: 927313 - protein, 27 aa, Mycobacterium
FQRAARLGVHPSLFIEHVYFWGDPLID

SEQ ID NO: 927314 - protein, 19 aa, Mycobacterium
FQRGQIMVCSYVLRTGGSY

SEQ ID NO: 927315 - protein, 22 aa, Mycobacterium
FQRRLAQFVAIAARHHIKPLFV

SEQ ID NO: 927316 - protein, 18 aa, Mycobacterium
FQRTPGWVLPRPDFPHPS

SEQ ID NO: 927317 - protein, 19 aa, Mycobacterium
FQRTPGWVLPRPDFSHPQW

SEQ ID NO: 927318 - protein, 26 aa, Mycobacterium
FQRTPIWISPRFDIPFTAEQQDLFER

SEQ ID NO: 927319 - protein, 18 aa, Mycobacterium
FQSGGAPAVYLLDGLRAR

SEQ ID NO: 927320 - protein, 24 aa, Mycobacterium
FQTQRSAIFITWDEDFNNLSLTIG

SEQ ID NO: 927321 - protein, 22 aa, Mycobacterium
FQTRLAQFVAIAARHGIKPLFV

SEQ ID NO: 927322 - protein, 22 aa, Mycobacterium
FQTRLAQFVGIAARHRIKPLFV

SEQ ID NO: 927323 - protein, 18 aa, Mycobacterium
FRAALNYPVIAQILRQTT

SEQ ID NO: 927324 - protein, 20 aa, Mycobacterium
FRAALRELTLMLVYEASREA

SEQ ID NO: 927325 - protein, 24 aa, Mycobacterium
FRADRLRLALETAVRGGGDTDTVA

SEQ ID NO: 927326 - protein, 17 aa, Mycobacterium
FRAGPAFVVSPKDFGQV

SEQ ID NO: 927327 - protein, 26 aa, Mycobacterium
FRASDLRWDLLQNLPIDATKYPVPSF

SEQ ID NO: 927328 - protein, 18 aa, Mycobacterium
FRENFGSGDAVVIKNTDG

SEQ ID NO: 927329 - protein, 19 aa, Mycobacterium
FRERPVELDAVWRGDSTNP

SEQ ID NO: 927330 - protein, 17 aa, Mycobacterium
FRFFGNVTVGQHVEAAE

SEQ ID NO: 927331 - protein, 17 aa, Mycobacterium
FRGCLLGGAVGDALGAP

SEQ ID NO: 927332 - protein, 18 aa, Mycobacterium
FRGFGGFTGSFWADNIGD

SEQ ID NO: 927333 - protein, 19 aa, Mycobacterium
FRHDGFLEGFGLTDNSPEI

SEQ ID NO: 927334 - protein, 18 aa, Mycobacterium
FRIGCKRILLTNDWLPTL

SEQ ID NO: 927335 - protein, 17 aa, Mycobacterium
FRLGEKVDDPLAMYQFD

SEQ ID NO: 927336 - protein, 25 aa, Mycobacterium
FRNALRELSQTAGRLGDSRTDLFGT

SEQ ID NO: 927337 - protein, 19 aa, Mycobacterium
FRNPAAVWRRYDHMTRLPR

SEQ ID NO: 927338 - protein, 25 aa, Mycobacterium
FRNVQRLPLVGSWVRQGIDELSQRG

SEQ ID NO: 927339 - protein, 18 aa, Mycobacterium
FRPEMATFNAGSFNFGLF

SEQ ID NO: 927340 - protein, 17 aa, Mycobacterium
FRPESFAAQVRAHGVRS

SEQ ID NO: 927341 - protein, 20 aa, Mycobacterium
FRPKTITAYFTKTTAIYPGD

SEQ ID NO: 927342 - protein, 18 aa, Mycobacterium
FRPLFKALDPDQVNALST

SEQ ID NO: 927343 - protein, 19 aa, Mycobacterium
FRRKGVALGSSLLTCLTLA

SEQ ID NO: 927344 - protein, 18 aa, Mycobacterium
FRSACTTNGCAATGTQLD

SEQ ID NO: 927345 - protein, 25 aa, Mycobacterium
FRSEIDHWSRLVAVGGGANRQALAT

SEQ ID NO: 927346 - protein, 17 aa, Mycobacterium
FRSGGAIDDPDREQQVI

SEQ ID NO: 927347 - protein, 18 aa, Mycobacterium
FRSSDRDLADGMTIPDGE

SEQ ID NO: 927348 - protein, 24 aa, Mycobacterium
FRTGRWPDVLNQFSEGKGWRQPEL

SEQ ID NO: 927349 - protein, 18 aa, Mycobacterium
FRTLPVVRYDNIDGQDVN

SEQ ID NO: 927350 - protein, 29 aa, Mycobacterium
FRVAIGLTETHTWWRVDWNTLQDATVPVA

SEQ ID NO: 927351 - protein, 20 aa, Mycobacterium
FRVATLIFIADFVPRVLAGL

SEQ ID NO: 927352 - protein, 19 aa, Mycobacterium
FRVLVPYLRGYGSTRFRSG

SEQ ID NO: 927353 - protein, 19 aa, Mycobacterium
FRVTACETVSGGGGGKNVA

SEQ ID NO: 927354 - protein, 17 aa, Mycobacterium
FSAERRAFLKIPADTPF

SEQ ID NO: 927355 - protein, 23 aa, Mycobacterium
FSAIKHPCCGDLTYGADPTLAAK

SEQ ID NO: 927356 - protein, 21 aa, Mycobacterium
FSALDGVTCVLDRGSGSYGCS

SEQ ID NO: 927357 - protein, 24 aa, Mycobacterium
FSALEEKAGRCKSVTLDLDGVEGT

SEQ ID NO: 927358 - protein, 26 aa, Mycobacterium
FSDNLPTCIVKYIPLHTPAVVQSFNA

SEQ ID NO: 927359 - protein, 24 aa, Mycobacterium
FSDPTGPCLEGWTTLTALAQATTR

SEQ ID NO: 927360 - protein, 26 aa, Mycobacterium
FSDSLPTCITKYIPLHTPAVVMSMNA

SEQ ID NO: 927361 - protein, 19 aa, Mycobacterium
FSEGKGWRQPELKAAGAAM

SEQ ID NO: 927362 - protein, 17 aa, Mycobacterium
FSENWAGDIVTWDQDAS

SEQ ID NO: 927363 - protein, 20 aa, Mycobacterium
FSERARGRAGAADIVVTNHA

SEQ ID NO: 927364 - protein, 22 aa, Mycobacterium
FSFAPSAKWSHTFARQPEIHRY

SEQ ID NO: 927365 - protein, 23 aa, Mycobacterium
FSGEVYFTAAWPREDPDLRGKRV

SEQ ID NO: 927366 - protein, 17 aa, Mycobacterium
FSGGLGLGGEQTVEITI

SEQ ID NO: 927367 - protein, 17 aa, Mycobacterium
FSGLDLCEALQGVDVAI

SEQ ID NO: 927368 - protein, 18 aa, Mycobacterium
FSHAGAIMTWVAMNVDNP

SEQ ID NO: 927369 - protein, 28 aa, Mycobacterium
FSIEPGIYFPGRWGARIEDIVVVTEDGA

SEQ ID NO: 927370 - protein, 24 aa, Mycobacterium
FSKVNGMVVVGVWQPGAPAAGLVG

SEQ ID NO: 927371 - protein, 28 aa, Mycobacterium
FSLRNKSRLAALRVKDFSKRDVMMIHTL

SEQ ID NO: 927372 - protein, 18 aa, Mycobacterium
FSLRRNVDAASEITIGWV

SEQ ID NO: 927373 - protein, 17 aa, Mycobacterium
FSLSTIPNMVWGTAESA

SEQ ID NO: 927374 - protein, 25 aa, Mycobacterium
FSNVSGLRAGQFVRASGVEIGKVKE

SEQ ID NO: 927375 - protein, 17 aa, Mycobacterium
FSPATLYDPANYQNFAV

SEQ ID NO: 927376 - protein, 29 aa, Mycobacterium
FSQPYPAWRELFNDILPAHIVKDIPGGFG

SEQ ID NO: 927377 - protein, 17 aa, Mycobacterium
FSRNQFLAGRMALLQSG

SEQ ID NO: 927378 - protein, 17 aa, Mycobacterium
FSSGITIMIQKGNPENI

SEQ ID NO: 927379 - protein, 17 aa, Mycobacterium
FSSLRMGRDRYAEYAAQ

SEQ ID NO: 927380 - protein, 17 aa, Mycobacterium
FSVAACGTHGDTNAAST

SEQ ID NO: 927381 - protein, 24 aa, Mycobacterium
FSVARRLALLLTFQRFLPATGPIA

SEQ ID NO: 927382 - protein, 19 aa, Mycobacterium
FSVARRLALLLTFQRFLPT

SEQ ID NO: 927383 - protein, 26 aa, Mycobacterium
FSVASWAAGWVPYIGILAPQINFFYY

SEQ ID NO: 927384 - protein, 17 aa, Mycobacterium
FSVGDCVTISPGAGKTG

SEQ ID NO: 927385 - protein, 20 aa, Mycobacterium
FSWFRGSPIGRERKTMELSR

SEQ ID NO: 927386 - protein, 25 aa, Mycobacterium
FSYPRDGRPALLRVQSGASLAGNSR

SEQ ID NO: 927387 - protein, 23 aa, Mycobacterium
FSYPRNGRPALLQVRSGSSLAGN

SEQ ID NO: 927388 - protein, 22 aa, Mycobacterium
FTAEFANAGFLRPYTAEETSRL

SEQ ID NO: 927389 - protein, 23 aa, Mycobacterium
FTAEGLLRYLVRGRIKGLSTYTG

SEQ ID NO: 927390 - protein, 17 aa, Mycobacterium
FTAGFALAGSVAAAADP

SEQ ID NO: 927391 - protein, 22 aa, Mycobacterium
FTAGHCRGGGGVVTDRGGTVIG

SEQ ID NO: 927392 - protein, 19 aa, Mycobacterium
FTARLAPLFDNAPRVPDAT

SEQ ID NO: 927393 - protein, 18 aa, Mycobacterium
FTASYDWLPAVLEGILLA

SEQ ID NO: 927394 - protein, 18 aa, Mycobacterium
FTDKALFGAFSYGTYVMR

SEQ ID NO: 927395 - protein, 23 aa, Mycobacterium
FTDRARRARPEFVVTEENRALLE

SEQ ID NO: 927396 - protein, 24 aa, Mycobacterium
FTDTLELFACEARAGRLQRRGGGR

SEQ ID NO: 927397 - protein, 18 aa, Mycobacterium
FTEFTGYQHRVFALHAGQ

SEQ ID NO: 927398 - protein, 18 aa, Mycobacterium
FTEQEWGELVGRIDSAGI

SEQ ID NO: 927399 - protein, 17 aa, Mycobacterium
FTEVPRRGVAQTTTTPP

SEQ ID NO: 927400 - protein, 18 aa, Mycobacterium
FTFLSAAHYCPKYITGED

SEQ ID NO: 927401 - protein, 18 aa, Mycobacterium
FTGCNQFNGHAEVSGTPA

SEQ ID NO: 927402 - protein, 18 aa, Mycobacterium
FTGGLAATIDWYRRNEEW

SEQ ID NO: 927403 - protein, 17 aa, Mycobacterium
FTGLAISIFCPRAVDAM

SEQ ID NO: 927404 - protein, 17 aa, Mycobacterium
FTGTGVKGWINRWFYSV

SEQ ID NO: 927405 - protein, 21 aa, Mycobacterium
FTLDVYPRYLSLIPSNVNADI

SEQ ID NO: 927406 - protein, 22 aa, Mycobacterium
FTLSATWKFGPQKTTEWTYTAA

SEQ ID NO: 927407 - protein, 41 aa, Mycobacterium
FTLTDTRTGALRVVPLDASYSFRSLDRGPRGEAVILGTDGA

SEQ ID NO: 927408 - protein, 17 aa, Mycobacterium
FTPDRWTPDKVYSGGYK

SEQ ID NO: 927409 - protein, 17 aa, Mycobacterium
FTPEGFYIDTGIKTLPL

SEQ ID NO: 927410 - protein, 20 aa, Mycobacterium
FTPEGLYPVTGVKNLTFDTS

SEQ ID NO: 927411 - protein, 25 aa, Mycobacterium
FTPGEFEGGSSFSHLDDFTFDGDDQ

SEQ ID NO: 927412 - protein, 32 aa, Mycobacterium
FTPIHGGWQLSQRTSEMLLALGNSRGSQTATP

SEQ ID NO: 927413 - protein, 30 aa, Mycobacterium
FTPTRWLLNRLCAPTDPILGTEVFGVHFPA

SEQ ID NO: 927414 - protein, 18 aa, Mycobacterium
FTPVAQSIGVDFDVAFEA

SEQ ID NO: 927415 - protein, 18 aa, Mycobacterium
FTQAALVTDLPGELMSAL

SEQ ID NO: 927416 - protein, 20 aa, Mycobacterium
FTQRCPQSKVVLAGYSQGAM

SEQ ID NO: 927417 - protein, 22 aa, Mycobacterium
FTTQELPAYLAANKGISQTGNA

SEQ ID NO: 927418 - protein, 19 aa, Mycobacterium
FTTRARPLLTTARNECLAQ

SEQ ID NO: 927419 - protein, 26 aa, Mycobacterium
FTTVTGLEWGNWGPFAFTSNYSTQQH

SEQ ID NO: 927420 - protein, 18 aa, Mycobacterium
FTVSRLHGVFGNEKRPSY

SEQ ID NO: 927421 - protein, 18 aa, Mycobacterium
FVAQWQKCDGTTLIAPPT

SEQ ID NO: 927422 - protein, 23 aa, Mycobacterium
FVASALARLGPLLVVTATGREAD

SEQ ID NO: 927423 - protein, 18 aa, Mycobacterium
FVAVAGIGLLSPGDIGQL

SEQ ID NO: 927424 - protein, 17 aa, Mycobacterium
FVDLPDYSHSIVSLPDG

SEQ ID NO: 927425 - protein, 22 aa, Mycobacterium
FVEDFKARFGADRVTSDPMESA

SEQ ID NO: 927426 - protein, 25 aa, Mycobacterium
FVEGRAMVDMEFDCVIGNPTPADIL

SEQ ID NO: 927427 - protein, 20 aa, Mycobacterium
FVEREIAPKLAEWEHVGEIP

SEQ ID NO: 927428 - protein, 17 aa, Mycobacterium
FVGAATFEALSGNPVHT

SEQ ID NO: 927429 - protein, 19 aa, Mycobacterium
FVGDLWPNGDVAGLHAAAG

SEQ ID NO: 927430 - protein, 25 aa, Mycobacterium
FVGEFARPTPGFLGFRDHHTSPPWT

SEQ ID NO: 927431 - protein, 24 aa, Mycobacterium
FVGELRAGLRAADCALFVIAANEG

SEQ ID NO: 927432 - protein, 25 aa, Mycobacterium
FVGIRGDLALAVFVSDARSSAPAVD

SEQ ID NO: 927433 - protein, 22 aa, Mycobacterium
FVGNPRIGKTFFDATQAIGAVI

SEQ ID NO: 927434 - protein, 24 aa, Mycobacterium
FVGSVAMTTHMQWVDAAHDMQLAE

SEQ ID NO: 927435 - protein, 18 aa, Mycobacterium
FVGTGLYGASFVGNLGAL

SEQ ID NO: 927436 - protein, 22 aa, Mycobacterium
FVIDRTLSWLDRYVKGNENADT

SEQ ID NO: 927437 - protein, 30 aa, Mycobacterium
FVKNLGEFANDVFLAAVWIVADEAYLHIPG

SEQ ID NO: 927438 - protein, 19 aa, Mycobacterium
FVMELARPLVALGTRALLL

SEQ ID NO: 927439 - protein, 18 aa, Mycobacterium
FVNGDWWVVGPVKVVSVT

SEQ ID NO: 927440 - protein, 28 aa, Mycobacterium
FVPAKTLPLVEPLRWVGLGQLADELTPG

SEQ ID NO: 927441 - protein, 21 aa, Mycobacterium
FVPRIRRVAGRVTVFQRSAPY

SEQ ID NO: 927442 - protein, 17 aa, Mycobacterium
FVQSLFTPEGFYIDTGI

SEQ ID NO: 927443 - protein, 18 aa, Mycobacterium
FVQVAMNLVTGWPKPANA

SEQ ID NO: 927444 - protein, 18 aa, Mycobacterium
FVQVLKWLNQPLDAAISV

SEQ ID NO: 927445 - protein, 17 aa, Mycobacterium
FVRMLHFGAGSYAATEA

SEQ ID NO: 927446 - protein, 18 aa, Mycobacterium
FVRQRHGLDNGDLDRTHR

SEQ ID NO: 927447 - protein, 17 aa, Mycobacterium
FVRRVIDTLILPAVCAA

SEQ ID NO: 927448 - protein, 24 aa, Mycobacterium
FVSSLRLAGPAIVLSATATQAAGP

SEQ ID NO: 927449 - protein, 26 aa, Mycobacterium
FVSYYRRPIYTAAMAGVLVAPEILTA

SEQ ID NO: 927450 - protein, 20 aa, Mycobacterium
FVTGEPRSGTTLMHALMSVD

SEQ ID NO: 927451 - protein, 32 aa, Mycobacterium
FVTHFADPLTLAWPNHAKLFFNNKGVAAHTTD

SEQ ID NO: 927452 - protein, 17 aa, Mycobacterium
FVTRGILLGIKRRAEKA

SEQ ID NO: 927453 - protein, 28 aa, Mycobacterium
FVVDAWEAAVPWIDYGVGLVDGALGWVP

SEQ ID NO: 927454 - protein, 19 aa, Mycobacterium
FVVRSGSIVAWRGVDMEGE

SEQ ID NO: 927455 - protein, 17 aa, Mycobacterium
FWGRHGAAGLLLRAPMP

SEQ ID NO: 927456 - protein, 26 aa, Mycobacterium
FWLDPESRVLAGMNVNIWDVLDDVKA

SEQ ID NO: 927457 - protein, 21 aa, Mycobacterium
FWLDYADGMQPYFSVPATGIE

SEQ ID NO: 927458 - protein, 21 aa, Mycobacterium
FWNREYDILVCTTIVETGLDI

SEQ ID NO: 927459 - protein, 23 aa, Mycobacterium
FWSLTMYELPGSVLVANPMNRYL

SEQ ID NO: 927460 - protein, 17 aa, Mycobacterium
FWVDKEFQVPADATAAI

SEQ ID NO: 927461 - protein, 17 aa, Mycobacterium
FWVKDGQNYLPFGTPAG

SEQ ID NO: 927462 - protein, 21 aa, Mycobacterium
FWWSADSRIGDSTVIEQTNHE

SEQ ID NO: 927463 - protein, 22 aa, Mycobacterium
FWYSSCMVTFKTSYGVIQQSLF

SEQ ID NO: 927464 - protein, 19 aa, Mycobacterium
FYAAVKLALNKNVVLPANS

SEQ ID NO: 927465 - protein, 25 aa, Mycobacterium
FYDASVRRWFACANRKFVDRPPGKP

SEQ ID NO: 927466 - protein, 25 aa, Mycobacterium
FYDASVRRWSACANRRFVDHPPGQP

SEQ ID NO: 927467 - protein, 17 aa, Mycobacterium
FYDHIKSGDIVEVVNTV

SEQ ID NO: 927468 - protein, 23 aa, Mycobacterium
FYEGGGWERPAWFQANAELVREL

SEQ ID NO: 927469 - protein, 25 aa, Mycobacterium
FYEGGGWERPAWYGANDRLVQRLFD

SEQ ID NO: 927470 - protein, 20 aa, Mycobacterium
FYERLWRPTVEEKQESARAV

SEQ ID NO: 927471 - protein, 20 aa, Mycobacterium
FYERLWRPVVEDKQQSGQAA

SEQ ID NO: 927472 - protein, 23 aa, Mycobacterium
FYGPEGTQSVAMYLGNNQMLEVG

SEQ ID NO: 927473 - protein, 26 aa, Mycobacterium
FYKPKQAGSYPIVLATYEIVCSKYPD

SEQ ID NO: 927474 - protein, 20 aa, Mycobacterium
FYNTEGLPYFSVGMGNFGVQ

SEQ ID NO: 927475 - protein, 23 aa, Mycobacterium
FYPVPGLTLGGLVVDEKTGEVMH

SEQ ID NO: 927476 - protein, 24 aa, Mycobacterium
FYQACITALGPRATVLANPPSTNL

SEQ ID NO: 927477 - protein, 23 aa, Mycobacterium
FYRELLDRASVYGVKARITPTRQ

SEQ ID NO: 927478 - protein, 18 aa, Mycobacterium
FYSEGAFINVYMCDLNLT

SEQ ID NO: 927479 - protein, 17 aa, Mycobacterium
FYSGGAITIDELSVRLP

SEQ ID NO: 927480 - protein, 17 aa, Mycobacterium
FYVWDFAEKFNEDVIDD

SEQ ID NO: 927481 - protein, 17 aa, Mycobacterium
GAAALWDGPGRWKQTPA

SEQ ID NO: 927482 - protein, 25 aa, Mycobacterium
GAAARLRQSIGIDVEGIPEFGHQIN

SEQ ID NO: 927483 - protein, 20 aa, Mycobacterium
GAAGAARPNAPAIAAGPTSA

SEQ ID NO: 927484 - protein, 20 aa, Mycobacterium
GAAGCGRPGTDHATPDAPPP

SEQ ID NO: 927485 - protein, 18 aa, Mycobacterium
GAAGLIVISAAPDRGSSA

SEQ ID NO: 927486 - protein, 18 aa, Mycobacterium
GAAGLLLAGWAGSMGVAA

SEQ ID NO: 927487 - protein, 24 aa, Mycobacterium
GAAGRRGGGLLGRHGGAGQRARAA

SEQ ID NO: 927488 - protein, 22 aa, Mycobacterium
GAAGTARRDRIATNTTDSTGRT

SEQ ID NO: 927489 - protein, 19 aa, Mycobacterium
GAAHPEVFAFATTLTRLTA

SEQ ID NO: 927490 - protein, 26 aa, Mycobacterium
GAAIYSPCALPPVLDYLTSGELPSTD

SEQ ID NO: 927491 - protein, 21 aa, Mycobacterium
GAAKTMPRRLGIAAVGAALLS

SEQ ID NO: 927492 - protein, 18 aa, Mycobacterium
GAALALAVMTGRWQLVVF

SEQ ID NO: 927493 - protein, 23 aa, Mycobacterium
GAARRIAPAGARIEVHRDGEFLV

SEQ ID NO: 927494 - protein, 27 aa, Mycobacterium
GAATARLFADRGADVWIGDVDDVVAKE

SEQ ID NO: 927495 - protein, 25 aa, Mycobacterium
GAATKLPVCVIKYIPLHTPTTTYSI

SEQ ID NO: 927496 - protein, 21 aa, Mycobacterium
GAAVEGLKAIVLLANGADAYA

SEQ ID NO: 927497 - protein, 19 aa, Mycobacterium
GAAVIDVIAAVPFPAIGFN

SEQ ID NO: 927498 - protein, 18 aa, Mycobacterium
GACSCSIGSSSHSVSKSE

SEQ ID NO: 927499 - protein, 17 aa, Mycobacterium
GACVYTYTIDPKYIGLH

SEQ ID NO: 927500 - protein, 19 aa, Mycobacterium
GADALPVLRRSVSLLRYIE

SEQ ID NO: 927501 - protein, 25 aa, Mycobacterium
GADEVSAVVAALFDAHAQAYQSLSA

SEQ ID NO: 927502 - protein, 17 aa, Mycobacterium
GADFPAGLQRLDAAQAL

SEQ ID NO: 927503 - protein, 22 aa, Mycobacterium
GADLCQQLSWGASPQQLELLAL

SEQ ID NO: 927504 - protein, 25 aa, Mycobacterium
GADPPPASAPWFWTDRHGDHVEAVG

SEQ ID NO: 927505 - protein, 21 aa, Mycobacterium
GADRGGVVGACAAVAAESSGA

SEQ ID NO: 927506 - protein, 17 aa, Mycobacterium
GADSPGVHYLRTYEDAV

SEQ ID NO: 927507 - protein, 19 aa, Mycobacterium
GADTPEWAWSAMVSTDPAF

SEQ ID NO: 927508 - protein, 19 aa, Mycobacterium
GADVLKTNPIVSVDRRGIG

SEQ ID NO: 927509 - protein, 24 aa, Mycobacterium
GAEGFGRALVRDMIAAEPLLGTAD

SEQ ID NO: 927510 - protein, 27 aa, Mycobacterium
GAEGPDGSVLWSLRAVDWNCDNLFVAA

SEQ ID NO: 927511 - protein, 18 aa, Mycobacterium
GAELARELVSHAVKVGEA

SEQ ID NO: 927512 - protein, 19 aa, Mycobacterium
GAELEICIVLPPDTRAPGM

SEQ ID NO: 927513 - protein, 19 aa, Mycobacterium
GAEPCTIAGYAGVDSGAGG

SEQ ID NO: 927514 - protein, 20 aa, Mycobacterium
GAEPCTLTGYPGVDSGSGGP

SEQ ID NO: 927515 - protein, 21 aa, Mycobacterium
GAEPGRWPAERANSWYQAQGW

SEQ ID NO: 927516 - protein, 25 aa, Mycobacterium
GAFFEIAKAVAPITVCLNDDTSDPY

SEQ ID NO: 927517 - protein, 24 aa, Mycobacterium
GAFFNIYFCTVTIKINGPAGSDIL

SEQ ID NO: 927518 - protein, 23 aa, Mycobacterium
GAFQRLAPPAPRSEGGFASRHQC

SEQ ID NO: 927519 - protein, 24 aa, Mycobacterium
GAGADRGGVVGACAAVAAESSGAA

SEQ ID NO: 927520 - protein, 23 aa, Mycobacterium
GAGADRGGVVGARAAVAAESAGA

SEQ ID NO: 927521 - protein, 21 aa, Mycobacterium
GAGALAIRLTRHRPRVPIGVN

SEQ ID NO: 927522 - protein, 19 aa, Mycobacterium
GAGALTVASLAPWPSGCAS

SEQ ID NO: 927523 - protein, 24 aa, Mycobacterium
GAGANMPRRLAIAAVGASLLSGLV

SEQ ID NO: 927524 - protein, 23 aa, Mycobacterium
GAGARLDGAVIFDGVRVEAGAVI

SEQ ID NO: 927525 - protein, 18 aa, Mycobacterium
GAGDARRALADFSAGKLV

SEQ ID NO: 927526 - protein, 23 aa, Mycobacterium
GAGDIPPPPGWGAPPGPRGIYQP

SEQ ID NO: 927527 - protein, 27 aa, Mycobacterium
GAGGAGGATGWFGSTGTTGAGGNGGTG

SEQ ID NO: 927528 - protein, 18 aa, Mycobacterium
GAGGLFFGHGGAGGAGGN

SEQ ID NO: 927529 - protein, 19 aa, Mycobacterium
GAGGLLFGLGGAGGNAPVF

SEQ ID NO: 927530 - protein, 20 aa, Mycobacterium
GAGGLLYGNGGAGFNNGATA

SEQ ID NO: 927531 - protein, 29 aa, Mycobacterium
GAGGMATARIPAGINFNVGGAGGHGGAGA

SEQ ID NO: 927532 - protein, 21 aa, Mycobacterium
GAGGNGGWVVGNGGIAGAGGH

SEQ ID NO: 927533 - protein, 18 aa, Mycobacterium
GAGGRGGNNLANPATDGG

SEQ ID NO: 927534 - protein, 32 aa, Mycobacterium
GAGGSGGSCVAFDFVGFAAAHGGAGGTGGAAT

SEQ ID NO: 927535 - protein, 24 aa, Mycobacterium
GAGIGRRPLITEALRGEGAKLVDR

SEQ ID NO: 927536 - protein, 24 aa, Mycobacterium
GAGNIADVATVLFSSHSTAHASAL

SEQ ID NO: 927537 - protein, 18 aa, Mycobacterium
GAGRPLVYGRAAVERVIQ

SEQ ID NO: 927538 - protein, 18 aa, Mycobacterium
GAGTRFGMPKVLADGGEW

SEQ ID NO: 927539 - protein, 31 aa, Mycobacterium
GAGTVGFDCSGLMLYMFAGVGIKLDHYSGSQ

SEQ ID NO: 927540 - protein, 19 aa, Mycobacterium
GAGTVVIWESCCAADDDVV

SEQ ID NO: 927541 - protein, 33 aa, Mycobacterium
GAGVIGLSWARLARSHGWRVGITDPRDDLDAVV

SEQ ID NO: 927542 - protein, 19 aa, Mycobacterium
GAHLRRWGIPEHRIVELDW

SEQ ID NO: 927543 - protein, 29 aa, Mycobacterium
GAHPQTWFKSFNWDVAKKAPITFDTLFKP

SEQ ID NO: 927544 - protein, 17 aa, Mycobacterium
GAIGLFGNGAAGGDGGI

SEQ ID NO: 927545 - protein, 23 aa, Mycobacterium
GAIIDFRDNVLWVATDNARTQIN

SEQ ID NO: 927546 - protein, 17 aa, Mycobacterium
GAIKEWNDPAIQGLNPG

SEQ ID NO: 927547 - protein, 31 aa, Mycobacterium
GAILADPALRLAICKGIDRRTIAKVALYGLT

SEQ ID NO: 927548 - protein, 26 aa, Mycobacterium
GAIPRVYGREAVEYVIRRGMSQIGVP

SEQ ID NO: 927549 - protein, 18 aa, Mycobacterium
GAIRRGGPGTAIGLSEGA

SEQ ID NO: 927550 - protein, 19 aa, Mycobacterium
GAITLWLGLVAQVGGVSGA

SEQ ID NO: 927551 - protein, 19 aa, Mycobacterium
GAITLWLGLVGNVGQVLNG

SEQ ID NO: 927552 - protein, 21 aa, Mycobacterium
GAITRPALLDFVRNYQGQGVA

SEQ ID NO: 927553 - protein, 17 aa, Mycobacterium
GAIVGVWGPKGQYVRTF

SEQ ID NO: 927554 - protein, 24 aa, Mycobacterium
GAIYDAWASLSYERGPLGLPTSAE

SEQ ID NO: 927555 - protein, 26 aa, Mycobacterium
GAKAGNLPGDMTFSWYAVDRSGQPWV

SEQ ID NO: 927556 - protein, 19 aa, Mycobacterium
GAKARLAIIKYPAKGNKIG

SEQ ID NO: 927557 - protein, 24 aa, Mycobacterium
GAKDFDVRAALRYMVDGATKGGAG

SEQ ID NO: 927558 - protein, 17 aa, Mycobacterium
GALAAIPLLSGCATTTH

SEQ ID NO: 927559 - protein, 26 aa, Mycobacterium
GALAAVPARRALAFCTPRDVIARNAE

SEQ ID NO: 927560 - protein, 18 aa, Mycobacterium
GALARRNLVLDTMIENIP

SEQ ID NO: 927561 - protein, 20 aa, Mycobacterium
GALCDARGGAFSPVVTGQYR

SEQ ID NO: 927562 - protein, 22 aa, Mycobacterium
GALDATVTWTSEGIKESFQNAI

SEQ ID NO: 927563 - protein, 23 aa, Mycobacterium
GALDCRDLFDRQEMFEQAQFQSG

SEQ ID NO: 927564 - protein, 25 aa, Mycobacterium
GALDMVKCLNWPSGSAPAEPSELEI

SEQ ID NO: 927565 - protein, 35 aa, Mycobacterium
GALFLSAGMGIANAQPRDGQVDLALGTAGVLEDVP

SEQ ID NO: 927566 - protein, 17 aa, Mycobacterium
GALGAPFEWPLVANAAQ

SEQ ID NO: 927567 - protein, 19 aa, Mycobacterium
GALGHPMGPFRLLDIVGMD

SEQ ID NO: 927568 - protein, 26 aa, Mycobacterium
GALGRLRPLFRAGLGARLGSGRQYMS

SEQ ID NO: 927569 - protein, 26 aa, Mycobacterium
GALGRLRPLFRTGLGARLGSGRQYMS

SEQ ID NO: 927570 - protein, 22 aa, Mycobacterium
GALNGTITWSSDGIKQSIQDAI

SEQ ID NO: 927571 - protein, 25 aa, Mycobacterium
GALPWLKKLHGTIVVIKYGGNAMTD

SEQ ID NO: 927572 - protein, 21 aa, Mycobacterium
GALRSRTGFPTTITGSPPEGR

SEQ ID NO: 927573 - protein, 25 aa, Mycobacterium
GAMVLDEFLPLLAAQGLDTSRVGFL

SEQ ID NO: 927574 - protein, 18 aa, Mycobacterium
GANGLFGAAGSGGSGGAG

SEQ ID NO: 927575 - protein, 29 aa, Mycobacterium
GANGYLGRFLCLEWLQRLSQTGGQLICLV

SEQ ID NO: 927576 - protein, 19 aa, Mycobacterium
GANLMKFGPLLGELLARAV

SEQ ID NO: 927577 - protein, 39 aa, Mycobacterium
GAPAAPSQPPLLWVVLAWVRRELQRTFANSTPTTTPQSV

SEQ ID NO: 927578 - protein, 19 aa, Mycobacterium
GAPARYFGSNLSRLTTVRQ

SEQ ID NO: 927579 - protein, 21 aa, Mycobacterium
GAPEGQRREAIKTYLDGQPAA

SEQ ID NO: 927580 - protein, 17 aa, Mycobacterium
GAPGDFNSAGGHFQVSG

SEQ ID NO: 927581 - protein, 24 aa, Mycobacterium
GAPGMPGFSAGLLGPQGVVAGLLT

SEQ ID NO: 927582 - protein, 19 aa, Mycobacterium
GAPGSNWAAPVQPQNGAST

SEQ ID NO: 927583 - protein, 26 aa, Mycobacterium
GAPIRARIGDELVVTVSNRLDHPTSV

SEQ ID NO: 927584 - protein, 32 aa, Mycobacterium
GAPKTTFKSFNWDQTYRKAIVWTAASDDKNNT

SEQ ID NO: 927585 - protein, 28 aa, Mycobacterium
GAPLSYPSVYLGCHYSNCSPGSRLPAQL

SEQ ID NO: 927586 - protein, 18 aa, Mycobacterium
GAPMARRIVEGGFETTLW

SEQ ID NO: 927587 - protein, 18 aa, Mycobacterium
GAPNRIGGLSGITYDPAH

SEQ ID NO: 927588 - protein, 17 aa, Mycobacterium
GAPSEFLHRSVGLAGLK

SEQ ID NO: 927589 - protein, 26 aa, Mycobacterium
GAPTIQLPIPPGWEPAGPQTPEGAYD

SEQ ID NO: 927590 - protein, 25 aa, Mycobacterium
GAPVDFPLNGVVPGFQKAIAGQKVG

SEQ ID NO: 927591 - protein, 19 aa, Mycobacterium
GAQSGPPTLTWYILPDNGG

SEQ ID NO: 927592 - protein, 25 aa, Mycobacterium
GAREWQPATRWRFANDPANLIAVQG

SEQ ID NO: 927593 - protein, 20 aa, Mycobacterium
GARGYAHIGVLNELRERGHE

SEQ ID NO: 927594 - protein, 25 aa, Mycobacterium
GARMVITVLSWRLDLDRLAATAQRC

SEQ ID NO: 927595 - protein, 24 aa, Mycobacterium
GARNMRLALGVFVYKSCCNDTSSD

SEQ ID NO: 927596 - protein, 20 aa, Mycobacterium
GARPPVPPPRPPTVKPGVTP

SEQ ID NO: 927597 - protein, 20 aa, Mycobacterium
GARVWPGVTIPDGGIRYSTD

SEQ ID NO: 927598 - protein, 26 aa, Mycobacterium
GASADVANFMFSYFVGVDENGHMFGG

SEQ ID NO: 927599 - protein, 18 aa, Mycobacterium
GASLITFVPGFVGDAAPA

SEQ ID NO: 927600 - protein, 26 aa, Mycobacterium
GASMALDVCRLLTLVAGLDPKLMGVF

SEQ ID NO: 927601 - protein, 25 aa, Mycobacterium
GASMALDVCRLLTLVSGLDPRLMGL

SEQ ID NO: 927602 - protein, 24 aa, Mycobacterium
GASVESRAGLALTLGVTPPPGSRV

SEQ ID NO: 927603 - protein, 17 aa, Mycobacterium
GASYLVFDGVRPDEQAA

SEQ ID NO: 927604 - protein, 20 aa, Mycobacterium
GATARLGLSPADLAERHPQV

SEQ ID NO: 927605 - protein, 25 aa, Mycobacterium
GATDLCEFMVFTGGMLQVCGDSFAG

SEQ ID NO: 927606 - protein, 20 aa, Mycobacterium
GATFLDGRATAVSHAENHFD

SEQ ID NO: 927607 - protein, 17 aa, Mycobacterium
GATGNCWSVHTNCPVPG

SEQ ID NO: 927608 - protein, 18 aa, Mycobacterium
GATGNCWSVHTNCPVPGP

SEQ ID NO: 927609 - protein, 23 aa, Mycobacterium
GATGNGGIRTRSSRHTVTTGAAG

SEQ ID NO: 927610 - protein, 17 aa, Mycobacterium
GATGNMGSLIFTSPTTL

SEQ ID NO: 927611 - protein, 18 aa, Mycobacterium
GATLPAEPITVIFRSDES

SEQ ID NO: 927612 - protein, 27 aa, Mycobacterium
GATLVLACALAGCAAPKSLPPTAAPDL

SEQ ID NO: 927613 - protein, 25 aa, Mycobacterium
GATSMKVWFNAKAMWDWSKNISDKN

SEQ ID NO: 927614 - protein, 26 aa, Mycobacterium
GATTGGPGNEVWTFKALTVGTTTIAI

SEQ ID NO: 927615 - protein, 20 aa, Mycobacterium
GATVARFAAGLAPHGSGTVL

SEQ ID NO: 927616 - protein, 17 aa, Mycobacterium
GAVAALLNDARSDNGPG

SEQ ID NO: 927617 - protein, 26 aa, Mycobacterium
GAVAQYCILASWVGIPAELGQAQEAL

SEQ ID NO: 927618 - protein, 24 aa, Mycobacterium
GAVASMPRRLVVGAASAALLTGLI

SEQ ID NO: 927619 - protein, 19 aa, Mycobacterium
GAVAVSWRDLQHAAHDRPL

SEQ ID NO: 927620 - protein, 23 aa, Mycobacterium
GAVAVVGTGLFLLNVSRQPEPTA

SEQ ID NO: 927621 - protein, 22 aa, Mycobacterium
GAVDGAVWGTHWHGVLDNDDFR

SEQ ID NO: 927622 - protein, 19 aa, Mycobacterium
GAVIFPPTVAYYARPTSVD

SEQ ID NO: 927623 - protein, 23 aa, Mycobacterium
GAVKFAKAVCVSMANGELGPQMV

SEQ ID NO: 927624 - protein, 26 aa, Mycobacterium
GAVLACPCGPATGAFAEEYTAKFNQE

SEQ ID NO: 927625 - protein, 30 aa, Mycobacterium
GAVLADPALRLAVCKGIDRRTIAKVALYGL

SEQ ID NO: 927626 - protein, 19 aa, Mycobacterium
GAVLDRANRFLPFETPFTS

SEQ ID NO: 927627 - protein, 20 aa, Mycobacterium
GAVLEVRTAISYVGIDGARA

SEQ ID NO: 927628 - protein, 19 aa, Mycobacterium
GAVMAFGYIQLPAMFGVGR

SEQ ID NO: 927629 - protein, 20 aa, Mycobacterium
GAVNTAAWFVMATIPNAVFL

SEQ ID NO: 927630 - protein, 18 aa, Mycobacterium
GAVPCTLTGYPGVDSGAG

SEQ ID NO: 927631 - protein, 20 aa, Mycobacterium
GAVPPARIPGAAMPLPPPPS

SEQ ID NO: 927632 - protein, 18 aa, Mycobacterium
GAVPRQGARVGVAAPVNA

SEQ ID NO: 927633 - protein, 18 aa, Mycobacterium
GAVQAASRLNSQQAAKLC

SEQ ID NO: 927634 - protein, 23 aa, Mycobacterium
GAVSKAGLFAPINADALAAVPKQ

SEQ ID NO: 927635 - protein, 25 aa, Mycobacterium
GAVTGMPRRLMVGAVGAALLLGLVG

SEQ ID NO: 927636 - protein, 20 aa, Mycobacterium
GAVVIGVFGVVLTTIPPVAA

SEQ ID NO: 927637 - protein, 20 aa, Mycobacterium
GAVVPVRMQVWAESRGPAHI

SEQ ID NO: 927638 - protein, 19 aa, Mycobacterium
GAVVSWIERCGDRADYSAV

SEQ ID NO: 927639 - protein, 18 aa, Mycobacterium
GAYFIWQYGPPGWIEDLN

SEQ ID NO: 927640 - protein, 33 aa, Mycobacterium
GAYLPKNTYRLKIEFSSVLNLPGRAKVDSGGVQ

SEQ ID NO: 927641 - protein, 18 aa, Mycobacterium
GAYLQSWVHRVAQFQYAL

SEQ ID NO: 927642 - protein, 20 aa, Mycobacterium
GAYVEFPSGAALEVQTAISY

SEQ ID NO: 927643 - protein, 17 aa, Mycobacterium
GCAPKAPDYQSILSKTP

SEQ ID NO: 927644 - protein, 18 aa, Mycobacterium
GCCSAPGLYTAALGLANV

SEQ ID NO: 927645 - protein, 33 aa, Mycobacterium; identical to SEQ ID NO: 80026

SEQ ID NO: 927646 - protein, 18 aa, Mycobacterium
GCELHLVEPLGFDLSEPK

SEQ ID NO: 927647 - protein, 24 aa, Mycobacterium
GCESSSGLSARLPITGAPDVTVDG

SEQ ID NO: 927648 - protein, 19 aa, Mycobacterium
GCGEQRVSAARSRDQAGTL

SEQ ID NO: 927649 - protein, 22 aa, Mycobacterium
GCGGVMRVAPVGLFVSRQPDGT

SEQ ID NO: 927650 - protein, 18 aa, Mycobacterium
GCGLAVLLTGTALAVGTG

SEQ ID NO: 927651 - protein, 21 aa, Mycobacterium
GCLDPEWKRLLDGLRLPWSSP

SEQ ID NO: 927652 - protein, 37 aa, Mycobacterium
GCPDPASAGDCLRALPVDRLRKPVWYFNIGSDQMTTP

SEQ ID NO: 927653 - protein, 19 aa, Mycobacterium
GCSPFCVAGKFLDTQTGLC

SEQ ID NO: 927654 - protein, 17 aa, Mycobacterium
GCSTGGLADLPLPAPGL

SEQ ID NO: 927655 - protein, 23 aa, Mycobacterium
GCTGQACLHWGAMWGPASRADYV

SEQ ID NO: 927656 - protein, 19 aa, Mycobacterium
GCVGESFLRSYAVLTSSTD

SEQ ID NO: 927657 - protein, 18 aa, Mycobacterium
GDAARLSGVSFDLDNDAD

SEQ ID NO: 927658 - protein, 24 aa, Mycobacterium
GDAGCGPPGIPLPGPTGCYPYREP

SEQ ID NO: 927659 - protein, 26 aa, Mycobacterium
GDAGEIAYPYYLINGRIPAAPMTFSA

SEQ ID NO: 927660 - protein, 19 aa, Mycobacterium
GDAIQRWAANLNTLAAQSA

SEQ ID NO: 927661 - protein, 22 aa, Mycobacterium
GDAKRPPYLVNHVAVVQDLVAH

SEQ ID NO: 927662 - protein, 24 aa, Mycobacterium
GDALKADGLTAVHRVGAAGIRIKV

SEQ ID NO: 927663 - protein, 23 aa, Mycobacterium
GDALTRRRALTILGLTVPAVAAA

SEQ ID NO: 927664 - protein, 37 aa, Mycobacterium
GDANDLPFWDGHSMDITRMYNWECWIYGSDPAANANM

SEQ ID NO: 927665 - protein, 20 aa, Mycobacterium
GDAPASLVYTNFGRGDRFGL

SEQ ID NO: 927666 - protein, 37 aa, Mycobacterium
GDAPQPPFLWALMAFARRELDTLFAARTSNSPRSSTA

SEQ ID NO: 927667 - protein, 24 aa, Mycobacterium
GDDRYLVSLSVNWSAANQGISAAA

SEQ ID NO: 927668 - protein, 24 aa, Mycobacterium
GDEDGRSGLEIRDAAGGRIAVNDQ

SEQ ID NO: 927669 - protein, 20 aa, Mycobacterium
GDELGCRIIVNGEVRDEQVQ

SEQ ID NO: 927670 - protein, 32 aa, Mycobacterium
GDEPAKAWDHGRFDAPYLRDALIDAGAVVETL

SEQ ID NO: 927671 - protein, 25 aa, Mycobacterium
GDESRGLHRLRMMVPNSPGGGYDLT

SEQ ID NO: 927672 - protein, 25 aa, Mycobacterium
GDFDPAEAIAHGFVDSQKLLAWRTT

SEQ ID NO: 927673 - protein, 19 aa, Mycobacterium
GDFGFGLTGDHQFGFGGFN

SEQ ID NO: 927674 - protein, 17 aa, Mycobacterium
GDFSIAFARFHTLMAPY

SEQ ID NO: 927675 - protein, 23 aa, Mycobacterium
GDFSRNQFLAGRMALFQSGTYNL

SEQ ID NO: 927676 - protein, 23 aa, Mycobacterium
GDFSRNQFLAGRMALFQSGTYSL

SEQ ID NO: 927677 - protein, 17 aa, Mycobacterium
GDFSRNQFLAGRMALLQ

SEQ ID NO: 927678 - protein, 17 aa, Mycobacterium
GDGAPVSGRAGRTRAAG

SEQ ID NO: 927679 - protein, 30 aa, Mycobacterium
GDGGIRTRSSRHAVTTGAAGAARPNAPAIA

SEQ ID NO: 927680 - protein, 30 aa, Mycobacterium
GDGGLSGAGGRGGLLAGLQGSTGSGGAGGT

SEQ ID NO: 927681 - protein, 17 aa, Mycobacterium
GDGGPRPPTPFYTDISG

SEQ ID NO: 927682 - protein, 20 aa, Mycobacterium
GDGGTSFDMDDNPVPPSGTA

SEQ ID NO: 927683 - protein, 18 aa, Mycobacterium
GDGGWLIGSGGRGGSGGV

SEQ ID NO: 927684 - protein, 24 aa, Mycobacterium
GDGIRIDLPVALMERAATTGIAAA

SEQ ID NO: 927685 - protein, 24 aa, Mycobacterium
GDGIRLDLPAALMERAATTGWAAA

SEQ ID NO: 927686 - protein, 17 aa, Mycobacterium
GDGKRVSAMPVADDRFY

SEQ ID NO: 927687 - protein, 17 aa, Mycobacterium
GDGLGSYFWQHNWGSPK

SEQ ID NO: 927688 - protein, 19 aa, Mycobacterium
GDGPALRNGDVISRDRARV

SEQ ID NO: 927689 - protein, 20 aa, Mycobacterium
GDGPRIYCQILIDGQVVDED

SEQ ID NO: 927690 - protein, 18 aa, Mycobacterium
GDGRVQSIVLGRNELVTD

SEQ ID NO: 927691 - protein, 19 aa, Mycobacterium
GDGTYRVGVDIRPGTYRSQ

SEQ ID NO: 927692 - protein, 35 aa, Mycobacterium; identical to SEQ ID NO: 663919

SEQ ID NO: 927693 - protein, 24 aa, Mycobacterium
GDGYPEHAFTWAVVGLIADQLNQI

SEQ ID NO: 927694 - protein, 24 aa, Mycobacterium
GDHGSGCRELDASLEWHDGVREFL

SEQ ID NO: 927695 - protein, 20 aa, Mycobacterium
GDHLRAFAAYELQMREPVHR

SEQ ID NO: 927696 - protein, 17 aa, Mycobacterium
GDHSSDIFGTVKSLATI

SEQ ID NO: 927697 - protein, 17 aa, Mycobacterium
GDHVDFLAFDRVTRAGV

SEQ ID NO: 927698 - protein, 24 aa, Mycobacterium
GDIDAFALYQPVGWQSQAVSGDKV

SEQ ID NO: 927699 - protein, 26 aa, Mycobacterium
GDIERRGRLPFRVVASYTVKAPPFGD

SEQ ID NO: 927700 - protein, 21 aa, Mycobacterium
GDIKFFQGMTFVVGSTDDEAR

SEQ ID NO: 927701 - protein, 22 aa, Mycobacterium
GDIPGYATVAVYLPQRDATLVV

SEQ ID NO: 927702 - protein, 23 aa, Mycobacterium
GDIVKSCYAEVLPAAPTGTLFID

SEQ ID NO: 927703 - protein, 28 aa, Mycobacterium
GDKRKQASIDFVKWLTAPEQVKAFSLQT

SEQ ID NO: 927704 - protein, 19 aa, Mycobacterium
GDLCLIWSEQMLRESGVDS

SEQ ID NO: 927705 - protein, 20 aa, Mycobacterium
GDLNANGGGGGRGGTGGAGG

SEQ ID NO: 927706 - protein, 18 aa, Mycobacterium
GDLPAQWVIHTVGPNYDT

SEQ ID NO: 927707 - protein, 17 aa, Mycobacterium
GDLPLRDILAALPADIV

SEQ ID NO: 927708 - protein, 25 aa, Mycobacterium
GDLPPEVRGGLIGDIVFGVIWYRML

SEQ ID NO: 927709 - protein, 22 aa, Mycobacterium
GDLPVRGAVVLVDRGTCPFAQK

SEQ ID NO: 927710 - protein, 28 aa, Mycobacterium
GDLQRSCLDIGLAERVLGWRPRVELAEG

SEQ ID NO: 927711 - protein, 17 aa, Mycobacterium
GDLRLALTAFPPNFNIL

SEQ ID NO: 927712 - protein, 37 aa, Mycobacterium
GDLRRSCLDIGLAERVLGWRPRVALDEGVRRTVEYFR

SEQ ID NO: 927713 - protein, 17 aa, Mycobacterium
GDLTIDVTRQYDGWADF

SEQ ID NO: 927714 - protein, 25 aa, Mycobacterium
GDLTPKTKLTMLASRAGLVMDPGSK

SEQ ID NO: 927715 - protein, 18 aa, Mycobacterium
GDLVGIVLQIPRDPAPPV

SEQ ID NO: 927716 - protein, 25 aa, Mycobacterium
GDNDLRGVVMFDGFAFDGALADSLA

SEQ ID NO: 927717 - protein, 22 aa, Mycobacterium
GDPAGGLVYAFGAPIAADIALG

SEQ ID NO: 927718 - protein, 17 aa, Mycobacterium
GDPDERSGAVAFDSNQA

SEQ ID NO: 927719 - protein, 25 aa, Mycobacterium
GDPIVTRVAARYGLTSTKPPNDGRW

SEQ ID NO: 927720 - protein, 25 aa, Mycobacterium
GDPMGFVNAVGYPLAADVALITVAG

SEQ ID NO: 927721 - protein, 22 aa, Mycobacterium
GDPRAGTFVNQFAIDLARNAGR

SEQ ID NO: 927722 - protein, 23 aa, Mycobacterium
GDPVAAAKWWRYQKYDDCVIMSS

SEQ ID NO: 927723 - protein, 23 aa, Mycobacterium
GDQARLKLAIRSAEMHFIPSNAT

SEQ ID NO: 927724 - protein, 23 aa, Mycobacterium
GDQLRYVAPEGVTIDVEQVNDHT

SEQ ID NO: 927725 - protein, 29 aa, Mycobacterium
GDQTRPRAASRSKVLPPWATGQGADEQLP

SEQ ID NO: 927726 - protein, 24 aa, Mycobacterium
GDRDRRHWYILDSFIVTRNGTSPI

SEQ ID NO: 927727 - protein, 25 aa, Mycobacterium
GDRGREALAAAGFRGPDFAPLQGNG

SEQ ID NO: 927728 - protein, 20 aa, Mycobacterium
GDRIGISYIPPGTPWNNGHI

SEQ ID NO: 927729 - protein, 26 aa, Mycobacterium
GDRRAAIDHAVAWAQPGDIVLIAGKG

SEQ ID NO: 927730 - protein, 20 aa, Mycobacterium
GDRWLAQNVDPLRARVLPIA

SEQ ID NO: 927731 - protein, 20 aa, Mycobacterium
GDSALTFGVGDLIPADEALS

SEQ ID NO: 927732 - protein, 30 aa, Mycobacterium
GDSHVDEWRATFNVNLFGAVALTLALLPAL

SEQ ID NO: 927733 - protein, 19 aa, Mycobacterium
GDSLKYWTRALGNPAAPAN

SEQ ID NO: 927734 - protein, 20 aa, Mycobacterium
GDSNVAFFREYRNVGLTPDT

SEQ ID NO: 927735 - protein, 19 aa, Mycobacterium
GDSRCTLGYVDPVSRIGLT

SEQ ID NO: 927736 - protein, 20 aa, Mycobacterium
GDSRTDLFGTVRNLQILVDA

SEQ ID NO: 927737 - protein, 19 aa, Mycobacterium
GDTAQKWATFPLETAAKWA

SEQ ID NO: 927738 - protein, 24 aa, Mycobacterium
GDTDRVTLFRAWYSRSNFGQLAGA

SEQ ID NO: 927739 - protein, 24 aa, Mycobacterium
GDTDRVTMFRAWYSRNNFGQLASA

SEQ ID NO: 927740 - protein, 21 aa, Mycobacterium
GDTFVIRGSVTYSPADGSSES

SEQ ID NO: 927741 - protein, 19 aa, Mycobacterium
GDTLLALADMYMRRDSHGH

SEQ ID NO: 927742 - protein, 18 aa, Mycobacterium
GDTNFGFGNIGDLNLGSG

SEQ ID NO: 927743 - protein, 18 aa, Mycobacterium
GDTRAFLGERIAVRRGAV

SEQ ID NO: 927744 - protein, 20 aa, Mycobacterium
GDTTATFEWAFRWLERNRPE

SEQ ID NO: 927745 - protein, 31 aa, Mycobacterium
GDTYPTAMLLAFKLYGDFDVKAALRDHGYAD

SEQ ID NO: 927746 - protein, 21 aa, Mycobacterium
GDVAALALIRFPATGDKIGSL

SEQ ID NO: 927747 - protein, 25 aa, Mycobacterium
GDVAFRAPRELGPRVVGGCITQVKY

SEQ ID NO: 927748 - protein, 20 aa, Mycobacterium
GDVAGALRWYEKTRRRKVMA

SEQ ID NO: 927749 - protein, 28 aa, Mycobacterium
GDVGDAFLRPFGDFWVNHREEFIEKVRD

SEQ ID NO: 927750 - protein, 18 aa, Mycobacterium
GDVIWVDAGVMWQGYVSD

SEQ ID NO: 927751 - protein, 18 aa, Mycobacterium
GDVLTQYGGITVEVQNTD

SEQ ID NO: 927752 - protein, 26 aa, Mycobacterium
GDVRRWMRRTAEALGVPWTNDTPIGE

SEQ ID NO: 927753 - protein, 17 aa, Mycobacterium
GDVSAAWAAGEAAVEGA

SEQ ID NO: 927754 - protein, 28 aa, Mycobacterium
GDVTPRALERLPLDFPIYNLAARSYFWN

SEQ ID NO: 927755 - protein, 17 aa, Mycobacterium
GDVVDVLTTHDEEAKSA

SEQ ID NO: 927756 - protein, 19 aa, Mycobacterium
GDWTISWADWRKGSALKPT

SEQ ID NO: 927757 - protein, 23 aa, Mycobacterium
GDYKYAINNSFGFGGHNVALAFG

SEQ ID NO: 927758 - protein, 19 aa, Mycobacterium
GEAAGRAYDAAQIAAATRA

SEQ ID NO: 927759 - protein, 20 aa, Mycobacterium
GEALGVPRSALCEVITRGSA

SEQ ID NO: 927760 - protein, 20 aa, Mycobacterium
GEAPTTVVYNDGERDLLAWS

SEQ ID NO: 927761 - protein, 18 aa, Mycobacterium
GEAQRWRFLNACPHRSIW

SEQ ID NO: 927762 - protein, 26 aa, Mycobacterium
GEDAWRRMLRVHLGGLVNIARATLPD

SEQ ID NO: 927763 - protein, 19 aa, Mycobacterium
GEDGAPLWAAPAHSGGEPL

SEQ ID NO: 927764 - protein, 23 aa, Mycobacterium
GEDLSWLWDVRFEDFSGVQVVAA

SEQ ID NO: 927765 - protein, 23 aa, Mycobacterium
GEDLSWLWDVRFEHFENTAVVAA

SEQ ID NO: 927766 - protein, 22 aa, Mycobacterium
GEDLSWLWDVRFEHFEQTEVVA

SEQ ID NO: 927767 - protein, 24 aa, Mycobacterium
GEFKDMYTRSSVQLRQLLIDNKAT

SEQ ID NO: 927768 - protein, 23 aa, Mycobacterium
GEFPDGAAMFARLRDGRLTAAWT

SEQ ID NO: 927769 - protein, 17 aa, Mycobacterium
GEFRPVEDLISYDSDDP

SEQ ID NO: 927770 - protein, 20 aa, Mycobacterium
GEGAVLEFTEKCGPALKEYA

SEQ ID NO: 927771 - protein, 19 aa, Mycobacterium
GEGGLKPMLDSVRKLTQFA

SEQ ID NO: 927772 - protein, 19 aa, Mycobacterium
GEGLAVWFNTVLTSVGGQV

SEQ ID NO: 927773 - protein, 23 aa, Mycobacterium
GEGLKVWGPLGFGYAEVGTVTAI

SEQ ID NO: 927774 - protein, 23 aa, Mycobacterium
GEGLPPRRVVIAAEVDAEADEVT

SEQ ID NO: 927775 - protein, 20 aa, Mycobacterium
GEGPVAVQCQVYADNNFGPP

SEQ ID NO: 927776 - protein, 23 aa, Mycobacterium
GEHRELGGFWVAEAVWVTHSAGV

SEQ ID NO: 927777 - protein, 20 aa, Mycobacterium
GEIACKAVIVADGVRSTLGK

SEQ ID NO: 927778 - protein, 17 aa, Mycobacterium
GEICWARSEAGPLREAL

SEQ ID NO: 927779 - protein, 17 aa, Mycobacterium
GEIDACICYPDLSAREL

SEQ ID NO: 927780 - protein, 22 aa, Mycobacterium
GELAALRVAYGVPEDTPEDIED

SEQ ID NO: 927781 - protein, 20 aa, Mycobacterium
GELDLGMARPPLKRPGLVSR

SEQ ID NO: 927782 - protein, 17 aa, Mycobacterium
GELDWSALGALPAWEAG

SEQ ID NO: 927783 - protein, 18 aa, Mycobacterium
GELEILWGDLARILHEAV

SEQ ID NO: 927784 - protein, 17 aa, Mycobacterium
GELGRLGQTEVRFYRQL

SEQ ID NO: 927785 - protein, 18 aa, Mycobacterium
GELNKPYLVLARPPWDPG

SEQ ID NO: 927786 - protein, 25 aa, Mycobacterium
GELRLKGPQCFLGYADPSLDAEAFD

SEQ ID NO: 927787 - protein, 21 aa, Mycobacterium
GELRTGQVLRGDHVTVEINTV

SEQ ID NO: 927788 - protein, 20 aa, Mycobacterium
GELVGCYRMLPPPGAIAAGG

SEQ ID NO: 927789 - protein, 27 aa, Mycobacterium
GELYCMPQFDAKVGWNIKRLAPQAYTR

SEQ ID NO: 927790 - protein, 17 aa, Mycobacterium
GENGWPMPLPDELKEDL

SEQ ID NO: 927791 - protein, 17 aa, Mycobacterium
GEPAMQWIAARFNGEPT

SEQ ID NO: 927792 - protein, 17 aa, Mycobacterium
GEPAPAALLLSESGGTD

SEQ ID NO: 927793 - protein, 33 aa, Mycobacterium
GEPAPTPEQWLRIVTELAPVFKAAGFRPNNAAP

SEQ ID NO: 927794 - protein, 24 aa, Mycobacterium
GEPGASAAGFGECATQFAQGRAAM

SEQ ID NO: 927795 - protein, 23 aa, Mycobacterium
GEPHLRTWMAFGASAEIWGKRLN

SEQ ID NO: 927796 - protein, 19 aa, Mycobacterium
GEPKPWTLVPAKDPLKTAA

SEQ ID NO: 927797 - protein, 18 aa, Mycobacterium
GEPLLRPLRTALSAESPQ

SEQ ID NO: 927798 - protein, 22 aa, Mycobacterium
GEPRAGLSALLPMGGAVSGVAG

SEQ ID NO: 927799 - protein, 19 aa, Mycobacterium
GEPSIPFNEGKRCRVNEQV

SEQ ID NO: 927800 - protein, 20 aa, Mycobacterium
GEPTGQLWILDATGSQIGQP

SEQ ID NO: 927801 - protein, 20 aa, Mycobacterium
GEQRLRGMQEGRAFIARADE

SEQ ID NO: 927802 - protein, 21 aa, Mycobacterium
GEQRVAVGIASGFGAARLAPG

SEQ ID NO: 927803 - protein, 19 aa, Mycobacterium
GERHGRAFGIVEGYGGHGI

SEQ ID NO: 927804 - protein, 20 aa, Mycobacterium
GESLLTYALCVEELARGWMS

SEQ ID NO: 927805 - protein, 25 aa, Mycobacterium
GESNLVPAFSLVTVLGLPVDAPPSL

SEQ ID NO: 927806 - protein, 24 aa, Mycobacterium
GETDLYLRRDIFVNHFAKDLPQDQ

SEQ ID NO: 927807 - protein, 24 aa, Mycobacterium
GETIAAPRCLAWFGNQADGHCLSY

SEQ ID NO: 927808 - protein, 17 aa, Mycobacterium
GETLFTTSFFDPNMQHF

SEQ ID NO: 927809 - protein, 25 aa, Mycobacterium
GETLWPDRLWLAIARTTAAEVDLAA

SEQ ID NO: 927810 - protein, 19 aa, Mycobacterium
GEVACKLGRSTGYSCGVTW

SEQ ID NO: 927811 - protein, 31 aa, Mycobacterium
GEVEAELRRLLGLHKVIWLPGIAGMDITDGH

SEQ ID NO: 927812 - protein, 18 aa, Mycobacterium
GEVEIAWPGPSFPAHSSA

SEQ ID NO: 927813 - protein, 20 aa, Mycobacterium
GEVGCRILVNDVVRDEKFDD

SEQ ID NO: 927814 - protein, 21 aa, Mycobacterium
GEVLRLRWRKGCMPLLQRVVR

SEQ ID NO: 927815 - protein, 19 aa, Mycobacterium
GEVPQDSFGDVFLVIDGWP

SEQ ID NO: 927816 - protein, 25 aa, Mycobacterium
GEWGKRITSFPADWSNVGIDAETRA

SEQ ID NO: 927817 - protein, 19 aa, Mycobacterium
GFAPEDWTTAGVTVLKPSR

SEQ ID NO: 927818 - protein, 19 aa, Mycobacterium
GFDASGLMVYSYAAAGIKL

SEQ ID NO: 927819 - protein, 26 aa, Mycobacterium
GFDCSGLMRYAFAGVGVLIPRYSGDQ

SEQ ID NO: 927820 - protein, 20 aa, Mycobacterium
GFDFPFAAMGSVHLENHITQ

SEQ ID NO: 927821 - protein, 23 aa, Mycobacterium
GFDRRPADGGAHRFPSQPTPQPG

SEQ ID NO: 927822 - protein, 21 aa, Mycobacterium
GFEARRVRQWGYNAANDPQGI

SEQ ID NO: 927823 - protein, 28 aa, Mycobacterium
GFENSWRVNCLGAFLGMRATLEHLRAAP

SEQ ID NO: 927824 - protein, 28 aa, Mycobacterium
GFETTLWARRPASLEPFADTAAKVAGTP

SEQ ID NO: 927825 - protein, 33 aa, Mycobacterium
GFFARLSPHRSYCLAFRVPGAVTRGMYISTDSP

SEQ ID NO: 927826 - protein, 24 aa, Mycobacterium
GFGEVLPGLTIPGKIDKLGYKGID

SEQ ID NO: 927827 - protein, 24 aa, Mycobacterium
GFGHVWASDHIQPWQDNEGHSMFP

SEQ ID NO: 927828 - protein, 29 aa, Mycobacterium
GFGTGLDWRPNPGIGFPGYANYFPVTRAV

SEQ ID NO: 927829 - protein, 20 aa, Mycobacterium
GFGTVAVRYSQLGFGRTSST

SEQ ID NO: 927830 - protein, 29 aa, Mycobacterium
GFHGLQIHSVGKCEGDFDSAGSVYQAADH

SEQ ID NO: 927831 - protein, 20 aa, Mycobacterium
GFHGVHIHKVGKCEANSAGP

SEQ ID NO: 927832 - protein, 23 aa, Mycobacterium
GFLKNRRATTHWSALDTLTQLDS

SEQ ID NO: 927833 - protein, 18 aa, Mycobacterium
GFLSFRAPWETYRASVTP

SEQ ID NO: 927834 - protein, 23 aa, Mycobacterium
GFNDLQMSLAMRVDAMSTTARTP

SEQ ID NO: 927835 - protein, 23 aa, Mycobacterium
GFNEHSWGIALIGDFTRDEPSPA

SEQ ID NO: 927836 - protein, 18 aa, Mycobacterium
GFPNLSCLGLLADRVLGA

SEQ ID NO: 927837 - protein, 29 aa, Mycobacterium
GFQRRLVQTLCRWNLRLSVRDPQLRAKLT

SEQ ID NO: 927838 - protein, 19 aa, Mycobacterium
GFRTGGYMIDFWGVGYQVA

SEQ ID NO: 927839 - protein, 18 aa, Mycobacterium
GFSKQIISSIKWAPDETG

SEQ ID NO: 927840 - protein, 18 aa, Mycobacterium
GFSQRAGDIGARHDASHF

SEQ ID NO: 927841 - protein, 18 aa, Mycobacterium
GFSTRPTVGSVLRVEPRR

SEQ ID NO: 927842 - protein, 17 aa, Mycobacterium
GFTAALAAPALIFLGAA

SEQ ID NO: 927843 - protein, 26 aa, Mycobacterium
GFVETRLRIAVSAGRCDEGSTVTDSK

SEQ ID NO: 927844 - protein, 18 aa, Mycobacterium
GFVLAATHLPGAFEDVVR

SEQ ID NO: 927845 - protein, 22 aa, Mycobacterium
GFVSTPAPGRCEVICFSADHTG

SEQ ID NO: 927846 - protein, 23 aa, Mycobacterium
GFVVGCGLALFGPVGGTAQAAPT

SEQ ID NO: 927847 - protein, 20 aa, Mycobacterium
GFYTPGNFLGTLADAVGLQG

SEQ ID NO: 927848 - protein, 19 aa, Mycobacterium
GGAASAFFGNGGAGGDGGA

SEQ ID NO: 927849 - protein, 21 aa, Mycobacterium
GGAGAHGFGLLSGTAGAGGAG

SEQ ID NO: 927850 - protein, 20 aa, Mycobacterium
GGAGASVFAAALALSAPGAL

SEQ ID NO: 927851 - protein, 27 aa, Mycobacterium
GGAGGAGGLMWGHGGSGGAGGDGGAGS

SEQ ID NO: 927852 - protein, 26 aa, Mycobacterium
GGAGGANQFFGHAGDGGHGGTGGTGG

SEQ ID NO: 927853 - protein, 22 aa, Mycobacterium
GGAGGDGGWLVGNGGTGGTGGI

SEQ ID NO: 927854 - protein, 29 aa, Mycobacterium
GGAGGLGGGGFRVGHGGGGGNGGNGGVGG

SEQ ID NO: 927855 - protein, 19 aa, Mycobacterium
GGAGGNGGDSFDNPNAPGN

SEQ ID NO: 927856 - protein, 19 aa, Mycobacterium
GGAGGRAGPLVGAGGNGGD

SEQ ID NO: 927857 - protein, 23 aa, Mycobacterium
GGAGGRGGLLYGSGGDGGDGGNG

SEQ ID NO: 927858 - protein, 26 aa, Mycobacterium
GGAGGVGGRGGWLFGNGGAGGNGGAG

SEQ ID NO: 927859 - protein, 22 aa, Mycobacterium
GGAGGVGGWLYGNGGAGGAGGH

SEQ ID NO: 927860 - protein, 17 aa, Mycobacterium
GGAGLLYGYGGAGGAGG

SEQ ID NO: 927861 - protein, 24 aa, Mycobacterium
GGAGLNEIVLASAFGNNNSVAATA

SEQ ID NO: 927862 - protein, 22 aa, Mycobacterium
GGAIAKLPAIFTHRDVGNTDCP

SEQ ID NO: 927863 - protein, 19 aa, Mycobacterium
GGAIMIWTLMNIREPDLSL

SEQ ID NO: 927864 - protein, 25 aa, Mycobacterium
GGAIYQRWQELGAMNSVLGAPTSPE

SEQ ID NO: 927865 - protein, 17 aa, Mycobacterium
GGALAAYVQVDRYAQLF

SEQ ID NO: 927866 - protein, 18 aa, Mycobacterium
GGALPALPTRDLAEMRDD

SEQ ID NO: 927867 - protein, 21 aa, Mycobacterium
GGAPCGPGPTVSLQEAFAKSC

SEQ ID NO: 927868 - protein, 21 aa, Mycobacterium
GGAPGDFLSAGGHFQVPGHAT

SEQ ID NO: 927869 - protein, 21 aa, Mycobacterium
GGAPPDFATMLALAEGALPPE

SEQ ID NO: 927870 - protein, 21 aa, Mycobacterium
GGAPPPVPMQAPRAMEAAVPM

SEQ ID NO: 927871 - protein, 18 aa, Mycobacterium
GGAPQLASMLPMLQAALP

SEQ ID NO: 927872 - protein, 22 aa, Mycobacterium
GGAPYRVFDEVLSRGSSAPHGV

SEQ ID NO: 927873 - protein, 31 aa, Mycobacterium
GGARAVVVPKMIYRVGFFRPPKGASVVTGPE

SEQ ID NO: 927874 - protein, 19 aa, Mycobacterium
GGATGDFNSAGSVYQAPDH

SEQ ID NO: 927875 - protein, 24 aa, Mycobacterium
GGAVPYTLSGWLGGNRLELSEASA

SEQ ID NO: 927876 - protein, 24 aa, Mycobacterium
GGAVSRFGLARAVFEECGTDPQRV

SEQ ID NO: 927877 - protein, 17 aa, Mycobacterium
GGAVTNWAIARPPGRTE

SEQ ID NO: 927878 - protein, 19 aa, Mycobacterium
GGCSPEFDTGSALQNELRQ

SEQ ID NO: 927879 - protein, 23 aa, Mycobacterium
GGDAFPLGGLTQIYASGGESNFG

SEQ ID NO: 927880 - protein, 22 aa, Mycobacterium
GGDCGRCRRTLRAILADAAKLE

SEQ ID NO: 927881 - protein, 25 aa, Mycobacterium
GGDEVWTALATMVFSQGSAPEVIAS

SEQ ID NO: 927882 - protein, 31 aa, Mycobacterium
GGDLIGLKDGRQWRIPMWQLNAGAQRGFLSG

SEQ ID NO: 927883 - protein, 20 aa, Mycobacterium
GGDLRRPWSDPEDLRHLAEP

SEQ ID NO: 927884 - protein, 28 aa, Mycobacterium
GGDPQWAAPPPFAWDYRLFAHPAPVPPP

SEQ ID NO: 927885 - protein, 20 aa, Mycobacterium
GGDVTIRSYVYLRISTASAH

SEQ ID NO: 927886 - protein, 19 aa, Mycobacterium
GGDYEWTRAKAAYFMVVFS

SEQ ID NO: 927887 - protein, 17 aa, Mycobacterium
GGEATVSMTGRTYDISG

SEQ ID NO: 927888 - protein, 22 aa, Mycobacterium
GGFAVSRVRGMFGSQQLPTYAD

SEQ ID NO: 927889 - protein, 25 aa, Mycobacterium
GGFGGVDGLRRWLRDEGIDAVVDAT

SEQ ID NO: 927890 - protein, 18 aa, Mycobacterium
GGFGGVDGLRRWLVDEHI

SEQ ID NO: 927891 - protein, 23 aa, Mycobacterium
GGFKGDPAFHGPMRRDWNYMIGS

SEQ ID NO: 927892 - protein, 18 aa, Mycobacterium
GGFKPVFRALDPDKVNTI

SEQ ID NO: 927893 - protein, 27 aa, Mycobacterium
GGFNHNTWGVAMLGNFEAVPPTPIQLR

SEQ ID NO: 927894 - protein, 23 aa, Mycobacterium
GGFPELSCDGLVAGTSGAPWVSA

SEQ ID NO: 927895 - protein, 20 aa, Mycobacterium
GGFTAWRPALPVTQWSVVKA

SEQ ID NO: 927896 - protein, 18 aa, Mycobacterium
GGGAAFFFHTTDGGPTAG

SEQ ID NO: 927897 - protein, 18 aa, Mycobacterium
GGGARIPLVTERLSEALQ

SEQ ID NO: 927898 - protein, 18 aa, Mycobacterium
GGGARVVGDGGDGGDGGY

SEQ ID NO: 927899 - protein, 18 aa, Mycobacterium
GGGAYAMYAHLIKGSLLV

SEQ ID NO: 927900 - protein, 23 aa, Mycobacterium
GGGGFIGKWLKRMLSSARKTGSG

SEQ ID NO: 927901 - protein, 23 aa, Mycobacterium
GGGGGCYNGVCGGWNPSQGGWGH

SEQ ID NO: 927902 - protein, 19 aa, Mycobacterium
GGGGHIPGVGGGHGGPGGG

SEQ ID NO: 927903 - protein, 20 aa, Mycobacterium
GGGGNFGVTTSMTFSTFATT

SEQ ID NO: 927904 - protein, 19 aa, Mycobacterium
GGGLGRCHALELARRGARV

SEQ ID NO: 927905 - protein, 19 aa, Mycobacterium
GGGNFGVTTSMTFATFPTA

SEQ ID NO: 927906 - protein, 18 aa, Mycobacterium
GGGQRFNIGTGIETSDRQ

SEQ ID NO: 927907 - protein, 17 aa, Mycobacterium
GGGQRFNIGTGVETSDR

SEQ ID NO: 927908 - protein, 18 aa, Mycobacterium
GGGSRVGASYASTTGTAR

SEQ ID NO: 927909 - protein, 19 aa, Mycobacterium
GGGTGLWGSGGAGGQGGTG

SEQ ID NO: 927910 - protein, 25 aa, Mycobacterium
GGGTPSFLGYHGFPASICASVNERV

SEQ ID NO: 927911 - protein, 22 aa, Mycobacterium
GGHCIPCDPHYLLWQLRARRFD

SEQ ID NO: 927912 - protein, 27 aa, Mycobacterium
GGHGGAGGRGGWLLGDGGNGGAGGDGA

SEQ ID NO: 927913 - protein, 24 aa, Mycobacterium
GGHGRSGFLLAPWTAEQIVSELAP

SEQ ID NO: 927914 - protein, 23 aa, Mycobacterium
GGHSRWVSADVMAARLNEVGVSK

SEQ ID NO: 927915 - protein, 18 aa, Mycobacterium
GGIDCVIVNAGIGKGYPL

SEQ ID NO: 927916 - protein, 18 aa, Mycobacterium
GGIEILRRGYNFTDGSDG

SEQ ID NO: 927917 - protein, 25 aa, Mycobacterium
GGIGGAGGNGGWLYGNGGAGGAGGA

SEQ ID NO: 927918 - protein, 20 aa, Mycobacterium
GGIGGGVAMLAHPDHSLGGI

SEQ ID NO: 927919 - protein, 18 aa, Mycobacterium
GGISIPDRWDTTADPDLT

SEQ ID NO: 927920 - protein, 22 aa, Mycobacterium
GGISVFALSFVVAGCGSDTTAE

SEQ ID NO: 927921 - protein, 18 aa, Mycobacterium
GGITTNWAIARPPGQTQP

SEQ ID NO: 927922 - protein, 17 aa, Mycobacterium
GGKDFDVGTALRYMVRG

SEQ ID NO: 927923 - protein, 26 aa, Mycobacterium
GGKIPRVYGRQAIEYVIKRMGSQMGV

SEQ ID NO: 927924 - protein, 27 aa, Mycobacterium
GGKIPRVYGRQAIEYVIKRMGSQMGVP

SEQ ID NO: 927925 - protein, 22 aa, Mycobacterium
GGKTFPLPNPFLVMATQNPIEH

SEQ ID NO: 927926 - protein, 27 aa, Mycobacterium
GGLGARSWPSRAWQALGARGSRVSADV

SEQ ID NO: 927927 - protein, 18 aa, Mycobacterium
GGLGESLLTYALCVEELA

SEQ ID NO: 927928 - protein, 27 aa, Mycobacterium
GGLGGVGGPGGWIFGTGGAGGNGGLGG

SEQ ID NO: 927929 - protein, 22 aa, Mycobacterium
GGLKTGAAVQVFGARVGQVSRI

SEQ ID NO: 927930 - protein, 25 aa, Mycobacterium
GGLLGGLLGGLGLDLGLDLDALGLG

SEQ ID NO: 927931 - protein, 19 aa, Mycobacterium
GGLNPAVNIDPVLDNGPYV

SEQ ID NO: 927932 - protein, 19 aa, Mycobacterium
GGLPLQFPPEITDDAQMQA

SEQ ID NO: 927933 - protein, 24 aa, Mycobacterium
GGLPRPENAVKWSVDGIKLPAGHV

SEQ ID NO: 927934 - protein, 20 aa, Mycobacterium
GGLQVHTIWVARAIATMFPE

SEQ ID NO: 927935 - protein, 19 aa, Mycobacterium
GGLSRAISAASMIERWRAV

SEQ ID NO: 927936 - protein, 17 aa, Mycobacterium
GGLSVGPHSGRGAGGGG

SEQ ID NO: 927937 - protein, 17 aa, Mycobacterium
GGLTSEALLAVGANPVA

SEQ ID NO: 927938 - protein, 19 aa, Mycobacterium
GGLVGGNIATLATVIGNNN

SEQ ID NO: 927939 - protein, 19 aa, Mycobacterium
GGLVIKNYLAQVTGDSVAN

SEQ ID NO: 927940 - protein, 18 aa, Mycobacterium
GGLVWKFTSGGDDDTDAA

SEQ ID NO: 927941 - protein, 17 aa, Mycobacterium
GGMLKGASVEDLVSDSA

SEQ ID NO: 927942 - protein, 23 aa, Mycobacterium
GGMPLSGLGARGFAEAPRYGFRP

SEQ ID NO: 927943 - protein, 24 aa, Mycobacterium
GGMWCPPNPIAEVYDRYGEPVSVT

SEQ ID NO: 927944 - protein, 24 aa, Mycobacterium
GGNGGAGGLLWGNGGRGGSGAAGQ

SEQ ID NO: 927945 - protein, 19 aa, Mycobacterium
GGPGGGWNKPPTPLWPDQV

SEQ ID NO: 927946 - protein, 21 aa, Mycobacterium
GGPGQDWKELLPIRTLGEKVG

SEQ ID NO: 927947 - protein, 18 aa, Mycobacterium
GGPKAVYLLDGLRAQDDF

SEQ ID NO: 927948 - protein, 26 aa, Mycobacterium
GGPQGGSIGLGFAIPVDQAKRIADEI

SEQ ID NO: 927949 - protein, 19 aa, Mycobacterium
GGPRGSLVRSVHDFAQRFA

SEQ ID NO: 927950 - protein, 20 aa, Mycobacterium
GGPRPAMPLGTLVVNGNQVT

SEQ ID NO: 927951 - protein, 29 aa, Mycobacterium
GGPTDNGACYWKRMGNPDGNIIDNSMSKK

SEQ ID NO: 927952 - protein, 18 aa, Mycobacterium
GGQARMAAYVSSKAGVIG

SEQ ID NO: 927953 - protein, 25 aa, Mycobacterium
GGQGAKGWPTLAWQTLARRGVQINA

SEQ ID NO: 927954 - protein, 17 aa, Mycobacterium
GGQIRRYASVGGDHNPI

SEQ ID NO: 927955 - protein, 20 aa, Mycobacterium
GGQLCLPFYGAIVTNCDLDR

SEQ ID NO: 927956 - protein, 17 aa, Mycobacterium
GGQLLRIGAPEVDAIEA

SEQ ID NO: 927957 - protein, 17 aa, Mycobacterium
GGRDYCAELGLPEMPAE

SEQ ID NO: 927958 - protein, 17 aa, Mycobacterium
GGRILRSLFTALVEFNN

SEQ ID NO: 927959 - protein, 22 aa, Mycobacterium
GGRKGLPPHLGITYEGTLVNDC

SEQ ID NO: 927960 - protein, 25 aa, Mycobacterium
GGRLGPARTAAICAVSPALWTSAGA

SEQ ID NO: 927961 - protein, 25 aa, Mycobacterium
GGRMDWARAFASWSPHELTGLATAL

SEQ ID NO: 927962 - protein, 25 aa, Mycobacterium
GGRVSDALTGQVLWQQLDDVPLVPA

SEQ ID NO: 927963 - protein, 19 aa, Mycobacterium
GGRYSVYVWALLAMAAARL

SEQ ID NO: 927964 - protein, 19 aa, Mycobacterium
GGSAILWWEQPNRLMRLDL

SEQ ID NO: 927965 - protein, 24 aa, Mycobacterium
GGSANLGKLALRNIHLVGNSDPVK

SEQ ID NO: 927966 - protein, 26 aa, Mycobacterium
GGSAYSGYVGIAFGQGGAGGIGGAAS

SEQ ID NO: 927967 - protein, 27 aa, Mycobacterium
GGSDAWNLPAVFGPIAITYNVAGVDGL

SEQ ID NO: 927968 - protein, 27 aa, Mycobacterium
GGSELDLLPRHCDGLVVGMLTGAHPPA

SEQ ID NO: 927969 - protein, 25 aa, Mycobacterium
GGSETSRLSLRWIDAVVRVSPETMA

SEQ ID NO: 927970 - protein, 19 aa, Mycobacterium
GGSEVQWWFDLPWSHGFVR

SEQ ID NO: 927971 - protein, 24 aa, Mycobacterium
GGSGAPGHAGGRGGNAGLIGTGGA

SEQ ID NO: 927972 - protein, 21 aa, Mycobacterium
GGSGGRAGILYGDGGDGGDGG

SEQ ID NO: 927973 - protein, 25 aa, Mycobacterium
GGSIEFRADGTLGRTYTTEGNALVT

SEQ ID NO: 927974 - protein, 18 aa, Mycobacterium
GGSLEIFLTPQLPAPLVR

SEQ ID NO: 927975 - protein, 20 aa, Mycobacterium
GGSLLFTAGLGMAQAQPVDA

SEQ ID NO: 927976 - protein, 25 aa, Mycobacterium
GGSPLRLDYITTLWNGRFGIEVEDT

SEQ ID NO: 927977 - protein, 22 aa, Mycobacterium
GGSRPAKPIPLAAPQVYQGDAS

SEQ ID NO: 927978 - protein, 20 aa, Mycobacterium
GGTGGAGFNSGVIDDNPFGG

SEQ ID NO: 927979 - protein, 24 aa, Mycobacterium
GGTGGGGFHGPGGAAGDGGTGGIG

SEQ ID NO: 927980 - protein, 19 aa, Mycobacterium
GGTGGWGGFSVPGQGGTGG

SEQ ID NO: 927981 - protein, 25 aa, Mycobacterium
GGTKWSFKVGDAFVSTVDDATYTMT

SEQ ID NO: 927982 - protein, 23 aa, Mycobacterium
GGTNHLAGIVLLDGAPPAGVLAG

SEQ ID NO: 927983 - protein, 17 aa, Mycobacterium
GGTPVSLSELQPGDVIN

SEQ ID NO: 927984 - protein, 21 aa, Mycobacterium
GGTRSAWDYGPLGVELKENIK

SEQ ID NO: 927985 - protein, 20 aa, Mycobacterium
GGTWCPPNPIDKVVDRKGNE

SEQ ID NO: 927986 - protein, 18 aa, Mycobacterium
GGTWCPPNPVDKLIDRHG

SEQ ID NO: 927987 - protein, 18 aa, Mycobacterium
GGTYLLTRRIRMRIENWD

SEQ ID NO: 927988 - protein, 20 aa, Mycobacterium
GGVADARTAWQLHTAAGGGQ

SEQ ID NO: 927989 - protein, 17 aa, Mycobacterium
GGVDSSVAAARMVDAGH

SEQ ID NO: 927990 - protein, 19 aa, Mycobacterium
GGVDVCLKEPVFEPLSGAD

SEQ ID NO: 927991 - protein, 32 aa, Mycobacterium
GGVEAVMLLSGYRVMPQWVKIRNVDGFTGSFW

SEQ ID NO: 927992 - protein, 18 aa, Mycobacterium
GGVEVCLNHAVSDSYSGA

SEQ ID NO: 927993 - protein, 18 aa, Mycobacterium
GGVGAEFVDTGTVPEPGN

SEQ ID NO: 927994 - protein, 27 aa, Mycobacterium
GGVGPRSWPARAWDLLAARGERISADV

SEQ ID NO: 927995 - protein, 17 aa, Mycobacterium
GGVRIGGGGAYQAQFTH

SEQ ID NO: 927996 - protein, 19 aa, Mycobacterium
GGVTPLPVQAWPLIVQFEG

SEQ ID NO: 927997 - protein, 33 aa, Mycobacterium; identical to SEQ ID NO: 143066

SEQ ID NO: 927998 - protein, 18 aa, Mycobacterium
GGYVEFPAGAVLEVRTAI

SEQ ID NO: 927999 - protein, 23 aa, Mycobacterium
GHADWPHIGVALMQPRARGRITL

SEQ ID NO: 928000 - protein, 28 aa, Mycobacterium
GHALQARILPILKHHYANFIAEVPGQET

SEQ ID NO: 928001 - protein, 26 aa, Mycobacterium
GHALRSVPTAGRFAPLRWLATREERR

SEQ ID NO: 928002 - protein, 19 aa, Mycobacterium
GHDDSAVALGDFKVDPDAE

SEQ ID NO: 928003 - protein, 17 aa, Mycobacterium
GHDLRYAIDPSTLQDEL

SEQ ID NO: 928004 - protein, 18 aa, Mycobacterium
GHDLRYAIDPSTLYDELC

SEQ ID NO: 928005 - protein, 19 aa, Mycobacterium
GHDVLLVDFVRAMGATGYT

SEQ ID NO: 928006 - protein, 17 aa, Mycobacterium
GHFRVGLTNGHVLAADY

SEQ ID NO: 928007 - protein, 21 aa, Mycobacterium
GHGSFAYCLGQHGVPAPPGPV

SEQ ID NO: 928008 - protein, 23 aa, Mycobacterium
GHGVGLGSGLGRSLDGYGTAALA

SEQ ID NO: 928009 - protein, 19 aa, Mycobacterium
GHIRDAWPPSARGEPRSHQ

SEQ ID NO: 928010 - protein, 20 aa, Mycobacterium
GHKDLTLSAAYRNTPEFEKI

SEQ ID NO: 928011 - protein, 18 aa, Mycobacterium
GHKVRFLVRKEARLHTTV

SEQ ID NO: 928012 - protein, 17 aa, Mycobacterium
GHKWDRRSTPIGPAELN

SEQ ID NO: 928013 - protein, 24 aa, Mycobacterium
GHLMRGATCAGLWVTGTGKDGRPR

SEQ ID NO: 928014 - protein, 20 aa, Mycobacterium
GHPEVFVVGDLVGRDKLPGV

SEQ ID NO: 928015 - protein, 24 aa, Mycobacterium
GHPGCAAAACLHWGAMWGPSSRAD

SEQ ID NO: 928016 - protein, 18 aa, Mycobacterium
GHPVRDLVKSVSKALGID

SEQ ID NO: 928017 - protein, 19 aa, Mycobacterium
GHQWPGSRSKPVLETIAGI

SEQ ID NO: 928018 - protein, 19 aa, Mycobacterium
GHRAAQYWVLKPTYHNSFW

SEQ ID NO: 928019 - protein, 24 aa, Mycobacterium
GHRADERFLMCSTVKTFIVSAILR

SEQ ID NO: 928020 - protein, 41 aa, Mycobacterium
GHREPGISGSPAFTAVRAVRPGSSTARLVFAPKTSTSGTAL

SEQ ID NO: 928021 - protein, 17 aa, Mycobacterium
GHRRIVFRFMTSPIEIK

SEQ ID NO: 928022 - protein, 23 aa, Mycobacterium
GHSNGPIILRCVRTETAPTPAAR

SEQ ID NO: 928023 - protein, 19 aa, Mycobacterium
GHTFAGYYWERTVKLDGAR

SEQ ID NO: 928024 - protein, 17 aa, Mycobacterium
GHTLERLFPGIGAFGDR

SEQ ID NO: 928025 - protein, 35 aa, Mycobacterium
GHTLERLFPGIGALGERFMPGLGLDGPSYGESIDV

SEQ ID NO: 928026 - protein, 22 aa, Mycobacterium
GHTRGSVCFRVLQASKDDRDVV

SEQ ID NO: 928027 - protein, 17 aa, Mycobacterium
GHTVKGYNRSPHRTADL

SEQ ID NO: 928028 - protein, 18 aa, Mycobacterium
GHVRAVATQDYWNYDSGV

SEQ ID NO: 928029 - protein, 17 aa, Mycobacterium
GHWARRMTVAAVAALLL

SEQ ID NO: 928030 - protein, 25 aa, Mycobacterium
GHYMVRYWSEWHWRTTDFVADYLSD

SEQ ID NO: 928031 - protein, 23 aa, Mycobacterium
GIAAALAARGWRVYATSRSVADA

SEQ ID NO: 928032 - protein, 18 aa, Mycobacterium
GIAGRAALGVGKRLAGKS

SEQ ID NO: 928033 - protein, 25 aa, Mycobacterium
GIAKGWHLGGGKSWANIQTIETNLI

SEQ ID NO: 928034 - protein, 25 aa, Mycobacterium
GIAQRDGTSFVMPKSEADAMIAGTG

SEQ ID NO: 928035 - protein, 25 aa, Mycobacterium
GICAARIMLDGGIGMLRTLPPADGD

SEQ ID NO: 928036 - protein, 17 aa, Mycobacterium
GICALSMQLRCVDAARE

SEQ ID NO: 928037 - protein, 25 aa, Mycobacterium
GIDKFPRMVDYVVPTGVRIADADRV

SEQ ID NO: 928038 - protein, 20 aa, Mycobacterium
GIDKHVKLPADIAAQLGGQG

SEQ ID NO: 928039 - protein, 20 aa, Mycobacterium
GIDMALRLVELLVDRQAAQA

SEQ ID NO: 928040 - protein, 24 aa, Mycobacterium
GIDTEGRPGLSWRARRAARDAVAA

SEQ ID NO: 928041 - protein, 18 aa, Mycobacterium
GIDVCQWAAADGVIGSSG

SEQ ID NO: 928042 - protein, 18 aa, Mycobacterium
GIDYAFRHLQFWFNDDIT

SEQ ID NO: 928043 - protein, 24 aa, Mycobacterium
GIERLLVAYLKLAGKTAQDTAFDG

SEQ ID NO: 928044 - protein, 18 aa, Mycobacterium
GIFAKHGIDLTIDAGQGS

SEQ ID NO: 928045 - protein, 18 aa, Mycobacterium
GIFAYRVADPTAYGVVEF

SEQ ID NO: 928046 - protein, 23 aa, Mycobacterium
GIGAKPYWRPPYAKRNAAVDAVA

SEQ ID NO: 928047 - protein, 34 aa, Mycobacterium
GIGALRKAGYNVVTWDPRGEWRSEGRMQLQSPDF

SEQ ID NO: 928048 - protein, 18 aa, Mycobacterium
GIGFAVANAATGFAYADT

SEQ ID NO: 928049 - protein, 27 aa, Mycobacterium
GIGPILRDIDAVLKLSVDRQAALQTII

SEQ ID NO: 928050 - protein, 18 aa, Mycobacterium
GIGVPACVGAATRAALTL

SEQ ID NO: 928051 - protein, 30 aa, Mycobacterium
GIIDVPFTLSFKAPLPIPVDQYPLICEPGG

SEQ ID NO: 928052 - protein, 25 aa, Mycobacterium
GIIQDIEDFLGIGFVANVINGGVNT

SEQ ID NO: 928053 - protein, 17 aa, Mycobacterium
GIKSVDLLNRFLGLGLR

SEQ ID NO: 928054 - protein, 18 aa, Mycobacterium
GIPIPVPPGGPARYNPIH

SEQ ID NO: 928055 - protein, 18 aa, Mycobacterium
GIPSCGRPAQPITAPSIV

SEQ ID NO: 928056 - protein, 24 aa, Mycobacterium
GIQFGDDFIEWSVSYAQPPYPNAC

SEQ ID NO: 928057 - protein, 17 aa, Mycobacterium
GISEGRLADSGEILASG

SEQ ID NO: 928058 - protein, 25 aa, Mycobacterium
GISGLGSVVKFRWNGNGVELISNKT

SEQ ID NO: 928059 - protein, 17 aa, Mycobacterium
GITAPVLAWLHPPGIDF

SEQ ID NO: 928060 - protein, 18 aa, Mycobacterium
GITMRPYLVDNLRGPDLA

SEQ ID NO: 928061 - protein, 25 aa, Mycobacterium
GIYGPRDYNAWIGKIACKRLHNGLD

SEQ ID NO: 928062 - protein, 18 aa, Mycobacterium
GKANQFAAIAASTYCPGA

SEQ ID NO: 928063 - protein, 17 aa, Mycobacterium
GKASWNLEPWRPVVDDA

SEQ ID NO: 928064 - protein, 22 aa, Mycobacterium
GKDGVWTYKWETFLTTELPQWL

SEQ ID NO: 928065 - protein, 21 aa, Mycobacterium
GKDGVWTYKWETFTTQELPAY

SEQ ID NO: 928066 - protein, 18 aa, Mycobacterium
GKDLPGLDLNSVTCVKEG

SEQ ID NO: 928067 - protein, 22 aa, Mycobacterium
GKEQKIEGAVVCQSSNGNVNIV

SEQ ID NO: 928068 - protein, 25 aa, Mycobacterium
GKFKDQQRVSVKWPAQAGPMTGKGD

SEQ ID NO: 928069 - protein, 18 aa, Mycobacterium
GKFKEAADSYKRYVNSQV

SEQ ID NO: 928070 - protein, 22 aa, Mycobacterium
GKGAWGRPPTPLWGDHLGEMSM

SEQ ID NO: 928071 - protein, 20 aa, Mycobacterium
GKGFKLGDCGGMTDAEVNAA

SEQ ID NO: 928072 - protein, 21 aa, Mycobacterium
GKGGGTLPITLYIVDVKAAGT

SEQ ID NO: 928073 - protein, 20 aa, Mycobacterium
GKGPFNLELFAGSPDDNNAT

SEQ ID NO: 928074 - protein, 19 aa, Mycobacterium
GKGPWCTTVSLVNPHDICW

SEQ ID NO: 928075 - protein, 19 aa, Mycobacterium
GKGVMRTWYLVGRRDGERA

SEQ ID NO: 928076 - protein, 22 aa, Mycobacterium
GKHDAFMLGAYFIWQYGPPGWI

SEQ ID NO: 928077 - protein, 19 aa, Mycobacterium
GKIIHCGGSGTGQAAKLCN

SEQ ID NO: 928078 - protein, 17 aa, Mycobacterium
GKLAVPVDYRQPRGDVA

SEQ ID NO: 928079 - protein, 20 aa, Mycobacterium
GKLPRISAWVLAGTLVPATL

SEQ ID NO: 928080 - protein, 23 aa, Mycobacterium
GKLRNDFNIAPGHVFVTGMSNGG

SEQ ID NO: 928081 - protein, 17 aa, Mycobacterium
GKLYPQFGTVAALNLVK

SEQ ID NO: 928082 - protein, 18 aa, Mycobacterium
GKLYPQFGTVAALNMVKC

SEQ ID NO: 928083 - protein, 18 aa, Mycobacterium
GKMSADQAKLWGGTADQP

SEQ ID NO: 928084 - protein, 19 aa, Mycobacterium
GKNALARAILSTGAGAAPD

SEQ ID NO: 928085 - protein, 20 aa, Mycobacterium
GKNPRVEVGSTFMCAVDING

SEQ ID NO: 928086 - protein, 29 aa, Mycobacterium
GKPAILQPWIRVAGLDGAYQGEFALPPSF

SEQ ID NO: 928087 - protein, 32 aa, Mycobacterium
GKPAVLWFWTPWCPFCNAEAPGVSHVAAVNPN

SEQ ID NO: 928088 - protein, 31 aa, Mycobacterium
GKPAVLWFWTPWCPFCNAEGPAASQVAAANP

SEQ ID NO: 928089 - protein, 18 aa, Mycobacterium
GKPLIRISPIAKPNEGMT

SEQ ID NO: 928090 - protein, 18 aa, Mycobacterium
GKPPFAVVGVDGGNTYWH

SEQ ID NO: 928091 - protein, 24 aa, Mycobacterium
GKPSGWRCFYDYRVKNNALFGSLL

SEQ ID NO: 928092 - protein, 19 aa, Mycobacterium
GKPTLPAWRVREPPPADEL

SEQ ID NO: 928093 - protein, 19 aa, Mycobacterium
GKPYDEWSAEDWPHTYESP

SEQ ID NO: 928094 - protein, 19 aa, Mycobacterium
GKPYDEWTAEDWPHTYESV

SEQ ID NO: 928095 - protein, 19 aa, Mycobacterium
GKPYDQWSAEDWPHTYESV

SEQ ID NO: 928096 - protein, 22 aa, Mycobacterium
GKQGRVPFLADYVASKFGVVGL

SEQ ID NO: 928097 - protein, 19 aa, Mycobacterium
GKQRFAELVADTGPQNYSD

SEQ ID NO: 928098 - protein, 17 aa, Mycobacterium
GKRAELFAVVGDHTAAT

SEQ ID NO: 928099 - protein, 19 aa, Mycobacterium
GKRAELFAVVGGNAEAARA

SEQ ID NO: 928100 - protein, 22 aa, Mycobacterium
GKRDVMVVHTLLWPDEIRDPDF

SEQ ID NO: 928101 - protein, 21 aa, Mycobacterium
GKRPGGRSGLSVHGQARLLSE

SEQ ID NO: 928102 - protein, 18 aa, Mycobacterium
GKSAIEVVTYLQGLSPQL

SEQ ID NO: 928103 - protein, 21 aa, Mycobacterium
GKSATTAWLIERLQRPTLVMA

SEQ ID NO: 928104 - protein, 19 aa, Mycobacterium
GKSGGLFGFTKPGYTVSEM

SEQ ID NO: 928105 - protein, 19 aa, Mycobacterium
GKSGPYLLGALKIFLTAPY

SEQ ID NO: 928106 - protein, 19 aa, Mycobacterium
GKSISLWTPSGVYTVLDKG

SEQ ID NO: 928107 - protein, 18 aa, Mycobacterium
GKSPRFTLSTGDGLDHVL

SEQ ID NO: 928108 - protein, 24 aa, Mycobacterium
GKSTRAGLLDWVRNYQGQGVAREY

SEQ ID NO: 928109 - protein, 18 aa, Mycobacterium
GKSVCGMITRGVSGLQLL

SEQ ID NO: 928110 - protein, 18 aa, Mycobacterium
GKTAVGISQGGLVLAEVK

SEQ ID NO: 928111 - protein, 17 aa, Mycobacterium
GKTIKALELSGANNLLF

SEQ ID NO: 928112 - protein, 29 aa, Mycobacterium
GKTIPVIRVIGYRAGLPPAARSAPLSGMA

SEQ ID NO: 928113 - protein, 23 aa, Mycobacterium
GKTQTFLPWDSWERPVIEPPLWF

SEQ ID NO: 928114 - protein, 20 aa, Mycobacterium
GKTTPAPRRKPIQMPGLQDV

SEQ ID NO: 928115 - protein, 20 aa, Mycobacterium
GKTTWNSGCQSWYLTEDGKN

SEQ ID NO: 928116 - protein, 17 aa, Mycobacterium
GKVDENWNAGPNKGIAF

SEQ ID NO: 928117 - protein, 17 aa, Mycobacterium
GKVKAVRLIDGGRRVMV

SEQ ID NO: 928118 - protein, 17 aa, Mycobacterium
GKVLTAYTRTAAQSDGE

SEQ ID NO: 928119 - protein, 20 aa, Mycobacterium
GKVQSLWRGGVGHTWEARIK

SEQ ID NO: 928120 - protein, 18 aa, Mycobacterium
GKVRLRYRGAKVDYTGAG

SEQ ID NO: 928121 - protein, 19 aa, Mycobacterium
GKVSAEFKATFDPIDEKLA

SEQ ID NO: 928122 - protein, 17 aa, Mycobacterium
GKVVRIEPKGGYVEVEF

SEQ ID NO: 928123 - protein, 20 aa, Mycobacterium
GLAALGGWFGYQTYQSHQAQ

SEQ ID NO: 928124 - protein, 18 aa, Mycobacterium
GLAAQLWDLPAWARTGHR

SEQ ID NO: 928125 - protein, 18 aa, Mycobacterium
GLAEIMRLGIALGAKGAT

SEQ ID NO: 928126 - protein, 20 aa, Mycobacterium
GLAEIMRLGIALGAKPATLA

SEQ ID NO: 928127 - protein, 18 aa, Mycobacterium
GLAGRGAGGMGPRVPNEA

SEQ ID NO: 928128 - protein, 18 aa, Mycobacterium
GLALEVYEDGRIVRDFVY

SEQ ID NO: 928129 - protein, 21 aa, Mycobacterium
GLAPAIHRFPFTLTFKEPLPI

SEQ ID NO: 928130 - protein, 39 aa, Mycobacterium
GLAPELAAPMHAWSGDAYKLVVLMGLRIGQDSVNGKAGD

SEQ ID NO: 928131 - protein, 23 aa, Mycobacterium
GLAPRIGNLAQWRTHLIERLRRE

SEQ ID NO: 928132 - protein, 17 aa, Mycobacterium
GLARVFGQGTYMNVYGC

SEQ ID NO: 928133 - protein, 17 aa, Mycobacterium
GLASSIGGRVLLPDSGG

SEQ ID NO: 928134 - protein, 25 aa, Mycobacterium
GLAVCGLATAVALTACSAGQISQTT

SEQ ID NO: 928135 - protein, 25 aa, Mycobacterium
GLAVPLGAFMWAWAPDAFETITADG

SEQ ID NO: 928136 - protein, 28 aa, Mycobacterium
GLDARAYRLDWPAGTVVYEVDMPEVIEF

SEQ ID NO: 928137 - protein, 27 aa, Mycobacterium
GLDARAYRLPWPKGTVVYEVDMPEVIA

SEQ ID NO: 928138 - protein, 24 aa, Mycobacterium
GLDIRGYTYWSFVDNLEWSEGYDL

SEQ ID NO: 928139 - protein, 21 aa, Mycobacterium
GLDIRPGNFVAIDDGGGAVTV

SEQ ID NO: 928140 - protein, 37 aa, Mycobacterium
GLDLQWRGPAAQAMAFAAIRYAEWLQVTAEQTRQTAM

SEQ ID NO: 928141 - protein, 19 aa, Mycobacterium
GLDPAPVDIRHCWVTELPW

SEQ ID NO: 928142 - protein, 22 aa, Mycobacterium
GLDPKLMGVFMVTPDIFDSLPE

SEQ ID NO: 928143 - protein, 25 aa, Mycobacterium
GLDRLDVGFSLARRTAFEYRAVVLG

SEQ ID NO: 928144 - protein, 25 aa, Mycobacterium
GLDSRAYRLDWPGGTTVYEIDLPKV

SEQ ID NO: 928145 - protein, 19 aa, Mycobacterium
GLDSVVRFRWNGSGVELIG

SEQ ID NO: 928146 - protein, 27 aa, Mycobacterium
GLEKCIGCELCAWACPADAIYVEGADN

SEQ ID NO: 928147 - protein, 18 aa, Mycobacterium
GLERGGCAPDISYSAPFD

SEQ ID NO: 928148 - protein, 20 aa, Mycobacterium
GLESLRLWREGGFLDGLPPQ

SEQ ID NO: 928149 - protein, 19 aa, Mycobacterium
GLESVVSFRWNGTGVEKVQ

SEQ ID NO: 928150 - protein, 19 aa, Mycobacterium
GLFDLPRCEPSYPTVAGLA

SEQ ID NO: 928151 - protein, 23 aa, Mycobacterium
GLGAGELLASLTAAKTTAPSRSA

SEQ ID NO: 928152 - protein, 21 aa, Mycobacterium
GLGGLECLSGIPGSAGATPIQ

SEQ ID NO: 928153 - protein, 18 aa, Mycobacterium
GLGGLVIGNGGNGGIGGA

SEQ ID NO: 928154 - protein, 20 aa, Mycobacterium
GLGIYRLHRVFGVHEQPVVQ

SEQ ID NO: 928155 - protein, 21 aa, Mycobacterium
GLGLDSGFWNRGGGGRATGFF

SEQ ID NO: 928156 - protein, 18 aa, Mycobacterium
GLGRCIGTGLAQRGAHVA

SEQ ID NO: 928157 - protein, 17 aa, Mycobacterium
GLGRLAFGALFSEPRQL

SEQ ID NO: 928158 - protein, 18 aa, Mycobacterium
GLGRNFLQQLGILKPDDT

SEQ ID NO: 928159 - protein, 23 aa, Mycobacterium
GLGSYFWQHNWGSPKGYTHPAAN

SEQ ID NO: 928160 - protein, 19 aa, Mycobacterium
GLGVCQVRFGKAMRGSPPR

SEQ ID NO: 928161 - protein, 18 aa, Mycobacterium
GLGWRQCQTPTPPFALVL

SEQ ID NO: 928162 - protein, 21 aa, Mycobacterium
GLGYGPPVLWYGSLSDSGVVT

SEQ ID NO: 928163 - protein, 18 aa, Mycobacterium
GLGYRPASIEQPLTTGLD

SEQ ID NO: 928164 - protein, 26 aa, Mycobacterium
GLGYWRRPGLTGSRFVACPFGGTSAP

SEQ ID NO: 928165 - protein, 19 aa, Mycobacterium
GLHALKLLGVGDRVAGIGV

SEQ ID NO: 928166 - protein, 19 aa, Mycobacterium
GLHRLRMMVPNSPGGGYDL

SEQ ID NO: 928167 - protein, 24 aa, Mycobacterium
GLIEVTRAVVRFIPDTVRDIVDEF

SEQ ID NO: 928168 - protein, 25 aa, Mycobacterium
GLIGSLRIGNRFVHTGKPTPERYAE

SEQ ID NO: 928169 - protein, 17 aa, Mycobacterium
GLLAGAVAVLALTGGTG

SEQ ID NO: 928170 - protein, 18 aa, Mycobacterium
GLLAGGWLLGALRGTYAS

SEQ ID NO: 928171 - protein, 26 aa, Mycobacterium
GLLAPEWKGKIGFAPSNASWQAFVTG

SEQ ID NO: 928172 - protein, 26 aa, Mycobacterium
GLLAPEWKGKIGFAPSNASWQSFVTG

SEQ ID NO: 928173 - protein, 26 aa, Mycobacterium
GLLATLWRARLIAPMRPDRYLRMGLA

SEQ ID NO: 928174 - protein, 27 aa, Mycobacterium
GLLGRLGATVPRSARDLPEFGPDRLQE

SEQ ID NO: 928175 - protein, 24 aa, Mycobacterium
GLLGTGESLLMIWQNATAEVTGAL

SEQ ID NO: 928176 - protein, 19 aa, Mycobacterium
GLLLHYLPEVDLWTGAIVG

SEQ ID NO: 928177 - protein, 18 aa, Mycobacterium
GLLNVAVVVGGNSTAVAG

SEQ ID NO: 928178 - protein, 17 aa, Mycobacterium
GLLPRPGTRGRALTYGR

SEQ ID NO: 928179 - protein, 23 aa, Mycobacterium
GLLPVAEIMIMDFIGIAADQLIN

SEQ ID NO: 928180 - protein, 25 aa, Mycobacterium
GLLRSGGYGGPPFGGVVFTDDLSGM

SEQ ID NO: 928181 - protein, 18 aa, Mycobacterium
GLLSDCGQALLGADAVLG

SEQ ID NO: 928182 - protein, 18 aa, Mycobacterium
GLLSIPNFANPVQFICGG

SEQ ID NO: 928183 - protein, 19 aa, Mycobacterium
GLLTSCWTSAAKTLDYAVD

SEQ ID NO: 928184 - protein, 21 aa, Mycobacterium
GLLYNFTFNFEKAGQATVLVP

SEQ ID NO: 928185 - protein, 18 aa, Mycobacterium
GLMAHKAAVSLLDIKSEY

SEQ ID NO: 928186 - protein, 25 aa, Mycobacterium
GLMASAMALAGCSSDGPAYPDADIA

SEQ ID NO: 928187 - protein, 17 aa, Mycobacterium
GLMMFPTTVAVTSAEPN

SEQ ID NO: 928188 - protein, 21 aa, Mycobacterium
GLMMTFDLIPILTKAEVEESL

SEQ ID NO: 928189 - protein, 20 aa, Mycobacterium
GLMMYGFAAVGIRLRHYTGY

SEQ ID NO: 928190 - protein, 23 aa, Mycobacterium
GLNCALEGMAWVKNQPPQSDPGV

SEQ ID NO: 928191 - protein, 18 aa, Mycobacterium
GLNSIPLPGTAGRGPGAF

SEQ ID NO: 928192 - protein, 19 aa, Mycobacterium
GLNSLPLPGAVGRGPGANI

SEQ ID NO: 928193 - protein, 25 aa, Mycobacterium
GLPKARRFDVLDVFSGQRSVQQLTY

SEQ ID NO: 928194 - protein, 20 aa, Mycobacterium
GLPQRTGQVSLPWTLTLETT

SEQ ID NO: 928195 - protein, 18 aa, Mycobacterium
GLPSEIGPVAAFLASRRN

SEQ ID NO: 928196 - protein, 23 aa, Mycobacterium
GLPVERLQVPSAAMGRDITVQFQ

SEQ ID NO: 928197 - protein, 19 aa, Mycobacterium
GLQMLDWSGHTCIMQTGID

SEQ ID NO: 928198 - protein, 21 aa, Mycobacterium
GLRDRIRFGTEISDARFEDGR

SEQ ID NO: 928199 - protein, 20 aa, Mycobacterium
GLRGNCLVEVEIAFFSVRGP

SEQ ID NO: 928200 - protein, 19 aa, Mycobacterium
GLRGSEDVLGILLAAIDSG

SEQ ID NO: 928201 - protein, 24 aa, Mycobacterium
GLRMLYEAWLQFRGEAGQRQLPDP

SEQ ID NO: 928202 - protein, 21 aa, Mycobacterium
GLRPAGALGAEAMRPQTTTTG

SEQ ID NO: 928203 - protein, 19 aa, Mycobacterium
GLRRVIVVVSMVFGAATFN

SEQ ID NO: 928204 - protein, 26 aa, Mycobacterium
GLRTVVLEEGRRWTVREFRTTHPIDR

SEQ ID NO: 928205 - protein, 18 aa, Mycobacterium
GLSAMIWLAAPAHAHPDE

SEQ ID NO: 928206 - protein, 23 aa, Mycobacterium
GLSGGLSVYSHRVLQTNITAEDL

SEQ ID NO: 928207 - protein, 24 aa, Mycobacterium
GLSHACSVYGSSVLVLPDASREGV

SEQ ID NO: 928208 - protein, 25 aa, Mycobacterium
GLSIARMYFAYGLGNSVWFPLATGS

SEQ ID NO: 928209 - protein, 24 aa, Mycobacterium
GLSPLAPLRGGYVSAVTPEIGGVA

SEQ ID NO: 928210 - protein, 20 aa, Mycobacterium
GLSRVKLCLQGHWLKTSGVM

SEQ ID NO: 928211 - protein, 25 aa, Mycobacterium
GLSSARMYFAYGLGNSVWFPLATGS

SEQ ID NO: 928212 - protein, 24 aa, Mycobacterium
GLSVGSWLGPASMLMAAAAAPYVA

SEQ ID NO: 928213 - protein, 18 aa, Mycobacterium
GLTFLVGIGIAYPAQVRT

SEQ ID NO: 928214 - protein, 24 aa, Mycobacterium
GLTISIPTPQGWAPFTSPNITPQT

SEQ ID NO: 928215 - protein, 19 aa, Mycobacterium
GLTLESWMGPASASMAAAA

SEQ ID NO: 928216 - protein, 22 aa, Mycobacterium
GLTPDDVKLVFLQPADALSAFK

SEQ ID NO: 928217 - protein, 24 aa, Mycobacterium
GLTPLRPWRSALVAALAAASDRAL

SEQ ID NO: 928218 - protein, 25 aa, Mycobacterium
GLTPRAVEQLELLGLRPWLDEHIRY

SEQ ID NO: 928219 - protein, 18 aa, Mycobacterium
GLTVSIPTPPGWSPYEGP

SEQ ID NO: 928220 - protein, 18 aa, Mycobacterium
GLVAFLLSEEGEWINGQV

SEQ ID NO: 928221 - protein, 19 aa, Mycobacterium
GLVALPWHAAYSASKYGLR

SEQ ID NO: 928222 - protein, 22 aa, Mycobacterium
GLVCLLVGCSHGASPSMTADIS

SEQ ID NO: 928223 - protein, 22 aa, Mycobacterium
GLVEPRLRVAITSGQCGSGESG

SEQ ID NO: 928224 - protein, 17 aa, Mycobacterium
GLVGWGGARALARRIER

SEQ ID NO: 928225 - protein, 17 aa, Mycobacterium
GLVLVALLVVGVALLVR

SEQ ID NO: 928226 - protein, 19 aa, Mycobacterium
GLVMNPDAKVKMRGVQVGK

SEQ ID NO: 928227 - protein, 17 aa, Mycobacterium
GLVQAFLRGPMHGAVSP

SEQ ID NO: 928228 - protein, 18 aa, Mycobacterium
GLVSAMLVAGLVGCGSTP

SEQ ID NO: 928229 - protein, 18 aa, Mycobacterium
GLVSRPLLHEQLIAALPA

SEQ ID NO: 928230 - protein, 24 aa, Mycobacterium
GLVTRKYKYSFGIASDQTLADAKR

SEQ ID NO: 928231 - protein, 17 aa, Mycobacterium
GLWPEVSPLTIADALAA

SEQ ID NO: 928232 - protein, 25 aa, Mycobacterium
GLYAAGKLDEFAEWACTLTQRAVLR

SEQ ID NO: 928233 - protein, 25 aa, Mycobacterium
GLYEEMWAADVAVMSAYHTGVSAAA

SEQ ID NO: 928234 - protein, 26 aa, Mycobacterium
GLYGTIPSSLIPGVPVGYSVPVGTTI

SEQ ID NO: 928235 - protein, 25 aa, Mycobacterium
GLYPGNVVAVLGMPVGQVSKITARG

SEQ ID NO: 928236 - protein, 26 aa, Mycobacterium
GLYPGSTVAVLGMRVGSVEKITPEGG

SEQ ID NO: 928237 - protein, 25 aa, Mycobacterium
GMAACAATVAMLFATAGWAAADVPA

SEQ ID NO: 928238 - protein, 18 aa, Mycobacterium
GMDMRAYMNMFMRHGELR

SEQ ID NO: 928239 - protein, 25 aa, Mycobacterium
GMDSWKAMGVKEYFGQDGRIAGQGV

SEQ ID NO: 928240 - protein, 20 aa, Mycobacterium
GMFSHLRALQAIADANNGNR

SEQ ID NO: 928241 - protein, 22 aa, Mycobacterium
GMGAMAMPIAGMAAARAAMAAG

SEQ ID NO: 928242 - protein, 18 aa, Mycobacterium
GMGCTAGFLVRTRTGQPG

SEQ ID NO: 928243 - protein, 19 aa, Mycobacterium
GMGNFGVQMAKTLGLITQP

SEQ ID NO: 928244 - protein, 23 aa, Mycobacterium
GMGSMVFPGYGAELLGWLDRAAR

SEQ ID NO: 928245 - protein, 18 aa, Mycobacterium
GMLACNCYVLAERPGSDA

SEQ ID NO: 928246 - protein, 18 aa, Mycobacterium
GMMGPGMMGPGWNGPNGP

SEQ ID NO: 928247 - protein, 21 aa, Mycobacterium
GMNDVKTWISFGASPRASLGI

SEQ ID NO: 928248 - protein, 23 aa, Mycobacterium
GMPEGVPLAARRPEPTLPVPAGW

SEQ ID NO: 928249 - protein, 18 aa, Mycobacterium
GMPGMAAAAKGAGAYGTG

SEQ ID NO: 928250 - protein, 22 aa, Mycobacterium
GMPKGVLWRQHDIFMTAFGGRN

SEQ ID NO: 928251 - protein, 18 aa, Mycobacterium
GMPKVLADGGEWLRRSVA

SEQ ID NO: 928252 - protein, 19 aa, Mycobacterium
GMPVRRARRVYQLTDAGRR

SEQ ID NO: 928253 - protein, 19 aa, Mycobacterium
GMPYARIATNKGVVVPLTN

SEQ ID NO: 928254 - protein, 18 aa, Mycobacterium
GMQAIRMVVVVLAAAFAV

SEQ ID NO: 928255 - protein, 23 aa, Mycobacterium
GMRAQFLCHWQFAELARPGKTSW

SEQ ID NO: 928256 - protein, 23 aa, Mycobacterium
GMRAQFVCHWDFAEVAAPGKSSW

SEQ ID NO: 928257 - protein, 22 aa, Mycobacterium
GMSALDCHGRFFGAPDGANSAH

SEQ ID NO: 928258 - protein, 26 aa, Mycobacterium
GMSAPVFRVPLAVAEMVKYADNGFHA

SEQ ID NO: 928259 - protein, 23 aa, Mycobacterium
GMSQGAQVVGEWLSSFAQDADAP

SEQ ID NO: 928260 - protein, 21 aa, Mycobacterium
GMSRREFMARIATAGSAGALM

SEQ ID NO: 928261 - protein, 24 aa, Mycobacterium
GMSSPIDCRDHFQRDEMRDQSQFQ

SEQ ID NO: 928262 - protein, 20 aa, Mycobacterium
GMSSPIDCRDHYERTEMRDQ

SEQ ID NO: 928263 - protein, 26 aa, Mycobacterium
GMSYCPPQLPGLAELWGTAVFHCPFC

SEQ ID NO: 928264 - protein, 19 aa, Mycobacterium
GMVEPRLRVALTSGQCDGG

SEQ ID NO: 928265 - protein, 19 aa, Mycobacterium
GMVVTPMLEKAIAEGRFTA

SEQ ID NO: 928266 - protein, 19 aa, Mycobacterium
GMWCPPTPIDKVFDRNGKE

SEQ ID NO: 928267 - protein, 24 aa, Mycobacterium
GMWGAPQLGRWKWHDPCVHVALLA

SEQ ID NO: 928268 - protein, 31 aa, Mycobacterium
GMWGAPQLGRWKWHDPWVHAALLAQNNTRVW

SEQ ID NO: 928269 - protein, 29 aa, Mycobacterium
GMWGAPQLGRWKWHDPYVHSALLAQNNTR

SEQ ID NO: 928270 - protein, 23 aa, Mycobacterium
GNAAEFCRGADAVVISEHAIASA

SEQ ID NO: 928271 - protein, 25 aa, Mycobacterium
GNAAPVGRLSVPQGWATANPPVLAA

SEQ ID NO: 928272 - protein, 22 aa, Mycobacterium
GNAAQYVWWVPHNVAGLVTALG

SEQ ID NO: 928273 - protein, 25 aa, Mycobacterium
GNAEAARAATLWRFTAGAVDQPNPV

SEQ ID NO: 928274 - protein, 25 aa, Mycobacterium
GNAEARLPEILTFLESKLGTYPHVA

SEQ ID NO: 928275 - protein, 26 aa, Mycobacterium
GNAPDRSKGVVILLFTEGRALATLQF

SEQ ID NO: 928276 - protein, 21 aa, Mycobacterium
GNAPLGVCAFWPVPPTSKPHP

SEQ ID NO: 928277 - protein, 24 aa, Mycobacterium
GNATCPPVSIAMAGALNGPDAALG

SEQ ID NO: 928278 - protein, 18 aa, Mycobacterium
GNEESAQVLLEWLQANFP

SEQ ID NO: 928279 - protein, 17 aa, Mycobacterium
GNFPEQFNVTNIAPAGP

SEQ ID NO: 928280 - protein, 25 aa, Mycobacterium
GNGGEGRGGFSVPQHGVGGQGGTGG

SEQ ID NO: 928281 - protein, 30 aa, Mycobacterium
GNGGFVENFDFFGFGVAHGGDGGSGGAASG

SEQ ID NO: 928282 - protein, 17 aa, Mycobacterium
GNGGGRVVGAAPSVPAA

SEQ ID NO: 928283 - protein, 19 aa, Mycobacterium
GNGGIGYYDAQNALGGNGG

SEQ ID NO: 928284 - protein, 19 aa, Mycobacterium
GNGGLLWGGGGSGGDAGNA

SEQ ID NO: 928285 - protein, 21 aa, Mycobacterium
GNGGTAIVIGNGGSGGAGGTG

SEQ ID NO: 928286 - protein, 21 aa, Mycobacterium
GNGGVWTYKWETFLTDELPLW

SEQ ID NO: 928287 - protein, 25 aa, Mycobacterium
GNGGYAAIVGGWGGDGGAGGDGGGA

SEQ ID NO: 928288 - protein, 17 aa, Mycobacterium
GNGYGWGDYGYGRDSNN

SEQ ID NO: 928289 - protein, 21 aa, Mycobacterium
GNGYMLLGLEVDGLAARYRDD

SEQ ID NO: 928290 - protein, 20 aa, Mycobacterium
GNILKERFLASPAFTEVYDK

SEQ ID NO: 928291 - protein, 23 aa, Mycobacterium
GNIVGAPMGWESVFTEPFQAYSV

SEQ ID NO: 928292 - protein, 23 aa, Mycobacterium
GNIVGGPMGWESVFTQPGQGPWV

SEQ ID NO: 928293 - protein, 22 aa, Mycobacterium
GNIVGGPMGWESVFTQPVQNDW

SEQ ID NO: 928294 - protein, 25 aa, Mycobacterium
GNIVNRFAPVQSLAGAYGDRVLDLC

SEQ ID NO: 928295 - protein, 27 aa, Mycobacterium
GNLDGYRAGYFVGLSVAAYCPRHHHSS

SEQ ID NO: 928296 - protein, 18 aa, Mycobacterium
GNLEVPWPGTSFGGTGSA

SEQ ID NO: 928297 - protein, 22 aa, Mycobacterium
GNLQPLINFLKWLDSADDEEFA

SEQ ID NO: 928298 - protein, 21 aa, Mycobacterium
GNLRMLLKWLLGAVFISLYAF

SEQ ID NO: 928299 - protein, 18 aa, Mycobacterium
GNLTELELQWGRTIGQMP

SEQ ID NO: 928300 - protein, 22 aa, Mycobacterium
GNLTELELQWGRTIGQMPSPYT

SEQ ID NO: 928301 - protein, 27 aa, Mycobacterium
GNMIKPMLARGELRLVGATTLDEYRKH

SEQ ID NO: 928302 - protein, 21 aa, Mycobacterium
GNMQSGHVFVCYQQDLERQFE

SEQ ID NO: 928303 - protein, 17 aa, Mycobacterium
GNNSGLVANSFGLENIA

SEQ ID NO: 928304 - protein, 19 aa, Mycobacterium
GNPATGWKLVDWDGIRNFG

SEQ ID NO: 928305 - protein, 24 aa, Mycobacterium
GNPHPAVAVLPEFGRKRRDLGLAR

SEQ ID NO: 928306 - protein, 20 aa, Mycobacterium
GNPMTGWTLVDWDGIRDFHS

SEQ ID NO: 928307 - protein, 22 aa, Mycobacterium
GNPMVDAFLWVKRPGESDGACR

SEQ ID NO: 928308 - protein, 18 aa, Mycobacterium
GNPTGGWTLVDWGGINTE

SEQ ID NO: 928309 - protein, 26 aa, Mycobacterium
GNPVPRPAAVPVLWLGAGERVSALVT

SEQ ID NO: 928310 - protein, 18 aa, Mycobacterium
GNQLPAPFINPGGTGGSG

SEQ ID NO: 928311 - protein, 23 aa, Mycobacterium
GNQPLRPGGTLPLGQSTTPYQIY

SEQ ID NO: 928312 - protein, 20 aa, Mycobacterium
GNRVCGNFDIADKWTSASGT

SEQ ID NO: 928313 - protein, 17 aa, Mycobacterium
GNSERAYLLAVVVPTEE

SEQ ID NO: 928314 - protein, 18 aa, Mycobacterium
GNSLPPQYADNIAAVATF

SEQ ID NO: 928315 - protein, 25 aa, Mycobacterium
GNSPDKSKGVTILMFTEGRAFVTIQ

SEQ ID NO: 928316 - protein, 19 aa, Mycobacterium
GNVADAIAPWVPPPAAYAP

SEQ ID NO: 928317 - protein, 20 aa, Mycobacterium
GNVDLAFFGPFAYVVAGVNG

SEQ ID NO: 928318 - protein, 19 aa, Mycobacterium
GNVEAAKILEFAPGELKNL

SEQ ID NO: 928319 - protein, 27 aa, Mycobacterium
GNVICRALRGGTSFDTLVNMTTSDGYY

SEQ ID NO: 928320 - protein, 17 aa, Mycobacterium
GPADIALCTRARLDEAD

SEQ ID NO: 928321 - protein, 20 aa, Mycobacterium
GPAEARYILFANTDAMNGKF

SEQ ID NO: 928322 - protein, 20 aa, Mycobacterium
GPALAFWLTEAGWEVTVIER

SEQ ID NO: 928323 - protein, 20 aa, Mycobacterium
GPALRLNWTDRATISNSGLQ

SEQ ID NO: 928324 - protein, 19 aa, Mycobacterium
GPANRPAVPQGRHVHLLMA

SEQ ID NO: 928325 - protein, 21 aa, Mycobacterium
GPAPKTTVTFADGRTAPFTVV

SEQ ID NO: 928326 - protein, 34 aa, Mycobacterium
GPAPSATAITAQWAGTFAAMSARDRAGPAGAAST

SEQ ID NO: 928327 - protein, 40 aa, Mycobacterium
GPAQRSVPANAARAMTAGDIASRYRTAASPTGTAGTTSTA

SEQ ID NO: 928328 - protein, 19 aa, Mycobacterium
GPASFKLGRRVVYRRSEVE

SEQ ID NO: 928329 - protein, 17 aa, Mycobacterium
GPCGLAALHAFEQARLD

SEQ ID NO: 928330 - protein, 17 aa, Mycobacterium
GPCRAEVGQLQQVYDAT

SEQ ID NO: 928331 - protein, 18 aa, Mycobacterium
GPDFGAAIAASFVFPFTQ

SEQ ID NO: 928332 - protein, 18 aa, Mycobacterium
GPDGRPRYVTAIDAETAT

SEQ ID NO: 928333 - protein, 24 aa, Mycobacterium
GPDKFGMDDFVRMGLAAHGDSRQV

SEQ ID NO: 928334 - protein, 28 aa, Mycobacterium
GPDMVGICLRGKPGWGEVLAPLDTVINT

SEQ ID NO: 928335 - protein, 19 aa, Mycobacterium
GPDSGALAPLVDRANALRD

SEQ ID NO: 928336 - protein, 24 aa, Mycobacterium
GPEGINPGFMSGFVNSSGTFISGF

SEQ ID NO: 928337 - protein, 31 aa, Mycobacterium
GPEGRPGCWQKITRELWPAPYLVMDTGLSVA

SEQ ID NO: 928338 - protein, 28 aa, Mycobacterium
GPEHIAARPGRIWLRISGYGEHSRRPAF

SEQ ID NO: 928339 - protein, 20 aa, Mycobacterium
GPEKEANWLPAPTGKFNLML

SEQ ID NO: 928340 - protein, 23 aa, Mycobacterium
GPEPEGLAITDLDGRRTALIASE

SEQ ID NO: 928341 - protein, 21 aa, Mycobacterium
GPEPEGLAITEIGGRPVALVA

SEQ ID NO: 928342 - protein, 19 aa, Mycobacterium
GPGAWPKCGGGGIGGGAGC

SEQ ID NO: 928343 - protein, 24 aa, Mycobacterium
GPGDPRCIEMPTAGVCQGGPYAIA

SEQ ID NO: 928344 - protein, 17 aa, Mycobacterium
GPGGWLYGNGGTGGAGG

SEQ ID NO: 928345 - protein, 31 aa, Mycobacterium
GPGKADPGLLRWLEDPEIGGVELKGFSRVGG

SEQ ID NO: 928346 - protein, 17 aa, Mycobacterium
GPGPISFWSNHPGQSSG

SEQ ID NO: 928347 - protein, 17 aa, Mycobacterium
GPGPRRGELKIEQYYRG

SEQ ID NO: 928348 - protein, 24 aa, Mycobacterium
GPGQKGGNGGFLLGNGGRGGDGLA

SEQ ID NO: 928349 - protein, 17 aa, Mycobacterium
GPGSYPADMLIDWIRVW

SEQ ID NO: 928350 - protein, 17 aa, Mycobacterium
GPGTYPADMLIDWIRVW

SEQ ID NO: 928351 - protein, 18 aa, Mycobacterium
GPGTYVAIMLPRCAQAIV

SEQ ID NO: 928352 - protein, 23 aa, Mycobacterium
GPGVLEACFDRLSTGGRLVVNAV

SEQ ID NO: 928353 - protein, 23 aa, Mycobacterium
GPGVRIFSEMELAILRDLGYHVV

SEQ ID NO: 928354 - protein, 20 aa, Mycobacterium
GPHFSFSWFRGSPIGRERKT

SEQ ID NO: 928355 - protein, 25 aa, Mycobacterium
GPHFSFSWYRGSPIGRERKTEELSR

SEQ ID NO: 928356 - protein, 22 aa, Mycobacterium
GPIDRLALLSVNDIEDYWQSAY

SEQ ID NO: 928357 - protein, 25 aa, Mycobacterium
GPIELVKTAGGWRIDRLPNGVFLDW

SEQ ID NO: 928358 - protein, 26 aa, Mycobacterium
GPIELVKTPGGWRIDRLPNGVFLDWQ

SEQ ID NO: 928359 - protein, 25 aa, Mycobacterium
GPIELVKTSGGWRIDKLPNGVFLDW

SEQ ID NO: 928360 - protein, 22 aa, Mycobacterium
GPINRRMALMALGAGVLAPNVL

SEQ ID NO: 928361 - protein, 20 aa, Mycobacterium
GPISEISPWYGHKAIDLCAP

SEQ ID NO: 928362 - protein, 27 aa, Mycobacterium
GPKPIAPELPPAVSAYTGLPGDTPEAP

SEQ ID NO: 928363 - protein, 25 aa, Mycobacterium
GPLAFRYSGYTAWRGIADISIPDEL

SEQ ID NO: 928364 - protein, 18 aa, Mycobacterium
GPLAGRWIDQCNPGDPVC

SEQ ID NO: 928365 - protein, 30 aa, Mycobacterium
GPLGLCYLPAFVCLGIVPVVVGLAGDVLGA

SEQ ID NO: 928366 - protein, 18 aa, Mycobacterium
GPLLGELLARAVLEDEPP

SEQ ID NO: 928367 - protein, 26 aa, Mycobacterium
GPLNPRIVLVAAAIPQPAHIVIVVEE

SEQ ID NO: 928368 - protein, 23 aa, Mycobacterium
GPLPVESGFRCELAVDGEVVATG

SEQ ID NO: 928369 - protein, 17 aa, Mycobacterium
GPLQTAFTTLELRELGD

SEQ ID NO: 928370 - protein, 24 aa, Mycobacterium
GPLRRRYAGYTAWRGIAAHPLDPE

SEQ ID NO: 928371 - protein, 20 aa, Mycobacterium
GPLSTEFFTSGEFNSGVGSS

SEQ ID NO: 928372 - protein, 24 aa, Mycobacterium
GPMQFIPETWRIYGVRAAGDGEPS

SEQ ID NO: 928373 - protein, 26 aa, Mycobacterium
GPMQFIPETWRLYGVDAHNDGRVSPD

SEQ ID NO: 928374 - protein, 17 aa, Mycobacterium
GPMRLTAERVAVIGGGE

SEQ ID NO: 928375 - protein, 22 aa, Mycobacterium
GPNARLAAIIGAIAKSCGPAGI

SEQ ID NO: 928376 - protein, 34 aa, Mycobacterium
GPNQVLSPGFHGLQIHSVGKCEANSAAPGGGATG

SEQ ID NO: 928377 - protein, 25 aa, Mycobacterium
GPNVDLPVPNGWQLNQNAGTSYGGI

SEQ ID NO: 928378 - protein, 21 aa, Mycobacterium
GPPPPPPFTGRPPGTPPPGAA

SEQ ID NO: 928379 - protein, 18 aa, Mycobacterium
GPPSAHWLDPADVAGKPG

SEQ ID NO: 928380 - protein, 19 aa, Mycobacterium
GPPTLTWYILPDNGGSVAR

SEQ ID NO: 928381 - protein, 18 aa, Mycobacterium
GPPVRPSRSDGCAVADYP

SEQ ID NO: 928382 - protein, 21 aa, Mycobacterium
GPQFEAWKHTQLVIDVVPGRG

SEQ ID NO: 928383 - protein, 26 aa, Mycobacterium
GPQRLDGPEALSFVRQRHELPRGDLD

SEQ ID NO: 928384 - protein, 17 aa, Mycobacterium
GPRYGVIPTVMTRPPSG

SEQ ID NO: 928385 - protein, 20 aa, Mycobacterium
GPSGDWGGVGMWCQNLRANC

SEQ ID NO: 928386 - protein, 17 aa, Mycobacterium
GPSKPQRPASESSGAES

SEQ ID NO: 928387 - protein, 21 aa, Mycobacterium
GPSKYRCFVSYNGVANVVVQT

SEQ ID NO: 928388 - protein, 26 aa, Mycobacterium
GPTFPNRLYWVSAWLDPDGANGGPLV

SEQ ID NO: 928389 - protein, 20 aa, Mycobacterium
GPTKLPSLAKVVLSLSDLII

SEQ ID NO: 928390 - protein, 18 aa, Mycobacterium
GPTMPKFLAFPSAQHGPP

SEQ ID NO: 928391 - protein, 19 aa, Mycobacterium
GPTPPPGCYAGKSSVNNPQ

SEQ ID NO: 928392 - protein, 25 aa, Mycobacterium
GPTSNRGWCRYVFNLGLDERPVQPA

SEQ ID NO: 928393 - protein, 25 aa, Mycobacterium
GPTVPAVTVEPAFAAVAAVPAGRVA

SEQ ID NO: 928394 - protein, 30 aa, Mycobacterium
GPTVPGDPPLLLGVLAFVRREIQRTFFNSS

SEQ ID NO: 928395 - protein, 17 aa, Mycobacterium
GPTVVHFSAPWCGPCDR

SEQ ID NO: 928396 - protein, 18 aa, Mycobacterium
GPVAFWGWFSGGSAALAA

SEQ ID NO: 928397 - protein, 25 aa, Mycobacterium
GPVDDGACYWKRVAGEELVDNALTK

SEQ ID NO: 928398 - protein, 21 aa, Mycobacterium
GPVDSDSWCNPPGRALGSPPT

SEQ ID NO: 928399 - protein, 28 aa, Mycobacterium
GPVKLSGLSGWIGWGFIHIAFLTGVRNR

SEQ ID NO: 928400 - protein, 19 aa, Mycobacterium
GPVLAYWLSRYGFDVTVVE

SEQ ID NO: 928401 - protein, 27 aa, Mycobacterium
GPVPLRLRESPGLMILGRQGCGKTLSL

SEQ ID NO: 928402 - protein, 24 aa, Mycobacterium
GPVRGCPFVAAATEFPDPDSPAHA

SEQ ID NO: 928403 - protein, 18 aa, Mycobacterium
GPWARRLGIATLAALLLP

SEQ ID NO: 928404 - protein, 22 aa, Mycobacterium
GPYGCSGVLPGAPNNANLVSGR

SEQ ID NO: 928405 - protein, 20 aa, Mycobacterium
GPYMYCDVLRLDECQTPQTQ

SEQ ID NO: 928406 - protein, 19 aa, Mycobacterium
GPYRYCQVFNPTDCAVPAE

SEQ ID NO: 928407 - protein, 23 aa, Mycobacterium
GQAASGWLWPGPSQSAIRRAMLR

SEQ ID NO: 928408 - protein, 17 aa, Mycobacterium
GQADAWAIWDPYTALAQ

SEQ ID NO: 928409 - protein, 21 aa, Mycobacterium
GQAFWSFGGLFFVNSPEQRRL

SEQ ID NO: 928410 - protein, 28 aa, Mycobacterium
GQAIDLLKGVLMPSIMQAVQNGGAAAPA

SEQ ID NO: 928411 - protein, 17 aa, Mycobacterium
GQAPPIISRAEWGADES

SEQ ID NO: 928412 - protein, 23 aa, Mycobacterium
GQARPADQPLWLGSIKSNMGHTQ

SEQ ID NO: 928413 - protein, 19 aa, Mycobacterium
GQAVWRGLAGFHLVHDDEE

SEQ ID NO: 928414 - protein, 27 aa, Mycobacterium
GQAYQFPMGLGLVSQFFGRYFTPDEAR

SEQ ID NO: 928415 - protein, 20 aa, Mycobacterium
GQAYWSFGGLFFVDSPEQRR

SEQ ID NO: 928416 - protein, 20 aa, Mycobacterium
GQFRRWRAVVDACLEVLGPG

SEQ ID NO: 928417 - protein, 18 aa, Mycobacterium
GQGFAIPIGQAMAIANQI

SEQ ID NO: 928418 - protein, 24 aa, Mycobacterium
GQGGEPRLTLPDAITGNPGDPRYP

SEQ ID NO: 928419 - protein, 20 aa, Mycobacterium
GQGPAIRDAIIRLSQSVSAL

SEQ ID NO: 928420 - protein, 24 aa, Mycobacterium
GQGVLDPTCRVLGVERLWVVDGSI

SEQ ID NO: 928421 - protein, 22 aa, Mycobacterium
GQIAQRGYQLWADTVNSKGGLQ

SEQ ID NO: 928422 - protein, 19 aa, Mycobacterium
GQIFEGRFGGITNNVQGAH

SEQ ID NO: 928423 - protein, 23 aa, Mycobacterium
GQKARSTFDLARRLAPSARFLVI

SEQ ID NO: 928424 - protein, 17 aa, Mycobacterium
GQKRARVSFAQDRGFLD

SEQ ID NO: 928425 - protein, 18 aa, Mycobacterium
GQLCLPLYGAIVTNCELD

SEQ ID NO: 928426 - protein, 18 aa, Mycobacterium
GQLFSTGVGVDWSAVFAG

SEQ ID NO: 928427 - protein, 28 aa, Mycobacterium
GQLKMARDEGRWRVRWTSTGLHPKLGEH

SEQ ID NO: 928428 - protein, 19 aa, Mycobacterium
GQLNPAVNITGVLDNGPYV

SEQ ID NO: 928429 - protein, 21 aa, Mycobacterium
GQPDPALDCTIHTSDGSGVVF

SEQ ID NO: 928430 - protein, 19 aa, Mycobacterium
GQPLMTWQTVGVITVERAH

SEQ ID NO: 928431 - protein, 30 aa, Mycobacterium
GQPQTAYKAFNWDQSYRKPVLYTVPKDDKD

SEQ ID NO: 928432 - protein, 23 aa, Mycobacterium
GQPRTGELYNYVASFDNYMVIVT

SEQ ID NO: 928433 - protein, 21 aa, Mycobacterium
GQRLAAFVVARPGCDIDADAI

SEQ ID NO: 928434 - protein, 19 aa, Mycobacterium
GQRLLHPHYADYSLGSPGI

SEQ ID NO: 928435 - protein, 17 aa, Mycobacterium
GQSGWLYQQRQLHSQRA

SEQ ID NO: 928436 - protein, 18 aa, Mycobacterium
GQSICPMLAEPGGNFAAA

SEQ ID NO: 928437 - protein, 17 aa, Mycobacterium
GQSPTNWHQGSNSANAG

SEQ ID NO: 928438 - protein, 21 aa, Mycobacterium
GQSVCPMLFEPGGSFDAVTSK

SEQ ID NO: 928439 - protein, 17 aa, Mycobacterium
GQSYLYLGDIGDNGLSR

SEQ ID NO: 928440 - protein, 21 aa, Mycobacterium
GQTCPPKPPPAAVEQAPTNAV

SEQ ID NO: 928441 - protein, 20 aa, Mycobacterium
GQTEVRFYRQLARQVVGAPY

SEQ ID NO: 928442 - protein, 20 aa, Mycobacterium
GQVGCRIRVNDVVRDQMSDD

SEQ ID NO: 928443 - protein, 17 aa, Mycobacterium
GQVSLPWTLTLETTIPS

SEQ ID NO: 928444 - protein, 20 aa, Mycobacterium
GQVWANVWPSNEIVRIDPGS

SEQ ID NO: 928445 - protein, 17 aa, Mycobacterium
GQYPAAVSWQAASDQLR

SEQ ID NO: 928446 - protein, 19 aa, Mycobacterium
GQYPGWRVTGPDGKVDEAG

SEQ ID NO: 928447 - protein, 17 aa, Mycobacterium
GQYQLPYQATKSATQVL

SEQ ID NO: 928448 - protein, 24 aa, Mycobacterium
GRAAFWRYRRSRPLQASLPMADAE

SEQ ID NO: 928449 - protein, 18 aa, Mycobacterium
GRAARLGVAALTAVVISG

SEQ ID NO: 928450 - protein, 20 aa, Mycobacterium
GRAAVDFNFNGWGGKQEHKS

SEQ ID NO: 928451 - protein, 17 aa, Mycobacterium
GRAAYAAAVTRGIVAFL

SEQ ID NO: 928452 - protein, 23 aa, Mycobacterium
GRAEAVGLARLGATVVVNDIGSA

SEQ ID NO: 928453 - protein, 19 aa, Mycobacterium
GRAFRGIRYLDGRHTAEAR

SEQ ID NO: 928454 - protein, 17 aa, Mycobacterium
GRAGLRQVVILASGLDT

SEQ ID NO: 928455 - protein, 23 aa, Mycobacterium
GRALRAGGPVERIMAPGGLADRL

SEQ ID NO: 928456 - protein, 19 aa, Mycobacterium
GRALRRRRLDAGDQAGFPL

SEQ ID NO: 928457 - protein, 26 aa, Mycobacterium
GRAPIVIRKEIPGFVANRLQVALTRE

SEQ ID NO: 928458 - protein, 22 aa, Mycobacterium
GRATSPRSAPVTTQTAVPTSAI

SEQ ID NO: 928459 - protein, 22 aa, Mycobacterium
GRAVRRVAVFGLGYVGSVTAAC

SEQ ID NO: 928460 - protein, 29 aa, Mycobacterium
GRAVVPGWPWWPLVEVMKLLPPRFTKYFA

SEQ ID NO: 928461 - protein, 27 aa, Mycobacterium
GRAVVPRWPWAPLTQVMRLLPPKYTKR

SEQ ID NO: 928462 - protein, 19 aa, Mycobacterium
GRCRRTLRAIIAAAVQPAA

SEQ ID NO: 928463 - protein, 17 aa, Mycobacterium
GRDGSIFDSSYQRGAPV

SEQ ID NO: 928464 - protein, 20 aa, Mycobacterium
GRDLPEPVLYTAGDDQRTAL

SEQ ID NO: 928465 - protein, 21 aa, Mycobacterium
GRDPRGGSVVTTIRPDVQQAA

SEQ ID NO: 928466 - protein, 19 aa, Mycobacterium
GRFATRLAFAALRAATGRD

SEQ ID NO: 928467 - protein, 18 aa, Mycobacterium
GRFEDAVQMARTIVITQE

SEQ ID NO: 928468 - protein, 19 aa, Mycobacterium
GRFGPPRQWLVVTGTNGKT

SEQ ID NO: 928469 - protein, 24 aa, Mycobacterium
GRFLPFDTPFTWAGMQYYTQMPAS

SEQ ID NO: 928470 - protein, 18 aa, Mycobacterium
GRFTRFADLDSMNRAFQN

SEQ ID NO: 928471 - protein, 17 aa, Mycobacterium
GRFTYVRDTVVFGPDGV

SEQ ID NO: 928472 - protein, 19 aa, Mycobacterium
GRGDCGWGGLGGAVDVVIA

SEQ ID NO: 928473 - protein, 19 aa, Mycobacterium
GRGGFGRDGKTGNPGNATD

SEQ ID NO: 928474 - protein, 20 aa, Mycobacterium
GRGGFTGMLLGSVSNAVVHS

SEQ ID NO: 928475 - protein, 25 aa, Mycobacterium
GRGGNGGTGGWLFGNGGVGGAGGTG

SEQ ID NO: 928476 - protein, 25 aa, Mycobacterium
GRGGSGGHGGVFGASGDQGAGGAGG

SEQ ID NO: 928477 - protein, 27 aa, Mycobacterium
GRGGSQMAARGFVWRTDGNLQNGDIVV

SEQ ID NO: 928478 - protein, 24 aa, Mycobacterium
GRGIKEFAPLIGVRKAGLFTSSSF

SEQ ID NO: 928479 - protein, 19 aa, Mycobacterium
GRGIPIPPGSVIPVERTEP

SEQ ID NO: 928480 - protein, 32 aa, Mycobacterium
GRGIPRERLESVAEHYLHFGGVSPINGINRDL

SEQ ID NO: 928481 - protein, 20 aa, Mycobacterium
GRGLAAWGALGFGYAEVGTV

SEQ ID NO: 928482 - protein, 32 aa, Mycobacterium
GRGLARLARRVWPDARWDDIGAQPHLAVAAGR

SEQ ID NO: 928483 - protein, 26 aa, Mycobacterium
GRGPGGVAMQCKWIPNQWPPVSTGFW

SEQ ID NO: 928484 - protein, 17 aa, Mycobacterium
GRGPGSFTIHAQLPDVG

SEQ ID NO: 928485 - protein, 22 aa, Mycobacterium
GRGRLQPGASIPLNRASTYPST

SEQ ID NO: 928486 - protein, 23 aa, Mycobacterium
GRGRWLAILGSLALAAGMIYAQD

SEQ ID NO: 928487 - protein, 20 aa, Mycobacterium
GRGRWLAVAVSVALSAAMVY

SEQ ID NO: 928488 - protein, 26 aa, Mycobacterium
GRHFSYADYPGFVAISSDGRTAFVTE

SEQ ID NO: 928489 - protein, 18 aa, Mycobacterium
GRHGDGWITQAGDLKNPR

SEQ ID NO: 928490 - protein, 17 aa, Mycobacterium
GRHGPMFPQCGGVSDQT

SEQ ID NO: 928491 - protein, 24 aa, Mycobacterium
GRHLPRGGVLVSISSLNARQPAAG

SEQ ID NO: 928492 - protein, 20 aa, Mycobacterium
GRIARAPWMLSRIYAPTGDV

SEQ ID NO: 928493 - protein, 20 aa, Mycobacterium
GRINVAWSRTADPEIPSHLV

SEQ ID NO: 928494 - protein, 21 aa, Mycobacterium
GRIRSAGAIFVGAWSPVSLGD

SEQ ID NO: 928495 - protein, 21 aa, Mycobacterium
GRITSVLALSALVNGARPEQF

SEQ ID NO: 928496 - protein, 20 aa, Mycobacterium
GRIVNFSSMSWRGNFGQTNY

SEQ ID NO: 928497 - protein, 25 aa, Mycobacterium
GRKMLRFGRVIVRFGKPMDFSRFEG

SEQ ID NO: 928498 - protein, 21 aa, Mycobacterium
GRKSPDCYVVPSDLHDILTDK

SEQ ID NO: 928499 - protein, 20 aa, Mycobacterium
GRLAIAFAVAVLAVGAPGRA

SEQ ID NO: 928500 - protein, 19 aa, Mycobacterium
GRLARCAETGWFDIDSEVQ

SEQ ID NO: 928501 - protein, 19 aa, Mycobacterium
GRLDEAFPGLGVDGPSIGE

SEQ ID NO: 928502 - protein, 21 aa, Mycobacterium
GRLDVGVGVGWMKDEHDIARG

SEQ ID NO: 928503 - protein, 19 aa, Mycobacterium
GRLFPDKYWPVTNNERANA

SEQ ID NO: 928504 - protein, 21 aa, Mycobacterium
GRLILADAIVRACEDNPDYLI

SEQ ID NO: 928505 - protein, 23 aa, Mycobacterium
GRLLPGHVPMWALGPLRRGNLWE

SEQ ID NO: 928506 - protein, 17 aa, Mycobacterium
GRLPEPSPTVLLDDPVE

SEQ ID NO: 928507 - protein, 31 aa, Mycobacterium
GRLRRLALSAAIDRPQICQQIFNGTRSAARD

SEQ ID NO: 928508 - protein, 23 aa, Mycobacterium
GRLRRLALSAAINRAQISRQIFV

SEQ ID NO: 928509 - protein, 32 aa, Mycobacterium
GRLRRLALSAAINRPQICQQIFNGSRSPARDF

SEQ ID NO: 928510 - protein, 32 aa, Mycobacterium
GRLRRLALSAAINRPQICQQIFNGTRSPARDF

SEQ ID NO: 928511 - protein, 17 aa, Mycobacterium
GRLTAPGFGRLETAVGF

SEQ ID NO: 928512 - protein, 19 aa, Mycobacterium
GRLVFCGSPRRYEPRWFRS

SEQ ID NO: 928513 - protein, 23 aa, Mycobacterium
GRMDWARAFASWSPHELSGLPTA

SEQ ID NO: 928514 - protein, 24 aa, Mycobacterium
GRNAELRTATQIILHDAAHPSTLT

SEQ ID NO: 928515 - protein, 19 aa, Mycobacterium
GRNELWIGFFRFREYPIRR

SEQ ID NO: 928516 - protein, 21 aa, Mycobacterium
GRNGIDLHRVWGRRPYAYLGI

SEQ ID NO: 928517 - protein, 21 aa, Mycobacterium
GRNLGGDPGKIGEHPKLDGAD

SEQ ID NO: 928518 - protein, 20 aa, Mycobacterium
GRPAAGWAPGLGERDRWSGT

SEQ ID NO: 928519 - protein, 18 aa, Mycobacterium
GRPADQLHDWAAERAPAL

SEQ ID NO: 928520 - protein, 17 aa, Mycobacterium
GRPAFAGSDARRLEGSY

SEQ ID NO: 928521 - protein, 25 aa, Mycobacterium
GRPQGWPAWADPDVVRAFTDRGVGS

SEQ ID NO: 928522 - protein, 18 aa, Mycobacterium
GRPRAPCPAGTWDTALLS

SEQ ID NO: 928523 - protein, 19 aa, Mycobacterium
GRPRYVTAIDAETATVRVG

SEQ ID NO: 928524 - protein, 20 aa, Mycobacterium
GRPSPRLDAVAERLGATTWP

SEQ ID NO: 928525 - protein, 25 aa, Mycobacterium
GRPTPAGLIPRINLVKLVSDLINDI

SEQ ID NO: 928526 - protein, 24 aa, Mycobacterium
GRPVLGICGGFQMLCRSIEDTIES

SEQ ID NO: 928527 - protein, 17 aa, Mycobacterium
GRQFGLCQIYANEIWHF

SEQ ID NO: 928528 - protein, 25 aa, Mycobacterium
GRQKLNGPQALSFVRQRHELPRGDL

SEQ ID NO: 928529 - protein, 26 aa, Mycobacterium
GRQRLDAAQALAFVRQRHGLDNGDLD

SEQ ID NO: 928530 - protein, 20 aa, Mycobacterium
GRQYMPWISLDDHIRAVRFT

SEQ ID NO: 928531 - protein, 20 aa, Mycobacterium
GRREVWTFTGPAAGATDAAW

SEQ ID NO: 928532 - protein, 25 aa, Mycobacterium
GRRLGAAALCCFTRTGDTALRLARQ

SEQ ID NO: 928533 - protein, 17 aa, Mycobacterium
GRRRGWNGCGWRSHRTG

SEQ ID NO: 928534 - protein, 27 aa, Mycobacterium
GRRSPRIGIPMSVLRAGARVNDAAAWL

SEQ ID NO: 928535 - protein, 21 aa, Mycobacterium
GRRVVLNLWAYWCAPCAAELP

SEQ ID NO: 928536 - protein, 19 aa, Mycobacterium
GRRWDGWDPTLPQIPSANI

SEQ ID NO: 928537 - protein, 21 aa, Mycobacterium
GRSGAWLIVDVRDLAALHAAL

SEQ ID NO: 928538 - protein, 21 aa, Mycobacterium
GRSGTFEGLIPRLAELTDSLD

SEQ ID NO: 928539 - protein, 23 aa, Mycobacterium
GRSTGNSCGVTWGPGQDPGTIVM

SEQ ID NO: 928540 - protein, 23 aa, Mycobacterium
GRTEGSITYVEWSFAQAQHLDMA

SEQ ID NO: 928541 - protein, 19 aa, Mycobacterium
GRTHLAYELMLTNPMSGNV

SEQ ID NO: 928542 - protein, 18 aa, Mycobacterium
GRTPRRMVPLRPAPSAVV

SEQ ID NO: 928543 - protein, 17 aa, Mycobacterium
GRTPWRDLFSPAVTLAD

SEQ ID NO: 928544 - protein, 18 aa, Mycobacterium
GRTQLLCEAVDYAGEHVA

SEQ ID NO: 928545 - protein, 24 aa, Mycobacterium
GRTTGNSCGVTWGAGQTPGTIVMQ

SEQ ID NO: 928546 - protein, 23 aa, Mycobacterium
GRTTGNSCGVTWGPGQDPGTILM

SEQ ID NO: 928547 - protein, 23 aa, Mycobacterium
GRTTGNSCGVTWGPGQDPGTIVM

SEQ ID NO: 928548 - protein, 18 aa, Mycobacterium
GRTVLIGLFNSTWGTFPA

SEQ ID NO: 928549 - protein, 19 aa, Mycobacterium
GRVAGLIGTVGVRIDGTDL

SEQ ID NO: 928550 - protein, 17 aa, Mycobacterium
GRVDPVSQWGFGAGWGA

SEQ ID NO: 928551 - protein, 25 aa, Mycobacterium
GRVSIEVDPRLAAETDKTVAQAVEL

SEQ ID NO: 928552 - protein, 18 aa, Mycobacterium
GRVSRLKSLLGGRGPSAR

SEQ ID NO: 928553 - protein, 19 aa, Mycobacterium
GRVSRLRSLIGASPSPREL

SEQ ID NO: 928554 - protein, 17 aa, Mycobacterium
GRVSYAFGVGHRREEYD

SEQ ID NO: 928555 - protein, 19 aa, Mycobacterium
GRVTTNWPGLVHEYQRRTR

SEQ ID NO: 928556 - protein, 18 aa, Mycobacterium
GRVVSLFDRVEALRVTAL

SEQ ID NO: 928557 - protein, 21 aa, Mycobacterium
GRVVVINVWGQWCGPCRSEFS

SEQ ID NO: 928558 - protein, 17 aa, Mycobacterium
GRWLAGRIRHHGLRMSG

SEQ ID NO: 928559 - protein, 19 aa, Mycobacterium
GRYADVWNAVEKRWGNPRP

SEQ ID NO: 928560 - protein, 24 aa, Mycobacterium
GRYANAPLHYERFGPPPVVDGVPF

SEQ ID NO: 928561 - protein, 23 aa, Mycobacterium
GSAKWNLLAPYAVKSEGGRNSQA

SEQ ID NO: 928562 - protein, 17 aa, Mycobacterium
GSALAACAAGAPGGALG

SEQ ID NO: 928563 - protein, 22 aa, Mycobacterium
GSALLRRATCPVAVVRDPDPAA

SEQ ID NO: 928564 - protein, 28 aa, Mycobacterium
GSASRRLPIPGADAAGVHYLRTFEDASA

SEQ ID NO: 928565 - protein, 25 aa, Mycobacterium
GSASRRPPIPGADSPGVHYLRTYED

SEQ ID NO: 928566 - protein, 20 aa, Mycobacterium
GSATARRALVEGADVVVSDH

SEQ ID NO: 928567 - protein, 20 aa, Mycobacterium
GSATGADMANPMAGAVTKPF

SEQ ID NO: 928568 - protein, 20 aa, Mycobacterium
GSAVVYGYRKGACGKLCELH

SEQ ID NO: 928569 - protein, 18 aa, Mycobacterium
GSAYLARVPQRFVPDLTK

SEQ ID NO: 928570 - protein, 17 aa, Mycobacterium
GSCLPKDLRALIHRART

SEQ ID NO: 928571 - protein, 19 aa, Mycobacterium
GSDCGRCRRTLRAIIAAAV

SEQ ID NO: 928572 - protein, 21 aa, Mycobacterium
GSDFNSRFTGAIRKIYDGGHN

SEQ ID NO: 928573 - protein, 18 aa, Mycobacterium
GSDGRIYVADHLTGSITV

SEQ ID NO: 928574 - protein, 25 aa, Mycobacterium
GSDPFVAIVAFPFIPQAMRGNYDQV

SEQ ID NO: 928575 - protein, 18 aa, Mycobacterium
GSECFSERARGRAGAADI

SEQ ID NO: 928576 - protein, 17 aa, Mycobacterium
GSENAAIHVLRDVADAQ

SEQ ID NO: 928577 - protein, 17 aa, Mycobacterium
GSEPLAVIFPIVRSDIS

SEQ ID NO: 928578 - protein, 23 aa, Mycobacterium
GSFDPVALLENFLGTQLGTDVNT

SEQ ID NO: 928579 - protein, 23 aa, Mycobacterium
GSFRARVAPFNVNYRYVKNELHY

SEQ ID NO: 928580 - protein, 27 aa, Mycobacterium
GSFTGYAPRDMCAFWPVPPTSTPHTPS

SEQ ID NO: 928581 - protein, 24 aa, Mycobacterium
GSGAELRTATPLGDVFVSIVPPSQ

SEQ ID NO: 928582 - protein, 24 aa, Mycobacterium
GSGAPGQRGGAGGAGGLLLGNGGA

SEQ ID NO: 928583 - protein, 19 aa, Mycobacterium
GSGARYGRQGSEYWEHQGE

SEQ ID NO: 928584 - protein, 25 aa, Mycobacterium
GSGDAGGPGGLLFGNGGNGGSGSAG

SEQ ID NO: 928585 - protein, 24 aa, Mycobacterium
GSGGAGGDGGWMYGDGGAGGAGGK

SEQ ID NO: 928586 - protein, 37 aa, Mycobacterium
GSGGIRGPIGLGFRVPCLVISPFSRGGLMAHDVFDHT

SEQ ID NO: 928587 - protein, 37 aa, Mycobacterium
GSGGIRGPIGLGFRVPCLVISPFSRGGLMVHDTFDHT

SEQ ID NO: 928588 - protein, 35 aa, Mycobacterium
GSGGIRGPIGLGYRVPCFIISPYSRGPLMVHDTFD

SEQ ID NO: 928589 - protein, 35 aa, Mycobacterium
GSGGIRGPIGLGYRVPCFVISPYSRGPLMVHDIFD

SEQ ID NO: 928590 - protein, 35 aa, Mycobacterium
GSGGIRGPIGLGYRVPCFVISPYSRGPLMVHDTFD

SEQ ID NO: 928591 - protein, 33 aa, Mycobacterium
GSGGIRGPIGLGYRVPCIVISPYSRGPLVVSDT

SEQ ID NO: 928592 - protein, 37 aa, Mycobacterium
GSGGIRGPLGLGFRVPCIVVSPFSRGGLMVHDIFDHT

SEQ ID NO: 928593 - protein, 21 aa, Mycobacterium
GSGGKGTFDGGAGGAGGDGGK

SEQ ID NO: 928594 - protein, 19 aa, Mycobacterium
GSGGLLWGNGGAGGAGGNG

SEQ ID NO: 928595 - protein, 18 aa, Mycobacterium
GSGHLVLISSVLGNKGVP

SEQ ID NO: 928596 - protein, 19 aa, Mycobacterium
GSGIEVWYFHEPQDMSKSD

SEQ ID NO: 928597 - protein, 17 aa, Mycobacterium
GSGILIGYHAAPVRIEI

SEQ ID NO: 928598 - protein, 22 aa, Mycobacterium
GSGISRKLIVQFTEPGTYQTAC

SEQ ID NO: 928599 - protein, 18 aa, Mycobacterium
GSGMEDWIGLSGADLSSP

SEQ ID NO: 928600 - protein, 25 aa, Mycobacterium
GSGNEMKVSSFGVENIATLGTVIGD

SEQ ID NO: 928601 - protein, 19 aa, Mycobacterium
GSGNKGDTNFGFGNIGDLN

SEQ ID NO: 928602 - protein, 20 aa, Mycobacterium
GSGPRYGFKPTVMARPLPAG

SEQ ID NO: 928603 - protein, 17 aa, Mycobacterium
GSGSAWADGKVGKGGVG

SEQ ID NO: 928604 - protein, 25 aa, Mycobacterium
GSGTPAFLLFDGRRAVVDLADSAVL

SEQ ID NO: 928605 - protein, 19 aa, Mycobacterium
GSHAAEIYAKFAADHADQD

SEQ ID NO: 928606 - protein, 19 aa, Mycobacterium
GSHAIKVTIAVYDDPEAAT

SEQ ID NO: 928607 - protein, 24 aa, Mycobacterium
GSHHAIGTLCVWDTSPREWTSGHV

SEQ ID NO: 928608 - protein, 17 aa, Mycobacterium
GSHSHGLVLSFYTPATD

SEQ ID NO: 928609 - protein, 28 aa, Mycobacterium
GSICGGNGTPCYEVEYAPIWTGPGYFGL

SEQ ID NO: 928610 - protein, 19 aa, Mycobacterium
GSIFAFPAVAAADPAPPPA

SEQ ID NO: 928611 - protein, 22 aa, Mycobacterium
GSINWNWGKGWEIGDEVPSDKF

SEQ ID NO: 928612 - protein, 24 aa, Mycobacterium
GSIPAVVKNAIDWLSRPFGDGALK

SEQ ID NO: 928613 - protein, 17 aa, Mycobacterium
GSIRRRAPLLGEHTDEV

SEQ ID NO: 928614 - protein, 22 aa, Mycobacterium
GSISALRLRLPAAADQLLTGLR

SEQ ID NO: 928615 - protein, 26 aa, Mycobacterium
GSITNRFAPVPAQVPAPMQVPAATAA

SEQ ID NO: 928616 - protein, 19 aa, Mycobacterium
GSITYNEWSFAQAQHLNMA

SEQ ID NO: 928617 - protein, 19 aa, Mycobacterium
GSITYNEWSFAQAQKLNMA

SEQ ID NO: 928618 - protein, 20 aa, Mycobacterium
GSITYNEWSFAQAQKLNMAK

SEQ ID NO: 928619 - protein, 27 aa, Mycobacterium
GSITYNEWSFAVGKQLNMASIITSAGP

SEQ ID NO: 928620 - protein, 23 aa, Mycobacterium
GSKATVADLSWLRERGLAEAIVS

SEQ ID NO: 928621 - protein, 23 aa, Mycobacterium
GSKATVADLSWLRERGLARGIVD

SEQ ID NO: 928622 - protein, 17 aa, Mycobacterium
GSKRELLEAAVAHRIDS

SEQ ID NO: 928623 - protein, 23 aa, Mycobacterium
GSKRELLEAAVAYRIDSIVAARE

SEQ ID NO: 928624 - protein, 18 aa, Mycobacterium
GSLGDGWYSFDIAGVHVI

SEQ ID NO: 928625 - protein, 17 aa, Mycobacterium
GSLLIGIGVGVAALLRL

SEQ ID NO: 928626 - protein, 20 aa, Mycobacterium
GSLMRPAPVALAYLDDEAAL

SEQ ID NO: 928627 - protein, 22 aa, Mycobacterium
GSLRAAAALAVAVAVTCSGCGS

SEQ ID NO: 928628 - protein, 20 aa, Mycobacterium
GSLRCASGISFLVDPVRANR

SEQ ID NO: 928629 - protein, 27 aa, Mycobacterium
GSLTGYRAGLLASIAASCTASFTVALA

SEQ ID NO: 928630 - protein, 19 aa, Mycobacterium
GSMHLELAAPLGEPAVGVL

SEQ ID NO: 928631 - protein, 21 aa, Mycobacterium
GSMQPYAVVYLHLMRAAAVSR

SEQ ID NO: 928632 - protein, 20 aa, Mycobacterium
GSPKIAVTVGSKLSQDDCIV

SEQ ID NO: 928633 - protein, 24 aa, Mycobacterium
GSPTINLPMPNGWQTANDSSTSYG

SEQ ID NO: 928634 - protein, 25 aa, Mycobacterium
GSQCFSERARARAGAADIVVTNHAL

SEQ ID NO: 928635 - protein, 20 aa, Mycobacterium
GSQFSLVFRDSELAPQSTVF

SEQ ID NO: 928636 - protein, 25 aa, Mycobacterium
GSRLGPARTAAICAVSPALWTSPGA

SEQ ID NO: 928637 - protein, 17 aa, Mycobacterium
GSSEGRHGPFFPQCGGV

SEQ ID NO: 928638 - protein, 19 aa, Mycobacterium
GSSEYAVRMLKGMLDSLPP

SEQ ID NO: 928639 - protein, 23 aa, Mycobacterium
GSSGGRQALAVVMTDEATPKVES

SEQ ID NO: 928640 - protein, 23 aa, Mycobacterium
GSSNRRVIWQGIGHGAAIYSPCA

SEQ ID NO: 928641 - protein, 23 aa, Mycobacterium
GSSSRRPPIPGSDAESVHYLRTY

SEQ ID NO: 928642 - protein, 25 aa, Mycobacterium
GSTAELRSATPLGDVFIAIKPPAPV

SEQ ID NO: 928643 - protein, 25 aa, Mycobacterium
GSTAELRSATPLGDVFVAIKPPTPV

SEQ ID NO: 928644 - protein, 25 aa, Mycobacterium
GSTAELRSATPLGDVFVSIKPPPSA

SEQ ID NO: 928645 - protein, 25 aa, Mycobacterium
GSTAELRSATPLGDVFVSIRPPAGA

SEQ ID NO: 928646 - protein, 25 aa, Mycobacterium
GSTAELRTATPLGDVFVALKPPAAG

SEQ ID NO: 928647 - protein, 25 aa, Mycobacterium
GSTAELRTATPLGDVFVALRPPAGA

SEQ ID NO: 928648 - protein, 24 aa, Mycobacterium
GSTDKVLPGYGWIFPLGNGEVNIG

SEQ ID NO: 928649 - protein, 17 aa, Mycobacterium
GSTDPKGLAWVAQTANN

SEQ ID NO: 928650 - protein, 24 aa, Mycobacterium
GSTDRLKPGSVIPLEQTEPSFDIG

SEQ ID NO: 928651 - protein, 23 aa, Mycobacterium
GSTEVMLSLGLADRMVGTATWTD

SEQ ID NO: 928652 - protein, 18 aa, Mycobacterium
GSTGSWLMDAYALRSREG

SEQ ID NO: 928653 - protein, 25 aa, Mycobacterium
GSTIIQFVVKTVVGMLDWGLDPQQA

SEQ ID NO: 928654 - protein, 20 aa, Mycobacterium
GSTIRCRIVIDGKVKDERTS

SEQ ID NO: 928655 - protein, 27 aa, Mycobacterium
GSTVARFASGLARHGSGTVLVGREGSA

SEQ ID NO: 928656 - protein, 33 aa, Mycobacterium
GSVEAVVLTSGYRAMPQWVKIRNIDGFTGSFWE

SEQ ID NO: 928657 - protein, 19 aa, Mycobacterium
GSVSKGYGLNNCAAQTITS

SEQ ID NO: 928658 - protein, 23 aa, Mycobacterium
GSVTSELAAGVWQGPASAAMTVA

SEQ ID NO: 928659 - protein, 19 aa, Mycobacterium
GSVVFGFNRLSIIDIEHSH

SEQ ID NO: 928660 - protein, 17 aa, Mycobacterium
GSWGPWYQAEYETAAPD

SEQ ID NO: 928661 - protein, 17 aa, Mycobacterium
GSWKDFPRKGLQIPSND

SEQ ID NO: 928662 - protein, 17 aa, Mycobacterium
GSWWRSLHAASTRRALL

SEQ ID NO: 928663 - protein, 17 aa, Mycobacterium
GSWYAGVKVSLEPEVHL

SEQ ID NO: 928664 - protein, 18 aa, Mycobacterium
GSYARIRPGAAPEVTRYF

SEQ ID NO: 928665 - protein, 17 aa, Mycobacterium
GSYAVAYPATFDFLAAA

SEQ ID NO: 928666 - protein, 20 aa, Mycobacterium
GSYDASLRVSWRQLQPTDPK

SEQ ID NO: 928667 - protein, 23 aa, Mycobacterium
GSYFWQHNWGSPKGFTHPAANLH

SEQ ID NO: 928668 - protein, 23 aa, Mycobacterium
GSYFWQHNWGSPKGYAHPAAHLH

SEQ ID NO: 928669 - protein, 24 aa, Mycobacterium
GSYFWQHNWGSPKGYAHPAAHLHQ

SEQ ID NO: 928670 - protein, 19 aa, Mycobacterium
GSYPRWALANSATGMMTGD

SEQ ID NO: 928671 - protein, 19 aa, Mycobacterium
GSYQVAFSLADTASDAIEG

SEQ ID NO: 928672 - protein, 23 aa, Mycobacterium
GSYRPRFGLYTVDALGDPALKRV

SEQ ID NO: 928673 - protein, 25 aa, Mycobacterium
GTADPAGDIDRTFAAITAGTAVAAV

SEQ ID NO: 928674 - protein, 26 aa, Mycobacterium
GTAEIPKRLAALISEHIVLDSPVQLI

SEQ ID NO: 928675 - protein, 17 aa, Mycobacterium
GTAKMGAVVDERCRVYG

SEQ ID NO: 928676 - protein, 17 aa, Mycobacterium
GTAKPAPNLKLRPLSGA

SEQ ID NO: 928677 - protein, 26 aa, Mycobacterium
GTANAAYPGVVEWYAQAQEHFTNTAK

SEQ ID NO: 928678 - protein, 25 aa, Mycobacterium
GTAPMLSAAAAWDRLANELSAAASS

SEQ ID NO: 928679 - protein, 25 aa, Mycobacterium
GTAPNRLYWLSAWIDPDGTNGGPLL

SEQ ID NO: 928680 - protein, 20 aa, Mycobacterium
GTAPRRARLADVMALSASAF

SEQ ID NO: 928681 - protein, 18 aa, Mycobacterium
GTARAARASRTRATDATG

SEQ ID NO: 928682 - protein, 22 aa, Mycobacterium
GTARLAVEQGRAALAVNWPYAL

SEQ ID NO: 928683 - protein, 23 aa, Mycobacterium
GTARPRLAPPVPSIPGRRGKPTI

SEQ ID NO: 928684 - protein, 20 aa, Mycobacterium
GTAVAYWLGQQGYSVTVVER

SEQ ID NO: 928685 - protein, 18 aa, Mycobacterium
GTAVPSVASTFFADGSID

SEQ ID NO: 928686 - protein, 17 aa, Mycobacterium
GTDCFSERARGRAAEAD

SEQ ID NO: 928687 - protein, 31 aa, Mycobacterium
GTDEVSGAIATLFCGYARDYQNLSTQLADFH

SEQ ID NO: 928688 - protein, 20 aa, Mycobacterium
GTDGFATSCINTFNQSGFVI

SEQ ID NO: 928689 - protein, 24 aa, Mycobacterium
GTDLPAKFLEGFVCRTNSTFQEKY

SEQ ID NO: 928690 - protein, 26 aa, Mycobacterium
GTDYAFRHVQPWFKNDILQAVRQEPF

SEQ ID NO: 928691 - protein, 19 aa, Mycobacterium
GTEARLADHELKKAAKNGD

SEQ ID NO: 928692 - protein, 20 aa, Mycobacterium
GTEARLADHELKKAAKNGDL

SEQ ID NO: 928693 - protein, 20 aa, Mycobacterium
GTEVPVVIDGSIWDAIAGCE

SEQ ID NO: 928694 - protein, 18 aa, Mycobacterium
GTFAGAPDIEWTRDRELL

SEQ ID NO: 928695 - protein, 24 aa, Mycobacterium
GTFDPEPFPLYVSLINSSYIKPFF

SEQ ID NO: 928696 - protein, 23 aa, Mycobacterium
GTGAFDRLAGVVMLDGVGFGDVT

SEQ ID NO: 928697 - protein, 17 aa, Mycobacterium
GTGALAFGNNNTVRANS

SEQ ID NO: 928698 - protein, 19 aa, Mycobacterium
GTGCAAPPPAYAPPPAPGV

SEQ ID NO: 928699 - protein, 18 aa, Mycobacterium
GTGEVVWDAGNSVEQLAV

SEQ ID NO: 928700 - protein, 17 aa, Mycobacterium
GTGFVELAIRAGDEVGC

SEQ ID NO: 928701 - protein, 26 aa, Mycobacterium
GTGGAGGRGGWLYGDGGAGGTGGDSI

SEQ ID NO: 928702 - protein, 27 aa, Mycobacterium
GTGGNGGRAGLFFGVGGTGGNGGATST

SEQ ID NO: 928703 - protein, 24 aa, Mycobacterium
GTGGNGSDGGWLYGDGGAGGAGGN

SEQ ID NO: 928704 - protein, 30 aa, Mycobacterium
GTGKSAMVIRCWRGSGSLTDRDATMVMTTP

SEQ ID NO: 928705 - protein, 18 aa, Mycobacterium
GTGMGWVTYHGALDGITT

SEQ ID NO: 928706 - protein, 23 aa, Mycobacterium
GTGPTARPAACCTATAEPAGRGR

SEQ ID NO: 928707 - protein, 25 aa, Mycobacterium
GTGQAGGNGGLLIGNGGAGGSGAPG

SEQ ID NO: 928708 - protein, 21 aa, Mycobacterium
GTHDWPYWGAQLQAMKPDMQS

SEQ ID NO: 928709 - protein, 21 aa, Mycobacterium
GTHDWPYWGAQLQAMKPELQS

SEQ ID NO: 928710 - protein, 20 aa, Mycobacterium
GTHGQRPSPRPGGPGHTGQA

SEQ ID NO: 928711 - protein, 28 aa, Mycobacterium
GTHRLLQTGVRWKDLGLVVVDEEQRFGV

SEQ ID NO: 928712 - protein, 17 aa, Mycobacterium
GTIAKWDDPAIKALNTS

SEQ ID NO: 928713 - protein, 17 aa, Mycobacterium
GTIGCAAALVGCSSGGH

SEQ ID NO: 928714 - protein, 36 aa, Mycobacterium
GTILPAVLALTFAREHPRIFPVAIQGVLFGIAQQSD

SEQ ID NO: 928715 - protein, 30 aa, Mycobacterium
GTILPLYSPNLWRHLTDALTALKKGDGNLM

SEQ ID NO: 928716 - protein, 24 aa, Mycobacterium
GTITFSQGLSNFWSATTASVNQFI

SEQ ID NO: 928717 - protein, 18 aa, Mycobacterium
GTITKWDDPALKAINSGL

SEQ ID NO: 928718 - protein, 21 aa, Mycobacterium
GTKADAVMKVVRDFMGPAHLR

SEQ ID NO: 928719 - protein, 23 aa, Mycobacterium
GTKATVADLAWMRRHGVADAVVA

SEQ ID NO: 928720 - protein, 22 aa, Mycobacterium
GTKPRCCAETPAATPTSATAAA

SEQ ID NO: 928721 - protein, 18 aa, Mycobacterium
GTKWNRWDHPVVPLDVPG

SEQ ID NO: 928722 - protein, 18 aa, Mycobacterium
GTLAEFFAAKGVTLEPQN

SEQ ID NO: 928723 - protein, 31 aa, Mycobacterium
GTLELGYQVGYPWSLGVGLNFNYTTPNTSIL

SEQ ID NO: 928724 - protein, 32 aa, Mycobacterium
GTLELGYQVGYPWSLGVGLNFNYTTPNTSILY

SEQ ID NO: 928725 - protein, 17 aa, Mycobacterium
GTLGRGDDQVCIQKTLD

SEQ ID NO: 928726 - protein, 17 aa, Mycobacterium
GTLHAGLDIANAVGTPI

SEQ ID NO: 928727 - protein, 19 aa, Mycobacterium
GTLLDTARTLTLVLDQHYP

SEQ ID NO: 928728 - protein, 24 aa, Mycobacterium
GTLTRTPLMSELLDKPVGPAVQPA

SEQ ID NO: 928729 - protein, 25 aa, Mycobacterium
GTLVPKSRLGLCTLVHGARILGHLP

SEQ ID NO: 928730 - protein, 18 aa, Mycobacterium
GTMKDFGPDFGLTYILDG

SEQ ID NO: 928731 - protein, 19 aa, Mycobacterium
GTMKTVKLLATSVAAFAVI

SEQ ID NO: 928732 - protein, 19 aa, Mycobacterium
GTMVVALLAGCPRLTILAT

SEQ ID NO: 928733 - protein, 17 aa, Mycobacterium
GTNIALSVRTIAATIPY

SEQ ID NO: 928734 - protein, 18 aa, Mycobacterium
GTNIRNGVQLAIDKHNAA

SEQ ID NO: 928735 - protein, 18 aa, Mycobacterium
GTPAEGVLVWSMGRSDWN

SEQ ID NO: 928736 - protein, 19 aa, Mycobacterium
GTPGKAWAWQTRSWSKGKI

SEQ ID NO: 928737 - protein, 20 aa, Mycobacterium
GTPGRRWAWQTRAWSGHRIY

SEQ ID NO: 928738 - protein, 21 aa, Mycobacterium
GTPKIAVTVGSKLSQDDCIVT

SEQ ID NO: 928739 - protein, 18 aa, Mycobacterium
GTPNRSLWSFDVNDDGTV

SEQ ID NO: 928740 - protein, 29 aa, Mycobacterium
GTPRGQRTPERWFVVWLGTANNPIDKDAA

SEQ ID NO: 928741 - protein, 18 aa, Mycobacterium
GTPVAAPVDDEWRDAVTQ

SEQ ID NO: 928742 - protein, 25 aa, Mycobacterium
GTPVLDIPIPPGWADAGADTPEWAW

SEQ ID NO: 928743 - protein, 17 aa, Mycobacterium
GTQPWRAPERIAHDDTE

SEQ ID NO: 928744 - protein, 25 aa, Mycobacterium
GTRAFTVAHDALWVIESKTGQATPV

SEQ ID NO: 928745 - protein, 17 aa, Mycobacterium
GTRGYDASVDYVANSLR

SEQ ID NO: 928746 - protein, 22 aa, Mycobacterium
GTRHLLEFPDQFGVRYPGGHAE

SEQ ID NO: 928747 - protein, 23 aa, Mycobacterium
GTRIAYTAGHCRASGTVSDKFGT

SEQ ID NO: 928748 - protein, 20 aa, Mycobacterium
GTRLHSWNRVVVPTGPPPDN

SEQ ID NO: 928749 - protein, 22 aa, Mycobacterium
GTRLPTWLSQWGFERPREDTVD

SEQ ID NO: 928750 - protein, 18 aa, Mycobacterium
GTRSSFRTGDALVATADD

SEQ ID NO: 928751 - protein, 23 aa, Mycobacterium
GTRTSYNNGLGMLFGRANGNLTF

SEQ ID NO: 928752 - protein, 27 aa, Mycobacterium
GTSIYAEYRLSASVRKAANLGSDPFVA

SEQ ID NO: 928753 - protein, 18 aa, Mycobacterium
GTSLPELVAAFTGGLNGL

SEQ ID NO: 928754 - protein, 24 aa, Mycobacterium
GTSMPALFYAKAGSLYVSDPAGTP

SEQ ID NO: 928755 - protein, 25 aa, Mycobacterium
GTSPNRLYWMSAWIDPNGEQGGPLL

SEQ ID NO: 928756 - protein, 20 aa, Mycobacterium
GTSTPPARAFVAGSDVIGPV

SEQ ID NO: 928757 - protein, 24 aa, Mycobacterium
GTTKLRPGDAIPLDRTAPALDLDA

SEQ ID NO: 928758 - protein, 24 aa, Mycobacterium
GTTKRPLAELKDRKIELAADEAFL

SEQ ID NO: 928759 - protein, 17 aa, Mycobacterium
GTTPAIWTGSPSPSGAK

SEQ ID NO: 928760 - protein, 18 aa, Mycobacterium
GTTPPVWTGSTAPATAGE

SEQ ID NO: 928761 - protein, 20 aa, Mycobacterium
GTTVRYDKLLLATGSSSRRP

SEQ ID NO: 928762 - protein, 29 aa, Mycobacterium
GTVAALNLVKCVHWPSGSPPQLPKELKVD

SEQ ID NO: 928763 - protein, 26 aa, Mycobacterium
GTVAALNLVKCVHWPSGSTTDAPKSL

SEQ ID NO: 928764 - protein, 20 aa, Mycobacterium
GTVAKWRLQATKSRVRDVQV

SEQ ID NO: 928765 - protein, 19 aa, Mycobacterium
GTVAKWRLQATKSRVRNVQ

SEQ ID NO: 928766 - protein, 17 aa, Mycobacterium
GTVATAFVGDGNTVAAS

SEQ ID NO: 928767 - protein, 19 aa, Mycobacterium
GTVATWKLQATKSRVRDVK

SEQ ID NO: 928768 - protein, 17 aa, Mycobacterium
GTVGYKAPYGRIPGLPP

SEQ ID NO: 928769 - protein, 20 aa, Mycobacterium
GTVPGYRPVIPAAKCSTTVG

SEQ ID NO: 928770 - protein, 18 aa, Mycobacterium
GTVPKEIDLHSGYSSKGA

SEQ ID NO: 928771 - protein, 18 aa, Mycobacterium
GTVPMSRAFASSCNTTFA

SEQ ID NO: 928772 - protein, 19 aa, Mycobacterium
GTVRITGWPAASVQPADHI

SEQ ID NO: 928773 - protein, 24 aa, Mycobacterium
GTVSRLPTLGSLSERTIQYEAVGP

SEQ ID NO: 928774 - protein, 23 aa, Mycobacterium
GTWKRSTKAVALFDWDNTEVKND

SEQ ID NO: 928775 - protein, 17 aa, Mycobacterium
GTWLQPRSNTFHRWLDD

SEQ ID NO: 928776 - protein, 24 aa, Mycobacterium
GTWNGTRLAAAIMRENKRGAIINM

SEQ ID NO: 928777 - protein, 22 aa, Mycobacterium
GTYTATVIGDWARTNTVYHDEP

SEQ ID NO: 928778 - protein, 20 aa, Mycobacterium
GVAAALWAGLALRHLHTGNA

SEQ ID NO: 928779 - protein, 20 aa, Mycobacterium
GVAANWQAGGGWTDGAQSLG

SEQ ID NO: 928780 - protein, 17 aa, Mycobacterium
GVADARTGWALHTAAGG

SEQ ID NO: 928781 - protein, 17 aa, Mycobacterium
GVADYAGTKAAILGYAK

SEQ ID NO: 928782 - protein, 19 aa, Mycobacterium
GVAGCAAMDGTVLVNLIET

SEQ ID NO: 928783 - protein, 20 aa, Mycobacterium
GVAGCAAMDGTVLVNLINTK

SEQ ID NO: 928784 - protein, 22 aa, Mycobacterium
GVAGRQCLTTGATVTAGPAGPT

SEQ ID NO: 928785 - protein, 25 aa, Mycobacterium
GVAICPVSAVGAGFPGAVRSFSPRW

SEQ ID NO: 928786 - protein, 18 aa, Mycobacterium
GVAKPIYINFQRPIANKQ

SEQ ID NO: 928787 - protein, 19 aa, Mycobacterium
GVANARLAYAAYEEVFGSD

SEQ ID NO: 928788 - protein, 18 aa, Mycobacterium
GVARCPFGSQCFSERARA

SEQ ID NO: 928789 - protein, 24 aa, Mycobacterium
GVASDAAGVVGWWVNPQGRGGDSC

SEQ ID NO: 928790 - protein, 21 aa, Mycobacterium
GVASDAAGVVGWWVNPQTPGM

SEQ ID NO: 928791 - protein, 26 aa, Mycobacterium
GVASGFPRTDGAVIWARSDRPAALIV

SEQ ID NO: 928792 - protein, 24 aa, Mycobacterium
GVATQNPWLARGLDPEQKSHRLAN

SEQ ID NO: 928793 - protein, 23 aa, Mycobacterium
GVATRFPGLSLPSLGITASGATP

SEQ ID NO: 928794 - protein, 25 aa, Mycobacterium
GVAVAHSPIGIDIGIGGAGGHGGSG

SEQ ID NO: 928795 - protein, 22 aa, Mycobacterium
GVAVGARLSQRLVRRRQQASTE

SEQ ID NO: 928796 - protein, 21 aa, Mycobacterium
GVAYHGVLCAWAGARGDVDRS

SEQ ID NO: 928797 - protein, 21 aa, Mycobacterium
GVDAAKLFLTHMIAHHEGAID

SEQ ID NO: 928798 - protein, 29 aa, Mycobacterium
GVDALHRLRGMFAFAIWDTEKRELFCARD

SEQ ID NO: 928799 - protein, 24 aa, Mycobacterium
GVDEVWAVGGAQAVALLAYGGTDT

SEQ ID NO: 928800 - protein, 20 aa, Mycobacterium
GVDGLRRWLLEENIGAVIDA

SEQ ID NO: 928801 - protein, 17 aa, Mycobacterium
GVDPRHVLGPAPEAVPQ

SEQ ID NO: 928802 - protein, 24 aa, Mycobacterium
GVDVELPLIVTPVGLPVHTIGKAP

SEQ ID NO: 928803 - protein, 20 aa, Mycobacterium
GVDVLAGIAVVPVRLHRYDY

SEQ ID NO: 928804 - protein, 18 aa, Mycobacterium
GVDWKGTLTGLAGYARGD

SEQ ID NO: 928805 - protein, 21 aa, Mycobacterium
GVEGMRRWLRDEGIDAVVDAT

SEQ ID NO: 928806 - protein, 18 aa, Mycobacterium
GVELNMFFGGPRRSTRVF

SEQ ID NO: 928807 - protein, 17 aa, Mycobacterium
GVENDFTVATAIGDNNG

SEQ ID NO: 928808 - protein, 22 aa, Mycobacterium
GVENTGIVSAVFGSNNSGVAAN

SEQ ID NO: 928809 - protein, 24 aa, Mycobacterium
GVEVAQRFVPLLVLGAAVVDPSVD

SEQ ID NO: 928810 - protein, 25 aa, Mycobacterium
GVFGDAVAAFPSWETLPHERLSPGV

SEQ ID NO: 928811 - protein, 24 aa, Mycobacterium
GVFTRLMRDIGFDYYWADKHSPNL

SEQ ID NO: 928812 - protein, 24 aa, Mycobacterium
GVFTTVSGTLVWSALIKQMHDLDV

SEQ ID NO: 928813 - protein, 21 aa, Mycobacterium
GVGAACLFGGLAAATAIAPAS

SEQ ID NO: 928814 - protein, 28 aa, Mycobacterium
GVGCGYWRRPALTAARFVACPYGVGQRM

SEQ ID NO: 928815 - protein, 29 aa, Mycobacterium
GVGDPIIKVFGGYGIRLGDYLDTRVFEVV

SEQ ID NO: 928816 - protein, 24 aa, Mycobacterium
GVGGFEWDPGLVQAFLRGPMHGAV

SEQ ID NO: 928817 - protein, 27 aa, Mycobacterium
GVGGGGGAGGWLFGAGGQGGTGGNGLT

SEQ ID NO: 928818 - protein, 28 aa, Mycobacterium
GVGGGGGAGGWLFGAGGQGGTGGNGLTT

SEQ ID NO: 928819 - protein, 20 aa, Mycobacterium
GVGLGGWYSPIALHVDTASV

SEQ ID NO: 928820 - protein, 24 aa, Mycobacterium
GVGNVPALPAGVSYTQVAGGAFHT

SEQ ID NO: 928821 - protein, 17 aa, Mycobacterium
GVHNSGWVQSPGAEHLG

SEQ ID NO: 928822 - protein, 23 aa, Mycobacterium
GVIDLKSRFRDTLAADFNGTDLT

SEQ ID NO: 928823 - protein, 21 aa, Mycobacterium
GVIFLLLGWQALDSSGKAVDD

SEQ ID NO: 928824 - protein, 20 aa, Mycobacterium
GVIFLLLGWQALGSSGKSDD

SEQ ID NO: 928825 - protein, 18 aa, Mycobacterium
GVIHLAFVHDFENFAGAV

SEQ ID NO: 928826 - protein, 25 aa, Mycobacterium
GVITAIPQPLRWVARSRGLRLAHAQ

SEQ ID NO: 928827 - protein, 17 aa, Mycobacterium
GVIVRAAALLTAMCVVA

SEQ ID NO: 928828 - protein, 19 aa, Mycobacterium
GVKVTGCTVHLVDAGTDTG

SEQ ID NO: 928829 - protein, 19 aa, Mycobacterium
GVLACNCYVLAERPGTDAV

SEQ ID NO: 928830 - protein, 19 aa, Mycobacterium
GVLAPALWSVVEAFVGDLW

SEQ ID NO: 928831 - protein, 26 aa, Mycobacterium
GVLAPGFHGVHIHKVGKCEPNSVAPN

SEQ ID NO: 928832 - protein, 19 aa, Mycobacterium
GVLCAVPAEAGSGGGVADP

SEQ ID NO: 928833 - protein, 28 aa, Mycobacterium
GVLDEATNRWGLRVARVELRSIDPPPSI

SEQ ID NO: 928834 - protein, 24 aa, Mycobacterium
GVLDGTPYDVEWAILAGPAANLSA

SEQ ID NO: 928835 - protein, 27 aa, Mycobacterium
GVLGPEAFDAVPFLELLSAYGAPWGLQ

SEQ ID NO: 928836 - protein, 24 aa, Mycobacterium
GVLSGVVVLALFVFVPGPVSGILK

SEQ ID NO: 928837 - protein, 20 aa, Mycobacterium
GVLVGFRMTGPAARTTITAY

SEQ ID NO: 928838 - protein, 18 aa, Mycobacterium
GVMQGCLEATSGLIMGSD

SEQ ID NO: 928839 - protein, 25 aa, Mycobacterium
GVNLMGVVHGCRFFGAQMVEHGGGH

SEQ ID NO: 928840 - protein, 18 aa, Mycobacterium
GVNTAAWYTTATIPTAIF

SEQ ID NO: 928841 - protein, 20 aa, Mycobacterium
GVPEVWPFTPAAHRAMLANT

SEQ ID NO: 928842 - protein, 17 aa, Mycobacterium
GVPGEVPQDSFGDVFLV

SEQ ID NO: 928843 - protein, 24 aa, Mycobacterium
GVPHGWGANLLMYNVNVVRDAPNS

SEQ ID NO: 928844 - protein, 27 aa, Mycobacterium
GVPLFCIHTAVGLSWPYHALGAYLDCP

SEQ ID NO: 928845 - protein, 27 aa, Mycobacterium
GVPYSLRMGIEIIDGTNAVPVYTGVTG

SEQ ID NO: 928846 - protein, 17 aa, Mycobacterium
GVQEIGRPLGIADAGVV

SEQ ID NO: 928847 - protein, 27 aa, Mycobacterium
GVQEYKSPTALVWLLGRIYCTGTPEDY

SEQ ID NO: 928848 - protein, 25 aa, Mycobacterium
GVQLLFPLPLGISMVGLEEPALTPN

SEQ ID NO: 928849 - protein, 23 aa, Mycobacterium
GVQSLPIGWQFVHIDVPSGAEAG

SEQ ID NO: 928850 - protein, 18 aa, Mycobacterium
GVRIATNTAQDWKLSAKE

SEQ ID NO: 928851 - protein, 17 aa, Mycobacterium
GVRIATNTAQDWRLSAK

SEQ ID NO: 928852 - protein, 18 aa, Mycobacterium
GVRIWHPDWDQVVSTLDA

SEQ ID NO: 928853 - protein, 18 aa, Mycobacterium
GVRNRFSTVGTWLATIAR

SEQ ID NO: 928854 - protein, 25 aa, Mycobacterium
GVRPGDPRLLIARGGTAVVARTEAP

SEQ ID NO: 928855 - protein, 19 aa, Mycobacterium
GVRRHCRAGVAVVVSTRVP

SEQ ID NO: 928856 - protein, 19 aa, Mycobacterium
GVRWEDLRRSLSGALVVRG

SEQ ID NO: 928857 - protein, 17 aa, Mycobacterium
GVSIGAVVALRWALNHP

SEQ ID NO: 928858 - protein, 24 aa, Mycobacterium
GVSISEGIFAIDVNLGGAGGDGGT

SEQ ID NO: 928859 - protein, 24 aa, Mycobacterium
GVSSSVNDMARWLMMLLGNGTHDG

SEQ ID NO: 928860 - protein, 28 aa, Mycobacterium
GVSTAGCALAFCGAGMAAAAPDVVGQPY

SEQ ID NO: 928861 - protein, 18 aa, Mycobacterium
GVSWKIYQNKLLGALNNT

SEQ ID NO: 928862 - protein, 24 aa, Mycobacterium
GVSYPAQLWPLTIFQGNLTLNESV

SEQ ID NO: 928863 - protein, 26 aa, Mycobacterium
GVTDWGRLVFCGSPRRYEPRWFRSPE

SEQ ID NO: 928864 - protein, 18 aa, Mycobacterium
GVTLKLLVNQPHVTSFRD

SEQ ID NO: 928865 - protein, 18 aa, Mycobacterium
GVTPRFVDLPDYSHSIVS

SEQ ID NO: 928866 - protein, 17 aa, Mycobacterium
GVTRAMGPMQFIPETWR

SEQ ID NO: 928867 - protein, 24 aa, Mycobacterium
GVTSYRFEDYASRRDRAVGHIRID

SEQ ID NO: 928868 - protein, 25 aa, Mycobacterium
GVTVYDMSSFITAGKEGMDAYAKDN

SEQ ID NO: 928869 - protein, 17 aa, Mycobacterium
GVTYSWDTVLRLVQMRT

SEQ ID NO: 928870 - protein, 20 aa, Mycobacterium
GVVCGTVFASAALALSSSSL

SEQ ID NO: 928871 - protein, 22 aa, Mycobacterium
GVVDFPAYPLNLLATANALAGF

SEQ ID NO: 928872 - protein, 18 aa, Mycobacterium
GVVMRPYLVDSLKGPDLA

SEQ ID NO: 928873 - protein, 17 aa, Mycobacterium
GVVPAAGLLGVLGTTPA

SEQ ID NO: 928874 - protein, 17 aa, Mycobacterium
GVVRDGRTLYTTFESKL

SEQ ID NO: 928875 - protein, 22 aa, Mycobacterium
GVVRGAIFGTHWHGVLDNDDFR

SEQ ID NO: 928876 - protein, 21 aa, Mycobacterium
GVVTPEYIVDMARKYFNPQAI

SEQ ID NO: 928877 - protein, 19 aa, Mycobacterium
GVVVAEWADQLLEVAQRVD

SEQ ID NO: 928878 - protein, 23 aa, Mycobacterium
GVYPQRFGIPDGLYAEPVAVKQG

SEQ ID NO: 928879 - protein, 19 aa, Mycobacterium
GVYSRGGGPVQRWRRGTPF

SEQ ID NO: 928880 - protein, 39 aa, Mycobacterium
GVYYLRIPSLAGIGRYTLKAELPASGGLYPTANVTYRGV

SEQ ID NO: 928881 - protein, 20 aa, Mycobacterium
GWADAGADTPEWAWSAMVST

SEQ ID NO: 928882 - protein, 25 aa, Mycobacterium
GWADFPRYLWNPVAIANAIAGIALI

SEQ ID NO: 928883 - protein, 20 aa, Mycobacterium
GWARRGVLAVGALLMTLVAL

SEQ ID NO: 928884 - protein, 17 aa, Mycobacterium
GWDIMFNYEELFVATMV

SEQ ID NO: 928885 - protein, 24 aa, Mycobacterium
GWFARNDIDLHLGVTVDHIDVDTQ

SEQ ID NO: 928886 - protein, 18 aa, Mycobacterium
GWGGLGGAVDVVIADRDD

SEQ ID NO: 928887 - protein, 22 aa, Mycobacterium
GWGKRAGKHFNGGVGEGAKGNA

SEQ ID NO: 928888 - protein, 28 aa, Mycobacterium
GWLAVACCAVLTVSGCRFDGVNSLPLPG

SEQ ID NO: 928889 - protein, 22 aa, Mycobacterium
GWLGDAFPLSSLTQIYKSDGES

SEQ ID NO: 928890 - protein, 18 aa, Mycobacterium
GWNGCGWRSHRTGRQHHR

SEQ ID NO: 928891 - protein, 25 aa, Mycobacterium
GWPGEERLLRLGLESLRLWHESGFL

SEQ ID NO: 928892 - protein, 18 aa, Mycobacterium
GWQGDFPSMIEFLAPLYG

SEQ ID NO: 928893 - protein, 26 aa, Mycobacterium
GWRIDRLPNGVFLDWQQFQATYKRNT

SEQ ID NO: 928894 - protein, 26 aa, Mycobacterium
GWRIDRLPNGVFLDWQQFQATYKRYT

SEQ ID NO: 928895 - protein, 21 aa, Mycobacterium
GWRQPELKAAGAAMATTALAS

SEQ ID NO: 928896 - protein, 24 aa, Mycobacterium
GWSTYATALLRWWDQAEAIPARFV

SEQ ID NO: 928897 - protein, 18 aa, Mycobacterium
GYAPRTAPQLVELLERRT

SEQ ID NO: 928898 - protein, 17 aa, Mycobacterium
GYDFTIFERADGFGGTW

SEQ ID NO: 928899 - protein, 19 aa, Mycobacterium
GYFMRRLAERPANLGFFLR

SEQ ID NO: 928900 - protein, 19 aa, Mycobacterium
GYGNSKWAGEVLLREAHDL

SEQ ID NO: 928901 - protein, 29 aa, Mycobacterium
GYGSRYIPFSILGVYPWPTPTDEGVDIVD

SEQ ID NO: 928902 - protein, 18 aa, Mycobacterium
GYHIPPHFRLRHDRIDAA

SEQ ID NO: 928903 - protein, 17 aa, Mycobacterium
GYHISHLDLPQITNGSS

SEQ ID NO: 928904 - protein, 25 aa, Mycobacterium
GYHLNPDTAWRVAHQACIGGIPGYI

SEQ ID NO: 928905 - protein, 23 aa, Mycobacterium
GYIGYYPGVYGLQSIWSLTPPPR

SEQ ID NO: 928906 - protein, 17 aa, Mycobacterium
GYIPVPEAFKTRLTEAV

SEQ ID NO: 928907 - protein, 19 aa, Mycobacterium
GYIQLPAMFGVGRYRVTVE

SEQ ID NO: 928908 - protein, 20 aa, Mycobacterium
GYKAWAISGDELILYMPDYP

SEQ ID NO: 928909 - protein, 18 aa, Mycobacterium
GYKAWALTPDELVIYMPD

SEQ ID NO: 928910 - protein, 18 aa, Mycobacterium
GYKAWALTPSELILYLPD

SEQ ID NO: 928911 - protein, 31 aa, Mycobacterium
GYLGKQLYIGFNFGESIIASAVFNGTDVLRG

SEQ ID NO: 928912 - protein, 27 aa, Mycobacterium
GYLQRMSTILSRRVWENAGSPEVDSDR

SEQ ID NO: 928913 - protein, 18 aa, Mycobacterium
GYLVGSFKYSLYRLQERV

SEQ ID NO: 928914 - protein, 20 aa, Mycobacterium
GYLVPLRTSTIWGGASSISH

SEQ ID NO: 928915 - protein, 19 aa, Mycobacterium
GYMRLPEMIGIGQYKVTLE

SEQ ID NO: 928916 - protein, 20 aa, Mycobacterium
GYPLGGGKMWANKATLETNL

SEQ ID NO: 928917 - protein, 19 aa, Mycobacterium
GYQHRVFALHAGQAYQFPM

SEQ ID NO: 928918 - protein, 24 aa, Mycobacterium
GYRGDMAFSALIVGGGSSEYAVRM

SEQ ID NO: 928919 - protein, 27 aa, Mycobacterium
GYRTRLRPWIYRWGATYEESVAGLPGD

SEQ ID NO: 928920 - protein, 18 aa, Mycobacterium
GYTAWLLEPYADKPDSIG

SEQ ID NO: 928921 - protein, 18 aa, Mycobacterium
GYTVPVLWSGSLSDSTLI

SEQ ID NO: 928922 - protein, 19 aa, Mycobacterium
GYTWPTDFGGVIYCQHALA

SEQ ID NO: 928923 - protein, 17 aa, Mycobacterium
GYVALTLVMLAVSACGW

SEQ ID NO: 928924 - protein, 19 aa, Mycobacterium
GYVAQHVFAPIGMQDSDFL

SEQ ID NO: 928925 - protein, 20 aa, Mycobacterium
GYVCDLNITGFFPGLNDVVP

SEQ ID NO: 928926 - protein, 24 aa, Mycobacterium
GYVHRPGMTASRFVACPFAADGSR

SEQ ID NO: 928927 - protein, 22 aa, Mycobacterium
HAAGALLCLVNLTSPPPAPPTS

SEQ ID NO: 928928 - protein, 19 aa, Mycobacterium
HAAGLPKLLVVSTTYDPAT

SEQ ID NO: 928929 - protein, 29 aa, Mycobacterium
HAAYLAGSPMTGWAVGVFRSPSGTEIVIT

SEQ ID NO: 928930 - protein, 20 aa, Mycobacterium
HADFVFRNGRVYTVAGPTEW

SEQ ID NO: 928931 - protein, 19 aa, Mycobacterium
HADGEVMVALNCDGDHATA

SEQ ID NO: 928932 - protein, 32 aa, Mycobacterium
HADHCLDLPGLFVWRRYHPMPATTRGVLYGPA

SEQ ID NO: 928933 - protein, 19 aa, Mycobacterium
HADPPCARFNTCQYMPNPY

SEQ ID NO: 928934 - protein, 19 aa, Mycobacterium
HAFAAKGRDLALCARRTDR

SEQ ID NO: 928935 - protein, 17 aa, Mycobacterium
HAFFRQYYNLRALLARV

SEQ ID NO: 928936 - protein, 18 aa, Mycobacterium
HAFGESFLTQNFPVGSVV

SEQ ID NO: 928937 - protein, 18 aa, Mycobacterium
HAGLLCDALTSAAVVLPS

SEQ ID NO: 928938 - protein, 18 aa, Mycobacterium
HAGLTCDALRSATVVLPG

SEQ ID NO: 928939 - protein, 19 aa, Mycobacterium
HAHHTLEFDSTVNYPLDRR

SEQ ID NO: 928940 - protein, 25 aa, Mycobacterium
HAIRRLAVPIVLLWLALAAITNASV

SEQ ID NO: 928941 - protein, 23 aa, Mycobacterium
HAKARGANILARIMGAAITSDGY

SEQ ID NO: 928942 - protein, 23 aa, Mycobacterium
HALESLRPCGVREVVLVGRRGPL

SEQ ID NO: 928943 - protein, 18 aa, Mycobacterium
HALVAAGRHCCFAVLNPD

SEQ ID NO: 928944 - protein, 24 aa, Mycobacterium
HAMSRLRRRAHLVVWLNPRAAAPG

SEQ ID NO: 928945 - protein, 17 aa, Mycobacterium
HANAWGLPYAAMMAGAQ

SEQ ID NO: 928946 - protein, 17 aa, Mycobacterium
HARCRLSSKHALALTNR

SEQ ID NO: 928947 - protein, 20 aa, Mycobacterium
HARSVTEFVIRHADAGSFPD

SEQ ID NO: 928948 - protein, 17 aa, Mycobacterium
HASDLAERLAVSRQAVA

SEQ ID NO: 928949 - protein, 19 aa, Mycobacterium
HASRAAVRMVNPYAFDQAG

SEQ ID NO: 928950 - protein, 20 aa, Mycobacterium
HCHNEYHLAAGMATVVSYRT

SEQ ID NO: 928951 - protein, 23 aa, Mycobacterium
HDAGKIVLRRSRPLQISLDGHDT

SEQ ID NO: 928952 - protein, 18 aa, Mycobacterium
HDALGGKSVVVFRTPDAH

SEQ ID NO: 928953 - protein, 17 aa, Mycobacterium
HDAMLTAMRLLLAHKDL

SEQ ID NO: 928954 - protein, 24 aa, Mycobacterium
HDDDPRLGVLRVYGQCRNVGDHHG

SEQ ID NO: 928955 - protein, 27 aa, Mycobacterium
HDDEVRGRLTFSWGVESAVLAPTELAE

SEQ ID NO: 928956 - protein, 22 aa, Mycobacterium
HDEARFNISRVALLVVALTQRP

SEQ ID NO: 928957 - protein, 18 aa, Mycobacterium
HDELKRLQQIVALGGAVV

SEQ ID NO: 928958 - protein, 23 aa, Mycobacterium
HDEPDERWALLPLVPLIPKPVFR

SEQ ID NO: 928959 - protein, 17 aa, Mycobacterium
HDLRYAIDPSPLYDELA

SEQ ID NO: 928960 - protein, 17 aa, Mycobacterium
HDMPTIPLWDYIAVVGW

SEQ ID NO: 928961 - protein, 17 aa, Mycobacterium
HDPRYLCDVRDICRRHD

SEQ ID NO: 928962 - protein, 22 aa, Mycobacterium
HDRFRLLTGGARTALPRQQTLR

SEQ ID NO: 928963 - protein, 23 aa, Mycobacterium
HDRGNPGLSHYFCPIPDTDLSFE

SEQ ID NO: 928964 - protein, 20 aa, Mycobacterium
HDRIDAAGVITVRYNSRLHH

SEQ ID NO: 928965 - protein, 29 aa, Mycobacterium
HDRYWKGRITIAVPLPWNGYRGAEGIRLV

SEQ ID NO: 928966 - protein, 18 aa, Mycobacterium
HDSSSPPPVFTVNGPQAP

SEQ ID NO: 928967 - protein, 21 aa, Mycobacterium
HDVDLRLGARVSSLDPDAHTV

SEQ ID NO: 928968 - protein, 17 aa, Mycobacterium
HDVLCFTNPAFANGHSS

SEQ ID NO: 928969 - protein, 18 aa, Mycobacterium
HDYRRAAFGDAWTDDNDA

SEQ ID NO: 928970 - protein, 27 aa, Mycobacterium
HDYSPEFGCLFKGIGRGIKEFAPLIGV

SEQ ID NO: 928971 - protein, 23 aa, Mycobacterium
HEAEAPPGYPAIHHLTSPLRKAA

SEQ ID NO: 928972 - protein, 17 aa, Mycobacterium
HEARRASEIDVINGAVG

SEQ ID NO: 928973 - protein, 17 aa, Mycobacterium
HEGGLPAGFGPILRLAR

SEQ ID NO: 928974 - protein, 30 aa, Mycobacterium
HEIQDAQTFARWGVDYVKYDWCGPPADVDE

SEQ ID NO: 928975 - protein, 23 aa, Mycobacterium
HELGLRAEFDSVRFTDDDIEELI

SEQ ID NO: 928976 - protein, 22 aa, Mycobacterium
HEQFPRLSLIEIVGHDGDLADE

SEQ ID NO: 928977 - protein, 21 aa, Mycobacterium
HEQTRRWLLMPRFKINQADLL

SEQ ID NO: 928978 - protein, 22 aa, Mycobacterium
HEVPGDSFWDLVRKGAEAAAQK

SEQ ID NO: 928979 - protein, 18 aa, Mycobacterium
HFDYLELELGYVYGGHND

SEQ ID NO: 928980 - protein, 18 aa, Mycobacterium
HFEWIKDDVVQWVPNRYW

SEQ ID NO: 928981 - protein, 25 aa, Mycobacterium
HFGAAMAIRTRFFDDFFLDATASGI

SEQ ID NO: 928982 - protein, 17 aa, Mycobacterium
HFQRVRLTEHWGAQVRM

SEQ ID NO: 928983 - protein, 22 aa, Mycobacterium
HFRGLRIGPTILGFSAPSAYAM

SEQ ID NO: 928984 - protein, 20 aa, Mycobacterium
HFRHPIPGPGHGPVTLLGDA

SEQ ID NO: 928985 - protein, 23 aa, Mycobacterium
HFSAEWCGPCAGVRRVVDQVCAE

SEQ ID NO: 928986 - protein, 26 aa, Mycobacterium
HFSANWCGPCAAVRRVVDQVCEELPD

SEQ ID NO: 928987 - protein, 26 aa, Mycobacterium
HFSAVWCGPCAAVRRVVDQVSADHPE

SEQ ID NO: 928988 - protein, 25 aa, Mycobacterium
HGAAGLLNLFTFGLLGSSGHRSTQD

SEQ ID NO: 928989 - protein, 23 aa, Mycobacterium
HGARVQRPLWASTGVKNPDYSDT

SEQ ID NO: 928990 - protein, 17 aa, Mycobacterium
HGASYFDLGEAWNSLSP

SEQ ID NO: 928991 - protein, 27 aa, Mycobacterium
HGEPLPWQDLRAAFTERGWLDMTHTRR

SEQ ID NO: 928992 - protein, 24 aa, Mycobacterium
HGGATTDWWAFRSACTTNGCAATG

SEQ ID NO: 928993 - protein, 27 aa, Mycobacterium
HGHLFTVLMDREWKHGVMAAVDVTLLS

SEQ ID NO: 928994 - protein, 18 aa, Mycobacterium
HGLPELRAIFGELLGIPV

SEQ ID NO: 928995 - protein, 19 aa, Mycobacterium
HGLPEPSYFAYPFSAHEGE

SEQ ID NO: 928996 - protein, 21 aa, Mycobacterium
HGLSWGFDRIFAASANHSIWF

SEQ ID NO: 928997 - protein, 20 aa, Mycobacterium
HGNHEPGWVVAPGEQGLTVG

SEQ ID NO: 928998 - protein, 24 aa, Mycobacterium
HGNSVPRFHITWGTGPALVDIFAR

SEQ ID NO: 928999 - protein, 24 aa, Mycobacterium
HGNSVPRFHITWGTGPALVEIFAR

SEQ ID NO: 929000 - protein, 21 aa, Mycobacterium
HGSELGYLFDLSRTMNPESAA

SEQ ID NO: 929001 - protein, 27 aa, Mycobacterium
HGTFTLRSDGSFTYTPVANFHGTDSFT

SEQ ID NO: 929002 - protein, 20 aa, Mycobacterium
HGVPDTYGYNAIDLSASTLD

SEQ ID NO: 929003 - protein, 24 aa, Mycobacterium
HGVVSYQLASLVAMSQDGPASETL

SEQ ID NO: 929004 - protein, 21 aa, Mycobacterium
HGVWLRPFRNLVYAMPPYICP

SEQ ID NO: 929005 - protein, 20 aa, Mycobacterium
HHAAYGSAKWALRGLTQNAA

SEQ ID NO: 929006 - protein, 17 aa, Mycobacterium
HHFDCIVFATGYDVHLT

SEQ ID NO: 929007 - protein, 17 aa, Mycobacterium
HHRLVARLVVLAAGAAV

SEQ ID NO: 929008 - protein, 26 aa, Mycobacterium
HIFRGELPLPCPFAMGHEMVGEIAEL

SEQ ID NO: 929009 - protein, 18 aa, Mycobacterium
HIHERWAVRISNNGEFIH

SEQ ID NO: 929010 - protein, 20 aa, Mycobacterium
HIKPLFVFFDSCWDPLPHPG

SEQ ID NO: 929011 - protein, 17 aa, Mycobacterium
HILANKDQFAFLGSNLP

SEQ ID NO: 929012 - protein, 24 aa, Mycobacterium
HIPLFAMYPNWGWGTDDAAHALSY

SEQ ID NO: 929013 - protein, 25 aa, Mycobacterium
HISPDQARRGDLIFYGPGGSQHVTM

SEQ ID NO: 929014 - protein, 19 aa, Mycobacterium
HITTAILMATNFFGINTVP

SEQ ID NO: 929015 - protein, 23 aa, Mycobacterium
HIVPIAALMYVPGFLNLPAEYMY

SEQ ID NO: 929016 - protein, 24 aa, Mycobacterium
HIYFLGSSEGLVFDVATSNFDVAL

SEQ ID NO: 929017 - protein, 24 aa, Mycobacterium
HKAEAFEAIRCLRNVENQRYTSIE

SEQ ID NO: 929018 - protein, 19 aa, Mycobacterium
HKLVPLRWALAAMLAGLPT

SEQ ID NO: 929019 - protein, 24 aa, Mycobacterium
HLAAATVVWCAGMRANSLTGQLPV

SEQ ID NO: 929020 - protein, 25 aa, Mycobacterium
HLAEIPRLGAPFIVAALDAAPPPHQ

SEQ ID NO: 929021 - protein, 17 aa, Mycobacterium
HLAELREGVWVRPDNLD

SEQ ID NO: 929022 - protein, 19 aa, Mycobacterium
HLALIPTFVMLRRVQLTAW

SEQ ID NO: 929023 - protein, 23 aa, Mycobacterium
HLEASGALPIVCDVFDRPSLDHH

SEQ ID NO: 929024 - protein, 23 aa, Mycobacterium
HLIEVNAGPVLKVHPNLRYATDG

SEQ ID NO: 929025 - protein, 19 aa, Mycobacterium
HLLAEALAVVAGDVPLAFA

SEQ ID NO: 929026 - protein, 19 aa, Mycobacterium
HLLAEALAVVAGEVPLAFA

SEQ ID NO: 929027 - protein, 17 aa, Mycobacterium
HLLFLGFSIAVRKRAAD

SEQ ID NO: 929028 - protein, 19 aa, Mycobacterium
HLLPGVLATLGHRAVAGRS

SEQ ID NO: 929029 - protein, 25 aa, Mycobacterium
HLPVFEWFDQSGLSLVMPVGGMASF

SEQ ID NO: 929030 - protein, 21 aa, Mycobacterium
HLTELELQWGRTIGQLPSPYT

SEQ ID NO: 929031 - protein, 20 aa, Mycobacterium
HLVARQATFHAMFAALTELV

SEQ ID NO: 929032 - protein, 17 aa, Mycobacterium
HLVGGAVLFPGTGFVEL

SEQ ID NO: 929033 - protein, 22 aa, Mycobacterium
HMRADVTVGSFLSGGIDSTAIA

SEQ ID NO: 929034 - protein, 26 aa, Mycobacterium
HMRPGQRLKQAWLRELAQWQPDLVIN

SEQ ID NO: 929035 - protein, 20 aa, Mycobacterium
HMRYISGLRINGAATDQTYL

SEQ ID NO: 929036 - protein, 19 aa, Mycobacterium
HMTPGQRRKQAWLRELAGW

SEQ ID NO: 929037 - protein, 23 aa, Mycobacterium
HNALRELSQVAGRLGDSRNDIFS

SEQ ID NO: 929038 - protein, 24 aa, Mycobacterium
HNAVRVAFWGAEELGLIGSRNYVQ

SEQ ID NO: 929039 - protein, 24 aa, Mycobacterium
HNEASGIHYGRFISLTDILGNIAA

SEQ ID NO: 929040 - protein, 24 aa, Mycobacterium
HNIVGASITLEWSVDDFTISRFAD

SEQ ID NO: 929041 - protein, 25 aa, Mycobacterium
HNIYWVEQDGAWKLSNPSACVIARD

SEQ ID NO: 929042 - protein, 24 aa, Mycobacterium
HNKGLRFEFYANLDTAYADLLSGN

SEQ ID NO: 929043 - protein, 20 aa, Mycobacterium
HNRVRMIVASFLVKDLHLPW

SEQ ID NO: 929044 - protein, 18 aa, Mycobacterium
HPAPMLNAGGSWYEMNNG

SEQ ID NO: 929045 - protein, 25 aa, Mycobacterium
HPAVPDPRIGALFLGGGPVHTCTGT

SEQ ID NO: 929046 - protein, 17 aa, Mycobacterium
HPDENYASTVFDSDGYL

SEQ ID NO: 929047 - protein, 17 aa, Mycobacterium
HPDIKVRTLLSGPGALQ

SEQ ID NO: 929048 - protein, 17 aa, Mycobacterium
HPDMYPTGTVDVVDTSW

SEQ ID NO: 929049 - protein, 24 aa, Mycobacterium
HPEAVREVLAWMGSRRGNEFVGRR

SEQ ID NO: 929050 - protein, 20 aa, Mycobacterium
HPEFSGKTALLLAGSVTGDG

SEQ ID NO: 929051 - protein, 25 aa, Mycobacterium
HPELSRGGTCGMCIAASDRIYKVGE

SEQ ID NO: 929052 - protein, 31 aa, Mycobacterium; identical to SEQ ID NO: 98354

SEQ ID NO: 929053 - protein, 17 aa, Mycobacterium
HPFFGAFLSGGVNLQVS

SEQ ID NO: 929054 - protein, 21 aa, Mycobacterium
HPFLFDLQNLRGHGTGVGCSN

SEQ ID NO: 929055 - protein, 26 aa, Mycobacterium
HPGCPAKACLHWGAMWGPASDAHYVD

SEQ ID NO: 929056 - protein, 20 aa, Mycobacterium
HPGDGRWIEITSEYPEDLAH

SEQ ID NO: 929057 - protein, 17 aa, Mycobacterium
HPIGRFAARQSLTGPTL

SEQ ID NO: 929058 - protein, 19 aa, Mycobacterium
HPISTSWARSGHAGHQAGT

SEQ ID NO: 929059 - protein, 24 aa, Mycobacterium
HPLVDRDRILGGFHTPADGLAKAL

SEQ ID NO: 929060 - protein, 24 aa, Mycobacterium
HPMGPFRLLDIVGMDIHQQVATRL

SEQ ID NO: 929061 - protein, 18 aa, Mycobacterium
HPNAIPLVLTRRTVSASS

SEQ ID NO: 929062 - protein, 24 aa, Mycobacterium
HPPDAASRLLALVVGTGGDATRIR

SEQ ID NO: 929063 - protein, 21 aa, Mycobacterium
HPRCAVVIDIEDIYTLKPGAG

SEQ ID NO: 929064 - protein, 25 aa, Mycobacterium
HPRVVRCTQIEWYRTIQIGDQASGV

SEQ ID NO: 929065 - protein, 27 aa, Mycobacterium
HPTELLRRARLYVGRPGEAFAEFCKVS

SEQ ID NO: 929066 - protein, 25 aa, Mycobacterium
HPVDNAWHTWRMTWQPTGLYFWKDY

SEQ ID NO: 929067 - protein, 23 aa, Mycobacterium
HPVRPAPMGLFRTAGRGNRLLRD

SEQ ID NO: 929068 - protein, 18 aa, Mycobacterium
HQATRQWLATSPMSTGQA

SEQ ID NO: 929069 - protein, 17 aa, Mycobacterium
HQDGRKSPDCYVVPSDL

SEQ ID NO: 929070 - protein, 23 aa, Mycobacterium
HQDSVLCTLGYVDPGTRIAYTAG

SEQ ID NO: 929071 - protein, 28 aa, Mycobacterium
HQIVLWCMGEAHAGVVLDALANRYGVTV

SEQ ID NO: 929072 - protein, 17 aa, Mycobacterium
HQLCFALYSASRAMTAV

SEQ ID NO: 929073 - protein, 19 aa, Mycobacterium
HQLRVPTYIIVGAHDAQTP

SEQ ID NO: 929074 - protein, 18 aa, Mycobacterium
HQPAFAFLGAEGKAEVVK

SEQ ID NO: 929075 - protein, 32 aa, Mycobacterium
HQPGAYTYILGFWMRPRRVLDAAGTGAMTNTD

SEQ ID NO: 929076 - protein, 29 aa, Mycobacterium
HQPGTYPFVFDRWLPDKVYSGAYKAWALT

SEQ ID NO: 929077 - protein, 21 aa, Mycobacterium
HQQGIELAKLVSARSGNQQLT

SEQ ID NO: 929078 - protein, 17 aa, Mycobacterium
HQRCGAVTAAVKSLEQH

SEQ ID NO: 929079 - protein, 21 aa, Mycobacterium
HQVRILPPFLSRKHLPSRLAR

SEQ ID NO: 929080 - protein, 19 aa, Mycobacterium
HQWRYNTLFRSQDRNLADG

SEQ ID NO: 929081 - protein, 18 aa, Mycobacterium
HRAAQYWVMKPTYHNSFW

SEQ ID NO: 929082 - protein, 29 aa, Mycobacterium
HRAASPAVWLNPWRWYAVPHAAAGALTVD

SEQ ID NO: 929083 - protein, 18 aa, Mycobacterium
HRAPANSEELHWIPESGE

SEQ ID NO: 929084 - protein, 23 aa, Mycobacterium
HRAVIPRDHVKTVLDSADVIIWT

SEQ ID NO: 929085 - protein, 18 aa, Mycobacterium
HRDGCPIEPIATEAVHAS

SEQ ID NO: 929086 - protein, 23 aa, Mycobacterium
HRGVPFDLSLMIFGDSTAAGYGC

SEQ ID NO: 929087 - protein, 21 aa, Mycobacterium
HRPRPELVVGSGADPEAKLLA

SEQ ID NO: 929088 - protein, 21 aa, Mycobacterium
HRRAEQRSEPGARCHRPAMTP

SEQ ID NO: 929089 - protein, 23 aa, Mycobacterium
HRRAGTPTSIRRSVVTGATTAAL

SEQ ID NO: 929090 - protein, 18 aa, Mycobacterium
HRRGRIVIVGASLAGLRA

SEQ ID NO: 929091 - protein, 17 aa, Mycobacterium
HRSAIDLAHAMMDKVSA

SEQ ID NO: 929092 - protein, 17 aa, Mycobacterium
HRSAIRMSEELEVYGCA

SEQ ID NO: 929093 - protein, 18 aa, Mycobacterium
HRSIPLQSVYCGAKHAVN

SEQ ID NO: 929094 - protein, 17 aa, Mycobacterium
HRSSAFLGFTNQYAAAN

SEQ ID NO: 929095 - protein, 18 aa, Mycobacterium
HRSSGFVGFTSHYAAANY

SEQ ID NO: 929096 - protein, 24 aa, Mycobacterium
HRVDAAPLPWSFEIVTTLPSMSAN

SEQ ID NO: 929097 - protein, 19 aa, Mycobacterium
HRVGIRLPGHYNVANCLVA

SEQ ID NO: 929098 - protein, 20 aa, Mycobacterium
HRVWGRRPYAYLGITVPGFP

SEQ ID NO: 929099 - protein, 25 aa, Mycobacterium
HSAFYPLPDMAFRDMAAFGRHPVGN

SEQ ID NO: 929100 - protein, 18 aa, Mycobacterium
HSAGDWFIRVFAQRIEEC

SEQ ID NO: 929101 - protein, 24 aa, Mycobacterium
HSANLRFAAPSAFQNRPSGLRGLR

SEQ ID NO: 929102 - protein, 19 aa, Mycobacterium
HSEDLLKVMLREPDELGDL

SEQ ID NO: 929103 - protein, 18 aa, Mycobacterium
HSFVDAWNYGALSTNAQL

SEQ ID NO: 929104 - protein, 19 aa, Mycobacterium
HSGSIPGYQTLAIYSPAEQ

SEQ ID NO: 929105 - protein, 28 aa, Mycobacterium
HSGWGAGHGALFTRAPWVVSVDDHVDPV

SEQ ID NO: 929106 - protein, 17 aa, Mycobacterium
HSIRNGYSDGLRNSLSN

SEQ ID NO: 929107 - protein, 21 aa, Mycobacterium
HSKKRSGLRAQSGRLRDSGDA

SEQ ID NO: 929108 - protein, 22 aa, Mycobacterium
HSLELRYLFDVGGAPPLNPRQQ

SEQ ID NO: 929109 - protein, 18 aa, Mycobacterium
HSLPGAKPTDVIKHVDTP

SEQ ID NO: 929110 - protein, 25 aa, Mycobacterium
HSNGLKIVSCYQYGKGNTADWLGGA

SEQ ID NO: 929111 - protein, 17 aa, Mycobacterium
HSSDIFGTVKSLATIVS

SEQ ID NO: 929112 - protein, 24 aa, Mycobacterium
HTAATRAAGLWRFTAGAVDQPNPV

SEQ ID NO: 929113 - protein, 19 aa, Mycobacterium
HTADWAHKATLEFLASLGK

SEQ ID NO: 929114 - protein, 22 aa, Mycobacterium
HTEWAQWGSLRGLRVFPTSAGR

SEQ ID NO: 929115 - protein, 24 aa, Mycobacterium
HTFNYLDLVNYLAVGNLNPSPLGY

SEQ ID NO: 929116 - protein, 25 aa, Mycobacterium
HTFNYLDLVRYLAVNNLNPSPLGYV

SEQ ID NO: 929117 - protein, 20 aa, Mycobacterium
HTFTAPGTFEYVCSIHPMMR

SEQ ID NO: 929118 - protein, 28 aa, Mycobacterium
HTGGFNRDTWGVAMIGNFDDVAPTPLQI

SEQ ID NO: 929119 - protein, 28 aa, Mycobacterium
HTGGFNRDTWGVAMIGNFDDVAPTPLQL

SEQ ID NO: 929120 - protein, 28 aa, Mycobacterium
HTGGFNRNTWGVSMIGNFDDVPPTPIQL

SEQ ID NO: 929121 - protein, 21 aa, Mycobacterium
HTGSALVCLVSLTNPPPAPAT

SEQ ID NO: 929122 - protein, 22 aa, Mycobacterium
HTIGRPGVVIAPVVTIEDLDSP

SEQ ID NO: 929123 - protein, 24 aa, Mycobacterium
HTKRLASPAQRIMLYAKDRGCTKP

SEQ ID NO: 929124 - protein, 17 aa, Mycobacterium
HTLARRHLRVIAADIAQ

SEQ ID NO: 929125 - protein, 22 aa, Mycobacterium
HTLDVMAMDVVWTAEFAEAGWT

SEQ ID NO: 929126 - protein, 19 aa, Mycobacterium
HTPGTYPFTVDRWTPDNVF

SEQ ID NO: 929127 - protein, 24 aa, Mycobacterium
HTQGKVPVLVWIHGGAFIAGNGVD

SEQ ID NO: 929128 - protein, 27 aa, Mycobacterium
HTRSLCANFRDGSGLYKGNKVLLLGVE

SEQ ID NO: 929129 - protein, 19 aa, Mycobacterium
HTVAGLPAGAVVGADGVYL

SEQ ID NO: 929130 - protein, 19 aa, Mycobacterium
HVAAYDAIHAWDTTSAVEG

SEQ ID NO: 929131 - protein, 20 aa, Mycobacterium
HVAQTLALAARFQTALDGTL

SEQ ID NO: 929132 - protein, 19 aa, Mycobacterium
HVGGPLPLDPVLPAPAPAP

SEQ ID NO: 929133 - protein, 34 aa, Mycobacterium
HVHPTMSAEGRWSIPWAWNAAGTYRVFADFVPEG

SEQ ID NO: 929134 - protein, 20 aa, Mycobacterium
HVLAIEGARNGIAVNAIAPI

SEQ ID NO: 929135 - protein, 21 aa, Mycobacterium
HVNLRFVNFLERLSASGTYDS

SEQ ID NO: 929136 - protein, 21 aa, Mycobacterium
HVPHLSYAVLRQWDQAAIAQA

SEQ ID NO: 929137 - protein, 26 aa, Mycobacterium
HVRVYLPFGTQWYGYFMRRLAERPAN

SEQ ID NO: 929138 - protein, 25 aa, Mycobacterium
HVSFPFRIGFTRVYGLFAQAGLTDR

SEQ ID NO: 929139 - protein, 21 aa, Mycobacterium
HVTSFRDVLAPAWQEATGGTL

SEQ ID NO: 929140 - protein, 21 aa, Mycobacterium
HWARVVWSRTAVQLAAEARRR

SEQ ID NO: 929141 - protein, 25 aa, Mycobacterium
HWCPGEFWNPIWGFNMNWGECHADG

SEQ ID NO: 929142 - protein, 25 aa, Mycobacterium
HWCPGEFWNPIWGFNWEFGECHDDW

SEQ ID NO: 929143 - protein, 21 aa, Mycobacterium
HWLIANGRQFGLCQIYANEIW

SEQ ID NO: 929144 - protein, 19 aa, Mycobacterium
HWRTREYYPAGTTVNVDAR

SEQ ID NO: 929145 - protein, 20 aa, Mycobacterium
HYLPEVDLWTGAIVGAEALV

SEQ ID NO: 929146 - protein, 24 aa, Mycobacterium
HYPTARLVVFLLRGNFDPADVARR

SEQ ID NO: 929147 - protein, 27 aa, Mycobacterium
HYSNCSPGSRLPAQLSELTSANSSISY

SEQ ID NO: 929148 - protein, 26 aa, Mycobacterium
HYTAPPAMTDLRFGGAEPGHVVAHDE

SEQ ID NO: 929149 - protein, 18 aa, Mycobacterium
HYYNHWFPNAVIDGWIDL

SEQ ID NO: 929150 - protein, 20 aa, Mycobacterium
IAAACGYDAVYVDLEHTSTS

SEQ ID NO: 929151 - protein, 18 aa, Mycobacterium
IAAARWPERTAIVDDDGA

SEQ ID NO: 929152 - protein, 20 aa, Mycobacterium
IAAAYSWLPTLDDLRKTGKD

SEQ ID NO: 929153 - protein, 22 aa, Mycobacterium
IAADDFWYLWHQMVSQPGVVDP

SEQ ID NO: 929154 - protein, 23 aa, Mycobacterium
IAADDYWYLWRQMVSQPGVVDPA

SEQ ID NO: 929155 - protein, 23 aa, Mycobacterium
IAADGGCARDCAHEFVAAAVAAF

SEQ ID NO: 929156 - protein, 17 aa, Mycobacterium
IAAERSIEFSAPKVPAG

SEQ ID NO: 929157 - protein, 18 aa, Mycobacterium
IAAFAQMRIVMSTKNDDP

SEQ ID NO: 929158 - protein, 23 aa, Mycobacterium
IAAQKPDLILAIYETIDQQTYDR

SEQ ID NO: 929159 - protein, 18 aa, Mycobacterium
IAAQLGGQGLEGVAVDGD

SEQ ID NO: 929160 - protein, 29 aa, Mycobacterium
IAATEAHYGEMWAQDALAMYGYAASSAAA

SEQ ID NO: 929161 - protein, 25 aa, Mycobacterium
IAATEARYGEMWAQDASAMYGYAAS

SEQ ID NO: 929162 - protein, 17 aa, Mycobacterium
IACESYGKKVGTSYLEP

SEQ ID NO: 929163 - protein, 23 aa, Mycobacterium
IADARGVLQLTGLGTPEERWVEV

SEQ ID NO: 929164 - protein, 21 aa, Mycobacterium
IADATLAWMLRHDKVLQPADW

SEQ ID NO: 929165 - protein, 17 aa, Mycobacterium
IADAVLFMVTRDRRVAV

SEQ ID NO: 929166 - protein, 25 aa, Mycobacterium
IADFPDRPDNMFALANTLLGLATGH

SEQ ID NO: 929167 - protein, 25 aa, Mycobacterium
IADWPDRPDNLFALANAIAGLATGH

SEQ ID NO: 929168 - protein, 18 aa, Mycobacterium
IAEAVACEVKDKASASFG

SEQ ID NO: 929169 - protein, 23 aa, Mycobacterium
IAEFNKAWGQVCGGKNLSYNPTG

SEQ ID NO: 929170 - protein, 21 aa, Mycobacterium
IAEPAAWFTYYYWLDDTRAPE

SEQ ID NO: 929171 - protein, 21 aa, Mycobacterium
IAEQLMPHWLLSLQDAARRRG

SEQ ID NO: 929172 - protein, 22 aa, Mycobacterium
IAEQLMPRWLVSLHADARRRGV

SEQ ID NO: 929173 - protein, 25 aa, Mycobacterium
IAESYWNWPEPLLTDEGWLDTRDRV

SEQ ID NO: 929174 - protein, 23 aa, Mycobacterium
IAEVVEAWTGIPAGRMLEGETAK

SEQ ID NO: 929175 - protein, 17 aa, Mycobacterium
IAFGLVNVPVKVYSATQ

SEQ ID NO: 929176 - protein, 23 aa, Mycobacterium
IAFSPVVRTGWDAVLQETKNAGI

SEQ ID NO: 929177 - protein, 24 aa, Mycobacterium
IAGAFSRPGLPVEYLQVPSPAMGR

SEQ ID NO: 929178 - protein, 22 aa, Mycobacterium
IAGASITLEWAIDDFTISRFAQ

SEQ ID NO: 929179 - protein, 25 aa, Mycobacterium
IAGDPLRRRTWAVWPATSRRRDVGE

SEQ ID NO: 929180 - protein, 19 aa, Mycobacterium
IAGIEYLKRLYDMYQAGGL

SEQ ID NO: 929181 - protein, 18 aa, Mycobacterium
IAGMAAARAAMAAGGGQS

SEQ ID NO: 929182 - protein, 19 aa, Mycobacterium
IAGNETIDGIATVKVTGTI

SEQ ID NO: 929183 - protein, 21 aa, Mycobacterium
IAGPVLAYWLSRHGFGVTVVE

SEQ ID NO: 929184 - protein, 21 aa, Mycobacterium
IAGTCPDLGVITAIPQPLRSL

SEQ ID NO: 929185 - protein, 25 aa, Mycobacterium
IAHADAPLVYPGMRINQGTQSCTLG

SEQ ID NO: 929186 - protein, 22 aa, Mycobacterium
IAKRWDGWANWENWPNITRESG

SEQ ID NO: 929187 - protein, 18 aa, Mycobacterium
IALCVAMCGSNDTTTTSP

SEQ ID NO: 929188 - protein, 17 aa, Mycobacterium
IALEAYAYAARVAEVEN

SEQ ID NO: 929189 - protein, 25 aa, Mycobacterium
IALGAKGEDGFFFAESSAGRSATGV

SEQ ID NO: 929190 - protein, 19 aa, Mycobacterium
IALITWGIVALFTGGQGGS

SEQ ID NO: 929191 - protein, 17 aa, Mycobacterium
IALLLPACVSRQQAAGP

SEQ ID NO: 929192 - protein, 21 aa, Mycobacterium
IALVYHLADVPALVVSSDALA

SEQ ID NO: 929193 - protein, 22 aa, Mycobacterium
IAMTPPPGWQYRDAGGDRAQLR

SEQ ID NO: 929194 - protein, 19 aa, Mycobacterium
IANALKGFELVGKDASEVD

SEQ ID NO: 929195 - protein, 19 aa, Mycobacterium
IANYLDWLSRCGSYRVTNY

SEQ ID NO: 929196 - protein, 18 aa, Mycobacterium
IAPDAPFVVETTLNDPTQ

SEQ ID NO: 929197 - protein, 19 aa, Mycobacterium
IAPDIRRARTSTVSLHDTT

SEQ ID NO: 929198 - protein, 17 aa, Mycobacterium
IAPGGSISIGFQAELTG

SEQ ID NO: 929199 - protein, 17 aa, Mycobacterium
IAPLQLFGHCLGAVVAF

SEQ ID NO: 929200 - protein, 25 aa, Mycobacterium
IAPNAAAYRVLWYVASPTNISGATI

SEQ ID NO: 929201 - protein, 17 aa, Mycobacterium
IAPNGPMDRMLRPGGVV

SEQ ID NO: 929202 - protein, 24 aa, Mycobacterium
IAPWSDCVEVYWAPDARVNAEAYV

SEQ ID NO: 929203 - protein, 20 aa, Mycobacterium
IAPYLRSWESVIGHQRTGVY

SEQ ID NO: 929204 - protein, 25 aa, Mycobacterium
IAQLAEAFLKAGRCTAEATNAFDQA

SEQ ID NO: 929205 - protein, 21 aa, Mycobacterium
IAQQMLSFMASAAGGAGSLFQ

SEQ ID NO: 929206 - protein, 21 aa, Mycobacterium
IARAWRVAGGGSRRLDSRPPF

SEQ ID NO: 929207 - protein, 21 aa, Mycobacterium
IARGAAPLPLPAGVADNVAAV

SEQ ID NO: 929208 - protein, 20 aa, Mycobacterium
IARVIKRSAVGSLVSFTVLS

SEQ ID NO: 929209 - protein, 19 aa, Mycobacterium
IARVWRTAGLASRRIDQRV

SEQ ID NO: 929210 - protein, 17 aa, Mycobacterium
IASAIVYMVTRPAHAAV

SEQ ID NO: 929211 - protein, 23 aa, Mycobacterium
IASNSVYLEPGWVAEQSAPYGTP

SEQ ID NO: 929212 - protein, 17 aa, Mycobacterium
IASPLFDGFDNLYIGQP

SEQ ID NO: 929213 - protein, 24 aa, Mycobacterium
IASPNSRLGHRIWQTNVLGSYHVA

SEQ ID NO: 929214 - protein, 24 aa, Mycobacterium
IASTLAQRDWRVVVTDVNGEAARS

SEQ ID NO: 929215 - protein, 17 aa, Mycobacterium
IASVATVLFGGNNTVSA

SEQ ID NO: 929216 - protein, 28 aa, Mycobacterium
IATETVGTWPVRLMKQVLSAGWRATAAR

SEQ ID NO: 929217 - protein, 24 aa, Mycobacterium
IATFPDLPALLATPLGAAGSPSLL

SEQ ID NO: 929218 - protein, 35 aa, Mycobacterium
IATLEKARLAALYPYGEGPDVSFILTANGNRPNGG

SEQ ID NO: 929219 - protein, 28 aa, Mycobacterium
IATMAGWRTDFLNQMGLVVSDAIKPYAA

SEQ ID NO: 929220 - protein, 25 aa, Mycobacterium
IATMQGWLTQWGVPASSGHEGHDMG

SEQ ID NO: 929221 - protein, 18 aa, Mycobacterium
IATPELRANLDAWLARFA

SEQ ID NO: 929222 - protein, 18 aa, Mycobacterium
IATPRGDLNLGRAPASAA

SEQ ID NO: 929223 - protein, 23 aa, Mycobacterium
IAVLLCSACSASQVINTGGDTKC

SEQ ID NO: 929224 - protein, 25 aa, Mycobacterium
IAVLQLRGAGGLPTAAIGGGVSIGE

SEQ ID NO: 929225 - protein, 34 aa, Mycobacterium
IAVTDWFGAEPFGVWPWARPQLGAAQPVVLSLAD

SEQ ID NO: 929226 - protein, 33 aa, Mycobacterium
IAVTNWFGDQPFAVWPWAQPKLGRAQPVVLNLD

SEQ ID NO: 929227 - protein, 34 aa, Mycobacterium
IAVTRWFGDQPFAVWPWAQPKLGAAQPVVLSLDD

SEQ ID NO: 929228 - protein, 17 aa, Mycobacterium
IAVVDNFRDVVYKNDRA

SEQ ID NO: 929229 - protein, 17 aa, Mycobacterium
IAYPTARQANTFYDASV

SEQ ID NO: 929230 - protein, 17 aa, Mycobacterium
ICADSPLLVAHAARVLL

SEQ ID NO: 929231 - protein, 18 aa, Mycobacterium
ICALVDALSAPGPVVHLG

SEQ ID NO: 929232 - protein, 24 aa, Mycobacterium
ICASIDFGSASARSPVLLPGPPPV

SEQ ID NO: 929233 - protein, 19 aa, Mycobacterium
ICCTVRAWVAQGLAAMLMS

SEQ ID NO: 929234 - protein, 22 aa, Mycobacterium
ICDAAGRAGVWVTVDAENHTTT

SEQ ID NO: 929235 - protein, 17 aa, Mycobacterium
ICDAELVSSLVAESDAV

SEQ ID NO: 929236 - protein, 20 aa, Mycobacterium
ICDTASRILTSFTPAIPERT

SEQ ID NO: 929237 - protein, 24 aa, Mycobacterium
ICGLPVSVFRSDMILTHRRYSGQL

SEQ ID NO: 929238 - protein, 26 aa, Mycobacterium
ICLAEAGWPVRVWADTMPKRTTSAVA

SEQ ID NO: 929239 - protein, 18 aa, Mycobacterium
ICPMLAQPGGSFAGAASS

SEQ ID NO: 929240 - protein, 18 aa, Mycobacterium
IDAAHLWHPYSTIGAEAL

SEQ ID NO: 929241 - protein, 24 aa, Mycobacterium
IDAALRPLVDRAYDPGPAHNPVAM

SEQ ID NO: 929242 - protein, 17 aa, Mycobacterium
IDAAREAARLAARGDSA

SEQ ID NO: 929243 - protein, 22 aa, Mycobacterium
IDAFPRGAGRALAIMHALDGAL

SEQ ID NO: 929244 - protein, 18 aa, Mycobacterium
IDAGCRGATLVVCDVPRR

SEQ ID NO: 929245 - protein, 18 aa, Mycobacterium
IDAGGRWRPLAAGRAEVP

SEQ ID NO: 929246 - protein, 20 aa, Mycobacterium
IDALDIAAVRPFWQAITDYV

SEQ ID NO: 929247 - protein, 18 aa, Mycobacterium
IDALDPLIAYSAESWQVI

SEQ ID NO: 929248 - protein, 23 aa, Mycobacterium
IDALRPMMRLVVTNGTAKEIAGC

SEQ ID NO: 929249 - protein, 18 aa, Mycobacterium
IDALTAFLRHNGQLEAAA

SEQ ID NO: 929250 - protein, 19 aa, Mycobacterium
IDALVGFDLVGAAYAVLNI

SEQ ID NO: 929251 - protein, 23 aa, Mycobacterium
IDAPRLWPDLPVRPVKGEVLRLR

SEQ ID NO: 929252 - protein, 17 aa, Mycobacterium
IDARSAGPIQPPLGHTI

SEQ ID NO: 929253 - protein, 18 aa, Mycobacterium
IDCDTVVFTGDWIPDHEL

SEQ ID NO: 929254 - protein, 23 aa, Mycobacterium
IDCSDASRLARFYADLTGGTVTG

SEQ ID NO: 929255 - protein, 17 aa, Mycobacterium
IDDDGWVTYACRADDTE

SEQ ID NO: 929256 - protein, 18 aa, Mycobacterium
IDDVGVKMDTIWWDRPFK

SEQ ID NO: 929257 - protein, 21 aa, Mycobacterium
IDEGPLPLSRLARLAHMDAGM

SEQ ID NO: 929258 - protein, 23 aa, Mycobacterium
IDERARPFAWRPGSDPSVADVVG

SEQ ID NO: 929259 - protein, 22 aa, Mycobacterium
IDESRFPLVRAGLEILRNTARD

SEQ ID NO: 929260 - protein, 27 aa, Mycobacterium
IDGFAEALPRWLGGGTDGDRYVNSSED

SEQ ID NO: 929261 - protein, 25 aa, Mycobacterium
IDGGTRLGPGGAYLQPALDRPNLHL

SEQ ID NO: 929262 - protein, 19 aa, Mycobacterium
IDGNYHWQGTVLDPLPRDT

SEQ ID NO: 929263 - protein, 21 aa, Mycobacterium
IDGQAGAPVAIFVKDPSDAVV

SEQ ID NO: 929264 - protein, 21 aa, Mycobacterium
IDGWIDLDFDGIKSADEIRPD

SEQ ID NO: 929265 - protein, 25 aa, Mycobacterium
IDGYPQRFGIPDGLYAEPVAVKQGW

SEQ ID NO: 929266 - protein, 17 aa, Mycobacterium
IDGYRVLTDPVWSDRCS

SEQ ID NO: 929267 - protein, 19 aa, Mycobacterium
IDGYRVLTDPVWSDRCSPS

SEQ ID NO: 929268 - protein, 26 aa, Mycobacterium
IDHRIDAIVPTIAWNSLAHSLFPNGA

SEQ ID NO: 929269 - protein, 19 aa, Mycobacterium
IDHYAEIGFGGFAALVDAL

SEQ ID NO: 929270 - protein, 21 aa, Mycobacterium
IDHYAEIGFNGFASVVDAIGG

SEQ ID NO: 929271 - protein, 19 aa, Mycobacterium
IDIFGSYPNYSPLAFDSVL

SEQ ID NO: 929272 - protein, 17 aa, Mycobacterium
IDIGDKWTTYRNVWYQE

SEQ ID NO: 929273 - protein, 18 aa, Mycobacterium
IDIGKNGQINLGFGNSGT

SEQ ID NO: 929274 - protein, 23 aa, Mycobacterium
IDIPEPGLGVSYTGVAAGELGTI

SEQ ID NO: 929275 - protein, 20 aa, Mycobacterium
IDIVAGVPLAGISFGNELPA

SEQ ID NO: 929276 - protein, 20 aa, Mycobacterium
IDIVAGVPLAGISFGSPLPA

SEQ ID NO: 929277 - protein, 17 aa, Mycobacterium
IDKARPTPLTVTVGSNP

SEQ ID NO: 929278 - protein, 25 aa, Mycobacterium
IDLDGPRVLVKFTVAKNIRLGDRTE

SEQ ID NO: 929279 - protein, 17 aa, Mycobacterium
IDLGQDFLALVDYAHKP

SEQ ID NO: 929280 - protein, 17 aa, Mycobacterium
IDLSRTAIPVEWDEVKE

SEQ ID NO: 929281 - protein, 20 aa, Mycobacterium
IDLSRTVGWFTTKYPVAITV

SEQ ID NO: 929282 - protein, 17 aa, Mycobacterium
IDLTDVFVVLEKEGVEK

SEQ ID NO: 929283 - protein, 17 aa, Mycobacterium
IDLTFTNWRGVLAPPGI

SEQ ID NO: 929284 - protein, 19 aa, Mycobacterium
IDLVNSLSFGDQIKDITAP

SEQ ID NO: 929285 - protein, 26 aa, Mycobacterium
IDLVPEYIGNLLLYFAPDSEATTLDV

SEQ ID NO: 929286 - protein, 25 aa, Mycobacterium
IDLVPEYIGNLLLYFAPESTATLLD

SEQ ID NO: 929287 - protein, 25 aa, Mycobacterium
IDLVPEYIGNLLLYFDPHATVTLLD

SEQ ID NO: 929288 - protein, 31 aa, Mycobacterium
IDPENFWRSAGLPEFRWPDPNGTRLPNGAPP

SEQ ID NO: 929289 - protein, 19 aa, Mycobacterium
IDPIAERWFVGRPDLIGAD

SEQ ID NO: 929290 - protein, 23 aa, Mycobacterium
IDPRLRTLAIRPALRRLAGLPTA

SEQ ID NO: 929291 - protein, 21 aa, Mycobacterium
IDPRVRPWRGEWVTLVVTSVG

SEQ ID NO: 929292 - protein, 17 aa, Mycobacterium
IDPSLSMLSPLTDYPLV

SEQ ID NO: 929293 - protein, 17 aa, Mycobacterium
IDQRAAAANAMRPDVIV

SEQ ID NO: 929294 - protein, 22 aa, Mycobacterium
IDRGGLLAHLFGTVAVLDPDDQ

SEQ ID NO: 929295 - protein, 22 aa, Mycobacterium
IDRGRQLAVLTCGQSPDPKGPA

SEQ ID NO: 929296 - protein, 18 aa, Mycobacterium
IDRLRGVFGSDPIFTATG

SEQ ID NO: 929297 - protein, 24 aa, Mycobacterium
IDSRGRYPGRYRVKVLENLSRECS

SEQ ID NO: 929298 - protein, 17 aa, Mycobacterium
IDTAFRAGWIGDYPSMI

SEQ ID NO: 929299 - protein, 25 aa, Mycobacterium
IDTAYPGRFLLGIGAGHREHTVEYR

SEQ ID NO: 929300 - protein, 29 aa, Mycobacterium
IDTELRWARLCGLNSVRVFLHDQLWAQDN

SEQ ID NO: 929301 - protein, 23 aa, Mycobacterium
IDTELWRRWVQRTADEQGVDFTT

SEQ ID NO: 929302 - protein, 18 aa, Mycobacterium
IDTFTGWLKQWNQPLMPE

SEQ ID NO: 929303 - protein, 17 aa, Mycobacterium
IDTKFGYNNAVGAGTGI

SEQ ID NO: 929304 - protein, 23 aa, Mycobacterium
IDTRRRIAYSAGHCATTQTVTDQ

SEQ ID NO: 929305 - protein, 18 aa, Mycobacterium
IDTVHGFFDKSVRLGKLD

SEQ ID NO: 929306 - protein, 19 aa, Mycobacterium
IDVEERWTQILGRRRLAEL

SEQ ID NO: 929307 - protein, 17 aa, Mycobacterium
IDVTAPFSVTQTQVHTL

SEQ ID NO: 929308 - protein, 17 aa, Mycobacterium
IDVTRQYDGWADFPRYL

SEQ ID NO: 929309 - protein, 19 aa, Mycobacterium
IDWFNRAVAPAVDHPLIPD

SEQ ID NO: 929310 - protein, 17 aa, Mycobacterium
IDYCRSHDISVQREDAY

SEQ ID NO: 929311 - protein, 22 aa, Mycobacterium
IDYGGGVLQLPKVVANVPVGSR

SEQ ID NO: 929312 - protein, 17 aa, Mycobacterium
IDYLVALGAPFALTAVQ

SEQ ID NO: 929313 - protein, 23 aa, Mycobacterium
IEADAPKVVWAIDFQFDSTVDDK

SEQ ID NO: 929314 - protein, 25 aa, Mycobacterium
IEADIVVCAAGFWGAQLAKQVGLVL

SEQ ID NO: 929315 - protein, 19 aa, Mycobacterium
IEADLGKPVKLEVRNFHRA

SEQ ID NO: 929316 - protein, 22 aa, Mycobacterium
IEAFPGEALAVFADDDALAAFG

SEQ ID NO: 929317 - protein, 20 aa, Mycobacterium
IEALGVEFHQGYGMTETGGN

SEQ ID NO: 929318 - protein, 17 aa, Mycobacterium
IEARLAQMGAPGAIVSL

SEQ ID NO: 929319 - protein, 24 aa, Mycobacterium
IEAYRAATQMARIRAARGMKVAQT

SEQ ID NO: 929320 - protein, 26 aa, Mycobacterium
IEDKRFTSHNGVDWKGTLGGLAGYAS

SEQ ID NO: 929321 - protein, 24 aa, Mycobacterium
IEDLKFALELGADMIAMSFVRAPE

SEQ ID NO: 929322 - protein, 23 aa, Mycobacterium
IEHELDCIVFATGFDVCKAGTPF

SEQ ID NO: 929323 - protein, 17 aa, Mycobacterium
IEHPEIGFTRLAVGDSL

SEQ ID NO: 929324 - protein, 26 aa, Mycobacterium
IEHSAAVFRRWIDLIADKLVAVGVVR

SEQ ID NO: 929325 - protein, 19 aa, Mycobacterium
IEHVSRQALLEVAQRDGQV

SEQ ID NO: 929326 - protein, 18 aa, Mycobacterium
IEISRRRLANSLSPDPHM

SEQ ID NO: 929327 - protein, 19 aa, Mycobacterium
IEKFIPRQITNVLTGRRPK

SEQ ID NO: 929328 - protein, 24 aa, Mycobacterium
IEKRREVFIYPKARNLSFRSLEIL

SEQ ID NO: 929329 - protein, 17 aa, Mycobacterium
IELAHAIDALSKEVSEV

SEQ ID NO: 929330 - protein, 18 aa, Mycobacterium
IELRNWVATLTLDLEPNI

SEQ ID NO: 929331 - protein, 27 aa, Mycobacterium
IELSPPYRGGPELRDGDTIGLSRTRTP

SEQ ID NO: 929332 - protein, 23 aa, Mycobacterium
IELTPPYRGGPVLQSHDTIGLTR

SEQ ID NO: 929333 - protein, 18 aa, Mycobacterium
IENAPLPWSFTIVTTLPS

SEQ ID NO: 929334 - protein, 19 aa, Mycobacterium
IENAPLPWSFTIVTTLPSM

SEQ ID NO: 929335 - protein, 17 aa, Mycobacterium
IEPMLTLGTGRTVVLDD

SEQ ID NO: 929336 - protein, 17 aa, Mycobacterium
IEPMLTLGTRKTLILDD

SEQ ID NO: 929337 - protein, 25 aa, Mycobacterium
IEPRPSDVKIEMTLDRGVKVPADAK

SEQ ID NO: 929338 - protein, 24 aa, Mycobacterium
IEQFVYAYVRACPGYTLDYDANGS

SEQ ID NO: 929339 - protein, 20 aa, Mycobacterium
IERYRAATMMARVRAAKGMK

SEQ ID NO: 929340 - protein, 19 aa, Mycobacterium
IERYVRPTLAGKMIGSLGV

SEQ ID NO: 929341 - protein, 27 aa, Mycobacterium
IESGRLHINLRFVDFLDKYSASGTYDT

SEQ ID NO: 929342 - protein, 19 aa, Mycobacterium
IESKTGQATPVYVPADNNF

SEQ ID NO: 929343 - protein, 25 aa, Mycobacterium
IETNVEFWAAVILDFAEVPPTMMPA

SEQ ID NO: 929344 - protein, 27 aa, Mycobacterium
IETRFGVPVPNISAWRNGLVGDMTSTF

SEQ ID NO: 929345 - protein, 17 aa, Mycobacterium
IEVDPRLAGDTDKTIAQ

SEQ ID NO: 929346 - protein, 18 aa, Mycobacterium
IEVETRYAGSGELAAQLI

SEQ ID NO: 929347 - protein, 21 aa, Mycobacterium
IFADLRFGERKQYTAQFSDIS

SEQ ID NO: 929348 - protein, 28 aa, Mycobacterium
IFAEPQCPPCGRLQRDYGDEIAEYVGEG

SEQ ID NO: 929349 - protein, 27 aa, Mycobacterium
IFEHRCPACGDPVRWRLVDEAAAVRPR

SEQ ID NO: 929350 - protein, 18 aa, Mycobacterium
IFFLLGVTDHEALRWIDG

SEQ ID NO: 929351 - protein, 18 aa, Mycobacterium
IFGPAGTKGEVNYLDDKA

SEQ ID NO: 929352 - protein, 18 aa, Mycobacterium
IFHGLEPGELVSIVDIQL

SEQ ID NO: 929353 - protein, 21 aa, Mycobacterium
IFLDIPRFVESAFHGLGATAD

SEQ ID NO: 929354 - protein, 18 aa, Mycobacterium
IFPTTLANFGNIYEPANG

SEQ ID NO: 929355 - protein, 20 aa, Mycobacterium
IFRPDSRLAVTIPTVDPHRG

SEQ ID NO: 929356 - protein, 21 aa, Mycobacterium
IFTGRCAVMAAGPLANVSWPD

SEQ ID NO: 929357 - protein, 18 aa, Mycobacterium
IFWNRSGGDPIVTRVAAR

SEQ ID NO: 929358 - protein, 19 aa, Mycobacterium
IFYCSVRLKVNGPAGSDIL

SEQ ID NO: 929359 - protein, 26 aa, Mycobacterium
IFYRKELFAGIGPYNLRYRLWADWDF

SEQ ID NO: 929360 - protein, 24 aa, Mycobacterium
IFYRRELFSSIGPYNLRYRSLADW

SEQ ID NO: 929361 - protein, 23 aa, Mycobacterium
IGADDFWYLWRQMVSQPGAVDPA

SEQ ID NO: 929362 - protein, 17 aa, Mycobacterium
IGADRTRIIAVLDDLQE

SEQ ID NO: 929363 - protein, 30 aa, Mycobacterium
IGAGAKAFNGILNLAVAFADNVQATAGPGN

SEQ ID NO: 929364 - protein, 28 aa, Mycobacterium
IGAKAGGLPGDLTFSWYAVDKTRQPWVV

SEQ ID NO: 929365 - protein, 28 aa, Mycobacterium
IGAKAGGLPGDLTFSWYAVDKTRQPYVV

SEQ ID NO: 929366 - protein, 19 aa, Mycobacterium
IGAKPYWRPPYAKHNAAVD

SEQ ID NO: 929367 - protein, 22 aa, Mycobacterium
IGAKSWPLVLATRLGISSKEAR

SEQ ID NO: 929368 - protein, 18 aa, Mycobacterium
IGALKLILTQPFDIDAVP

SEQ ID NO: 929369 - protein, 21 aa, Mycobacterium
IGATDLCEFVEFPSQLLQVCG

SEQ ID NO: 929370 - protein, 20 aa, Mycobacterium
IGAVVALRWALNHPNAAVAV

SEQ ID NO: 929371 - protein, 18 aa, Mycobacterium
IGAWCARHDLAEIQDKAD

SEQ ID NO: 929372 - protein, 19 aa, Mycobacterium
IGCRVTVNGIVREEKSANG

SEQ ID NO: 929373 - protein, 23 aa, Mycobacterium
IGDKGSAEVTVFGLENIATVATS

SEQ ID NO: 929374 - protein, 21 aa, Mycobacterium
IGEVSLRRAIRRSPHSERLFC

SEQ ID NO: 929375 - protein, 25 aa, Mycobacterium
IGFFATRTRFGLWFRNIAMRTMNIG

SEQ ID NO: 929376 - protein, 17 aa, Mycobacterium
IGFRPAGSITLVRTPAE

SEQ ID NO: 929377 - protein, 23 aa, Mycobacterium
IGGAIPQCRIVGCVAQGVNSQDV

SEQ ID NO: 929378 - protein, 24 aa, Mycobacterium
IGGEARVGEPIVALGNAGGQGGTP

SEQ ID NO: 929379 - protein, 18 aa, Mycobacterium
IGGIPGYIGLELAAQGVV

SEQ ID NO: 929380 - protein, 18 aa, Mycobacterium
IGGLAVALGVGAAVVAGA

SEQ ID NO: 929381 - protein, 20 aa, Mycobacterium
IGGLNAGIGNMGFGNAGDNN

SEQ ID NO: 929382 - protein, 21 aa, Mycobacterium
IGGSFGQYGGVWAHDETRKSF

SEQ ID NO: 929383 - protein, 21 aa, Mycobacterium
IGGWHTDLWEAHQIVTDALSG

SEQ ID NO: 929384 - protein, 28 aa, Mycobacterium
IGHAGKIVFRQAFGWRKLPDEPGLNGSP

SEQ ID NO: 929385 - protein, 19 aa, Mycobacterium
IGHAPRPLAPGALAGLLLD

SEQ ID NO: 929386 - protein, 17 aa, Mycobacterium
IGHGAAIYSPCALPPVL

SEQ ID NO: 929387 - protein, 24 aa, Mycobacterium
IGKGWPLGEGKPWANKATLETNLV

SEQ ID NO: 929388 - protein, 18 aa, Mycobacterium
IGLAAAAIPQPAHIVIVV

SEQ ID NO: 929389 - protein, 17 aa, Mycobacterium
IGLALLGAPMVVPTVAT

SEQ ID NO: 929390 - protein, 18 aa, Mycobacterium
IGLAMLAAPMIAAAIASA

SEQ ID NO: 929391 - protein, 18 aa, Mycobacterium
IGLAMMVSPMAAVPGLAA

SEQ ID NO: 929392 - protein, 20 aa, Mycobacterium
IGLIPTRYYVRMRVADKPGV

SEQ ID NO: 929393 - protein, 24 aa, Mycobacterium
IGLLTMRLGRDWPHGPGPALADPE

SEQ ID NO: 929394 - protein, 20 aa, Mycobacterium
IGLPEVFNDPDLASFNGATT

SEQ ID NO: 929395 - protein, 26 aa, Mycobacterium
IGLSAAGGWFYWARVQARGEQAARAV

SEQ ID NO: 929396 - protein, 17 aa, Mycobacterium
IGLSFLGGVGIAYPPQV

SEQ ID NO: 929397 - protein, 23 aa, Mycobacterium
IGLSLFVVFAIGVTTLVYGTLRR

SEQ ID NO: 929398 - protein, 17 aa, Mycobacterium
IGLVMMAAPMAAAPGIA

SEQ ID NO: 929399 - protein, 19 aa, Mycobacterium
IGNATLFWMIRNSKVRQPA

SEQ ID NO: 929400 - protein, 17 aa, Mycobacterium
IGPGVTWLGFDARSVAV

SEQ ID NO: 929401 - protein, 18 aa, Mycobacterium
IGPVAAFLASRRNSYMTG

SEQ ID NO: 929402 - protein, 24 aa, Mycobacterium
IGQFDPREAISHGFVESQKLPAWR

SEQ ID NO: 929403 - protein, 21 aa, Mycobacterium
IGQPVDLRLPSAGVAVASNGN

SEQ ID NO: 929404 - protein, 17 aa, Mycobacterium
IGRSGTPGKAWAWQTRS

SEQ ID NO: 929405 - protein, 23 aa, Mycobacterium
IGRTAGSLVVICLDRSGHFEYHG

SEQ ID NO: 929406 - protein, 22 aa, Mycobacterium
IGRVGGLAVALGIGAAIAAASP

SEQ ID NO: 929407 - protein, 17 aa, Mycobacterium
IGSLVINPGGPGESGVE

SEQ ID NO: 929408 - protein, 19 aa, Mycobacterium
IGTGLAQRGAHVALLARRY

SEQ ID NO: 929409 - protein, 17 aa, Mycobacterium
IGTNCLADGSNIIATAL

SEQ ID NO: 929410 - protein, 18 aa, Mycobacterium
IGTVKGHDDSAVALGDFK

SEQ ID NO: 929411 - protein, 20 aa, Mycobacterium
IGTYAVKYPATWDFAQVAVG

SEQ ID NO: 929412 - protein, 19 aa, Mycobacterium
IGVACADAGVAVGDLGAIV

SEQ ID NO: 929413 - protein, 17 aa, Mycobacterium
IGVDAMLPAAHRTGAQP

SEQ ID NO: 929414 - protein, 17 aa, Mycobacterium
IGVGQSFTSVPMLMAKP

SEQ ID NO: 929415 - protein, 18 aa, Mycobacterium
IGVRRPLSRLGMGLHRRH

SEQ ID NO: 929416 - protein, 18 aa, Mycobacterium
IGWSDGRQRIVIDHITRI

SEQ ID NO: 929417 - protein, 17 aa, Mycobacterium
IGWYDTFTMHLDANVRP

SEQ ID NO: 929418 - protein, 18 aa, Mycobacterium
IGYELLPALSKEQLERGV

SEQ ID NO: 929419 - protein, 26 aa, Mycobacterium
IGYHSALRFGIEHGKRNMVQPDYSST

SEQ ID NO: 929420 - protein, 19 aa, Mycobacterium
IHERGRLIVGLDIGSNLFS

SEQ ID NO: 929421 - protein, 18 aa, Mycobacterium
IHGSRAIQGYALLSRLAE

SEQ ID NO: 929422 - protein, 18 aa, Mycobacterium
IHLDNMLALSRMGAHIVP

SEQ ID NO: 929423 - protein, 17 aa, Mycobacterium
IHLVTLLEALPMQETAE

SEQ ID NO: 929424 - protein, 18 aa, Mycobacterium
IHLVTLLEALPMQETLEA

SEQ ID NO: 929425 - protein, 17 aa, Mycobacterium
IHNRHALAVLDSLRDAL

SEQ ID NO: 929426 - protein, 19 aa, Mycobacterium
IHQREFMSGLLHRAASPAV

SEQ ID NO: 929427 - protein, 17 aa, Mycobacterium
IHVETMLANPAYRAVAH

SEQ ID NO: 929428 - protein, 17 aa, Mycobacterium
IHVLPLVGDIIHPVIGF

SEQ ID NO: 929429 - protein, 18 aa, Mycobacterium
IHWWVWRVGAVNTVAVAF

SEQ ID NO: 929430 - protein, 17 aa, Mycobacterium
IIDKALETIPDALAVIN

SEQ ID NO: 929431 - protein, 20 aa, Mycobacterium
IIGAPLPWAIEVETDSPAMV

SEQ ID NO: 929432 - protein, 19 aa, Mycobacterium
IILNCAFAAAGFATASDGN

SEQ ID NO: 929433 - protein, 34 aa, Mycobacterium
IIPELVKRAEFVKVFQRTPCWVLPRLDVATPPAV

SEQ ID NO: 929434 - protein, 23 aa, Mycobacterium
IIRSDTDLAFVLYRTQLFGPRDL

SEQ ID NO: 929435 - protein, 17 aa, Mycobacterium
IISHGRLELGIGAGWNE

SEQ ID NO: 929436 - protein, 18 aa, Mycobacterium
IITLWLGLVAHFGEMANG

SEQ ID NO: 929437 - protein, 23 aa, Mycobacterium
IIVSVVTWADCLVALQQRQADAV

SEQ ID NO: 929438 - protein, 17 aa, Mycobacterium
IKAEVAAAIGTGAPAAT

SEQ ID NO: 929439 - protein, 22 aa, Mycobacterium
IKAGRPTPELLAYQYLQTLPQM

SEQ ID NO: 929440 - protein, 17 aa, Mycobacterium
IKAGRPTPEMLAYQYLQ

SEQ ID NO: 929441 - protein, 21 aa, Mycobacterium
IKALELSGANNLLFRRNSQTG

SEQ ID NO: 929442 - protein, 18 aa, Mycobacterium
IKATTVFGGKYVSLTTPK

SEQ ID NO: 929443 - protein, 19 aa, Mycobacterium
IKDANAVAAAWNDVALDPD

SEQ ID NO: 929444 - protein, 17 aa, Mycobacterium
IKDANTIAAAWNDVVLS

SEQ ID NO: 929445 - protein, 18 aa, Mycobacterium
IKDTIQVFADPGAATDAL

SEQ ID NO: 929446 - protein, 17 aa, Mycobacterium
IKGALDALSRALRLSSD

SEQ ID NO: 929447 - protein, 21 aa, Mycobacterium
IKIDGCVGQSFLRSYAVMTSS

SEQ ID NO: 929448 - protein, 26 aa, Mycobacterium
IKKQFKGANPWVMISNFHIKIDGCVG

SEQ ID NO: 929449 - protein, 19 aa, Mycobacterium
IKLAERDPCEILREYPGKA

SEQ ID NO: 929450 - protein, 19 aa, Mycobacterium
IKLSQAFSALGDHSTDIFS

SEQ ID NO: 929451 - protein, 25 aa, Mycobacterium
IKLSQAFSALGDRSTDIFSTIKNLA

SEQ ID NO: 929452 - protein, 17 aa, Mycobacterium
IKNLPGYDGEGSEGTAD

SEQ ID NO: 929453 - protein, 19 aa, Mycobacterium
IKNPVEWDKPYNMGRYVTD

SEQ ID NO: 929454 - protein, 20 aa, Mycobacterium
IKNRVVWPTLMAARNGWSVS

SEQ ID NO: 929455 - protein, 18 aa, Mycobacterium
IKPGSSNPTPGTWTPPST

SEQ ID NO: 929456 - protein, 18 aa, Mycobacterium
IKPLFVLFDSCWDPHPRL

SEQ ID NO: 929457 - protein, 26 aa, Mycobacterium
IKRGAARLGTPYSWGGGKPTGPSLGV

SEQ ID NO: 929458 - protein, 26 aa, Mycobacterium
IKRGMSQMGVPYSWGGGNAAGPSRGI

SEQ ID NO: 929459 - protein, 17 aa, Mycobacterium
IKSAVSVAGHTVIEKDA

SEQ ID NO: 929460 - protein, 22 aa, Mycobacterium
IKTPEELAAFLAADGATGQHLV

SEQ ID NO: 929461 - protein, 18 aa, Mycobacterium
IKVPLLRDAASLTDGSVP

SEQ ID NO: 929462 - protein, 17 aa, Mycobacterium
IKVQGSRQVELLRTQLT

SEQ ID NO: 929463 - protein, 17 aa, Mycobacterium
IKVSIFAAAMLLVSAAL

SEQ ID NO: 929464 - protein, 19 aa, Mycobacterium
IKVTYRQGGDTELGNQLIA

SEQ ID NO: 929465 - protein, 20 aa, Mycobacterium
IKYSLWRLQERVVGQGPAAQ

SEQ ID NO: 929466 - protein, 21 aa, Mycobacterium
IKYVLWRLQERVVGRGPQTPM

SEQ ID NO: 929467 - protein, 17 aa, Mycobacterium
ILAAGGFIFNREWVQAH

SEQ ID NO: 929468 - protein, 19 aa, Mycobacterium
ILAAGRYLAANGFANDRDR

SEQ ID NO: 929469 - protein, 21 aa, Mycobacterium
ILADAACQFIRSATVSEVLMG

SEQ ID NO: 929470 - protein, 17 aa, Mycobacterium
ILALWAAVAGAFVSVLY

SEQ ID NO: 929471 - protein, 23 aa, Mycobacterium
ILANRLTPGTVRYGARVSNVRDG

SEQ ID NO: 929472 - protein, 26 aa, Mycobacterium
ILASLSVSAVLGWHLFAAHHANVAAE

SEQ ID NO: 929473 - protein, 17 aa, Mycobacterium
ILAYLGHVADRFDLRRH

SEQ ID NO: 929474 - protein, 19 aa, Mycobacterium
ILDDRAWQAAQRVFETGQD

SEQ ID NO: 929475 - protein, 18 aa, Mycobacterium
ILDNRRGALVDSVGSTAF

SEQ ID NO: 929476 - protein, 18 aa, Mycobacterium
ILDTCRELGIGITAYGVL

SEQ ID NO: 929477 - protein, 17 aa, Mycobacterium
ILFRDMPVVPLWDNIAV

SEQ ID NO: 929478 - protein, 22 aa, Mycobacterium
ILFYNAELFDRYKVEPPTTWDE

SEQ ID NO: 929479 - protein, 19 aa, Mycobacterium
ILGELPIGGALGDALIGVV

SEQ ID NO: 929480 - protein, 21 aa, Mycobacterium
ILGGAFPGYGIYECADGHVAL

SEQ ID NO: 929481 - protein, 19 aa, Mycobacterium
ILGLLDIDLLAAVGAGSDN

SEQ ID NO: 929482 - protein, 20 aa, Mycobacterium
ILGNPKSRRLLVAVSAIVAV

SEQ ID NO: 929483 - protein, 19 aa, Mycobacterium
ILGPPGTTGVVNWMDAESL

SEQ ID NO: 929484 - protein, 27 aa, Mycobacterium
ILGRLPLWPFLRFQRRFDAPTEEPVSI

SEQ ID NO: 929485 - protein, 28 aa, Mycobacterium
ILIRGGDPYLRRPGCAAPAKFSVAELVQ

SEQ ID NO: 929486 - protein, 32 aa, Mycobacterium
ILKNPALEAVRFTARYAPKLVHRGRGAARSVI

SEQ ID NO: 929487 - protein, 26 aa, Mycobacterium
ILLFTEGRALATLQFDGPTDTLAPPD

SEQ ID NO: 929488 - protein, 17 aa, Mycobacterium
ILLGAGGALVFAALGSS

SEQ ID NO: 929489 - protein, 28 aa, Mycobacterium
ILLRDMPAVPLWYYIAVVGWSPQVSGVK

SEQ ID NO: 929490 - protein, 21 aa, Mycobacterium
ILMQVCGGPGDSGAPVTVNNM

SEQ ID NO: 929491 - protein, 23 aa, Mycobacterium
ILPAQALPGDLIFYGPNGSQSVT

SEQ ID NO: 929492 - protein, 22 aa, Mycobacterium
ILPSGGAPYVVWPKTKKDYDAA

SEQ ID NO: 929493 - protein, 22 aa, Mycobacterium
ILPSGGAPYVVWPRTKSDYDSA

SEQ ID NO: 929494 - protein, 29 aa, Mycobacterium
ILRNPALEAVRFSARYAPKLVHRTRGAAR

SEQ ID NO: 929495 - protein, 17 aa, Mycobacterium
ILTQPFDIDAVPKIFRG

SEQ ID NO: 929496 - protein, 17 aa, Mycobacterium
ILTQPFDIDTVPKIFRG

SEQ ID NO: 929497 - protein, 17 aa, Mycobacterium
ILTRYLNLVAFGNGAFG

SEQ ID NO: 929498 - protein, 23 aa, Mycobacterium
ILVCTTCAVAMTACSSSVNNNAD

SEQ ID NO: 929499 - protein, 20 aa, Mycobacterium
ILVDGDLATVRLVWTLTVRD

SEQ ID NO: 929500 - protein, 25 aa, Mycobacterium
ILVVAVLVLIGFVMGYNRIRSADVR

SEQ ID NO: 929501 - protein, 20 aa, Mycobacterium
IMALLLVLVGQSFRGAFDPK

SEQ ID NO: 929502 - protein, 18 aa, Mycobacterium
IMAYAMANAARFGLQDVI

SEQ ID NO: 929503 - protein, 25 aa, Mycobacterium
IMIRLPLLRRACTVAATVCVLAGCG

SEQ ID NO: 929504 - protein, 19 aa, Mycobacterium
IMKPTDWNNRWWITCMVAF

SEQ ID NO: 929505 - protein, 22 aa, Mycobacterium
IMKRRNIGAYTWGFVAGKTQTF

SEQ ID NO: 929506 - protein, 19 aa, Mycobacterium
IMRNCAYTQMGVWSENSLD

SEQ ID NO: 929507 - protein, 22 aa, Mycobacterium
IMSVVTWADCLVALQQRQVDAV

SEQ ID NO: 929508 - protein, 17 aa, Mycobacterium
IMVFGYMRLPEMIGIGQ

SEQ ID NO: 929509 - protein, 26 aa, Mycobacterium
IMVPEKHLPLVMPLKYVGIDEDTLNK

SEQ ID NO: 929510 - protein, 33 aa, Mycobacterium
INAAFCPLDNSFAWDRGQLFPFLRKQMGDMAMN

SEQ ID NO: 929511 - protein, 17 aa, Mycobacterium
INAGNYRGSMSVTDALA

SEQ ID NO: 929512 - protein, 23 aa, Mycobacterium
INAKAASKRVMWQGIGHGAIVYT

SEQ ID NO: 929513 - protein, 25 aa, Mycobacterium
INAPPPCLTGFLPASQWRSPADTRT

SEQ ID NO: 929514 - protein, 29 aa, Mycobacterium
INAPTQALLARPLIGDGSNGAPGTGQAGG

SEQ ID NO: 929515 - protein, 17 aa, Mycobacterium
INDALIRLVERATPSKL

SEQ ID NO: 929516 - protein, 19 aa, Mycobacterium
INELGWRPERSLDDGLRAL

SEQ ID NO: 929517 - protein, 23 aa, Mycobacterium
INELKSNGYRVIVTKVGSEHPSQ

SEQ ID NO: 929518 - protein, 18 aa, Mycobacterium
INEPLAFGAMEVRTGAIK

SEQ ID NO: 929519 - protein, 17 aa, Mycobacterium
INFFYYLFEPMVQSGLF

SEQ ID NO: 929520 - protein, 19 aa, Mycobacterium
INFPPAARHLAFEVFSRSF

SEQ ID NO: 929521 - protein, 17 aa, Mycobacterium
INFQRPIANRQMAQDAV

SEQ ID NO: 929522 - protein, 17 aa, Mycobacterium
INFTPGVMQWYMDGGTV

SEQ ID NO: 929523 - protein, 18 aa, Mycobacterium
INGNTTWHGTNGDPGTPG

SEQ ID NO: 929524 - protein, 23 aa, Mycobacterium
INNFPGAAVPFGMVQYSPDTTDN

SEQ ID NO: 929525 - protein, 28 aa, Mycobacterium
INPKATWSNGRPVTWEDLAAQINATSGK

SEQ ID NO: 929526 - protein, 22 aa, Mycobacterium
INPRRSPVFAGVIWVQQGTQPL

SEQ ID NO: 929527 - protein, 24 aa, Mycobacterium
INSNRYDPLVPWTAANQLGRDWCA

SEQ ID NO: 929528 - protein, 17 aa, Mycobacterium
INSRGQVAVTLQENNGI

SEQ ID NO: 929529 - protein, 18 aa, Mycobacterium
INTGNGFYGGVQFDQNTW

SEQ ID NO: 929530 - protein, 26 aa, Mycobacterium
INTGNGFYGGVQFDYGTWLAHGGGKY

SEQ ID NO: 929531 - protein, 24 aa, Mycobacterium
INYLGPVRLLLGLVPAMRDNGSGH

SEQ ID NO: 929532 - protein, 21 aa, Mycobacterium
IPAAGAEDVHRWWTSLTPQQR

SEQ ID NO: 929533 - protein, 17 aa, Mycobacterium
IPAGGLFSGAEGKMSAD

SEQ ID NO: 929534 - protein, 19 aa, Mycobacterium
IPAGVFVPRSVRVLATDPL

SEQ ID NO: 929535 - protein, 17 aa, Mycobacterium
IPALAGQPPGVIVLVTG

SEQ ID NO: 929536 - protein, 17 aa, Mycobacterium
IPALSGEPPGVIVLVAG

SEQ ID NO: 929537 - protein, 18 aa, Mycobacterium
IPDGEWFNGNMFGGAPLD

SEQ ID NO: 929538 - protein, 23 aa, Mycobacterium
IPDHPTVSMRIMLASNDSGPNNP

SEQ ID NO: 929539 - protein, 25 aa, Mycobacterium
IPEEHLPLVLPFKYLGVDKDTLNKL

SEQ ID NO: 929540 - protein, 25 aa, Mycobacterium
IPEEHLPLVLPFKYLGVPKDTLMEL

SEQ ID NO: 929541 - protein, 19 aa, Mycobacterium
IPEGARLQLDPQLDLDSMD

SEQ ID NO: 929542 - protein, 20 aa, Mycobacterium
IPEKGIRAGSSFRTTVTYTF

SEQ ID NO: 929543 - protein, 21 aa, Mycobacterium
IPELVKTAARVKVFQRTPGWV

SEQ ID NO: 929544 - protein, 21 aa, Mycobacterium
IPETLPLPDGRIWRNEISEAK

SEQ ID NO: 929545 - protein, 18 aa, Mycobacterium
IPGGSGLPGGLDVGGSAL

SEQ ID NO: 929546 - protein, 19 aa, Mycobacterium
IPGLSGLNIPGLGGGGLGS

SEQ ID NO: 929547 - protein, 18 aa, Mycobacterium
IPGSDSWSLHAYGRAIDV

SEQ ID NO: 929548 - protein, 20 aa, Mycobacterium
IPHRDCGSFAAGGFGSADAY

SEQ ID NO: 929549 - protein, 19 aa, Mycobacterium
IPIPDEFKSRLSTAVNAIA

SEQ ID NO: 929550 - protein, 18 aa, Mycobacterium
IPIQCEYYALEGVSQLMR

SEQ ID NO: 929551 - protein, 25 aa, Mycobacterium
IPLIGDILHPVFGFPIDHNAPPGTP

SEQ ID NO: 929552 - protein, 19 aa, Mycobacterium
IPLPGGGALMKLPGEGDLL

SEQ ID NO: 929553 - protein, 22 aa, Mycobacterium
IPLPPDQNGYVFIETKSGQTRC

SEQ ID NO: 929554 - protein, 17 aa, Mycobacterium
IPLSRGGAYPSTEQTLA

SEQ ID NO: 929555 - protein, 18 aa, Mycobacterium
IPLTRTGSPYSLTDAVGE

SEQ ID NO: 929556 - protein, 25 aa, Mycobacterium
IPMGAGDFIATIGFSSPDYVTLDLA

SEQ ID NO: 929557 - protein, 32 aa, Mycobacterium
IPNLFTIQFFQWFIDYAFGFRAHGAPGQPPDN

SEQ ID NO: 929558 - protein, 24 aa, Mycobacterium
IPNNGRSATAISIPRDSYVQAPGL

SEQ ID NO: 929559 - protein, 20 aa, Mycobacterium
IPNPFAVGYYLALGSLQAPY

SEQ ID NO: 929560 - protein, 20 aa, Mycobacterium
IPPDQARRGDLIFYGPNGGQ

SEQ ID NO: 929561 - protein, 21 aa, Mycobacterium
IPPDQARRGDLIFYGPNGGQH

SEQ ID NO: 929562 - protein, 37 aa, Mycobacterium
IPPGPPLPSPHHRLHWGKPGVLPATMGRPEYPTPVGK

SEQ ID NO: 929563 - protein, 31 aa, Mycobacterium
IPPMKEPPPFLRGVFTAVIMALGLGQESKYI

SEQ ID NO: 929564 - protein, 20 aa, Mycobacterium
IPPNEARRGDLIFYGPGGSQ

SEQ ID NO: 929565 - protein, 17 aa, Mycobacterium
IPQRPVPPLPPGPGAPP

SEQ ID NO: 929566 - protein, 21 aa, Mycobacterium
IPRDKALLLGCHNGLDPARSA

SEQ ID NO: 929567 - protein, 26 aa, Mycobacterium
IPRDRLTRTFTRFVAAAVQAYCPTNQ

SEQ ID NO: 929568 - protein, 20 aa, Mycobacterium
IPRPRYRAVSAVEGTALMLS

SEQ ID NO: 929569 - protein, 20 aa, Mycobacterium
IPRVYGRQASEYVIRRGMAQ

SEQ ID NO: 929570 - protein, 28 aa, Mycobacterium
IPSGDTRAFLGARIGVRRGLVVDADGAV

SEQ ID NO: 929571 - protein, 18 aa, Mycobacterium
IPSGGLFSGAEVKMTEEQ

SEQ ID NO: 929572 - protein, 19 aa, Mycobacterium
IPTDGAVFVLKVTAEGTDD

SEQ ID NO: 929573 - protein, 18 aa, Mycobacterium
IPTEKLPLLQPLRDLGFP

SEQ ID NO: 929574 - protein, 17 aa, Mycobacterium
IPTEMIAPGTGYMYSHP

SEQ ID NO: 929575 - protein, 25 aa, Mycobacterium
IPTPESPSGWVYIVADSFTRRDPVV

SEQ ID NO: 929576 - protein, 18 aa, Mycobacterium
IPTPPGWSPYEGPKINPE

SEQ ID NO: 929577 - protein, 18 aa, Mycobacterium
IPTPPGWSPYSGPKISPE

SEQ ID NO: 929578 - protein, 19 aa, Mycobacterium
IPTTAIATAAADDVSAAIA

SEQ ID NO: 929579 - protein, 19 aa, Mycobacterium
IPVASRCEHALRPRVVEDG

SEQ ID NO: 929580 - protein, 24 aa, Mycobacterium
IPVDCAAPHAMEVTGAVNLAAKFP

SEQ ID NO: 929581 - protein, 18 aa, Mycobacterium
IPVDGFVRLNSAADGRHV

SEQ ID NO: 929582 - protein, 26 aa, Mycobacterium
IPVDSVAVATRFPGPITDLQLSRDST

SEQ ID NO: 929583 - protein, 27 aa, Mycobacterium
IPVDSVAVSSRFPGPITDLQLSRDSTR

SEQ ID NO: 929584 - protein, 17 aa, Mycobacterium
IPVESPRGLNYAVPPDW

SEQ ID NO: 929585 - protein, 19 aa, Mycobacterium
IPVGGAPYVLRPKGRQDYD

SEQ ID NO: 929586 - protein, 21 aa, Mycobacterium
IPVTVKFRIGIDDEHHTHLDA

SEQ ID NO: 929587 - protein, 27 aa, Mycobacterium
IPYDEYIMRTGADWFPGLDREIVDYPA

SEQ ID NO: 929588 - protein, 28 aa, Mycobacterium
IPYDEYIMRTGADWFPGLDRQIVDYPAG

SEQ ID NO: 929589 - protein, 19 aa, Mycobacterium
IPYYARFGFEVTGEVRLPD

SEQ ID NO: 929590 - protein, 25 aa, Mycobacterium
IQAHGGTRCTLGYTFTDPGTNINYG

SEQ ID NO: 929591 - protein, 20 aa, Mycobacterium
IQALPGRVAAMATTGPAASA

SEQ ID NO: 929592 - protein, 24 aa, Mycobacterium
IQASDISAPVPFAAAPPTSNPNGK

SEQ ID NO: 929593 - protein, 17 aa, Mycobacterium
IQDILRTGAHVALGTDW

SEQ ID NO: 929594 - protein, 19 aa, Mycobacterium
IQEPLRITQNFQHGVLNFQ

SEQ ID NO: 929595 - protein, 28 aa, Mycobacterium
IQFHVRPGVQILRTWLYEEAFAIEGQNE

SEQ ID NO: 929596 - protein, 24 aa, Mycobacterium
IQFLCGAVQAASRLGAEESAKLCV

SEQ ID NO: 929597 - protein, 18 aa, Mycobacterium
IQFLGGYLAVLSVPKTLA

SEQ ID NO: 929598 - protein, 22 aa, Mycobacterium
IQFQDDFIEWSISFSQKPFPPP

SEQ ID NO: 929599 - protein, 25 aa, Mycobacterium
IQFVAGPSPTGWQISKGSALSLLSS

SEQ ID NO: 929600 - protein, 21 aa, Mycobacterium
IQGKIPGLPIKTLNGDLTTAP

SEQ ID NO: 929601 - protein, 17 aa, Mycobacterium
IQLRLPVDGRWVLVVTA

SEQ ID NO: 929602 - protein, 32 aa, Mycobacterium
IQLRTVGRLLGWRLGIDGVDPKGTVQLESAGS

SEQ ID NO: 929603 - protein, 17 aa, Mycobacterium
IQLTPVYTGGPVLGDNA

SEQ ID NO: 929604 - protein, 23 aa, Mycobacterium
IQMPRWSSKRVVLIGDASFAVSA

SEQ ID NO: 929605 - protein, 26 aa, Mycobacterium
IQNLLHAVARFFRLAQPDNYTQTVAF

SEQ ID NO: 929606 - protein, 24 aa, Mycobacterium
IQPDLRVLVDLGYSDWGNGQDYAN

SEQ ID NO: 929607 - protein, 19 aa, Mycobacterium
IQPFGCLKSVPPPDGVGAA

SEQ ID NO: 929608 - protein, 24 aa, Mycobacterium
IQQADSFSLIAVRGEDLSSLDVSV

SEQ ID NO: 929609 - protein, 21 aa, Mycobacterium
IQQLRRVAGTFANQQQVIDRA

SEQ ID NO: 929610 - protein, 30 aa, Mycobacterium
IQRRAVPMNAVYRWPALGAVATALTRTTPR

SEQ ID NO: 929611 - protein, 19 aa, Mycobacterium
IQRVVRVGLSLAMGPAGVQ

SEQ ID NO: 929612 - protein, 21 aa, Mycobacterium
IQSFDWRTLPMTKRAEPGIPL

SEQ ID NO: 929613 - protein, 18 aa, Mycobacterium
IQSISLFGAKYVDLVYPP

SEQ ID NO: 929614 - protein, 25 aa, Mycobacterium
IQSTFVGAICRWQAANPAGLIDITR

SEQ ID NO: 929615 - protein, 26 aa, Mycobacterium
IQSTFVGAICRWQAANPAGLIDITRY

SEQ ID NO: 929616 - protein, 26 aa, Mycobacterium
IQSTFVGAICRWQAANPAGLVDITRF

SEQ ID NO: 929617 - protein, 25 aa, Mycobacterium
IQSTFVGALCRWQAMSKSGGLVDIT

SEQ ID NO: 929618 - protein, 25 aa, Mycobacterium
IQTQEWISYLGVWARGMQDGVGMAQ

SEQ ID NO: 929619 - protein, 23 aa, Mycobacterium
IQVRMLTVVGGYYVNLVSLGRKP

SEQ ID NO: 929620 - protein, 23 aa, Mycobacterium
IRAGSSFRTTVTYTFNEQQEAQK

SEQ ID NO: 929621 - protein, 27 aa, Mycobacterium
IRAPAQALLGRPLIGNGADGAPGQAGG

SEQ ID NO: 929622 - protein, 18 aa, Mycobacterium
IRATKDCVPDCATGGTTR

SEQ ID NO: 929623 - protein, 24 aa, Mycobacterium
IRAVLPHLLARGGGSIVNTSSGAA

SEQ ID NO: 929624 - protein, 17 aa, Mycobacterium
IRDAYDWAEDDDSFFAR

SEQ ID NO: 929625 - protein, 19 aa, Mycobacterium
IRDEEQWRLVGAGSQVRVY

SEQ ID NO: 929626 - protein, 20 aa, Mycobacterium
IRDYLHTLVNNWRNANSSMA

SEQ ID NO: 929627 - protein, 26 aa, Mycobacterium
IREAGAIPSFLGYHGYPASICASVNE

SEQ ID NO: 929628 - protein, 18 aa, Mycobacterium
IRELHEIAATAVGRRSPR

SEQ ID NO: 929629 - protein, 24 aa, Mycobacterium
IRELLGRLDRFVGILDTQTDDIIA

SEQ ID NO: 929630 - protein, 18 aa, Mycobacterium
IREYLHTLMNNWRAKGAS

SEQ ID NO: 929631 - protein, 17 aa, Mycobacterium
IRFWKDYTDGATPYFEV

SEQ ID NO: 929632 - protein, 18 aa, Mycobacterium
IRGFDASVLSMDFFEAHG

SEQ ID NO: 929633 - protein, 19 aa, Mycobacterium
IRGTWVFDVPASTTSLKLL

SEQ ID NO: 929634 - protein, 17 aa, Mycobacterium
IRGVPVGKIVKIEPQPL

SEQ ID NO: 929635 - protein, 18 aa, Mycobacterium
IRKHIAWYLHGFPAGSEL

SEQ ID NO: 929636 - protein, 23 aa, Mycobacterium
IRLALVVMCSALVTAAAGCADVV

SEQ ID NO: 929637 - protein, 24 aa, Mycobacterium
IRLTRHRPRVPIGVNIGKSKATPA

SEQ ID NO: 929638 - protein, 19 aa, Mycobacterium
IRNGIRGAIKNVRNGVKDA

SEQ ID NO: 929639 - protein, 17 aa, Mycobacterium
IRNGVQLAIDKHNAANP

SEQ ID NO: 929640 - protein, 18 aa, Mycobacterium
IRPDVSMDLAKQAADHDL

SEQ ID NO: 929641 - protein, 18 aa, Mycobacterium
IRPEAQWTDNAPIAADDY

SEQ ID NO: 929642 - protein, 19 aa, Mycobacterium
IRPEAQWTDNAPIGADDFS

SEQ ID NO: 929643 - protein, 24 aa, Mycobacterium
IRPGDCGRDYRVLSVALLEVTFCG

SEQ ID NO: 929644 - protein, 17 aa, Mycobacterium
IRPGNFVAIDDGGGAVT

SEQ ID NO: 929645 - protein, 18 aa, Mycobacterium
IRPHIKFGAEVISARYDD

SEQ ID NO: 929646 - protein, 20 aa, Mycobacterium
IRPKGGYVEVEFTIDRKVKI

SEQ ID NO: 929647 - protein, 24 aa, Mycobacterium
IRPRRAGAVAAVLATAVAAALLPI

SEQ ID NO: 929648 - protein, 19 aa, Mycobacterium
IRQDPRLTAAAQRHADDML

SEQ ID NO: 929649 - protein, 22 aa, Mycobacterium
IRQGNIPACMGYYTRADLPIHY

SEQ ID NO: 929650 - protein, 26 aa, Mycobacterium
IRRAGSQMGVPYSWGGGTLEGPSKGV

SEQ ID NO: 929651 - protein, 22 aa, Mycobacterium
IRRAMSQLGVPYSWGGGNANGP

SEQ ID NO: 929652 - protein, 22 aa, Mycobacterium
IRRAPAPSWSHFTINGAPGAIL

SEQ ID NO: 929653 - protein, 22 aa, Mycobacterium
IRRAPAPSWSHFTLNGAPGAVL

SEQ ID NO: 929654 - protein, 21 aa, Mycobacterium
IRRAPSPSWYHFTFNGAPGSI

SEQ ID NO: 929655 - protein, 20 aa, Mycobacterium
IRRDGTWNTLYRKWLTVLGP

SEQ ID NO: 929656 - protein, 26 aa, Mycobacterium
IRRDGTWYTLYRKWLTVLGPAPAPPV

SEQ ID NO: 929657 - protein, 17 aa, Mycobacterium
IRRGMYFFWPRSDAHLY

SEQ ID NO: 929658 - protein, 17 aa, Mycobacterium
IRRRVFAAFEIAETLPP

SEQ ID NO: 929659 - protein, 19 aa, Mycobacterium
IRRSDAPRLVDLVREAQQS

SEQ ID NO: 929660 - protein, 17 aa, Mycobacterium
IRRSIRYALAALCAVTL

SEQ ID NO: 929661 - protein, 26 aa, Mycobacterium
IRSGPVRWRLLLTVGEQQDPVTDATV

SEQ ID NO: 929662 - protein, 18 aa, Mycobacterium
IRSIPLVGNTVWNAIDGL

SEQ ID NO: 929663 - protein, 25 aa, Mycobacterium
IRSNCLVEVEVVFFGGRRSTDPGSA

SEQ ID NO: 929664 - protein, 18 aa, Mycobacterium
IRTIAAIFGVPERADALI

SEQ ID NO: 929665 - protein, 19 aa, Mycobacterium
IRTLDYRAGLPSGPVASAP

SEQ ID NO: 929666 - protein, 29 aa, Mycobacterium
IRTYAPIRSTMWTDYTIEFDVSGFAPEDW

SEQ ID NO: 929667 - protein, 20 aa, Mycobacterium
IRVAENVLRSQGIGAWPVCG

SEQ ID NO: 929668 - protein, 17 aa, Mycobacterium
ISAASMIERWRAVDECQ

SEQ ID NO: 929669 - protein, 23 aa, Mycobacterium
ISAGCLLGGITMGVVGAPTAAAA

SEQ ID NO: 929670 - protein, 25 aa, Mycobacterium
ISAIKSCPPGHVEVIANYTAFLQLN

SEQ ID NO: 929671 - protein, 17 aa, Mycobacterium
ISAKAYCPGQLEESKGK

SEQ ID NO: 929672 - protein, 19 aa, Mycobacterium
ISAQFAAAFAAEGAQVLAL

SEQ ID NO: 929673 - protein, 26 aa, Mycobacterium
ISARSEAGLVTPMVNDFIARGPNGQN

SEQ ID NO: 929674 - protein, 24 aa, Mycobacterium
ISASAEPVVRVWAADVGIAADHVM

SEQ ID NO: 929675 - protein, 25 aa, Mycobacterium
ISASAEPVVRVWATGIGIPADHVMG

SEQ ID NO: 929676 - protein, 19 aa, Mycobacterium
ISAVAGMRAATAAVPAGTT

SEQ ID NO: 929677 - protein, 17 aa, Mycobacterium
ISDGSIWDAIAGCEAGG

SEQ ID NO: 929678 - protein, 34 aa, Mycobacterium
ISDPGYRLVAACVRQGIPITCLPGPSAVTTALAV

SEQ ID NO: 929679 - protein, 17 aa, Mycobacterium
ISDTLCRLTDGAFAGVV

SEQ ID NO: 929680 - protein, 21 aa, Mycobacterium
ISEQLMPHWLLSLQTEAARRG

SEQ ID NO: 929681 - protein, 23 aa, Mycobacterium
ISETYPPGSTFKVLTTAAALEAG

SEQ ID NO: 929682 - protein, 22 aa, Mycobacterium
ISEVTVRDAIKLAVEEINADGG

SEQ ID NO: 929683 - protein, 21 aa, Mycobacterium
ISEVTVRNAIDLAVEQINASG

SEQ ID NO: 929684 - protein, 25 aa, Mycobacterium
ISFICGAIEAASRLGAERSAKLCVQ

SEQ ID NO: 929685 - protein, 27 aa, Mycobacterium
ISFYRPNLPGSYPIVLATYEIVCSKYP

SEQ ID NO: 929686 - protein, 17 aa, Mycobacterium
ISGRAGIDRLVLGAIPD

SEQ ID NO: 929687 - protein, 21 aa, Mycobacterium
ISGWALTAWVLMSLGTRATQL

SEQ ID NO: 929688 - protein, 20 aa, Mycobacterium
ISIFCPRAVDAMTDGVPFSF

SEQ ID NO: 929689 - protein, 25 aa, Mycobacterium
ISKGGKFPTARLVVFQLNGDFDPAE

SEQ ID NO: 929690 - protein, 26 aa, Mycobacterium
ISKGGKYPTARLVVFKLHGDFDPAQV

SEQ ID NO: 929691 - protein, 17 aa, Mycobacterium
ISKLPVLHLPIGRKPVQ

SEQ ID NO: 929692 - protein, 20 aa, Mycobacterium
ISLAAVFLALAIGVVLGSGF

SEQ ID NO: 929693 - protein, 21 aa, Mycobacterium
ISLAAVFLALAIGVVLGSGFF

SEQ ID NO: 929694 - protein, 20 aa, Mycobacterium
ISLAAVFLALAVGVILGSGL

SEQ ID NO: 929695 - protein, 24 aa, Mycobacterium
ISPGLERRLIVQLSQPGTYQTACK

SEQ ID NO: 929696 - protein, 19 aa, Mycobacterium
ISPGLKRQLIVQLTQPGTY

SEQ ID NO: 929697 - protein, 20 aa, Mycobacterium
ISPWYGHKAIDLCAPNDPIC

SEQ ID NO: 929698 - protein, 17 aa, Mycobacterium
ISQRAGLVMNPDAKVKM

SEQ ID NO: 929699 - protein, 19 aa, Mycobacterium
ISQWCRLPSGADPRSYYEK

SEQ ID NO: 929700 - protein, 19 aa, Mycobacterium
ISRADWGADEALRCESPEY

SEQ ID NO: 929701 - protein, 26 aa, Mycobacterium
ISRRTLLRASLAGALLVPAAACGTPS

SEQ ID NO: 929702 - protein, 24 aa, Mycobacterium
ISSAARLVATYALIVPGTGTPNPA

SEQ ID NO: 929703 - protein, 33 aa, Mycobacterium
ISSDGRRVIAADNFGSLTAFYLSGGGSVKPPNL

SEQ ID NO: 929704 - protein, 22 aa, Mycobacterium
ISSDGRTAFVTEHDSPRRVTII

SEQ ID NO: 929705 - protein, 24 aa, Mycobacterium
ISSEKHTLCGLPAETIHYQMPQMG

SEQ ID NO: 929706 - protein, 19 aa, Mycobacterium
ISSGCGLTGGGCNVVELTI

SEQ ID NO: 929707 - protein, 23 aa, Mycobacterium
ISSGPFFKVVLHNLAPYQILQPW

SEQ ID NO: 929708 - protein, 26 aa, Mycobacterium
ISSIPPVPGKFYWMSPTQVRWRPLQF

SEQ ID NO: 929709 - protein, 27 aa, Mycobacterium
ISSNPPVPGRFYWVTDTQLRWRPQDFW

SEQ ID NO: 929710 - protein, 17 aa, Mycobacterium
ISSTAGWVARPNTAVYS

SEQ ID NO: 929711 - protein, 18 aa, Mycobacterium
ISSTAGWVARPNTAVYSL

SEQ ID NO: 929712 - protein, 18 aa, Mycobacterium
ISTAAGYWRTVVQNKLQT

SEQ ID NO: 929713 - protein, 17 aa, Mycobacterium
ISTGLGYALTFPLNQNI

SEQ ID NO: 929714 - protein, 26 aa, Mycobacterium
ISTSVRRVVAAAGIGLAILVPTYAAI

SEQ ID NO: 929715 - protein, 21 aa, Mycobacterium
ISTVLGERVLVLKPDGSRSLG

SEQ ID NO: 929716 - protein, 19 aa, Mycobacterium
ISVASARQALQTAGAAVPG

SEQ ID NO: 929717 - protein, 24 aa, Mycobacterium
ISVDGRTGYYFTTPSGRWACAILP

SEQ ID NO: 929718 - protein, 21 aa, Mycobacterium
ISVDTFVDWLMEDGHSIDIID

SEQ ID NO: 929719 - protein, 20 aa, Mycobacterium
ISVEVGDGWFQRVALTNPSG

SEQ ID NO: 929720 - protein, 17 aa, Mycobacterium
ISVFLEWFHQHLDRHGP

SEQ ID NO: 929721 - protein, 18 aa, Mycobacterium
ISVPAGFTRIAAFRAGVS

SEQ ID NO: 929722 - protein, 21 aa, Mycobacterium
ISVQISDGWFQHVALTNSAGK

SEQ ID NO: 929723 - protein, 27 aa, Mycobacterium
ISWGIMIKRGLALAAVTALTVAGLNSS

SEQ ID NO: 929724 - protein, 23 aa, Mycobacterium
ISYFDPAPLFSVVDPARADVGQQ

SEQ ID NO: 929725 - protein, 18 aa, Mycobacterium
ITAGEIGERLGLSAAGVR

SEQ ID NO: 929726 - protein, 19 aa, Mycobacterium
ITANAGWSVYLVDADGAPA

SEQ ID NO: 929727 - protein, 18 aa, Mycobacterium
ITASAFAVAAMGLAGTAA

SEQ ID NO: 929728 - protein, 23 aa, Mycobacterium
ITASYAVRVTWSGVYVHSAPWSV

SEQ ID NO: 929729 - protein, 27 aa, Mycobacterium
ITATPLRPGVWRAYADHRMAMAGAIVG

SEQ ID NO: 929730 - protein, 32 aa, Mycobacterium
ITDQMFKVQLWDFFAPGGFTFTDPITPEYNPI

SEQ ID NO: 929731 - protein, 18 aa, Mycobacterium
ITDRVAVRDALQGCDAVV

SEQ ID NO: 929732 - protein, 20 aa, Mycobacterium
ITELDRFSATLAQQRDVVSR

SEQ ID NO: 929733 - protein, 19 aa, Mycobacterium
ITFGDVWGLLVDGRFGDGL

SEQ ID NO: 929734 - protein, 22 aa, Mycobacterium
ITGATCCIGVWGPAARDLVQPL

SEQ ID NO: 929735 - protein, 28 aa, Mycobacterium
ITGFDCSGLMRYGFAGVGVLIPRFSGDQ

SEQ ID NO: 929736 - protein, 23 aa, Mycobacterium
ITGGTCCLGVWGPRAREVIAPLC

SEQ ID NO: 929737 - protein, 21 aa, Mycobacterium
ITGKLPSERAIIKVAQSTPSA

SEQ ID NO: 929738 - protein, 24 aa, Mycobacterium
ITGPKFAGPVTKHLAFVNQGGNWV

SEQ ID NO: 929739 - protein, 27 aa, Mycobacterium
ITKDSQVSTVWTWPDRPGVAGCAALDG

SEQ ID NO: 929740 - protein, 18 aa, Mycobacterium
ITNGPRFGLCQIYANESW

SEQ ID NO: 929741 - protein, 25 aa, Mycobacterium
ITNGRIPRLYGRQASEFVIRRAMSQ

SEQ ID NO: 929742 - protein, 17 aa, Mycobacterium
ITNILTGRRPRLYGAGA

SEQ ID NO: 929743 - protein, 20 aa, Mycobacterium
ITPAQIRRYAAVGGDHNPIH

SEQ ID NO: 929744 - protein, 17 aa, Mycobacterium
ITRHSVDNYHLVAKNYD

SEQ ID NO: 929745 - protein, 40 aa, Mycobacterium
ITSPAGGHALVIGNRVRYFSAPNFHGTETFTYTLNGGATA

SEQ ID NO: 929746 - protein, 17 aa, Mycobacterium
ITSRFLPDKAIDLVDEA

SEQ ID NO: 929747 - protein, 25 aa, Mycobacterium
ITSRRPHELAAWADGYDDRVLVVPL

SEQ ID NO: 929748 - protein, 23 aa, Mycobacterium
ITSSRWLVDASIEILQRYSPTLL

SEQ ID NO: 929749 - protein, 17 aa, Mycobacterium
ITTIGVDVDELVPVGAP

SEQ ID NO: 929750 - protein, 29 aa, Mycobacterium
ITTKPAVEGAFYWLNNREVRWRPEHFWKS

SEQ ID NO: 929751 - protein, 41 aa, Mycobacterium
ITTNPPVEGAFYWLNNREVRWRPEHFWKPGTAVDVAVNTYG

SEQ ID NO: 929752 - protein, 25 aa, Mycobacterium
ITTRTGTKYAVRWQDYDTGAPITAQ

SEQ ID NO: 929753 - protein, 20 aa, Mycobacterium
ITVALGFPAGGRVNATNGLA

SEQ ID NO: 929754 - protein, 19 aa, Mycobacterium
ITVALGFPSGGRVNATTDL

SEQ ID NO: 929755 - protein, 24 aa, Mycobacterium
ITVDEWFDRVGFPPEVRRVVLNSM

SEQ ID NO: 929756 - protein, 17 aa, Mycobacterium
ITVKPAAPFRANVASVP

SEQ ID NO: 929757 - protein, 17 aa, Mycobacterium
ITVLRLRPVEVVSAEAL

SEQ ID NO: 929758 - protein, 20 aa, Mycobacterium
IVAEERLRYLAEHDDLTGVY

SEQ ID NO: 929759 - protein, 32 aa, Mycobacterium
IVARNEVFTAFVPFAARWPVEVHIYPNRFVPN

SEQ ID NO: 929760 - protein, 25 aa, Mycobacterium
IVAVPRPGTPVQWLPCNGGAGNQTP

SEQ ID NO: 929761 - protein, 20 aa, Mycobacterium
IVAYALKNAERFALQDCIWR

SEQ ID NO: 929762 - protein, 24 aa, Mycobacterium
IVDRSWRYLQFHSTIEFWDQDGGS

SEQ ID NO: 929763 - protein, 17 aa, Mycobacterium
IVECDWLYAPEVAAAGD

SEQ ID NO: 929764 - protein, 33 aa, Mycobacterium
IVFDFTIPRLKSGILLGTRWGQPGASLVPAPGD

SEQ ID NO: 929765 - protein, 19 aa, Mycobacterium
IVGACGGGGTQARNITVTF

SEQ ID NO: 929766 - protein, 23 aa, Mycobacterium
IVGTCPDLGFISAIPQPLRSLAH

SEQ ID NO: 929767 - protein, 22 aa, Mycobacterium
IVGVVTWADCLVALQQRQVDAV

SEQ ID NO: 929768 - protein, 17 aa, Mycobacterium
IVHAARRRRVYAAVEEF

SEQ ID NO: 929769 - protein, 25 aa, Mycobacterium
IVIGCGESGILAGIRLKQANIAFTI

SEQ ID NO: 929770 - protein, 18 aa, Mycobacterium
IVIPTGPPPDHKRYLVQL

SEQ ID NO: 929771 - protein, 26 aa, Mycobacterium
IVIVFGQIRFDRTYGYSAEFSNVSGL

SEQ ID NO: 929772 - protein, 17 aa, Mycobacterium
IVIYDYFGTPSVEDKWA

SEQ ID NO: 929773 - protein, 20 aa, Mycobacterium
IVLAGVLGMCSFTPSGPTTG

SEQ ID NO: 929774 - protein, 19 aa, Mycobacterium
IVLGVVRGGQLLRIGAPEV

SEQ ID NO: 929775 - protein, 20 aa, Mycobacterium
IVLIHELFHYAARVDTAPDA

SEQ ID NO: 929776 - protein, 37 aa, Mycobacterium
IVLPRLQAASGLRAGEDFGVAVNPEFLREGSSIRDFF

SEQ ID NO: 929777 - protein, 20 aa, Mycobacterium
IVLTHELFHYAARVDTALDA

SEQ ID NO: 929778 - protein, 24 aa, Mycobacterium
IVLVDRGSCPFGGKQAIAAERGAV

SEQ ID NO: 929779 - protein, 18 aa, Mycobacterium
IVMLCLVVAVATSVTSCK

SEQ ID NO: 929780 - protein, 25 aa, Mycobacterium
IVNIGGPEKLSFADMARAVLAKHGD

SEQ ID NO: 929781 - protein, 17 aa, Mycobacterium
IVQRELAHQTGLGVAIL

SEQ ID NO: 929782 - protein, 18 aa, Mycobacterium
IVREGLRAKVTVGNTSNL

SEQ ID NO: 929783 - protein, 23 aa, Mycobacterium
IVRRRGDLPTGLRVDSSGNPETG

SEQ ID NO: 929784 - protein, 20 aa, Mycobacterium
IVSALNRPVSTTGESGNQNT

SEQ ID NO: 929785 - protein, 21 aa, Mycobacterium
IVSGCATNGLADLPLPAPGVG

SEQ ID NO: 929786 - protein, 22 aa, Mycobacterium
IVSLNAEMIWGQPIENKDSDGN

SEQ ID NO: 929787 - protein, 24 aa, Mycobacterium
IVSRHCRRVVLVAAVIDGVVDWLR

SEQ ID NO: 929788 - protein, 19 aa, Mycobacterium
IVSVVNWADCLVAMQQRQI

SEQ ID NO: 929789 - protein, 29 aa, Mycobacterium
IVTASGGLRINPEFHCEIAVDGQVVVSQN

SEQ ID NO: 929790 - protein, 27 aa, Mycobacterium
IVTFAKPYAEWRGMFAGNGMLLPSSMT

SEQ ID NO: 929791 - protein, 18 aa, Mycobacterium
IVTNAWDAPFMRDVGGEF

SEQ ID NO: 929792 - protein, 18 aa, Mycobacterium
IVTSVGFTALAVCAARAL

SEQ ID NO: 929793 - protein, 24 aa, Mycobacterium
IVTVNWPRALIMGRKALTERTPYR

SEQ ID NO: 929794 - protein, 27 aa, Mycobacterium
IVVIASEWGVIGWPEATAYAAAKSGLI

SEQ ID NO: 929795 - protein, 26 aa, Mycobacterium
IVYEVFGDYGGWARISYWDTNNRPVD

SEQ ID NO: 929796 - protein, 24 aa, Mycobacterium
IVYPSSPVFMDWSVAHGAGSLHAA

SEQ ID NO: 929797 - protein, 21 aa, Mycobacterium
IWADGPVTFLGLMVPGLPNMF

SEQ ID NO: 929798 - protein, 20 aa, Mycobacterium
IWAEAGFRPVDPAVAAEFAA

SEQ ID NO: 929799 - protein, 19 aa, Mycobacterium
IWPPGRAPIVMAVLTVPED

SEQ ID NO: 929800 - protein, 18 aa, Mycobacterium
IWRTYEATLPPDAVETTI

SEQ ID NO: 929801 - protein, 24 aa, Mycobacterium
IYAVNYPASFDWVRAGDGANDMSY

SEQ ID NO: 929802 - protein, 23 aa, Mycobacterium
IYDPSMRTLIAFGKKFPTGAIPA

SEQ ID NO: 929803 - protein, 22 aa, Mycobacterium
IYFLGSSEGLVFDVPTSNYDTA

SEQ ID NO: 929804 - protein, 18 aa, Mycobacterium
IYGLGPRVAQLVAGAFFR

SEQ ID NO: 929805 - protein, 25 aa, Mycobacterium
IYGMGGEPFKPLPPGSRLSYREVSC

SEQ ID NO: 929806 - protein, 23 aa, Mycobacterium
IYIVGARFKHMIMDSSTYGVPVN

SEQ ID NO: 929807 - protein, 23 aa, Mycobacterium
IYKWWPSAPAIVLEGLLDSVRDS

SEQ ID NO: 929808 - protein, 30 aa, Mycobacterium
IYLNTFRHLYGLECSHIAPANVYGPRQDPH

SEQ ID NO: 929809 - protein, 31 aa, Mycobacterium
IYLNTFRHLYGLECSHIAPANVYGPRQDPHG

SEQ ID NO: 929810 - protein, 27 aa, Mycobacterium
IYLNTFRHLYGMDCSHIAPANVYGPRQ

SEQ ID NO: 929811 - protein, 17 aa, Mycobacterium
IYLSLPGLGVILGARVL

SEQ ID NO: 929812 - protein, 23 aa, Mycobacterium
IYPSCVPVVGDLREPLYLPVACV

SEQ ID NO: 929813 - protein, 18 aa, Mycobacterium
IYQRKGIIFHQALATAIR

SEQ ID NO: 929814 - protein, 17 aa, Mycobacterium
IYQRKGIVFHQALATAI

SEQ ID NO: 929815 - protein, 25 aa, Mycobacterium
IYQRTAAGWQALRTGIPTHVGSAGM

SEQ ID NO: 929816 - protein, 18 aa, Mycobacterium
IYRTDVFAAPSIERLRDR

SEQ ID NO: 929817 - protein, 23 aa, Mycobacterium
IYSEPDLRPGGPGTRSGPTAIAP

SEQ ID NO: 929818 - protein, 19 aa, Mycobacterium
IYTYHSKTLGWCDIAYNAL

SEQ ID NO: 929819 - protein, 20 aa, Mycobacterium
IYTYHSKTLGWCDIAYNALV

SEQ ID NO: 929820 - protein, 18 aa, Mycobacterium
IYVGWRAARSQVHRPKTR

SEQ ID NO: 929821 - protein, 20 aa, Mycobacterium
IYYERIEPVAESFPDDLDPR

SEQ ID NO: 929822 - protein, 19 aa, Mycobacterium
KAAGEPVGHAFQLLEYPQP

SEQ ID NO: 929823 - protein, 17 aa, Mycobacterium
KAAHLTIDGYTRTTRPA

SEQ ID NO: 929824 - protein, 25 aa, Mycobacterium
KAAKNGDLPLSFTVANIAPAAAGAA

SEQ ID NO: 929825 - protein, 25 aa, Mycobacterium
KAAKNGDLPLSFTVSNIQSAGAGTA

SEQ ID NO: 929826 - protein, 26 aa, Mycobacterium
KAAPAADCGFSIRIVGTNAVFRYHTA

SEQ ID NO: 929827 - protein, 31 aa, Mycobacterium
KAAQRLASDMGEFFMPFPGTRVNQQVVPLDA

SEQ ID NO: 929828 - protein, 19 aa, Mycobacterium
KAAVIGGGIAGLAAATSLA

SEQ ID NO: 929829 - protein, 22 aa, Mycobacterium
KADCPCCKDLPAAAPGTDCPCC

SEQ ID NO: 929830 - protein, 22 aa, Mycobacterium
KAEAFEAVRCLRNLQNQKYVSI

SEQ ID NO: 929831 - protein, 22 aa, Mycobacterium
KAEKLYPVLPPRQAELADRLLS

SEQ ID NO: 929832 - protein, 26 aa, Mycobacterium
KAELMCRAYDGLYAKGGKWAVNPMFM

SEQ ID NO: 929833 - protein, 22 aa, Mycobacterium
KAEPARGGWQTVPGSRRDASYQ

SEQ ID NO: 929834 - protein, 21 aa, Mycobacterium
KAFRTSGCQPWQITGEGTAPA

SEQ ID NO: 929835 - protein, 20 aa, Mycobacterium
KAFWSDGTPITWRDIASQIH

SEQ ID NO: 929836 - protein, 25 aa, Mycobacterium
KAGEIRSRLQAAWDQLFRVETISAM

SEQ ID NO: 929837 - protein, 23 aa, Mycobacterium
KAGEPRTDGRYIVFDVDEDGNPI

SEQ ID NO: 929838 - protein, 24 aa, Mycobacterium
KAGESGGRADTAFTSDPAGAGVTA

SEQ ID NO: 929839 - protein, 25 aa, Mycobacterium
KAGKIGATVMQFPAKMAELGVQAVV

SEQ ID NO: 929840 - protein, 18 aa, Mycobacterium
KAGQKVRIAGIPVGAVSG

SEQ ID NO: 929841 - protein, 18 aa, Mycobacterium
KAIAAALPMVTWLQTAST

SEQ ID NO: 929842 - protein, 25 aa, Mycobacterium
KAIAEGRFTASLEHFASITPVRRAG

SEQ ID NO: 929843 - protein, 17 aa, Mycobacterium
KAKGLIWRVYTEGLTAY

SEQ ID NO: 929844 - protein, 25 aa, Mycobacterium
KAKIPAGALCGKLAVPVDYDHLDGD

SEQ ID NO: 929845 - protein, 21 aa, Mycobacterium
KAKPAECIGVVHLMQRGPYGS

SEQ ID NO: 929846 - protein, 19 aa, Mycobacterium
KALADFLFDDERAMVRIDM

SEQ ID NO: 929847 - protein, 25 aa, Mycobacterium
KALDITLPVPARWTQVPDPNVPDAF

SEQ ID NO: 929848 - protein, 27 aa, Mycobacterium
KALDVTLPMPPRWTPVPDPNVPDAFLV

SEQ ID NO: 929849 - protein, 25 aa, Mycobacterium
KALQGGAIYDHWQAIGGMNSVLGAP

SEQ ID NO: 929850 - protein, 22 aa, Mycobacterium
KAMIDCGVNLFGFDQLLPEDGR

SEQ ID NO: 929851 - protein, 17 aa, Mycobacterium
KAMLPVFEDNNALLYYG

SEQ ID NO: 929852 - protein, 19 aa, Mycobacterium
KAMWDWSKNISDKNCLAVD

SEQ ID NO: 929853 - protein, 26 aa, Mycobacterium
KAPTVDFTLRLGHSAFYPLPDMAFRD

SEQ ID NO: 929854 - protein, 21 aa, Mycobacterium
KAQCIPEKLALATGIAEREAT

SEQ ID NO: 929855 - protein, 18 aa, Mycobacterium
KAQGLSIAEIVTSAGPEP

SEQ ID NO: 929856 - protein, 27 aa, Mycobacterium
KAQPPSLRKALGIKGHPVRDLVKSVSK

SEQ ID NO: 929857 - protein, 17 aa, Mycobacterium
KARADVVAVECGDLSSG

SEQ ID NO: 929858 - protein, 20 aa, Mycobacterium
KARGARILARLMGAGVTSDG

SEQ ID NO: 929859 - protein, 30 aa, Mycobacterium
KARNLSFRSLEILRGLGLRDEVHAVADHVS

SEQ ID NO: 929860 - protein, 29 aa, Mycobacterium
KARNLSFRSLEILRGLGLSDQVHAVADGV

SEQ ID NO: 929861 - protein, 24 aa, Mycobacterium
KARNLSFRSLEILRGLGVGDQIRA

SEQ ID NO: 929862 - protein, 28 aa, Mycobacterium
KASASFGVAPLVLWQLATKHFTNITAET

SEQ ID NO: 929863 - protein, 18 aa, Mycobacterium
KASDWEDIAIGPGPVPGQ

SEQ ID NO: 929864 - protein, 31 aa, Mycobacterium
KASERCGSEAWDLPVVFGPIAVTYNLKGVSA

SEQ ID NO: 929865 - protein, 18 aa, Mycobacterium
KATLPRAFVIGPDGSTTV

SEQ ID NO: 929866 - protein, 22 aa, Mycobacterium
KAVAGAMWPGVPLVPTMSTGAT

SEQ ID NO: 929867 - protein, 31 aa, Mycobacterium
KAVARGSFFPVIPVCASTGVGTLELLEVATR

SEQ ID NO: 929868 - protein, 20 aa, Mycobacterium
KAVYSEALKGTFKPVDKLVS

SEQ ID NO: 929869 - protein, 19 aa, Mycobacterium
KAYGAGPCSGHLTDIEHIV

SEQ ID NO: 929870 - protein, 26 aa, Mycobacterium
KCAVTKDEGVYCFRGHSASSFNGDQF

SEQ ID NO: 929871 - protein, 23 aa, Mycobacterium
KDAKLTVVFAHGFCLRMSAFHFQ

SEQ ID NO: 929872 - protein, 24 aa, Mycobacterium
KDCVPDCATGGTTRRDVTLTFHDA

SEQ ID NO: 929873 - protein, 20 aa, Mycobacterium
KDFGIGVDFMVPGLTTVTGR

SEQ ID NO: 929874 - protein, 20 aa, Mycobacterium
KDFVKRCVDKVGLEFLANVG

SEQ ID NO: 929875 - protein, 19 aa, Mycobacterium
KDGCRGAVVALEPSTGKIL

SEQ ID NO: 929876 - protein, 17 aa, Mycobacterium
KDGKDRFGIADQQPAEL

SEQ ID NO: 929877 - protein, 23 aa, Mycobacterium
KDGKRLTIRDVFYDGASTRGIAQ

SEQ ID NO: 929878 - protein, 22 aa, Mycobacterium
KDGKRLTIRDVLYDSQSTRQIA

SEQ ID NO: 929879 - protein, 21 aa, Mycobacterium
KDGNGPFGLVVFIHGDGPADA

SEQ ID NO: 929880 - protein, 32 aa, Mycobacterium
KDGSIDAMFWSGGLPTPGITDLFTSAREDVTF

SEQ ID NO: 929881 - protein, 21 aa, Mycobacterium
KDGVFTYKWETFLTQELPAFL

SEQ ID NO: 929882 - protein, 27 aa, Mycobacterium
KDGVNQMEIMIWFNRQGSIQPVGAQVG

SEQ ID NO: 929883 - protein, 21 aa, Mycobacterium
KDHNSRIIPRLRRIRNKIERM

SEQ ID NO: 929884 - protein, 18 aa, Mycobacterium
KDHRGVIAAAEVTVKDFV

SEQ ID NO: 929885 - protein, 26 aa, Mycobacterium
KDIPGGFGAGLARAMPVTGGQFRVET

SEQ ID NO: 929886 - protein, 20 aa, Mycobacterium
KDIVYEIFGPAGTKGEVNYL

SEQ ID NO: 929887 - protein, 20 aa, Mycobacterium
KDKGLGNVIAKVQSPQIAGN

SEQ ID NO: 929888 - protein, 24 aa, Mycobacterium
KDLHLPWQWGARWFLDQLTDGDMA

SEQ ID NO: 929889 - protein, 25 aa, Mycobacterium
KDLPLLDPLRAIPFVGEPLAELIQP

SEQ ID NO: 929890 - protein, 18 aa, Mycobacterium
KDLRLIPSNATVRIAGTT

SEQ ID NO: 929891 - protein, 21 aa, Mycobacterium
KDLSEAVGLVQGFISGTRDQT

SEQ ID NO: 929892 - protein, 18 aa, Mycobacterium
KDLTAALQRLRAPATLLG

SEQ ID NO: 929893 - protein, 18 aa, Mycobacterium
KDMLRGSVTPAWGVQALS

SEQ ID NO: 929894 - protein, 24 aa, Mycobacterium
KDNYLYRMAGAVLGIYGNTAAEAI

SEQ ID NO: 929895 - protein, 23 aa, Mycobacterium
KDPRAEWTLPTFSPDGTQIAYTD

SEQ ID NO: 929896 - protein, 19 aa, Mycobacterium
KDPRAFEATGRMVFGDELW

SEQ ID NO: 929897 - protein, 18 aa, Mycobacterium
KDRLVTLVADIERDGGAA

SEQ ID NO: 929898 - protein, 24 aa, Mycobacterium
KDSGAKGEIAWRRDDLVPLSTSSQ

SEQ ID NO: 929899 - protein, 19 aa, Mycobacterium
KDSNRLLGTLNTRSAQISE

SEQ ID NO: 929900 - protein, 19 aa, Mycobacterium
KDTHAHAWALRMSPDGNVW

SEQ ID NO: 929901 - protein, 23 aa, Mycobacterium
KDTKPGDVVVIDFRRKNEAPGVA

SEQ ID NO: 929902 - protein, 21 aa, Mycobacterium
KDVGFPYRSAILPGRNAEIDA

SEQ ID NO: 929903 - protein, 24 aa, Mycobacterium
KDVGFPYRSALVPGRNAELDERMM

SEQ ID NO: 929904 - protein, 20 aa, Mycobacterium
KDVGFPYRSSLVPRRNAELD

SEQ ID NO: 929905 - protein, 19 aa, Mycobacterium
KDVYARAATRIADEVSYIY

SEQ ID NO: 929906 - protein, 30 aa, Mycobacterium
KEANRIASADLAWFPLIERVKTIPTSDRVT

SEQ ID NO: 929907 - protein, 23 aa, Mycobacterium
KEDAGWDRGFYWGTATAGYQVEG

SEQ ID NO: 929908 - protein, 22 aa, Mycobacterium
KEFQKRYLAAGGHNAVFNFPPN

SEQ ID NO: 929909 - protein, 20 aa, Mycobacterium
KEGSTGWSDTWMLSSKAAHP

SEQ ID NO: 929910 - protein, 28 aa, Mycobacterium
KEIEPLPERAKVTFWVDKEFQVPADATA

SEQ ID NO: 929911 - protein, 20 aa, Mycobacterium
KEIPEVFAYDYQTVERSLSA

SEQ ID NO: 929912 - protein, 24 aa, Mycobacterium
KEKDLVVSHILHLLLTGKLRSGDR

SEQ ID NO: 929913 - protein, 21 aa, Mycobacterium
KEKHGIAGLRLEQGLAAHRGR

SEQ ID NO: 929914 - protein, 25 aa, Mycobacterium
KEKLRPMPHLLLIVDEFTQMFAEHD

SEQ ID NO: 929915 - protein, 28 aa, Mycobacterium
KELARLLGEGAPILWNDVPTLPLYRQQR

SEQ ID NO: 929916 - protein, 17 aa, Mycobacterium
KELQAGVSAPDFSVDST

SEQ ID NO: 929917 - protein, 34 aa, Mycobacterium
KEMVKGLLHLEDWRRDRPGLGFGGNLFDVATLFV

SEQ ID NO: 929918 - protein, 26 aa, Mycobacterium
KENAAWKRLTEDPAQPMLNRAIAQTY

SEQ ID NO: 929919 - protein, 18 aa, Mycobacterium
KEPPKRVVSAGFTEQDDL

SEQ ID NO: 929920 - protein, 19 aa, Mycobacterium
KEQLTRLATDLGPANGVSE

SEQ ID NO: 929921 - protein, 21 aa, Mycobacterium
KEQLTRLATELGPRSGVDGTS

SEQ ID NO: 929922 - protein, 18 aa, Mycobacterium
KETLTNWMRGDYANLTLI

SEQ ID NO: 929923 - protein, 17 aa, Mycobacterium
KFAAAQSQRCEQEGKPA

SEQ ID NO: 929924 - protein, 22 aa, Mycobacterium
KFALCGWSEAMAVDLAGTGVSV

SEQ ID NO: 929925 - protein, 21 aa, Mycobacterium
KFALCGWSEAMAVDLHGTPIA

SEQ ID NO: 929926 - protein, 19 aa, Mycobacterium
KFALRGFADVLRAEEPALR

SEQ ID NO: 929927 - protein, 20 aa, Mycobacterium
KFCLAGALGIAALGIGVVAH

SEQ ID NO: 929928 - protein, 17 aa, Mycobacterium
KFKFWRTATALAATGIL

SEQ ID NO: 929929 - protein, 19 aa, Mycobacterium
KFLDRLDPAAVHDDLVEDR

SEQ ID NO: 929930 - protein, 18 aa, Mycobacterium
KFNLPGGSWEERAEDLVD

SEQ ID NO: 929931 - protein, 17 aa, Mycobacterium
KFNNAYRTFTFDMASGR

SEQ ID NO: 929932 - protein, 18 aa, Mycobacterium
KFNQPFISYGAWDGYAVY

SEQ ID NO: 929933 - protein, 19 aa, Mycobacterium
KFSRTAIIVGSLVILLASI

SEQ ID NO: 929934 - protein, 20 aa, Mycobacterium
KFTYLSAAHYCPKYVTGEGR

SEQ ID NO: 929935 - protein, 19 aa, Mycobacterium
KGAMFTEWTVTRFWSSGAA

SEQ ID NO: 929936 - protein, 19 aa, Mycobacterium
KGARERAFNDAKSRAEQYA

SEQ ID NO: 929937 - protein, 20 aa, Mycobacterium
KGASGLIVLSAPTGRGAPPT

SEQ ID NO: 929938 - protein, 19 aa, Mycobacterium
KGAVGVTVENGWFQKVSLV

SEQ ID NO: 929939 - protein, 19 aa, Mycobacterium
KGDAEAALSYSADQPASKE

SEQ ID NO: 929940 - protein, 19 aa, Mycobacterium
KGDGNLMLALADLYMGRDA

SEQ ID NO: 929941 - protein, 27 aa, Mycobacterium
KGDLKPGQLKTVWKSDMIAGSVFAAND

SEQ ID NO: 929942 - protein, 18 aa, Mycobacterium
KGESLECSAQVGGQTVRV

SEQ ID NO: 929943 - protein, 25 aa, Mycobacterium
KGEVLRLRWRKGCMPVPQRVIRARV

SEQ ID NO: 929944 - protein, 27 aa, Mycobacterium
KGEVLRLRWRRGCLPVPRRVVRARVRG

SEQ ID NO: 929945 - protein, 27 aa, Mycobacterium
KGEVLRLRWRRGCMPVPRRVIRARVHG

SEQ ID NO: 929946 - protein, 25 aa, Mycobacterium
KGFSSKCTHKGCTVNEIADGTIHCP

SEQ ID NO: 929947 - protein, 19 aa, Mycobacterium
KGGAGLAGYVERPGIETYL

SEQ ID NO: 929948 - protein, 21 aa, Mycobacterium
KGGDPRAQIEPYLASLQAPDA

SEQ ID NO: 929949 - protein, 18 aa, Mycobacterium
KGGNGYTPTTPGADGGAG

SEQ ID NO: 929950 - protein, 25 aa, Mycobacterium
KGGNLPGDLTFSWYAVDHTGQPWVV

SEQ ID NO: 929951 - protein, 20 aa, Mycobacterium
KGHGSSMLYDPFHVGGLPAV

SEQ ID NO: 929952 - protein, 25 aa, Mycobacterium
KGHRDWPHLGVALMRPRSRARVTLA

SEQ ID NO: 929953 - protein, 17 aa, Mycobacterium
KGIAFGSIVTFAVRPGN

SEQ ID NO: 929954 - protein, 19 aa, Mycobacterium
KGISIRRAPAPSWSHFTIN

SEQ ID NO: 929955 - protein, 19 aa, Mycobacterium
KGISIRRAPAPSWSHFTLN

SEQ ID NO: 929956 - protein, 26 aa, Mycobacterium
KGITIRRAPAPAWSHITFNGAPGSIL

SEQ ID NO: 929957 - protein, 23 aa, Mycobacterium
KGKEARVTLKDVHIKIDGCVGQS

SEQ ID NO: 929958 - protein, 21 aa, Mycobacterium
KGNDAKATFFLIGNKVAANPA

SEQ ID NO: 929959 - protein, 20 aa, Mycobacterium
KGNQGIEYVIPVFQQMVRSC

SEQ ID NO: 929960 - protein, 31 aa, Mycobacterium; identical to SEQ ID NO: 143145

SEQ ID NO: 929961 - protein, 19 aa, Mycobacterium
KGPKLNIYYTLDAKSLPLL

SEQ ID NO: 929962 - protein, 17 aa, Mycobacterium
KGPTVFEGYLNRPEATA

SEQ ID NO: 929963 - protein, 26 aa, Mycobacterium
KGQFPPAEGFWSLTMYDAGMFFVDNP

SEQ ID NO: 929964 - protein, 20 aa, Mycobacterium
KGRVLSVEREVFPALLADGL

SEQ ID NO: 929965 - protein, 18 aa, Mycobacterium
KGTDTWYKGAARISDLAD

SEQ ID NO: 929966 - protein, 19 aa, Mycobacterium
KGTVTPLVADFNARAANGQ

SEQ ID NO: 929967 - protein, 20 aa, Mycobacterium
KGVNVEPFFAVLSGSRIPAP

SEQ ID NO: 929968 - protein, 24 aa, Mycobacterium
KHAFGESFLTQMFPVGSVVPSLDY

SEQ ID NO: 929969 - protein, 30 aa, Mycobacterium
KHGEPLPWQDLRAAFTERGWHDMTHTRREI

SEQ ID NO: 929970 - protein, 23 aa, Mycobacterium
KHMRADVTVGAFLSGGIDSTAIA

SEQ ID NO: 929971 - protein, 41 aa, Mycobacterium
KHMVQIEPKLAFLGGNLPLLLKGLARITGDGAYGNAYICDL

SEQ ID NO: 929972 - protein, 20 aa, Mycobacterium
KHPRHKEYWVGASTTATLLG

SEQ ID NO: 929973 - protein, 19 aa, Mycobacterium
KHYLAELIGNTSTITNGLG

SEQ ID NO: 929974 - protein, 19 aa, Mycobacterium
KIACKRLHNGLDRNANDSV

SEQ ID NO: 929975 - protein, 17 aa, Mycobacterium
KIASLKPDLIVAADAGL

SEQ ID NO: 929976 - protein, 20 aa, Mycobacterium
KIAYIAGKPAQVFVTDSDLK

SEQ ID NO: 929977 - protein, 19 aa, Mycobacterium
KIFQIEPNWILPKDSRDFS

SEQ ID NO: 929978 - protein, 24 aa, Mycobacterium
KIHPPDAASRMLALIVGTGGDATR

SEQ ID NO: 929979 - protein, 18 aa, Mycobacterium
KIIAGWRNNFDPRYPPLV

SEQ ID NO: 929980 - protein, 20 aa, Mycobacterium
KILGPQFLSRFYGRIINTHP

SEQ ID NO: 929981 - protein, 20 aa, Mycobacterium
KIMGTWRGGIGTTWEARVKL

SEQ ID NO: 929982 - protein, 18 aa, Mycobacterium
KINPQLQLAAQWHANDVL

SEQ ID NO: 929983 - protein, 19 aa, Mycobacterium
KIPLVLAASAAISPLVTTA

SEQ ID NO: 929984 - protein, 19 aa, Mycobacterium
KIQLPKFSRTAIIVGSLVI

SEQ ID NO: 929985 - protein, 23 aa, Mycobacterium
KIREMRIPLQVYLVGRDLEPIGG

SEQ ID NO: 929986 - protein, 21 aa, Mycobacterium
KITLWKDYWDMGALTNSAPPS

SEQ ID NO: 929987 - protein, 20 aa, Mycobacterium
KITVEGMVTHLRALQDIANA

SEQ ID NO: 929988 - protein, 19 aa, Mycobacterium
KIVANDLPISIVVPDKATN

SEQ ID NO: 929989 - protein, 20 aa, Mycobacterium
KIVIIGESMGSMVAARVAKE

SEQ ID NO: 929990 - protein, 21 aa, Mycobacterium
KIWAAERFAIDYVQLGTDGRI

SEQ ID NO: 929991 - protein, 17 aa, Mycobacterium
KKAARRAWLDSLADERR

SEQ ID NO: 929992 - protein, 20 aa, Mycobacterium
KKCLLDLVDLVGFDTEIDHR

SEQ ID NO: 929993 - protein, 19 aa, Mycobacterium
KKFEVSMANVWPGTQSQLY

SEQ ID NO: 929994 - protein, 20 aa, Mycobacterium
KKFTLDWTSLIVGGPFNSFT

SEQ ID NO: 929995 - protein, 19 aa, Mycobacterium
KKIVTKWGMPENSIYTGAS

SEQ ID NO: 929996 - protein, 18 aa, Mycobacterium
KKLVNFSTAYLIANQRIL

SEQ ID NO: 929997 - protein, 25 aa, Mycobacterium
KKMEDSGAWKEAFDKNLGPAGITAP

SEQ ID NO: 929998 - protein, 18 aa, Mycobacterium
KKRAAEVFVSDPPILARC

SEQ ID NO: 929999 - protein, 17 aa, Mycobacterium
KKTLGYQKICVVDDSTD

SEQ ID NO: 930000 - protein, 19 aa, Mycobacterium
KLAPTLERLNAVTAMLEKN

SEQ ID NO: 930001 - protein, 25 aa, Mycobacterium
KLAQFPKAVMLRLHGTGVTAPGSSA

SEQ ID NO: 930002 - protein, 19 aa, Mycobacterium
KLDALTMLVERGLVKPVLG

SEQ ID NO: 930003 - protein, 20 aa, Mycobacterium
KLDGARPILRVTPAGPPSVF

SEQ ID NO: 930004 - protein, 24 aa, Mycobacterium
KLDPAEPLRSVWDSWTAEPTGIET

SEQ ID NO: 930005 - protein, 23 aa, Mycobacterium
KLDVWQRTPAGWKPVDGGVGIAA

SEQ ID NO: 930006 - protein, 25 aa, Mycobacterium
KLEAIGIDLSDVFDVLESEGVEKFE

SEQ ID NO: 930007 - protein, 18 aa, Mycobacterium
KLEKTFPVSMGKNDGKHE

SEQ ID NO: 930008 - protein, 24 aa, Mycobacterium
KLELPRDAVLVAILRGSRVIAAQP

SEQ ID NO: 930009 - protein, 17 aa, Mycobacterium
KLGGDMQRYDWTINGRS

SEQ ID NO: 930010 - protein, 17 aa, Mycobacterium
KLGIFSLVLLTFTALIF

SEQ ID NO: 930011 - protein, 18 aa, Mycobacterium
KLGRLRYGSSVMNVTADR

SEQ ID NO: 930012 - protein, 19 aa, Mycobacterium
KLGRRWHQETVYGIAARGY

SEQ ID NO: 930013 - protein, 26 aa, Mycobacterium
KLGRSTGYSCGVTWGPGQEPGTILNQ

SEQ ID NO: 930014 - protein, 18 aa, Mycobacterium
KLGTAWDKAKPAECIGVV

SEQ ID NO: 930015 - protein, 19 aa, Mycobacterium
KLGTFPLFQYWGPTADITS

SEQ ID NO: 930016 - protein, 19 aa, Mycobacterium
KLHGTFRGGMGHTFEARIK

SEQ ID NO: 930017 - protein, 26 aa, Mycobacterium
KLIGDFDPRAAISHGYVDSQKLLGWR

SEQ ID NO: 930018 - protein, 21 aa, Mycobacterium
KLLTLSGDSLKYWTRALGNPA

SEQ ID NO: 930019 - protein, 18 aa, Mycobacterium
KLNEVIVQFGEVLDTHRE

SEQ ID NO: 930020 - protein, 26 aa, Mycobacterium
KLNISRAYLRPGFAFGGSCLPKDLRA

SEQ ID NO: 930021 - protein, 25 aa, Mycobacterium
KLNNGDVVQAWTVTDLKPSSDTIPY

SEQ ID NO: 930022 - protein, 20 aa, Mycobacterium
KLNSSPMAQSYIRSFLASPP

SEQ ID NO: 930023 - protein, 27 aa, Mycobacterium
KLPDVPGLDRFGGTVFHSATWNHDHDL

SEQ ID NO: 930024 - protein, 18 aa, Mycobacterium
KLPLLLAAGAALAQPPRA

SEQ ID NO: 930025 - protein, 20 aa, Mycobacterium
KLPLLQPLRDLGFPESFVAA

SEQ ID NO: 930026 - protein, 23 aa, Mycobacterium
KLPNPRYTRLTGITRNRFPWLDR

SEQ ID NO: 930027 - protein, 21 aa, Mycobacterium
KLPQCIPNVVLGTSDGTFPAI

SEQ ID NO: 930028 - protein, 20 aa, Mycobacterium
KLPQCVPNYVLGTVTKTAVP

SEQ ID NO: 930029 - protein, 18 aa, Mycobacterium
KLQATKSRVRDVKATVDV

SEQ ID NO: 930030 - protein, 18 aa, Mycobacterium
KLQATKSRVRDVQVDVDV

SEQ ID NO: 930031 - protein, 21 aa, Mycobacterium
KLQLARPGRFNGVGLQGGLHI

SEQ ID NO: 930032 - protein, 17 aa, Mycobacterium
KLRASDIPDEAAGTVSR

SEQ ID NO: 930033 - protein, 21 aa, Mycobacterium
KLREELGWQPGYGDFEHGLAA

SEQ ID NO: 930034 - protein, 19 aa, Mycobacterium
KLSDTQVRKAILGLLDVDL

SEQ ID NO: 930035 - protein, 21 aa, Mycobacterium
KLSELRRFYDAVIFSTGARAD

SEQ ID NO: 930036 - protein, 24 aa, Mycobacterium
KLSFPASAAPSGWTVFSDDQGPNL

SEQ ID NO: 930037 - protein, 19 aa, Mycobacterium
KLSKWLPDFPHADRVTLGQ

SEQ ID NO: 930038 - protein, 24 aa, Mycobacterium
KLSPDGLRWSTTEQLGYNRRYTLN

SEQ ID NO: 930039 - protein, 21 aa, Mycobacterium
KLTDERWLHITGAVEIVSGDD

SEQ ID NO: 930040 - protein, 23 aa, Mycobacterium
KLTGGDRGLYFGGKNAVEAYGGY

SEQ ID NO: 930041 - protein, 20 aa, Mycobacterium
KLTKDFPLGIHWDSVQVTDT

SEQ ID NO: 930042 - protein, 27 aa, Mycobacterium
KLTKDGKISTVWTWPDKPGVAGCAALD

SEQ ID NO: 930043 - protein, 23 aa, Mycobacterium
KLVKTVDEVSCIRQAQRLNELAM

SEQ ID NO: 930044 - protein, 20 aa, Mycobacterium
KLVRARRLGVGAAAAVGACA

SEQ ID NO: 930045 - protein, 17 aa, Mycobacterium
KMAAFHDQFVRTLSNGA

SEQ ID NO: 930046 - protein, 24 aa, Mycobacterium
KMGGFAVPMSFSPEGEGWKLSKRT

SEQ ID NO: 930047 - protein, 28 aa, Mycobacterium
KMLDRSFDPGFRIELHHKDLGILTNAAR

SEQ ID NO: 930048 - protein, 22 aa, Mycobacterium
KMLTECLRLELGPKGIGVSAIC

SEQ ID NO: 930049 - protein, 23 aa, Mycobacterium
KMLTECLRLELGPRGIGVSAVCP

SEQ ID NO: 930050 - protein, 20 aa, Mycobacterium
KMQNGSWFRSPFLVTDNAYI

SEQ ID NO: 930051 - protein, 20 aa, Mycobacterium
KMSRREFLAKLAAATSTGAL

SEQ ID NO: 930052 - protein, 24 aa, Mycobacterium
KNAAPDAVYFGGYYAEAAPLVQQL

SEQ ID NO: 930053 - protein, 18 aa, Mycobacterium
KNAERFALQDCIWRDTYY

SEQ ID NO: 930054 - protein, 22 aa, Mycobacterium
KNAKFVAVAGIGLLSPGNTGQL

SEQ ID NO: 930055 - protein, 26 aa, Mycobacterium
KNELSWRDCTSRVFASASVPPLPGVK

SEQ ID NO: 930056 - protein, 17 aa, Mycobacterium
KNEPAGVAQITLGSNKD

SEQ ID NO: 930057 - protein, 17 aa, Mycobacterium
KNEPAGVAQITLGTNKD

SEQ ID NO: 930058 - protein, 25 aa, Mycobacterium
KNGDPFIWDRGRELGMVNRLQRVGP

SEQ ID NO: 930059 - protein, 19 aa, Mycobacterium
KNLIRWRGRVRSYRSTIPR

SEQ ID NO: 930060 - protein, 24 aa, Mycobacterium
KNLTRFQTAFVLKSYVPPQRAAAA

SEQ ID NO: 930061 - protein, 29 aa, Mycobacterium
KNNTYTVYFAMRFSRPFTSYGTWDGYAVY

SEQ ID NO: 930062 - protein, 23 aa, Mycobacterium
KNRHLADAIDMWAYSSLRASPGA

SEQ ID NO: 930063 - protein, 18 aa, Mycobacterium
KNSLARALLSTGAGSAPD

SEQ ID NO: 930064 - protein, 20 aa, Mycobacterium
KNTPAMLSVPPWAVEPVIEL

SEQ ID NO: 930065 - protein, 17 aa, Mycobacterium
KNYPGRYADVWNAVEKR

SEQ ID NO: 930066 - protein, 27 aa, Mycobacterium
KPANARAAELISAGWLDDMFTATSASG

SEQ ID NO: 930067 - protein, 19 aa, Mycobacterium
KPDDIGWAAAFLASDAASY

SEQ ID NO: 930068 - protein, 19 aa, Mycobacterium
KPDPFRAGWATVPGSVRPG

SEQ ID NO: 930069 - protein, 28 aa, Mycobacterium
KPESVTCPADLPAKVGAQLNCEMKVKDS

SEQ ID NO: 930070 - protein, 28 aa, Mycobacterium
KPESVTCPGDLPAKVGAQLNCEMKVKDS

SEQ ID NO: 930071 - protein, 19 aa, Mycobacterium
KPGECVADLPPPDLSRVTV

SEQ ID NO: 930072 - protein, 25 aa, Mycobacterium
KPGPPELPPAVSAYTGLPGDTPDYP

SEQ ID NO: 930073 - protein, 25 aa, Mycobacterium
KPGPPELPPAVSAYTGLPGDTPEAP

SEQ ID NO: 930074 - protein, 17 aa, Mycobacterium
KPGRRIHGEPLPWQDLR

SEQ ID NO: 930075 - protein, 21 aa, Mycobacterium
KPGSYPIVLATYEIVCSQYPD

SEQ ID NO: 930076 - protein, 24 aa, Mycobacterium
KPGVADLRESPALAIIDDLTAAGA

SEQ ID NO: 930077 - protein, 23 aa, Mycobacterium
KPGVTVFPGMEIHQGAMVCTVGF

SEQ ID NO: 930078 - protein, 19 aa, Mycobacterium
KPHHGVAVVLSDGSFIRTE

SEQ ID NO: 930079 - protein, 24 aa, Mycobacterium
KPISEDRLSALLLSPSEINSVMGA

SEQ ID NO: 930080 - protein, 18 aa, Mycobacterium
KPKVSSGIGVSVTLLERT

SEQ ID NO: 930081 - protein, 20 aa, Mycobacterium
KPLDPKWRLNANVKCAMNLS

SEQ ID NO: 930082 - protein, 17 aa, Mycobacterium
KPLFVLFDSCWDPFPKL

SEQ ID NO: 930083 - protein, 20 aa, Mycobacterium
KPLNRWTTDRIALLGDAAHP

SEQ ID NO: 930084 - protein, 30 aa, Mycobacterium
KPNAYTVYFAMKFSRPFTSFGSWDGATVYA

SEQ ID NO: 930085 - protein, 17 aa, Mycobacterium
KPPEGRLYASLVKGQLT

SEQ ID NO: 930086 - protein, 24 aa, Mycobacterium
KPPPDACPLCPGPTGLTSEVPAPD

SEQ ID NO: 930087 - protein, 20 aa, Mycobacterium
KPRGMLFPIGSFGHSGFTGV

SEQ ID NO: 930088 - protein, 19 aa, Mycobacterium
KPTAPEIPPAVSAYTGLPG

SEQ ID NO: 930089 - protein, 19 aa, Mycobacterium
KPTLDLAVVSSEFAKSHPE

SEQ ID NO: 930090 - protein, 18 aa, Mycobacterium
KPVTCDDLVLAWAAQSGR

SEQ ID NO: 930091 - protein, 21 aa, Mycobacterium
KPYGFMPFYPGPGVGGHCIPC

SEQ ID NO: 930092 - protein, 20 aa, Mycobacterium
KQADWGYLVGSFKYSLYRLQ

SEQ ID NO: 930093 - protein, 25 aa, Mycobacterium
KQAEAAQIPYFFSQKGMLGVEPASQ

SEQ ID NO: 930094 - protein, 21 aa, Mycobacterium
KQAEWEVESAIYVYAPEVIPK

SEQ ID NO: 930095 - protein, 28 aa, Mycobacterium
KQAVQRCLCAAAALLTLVTACSSNPLHT

SEQ ID NO: 930096 - protein, 20 aa, Mycobacterium
KQDPDGWGRSPGFGTTVSFP

SEQ ID NO: 930097 - protein, 21 aa, Mycobacterium
KQDYKGLFLSFNLNLNVPPPC

SEQ ID NO: 930098 - protein, 25 aa, Mycobacterium
KQGYKGAFLSFNLRLNLPPPCLTGF

SEQ ID NO: 930099 - protein, 18 aa, Mycobacterium
KQLIAPYLRSWESVIGHQ

SEQ ID NO: 930100 - protein, 22 aa, Mycobacterium
KQPWPAGWQFPDDCVYAIGPGQ

SEQ ID NO: 930101 - protein, 19 aa, Mycobacterium
KQQLTRLATELGPSGGVSE

SEQ ID NO: 930102 - protein, 18 aa, Mycobacterium
KQRLLYGLVQYGIDLQGM

SEQ ID NO: 930103 - protein, 23 aa, Mycobacterium
KQRRGDLPIALTYDRSGRLETGE

SEQ ID NO: 930104 - protein, 25 aa, Mycobacterium
KQSGYRAGLLASISAACSCAAEVDL

SEQ ID NO: 930105 - protein, 24 aa, Mycobacterium
KQTIYRWWPTKGDILLESLAAQAD

SEQ ID NO: 930106 - protein, 17 aa, Mycobacterium
KQVPIDTFMQAWQASDY

SEQ ID NO: 930107 - protein, 25 aa, Mycobacterium
KQVVLEVFGAPGAVATINYLDVNAQ

SEQ ID NO: 930108 - protein, 19 aa, Mycobacterium
KQWLPANSVVPLYRRNELT

SEQ ID NO: 930109 - protein, 19 aa, Mycobacterium
KQYVVRFGLGYREEAKSDV

SEQ ID NO: 930110 - protein, 22 aa, Mycobacterium
KRAEPGIPLVALWDETTWYPGS

SEQ ID NO: 930111 - protein, 17 aa, Mycobacterium
KRAMILTAEGMREAAIK

SEQ ID NO: 930112 - protein, 17 aa, Mycobacterium
KRAMILTAEGMRESSIK

SEQ ID NO: 930113 - protein, 22 aa, Mycobacterium
KRDKLVKAAQAFGLDRELDSIP

SEQ ID NO: 930114 - protein, 18 aa, Mycobacterium
KREAVLHAFSSRLPNQKL

SEQ ID NO: 930115 - protein, 22 aa, Mycobacterium
KRELDALGWKQVGQFREKDGRP

SEQ ID NO: 930116 - protein, 25 aa, Mycobacterium
KRELFCARDPFGIKPLFMATGPGGT

SEQ ID NO: 930117 - protein, 23 aa, Mycobacterium
KRFAELREGVWLRPDNLDLELAA

SEQ ID NO: 930118 - protein, 18 aa, Mycobacterium
KRFDSFAAATYMNGPSRS

SEQ ID NO: 930119 - protein, 21 aa, Mycobacterium
KRFGVPVPNLTAWRRSVTGDM

SEQ ID NO: 930120 - protein, 33 aa, Mycobacterium
KRFKEVDALLGKYRKGDGFVFYDTVTQDQRIEL

SEQ ID NO: 930121 - protein, 21 aa, Mycobacterium
KRFQEMATLTTFTTWTTYDSW

SEQ ID NO: 930122 - protein, 23 aa, Mycobacterium
KRIDGAPLPWTLVLSTTAPSVFP

SEQ ID NO: 930123 - protein, 24 aa, Mycobacterium
KRIDGAPLPWTLVLSTTAPSVFPN

SEQ ID NO: 930124 - protein, 22 aa, Mycobacterium
KRIERGLWLTALLRATLTVVRG

SEQ ID NO: 930125 - protein, 20 aa, Mycobacterium
KRIRAGFPADWRVIDKTGSG

SEQ ID NO: 930126 - protein, 20 aa, Mycobacterium
KRLIVTGVSAAAMGLATFAG

SEQ ID NO: 930127 - protein, 20 aa, Mycobacterium
KRPADMPLTASADYHPFLVA

SEQ ID NO: 930128 - protein, 17 aa, Mycobacterium
KRPDYAWPPVNSPNQGA

SEQ ID NO: 930129 - protein, 21 aa, Mycobacterium
KRPGGDVSLIGYGRCVHDALA

SEQ ID NO: 930130 - protein, 20 aa, Mycobacterium
KRPRRFPLYDSRRVGPAVGT

SEQ ID NO: 930131 - protein, 26 aa, Mycobacterium
KRPSGYLAGAAYDYIVKTWLKPINID

SEQ ID NO: 930132 - protein, 18 aa, Mycobacterium
KRRGELPRGLGVGPNGDN

SEQ ID NO: 930133 - protein, 29 aa, Mycobacterium
KRTLLRLDPRLAPVKAAVLPLSRHADLSP

SEQ ID NO: 930134 - protein, 30 aa, Mycobacterium
KRTLRITARYAQHWNFAGGTPEEFARKRDV

SEQ ID NO: 930135 - protein, 26 aa, Mycobacterium
KRTTVELRTATPLGDVFVALKPPRPA

SEQ ID NO: 930136 - protein, 17 aa, Mycobacterium
KRVDILARHGHRAFHEW

SEQ ID NO: 930137 - protein, 25 aa, Mycobacterium
KRVDPPESCPVRINLEVVLETRGDL

SEQ ID NO: 930138 - protein, 19 aa, Mycobacterium
KRVGTPFASTAHYSLLSAL

SEQ ID NO: 930139 - protein, 19 aa, Mycobacterium
KRVLFSSDWYPALACDNVD

SEQ ID NO: 930140 - protein, 19 aa, Mycobacterium
KRVRVGVVGPGTVETEIFS

SEQ ID NO: 930141 - protein, 19 aa, Mycobacterium
KRVSAMPVADDRFYFFFDV

SEQ ID NO: 930142 - protein, 17 aa, Mycobacterium
KSADFDRRVSVAVDLSI

SEQ ID NO: 930143 - protein, 18 aa, Mycobacterium
KSAGCPLGTDPTQFVARF

SEQ ID NO: 930144 - protein, 18 aa, Mycobacterium
KSAMGPEMPPDLQGNMAA

SEQ ID NO: 930145 - protein, 33 aa, Mycobacterium
KSAYEYFTPFGWIKGFPFLALQVVWAPGSEMSV

SEQ ID NO: 930146 - protein, 23 aa, Mycobacterium
KSFPQLPFYAVWHPRLDHDASHL

SEQ ID NO: 930147 - protein, 21 aa, Mycobacterium
KSGAKWPDKFLAGAAGVAHGV

SEQ ID NO: 930148 - protein, 20 aa, Mycobacterium
KSGSGHLVLISSVLASKGVP

SEQ ID NO: 930149 - protein, 19 aa, Mycobacterium
KSGYAEVEFTVDRAVQVPA

SEQ ID NO: 930150 - protein, 17 aa, Mycobacterium
KSIRMLNAYVMSLGEAV

SEQ ID NO: 930151 - protein, 20 aa, Mycobacterium
KSKGIPLLAVNAALETPDLA

SEQ ID NO: 930152 - protein, 18 aa, Mycobacterium
KSLAREWAPHGITVNVVS

SEQ ID NO: 930153 - protein, 33 aa, Mycobacterium
KSLDVMALDVVWTAEFAEAGWAVPLSEDPAGLA

SEQ ID NO: 930154 - protein, 18 aa, Mycobacterium
KSLEGGAIYQRWQELGAM

SEQ ID NO: 930155 - protein, 19 aa, Mycobacterium
KSQGLKATFGGSRGSALPQ

SEQ ID NO: 930156 - protein, 20 aa, Mycobacterium
KSRRLLVAVSAIVAVVGAVV

SEQ ID NO: 930157 - protein, 24 aa, Mycobacterium
KSRTMPAMVAVAVVAFLVVGCVRW

SEQ ID NO: 930158 - protein, 19 aa, Mycobacterium
KSRVIDIVEENGFEVSDRD

SEQ ID NO: 930159 - protein, 19 aa, Mycobacterium
KSRVSEVLADYGYALSDRD

SEQ ID NO: 930160 - protein, 20 aa, Mycobacterium
KSTYLVAPVNWIKGDVSYSI

SEQ ID NO: 930161 - protein, 19 aa, Mycobacterium
KSVAARRAAVGSGASSTRV

SEQ ID NO: 930162 - protein, 28 aa, Mycobacterium
KSVDLLNRFLGLGLRFISAGTDVGMMTE

SEQ ID NO: 930163 - protein, 24 aa, Mycobacterium
KSVLFKYYTFFGGAAHPNTALATF

SEQ ID NO: 930164 - protein, 25 aa, Mycobacterium
KSVTDRFSGVIPESTLASMQNQHPV

SEQ ID NO: 930165 - protein, 21 aa, Mycobacterium
KSWLGVSGRARVLVYNPDIAP

SEQ ID NO: 930166 - protein, 18 aa, Mycobacterium
KSYPGYRVSNVGLCELSA

SEQ ID NO: 930167 - protein, 19 aa, Mycobacterium
KTAALIGCCCGLGALAADA

SEQ ID NO: 930168 - protein, 20 aa, Mycobacterium
KTAMAMAFTAGFALAGSVAA

SEQ ID NO: 930169 - protein, 25 aa, Mycobacterium
KTANPGVGVELDFAGSSELATQLTQ

SEQ ID NO: 930170 - protein, 26 aa, Mycobacterium
KTDAPLLKKILTYHVVPGQLSPSQVV

SEQ ID NO: 930171 - protein, 36 aa, Mycobacterium
KTDPSGVARLGRYLPDSDTWEWFGYPLESTDVDGDW

SEQ ID NO: 930172 - protein, 28 aa, Mycobacterium
KTFVGAAARGGRRLVIAMMYGLVKEGGP

SEQ ID NO: 930173 - protein, 20 aa, Mycobacterium
KTGLARLALHTGVPVIPVAM

SEQ ID NO: 930174 - protein, 20 aa, Mycobacterium
KTGPKWSILESAIGPTDVPW

SEQ ID NO: 930175 - protein, 31 aa, Mycobacterium
KTGVINNVFTPWTYDTWPSVFTQLEAQNPDI

SEQ ID NO: 930176 - protein, 26 aa, Mycobacterium
KTHPEVNGSFEWAEDNVVQWVPDDYW

SEQ ID NO: 930177 - protein, 17 aa, Mycobacterium
KTIGCSSPLGAYVDNTR

SEQ ID NO: 930178 - protein, 23 aa, Mycobacterium
KTILELAKAQGFATGDVTTSEIQ

SEQ ID NO: 930179 - protein, 17 aa, Mycobacterium
KTLRRWGPPGLTGYEIH

SEQ ID NO: 930180 - protein, 21 aa, Mycobacterium
KTLSAQGWGAWPVCSARVGAR

SEQ ID NO: 930181 - protein, 24 aa, Mycobacterium
KTMLRCALGFTVAATVLVTAPACG

SEQ ID NO: 930182 - protein, 20 aa, Mycobacterium
KTNLGIAFRDLCMRVVNAVP

SEQ ID NO: 930183 - protein, 20 aa, Mycobacterium
KTPRCRQLAGTQIPNLVLSQ

SEQ ID NO: 930184 - protein, 20 aa, Mycobacterium
KTPVEFSRVVAVLDKLSISL

SEQ ID NO: 930185 - protein, 22 aa, Mycobacterium
KTRAQPDCPTCFEQSEGYTYGL

SEQ ID NO: 930186 - protein, 26 aa, Mycobacterium
KTRQPWVVSFQLTWPRDHGPTVTGWM

SEQ ID NO: 930187 - protein, 19 aa, Mycobacterium
KTSEVDWVLERLGYELDSL

SEQ ID NO: 930188 - protein, 17 aa, Mycobacterium
KTSSEWDITDAAATEEI

SEQ ID NO: 930189 - protein, 40 aa, Mycobacterium
KTTPEVEGAFYWLNNREVRWRPAKYWKPGTTVEVEVNTYG

SEQ ID NO: 930190 - protein, 40 aa, Mycobacterium
KTTPPVEGAFYWLNNREVRWRPAEYWKPGTTVDVQVNTYG

SEQ ID NO: 930191 - protein, 18 aa, Mycobacterium
KTTYPVWTMNAIGDISFH

SEQ ID NO: 930192 - protein, 17 aa, Mycobacterium
KTVASRAKLNWWESRAL

SEQ ID NO: 930193 - protein, 18 aa, Mycobacterium
KTVLGPFLGLGFEVALLA

SEQ ID NO: 930194 - protein, 23 aa, Mycobacterium
KTVSGQLTILVPFVDRIRAKVDL

SEQ ID NO: 930195 - protein, 22 aa, Mycobacterium
KTVVPDPRYVAVADHDQLATEL

SEQ ID NO: 930196 - protein, 33 aa, Mycobacterium
KTVVSLDMGSMVAGAKYRGEFEERLKAVLDDIK

SEQ ID NO: 930197 - protein, 19 aa, Mycobacterium
KTVWVTGCRSWYLDDRGVP

SEQ ID NO: 930198 - protein, 18 aa, Mycobacterium
KVADGPRVRAGTRAIDLV

SEQ ID NO: 930199 - protein, 44 aa, Mycobacterium
KVADPELRAKLTPDYPVGCKRPLMSRDWYPTFSLPNVSLETTAI

SEQ ID NO: 930200 - protein, 21 aa, Mycobacterium
KVAQLKSSFGPEFKVSEVAPT

SEQ ID NO: 930201 - protein, 27 aa, Mycobacterium
KVATGLRWAEGPVYFPDGGYLLCSDTP

SEQ ID NO: 930202 - protein, 18 aa, Mycobacterium
KVDDGRCVKVAGSNTDLS

SEQ ID NO: 930203 - protein, 20 aa, Mycobacterium
KVECSCVGLKPGQPYTTRQL

SEQ ID NO: 930204 - protein, 19 aa, Mycobacterium
KVEGLPPILVVSTTNDPAT

SEQ ID NO: 930205 - protein, 23 aa, Mycobacterium
KVEGLRIDGDHIVMKFSIGTNTI

SEQ ID NO: 930206 - protein, 18 aa, Mycobacterium
KVESLAMVVDGNALSVSN

SEQ ID NO: 930207 - protein, 22 aa, Mycobacterium
KVFQRTPCWVLPRLDAATPPAV

SEQ ID NO: 930208 - protein, 21 aa, Mycobacterium
KVFQRTPCWVLPRLDVATPPA

SEQ ID NO: 930209 - protein, 19 aa, Mycobacterium
KVGAIGGITHKMAAARAAG

SEQ ID NO: 930210 - protein, 20 aa, Mycobacterium
KVGDRWEARFQRDPDAQTPA

SEQ ID NO: 930211 - protein, 25 aa, Mycobacterium
KVGELQGQGLVDCLGDRPANVVFLN

SEQ ID NO: 930212 - protein, 18 aa, Mycobacterium
KVGIFTMVMLLVAAGLVV

SEQ ID NO: 930213 - protein, 19 aa, Mycobacterium
KVGLAGLLENLGIELDPID

SEQ ID NO: 930214 - protein, 24 aa, Mycobacterium
KVGLPITASPVWGTRSIDLCNGAD

SEQ ID NO: 930215 - protein, 19 aa, Mycobacterium
KVGQKVLPQQARKADLLFY

SEQ ID NO: 930216 - protein, 19 aa, Mycobacterium
KVGQKVLPQQARKGDLIFY

SEQ ID NO: 930217 - protein, 27 aa, Mycobacterium
KVGVARRRFRVVAAWLACAGLLAPLAC

SEQ ID NO: 930218 - protein, 20 aa, Mycobacterium
KVGYDCSGFTMFSYAAAGVK

SEQ ID NO: 930219 - protein, 21 aa, Mycobacterium
KVKALPGAITYVEKGYADDVK

SEQ ID NO: 930220 - protein, 25 aa, Mycobacterium
KVKLPAGALCGKLAVPVDYDNLDGD

SEQ ID NO: 930221 - protein, 17 aa, Mycobacterium
KVMAVSWVASLPVSHGE

SEQ ID NO: 930222 - protein, 21 aa, Mycobacterium
KVNQWHMRLAVSKVGDQLSIT

SEQ ID NO: 930223 - protein, 19 aa, Mycobacterium
KVPLSLAQHRMWTVIQAQG

SEQ ID NO: 930224 - protein, 18 aa, Mycobacterium
KVRLGLPAGTHWVRHGTT

SEQ ID NO: 930225 - protein, 20 aa, Mycobacterium
KVSLPWSLHFDIGKTTAVGS

SEQ ID NO: 930226 - protein, 24 aa, Mycobacterium
KVTLELPETGGLYERSNVTYRGSQ

SEQ ID NO: 930227 - protein, 18 aa, Mycobacterium
KVTVAVDSSGRPMIGPGG

SEQ ID NO: 930228 - protein, 27 aa, Mycobacterium
KVVAFSIPRDDWVPFAGVPGYNHIKIK

SEQ ID NO: 930229 - protein, 17 aa, Mycobacterium
KWETFLTEELPAWLENN

SEQ ID NO: 930230 - protein, 18 aa, Mycobacterium
KWLTVLGPAPAPPVARYT

SEQ ID NO: 930231 - protein, 18 aa, Mycobacterium
KWLTVLGPAPAPPVARYV

SEQ ID NO: 930232 - protein, 20 aa, Mycobacterium
KWPVLFAGLMLGEPSFIPEP

SEQ ID NO: 930233 - protein, 21 aa, Mycobacterium
KWQGWAGGPGGGWNKPPTPLW

SEQ ID NO: 930234 - protein, 19 aa, Mycobacterium
KYDDCLIMAVADVVGQVTG

SEQ ID NO: 930235 - protein, 18 aa, Mycobacterium
KYKIESRPIAGIDSIVMR

SEQ ID NO: 930236 - protein, 25 aa, Mycobacterium
KYLCPKRRQGVLLALTEVWEHRLPK

SEQ ID NO: 930237 - protein, 22 aa, Mycobacterium
KYPANIEFIRVFLASPRDQRVN

SEQ ID NO: 930238 - protein, 26 aa, Mycobacterium
KYPAWRELFNDLLPAHIVKDIPGGFA

SEQ ID NO: 930239 - protein, 21 aa, Mycobacterium
KYSSGMPGLDSVVRFRWNGSG

SEQ ID NO: 930240 - protein, 19 aa, Mycobacterium
KYYFCDNCGGLQTEDPYWL

SEQ ID NO: 930241 - protein, 17 aa, Mycobacterium
LAAAAVEDLTRWASPQR

SEQ ID NO: 930242 - protein, 17 aa, Mycobacterium
LAAAGHRAIALDLPGYG

SEQ ID NO: 930243 - protein, 19 aa, Mycobacterium
LAAALKLFAEKGYAATSVA

SEQ ID NO: 930244 - protein, 17 aa, Mycobacterium
LAAALLAKAEFGVARVV

SEQ ID NO: 930245 - protein, 18 aa, Mycobacterium
LAAALLFKSADVPSQAVP

SEQ ID NO: 930246 - protein, 19 aa, Mycobacterium
LAAALPFAMTACGGGGDSG

SEQ ID NO: 930247 - protein, 18 aa, Mycobacterium
LAAALSLGALLAGCGAPD

SEQ ID NO: 930248 - protein, 27 aa, Mycobacterium
LAAARLAAHAAVFWLGRGRTASRETAI

SEQ ID NO: 930249 - protein, 17 aa, Mycobacterium
LAAARRTTITIPVPPDA

SEQ ID NO: 930250 - protein, 17 aa, Mycobacterium
LAAASMFGRIGRADEVA

SEQ ID NO: 930251 - protein, 20 aa, Mycobacterium
LAACAPWRPPSARPPPPDTL

SEQ ID NO: 930252 - protein, 30 aa, Mycobacterium
LAADGLPFVFDSFRLDSRLTSATAGDALLD

SEQ ID NO: 930253 - protein, 24 aa, Mycobacterium
LAADGRPTLDLAVVANAFADAHPE

SEQ ID NO: 930254 - protein, 23 aa, Mycobacterium
LAADLRATPGLDRLDNIEGLTLG

SEQ ID NO: 930255 - protein, 17 aa, Mycobacterium
LAAEALVRWEHPTRGLL

SEQ ID NO: 930256 - protein, 19 aa, Mycobacterium
LAAEGLTGPFRDDYNSLIH

SEQ ID NO: 930257 - protein, 25 aa, Mycobacterium
LAAGGHPAHSWWLGPSTVLAAFSAF

SEQ ID NO: 930258 - protein, 24 aa, Mycobacterium
LAAGLRDLRRVGAVGAGAADTARA

SEQ ID NO: 930259 - protein, 18 aa, Mycobacterium
LAAGRFVLREHRAEERSR

SEQ ID NO: 930260 - protein, 19 aa, Mycobacterium
LAAHCERLAVRWAGQVDDL

SEQ ID NO: 930261 - protein, 18 aa, Mycobacterium
LAAHLGRGVGRVATDTVV

SEQ ID NO: 930262 - protein, 19 aa, Mycobacterium
LAAICAAVVAGCTVATGGQ

SEQ ID NO: 930263 - protein, 17 aa, Mycobacterium
LAAISSPVRAMLGGAAP

SEQ ID NO: 930264 - protein, 18 aa, Mycobacterium
LAAKEIPEVFAYDYQTVE

SEQ ID NO: 930265 - protein, 20 aa, Mycobacterium
LAALCAVTLVSSGCARFNDA

SEQ ID NO: 930266 - protein, 17 aa, Mycobacterium
LAALVLVFTACSTGERV

SEQ ID NO: 930267 - protein, 17 aa, Mycobacterium
LAAMEAQVGVTLAARTT

SEQ ID NO: 930268 - protein, 18 aa, Mycobacterium
LAAMEAQVGVTLAVRTTR

SEQ ID NO: 930269 - protein, 19 aa, Mycobacterium
LAAMLRRAAELAGEAGMNP

SEQ ID NO: 930270 - protein, 19 aa, Mycobacterium
LAAMLRRSAQLAGQADMNP

SEQ ID NO: 930271 - protein, 18 aa, Mycobacterium
LAAPKEWGLAPTASGVAW

SEQ ID NO: 930272 - protein, 18 aa, Mycobacterium
LAAPMIAAAIASADPGTR

SEQ ID NO: 930273 - protein, 18 aa, Mycobacterium
LAASSAFGRIGQPREVAD

SEQ ID NO: 930274 - protein, 22 aa, Mycobacterium
LAASSLRSGECDVALAGGVTVM

SEQ ID NO: 930275 - protein, 26 aa, Mycobacterium
LAATAGEVPLAFALAAGSFRDGTRVA

SEQ ID NO: 930276 - protein, 26 aa, Mycobacterium
LAATAVQSRGAAPVTPVGAAGTTIAD

SEQ ID NO: 930277 - protein, 17 aa, Mycobacterium
LAATPFPVQLNDITRAY

SEQ ID NO: 930278 - protein, 23 aa, Mycobacterium
LAAVCGPALCISTPGTATAAPGA

SEQ ID NO: 930279 - protein, 17 aa, Mycobacterium
LAAVLQGWAHTQLLDTY

SEQ ID NO: 930280 - protein, 19 aa, Mycobacterium
LAAYPAILVELGNMKNADD

SEQ ID NO: 930281 - protein, 24 aa, Mycobacterium
LACERADLFAAIAPVAGTLGSNVG

SEQ ID NO: 930282 - protein, 17 aa, Mycobacterium
LACLARGILAFLANPEL

SEQ ID NO: 930283 - protein, 24 aa, Mycobacterium
LACTTEIFAAIGPVAGTQLNACRT

SEQ ID NO: 930284 - protein, 22 aa, Mycobacterium
LACWGADGQLHYKGRSDEQVKI

SEQ ID NO: 930285 - protein, 19 aa, Mycobacterium
LACYVLDPRLKATGGSRRL

SEQ ID NO: 930286 - protein, 20 aa, Mycobacterium
LADAAAWAGGAVRHGLMGDN

SEQ ID NO: 930287 - protein, 25 aa, Mycobacterium
LADAGGEVILWARRADVAEQINSTR

SEQ ID NO: 930288 - protein, 27 aa, Mycobacterium
LADAGNSVTLWARRPELADAINRTHRN

SEQ ID NO: 930289 - protein, 17 aa, Mycobacterium
LADEAWAEVLALSPDAD

SEQ ID NO: 930290 - protein, 21 aa, Mycobacterium
LADELPNWLAANKGLAPGGHG

SEQ ID NO: 930291 - protein, 20 aa, Mycobacterium
LADGGEWLRRSVAAVSDGGC

SEQ ID NO: 930292 - protein, 20 aa, Mycobacterium
LADIPRGGQIAIPNDPPNQA

SEQ ID NO: 930293 - protein, 18 aa, Mycobacterium
LADLKDPRAEWTLPTFSP

SEQ ID NO: 930294 - protein, 21 aa, Mycobacterium
LADQMIGYWSQFVRTGDPAAE

SEQ ID NO: 930295 - protein, 17 aa, Mycobacterium
LADVMALSASAFRRDAQ

SEQ ID NO: 930296 - protein, 17 aa, Mycobacterium
LADVPALVVSSDALAKI

SEQ ID NO: 930297 - protein, 18 aa, Mycobacterium
LADYFVHRTGHGIGLSVH

SEQ ID NO: 930298 - protein, 18 aa, Mycobacterium
LAEAEVIEIITGLRPDRP

SEQ ID NO: 930299 - protein, 22 aa, Mycobacterium
LAEEDRRFAVVYVDDQSEHARM

SEQ ID NO: 930300 - protein, 21 aa, Mycobacterium
LAEEPRTCVFFESPRRLAACL

SEQ ID NO: 930301 - protein, 25 aa, Mycobacterium
LAEILWDVIPFDWANDSNTAATRSM

SEQ ID NO: 930302 - protein, 19 aa, Mycobacterium
LAELDHLDFDYVFVDCPPS

SEQ ID NO: 930303 - protein, 20 aa, Mycobacterium
LAELKGEIESAGGTALVVTA

SEQ ID NO: 930304 - protein, 31 aa, Mycobacterium
LAELWGTAVFHCPFCHGWEMRDRKLAALAAG

SEQ ID NO: 930305 - protein, 21 aa, Mycobacterium
LAEMQLPIGSVIVNRNIPAYL

SEQ ID NO: 930306 - protein, 26 aa, Mycobacterium
LAENYLRLNALGAYGSFFNIFYCSVR

SEQ ID NO: 930307 - protein, 22 aa, Mycobacterium
LAEPYLLEGFDRAAWAHSPGTY

SEQ ID NO: 930308 - protein, 21 aa, Mycobacterium
LAEQGWVCLSIDYRVAPHHRW

SEQ ID NO: 930309 - protein, 26 aa, Mycobacterium
LAEQMRGGAIFARWESVGGPAGPLGN

SEQ ID NO: 930310 - protein, 25 aa, Mycobacterium
LAERLTEFFGGIPILDGVGSTEVGQ

SEQ ID NO: 930311 - protein, 24 aa, Mycobacterium
LAEVKRRLMALPESDRPASGELVF

SEQ ID NO: 930312 - protein, 17 aa, Mycobacterium
LAEVVARVWRDTQDEEG

SEQ ID NO: 930313 - protein, 26 aa, Mycobacterium
LAFAGGYAISVCKTVTLTVDGVAMQV

SEQ ID NO: 930314 - protein, 27 aa, Mycobacterium
LAFATIPAVLLRWGVSQFDADARPAQV

SEQ ID NO: 930315 - protein, 19 aa, Mycobacterium
LAFLREWWTTTPVSWESEF

SEQ ID NO: 930316 - protein, 18 aa, Mycobacterium
LAFYDPVEYNAWTPVNSI

SEQ ID NO: 930317 - protein, 21 aa, Mycobacterium
LAGAAKITFVPGFSGDAPPAP

SEQ ID NO: 930318 - protein, 19 aa, Mycobacterium
LAGAIAFASPLSYPLVADQ

SEQ ID NO: 930319 - protein, 18 aa, Mycobacterium
LAGAIAYASTLSYPVLAD

SEQ ID NO: 930320 - protein, 19 aa, Mycobacterium
LAGALKDKSVVVFRTPDAA

SEQ ID NO: 930321 - protein, 19 aa, Mycobacterium
LAGCGLRSASGTVLDAGPG

SEQ ID NO: 930322 - protein, 18 aa, Mycobacterium
LAGGCALAGTVTATADPA

SEQ ID NO: 930323 - protein, 20 aa, Mycobacterium
LAGGRPRPDIGPYFYEPTIL

SEQ ID NO: 930324 - protein, 19 aa, Mycobacterium
LAGIAWETGVLLGIADESP

SEQ ID NO: 930325 - protein, 19 aa, Mycobacterium
LAGIAWETGVLLGILEEAP

SEQ ID NO: 930326 - protein, 18 aa, Mycobacterium
LAGICAGLGAGAASAQTG

SEQ ID NO: 930327 - protein, 17 aa, Mycobacterium
LAGKRPADMPLNSRADY

SEQ ID NO: 930328 - protein, 19 aa, Mycobacterium
LAGKRPADMPLSIRSDYHP

SEQ ID NO: 930329 - protein, 23 aa, Mycobacterium
LAGLKANYGLDIPESRFVAISDG

SEQ ID NO: 930330 - protein, 19 aa, Mycobacterium
LAGLMPELDVLFGPENFEP

SEQ ID NO: 930331 - protein, 22 aa, Mycobacterium
LAGLPMELGAQWIGDTHHRMFA

SEQ ID NO: 930332 - protein, 18 aa, Mycobacterium
LAGLPRNELTFCVESEFA

SEQ ID NO: 930333 - protein, 33 aa, Mycobacterium
LAGLTVGPGIEFGHLPLSLGRTYWFAGERSLEA

SEQ ID NO: 930334 - protein, 20 aa, Mycobacterium
LAGNNTRLWVYSGNGTPSEI

SEQ ID NO: 930335 - protein, 17 aa, Mycobacterium
LAGPGGKYTWTINGKTY

SEQ ID NO: 930336 - protein, 22 aa, Mycobacterium
LAGPGVQLVVCAPQVPCGSATE

SEQ ID NO: 930337 - protein, 17 aa, Mycobacterium
LAGRRVVLNLWAYWCAP

SEQ ID NO: 930338 - protein, 17 aa, Mycobacterium
LAGSAVAGEPGWSTSQH

SEQ ID NO: 930339 - protein, 18 aa, Mycobacterium
LAGSIAASCTAAYKVALD

SEQ ID NO: 930340 - protein, 27 aa, Mycobacterium
LAGTAVAIPFWWSIHNIVLQELLRAHG

SEQ ID NO: 930341 - protein, 23 aa, Mycobacterium
LAHEFGHALQVMAKLVTRNDATI

SEQ ID NO: 930342 - protein, 23 aa, Mycobacterium
LAHEFGHALQVMAKLVTRRDPTI

SEQ ID NO: 930343 - protein, 23 aa, Mycobacterium
LAHVPAIVHRRFAVLPLSSVVVG

SEQ ID NO: 930344 - protein, 19 aa, Mycobacterium
LAIALPFAATACGGGDSGG

SEQ ID NO: 930345 - protein, 19 aa, Mycobacterium
LAICALSGCSARGTEPSPH

SEQ ID NO: 930346 - protein, 24 aa, Mycobacterium
LAIDSWMCAISGRAKEFKMIQYFK

SEQ ID NO: 930347 - protein, 26 aa, Mycobacterium
LAIELGRSGAKLAICDVDTEGLAATE

SEQ ID NO: 930348 - protein, 17 aa, Mycobacterium
LAIEPMLTLGTRKTLIL

SEQ ID NO: 930349 - protein, 30 aa, Mycobacterium
LAIERRVVAELNRLTGIGVHGEEFGGESLE

SEQ ID NO: 930350 - protein, 24 aa, Mycobacterium
LAIPEGNPWFTPYDRYREDGEEGL

SEQ ID NO: 930351 - protein, 17 aa, Mycobacterium
LAIPLLLGAAFLMVERL

SEQ ID NO: 930352 - protein, 18 aa, Mycobacterium
LAIVGGIGAGAKAFNGIL

SEQ ID NO: 930353 - protein, 26 aa, Mycobacterium
LAKAAELRYGRIPEMEKKLDAAVPHA

SEQ ID NO: 930354 - protein, 23 aa, Mycobacterium
LAKAEFGVARVVARVNDLRNEWL

SEQ ID NO: 930355 - protein, 20 aa, Mycobacterium
LAKALCGKGVDVDYNTYPGK

SEQ ID NO: 930356 - protein, 25 aa, Mycobacterium
LAKILCPTCNAVDPFMPEDWKVGLD

SEQ ID NO: 930357 - protein, 18 aa, Mycobacterium
LAKLEGDAAFFWAPDTNA

SEQ ID NO: 930358 - protein, 29 aa, Mycobacterium
LAKRSRRIWDEWGRRLGVELLCSDGVVAI

SEQ ID NO: 930359 - protein, 25 aa, Mycobacterium
LALEFSLPGGEQWRTAMAAAPVFMA

SEQ ID NO: 930360 - protein, 19 aa, Mycobacterium
LALEGRAGSRLTGRSFIDL

SEQ ID NO: 930361 - protein, 18 aa, Mycobacterium
LALILWDEVQVHAAAPNV

SEQ ID NO: 930362 - protein, 19 aa, Mycobacterium
LALLGIACAQPAPPPPAAA

SEQ ID NO: 930363 - protein, 17 aa, Mycobacterium
LALLVALAVFVAYQTIS

SEQ ID NO: 930364 - protein, 18 aa, Mycobacterium
LALPAVVLEVEFALDASG

SEQ ID NO: 930365 - protein, 19 aa, Mycobacterium
LALRGRKGMVLDPDDHDTW

SEQ ID NO: 930366 - protein, 23 aa, Mycobacterium
LALSAGTPVPQWAREGLADIRSS

SEQ ID NO: 930367 - protein, 19 aa, Mycobacterium
LALSSGRIDAAMAANISLA

SEQ ID NO: 930368 - protein, 25 aa, Mycobacterium
LALTEVWEHRLPKGVVGIISPWNYP

SEQ ID NO: 930369 - protein, 17 aa, Mycobacterium
LANAAGPGFRCTPQPGF

SEQ ID NO: 930370 - protein, 24 aa, Mycobacterium
LANDPRFSYVLLWEMFFPSLIEKK

SEQ ID NO: 930371 - protein, 18 aa, Mycobacterium
LANLAVNARLSYVRVPAL

SEQ ID NO: 930372 - protein, 17 aa, Mycobacterium
LAPAAVFLAVKGDTNPV

SEQ ID NO: 930373 - protein, 23 aa, Mycobacterium
LAPEGRDALYAQYAQQLPAGRMG

SEQ ID NO: 930374 - protein, 18 aa, Mycobacterium
LAPKELKIATAEGGGVVN

SEQ ID NO: 930375 - protein, 23 aa, Mycobacterium
LAPLGRPILCTEYMARPRGSTIE

SEQ ID NO: 930376 - protein, 30 aa, Mycobacterium
LAPVARDARFHWGVALMPSGPAGRVSVTNG

SEQ ID NO: 930377 - protein, 31 aa, Mycobacterium
LAPVARDARFRWGVAMMPAGPVARVSVTNGI

SEQ ID NO: 930378 - protein, 19 aa, Mycobacterium
LAQGWPRTQIVDVAEHAND

SEQ ID NO: 930379 - protein, 23 aa, Mycobacterium
LAQPKARRALALCTPRDTLARDA

SEQ ID NO: 930380 - protein, 18 aa, Mycobacterium
LAQRHWRVTAVNLVDKAA

SEQ ID NO: 930381 - protein, 26 aa, Mycobacterium
LAQRLRAVVLFATWAGRVLDGAPQNR

SEQ ID NO: 930382 - protein, 19 aa, Mycobacterium
LAQYPAVLVELGNMKNAGD

SEQ ID NO: 930383 - protein, 17 aa, Mycobacterium
LAQYPSILVELGNMKNP

SEQ ID NO: 930384 - protein, 17 aa, Mycobacterium
LAQYPSILVELGNMKSP

SEQ ID NO: 930385 - protein, 18 aa, Mycobacterium
LARHCDGLVVGKVGGGAT

SEQ ID NO: 930386 - protein, 17 aa, Mycobacterium
LARLGRGRAELVESEAR

SEQ ID NO: 930387 - protein, 24 aa, Mycobacterium
LARLQKTHGALMFHQSGGCCDGSS

SEQ ID NO: 930388 - protein, 19 aa, Mycobacterium
LARLTRGATTLAIDTRNNL

SEQ ID NO: 930389 - protein, 20 aa, Mycobacterium
LARMLLIWTAIASVALVLTG

SEQ ID NO: 930390 - protein, 17 aa, Mycobacterium
LARRAAMSTRHFTRAFT

SEQ ID NO: 930391 - protein, 24 aa, Mycobacterium
LARTELDGLIVLPGGVRASIERGI

SEQ ID NO: 930392 - protein, 18 aa, Mycobacterium
LASATGLTVDEMRTMQKG

SEQ ID NO: 930393 - protein, 18 aa, Mycobacterium
LASEGIDHVSAWLNMAKE

SEQ ID NO: 930394 - protein, 17 aa, Mycobacterium
LASERWRQTGFRTPRPE

SEQ ID NO: 930395 - protein, 24 aa, Mycobacterium
LASIFKLYVLHALADAIKSGTASW

SEQ ID NO: 930396 - protein, 27 aa, Mycobacterium
LASLDIAKGGLLGGVYAYLDNNNQLVM

SEQ ID NO: 930397 - protein, 42 aa, Mycobacterium
LASLQCPLREIGRAAPYLIRALKLILVRPFDIDAVPKAFRGD

SEQ ID NO: 930398 - protein, 22 aa, Mycobacterium
LASQGKGAWPTCGRGLSGATPR

SEQ ID NO: 930399 - protein, 19 aa, Mycobacterium
LASRGDIVVVTVNYRLGTL

SEQ ID NO: 930400 - protein, 19 aa, Mycobacterium
LASRYGCPALESTQVPTSA

SEQ ID NO: 930401 - protein, 26 aa, Mycobacterium
LASRYGCPALQAGRLPDTRTTTPPPP

SEQ ID NO: 930402 - protein, 23 aa, Mycobacterium
LASSCTWQLSLFIPDGVPPPAGD

SEQ ID NO: 930403 - protein, 28 aa, Mycobacterium
LATALPRRPQFALLKGRGNYLCLNKVHN

SEQ ID NO: 930404 - protein, 22 aa, Mycobacterium
LATELPRFAPPPDTTSVNAAGG

SEQ ID NO: 930405 - protein, 21 aa, Mycobacterium
LATGAGSRCQWLGNIKIANPQ

SEQ ID NO: 930406 - protein, 24 aa, Mycobacterium
LATIWRVLSRRGFITAQPQKRPRS

SEQ ID NO: 930407 - protein, 23 aa, Mycobacterium
LATKEIPQVFAYDYQTVERSLSD

SEQ ID NO: 930408 - protein, 26 aa, Mycobacterium
LATLSGCGFRGLNSFNLPGTKGGGPG

SEQ ID NO: 930409 - protein, 18 aa, Mycobacterium
LATVLSRCSYLCDGVAVR

SEQ ID NO: 930410 - protein, 30 aa, Mycobacterium
LAVAVSGCSGWRGLNSLPLPGVQGGGPGSF

SEQ ID NO: 930411 - protein, 24 aa, Mycobacterium
LAVELGRSGAKVAISDVDLEGLAQ

SEQ ID NO: 930412 - protein, 26 aa, Mycobacterium
LAVELRRRGCVVGRLIVLDATPRAEE

SEQ ID NO: 930413 - protein, 20 aa, Mycobacterium
LAVEPIIWRTYEATLPPDAV

SEQ ID NO: 930414 - protein, 22 aa, Mycobacterium
LAVGDCLKLAGPPDRPQATKAA

SEQ ID NO: 930415 - protein, 19 aa, Mycobacterium
LAVIFRAALNYPVIAQILR

SEQ ID NO: 930416 - protein, 26 aa, Mycobacterium
LAVIGLAGCGWRGLNSIPLPGTAGRG

SEQ ID NO: 930417 - protein, 17 aa, Mycobacterium
LAVLLVGLLAAGVVVLL

SEQ ID NO: 930418 - protein, 24 aa, Mycobacterium
LAVMTGRWQLVVFAAPFVGALAGA

SEQ ID NO: 930419 - protein, 19 aa, Mycobacterium
LAVNARLSYVRVPALNALF

SEQ ID NO: 930420 - protein, 19 aa, Mycobacterium
LAVPASWSSAAPALPSGTT

SEQ ID NO: 930421 - protein, 21 aa, Mycobacterium
LAVPMRLALPGAVNRGNAAQA

SEQ ID NO: 930422 - protein, 26 aa, Mycobacterium
LAVTAAEVPLAFALAAGSFRDATRVA

SEQ ID NO: 930423 - protein, 26 aa, Mycobacterium
LAVTASEVPLAFALAAGSFRDATRVA

SEQ ID NO: 930424 - protein, 17 aa, Mycobacterium
LAVTGRLLPYLVGADPV

SEQ ID NO: 930425 - protein, 26 aa, Mycobacterium
LAVVAGDVPLAFALAAGSFRDGTRVA

SEQ ID NO: 930426 - protein, 26 aa, Mycobacterium
LAVVAGEVPLAFALAAGSFRDGTRVA

SEQ ID NO: 930427 - protein, 17 aa, Mycobacterium
LAVVLAIGGCSSNGGSG

SEQ ID NO: 930428 - protein, 27 aa, Mycobacterium
LAWDRVYCSAGRRGWDVGVSPQDLIRL

SEQ ID NO: 930429 - protein, 26 aa, Mycobacterium
LAYAWDMGAYGWPAPERLRFANDPAN

SEQ ID NO: 930430 - protein, 19 aa, Mycobacterium
LAYGLGLWYGVMRERNAGA

SEQ ID NO: 930431 - protein, 17 aa, Mycobacterium
LCKSGARTGLSCGPVTS

SEQ ID NO: 930432 - protein, 19 aa, Mycobacterium
LCLVENLTVGHCYHPQPGS

SEQ ID NO: 930433 - protein, 24 aa, Mycobacterium
LCRNDCPRLAPGDFAQRPTVRTPH

SEQ ID NO: 930434 - protein, 17 aa, Mycobacterium
LCTPRDVIARNAEMPIA

SEQ ID NO: 930435 - protein, 19 aa, Mycobacterium
LCTQGEINAALLYATVSLV

SEQ ID NO: 930436 - protein, 20 aa, Mycobacterium
LCVVRAAAAATTWSEAAREL

SEQ ID NO: 930437 - protein, 19 aa, Mycobacterium
LDAALAYAPTYPFTQNLID

SEQ ID NO: 930438 - protein, 17 aa, Mycobacterium
LDACGAMAIELLAACPQ

SEQ ID NO: 930439 - protein, 17 aa, Mycobacterium
LDADYGLYAPVIIDDPA

SEQ ID NO: 930440 - protein, 23 aa, Mycobacterium
LDAGCLSTIMGRTVRTLSVLGGD

SEQ ID NO: 930441 - protein, 24 aa, Mycobacterium
LDAGRELAEALGLDPAAVTIASAP

SEQ ID NO: 930442 - protein, 21 aa, Mycobacterium
LDAGRELAKALGLDPGAVTIA

SEQ ID NO: 930443 - protein, 19 aa, Mycobacterium
LDAGRELAKALNLDPAAVT

SEQ ID NO: 930444 - protein, 23 aa, Mycobacterium
LDAGRELARALGLDPATVSIASA

SEQ ID NO: 930445 - protein, 25 aa, Mycobacterium
LDAIKKARDAGVVVIALDTATDPED

SEQ ID NO: 930446 - protein, 24 aa, Mycobacterium
LDALARNKMRVVPGLTSKAMSVAS

SEQ ID NO: 930447 - protein, 25 aa, Mycobacterium
LDALGWKLNGKFREKDGHQLVVRLL

SEQ ID NO: 930448 - protein, 22 aa, Mycobacterium
LDALRRFSDTAGTVIDAVHTDL

SEQ ID NO: 930449 - protein, 33 aa, Mycobacterium
LDANGVPVEMIWACGGHGVCLDPLNPIQTPLLV

SEQ ID NO: 930450 - protein, 34 aa, Mycobacterium
LDAPADATGTCWVAQYGKPAWPMVFAPVESPDSR

SEQ ID NO: 930451 - protein, 25 aa, Mycobacterium
LDAQPRLSILLGDYVAAPEGRVRLL

SEQ ID NO: 930452 - protein, 25 aa, Mycobacterium
LDAQPRLSILLGDYVVPAEGRVGLL

SEQ ID NO: 930453 - protein, 17 aa, Mycobacterium
LDARGIADFPTRFPTVT

SEQ ID NO: 930454 - protein, 17 aa, Mycobacterium
LDASLEWHDGVREFLQS

SEQ ID NO: 930455 - protein, 17 aa, Mycobacterium
LDAVAERLGATTWPVDL

SEQ ID NO: 930456 - protein, 17 aa, Mycobacterium
LDAYVAAGARAIVLEAL

SEQ ID NO: 930457 - protein, 30 aa, Mycobacterium
LDDRGVPVAWPWTFTRFRDVMARPALEDYE

SEQ ID NO: 930458 - protein, 19 aa, Mycobacterium
LDDRWTLSQILSWQSNAAV

SEQ ID NO: 930459 - protein, 31 aa, Mycobacterium
LDEDRPRLPAGEECSMFQLLIGYRYQSAAVV

SEQ ID NO: 930460 - protein, 17 aa, Mycobacterium
LDELADWATGGVLGEIT

SEQ ID NO: 930461 - protein, 20 aa, Mycobacterium
LDELIPMLGEQGLDTSRVGF

SEQ ID NO: 930462 - protein, 18 aa, Mycobacterium
LDELLVAQSYEFDPEKRK

SEQ ID NO: 930463 - protein, 17 aa, Mycobacterium
LDELRTQLLADFPNIKV

SEQ ID NO: 930464 - protein, 26 aa, Mycobacterium
LDFAGPWEVFGAWAADFPQDKYKPVS

SEQ ID NO: 930465 - protein, 27 aa, Mycobacterium
LDFDFAMLLPPFRGAALTAYDKRGNDI

SEQ ID NO: 930466 - protein, 28 aa, Mycobacterium
LDFDFAMLLPPFRGASLAAYDNAGNDIT

SEQ ID NO: 930467 - protein, 27 aa, Mycobacterium
LDFDFAMLLPPFRGASLAAYDRDGNDI

SEQ ID NO: 930468 - protein, 26 aa, Mycobacterium
LDFEGFRIADKPGLWFSTPFGLDCGI

SEQ ID NO: 930469 - protein, 22 aa, Mycobacterium
LDFMFRHIQPYFTEDINQLVNE

SEQ ID NO: 930470 - protein, 34 aa, Mycobacterium
LDGAAVGMPTCWDEWFPEVSRMYSLAGAEILVYP

SEQ ID NO: 930471 - protein, 18 aa, Mycobacterium
LDGCGTMVVALLAGCPRL

SEQ ID NO: 930472 - protein, 17 aa, Mycobacterium
LDGDSLLLFLPSVRLGP

SEQ ID NO: 930473 - protein, 23 aa, Mycobacterium
LDGESMLSMGPQLVSTIPQALQG

SEQ ID NO: 930474 - protein, 24 aa, Mycobacterium
LDGFKRFANITFEDWQRVIDVNLN

SEQ ID NO: 930475 - protein, 20 aa, Mycobacterium
LDGFVAIYLDVLRRFDRMYS

SEQ ID NO: 930476 - protein, 19 aa, Mycobacterium
LDGIPRIVAEGVYDDAGLD

SEQ ID NO: 930477 - protein, 18 aa, Mycobacterium
LDGLRWSPGPDDTLRALL

SEQ ID NO: 930478 - protein, 17 aa, Mycobacterium
LDGMPLAIELAAARVRA

SEQ ID NO: 930479 - protein, 18 aa, Mycobacterium
LDGSHLVVRAIERGLAAG

SEQ ID NO: 930480 - protein, 21 aa, Mycobacterium
LDGWLRPVPVGVVGELYVAGA

SEQ ID NO: 930481 - protein, 25 aa, Mycobacterium
LDGYPQRFGIPEGLYAEPVAVKQGW

SEQ ID NO: 930482 - protein, 20 aa, Mycobacterium
LDHTGRLFVVDRLKDIIVTG

SEQ ID NO: 930483 - protein, 17 aa, Mycobacterium
LDIPPLPTGITYTQVAA

SEQ ID NO: 930484 - protein, 25 aa, Mycobacterium
LDISRAEEVLGWRPQVELADGVRRT

SEQ ID NO: 930485 - protein, 23 aa, Mycobacterium
LDKFLRPVLDGVIGELYIAGAGV

SEQ ID NO: 930486 - protein, 17 aa, Mycobacterium
LDKVVGGAVPRQFIPSV

SEQ ID NO: 930487 - protein, 17 aa, Mycobacterium
LDLAGTRVSTWAYGGRV

SEQ ID NO: 930488 - protein, 21 aa, Mycobacterium
LDLAYMCRVRPALAGEPVPAG

SEQ ID NO: 930489 - protein, 18 aa, Mycobacterium
LDLEWPVPQRTPPVCEAL

SEQ ID NO: 930490 - protein, 22 aa, Mycobacterium
LDLHPDIHLFSAIPEVRSSTAE

SEQ ID NO: 930491 - protein, 20 aa, Mycobacterium
LDLIARRQVAALLINPQTST

SEQ ID NO: 930492 - protein, 20 aa, Mycobacterium
LDLLGRMRSGLIDYTETGDF

SEQ ID NO: 930493 - protein, 17 aa, Mycobacterium
LDLPGWIREAQFEAGND

SEQ ID NO: 930494 - protein, 17 aa, Mycobacterium
LDLRWGRPYARSPWRTN

SEQ ID NO: 930495 - protein, 21 aa, Mycobacterium
LDMFYNLGIAGRAMRRVGAIE

SEQ ID NO: 930496 - protein, 17 aa, Mycobacterium
LDPAAAVERIAAFDLVV

SEQ ID NO: 930497 - protein, 23 aa, Mycobacterium
LDPAGRRQLVDWMLANQTSSMRA

SEQ ID NO: 930498 - protein, 19 aa, Mycobacterium
LDPAKALALANEVDKLIWA

SEQ ID NO: 930499 - protein, 24 aa, Mycobacterium
LDPKTGEVYGWLAEEFSRNDDATR

SEQ ID NO: 930500 - protein, 20 aa, Mycobacterium
LDPRCRKASALAGRAQGRRE

SEQ ID NO: 930501 - protein, 23 aa, Mycobacterium
LDQIGIDLSDVFVVLEDEGVEKF

SEQ ID NO: 930502 - protein, 23 aa, Mycobacterium
LDQMKGIFDKATFTPQECADKML

SEQ ID NO: 930503 - protein, 17 aa, Mycobacterium
LDQSAAFLAPRADTLFI

SEQ ID NO: 930504 - protein, 25 aa, Mycobacterium
LDRAGFKGLCYFDPGARSFYTTDRV

SEQ ID NO: 930505 - protein, 25 aa, Mycobacterium
LDREHRVAAVFLRELLAQDLQPVVE

SEQ ID NO: 930506 - protein, 19 aa, Mycobacterium
LDRGAYRGYSMVFDLFAVG

SEQ ID NO: 930507 - protein, 27 aa, Mycobacterium
LDRMIWEVGHSLPLFQAPGNVAVRSDL

SEQ ID NO: 930508 - protein, 23 aa, Mycobacterium
LDRNTTLWASWAFTGPNRRAYFG

SEQ ID NO: 930509 - protein, 21 aa, Mycobacterium
LDRNTTLWASWVFRGPTHRAY

SEQ ID NO: 930510 - protein, 24 aa, Mycobacterium
LDRQHRVAAVFLRELLAEDLEPLI

SEQ ID NO: 930511 - protein, 25 aa, Mycobacterium
LDRQHRVAAVFLRELLAPDLQPVVQ

SEQ ID NO: 930512 - protein, 25 aa, Mycobacterium
LDRQHRVAAVFLRELLAQDLRPVVE

SEQ ID NO: 930513 - protein, 24 aa, Mycobacterium
LDRQHRVAAVFLREMLAGDLQPVV

SEQ ID NO: 930514 - protein, 35 aa, Mycobacterium
LDRTPWRAEEPIVIAAPMFHAWGFSQLLFAALLAC

SEQ ID NO: 930515 - protein, 24 aa, Mycobacterium
LDRYLRLPLRDALWGGDEHLLEST

SEQ ID NO: 930516 - protein, 18 aa, Mycobacterium
LDSATAYVLAKRGVVRLA

SEQ ID NO: 930517 - protein, 21 aa, Mycobacterium
LDSEHPFIYITTITNPRHGTF

SEQ ID NO: 930518 - protein, 19 aa, Mycobacterium
LDSFLARLEPSLPAFRHDL

SEQ ID NO: 930519 - protein, 17 aa, Mycobacterium
LDSGGTLTCVNNRWQNG

SEQ ID NO: 930520 - protein, 19 aa, Mycobacterium
LDSGIFEHRCPACGDPVRW

SEQ ID NO: 930521 - protein, 19 aa, Mycobacterium
LDSPCAREGDSWELLGNAR

SEQ ID NO: 930522 - protein, 26 aa, Mycobacterium
LDSRAYRLDWPAGHTVYEVDQPRVLA

SEQ ID NO: 930523 - protein, 24 aa, Mycobacterium
LDSRGRDLLTDWLKRNTTGDQSIR

SEQ ID NO: 930524 - protein, 19 aa, Mycobacterium
LDSVKDWVLSAAASVPDNA

SEQ ID NO: 930525 - protein, 27 aa, Mycobacterium
LDSVLPDRPGFFFAVDAHSMWANSKSL

SEQ ID NO: 930526 - protein, 17 aa, Mycobacterium
LDSVRKLTQFASDREQV

SEQ ID NO: 930527 - protein, 27 aa, Mycobacterium
LDTASHGAWGRGAGRQFYGGVGEGVKG

SEQ ID NO: 930528 - protein, 26 aa, Mycobacterium
LDTDAGRAAAGWLRAKTGSLTGTNAL

SEQ ID NO: 930529 - protein, 25 aa, Mycobacterium
LDVADSRIKAVFAMAPGMVRDFGMD

SEQ ID NO: 930530 - protein, 17 aa, Mycobacterium
LDVALLFGVTDQTALKT

SEQ ID NO: 930531 - protein, 21 aa, Mycobacterium
LDVIRAGDVVDVLTTHDEEAK

SEQ ID NO: 930532 - protein, 18 aa, Mycobacterium
LDVPYTRIHEFRHFHLER

SEQ ID NO: 930533 - protein, 19 aa, Mycobacterium
LDVRWRLDEPDGRPAYLAG

SEQ ID NO: 930534 - protein, 18 aa, Mycobacterium
LDVSGYLKSIYDPYTLLD

SEQ ID NO: 930535 - protein, 20 aa, Mycobacterium
LDVVSKLLFEGHGVITGVNN

SEQ ID NO: 930536 - protein, 26 aa, Mycobacterium
LDVVYSFAANPSWNPFAFSSLTSTDR

SEQ ID NO: 930537 - protein, 19 aa, Mycobacterium
LDWSALGALPAWEAGAPHP

SEQ ID NO: 930538 - protein, 18 aa, Mycobacterium
LDYFPEDFLLVIDESHVT

SEQ ID NO: 930539 - protein, 18 aa, Mycobacterium
LEAAIDWAGEPGADVFSH

SEQ ID NO: 930540 - protein, 27 aa, Mycobacterium
LEAAVQRSVVISAGWDVMDFVQQMQKL

SEQ ID NO: 930541 - protein, 21 aa, Mycobacterium
LEAAVQRSVVISSGWDVMDFV

SEQ ID NO: 930542 - protein, 17 aa, Mycobacterium
LEAFPLWSTPWGLGVPS

SEQ ID NO: 930543 - protein, 17 aa, Mycobacterium
LEARGSGDYGGFDVDLR

SEQ ID NO: 930544 - protein, 17 aa, Mycobacterium
LEDGCLVWAEAQEYSYE

SEQ ID NO: 930545 - protein, 22 aa, Mycobacterium
LEDLPGLLSPLSETGLPPGPIA

SEQ ID NO: 930546 - protein, 18 aa, Mycobacterium
LEDVPIGAASQVAAGVCD

SEQ ID NO: 930547 - protein, 18 aa, Mycobacterium
LEEGRRWTVEEFRTTHPI

SEQ ID NO: 930548 - protein, 19 aa, Mycobacterium
LEELASWARKHYPGAEQTH

SEQ ID NO: 930549 - protein, 20 aa, Mycobacterium
LEELKAELLGANPGIKVAVR

SEQ ID NO: 930550 - protein, 24 aa, Mycobacterium
LEELQRRAAVRWAQVTAVRVDRDA

SEQ ID NO: 930551 - protein, 20 aa, Mycobacterium
LEGETAKLLRMEDELGHRVI

SEQ ID NO: 930552 - protein, 19 aa, Mycobacterium
LEGETAKLLRMEEELGKRV

SEQ ID NO: 930553 - protein, 17 aa, Mycobacterium
LEGGEAFTAEEQPAELD

SEQ ID NO: 930554 - protein, 19 aa, Mycobacterium
LEGLTLRTNQQFQNSYVAA

SEQ ID NO: 930555 - protein, 18 aa, Mycobacterium
LEGPEPFLHTNVVGTFTI

SEQ ID NO: 930556 - protein, 17 aa, Mycobacterium
LEHAIATTRGSYLVYNF

SEQ ID NO: 930557 - protein, 20 aa, Mycobacterium
LEHDGSRWRIETSIGERDEA

SEQ ID NO: 930558 - protein, 19 aa, Mycobacterium
LEHGHRADAPTAGDMIFTD

SEQ ID NO: 930559 - protein, 23 aa, Mycobacterium
LEHWPAFLKSFLRLSALIESAAD

SEQ ID NO: 930560 - protein, 32 aa, Mycobacterium
LEKAKSLLDAAGWKPGPDGIRVKDGKRLSIHQ

SEQ ID NO: 930561 - protein, 24 aa, Mycobacterium
LEKDNCKLITWPIATLSPNGIRTA

SEQ ID NO: 930562 - protein, 30 aa, Mycobacterium
LELDLHYIRRLDLVGGRGVTVCHGLGPDKA

SEQ ID NO: 930563 - protein, 19 aa, Mycobacterium
LELDLHYLPRLELLGKREV

SEQ ID NO: 930564 - protein, 19 aa, Mycobacterium
LELDRRLPGDLAILTPSPA

SEQ ID NO: 930565 - protein, 28 aa, Mycobacterium
LELGLAQRLMKFFGGIPLLDGIGSTEVG

SEQ ID NO: 930566 - protein, 17 aa, Mycobacterium
LELGVTYRDPRTTLADT

SEQ ID NO: 930567 - protein, 20 aa, Mycobacterium
LELLGKREVTVCHGLAPNNG

SEQ ID NO: 930568 - protein, 18 aa, Mycobacterium
LELRRRLPGDLSILTPAP

SEQ ID NO: 930569 - protein, 17 aa, Mycobacterium
LELRYLFDTGGAPPPSP

SEQ ID NO: 930570 - protein, 21 aa, Mycobacterium
LELTSAAAMRAAVLAGAGPAA

SEQ ID NO: 930571 - protein, 19 aa, Mycobacterium
LEMYRRKGGDYDRWISGMR

SEQ ID NO: 930572 - protein, 24 aa, Mycobacterium
LENGDVVQAWTISDLKPSSDPIPY

SEQ ID NO: 930573 - protein, 22 aa, Mycobacterium
LEPARAAFDWSRRTQRPDGSWP

SEQ ID NO: 930574 - protein, 23 aa, Mycobacterium
LEPLGRPILCTEYLARSEGSTLE

SEQ ID NO: 930575 - protein, 19 aa, Mycobacterium
LEPPFNLQFVLGVLGANAA

SEQ ID NO: 930576 - protein, 18 aa, Mycobacterium
LEPSIGMPVGDIAGRYQV

SEQ ID NO: 930577 - protein, 23 aa, Mycobacterium
LEPSVRFNPVLLKPGSDRTSQLV

SEQ ID NO: 930578 - protein, 26 aa, Mycobacterium
LEPTYLAVDVINLFTGLNLNNPIGTA

SEQ ID NO: 930579 - protein, 25 aa, Mycobacterium
LEQLAGRTLTEWSIDDNEGFKAFDD

SEQ ID NO: 930580 - protein, 17 aa, Mycobacterium
LEQQLLAAINAPTQTLL

SEQ ID NO: 930581 - protein, 25 aa, Mycobacterium
LERGGLRLTRRSPLATAARRVLGVL

SEQ ID NO: 930582 - protein, 19 aa, Mycobacterium
LERPQRFTLTDTRTGALRV

SEQ ID NO: 930583 - protein, 18 aa, Mycobacterium
LERRYVHGARWCDASDIA

SEQ ID NO: 930584 - protein, 20 aa, Mycobacterium
LERTRLRVGSRMTLATPMFH

SEQ ID NO: 930585 - protein, 19 aa, Mycobacterium
LESGCYARIRPGCNPVVTR

SEQ ID NO: 930586 - protein, 17 aa, Mycobacterium
LESLRLWHEQFLGSLPA

SEQ ID NO: 930587 - protein, 18 aa, Mycobacterium
LESLRLWHESGFLDGLPP

SEQ ID NO: 930588 - protein, 19 aa, Mycobacterium
LESLRPCGVDEVVVIGRRG

SEQ ID NO: 930589 - protein, 18 aa, Mycobacterium
LESTSGLIMLPDSQSALV

SEQ ID NO: 930590 - protein, 25 aa, Mycobacterium
LESVITPNLFPGVSISADLGNGPGI

SEQ ID NO: 930591 - protein, 19 aa, Mycobacterium
LETAAKWAGLGGLTKAAKK

SEQ ID NO: 930592 - protein, 22 aa, Mycobacterium
LETARPADLLVLLDSLQQREAA

SEQ ID NO: 930593 - protein, 20 aa, Mycobacterium
LETLPPPTITAWRDVDAVLS

SEQ ID NO: 930594 - protein, 25 aa, Mycobacterium
LETPRAAPRLRNVLRQAAERDVPVV

SEQ ID NO: 930595 - protein, 19 aa, Mycobacterium
LETTRPALVLGDTVYLDAL

SEQ ID NO: 930596 - protein, 25 aa, Mycobacterium
LEVFLPSGHAFRFPSWSVERVVMPW

SEQ ID NO: 930597 - protein, 19 aa, Mycobacterium
LEVNWPYVLASMLENAVKG

SEQ ID NO: 930598 - protein, 25 aa, Mycobacterium
LEVRGYRFAPSFSIWTTIEECLNPP

SEQ ID NO: 930599 - protein, 25 aa, Mycobacterium
LEYELDPAKLLDFPAMTDMRDPLTT

SEQ ID NO: 930600 - protein, 24 aa, Mycobacterium
LEYELDVAKLLDFPLMTDMRDPLT

SEQ ID NO: 930601 - protein, 17 aa, Mycobacterium
LEYLKYPDAVTVATVSE

SEQ ID NO: 930602 - protein, 23 aa, Mycobacterium
LFAAGLTKPGLRRKMMGALCRAS

SEQ ID NO: 930603 - protein, 18 aa, Mycobacterium
LFAGIPYAAPPVGALRWQ

SEQ ID NO: 930604 - protein, 18 aa, Mycobacterium
LFAGIPYAAPPVGSLRFA

SEQ ID NO: 930605 - protein, 22 aa, Mycobacterium
LFAVGLTKPGVRRKIMGALCRA

SEQ ID NO: 930606 - protein, 18 aa, Mycobacterium
LFCRAAGGQWSDLVQGKQ

SEQ ID NO: 930607 - protein, 17 aa, Mycobacterium
LFDAGVVKKHVDVAIEY

SEQ ID NO: 930608 - protein, 19 aa, Mycobacterium
LFDGAPPPPGEWMYYAFAT

SEQ ID NO: 930609 - protein, 24 aa, Mycobacterium
LFEAQRWPGHSGDYFVVRSGSIVA

SEQ ID NO: 930610 - protein, 17 aa, Mycobacterium
LFETHFFGTVALIKAVL

SEQ ID NO: 930611 - protein, 27 aa, Mycobacterium
LFGEPLLAFRIPWYVTVLDLGPAGAVY

SEQ ID NO: 930612 - protein, 25 aa, Mycobacterium
LFGEPSSGFSSMLWGGQPLPTINPL

SEQ ID NO: 930613 - protein, 25 aa, Mycobacterium
LFGEPSSGFSSMLWGGQPLPTLNPL

SEQ ID NO: 930614 - protein, 18 aa, Mycobacterium
LFGFPTVIAHGMFTAAAV

SEQ ID NO: 930615 - protein, 24 aa, Mycobacterium
LFGHCLGAVVAFEFARIAEGHGVD

SEQ ID NO: 930616 - protein, 22 aa, Mycobacterium
LFGTPSPFFLGLVDHSAPPLVI

SEQ ID NO: 930617 - protein, 17 aa, Mycobacterium
LFIEHVYFWGDPLIDEL

SEQ ID NO: 930618 - protein, 17 aa, Mycobacterium
LFRPDLETLTADLPVVG

SEQ ID NO: 930619 - protein, 19 aa, Mycobacterium
LFTAGSMILFGIDFATCAD

SEQ ID NO: 930620 - protein, 18 aa, Mycobacterium
LFTNPAAAMQFLVELMLF

SEQ ID NO: 930621 - protein, 18 aa, Mycobacterium
LFTTIPFVKDNLTKWWRG

SEQ ID NO: 930622 - protein, 19 aa, Mycobacterium
LFTTSFFDPNMQHFNDVVN

SEQ ID NO: 930623 - protein, 18 aa, Mycobacterium
LFYNKRLFADAGVPAPPT

SEQ ID NO: 930624 - protein, 24 aa, Mycobacterium
LFYNKRLFAEAGLPAPPRTWEQPW

SEQ ID NO: 930625 - protein, 30 aa, Mycobacterium
LGAAALVLTSCGSWKGIANIPLPGGPGTGS

SEQ ID NO: 930626 - protein, 25 aa, Mycobacterium
LGACRLLGFNTVRVFLHDLLWAQDR

SEQ ID NO: 930627 - protein, 28 aa, Mycobacterium
LGADEISSAVAVMFGNHAQAYQAVSAQA

SEQ ID NO: 930628 - protein, 18 aa, Mycobacterium
LGADGGRVTAEQLATVIK

SEQ ID NO: 930629 - protein, 17 aa, Mycobacterium
LGADQVWVLPTGYSCAL

SEQ ID NO: 930630 - protein, 25 aa, Mycobacterium
LGADTWHWHPMASFASSSKVGGLSV

SEQ ID NO: 930631 - protein, 19 aa, Mycobacterium
LGAEMARQFAAKGRDLALC

SEQ ID NO: 930632 - protein, 24 aa, Mycobacterium
LGAGDAVLAGGTWLFSEPQPQLRR

SEQ ID NO: 930633 - protein, 21 aa, Mycobacterium
LGAGGALVFAALGSSVACESG

SEQ ID NO: 930634 - protein, 26 aa, Mycobacterium
LGAGGYRLTAVFANALNLPERAKVKL

SEQ ID NO: 930635 - protein, 20 aa, Mycobacterium
LGAGMAHAFAAKGRDLALCA

SEQ ID NO: 930636 - protein, 20 aa, Mycobacterium
LGAGMARAFAARGRDLALCA

SEQ ID NO: 930637 - protein, 18 aa, Mycobacterium
LGAISAAFGGRGEKMGQT

SEQ ID NO: 930638 - protein, 17 aa, Mycobacterium
LGALCCAACGHSGAQGL

SEQ ID NO: 930639 - protein, 25 aa, Mycobacterium
LGALLQPIIGYRVITTIGVDVDELV

SEQ ID NO: 930640 - protein, 18 aa, Mycobacterium
LGALPGWVRSTSGGYAKG

SEQ ID NO: 930641 - protein, 22 aa, Mycobacterium
LGAQSSWYVWAALGLFPSTPGT

SEQ ID NO: 930642 - protein, 17 aa, Mycobacterium
LGARSASSLGFALDVPW

SEQ ID NO: 930643 - protein, 17 aa, Mycobacterium
LGATAFTISGTRILHDP

SEQ ID NO: 930644 - protein, 17 aa, Mycobacterium
LGATSNEATVFITITPV

SEQ ID NO: 930645 - protein, 23 aa, Mycobacterium
LGDAESYFRTAIYGDPVEVTGTS

SEQ ID NO: 930646 - protein, 17 aa, Mycobacterium
LGDASAILWNDLPTLPL

SEQ ID NO: 930647 - protein, 23 aa, Mycobacterium
LGDDCIIEAGLYVTAGTKVATPD

SEQ ID NO: 930648 - protein, 19 aa, Mycobacterium
LGDEVYPGLAGGTLMVLRR

SEQ ID NO: 930649 - protein, 21 aa, Mycobacterium
LGDLLAVPGVFVFGSNDYFAP

SEQ ID NO: 930650 - protein, 25 aa, Mycobacterium
LGDLLSIPGLFVFGSNDYFGPRLKN

SEQ ID NO: 930651 - protein, 22 aa, Mycobacterium
LGDLLSRPGVFVFGSNDYFGPR

SEQ ID NO: 930652 - protein, 27 aa, Mycobacterium
LGEARDWLSRFDIGSGFEVVLSSPEPL

SEQ ID NO: 930653 - protein, 17 aa, Mycobacterium
LGFAVRMSKDFIGKAAL

SEQ ID NO: 930654 - protein, 19 aa, Mycobacterium
LGGDLKMLIVLPAEGELQA

SEQ ID NO: 930655 - protein, 27 aa, Mycobacterium
LGGFRTAVRRAKILAGLDEDTDVRLVS

SEQ ID NO: 930656 - protein, 24 aa, Mycobacterium
LGGHPRLGRNLALHPATMVAGRFD

SEQ ID NO: 930657 - protein, 17 aa, Mycobacterium
LGGITWADPLPAQYANN

SEQ ID NO: 930658 - protein, 20 aa, Mycobacterium
LGGKVLRPDDGPQFATAKQV

SEQ ID NO: 930659 - protein, 25 aa, Mycobacterium
LGGLACGFGTCTITITTTDPDGDDL

SEQ ID NO: 930660 - protein, 17 aa, Mycobacterium
LGGLPVVADSSVPPGTV

SEQ ID NO: 930661 - protein, 17 aa, Mycobacterium
LGGLPVVADTSIPSGSV

SEQ ID NO: 930662 - protein, 17 aa, Mycobacterium
LGGNRPRWMGADIGQRQ

SEQ ID NO: 930663 - protein, 25 aa, Mycobacterium
LGGRPIREPVFHYGPFVMNSRAELI

SEQ ID NO: 930664 - protein, 17 aa, Mycobacterium
LGGRPSLRLDTLADELD

SEQ ID NO: 930665 - protein, 23 aa, Mycobacterium
LGGTHPSIWYKAFNYNLGTKQPI

SEQ ID NO: 930666 - protein, 18 aa, Mycobacterium
LGGVDVCLKEPVYEPLSG

SEQ ID NO: 930667 - protein, 20 aa, Mycobacterium
LGGVISHGVPDTYGYNAIDL

SEQ ID NO: 930668 - protein, 23 aa, Mycobacterium
LGHAAGSCPHRFGAAQQLADAGG

SEQ ID NO: 930669 - protein, 18 aa, Mycobacterium
LGHDQLRAAHALTAAIPR

SEQ ID NO: 930670 - protein, 18 aa, Mycobacterium
LGIGCALGQVAPASADPD

SEQ ID NO: 930671 - protein, 21 aa, Mycobacterium
LGIQRLLRYYPPANYTGQITI

SEQ ID NO: 930672 - protein, 17 aa, Mycobacterium
LGIRCVADRPWVTGAET

SEQ ID NO: 930673 - protein, 20 aa, Mycobacterium
LGIRLLETLGHLGVETHLVL

SEQ ID NO: 930674 - protein, 21 aa, Mycobacterium
LGIRLVIIAARWWVKWRARGD

SEQ ID NO: 930675 - protein, 17 aa, Mycobacterium
LGKNGDRDYGFLGVGVV

SEQ ID NO: 930676 - protein, 22 aa, Mycobacterium
LGKQFLGGLGINIGGDPAPSAA

SEQ ID NO: 930677 - protein, 19 aa, Mycobacterium
LGLAFGFPSGQQWRTAMLS

SEQ ID NO: 930678 - protein, 26 aa, Mycobacterium
LGLARLIGFNSMRVFLHDQLWASDQR

SEQ ID NO: 930679 - protein, 19 aa, Mycobacterium
LGLLLALYCLITASSANEA

SEQ ID NO: 930680 - protein, 19 aa, Mycobacterium
LGLRPRWIDSTAVGGASWE

SEQ ID NO: 930681 - protein, 19 aa, Mycobacterium
LGLVDAPWSYLVVGKVVLH

SEQ ID NO: 930682 - protein, 17 aa, Mycobacterium
LGMLSVFGLPPIEFVEL

SEQ ID NO: 930683 - protein, 22 aa, Mycobacterium
LGMTGAGYWVAHGALGGITISQ

SEQ ID NO: 930684 - protein, 23 aa, Mycobacterium
LGNARWLPLVIAHGLLDELVPFP

SEQ ID NO: 930685 - protein, 17 aa, Mycobacterium
LGNDLDSEHPFIYITTI

SEQ ID NO: 930686 - protein, 22 aa, Mycobacterium
LGNGEFGGFGGSGGDGGNGGLL

SEQ ID NO: 930687 - protein, 18 aa, Mycobacterium
LGNGGRGGDGLAGVNGGR

SEQ ID NO: 930688 - protein, 24 aa, Mycobacterium
LGPAADRFAAVFLDALDAQAKAVA

SEQ ID NO: 930689 - protein, 17 aa, Mycobacterium
LGPATMFTGIAVSMFCP

SEQ ID NO: 930690 - protein, 22 aa, Mycobacterium
LGPDALMAYRHIAQRRDVEITD

SEQ ID NO: 930691 - protein, 19 aa, Mycobacterium
LGPDLARLVAGGSSLSTDA

SEQ ID NO: 930692 - protein, 21 aa, Mycobacterium
LGPERRGPLGWLYTPSGDATS

SEQ ID NO: 930693 - protein, 25 aa, Mycobacterium
LGPLVTRSPLLTSLVSSIPPMKEPP

SEQ ID NO: 930694 - protein, 18 aa, Mycobacterium
LGPNFTYALLNGAPGMPG

SEQ ID NO: 930695 - protein, 17 aa, Mycobacterium
LGPVTILVNAAGLDGFK

SEQ ID NO: 930696 - protein, 25 aa, Mycobacterium
LGQHGVNIMEFCKAYNAATENQRGQ

SEQ ID NO: 930697 - protein, 22 aa, Mycobacterium
LGQRLAPAGSYLMTSTGDEFAI

SEQ ID NO: 930698 - protein, 19 aa, Mycobacterium
LGRATVPVRLVLDTENVKI

SEQ ID NO: 930699 - protein, 17 aa, Mycobacterium
LGRCPGVTGAVAMGREV

SEQ ID NO: 930700 - protein, 17 aa, Mycobacterium
LGRLDLKLFAGAETDNT

SEQ ID NO: 930701 - protein, 17 aa, Mycobacterium
LGRRAAGATAVRVHARG

SEQ ID NO: 930702 - protein, 22 aa, Mycobacterium
LGRSGFLLAPWTAEQIVSELVP

SEQ ID NO: 930703 - protein, 23 aa, Mycobacterium
LGSDPFVAILGFPFIPQAMRDRY

SEQ ID NO: 930704 - protein, 17 aa, Mycobacterium
LGSDPKGAVAALLNDAR

SEQ ID NO: 930705 - protein, 24 aa, Mycobacterium
LGSGGYRITAIFANALNLNEHAKV

SEQ ID NO: 930706 - protein, 24 aa, Mycobacterium
LGSHPRLGRNLALHPATMLAGRFD

SEQ ID NO: 930707 - protein, 28 aa, Mycobacterium
LGSTSWTARAWQALARAGERIAAEVAAE

SEQ ID NO: 930708 - protein, 22 aa, Mycobacterium
LGTAAARAAVTAAQANAAAAVF

SEQ ID NO: 930709 - protein, 23 aa, Mycobacterium
LGTDWPAAGYFSTYKPLESIQIG

SEQ ID NO: 930710 - protein, 17 aa, Mycobacterium
LGTERPDAEVLVSAPNI

SEQ ID NO: 930711 - protein, 17 aa, Mycobacterium
LGTLGFLAAPGLSGGIG

SEQ ID NO: 930712 - protein, 24 aa, Mycobacterium
LGTRKTLILDDGWTVVTADGTRAA

SEQ ID NO: 930713 - protein, 23 aa, Mycobacterium
LGTSFPELMAGFTGGFTGLLQTG

SEQ ID NO: 930714 - protein, 23 aa, Mycobacterium
LGTYCGYGALRIARAAPQAKVYS

SEQ ID NO: 930715 - protein, 22 aa, Mycobacterium
LGVASVSMWKVHQMSAPEPVIT

SEQ ID NO: 930716 - protein, 25 aa, Mycobacterium
LGVAYPAAVWLFGRINSGSAEGSPL

SEQ ID NO: 930717 - protein, 17 aa, Mycobacterium
LGVELRATIAAPVAGLD

SEQ ID NO: 930718 - protein, 21 aa, Mycobacterium
LGVGLPGRYNVANAALAVALL

SEQ ID NO: 930719 - protein, 17 aa, Mycobacterium
LGVHLRAAIAAPVAGLR

SEQ ID NO: 930720 - protein, 27 aa, Mycobacterium
LGVNTFRMGIEWSRIFPDSTASVDISD

SEQ ID NO: 930721 - protein, 19 aa, Mycobacterium
LGVTAMLQKSVYRSAQVQD

SEQ ID NO: 930722 - protein, 17 aa, Mycobacterium
LGWRAQHSQSHYAAAKA

SEQ ID NO: 930723 - protein, 22 aa, Mycobacterium
LGYYQKIKLEWVGNTTSGPQDI

SEQ ID NO: 930724 - protein, 22 aa, Mycobacterium
LHAAGARPGWHTGRPIELQEIP

SEQ ID NO: 930725 - protein, 24 aa, Mycobacterium
LHAASTRRALLLTALGGLLIAGVI

SEQ ID NO: 930726 - protein, 18 aa, Mycobacterium
LHAPGRSGQLSWWAGPWP

SEQ ID NO: 930727 - protein, 23 aa, Mycobacterium
LHDRFRLLTGGARTAVRRQQTLR

SEQ ID NO: 930728 - protein, 22 aa, Mycobacterium
LHEVPVLSGLGLTMTGPRPGGF

SEQ ID NO: 930729 - protein, 18 aa, Mycobacterium
LHGFGGNLEVPWPGTSFG

SEQ ID NO: 930730 - protein, 20 aa, Mycobacterium
LHGLPPRRVEGPDPVPAYGS

SEQ ID NO: 930731 - protein, 24 aa, Mycobacterium
LHGPKRYNWHQLVGSLRYTLLRLQ

SEQ ID NO: 930732 - protein, 18 aa, Mycobacterium
LHGQFPVFAQAFDAVVEQ

SEQ ID NO: 930733 - protein, 25 aa, Mycobacterium
LHHPRLPSIPGLNDFGGHAFHSARW

SEQ ID NO: 930734 - protein, 19 aa, Mycobacterium
LHIPHLLQKAFVGIDESGT

SEQ ID NO: 930735 - protein, 17 aa, Mycobacterium
LHLLSHRLIQPHGASVD

SEQ ID NO: 930736 - protein, 20 aa, Mycobacterium
LHLVEPLGFDLSEPKLRRAG

SEQ ID NO: 930737 - protein, 18 aa, Mycobacterium
LHPALDATGTWSVPLDVP

SEQ ID NO: 930738 - protein, 19 aa, Mycobacterium
LHQCCGALLASFKIWHCAT

SEQ ID NO: 930739 - protein, 20 aa, Mycobacterium
LHSPGCRAELDQAKATVAQE

SEQ ID NO: 930740 - protein, 26 aa, Mycobacterium
LHSWGQSWLQICHNAFAGIDVDPDRV

SEQ ID NO: 930741 - protein, 22 aa, Mycobacterium
LHSYELPADFIIETTPFTIESG

SEQ ID NO: 930742 - protein, 26 aa, Mycobacterium
LIAGLLAAALMFPFVGGAGTVVMRVS

SEQ ID NO: 930743 - protein, 18 aa, Mycobacterium
LIAGVVKLARTVDADAAG

SEQ ID NO: 930744 - protein, 25 aa, Mycobacterium
LIAHSAGLYPAWAVSTSRPVLFRSW

SEQ ID NO: 930745 - protein, 18 aa, Mycobacterium
LIARRPGPLESRSTELED

SEQ ID NO: 930746 - protein, 19 aa, Mycobacterium
LIASLWAATAFLTALLVVA

SEQ ID NO: 930747 - protein, 18 aa, Mycobacterium
LIASVIAPVIALAGICAG

SEQ ID NO: 930748 - protein, 18 aa, Mycobacterium
LIAVPLVPSLLVEVSPAD

SEQ ID NO: 930749 - protein, 17 aa, Mycobacterium
LICLGLALAATTAGAAW

SEQ ID NO: 930750 - protein, 17 aa, Mycobacterium
LIDCGLGSLNAFTNAGL

SEQ ID NO: 930751 - protein, 23 aa, Mycobacterium
LIDRGRRVHRLAVSHAFHSPLME

SEQ ID NO: 930752 - protein, 31 aa, Mycobacterium
LIDSLDLLPTFPFSTKYLRNAVRGDYLNVFV

SEQ ID NO: 930753 - protein, 20 aa, Mycobacterium
LIERLQRPTLVMAPNKTLAA

SEQ ID NO: 930754 - protein, 23 aa, Mycobacterium
LIERSHAATREWLAARPPATGQA

SEQ ID NO: 930755 - protein, 18 aa, Mycobacterium
LIETRFGSINGVSTAGAQ

SEQ ID NO: 930756 - protein, 20 aa, Mycobacterium
LIGALKLILTQPFDIDTVPK

SEQ ID NO: 930757 - protein, 24 aa, Mycobacterium
LIGESCLFVPVLRSALNSEGFANA

SEQ ID NO: 930758 - protein, 17 aa, Mycobacterium
LIGFAAVVAILLSGCGA

SEQ ID NO: 930759 - protein, 22 aa, Mycobacterium
LIGGFRPLFRALDPHQVNALSD

SEQ ID NO: 930760 - protein, 23 aa, Mycobacterium
LIGRSIGLYGDWVNFYLCDLSIR

SEQ ID NO: 930761 - protein, 21 aa, Mycobacterium
LIGSSLPWLLPPALGDVQTIN

SEQ ID NO: 930762 - protein, 20 aa, Mycobacterium
LIGYGRCVHDALAAAATLAE

SEQ ID NO: 930763 - protein, 19 aa, Mycobacterium
LIHGAAQWAAMTAVTTGQT

SEQ ID NO: 930764 - protein, 19 aa, Mycobacterium
LIHMLRTAERVFGRDAFTW

SEQ ID NO: 930765 - protein, 24 aa, Mycobacterium
LIITPLRIAFLILLVGTTLEVVTE

SEQ ID NO: 930766 - protein, 17 aa, Mycobacterium
LIKESDLPYSIVRATQF

SEQ ID NO: 930767 - protein, 18 aa, Mycobacterium
LILFRRAGAPAALADSVR

SEQ ID NO: 930768 - protein, 18 aa, Mycobacterium
LILFRRGGAPAALADSIR

SEQ ID NO: 930769 - protein, 21 aa, Mycobacterium
LILGCGPAWGTPRASAGPDVP

SEQ ID NO: 930770 - protein, 17 aa, Mycobacterium
LILGVPVGKIAKIEPQP

SEQ ID NO: 930771 - protein, 19 aa, Mycobacterium
LINGRIPAAPMTFSAKPGQ

SEQ ID NO: 930772 - protein, 24 aa, Mycobacterium
LINQNAIRFVFNYTGDDWTEDRQD

SEQ ID NO: 930773 - protein, 17 aa, Mycobacterium
LIPDPNVPNAFAVLADR

SEQ ID NO: 930774 - protein, 21 aa, Mycobacterium
LIPERVMRRLIGVVTGSATTV

SEQ ID NO: 930775 - protein, 17 aa, Mycobacterium
LIPPGAIDDLTRMVLLN

SEQ ID NO: 930776 - protein, 23 aa, Mycobacterium
LIRATTHWLRTTVLAVAVLLIAA

SEQ ID NO: 930777 - protein, 22 aa, Mycobacterium
LIRERPRITAALDKLGTFSDTA

SEQ ID NO: 930778 - protein, 26 aa, Mycobacterium
LIRERPRITAALDRLRVFSDTATRLV

SEQ ID NO: 930779 - protein, 17 aa, Mycobacterium
LIRKTGATSAEMVAQLA

SEQ ID NO: 930780 - protein, 22 aa, Mycobacterium
LIRTGLLGLVLVVLIIVVGLQP

SEQ ID NO: 930781 - protein, 18 aa, Mycobacterium
LISSERYFWSRGGDMADK

SEQ ID NO: 930782 - protein, 25 aa, Mycobacterium
LITEALGGVDVCLKEPVFEPLSGAD

SEQ ID NO: 930783 - protein, 27 aa, Mycobacterium
LITNCAYKDFGVGMVRNDDREFSVVSL

SEQ ID NO: 930784 - protein, 17 aa, Mycobacterium
LIVGLDIGSNLFSFRDP

SEQ ID NO: 930785 - protein, 27 aa, Mycobacterium
LIVRLRVPLRGVARGQTLVLYRPDPDG

SEQ ID NO: 930786 - protein, 27 aa, Mycobacterium
LIVSFRLRLRPAINAIRRFNRAVLNPA

SEQ ID NO: 930787 - protein, 22 aa, Mycobacterium
LIYFQHGFMAAGPFYSFTAARL

SEQ ID NO: 930788 - protein, 20 aa, Mycobacterium
LKAAEIVGTLGRSPAAPTDM

SEQ ID NO: 930789 - protein, 20 aa, Mycobacterium
LKAAPSYRIARGMYVDVPPL

SEQ ID NO: 930790 - protein, 24 aa, Mycobacterium
LKACQAAGLPAVWEDDADVPFDYH

SEQ ID NO: 930791 - protein, 19 aa, Mycobacterium
LKAGQKVRIAGVPVGAVSD

SEQ ID NO: 930792 - protein, 17 aa, Mycobacterium
LKAKIDAAYSRNDVVAV

SEQ ID NO: 930793 - protein, 19 aa, Mycobacterium
LKAKTRFAPPGSYEQDSLP

SEQ ID NO: 930794 - protein, 26 aa, Mycobacterium
LKALEGGVIYERWQALGGMNSVLGAP

SEQ ID NO: 930795 - protein, 18 aa, Mycobacterium
LKALITHGSATNWNADGI

SEQ ID NO: 930796 - protein, 21 aa, Mycobacterium
LKATLCRRGVGLLRAYCMERG

SEQ ID NO: 930797 - protein, 18 aa, Mycobacterium
LKCPFTLGHSRAVAELAE

SEQ ID NO: 930798 - protein, 17 aa, Mycobacterium
LKDGETYGVGMVIVARF

SEQ ID NO: 930799 - protein, 20 aa, Mycobacterium
LKDLEIRGAGNVLGVEQSGH

SEQ ID NO: 930800 - protein, 17 aa, Mycobacterium
LKDSLSYQGDMYSVPFY

SEQ ID NO: 930801 - protein, 20 aa, Mycobacterium
LKEAFARSCNTAFAKLGAEQ

SEQ ID NO: 930802 - protein, 17 aa, Mycobacterium
LKELGRGSQYLIGALKL

SEQ ID NO: 930803 - protein, 21 aa, Mycobacterium
LKENIKRQWWRSVVTGRDDVV

SEQ ID NO: 930804 - protein, 21 aa, Mycobacterium
LKFIVPESGGDWFIDTMVIPY

SEQ ID NO: 930805 - protein, 34 aa, Mycobacterium
LKFTPSYRLTHLWYRDNPPMFPFLSAQNYAVLFP

SEQ ID NO: 930806 - protein, 20 aa, Mycobacterium
LKGAVLQTISLRYTPTNLAV

SEQ ID NO: 930807 - protein, 22 aa, Mycobacterium
LKGGETIGLPATRAAATVESVL

SEQ ID NO: 930808 - protein, 18 aa, Mycobacterium
LKGMGDVGDAFLRPFGDF

SEQ ID NO: 930809 - protein, 19 aa, Mycobacterium
LKIAGTVAMEPVTDMASVA

SEQ ID NO: 930810 - protein, 17 aa, Mycobacterium
LKINVLILGGQHDPISG

SEQ ID NO: 930811 - protein, 23 aa, Mycobacterium
LKIPSAILGGFDWGARNADIVAA

SEQ ID NO: 930812 - protein, 17 aa, Mycobacterium
LKKSAAVLPGYAPAGQL

SEQ ID NO: 930813 - protein, 23 aa, Mycobacterium
LKLAVILALWAAVVAAFVSVIYR

SEQ ID NO: 930814 - protein, 18 aa, Mycobacterium
LKNPMAGMITKDFNIKVT

SEQ ID NO: 930815 - protein, 17 aa, Mycobacterium
LKPEYQGKVALNGDPTQ

SEQ ID NO: 930816 - protein, 19 aa, Mycobacterium
LKQKVLAPLGLTATANSET

SEQ ID NO: 930817 - protein, 25 aa, Mycobacterium
LKRDVDSLLGCRWSTGPGTGDTSIS

SEQ ID NO: 930818 - protein, 26 aa, Mycobacterium
LKRFNVYGTDVGVMWDNGMVDDPSTP

SEQ ID NO: 930819 - protein, 22 aa, Mycobacterium
LKRFPSSGPYRLDSVSEDGSVV

SEQ ID NO: 930820 - protein, 19 aa, Mycobacterium
LKRMYPSASYRATTSTVQV

SEQ ID NO: 930821 - protein, 19 aa, Mycobacterium
LKRSSDRAGFLAQLTQIRY

SEQ ID NO: 930822 - protein, 22 aa, Mycobacterium
LKSDPTGVVRIGRYTPEGDRWE

SEQ ID NO: 930823 - protein, 21 aa, Mycobacterium
LKSGKNPVLAHLFLNHMLDPV

SEQ ID NO: 930824 - protein, 19 aa, Mycobacterium
LKSLPWSQFLPLQDGKGMT

SEQ ID NO: 930825 - protein, 25 aa, Mycobacterium
LKSPPRWRTAAALAVTTTLLAACGG

SEQ ID NO: 930826 - protein, 21 aa, Mycobacterium
LKSSGRQGVDVVGLDGQTDMF

SEQ ID NO: 930827 - protein, 26 aa, Mycobacterium
LKTAADFLVAIPTGWDNAIEDVNGTR

SEQ ID NO: 930828 - protein, 17 aa, Mycobacterium
LKTADGIPVANATVEFA

SEQ ID NO: 930829 - protein, 26 aa, Mycobacterium
LKTIPGMIAGVVPLRLMTPPSSSVAE

SEQ ID NO: 930830 - protein, 19 aa, Mycobacterium
LKTPHVFTVPGEHDSVDDA

SEQ ID NO: 930831 - protein, 19 aa, Mycobacterium
LKVIAPWFQINDFSWISPP

SEQ ID NO: 930832 - protein, 21 aa, Mycobacterium
LKYTLLRLQERVVGQGPGVPQ

SEQ ID NO: 930833 - protein, 22 aa, Mycobacterium
LLACLLAACSAPKPPPPAAAPD

SEQ ID NO: 930834 - protein, 27 aa, Mycobacterium
LLADENHRLVGTRLCWSDEPRADQLRR

SEQ ID NO: 930835 - protein, 34 aa, Mycobacterium
LLADTRANAGWKRYPLGLAAPLIRAFLRSKSAYK

SEQ ID NO: 930836 - protein, 17 aa, Mycobacterium
LLAEALAVTAAEVPLAF

SEQ ID NO: 930837 - protein, 29 aa, Mycobacterium
LLAEPEVYNVLGPLLAPVQLLTDLTDAVG

SEQ ID NO: 930838 - protein, 26 aa, Mycobacterium
LLAIIFPDNDFRIMQGWYDSELSIAI

SEQ ID NO: 930839 - protein, 17 aa, Mycobacterium
LLAKIFQGQITKWNDPA

SEQ ID NO: 930840 - protein, 23 aa, Mycobacterium
LLALARVWARPLWLAVGRSDAAD

SEQ ID NO: 930841 - protein, 34 aa, Mycobacterium
LLALICVLPIALAPWPARAFVILLAVLMTAVVVD

SEQ ID NO: 930842 - protein, 18 aa, Mycobacterium
LLAPCVDCEFDILICDAP

SEQ ID NO: 930843 - protein, 19 aa, Mycobacterium
LLAPRIMRRRGMGGDLTQG

SEQ ID NO: 930844 - protein, 19 aa, Mycobacterium
LLASFKIWHCATVGGNICL

SEQ ID NO: 930845 - protein, 24 aa, Mycobacterium
LLASSCTWQLSLFIPDGVPPPPGD

SEQ ID NO: 930846 - protein, 24 aa, Mycobacterium
LLASSCTWQLSLFIPEGVPPPAGA

SEQ ID NO: 930847 - protein, 25 aa, Mycobacterium
LLATANALAGFWYVHGTYLAPDDDE

SEQ ID NO: 930848 - protein, 22 aa, Mycobacterium
LLATAVLLGWPAAAEPPSCASL

SEQ ID NO: 930849 - protein, 28 aa, Mycobacterium
LLATLIGMPRRVRRFFVTVGVVGSLAGL

SEQ ID NO: 930850 - protein, 36 aa, Mycobacterium
LLATLISVPRRVRRLFMVLGGLVSLVGLVVSACTVN

SEQ ID NO: 930851 - protein, 18 aa, Mycobacterium
LLATSVAAFAVIGGAAAG

SEQ ID NO: 930852 - protein, 21 aa, Mycobacterium
LLCATAIMAVGCTQIVGGDAV

SEQ ID NO: 930853 - protein, 28 aa, Mycobacterium
LLDDACALLPCLGEYEFAECAAGLRPMT

SEQ ID NO: 930854 - protein, 23 aa, Mycobacterium
LLDEAGWKVGGDGIREKDGKKLN

SEQ ID NO: 930855 - protein, 21 aa, Mycobacterium
LLDEYRRALAAAGGPRLDADE

SEQ ID NO: 930856 - protein, 17 aa, Mycobacterium
LLDGLRAQDDFNGWDIN

SEQ ID NO: 930857 - protein, 20 aa, Mycobacterium
LLDHAGGALAAYVQVDRYAQ

SEQ ID NO: 930858 - protein, 23 aa, Mycobacterium
LLDRARTAGIAVVHIQHDDGPGS

SEQ ID NO: 930859 - protein, 23 aa, Mycobacterium
LLDSDFRAGCPVVAVSVEAGEEE

SEQ ID NO: 930860 - protein, 23 aa, Mycobacterium
LLDVSRIQWRFDRISKRVPVDQP

SEQ ID NO: 930861 - protein, 17 aa, Mycobacterium
LLDWARASVEGLISRSD

SEQ ID NO: 930862 - protein, 17 aa, Mycobacterium
LLEALPMQETLEAIEEL

SEQ ID NO: 930863 - protein, 24 aa, Mycobacterium
LLELGIESLGIWRDGFIDDVENPV

SEQ ID NO: 930864 - protein, 18 aa, Mycobacterium
LLELGRDWRSWALVDRDP

SEQ ID NO: 930865 - protein, 22 aa, Mycobacterium
LLFKRNICHQSIFYRRELFSSI

SEQ ID NO: 930866 - protein, 21 aa, Mycobacterium
LLGDRLLDDRAWVAAQRTLTT

SEQ ID NO: 930867 - protein, 17 aa, Mycobacterium
LLGELTKAIGSGMFSGG

SEQ ID NO: 930868 - protein, 27 aa, Mycobacterium
LLGEPLLALRIPWYVTVLDLGPAGAVY

SEQ ID NO: 930869 - protein, 25 aa, Mycobacterium
LLGFERWAPDMPWEISTGKTVLTGE

SEQ ID NO: 930870 - protein, 19 aa, Mycobacterium
LLGGMAMGIVGAPSAAAAP

SEQ ID NO: 930871 - protein, 26 aa, Mycobacterium
LLGLRPWLDEHIRYRGLRLHGFGGNL

SEQ ID NO: 930872 - protein, 17 aa, Mycobacterium
LLGSMHIDLARPKNKPA

SEQ ID NO: 930873 - protein, 21 aa, Mycobacterium
LLGVETFRVATLIFIADFVPR

SEQ ID NO: 930874 - protein, 27 aa, Mycobacterium
LLHDYRKSLWCGIGGLVPFAQSPPQFS

SEQ ID NO: 930875 - protein, 17 aa, Mycobacterium
LLHQWQQTIPLLSTPAT

SEQ ID NO: 930876 - protein, 17 aa, Mycobacterium
LLIENGEWKDCFPPPQG

SEQ ID NO: 930877 - protein, 19 aa, Mycobacterium
LLLCSCGVTRGEETGLHRL

SEQ ID NO: 930878 - protein, 19 aa, Mycobacterium
LLLECSWEALEDAGIDPVS

SEQ ID NO: 930879 - protein, 25 aa, Mycobacterium
LLLFPEGGNFSWARWHEAISRLRSS

SEQ ID NO: 930880 - protein, 17 aa, Mycobacterium
LLLFPVFGGGGMLVMRL

SEQ ID NO: 930881 - protein, 17 aa, Mycobacterium
LLLPDRFLQAGPLVEMI

SEQ ID NO: 930882 - protein, 20 aa, Mycobacterium
LLLRFREGFLERRRAALFQI

SEQ ID NO: 930883 - protein, 17 aa, Mycobacterium
LLLSCCGRPTSQAPSAG

SEQ ID NO: 930884 - protein, 19 aa, Mycobacterium
LLLTHIPPWTSREDVISEA

SEQ ID NO: 930885 - protein, 18 aa, Mycobacterium
LLMAHCRAAKAFLHCSSA

SEQ ID NO: 930886 - protein, 17 aa, Mycobacterium
LLMASSCSWQMGIRVPD

SEQ ID NO: 930887 - protein, 23 aa, Mycobacterium
LLPALRAARGHVVFINSGAGRKV

SEQ ID NO: 930888 - protein, 22 aa, Mycobacterium
LLPALRSARGQVVFINSGAGRN

SEQ ID NO: 930889 - protein, 23 aa, Mycobacterium
LLPKSSDFPASWTVSDIKELSDT

SEQ ID NO: 930890 - protein, 18 aa, Mycobacterium
LLPQVFGWARSVNAAQPL

SEQ ID NO: 930891 - protein, 26 aa, Mycobacterium
LLQSFPTTQWVRWRKPVIGLPLTARL

SEQ ID NO: 930892 - protein, 30 aa, Mycobacterium
LLREAHDLCGLPVRVFRCDMILTDTTYSGQ

SEQ ID NO: 930893 - protein, 24 aa, Mycobacterium
LLRHGCYRAQGFLLSKPILGSEMQ

SEQ ID NO: 930894 - protein, 21 aa, Mycobacterium
LLRQCAQALAAIHRADPDIPG

SEQ ID NO: 930895 - protein, 29 aa, Mycobacterium
LLRQLRLGEYDVLVGINLLREGLDLPEVS

SEQ ID NO: 930896 - protein, 23 aa, Mycobacterium
LLRSDGVAVAFGANDWGQTDIPA

SEQ ID NO: 930897 - protein, 18 aa, Mycobacterium
LLSALWVPHTHQLVLMIH

SEQ ID NO: 930898 - protein, 26 aa, Mycobacterium
LLSEEDRRFTVVFAYDQSDYARMEAT

SEQ ID NO: 930899 - protein, 25 aa, Mycobacterium
LLSFERWAPDMPWEISTGKAVLPGE

SEQ ID NO: 930900 - protein, 24 aa, Mycobacterium
LLSGLRLQMEFDGRTTVDSPLGEF

SEQ ID NO: 930901 - protein, 19 aa, Mycobacterium
LLSGMALAGLAGRGAGGMG

SEQ ID NO: 930902 - protein, 19 aa, Mycobacterium
LLSGMALASLAGRGATGAG

SEQ ID NO: 930903 - protein, 18 aa, Mycobacterium
LLTACAGSDSGGESTLET

SEQ ID NO: 930904 - protein, 25 aa, Mycobacterium
LLTFTALIFVVFGQIRFNRTTEYSA

SEQ ID NO: 930905 - protein, 18 aa, Mycobacterium
LLTGCLKPNTLDPYANPG

SEQ ID NO: 930906 - protein, 18 aa, Mycobacterium
LLTPEFHKTPELLFSEDM

SEQ ID NO: 930907 - protein, 17 aa, Mycobacterium
LLTRIVGITALALGLMG

SEQ ID NO: 930908 - protein, 18 aa, Mycobacterium
LLTSILTYHVVPGQLGPD

SEQ ID NO: 930909 - protein, 25 aa, Mycobacterium
LLTTYPFPKDTISNWARGDYANLTA

SEQ ID NO: 930910 - protein, 17 aa, Mycobacterium
LLVADEISHVGEVISTF

SEQ ID NO: 930911 - protein, 18 aa, Mycobacterium
LLVAGGRGLIAFTSSPGS

SEQ ID NO: 930912 - protein, 25 aa, Mycobacterium
LLVDAFAGHGEWRVPELLDAAIADP

SEQ ID NO: 930913 - protein, 24 aa, Mycobacterium
LLVGSCARSPAPVIVPVRSSPAAR

SEQ ID NO: 930914 - protein, 18 aa, Mycobacterium
LLVLAAPVIGVIYAGIRA

SEQ ID NO: 930915 - protein, 19 aa, Mycobacterium
LLVPELMGAAAAEMAPLRD

SEQ ID NO: 930916 - protein, 17 aa, Mycobacterium
LLVPIHWGTFRLAPHPW

SEQ ID NO: 930917 - protein, 20 aa, Mycobacterium
LLVRLHAPLRGVARGQTAVL

SEQ ID NO: 930918 - protein, 25 aa, Mycobacterium
LLVRPDDFVGWRWEALPADPEAELR

SEQ ID NO: 930919 - protein, 37 aa, Mycobacterium
LLVTLGVGIYQVWPSRGGLKLTAYFTNAVGLYPGDQV

SEQ ID NO: 930920 - protein, 23 aa, Mycobacterium
LLVWVVGCGSPSRPADGARSITI

SEQ ID NO: 930921 - protein, 17 aa, Mycobacterium
LLWPRGSSRPVAASVPE

SEQ ID NO: 930922 - protein, 18 aa, Mycobacterium
LLYDFTFTFEDGETTVAV

SEQ ID NO: 930923 - protein, 18 aa, Mycobacterium
LLYHPRRLQFYVIALSGP

SEQ ID NO: 930924 - protein, 25 aa, Mycobacterium
LMAFGDTYGYCGMKSQQWRYNTLLR

SEQ ID NO: 930925 - protein, 29 aa, Mycobacterium
LMAGAGPAPMLAAATGWAAFAAALDAQAV

SEQ ID NO: 930926 - protein, 25 aa, Mycobacterium
LMAGHPGCRVAACLHWGAMWGPASG

SEQ ID NO: 930927 - protein, 24 aa, Mycobacterium
LMANLAGGFSLPALAAQISAAVQA

SEQ ID NO: 930928 - protein, 37 aa, Mycobacterium
LMESINALIPFPAFSEPWGRHVNWWVTANLPMHEGCN

SEQ ID NO: 930929 - protein, 17 aa, Mycobacterium
LMFSLAVVDKLTTGDLT

SEQ ID NO: 930930 - protein, 25 aa, Mycobacterium
LMFTEGRAFVTIQFDGPPDTLAPAD

SEQ ID NO: 930931 - protein, 26 aa, Mycobacterium
LMFTQGRALVRLEFDSAIEDPVTEQT

SEQ ID NO: 930932 - protein, 18 aa, Mycobacterium
LMGAAAAEMAPLRDAALA

SEQ ID NO: 930933 - protein, 26 aa, Mycobacterium
LMGANRWKHASAWPLPQTNWTVYHLG

SEQ ID NO: 930934 - protein, 18 aa, Mycobacterium
LMGSFAYLGIGIGTASAE

SEQ ID NO: 930935 - protein, 18 aa, Mycobacterium
LMHSFGFLSSLGKPGSAQ

SEQ ID NO: 930936 - protein, 21 aa, Mycobacterium
LMLSSVVGCHFASRNPPSTKT

SEQ ID NO: 930937 - protein, 18 aa, Mycobacterium
LMNLVICLLSTRTYVTAE

SEQ ID NO: 930938 - protein, 24 aa, Mycobacterium
LMPTWELPGGYGLPGGDPTMCDPR

SEQ ID NO: 930939 - protein, 41 aa, Mycobacterium
LMQYAYAGAGIKLPRSSGAIYKVGQKVLPQQAHKGDMIFYG

SEQ ID NO: 930940 - protein, 25 aa, Mycobacterium
LMRPLSRGRVTICSADPDADPVIEH

SEQ ID NO: 930941 - protein, 26 aa, Mycobacterium
LMSEGPPWKVRRQWWVDHPPRELISG

SEQ ID NO: 930942 - protein, 23 aa, Mycobacterium
LMTDMRDPLTIAFHKAKLRADFL

SEQ ID NO: 930943 - protein, 28 aa, Mycobacterium
LMTPEVSTALALDRMVDRAQKWRDTDPA

SEQ ID NO: 930944 - protein, 25 aa, Mycobacterium
LMVLPGQKLLAVLVADNPGVWMLHC

SEQ ID NO: 930945 - protein, 18 aa, Mycobacterium
LMVRGQKYLTLTFATDGG

SEQ ID NO: 930946 - protein, 28 aa, Mycobacterium
LNADMGNGWLRRDPAVPASAWTDEQRRQ

SEQ ID NO: 930947 - protein, 21 aa, Mycobacterium
LNAFGQLLAALGRRYDGDERL

SEQ ID NO: 930948 - protein, 17 aa, Mycobacterium
LNATMGFFTNHLGRGYS

SEQ ID NO: 930949 - protein, 23 aa, Mycobacterium
LNDGRADFFAVLRSMALFVNALY

SEQ ID NO: 930950 - protein, 22 aa, Mycobacterium
LNDNRVDAIVGWHQAGGNLATL

SEQ ID NO: 930951 - protein, 25 aa, Mycobacterium
LNDRGWRWVHARAGEIAGGSWVDES

SEQ ID NO: 930952 - protein, 20 aa, Mycobacterium
LNEFIPLLAEQGLDTSRVAF

SEQ ID NO: 930953 - protein, 18 aa, Mycobacterium
LNEYWAAVRQPDWSQFVL

SEQ ID NO: 930954 - protein, 18 aa, Mycobacterium
LNGVVTVGLKPGVVVVVP

SEQ ID NO: 930955 - protein, 20 aa, Mycobacterium
LNINGFFPGLNDLVPEIVRR

SEQ ID NO: 930956 - protein, 26 aa, Mycobacterium
LNKLDAILIPRVNAGYSRNDDPSTAP

SEQ ID NO: 930957 - protein, 29 aa, Mycobacterium
LNLALLWTSAFPYGPTFADRVTKGDYINL

SEQ ID NO: 930958 - protein, 22 aa, Mycobacterium
LNLEAWFARFVDGIDVPHVVVS

SEQ ID NO: 930959 - protein, 23 aa, Mycobacterium
LNLPPPCLTGFLPAQQQRVPSWE

SEQ ID NO: 930960 - protein, 24 aa, Mycobacterium
LNLSEGWWPALVNISMGDAGGYDA

SEQ ID NO: 930961 - protein, 17 aa, Mycobacterium
LNNHPLPNIGRVVVTGN

SEQ ID NO: 930962 - protein, 18 aa, Mycobacterium
LNNITLPWTMTVTATAAS

SEQ ID NO: 930963 - protein, 34 aa, Mycobacterium
LNPDGSFTYTPDFGFIGDDSFRYTVTDGASSSNI

SEQ ID NO: 930964 - protein, 25 aa, Mycobacterium
LNPSEGWWPMLIGLAMNDAGGFNAE

SEQ ID NO: 930965 - protein, 25 aa, Mycobacterium
LNPTEFPRSLLLNVSRPISEKFDKA

SEQ ID NO: 930966 - protein, 23 aa, Mycobacterium
LNQDPRLAGSINDVGTFVPSDEQ

SEQ ID NO: 930967 - protein, 20 aa, Mycobacterium
LNQRGMTALHHLAEKLTDER

SEQ ID NO: 930968 - protein, 24 aa, Mycobacterium
LNRLLPPFIKSMSSGAISLDASVD

SEQ ID NO: 930969 - protein, 26 aa, Mycobacterium
LNRLNLPPLQAMWLPPLQPVPADELV

SEQ ID NO: 930970 - protein, 17 aa, Mycobacterium
LNRNLAFVTGLLANDPD

SEQ ID NO: 930971 - protein, 22 aa, Mycobacterium
LNRPDIPGVQDFSGEVYFTAAW

SEQ ID NO: 930972 - protein, 24 aa, Mycobacterium
LNRQLSTIPWMFVAPLTGVTEREY

SEQ ID NO: 930973 - protein, 23 aa, Mycobacterium
LNRTRTPVEFARVLDVLDKLAGS

SEQ ID NO: 930974 - protein, 23 aa, Mycobacterium
LNRTRTPVEFARVLDVLDKLSTS

SEQ ID NO: 930975 - protein, 20 aa, Mycobacterium
LNSTAGFFFTHQTYEPVDIY

SEQ ID NO: 930976 - protein, 17 aa, Mycobacterium
LNTHPLPNIGRVVISGN

SEQ ID NO: 930977 - protein, 17 aa, Mycobacterium
LNVASALGFCLDSIACQ

SEQ ID NO: 930978 - protein, 19 aa, Mycobacterium
LNVFVTFDLTARRLGETLF

SEQ ID NO: 930979 - protein, 19 aa, Mycobacterium
LNVPPPCRTGYLPAQQQRA

SEQ ID NO: 930980 - protein, 20 aa, Mycobacterium
LNVRAPYFLVGALAPTMAKR

SEQ ID NO: 930981 - protein, 17 aa, Mycobacterium
LNVSGGVLSRFAVGPDR

SEQ ID NO: 930982 - protein, 19 aa, Mycobacterium
LPADKFIRLSAPGASAPSH

SEQ ID NO: 930983 - protein, 23 aa, Mycobacterium
LPADLRDALTEWVDAVRAVASAI

SEQ ID NO: 930984 - protein, 21 aa, Mycobacterium
LPAELIPTAVFPAALQDPDTF

SEQ ID NO: 930985 - protein, 19 aa, Mycobacterium
LPAKEWLAQRGFDPVYGAR

SEQ ID NO: 930986 - protein, 24 aa, Mycobacterium
LPAKKWLAERGFDPLYGARPLRRL

SEQ ID NO: 930987 - protein, 23 aa, Mycobacterium
LPAKQWLAHRGFDPVYGARPLRR

SEQ ID NO: 930988 - protein, 22 aa, Mycobacterium
LPAKQWLAQRGFDPVYGARPLR

SEQ ID NO: 930989 - protein, 19 aa, Mycobacterium
LPALRAAQGDVVFINSGAG

SEQ ID NO: 930990 - protein, 20 aa, Mycobacterium
LPANAIVAFALGVDLLNVAR

SEQ ID NO: 930991 - protein, 18 aa, Mycobacterium
LPAQLVVRSVGYRGVPTP

SEQ ID NO: 930992 - protein, 18 aa, Mycobacterium
LPAQRVDDALGRVATMKG

SEQ ID NO: 930993 - protein, 19 aa, Mycobacterium
LPAQSGRPDLAFLTGSGLP

SEQ ID NO: 930994 - protein, 17 aa, Mycobacterium
LPATEPIATTWSVRPFA

SEQ ID NO: 930995 - protein, 17 aa, Mycobacterium
LPAVERIDRVMVVATSV

SEQ ID NO: 930996 - protein, 27 aa, Mycobacterium
LPAVGSPVCSAGKYARKHVPWANFTNV

SEQ ID NO: 930997 - protein, 20 aa, Mycobacterium
LPAVRTSLYADPQFQAKYPM

SEQ ID NO: 930998 - protein, 17 aa, Mycobacterium
LPAYMVPAAVVVLDSLP

SEQ ID NO: 930999 - protein, 20 aa, Mycobacterium
LPDCQAALYTSQDPVYAGTG

SEQ ID NO: 931000 - protein, 19 aa, Mycobacterium
LPDDVIGIGALRKAGYNVV

SEQ ID NO: 931001 - protein, 17 aa, Mycobacterium
LPDEQRRASVLPLLDAY

SEQ ID NO: 931002 - protein, 22 aa, Mycobacterium
LPDGGPLVGRRVRDLEMPTDSA

SEQ ID NO: 931003 - protein, 17 aa, Mycobacterium
LPDGVVIRPLTPTTVRN

SEQ ID NO: 931004 - protein, 26 aa, Mycobacterium
LPDKYRVLGRQAMYGDYFSFYLCDLI

SEQ ID NO: 931005 - protein, 24 aa, Mycobacterium
LPDPARPGAAPPFGIDDTVEVRAT

SEQ ID NO: 931006 - protein, 20 aa, Mycobacterium
LPDPFRPRRTAMLTESVTSP

SEQ ID NO: 931007 - protein, 26 aa, Mycobacterium
LPDTYRVMLRQGLYGNYFTFYLCDLL

SEQ ID NO: 931008 - protein, 22 aa, Mycobacterium
LPDYNIKWTKFDSGADVNTAFV

SEQ ID NO: 931009 - protein, 26 aa, Mycobacterium
LPDYNIKWTRFDSGADINTAFIAREL

SEQ ID NO: 931010 - protein, 26 aa, Mycobacterium
LPEADGRYYLFPMLDGFTNVFEVPGK

SEQ ID NO: 931011 - protein, 20 aa, Mycobacterium
LPEETWYQGWSFPSFEAGAQ

SEQ ID NO: 931012 - protein, 17 aa, Mycobacterium
LPEGFPVTSTIVSGTSV

SEQ ID NO: 931013 - protein, 19 aa, Mycobacterium
LPEHHRWTYLTARDDVRGT

SEQ ID NO: 931014 - protein, 20 aa, Mycobacterium
LPEIANWLGTPAHSDQVILL

SEQ ID NO: 931015 - protein, 21 aa, Mycobacterium
LPELGKLPLAILKQVLPQQSA

SEQ ID NO: 931016 - protein, 22 aa, Mycobacterium
LPEQWSGNFLFYNKRLFAEAGL

SEQ ID NO: 931017 - protein, 24 aa, Mycobacterium
LPERSGRGPLGWLYSASGDDTSLL

SEQ ID NO: 931018 - protein, 19 aa, Mycobacterium
LPESVAVTYPAHWASPVVE

SEQ ID NO: 931019 - protein, 18 aa, Mycobacterium
LPFGFAGNACKPVGDAPP

SEQ ID NO: 931020 - protein, 19 aa, Mycobacterium
LPFIPRPSTLPTRVVRTQG

SEQ ID NO: 931021 - protein, 20 aa, Mycobacterium
LPFMDLRYTAILGEQVRCNG

SEQ ID NO: 931022 - protein, 17 aa, Mycobacterium
LPFPINPYLRPAISPDR

SEQ ID NO: 931023 - protein, 20 aa, Mycobacterium
LPFRIARSVVEAVVPVGQRS

SEQ ID NO: 931024 - protein, 17 aa, Mycobacterium
LPFRRLIRAGNRGTDWF

SEQ ID NO: 931025 - protein, 19 aa, Mycobacterium
LPFTLCSGGHLEADVVVSI

SEQ ID NO: 931026 - protein, 20 aa, Mycobacterium
LPGAGVMTVGPGPRRGELKI

SEQ ID NO: 931027 - protein, 17 aa, Mycobacterium
LPGDLAILTPSPASDTD

SEQ ID NO: 931028 - protein, 17 aa, Mycobacterium
LPGDLSILTPAPATDTD

SEQ ID NO: 931029 - protein, 20 aa, Mycobacterium
LPGEAEALVAQYHGMARYQT

SEQ ID NO: 931030 - protein, 17 aa, Mycobacterium
LPGHRPAPVEDRRSLPP

SEQ ID NO: 931031 - protein, 18 aa, Mycobacterium
LPGIRQLVARQALKVGRS

SEQ ID NO: 931032 - protein, 23 aa, Mycobacterium
LPGNPRVLSIAQFWDRAANHDRI

SEQ ID NO: 931033 - protein, 26 aa, Mycobacterium
LPGPGARLAPIFAYPLLAACPSITQG

SEQ ID NO: 931034 - protein, 20 aa, Mycobacterium
LPGRHRDAIDALGYGVLAKS

SEQ ID NO: 931035 - protein, 20 aa, Mycobacterium
LPGWAWSDVLEHFRAIETDL

SEQ ID NO: 931036 - protein, 18 aa, Mycobacterium
LPHNRVWVKALGEVPEDP

SEQ ID NO: 931037 - protein, 20 aa, Mycobacterium
LPHTPPWNALWFALRSPTFR

SEQ ID NO: 931038 - protein, 25 aa, Mycobacterium
LPIAVSPWPATAFGALLVLLLAAVG

SEQ ID NO: 931039 - protein, 21 aa, Mycobacterium
LPIAVSPWPATAFVALLVALA

SEQ ID NO: 931040 - protein, 17 aa, Mycobacterium
LPITAVTIVAVGSQWGP

SEQ ID NO: 931041 - protein, 17 aa, Mycobacterium
LPKDGNGPFGLVVFIHG

SEQ ID NO: 931042 - protein, 22 aa, Mycobacterium
LPKELKVDVLLMGVQDDPIVGV

SEQ ID NO: 931043 - protein, 24 aa, Mycobacterium
LPKNSRLGYRETINYATRISTDGI

SEQ ID NO: 931044 - protein, 22 aa, Mycobacterium
LPKRVHERFDLVGFDPRGVASS

SEQ ID NO: 931045 - protein, 24 aa, Mycobacterium
LPKRVRERFDLVGFDPRGVGASRP

SEQ ID NO: 931046 - protein, 23 aa, Mycobacterium
LPKRVRERFDLVGFDPRGVGSSR

SEQ ID NO: 931047 - protein, 18 aa, Mycobacterium
LPLALPIAAPGLLGGFAG

SEQ ID NO: 931048 - protein, 17 aa, Mycobacterium
LPLDRAGFIVNDLARST

SEQ ID NO: 931049 - protein, 27 aa, Mycobacterium
LPLLEPLRALPVLGDPLADLVQPNLKV

SEQ ID NO: 931050 - protein, 19 aa, Mycobacterium
LPLLLAAGTALARAPRASA

SEQ ID NO: 931051 - protein, 20 aa, Mycobacterium
LPLLRLRGLVAPAHGDAPGH

SEQ ID NO: 931052 - protein, 25 aa, Mycobacterium
LPLRAMVMVLLFLGVVFLLVGFQAL

SEQ ID NO: 931053 - protein, 21 aa, Mycobacterium
LPLSACSPGLAANPRYATDSG

SEQ ID NO: 931054 - protein, 19 aa, Mycobacterium
LPLVFGPIAIAYRVNGLTS

SEQ ID NO: 931055 - protein, 19 aa, Mycobacterium
LPLYRQQRTLLMSKKMYAV

SEQ ID NO: 931056 - protein, 17 aa, Mycobacterium
LPMSWRNLSGPLFGNTI

SEQ ID NO: 931057 - protein, 22 aa, Mycobacterium
LPNEIPAGVRWEDLRRSLSGAL

SEQ ID NO: 931058 - protein, 27 aa, Mycobacterium
LPNGELVKRCYADILPAATAGTLFIDS

SEQ ID NO: 931059 - protein, 21 aa, Mycobacterium
LPNVQRQSATFALDTDRPDCG

SEQ ID NO: 931060 - protein, 17 aa, Mycobacterium
LPPELPATARAWRDGQL

SEQ ID NO: 931061 - protein, 17 aa, Mycobacterium
LPPGLTFDPQDCAKSAT

SEQ ID NO: 931062 - protein, 27 aa, Mycobacterium
LPPLYRTRLPIPIRLAPVASDAASDYY

SEQ ID NO: 931063 - protein, 19 aa, Mycobacterium
LPPPAPVDMLAAPMPAPEG

SEQ ID NO: 931064 - protein, 23 aa, Mycobacterium
LPPPEERIAALAARHDARIGLYA

SEQ ID NO: 931065 - protein, 19 aa, Mycobacterium
LPPSALSVHFINGGDTGKD

SEQ ID NO: 931066 - protein, 19 aa, Mycobacterium
LPPTPGIPIAGRPGDPPPN

SEQ ID NO: 931067 - protein, 18 aa, Mycobacterium
LPPVINWLADDIYLPNTK

SEQ ID NO: 931068 - protein, 18 aa, Mycobacterium
LPPVPVVLPKPVRQLEQT

SEQ ID NO: 931069 - protein, 20 aa, Mycobacterium
LPPVVAVAAHGAWLTLIRDG

SEQ ID NO: 931070 - protein, 23 aa, Mycobacterium
LPQEVKERFDIVGFDPRGVASSS

SEQ ID NO: 931071 - protein, 17 aa, Mycobacterium
LPQEVVDDIGWARYPRV

SEQ ID NO: 931072 - protein, 20 aa, Mycobacterium
LPQGCIAAGDRGFFCEYAMR

SEQ ID NO: 931073 - protein, 24 aa, Mycobacterium
LPQQARKADLLFYGPEGTQSVAMY

SEQ ID NO: 931074 - protein, 24 aa, Mycobacterium
LPQQSAKKKPGWAQELARPALPNP

SEQ ID NO: 931075 - protein, 20 aa, Mycobacterium
LPQRVELRAILEYDAAHPSG

SEQ ID NO: 931076 - protein, 18 aa, Mycobacterium
LPQSACLVGSQKVTSGGR

SEQ ID NO: 931077 - protein, 23 aa, Mycobacterium
LPRGCIAAGDRAFFCDYVLDYLA

SEQ ID NO: 931078 - protein, 17 aa, Mycobacterium
LPRMHLARYAGTARPRL

SEQ ID NO: 931079 - protein, 20 aa, Mycobacterium
LPRNVTRSGIHVVTEKYEDF

SEQ ID NO: 931080 - protein, 17 aa, Mycobacterium
LPRPWNPLPCAGGGIGP

SEQ ID NO: 931081 - protein, 29 aa, Mycobacterium
LPRVNSRGGPGGAPGCWQQITHSLWPTPE

SEQ ID NO: 931082 - protein, 17 aa, Mycobacterium
LPSAPTYHWCPGEFWNP

SEQ ID NO: 931083 - protein, 22 aa, Mycobacterium
LPSQRVAIAVALTYTPEAFDDE

SEQ ID NO: 931084 - protein, 21 aa, Mycobacterium
LPTAGCARHSSGLSVQTFLRG

SEQ ID NO: 931085 - protein, 26 aa, Mycobacterium
LPTARAVVLPQWLFSVLLTPAIRLTN

SEQ ID NO: 931086 - protein, 25 aa, Mycobacterium
LPTGLRLQSKPGFRVQPGARVCEAT

SEQ ID NO: 931087 - protein, 24 aa, Mycobacterium
LPTNVDLRFGTSVSEVTHGDDRAV

SEQ ID NO: 931088 - protein, 18 aa, Mycobacterium
LPTPATSVTLTMSDWGKQ

SEQ ID NO: 931089 - protein, 26 aa, Mycobacterium
LPTPGVLVLVGFEWGAERYRYPVNLP

SEQ ID NO: 931090 - protein, 25 aa, Mycobacterium
LPTPYAMGITFAFRGVTPTGDAYEP

SEQ ID NO: 931091 - protein, 25 aa, Mycobacterium
LPTSAEIAEPLWIVQNFQHGTLNFD

SEQ ID NO: 931092 - protein, 19 aa, Mycobacterium
LPTTFIFDAAGRQRYRTAG

SEQ ID NO: 931093 - protein, 19 aa, Mycobacterium
LPTTFIFDADGRQLYRTAG

SEQ ID NO: 931094 - protein, 19 aa, Mycobacterium
LPTTFIFDATGRQAYRVSG

SEQ ID NO: 931095 - protein, 17 aa, Mycobacterium
LPTVGSPVCTAGKYARK

SEQ ID NO: 931096 - protein, 18 aa, Mycobacterium
LPTVNGLVNPFFDERPGH

SEQ ID NO: 931097 - protein, 26 aa, Mycobacterium
LPTYAFARRRFWLDGSASAADVGEAG

SEQ ID NO: 931098 - protein, 17 aa, Mycobacterium
LPVDGAIVLVDRGSCPF

SEQ ID NO: 931099 - protein, 17 aa, Mycobacterium
LPVDGRWVLVVTADTGA

SEQ ID NO: 931100 - protein, 17 aa, Mycobacterium
LPVDGYTAWLQNMAADE

SEQ ID NO: 931101 - protein, 21 aa, Mycobacterium
LPVESFEPVGMRLDPAPDAPK

SEQ ID NO: 931102 - protein, 29 aa, Mycobacterium
LPVGSRLGYRTTIPYATRISVDGIYLHQL

SEQ ID NO: 931103 - protein, 19 aa, Mycobacterium
LPVMAAGGLATPAAVAGVI

SEQ ID NO: 931104 - protein, 19 aa, Mycobacterium
LPVQAWPLIVQFEGVRPRM

SEQ ID NO: 931105 - protein, 18 aa, Mycobacterium
LPVQLVVRSVGYRGVPTP

SEQ ID NO: 931106 - protein, 21 aa, Mycobacterium
LPVVLGGNMVQYDWTINGKPY

SEQ ID NO: 931107 - protein, 19 aa, Mycobacterium
LPWGSDGVGVWQHDGIFFI

SEQ ID NO: 931108 - protein, 20 aa, Mycobacterium
LPYLTLRLTGVASLTVDVKR

SEQ ID NO: 931109 - protein, 20 aa, Mycobacterium
LPYQCTAGFTVRTPGGSPGM

SEQ ID NO: 931110 - protein, 20 aa, Mycobacterium
LPYQPKGTLWEATATDEAIQ

SEQ ID NO: 931111 - protein, 18 aa, Mycobacterium
LPYRIEFSTFTSGPPMVE

SEQ ID NO: 931112 - protein, 31 aa, Mycobacterium
LQAAGRILGWRLRLAGVDPRGQVDLASEGGP

SEQ ID NO: 931113 - protein, 23 aa, Mycobacterium
LQAKQWLAHRGFDPVYGARPLRR

SEQ ID NO: 931114 - protein, 30 aa, Mycobacterium
LQALQCPLKELGRASPYLIGALKLILTQPF

SEQ ID NO: 931115 - protein, 30 aa, Mycobacterium
LQALQCPLKELGRASPYLVGALKLILTQPF

SEQ ID NO: 931116 - protein, 21 aa, Mycobacterium
LQALQCPLKELGRGSQYLIGA

SEQ ID NO: 931117 - protein, 25 aa, Mycobacterium
LQANGFDIGRRMGIGSRETYIPALK

SEQ ID NO: 931118 - protein, 19 aa, Mycobacterium
LQAQILHWRGDTARGGEIA

SEQ ID NO: 931119 - protein, 27 aa, Mycobacterium
LQASPGLPTRGVIALCDLGAGGSSITL

SEQ ID NO: 931120 - protein, 27 aa, Mycobacterium
LQDHLAFPVEWEFPPGWGPDARGQACI

SEQ ID NO: 931121 - protein, 18 aa, Mycobacterium
LQDISRLVAQDGRTMTAE

SEQ ID NO: 931122 - protein, 23 aa, Mycobacterium
LQELEKAAGVAITAGGTKLSIPD

SEQ ID NO: 931123 - protein, 31 aa, Mycobacterium
LQIRAVGRLLGWRLGIAEVDPKSMVELESTG

SEQ ID NO: 931124 - protein, 17 aa, Mycobacterium
LQKDCRHAASLADAASA

SEQ ID NO: 931125 - protein, 17 aa, Mycobacterium
LQLAIFAMVTVLAGGSM

SEQ ID NO: 931126 - protein, 18 aa, Mycobacterium
LQLASAICRHYWPVTLIA

SEQ ID NO: 931127 - protein, 24 aa, Mycobacterium
LQLPIETFNALGFTLPKESVQSMI

SEQ ID NO: 931128 - protein, 31 aa, Mycobacterium
LQLRAVGRLLGWRLGMDDVDPKGTVELESAG

SEQ ID NO: 931129 - protein, 18 aa, Mycobacterium
LQLVDILKPGLGLDAITP

SEQ ID NO: 931130 - protein, 34 aa, Mycobacterium
LQMLLDMVNAPTLALVGRPLIGNGANGAPGNGAN

SEQ ID NO: 931131 - protein, 24 aa, Mycobacterium
LQPEMKKQPFSLAMTGPPPSPIER

SEQ ID NO: 931132 - protein, 25 aa, Mycobacterium
LQPIEWRYTNDPAWVMRTKGDRLPH

SEQ ID NO: 931133 - protein, 21 aa, Mycobacterium
LQPYLGAYGHLVALRASDLHY

SEQ ID NO: 931134 - protein, 19 aa, Mycobacterium
LQQAIPLINTYVMSLGESV

SEQ ID NO: 931135 - protein, 34 aa, Mycobacterium
LQQALALPAAVDFSISIFGLQLVQGGTANANSTF

SEQ ID NO: 931136 - protein, 19 aa, Mycobacterium
LQRALGCQKVNTSFGARAY

SEQ ID NO: 931137 - protein, 26 aa, Mycobacterium
LQRCLFARGRYVTWVEGTRSVIGQRA

SEQ ID NO: 931138 - protein, 19 aa, Mycobacterium
LQRNTTLWASWVVIGPGHR

SEQ ID NO: 931139 - protein, 18 aa, Mycobacterium
LQSACADLRGYIDKAKRK

SEQ ID NO: 931140 - protein, 24 aa, Mycobacterium
LQSEFSVPAGHVFATGMSNGGFMS

SEQ ID NO: 931141 - protein, 19 aa, Mycobacterium
LQSIPGFGVQPALPVCHAG

SEQ ID NO: 931142 - protein, 21 aa, Mycobacterium
LQSLQCPLKELGRGSQYLIGA

SEQ ID NO: 931143 - protein, 24 aa, Mycobacterium
LQSQWREAGVEIKLTSPSLTEYEA

SEQ ID NO: 931144 - protein, 18 aa, Mycobacterium
LQSVYCGAKHAVNGFTES

SEQ ID NO: 931145 - protein, 18 aa, Mycobacterium
LQVALTREAQYLVEEGVV

SEQ ID NO: 931146 - protein, 17 aa, Mycobacterium
LQVFRFKPMTPNGAMND

SEQ ID NO: 931147 - protein, 18 aa, Mycobacterium
LQVPSAGMGHNITVEFQS

SEQ ID NO: 931148 - protein, 29 aa, Mycobacterium
LRAAAARCDIAWPRPKVLCTVRLARRVLS

SEQ ID NO: 931149 - protein, 17 aa, Mycobacterium
LRAAFGNDYGLVVETAL

SEQ ID NO: 931150 - protein, 17 aa, Mycobacterium
LRAAKAQPLGVLPRPAP

SEQ ID NO: 931151 - protein, 17 aa, Mycobacterium
LRAAQPVRGHLAVRTEQ

SEQ ID NO: 931152 - protein, 23 aa, Mycobacterium
LRAEFPWLGVALQAYLRRTPGDC

SEQ ID NO: 931153 - protein, 17 aa, Mycobacterium
LRAGAVLATAAVLAGCG

SEQ ID NO: 931154 - protein, 21 aa, Mycobacterium
LRAGDELLFVFASGVEERIRA

SEQ ID NO: 931155 - protein, 20 aa, Mycobacterium
LRAGESVRFAGVRIGTVKDL

SEQ ID NO: 931156 - protein, 17 aa, Mycobacterium
LRAGLGVAMGNAHPDAR

SEQ ID NO: 931157 - protein, 21 aa, Mycobacterium
LRAGYPLAQITTALCDRWQPG

SEQ ID NO: 931158 - protein, 25 aa, Mycobacterium
LRAKIKEVFPLASSDAVESFVQAVA

SEQ ID NO: 931159 - protein, 17 aa, Mycobacterium
LRALIAAQRETTDVNTF

SEQ ID NO: 931160 - protein, 20 aa, Mycobacterium
LRALKPWEGARHFVLIDDVQ

SEQ ID NO: 931161 - protein, 18 aa, Mycobacterium
LRALLDLLPIAAGSGTLG

SEQ ID NO: 931162 - protein, 17 aa, Mycobacterium
LRALQAIADANNGNRAT

SEQ ID NO: 931163 - protein, 21 aa, Mycobacterium
LRANLERWAGLLPEDATLVSL

SEQ ID NO: 931164 - protein, 18 aa, Mycobacterium
LRANTAVTTVRWSDTGRR

SEQ ID NO: 931165 - protein, 22 aa, Mycobacterium
LRARPGDYLLALSVAGASLPVV

SEQ ID NO: 931166 - protein, 19 aa, Mycobacterium
LRAVLRWDQRLGGRLRRRI

SEQ ID NO: 931167 - protein, 23 aa, Mycobacterium
LRAVNIGAVLPPLAVGEKHTAAA

SEQ ID NO: 931168 - protein, 26 aa, Mycobacterium
LRAVPVDLRHDWPQALRDAGFQTSLP

SEQ ID NO: 931169 - protein, 18 aa, Mycobacterium
LRDALTQYVEQSRKLAGA

SEQ ID NO: 931170 - protein, 18 aa, Mycobacterium
LRDAVPWNQSDDDDFYGR

SEQ ID NO: 931171 - protein, 19 aa, Mycobacterium
LRDCVKRFPDGLATGDAGW

SEQ ID NO: 931172 - protein, 20 aa, Mycobacterium
LRDEARLVFTAHSIPLRAAS

SEQ ID NO: 931173 - protein, 18 aa, Mycobacterium
LRDGLRSGVRVLIVGAGL

SEQ ID NO: 931174 - protein, 27 aa, Mycobacterium
LRDLWNMRNSPEFMQSVGPGQMDPSTW

SEQ ID NO: 931175 - protein, 27 aa, Mycobacterium
LRDMLNGIYDPVQWEINIIKTTTGATV

SEQ ID NO: 931176 - protein, 23 aa, Mycobacterium
LRDNGYLPMSFVARDIAWSDKTP

SEQ ID NO: 931177 - protein, 19 aa, Mycobacterium
LRDPAPLFRTNVEGLRHVL

SEQ ID NO: 931178 - protein, 25 aa, Mycobacterium
LRDRGLQIFPLVGWAERGGYDANGH

SEQ ID NO: 931179 - protein, 17 aa, Mycobacterium
LREFRTLVHYRLQSAPW

SEQ ID NO: 931180 - protein, 17 aa, Mycobacterium
LREGVWMRPDNLELGLD

SEQ ID NO: 931181 - protein, 17 aa, Mycobacterium
LREGVWVRPDNLDPQRL

SEQ ID NO: 931182 - protein, 22 aa, Mycobacterium
LREIWSDSPLTFLGLMVPGLPN

SEQ ID NO: 931183 - protein, 21 aa, Mycobacterium
LRELFDLIQKYPFWTDDGGLS

SEQ ID NO: 931184 - protein, 22 aa, Mycobacterium
LREPRIPGVDKIRLRLQRIGSV

SEQ ID NO: 931185 - protein, 20 aa, Mycobacterium
LRFCCRPEATMLTLVAAPTG

SEQ ID NO: 931186 - protein, 20 aa, Mycobacterium
LRGAAVLAARIMARLAATPS

SEQ ID NO: 931187 - protein, 20 aa, Mycobacterium
LRGAGRLVIERMGLLEQMRQ

SEQ ID NO: 931188 - protein, 36 aa, Mycobacterium
LRGAHFCAVSAFPALKKRGGTFLVMTSPAGIEGSAT

SEQ ID NO: 931189 - protein, 21 aa, Mycobacterium
LRGDGRGGGPVADVVNASAAI

SEQ ID NO: 931190 - protein, 17 aa, Mycobacterium
LRGLLAQKFPTVPPDVI

SEQ ID NO: 931191 - protein, 31 aa, Mycobacterium
LRGLRTSPFYPRQCELGASFYEGGGWERPAW

SEQ ID NO: 931192 - protein, 24 aa, Mycobacterium
LRGNNWVAFNGCCDPGWAHRDAIM

SEQ ID NO: 931193 - protein, 24 aa, Mycobacterium
LRGNNWVAFNGCCEPGWAHRDSIL

SEQ ID NO: 931194 - protein, 22 aa, Mycobacterium
LRGPGTLPPFFAAVTGERHENR

SEQ ID NO: 931195 - protein, 24 aa, Mycobacterium
LRGRARDTYLLSVKFGAQIGPGVT

SEQ ID NO: 931196 - protein, 20 aa, Mycobacterium
LRGSVTPAWGVQALSAGGYV

SEQ ID NO: 931197 - protein, 19 aa, Mycobacterium
LRHCGEGDLYGGNEPARTW

SEQ ID NO: 931198 - protein, 17 aa, Mycobacterium
LRHLATLLLHLASRAGA

SEQ ID NO: 931199 - protein, 17 aa, Mycobacterium
LRHLPLTLVHMVNAAVP

SEQ ID NO: 931200 - protein, 19 aa, Mycobacterium
LRHPGAPTYMVSWDRVDRV

SEQ ID NO: 931201 - protein, 19 aa, Mycobacterium
LRHYTGYQYNSGRKVPSAQ

SEQ ID NO: 931202 - protein, 18 aa, Mycobacterium
LRIDCGYDDPFASATEQF

SEQ ID NO: 931203 - protein, 26 aa, Mycobacterium
LRIDPRNRLPVAITGGLVRLGEPLLR

SEQ ID NO: 931204 - protein, 26 aa, Mycobacterium
LRIEPSALVGPVWRREEIIDFNASVV

SEQ ID NO: 931205 - protein, 18 aa, Mycobacterium
LRIHLGVPEWPQPDPHQT

SEQ ID NO: 931206 - protein, 31 aa, Mycobacterium
LRITPTGSWIFRECAAWGLGRSDTADRLSVS

SEQ ID NO: 931207 - protein, 19 aa, Mycobacterium
LRIWVPALATGVLLKPDSQ

SEQ ID NO: 931208 - protein, 21 aa, Mycobacterium
LRKRLTGLLGAFRAFSYGSLY

SEQ ID NO: 931209 - protein, 23 aa, Mycobacterium
LRKVRLVAAFAMTVIVSGCATNG

SEQ ID NO: 931210 - protein, 23 aa, Mycobacterium
LRKWGIPEARIVELDWNESHRIG

SEQ ID NO: 931211 - protein, 25 aa, Mycobacterium
LRLDRWSRRRVTLVGDAGYCPGPAV

SEQ ID NO: 931212 - protein, 17 aa, Mycobacterium
LRLLCRAAGITEVSAPS

SEQ ID NO: 931213 - protein, 21 aa, Mycobacterium
LRLLLALSRLGSMRAVADAFS

SEQ ID NO: 931214 - protein, 21 aa, Mycobacterium
LRLLLTTGLAAAVVATAAGCQ

SEQ ID NO: 931215 - protein, 19 aa, Mycobacterium
LRLLVATVISVMFTTFAVA

SEQ ID NO: 931216 - protein, 20 aa, Mycobacterium
LRLPIGIGSPLVRRYQTQLT

SEQ ID NO: 931217 - protein, 19 aa, Mycobacterium
LRLPIPLNAEVSASEQQLA

SEQ ID NO: 931218 - protein, 17 aa, Mycobacterium
LRLPVDGRWVLVVTADT

SEQ ID NO: 931219 - protein, 31 aa, Mycobacterium
LRLRAELEYGGRLVVVGGGFIGAEIAATARS

SEQ ID NO: 931220 - protein, 18 aa, Mycobacterium
LRLSDYCLGLYGSRDYLA

SEQ ID NO: 931221 - protein, 17 aa, Mycobacterium
LRLVRELYRGGTNLYTP

SEQ ID NO: 931222 - protein, 21 aa, Mycobacterium
LRLVVGALLLGLAFAGGYAVS

SEQ ID NO: 931223 - protein, 25 aa, Mycobacterium
LRLWPDRRLSRRGVEIIARRGPRGD

SEQ ID NO: 931224 - protein, 18 aa, Mycobacterium
LRMLRMVKEECEVDALRK

SEQ ID NO: 931225 - protein, 28 aa, Mycobacterium
LRMRPGNWAGAYACWGTENREAAVRFVK

SEQ ID NO: 931226 - protein, 19 aa, Mycobacterium
LRNAMKYGGLSAYLGEWWH

SEQ ID NO: 931227 - protein, 26 aa, Mycobacterium
LRNHARWAVLLRNLRFVIVDECHYYR

SEQ ID NO: 931228 - protein, 26 aa, Mycobacterium
LRNKTRLAALRVKDFGKRDVMMVHTL

SEQ ID NO: 931229 - protein, 26 aa, Mycobacterium
LRNKTRLAALRVKDFGKRDVMVVHTL

SEQ ID NO: 931230 - protein, 21 aa, Mycobacterium
LRNLSELMVAAGQIPEPIDWA

SEQ ID NO: 931231 - protein, 27 aa, Mycobacterium
LRNTKRVNWALTYGPSKYRCFVSYNGV

SEQ ID NO: 931232 - protein, 19 aa, Mycobacterium
LRPALSLIAALTAVITALA

SEQ ID NO: 931233 - protein, 19 aa, Mycobacterium
LRPDPIPDDVRVLGFPPDT

SEQ ID NO: 931234 - protein, 20 aa, Mycobacterium
LRPEAVAGELRSRVQEPSGI

SEQ ID NO: 931235 - protein, 17 aa, Mycobacterium
LRPEDIADAVLFMVTRD

SEQ ID NO: 931236 - protein, 25 aa, Mycobacterium
LRPHAAELWARMIADERAVFLRKYR

SEQ ID NO: 931237 - protein, 17 aa, Mycobacterium
LRPNAVVSLHADGGPAT

SEQ ID NO: 931238 - protein, 28 aa, Mycobacterium
LRPQGHVLVFWDCYRPHEAQVKMFNAVP

SEQ ID NO: 931239 - protein, 17 aa, Mycobacterium
LRPSDWERQLGVNLMGV

SEQ ID NO: 931240 - protein, 17 aa, Mycobacterium
LRQARRLAPQLGGRKPA

SEQ ID NO: 931241 - protein, 18 aa, Mycobacterium
LRQATVLGDIYIAMISPK

SEQ ID NO: 931242 - protein, 19 aa, Mycobacterium
LRQGNVIATMAGWRTDFLN

SEQ ID NO: 931243 - protein, 19 aa, Mycobacterium
LRQHFPATITGLLEHGHRA

SEQ ID NO: 931244 - protein, 17 aa, Mycobacterium
LRQKGPWSDDLILQGQA

SEQ ID NO: 931245 - protein, 20 aa, Mycobacterium
LRQLTGRPSTDFTIPPQGSR

SEQ ID NO: 931246 - protein, 24 aa, Mycobacterium
LRQNNCKLITWPIATISPIGIRTA

SEQ ID NO: 931247 - protein, 20 aa, Mycobacterium
LRQRFPVIAISTDPRLETDC

SEQ ID NO: 931248 - protein, 18 aa, Mycobacterium
LRQRGIRPSMANAQALKA

SEQ ID NO: 931249 - protein, 18 aa, Mycobacterium
LRQRPGAMPPPANVIRAR

SEQ ID NO: 931250 - protein, 25 aa, Mycobacterium
LRQSCLDVGLAKRVLGWEPRVPLAD

SEQ ID NO: 931251 - protein, 20 aa, Mycobacterium
LRQSVAGLVVLLALTVVLGV

SEQ ID NO: 931252 - protein, 21 aa, Mycobacterium
LRRELLRDGQVFYVHNRVSSI

SEQ ID NO: 931253 - protein, 27 aa, Mycobacterium
LRRHQTLRASLDWSYGLLSEPERILLR

SEQ ID NO: 931254 - protein, 17 aa, Mycobacterium
LRRHYRFGVDVVGAAFE

SEQ ID NO: 931255 - protein, 17 aa, Mycobacterium
LRRKFRAIWVGGRTPPA

SEQ ID NO: 931256 - protein, 20 aa, Mycobacterium
LRRLAGTPIGGWHTDLWEAH

SEQ ID NO: 931257 - protein, 19 aa, Mycobacterium
LRRNFPLVARARYLLESIG

SEQ ID NO: 931258 - protein, 20 aa, Mycobacterium
LRRWASRLGAVFTRRNKRHH

SEQ ID NO: 931259 - protein, 20 aa, Mycobacterium
LRRWGPPGLTGYEIHHGTVT

SEQ ID NO: 931260 - protein, 21 aa, Mycobacterium
LRRWLTQLIVTGRVVAAEADA

SEQ ID NO: 931261 - protein, 19 aa, Mycobacterium
LRSADWAQNFVKVDSGEVD

SEQ ID NO: 931262 - protein, 18 aa, Mycobacterium
LRSDGTAVGAGYNTYGQL

SEQ ID NO: 931263 - protein, 26 aa, Mycobacterium
LRSKTRLAALRVKDFGKREVMVVHTL

SEQ ID NO: 931264 - protein, 20 aa, Mycobacterium
LRSRELWEKLAVDVPGIGFR

SEQ ID NO: 931265 - protein, 17 aa, Mycobacterium
LRSRFATRIEFEPYAPQ

SEQ ID NO: 931266 - protein, 22 aa, Mycobacterium
LRSRFDGFAGVVVEADDPAMSL

SEQ ID NO: 931267 - protein, 24 aa, Mycobacterium
LRSRPELAGVPAIRDDRYAVLTLQ

SEQ ID NO: 931268 - protein, 17 aa, Mycobacterium
LRTADRNSWALADSTTD

SEQ ID NO: 931269 - protein, 19 aa, Mycobacterium
LRTATPLGDVFVAITPPDQ

SEQ ID NO: 931270 - protein, 21 aa, Mycobacterium
LRTLWDVPAVALVGVGNGAQV

SEQ ID NO: 931271 - protein, 29 aa, Mycobacterium
LRTQGIKAWPKCGAKGMAAQVWGNPAPSA

SEQ ID NO: 931272 - protein, 18 aa, Mycobacterium
LRTQIAEVEALYRALTPD

SEQ ID NO: 931273 - protein, 18 aa, Mycobacterium
LRTRGIAHVVAFMDVSLF

SEQ ID NO: 931274 - protein, 18 aa, Mycobacterium
LRTRLYRLADDQHVFVLV

SEQ ID NO: 931275 - protein, 24 aa, Mycobacterium
LRTRRAGAVGLVITEPLNYSFSDP

SEQ ID NO: 931276 - protein, 17 aa, Mycobacterium
LRTSTIWGGASSISHLS

SEQ ID NO: 931277 - protein, 19 aa, Mycobacterium
LRTVAAWLCAQGHPVTPTT

SEQ ID NO: 931278 - protein, 21 aa, Mycobacterium
LRTVVRHELFHYAARADTAAD

SEQ ID NO: 931279 - protein, 17 aa, Mycobacterium
LRTVVSAIQIIADVDRM

SEQ ID NO: 931280 - protein, 25 aa, Mycobacterium
LRVADALECLVRLAAGVGTHSYGAR

SEQ ID NO: 931281 - protein, 17 aa, Mycobacterium
LRVAGAVLDRANRFLPF

SEQ ID NO: 931282 - protein, 25 aa, Mycobacterium
LRVAVPSFLLLFLVACGGSGRVSHP

SEQ ID NO: 931283 - protein, 18 aa, Mycobacterium
LRVGQDVVAIGSPLGLEG

SEQ ID NO: 931284 - protein, 18 aa, Mycobacterium
LRVIRGDDGARQWLEAFK

SEQ ID NO: 931285 - protein, 17 aa, Mycobacterium
LRVPLRETFSGNAKGHG

SEQ ID NO: 931286 - protein, 18 aa, Mycobacterium
LRVPLSELQRLRGMTPRA

SEQ ID NO: 931287 - protein, 18 aa, Mycobacterium
LRVVPGLCPVRTSPADFS

SEQ ID NO: 931288 - protein, 23 aa, Mycobacterium
LRWRPVVALALIVAVLAGCGGGA

SEQ ID NO: 931289 - protein, 17 aa, Mycobacterium
LRYAIDPSPLYDELAWA

SEQ ID NO: 931290 - protein, 26 aa, Mycobacterium
LRYRNNVPLTYPFVLAFPSVMALVTG

SEQ ID NO: 931291 - protein, 22 aa, Mycobacterium
LRYTLLRLQERVVGKGPGVPQM

SEQ ID NO: 931292 - protein, 22 aa, Mycobacterium
LRYYPPANYTGQITIPYTVWDG

SEQ ID NO: 931293 - protein, 24 aa, Mycobacterium
LSAALKLFAAKGYAATSVADIQRC

SEQ ID NO: 931294 - protein, 17 aa, Mycobacterium
LSAAPPGVETWYRGAAR

SEQ ID NO: 931295 - protein, 20 aa, Mycobacterium
LSAAQLRSALPRGGVDVDAV

SEQ ID NO: 931296 - protein, 17 aa, Mycobacterium
LSAAQLVPTIAGAAATT

SEQ ID NO: 931297 - protein, 38 aa, Mycobacterium
LSAARALGRYGVCANAICPRARTAMTADVFGATPDVAA

SEQ ID NO: 931298 - protein, 23 aa, Mycobacterium
LSAARALGRYGVRANAICPRART

SEQ ID NO: 931299 - protein, 22 aa, Mycobacterium
LSADGELSWVVGNLGAIPAVTL

SEQ ID NO: 931300 - protein, 20 aa, Mycobacterium
LSAGHARALLALEGGPEAQE

SEQ ID NO: 931301 - protein, 26 aa, Mycobacterium
LSAGWRATAAREYRQISGPDPENLVT

SEQ ID NO: 931302 - protein, 17 aa, Mycobacterium
LSAKESGDANDLPFWDG

SEQ ID NO: 931303 - protein, 17 aa, Mycobacterium
LSALAMLANEGPMTPGA

SEQ ID NO: 931304 - protein, 20 aa, Mycobacterium
LSALIVSRLHKIFGSQDLNA

SEQ ID NO: 931305 - protein, 18 aa, Mycobacterium
LSALPALDAVVISHDHYD

SEQ ID NO: 931306 - protein, 25 aa, Mycobacterium
LSAPGPCRAAGTSDLTFASGWLEFR

SEQ ID NO: 931307 - protein, 25 aa, Mycobacterium
LSAPGSRLAFEFVPDTKIFADERWR

SEQ ID NO: 931308 - protein, 20 aa, Mycobacterium
LSAQAAVFHDQFVQNLNVAA

SEQ ID NO: 931309 - protein, 18 aa, Mycobacterium
LSARLGIHRNVMVTVIDD

SEQ ID NO: 931310 - protein, 20 aa, Mycobacterium
LSASGKMRWIVGNLGAIPAV

SEQ ID NO: 931311 - protein, 21 aa, Mycobacterium
LSAYLGEWWHFDGPGAGTDLP

SEQ ID NO: 931312 - protein, 17 aa, Mycobacterium
LSCQIVTWRCWAEELGI

SEQ ID NO: 931313 - protein, 19 aa, Mycobacterium
LSDEAEWITGQVWYIGGGS

SEQ ID NO: 931314 - protein, 17 aa, Mycobacterium
LSDRLVSITSDIGKVTM

SEQ ID NO: 931315 - protein, 18 aa, Mycobacterium
LSDWARATIKLETDTSVE

SEQ ID NO: 931316 - protein, 18 aa, Mycobacterium
LSEEIVRLTGHAAPTPST

SEQ ID NO: 931317 - protein, 18 aa, Mycobacterium
LSEGKANQFAAIAASTYC

SEQ ID NO: 931318 - protein, 17 aa, Mycobacterium
LSFGRYGDDLARSTGDE

SEQ ID NO: 931319 - protein, 19 aa, Mycobacterium
LSFPAGAMISLCTALDGEA

SEQ ID NO: 931320 - protein, 25 aa, Mycobacterium
LSFYRPNQPGAYPIVLATYEIVCSK

SEQ ID NO: 931321 - protein, 19 aa, Mycobacterium
LSGADFPAGRQKLNGPQAL

SEQ ID NO: 931322 - protein, 19 aa, Mycobacterium
LSGADFPAGRQKLTGPQAL

SEQ ID NO: 931323 - protein, 26 aa, Mycobacterium
LSGAFYCARAAFGPMTDQGYGRIVNF

SEQ ID NO: 931324 - protein, 27 aa, Mycobacterium
LSGALPRRPVFALLKGRGNYLCLNKIH

SEQ ID NO: 931325 - protein, 17 aa, Mycobacterium
LSGAPRTFASNTLVIVT

SEQ ID NO: 931326 - protein, 23 aa, Mycobacterium
LSGDGRLPAGGMLLIGTPDGQKV

SEQ ID NO: 931327 - protein, 22 aa, Mycobacterium
LSGDLGFLAPLLNWTLYAQNIN

SEQ ID NO: 931328 - protein, 25 aa, Mycobacterium
LSGGRLDVGVGIGWMKDEHDIARGA

SEQ ID NO: 931329 - protein, 20 aa, Mycobacterium
LSGIAGVFGSRAIDLCNQGD

SEQ ID NO: 931330 - protein, 18 aa, Mycobacterium
LSGIDVELTRRASLIPSL

SEQ ID NO: 931331 - protein, 18 aa, Mycobacterium
LSGLIGPQPSARVLAQTK

SEQ ID NO: 931332 - protein, 18 aa, Mycobacterium
LSGLSMRSLAAALGTGPM

SEQ ID NO: 931333 - protein, 19 aa, Mycobacterium
LSGSCAFLSDGDVLVSVVA

SEQ ID NO: 931334 - protein, 20 aa, Mycobacterium
LSGSTPRTAPAANITPAAHH

SEQ ID NO: 931335 - protein, 18 aa, Mycobacterium
LSHACDVYGSSVLVLPEA

SEQ ID NO: 931336 - protein, 26 aa, Mycobacterium
LSHTAPGHWLPWGLLPDAIRSGERQI

SEQ ID NO: 931337 - protein, 25 aa, Mycobacterium
LSIAGDLRVDFAWLGTVVQAYLRRT

SEQ ID NO: 931338 - protein, 17 aa, Mycobacterium
LSICPPPPPDAEGNPAC

SEQ ID NO: 931339 - protein, 24 aa, Mycobacterium
LSILAAGGGGAWIMTATTPGTAPA

SEQ ID NO: 931340 - protein, 27 aa, Mycobacterium
LSIRRAGLRFTWRPLINRFVETTLAGE

SEQ ID NO: 931341 - protein, 22 aa, Mycobacterium
LSKIHSVASFFVSRVDTEVDKR

SEQ ID NO: 931342 - protein, 19 aa, Mycobacterium
LSKSFVRWYSSSQAERFTG

SEQ ID NO: 931343 - protein, 25 aa, Mycobacterium
LSKSFVRWYSVAQAERFNGKGLRIL

SEQ ID NO: 931344 - protein, 18 aa, Mycobacterium
LSLAACGSSNKSSPTTST

SEQ ID NO: 931345 - protein, 20 aa, Mycobacterium
LSLAAVFLALAVGVVLGSGL

SEQ ID NO: 931346 - protein, 19 aa, Mycobacterium
LSLADRLGLDLGIDQRAVQ

SEQ ID NO: 931347 - protein, 18 aa, Mycobacterium
LSLFEWAFHYAYQTAGYV

SEQ ID NO: 931348 - protein, 22 aa, Mycobacterium
LSLLGHPLLGTGADSAARAATA

SEQ ID NO: 931349 - protein, 20 aa, Mycobacterium
LSLNGRLTIMFSDIEESTAL

SEQ ID NO: 931350 - protein, 20 aa, Mycobacterium
LSLNPFRVFTSMLATRDARF

SEQ ID NO: 931351 - protein, 17 aa, Mycobacterium
LSLPDCQAALYTSQDPV

SEQ ID NO: 931352 - protein, 18 aa, Mycobacterium
LSLVFLLVVSVTYLLVGV

SEQ ID NO: 931353 - protein, 23 aa, Mycobacterium
LSNAGYDVEVNWVAGEPSNIPLS

SEQ ID NO: 931354 - protein, 22 aa, Mycobacterium
LSNMPMKPGMNVRVFNDVNMDA

SEQ ID NO: 931355 - protein, 18 aa, Mycobacterium
LSPACATYGASVLILPDA

SEQ ID NO: 931356 - protein, 18 aa, Mycobacterium
LSPDGAQLSYALYRATDN

SEQ ID NO: 931357 - protein, 20 aa, Mycobacterium
LSPMGVAVVDTFNDVVYSND

SEQ ID NO: 931358 - protein, 22 aa, Mycobacterium
LSPQAEWGWWYQYYFATERGLH

SEQ ID NO: 931359 - protein, 20 aa, Mycobacterium
LSPRFARPALDIDRISEGET

SEQ ID NO: 931360 - protein, 25 aa, Mycobacterium
LSPRQRAVLVLREVLQWKAAEVGEV

SEQ ID NO: 931361 - protein, 17 aa, Mycobacterium
LSPSYRAADSVLGHDDP

SEQ ID NO: 931362 - protein, 17 aa, Mycobacterium
LSQILSWQSNAAVVSGD

SEQ ID NO: 931363 - protein, 20 aa, Mycobacterium
LSQLWFEALTGICAHVRSGG

SEQ ID NO: 931364 - protein, 17 aa, Mycobacterium
LSQRLVRGMVYIYREGY

SEQ ID NO: 931365 - protein, 25 aa, Mycobacterium
LSQTSYPGNGWLPGPYAHGYNRAPN

SEQ ID NO: 931366 - protein, 21 aa, Mycobacterium
LSRALRLGADGGRVTAEQLAT

SEQ ID NO: 931367 - protein, 20 aa, Mycobacterium
LSRHTAETLLALGKSPAAPS

SEQ ID NO: 931368 - protein, 19 aa, Mycobacterium
LSRIDAGFFTGTRWEGDLT

SEQ ID NO: 931369 - protein, 22 aa, Mycobacterium
LSRIDAGLFTGTRFEGHLTELE

SEQ ID NO: 931370 - protein, 21 aa, Mycobacterium
LSRLDASFLTGTRFECNLTEL

SEQ ID NO: 931371 - protein, 29 aa, Mycobacterium
LSSDIRATLWRKFMLISSYGGVGVLCRQP

SEQ ID NO: 931372 - protein, 17 aa, Mycobacterium
LSSEEWMGPASATMAQA

SEQ ID NO: 931373 - protein, 30 aa, Mycobacterium
LSSFPLACAACWINGVPMREAVAGMFLDQR

SEQ ID NO: 931374 - protein, 19 aa, Mycobacterium
LSSLHRVFPGSVVDAYYRP

SEQ ID NO: 931375 - protein, 27 aa, Mycobacterium
LSSNGLKIVSCYQFGKGSTSDWLGGAA

SEQ ID NO: 931376 - protein, 24 aa, Mycobacterium
LSSNLPNGLALRMAQNAGPELGLP

SEQ ID NO: 931377 - protein, 25 aa, Mycobacterium
LSSNRYVRDGFWLGDDQAHRATADL

SEQ ID NO: 931378 - protein, 24 aa, Mycobacterium
LSSPSKLRGLLDVTKQNVALDAGF

SEQ ID NO: 931379 - protein, 19 aa, Mycobacterium
LSSSEGFRSYDVMNPHDDG

SEQ ID NO: 931380 - protein, 18 aa, Mycobacterium
LSSSVALAAGALALTACG

SEQ ID NO: 931381 - protein, 18 aa, Mycobacterium
LSSVFRATRAALRYFRQA

SEQ ID NO: 931382 - protein, 18 aa, Mycobacterium
LSSVVVGVRVAKAVDSLA

SEQ ID NO: 931383 - protein, 17 aa, Mycobacterium
LSTALGGKVLLPDSPQF

SEQ ID NO: 931384 - protein, 17 aa, Mycobacterium
LSTALSSVAALAVASPF

SEQ ID NO: 931385 - protein, 20 aa, Mycobacterium
LSTEISRAAGKITTSSTSET

SEQ ID NO: 931386 - protein, 30 aa, Mycobacterium
LSTFCAGGRCPDVLMAWDLTYAELAARGVL

SEQ ID NO: 931387 - protein, 25 aa, Mycobacterium
LSTLPRHCADLVLGTVAGHRAPSAI

SEQ ID NO: 931388 - protein, 17 aa, Mycobacterium
LSTLRWSNGPDDTLRPL

SEQ ID NO: 931389 - protein, 19 aa, Mycobacterium
LSTVLAEADVLLWGTESDE

SEQ ID NO: 931390 - protein, 19 aa, Mycobacterium
LSVAGLRWIVHTPDTTVTA

SEQ ID NO: 931391 - protein, 25 aa, Mycobacterium
LSVFMVIALAMTWLVYATLRREVAG

SEQ ID NO: 931392 - protein, 19 aa, Mycobacterium
LSVLSLPTTFIFDATGRQA

SEQ ID NO: 931393 - protein, 19 aa, Mycobacterium
LSVNGRETGRMPVSNNVLT

SEQ ID NO: 931394 - protein, 18 aa, Mycobacterium
LSVPAGWNAAAPASLASS

SEQ ID NO: 931395 - protein, 18 aa, Mycobacterium
LSVPASWGTAPGAVEQAS

SEQ ID NO: 931396 - protein, 26 aa, Mycobacterium
LSVPHGWTMAAPEIKLAVESLPSAGL

SEQ ID NO: 931397 - protein, 17 aa, Mycobacterium
LSVPPSWAAGGVPSVNA

SEQ ID NO: 931398 - protein, 19 aa, Mycobacterium
LSVPTSWTTSPAIRLAAST

SEQ ID NO: 931399 - protein, 18 aa, Mycobacterium
LSVPVGWTTAAPAATGGA

SEQ ID NO: 931400 - protein, 22 aa, Mycobacterium
LSVSLFRGSFIKSVPITVLTQR

SEQ ID NO: 931401 - protein, 24 aa, Mycobacterium
LSVVSVLSAAVWLAAGCGTGVRVN

SEQ ID NO: 931402 - protein, 29 aa, Mycobacterium
LSYADGDIWDWAVDWDTWVSMSALPRPTS

SEQ ID NO: 931403 - protein, 33 aa, Mycobacterium
LSYADGDLWDWVVDWPTWQSMSALPPNPRERTV

SEQ ID NO: 931404 - protein, 30 aa, Mycobacterium
LSYQQVAARMAAFHDQFVAALHSGAGAYLT

SEQ ID NO: 931405 - protein, 17 aa, Mycobacterium
LSYSDGDIWDWAVDWDT

SEQ ID NO: 931406 - protein, 33 aa, Mycobacterium
LSYSDGDIWDWAVDWDTWVAMSALPPPTAHAPA

SEQ ID NO: 931407 - protein, 33 aa, Mycobacterium
LSYSDGDIWDWAVDWDTWVAMSALPPPTAHPPS

SEQ ID NO: 931408 - protein, 22 aa, Mycobacterium
LTACAISALPAVFPPATHAAAA

SEQ ID NO: 931409 - protein, 19 aa, Mycobacterium
LTACIDPILNRGFVLQSAG

SEQ ID NO: 931410 - protein, 22 aa, Mycobacterium
LTADWIKKCGQYDRAFPAFAKP

SEQ ID NO: 931411 - protein, 24 aa, Mycobacterium
LTAEEMPVMSMCVGEEEVRSIGAP

SEQ ID NO: 931412 - protein, 22 aa, Mycobacterium
LTAELPGWLAANKGLAPDGHAV

SEQ ID NO: 931413 - protein, 18 aa, Mycobacterium
LTAGGIPTLVPAANPGAP

SEQ ID NO: 931414 - protein, 18 aa, Mycobacterium
LTAGLCAVAASLAGPLMA

SEQ ID NO: 931415 - protein, 19 aa, Mycobacterium
LTALAGRWSVRNGIALTAI

SEQ ID NO: 931416 - protein, 17 aa, Mycobacterium
LTAPEQVKAFSLQTGDL

SEQ ID NO: 931417 - protein, 18 aa, Mycobacterium
LTARRVGIGSTRWRLPGR

SEQ ID NO: 931418 - protein, 27 aa, Mycobacterium
LTATLLTARCPVLFAPAMHTEMWLHPA

SEQ ID NO: 931419 - protein, 19 aa, Mycobacterium
LTCDALRSATVVLPGGETV

SEQ ID NO: 931420 - protein, 21 aa, Mycobacterium
LTDGAWPAFWLLNDNPVRGGE

SEQ ID NO: 931421 - protein, 19 aa, Mycobacterium
LTDTEFNGRVAIADPLSNP

SEQ ID NO: 931422 - protein, 18 aa, Mycobacterium
LTDVRVGNELAWQQVTTF

SEQ ID NO: 931423 - protein, 22 aa, Mycobacterium
LTEARIAFAGVNTVSEFLDHPV

SEQ ID NO: 931424 - protein, 18 aa, Mycobacterium
LTELSLDGNKGFKAADTN

SEQ ID NO: 931425 - protein, 24 aa, Mycobacterium
LTETPRGAVPMALHAMTLAINQRL

SEQ ID NO: 931426 - protein, 25 aa, Mycobacterium
LTFIAGPSPTGWQLSKQSAMALMSA

SEQ ID NO: 931427 - protein, 17 aa, Mycobacterium
LTFMAGAPDELWTTLHA

SEQ ID NO: 931428 - protein, 31 aa, Mycobacterium
LTGATGFLGRFLVLEWLQRLEPVDGKLVCLV

SEQ ID NO: 931429 - protein, 26 aa, Mycobacterium
LTGCASVFHSIRCALALAALVDEQQP

SEQ ID NO: 931430 - protein, 18 aa, Mycobacterium
LTGGFIVAKHAGRHLPRG

SEQ ID NO: 931431 - protein, 17 aa, Mycobacterium
LTGLLGAFRAFSYGSLY

SEQ ID NO: 931432 - protein, 17 aa, Mycobacterium
LTGTRWEGNLTELELQW

SEQ ID NO: 931433 - protein, 28 aa, Mycobacterium
LTGVTGASIFPLVRPAPPSFPESPEESS

SEQ ID NO: 931434 - protein, 17 aa, Mycobacterium
LTHAIDLTVAKPMPPLI

SEQ ID NO: 931435 - protein, 23 aa, Mycobacterium
LTHPGPPGPRRAHTYHVPAETTR

SEQ ID NO: 931436 - protein, 18 aa, Mycobacterium
LTHPRRLGYGLGNSAVSL

SEQ ID NO: 931437 - protein, 26 aa, Mycobacterium
LTILKLAGFCLLASVVATALLFPVAG

SEQ ID NO: 931438 - protein, 17 aa, Mycobacterium
LTILKPGQTIPLANTKP

SEQ ID NO: 931439 - protein, 18 aa, Mycobacterium
LTISYQVPEPSWWKEGYL

SEQ ID NO: 931440 - protein, 17 aa, Mycobacterium
LTKEFIQRCVDKMGTDF

SEQ ID NO: 931441 - protein, 19 aa, Mycobacterium
LTKEGPRKLTEIIDGGTFL

SEQ ID NO: 931442 - protein, 26 aa, Mycobacterium
LTLAAWYPRQYKFAASLSGYLAPSQK

SEQ ID NO: 931443 - protein, 20 aa, Mycobacterium
LTLERARFGQSLKVRLQVAP

SEQ ID NO: 931444 - protein, 26 aa, Mycobacterium
LTLEVATWDRAFAVAARGSMLSAKHT

SEQ ID NO: 931445 - protein, 41 aa, Mycobacterium
LTLLKLSGFCLLASIVAAALMFPFAGGIGLMSNRASEVVAN

SEQ ID NO: 931446 - protein, 23 aa, Mycobacterium
LTLPDVPVTTVFFGEAEGEQESA

SEQ ID NO: 931447 - protein, 18 aa, Mycobacterium
LTLQPGTYRIDGWSLTLF

SEQ ID NO: 931448 - protein, 18 aa, Mycobacterium
LTLRVFAYNSCCDTTYAN

SEQ ID NO: 931449 - protein, 35 aa, Mycobacterium
LTMGAAGAAGWFVTLEIAEPVPPQPTAQISTAPAT

SEQ ID NO: 931450 - protein, 17 aa, Mycobacterium
LTMPYVLPNDGEVVGVG

SEQ ID NO: 931451 - protein, 25 aa, Mycobacterium
LTMTGPRPGGFGALDDRTNEICAEG

SEQ ID NO: 931452 - protein, 24 aa, Mycobacterium
LTNGDVVQAWTISDLKVSTDQLPY

SEQ ID NO: 931453 - protein, 18 aa, Mycobacterium
LTPAGIEPFGCLRPGPAP

SEQ ID NO: 931454 - protein, 17 aa, Mycobacterium
LTPAGVVVAEWAARLLD

SEQ ID NO: 931455 - protein, 23 aa, Mycobacterium
LTPDFRPGCKRMLMTSDYYPALR

SEQ ID NO: 931456 - protein, 29 aa, Mycobacterium
LTPDHVTELFKFFTKCPDWVTYAEQCRLE

SEQ ID NO: 931457 - protein, 24 aa, Mycobacterium
LTPEARATFEPVLAKLGAPGACNP

SEQ ID NO: 931458 - protein, 18 aa, Mycobacterium
LTPPPRVRDAGGTRAMTN

SEQ ID NO: 931459 - protein, 17 aa, Mycobacterium
LTPPYRGDGPTLRDHDT

SEQ ID NO: 931460 - protein, 19 aa, Mycobacterium
LTPSDWDLISAAVRQAASA

SEQ ID NO: 931461 - protein, 18 aa, Mycobacterium
LTQAGVVVAEWADQLLEV

SEQ ID NO: 931462 - protein, 22 aa, Mycobacterium
LTQELPAWLEANRGVSRTGNAV

SEQ ID NO: 931463 - protein, 22 aa, Mycobacterium
LTQPGLVLTGFVNRVADPRGVV

SEQ ID NO: 931464 - protein, 24 aa, Mycobacterium
LTQVCARSAAVGRLEGVDGSRPFC

SEQ ID NO: 931465 - protein, 23 aa, Mycobacterium
LTREKWLLPLLYELGWGRPEVVG

SEQ ID NO: 931466 - protein, 23 aa, Mycobacterium
LTRNLKSAHLVLTVNGKIPGLSM

SEQ ID NO: 931467 - protein, 23 aa, Mycobacterium
LTRNPKWWGEPPVLDSITYTVLD

SEQ ID NO: 931468 - protein, 17 aa, Mycobacterium
LTRRIRMRIENWDRTTL

SEQ ID NO: 931469 - protein, 26 aa, Mycobacterium
LTRTRAPVEFDRVLGMLDRLASSLQG

SEQ ID NO: 931470 - protein, 17 aa, Mycobacterium
LTSARFGALDLRVDTKP

SEQ ID NO: 931471 - protein, 17 aa, Mycobacterium
LTSGDFVRIAGVEVGKV

SEQ ID NO: 931472 - protein, 19 aa, Mycobacterium
LTSKLPRRAAIPVLLCNDA

SEQ ID NO: 931473 - protein, 26 aa, Mycobacterium
LTSLARPGRRLAVVFGAGGERDPGKR

SEQ ID NO: 931474 - protein, 24 aa, Mycobacterium
LTSPEVRKAVQFYVDTVREYGEPG

SEQ ID NO: 931475 - protein, 24 aa, Mycobacterium
LTSRAWKVLAATLLAGSLIVSGCG

SEQ ID NO: 931476 - protein, 17 aa, Mycobacterium
LTSTMPPSDGRWWNTIS

SEQ ID NO: 931477 - protein, 18 aa, Mycobacterium
LTTGCSRTTEGVVAQTTE

SEQ ID NO: 931478 - protein, 20 aa, Mycobacterium
LTTLRIGPIARRLVTCTNSD

SEQ ID NO: 931479 - protein, 25 aa, Mycobacterium
LTTPLRPGQDVVITLAFQDGSTTPM

SEQ ID NO: 931480 - protein, 18 aa, Mycobacterium
LTVFAAASLKSTFTELGS

SEQ ID NO: 931481 - protein, 26 aa, Mycobacterium
LTVFMAVALALTWLVYATLRRDVAGG

SEQ ID NO: 931482 - protein, 26 aa, Mycobacterium
LTVFMTVALTLGWLVYATLLREVSGS

SEQ ID NO: 931483 - protein, 23 aa, Mycobacterium
LTVISPRAGLVMNPDAKVQLHGV

SEQ ID NO: 931484 - protein, 21 aa, Mycobacterium
LTVNASMEFLGPDATAAMNQT

SEQ ID NO: 931485 - protein, 23 aa, Mycobacterium
LTVNGKIPGLSMKTLSGDLTTNP

SEQ ID NO: 931486 - protein, 23 aa, Mycobacterium
LTVNGKIPGLSMKTLTGDLTTNP

SEQ ID NO: 931487 - protein, 25 aa, Mycobacterium
LTVRDYLGAYVLEWTLHHLDLIAHL

SEQ ID NO: 931488 - protein, 17 aa, Mycobacterium
LTVRLGDGDVRLTVTRF

SEQ ID NO: 931489 - protein, 19 aa, Mycobacterium
LTVRVPIAPTGYVNQAPTD

SEQ ID NO: 931490 - protein, 24 aa, Mycobacterium
LTVSMPTPPGWHPYNNPNLAPFTR

SEQ ID NO: 931491 - protein, 17 aa, Mycobacterium
LTYAELAARGVLLDLNT

SEQ ID NO: 931492 - protein, 22 aa, Mycobacterium
LTYDFTFSFEKAGEVTVAVPIS

SEQ ID NO: 931493 - protein, 17 aa, Mycobacterium
LTYEIFGPAGTVADIDY

SEQ ID NO: 931494 - protein, 20 aa, Mycobacterium
LTYNFTFNFEKAGQATVLVP

SEQ ID NO: 931495 - protein, 26 aa, Mycobacterium
LTYSEDWLRPDYVPPHPDSPPTGDGT

SEQ ID NO: 931496 - protein, 17 aa, Mycobacterium
LTYWLVTRAETLRRPEV

SEQ ID NO: 931497 - protein, 20 aa, Mycobacterium
LVAAASTLPTPALRDAGVEH

SEQ ID NO: 931498 - protein, 18 aa, Mycobacterium
LVAARFIQLTPVYTGGAV

SEQ ID NO: 931499 - protein, 24 aa, Mycobacterium
LVACGGSGRVSHPAAHGSSSAQET

SEQ ID NO: 931500 - protein, 24 aa, Mycobacterium
LVAEARTAVLLDEIVTLVGTHARL

SEQ ID NO: 931501 - protein, 20 aa, Mycobacterium
LVAIYKRFQEMATLTTFTTW

SEQ ID NO: 931502 - protein, 23 aa, Mycobacterium
LVAKGRFPFYFDYSSEVVGIEDA

SEQ ID NO: 931503 - protein, 20 aa, Mycobacterium
LVALCCPPPHAIAAPEPLVD

SEQ ID NO: 931504 - protein, 23 aa, Mycobacterium
LVALNRLLPILIKANAGSALAVD

SEQ ID NO: 931505 - protein, 22 aa, Mycobacterium
LVANDKWWGAKPVTDRVTVWPR

SEQ ID NO: 931506 - protein, 21 aa, Mycobacterium
LVANDKWWGTPAITPKVTVWP

SEQ ID NO: 931507 - protein, 17 aa, Mycobacterium
LVANNTRIWVYCGNGTP

SEQ ID NO: 931508 - protein, 18 aa, Mycobacterium
LVANSFGLENIATMATSW

SEQ ID NO: 931509 - protein, 25 aa, Mycobacterium
LVARFCGDFDPPVQIIPDDPVMAWR

SEQ ID NO: 931510 - protein, 18 aa, Mycobacterium
LVATNFFGVNTIPIALNE

SEQ ID NO: 931511 - protein, 25 aa, Mycobacterium
LVDGELGAPFAWPLVANAARSPGGV

SEQ ID NO: 931512 - protein, 19 aa, Mycobacterium
LVDITRFWFETGSLDNERS

SEQ ID NO: 931513 - protein, 19 aa, Mycobacterium
LVDNTVDAVVGWHPAGGDL

SEQ ID NO: 931514 - protein, 18 aa, Mycobacterium
LVDNYRVQYSYFVDKEDP

SEQ ID NO: 931515 - protein, 18 aa, Mycobacterium
LVDQSMVIFPEWSDATDF

SEQ ID NO: 931516 - protein, 17 aa, Mycobacterium
LVDRWAPGRMMINTYGP

SEQ ID NO: 931517 - protein, 27 aa, Mycobacterium
LVDSLRGGAIYDTWTRLGSAESDLGAP

SEQ ID NO: 931518 - protein, 18 aa, Mycobacterium
LVDVLSRLADPNIPGDKK

SEQ ID NO: 931519 - protein, 19 aa, Mycobacterium
LVEAIKLIRQLWSGERISF

SEQ ID NO: 931520 - protein, 28 aa, Mycobacterium
LVEGRVAVTVPADWPTQRVLAGPGSARV

SEQ ID NO: 931521 - protein, 19 aa, Mycobacterium
LVFGLVRYRSRRISLTRSD

SEQ ID NO: 931522 - protein, 23 aa, Mycobacterium
LVFRRGEFALAHDTVRHELGDRP

SEQ ID NO: 931523 - protein, 22 aa, Mycobacterium
LVGDIIHPVIGFPIDHRAPAGT

SEQ ID NO: 931524 - protein, 17 aa, Mycobacterium
LVGGLYAAGKLDEFAEW

SEQ ID NO: 931525 - protein, 18 aa, Mycobacterium
LVGHSYGGAVITEAAAGN

SEQ ID NO: 931526 - protein, 17 aa, Mycobacterium
LVGKLAVPTSWSSALPE

SEQ ID NO: 931527 - protein, 24 aa, Mycobacterium
LVGNGLKVVSCYQYGKGSTSDWLG

SEQ ID NO: 931528 - protein, 17 aa, Mycobacterium
LVGTLKYTLLRLQERVV

SEQ ID NO: 931529 - protein, 23 aa, Mycobacterium
LVHGLPLFHVHGLVLGLIGSLRI

SEQ ID NO: 931530 - protein, 17 aa, Mycobacterium
LVHHCHRQQWPVAGPVL

SEQ ID NO: 931531 - protein, 20 aa, Mycobacterium
LVIALCYRLWKLRQVGGTAA

SEQ ID NO: 931532 - protein, 19 aa, Mycobacterium
LVIPFVGVYCATKHAIEAI

SEQ ID NO: 931533 - protein, 20 aa, Mycobacterium
LVISRWGRATIDYETDRTPV

SEQ ID NO: 931534 - protein, 18 aa, Mycobacterium
LVITPGYDLRYLVGSRAQ

SEQ ID NO: 931535 - protein, 17 aa, Mycobacterium
LVLATSVVNIWSAPAQQ

SEQ ID NO: 931536 - protein, 20 aa, Mycobacterium
LVLCVVVVLAGGYWLSNSRT

SEQ ID NO: 931537 - protein, 25 aa, Mycobacterium
LVLDPPSAAAWASFTAEHVKDHVAF

SEQ ID NO: 931538 - protein, 21 aa, Mycobacterium
LVLNTRWILDNSVNRPNGGYG

SEQ ID NO: 931539 - protein, 17 aa, Mycobacterium
LVLSGGWDEDLIRRMGE

SEQ ID NO: 931540 - protein, 23 aa, Mycobacterium
LVLSSCGWRGISNVAIPGAPGTG

SEQ ID NO: 931541 - protein, 28 aa, Mycobacterium
LVLVSAIPSWAMTLTFVRHAESLANEAG

SEQ ID NO: 931542 - protein, 19 aa, Mycobacterium
LVMNPDAKVKMRGVQVGTV

SEQ ID NO: 931543 - protein, 29 aa, Mycobacterium
LVNAFYTSRCNLIAWDRGVFMPVAQKYFG

SEQ ID NO: 931544 - protein, 18 aa, Mycobacterium
LVNGRARVTFALDGKTRL

SEQ ID NO: 931545 - protein, 18 aa, Mycobacterium
LVNTEFRATALAAALEAH

SEQ ID NO: 931546 - protein, 21 aa, Mycobacterium
LVNTTLDWLDRYVRGNELIPT

SEQ ID NO: 931547 - protein, 27 aa, Mycobacterium
LVPAEKLPLVRLFPSLANREAELKAKI

SEQ ID NO: 931548 - protein, 25 aa, Mycobacterium
LVPAPTRWTAARGRGGDPVTAVAAV

SEQ ID NO: 931549 - protein, 17 aa, Mycobacterium
LVPEVLERCPPSADIYF

SEQ ID NO: 931550 - protein, 26 aa, Mycobacterium
LVPLIPKPVFRRLLSVVTGGAATVVS

SEQ ID NO: 931551 - protein, 24 aa, Mycobacterium
LVPLRLADSALIELVRVGDVVDVL

SEQ ID NO: 931552 - protein, 22 aa, Mycobacterium
LVPMSDWRLEFDLPAGESISHA

SEQ ID NO: 931553 - protein, 17 aa, Mycobacterium
LVPPSRYLAAPQAATPL

SEQ ID NO: 931554 - protein, 25 aa, Mycobacterium
LVQGGGFAGPLFDGFDNLYVGQPGA

SEQ ID NO: 931555 - protein, 19 aa, Mycobacterium
LVQGGGIASPLFDGFDNLY

SEQ ID NO: 931556 - protein, 18 aa, Mycobacterium
LVQHRWLADPDQLRDQLL

SEQ ID NO: 931557 - protein, 25 aa, Mycobacterium
LVQIFPKLGSFVARIDPERVADAQF

SEQ ID NO: 931558 - protein, 18 aa, Mycobacterium
LVQIIRWLRPGAVIAIAK

SEQ ID NO: 931559 - protein, 27 aa, Mycobacterium
LVQPNLRYLVNWGYGDPAYGWSTSPPN

SEQ ID NO: 931560 - protein, 18 aa, Mycobacterium
LVQVAGWDEPPGALTPLY

SEQ ID NO: 931561 - protein, 17 aa, Mycobacterium
LVRDARAEAFNDAKNRA

SEQ ID NO: 931562 - protein, 25 aa, Mycobacterium
LVRDEGRWEVRWSATGLHPRLGENQ

SEQ ID NO: 931563 - protein, 19 aa, Mycobacterium
LVRGDLPPSALSVHFINGG

SEQ ID NO: 931564 - protein, 26 aa, Mycobacterium
LVRPDDFVGWRCRELPADPTGVLRQA

SEQ ID NO: 931565 - protein, 18 aa, Mycobacterium
LVRRLEIEEMALAKEEDA

SEQ ID NO: 931566 - protein, 24 aa, Mycobacterium
LVRSDFRAGCPVVAVAVEAGDPES

SEQ ID NO: 931567 - protein, 24 aa, Mycobacterium
LVRSEGWLEIHPADFSADLPATKA

SEQ ID NO: 931568 - protein, 19 aa, Mycobacterium
LVSCVFRPATAACLPHTDD

SEQ ID NO: 931569 - protein, 18 aa, Mycobacterium
LVSGRSGTVPGFGAAPQP

SEQ ID NO: 931570 - protein, 27 aa, Mycobacterium
LVSSWQMPGGIYAPMMHPWSTGKDVYF

SEQ ID NO: 931571 - protein, 25 aa, Mycobacterium
LVSVPRPGTPIDWSPCETGPSDQKR

SEQ ID NO: 931572 - protein, 26 aa, Mycobacterium
LVSYLCSRPFLETHVRQRVRSAGNIQ

SEQ ID NO: 931573 - protein, 24 aa, Mycobacterium
LVSYVRGVLYFRTGRWPDVLNQFS

SEQ ID NO: 931574 - protein, 19 aa, Mycobacterium
LVTDFGIPRDRVYATGLSA

SEQ ID NO: 931575 - protein, 24 aa, Mycobacterium
LVTGIGGWLFGWLADRTGSLAAPM

SEQ ID NO: 931576 - protein, 20 aa, Mycobacterium
LVTIRLDAGVALPANATARI

SEQ ID NO: 931577 - protein, 26 aa, Mycobacterium
LVTLYKRYAVRFGLGYTEETRDVELV

SEQ ID NO: 931578 - protein, 17 aa, Mycobacterium
LVVGMLLATALYGGGPA

SEQ ID NO: 931579 - protein, 22 aa, Mycobacterium
LVVGRRAIRDGGTYNVEDVGYV

SEQ ID NO: 931580 - protein, 27 aa, Mycobacterium
LVVLAAVFGAFGLAGCTVDTWQDNATP

SEQ ID NO: 931581 - protein, 17 aa, Mycobacterium
LVVLDIGNPFFTDIARA

SEQ ID NO: 931582 - protein, 18 aa, Mycobacterium
LVVPLELTDAAQVQRVVQ

SEQ ID NO: 931583 - protein, 17 aa, Mycobacterium
LVVRRLRARGAVVIVGT

SEQ ID NO: 931584 - protein, 17 aa, Mycobacterium
LVWTGDGEPAWTAGGTY

SEQ ID NO: 931585 - protein, 18 aa, Mycobacterium
LVYAGWRISQSVPTRPQT

SEQ ID NO: 931586 - protein, 26 aa, Mycobacterium
LVYRLVTRPKFGTVVFDDDGGYTYTP

SEQ ID NO: 931587 - protein, 23 aa, Mycobacterium
LWAEPIAFAYQRSFDAFTRAHPD

SEQ ID NO: 931588 - protein, 18 aa, Mycobacterium
LWAQAGFRPVDPAVATEF

SEQ ID NO: 931589 - protein, 24 aa, Mycobacterium
LWAYWCAPCAAELPAMAEYQRRAG

SEQ ID NO: 931590 - protein, 25 aa, Mycobacterium
LWAYWCAPCAAELPAMAEYQRRVGS

SEQ ID NO: 931591 - protein, 21 aa, Mycobacterium
LWAYWCGPCADELPAMAEYQR

SEQ ID NO: 931592 - protein, 22 aa, Mycobacterium
LWCCAVALTVACTRVVDGEALP

SEQ ID NO: 931593 - protein, 19 aa, Mycobacterium
LWDLTGWAVDGRRLLKEMD

SEQ ID NO: 931594 - protein, 25 aa, Mycobacterium
LWEVLERLRAQGCSRYVVTDVTKDG

SEQ ID NO: 931595 - protein, 18 aa, Mycobacterium
LWHDRITANAGWSVYLVD

SEQ ID NO: 931596 - protein, 25 aa, Mycobacterium
LWLEELDRTPAFYFDSITQLQLDTW

SEQ ID NO: 931597 - protein, 18 aa, Mycobacterium
LWLGLVAHFGEMANGGSA

SEQ ID NO: 931598 - protein, 18 aa, Mycobacterium
LWLILAIAIASVILGVTT

SEQ ID NO: 931599 - protein, 17 aa, Mycobacterium
LWMVPQNIAGLVTALGG

SEQ ID NO: 931600 - protein, 25 aa, Mycobacterium
LWQQRTDAAVGWAVLAETATGPERV

SEQ ID NO: 931601 - protein, 17 aa, Mycobacterium
LWTESLFRERGVKAITQ

SEQ ID NO: 931602 - protein, 17 aa, Mycobacterium
LWTESLFRERGVRAITQ

SEQ ID NO: 931603 - protein, 21 aa, Mycobacterium
LWTYLGYPVANSVVLDLVAPV

SEQ ID NO: 931604 - protein, 19 aa, Mycobacterium
LYAAALRYYGSPAEVVETD

SEQ ID NO: 931605 - protein, 18 aa, Mycobacterium
LYAAMSIVSLLYGRATRP

SEQ ID NO: 931606 - protein, 18 aa, Mycobacterium
LYAEMWAQDAGAMYGYAA

SEQ ID NO: 931607 - protein, 18 aa, Mycobacterium
LYDGRAFLYQVVKLYANG

SEQ ID NO: 931608 - protein, 18 aa, Mycobacterium
LYDGRTASFTVVGADPTS

SEQ ID NO: 931609 - protein, 25 aa, Mycobacterium
LYEGNVVAVLGMPVGKVSKVTSKGS

SEQ ID NO: 931610 - protein, 18 aa, Mycobacterium
LYELGWGRPEVVGGGLSV

SEQ ID NO: 931611 - protein, 17 aa, Mycobacterium
LYETFAFNGSQFALPEQ

SEQ ID NO: 931612 - protein, 26 aa, Mycobacterium
LYFGAGLPDLLSPVGANVGYRTYRIS

SEQ ID NO: 931613 - protein, 17 aa, Mycobacterium
LYFREHVDRLGIGSYGH

SEQ ID NO: 931614 - protein, 21 aa, Mycobacterium
LYGQAIAYWRTYADSIETYRP

SEQ ID NO: 931615 - protein, 17 aa, Mycobacterium
LYIDARSAGPIQPPLGH

SEQ ID NO: 931616 - protein, 18 aa, Mycobacterium
LYLTDAIALVRGDGGTVR

SEQ ID NO: 931617 - protein, 31 aa, Mycobacterium
LYREIQARYAAAPSHVFLVFLHHTYSYRDLG

SEQ ID NO: 931618 - protein, 26 aa, Mycobacterium
LYREYRWPRLAGLAVTTVSPRFRFEQ

SEQ ID NO: 931619 - protein, 18 aa, Mycobacterium
LYRPLGMTSTSSRFADFL

SEQ ID NO: 931620 - protein, 18 aa, Mycobacterium
LYRQPRVLIAPKSMYAAT

SEQ ID NO: 931621 - protein, 21 aa, Mycobacterium
LYRRMAADPGVKLRIRAYEMG

SEQ ID NO: 931622 - protein, 19 aa, Mycobacterium
LYRRNELTEAQVLSLNKVA

SEQ ID NO: 931623 - protein, 19 aa, Mycobacterium
LYRTRLKAVDSDRALRDVA

SEQ ID NO: 931624 - protein, 18 aa, Mycobacterium
LYSFSFAPSAKWSHTFAR

SEQ ID NO: 931625 - protein, 21 aa, Mycobacterium
LYSQRFWPYLTSGLLGLQRGT

SEQ ID NO: 931626 - protein, 18 aa, Mycobacterium
LYTPLAIAAARWPERTAI

SEQ ID NO: 931627 - protein, 17 aa, Mycobacterium
LYVLLAVADAVKAGTLQ

SEQ ID NO: 931628 - protein, 17 aa, Mycobacterium
LYVLLAVSDAIKEGTLS

SEQ ID NO: 931629 - protein, 17 aa, Mycobacterium
LYVRACGFDHPDIATAV

SEQ ID NO: 931630 - protein, 17 aa, Mycobacterium
LYVSLCVVRAAAAATTW

SEQ ID NO: 931631 - protein, 24 aa, Mycobacterium
LYYNKRLFAEAGIRPPPTGWEQPW

SEQ ID NO: 931632 - protein, 18 aa, Mycobacterium
MAAAAAPYVAWMNATAAQ

SEQ ID NO: 931633 - protein, 23 aa, Mycobacterium
MAAAAQPLLAWLSYTAESSALAA

SEQ ID NO: 931634 - protein, 22 aa, Mycobacterium
MAAAAQPYLAWLTYTAESAAHA

SEQ ID NO: 931635 - protein, 24 aa, Mycobacterium
MAAALKLFAAKGYAATSVAEIQQQ

SEQ ID NO: 931636 - protein, 17 aa, Mycobacterium
MAAAQAFAANKTEPADS

SEQ ID NO: 931637 - protein, 18 aa, Mycobacterium
MAAARAAGATVFLVPAKN

SEQ ID NO: 931638 - protein, 19 aa, Mycobacterium
MAADMAVDFHDTGVATVSI

SEQ ID NO: 931639 - protein, 24 aa, Mycobacterium
MAAEAQLQIALMLVQGEKIETGTD

SEQ ID NO: 931640 - protein, 17 aa, Mycobacterium
MAAGERVRWSPGVTVAG

SEQ ID NO: 931641 - protein, 18 aa, Mycobacterium
MAAIFVDSLMRYRTENFV

SEQ ID NO: 931642 - protein, 19 aa, Mycobacterium
MAALLHRAASPAVWLNPWR

SEQ ID NO: 931643 - protein, 21 aa, Mycobacterium
MAALMWCDEAAMKTMMAAMKS

SEQ ID NO: 931644 - protein, 19 aa, Mycobacterium
MAALPMRLLLATMLVAGSL

SEQ ID NO: 931645 - protein, 17 aa, Mycobacterium
MAAPGVEQVFCFENRGE

SEQ ID NO: 931646 - protein, 20 aa, Mycobacterium
MAAQCPNTRIVLGGYSQGAA

SEQ ID NO: 931647 - protein, 26 aa, Mycobacterium
MAATVARVVLAAAMAVTRATVVAAAP

SEQ ID NO: 931648 - protein, 20 aa, Mycobacterium
MAAVDAWEAATGEQWTIMMV

SEQ ID NO: 931649 - protein, 18 aa, Mycobacterium
MAAVTAFNAVFSMTVPPP

SEQ ID NO: 931650 - protein, 20 aa, Mycobacterium
MAAVVCAGLFWAVPADAETV

SEQ ID NO: 931651 - protein, 21 aa, Mycobacterium
MACAAAAVAVAPVFSALSAPT

SEQ ID NO: 931652 - protein, 33 aa, Mycobacterium
MADATDVPARFVVAAGIVRHLLVDPVLPDDLLP

SEQ ID NO: 931653 - protein, 22 aa, Mycobacterium
MADRLARLFTLIAADPRRRLSS

SEQ ID NO: 931654 - protein, 23 aa, Mycobacterium
MAEAMACRTRFYDQFFVEATRSG

SEQ ID NO: 931655 - protein, 17 aa, Mycobacterium
MAEAVARAFATGEHLAV

SEQ ID NO: 931656 - protein, 23 aa, Mycobacterium
MAFGDTYGYCGVRGQQWRYNVLF

SEQ ID NO: 931657 - protein, 24 aa, Mycobacterium
MAFGGKGRAAIVIGDPDTAKNTAV

SEQ ID NO: 931658 - protein, 25 aa, Mycobacterium
MAGDRCGRNIVILAYSEFGRRVAAN

SEQ ID NO: 931659 - protein, 23 aa, Mycobacterium
MAGFPVTVKGLSRFTDNAESRAV

SEQ ID NO: 931660 - protein, 21 aa, Mycobacterium
MAGKLAVPGMVTYNASKFGAV

SEQ ID NO: 931661 - protein, 17 aa, Mycobacterium
MAGQAERGAWAPIRESH

SEQ ID NO: 931662 - protein, 17 aa, Mycobacterium
MAIAATDTWVARPLTTA

SEQ ID NO: 931663 - protein, 17 aa, Mycobacterium
MAIQLRQVLGHGVRVLG

SEQ ID NO: 931664 - protein, 24 aa, Mycobacterium
MALDSSLLTPVDWDRIRAAVQAAV

SEQ ID NO: 931665 - protein, 24 aa, Mycobacterium
MALLCVGVGVGTWLLVGRSGPQRP

SEQ ID NO: 931666 - protein, 19 aa, Mycobacterium
MANALRPNAVVSLHADGGP

SEQ ID NO: 931667 - protein, 17 aa, Mycobacterium
MANPMAGAVTKPFELEI

SEQ ID NO: 931668 - protein, 24 aa, Mycobacterium
MANSLRPHAIVSIHADGGPPTGRG

SEQ ID NO: 931669 - protein, 18 aa, Mycobacterium
MANVWPGTQSQLYSELNK

SEQ ID NO: 931670 - protein, 21 aa, Mycobacterium
MARITGVPLALGMAQVIDGSG

SEQ ID NO: 931671 - protein, 19 aa, Mycobacterium
MARLRARAEALGFEPLVAA

SEQ ID NO: 931672 - protein, 18 aa, Mycobacterium
MARNCPDTRLVLGGYSLG

SEQ ID NO: 931673 - protein, 24 aa, Mycobacterium
MARVLELPATIARLNVPYGNNGGW

SEQ ID NO: 931674 - protein, 18 aa, Mycobacterium
MASGRITTVLALREQSDG

SEQ ID NO: 931675 - protein, 21 aa, Mycobacterium
MASGTPFALSHTFAQTGPFRP

SEQ ID NO: 931676 - protein, 18 aa, Mycobacterium
MASLACLGTATANADPTG

SEQ ID NO: 931677 - protein, 18 aa, Mycobacterium
MASSCPNTKIVLGGYSQG

SEQ ID NO: 931678 - protein, 21 aa, Mycobacterium
MASSCSWQMGIRVPDGVPPPA

SEQ ID NO: 931679 - protein, 30 aa, Mycobacterium
MATAAPACGISWNLLAGIGRIESMHANGGA

SEQ ID NO: 931680 - protein, 18 aa, Mycobacterium
MATAAWTYNTSFPGPTIV

SEQ ID NO: 931681 - protein, 24 aa, Mycobacterium
MATCVPLAGCARSGGGAHPASTTA

SEQ ID NO: 931682 - protein, 24 aa, Mycobacterium
MATDGWVRAQLLHYMKSAPDFYFD

SEQ ID NO: 931683 - protein, 26 aa, Mycobacterium
MATLVLSSCGWRGISNVAIPGGPGSG

SEQ ID NO: 931684 - protein, 17 aa, Mycobacterium
MATSVRYHAEFAEAGGL

SEQ ID NO: 931685 - protein, 25 aa, Mycobacterium
MATTWPDKRIDLYFPGESALQEYHP

SEQ ID NO: 931686 - protein, 17 aa, Mycobacterium
MAVGMVWDTPVTTGIQL

SEQ ID NO: 931687 - protein, 19 aa, Mycobacterium
MAVQLRYTLGAGVRVLGWN

SEQ ID NO: 931688 - protein, 20 aa, Mycobacterium
MAYAPSGAWGRTRGYGTRER

SEQ ID NO: 931689 - protein, 19 aa, Mycobacterium
MCGVLDARARFTDSLTLGY

SEQ ID NO: 931690 - protein, 17 aa, Mycobacterium
MCNMMGLRQLGCSTGTL

SEQ ID NO: 931691 - protein, 17 aa, Mycobacterium
MCRAYADADGRWLVNPM

SEQ ID NO: 931692 - protein, 20 aa, Mycobacterium
MCSKPGSLQFAFVLPEQTQA

SEQ ID NO: 931693 - protein, 19 aa, Mycobacterium
MCSTFKAYLAARILRGAER

SEQ ID NO: 931694 - protein, 25 aa, Mycobacterium
MDAHFKGNCGPLPMLNEDTEIGPFK

SEQ ID NO: 931695 - protein, 20 aa, Mycobacterium
MDFGNDFIEWSINFEPGSGA

SEQ ID NO: 931696 - protein, 20 aa, Mycobacterium
MDGPDPLAADGLPFVFDSFR

SEQ ID NO: 931697 - protein, 17 aa, Mycobacterium
MDKLGAQACEDLRRTGA

SEQ ID NO: 931698 - protein, 20 aa, Mycobacterium
MDPDVLLREFLKATADPANR

SEQ ID NO: 931699 - protein, 17 aa, Mycobacterium
MDPKLFLLWGKANTSAG

SEQ ID NO: 931700 - protein, 22 aa, Mycobacterium
MDRWSRDRVLLIGDAAGCISLL

SEQ ID NO: 931701 - protein, 24 aa, Mycobacterium
MDRWSRGRTVLVGDAAACISLLGG

SEQ ID NO: 931702 - protein, 18 aa, Mycobacterium
MEALWWDRPFTLDGVDIG

SEQ ID NO: 931703 - protein, 18 aa, Mycobacterium
MEALWWDRPFTLDGVDLR

SEQ ID NO: 931704 - protein, 25 aa, Mycobacterium
MEDGCNGPCKGSVVALEPSTGKILA

SEQ ID NO: 931705 - protein, 26 aa, Mycobacterium
MEFAPFQGGWQLSRHTAETLLALGKS

SEQ ID NO: 931706 - protein, 21 aa, Mycobacterium
MEIIGAAVRFVSGPPVTPPGS

SEQ ID NO: 931707 - protein, 36 aa, Mycobacterium
MENAIKGGVPFLRLDRRPDLTGAIGDAGRFAPSEEQ

SEQ ID NO: 931708 - protein, 21 aa, Mycobacterium
MEPLALCGHTIGAPKGTIQAI

SEQ ID NO: 931709 - protein, 18 aa, Mycobacterium
MESPMLWDPIRYDETCPS

SEQ ID NO: 931710 - protein, 23 aa, Mycobacterium
MESSGAWKEAFDKNLGPAGIQAP

SEQ ID NO: 931711 - protein, 20 aa, Mycobacterium
METYPLLTPGFRQQFESDAQ

SEQ ID NO: 931712 - protein, 21 aa, Mycobacterium
MFAKFTQQWQRCVGARIQSGA

SEQ ID NO: 931713 - protein, 24 aa, Mycobacterium
MFEAGCTRLVLASSMVVYGQGRFY

SEQ ID NO: 931714 - protein, 18 aa, Mycobacterium
MFHKSGSGHLVLISSVLA

SEQ ID NO: 931715 - protein, 18 aa, Mycobacterium
MGAAHADPATPDPRPAPV

SEQ ID NO: 931716 - protein, 19 aa, Mycobacterium
MGAAHARRLAKAGATVAVN

SEQ ID NO: 931717 - protein, 20 aa, Mycobacterium
MGAAHARRLASAGATVAVND

SEQ ID NO: 931718 - protein, 20 aa, Mycobacterium
MGAALLGFSLMGPSTGTAAA

SEQ ID NO: 931719 - protein, 24 aa, Mycobacterium
MGADLCQQLSWGASPQQLENLAIQ

SEQ ID NO: 931720 - protein, 17 aa, Mycobacterium
MGDFYGFPSSFIEGSYT

SEQ ID NO: 931721 - protein, 17 aa, Mycobacterium
MGELPGVDVVVDPEDLA

SEQ ID NO: 931722 - protein, 17 aa, Mycobacterium
MGGHWRYQTFIRADGLD

SEQ ID NO: 931723 - protein, 21 aa, Mycobacterium
MGGLYGDTMYAMFAHAALITG

SEQ ID NO: 931724 - protein, 22 aa, Mycobacterium
MGGRASGFDAMLTASSPQSLID

SEQ ID NO: 931725 - protein, 21 aa, Mycobacterium
MGHARFALYREGYDSAVAAIR

SEQ ID NO: 931726 - protein, 27 aa, Mycobacterium
MGINARLDVPGSFAGRGLGSSDTPGCP

SEQ ID NO: 931727 - protein, 18 aa, Mycobacterium
MGLARAAGLPVVLVGDID

SEQ ID NO: 931728 - protein, 24 aa, Mycobacterium
MGLARAAGLPVVLVGDIDRGGVLA

SEQ ID NO: 931729 - protein, 33 aa, Mycobacterium
MGMVRCVRAALPLLRKAEWARIVNFSAHSTQRQ

SEQ ID NO: 931730 - protein, 25 aa, Mycobacterium
MGNVAAWRFLAPLSAFLEGLTVGAD

SEQ ID NO: 931731 - protein, 27 aa, Mycobacterium
MGPMQFIPETWRLYGVDAHNDGRVSPD

SEQ ID NO: 931732 - protein, 17 aa, Mycobacterium
MGQPTIAINANFFDVRP

SEQ ID NO: 931733 - protein, 21 aa, Mycobacterium
MGREELRLILWEFVGNRGGSR

SEQ ID NO: 931734 - protein, 19 aa, Mycobacterium
MGREIKVQFQPGGAKAVYL

SEQ ID NO: 931735 - protein, 19 aa, Mycobacterium
MGRPEYPTPVGKYTVLAKE

SEQ ID NO: 931736 - protein, 17 aa, Mycobacterium
MGSGVAFAVGAYAESIR

SEQ ID NO: 931737 - protein, 29 aa, Mycobacterium
MGSLELKVSQFWDPAWMAANREAVNNGTA

SEQ ID NO: 931738 - protein, 25 aa, Mycobacterium
MGSQSYKLTARFANALNLPAKAKVR

SEQ ID NO: 931739 - protein, 25 aa, Mycobacterium
MGTHAAAARHSRSFGIVEGYGGHGI

SEQ ID NO: 931740 - protein, 23 aa, Mycobacterium
MGTHCRIMATCPVGSGSSVGSAI

SEQ ID NO: 931741 - protein, 28 aa, Mycobacterium
MGVIHVIWRQGFYPGIGAPSWTADYGSE

SEQ ID NO: 931742 - protein, 33 aa, Mycobacterium
MHAHRLALLWPEMYPRLLRIMDADPIYQDRIVS

SEQ ID NO: 931743 - protein, 26 aa, Mycobacterium
MHAVAGLGPRHLVVVVGKHREQVAPA

SEQ ID NO: 931744 - protein, 19 aa, Mycobacterium
MHDLVAFSMLYGGVDSQRP

SEQ ID NO: 931745 - protein, 18 aa, Mycobacterium
MHHRIFGPRIEFAQQLDE

SEQ ID NO: 931746 - protein, 17 aa, Mycobacterium
MHIALAAARLAAHAAVF

SEQ ID NO: 931747 - protein, 24 aa, Mycobacterium
MHLHRHTFEITRFAGTPTAGVRKD

SEQ ID NO: 931748 - protein, 17 aa, Mycobacterium
MHSWNRIVIPTGPPPDN

SEQ ID NO: 931749 - protein, 18 aa, Mycobacterium
MHWGEEGFEFARDGAEYF

SEQ ID NO: 931750 - protein, 22 aa, Mycobacterium
MIAAAQPYLAWLTYTSEAAMHA

SEQ ID NO: 931751 - protein, 20 aa, Mycobacterium
MIGRCPGTRLVLGGFSQGAG

SEQ ID NO: 931752 - protein, 18 aa, Mycobacterium
MIGRTIGSYGDFVNFYSC

SEQ ID NO: 931753 - protein, 23 aa, Mycobacterium
MIIPAGGAPYVLRPKGREDYDLA

SEQ ID NO: 931754 - protein, 22 aa, Mycobacterium
MIKAVLPGMRGRRRGAIVNISS

SEQ ID NO: 931755 - protein, 23 aa, Mycobacterium
MIKRGWMLLVAVVVVAAAGFGVY

SEQ ID NO: 931756 - protein, 20 aa, Mycobacterium
MINTTCSYDQAMRAVHAENP

SEQ ID NO: 931757 - protein, 25 aa, Mycobacterium
MIQIATRSEPALILMANRSITSAKD

SEQ ID NO: 931758 - protein, 24 aa, Mycobacterium
MITLMHWVYPGWVADSGGFMNNLP

SEQ ID NO: 931759 - protein, 25 aa, Mycobacterium
MKAFLESSLDFHLLDLYGLTEVGGV

SEQ ID NO: 931760 - protein, 17 aa, Mycobacterium
MKHSDLYSALKAEAESI

SEQ ID NO: 931761 - protein, 26 aa, Mycobacterium
MKLNNSQRFAIDWMHMDDQGNFYTGD

SEQ ID NO: 931762 - protein, 26 aa, Mycobacterium
MKLNNSQRFAIDWMRTNDQGNFFAGD

SEQ ID NO: 931763 - protein, 17 aa, Mycobacterium
MKPDMQQVLLASNTTAQ

SEQ ID NO: 931764 - protein, 18 aa, Mycobacterium
MKSTGIPGMAVAIVHGGK

SEQ ID NO: 931765 - protein, 17 aa, Mycobacterium
MKTGFPVVDRFNALSAL

SEQ ID NO: 931766 - protein, 32 aa, Mycobacterium
MKTLNGEVFDQLWLQSMIAHHQGAIAMSNAEL

SEQ ID NO: 931767 - protein, 17 aa, Mycobacterium
MLAELVRRRVFTPSDDI

SEQ ID NO: 931768 - protein, 26 aa, Mycobacterium
MLALRLGCQTDIFAAIAPVAGTLLTD

SEQ ID NO: 931769 - protein, 18 aa, Mycobacterium
MLDVLPLTLENLYNTVDR

SEQ ID NO: 931770 - protein, 18 aa, Mycobacterium
MLEAPYTGSVVKISPVRS

SEQ ID NO: 931771 - protein, 21 aa, Mycobacterium
MLEASAAWNALASELDAAAQS

SEQ ID NO: 931772 - protein, 17 aa, Mycobacterium
MLFGRANGNLTFATNDE

SEQ ID NO: 931773 - protein, 17 aa, Mycobacterium
MLGGLPLGPTPSGGGSG

SEQ ID NO: 931774 - protein, 20 aa, Mycobacterium
MLGGPRVAVAAMNRKAAAVG

SEQ ID NO: 931775 - protein, 26 aa, Mycobacterium
MLIAYALAWNEFRGGGSASITIDVEG

SEQ ID NO: 931776 - protein, 18 aa, Mycobacterium
MLIPCDRDPLRIVQRTLT

SEQ ID NO: 931777 - protein, 19 aa, Mycobacterium
MLLHGFEPLFSVLDPTQVD

SEQ ID NO: 931778 - protein, 19 aa, Mycobacterium
MLMVPSAAMGRAIPVAFQG

SEQ ID NO: 931779 - protein, 20 aa, Mycobacterium
MLPGLIGFAGGSASAGAFSR

SEQ ID NO: 931780 - protein, 18 aa, Mycobacterium
MLPNGAVVKRCYAEVLPA

SEQ ID NO: 931781 - protein, 27 aa, Mycobacterium
MLRAAIAWRPRRVVSHFSILSYPTAQG

SEQ ID NO: 931782 - protein, 24 aa, Mycobacterium
MLSRECWQAIGGMDVRTFGRYGWG

SEQ ID NO: 931783 - protein, 17 aa, Mycobacterium
MLSVPPWAVEPVIELGD

SEQ ID NO: 931784 - protein, 17 aa, Mycobacterium
MLSVSAYLYGSDEYSDP

SEQ ID NO: 931785 - protein, 27 aa, Mycobacterium
MLVAANRSRLVSLVWSNVFGQNAPAIA

SEQ ID NO: 931786 - protein, 21 aa, Mycobacterium
MLVGTGCARFDAAQSEPFTTE

SEQ ID NO: 931787 - protein, 24 aa, Mycobacterium
MLVLTFIAGVVVVWQGAAATRKTT

SEQ ID NO: 931788 - protein, 17 aa, Mycobacterium
MMMMGLGVVGAVFTNGS

SEQ ID NO: 931789 - protein, 17 aa, Mycobacterium
MNAQKLSYCLDFDDDAE

SEQ ID NO: 931790 - protein, 25 aa, Mycobacterium
MNGIPCVGGSLGVCISMRQSNPSRS

SEQ ID NO: 931791 - protein, 19 aa, Mycobacterium
MNNGVPWSNPRLNPTHLNF

SEQ ID NO: 931792 - protein, 19 aa, Mycobacterium
MNNGVPWSSPRMNPSHLNL

SEQ ID NO: 931793 - protein, 23 aa, Mycobacterium
MNNRCPLTSYVLVGFSQGAVIAG

SEQ ID NO: 931794 - protein, 28 aa, Mycobacterium
MNPNGGLFERFVGLSLPSLGIEMYGATP

SEQ ID NO: 931795 - protein, 23 aa, Mycobacterium
MNQLRGLSPYGYDDVTMIARLIT

SEQ ID NO: 931796 - protein, 32 aa, Mycobacterium
MNSHALRSALVWAAAVLVVAGCTTFVDGRALS

SEQ ID NO: 931797 - protein, 19 aa, Mycobacterium
MNVGNWTLVLSGFLFTASG

SEQ ID NO: 931798 - protein, 17 aa, Mycobacterium
MPADLQGNMSAVTAEGR

SEQ ID NO: 931799 - protein, 20 aa, Mycobacterium
MPALHLLPLAGVLGALPVLA

SEQ ID NO: 931800 - protein, 18 aa, Mycobacterium
MPEDIRALLINRDLLAID

SEQ ID NO: 931801 - protein, 20 aa, Mycobacterium
MPEGHDPAGHMPGMVDAPVL

SEQ ID NO: 931802 - protein, 25 aa, Mycobacterium
MPGEVSRALLSMGACHPGDVVVVVS

SEQ ID NO: 931803 - protein, 20 aa, Mycobacterium
MPGFPNFFMMLGPHSPVGNL

SEQ ID NO: 931804 - protein, 19 aa, Mycobacterium
MPGGPYAPYLHPWTTGKEL

SEQ ID NO: 931805 - protein, 17 aa, Mycobacterium
MPGPAAWAAPVDSNDEP

SEQ ID NO: 931806 - protein, 28 aa, Mycobacterium
MPLPAGAPHPGPLVYRYGSTTLAGTAAD

SEQ ID NO: 931807 - protein, 24 aa, Mycobacterium
MPNLPIARRRTMVFSGDITGRTGM

SEQ ID NO: 931808 - protein, 18 aa, Mycobacterium
MPSAPPLGGANLGIGAYT

SEQ ID NO: 931809 - protein, 26 aa, Mycobacterium
MPTIPLWDYIAVVGWSTEVSNVQVTW

SEQ ID NO: 931810 - protein, 31 aa, Mycobacterium
MPTKGIFTSNFGYRWGVLHAGIDLANSIGTP

SEQ ID NO: 931811 - protein, 32 aa, Mycobacterium
MPVLRKRGLARLDWRGTSFRSRLFGHDLLPDR

SEQ ID NO: 931812 - protein, 17 aa, Mycobacterium
MQAPRAMEAAVPMEPGQ

SEQ ID NO: 931813 - protein, 25 aa, Mycobacterium
MQAQPRGGSIINICSLSGRRPSPGT

SEQ ID NO: 931814 - protein, 19 aa, Mycobacterium
MQDRLVWQAASLLLAYPDD

SEQ ID NO: 931815 - protein, 22 aa, Mycobacterium
MQPVFKQLRQKGPWSDDLILQG

SEQ ID NO: 931816 - protein, 19 aa, Mycobacterium
MQRRQRVSTEWTGITVGQM

SEQ ID NO: 931817 - protein, 17 aa, Mycobacterium
MQSWLKQWGNPPMGDHE

SEQ ID NO: 931818 - protein, 21 aa, Mycobacterium
MQVWAESRGPAHISYFDPAPL

SEQ ID NO: 931819 - protein, 19 aa, Mycobacterium
MQYAYAGAGVKLPRSSGAI

SEQ ID NO: 931820 - protein, 20 aa, Mycobacterium
MRAAKAMLRHARGMEQASAP

SEQ ID NO: 931821 - protein, 17 aa, Mycobacterium
MRAIVGFAAETGDANGD

SEQ ID NO: 931822 - protein, 17 aa, Mycobacterium
MRAQFATNVFGVAATLQ

SEQ ID NO: 931823 - protein, 26 aa, Mycobacterium
MRAVSRRAWQGLALLMVALVLSSCGW

SEQ ID NO: 931824 - protein, 23 aa, Mycobacterium
MRAYMNMFMRHGELRRSVEEIPG

SEQ ID NO: 931825 - protein, 19 aa, Mycobacterium
MRDRLVWQAASLLLAYPDD

SEQ ID NO: 931826 - protein, 21 aa, Mycobacterium
MRFAACADLNGFVNAKWIAQA

SEQ ID NO: 931827 - protein, 17 aa, Mycobacterium
MRGLEAFGHQDMPYGVL

SEQ ID NO: 931828 - protein, 17 aa, Mycobacterium
MRHGELRRSVEEIPGGV

SEQ ID NO: 931829 - protein, 17 aa, Mycobacterium
MRIRRSIRYALAALCAV

SEQ ID NO: 931830 - protein, 20 aa, Mycobacterium
MRLALDCGAFVVPARSDEHD

SEQ ID NO: 931831 - protein, 17 aa, Mycobacterium
MRNRVSTVITWMATIAR

SEQ ID NO: 931832 - protein, 23 aa, Mycobacterium
MRPDRYLRMGLAMRRAGLTATVG

SEQ ID NO: 931833 - protein, 23 aa, Mycobacterium
MRPRARGRITLISADPDVPPRIE

SEQ ID NO: 931834 - protein, 17 aa, Mycobacterium
MRQRIAAVAAQLVADRG

SEQ ID NO: 931835 - protein, 22 aa, Mycobacterium
MRRNSPAWLADELARSWLGQWP

SEQ ID NO: 931836 - protein, 24 aa, Mycobacterium
MSAKAEWNHNAFFDNIDDWMRKDD

SEQ ID NO: 931837 - protein, 17 aa, Mycobacterium
MSALPPPTAHPPSTQIP

SEQ ID NO: 931838 - protein, 20 aa, Mycobacterium
MSALPRPTSRPPGTQIPVTA

SEQ ID NO: 931839 - protein, 23 aa, Mycobacterium
MSARKRGGIILMTSLSGMQGAPW

SEQ ID NO: 931840 - protein, 29 aa, Mycobacterium
MSGGGQGFAIPIGRAMGVAGQIRSGAGSN

SEQ ID NO: 931841 - protein, 18 aa, Mycobacterium
MSGLRVINDLEFTVRLKA

SEQ ID NO: 931842 - protein, 23 aa, Mycobacterium
MSGLRVVKDLEFDVRLKAPTVDF

SEQ ID NO: 931843 - protein, 18 aa, Mycobacterium
MSGLRVVNDLEFSVRLKA

SEQ ID NO: 931844 - protein, 17 aa, Mycobacterium
MSIRELHEIAATAVGRR

SEQ ID NO: 931845 - protein, 24 aa, Mycobacterium
MSKSGGLVDITRFWFETGSLEAEK

SEQ ID NO: 931846 - protein, 20 aa, Mycobacterium
MSPMMARMFTTIAIQTYCPE

SEQ ID NO: 931847 - protein, 17 aa, Mycobacterium
MSPNRYGNHDGFYLAVY

SEQ ID NO: 931848 - protein, 27 aa, Mycobacterium
MSPTQVRWRPLQFWPANTAVNIDAAGT

SEQ ID NO: 931849 - protein, 27 aa, Mycobacterium
MSQSLPALFRNAGGYRRQLTLTPTGVI

SEQ ID NO: 931850 - protein, 20 aa, Mycobacterium
MSRAFASSCNTTFAELASRM

SEQ ID NO: 931851 - protein, 19 aa, Mycobacterium
MSRAFASSCNTTFAELSSK

SEQ ID NO: 931852 - protein, 19 aa, Mycobacterium
MSRAFASSCNTTFAELSSR

SEQ ID NO: 931853 - protein, 19 aa, Mycobacterium
MSRREFFAKLTGAGAAALL

SEQ ID NO: 931854 - protein, 17 aa, Mycobacterium
MSRREFLAKAAAASGAG

SEQ ID NO: 931855 - protein, 18 aa, Mycobacterium
MSRREFMAKLAAASSAGA

SEQ ID NO: 931856 - protein, 21 aa, Mycobacterium
MSTGKRLQLVDILKPGLGLDA

SEQ ID NO: 931857 - protein, 24 aa, Mycobacterium
MSTGRHELYPNLDVNDAVPLPTSP

SEQ ID NO: 931858 - protein, 20 aa, Mycobacterium
MSVLSLPTTFIFDADGRQLY

SEQ ID NO: 931859 - protein, 21 aa, Mycobacterium
MSVSNLRWDGDYVLVDVDASP

SEQ ID NO: 931860 - protein, 17 aa, Mycobacterium
MTAGWLLGQIIGRIQIP

SEQ ID NO: 931861 - protein, 19 aa, Mycobacterium
MTALSQGLSSFGINLPPVP

SEQ ID NO: 931862 - protein, 23 aa, Mycobacterium
MTARRFAQRWLVVDLNTDADLGH

SEQ ID NO: 931863 - protein, 22 aa, Mycobacterium
MTESGLLVPIHWATFRLAPHPW

SEQ ID NO: 931864 - protein, 20 aa, Mycobacterium
MTETFRWGLYDRKPLNRWTT

SEQ ID NO: 931865 - protein, 18 aa, Mycobacterium
MTFLDAMKFMGGCTTLTV

SEQ ID NO: 931866 - protein, 24 aa, Mycobacterium
MTGDARLPAGGMLFVGTPDGQLVA

SEQ ID NO: 931867 - protein, 24 aa, Mycobacterium
MTGLRTACLTGYFTSRAAGKGIVT

SEQ ID NO: 931868 - protein, 17 aa, Mycobacterium
MTGMPAAGDLPPLLVRS

SEQ ID NO: 931869 - protein, 23 aa, Mycobacterium
MTKKPFSLQFVKPLDVPVERFPQ

SEQ ID NO: 931870 - protein, 17 aa, Mycobacterium
MTLGGWLNSDFAPGGTW

SEQ ID NO: 931871 - protein, 18 aa, Mycobacterium
MTLNFQIGRRQIVKAEVP

SEQ ID NO: 931872 - protein, 19 aa, Mycobacterium
MTPFPTMHELFSVGWGTPD

SEQ ID NO: 931873 - protein, 21 aa, Mycobacterium
MTRVAAGLSVVALTAAACSST

SEQ ID NO: 931874 - protein, 19 aa, Mycobacterium
MTRYSWQAYLIATGQFAQW

SEQ ID NO: 931875 - protein, 22 aa, Mycobacterium
MTVRVLPPYGVGLHCEIQVDDV

SEQ ID NO: 931876 - protein, 23 aa, Mycobacterium
MTVTSGWRSKGFQQRLFDDAVVA

SEQ ID NO: 931877 - protein, 18 aa, Mycobacterium
MTYERSRAFELACVDGDD

SEQ ID NO: 931878 - protein, 20 aa, Mycobacterium
MVAARRAAGRIVDMLDTVDR

SEQ ID NO: 931879 - protein, 23 aa, Mycobacterium
MVAGAKYRGEFEERLKAVLDDIK

SEQ ID NO: 931880 - protein, 28 aa, Mycobacterium
MVALEPYGGAWVQTWLDRDLGLSGRVLV

SEQ ID NO: 931881 - protein, 18 aa, Mycobacterium
MVAPLAAYVPAVRTGNLV

SEQ ID NO: 931882 - protein, 24 aa, Mycobacterium
MVARENRLRTALAELDHLDFDYVF

SEQ ID NO: 931883 - protein, 18 aa, Mycobacterium
MVCFGSVFAPASSAAGSC

SEQ ID NO: 931884 - protein, 29 aa, Mycobacterium
MVDEIARQWPVLHSPVCRPDLDRALDAVA

SEQ ID NO: 931885 - protein, 21 aa, Mycobacterium
MVFGELVPKYLAVARPLPTAR

SEQ ID NO: 931886 - protein, 20 aa, Mycobacterium
MVIFPEWSDATDFALAEADR

SEQ ID NO: 931887 - protein, 25 aa, Mycobacterium
MVITIKADATWEYDLLSDAPVTANP

SEQ ID NO: 931888 - protein, 25 aa, Mycobacterium
MVIVAALGVPGCHKKQQAVDKPPVA

SEQ ID NO: 931889 - protein, 19 aa, Mycobacterium
MVLASRPRLWKTLDTGVPA

SEQ ID NO: 931890 - protein, 18 aa, Mycobacterium
MVLGCGRSGHGTGSGEEG

SEQ ID NO: 931891 - protein, 25 aa, Mycobacterium
MVLLNAAYLKASWERPFSKEDTRDG

SEQ ID NO: 931892 - protein, 25 aa, Mycobacterium
MVLLNAAYLKASWESPFPKERTADG

SEQ ID NO: 931893 - protein, 22 aa, Mycobacterium
MVPGLPNLFTISGPGSPSVLAN

SEQ ID NO: 931894 - protein, 20 aa, Mycobacterium
MVQIPRLVANNTRIWVYCGN

SEQ ID NO: 931895 - protein, 17 aa, Mycobacterium
MVQPDYSSTAFLYTQPD

SEQ ID NO: 931896 - protein, 20 aa, Mycobacterium
MVRDVGWTMMDIGKRIERGL

SEQ ID NO: 931897 - protein, 18 aa, Mycobacterium
MVVIAGRCGFGSAESLRR

SEQ ID NO: 931898 - protein, 20 aa, Mycobacterium
MVVKPDIKTAADLKGKTVAD

SEQ ID NO: 931899 - protein, 23 aa, Mycobacterium
MVVPELQRRGLFRTEYESSTLRG

SEQ ID NO: 931900 - protein, 18 aa, Mycobacterium
MWGPDSDPAWARNDPFLH

SEQ ID NO: 931901 - protein, 22 aa, Mycobacterium
MWLGPGRSFLIYPVSRGRLLNV

SEQ ID NO: 931902 - protein, 20 aa, Mycobacterium
MWSGDIIQALGYLPENTPPE

SEQ ID NO: 931903 - protein, 23 aa, Mycobacterium
MWTAEFAEAGWALPLSEDPAGLA

SEQ ID NO: 931904 - protein, 18 aa, Mycobacterium
MYTRIGSLTKTFTITALL

SEQ ID NO: 931905 - protein, 18 aa, Mycobacterium
NAAFHCQYAMQFIAVLRG

SEQ ID NO: 931906 - protein, 28 aa, Mycobacterium
NAAFHCQYAMQFIEVMRGYALPVDAPSV

SEQ ID NO: 931907 - protein, 27 aa, Mycobacterium
NAAGGFSYVVPAGWKVSDATQLSYGQA

SEQ ID NO: 931908 - protein, 26 aa, Mycobacterium
NAAGGFSYVVPEGWQVSDATQLSYGQ

SEQ ID NO: 931909 - protein, 20 aa, Mycobacterium
NAAIASLVLPSSFRPVPDPT

SEQ ID NO: 931910 - protein, 19 aa, Mycobacterium
NAAIPWSLTVVTTLSAVIA

SEQ ID NO: 931911 - protein, 20 aa, Mycobacterium
NAAISALVLPSAFRPVPDAS

SEQ ID NO: 931912 - protein, 20 aa, Mycobacterium
NAAISALVLPSAFRPVPDPA

SEQ ID NO: 931913 - protein, 20 aa, Mycobacterium
NAAISALVLPSAFRPVPDPN

SEQ ID NO: 931914 - protein, 20 aa, Mycobacterium
NAAISALVLPSAFRPVPDTA

SEQ ID NO: 931915 - protein, 20 aa, Mycobacterium
NAAISALVLPSSFRPIPDSQ

SEQ ID NO: 931916 - protein, 21 aa, Mycobacterium
NAAPPRPAVGVPVPVDPNTAP

SEQ ID NO: 931917 - protein, 24 aa, Mycobacterium
NAARCQAHVLPLTRMATDLANTNT

SEQ ID NO: 931918 - protein, 26 aa, Mycobacterium
NAAVYAFGVGALRSALSRLKTDNAQG

SEQ ID NO: 931919 - protein, 28 aa, Mycobacterium
NADGAFPLGPGFVAPLWGFGQDGYDEGN

SEQ ID NO: 931920 - protein, 28 aa, Mycobacterium
NAEALMVDPRTGRMLIIDKTSSGNPAIY

SEQ ID NO: 931921 - protein, 17 aa, Mycobacterium
NAGFPLGPATRVQQPDG

SEQ ID NO: 931922 - protein, 25 aa, Mycobacterium
NAGLHAALMLRGWTDDVVLLTDGKT

SEQ ID NO: 931923 - protein, 30 aa, Mycobacterium
NAGLRKSILLGTHWGRLGAEGVPAPGDPEY

SEQ ID NO: 931924 - protein, 19 aa, Mycobacterium
NAGPGFPNLSCLGLLADRV

SEQ ID NO: 931925 - protein, 20 aa, Mycobacterium
NAGPRAEFPWPYNGIPGGSR

SEQ ID NO: 931926 - protein, 17 aa, Mycobacterium
NAGQRLLHPHYADYSLG

SEQ ID NO: 931927 - protein, 22 aa, Mycobacterium
NAGSCPARVNLELVRETQGDLA

SEQ ID NO: 931928 - protein, 24 aa, Mycobacterium
NAICPRARTAMTAEVFGAEPEIAE

SEQ ID NO: 931929 - protein, 18 aa, Mycobacterium
NAIEVKIRPPDAASRLLE

SEQ ID NO: 931930 - protein, 27 aa, Mycobacterium
NAIRAEPRWNVVLSFHLQPHWEDRVRL

SEQ ID NO: 931931 - protein, 21 aa, Mycobacterium
NAIRFDFTYEGDEWTEERREK

SEQ ID NO: 931932 - protein, 22 aa, Mycobacterium
NAIRLRGLMSHMVFADQPDNPV

SEQ ID NO: 931933 - protein, 29 aa, Mycobacterium
NAKLRKSLLLGTHWGRLGAEEVPAPGDPY

SEQ ID NO: 931934 - protein, 20 aa, Mycobacterium
NAKPSALLDHEARRASEIDV

SEQ ID NO: 931935 - protein, 19 aa, Mycobacterium
NAKVVVCERLSRMRTSFLE

SEQ ID NO: 931936 - protein, 18 aa, Mycobacterium
NALGNWVANVAFPAQSVA

SEQ ID NO: 931937 - protein, 18 aa, Mycobacterium
NALIEVGQALAANLAGGF

SEQ ID NO: 931938 - protein, 18 aa, Mycobacterium
NALLSCAALAAATHAGAQ

SEQ ID NO: 931939 - protein, 27 aa, Mycobacterium
NALYSPRYWPFLTSGLLGLERGTDAED

SEQ ID NO: 931940 - protein, 27 aa, Mycobacterium
NALYTPAHWKYLTSGLLGLQRGTDAGD

SEQ ID NO: 931941 - protein, 23 aa, Mycobacterium
NAPAEQPQQPWNPFAPQQPAPET

SEQ ID NO: 931942 - protein, 23 aa, Mycobacterium
NAPEIASRLAGGIAAKAADEIAA

SEQ ID NO: 931943 - protein, 25 aa, Mycobacterium
NAPKPKFRIGDIVVHGDAASATLIF

SEQ ID NO: 931944 - protein, 24 aa, Mycobacterium
NAPLPWSTEFTGFGGEVFTISAQG

SEQ ID NO: 931945 - protein, 31 aa, Mycobacterium
NAPRYPLNILSDINAFMGYFYVHNTYPTLSA

SEQ ID NO: 931946 - protein, 26 aa, Mycobacterium
NAQPRPPGLPGQWIGGWVSFDGATVT

SEQ ID NO: 931947 - protein, 18 aa, Mycobacterium
NARQLGQFRRWRAVVDAC

SEQ ID NO: 931948 - protein, 25 aa, Mycobacterium
NATETRKLPSWTVVVPPQGVVAGYY

SEQ ID NO: 931949 - protein, 17 aa, Mycobacterium
NAVAAAWNDVALDPDAR

SEQ ID NO: 931950 - protein, 19 aa, Mycobacterium
NAVIARTVSRYGLGGTTAP

SEQ ID NO: 931951 - protein, 18 aa, Mycobacterium
NAYLRWLRTQGEAPVHPV

SEQ ID NO: 931952 - protein, 25 aa, Mycobacterium
NCADARPSPPASFCPATNTIVVDLP

SEQ ID NO: 931953 - protein, 20 aa, Mycobacterium
NCDPAGACVYTYTIDPKYIG

SEQ ID NO: 931954 - protein, 23 aa, Mycobacterium
NCLTAGAWPAFWLGNTGEGELDI

SEQ ID NO: 931955 - protein, 21 aa, Mycobacterium
NCLTAGAWPAYWLGNDDQGEI

SEQ ID NO: 931956 - protein, 20 aa, Mycobacterium
NCLTAGAWPAYWLGNEDQGE

SEQ ID NO: 931957 - protein, 21 aa, Mycobacterium
NCLTPGAWPAFWLGSDQDGEI

SEQ ID NO: 931958 - protein, 18 aa, Mycobacterium
NCPGGWWDPAANTCRPPV

SEQ ID NO: 931959 - protein, 23 aa, Mycobacterium
NCPPGMTCTHWFPGDPAPPGSQV

SEQ ID NO: 931960 - protein, 29 aa, Mycobacterium
NCTEARSAPRDGLELVKVETLEGAVDALK

SEQ ID NO: 931961 - protein, 22 aa, Mycobacterium
NDADGSIWARYNVPWQPAYVFY

SEQ ID NO: 931962 - protein, 19 aa, Mycobacterium
NDAFCVPGINPHAVLGAPC

SEQ ID NO: 931963 - protein, 21 aa, Mycobacterium
NDFPLPDQVTAALPGDLNQGV

SEQ ID NO: 931964 - protein, 25 aa, Mycobacterium
NDGETYRVLYGVASAQGVNPGTLSQ

SEQ ID NO: 931965 - protein, 30 aa, Mycobacterium
NDGGDPTQLSWWINRFTEITQTLARDLEQF

SEQ ID NO: 931966 - protein, 22 aa, Mycobacterium
NDIRAGDALHALAQEIGGLTAP

SEQ ID NO: 931967 - protein, 23 aa, Mycobacterium
NDLKSNGYRVIVSKTGAGDLTKC

SEQ ID NO: 931968 - protein, 17 aa, Mycobacterium
NDLSFTRGSFRVRGDTV

SEQ ID NO: 931969 - protein, 17 aa, Mycobacterium
NDMTHWLTMVLANGTYN

SEQ ID NO: 931970 - protein, 18 aa, Mycobacterium
NDPGYRLVAACIEAGISV

SEQ ID NO: 931971 - protein, 25 aa, Mycobacterium
NDPICTPGALALPSHDEMFSAAHLS

SEQ ID NO: 931972 - protein, 26 aa, Mycobacterium
NDRAGSGFLARLCEDWEAATLPAQYG

SEQ ID NO: 931973 - protein, 18 aa, Mycobacterium
NDSAYAFCQHVLLGERNV

SEQ ID NO: 931974 - protein, 25 aa, Mycobacterium
NDSVSCPRSGEVIVRDGRDWYSTGT

SEQ ID NO: 931975 - protein, 25 aa, Mycobacterium
NDSVSCPRSGEVIVRDQGHWYSTGA

SEQ ID NO: 931976 - protein, 28 aa, Mycobacterium
NDTIPFPKDGFIGFSLANRSSDVDGDTL

SEQ ID NO: 931977 - protein, 18 aa, Mycobacterium
NDTSVLLGRLDLKLFAGA

SEQ ID NO: 931978 - protein, 19 aa, Mycobacterium
NDVALPWSIEVETDAPSMV

SEQ ID NO: 931979 - protein, 17 aa, Mycobacterium
NDVAVVWSPGGTPYVVA

SEQ ID NO: 931980 - protein, 27 aa, Mycobacterium
NDVKLPWSVTVAWPYKDTVKQVTAIWG

SEQ ID NO: 931981 - protein, 25 aa, Mycobacterium
NDVRVRQAIAYAIDRDAIVQATSYG

SEQ ID NO: 931982 - protein, 24 aa, Mycobacterium
NDVRVRQAIAYGIDRDAIATATSY

SEQ ID NO: 931983 - protein, 19 aa, Mycobacterium
NDYARLLIQASDISAPVPF

SEQ ID NO: 931984 - protein, 23 aa, Mycobacterium
NECFASYLPWMWSEEKEGKSIDK

SEQ ID NO: 931985 - protein, 17 aa, Mycobacterium
NEFPGLRAPKNIVNQRL

SEQ ID NO: 931986 - protein, 20 aa, Mycobacterium
NEGPHLVGIAVDPTTMITLL

SEQ ID NO: 931987 - protein, 18 aa, Mycobacterium
NEISEAKSAVAQTLDQYR

SEQ ID NO: 931988 - protein, 25 aa, Mycobacterium
NEKQRFFLNYARIWRDKQRPEDAIT

SEQ ID NO: 931989 - protein, 23 aa, Mycobacterium
NELKANGYRVIITKSGAGDMSKC

SEQ ID NO: 931990 - protein, 26 aa, Mycobacterium
NELREMLPHNAVEYFVSYYDYYQPEA

SEQ ID NO: 931991 - protein, 17 aa, Mycobacterium
NELSLNPFRVFTSMLAT

SEQ ID NO: 931992 - protein, 27 aa, Mycobacterium
NEQSAKLCVQYLAPIIKNRQYNFPPIG

SEQ ID NO: 931993 - protein, 19 aa, Mycobacterium
NERGWRWVHARATEIATGS

SEQ ID NO: 931994 - protein, 24 aa, Mycobacterium
NERSDWKTIYTYDTKSFSKDPITR

SEQ ID NO: 931995 - protein, 19 aa, Mycobacterium
NERVLPATITGVLTGKVAQ

SEQ ID NO: 931996 - protein, 18 aa, Mycobacterium
NESLGALLDAAADVTGVL

SEQ ID NO: 931997 - protein, 20 aa, Mycobacterium
NETIALPGFEGATEGKPSTL

SEQ ID NO: 931998 - protein, 22 aa, Mycobacterium
NEVRGMPAVQEYTVLINQVANS

SEQ ID NO: 931999 - protein, 23 aa, Mycobacterium
NFFAPMRLTLALLPRMRERGSGM

SEQ ID NO: 932000 - protein, 26 aa, Mycobacterium
NFFAPMRMTLALLPRMLARRSGIVVN

SEQ ID NO: 932001 - protein, 19 aa, Mycobacterium
NFHTEVWTFTGGPAGPADA

SEQ ID NO: 932002 - protein, 19 aa, Mycobacterium
NFIVLPYAALVEGPRNPDA

SEQ ID NO: 932003 - protein, 23 aa, Mycobacterium
NFLHALLPFLARGLLSNLKVPVQ

SEQ ID NO: 932004 - protein, 25 aa, Mycobacterium
NFPIEPRSGQQFQFTVDVPGTVDIE

SEQ ID NO: 932005 - protein, 21 aa, Mycobacterium
NFQAARTAFFDNFFTTTSDTG

SEQ ID NO: 932006 - protein, 19 aa, Mycobacterium
NFQYTAAAQKLWAQAGFRP

SEQ ID NO: 932007 - protein, 19 aa, Mycobacterium
NFQYTAAAQKLWAQSGFRP

SEQ ID NO: 932008 - protein, 25 aa, Mycobacterium
NFSARARLTSVLWTFQVNQAEGVLC

SEQ ID NO: 932009 - protein, 26 aa, Mycobacterium
NFSGRARLSSVLWTFTVTKQDGVVCP

SEQ ID NO: 932010 - protein, 22 aa, Mycobacterium
NFSRWSGLRNVLRRGFGGNGHK

SEQ ID NO: 932011 - protein, 18 aa, Mycobacterium
NFTTLPWSKTIVAEMPGI

SEQ ID NO: 932012 - protein, 26 aa, Mycobacterium
NFVTSLQLLLTFPFPNFGIKQAVRGD

SEQ ID NO: 932013 - protein, 28 aa, Mycobacterium
NFYLWAEPWVQWGFSVASWAAGWVPYIG

SEQ ID NO: 932014 - protein, 25 aa, Mycobacterium
NGAEARRPGLFGVIQLVMHNIAIGL

SEQ ID NO: 932015 - protein, 24 aa, Mycobacterium
NGAGARPGPRYGVKPRVMPKKVLV

SEQ ID NO: 932016 - protein, 25 aa, Mycobacterium
NGAKTDGWITWNFADHKWALGDVVS

SEQ ID NO: 932017 - protein, 19 aa, Mycobacterium
NGAPLPGLEPVSLAESIVG

SEQ ID NO: 932018 - protein, 20 aa, Mycobacterium
NGAPWPVLHTDPARYRLRLL

SEQ ID NO: 932019 - protein, 25 aa, Mycobacterium
NGASEVTGGFDWRKASGSTINILQT

SEQ ID NO: 932020 - protein, 23 aa, Mycobacterium
NGAVPRYGARVGVAAPVNATLTA

SEQ ID NO: 932021 - protein, 19 aa, Mycobacterium
NGAVRAHFLTDRMIFDSQL

SEQ ID NO: 932022 - protein, 32 aa, Mycobacterium
NGAVVKRCYAEVLPAARSGALFIDSSTISVND

SEQ ID NO: 932023 - protein, 23 aa, Mycobacterium
NGCDGPCRGSVVALEPSTGKILA

SEQ ID NO: 932024 - protein, 19 aa, Mycobacterium
NGEPCPTYTDLLVNPPDTT

SEQ ID NO: 932025 - protein, 17 aa, Mycobacterium
NGFDPLLIISGGGRPMA

SEQ ID NO: 932026 - protein, 20 aa, Mycobacterium
NGGAGGLFFGDGGAGGNGAP

SEQ ID NO: 932027 - protein, 21 aa, Mycobacterium
NGGAGGLLFGVGGAGGAAALS

SEQ ID NO: 932028 - protein, 23 aa, Mycobacterium
NGGAGGNSFYYGNDGGAGGNGGA

SEQ ID NO: 932029 - protein, 17 aa, Mycobacterium
NGGDFGLALDTTLRAMK

SEQ ID NO: 932030 - protein, 26 aa, Mycobacterium
NGGDGFDVANGGGWGSSGGSALLFGD

SEQ ID NO: 932031 - protein, 29 aa, Mycobacterium
NGGDGRYGGAGGKAGLYFGDGGNGGDGVN

SEQ ID NO: 932032 - protein, 20 aa, Mycobacterium
NGGFFERLAFLGTVPVLDAT

SEQ ID NO: 932033 - protein, 23 aa, Mycobacterium
NGGLGGAGGWLYGDGGAGGNGGM

SEQ ID NO: 932034 - protein, 22 aa, Mycobacterium
NGGMGGAGLRGGDGGTGGLGGW

SEQ ID NO: 932035 - protein, 19 aa, Mycobacterium
NGGSLNFGFGNGGVENMGH

SEQ ID NO: 932036 - protein, 21 aa, Mycobacterium
NGGTWTYKWETFLTEELPAWL

SEQ ID NO: 932037 - protein, 24 aa, Mycobacterium
NGHHPGDIVSISWTSNSGGQRTEN

SEQ ID NO: 932038 - protein, 26 aa, Mycobacterium
NGHHPGDVVSISWLSKSGVARTENVT

SEQ ID NO: 932039 - protein, 17 aa, Mycobacterium
NGIAPTYPLDFVADVAA

SEQ ID NO: 932040 - protein, 23 aa, Mycobacterium
NGILPYREFFGPNVAGTAEVIRF

SEQ ID NO: 932041 - protein, 22 aa, Mycobacterium
NGISQLLAALGRRYDGDERLSV

SEQ ID NO: 932042 - protein, 17 aa, Mycobacterium
NGLGDLPLPAPGVGTGG

SEQ ID NO: 932043 - protein, 24 aa, Mycobacterium
NGLGEIRAGDILKQSAKTVPRSLA

SEQ ID NO: 932044 - protein, 19 aa, Mycobacterium
NGLSRSAIAVYRVPEPIVT

SEQ ID NO: 932045 - protein, 22 aa, Mycobacterium
NGMADRAATFAMGRLAELKPES

SEQ ID NO: 932046 - protein, 30 aa, Mycobacterium; identical to SEQ ID NO: 145328

SEQ ID NO: 932047 - protein, 24 aa, Mycobacterium
NGPFKADGDWVRGVGFTLSRYDQY

SEQ ID NO: 932048 - protein, 27 aa, Mycobacterium
NGPFLELTGRPLIGNGADGYTNAQGIG

SEQ ID NO: 932049 - protein, 22 aa, Mycobacterium
NGPGGLAAHFVWSNRGKESVTL

SEQ ID NO: 932050 - protein, 17 aa, Mycobacterium
NGQFIGCRVTVDGEVED

SEQ ID NO: 932051 - protein, 19 aa, Mycobacterium
NGQVDAWAVWDPYTAQAEQ

SEQ ID NO: 932052 - protein, 21 aa, Mycobacterium
NGQYRGGFVNRGNKETLNQPL

SEQ ID NO: 932053 - protein, 19 aa, Mycobacterium
NGRQLVVRLLFYDAQSTRQ

SEQ ID NO: 932054 - protein, 19 aa, Mycobacterium
NGSNGIVFGDIVKQSDQLM

SEQ ID NO: 932055 - protein, 19 aa, Mycobacterium
NGSVRARFLTDRLLFDSQY

SEQ ID NO: 932056 - protein, 25 aa, Mycobacterium
NGTDVLRGEGFVKNLGEFANDVFLA

SEQ ID NO: 932057 - protein, 20 aa, Mycobacterium
NGTITRWDDPAIKALNSDTN

SEQ ID NO: 932058 - protein, 23 aa, Mycobacterium
NGVDWKGTLTGLAGYARGDVDTR

SEQ ID NO: 932059 - protein, 17 aa, Mycobacterium
NGVELHDAWQGEPEAFL

SEQ ID NO: 932060 - protein, 22 aa, Mycobacterium
NGVFPGPGLPKPDPRDATPPYA

SEQ ID NO: 932061 - protein, 25 aa, Mycobacterium
NHADNCLLMSILMIEGQFTGQVPTR

SEQ ID NO: 932062 - protein, 17 aa, Mycobacterium
NHAVTHIKVADKWEARF

SEQ ID NO: 932063 - protein, 19 aa, Mycobacterium
NHGAVLLAVCDDIHNRHAL

SEQ ID NO: 932064 - protein, 17 aa, Mycobacterium
NHGPMFPQCGGISDQTV

SEQ ID NO: 932065 - protein, 20 aa, Mycobacterium
NHHGGALAFGPDGKLYWGVG

SEQ ID NO: 932066 - protein, 25 aa, Mycobacterium
NHLAGRVGLLTAFIPGGTCYFVPES

SEQ ID NO: 932067 - protein, 18 aa, Mycobacterium
NHLGRFIGINDLAVEPPP

SEQ ID NO: 932068 - protein, 19 aa, Mycobacterium
NHLTRHVAVNWGKHNIRSN

SEQ ID NO: 932069 - protein, 25 aa, Mycobacterium
NHQYNIKAGDQFLQQVLPTIVNSPA

SEQ ID NO: 932070 - protein, 19 aa, Mycobacterium
NHREVFVIGDLAGRDGLPG

SEQ ID NO: 932071 - protein, 24 aa, Mycobacterium
NHVAGGWWWRYDLVPRGEHTDVTL

SEQ ID NO: 932072 - protein, 24 aa, Mycobacterium
NIAASRYHSVLLRSDGTSVAAGQN

SEQ ID NO: 932073 - protein, 23 aa, Mycobacterium
NIAIPDWMRFASTSYTGPQRYWW

SEQ ID NO: 932074 - protein, 21 aa, Mycobacterium
NIAIPDWVRPYAASYPAPAKS

SEQ ID NO: 932075 - protein, 25 aa, Mycobacterium
NIDRRGGGMTGPLAGRWIDQCNPGD

SEQ ID NO: 932076 - protein, 24 aa, Mycobacterium
NIEDLRAPLLAALGAADLALATVN

SEQ ID NO: 932077 - protein, 20 aa, Mycobacterium
NILAGTQCMTVYKSATEEAN

SEQ ID NO: 932078 - protein, 18 aa, Mycobacterium
NINLPWSSEFTAFGGQVF

SEQ ID NO: 932079 - protein, 18 aa, Mycobacterium
NINTKFGYNNAVGAGTGI

SEQ ID NO: 932080 - protein, 20 aa, Mycobacterium
NIPARYWAPEQRKLGDDTAG

SEQ ID NO: 932081 - protein, 19 aa, Mycobacterium
NKDQFAFLGSNLPLLLKGL

SEQ ID NO: 932082 - protein, 20 aa, Mycobacterium
NKGLRFEFYANLETAYSDLL

SEQ ID NO: 932083 - protein, 19 aa, Mycobacterium
NKLSGTWFKMVQPGGNPQE

SEQ ID NO: 932084 - protein, 22 aa, Mycobacterium
NKPGAFTSYTLVGGTTKGTVTS

SEQ ID NO: 932085 - protein, 23 aa, Mycobacterium
NKPPGRFDHGWKDTVDVAPAEAV

SEQ ID NO: 932086 - protein, 25 aa, Mycobacterium
NKTPDTRPGVNYLVLGSKNDTTATP

SEQ ID NO: 932087 - protein, 33 aa, Mycobacterium
NLAGELGRWVLRTACAEFSRWRANGVGRNIVLR

SEQ ID NO: 932088 - protein, 19 aa, Mycobacterium
NLAGGFSLPTLAAELSAAL

SEQ ID NO: 932089 - protein, 26 aa, Mycobacterium
NLAKACARAGAALIHVSTDYVFDGDH

SEQ ID NO: 932090 - protein, 19 aa, Mycobacterium
NLAQYPSILVELGNMKNPA

SEQ ID NO: 932091 - protein, 23 aa, Mycobacterium
NLARAKMGLPVPVTSRHTLLLGP

SEQ ID NO: 932092 - protein, 21 aa, Mycobacterium
NLDPSMCDAWLARMLAGEQSL

SEQ ID NO: 932093 - protein, 17 aa, Mycobacterium
NLEDAGVSWKVYQNKDA

SEQ ID NO: 932094 - protein, 18 aa, Mycobacterium
NLEQILALYPIEIAGLQG

SEQ ID NO: 932095 - protein, 17 aa, Mycobacterium
NLERGIDTVHGFFDKSV

SEQ ID NO: 932096 - protein, 25 aa, Mycobacterium
NLFQHLRFLGEYNVADNATLAPVGA

SEQ ID NO: 932097 - protein, 19 aa, Mycobacterium
NLGEIMAAVDAWEAATGEQ

SEQ ID NO: 932098 - protein, 24 aa, Mycobacterium
NLGLKPEFVQSAFAAVIPTLQAKQ

SEQ ID NO: 932099 - protein, 24 aa, Mycobacterium
NLGWAGGSDLGFRIAFSEGHSHAM

SEQ ID NO: 932100 - protein, 27 aa, Mycobacterium
NLKVVACAGLCGAAIALSPDVAAAPLK

SEQ ID NO: 932101 - protein, 19 aa, Mycobacterium
NLLGIPIDHFVEVTLGAFF

SEQ ID NO: 932102 - protein, 25 aa, Mycobacterium
NLLLDAATALGWRAAPIPRNAPGCG

SEQ ID NO: 932103 - protein, 21 aa, Mycobacterium
NLNQRSAPSITNFSSDDAELR

SEQ ID NO: 932104 - protein, 19 aa, Mycobacterium
NLPDLNGLLPTAGTTNVAA

SEQ ID NO: 932105 - protein, 26 aa, Mycobacterium
NLRDERFRTALPMSENAKYGVGAFDT

SEQ ID NO: 932106 - protein, 19 aa, Mycobacterium
NLREGKLVRIAGVEVGKVE

SEQ ID NO: 932107 - protein, 21 aa, Mycobacterium
NLRILLKNRIVPVGIPTNNVF

SEQ ID NO: 932108 - protein, 21 aa, Mycobacterium
NLSAGKWPSLVSVAQLGAGGF

SEQ ID NO: 932109 - protein, 17 aa, Mycobacterium
NLTKGWITPAARIGRRS

SEQ ID NO: 932110 - protein, 20 aa, Mycobacterium
NLTYPQYLVLLALWEEDRAT

SEQ ID NO: 932111 - protein, 18 aa, Mycobacterium
NLVKAGHTVKGYNRSPHR

SEQ ID NO: 932112 - protein, 18 aa, Mycobacterium
NLVTGWPKPANARAAELI

SEQ ID NO: 932113 - protein, 27 aa, Mycobacterium
NMATTWPRKRIDLYFPGRSALQGHHPR

SEQ ID NO: 932114 - protein, 23 aa, Mycobacterium
NMAVSNLRWDGDFVLVDVDASAA

SEQ ID NO: 932115 - protein, 24 aa, Mycobacterium
NMDKAWKAHAVVNPVDFAANTLTI

SEQ ID NO: 932116 - protein, 20 aa, Mycobacterium
NMGDGRRLVGLQALPDPDNT

SEQ ID NO: 932117 - protein, 25 aa, Mycobacterium
NMIRLLRLPIAVQRRVAAGVLSAGH

SEQ ID NO: 932118 - protein, 24 aa, Mycobacterium
NMMDPRTGGASGVFVLNNMADPTA

SEQ ID NO: 932119 - protein, 22 aa, Mycobacterium
NMPEYPGFASFPGRILHSHDFR

SEQ ID NO: 932120 - protein, 23 aa, Mycobacterium
NMSEPLHFICGAIGAVENVTAPE

SEQ ID NO: 932121 - protein, 20 aa, Mycobacterium
NMTAEGRWFADQVRSADNPL

SEQ ID NO: 932122 - protein, 27 aa, Mycobacterium
NMTGHFEWVDSFVVQWIPDHYWPAHSH

SEQ ID NO: 932123 - protein, 24 aa, Mycobacterium
NNADPRAGAPYRVIQFAVNPFKPG

SEQ ID NO: 932124 - protein, 18 aa, Mycobacterium
NNDLMMMMGLGVVGAVYT

SEQ ID NO: 932125 - protein, 27 aa, Mycobacterium
NNDQGGFSFVVPQGWVQSDARRLTYGS

SEQ ID NO: 932126 - protein, 22 aa, Mycobacterium
NNESRIPTWDDFVKPRDLYAKF

SEQ ID NO: 932127 - protein, 26 aa, Mycobacterium
NNGGWPFFHMEMMLAGIPIPVPPGGP

SEQ ID NO: 932128 - protein, 25 aa, Mycobacterium
NNHGQCEWIPPQLLDRGQHRTNTYH

SEQ ID NO: 932129 - protein, 26 aa, Mycobacterium
NNREVRWRPEHFWKSGTSVDVAVNTY

SEQ ID NO: 932130 - protein, 25 aa, Mycobacterium
NNRLPKVSWVLPGFLLSEHPAFPVN

SEQ ID NO: 932131 - protein, 21 aa, Mycobacterium
NNRPPRAFDDFANIRENTTLT

SEQ ID NO: 932132 - protein, 18 aa, Mycobacterium
NNTYTVYFAMKFSRPFTS

SEQ ID NO: 932133 - protein, 18 aa, Mycobacterium
NNYQLAVEAVVWRTYEDS

SEQ ID NO: 932134 - protein, 18 aa, Mycobacterium
NPAELRRTGYLARMSTVV

SEQ ID NO: 932135 - protein, 23 aa, Mycobacterium
NPALLRLLRDVLPPREWTTDELV

SEQ ID NO: 932136 - protein, 25 aa, Mycobacterium
NPALRGRFLGGLHCALDAAVESRQA

SEQ ID NO: 932137 - protein, 17 aa, Mycobacterium
NPCRDIPLDAVQRIGLA

SEQ ID NO: 932138 - protein, 21 aa, Mycobacterium
NPDIKALVYVDAAAPDVGETN

SEQ ID NO: 932139 - protein, 24 aa, Mycobacterium
NPDLGTRVDQRFEEVEALLQRYRE

SEQ ID NO: 932140 - protein, 24 aa, Mycobacterium
NPDSWFDNWGWRYGGRDWRGEGGR

SEQ ID NO: 932141 - protein, 22 aa, Mycobacterium
NPEGAQAFASYLIGKSAQEYFA

SEQ ID NO: 932142 - protein, 18 aa, Mycobacterium
NPFFDERPGHWVIPGDPA

SEQ ID NO: 932143 - protein, 24 aa, Mycobacterium
NPFPGSPVWSYGHRNIQGLAWDAA

SEQ ID NO: 932144 - protein, 23 aa, Mycobacterium
NPGQWLTHCHNIYHGETGMMAVV

SEQ ID NO: 932145 - protein, 29 aa, Mycobacterium
NPGRPNGGLYARFAPIYQELTGVNPVSPE

SEQ ID NO: 932146 - protein, 24 aa, Mycobacterium
NPGTRLMILPPLIHGAAQWAAMTA

SEQ ID NO: 932147 - protein, 26 aa, Mycobacterium
NPGVVFPAEPIRVIFRNDQSGTTDNF

SEQ ID NO: 932148 - protein, 19 aa, Mycobacterium
NPHDICWWPKNPLPEDVPH

SEQ ID NO: 932149 - protein, 19 aa, Mycobacterium
NPIAGAWLQQFVASPKPKR

SEQ ID NO: 932150 - protein, 18 aa, Mycobacterium
NPIDGWKLVDWDGIRNFT

SEQ ID NO: 932151 - protein, 22 aa, Mycobacterium
NPILTEIWFLLTGQTVLPNNLG

SEQ ID NO: 932152 - protein, 23 aa, Mycobacterium
NPLATRAACEVLRDGGTAADALV

SEQ ID NO: 932153 - protein, 21 aa, Mycobacterium
NPLDPACRIPSARAGRAQGRR

SEQ ID NO: 932154 - protein, 17 aa, Mycobacterium
NPLPCAGGGIGPFGGPG

SEQ ID NO: 932155 - protein, 22 aa, Mycobacterium
NPMEISEAVFVEGRAMVDMEFD

SEQ ID NO: 932156 - protein, 18 aa, Mycobacterium
NPNHVFTFNDAVRSGARL

SEQ ID NO: 932157 - protein, 27 aa, Mycobacterium
NPNSGHWRIPGVLTLTAYLRDAGRYET

SEQ ID NO: 932158 - protein, 30 aa, Mycobacterium
NPNSGMGTSMWDVPALLAHYGVDAKVTDTD

SEQ ID NO: 932159 - protein, 21 aa, Mycobacterium
NPPQVKSVGLGNVNGVTLGYT

SEQ ID NO: 932160 - protein, 40 aa, Mycobacterium
NPPYPLAHPDWLPQRLGFRPFPYPSFTRRLVEAMCDTVVD

SEQ ID NO: 932161 - protein, 25 aa, Mycobacterium
NPQWKGKKALLLQGRLRQGNVIATM

SEQ ID NO: 932162 - protein, 25 aa, Mycobacterium
NPSDMKFQIGLAMGDAGGFSASDMW

SEQ ID NO: 932163 - protein, 24 aa, Mycobacterium
NPSEGWWPMLIGISMGDAGGYKAD

SEQ ID NO: 932164 - protein, 24 aa, Mycobacterium
NPSEGWWPMLIGLAMNDAGGYNAE

SEQ ID NO: 932165 - protein, 25 aa, Mycobacterium
NPSGWRCMAEARAIDNVLFMAMICQ

SEQ ID NO: 932166 - protein, 23 aa, Mycobacterium
NPVQFICGGSFDTAAGKSAPDYY

SEQ ID NO: 932167 - protein, 31 aa, Mycobacterium
NPVSALVSFEVFIRPALRNAMGLPDPFRPRR

SEQ ID NO: 932168 - protein, 19 aa, Mycobacterium
NPVTGWTLVDWDGIRDFHS

SEQ ID NO: 932169 - protein, 22 aa, Mycobacterium
NPYEVDGPPLISVSPDGTQLYW

SEQ ID NO: 932170 - protein, 28 aa, Mycobacterium
NQFIGSLKYTLWRLQERVVGRGPGSPQL

SEQ ID NO: 932171 - protein, 32 aa, Mycobacterium
NQFRKEGGKWAWCQQPPPGLFTQWTTSSAAQA

SEQ ID NO: 932172 - protein, 23 aa, Mycobacterium
NQGMWLDFFERLIAESAPFPPAA

SEQ ID NO: 932173 - protein, 19 aa, Mycobacterium
NQHTMSWTGNSGGLGTQQT

SEQ ID NO: 932174 - protein, 23 aa, Mycobacterium
NQIVPYLRAWESVIGHQRTGVYA

SEQ ID NO: 932175 - protein, 22 aa, Mycobacterium
NQKAAEAWIDYVYDRPNYAKLV

SEQ ID NO: 932176 - protein, 25 aa, Mycobacterium
NQPYAVEGFFLIAISPVLAGVAATQ

SEQ ID NO: 932177 - protein, 17 aa, Mycobacterium
NQRGQVIPVEITVYEDR

SEQ ID NO: 932178 - protein, 17 aa, Mycobacterium
NQSRRVLPELAQCGLGI

SEQ ID NO: 932179 - protein, 19 aa, Mycobacterium
NQWYYRPDYMAIMSNCANT

SEQ ID NO: 932180 - protein, 21 aa, Mycobacterium
NRALGSPGYRESVDYVADILR

SEQ ID NO: 932181 - protein, 17 aa, Mycobacterium
NRARSVMAAALFAEQLR

SEQ ID NO: 932182 - protein, 24 aa, Mycobacterium
NRESPEVYQFVVLFPAPDQANAFF

SEQ ID NO: 932183 - protein, 21 aa, Mycobacterium
NRFSTVGTWLATIARSNRSDR

SEQ ID NO: 932184 - protein, 21 aa, Mycobacterium
NRGREMLAFATAYREAGAQPP

SEQ ID NO: 932185 - protein, 21 aa, Mycobacterium
NRGREMLAFATAYREAGVEPP

SEQ ID NO: 932186 - protein, 24 aa, Mycobacterium
NRGRWVRLALAALLLVTLGVGIYQ

SEQ ID NO: 932187 - protein, 18 aa, Mycobacterium
NRIVALIVAGGLAAGLTA

SEQ ID NO: 932188 - protein, 17 aa, Mycobacterium
NRLAAQRAITVKTTPEV

SEQ ID NO: 932189 - protein, 27 aa, Mycobacterium
NRLDAILQPRVDAGYSRNDDPATAPIA

SEQ ID NO: 932190 - protein, 22 aa, Mycobacterium
NRLNTYGGMINWRVENPVLNGD

SEQ ID NO: 932191 - protein, 19 aa, Mycobacterium
NRLPKVSWVVPNIIQSEHP

SEQ ID NO: 932192 - protein, 28 aa, Mycobacterium
NRLQGALLREAYCLLRDGVATVDDIDEV

SEQ ID NO: 932193 - protein, 20 aa, Mycobacterium
NRLTREWFHSGRAAYEVTGA

SEQ ID NO: 932194 - protein, 20 aa, Mycobacterium
NRLTREWFHSGRAVYEVTGA

SEQ ID NO: 932195 - protein, 18 aa, Mycobacterium
NRLTVRFFGPPSAAPPGN

SEQ ID NO: 932196 - protein, 26 aa, Mycobacterium
NRMWGPPQFGRWKWHDPAVHVQLLAD

SEQ ID NO: 932197 - protein, 19 aa, Mycobacterium
NRPDIPGVDDFAGEAYFTA

SEQ ID NO: 932198 - protein, 20 aa, Mycobacterium
NRPLLKDTIGYLDVIQAPLV

SEQ ID NO: 932199 - protein, 34 aa, Mycobacterium
NRPTPDRVRELVVAWAKLYPDFGTVAALNLVKCV

SEQ ID NO: 932200 - protein, 33 aa, Mycobacterium
NRPTPDRVRELVVAWAKLYPQFGTVAALNLVKC

SEQ ID NO: 932201 - protein, 29 aa, Mycobacterium
NRPTPDRVRELVVAWGKLYPQFGTVAALN

SEQ ID NO: 932202 - protein, 28 aa, Mycobacterium
NRPTPDRVRELVVAWGKMYPQFGTTGAL

SEQ ID NO: 932203 - protein, 18 aa, Mycobacterium
NRRVAAADVAVELRGAGN

SEQ ID NO: 932204 - protein, 25 aa, Mycobacterium
NRVGSGPMADCKATAVRPGRFLNPG

SEQ ID NO: 932205 - protein, 23 aa, Mycobacterium
NRVIAWYSAMAYRGLGNEEAAVR

SEQ ID NO: 932206 - protein, 19 aa, Mycobacterium
NRVRASVSVYGFGEQYAKV

SEQ ID NO: 932207 - protein, 21 aa, Mycobacterium
NRVTDVLSRIYGHPVTVQLQI

SEQ ID NO: 932208 - protein, 22 aa, Mycobacterium
NRWKRRLTVAALTTAALPWLVG

SEQ ID NO: 932209 - protein, 25 aa, Mycobacterium
NRYGIATRGSKSWATIHPGFMTQYV

SEQ ID NO: 932210 - protein, 18 aa, Mycobacterium
NSAFRAGWQGDYPSMIEF

SEQ ID NO: 932211 - protein, 18 aa, Mycobacterium
NSANWATLQMDPWMRFQN

SEQ ID NO: 932212 - protein, 30 aa, Mycobacterium
NSASLSFSSLSGWAQLGLRGQFVDLTDAVW

SEQ ID NO: 932213 - protein, 26 aa, Mycobacterium
NSATPDAAWAFVSWITAKPNDVVRTE

SEQ ID NO: 932214 - protein, 21 aa, Mycobacterium
NSEGLKNWLFGPLDGPPRNTA

SEQ ID NO: 932215 - protein, 20 aa, Mycobacterium
NSGFPMAEWAVTRRAQLDDR

SEQ ID NO: 932216 - protein, 17 aa, Mycobacterium
NSGLSNFGFGNSGVNNV

SEQ ID NO: 932217 - protein, 23 aa, Mycobacterium
NSGTCFRPPDAVQRRWRHEFGLD

SEQ ID NO: 932218 - protein, 17 aa, Mycobacterium
NSGTYWAHPHTGLDADT

SEQ ID NO: 932219 - protein, 18 aa, Mycobacterium
NSIPGAPIRARIGDELVV

SEQ ID NO: 932220 - protein, 17 aa, Mycobacterium
NSIRCVDGPTPKDSAPW

SEQ ID NO: 932221 - protein, 19 aa, Mycobacterium
NSLSELVAGLSARRTDITN

SEQ ID NO: 932222 - protein, 26 aa, Mycobacterium
NSNGLKIVSCYQYGKGNTADWLGGAN

SEQ ID NO: 932223 - protein, 25 aa, Mycobacterium
NSPDGYRTEVEWATQMSYSGIYVHS

SEQ ID NO: 932224 - protein, 26 aa, Mycobacterium
NSPDGYRTEVEWATQMSYSGIYVHSA

SEQ ID NO: 932225 - protein, 25 aa, Mycobacterium
NSPNGYRTDVDWATQISYSGVFVHS

SEQ ID NO: 932226 - protein, 24 aa, Mycobacterium
NSPNGYRTDVNWATQLSYSGVYVH

SEQ ID NO: 932227 - protein, 25 aa, Mycobacterium
NSPNGYRTEVDWATQMSYSGVFVHS

SEQ ID NO: 932228 - protein, 29 aa, Mycobacterium
NSPQVRNAVRFGFWGAEELGLIGSRNYVE

SEQ ID NO: 932229 - protein, 21 aa, Mycobacterium
NSRARALEIFTEITNYDESAC

SEQ ID NO: 932230 - protein, 25 aa, Mycobacterium
NSRNKLPAWLFIQWATGKESMNKAV

SEQ ID NO: 932231 - protein, 26 aa, Mycobacterium
NSTWGTFPAAISWEVASRQAQADTIS

SEQ ID NO: 932232 - protein, 25 aa, Mycobacterium
NSVWGDFPAAVSWGATSQQVREDLG

SEQ ID NO: 932233 - protein, 26 aa, Mycobacterium
NSVWGEFPAAVSWRATSEEVREDLGV

SEQ ID NO: 932234 - protein, 31 aa, Mycobacterium
NSYACPTFAMAEALARRAPVYAYEFADPVAP

SEQ ID NO: 932235 - protein, 25 aa, Mycobacterium
NSYWYYSCMVAFKTGYGVLQQALYY

SEQ ID NO: 932236 - protein, 18 aa, Mycobacterium
NTAFACQYAMQFIAVLRG

SEQ ID NO: 932237 - protein, 25 aa, Mycobacterium
NTAMETWRPGGFNGVKLDDSSHGDA

SEQ ID NO: 932238 - protein, 28 aa, Mycobacterium
NTARPWYFGYNGFRPAPSPGGIEPTQGE

SEQ ID NO: 932239 - protein, 18 aa, Mycobacterium
NTECPGEAAYRLIPRLRD

SEQ ID NO: 932240 - protein, 20 aa, Mycobacterium
NTGCPGVFIRLGGNRWTFHT

SEQ ID NO: 932241 - protein, 18 aa, Mycobacterium
NTGKPGAVTSWLRGTVSA

SEQ ID NO: 932242 - protein, 24 aa, Mycobacterium
NTGNYPFLLGPIYISNSPTGGGQT

SEQ ID NO: 932243 - protein, 27 aa, Mycobacterium
NTGVAEFNYFFGWLIPPVALTTPTETL

SEQ ID NO: 932244 - protein, 17 aa, Mycobacterium
NTITVLVVRQEFLAAHP

SEQ ID NO: 932245 - protein, 24 aa, Mycobacterium
NTIWDLKPGLDLKNFPSSGPYKIE

SEQ ID NO: 932246 - protein, 20 aa, Mycobacterium
NTKPGQSVTIDFRRKNEPAG

SEQ ID NO: 932247 - protein, 17 aa, Mycobacterium
NTLKRFNVYGTDVGVMW

SEQ ID NO: 932248 - protein, 17 aa, Mycobacterium
NTLPPVINWLADDIYLP

SEQ ID NO: 932249 - protein, 26 aa, Mycobacterium
NTLTVKGRCAKVIIGGDDNKISFENI

SEQ ID NO: 932250 - protein, 19 aa, Mycobacterium
NTLWASWAFVGPTHRAYFG

SEQ ID NO: 932251 - protein, 23 aa, Mycobacterium
NTRAVLFHLGKFIPTGVPDTYGF

SEQ ID NO: 932252 - protein, 17 aa, Mycobacterium
NTRGHVWALQLSPDGNV

SEQ ID NO: 932253 - protein, 23 aa, Mycobacterium
NTRSMELLRNWGIYDEIIADAID

SEQ ID NO: 932254 - protein, 21 aa, Mycobacterium
NTSILDVTWAYNILSDAPTTA

SEQ ID NO: 932255 - protein, 24 aa, Mycobacterium
NTSSQRWPACANRLDTAPADSNHP

SEQ ID NO: 932256 - protein, 23 aa, Mycobacterium
NTTCTYPQIMAALNEQSPAAAQQ

SEQ ID NO: 932257 - protein, 17 aa, Mycobacterium
NTTMGRLAVGLPPDGLT

SEQ ID NO: 932258 - protein, 18 aa, Mycobacterium
NTVAGAWNDVALAPDATL

SEQ ID NO: 932259 - protein, 19 aa, Mycobacterium
NTVGRLCLVENLTVGHCYH

SEQ ID NO: 932260 - protein, 28 aa, Mycobacterium
NTVGVAGRLCLTTGPTVTTTTAGPTVGA

SEQ ID NO: 932261 - protein, 23 aa, Mycobacterium
NTVWKPTVPLGYGRTYTLTVTGR

SEQ ID NO: 932262 - protein, 17 aa, Mycobacterium
NVAKIAFTGAVLGGGGL

SEQ ID NO: 932263 - protein, 18 aa, Mycobacterium
NVALDVARILGMDPESLH

SEQ ID NO: 932264 - protein, 23 aa, Mycobacterium
NVANCLVALAILDAVGVSPEQAA

SEQ ID NO: 932265 - protein, 20 aa, Mycobacterium
NVGVPGFKAAYSASKAGVTS

SEQ ID NO: 932266 - protein, 20 aa, Mycobacterium
NVHVRPGYNFPNAEAAIGYG

SEQ ID NO: 932267 - protein, 24 aa, Mycobacterium
NVIEIPGLPPIVLPWPAPPPPPPA

SEQ ID NO: 932268 - protein, 21 aa, Mycobacterium
NVLAAKGPVAAIFASQLIRTQ

SEQ ID NO: 932269 - protein, 23 aa, Mycobacterium
NVLPGKVGHEIFLNECNQLGREQ

SEQ ID NO: 932270 - protein, 17 aa, Mycobacterium
NVLRRGFGGNGHKIAAV

SEQ ID NO: 932271 - protein, 17 aa, Mycobacterium
NVMCWARGHKADWNFFA

SEQ ID NO: 932272 - protein, 25 aa, Mycobacterium
NVNWTIKLKPGWTFHNGEPVTAQSY

SEQ ID NO: 932273 - protein, 25 aa, Mycobacterium
NVNYRILLEPGWKFTDGSPVTAHSF

SEQ ID NO: 932274 - protein, 25 aa, Mycobacterium
NVNYRIVLKPGWKFTDGSPVTAHSF

SEQ ID NO: 932275 - protein, 25 aa, Mycobacterium
NVNYRVVLKPGWTFTDGSPVTAHSF

SEQ ID NO: 932276 - protein, 20 aa, Mycobacterium
NVRAELRQATVLGDIYIAMI

SEQ ID NO: 932277 - protein, 17 aa, Mycobacterium
NVRARRGVVLGVGGFEW

SEQ ID NO: 932278 - protein, 24 aa, Mycobacterium
NVRIDLRPNPGYRGNRRPHNKGLR

SEQ ID NO: 932279 - protein, 19 aa, Mycobacterium
NVTFARPAVVGGLLTRASA

SEQ ID NO: 932280 - protein, 25 aa, Mycobacterium
NVVTCQRPVPCGAATHRVEDSTGVR

SEQ ID NO: 932281 - protein, 25 aa, Mycobacterium
NVVTWDPRGEWRSEGVMHLNSPDLE

SEQ ID NO: 932282 - protein, 18 aa, Mycobacterium
NWDDFYPAEREAATVGDK

SEQ ID NO: 932283 - protein, 23 aa, Mycobacterium
NWGARGPLQWEAPYGHTLISKYA

SEQ ID NO: 932284 - protein, 31 aa, Mycobacterium
NWLPAPKGPFTLVLRLYWPKPDALNGTWQAP

SEQ ID NO: 932285 - protein, 25 aa, Mycobacterium
NWMPCPNGTFATGYQKFILWGMDTV

SEQ ID NO: 932286 - protein, 24 aa, Mycobacterium
NWPEFRSQTAAAWLMSIARQTFDL

SEQ ID NO: 932287 - protein, 20 aa, Mycobacterium
NWQVAGMNLDLSIRDDQRSK

SEQ ID NO: 932288 - protein, 23 aa, Mycobacterium
NWQVCSSTPPPGARFTVDTDIDF

SEQ ID NO: 932289 - protein, 17 aa, Mycobacterium
NYDAGGFVSAPGQTGVV

SEQ ID NO: 932290 - protein, 25 aa, Mycobacterium
NYGGLNVYSGEWWHFDGPGADVDRP

SEQ ID NO: 932291 - protein, 26 aa, Mycobacterium
NYIVECNPLLGPELMDLAKKVAAGEP

SEQ ID NO: 932292 - protein, 23 aa, Mycobacterium
NYNKCAPLSAIIVAADTHEPQPP

SEQ ID NO: 932293 - protein, 24 aa, Mycobacterium
NYQMAVEAFVWRTYEQTIPADALE

SEQ ID NO: 932294 - protein, 22 aa, Mycobacterium
NYRVTSFDGTRIFVNFMPAKGL

SEQ ID NO: 932295 - protein, 23 aa, Mycobacterium
NYVWTEGHITYVFVPTRNLPLLQ

SEQ ID NO: 932296 - protein, 18 aa, Mycobacterium
PAAAGIALDSKGRIYVTT

SEQ ID NO: 932297 - protein, 18 aa, Mycobacterium
PAAARIPGGSGLPGGLDV

SEQ ID NO: 932298 - protein, 20 aa, Mycobacterium
PAAATQLMQGFANLMGTAPA

SEQ ID NO: 932299 - protein, 26 aa, Mycobacterium
PAADEVSALVAVQFAAHAATYQAVSA

SEQ ID NO: 932300 - protein, 21 aa, Mycobacterium
PAADGRPRYVTSIDAETATVR

SEQ ID NO: 932301 - protein, 22 aa, Mycobacterium
PAADLRKLAAYIQHEREHSTAT

SEQ ID NO: 932302 - protein, 17 aa, Mycobacterium
PAADPQGAIAFSGLYPP

SEQ ID NO: 932303 - protein, 17 aa, Mycobacterium
PAAEHKGIPAATEPVFV

SEQ ID NO: 932304 - protein, 18 aa, Mycobacterium
PAAEKFFRALAVGDTATA

SEQ ID NO: 932305 - protein, 19 aa, Mycobacterium
PAAEPIPGVASVLPANGAV

SEQ ID NO: 932306 - protein, 23 aa, Mycobacterium
PAAGDLPPLLVRSDGNGKLVATT

SEQ ID NO: 932307 - protein, 18 aa, Mycobacterium
PAALAVAGLTAFSAACLH

SEQ ID NO: 932308 - protein, 24 aa, Mycobacterium
PAALPPTPGHRLGQIVNPRWSPTG

SEQ ID NO: 932309 - protein, 18 aa, Mycobacterium
PAAMLSDRLHTWLLTTFL

SEQ ID NO: 932310 - protein, 25 aa, Mycobacterium
PAANITRLPVRYTFDNRYFSDTYEG

SEQ ID NO: 932311 - protein, 26 aa, Mycobacterium
PAANSMPFSAFPMGNYASLPTVSFVI

SEQ ID NO: 932312 - protein, 23 aa, Mycobacterium
PAAPGCAALAIAAVCSAADPPRP

SEQ ID NO: 932313 - protein, 30 aa, Mycobacterium
PAAPIACCPTCNRWRAGGWARWASRRRAWG

SEQ ID NO: 932314 - protein, 25 aa, Mycobacterium
PAARGLGVVMCFAGRVLQPLGMYKV

SEQ ID NO: 932315 - protein, 25 aa, Mycobacterium
PAARREFTEELGLPVPDGPRIDLGV

SEQ ID NO: 932316 - protein, 20 aa, Mycobacterium
PAASEWPNYGYGNVGQGNFG

SEQ ID NO: 932317 - protein, 26 aa, Mycobacterium
PAATREMIKTGGFDAVCFTSSSTVRN

SEQ ID NO: 932318 - protein, 20 aa, Mycobacterium
PAAVPAALGIRDKLAQLLMV

SEQ ID NO: 932319 - protein, 19 aa, Mycobacterium
PAAVQAFRYLVGLINRDHV

SEQ ID NO: 932320 - protein, 17 aa, Mycobacterium
PAAYLFGSRPAAPGCAA

SEQ ID NO: 932321 - protein, 18 aa, Mycobacterium
PADAALRPLMSYYADLRR

SEQ ID NO: 932322 - protein, 22 aa, Mycobacterium
PADAKALIIAPNLVAARFIQLT

SEQ ID NO: 932323 - protein, 23 aa, Mycobacterium
PADAKAVILSPTLVTSRAIQLTP

SEQ ID NO: 932324 - protein, 24 aa, Mycobacterium
PADAKAVIVASNLVSARYVQLAPA

SEQ ID NO: 932325 - protein, 24 aa, Mycobacterium
PADARCLVHQSMAQGLAAAAVALR

SEQ ID NO: 932326 - protein, 20 aa, Mycobacterium
PADDVAAWKERAGIAEGWVN

SEQ ID NO: 932327 - protein, 21 aa, Mycobacterium
PADERLRFANDPANLLAVDGP

SEQ ID NO: 932328 - protein, 23 aa, Mycobacterium
PADHAARLWHRRFLTDSDGGDRD

SEQ ID NO: 932329 - protein, 25 aa, Mycobacterium
PADLVGPIWRRHDVFEFNGSLLDSE

SEQ ID NO: 932330 - protein, 26 aa, Mycobacterium
PADLVGPIWRRNEVFEFNGSKLDSEE

SEQ ID NO: 932331 - protein, 21 aa, Mycobacterium
PADRARVLGRIAAVGPDMGAA

SEQ ID NO: 932332 - protein, 28 aa, Mycobacterium
PADVAACTFRLAELCERTASEAAVGLAE

SEQ ID NO: 932333 - protein, 18 aa, Mycobacterium
PADVRHFLDQIGGTSLPA

SEQ ID NO: 932334 - protein, 19 aa, Mycobacterium
PADVVARVFPAASVDVEPD

SEQ ID NO: 932335 - protein, 25 aa, Mycobacterium
PAEEVRAVTGLPRLLKVWDPVDSMF

SEQ ID NO: 932336 - protein, 21 aa, Mycobacterium
PAELATHLWDLTGWAVDGRRL

SEQ ID NO: 932337 - protein, 20 aa, Mycobacterium
PAELDRVRWSPGSDDTLRPL

SEQ ID NO: 932338 - protein, 18 aa, Mycobacterium
PAELGYRPATKEQPFGQN

SEQ ID NO: 932339 - protein, 21 aa, Mycobacterium
PAERFDVVVDFSRYRRGTRVR

SEQ ID NO: 932340 - protein, 24 aa, Mycobacterium
PAESPLWLVAAAALRRQIDPATTY

SEQ ID NO: 932341 - protein, 25 aa, Mycobacterium
PAEVQRLPLNVTWVNLTTGKSGSVT

SEQ ID NO: 932342 - protein, 17 aa, Mycobacterium
PAFEWFYNSGISVVMPV

SEQ ID NO: 932343 - protein, 17 aa, Mycobacterium
PAFEWYYQSGISVAMPV

SEQ ID NO: 932344 - protein, 17 aa, Mycobacterium
PAFEWYYQSGISVVMPV

SEQ ID NO: 932345 - protein, 17 aa, Mycobacterium
PAFEWYYQSGLSVIMPV

SEQ ID NO: 932346 - protein, 24 aa, Mycobacterium
PAFKGRVSLLSDVQDGLGMIMQWQ

SEQ ID NO: 932347 - protein, 17 aa, Mycobacterium
PAGAAGTARAARASRTR

SEQ ID NO: 932348 - protein, 19 aa, Mycobacterium
PAGAGCLYGGPVLSKCDGP

SEQ ID NO: 932349 - protein, 21 aa, Mycobacterium
PAGARCLVHESMAPGLKTAAD

SEQ ID NO: 932350 - protein, 17 aa, Mycobacterium
PAGEQYINFEGTPGQHG

SEQ ID NO: 932351 - protein, 18 aa, Mycobacterium
PAGFGPILRLARDEKWEE

SEQ ID NO: 932352 - protein, 22 aa, Mycobacterium
PAGGAPGDFLSAGGHFNVPGYT

SEQ ID NO: 932353 - protein, 24 aa, Mycobacterium
PAGHMPGMVDAPVLDRMKTLNGEV

SEQ ID NO: 932354 - protein, 19 aa, Mycobacterium
PAGIPLEPGIYEWRVEVEG

SEQ ID NO: 932355 - protein, 18 aa, Mycobacterium
PAGPGCRHHNCWPRPGWG

SEQ ID NO: 932356 - protein, 29 aa, Mycobacterium
PAGPNRWRVPLRPGVVFSDGTTFDPVDVV

SEQ ID NO: 932357 - protein, 19 aa, Mycobacterium
PAGQIWAGVVGQPVAPGTP

SEQ ID NO: 932358 - protein, 26 aa, Mycobacterium
PAGSVLEARTAISYVSVDGARANLAA

SEQ ID NO: 932359 - protein, 24 aa, Mycobacterium
PAGTGSLTWWVQYRKGGDSCAAAR

SEQ ID NO: 932360 - protein, 17 aa, Mycobacterium
PAGTHWTPPTGVTMPGQ

SEQ ID NO: 932361 - protein, 33 aa, Mycobacterium
PAGTRSARVTVMFKDTHWAGGAYNHSYADNLSL

SEQ ID NO: 932362 - protein, 25 aa, Mycobacterium
PAGVPRLGSFEVMYRTIDIAQAALA

SEQ ID NO: 932363 - protein, 25 aa, Mycobacterium
PAHTEAITRYGLRITGRRGDLVITD

SEQ ID NO: 932364 - protein, 22 aa, Mycobacterium
PAIAKLDPRLLAAVQNAANAAA

SEQ ID NO: 932365 - protein, 27 aa, Mycobacterium
PAIATDLDVPWGIAFLPDGSALIAERD

SEQ ID NO: 932366 - protein, 17 aa, Mycobacterium
PAIDMDTIFAGLDTLSP

SEQ ID NO: 932367 - protein, 18 aa, Mycobacterium
PAIGALSVPPSWAAGGVP

SEQ ID NO: 932368 - protein, 20 aa, Mycobacterium
PAIKGMWTVPVFGNPTGVTY

SEQ ID NO: 932369 - protein, 17 aa, Mycobacterium
PAIPAARAIGVRDNCLI

SEQ ID NO: 932370 - protein, 21 aa, Mycobacterium
PAIPDRTDVVWLEHIEDGRSA

SEQ ID NO: 932371 - protein, 18 aa, Mycobacterium
PAKCGTLADPGNGRDQSA

SEQ ID NO: 932372 - protein, 26 aa, Mycobacterium
PAKLWTIADLGGWDVVDPQLFDKGTG

SEQ ID NO: 932373 - protein, 26 aa, Mycobacterium
PAKLWTVADLGGWEAVDPQLFDKSTG

SEQ ID NO: 932374 - protein, 19 aa, Mycobacterium
PALAEGRAGYFTARSHAAP

SEQ ID NO: 932375 - protein, 19 aa, Mycobacterium
PALARIALTNAAAMLDNAD

SEQ ID NO: 932376 - protein, 20 aa, Mycobacterium
PALHGRNATEYVIKRGMSQM

SEQ ID NO: 932377 - protein, 19 aa, Mycobacterium
PALIGAAGGDPWAVNASLQ

SEQ ID NO: 932378 - protein, 22 aa, Mycobacterium
PALPRAELQAAMTRYASVVRTA

SEQ ID NO: 932379 - protein, 20 aa, Mycobacterium
PALQAAWTWAPSAVDEAQVK

SEQ ID NO: 932380 - protein, 25 aa, Mycobacterium
PALQRDNCKLIDWPIATLSPAGIRT

SEQ ID NO: 932381 - protein, 27 aa, Mycobacterium
PALQRDNCKLVSWPIATLSPNGIRTAD

SEQ ID NO: 932382 - protein, 26 aa, Mycobacterium
PALQRRWWAADGHGAFVAFNGTPPRR

SEQ ID NO: 932383 - protein, 20 aa, Mycobacterium
PALQRRWWAAHGQGAFASVD

SEQ ID NO: 932384 - protein, 24 aa, Mycobacterium
PALQRRWWAARGRGAFVSVNGAPP

SEQ ID NO: 932385 - protein, 20 aa, Mycobacterium
PALQRRWWAGRGQGAFTAVQ

SEQ ID NO: 932386 - protein, 17 aa, Mycobacterium
PALRQAISKGIDRQAIA

SEQ ID NO: 932387 - protein, 25 aa, Mycobacterium
PALTCLCGARGCWDLSVDGRALARH

SEQ ID NO: 932388 - protein, 34 aa, Mycobacterium; identical to SEQ ID NO: 145363

SEQ ID NO: 932389 - protein, 18 aa, Mycobacterium
PALVEGLRIDADRPAAPN

SEQ ID NO: 932390 - protein, 21 aa, Mycobacterium
PALVLRHIFRLIVSRTAQMPS

SEQ ID NO: 932391 - protein, 20 aa, Mycobacterium
PAMEISEKMGALPQIEGLAT

SEQ ID NO: 932392 - protein, 19 aa, Mycobacterium
PAMHMCPDVLPTVRAFLGG

SEQ ID NO: 932393 - protein, 20 aa, Mycobacterium
PAMHTEMWLHPATVDNVATL

SEQ ID NO: 932394 - protein, 18 aa, Mycobacterium
PAMVSRLSQGVPPDLPMN

SEQ ID NO: 932395 - protein, 21 aa, Mycobacterium
PANAGCQYGGIGVINKCDGPI

SEQ ID NO: 932396 - protein, 20 aa, Mycobacterium
PANAKAVIVAQNLVAARYVQ

SEQ ID NO: 932397 - protein, 43 aa, Mycobacterium
PANASFHFPMEFTPFQGGWELSRRTAEMLLALGKSPAAPAPAP

SEQ ID NO: 932398 - protein, 20 aa, Mycobacterium
PANLRDALTLAALPELRGAG

SEQ ID NO: 932399 - protein, 21 aa, Mycobacterium
PAPAPKPAAIRGSVASVSGNT

SEQ ID NO: 932400 - protein, 30 aa, Mycobacterium
PAPAPLVRQPRGPVGVILGGPAAMIDIAAK

SEQ ID NO: 932401 - protein, 18 aa, Mycobacterium
PAPAPPQSAALMLEAATP

SEQ ID NO: 932402 - protein, 17 aa, Mycobacterium
PAPDGGPVGDFNSAGDH

SEQ ID NO: 932403 - protein, 25 aa, Mycobacterium
PAPDGVKLAAGWLLERAGFGKGYPG

SEQ ID NO: 932404 - protein, 26 aa, Mycobacterium
PAPDGVKLAAGWLVERAGFAKGFPFD

SEQ ID NO: 932405 - protein, 26 aa, Mycobacterium
PAPDGVKLAAGWLVERAGFAKGYPEP

SEQ ID NO: 932406 - protein, 19 aa, Mycobacterium
PAPEPVAFEPPAPDVAPPP

SEQ ID NO: 932407 - protein, 20 aa, Mycobacterium
PAPERLRFANDPANLLAVDG

SEQ ID NO: 932408 - protein, 24 aa, Mycobacterium
PAPEVMRTLPFPVGASHSLELRYL

SEQ ID NO: 932409 - protein, 18 aa, Mycobacterium
PAPGIVFANSLAPLRPTI

SEQ ID NO: 932410 - protein, 24 aa, Mycobacterium
PAPKPSAALPQTWGSCGQFGTDTS

SEQ ID NO: 932411 - protein, 18 aa, Mycobacterium
PAPLDYAAGGGYAPYETA

SEQ ID NO: 932412 - protein, 19 aa, Mycobacterium
PAPLGEEWGACRATFVDQN

SEQ ID NO: 932413 - protein, 18 aa, Mycobacterium
PAPNLKLRPLSGATVSKV

SEQ ID NO: 932414 - protein, 17 aa, Mycobacterium
PAPPAFLLLGPDALMAY

SEQ ID NO: 932415 - protein, 17 aa, Mycobacterium
PAPPGTTLVGWVTGPES

SEQ ID NO: 932416 - protein, 22 aa, Mycobacterium
PAPQHREFTQAALVTDLPGELM

SEQ ID NO: 932417 - protein, 18 aa, Mycobacterium
PAPRGHRVLAPGMSSGRV

SEQ ID NO: 932418 - protein, 21 aa, Mycobacterium
PAPSAAPTHVVFKDTPGGGGC

SEQ ID NO: 932419 - protein, 18 aa, Mycobacterium
PAQAPRVAIAVFVENGGD

SEQ ID NO: 932420 - protein, 20 aa, Mycobacterium
PAQATARYRAMVDPLVDHPA

SEQ ID NO: 932421 - protein, 19 aa, Mycobacterium
PAQGCTYWNGEAMQGVDFK

SEQ ID NO: 932422 - protein, 19 aa, Mycobacterium
PAQPSGCAAHDYPAAMPKG

SEQ ID NO: 932423 - protein, 18 aa, Mycobacterium
PARAWFEAMKPIADNYGP

SEQ ID NO: 932424 - protein, 24 aa, Mycobacterium
PARKLREIRIALALDNALSKGEIL

SEQ ID NO: 932425 - protein, 27 aa, Mycobacterium
PARKLREIRMALTLDKTFTKPEILTRY

SEQ ID NO: 932426 - protein, 30 aa, Mycobacterium
PARKRRRVMQFYKECVRRQLVLNGPGKTHL

SEQ ID NO: 932427 - protein, 18 aa, Mycobacterium
PARSAAIIRLRAKDFHGT

SEQ ID NO: 932428 - protein, 17 aa, Mycobacterium
PARTWFSAMQPIATAFG

SEQ ID NO: 932429 - protein, 17 aa, Mycobacterium
PARTWFTAMKPIATSFG

SEQ ID NO: 932430 - protein, 19 aa, Mycobacterium
PARVWQDVIAFPRNADPGK

SEQ ID NO: 932431 - protein, 26 aa, Mycobacterium
PASAAPDCPDLHWIGVAGSGERDNPT

SEQ ID NO: 932432 - protein, 20 aa, Mycobacterium
PASAPAEWIERLTAAAEEGR

SEQ ID NO: 932433 - protein, 18 aa, Mycobacterium
PASAVVRVSGLSPAGEQY

SEQ ID NO: 932434 - protein, 24 aa, Mycobacterium
PASDFPRYPLNLLADLNALMSTGR

SEQ ID NO: 932435 - protein, 17 aa, Mycobacterium
PASFRVRSGASLAGNSR

SEQ ID NO: 932436 - protein, 25 aa, Mycobacterium
PASNITRLPVRYTFDNRYFSDTYEG

SEQ ID NO: 932437 - protein, 27 aa, Mycobacterium
PASNMSVAYVFPGWLDIGSANKNLTAV

SEQ ID NO: 932438 - protein, 25 aa, Mycobacterium
PASRYFGPNLSRLSAVRQKYDPGRV

SEQ ID NO: 932439 - protein, 20 aa, Mycobacterium
PASTIKVLLALVALDELDLN

SEQ ID NO: 932440 - protein, 25 aa, Mycobacterium
PASYDASLRVSWRQLQPVDPRTLPP

SEQ ID NO: 932441 - protein, 18 aa, Mycobacterium
PATAMGGAAPALLSVSMA

SEQ ID NO: 932442 - protein, 27 aa, Mycobacterium
PATASRWRVLNIPKLLPAGRAPESGLQ

SEQ ID NO: 932443 - protein, 18 aa, Mycobacterium
PATCNLRSADNHGAVLLA

SEQ ID NO: 932444 - protein, 17 aa, Mycobacterium
PATEHRYLDASYYAKIG

SEQ ID NO: 932445 - protein, 24 aa, Mycobacterium
PATFPTYYRWDVYYVTTAGDVLLP

SEQ ID NO: 932446 - protein, 23 aa, Mycobacterium
PATGPRIGVLVVNPGGPGASAVD

SEQ ID NO: 932447 - protein, 19 aa, Mycobacterium
PATKCPDMGPNVPVAPTDP

SEQ ID NO: 932448 - protein, 18 aa, Mycobacterium
PATLGYRPLTMDFRLTHL

SEQ ID NO: 932449 - protein, 25 aa, Mycobacterium
PATPDPRPAPVVPDVNVPGVNVPDV

SEQ ID NO: 932450 - protein, 30 aa, Mycobacterium
PATPNGGFFTRFPGITIPWLDITFTEATPP

SEQ ID NO: 932451 - protein, 32 aa, Mycobacterium
PAVADDFRLQWPLRPAPAVVRGYDAPAPNWHP

SEQ ID NO: 932452 - protein, 19 aa, Mycobacterium
PAVCAVLLLAAVSFWSATA

SEQ ID NO: 932453 - protein, 19 aa, Mycobacterium
PAVRASLYSDPQFQAKYPM

SEQ ID NO: 932454 - protein, 18 aa, Mycobacterium
PAVRMLKLGGRAALPTYF

SEQ ID NO: 932455 - protein, 18 aa, Mycobacterium
PAVRTSLYDDPAFQKKYP

SEQ ID NO: 932456 - protein, 23 aa, Mycobacterium
PAVYRFSENPTFTRDVDVLPEGH

SEQ ID NO: 932457 - protein, 18 aa, Mycobacterium
PAWGTPRASAGPDVPPVS

SEQ ID NO: 932458 - protein, 25 aa, Mycobacterium
PAWLEPGQWWALVRIGCAGRLVYSP

SEQ ID NO: 932459 - protein, 19 aa, Mycobacterium
PAYAGRPAAGWAPGLGERD

SEQ ID NO: 932460 - protein, 21 aa, Mycobacterium
PAYNTGGPWGYSPKGATGVPV

SEQ ID NO: 932461 - protein, 19 aa, Mycobacterium
PCASVRRVVEQVCGALPDV

SEQ ID NO: 932462 - protein, 17 aa, Mycobacterium
PCATRPAPLTWKQSVAP

SEQ ID NO: 932463 - protein, 18 aa, Mycobacterium
PCAVEGFEAVRARLKARA

SEQ ID NO: 932464 - protein, 18 aa, Mycobacterium
PCDAPDWLDAALGNAPQG

SEQ ID NO: 932465 - protein, 17 aa, Mycobacterium
PCDRVRRVVTQVCDDLG

SEQ ID NO: 932466 - protein, 20 aa, Mycobacterium
PCLTGFIPASEWRSFADTSL

SEQ ID NO: 932467 - protein, 17 aa, Mycobacterium
PDADGSVVFGFNRLSII

SEQ ID NO: 932468 - protein, 27 aa, Mycobacterium
PDAGDACVLWCTTIRRAVRTGELDARA

SEQ ID NO: 932469 - protein, 20 aa, Mycobacterium
PDAKPSALLDHETRRVSEID

SEQ ID NO: 932470 - protein, 17 aa, Mycobacterium
PDAPVIYTGPLDRYFDY

SEQ ID NO: 932471 - protein, 26 aa, Mycobacterium
PDAQRYHRLATYPVHLNKPATDPVDA

SEQ ID NO: 932472 - protein, 20 aa, Mycobacterium
PDARWGNWRDAPALTKGDTA

SEQ ID NO: 932473 - protein, 18 aa, Mycobacterium
PDASKWVVAKARETIKDP

SEQ ID NO: 932474 - protein, 24 aa, Mycobacterium
PDAVGGNYVHWIVIGIPPGAGSSA

SEQ ID NO: 932475 - protein, 18 aa, Mycobacterium
PDCLGAVYGAEAPVYEGT

SEQ ID NO: 932476 - protein, 17 aa, Mycobacterium
PDCQPSPGWDWAEISGS

SEQ ID NO: 932477 - protein, 17 aa, Mycobacterium
PDDPEFHPPRLGDLRQS

SEQ ID NO: 932478 - protein, 23 aa, Mycobacterium
PDDRREAVLHAFATRVPNQRLPF

SEQ ID NO: 932479 - protein, 24 aa, Mycobacterium
PDDTPWGGKPVRKLELPRDAVLVA

SEQ ID NO: 932480 - protein, 23 aa, Mycobacterium
PDDTPWGGKPVRKLQLPRDAVLV

SEQ ID NO: 932481 - protein, 24 aa, Mycobacterium
PDDTPWGGKPVRRLQLPRDASLVT

SEQ ID NO: 932482 - protein, 25 aa, Mycobacterium
PDDVIDALIAWAPRHLVTAYDAVAA

SEQ ID NO: 932483 - protein, 19 aa, Mycobacterium
PDEAVAVAVCLRVAAGGSV

SEQ ID NO: 932484 - protein, 28 aa, Mycobacterium
PDELVTFYSCLYRSLLHPNTFNDADGRY

SEQ ID NO: 932485 - protein, 18 aa, Mycobacterium
PDEVELALLRKLDGDLDI

SEQ ID NO: 932486 - protein, 19 aa, Mycobacterium
PDEVLSLRFHEIFHQCPDS

SEQ ID NO: 932487 - protein, 28 aa, Mycobacterium
PDGGILSRFPGFYIPFLDVPFNGATPPN

SEQ ID NO: 932488 - protein, 18 aa, Mycobacterium
PDGGVGGDGGDPGAGGAG

SEQ ID NO: 932489 - protein, 18 aa, Mycobacterium
PDGHIAWIGTGLAVDPVE

SEQ ID NO: 932490 - protein, 19 aa, Mycobacterium
PDGKLYWGVGDNASGSNAQ

SEQ ID NO: 932491 - protein, 23 aa, Mycobacterium
PDGPRRLAVSLFYPAEQPSPDDR

SEQ ID NO: 932492 - protein, 19 aa, Mycobacterium
PDGRHCGIGPNGGPIGCDA

SEQ ID NO: 932493 - protein, 21 aa, Mycobacterium
PDGRVGFVDFGLCTDMDPYDA

SEQ ID NO: 932494 - protein, 17 aa, Mycobacterium
PDGSLWFTTSNRDGRGS

SEQ ID NO: 932495 - protein, 18 aa, Mycobacterium
PDGSYAPTQEKYVFNDET

SEQ ID NO: 932496 - protein, 22 aa, Mycobacterium
PDGTAAPGLQVFRFKPMTPNGA

SEQ ID NO: 932497 - protein, 20 aa, Mycobacterium
PDGTQSVAMYLGNNQMLEVG

SEQ ID NO: 932498 - protein, 22 aa, Mycobacterium
PDGTSAPGLQVFRFKAMNAEGA

SEQ ID NO: 932499 - protein, 25 aa, Mycobacterium
PDGVSWASAEPLGYNKQYTLQAQAH

SEQ ID NO: 932500 - protein, 17 aa, Mycobacterium
PDHARVLTGVPGASKTD

SEQ ID NO: 932501 - protein, 19 aa, Mycobacterium
PDHTGFPASGDLTALQVRN

SEQ ID NO: 932502 - protein, 20 aa, Mycobacterium
PDIANAGLLPLAVSVDEEGG

SEQ ID NO: 932503 - protein, 37 aa, Mycobacterium
PDIEGLAERWGRDVLHCVYCHGWEVRDRTIAVLGTGP

SEQ ID NO: 932504 - protein, 24 aa, Mycobacterium
PDIKVLAKDTANWKRDEAVNKMKN

SEQ ID NO: 932505 - protein, 28 aa, Mycobacterium
PDIPAGQDFTYRFSVPNSGTYWAHPHTG

SEQ ID NO: 932506 - protein, 18 aa, Mycobacterium
PDIRGLDSYTGHKIHSAR

SEQ ID NO: 932507 - protein, 25 aa, Mycobacterium
PDKPKLRPLLDVLPIAGGSGTLSER

SEQ ID NO: 932508 - protein, 21 aa, Mycobacterium
PDKRVGAIFIDGGPLHVCTGS

SEQ ID NO: 932509 - protein, 20 aa, Mycobacterium
PDKTPEGFYERTLAGKPLPS

SEQ ID NO: 932510 - protein, 20 aa, Mycobacterium
PDLFGPLGVDFVPHTRFTYR

SEQ ID NO: 932511 - protein, 17 aa, Mycobacterium
PDLGKRVDQRFADVEAL

SEQ ID NO: 932512 - protein, 18 aa, Mycobacterium
PDLGYRPATVQQPLGQNV

SEQ ID NO: 932513 - protein, 17 aa, Mycobacterium
PDLIVAINAGVDADTYQ

SEQ ID NO: 932514 - protein, 17 aa, Mycobacterium
PDLPPPAPDAMIAPVDM

SEQ ID NO: 932515 - protein, 25 aa, Mycobacterium
PDLQFVILVGAAVNWLRQGEFNTRA

SEQ ID NO: 932516 - protein, 18 aa, Mycobacterium
PDLSREVIEAAVQREIEA

SEQ ID NO: 932517 - protein, 17 aa, Mycobacterium
PDLTGFVNMGFSQDNPS

SEQ ID NO: 932518 - protein, 25 aa, Mycobacterium
PDLTVSIPTPAGWTVASNPHIAKET

SEQ ID NO: 932519 - protein, 23 aa, Mycobacterium
PDLVVSAGFMKILGPQFLSRFYG

SEQ ID NO: 932520 - protein, 28 aa, Mycobacterium
PDMARQWARCLDMYLWLQQQVDAQIGRV

SEQ ID NO: 932521 - protein, 17 aa, Mycobacterium
PDMPADLQGNMSAVTAE

SEQ ID NO: 932522 - protein, 17 aa, Mycobacterium
PDMQQVLLASNTTAQPA

SEQ ID NO: 932523 - protein, 18 aa, Mycobacterium
PDMRTCLQESYQTRLAQL

SEQ ID NO: 932524 - protein, 26 aa, Mycobacterium
PDMTKGYCPGGRWGWGELAVCDGEKY

SEQ ID NO: 932525 - protein, 27 aa, Mycobacterium
PDMTKGYCPGGRWGWGELAVCDGEKYP

SEQ ID NO: 932526 - protein, 27 aa, Mycobacterium
PDNPLPCAGVLEGPFGGFGFPAPLDGV

SEQ ID NO: 932527 - protein, 20 aa, Mycobacterium
PDNPSLLVGMFASPKVTTGT

SEQ ID NO: 932528 - protein, 23 aa, Mycobacterium
PDPADWFAAHGWTTDSVQAGAEA

SEQ ID NO: 932529 - protein, 22 aa, Mycobacterium
PDPAGLPSVFVYDGYPGGAGFA

SEQ ID NO: 932530 - protein, 21 aa, Mycobacterium
PDPLRFSGITMFRGAGRMAAF

SEQ ID NO: 932531 - protein, 19 aa, Mycobacterium
PDPNRWRLNGTADYVADAD

SEQ ID NO: 932532 - protein, 21 aa, Mycobacterium
PDQRVVLYAAERGCTHPGCDA

SEQ ID NO: 932533 - protein, 23 aa, Mycobacterium
PDRARELILEFADFTRYSFRAAG

SEQ ID NO: 932534 - protein, 18 aa, Mycobacterium
PDRPTAWALEGLLPYLPG

SEQ ID NO: 932535 - protein, 18 aa, Mycobacterium
PDRVRAMVLDGAIDPALN

SEQ ID NO: 932536 - protein, 19 aa, Mycobacterium
PDSAVTVRIYLNDKVVCQS

SEQ ID NO: 932537 - protein, 26 aa, Mycobacterium
PDSNPPTARRVMMWPSADGSCVREHP

SEQ ID NO: 932538 - protein, 18 aa, Mycobacterium
PDSRAVVYDRLAKADFGQ

SEQ ID NO: 932539 - protein, 18 aa, Mycobacterium
PDSSKWAVAKARETIKDP

SEQ ID NO: 932540 - protein, 26 aa, Mycobacterium
PDSVNCPNDLPAKVGAQLNCEMKVKN

SEQ ID NO: 932541 - protein, 18 aa, Mycobacterium
PDTESMLLADIYVAALRS

SEQ ID NO: 932542 - protein, 23 aa, Mycobacterium
PDTKIFADERWRSHHDRMSELGF

SEQ ID NO: 932543 - protein, 22 aa, Mycobacterium
PDTLTADVAIEFTAADVTSAMN

SEQ ID NO: 932544 - protein, 24 aa, Mycobacterium
PDTLTADVGIEFTAPDVTTAMNQT

SEQ ID NO: 932545 - protein, 20 aa, Mycobacterium
PDTLTAQVGIEFTSQDVTGA

SEQ ID NO: 932546 - protein, 19 aa, Mycobacterium
PDTPVACPGELTIENRTIP

SEQ ID NO: 932547 - protein, 18 aa, Mycobacterium
PDTRIVLGGFSQGAVVSG

SEQ ID NO: 932548 - protein, 17 aa, Mycobacterium
PDTRLVLGGYSLGAAVT

SEQ ID NO: 932549 - protein, 23 aa, Mycobacterium
PDTVVNMAARYGAPRKDNFYRIQ

SEQ ID NO: 932550 - protein, 24 aa, Mycobacterium
PDVAANWPLRQLITNTGWGTGLDI

SEQ ID NO: 932551 - protein, 17 aa, Mycobacterium
PDVEVVFARGSGEPPGI

SEQ ID NO: 932552 - protein, 27 aa, Mycobacterium
PDVKNAVRFAFWGAEEEGLIGSTDYVK

SEQ ID NO: 932553 - protein, 20 aa, Mycobacterium
PDVPAPRWWFTVGGAVQKGE

SEQ ID NO: 932554 - protein, 18 aa, Mycobacterium
PDWAGPRKDTVIVLPGQN

SEQ ID NO: 932555 - protein, 21 aa, Mycobacterium
PDWDPNVCHTYYFAPDSGLPA

SEQ ID NO: 932556 - protein, 25 aa, Mycobacterium
PDWPHIGVALMRPRARGRITLISAD

SEQ ID NO: 932557 - protein, 30 aa, Mycobacterium
PDWVAVREIERFFKAFLRPPAEEETGDEQE

SEQ ID NO: 932558 - protein, 25 aa, Mycobacterium
PDYERMMAMLTGFWVTQIVRAAAVF

SEQ ID NO: 932559 - protein, 25 aa, Mycobacterium
PDYRAGCKRLIISGNFYQAIQRPNA

SEQ ID NO: 932560 - protein, 22 aa, Mycobacterium
PDYVHLWAGTGYRDATAEPTSD

SEQ ID NO: 932561 - protein, 17 aa, Mycobacterium
PEAASLPLHEWNTEFSW

SEQ ID NO: 932562 - protein, 18 aa, Mycobacterium
PEAASSLRSYFTGHPQEY

SEQ ID NO: 932563 - protein, 20 aa, Mycobacterium
PEADSGPLLDVTKIIDDQTT

SEQ ID NO: 932564 - protein, 20 aa, Mycobacterium
PEAFAQVLVGWQNWLRTADR

SEQ ID NO: 932565 - protein, 25 aa, Mycobacterium
PEAFSGNGYMLLGLEITGLAQRYRD

SEQ ID NO: 932566 - protein, 26 aa, Mycobacterium
PEAPTGIATVRFRIGDDGRLVAVDPL

SEQ ID NO: 932567 - protein, 23 aa, Mycobacterium
PEARYGRARLSSRSRRRLAIALS

SEQ ID NO: 932568 - protein, 23 aa, Mycobacterium
PEDLRFGLYGALAHPIEATGIGA

SEQ ID NO: 932569 - protein, 21 aa, Mycobacterium
PEDPRMLSIAQFWQRTAGDNR

SEQ ID NO: 932570 - protein, 20 aa, Mycobacterium
PEEEAPMFALLAGYQYHSAA

SEQ ID NO: 932571 - protein, 18 aa, Mycobacterium
PEERTTWTGAAMILAADA

SEQ ID NO: 932572 - protein, 20 aa, Mycobacterium
PEEVLERFDIVGFDPRGVAN

SEQ ID NO: 932573 - protein, 35 aa, Mycobacterium
PEFINRLDDVIVFAGLEPGELVAIVDIQLAQLQKR

SEQ ID NO: 932574 - protein, 25 aa, Mycobacterium
PEFINRLDDVLIFDALNPDELVQIV

SEQ ID NO: 932575 - protein, 24 aa, Mycobacterium
PEFINRLDDVLIFEGLNPEELVQI

SEQ ID NO: 932576 - protein, 17 aa, Mycobacterium
PEFLFVDLIDPCVVRNL

SEQ ID NO: 932577 - protein, 18 aa, Mycobacterium
PEGDRWEWYGYPLEATSV

SEQ ID NO: 932578 - protein, 23 aa, Mycobacterium
PEGKVLPGYGWMFPLGNGEVNIG

SEQ ID NO: 932579 - protein, 18 aa, Mycobacterium
PEGLTFDPAHCAKSAMGP

SEQ ID NO: 932580 - protein, 20 aa, Mycobacterium
PEGPVPPVIRYGAMAYAPSG

SEQ ID NO: 932581 - protein, 24 aa, Mycobacterium
PEGQKLWAEAGFRPVDPAVQAEFA

SEQ ID NO: 932582 - protein, 17 aa, Mycobacterium
PEGVAARIGNDFEGVCT

SEQ ID NO: 932583 - protein, 32 aa, Mycobacterium
PEHPNVLSIAEFWRRCAGPMRLTAERVAVIGG

SEQ ID NO: 932584 - protein, 25 aa, Mycobacterium
PEHRNGAVMGILWAGIFRYQQMTEH

SEQ ID NO: 932585 - protein, 21 aa, Mycobacterium
PEHRSGIEFDPPLPAEHRELS

SEQ ID NO: 932586 - protein, 20 aa, Mycobacterium
PEHSFPVAVGPAQSFEFSVA

SEQ ID NO: 932587 - protein, 18 aa, Mycobacterium
PEHSFTWDTTLRVRAALT

SEQ ID NO: 932588 - protein, 19 aa, Mycobacterium
PEHTFAWDTALRVRQELNA

SEQ ID NO: 932589 - protein, 21 aa, Mycobacterium
PEIDIGSAVAYLIGPAARYVT

SEQ ID NO: 932590 - protein, 22 aa, Mycobacterium
PEINILNVFLVQWDENPDIRTG

SEQ ID NO: 932591 - protein, 19 aa, Mycobacterium
PEINSVLMFAGAGSEPMLL

SEQ ID NO: 932592 - protein, 21 aa, Mycobacterium
PEIPPAVSAYTGLPGDPVGPP

SEQ ID NO: 932593 - protein, 24 aa, Mycobacterium
PEKLWTIADLGGWDTVDPQLFDKG

SEQ ID NO: 932594 - protein, 25 aa, Mycobacterium
PEKLWTIDDLGGWKNVDTQLFDKDN

SEQ ID NO: 932595 - protein, 20 aa, Mycobacterium
PELADLTALLDRARADSALA

SEQ ID NO: 932596 - protein, 17 aa, Mycobacterium
PELAPLLHAVWSSLAFD

SEQ ID NO: 932597 - protein, 19 aa, Mycobacterium
PELDSLLWHQGEDHEWLKG

SEQ ID NO: 932598 - protein, 25 aa, Mycobacterium
PELGLPVCLMGSVSGETCGKVEAIN

SEQ ID NO: 932599 - protein, 26 aa, Mycobacterium
PELGLRPRLAIGIFQPAPDERRAPTF

SEQ ID NO: 932600 - protein, 24 aa, Mycobacterium
PELGLRPRLAVGIYQPAVDPSRPP

SEQ ID NO: 932601 - protein, 30 aa, Mycobacterium
PELNAALDGRWDRNWLLGWRDITNASNERT

SEQ ID NO: 932602 - protein, 26 aa, Mycobacterium
PELPDWAEGLAVVWNPDLSAWGVWNG

SEQ ID NO: 932603 - protein, 23 aa, Mycobacterium
PELRPENFLHGSFQDIPRDKALL

SEQ ID NO: 932604 - protein, 20 aa, Mycobacterium
PEMAQVVGAAKGIALDNARD

SEQ ID NO: 932605 - protein, 23 aa, Mycobacterium
PENRVEVIEGMKILYADDDLVAV

SEQ ID NO: 932606 - protein, 18 aa, Mycobacterium
PENVFLAANVVPLVASQK

SEQ ID NO: 932607 - protein, 32 aa, Mycobacterium
PENYKRAEICRQRMGPVLKRITMNYPPVLFHP

SEQ ID NO: 932608 - protein, 27 aa, Mycobacterium
PEPALRLVAVARLRLLCRAAGITEVSA

SEQ ID NO: 932609 - protein, 20 aa, Mycobacterium
PEPAPAIDFVPPLTPDQQRT

SEQ ID NO: 932610 - protein, 17 aa, Mycobacterium
PEPARPEVRVFNISETP

SEQ ID NO: 932611 - protein, 18 aa, Mycobacterium
PEPDRMRFTLLGNPSRRL

SEQ ID NO: 932612 - protein, 25 aa, Mycobacterium
PEPERVKISFWYDDRYDVPADAAAA

SEQ ID NO: 932613 - protein, 30 aa, Mycobacterium
PEPPARSTSLWTVLTAAWRQPGRSGTDATA

SEQ ID NO: 932614 - protein, 19 aa, Mycobacterium
PEPVIKVWAGEVGIDDQHV

SEQ ID NO: 932615 - protein, 22 aa, Mycobacterium
PEQIKAAGYAGALVYVSELRPG

SEQ ID NO: 932616 - protein, 31 aa, Mycobacterium
PEQQYSWRIMPENLEDAGISWKVYQSKDAGR

SEQ ID NO: 932617 - protein, 18 aa, Mycobacterium
PEQSAPVPPVMAPPEPPE

SEQ ID NO: 932618 - protein, 20 aa, Mycobacterium
PERAEIKVPLLRDAASLTDG

SEQ ID NO: 932619 - protein, 17 aa, Mycobacterium
PERDYPDDKTVIMREYS

SEQ ID NO: 932620 - protein, 20 aa, Mycobacterium
PEREIGWGSGAWVNASSKVR

SEQ ID NO: 932621 - protein, 22 aa, Mycobacterium
PERLPEGSVIPVERTEPSFDVG

SEQ ID NO: 932622 - protein, 19 aa, Mycobacterium
PERLTAADALSWGLVTAVY

SEQ ID NO: 932623 - protein, 23 aa, Mycobacterium
PERSAELLRVFLLGELPPEQARE

SEQ ID NO: 932624 - protein, 20 aa, Mycobacterium
PESFAQVLVGWQNWLRTADR

SEQ ID NO: 932625 - protein, 20 aa, Mycobacterium
PESFIRTGGDVTFSLSTIPN

SEQ ID NO: 932626 - protein, 18 aa, Mycobacterium
PESIKAAGHLGAIRYVSD

SEQ ID NO: 932627 - protein, 19 aa, Mycobacterium
PESLLLPREDFPAGAGTYE

SEQ ID NO: 932628 - protein, 20 aa, Mycobacterium
PESYRAYAAIVQRDADRFGL

SEQ ID NO: 932629 - protein, 17 aa, Mycobacterium
PETAQGIFVNFANIVTT

SEQ ID NO: 932630 - protein, 20 aa, Mycobacterium
PETTRVALIGPHVVAGIQVY

SEQ ID NO: 932631 - protein, 18 aa, Mycobacterium
PEVAFAMVQLGLAFDDMN

SEQ ID NO: 932632 - protein, 18 aa, Mycobacterium
PEVAHAPAAAAAPGPAPA

SEQ ID NO: 932633 - protein, 26 aa, Mycobacterium
PEVANAVRFAFWGAEEDGLRGSNNYV

SEQ ID NO: 932634 - protein, 21 aa, Mycobacterium
PEVLCHALARVRRRAQLLVWL

SEQ ID NO: 932635 - protein, 18 aa, Mycobacterium
PEYKEASAAFGQVTLDSI

SEQ ID NO: 932636 - protein, 19 aa, Mycobacterium
PFAGGFGLASNRASDVVAN

SEQ ID NO: 932637 - protein, 25 aa, Mycobacterium
PFDRDRTGFVFGEAGALLVIETEEH

SEQ ID NO: 932638 - protein, 19 aa, Mycobacterium
PFGETKGFLDFLISTPEGI

SEQ ID NO: 932639 - protein, 17 aa, Mycobacterium
PFGGFGFPAPLDGVESS

SEQ ID NO: 932640 - protein, 19 aa, Mycobacterium
PFGPVALTLNGTVDLTTFQ

SEQ ID NO: 932641 - protein, 23 aa, Mycobacterium
PFGRPVPDLPIGVTDYATAVRVH

SEQ ID NO: 932642 - protein, 21 aa, Mycobacterium
PFLYTYCRDDDPAILVRGAKN

SEQ ID NO: 932643 - protein, 31 aa, Mycobacterium
PFMPEDWKVGLDVYPGAYIPPSVKDQYDPET

SEQ ID NO: 932644 - protein, 17 aa, Mycobacterium
PFNRRVALATLGLGVLA

SEQ ID NO: 932645 - protein, 23 aa, Mycobacterium
PFPGSDGKYHLAFDVQITNATGG

SEQ ID NO: 932646 - protein, 18 aa, Mycobacterium
PFPHFRHPIPGPGHGPVT

SEQ ID NO: 932647 - protein, 28 aa, Mycobacterium
PFPKACPAPGVMQGCLESTSGLIMGPDS

SEQ ID NO: 932648 - protein, 27 aa, Mycobacterium
PFPPVLTEFLAIPWVVPNWPPGVLRPD

SEQ ID NO: 932649 - protein, 23 aa, Mycobacterium
PFQHVEKFIPRQITNILTGRRPK

SEQ ID NO: 932650 - protein, 24 aa, Mycobacterium
PFSEPEVFDFPGGIGPVECVNVEH

SEQ ID NO: 932651 - protein, 17 aa, Mycobacterium
PFSHGGFDDLSYDDSFE

SEQ ID NO: 932652 - protein, 18 aa, Mycobacterium
PFTLQFPSVMSLVASLDF

SEQ ID NO: 932653 - protein, 18 aa, Mycobacterium
PFTLTFKEPLPIPVKTYP

SEQ ID NO: 932654 - protein, 19 aa, Mycobacterium
PFTVDRWTPDKVYSGGYKA

SEQ ID NO: 932655 - protein, 18 aa, Mycobacterium
PFTVDRWTPDNVFSGGYK

SEQ ID NO: 932656 - protein, 19 aa, Mycobacterium
PFVPERWTPDKVYSGGYKA

SEQ ID NO: 932657 - protein, 18 aa, Mycobacterium
PFVRSNIVGTFTILEAVR

SEQ ID NO: 932658 - protein, 18 aa, Mycobacterium
PGAALALLAEAGEIDVLV

SEQ ID NO: 932659 - protein, 18 aa, Mycobacterium
PGAAVPVIRVVRGAVLVI

SEQ ID NO: 932660 - protein, 23 aa, Mycobacterium
PGADGRPRYVTAIDAETGTVRVG

SEQ ID NO: 932661 - protein, 23 aa, Mycobacterium
PGADKPVLVGLRYQQGQTPQLTR

SEQ ID NO: 932662 - protein, 19 aa, Mycobacterium
PGADLRAAYNDFAAEMVAR

SEQ ID NO: 932663 - protein, 18 aa, Mycobacterium
PGAITYNEWSFAKAQNLS

SEQ ID NO: 932664 - protein, 26 aa, Mycobacterium
PGAQKRSVLVYDVPRGTVPKEIDLHS

SEQ ID NO: 932665 - protein, 18 aa, Mycobacterium
PGARLARGGVPVYESAVL

SEQ ID NO: 932666 - protein, 27 aa, Mycobacterium
PGATAFPWRRQSALVQWYVETPGSPAA

SEQ ID NO: 932667 - protein, 21 aa, Mycobacterium
PGAVREVLAWMGSREGNEFLG

SEQ ID NO: 932668 - protein, 30 aa, Mycobacterium
PGCDDFKKAVPSWKALNDVPVSQALAAIPE

SEQ ID NO: 932669 - protein, 25 aa, Mycobacterium
PGCGVSWNLLAGIGRIESMHANGGQ

SEQ ID NO: 932670 - protein, 25 aa, Mycobacterium
PGCGVSWNLLAGIGRIESMHSYGGA

SEQ ID NO: 932671 - protein, 25 aa, Mycobacterium
PGDAKTRFSAPMPVGRNLQISRKDD

SEQ ID NO: 932672 - protein, 23 aa, Mycobacterium
PGDECKRVKFLGTGARGQVDVVE

SEQ ID NO: 932673 - protein, 20 aa, Mycobacterium
PGDEVRILGVPVGRIDSIEP

SEQ ID NO: 932674 - protein, 22 aa, Mycobacterium
PGDIGLHGPHRYNWNQFIGSLK

SEQ ID NO: 932675 - protein, 21 aa, Mycobacterium
PGDKISLTFSDPAGGGSRTLP

SEQ ID NO: 932676 - protein, 28 aa, Mycobacterium
PGDLCSFPLRKCGDGNLYGGNEPARAWF

SEQ ID NO: 932677 - protein, 21 aa, Mycobacterium
PGDLHWDRILFCAKEATYKAW

SEQ ID NO: 932678 - protein, 23 aa, Mycobacterium
PGDPRYPYRPPLPQPPPGGPPPG

SEQ ID NO: 932679 - protein, 24 aa, Mycobacterium
PGDSRGVSYLKDIVFAMQTQDVKA

SEQ ID NO: 932680 - protein, 25 aa, Mycobacterium
PGDYAEVALPWTYEGTGVPETAFYL

SEQ ID NO: 932681 - protein, 18 aa, Mycobacterium
PGDYGRIGTVKGHDDSAV

SEQ ID NO: 932682 - protein, 23 aa, Mycobacterium
PGECVSLVKRFLLDVHGITAGAW

SEQ ID NO: 932683 - protein, 25 aa, Mycobacterium
PGEGFLGVDTFRVMAIDAGLHVNLL

SEQ ID NO: 932684 - protein, 19 aa, Mycobacterium
PGEHMIAAGWAMPRVLRWM

SEQ ID NO: 932685 - protein, 20 aa, Mycobacterium
PGEPEAAIQVGHEICKAVEA

SEQ ID NO: 932686 - protein, 19 aa, Mycobacterium
PGEVAAFLDLWDRGLAEWR

SEQ ID NO: 932687 - protein, 28 aa, Mycobacterium
PGEWVKGVPIGGGFRVPAIVISPWSVGG

SEQ ID NO: 932688 - protein, 19 aa, Mycobacterium
PGFHGMHVHEFGKCEPNSV

SEQ ID NO: 932689 - protein, 25 aa, Mycobacterium
PGFRCTPQPGFFCDYDMLVAGAPQV

SEQ ID NO: 932690 - protein, 30 aa, Mycobacterium
PGGAGAQCQNRWVVCGGTYNPPSSSLAPEN

SEQ ID NO: 932691 - protein, 18 aa, Mycobacterium
PGGDGWTVARRGRVVAFV

SEQ ID NO: 932692 - protein, 25 aa, Mycobacterium
PGGEVLRPQNGYVFIQTKSGKTRCQ

SEQ ID NO: 932693 - protein, 20 aa, Mycobacterium
PGGFREVLEVAASYGKPLWV

SEQ ID NO: 932694 - protein, 21 aa, Mycobacterium
PGGGPAERWHRGVPFDLSLMI

SEQ ID NO: 932695 - protein, 22 aa, Mycobacterium
PGGGRRWDGWDPSLPQIPSANI

SEQ ID NO: 932696 - protein, 17 aa, Mycobacterium
PGGIAELQLSRDGTRAA

SEQ ID NO: 932697 - protein, 17 aa, Mycobacterium
PGGLHNWTYWGNQLKAM

SEQ ID NO: 932698 - protein, 20 aa, Mycobacterium
PGGLVPHVIPLASLDIAKGG

SEQ ID NO: 932699 - protein, 20 aa, Mycobacterium
PGGMPTRASSTFTTVTPTYQ

SEQ ID NO: 932700 - protein, 23 aa, Mycobacterium
PGGQAQFAAPIWTPRARRDEIRL

SEQ ID NO: 932701 - protein, 24 aa, Mycobacterium
PGGQSQFAAPVWMPRAKRMPIRDV

SEQ ID NO: 932702 - protein, 23 aa, Mycobacterium
PGGQTQFAAPVWMPRARRSPIRD

SEQ ID NO: 932703 - protein, 18 aa, Mycobacterium
PGGRVEGRLVPARAEESP

SEQ ID NO: 932704 - protein, 17 aa, Mycobacterium
PGGSHSWFAGYRGDLAF

SEQ ID NO: 932705 - protein, 29 aa, Mycobacterium
PGGSHSWFAGYRGDLAFASLIVGGGSSEY

SEQ ID NO: 932706 - protein, 19 aa, Mycobacterium
PGGSISIGFQAELTGAYSP

SEQ ID NO: 932707 - protein, 25 aa, Mycobacterium
PGGVDWSGVVPFGISEIGLEPAVAN

SEQ ID NO: 932708 - protein, 25 aa, Mycobacterium
PGGVSNRFAPVPAQAPAPAPVVSAL

SEQ ID NO: 932709 - protein, 31 aa, Mycobacterium
PGGVYIKVPMPYRQSMRISVAANLEYYHVDY

SEQ ID NO: 932710 - protein, 30 aa, Mycobacterium
PGGVYIKVPMPYRRSMRISVASHLEYYHVD

SEQ ID NO: 932711 - protein, 18 aa, Mycobacterium
PGGWPGFPDGLTLRVAEM

SEQ ID NO: 932712 - protein, 38 aa, Mycobacterium
PGIEKESNWLPAPKGPFGLVLRLYWPKPDALNGTWTAP

SEQ ID NO: 932713 - protein, 28 aa, Mycobacterium
PGIETYLRFGYAPFTLVFGRNGWIADAS

SEQ ID NO: 932714 - protein, 17 aa, Mycobacterium
PGIGTAWVVLGHSQGGQ

SEQ ID NO: 932715 - protein, 22 aa, Mycobacterium
PGITVFPGMEIRQGATVCMVGL

SEQ ID NO: 932716 - protein, 25 aa, Mycobacterium
PGKDTIRVSIRWDQPSFNHVGVYAD

SEQ ID NO: 932717 - protein, 26 aa, Mycobacterium
PGKECGRIAFSGAQVRGGIEMVAAPH

SEQ ID NO: 932718 - protein, 26 aa, Mycobacterium
PGKGFPGRGRYCWPLTNRDRVSGARA

SEQ ID NO: 932719 - protein, 19 aa, Mycobacterium
PGKSSWNLEPWRPVVDDAE

SEQ ID NO: 932720 - protein, 21 aa, Mycobacterium
PGKVLPPYVRPYLQKKIDELN

SEQ ID NO: 932721 - protein, 17 aa, Mycobacterium
PGLAGGTLMVLRRIEMQ

SEQ ID NO: 932722 - protein, 20 aa, Mycobacterium
PGLAKTRLAAGVGADVAADI

SEQ ID NO: 932723 - protein, 20 aa, Mycobacterium
PGLDRGPLSYTTRAPQPAAR

SEQ ID NO: 932724 - protein, 24 aa, Mycobacterium
PGLGDWDLRALVGHASRSLVTVSA

SEQ ID NO: 932725 - protein, 20 aa, Mycobacterium
PGLINAGGTLISLFSELPKA

SEQ ID NO: 932726 - protein, 19 aa, Mycobacterium
PGLLPLLALASVVAVVSGC

SEQ ID NO: 932727 - protein, 23 aa, Mycobacterium
PGLPGLPGLPGMPDIEIPNLPLP

SEQ ID NO: 932728 - protein, 24 aa, Mycobacterium
PGLVGLRAAEAITRATTAQAQLTG

SEQ ID NO: 932729 - protein, 22 aa, Mycobacterium
PGMGSMVFPGYGTELLDWLDRA

SEQ ID NO: 932730 - protein, 19 aa, Mycobacterium
PGNEALDFNPQRARQLWAQ

SEQ ID NO: 932731 - protein, 22 aa, Mycobacterium
PGNPRVLSIAQFWHRAAQHDRI

SEQ ID NO: 932732 - protein, 17 aa, Mycobacterium
PGPAACARLAEFGAAVT

SEQ ID NO: 932733 - protein, 18 aa, Mycobacterium
PGPAVPPGSPCSYTPANP

SEQ ID NO: 932734 - protein, 25 aa, Mycobacterium
PGPEGILPIPSRNLLAISSETDDAE

SEQ ID NO: 932735 - protein, 24 aa, Mycobacterium
PGPEGILPVPARDLLVISSESDDA

SEQ ID NO: 932736 - protein, 17 aa, Mycobacterium
PGPLESRSTELEDKYGV

SEQ ID NO: 932737 - protein, 25 aa, Mycobacterium
PGPLPFESIPGLGPVAAPVAAPPPV

SEQ ID NO: 932738 - protein, 23 aa, Mycobacterium
PGPMPYPGAPPYGAPQYGPDGTP

SEQ ID NO: 932739 - protein, 18 aa, Mycobacterium
PGPQAAQMLARLPTDADL

SEQ ID NO: 932740 - protein, 33 aa, Mycobacterium
PGPQGSLALSAWWPMPFAHAARVTLINTTEDPV

SEQ ID NO: 932741 - protein, 26 aa, Mycobacterium
PGPRFRFEELCATPATARDPRDSAVS

SEQ ID NO: 932742 - protein, 19 aa, Mycobacterium
PGPSDDYWAGRGLATICLR

SEQ ID NO: 932743 - protein, 23 aa, Mycobacterium
PGPTGCYPYREPLPAPPPGGPPP

SEQ ID NO: 932744 - protein, 17 aa, Mycobacterium
PGPVAARHWQVEPDLTN

SEQ ID NO: 932745 - protein, 20 aa, Mycobacterium
PGQDRWIWEQTLENWNATIA

SEQ ID NO: 932746 - protein, 18 aa, Mycobacterium
PGQDTWYRGAARISDLVE

SEQ ID NO: 932747 - protein, 23 aa, Mycobacterium
PGQIKKVCPWQSPPGHWVGGPHG

SEQ ID NO: 932748 - protein, 19 aa, Mycobacterium
PGQLKKLPTVNGLVNPFFD

SEQ ID NO: 932749 - protein, 25 aa, Mycobacterium
PGQNFLARLAIDWEAATTVASQSGV

SEQ ID NO: 932750 - protein, 25 aa, Mycobacterium
PGQNGADGGLLWGNGGTGGTGDATH

SEQ ID NO: 932751 - protein, 17 aa, Mycobacterium
PGQPFDPAWGPQWDPTT

SEQ ID NO: 932752 - protein, 21 aa, Mycobacterium
PGQPVPDWFCESADLAELAAK

SEQ ID NO: 932753 - protein, 21 aa, Mycobacterium
PGRARSLLAIGAVPVAGLLSA

SEQ ID NO: 932754 - protein, 20 aa, Mycobacterium
PGRCRVLLVALVAAAAALTS

SEQ ID NO: 932755 - protein, 18 aa, Mycobacterium
PGRVIPAPSINNGLNPLP

SEQ ID NO: 932756 - protein, 20 aa, Mycobacterium
PGSECGMLSVPVDWDNPEDP

SEQ ID NO: 932757 - protein, 24 aa, Mycobacterium
PGSFSPHWIEQVVVLFTSDLHARD

SEQ ID NO: 932758 - protein, 25 aa, Mycobacterium
PGSIYIRPTPTQTWGTDPSDVVVLL

SEQ ID NO: 932759 - protein, 20 aa, Mycobacterium
PGSPCSYTPAADALPRPDNP

SEQ ID NO: 932760 - protein, 20 aa, Mycobacterium
PGSRLSYREVSCGLDSGGTL

SEQ ID NO: 932761 - protein, 36 aa, Mycobacterium
PGSRVAILLPAHWQTAAALFGVWWIGAEAVLEPGGT

SEQ ID NO: 932762 - protein, 18 aa, Mycobacterium
PGSTRGPLLERLGLPEPS

SEQ ID NO: 932763 - protein, 20 aa, Mycobacterium
PGTDGKYHLAYDVQITNATG

SEQ ID NO: 932764 - protein, 20 aa, Mycobacterium
PGTFGERWSDLSPGQQSAVI

SEQ ID NO: 932765 - protein, 20 aa, Mycobacterium
PGTIGKFGVDEAVTALEGGE

SEQ ID NO: 932766 - protein, 33 aa, Mycobacterium
PGTLGGDGGRGGFGPLVGGWGGNGGDGGADGGA

SEQ ID NO: 932767 - protein, 20 aa, Mycobacterium
PGTQVVFNFAGSTDLAAQIS

SEQ ID NO: 932768 - protein, 22 aa, Mycobacterium
PGTRAVVVGAELVSWSAVLTLR

SEQ ID NO: 932769 - protein, 18 aa, Mycobacterium
PGTRGRALTYGRTHLLRL

SEQ ID NO: 932770 - protein, 19 aa, Mycobacterium
PGTTLVGWVTGPESPNDTA

SEQ ID NO: 932771 - protein, 19 aa, Mycobacterium
PGTTPAIWTGSPSPAAPSG

SEQ ID NO: 932772 - protein, 31 aa, Mycobacterium
PGTYRSQGGNACYWERLRGLGGTVDDIIANG

SEQ ID NO: 932773 - protein, 17 aa, Mycobacterium
PGTYWAHPHTGLDADYG

SEQ ID NO: 932774 - protein, 18 aa, Mycobacterium
PGVDTWYRGAARISDLVE

SEQ ID NO: 932775 - protein, 19 aa, Mycobacterium
PGVGCGSGGQFSGPGGVPG

SEQ ID NO: 932776 - protein, 17 aa, Mycobacterium
PGVHNWVSTGGLNKGTV

SEQ ID NO: 932777 - protein, 18 aa, Mycobacterium
PGVTIKFAATHARGADRA

SEQ ID NO: 932778 - protein, 19 aa, Mycobacterium
PGWHRGRVVLVGDAAHCAS

SEQ ID NO: 932779 - protein, 25 aa, Mycobacterium
PGYSKQIIPPIKWAAQERGIIPTAA

SEQ ID NO: 932780 - protein, 31 aa, Mycobacterium
PHDGWTLVSWNGKPAWPGWAAKRYDRDANGL

SEQ ID NO: 932781 - protein, 17 aa, Mycobacterium
PHDSIMAAGRFLAANGF

SEQ ID NO: 932782 - protein, 22 aa, Mycobacterium
PHEAGPLGQVFGARPSSPMQQT

SEQ ID NO: 932783 - protein, 24 aa, Mycobacterium
PHFSFNWYRGSPIGRERATEERTR

SEQ ID NO: 932784 - protein, 24 aa, Mycobacterium
PHFSFSWYRGSPIGRERKTEELSR

SEQ ID NO: 932785 - protein, 19 aa, Mycobacterium
PHGIRCNCIVPGAIDTELW

SEQ ID NO: 932786 - protein, 19 aa, Mycobacterium
PHGSLHFRSDPVATEAMYT

SEQ ID NO: 932787 - protein, 23 aa, Mycobacterium
PHGVDVMACCAGAIETPNYTSSN

SEQ ID NO: 932788 - protein, 18 aa, Mycobacterium
PHLGVALMRPHSRGRVRL

SEQ ID NO: 932789 - protein, 20 aa, Mycobacterium
PHLLCNFFRRGTKAIERYLP

SEQ ID NO: 932790 - protein, 19 aa, Mycobacterium
PHLRDGRPLAEPPAEESAR

SEQ ID NO: 932791 - protein, 25 aa, Mycobacterium
PHNKGLRFEFYANLDTAYADLLSGN

SEQ ID NO: 932792 - protein, 29 aa, Mycobacterium
PHPELPASPGQVWSQWHSLVFDVSVWEIC

SEQ ID NO: 932793 - protein, 20 aa, Mycobacterium
PHPRKPRPAFQDASCPDVQL

SEQ ID NO: 932794 - protein, 20 aa, Mycobacterium
PHQLSWRVVLYQQQVADPNG

SEQ ID NO: 932795 - protein, 33 aa, Mycobacterium
PHRRATYPIDGRWYIAQRYAIDFNLLDAQNRPG

SEQ ID NO: 932796 - protein, 18 aa, Mycobacterium
PHRSIWLHVEGHTLHQIA

SEQ ID NO: 932797 - protein, 19 aa, Mycobacterium
PHSRLSFKTVSCGTDGFAT

SEQ ID NO: 932798 - protein, 17 aa, Mycobacterium
PHTRLAVTIPTEDPERG

SEQ ID NO: 932799 - protein, 17 aa, Mycobacterium
PIAEDFGPVSLPPTEPR

SEQ ID NO: 932800 - protein, 17 aa, Mycobacterium
PIAEHFGPIAMPPTDPR

SEQ ID NO: 932801 - protein, 19 aa, Mycobacterium
PIAGFAQMRIVLSNSNDDP

SEQ ID NO: 932802 - protein, 21 aa, Mycobacterium
PIDPIPGNGFFLVGPDIATGL

SEQ ID NO: 932803 - protein, 25 aa, Mycobacterium
PIDRLLRPGGVVDMLTSEGGLLDRL

SEQ ID NO: 932804 - protein, 26 aa, Mycobacterium
PIDVLLVPGGKGWRTLVDQPESIAKI

SEQ ID NO: 932805 - protein, 18 aa, Mycobacterium
PIEGLQIYKFYPVGENAQ

SEQ ID NO: 932806 - protein, 22 aa, Mycobacterium
PIEQNRYFSLQFVDGYTYNVAY

SEQ ID NO: 932807 - protein, 18 aa, Mycobacterium
PIGEKILPGLGLDGPSIG

SEQ ID NO: 932808 - protein, 20 aa, Mycobacterium
PIGVNPFVGATVRPNEVTYS

SEQ ID NO: 932809 - protein, 18 aa, Mycobacterium
PIIGDFVQPLVIGLQQVP

SEQ ID NO: 932810 - protein, 18 aa, Mycobacterium
PILAHAPAPLPPTVGSRT

SEQ ID NO: 932811 - protein, 24 aa, Mycobacterium
PILKGDKGEPCWPDGVVGSLTHCE

SEQ ID NO: 932812 - protein, 18 aa, Mycobacterium
PILTPGLAYYAREFADTA

SEQ ID NO: 932813 - protein, 19 aa, Mycobacterium
PILVPVWILVLVAALAGCA

SEQ ID NO: 932814 - protein, 26 aa, Mycobacterium
PIPGGKSALGLWSWAIPANSAASDAA

SEQ ID NO: 932815 - protein, 23 aa, Mycobacterium
PIPSRPTMFAMFACENDMYLVLG

SEQ ID NO: 932816 - protein, 25 aa, Mycobacterium
PIRNPVGFDRPEFWGQYRDNRQNVF

SEQ ID NO: 932817 - protein, 20 aa, Mycobacterium
PITAITWRDSLGHMRDQPVD

SEQ ID NO: 932818 - protein, 24 aa, Mycobacterium
PITNGLMYNFTFNFEKAGQGSVMV

SEQ ID NO: 932819 - protein, 18 aa, Mycobacterium
PITVPWEKITDLVDPTVV

SEQ ID NO: 932820 - protein, 24 aa, Mycobacterium
PIVNASGGPNCRGLPNIPTKMQNG

SEQ ID NO: 932821 - protein, 30 aa, Mycobacterium
PKAAVRLGSDMGEFFMPYPGTRINQETIPL

SEQ ID NO: 932822 - protein, 21 aa, Mycobacterium
PKAFFRDPVKFGVHPIGNGPF

SEQ ID NO: 932823 - protein, 24 aa, Mycobacterium
PKCSYGNCNRLRQLTGRPSTDFTI

SEQ ID NO: 932824 - protein, 18 aa, Mycobacterium
PKDLRALIHRARTSDVPL

SEQ ID NO: 932825 - protein, 24 aa, Mycobacterium
PKELPRGCIAAGDRAFFCDYALDY

SEQ ID NO: 932826 - protein, 21 aa, Mycobacterium
PKFRTGGYMIDFWGVGYQAAK

SEQ ID NO: 932827 - protein, 17 aa, Mycobacterium
PKFTAPITQNVTFVNQG

SEQ ID NO: 932828 - protein, 18 aa, Mycobacterium
PKFTPAREALDNPNYRLI

SEQ ID NO: 932829 - protein, 24 aa, Mycobacterium
PKGDIRYQIVMGERRWRAAQQAGL

SEQ ID NO: 932830 - protein, 18 aa, Mycobacterium
PKHADLLQRYAYAVTSAN

SEQ ID NO: 932831 - protein, 21 aa, Mycobacterium
PKIRLGCFADGPVVWATGEHV

SEQ ID NO: 932832 - protein, 23 aa, Mycobacterium
PKIVRYEIFGVPGATADINYIDD

SEQ ID NO: 932833 - protein, 25 aa, Mycobacterium
PKLADPQVRKAILGLIDVDLLASVG

SEQ ID NO: 932834 - protein, 23 aa, Mycobacterium
PKLESGMIPKIEACLRAVDGGVP

SEQ ID NO: 932835 - protein, 20 aa, Mycobacterium
PKLGQAVEWTPCRAANPKVK

SEQ ID NO: 932836 - protein, 19 aa, Mycobacterium
PKLGQAVEWTPCRSSNPKA

SEQ ID NO: 932837 - protein, 23 aa, Mycobacterium
PKLKDPVPVILMRTQYGKDTAQI

SEQ ID NO: 932838 - protein, 21 aa, Mycobacterium
PKLPQCIPNVVLGTTDGTLPA

SEQ ID NO: 932839 - protein, 19 aa, Mycobacterium
PKLRRAGLDYHDLASVTVH

SEQ ID NO: 932840 - protein, 18 aa, Mycobacterium
PKLTSPVTQNVTFVNQGG

SEQ ID NO: 932841 - protein, 18 aa, Mycobacterium
PKLTSPVTQNVTFVNQGS

SEQ ID NO: 932842 - protein, 29 aa, Mycobacterium
PKNPNSWINGPFTYIGPLLSGSRESQLIA

SEQ ID NO: 932843 - protein, 22 aa, Mycobacterium
PKPPELLRAAYVRLPDRAARSA

SEQ ID NO: 932844 - protein, 19 aa, Mycobacterium
PKPVMVWIHGGSFVAGSSG

SEQ ID NO: 932845 - protein, 22 aa, Mycobacterium
PKQCPAEGVMQGCLEATSGLIM

SEQ ID NO: 932846 - protein, 22 aa, Mycobacterium
PKRVRYEIFGAPGTIADINYMD

SEQ ID NO: 932847 - protein, 24 aa, Mycobacterium
PKRYDWAKFVGTIKYSLWRLQERV

SEQ ID NO: 932848 - protein, 17 aa, Mycobacterium
PKSSGFDHRVSVSVDLS

SEQ ID NO: 932849 - protein, 18 aa, Mycobacterium
PKTTVTLYDGRTASFTVV

SEQ ID NO: 932850 - protein, 25 aa, Mycobacterium
PKVAAKGGPHCMGLPHIGFGQRSKY

SEQ ID NO: 932851 - protein, 38 aa, Mycobacterium
PKVAATGGPQCWDLPVVPFDVAPPFVVADVGANPWQYG

SEQ ID NO: 932852 - protein, 19 aa, Mycobacterium
PKVAIAVLVEDGGDRALAA

SEQ ID NO: 932853 - protein, 19 aa, Mycobacterium
PKVAVAVLVEDGGDRLSAT

SEQ ID NO: 932854 - protein, 20 aa, Mycobacterium
PKVHSLALFQPLSGRYLDII

SEQ ID NO: 932855 - protein, 17 aa, Mycobacterium
PKVKVVIPVDPAGDGGL

SEQ ID NO: 932856 - protein, 20 aa, Mycobacterium
PKVLLLAAIVLLVLTGCART

SEQ ID NO: 932857 - protein, 18 aa, Mycobacterium
PKVTAALRDPAYRLETTT

SEQ ID NO: 932858 - protein, 25 aa, Mycobacterium
PKYVRYEVFGPPGTVVTVNYLDAQA

SEQ ID NO: 932859 - protein, 18 aa, Mycobacterium
PLAARAGITTGATSATSA

SEQ ID NO: 932860 - protein, 26 aa, Mycobacterium
PLAGPEMFGRAIALARQYGGALPALP

SEQ ID NO: 932861 - protein, 20 aa, Mycobacterium
PLARVRESFDINVFGHIQLA

SEQ ID NO: 932862 - protein, 25 aa, Mycobacterium
PLASARWKGKLYAAPVITNTELLWY

SEQ ID NO: 932863 - protein, 25 aa, Mycobacterium
PLATMAGYHLGWWDIDRSALAGSSG

SEQ ID NO: 932864 - protein, 25 aa, Mycobacterium
PLAYAWDMGAYAWPADERLRFANDP

SEQ ID NO: 932865 - protein, 23 aa, Mycobacterium
PLCPPPHRKQDCTISLKNSSAYP

SEQ ID NO: 932866 - protein, 24 aa, Mycobacterium
PLDDLRVRQAINYSVNRTGIVKAL

SEQ ID NO: 932867 - protein, 20 aa, Mycobacterium
PLDLLRRAIEALGVEFHQGY

SEQ ID NO: 932868 - protein, 25 aa, Mycobacterium
PLDPACRAPAAEAGRVQGRREAARV

SEQ ID NO: 932869 - protein, 19 aa, Mycobacterium
PLELREMGELPGVDVVVDP

SEQ ID NO: 932870 - protein, 19 aa, Mycobacterium
PLFIQKVPLPWSVKFEIGK

SEQ ID NO: 932871 - protein, 28 aa, Mycobacterium
PLGQTIPSFDIAKLFNGFRPIFETLDPA

SEQ ID NO: 932872 - protein, 20 aa, Mycobacterium
PLGREIAFSRILSATKDVRN

SEQ ID NO: 932873 - protein, 23 aa, Mycobacterium
PLGRTMAYHVWTESYDVARAAGF

SEQ ID NO: 932874 - protein, 25 aa, Mycobacterium
PLGTGGQWAIPWGFENNVVAYNKAY

SEQ ID NO: 932875 - protein, 19 aa, Mycobacterium
PLGVFLLEMITGTNIRWYY

SEQ ID NO: 932876 - protein, 20 aa, Mycobacterium
PLHSCGRLRMLPPSHEIPPD

SEQ ID NO: 932877 - protein, 37 aa, Mycobacterium
PLIGGVRPGLFLTNSFPLGAPVYTYPDSLPIVNASGG

SEQ ID NO: 932878 - protein, 20 aa, Mycobacterium
PLIGTGADGAPGRNGGDGGL

SEQ ID NO: 932879 - protein, 22 aa, Mycobacterium
PLILRQRYPVPDAPYGLAGSTD

SEQ ID NO: 932880 - protein, 22 aa, Mycobacterium
PLKGKRVAVVSARATPTGQDPR

SEQ ID NO: 932881 - protein, 19 aa, Mycobacterium
PLKHPDWYPQRLGYQPFPY

SEQ ID NO: 932882 - protein, 17 aa, Mycobacterium
PLLAQGIRHGFRAPTEL

SEQ ID NO: 932883 - protein, 20 aa, Mycobacterium
PLLKEFTELTGINVNVDLVP

SEQ ID NO: 932884 - protein, 18 aa, Mycobacterium
PLLRHRVELGHGSYADDD

SEQ ID NO: 932885 - protein, 24 aa, Mycobacterium
PLLRVCLIHPLAARAFIEVLKSVF

SEQ ID NO: 932886 - protein, 19 aa, Mycobacterium
PLLSGSRESQLIALGAKGE

SEQ ID NO: 932887 - protein, 18 aa, Mycobacterium
PLLYQCATGTLSIGQISR

SEQ ID NO: 932888 - protein, 19 aa, Mycobacterium
PLMRTAMTCIAARPRDVVS

SEQ ID NO: 932889 - protein, 19 aa, Mycobacterium
PLNFTPGVMQWYMDGGTVQ

SEQ ID NO: 932890 - protein, 22 aa, Mycobacterium
PLNLDVWANGFGAVASTTANSL

SEQ ID NO: 932891 - protein, 19 aa, Mycobacterium
PLNPPRVGPDGALYFGAGL

SEQ ID NO: 932892 - protein, 18 aa, Mycobacterium
PLPAPGVGSGGYRITAIF

SEQ ID NO: 932893 - protein, 29 aa, Mycobacterium
PLPPGSHTEKWIDLRAGECVADLPPADGS

SEQ ID NO: 932894 - protein, 18 aa, Mycobacterium
PLPTGTYCKIPMDTPANS

SEQ ID NO: 932895 - protein, 18 aa, Mycobacterium
PLQILRVAVPSFLLLFLV

SEQ ID NO: 932896 - protein, 27 aa, Mycobacterium
PLRDVKLDAGHWLDFWDSTFNNQGGLR

SEQ ID NO: 932897 - protein, 20 aa, Mycobacterium
PLRTRYVGYTAWRGIAAHPL

SEQ ID NO: 932898 - protein, 24 aa, Mycobacterium
PLRYGELTAALGMNSGERGEPRAV

SEQ ID NO: 932899 - protein, 19 aa, Mycobacterium
PLSACAKAASDQHMASTMA

SEQ ID NO: 932900 - protein, 22 aa, Mycobacterium
PLSNPKYPYWFNSMALNDDAAL

SEQ ID NO: 932901 - protein, 34 aa, Mycobacterium
PLSYAWDMGAYGWPAPERLRFANDPANLLAVQGQ

SEQ ID NO: 932902 - protein, 19 aa, Mycobacterium
PLTDSGVAMAGRYGNRSAG

SEQ ID NO: 932903 - protein, 19 aa, Mycobacterium
PLTLRIGYHGPNARLAAII

SEQ ID NO: 932904 - protein, 23 aa, Mycobacterium
PLTSGVWRGDWGQPQGRSAISDI

SEQ ID NO: 932905 - protein, 19 aa, Mycobacterium
PLVDNYRVQYSYFVDKTDP

SEQ ID NO: 932906 - protein, 24 aa, Mycobacterium
PLVHARPTPRGYLGGLPAGVNVAP

SEQ ID NO: 932907 - protein, 17 aa, Mycobacterium
PLVLAAIMVAFAGCSAS

SEQ ID NO: 932908 - protein, 19 aa, Mycobacterium
PLVYGRAAVERVIQRGGTQ

SEQ ID NO: 932909 - protein, 17 aa, Mycobacterium
PLWPDAVGEMCIRQIDG

SEQ ID NO: 932910 - protein, 19 aa, Mycobacterium
PMADPSLLVTRPALGDPSV

SEQ ID NO: 932911 - protein, 25 aa, Mycobacterium
PMAEFAGPMGLFGLPFIFDDADHMW

SEQ ID NO: 932912 - protein, 18 aa, Mycobacterium
PMAVCANGAVIYDPATDR

SEQ ID NO: 932913 - protein, 21 aa, Mycobacterium
PMDRVICGDVGYGKTEIAVRA

SEQ ID NO: 932914 - protein, 27 aa, Mycobacterium
PMIADPFTKLHCCIRSDGGAAAVLVSA

SEQ ID NO: 932915 - protein, 21 aa, Mycobacterium
PMIHTTCSYDQAMRAVHAENP

SEQ ID NO: 932916 - protein, 18 aa, Mycobacterium
PMILGCSYINRLTGYGGN

SEQ ID NO: 932917 - protein, 21 aa, Mycobacterium
PMIQIPRLVANNTRVWVYCGN

SEQ ID NO: 932918 - protein, 22 aa, Mycobacterium
PMLDLLPGSSYQVLPGLREISA

SEQ ID NO: 932919 - protein, 18 aa, Mycobacterium
PMLGSIFIVAGADGLTRP

SEQ ID NO: 932920 - protein, 21 aa, Mycobacterium
PMLMAKPHYYGQFTDTGGIGV

SEQ ID NO: 932921 - protein, 20 aa, Mycobacterium
PMLSAAFIGQGVESLLNPKP

SEQ ID NO: 932922 - protein, 27 aa, Mycobacterium
PMPALPLMLRHVRAVAPACALTDVTSV

SEQ ID NO: 932923 - protein, 19 aa, Mycobacterium
PMQFLPSTFAMYGAGTDIA

SEQ ID NO: 932924 - protein, 20 aa, Mycobacterium
PMSKTMIIAAAMETVNPIPA

SEQ ID NO: 932925 - protein, 17 aa, Mycobacterium
PMTLSIERLTGPRNSLF

SEQ ID NO: 932926 - protein, 17 aa, Mycobacterium
PNADFTGTDTFTYTATD

SEQ ID NO: 932927 - protein, 20 aa, Mycobacterium
PNAPVTQDFLYPSISNGCLS

SEQ ID NO: 932928 - protein, 18 aa, Mycobacterium
PNAVGTQLIIRTMRVEIR

SEQ ID NO: 932929 - protein, 23 aa, Mycobacterium
PNDYWDPSVNEIQLCYEDIQQSE

SEQ ID NO: 932930 - protein, 19 aa, Mycobacterium
PNEIPVRIPEGSAGIERTE

SEQ ID NO: 932931 - protein, 25 aa, Mycobacterium
PNEITFSEDWLRPDYIPPAQPVTQD

SEQ ID NO: 932932 - protein, 40 aa, Mycobacterium
PNFLPLQPFSWRIMPENLEDAGISWKVYQNKFFGHYINSP

SEQ ID NO: 932933 - protein, 30 aa, Mycobacterium
PNGEAGGLLYGNGGDGYSFTSGTTSEAGGA

SEQ ID NO: 932934 - protein, 18 aa, Mycobacterium
PNGKPGVETTFKDDDGSH

SEQ ID NO: 932935 - protein, 19 aa, Mycobacterium
PNGLRLGVDPAVVPRDGLP

SEQ ID NO: 932936 - protein, 23 aa, Mycobacterium
PNGQNYRVIDKVGAPNGLNPAPI

SEQ ID NO: 932937 - protein, 23 aa, Mycobacterium
PNGQNYRVIDKVGTPNGLSPAPI

SEQ ID NO: 932938 - protein, 19 aa, Mycobacterium
PNGSCDFVAGADLRTPDGV

SEQ ID NO: 932939 - protein, 24 aa, Mycobacterium
PNGSILLGRLDLKLFAGAEPDNQK

SEQ ID NO: 932940 - protein, 24 aa, Mycobacterium
PNIQPQAQFSWRTMPDNLSDAGIS

SEQ ID NO: 932941 - protein, 20 aa, Mycobacterium
PNISGWRRKTFGNLLSAFGF

SEQ ID NO: 932942 - protein, 21 aa, Mycobacterium
PNKPTIVAFVDKLTGPVDTAK

SEQ ID NO: 932943 - protein, 18 aa, Mycobacterium
PNLDWLRNSPTASSTAVT

SEQ ID NO: 932944 - protein, 19 aa, Mycobacterium
PNLLLPLVRLTHLAESAIE

SEQ ID NO: 932945 - protein, 24 aa, Mycobacterium
PNMTYLREIWHAIQTQDISGKDAL

SEQ ID NO: 932946 - protein, 17 aa, Mycobacterium
PNNDFPLPDQVTAALPG

SEQ ID NO: 932947 - protein, 17 aa, Mycobacterium
PNPCVRCNQRIKFSALS

SEQ ID NO: 932948 - protein, 18 aa, Mycobacterium
PNPEGAQAFASYLIGETA

SEQ ID NO: 932949 - protein, 17 aa, Mycobacterium
PNPQLPGLPALAQLSPI

SEQ ID NO: 932950 - protein, 24 aa, Mycobacterium
PNPRLDDVRVVLIAPPEVGVAEYF

SEQ ID NO: 932951 - protein, 19 aa, Mycobacterium
PNQHGIVGNGWYFRDLGEV

SEQ ID NO: 932952 - protein, 20 aa, Mycobacterium
PNQRLPFGVAPKTEGARGSD

SEQ ID NO: 932953 - protein, 20 aa, Mycobacterium
PNQVLSPGFHGLQIHSVGKC

SEQ ID NO: 932954 - protein, 19 aa, Mycobacterium
PNRDCGSLAAGGFGSAAAY

SEQ ID NO: 932955 - protein, 30 aa, Mycobacterium
PNRPPSEHVPGWRRPLSPQPGRDLVVPVPY

SEQ ID NO: 932956 - protein, 18 aa, Mycobacterium
PNSAAMKAFFVYDEPFWR

SEQ ID NO: 932957 - protein, 19 aa, Mycobacterium
PNSGWLYTWALGIPKSSDK

SEQ ID NO: 932958 - protein, 19 aa, Mycobacterium
PNTGLRRLLADRLEFARLE

SEQ ID NO: 932959 - protein, 25 aa, Mycobacterium
PNTVRYRIRRVEKLLSTSFADPDVR

SEQ ID NO: 932960 - protein, 24 aa, Mycobacterium
PNVAPFAAEFGCLAGDPMVNSPDK

SEQ ID NO: 932961 - protein, 18 aa, Mycobacterium
PNVESVNIGDVWSDGPSV

SEQ ID NO: 932962 - protein, 21 aa, Mycobacterium
PNVPDAFAVIADRRGSSIYSS

SEQ ID NO: 932963 - protein, 26 aa, Mycobacterium
PNVPDAFAVIADRVGGNSVYTSNAQV

SEQ ID NO: 932964 - protein, 26 aa, Mycobacterium
PNVPDAFLVIADRVGGNSVYTSNAQV

SEQ ID NO: 932965 - protein, 25 aa, Mycobacterium
PNVPNAFAVLADRVGGNGLYSSNAQ

SEQ ID NO: 932966 - protein, 27 aa, Mycobacterium
PNVRKVKRPQFNVFKPKKTRVTVPKAE

SEQ ID NO: 932967 - protein, 17 aa, Mycobacterium
PPAAFTRLADLERQATS

SEQ ID NO: 932968 - protein, 19 aa, Mycobacterium
PPAGAEAVDIGGLYERLAR

SEQ ID NO: 932969 - protein, 21 aa, Mycobacterium
PPAKQRYLVQLTITGLANEAV

SEQ ID NO: 932970 - protein, 18 aa, Mycobacterium
PPALALAAHIGHGVQRVA

SEQ ID NO: 932971 - protein, 17 aa, Mycobacterium
PPANLFEGAVTLSVGAG

SEQ ID NO: 932972 - protein, 17 aa, Mycobacterium
PPAPIPLAAPAIFDGDP

SEQ ID NO: 932973 - protein, 18 aa, Mycobacterium
PPAPRAMPSAVPLEPGQQ

SEQ ID NO: 932974 - protein, 17 aa, Mycobacterium
PPAPRLVTYTVTADRHV

SEQ ID NO: 932975 - protein, 19 aa, Mycobacterium
PPAVGLICVRQGGVLLRLA

SEQ ID NO: 932976 - protein, 22 aa, Mycobacterium
PPCPDVEVVFARGTFEPPGVGF

SEQ ID NO: 932977 - protein, 24 aa, Mycobacterium
PPDLKAAVQGVARLSQTLDMRDGQ

SEQ ID NO: 932978 - protein, 20 aa, Mycobacterium
PPDPARWFIVPARETIRNPV

SEQ ID NO: 932979 - protein, 18 aa, Mycobacterium
PPDPAWWYLVPARETIKN

SEQ ID NO: 932980 - protein, 23 aa, Mycobacterium
PPDTLVGPGCSAYAQQVPTGPGS

SEQ ID NO: 932981 - protein, 28 aa, Mycobacterium
PPDTSIPLLAYRAADEIGLVEGTTVVAS

SEQ ID NO: 932982 - protein, 18 aa, Mycobacterium
PPELMPLVEVVPGTQTSD

SEQ ID NO: 932983 - protein, 22 aa, Mycobacterium
PPELQRRVGTVGVFTAAPEAVL

SEQ ID NO: 932984 - protein, 21 aa, Mycobacterium
PPERAHTFVFALLRAVTAVAP

SEQ ID NO: 932985 - protein, 27 aa, Mycobacterium
PPEVGDHIRAIVTFGNIVNRFAPVQSL

SEQ ID NO: 932986 - protein, 24 aa, Mycobacterium
PPFRWHPERRALLRADLDAAFLHV

SEQ ID NO: 932987 - protein, 20 aa, Mycobacterium
PPGAEGYVYTYSQLVVPRWV

SEQ ID NO: 932988 - protein, 19 aa, Mycobacterium
PPGALGARMDALRAAGVDQ

SEQ ID NO: 932989 - protein, 30 aa, Mycobacterium
PPGAWTAHGRWLRAPVDGIFWAGTETADSW

SEQ ID NO: 932990 - protein, 26 aa, Mycobacterium
PPGDPSAWGLLAWVRRELFNSTPDEV

SEQ ID NO: 932991 - protein, 20 aa, Mycobacterium
PPGGQPRASINGVPVSPTLV

SEQ ID NO: 932992 - protein, 19 aa, Mycobacterium
PPGHKWTRRAHPVSAGELA

SEQ ID NO: 932993 - protein, 23 aa, Mycobacterium
PPGKESLSCTLGFVDPAARVGVT

SEQ ID NO: 932994 - protein, 17 aa, Mycobacterium
PPGPLTQVLLAWQNNKP

SEQ ID NO: 932995 - protein, 19 aa, Mycobacterium
PPGPPARIPGAAMPEPPAP

SEQ ID NO: 932996 - protein, 17 aa, Mycobacterium
PPGSEPFVVPAPAQLQP

SEQ ID NO: 932997 - protein, 30 aa, Mycobacterium
PPGTPRARSFRVTSFDGTRIFVNFMPAKGL

SEQ ID NO: 932998 - protein, 19 aa, Mycobacterium
PPGVETWYRGAARISDLVD

SEQ ID NO: 932999 - protein, 24 aa, Mycobacterium
PPHMPRVPLADLLGAERAVSTALA

SEQ ID NO: 933000 - protein, 25 aa, Mycobacterium
PPIAAPKNDLSWRDCTSQVYGNAAI

SEQ ID NO: 933001 - protein, 21 aa, Mycobacterium
PPIRQRWAGVYSQCLDPEQLV

SEQ ID NO: 933002 - protein, 24 aa, Mycobacterium
PPITAPKNDLAWHDCTSRVFADAA

SEQ ID NO: 933003 - protein, 19 aa, Mycobacterium
PPKRQEMAQQIQAMPSAMK

SEQ ID NO: 933004 - protein, 17 aa, Mycobacterium
PPLAAAGLLRFDLDLLA

SEQ ID NO: 933005 - protein, 24 aa, Mycobacterium
PPLAAPKNDLSWHDCTSRVFGDAA

SEQ ID NO: 933006 - protein, 22 aa, Mycobacterium
PPLAEPFVAAALDRAAPPHQPG

SEQ ID NO: 933007 - protein, 18 aa, Mycobacterium
PPLAGPRWIALGSCCDGP

SEQ ID NO: 933008 - protein, 20 aa, Mycobacterium
PPLGENLFVGAAARPNELTY

SEQ ID NO: 933009 - protein, 19 aa, Mycobacterium
PPLGVPAPAAAPVEVAPPA

SEQ ID NO: 933010 - protein, 20 aa, Mycobacterium
PPLHAMLSVSAYLYGSDEYS

SEQ ID NO: 933011 - protein, 27 aa, Mycobacterium
PPLLHGCLRIGGRICGPPSFDPEFDMA

SEQ ID NO: 933012 - protein, 17 aa, Mycobacterium
PPLPARSPAAIVVGAMT

SEQ ID NO: 933013 - protein, 18 aa, Mycobacterium
PPLRRDVAGLADLAAIYA

SEQ ID NO: 933014 - protein, 19 aa, Mycobacterium
PPLSARIPLPGGGALMKLP

SEQ ID NO: 933015 - protein, 24 aa, Mycobacterium
PPLTEVLRLLAPTTELLRDYHPAL

SEQ ID NO: 933016 - protein, 27 aa, Mycobacterium
PPLTGDRWLDINSCCDMTAHRMALNPI

SEQ ID NO: 933017 - protein, 18 aa, Mycobacterium
PPLTLAQNGDWTISWADW

SEQ ID NO: 933018 - protein, 18 aa, Mycobacterium
PPLVFPGMEIHQDIHICT

SEQ ID NO: 933019 - protein, 20 aa, Mycobacterium
PPMVDGFAISLTLPAGQYQL

SEQ ID NO: 933020 - protein, 23 aa, Mycobacterium
PPNAPDFIAAIALFGNPTTKVGL

SEQ ID NO: 933021 - protein, 18 aa, Mycobacterium
PPNDGRWWNTKSTAADLV

SEQ ID NO: 933022 - protein, 24 aa, Mycobacterium
PPNKEFWCQYSMQFAEVVRGYHLS

SEQ ID NO: 933023 - protein, 19 aa, Mycobacterium
PPPAPDAMIAPVDMPEAPA

SEQ ID NO: 933024 - protein, 21 aa, Mycobacterium
PPPDFDWRTVDTLHLDVGTTP

SEQ ID NO: 933025 - protein, 24 aa, Mycobacterium
PPPDHKRYLVQLTITSMANQAAAE

SEQ ID NO: 933026 - protein, 23 aa, Mycobacterium
PPPEALTDVLARLADPNVTGDAK

SEQ ID NO: 933027 - protein, 18 aa, Mycobacterium
PPPGEWMYYAFATGQHIT

SEQ ID NO: 933028 - protein, 18 aa, Mycobacterium
PPPKFPDLNAFQAVDAAP

SEQ ID NO: 933029 - protein, 19 aa, Mycobacterium
PPPPAGWAPPPPAWAPPPA

SEQ ID NO: 933030 - protein, 26 aa, Mycobacterium
PPPPDGCALAAIWTTGPMMNRTPLTM

SEQ ID NO: 933031 - protein, 18 aa, Mycobacterium
PPPPELADLTALLDRARA

SEQ ID NO: 933032 - protein, 18 aa, Mycobacterium
PPPPLVWSPPTPDPEPWE

SEQ ID NO: 933033 - protein, 18 aa, Mycobacterium
PPPPMKATQIIVAIDSIG

SEQ ID NO: 933034 - protein, 17 aa, Mycobacterium
PPPPNVVLIPGLPPITI

SEQ ID NO: 933035 - protein, 19 aa, Mycobacterium
PPPPPARIPGAAMPEPPAP

SEQ ID NO: 933036 - protein, 18 aa, Mycobacterium
PPPPPARIPGAAMPEPPP

SEQ ID NO: 933037 - protein, 24 aa, Mycobacterium
PPPPPPPRRPRAAVPPPSPTGRRI

SEQ ID NO: 933038 - protein, 18 aa, Mycobacterium
PPPPPRPTQIIMGIDSIG

SEQ ID NO: 933039 - protein, 20 aa, Mycobacterium
PPPRAEWRGPLPDRWGPPPQ

SEQ ID NO: 933040 - protein, 21 aa, Mycobacterium
PPQAKRWLLGRIGAKRPRRAP

SEQ ID NO: 933041 - protein, 19 aa, Mycobacterium
PPQDLKINVLILGGQHDPI

SEQ ID NO: 933042 - protein, 26 aa, Mycobacterium
PPQLPPGCAIGWTMVGHVLIYVPDCT

SEQ ID NO: 933043 - protein, 17 aa, Mycobacterium
PPQRYLIQLTVTTYAEQ

SEQ ID NO: 933044 - protein, 24 aa, Mycobacterium
PPQSRGRPGLIRGPDLMYPNRTLS

SEQ ID NO: 933045 - protein, 24 aa, Mycobacterium
PPQVELRFGATVSDVAQRDDRVTV

SEQ ID NO: 933046 - protein, 19 aa, Mycobacterium
PPRGRLREGSLIALSSAGS

SEQ ID NO: 933047 - protein, 18 aa, Mycobacterium
PPRPADCPDVTGYGQGIT

SEQ ID NO: 933048 - protein, 17 aa, Mycobacterium
PPRRAQMAAQLQAMPGA

SEQ ID NO: 933049 - protein, 20 aa, Mycobacterium
PPRRRRTFGVLSGVVVLALF

SEQ ID NO: 933050 - protein, 34 aa, Mycobacterium
PPRVPSWRPWPTAFDLRGAVTYVVDLAVSVVDAL

SEQ ID NO: 933051 - protein, 21 aa, Mycobacterium
PPSDDRGPCAVAKKSDVPATM

SEQ ID NO: 933052 - protein, 18 aa, Mycobacterium
PPSDGRWWNTFSSAPDLI

SEQ ID NO: 933053 - protein, 17 aa, Mycobacterium
PPSGPMVPPEHFSLPIH

SEQ ID NO: 933054 - protein, 18 aa, Mycobacterium
PPSISPPLTGDRWLDINS

SEQ ID NO: 933055 - protein, 21 aa, Mycobacterium
PPSLFTPGYFKQLTVPVAVAG

SEQ ID NO: 933056 - protein, 19 aa, Mycobacterium
PPSLGLLTINALVAAPEVL

SEQ ID NO: 933057 - protein, 25 aa, Mycobacterium
PPSRYFGPNLARLSAIRQKYDPGRV

SEQ ID NO: 933058 - protein, 20 aa, Mycobacterium
PPSVSYSFRSLARGPHAEAL

SEQ ID NO: 933059 - protein, 25 aa, Mycobacterium
PPTEPAMRPGFYGYGFNVGTTSAAR

SEQ ID NO: 933060 - protein, 19 aa, Mycobacterium
PPTPIHVVFRSDQSGTTAN

SEQ ID NO: 933061 - protein, 19 aa, Mycobacterium
PPTQVWPWLAQIGEDRGGF

SEQ ID NO: 933062 - protein, 23 aa, Mycobacterium
PPTSQRYLVQFTVTGYADKAAEE

SEQ ID NO: 933063 - protein, 18 aa, Mycobacterium
PPTTWDEYDEVAAKITKD

SEQ ID NO: 933064 - protein, 25 aa, Mycobacterium
PPVGKDLRPVMVWIHGGGFVNGSSD

SEQ ID NO: 933065 - protein, 25 aa, Mycobacterium
PPVGTQAHFLWVLQRAVNRLAGWPG

SEQ ID NO: 933066 - protein, 25 aa, Mycobacterium
PPVLRAAGVPVEIDLPVGVDTIDHP

SEQ ID NO: 933067 - protein, 17 aa, Mycobacterium
PPVNAFWSLTIYELPSS

SEQ ID NO: 933068 - protein, 30 aa, Mycobacterium
PPVPDDIRYGLGIFDARGWIGHSGSIPGYQ

SEQ ID NO: 933069 - protein, 19 aa, Mycobacterium
PPVRTSLYSDPQFQAKYPM

SEQ ID NO: 933070 - protein, 22 aa, Mycobacterium
PPVSNGHTWDALAQCEAGGNWA

SEQ ID NO: 933071 - protein, 18 aa, Mycobacterium
PPVVLGPPLAGPRWIALG

SEQ ID NO: 933072 - protein, 17 aa, Mycobacterium
PPVYVPWTPDFAGRNDF

SEQ ID NO: 933073 - protein, 20 aa, Mycobacterium
PPWGWAPPPRAEWRGPLPDR

SEQ ID NO: 933074 - protein, 18 aa, Mycobacterium
PPYICPPAEIAQITSAMV

SEQ ID NO: 933075 - protein, 22 aa, Mycobacterium
PPYRVPFPQVMPSQETSPTRGI

SEQ ID NO: 933076 - protein, 18 aa, Mycobacterium
PQAFARVLTGFSYHGPEG

SEQ ID NO: 933077 - protein, 19 aa, Mycobacterium
PQAGPRIITRAQWGANESD

SEQ ID NO: 933078 - protein, 19 aa, Mycobacterium
PQAILAAWERGDIDAAYTW

SEQ ID NO: 933079 - protein, 17 aa, Mycobacterium
PQARTAVPVEWDDLRQD

SEQ ID NO: 933080 - protein, 19 aa, Mycobacterium
PQAVPRPAAPATETVAAPA

SEQ ID NO: 933081 - protein, 26 aa, Mycobacterium
PQDPRPRLIGALAMATVRIALDDWLS

SEQ ID NO: 933082 - protein, 20 aa, Mycobacterium
PQDQLAWMGKITCDRIGKGV

SEQ ID NO: 933083 - protein, 18 aa, Mycobacterium
PQDRRQVLAAGDSNSDAT

SEQ ID NO: 933084 - protein, 23 aa, Mycobacterium
PQETYLRLTVIGNHFPPPQTQIP

SEQ ID NO: 933085 - protein, 30 aa, Mycobacterium
PQGGLLRHFPEGFRLPGFGVTVVETPETPW

SEQ ID NO: 933086 - protein, 25 aa, Mycobacterium
PQGNGWGLSFARLFDMTNDSGLFHQ

SEQ ID NO: 933087 - protein, 23 aa, Mycobacterium
PQGQRILLALMVRTRGDDPNADG

SEQ ID NO: 933088 - protein, 23 aa, Mycobacterium
PQGRLREGSLIPLSRGGAYPSTE

SEQ ID NO: 933089 - protein, 18 aa, Mycobacterium
PQGTRAKMTMAIDHDVPV

SEQ ID NO: 933090 - protein, 25 aa, Mycobacterium
PQHAPPLAAAPVRPAVPQVPQAPPI

SEQ ID NO: 933091 - protein, 18 aa, Mycobacterium
PQHLIVAAAAVLLTACTQ

SEQ ID NO: 933092 - protein, 19 aa, Mycobacterium
PQKGGSWRSTGCSSPLGAF

SEQ ID NO: 933093 - protein, 28 aa, Mycobacterium
PQKPAQCAVFCIQDLPAAPAPAPGPVPA

SEQ ID NO: 933094 - protein, 22 aa, Mycobacterium
PQKRPRSSWKRFEADLPNQCWQ

SEQ ID NO: 933095 - protein, 27 aa, Mycobacterium
PQLAGMTVRIDWPYSANLHCEILVDDQ

SEQ ID NO: 933096 - protein, 33 aa, Mycobacterium
PQLARLAAIGGFRRWEPMVRRFLSDERLLRVFT

SEQ ID NO: 933097 - protein, 19 aa, Mycobacterium
PQLDAKIGWNVKRLAPGIY

SEQ ID NO: 933098 - protein, 22 aa, Mycobacterium
PQLKIAVEGVARFSDTLNARDA

SEQ ID NO: 933099 - protein, 20 aa, Mycobacterium
PQLPGLPALAQLSPIIQQAA

SEQ ID NO: 933100 - protein, 19 aa, Mycobacterium
PQNIAGLVTALGGRAAAEN

SEQ ID NO: 933101 - protein, 17 aa, Mycobacterium
PQPAGPNRWRVPLRPGV

SEQ ID NO: 933102 - protein, 18 aa, Mycobacterium
PQPLRAGQVLSADHVTVE

SEQ ID NO: 933103 - protein, 26 aa, Mycobacterium
PQPLRSKISFWFDRKYKVPADAKAAI

SEQ ID NO: 933104 - protein, 31 aa, Mycobacterium
PQPQRVKITFWYDRKYKVPANVKAVIVSPAL

SEQ ID NO: 933105 - protein, 25 aa, Mycobacterium
PQPSAFTSPCFWRRGEYDCTTSPCG

SEQ ID NO: 933106 - protein, 24 aa, Mycobacterium
PQPTQVRITFWFDAKYPVPADAKA

SEQ ID NO: 933107 - protein, 23 aa, Mycobacterium
PQPVVDAIVRFLISADTNPHIDS

SEQ ID NO: 933108 - protein, 26 aa, Mycobacterium
PQQAGMRIVLHFPYSANVHCEIDVDD

SEQ ID NO: 933109 - protein, 26 aa, Mycobacterium
PQQLWAMATSVRYQAVFAEAGGLAAG

SEQ ID NO: 933110 - protein, 23 aa, Mycobacterium
PQQVRQWLPYVGPGLNTDSVLIN

SEQ ID NO: 933111 - protein, 20 aa, Mycobacterium
PQRCREMLTSAIGERIDIDV

SEQ ID NO: 933112 - protein, 19 aa, Mycobacterium
PQRPRAAAHPCGGHPGRGR

SEQ ID NO: 933113 - protein, 24 aa, Mycobacterium
PQRVSEVPLPWSLTLSTTLPSVMP

SEQ ID NO: 933114 - protein, 21 aa, Mycobacterium
PQRVVCGGISIPDRWDTTADP

SEQ ID NO: 933115 - protein, 26 aa, Mycobacterium
PQRVVCGGISIPGRWDTTAEPDVTER

SEQ ID NO: 933116 - protein, 38 aa, Mycobacterium
PQSRVAILLPAHWQTAAVLFGVWWIGAEVVLDGAADVA

SEQ ID NO: 933117 - protein, 37 aa, Mycobacterium
PQTRVAVLLPAHWQTAAVLFGIWWIGAEIVLEGPADI

SEQ ID NO: 933118 - protein, 18 aa, Mycobacterium
PQVNRWVNRFSGHAVSPE

SEQ ID NO: 933119 - protein, 18 aa, Mycobacterium
PQVVRIMPTDTAFMTRSC

SEQ ID NO: 933120 - protein, 19 aa, Mycobacterium
PQYKHAVVMGVNKNKTPGG

SEQ ID NO: 933121 - protein, 20 aa, Mycobacterium
PQYKHAVVMGVNKNKTPGGG

SEQ ID NO: 933122 - protein, 19 aa, Mycobacterium
PQYKHSVVMGVNKNKVPGG

SEQ ID NO: 933123 - protein, 20 aa, Mycobacterium
PQYMVPAAIMTLRQLPVTVN

SEQ ID NO: 933124 - protein, 25 aa, Mycobacterium
PRAAPDCATGAWSTALLTRIAPTAH

SEQ ID NO: 933125 - protein, 35 aa, Mycobacterium
PRALRMLSEPAPWQWLVELWRGISPHLGTFRDIVS

SEQ ID NO: 933126 - protein, 21 aa, Mycobacterium
PRAVLPRTFDYGFATGLMTKD

SEQ ID NO: 933127 - protein, 23 aa, Mycobacterium
PRAVRRAVLALRGRKGMVLDPDD

SEQ ID NO: 933128 - protein, 17 aa, Mycobacterium
PRDAISRDAGVPIANSR

SEQ ID NO: 933129 - protein, 20 aa, Mycobacterium
PRDDWVPFTGVPGYNHIKIK

SEQ ID NO: 933130 - protein, 20 aa, Mycobacterium
PRDFDRIGLPGWGWSEVLDS

SEQ ID NO: 933131 - protein, 18 aa, Mycobacterium
PRFAQLVVDLIDEMLHGL

SEQ ID NO: 933132 - protein, 20 aa, Mycobacterium
PRFATNPGRCANRDVLEEAI

SEQ ID NO: 933133 - protein, 25 aa, Mycobacterium
PRFLDLCAAHTRFVDEFAAEAGRAG

SEQ ID NO: 933134 - protein, 23 aa, Mycobacterium
PRFLTAQKLPPGLTFDPQDCAKS

SEQ ID NO: 933135 - protein, 17 aa, Mycobacterium
PRFVLAVVRGARTPGPR

SEQ ID NO: 933136 - protein, 21 aa, Mycobacterium
PRGDLDRVVRQQVVMASLAHR

SEQ ID NO: 933137 - protein, 24 aa, Mycobacterium
PRGKPLCIERVPPLPCQPKMGEST

SEQ ID NO: 933138 - protein, 20 aa, Mycobacterium
PRGKRQFRRAVLDAGSGQVT

SEQ ID NO: 933139 - protein, 19 aa, Mycobacterium
PRGLLPVLVLFDHEEVGST

SEQ ID NO: 933140 - protein, 19 aa, Mycobacterium
PRGPIKYLGLLPGVGAVAA

SEQ ID NO: 933141 - protein, 19 aa, Mycobacterium
PRGPIPLTAPGVFRADPSG

SEQ ID NO: 933142 - protein, 29 aa, Mycobacterium
PRGPLGAPDARRAVALCTPRDVIARNAEM

SEQ ID NO: 933143 - protein, 25 aa, Mycobacterium
PRGPRGELLSGTLLVTGVSPRPDAT

SEQ ID NO: 933144 - protein, 26 aa, Mycobacterium
PRGPYQWCPGEPVPAGGVNWDMNVCH

SEQ ID NO: 933145 - protein, 18 aa, Mycobacterium
PRGTDWHPHRGFETVTYM

SEQ ID NO: 933146 - protein, 22 aa, Mycobacterium
PRGTTVRIEVDRFIDPWTPEQD

SEQ ID NO: 933147 - protein, 20 aa, Mycobacterium
PRHTWLRSSWEHQEIDPRLP

SEQ ID NO: 933148 - protein, 22 aa, Mycobacterium
PRHWRMRVIVQKVGNDMKVSNV

SEQ ID NO: 933149 - protein, 18 aa, Mycobacterium
PRHWRRSTHALLAVAVVL

SEQ ID NO: 933150 - protein, 18 aa, Mycobacterium
PRIRLLERLISGQVGNPA

SEQ ID NO: 933151 - protein, 18 aa, Mycobacterium
PRISAAIQGMPLVPLGYP

SEQ ID NO: 933152 - protein, 20 aa, Mycobacterium
PRKLTEIIDGGTFLLSTLDS

SEQ ID NO: 933153 - protein, 21 aa, Mycobacterium
PRKRSGSALAAGAIALALVSG

SEQ ID NO: 933154 - protein, 19 aa, Mycobacterium
PRLADALATALPRRPQFAL

SEQ ID NO: 933155 - protein, 19 aa, Mycobacterium
PRLALSYDGGVLVLDAGTL

SEQ ID NO: 933156 - protein, 22 aa, Mycobacterium
PRLETDCAVLRPPRPGVDAAAE

SEQ ID NO: 933157 - protein, 18 aa, Mycobacterium
PRLPADEECSMFELLIGY

SEQ ID NO: 933158 - protein, 18 aa, Mycobacterium
PRLQIDYANFMSPIMTGA

SEQ ID NO: 933159 - protein, 24 aa, Mycobacterium
PRLRTGGYVVDFWGLGYEVACRMG

SEQ ID NO: 933160 - protein, 20 aa, Mycobacterium
PRLTRILLVALVALTAAGGG

SEQ ID NO: 933161 - protein, 27 aa, Mycobacterium
PRMAKDLPPQCGWVFAETQVFGSEVEE

SEQ ID NO: 933162 - protein, 17 aa, Mycobacterium
PRMPQGVIPNRRVWHSS

SEQ ID NO: 933163 - protein, 19 aa, Mycobacterium
PRMTSRFSGLSRDQLALLV

SEQ ID NO: 933164 - protein, 18 aa, Mycobacterium
PRNAKFGVHLNALPQACA

SEQ ID NO: 933165 - protein, 25 aa, Mycobacterium
PRNAPGCAGCCQCAIGCPSNAKFGV

SEQ ID NO: 933166 - protein, 26 aa, Mycobacterium
PRNAPGCGGCCQCAIGCPRNAKFGVH

SEQ ID NO: 933167 - protein, 19 aa, Mycobacterium
PRNEWLFDDAWGVDVAVST

SEQ ID NO: 933168 - protein, 19 aa, Mycobacterium
PRNEWLFDENWGVDVAVST

SEQ ID NO: 933169 - protein, 29 aa, Mycobacterium
PRNSLFSQLGGFAIPGLGPLVTRSPLLTS

SEQ ID NO: 933170 - protein, 24 aa, Mycobacterium
PRNTPPHAWYIAFAPAQAPTVAVA

SEQ ID NO: 933171 - protein, 23 aa, Mycobacterium
PRNTPPHAWYIAFAPAQDPKVAV

SEQ ID NO: 933172 - protein, 24 aa, Mycobacterium
PRNTPPHAWYIAFAPAQGTTTDPQ

SEQ ID NO: 933173 - protein, 20 aa, Mycobacterium
PRPAAPRSRSLQFVRQPTRR

SEQ ID NO: 933174 - protein, 27 aa, Mycobacterium
PRPFDPCFDIPSSVIAAAGLDQTPPAP

SEQ ID NO: 933175 - protein, 18 aa, Mycobacterium
PRPGSYPAQMLVDWVRVW

SEQ ID NO: 933176 - protein, 21 aa, Mycobacterium
PRPLAPGALAGLLLDTGGIGA

SEQ ID NO: 933177 - protein, 22 aa, Mycobacterium
PRPRPNIMLAAGNRAEFIIKGR

SEQ ID NO: 933178 - protein, 22 aa, Mycobacterium
PRPVGDADQWMSRFFDAQPSWS

SEQ ID NO: 933179 - protein, 18 aa, Mycobacterium
PRPYITVTAQGERDAVVQ

SEQ ID NO: 933180 - protein, 19 aa, Mycobacterium
PRQLAVAAMGAALMSGLVT

SEQ ID NO: 933181 - protein, 24 aa, Mycobacterium
PRQQTLRASVDWSHALLTEPERVL

SEQ ID NO: 933182 - protein, 26 aa, Mycobacterium
PRRAAIPVLLCNDATLAGLAEARSGA

SEQ ID NO: 933183 - protein, 17 aa, Mycobacterium
PRRLGIAAVGAALLSGV

SEQ ID NO: 933184 - protein, 23 aa, Mycobacterium
PRRRADLDAGIFEHRCPVGDEEL

SEQ ID NO: 933185 - protein, 25 aa, Mycobacterium
PRRSLAYDRAWWFARFVAQTYGTTA

SEQ ID NO: 933186 - protein, 19 aa, Mycobacterium
PRRVLLERLLDGFDAERIR

SEQ ID NO: 933187 - protein, 24 aa, Mycobacterium
PRRYEPRWFRSPEMHGVKNVGDLC

SEQ ID NO: 933188 - protein, 23 aa, Mycobacterium
PRSADDARWVYYSSGTTADPKGI

SEQ ID NO: 933189 - protein, 18 aa, Mycobacterium
PRSGTTLMHALMSVDPEA

SEQ ID NO: 933190 - protein, 20 aa, Mycobacterium
PRSNLARFGIAPTYPQDFVL

SEQ ID NO: 933191 - protein, 25 aa, Mycobacterium
PRSNMARYGIAPTYPLDFVADVASN

SEQ ID NO: 933192 - protein, 22 aa, Mycobacterium
PRTDFAVGPFFTILGGFMAMDV

SEQ ID NO: 933193 - protein, 17 aa, Mycobacterium
PRTGRPQGWPAWADPDV

SEQ ID NO: 933194 - protein, 21 aa, Mycobacterium
PRTITGPHPIRLPELTSKLLA

SEQ ID NO: 933195 - protein, 26 aa, Mycobacterium
PRTTARWKWRLSLFSEPSAPKSDWRF

SEQ ID NO: 933196 - protein, 25 aa, Mycobacterium
PRTVFARAGSYYSDLAALSSGELAF

SEQ ID NO: 933197 - protein, 20 aa, Mycobacterium
PRVGTAMTLAELCQAALQQS

SEQ ID NO: 933198 - protein, 18 aa, Mycobacterium
PRVPLADGIRRTVDFFRS

SEQ ID NO: 933199 - protein, 25 aa, Mycobacterium
PRVTTDWNPSWAWSNGNMISTLDDM

SEQ ID NO: 933200 - protein, 21 aa, Mycobacterium
PRVYGQQALEYVIRRGGSQMG

SEQ ID NO: 933201 - protein, 20 aa, Mycobacterium
PRWEPDDLLRALGLRPPGHQ

SEQ ID NO: 933202 - protein, 21 aa, Mycobacterium
PRWRLGILATVLATTACSTNG

SEQ ID NO: 933203 - protein, 20 aa, Mycobacterium
PRYAESFAAGAAIGAAVRGP

SEQ ID NO: 933204 - protein, 17 aa, Mycobacterium
PSAAKWTIAKARETIQD

SEQ ID NO: 933205 - protein, 17 aa, Mycobacterium
PSAAMGRAIPVAFQGGG

SEQ ID NO: 933206 - protein, 20 aa, Mycobacterium
PSAARGGAVTNWAIARPPGR

SEQ ID NO: 933207 - protein, 18 aa, Mycobacterium
PSAARTALAYAKQKDEMY

SEQ ID NO: 933208 - protein, 24 aa, Mycobacterium
PSAGDYRLYFDFKHDDVVRTAEFT

SEQ ID NO: 933209 - protein, 18 aa, Mycobacterium
PSAGLRRILTRELGFARL

SEQ ID NO: 933210 - protein, 25 aa, Mycobacterium
PSAKFGIPVTSRFGGRAIDACSDGD

SEQ ID NO: 933211 - protein, 18 aa, Mycobacterium
PSALAEVVARVWRDTQDE

SEQ ID NO: 933212 - protein, 25 aa, Mycobacterium
PSAPESFAIPGCYNPSVPPVARPKK

SEQ ID NO: 933213 - protein, 24 aa, Mycobacterium
PSARRLGAGVSRLRSAGAAVVVGT

SEQ ID NO: 933214 - protein, 19 aa, Mycobacterium
PSASRPGSGIPGGPYNAVA

SEQ ID NO: 933215 - protein, 20 aa, Mycobacterium
PSASRRALAERLPAYMVPAA

SEQ ID NO: 933216 - protein, 20 aa, Mycobacterium
PSAWSAEGLLVYLPDDAQDA

SEQ ID NO: 933217 - protein, 25 aa, Mycobacterium
PSDARCLVHQSMAPGLAAAAGALRP

SEQ ID NO: 933218 - protein, 18 aa, Mycobacterium
PSDEAFSRMFERDKNELR

SEQ ID NO: 933219 - protein, 17 aa, Mycobacterium
PSDGRWWNTMSSMTDLV

SEQ ID NO: 933220 - protein, 18 aa, Mycobacterium
PSDGRWWNTMSSVTDLIR

SEQ ID NO: 933221 - protein, 17 aa, Mycobacterium
PSDIAWAGWSAHYGAPA

SEQ ID NO: 933222 - protein, 18 aa, Mycobacterium
PSDYVGVYANDYWGPATV

SEQ ID NO: 933223 - protein, 23 aa, Mycobacterium
PSFRLLGIAARVFVLFDTGRWVV

SEQ ID NO: 933224 - protein, 24 aa, Mycobacterium
PSGAMGRDIPVAFLAGGPHAAYLL

SEQ ID NO: 933225 - protein, 23 aa, Mycobacterium
PSGAMGRDIPVAFLGGGPHAVYL

SEQ ID NO: 933226 - protein, 24 aa, Mycobacterium
PSGFEVRGDPTLLITAISNLVANA

SEQ ID NO: 933227 - protein, 23 aa, Mycobacterium
PSGGAPGDFLSAGGHFQVPGRAK

SEQ ID NO: 933228 - protein, 28 aa, Mycobacterium
PSGGMLSRLRLLFSLGLGARLGNGRQYL

SEQ ID NO: 933229 - protein, 23 aa, Mycobacterium
PSGLAFYGGSLWVAALRGERLFQ

SEQ ID NO: 933230 - protein, 17 aa, Mycobacterium
PSGMRLVKVETLSQAVD

SEQ ID NO: 933231 - protein, 19 aa, Mycobacterium
PSGMYWRVAINTAGHLTDE

SEQ ID NO: 933232 - protein, 18 aa, Mycobacterium
PSGQWDRSSPAPADSSGA

SEQ ID NO: 933233 - protein, 22 aa, Mycobacterium
PSGRSGSGFVSRALPGNLPDAA

SEQ ID NO: 933234 - protein, 21 aa, Mycobacterium
PSGRWACAILPRVRAGCQNAQ

SEQ ID NO: 933235 - protein, 30 aa, Mycobacterium
PSGSPLSWAMAAAARREALVAGGPISVDPT

SEQ ID NO: 933236 - protein, 23 aa, Mycobacterium
PSHDWPARILRVTAIDIATGELV

SEQ ID NO: 933237 - protein, 24 aa, Mycobacterium
PSHEWPQERILRIAAIDIATGELV

SEQ ID NO: 933238 - protein, 24 aa, Mycobacterium
PSINISASLTWGAERYRYPTNLPK

SEQ ID NO: 933239 - protein, 25 aa, Mycobacterium
PSIPGDSGGPVWQFARDTTATVIGI

SEQ ID NO: 933240 - protein, 27 aa, Mycobacterium
PSISTPMGMTADWWARANLPMNEGCTG

SEQ ID NO: 933241 - protein, 25 aa, Mycobacterium
PSIYDPPMRTMIAFGGRYPTTVIPS

SEQ ID NO: 933242 - protein, 25 aa, Mycobacterium
PSKLWTIKDLGGWKSVDKELFDKND

SEQ ID NO: 933243 - protein, 22 aa, Mycobacterium
PSKPRVSKFLAAGVAVVGAGAV

SEQ ID NO: 933244 - protein, 17 aa, Mycobacterium
PSLAMSTKAQLVHATNP

SEQ ID NO: 933245 - protein, 17 aa, Mycobacterium
PSLKDSLSYQGDMYSVP

SEQ ID NO: 933246 - protein, 22 aa, Mycobacterium
PSLPALERELALAPTVVGTYAE

SEQ ID NO: 933247 - protein, 19 aa, Mycobacterium
PSPFHVCATVAARLTAAGY

SEQ ID NO: 933248 - protein, 28 aa, Mycobacterium
PSPMLRFVVGGLLVVLAFAGGFAVSACK

SEQ ID NO: 933249 - protein, 20 aa, Mycobacterium
PSPQRLAAGTVLRAENVGTE

SEQ ID NO: 933250 - protein, 19 aa, Mycobacterium
PSPQWWFDDETLYGPDGLA

SEQ ID NO: 933251 - protein, 24 aa, Mycobacterium
PSPRATGRRALRAVAAAAVVLAGP

SEQ ID NO: 933252 - protein, 30 aa, Mycobacterium
PSPSGLCSYPLRKCGSGDLYGGTEPALTWY

SEQ ID NO: 933253 - protein, 18 aa, Mycobacterium
PSPSRLVQVAGWDEPPGA

SEQ ID NO: 933254 - protein, 21 aa, Mycobacterium
PSPTGRRIRRPRTNPRCPRSR

SEQ ID NO: 933255 - protein, 19 aa, Mycobacterium
PSQALPGDLIFYGPEGTQS

SEQ ID NO: 933256 - protein, 22 aa, Mycobacterium
PSRAAEVLGFRAAVEPLEGLRG

SEQ ID NO: 933257 - protein, 20 aa, Mycobacterium
PSRRFELAASEVLKLNPNTG

SEQ ID NO: 933258 - protein, 29 aa, Mycobacterium
PSRRLGSNPDLMGWNFRRVALTPEDTAYT

SEQ ID NO: 933259 - protein, 20 aa, Mycobacterium
PSRYDSFTGVATMTRVSQDL

SEQ ID NO: 933260 - protein, 20 aa, Mycobacterium
PSSAVGLCREMRGAWDESAA

SEQ ID NO: 933261 - protein, 17 aa, Mycobacterium
PSSGPRPEARAIGVRGN

SEQ ID NO: 933262 - protein, 17 aa, Mycobacterium
PSSLHWHGIALRNDMDG

SEQ ID NO: 933263 - protein, 19 aa, Mycobacterium
PSSVQLATWLNGPGAEVLK

SEQ ID NO: 933264 - protein, 18 aa, Mycobacterium
PSTLPTRVVRTQGVKIDP

SEQ ID NO: 933265 - protein, 31 aa, Mycobacterium
PSTRVAVLLPAHWQTAAVLLGVWWIGAEVVL

SEQ ID NO: 933266 - protein, 18 aa, Mycobacterium
PSVAGLDIDAARARIKEA

SEQ ID NO: 933267 - protein, 18 aa, Mycobacterium
PSVAGLDIEAARTRLKEA

SEQ ID NO: 933268 - protein, 18 aa, Mycobacterium
PSVAILVFPFIPQALRHR

SEQ ID NO: 933269 - protein, 17 aa, Mycobacterium
PSVAPCNPGDPGVATAT

SEQ ID NO: 933270 - protein, 22 aa, Mycobacterium
PSVRLGALARLFAVAAQPTHRA

SEQ ID NO: 933271 - protein, 24 aa, Mycobacterium
PSVVYADGLPYVFDSFDVTGRTPP

SEQ ID NO: 933272 - protein, 18 aa, Mycobacterium
PSYQGGNCPPGMTCTHWF

SEQ ID NO: 933273 - protein, 17 aa, Mycobacterium
PTADFTGTDTFTYTLNG

SEQ ID NO: 933274 - protein, 18 aa, Mycobacterium
PTADLIIVAVKAWQVSAA

SEQ ID NO: 933275 - protein, 21 aa, Mycobacterium
PTADVPLPILFIRDQLAAAAA

SEQ ID NO: 933276 - protein, 21 aa, Mycobacterium
PTADVPPSMFLIRDVLGGAAG

SEQ ID NO: 933277 - protein, 18 aa, Mycobacterium
PTADWKEANRIASADLAW

SEQ ID NO: 933278 - protein, 23 aa, Mycobacterium
PTAFFCGMLGALANVTAPESSKL

SEQ ID NO: 933279 - protein, 25 aa, Mycobacterium
PTAFGSFPDVEWAKVPGDVVTQLVR

SEQ ID NO: 933280 - protein, 18 aa, Mycobacterium
PTAGRYLLYLDFKVDDTV

SEQ ID NO: 933281 - protein, 18 aa, Mycobacterium
PTAVIAMLRQGMSDSDSP

SEQ ID NO: 933282 - protein, 25 aa, Mycobacterium
PTAWLAEGLLPFLPAAAQHALFTAI

SEQ ID NO: 933283 - protein, 24 aa, Mycobacterium
PTDFTAWAVPGWSWDDVLPHFRAI

SEQ ID NO: 933284 - protein, 28 aa, Mycobacterium
PTDGKPGWPGFLSIPLAAYRRHFEISVF

SEQ ID NO: 933285 - protein, 21 aa, Mycobacterium
PTDSFAVLALLARRLTNDEVQ

SEQ ID NO: 933286 - protein, 22 aa, Mycobacterium
PTESALRFVGAATFEALSGNPV

SEQ ID NO: 933287 - protein, 29 aa, Mycobacterium
PTGDRVVGRYVRWEVLPGVRDVGLVDLAG

SEQ ID NO: 933288 - protein, 17 aa, Mycobacterium
PTGGNLFTPEVKAPPAP

SEQ ID NO: 933289 - protein, 26 aa, Mycobacterium
PTGGQGLDMVPGWTELVTAISKLPLL

SEQ ID NO: 933290 - protein, 23 aa, Mycobacterium
PTGKFNLMLRLYWPKETPPSIID

SEQ ID NO: 933291 - protein, 24 aa, Mycobacterium
PTGSRWEMDPTLLVSADVTSQNPF

SEQ ID NO: 933292 - protein, 23 aa, Mycobacterium
PTHPVAGLLGFLGRRQHLVPSAG

SEQ ID NO: 933293 - protein, 26 aa, Mycobacterium
PTITARLNFQLAFGARVGQRLSEARD

SEQ ID NO: 933294 - protein, 23 aa, Mycobacterium
PTKPGSYPIVLATYEIVCSKYPD

SEQ ID NO: 933295 - protein, 31 aa, Mycobacterium
PTKTGNIALEIRVDGAKARAYACDNKGIETW

SEQ ID NO: 933296 - protein, 18 aa, Mycobacterium
PTLAAFVRHCDQLARGGQ

SEQ ID NO: 933297 - protein, 17 aa, Mycobacterium
PTLDLGVVSDKFATEHP

SEQ ID NO: 933298 - protein, 18 aa, Mycobacterium
PTLLNVVGSLVLNLLVGF

SEQ ID NO: 933299 - protein, 26 aa, Mycobacterium
PTLLRASPAWARLMRDVIRFDDSLDD

SEQ ID NO: 933300 - protein, 17 aa, Mycobacterium
PTLNVASALGFCLDSIA

SEQ ID NO: 933301 - protein, 23 aa, Mycobacterium
PTLPAEAPVPMPDPSNRQTDPAA

SEQ ID NO: 933302 - protein, 22 aa, Mycobacterium
PTLPAGVRYISVASGAGHAVLL

SEQ ID NO: 933303 - protein, 18 aa, Mycobacterium
PTLPLYRQQRTVLTSNKM

SEQ ID NO: 933304 - protein, 21 aa, Mycobacterium
PTLPQSYPWDTNPRSFDPSSN

SEQ ID NO: 933305 - protein, 17 aa, Mycobacterium
PTLRVLIQIADGSGNEL

SEQ ID NO: 933306 - protein, 19 aa, Mycobacterium
PTMDPRPYITVTAQGERDA

SEQ ID NO: 933307 - protein, 18 aa, Mycobacterium
PTMHELFSVGWGTPDLRE

SEQ ID NO: 933308 - protein, 24 aa, Mycobacterium
PTMPPHPVSIAWDPPGFTPGVGGS

SEQ ID NO: 933309 - protein, 18 aa, Mycobacterium
PTPADILLDLARKQDAAV

SEQ ID NO: 933310 - protein, 19 aa, Mycobacterium
PTPALVAWAQDGTDLDAPR

SEQ ID NO: 933311 - protein, 20 aa, Mycobacterium
PTPDPEPWEAPPPPEEGAPL

SEQ ID NO: 933312 - protein, 26 aa, Mycobacterium
PTPDRVRELVVAWGKQYPLFGRTSAL

SEQ ID NO: 933313 - protein, 22 aa, Mycobacterium
PTPDSPGGWVYIVADNFTRRDP

SEQ ID NO: 933314 - protein, 23 aa, Mycobacterium
PTPDSPTGWVYIVANSFTRWLPV

SEQ ID NO: 933315 - protein, 19 aa, Mycobacterium
PTPEALTDILARLADPNVP

SEQ ID NO: 933316 - protein, 18 aa, Mycobacterium
PTPEFAALGADTWHWHPM

SEQ ID NO: 933317 - protein, 18 aa, Mycobacterium
PTPFMVPGFAVRAALGEF

SEQ ID NO: 933318 - protein, 23 aa, Mycobacterium
PTPGRYLLYLDFQVNGRVHTAQF

SEQ ID NO: 933319 - protein, 18 aa, Mycobacterium
PTPLAVPGFVLRAALGEF

SEQ ID NO: 933320 - protein, 20 aa, Mycobacterium
PTPLMLPGFAVRAALGEFAD

SEQ ID NO: 933321 - protein, 19 aa, Mycobacterium
PTPLMLPGFAVRAGLGEFA

SEQ ID NO: 933322 - protein, 18 aa, Mycobacterium
PTPREVPAPAGLDAPLDA

SEQ ID NO: 933323 - protein, 37 aa, Mycobacterium
PTPTFPEPWPPFGLGGTRFSPCPAPPPPPPGQPYPSP

SEQ ID NO: 933324 - protein, 22 aa, Mycobacterium
PTPYAMALSFNFNGVTPYADAY

SEQ ID NO: 933325 - protein, 19 aa, Mycobacterium
PTQAGAYPIVLATYEIVCS

SEQ ID NO: 933326 - protein, 24 aa, Mycobacterium
PTQALFGRPLIGNGADGAPGTGQS

SEQ ID NO: 933327 - protein, 22 aa, Mycobacterium
PTQDSMCLWFTYSTPDTNKDNV

SEQ ID NO: 933328 - protein, 23 aa, Mycobacterium
PTQDSMCMWFTYSTPDANKDNVV

SEQ ID NO: 933329 - protein, 22 aa, Mycobacterium
PTQDSMCVWFTYSTPDANKDHV

SEQ ID NO: 933330 - protein, 23 aa, Mycobacterium
PTQPGSYPIVLATYEIVCSKYPD

SEQ ID NO: 933331 - protein, 22 aa, Mycobacterium
PTRAEGGLNRDATYISMLQSYG

SEQ ID NO: 933332 - protein, 21 aa, Mycobacterium
PTRETYSWDAVTLLGTIDSQF

SEQ ID NO: 933333 - protein, 17 aa, Mycobacterium
PTRVLTLSLLPGGNNDD

SEQ ID NO: 933334 - protein, 23 aa, Mycobacterium
PTSGKRPEHEGIRGTVASVSGNA

SEQ ID NO: 933335 - protein, 17 aa, Mycobacterium
PTSIALGGTQVGGLVPG

SEQ ID NO: 933336 - protein, 29 aa, Mycobacterium
PTTKYKAFNWDQGYRKPITYDTLWQPKTD

SEQ ID NO: 933337 - protein, 21 aa, Mycobacterium
PTTPDRLVGITSDVGAVAISG

SEQ ID NO: 933338 - protein, 19 aa, Mycobacterium
PTTSRLAVRAGLVSLAAAS

SEQ ID NO: 933339 - protein, 19 aa, Mycobacterium
PTTTFPIYLDKVGVPEDQV

SEQ ID NO: 933340 - protein, 17 aa, Mycobacterium
PTTVHWHGLAVPNDMDG

SEQ ID NO: 933341 - protein, 24 aa, Mycobacterium
PTTWQRPWDFSGFLDTARALTKRD

SEQ ID NO: 933342 - protein, 18 aa, Mycobacterium
PTVEVRWADLTDAAAVDT

SEQ ID NO: 933343 - protein, 17 aa, Mycobacterium
PTVSLQQAFALSCNTAF

SEQ ID NO: 933344 - protein, 17 aa, Mycobacterium
PTWPATERFNAKLRAAM

SEQ ID NO: 933345 - protein, 19 aa, Mycobacterium
PTYLAPLTLRACEELNEAA

SEQ ID NO: 933346 - protein, 24 aa, Mycobacterium
PVAAFKWHARVAIEDPDRVQQQLA

SEQ ID NO: 933347 - protein, 18 aa, Mycobacterium
PVAAFKWTTHAAIEDEGR

SEQ ID NO: 933348 - protein, 18 aa, Mycobacterium
PVAAWGDDEKHHMVTPGP

SEQ ID NO: 933349 - protein, 18 aa, Mycobacterium
PVAAYKWNTHGAIEDPVR

SEQ ID NO: 933350 - protein, 24 aa, Mycobacterium
PVADPALVPLFFIAREARKHVKVV

SEQ ID NO: 933351 - protein, 24 aa, Mycobacterium
PVADPALVPLFFVAREARKHVKVV

SEQ ID NO: 933352 - protein, 21 aa, Mycobacterium
PVAEIDAGPAPSYLAEDAGMR

SEQ ID NO: 933353 - protein, 18 aa, Mycobacterium
PVAFPVGLLPTNPNDSGG

SEQ ID NO: 933354 - protein, 22 aa, Mycobacterium
PVASGYPGYPGMPGGGASRSVG

SEQ ID NO: 933355 - protein, 23 aa, Mycobacterium
PVDFRFLPDGRILVAEKAGAIRV

SEQ ID NO: 933356 - protein, 24 aa, Mycobacterium
PVDPRRYREYAAIIQAEADQFGLT

SEQ ID NO: 933357 - protein, 18 aa, Mycobacterium
PVELARTVVDLTITGMTS

SEQ ID NO: 933358 - protein, 20 aa, Mycobacterium
PVETVRGWLRRFAERAEAVR

SEQ ID NO: 933359 - protein, 26 aa, Mycobacterium
PVFGGPAELFWDWPGAKQSDCAGLSK

SEQ ID NO: 933360 - protein, 17 aa, Mycobacterium
PVFKAAGFRPNNAAPGD

SEQ ID NO: 933361 - protein, 29 aa, Mycobacterium
PVGALRWQGPRPAPKWDGVRDATAYGPRC

SEQ ID NO: 933362 - protein, 17 aa, Mycobacterium
PVGDFLSAGGHLQVSGR

SEQ ID NO: 933363 - protein, 23 aa, Mycobacterium
PVGDGTCYWKRMSNPDGALIDNA

SEQ ID NO: 933364 - protein, 25 aa, Mycobacterium
PVGDSTVYVFPGWIDVGTTNPYITV

SEQ ID NO: 933365 - protein, 23 aa, Mycobacterium
PVGELDLLAAYIAVAATASLSLS

SEQ ID NO: 933366 - protein, 20 aa, Mycobacterium
PVGTGPFSFLGQKSGDSISL

SEQ ID NO: 933367 - protein, 23 aa, Mycobacterium
PVHPAEVGYAWVSAAPRAALRTV

SEQ ID NO: 933368 - protein, 24 aa, Mycobacterium
PVIEKAYAAGPCSGHLSDIEHIVL

SEQ ID NO: 933369 - protein, 17 aa, Mycobacterium
PVIEKAYGAGPCSGHLT

SEQ ID NO: 933370 - protein, 24 aa, Mycobacterium
PVIEKAYGAGPCSGHLTDIEHFVF

SEQ ID NO: 933371 - protein, 17 aa, Mycobacterium
PVIRVVRGAVLVIPGEP

SEQ ID NO: 933372 - protein, 27 aa, Mycobacterium
PVKAPDWLAPRRARGETVSRIVDTWTQ

SEQ ID NO: 933373 - protein, 20 aa, Mycobacterium
PVLGDPVPVSFDVVIRDDSE

SEQ ID NO: 933374 - protein, 20 aa, Mycobacterium
PVLHFEGWYDAFLRGGLENF

SEQ ID NO: 933375 - protein, 22 aa, Mycobacterium
PVLPDARVQFMLDDTAPIAAVT

SEQ ID NO: 933376 - protein, 17 aa, Mycobacterium
PVLQLPGPVPQAPGPAP

SEQ ID NO: 933377 - protein, 20 aa, Mycobacterium
PVMRSLRPYQVLRRLFDSHS

SEQ ID NO: 933378 - protein, 25 aa, Mycobacterium
PVNEICGSGSLLKSVTDRFSGVIPE

SEQ ID NO: 933379 - protein, 18 aa, Mycobacterium
PVPAECLRGLDANALRTP

SEQ ID NO: 933380 - protein, 25 aa, Mycobacterium
PVPDPRYPFLGVHFTRGIDGHVHVG

SEQ ID NO: 933381 - protein, 18 aa, Mycobacterium
PVPELTWIPAHPAPQPAP

SEQ ID NO: 933382 - protein, 26 aa, Mycobacterium
PVPIGRPVPHAAAFVLDKFLRPVLDG

SEQ ID NO: 933383 - protein, 18 aa, Mycobacterium
PVPLSKYLESIGVSGEQV

SEQ ID NO: 933384 - protein, 17 aa, Mycobacterium
PVQLKSRLGDFCLDAPS

SEQ ID NO: 933385 - protein, 24 aa, Mycobacterium
PVRANGMTPYMVRILGASAPTPQA

SEQ ID NO: 933386 - protein, 19 aa, Mycobacterium
PVSDLRTSLPTAVLEDSAD

SEQ ID NO: 933387 - protein, 19 aa, Mycobacterium
PVSGTAFAVTPKLRESYAE

SEQ ID NO: 933388 - protein, 21 aa, Mycobacterium
PVSRGRLLNVVAFTPSNLDAE

SEQ ID NO: 933389 - protein, 19 aa, Mycobacterium
PVTEPRVGTAMTLAELCQA

SEQ ID NO: 933390 - protein, 18 aa, Mycobacterium
PVTPEIRVTPAAPVTAPA

SEQ ID NO: 933391 - protein, 21 aa, Mycobacterium
PVTQWTRWRQPVIGMPSTPRF

SEQ ID NO: 933392 - protein, 18 aa, Mycobacterium
PVVDRFNALSALTTDRPD

SEQ ID NO: 933393 - protein, 27 aa, Mycobacterium
PVVFSHKFAIEYWTLMNAKNAKDSLLN

SEQ ID NO: 933394 - protein, 18 aa, Mycobacterium
PVVLNLWAYWCGPCADEL

SEQ ID NO: 933395 - protein, 19 aa, Mycobacterium
PVVLNLWAYWCGPCADELP

SEQ ID NO: 933396 - protein, 25 aa, Mycobacterium
PVVPLWNYISVLGWSAEVSNVTVTW

SEQ ID NO: 933397 - protein, 27 aa, Mycobacterium
PVVTRPDRSAGWVRRALRPGKATASPS

SEQ ID NO: 933398 - protein, 18 aa, Mycobacterium
PVYHDSRCTFGALCCSGL

SEQ ID NO: 933399 - protein, 20 aa, Mycobacterium
PVYPVCTLDAIGHGTAGRVL

SEQ ID NO: 933400 - protein, 17 aa, Mycobacterium
PWAPFTIDFNLANIGGP

SEQ ID NO: 933401 - protein, 18 aa, Mycobacterium
PWCADFTSWVMRASGKPF

SEQ ID NO: 933402 - protein, 19 aa, Mycobacterium
PWGGKPVKRLELPRDAALV

SEQ ID NO: 933403 - protein, 18 aa, Mycobacterium
PWGGKPVKRLELPRDATL

SEQ ID NO: 933404 - protein, 19 aa, Mycobacterium
PWHPKGLAIDVMIPNFHTP

SEQ ID NO: 933405 - protein, 18 aa, Mycobacterium
PWHPRGLALDVMIPNPGS

SEQ ID NO: 933406 - protein, 22 aa, Mycobacterium
PWIPSINPGLHFYIGQPEVTLL

SEQ ID NO: 933407 - protein, 18 aa, Mycobacterium
PWNGYRGAEGIRLVHANF

SEQ ID NO: 933408 - protein, 19 aa, Mycobacterium
PWPATAFVALLVALAVAVA

SEQ ID NO: 933409 - protein, 17 aa, Mycobacterium
PWPTADVPLPILFIRDQ

SEQ ID NO: 933410 - protein, 18 aa, Mycobacterium
PWQAEMEDAFGFTETVDQ

SEQ ID NO: 933411 - protein, 20 aa, Mycobacterium
PWRMEACSVVDGVERRVSPV

SEQ ID NO: 933412 - protein, 25 aa, Mycobacterium
PWTMPEPLLPMAIEAHAKTDEDKLA

SEQ ID NO: 933413 - protein, 22 aa, Mycobacterium
PWYGDPDQIRNCPAPGARCDQP

SEQ ID NO: 933414 - protein, 19 aa, Mycobacterium
PYAELFCRAAGGQWSDLVQ

SEQ ID NO: 933415 - protein, 17 aa, Mycobacterium
PYAPYLHPWTTGKELYF

SEQ ID NO: 933416 - protein, 27 aa, Mycobacterium
PYDDLAWFCIRAWRFGAPAGLGAGGLG

SEQ ID NO: 933417 - protein, 17 aa, Mycobacterium
PYFAEMFLGRLDVREAL

SEQ ID NO: 933418 - protein, 17 aa, Mycobacterium
PYFDEMFLGRGQVATIL

SEQ ID NO: 933419 - protein, 27 aa, Mycobacterium
PYFWFCGQCHACARGRSHACQNLMAGE

SEQ ID NO: 933420 - protein, 17 aa, Mycobacterium
PYINVIVARAEEKDNPT

SEQ ID NO: 933421 - protein, 20 aa, Mycobacterium
PYKIEFSTFTFGPPQIEALT

SEQ ID NO: 933422 - protein, 19 aa, Mycobacterium
PYLPAVMERHLPVVVVDQP

SEQ ID NO: 933423 - protein, 25 aa, Mycobacterium
PYNLRYRLWADWDFNIRCFSNPALI

SEQ ID NO: 933424 - protein, 24 aa, Mycobacterium
PYQHVEKFIPRQITNILTGRRPRL

SEQ ID NO: 933425 - protein, 22 aa, Mycobacterium
PYSVNCFRGRPTTVQGGAQRPI

SEQ ID NO: 933426 - protein, 19 aa, Mycobacterium
PYTAIPKVWFHDLLRPDGR

SEQ ID NO: 933427 - protein, 20 aa, Mycobacterium
PYTYLLDVVEEFLGRKLPPI

SEQ ID NO: 933428 - protein, 28 aa, Mycobacterium
PYVPYPCDWNYYNCNEWWDVDFDVDLDP

SEQ ID NO: 933429 - protein, 17 aa, Mycobacterium
QAAAGNWDRAPSGPASS

SEQ ID NO: 933430 - protein, 26 aa, Mycobacterium
QAADIPGRFVVAAAMVRHLLTDPMLP

SEQ ID NO: 933431 - protein, 18 aa, Mycobacterium
QAAKLCNNMVLAVQQIAI

SEQ ID NO: 933432 - protein, 17 aa, Mycobacterium
QAAKPTGWCSWQGLATV

SEQ ID NO: 933433 - protein, 41 aa, Mycobacterium
QAALSRIGSPYSWGGSGPGAFDCSGLVMWSFQQAGIALPHS

SEQ ID NO: 933434 - protein, 44 aa, Mycobacterium; identical to SEQ ID NO: 623198

SEQ ID NO: 933435 - protein, 17 aa, Mycobacterium
QAAPALNLPSLTLAPPT

SEQ ID NO: 933436 - protein, 23 aa, Mycobacterium
QAARFPPIGSRSISGPNAVSGYA

SEQ ID NO: 933437 - protein, 22 aa, Mycobacterium
QADCFAGVYLYWVAAGKSPRFT

SEQ ID NO: 933438 - protein, 22 aa, Mycobacterium
QADCFAGVYLYWVAEGKSPRFR

SEQ ID NO: 933439 - protein, 19 aa, Mycobacterium
QADCLAGTYMRWVAEGNSP

SEQ ID NO: 933440 - protein, 23 aa, Mycobacterium
QADCLGGVYMRWVAEGKSPRFTL

SEQ ID NO: 933441 - protein, 21 aa, Mycobacterium
QADFSTLPWTFTITTTVPAVI

SEQ ID NO: 933442 - protein, 21 aa, Mycobacterium
QADLFHAQFVQLLNSGASAYT

SEQ ID NO: 933443 - protein, 17 aa, Mycobacterium
QADYVLWWINRIREGRI

SEQ ID NO: 933444 - protein, 27 aa, Mycobacterium
QAEQRCGSPVWNLPLVFGPIAIAYRVN

SEQ ID NO: 933445 - protein, 20 aa, Mycobacterium
QAGAARFIGFFATRTRFGLW

SEQ ID NO: 933446 - protein, 19 aa, Mycobacterium
QAGAIAFASPLSYPVVADE

SEQ ID NO: 933447 - protein, 17 aa, Mycobacterium
QAGETFDSAPYGWPVEK

SEQ ID NO: 933448 - protein, 25 aa, Mycobacterium
QAGFPLGWVHDVVWAPRPVTVPVTG

SEQ ID NO: 933449 - protein, 26 aa, Mycobacterium
QAGLAMLAPIWGYRPLLDIDDQTARD

SEQ ID NO: 933450 - protein, 24 aa, Mycobacterium
QAIGSAKAVCWCLDGGESGLELVH

SEQ ID NO: 933451 - protein, 26 aa, Mycobacterium
QAILAAWERGDIAAAYSWLPTLDDLR

SEQ ID NO: 933452 - protein, 19 aa, Mycobacterium
QAKAMPAERMIRYYTARGL

SEQ ID NO: 933453 - protein, 24 aa, Mycobacterium
QAKYPMYMIIRRQLTDAAVRPATP

SEQ ID NO: 933454 - protein, 21 aa, Mycobacterium
QALLGRPLIGNGANGAPGTGA

SEQ ID NO: 933455 - protein, 21 aa, Mycobacterium
QALLGRPLIGNGANGTAADPN

SEQ ID NO: 933456 - protein, 17 aa, Mycobacterium
QALLPDMLDAGWGRIVN

SEQ ID NO: 933457 - protein, 30 aa, Mycobacterium
QALMSAAMELQRIGSVLVEANTAAAAPTTG

SEQ ID NO: 933458 - protein, 19 aa, Mycobacterium
QALNRLSATFADQRDVVTD

SEQ ID NO: 933459 - protein, 20 aa, Mycobacterium
QALQSITFRATRYGGGLLDV

SEQ ID NO: 933460 - protein, 24 aa, Mycobacterium
QAPARPALPYQVQYGDRCFHGHCL

SEQ ID NO: 933461 - protein, 26 aa, Mycobacterium
QAPEFPLPSAWRLLTSRGPYELAGEL

SEQ ID NO: 933462 - protein, 26 aa, Mycobacterium
QAPEILRNITYRARVDGVSRGASITY

SEQ ID NO: 933463 - protein, 23 aa, Mycobacterium
QAPINRRMALMALGAGVLAPNVL

SEQ ID NO: 933464 - protein, 20 aa, Mycobacterium
QAPSRLVIDVTIKGGEVTPT

SEQ ID NO: 933465 - protein, 22 aa, Mycobacterium
QARAAADMYTRYAASGDEPPPL

SEQ ID NO: 933466 - protein, 19 aa, Mycobacterium
QARALLREVLIDELQPELD

SEQ ID NO: 933467 - protein, 33 aa, Mycobacterium
QAREFPELVQIFGDFALYCAIRAKNMPQPPLAA

SEQ ID NO: 933468 - protein, 25 aa, Mycobacterium
QARIDRLNAQLARYGEVEMTSCVGG

SEQ ID NO: 933469 - protein, 24 aa, Mycobacterium
QARPVLEPMAGKIIHCGAAGAGQA

SEQ ID NO: 933470 - protein, 21 aa, Mycobacterium
QARPWWRPGGAIWPVSELQIV

SEQ ID NO: 933471 - protein, 22 aa, Mycobacterium
QARRAIARGAVFLAETEVQRVA

SEQ ID NO: 933472 - protein, 19 aa, Mycobacterium
QARSITLTFIRNAQSQADA

SEQ ID NO: 933473 - protein, 19 aa, Mycobacterium
QARSITVTFVRHAQSEANA

SEQ ID NO: 933474 - protein, 32 aa, Mycobacterium
QASATPALRPIIGPGGWLIGDGLDAAADCTGE

SEQ ID NO: 933475 - protein, 23 aa, Mycobacterium
QASDINAPIPFTATPPTGNPNGQ

SEQ ID NO: 933476 - protein, 26 aa, Mycobacterium
QASEIYAPLQAWQRMGQPTIAINANF

SEQ ID NO: 933477 - protein, 32 aa, Mycobacterium
QASGKVMVFAAASLKPVFTRLGQQFTAENPGS

SEQ ID NO: 933478 - protein, 22 aa, Mycobacterium
QASQLGRDWCAQGAQVEFWTNE

SEQ ID NO: 933479 - protein, 28 aa, Mycobacterium
QATGIAPRLSGYRAGLAGSIAASCTAAY

SEQ ID NO: 933480 - protein, 24 aa, Mycobacterium
QATKRIGKVFGEFDSDSSAMVVLE

SEQ ID NO: 933481 - protein, 21 aa, Mycobacterium
QATPCCVEIVAAPATSPQPAL

SEQ ID NO: 933482 - protein, 17 aa, Mycobacterium
QATPVYVPADNNFSQHQ

SEQ ID NO: 933483 - protein, 18 aa, Mycobacterium
QAVAALRPILAAVKAETT

SEQ ID NO: 933484 - protein, 23 aa, Mycobacterium
QAVLPHMRRLGAGRIVVIASEWG

SEQ ID NO: 933485 - protein, 17 aa, Mycobacterium
QAVLTLLAMRLMGDGYS

SEQ ID NO: 933486 - protein, 27 aa, Mycobacterium
QAYQFPMGLGLVAQFFGRYFTPDEARR

SEQ ID NO: 933487 - protein, 25 aa, Mycobacterium
QAYQFPMGLGLVSQFFGKYFSPAEA

SEQ ID NO: 933488 - protein, 25 aa, Mycobacterium
QAYQFPMGLGLVSQFFGKYFTPDEA

SEQ ID NO: 933489 - protein, 24 aa, Mycobacterium
QCLLLERWATVYPQPRAVHLDDEI

SEQ ID NO: 933490 - protein, 17 aa, Mycobacterium
QCSPRCWPPWEPPPAPG

SEQ ID NO: 933491 - protein, 27 aa, Mycobacterium
QDAAWLVTTWRLVRPYAIATDPHQLSW

SEQ ID NO: 933492 - protein, 24 aa, Mycobacterium
QDGFPGMAAAYGFDPARAQTPILQ

SEQ ID NO: 933493 - protein, 17 aa, Mycobacterium
QDIPRDKALLLGCHNGL

SEQ ID NO: 933494 - protein, 17 aa, Mycobacterium
QDLGGTHPSIWYKAFNY

SEQ ID NO: 933495 - protein, 23 aa, Mycobacterium
QDPARPVVLITLGITEDADATVL

SEQ ID NO: 933496 - protein, 19 aa, Mycobacterium
QDRRVRDAAPFMAYGEFTG

SEQ ID NO: 933497 - protein, 23 aa, Mycobacterium
QDSIRPGTTGVWVIIEQPNAHAQ

SEQ ID NO: 933498 - protein, 22 aa, Mycobacterium
QDSWGEENFQVFSHGRALSVAF

SEQ ID NO: 933499 - protein, 17 aa, Mycobacterium
QDVPGANQWMMTAEVGV

SEQ ID NO: 933500 - protein, 17 aa, Mycobacterium
QDWCGYLGTLIGKEPVF

SEQ ID NO: 933501 - protein, 18 aa, Mycobacterium
QDYWKAVYSEALKGTFKP

SEQ ID NO: 933502 - protein, 25 aa, Mycobacterium
QEATGGKGIPTWGSDSIDFEAIAAQ

SEQ ID NO: 933503 - protein, 22 aa, Mycobacterium
QEDAKFVYVDGHLYSDLGQPGT

SEQ ID NO: 933504 - protein, 17 aa, Mycobacterium
QEIGRPLGIADAGVVAF

SEQ ID NO: 933505 - protein, 20 aa, Mycobacterium
QEIRLRKGEILRVQTVNNLP

SEQ ID NO: 933506 - protein, 17 aa, Mycobacterium
QELPAYLAANKGVDPNR

SEQ ID NO: 933507 - protein, 19 aa, Mycobacterium
QELREAIAAFSAVKPSVAW

SEQ ID NO: 933508 - protein, 31 aa, Mycobacterium
QELREAIAAFSAVKPSVAWAETYPGTLSYYL

SEQ ID NO: 933509 - protein, 18 aa, Mycobacterium
QEMRERFARIGIGPDGDF

SEQ ID NO: 933510 - protein, 24 aa, Mycobacterium
QEPARLTTTMTRFITAAVEIYCPN

SEQ ID NO: 933511 - protein, 18 aa, Mycobacterium
QEPLRITQNFQHGVLNFE

SEQ ID NO: 933512 - protein, 22 aa, Mycobacterium
QERKPHAWKMITIALAVGAAMT

SEQ ID NO: 933513 - protein, 26 aa, Mycobacterium
QEVARNCPNTQFVLGGFSQGAAVVDV

SEQ ID NO: 933514 - protein, 19 aa, Mycobacterium
QEVVDDIGWARYPRVSPDM

SEQ ID NO: 933515 - protein, 19 aa, Mycobacterium
QEWYGKYAAAIGIDPAAGE

SEQ ID NO: 933516 - protein, 23 aa, Mycobacterium
QFADRAPDVILIYDYGDESAEQK

SEQ ID NO: 933517 - protein, 17 aa, Mycobacterium
QFAGWAPGVQALIDKLD

SEQ ID NO: 933518 - protein, 20 aa, Mycobacterium
QFDLCTLPLNLAGHCGMSVP

SEQ ID NO: 933519 - protein, 17 aa, Mycobacterium
QFEGGGPHAVYLLDGLR

SEQ ID NO: 933520 - protein, 21 aa, Mycobacterium
QFIAETWRLYGVDANNDGIVS

SEQ ID NO: 933521 - protein, 23 aa, Mycobacterium
QFLCGAVEAASRLGAKESAKLCV

SEQ ID NO: 933522 - protein, 17 aa, Mycobacterium
QFNASPIAQGWLHSFLA

SEQ ID NO: 933523 - protein, 17 aa, Mycobacterium
QFNASPVAQGWLHSFLA

SEQ ID NO: 933524 - protein, 20 aa, Mycobacterium
QFNGRLATLTSVVNDSKSDL

SEQ ID NO: 933525 - protein, 22 aa, Mycobacterium
QFQATYKRYTLYFVDPTGTTVV

SEQ ID NO: 933526 - protein, 21 aa, Mycobacterium
QFQDDFIEWSISFSQKPFPPP

SEQ ID NO: 933527 - protein, 17 aa, Mycobacterium
QFQDDFIEWSVSFNQKP

SEQ ID NO: 933528 - protein, 19 aa, Mycobacterium
QFRVGVPLAGRFDTPDADA

SEQ ID NO: 933529 - protein, 24 aa, Mycobacterium
QFTLVKANGEWRIDSLPNGVLLDW

SEQ ID NO: 933530 - protein, 24 aa, Mycobacterium
QFVSSPGYEHAWLNPDHTQVSIED

SEQ ID NO: 933531 - protein, 26 aa, Mycobacterium
QGADTRIACGVISPASTETSVSTSTS

SEQ ID NO: 933532 - protein, 23 aa, Mycobacterium
QGAGKYPTIPPFDYLEEVTFAHV

SEQ ID NO: 933533 - protein, 18 aa, Mycobacterium
QGAGTCIDRSAPLWTVKV

SEQ ID NO: 933534 - protein, 19 aa, Mycobacterium
QGAKATFFVIGEKVAADPA

SEQ ID NO: 933535 - protein, 27 aa, Mycobacterium
QGARFGEALALLGWNMAVSNLRWDGDF

SEQ ID NO: 933536 - protein, 19 aa, Mycobacterium
QGAVVASLYKATHTGNTYI

SEQ ID NO: 933537 - protein, 19 aa, Mycobacterium
QGCIGARDRAFFCEYALQY

SEQ ID NO: 933538 - protein, 18 aa, Mycobacterium
QGCTDIQVVFARGTDEPP

SEQ ID NO: 933539 - protein, 18 aa, Mycobacterium
QGELERLAAERAAAQAEL

SEQ ID NO: 933540 - protein, 33 aa, Mycobacterium
QGEPEAFLGMMVPKFPNFFIMYGPNTNSIPLVS

SEQ ID NO: 933541 - protein, 24 aa, Mycobacterium
QGFSSSAPAVWLVEGLLQYLDASD

SEQ ID NO: 933542 - protein, 23 aa, Mycobacterium
QGGEPRMTIPDAITGNPGDAGCG

SEQ ID NO: 933543 - protein, 19 aa, Mycobacterium
QGGFTSLWLGGARVNPDRY

SEQ ID NO: 933544 - protein, 23 aa, Mycobacterium
QGGNLRLALPGFPSNFNTLHIDG

SEQ ID NO: 933545 - protein, 20 aa, Mycobacterium
QGHVLERLFPGIGRLDEAFP

SEQ ID NO: 933546 - protein, 18 aa, Mycobacterium
QGHWADERLLHWAQTEID

SEQ ID NO: 933547 - protein, 19 aa, Mycobacterium
QGIHFSQGMDLMFNIEEGF

SEQ ID NO: 933548 - protein, 25 aa, Mycobacterium
QGITFSADGSRVFVADIAGSIRVLD

SEQ ID NO: 933549 - protein, 22 aa, Mycobacterium
QGKPAVLWFWTPWCPYCNAEAP

SEQ ID NO: 933550 - protein, 24 aa, Mycobacterium
QGKTYRWTFADVVGSPPKMTVIDT

SEQ ID NO: 933551 - protein, 25 aa, Mycobacterium
QGLAAWPKCGARGGVPAVWGGGAGA

SEQ ID NO: 933552 - protein, 31 aa, Mycobacterium
QGLPLAAAPLAWRPVIARGDLDGIAAGSRAV

SEQ ID NO: 933553 - protein, 25 aa, Mycobacterium
QGLYWSLSIGNPWWETIHYGRHQSS

SEQ ID NO: 933554 - protein, 17 aa, Mycobacterium
QGPLGAAINQAADTLNG

SEQ ID NO: 933555 - protein, 23 aa, Mycobacterium
QGPNARLAVNVGVITKSCAAAGI

SEQ ID NO: 933556 - protein, 17 aa, Mycobacterium
QGPSAVFNIPWVSELHG

SEQ ID NO: 933557 - protein, 21 aa, Mycobacterium
QGQGSITCRILVDGSVVTEQT

SEQ ID NO: 933558 - protein, 22 aa, Mycobacterium
QGRIRLSDPISRYVEGVPSGDV

SEQ ID NO: 933559 - protein, 17 aa, Mycobacterium
QGRLVTCEHSETRRITR

SEQ ID NO: 933560 - protein, 18 aa, Mycobacterium
QGSMPAYVPAPAVSGVAT

SEQ ID NO: 933561 - protein, 32 aa, Mycobacterium
QGSPTIVVPAEWRFIDGRWKLASKSMCNGISA

SEQ ID NO: 933562 - protein, 18 aa, Mycobacterium
QGSVIPIVANFNAKANDG

SEQ ID NO: 933563 - protein, 22 aa, Mycobacterium
QGTARAIRWTQVTPRDEVIAKF

SEQ ID NO: 933564 - protein, 22 aa, Mycobacterium
QGTRFVAVAGIGLLAPGDTGQL

SEQ ID NO: 933565 - protein, 25 aa, Mycobacterium
QGVDAARQFLDGMIVHHEGAVTMAQ

SEQ ID NO: 933566 - protein, 23 aa, Mycobacterium
QGVKSLYLVGSDYVFPRTSNAIV

SEQ ID NO: 933567 - protein, 23 aa, Mycobacterium
QHAIEVLLALGLEDSMVGTSFLD

SEQ ID NO: 933568 - protein, 32 aa, Mycobacterium
QHGDFGTICAVELGFRKDSAYRRKNHTWRDSG

SEQ ID NO: 933569 - protein, 24 aa, Mycobacterium
QHHGRGRPAKRFQLTADGRAKLNH

SEQ ID NO: 933570 - protein, 17 aa, Mycobacterium
QHIEKFIPRQITNVLTG

SEQ ID NO: 933571 - protein, 24 aa, Mycobacterium
QHIKEICNLMGLRQLGCSTGTMKD

SEQ ID NO: 933572 - protein, 17 aa, Mycobacterium
QHLDMAKIITSAGPAPV

SEQ ID NO: 933573 - protein, 20 aa, Mycobacterium
QHLRVIATFVRDLPQDTAPQ

SEQ ID NO: 933574 - protein, 24 aa, Mycobacterium
QHLSDAGVSWKIYYDKRLGPAVNS

SEQ ID NO: 933575 - protein, 21 aa, Mycobacterium
QHPPYPCGQAFVNSDGSKGPV

SEQ ID NO: 933576 - protein, 17 aa, Mycobacterium
QHSPAPQHREFTQAALV

SEQ ID NO: 933577 - protein, 18 aa, Mycobacterium
QHYIALLAQRQIGAALGN

SEQ ID NO: 933578 - protein, 21 aa, Mycobacterium
QIAGLKPDLIVAINAGVDADT

SEQ ID NO: 933579 - protein, 18 aa, Mycobacterium
QIALEIMEPAGWSPEQSG

SEQ ID NO: 933580 - protein, 21 aa, Mycobacterium
QIAPYLRSWESVIGHQRTGVY

SEQ ID NO: 933581 - protein, 22 aa, Mycobacterium
QIAVTIPIWGTKTHNIYWVEQD

SEQ ID NO: 933582 - protein, 24 aa, Mycobacterium
QIDPELLGGLSIAVGDEVIDGTLS

SEQ ID NO: 933583 - protein, 24 aa, Mycobacterium
QIDSVAFGSPAWRDAVSTTAAAPE

SEQ ID NO: 933584 - protein, 18 aa, Mycobacterium
QIEGLTFDKHAWAQAKLT

SEQ ID NO: 933585 - protein, 18 aa, Mycobacterium
QIEMAEAVARAFATGEHL

SEQ ID NO: 933586 - protein, 23 aa, Mycobacterium
QIGRTGERQGFWSGSLHADVDGR

SEQ ID NO: 933587 - protein, 20 aa, Mycobacterium
QIISSIKWAPDETGIIPTSG

SEQ ID NO: 933588 - protein, 26 aa, Mycobacterium
QILDYPNLMQILSYLTPFVHSASTAD

SEQ ID NO: 933589 - protein, 17 aa, Mycobacterium
QINDFSWISPPGRQLEG

SEQ ID NO: 933590 - protein, 18 aa, Mycobacterium
QIQCQIAVDGQVVVTQSA

SEQ ID NO: 933591 - protein, 18 aa, Mycobacterium
QIQLKFKRSQELADELER

SEQ ID NO: 933592 - protein, 24 aa, Mycobacterium
QIRAKRVLLATGMSYCPPQLPGLA

SEQ ID NO: 933593 - protein, 22 aa, Mycobacterium
QIREGMPFCKIGAVTGETCGFV

SEQ ID NO: 933594 - protein, 18 aa, Mycobacterium
QISSLRGGLDVPGGGHHD

SEQ ID NO: 933595 - protein, 25 aa, Mycobacterium
QISTNFFPASGLQFGETAPTVLNGP

SEQ ID NO: 933596 - protein, 23 aa, Mycobacterium
QIVNPRWSPTGKQIAFLQNDSNG

SEQ ID NO: 933597 - protein, 30 aa, Mycobacterium
QKAARRLASDMGEFFMPYPGNRVNQEDQSF

SEQ ID NO: 933598 - protein, 18 aa, Mycobacterium
QKDYNAWIGKIACKRLRT

SEQ ID NO: 933599 - protein, 23 aa, Mycobacterium
QKEKLAELTTRWQNEKNAIDVVR

SEQ ID NO: 933600 - protein, 24 aa, Mycobacterium
QKEKLAELTTRWQNEKSAIDVVRE

SEQ ID NO: 933601 - protein, 24 aa, Mycobacterium
QKFDGPYFVMQWLLRQPRRAILPV

SEQ ID NO: 933602 - protein, 31 aa, Mycobacterium
QKKARVSFIPDRAVVDYAQLFTATSLMPSHV

SEQ ID NO: 933603 - protein, 31 aa, Mycobacterium
QKKARVSFIPDRGVVDYNQLFTATSMMPSHV

SEQ ID NO: 933604 - protein, 19 aa, Mycobacterium
QKLPFGIAPTTEGARGSDI

SEQ ID NO: 933605 - protein, 17 aa, Mycobacterium
QKLRRIGEIAAQTQTVP

SEQ ID NO: 933606 - protein, 17 aa, Mycobacterium
QKPRPAFQSADCPDVQA

SEQ ID NO: 933607 - protein, 25 aa, Mycobacterium
QKQAEWEVESAIYVYAPDLIPRLKD

SEQ ID NO: 933608 - protein, 27 aa, Mycobacterium
QKVAPALAMPGDLIFYGPEGTQSVALF

SEQ ID NO: 933609 - protein, 19 aa, Mycobacterium
QKVPLPWSVKFEIGKTTAV

SEQ ID NO: 933610 - protein, 20 aa, Mycobacterium
QKYEARLGVYVPGTDATAAV

SEQ ID NO: 933611 - protein, 24 aa, Mycobacterium
QLAAGTVVWCAGMRASPLTEQVPV

SEQ ID NO: 933612 - protein, 18 aa, Mycobacterium
QLADGGYDFTIFERADGF

SEQ ID NO: 933613 - protein, 22 aa, Mycobacterium
QLAEGGYDFTIFDRADGFGGTW

SEQ ID NO: 933614 - protein, 25 aa, Mycobacterium
QLAMCSRIWCPGSPLPMPDVVWDMN

SEQ ID NO: 933615 - protein, 24 aa, Mycobacterium
QLARASVMALSYVAQSARGIYRPA

SEQ ID NO: 933616 - protein, 18 aa, Mycobacterium
QLARMLLSGQVHDGDVVP

SEQ ID NO: 933617 - protein, 23 aa, Mycobacterium
QLDVPAGAVATVLLTGANGYLGR

SEQ ID NO: 933618 - protein, 26 aa, Mycobacterium
QLGAGGFRSEAMWGPPTDPAWAANDP

SEQ ID NO: 933619 - protein, 27 aa, Mycobacterium
QLGEDYLRLAALGAYGSFFNIYFCSVT

SEQ ID NO: 933620 - protein, 27 aa, Mycobacterium
QLGEDYLRLAALGSYGAFFNIYFCTVT

SEQ ID NO: 933621 - protein, 27 aa, Mycobacterium
QLGEDYLRLAALGSYGSFFNIYFCSVT

SEQ ID NO: 933622 - protein, 20 aa, Mycobacterium
QLGFRPASAVEVIRRAPMGD

SEQ ID NO: 933623 - protein, 21 aa, Mycobacterium
QLGRYGAAVGEAFQLRDDVLG

SEQ ID NO: 933624 - protein, 17 aa, Mycobacterium
QLIKEVCNMMGLRQLGC

SEQ ID NO: 933625 - protein, 18 aa, Mycobacterium
QLIVFAVLTVVSLLVLGV

SEQ ID NO: 933626 - protein, 30 aa, Mycobacterium
QLKLIRARFGVPIPNLTAWRDGVVGDMTSA

SEQ ID NO: 933627 - protein, 22 aa, Mycobacterium
QLLCVQRLHGGLTIGDTHEYTE

SEQ ID NO: 933628 - protein, 18 aa, Mycobacterium
QLLDGLLLVSGNDAANTL

SEQ ID NO: 933629 - protein, 25 aa, Mycobacterium
QLLDSDFRAGCPIVAVSVEAGEQDA

SEQ ID NO: 933630 - protein, 19 aa, Mycobacterium
QLLLPDRFLQAGPLVEMIE

SEQ ID NO: 933631 - protein, 19 aa, Mycobacterium
QLLPALCNALGQWDGDDAL

SEQ ID NO: 933632 - protein, 19 aa, Mycobacterium
QLLQLGLESLRLWHSGFLD

SEQ ID NO: 933633 - protein, 26 aa, Mycobacterium
QLLTGLRLRIEFDGRTLVDAPLGEFF

SEQ ID NO: 933634 - protein, 21 aa, Mycobacterium
QLLWYRPDLVRQLPRTWDGMV

SEQ ID NO: 933635 - protein, 21 aa, Mycobacterium
QLMRHTAWFGAAVGLSVLGGE

SEQ ID NO: 933636 - protein, 22 aa, Mycobacterium
QLNIPQPPPGVTYTQAAVGLTH

SEQ ID NO: 933637 - protein, 19 aa, Mycobacterium
QLNSIALYLNFDMLGSPNA

SEQ ID NO: 933638 - protein, 22 aa, Mycobacterium
QLPDDMPVLLTCSDTDAQASCE

SEQ ID NO: 933639 - protein, 24 aa, Mycobacterium
QLPDGVKYSVRFAKPVILPARAGL

SEQ ID NO: 933640 - protein, 25 aa, Mycobacterium
QLPEISAKCVAEGKPEISISQFPSQ

SEQ ID NO: 933641 - protein, 28 aa, Mycobacterium
QLPGVSDPWGVVYANGLLYVTSTATQSV

SEQ ID NO: 933642 - protein, 23 aa, Mycobacterium
QLPPELRKLLPPIADIGAPFNKT

SEQ ID NO: 933643 - protein, 26 aa, Mycobacterium
QLPVLMSGPSRGPRFSAGVDGVPVPG

SEQ ID NO: 933644 - protein, 24 aa, Mycobacterium
QLQEGGDGWACQRALTIRNNVSVD

SEQ ID NO: 933645 - protein, 26 aa, Mycobacterium
QLQRRRLGPGPGRARATRRWLRQRRR

SEQ ID NO: 933646 - protein, 19 aa, Mycobacterium
QLQVLPLALPIAAPGLLGG

SEQ ID NO: 933647 - protein, 18 aa, Mycobacterium
QLRARRFDSPLMRTAMTC

SEQ ID NO: 933648 - protein, 18 aa, Mycobacterium
QLRIPHLILARPAWDPGE

SEQ ID NO: 933649 - protein, 30 aa, Mycobacterium
QLRTTGRLLGWRLGLDRIDPHGTVVLASEG

SEQ ID NO: 933650 - protein, 23 aa, Mycobacterium
QLSERLPDYMLPAAVVSVATLPL

SEQ ID NO: 933651 - protein, 27 aa, Mycobacterium
QLSGGMCQRALIAIGLAGRPALLIADE

SEQ ID NO: 933652 - protein, 24 aa, Mycobacterium
QLSGLRLGKVLSISEGSGSTAPTR

SEQ ID NO: 933653 - protein, 25 aa, Mycobacterium
QLSGLRLGTVLSISEGVGTRPSPGE

SEQ ID NO: 933654 - protein, 21 aa, Mycobacterium
QLSKDGHRFWMLPATPQTTQW

SEQ ID NO: 933655 - protein, 18 aa, Mycobacterium
QLSVSRGRNALFVADANF

SEQ ID NO: 933656 - protein, 26 aa, Mycobacterium
QLTPNFRAGCKRMLMSSDYYPALQRD

SEQ ID NO: 933657 - protein, 19 aa, Mycobacterium
QLTPRVPVLIAQGTEDVAV

SEQ ID NO: 933658 - protein, 23 aa, Mycobacterium
QLTTEQWLGPASMSMAAAAQPYL

SEQ ID NO: 933659 - protein, 22 aa, Mycobacterium
QLVCGLAGVAGRVMLFQRTAQW

SEQ ID NO: 933660 - protein, 17 aa, Mycobacterium
QLVREWTSDAVKDGVLA

SEQ ID NO: 933661 - protein, 19 aa, Mycobacterium
QLVTLPPSVSYSFRSLARG

SEQ ID NO: 933662 - protein, 24 aa, Mycobacterium
QMAGEPFGTIKIGAATLKGNTALH

SEQ ID NO: 933663 - protein, 18 aa, Mycobacterium
QMCRLRAVGPTYMLNMAF

SEQ ID NO: 933664 - protein, 25 aa, Mycobacterium
QMGGLEPHPAIVVGAVLHTETKTFV

SEQ ID NO: 933665 - protein, 22 aa, Mycobacterium
QMPAPPPPMFPWMQPTPQPLAP

SEQ ID NO: 933666 - protein, 22 aa, Mycobacterium
QMPLPVMIGLALLSAALSTAPA

SEQ ID NO: 933667 - protein, 18 aa, Mycobacterium
QMPSSMPDYQGGNNQPPL

SEQ ID NO: 933668 - protein, 31 aa, Mycobacterium
QMTRELIPAFTQRGSGHFVFVSSISGKTATA

SEQ ID NO: 933669 - protein, 22 aa, Mycobacterium
QMWASDVEAMYGYHADASAAVE

SEQ ID NO: 933670 - protein, 25 aa, Mycobacterium
QNATRFGIQDAIWRGVYYTPGGAQA

SEQ ID NO: 933671 - protein, 19 aa, Mycobacterium
QNAWDQLFRVEAMSQMAQL

SEQ ID NO: 933672 - protein, 29 aa, Mycobacterium
QNDYLPRDEFFGGVLGWVDGQQVTQASNR

SEQ ID NO: 933673 - protein, 21 aa, Mycobacterium
QNEPEWARFCTTVLGRPEVAE

SEQ ID NO: 933674 - protein, 17 aa, Mycobacterium
QNFAVLNDGIRFFFDQG

SEQ ID NO: 933675 - protein, 28 aa, Mycobacterium
QNFSGRARMSSMLWTFKVEKSDGVSCPG

SEQ ID NO: 933676 - protein, 26 aa, Mycobacterium
QNFSGRARMSSMLWTFKVQKDNGVAC

SEQ ID NO: 933677 - protein, 31 aa, Mycobacterium
QNGKLTPGFHGLHIHSFKKCEANSVAPAGGA

SEQ ID NO: 933678 - protein, 28 aa, Mycobacterium
QNLIEAWGRNAAYHFVFTRQNRGKLDAL

SEQ ID NO: 933679 - protein, 29 aa, Mycobacterium
QNQLRTGRVAAILNDLPSAVYISRTAGDG

SEQ ID NO: 933680 - protein, 24 aa, Mycobacterium
QNSLGLRWAATGLFEGNTLGGGPE

SEQ ID NO: 933681 - protein, 28 aa, Mycobacterium
QNVGRQAWFWGHELMAVGMVWDTPVTTG

SEQ ID NO: 933682 - protein, 17 aa, Mycobacterium
QNWPQHLASAYIQDGMV

SEQ ID NO: 933683 - protein, 25 aa, Mycobacterium
QNYASKRSFLGIDIYNETYGDKVKA

SEQ ID NO: 933684 - protein, 23 aa, Mycobacterium
QNYLRDHHDVWAASGSETVGTVV

SEQ ID NO: 933685 - protein, 19 aa, Mycobacterium
QPAGLFGVFVVQFTGAVTR

SEQ ID NO: 933686 - protein, 25 aa, Mycobacterium
QPAPEPVSAWAPPPPPPSMPPLQPS

SEQ ID NO: 933687 - protein, 19 aa, Mycobacterium
QPASLLAMKAMRNTNLTPK

SEQ ID NO: 933688 - protein, 18 aa, Mycobacterium
QPDQHWVLHAQGSVAPAA

SEQ ID NO: 933689 - protein, 18 aa, Mycobacterium
QPEGLPAGAALVVMLHGG

SEQ ID NO: 933690 - protein, 18 aa, Mycobacterium
QPETAWAVGDSHKVGGTL

SEQ ID NO: 933691 - protein, 23 aa, Mycobacterium
QPGARPVNAYSFLENDGQPRNEH

SEQ ID NO: 933692 - protein, 26 aa, Mycobacterium
QPGDPRVAPWYFDWIRHSTRDDYWKR

SEQ ID NO: 933693 - protein, 23 aa, Mycobacterium
QPGNDGNTGWGFLPGGAGAQCQN

SEQ ID NO: 933694 - protein, 26 aa, Mycobacterium
QPGPVAVMFFDLDRLKAINDYLGHTA

SEQ ID NO: 933695 - protein, 18 aa, Mycobacterium
QPGVLVSPGMEIHQDSVL

SEQ ID NO: 933696 - protein, 23 aa, Mycobacterium
QPHASQLPLVYGVDRNGGDFGLA

SEQ ID NO: 933697 - protein, 17 aa, Mycobacterium
QPHLAVAAGRVGAVSGL

SEQ ID NO: 933698 - protein, 17 aa, Mycobacterium
QPIRPAQPSGCAAHDYP

SEQ ID NO: 933699 - protein, 17 aa, Mycobacterium
QPMAQIFTSIAISTYCP

SEQ ID NO: 933700 - protein, 43 aa, Mycobacterium
QPMELDPRYPPVSGRPPLPLGDSDWFQKCLGVAVIMQGAAYRS

SEQ ID NO: 933701 - protein, 24 aa, Mycobacterium
QPPAPAPPWLRERKTWDDVVADVL

SEQ ID NO: 933702 - protein, 26 aa, Mycobacterium
QPPRQPECVVFCLGEQAPPAPAPGPP

SEQ ID NO: 933703 - protein, 24 aa, Mycobacterium
QPQKASNVPLPWTLSVTSTLPSVS

SEQ ID NO: 933704 - protein, 27 aa, Mycobacterium
QPQPRRVKITFWYESRYQVPADAKAVI

SEQ ID NO: 933705 - protein, 29 aa, Mycobacterium
QPQRGYKIFEEWANWLFAAGGSIYDKDGN

SEQ ID NO: 933706 - protein, 30 aa, Mycobacterium
QPQRGYKIFEEWGNWLFAAGGSIYDADGKI

SEQ ID NO: 933707 - protein, 31 aa, Mycobacterium
QPRFARGALLAFAGLTAFSVAACGTHGDTNA

SEQ ID NO: 933708 - protein, 20 aa, Mycobacterium
QPSHYAWDGTKWVEHFDFQW

SEQ ID NO: 933709 - protein, 20 aa, Mycobacterium
QPSRKVGPGDECNCAPEQAG

SEQ ID NO: 933710 - protein, 17 aa, Mycobacterium
QPYFPGYPPVSAEDVAT

SEQ ID NO: 933711 - protein, 21 aa, Mycobacterium
QPYSVCLPSTYAPGRAMPLTL

SEQ ID NO: 933712 - protein, 19 aa, Mycobacterium
QPYSWCPVLSPSLDSPGCG

SEQ ID NO: 933713 - protein, 24 aa, Mycobacterium
QQAAFDRIHWFFSLDPVGRRQYSE

SEQ ID NO: 933714 - protein, 21 aa, Mycobacterium
QQAALRWVRDNIAAFGGDPQR

SEQ ID NO: 933715 - protein, 19 aa, Mycobacterium
QQAALRWVRDNIANFGGDP

SEQ ID NO: 933716 - protein, 23 aa, Mycobacterium
QQADCFAGVYLFWVADGKSPRFT

SEQ ID NO: 933717 - protein, 19 aa, Mycobacterium
QQALARPGADQAALTAAQN

SEQ ID NO: 933718 - protein, 23 aa, Mycobacterium
QQAVSLPPQVMWGNIASAANGAV

SEQ ID NO: 933719 - protein, 19 aa, Mycobacterium
QQCLDRMGAPFLANIGTAS

SEQ ID NO: 933720 - protein, 24 aa, Mycobacterium
QQDLKATLLAAIGLGNNGYETLAP

SEQ ID NO: 933721 - protein, 32 aa, Mycobacterium
QQFDRPSGCAGWLIRDLVCHLIIDAQDVLITL

SEQ ID NO: 933722 - protein, 23 aa, Mycobacterium
QQIDAAQAMAFVRQRRDINDENF

SEQ ID NO: 933723 - protein, 25 aa, Mycobacterium
QQIPETQPVFGWLPGGWTTNTFGQW

SEQ ID NO: 933724 - protein, 25 aa, Mycobacterium
QQKTHFWKNISILGGLIIAGIDTEG

SEQ ID NO: 933725 - protein, 24 aa, Mycobacterium
QQQLCDTYKLAARAVGVDTNGNNP

SEQ ID NO: 933726 - protein, 23 aa, Mycobacterium
QQSFRIHGGYGYSKEYEIERLMR

SEQ ID NO: 933727 - protein, 19 aa, Mycobacterium
QQTELDRLTAERAQAQARL

SEQ ID NO: 933728 - protein, 17 aa, Mycobacterium
QQVPEGPGSVQGMAMDP

SEQ ID NO: 933729 - protein, 17 aa, Mycobacterium
QQWPVAGPVLGRLGWFV

SEQ ID NO: 933730 - protein, 17 aa, Mycobacterium
QQYLTCWVALSDSDESN

SEQ ID NO: 933731 - protein, 21 aa, Mycobacterium
QRAIPSVLERAGFVFHHNTIG

SEQ ID NO: 933732 - protein, 18 aa, Mycobacterium
QRALTARNNIVIDVEACG

SEQ ID NO: 933733 - protein, 26 aa, Mycobacterium
QRAQLPPIRLRVGIHTGDVQLRDDSN

SEQ ID NO: 933734 - protein, 20 aa, Mycobacterium
QRCPDRPGIIDELGTLTWKQ

SEQ ID NO: 933735 - protein, 21 aa, Mycobacterium
QRCRRIEPRLGDAEVIEVITG

SEQ ID NO: 933736 - protein, 21 aa, Mycobacterium
QRCRRIEPRLGQAAVIETITG

SEQ ID NO: 933737 - protein, 21 aa, Mycobacterium
QRDEILLARNDRFWSVPAKPD

SEQ ID NO: 933738 - protein, 27 aa, Mycobacterium
QRDGLSLGEAITLWLSGQEQLVPRDLV

SEQ ID NO: 933739 - protein, 27 aa, Mycobacterium
QRDGLSLGEALTLWLSGQEQLVPRDLV

SEQ ID NO: 933740 - protein, 21 aa, Mycobacterium
QRDGLTLADALRLWASGSEQL

SEQ ID NO: 933741 - protein, 27 aa, Mycobacterium
QRDGLTLGQAITLWMSGREQLVPRDLV

SEQ ID NO: 933742 - protein, 20 aa, Mycobacterium
QRDRFLFKINVGYPSPEEER

SEQ ID NO: 933743 - protein, 21 aa, Mycobacterium
QREARLRRPQFTFPARGILTS

SEQ ID NO: 933744 - protein, 25 aa, Mycobacterium
QREVTEFFDVLPLMADNLYNAVDQR

SEQ ID NO: 933745 - protein, 29 aa, Mycobacterium
QRFAGMLVAGVFLREFVADGVGWAHIDVA

SEQ ID NO: 933746 - protein, 28 aa, Mycobacterium
QRGAPVDFPLDGVIPGFQKAIAGQNVGS

SEQ ID NO: 933747 - protein, 21 aa, Mycobacterium
QRGINLTGWLNSGSGNIGLFN

SEQ ID NO: 933748 - protein, 18 aa, Mycobacterium
QRGVDFIAIDGGEGGTGA

SEQ ID NO: 933749 - protein, 26 aa, Mycobacterium
QRGVIPRDHIKEVLDSADVLIWLTES

SEQ ID NO: 933750 - protein, 22 aa, Mycobacterium
QRGYHRIRVWPGVSPSGMYWRV

SEQ ID NO: 933751 - protein, 25 aa, Mycobacterium
QRHTRASVMSRLWRRPAPGPAPSSC

SEQ ID NO: 933752 - protein, 24 aa, Mycobacterium
QRHTRTSVMSRLWRRPVARPAPSS

SEQ ID NO: 933753 - protein, 18 aa, Mycobacterium
QRIIASSVVRCVGNTLLL

SEQ ID NO: 933754 - protein, 22 aa, Mycobacterium
QRIRWVIGLFLGLQLVLASTLA

SEQ ID NO: 933755 - protein, 17 aa, Mycobacterium
QRIVTLMPLGVAVVDSH

SEQ ID NO: 933756 - protein, 23 aa, Mycobacterium
QRKEQAWEFVKFATGPVGQALIG

SEQ ID NO: 933757 - protein, 18 aa, Mycobacterium
QRLFGRRLADFFTGRDPR

SEQ ID NO: 933758 - protein, 21 aa, Mycobacterium
QRLGTDHIDICRPARLDPAVP

SEQ ID NO: 933759 - protein, 19 aa, Mycobacterium
QRLPFGVAPTTEGARGSDV

SEQ ID NO: 933760 - protein, 19 aa, Mycobacterium
QRLSQALGEQTWRESGLDA

SEQ ID NO: 933761 - protein, 17 aa, Mycobacterium
QRLVAGFIVNKFRGDPT

SEQ ID NO: 933762 - protein, 21 aa, Mycobacterium
QRNIEGWVARKRPGSKAAAAA

SEQ ID NO: 933763 - protein, 20 aa, Mycobacterium
QRNIPALPEGVTYTQVATAS

SEQ ID NO: 933764 - protein, 23 aa, Mycobacterium
QRPPRPGVHNSGWVQSPGAEHLG

SEQ ID NO: 933765 - protein, 27 aa, Mycobacterium
QRQGLKVGVPEEAAWRRGLIGDDALRE

SEQ ID NO: 933766 - protein, 20 aa, Mycobacterium
QRQNERWNRHGFDLDMAALV

SEQ ID NO: 933767 - protein, 23 aa, Mycobacterium
QRREQAWEFVKFATGPVGQALIG

SEQ ID NO: 933768 - protein, 23 aa, Mycobacterium
QRRRTAGRLSRLLVVATAGAALL

SEQ ID NO: 933769 - protein, 19 aa, Mycobacterium
QRRYPAWPGSYDASLRVSW

SEQ ID NO: 933770 - protein, 20 aa, Mycobacterium
QRSPERVLPLALDITEPDQI

SEQ ID NO: 933771 - protein, 18 aa, Mycobacterium
QRSYRLYKPAGLPRAAPL

SEQ ID NO: 933772 - protein, 18 aa, Mycobacterium
QRTAAGWQPLKTGIPTHV

SEQ ID NO: 933773 - protein, 27 aa, Mycobacterium
QRTGIYAGIRPCQWATADGVIGRSGTP

SEQ ID NO: 933774 - protein, 24 aa, Mycobacterium
QRTGTGWQSLRSGIPTHVGSAGMA

SEQ ID NO: 933775 - protein, 18 aa, Mycobacterium
QRTIPREALGMPVRADVQ

SEQ ID NO: 933776 - protein, 24 aa, Mycobacterium
QRTRLPQHLGPGVRMVFYDQRGHG

SEQ ID NO: 933777 - protein, 25 aa, Mycobacterium
QRTRVTEVLSRIYGHPVTVQLQTDP

SEQ ID NO: 933778 - protein, 19 aa, Mycobacterium
QRVAVGIDLADDWPKALRS

SEQ ID NO: 933779 - protein, 20 aa, Mycobacterium
QRVVCGGISIADRWDTTADP

SEQ ID NO: 933780 - protein, 17 aa, Mycobacterium
QRWCTRMITGSPWSGPL

SEQ ID NO: 933781 - protein, 18 aa, Mycobacterium
QRWLRGRLVGAMLNAAGD

SEQ ID NO: 933782 - protein, 17 aa, Mycobacterium
QRWPGEAAGRAYDAAQI

SEQ ID NO: 933783 - protein, 17 aa, Mycobacterium
QRYNSALQLISGAPPHC

SEQ ID NO: 933784 - protein, 23 aa, Mycobacterium
QSAAELLARFQAAPTTGGRRRRR

SEQ ID NO: 933785 - protein, 27 aa, Mycobacterium
QSAARQAWFWAHEVMAVGMVWNTPATT

SEQ ID NO: 933786 - protein, 39 aa, Mycobacterium
QSAGADVMGALNAPTMAWLGRPLIGDGANGVDGTGGNGG

SEQ ID NO: 933787 - protein, 18 aa, Mycobacterium
QSAGARLAPWIDLVAAER

SEQ ID NO: 933788 - protein, 28 aa, Mycobacterium
QSAIRRAMLRLSWRPLVNRFIEATLAGE

SEQ ID NO: 933789 - protein, 27 aa, Mycobacterium
QSAKDLLGRAGPLQVLQSPVALVGSAA

SEQ ID NO: 933790 - protein, 25 aa, Mycobacterium
QSAKELCNLMHLRQLGCSTGTLQDY

SEQ ID NO: 933791 - protein, 25 aa, Mycobacterium
QSAKLCVQYLAPIIKNRQYNFLPFG

SEQ ID NO: 933792 - protein, 36 aa, Mycobacterium
QSARLGESLPVLGWNMAVSNLRWSGDYVLVDVDASP

SEQ ID NO: 933793 - protein, 27 aa, Mycobacterium
QSAVCGVIGIFCPKAAPAAAASGEGGE

SEQ ID NO: 933794 - protein, 24 aa, Mycobacterium
QSDARRLTYGSALLTNPAAPNGSI

SEQ ID NO: 933795 - protein, 23 aa, Mycobacterium
QSDLDLFESLNFADRLANITAPT

SEQ ID NO: 933796 - protein, 26 aa, Mycobacterium
QSDPGVLVNVAFTLGIERYRYPQNLP

SEQ ID NO: 933797 - protein, 24 aa, Mycobacterium
QSELSRLMFPVGIEDRPRDHRQLV

SEQ ID NO: 933798 - protein, 30 aa, Mycobacterium
QSFTSVPMIFARPSYYGQFTDSGGINNGDK

SEQ ID NO: 933799 - protein, 26 aa, Mycobacterium
QSGERRMLCGLQLPGPNNQQLAFTGR

SEQ ID NO: 933800 - protein, 24 aa, Mycobacterium
QSGKYRRVLAMAWEKQSESNAMWA

SEQ ID NO: 933801 - protein, 24 aa, Mycobacterium
QSGLFNYSMSLAFSRDLEADPRRQ

SEQ ID NO: 933802 - protein, 18 aa, Mycobacterium
QSGRAAFFEPWRDQATAI

SEQ ID NO: 933803 - protein, 18 aa, Mycobacterium
QSIAKLGYYSQFRDQSIT

SEQ ID NO: 933804 - protein, 24 aa, Mycobacterium
QSKVWPVGTCLGIDPATNQPTDIP

SEQ ID NO: 933805 - protein, 19 aa, Mycobacterium
QSLHIFPTTLANFGNIYEP

SEQ ID NO: 933806 - protein, 18 aa, Mycobacterium
QSLSDLDSFLARLEPSLP

SEQ ID NO: 933807 - protein, 28 aa, Mycobacterium
QSLTVPLLAPVIRRWHRRHPDVAISLRE

SEQ ID NO: 933808 - protein, 30 aa, Mycobacterium
QSLWLRLAGRFDRTGLWPLASRGLGGDLRR

SEQ ID NO: 933809 - protein, 20 aa, Mycobacterium
QSMLFFPFVGGAGPNPLIIT

SEQ ID NO: 933810 - protein, 26 aa, Mycobacterium
QSNEPTRWIATYTRDAVNVGCQVLTT

SEQ ID NO: 933811 - protein, 26 aa, Mycobacterium
QSPARYFGPNLSRLSAVRQKYDPGRV

SEQ ID NO: 933812 - protein, 20 aa, Mycobacterium
QSPGTFKIVGEPFSEERYGI

SEQ ID NO: 933813 - protein, 23 aa, Mycobacterium
QSPNPIVWVPCDFEHDTLREKLL

SEQ ID NO: 933814 - protein, 32 aa, Mycobacterium
QSPPGRWFRCSEFPCAPTAPGNIMGSGAALRD

SEQ ID NO: 933815 - protein, 23 aa, Mycobacterium
QSPRLGSPAFVITRVDAETGQVT

SEQ ID NO: 933816 - protein, 17 aa, Mycobacterium
QSPWRGGIGHTWEARIK

SEQ ID NO: 933817 - protein, 24 aa, Mycobacterium
QSQKRLAIEGGLPAVRTSLYADPQ

SEQ ID NO: 933818 - protein, 19 aa, Mycobacterium
QSRGRPGPIRGPDLMDPNR

SEQ ID NO: 933819 - protein, 17 aa, Mycobacterium
QSRSLRLPIPLNAEVSA

SEQ ID NO: 933820 - protein, 21 aa, Mycobacterium
QSSFYSDWYKPACGKAGCVTY

SEQ ID NO: 933821 - protein, 19 aa, Mycobacterium
QSSFYTDWYRPAVGSAGTT

SEQ ID NO: 933822 - protein, 28 aa, Mycobacterium
QSTQRLSEEITRVLNVTGAPQVNLVGAS

SEQ ID NO: 933823 - protein, 24 aa, Mycobacterium
QSTYRRYTVYFADPAGRTVVPDPR

SEQ ID NO: 933824 - protein, 18 aa, Mycobacterium
QSYGYGISFQRFGPEAAM

SEQ ID NO: 933825 - protein, 18 aa, Mycobacterium
QTAGPGTFGERWSDLSPG

SEQ ID NO: 933826 - protein, 23 aa, Mycobacterium
QTDGFAVLDLGTWTDSHGDHGHH

SEQ ID NO: 933827 - protein, 24 aa, Mycobacterium
QTGDLLPLLATGWHQTSPREWTFD

SEQ ID NO: 933828 - protein, 25 aa, Mycobacterium
QTGVQRYTVYDGYYRVTNGVVDSSY

SEQ ID NO: 933829 - protein, 24 aa, Mycobacterium
QTGYRWPGMGMMRIVVTPASVPAG

SEQ ID NO: 933830 - protein, 22 aa, Mycobacterium
QTLERLTALVLPASGDPTVVVP

SEQ ID NO: 933831 - protein, 22 aa, Mycobacterium
QTLLGRPLIGNGANGAPGQNGA

SEQ ID NO: 933832 - protein, 19 aa, Mycobacterium
QTLLGWNMSVANLRFEAEY

SEQ ID NO: 933833 - protein, 17 aa, Mycobacterium
QTLQAFLHWAITEGNGP

SEQ ID NO: 933834 - protein, 17 aa, Mycobacterium
QTLRVALTRMVSAGDLV

SEQ ID NO: 933835 - protein, 33 aa, Mycobacterium
QTPNFWGYWLYFKTPGGWSCGLAPNGGPIGCDM

SEQ ID NO: 933836 - protein, 25 aa, Mycobacterium
QTQLFQRLQLIYLFTTGHRKSSTLE

SEQ ID NO: 933837 - protein, 18 aa, Mycobacterium
QTQTRAATSWVRGTMSAM

SEQ ID NO: 933838 - protein, 25 aa, Mycobacterium
QTSCRPGMVGDGIRGDFVVTGEAVQ

SEQ ID NO: 933839 - protein, 31 aa, Mycobacterium
QTSDDHLAYTFKLRSGVTFSDGTPLDAAVVK

SEQ ID NO: 933840 - protein, 17 aa, Mycobacterium
QTSTWTMPALRGEVLER

SEQ ID NO: 933841 - protein, 28 aa, Mycobacterium
QTTELRTSDRLNYLWVQWADNPNTVEHN

SEQ ID NO: 933842 - protein, 17 aa, Mycobacterium
QTTPRKAAHLTIDGATH

SEQ ID NO: 933843 - protein, 30 aa, Mycobacterium
QTTYKAFNWDQAYRKPITWDKLWQPETDPL

SEQ ID NO: 933844 - protein, 31 aa, Mycobacterium
QTVDLWATNLPKLLPAGVQQTLIPPALVNGI

SEQ ID NO: 933845 - protein, 17 aa, Mycobacterium
QTVLLRREPRGVTLTPA

SEQ ID NO: 933846 - protein, 26 aa, Mycobacterium
QTVTFADPWASAADTGMTAVFGTLQN

SEQ ID NO: 933847 - protein, 17 aa, Mycobacterium
QTYPPGSTFKVITTAAA

SEQ ID NO: 933848 - protein, 20 aa, Mycobacterium
QVAAAVKAFLRSTVGAGQDG

SEQ ID NO: 933849 - protein, 18 aa, Mycobacterium
QVANAITVALGFPSGGRV

SEQ ID NO: 933850 - protein, 25 aa, Mycobacterium
QVANMRVSIEWPYSANLHCEILIDD

SEQ ID NO: 933851 - protein, 19 aa, Mycobacterium
QVAQVLALAARFQSALDGT

SEQ ID NO: 933852 - protein, 24 aa, Mycobacterium
QVAWFPGDWRAHFDATGEQLFTPA

SEQ ID NO: 933853 - protein, 23 aa, Mycobacterium
QVCGNDNYIGYTWTVGHAETDKN

SEQ ID NO: 933854 - protein, 21 aa, Mycobacterium
QVDLGGPVVRTLAYGNSIPGA

SEQ ID NO: 933855 - protein, 24 aa, Mycobacterium
QVEGGIIYHYYWFRDQSQTKEISG

SEQ ID NO: 933856 - protein, 24 aa, Mycobacterium
QVESRFGGIDVWVNVAFTSVFAPF

SEQ ID NO: 933857 - protein, 18 aa, Mycobacterium
QVFEGRAGGMTRPVEGAH

SEQ ID NO: 933858 - protein, 23 aa, Mycobacterium
QVGDTSRLLARFPSIGGTDTSGR

SEQ ID NO: 933859 - protein, 18 aa, Mycobacterium
QVGMPRAVVITKLDHARA

SEQ ID NO: 933860 - protein, 18 aa, Mycobacterium
QVGTAVRAFLQSTIGAGQ

SEQ ID NO: 933861 - protein, 26 aa, Mycobacterium
QVHNAVRFGFWGAEELGLIGSRNYVE

SEQ ID NO: 933862 - protein, 23 aa, Mycobacterium
QVKDAPLPWSFTITTTEPAVIGN

SEQ ID NO: 933863 - protein, 26 aa, Mycobacterium
QVKTIWAERAISVLFPQIKTIYGYRE

SEQ ID NO: 933864 - protein, 22 aa, Mycobacterium
QVLARATLRGGIPAVVNALAEC

SEQ ID NO: 933865 - protein, 28 aa, Mycobacterium
QVLERLKYLPLDPFRISYAYTNFGVTAA

SEQ ID NO: 933866 - protein, 26 aa, Mycobacterium
QVLSAKAAEFHDRFVEILQTSAQAYG

SEQ ID NO: 933867 - protein, 23 aa, Mycobacterium
QVNAAPLPWSFTISTTLPSVSAN

SEQ ID NO: 933868 - protein, 18 aa, Mycobacterium
QVNGAEWLHQNRPQLVDA

SEQ ID NO: 933869 - protein, 24 aa, Mycobacterium
QVNGLTWLPPAPMNNTYTLAIRES

SEQ ID NO: 933870 - protein, 22 aa, Mycobacterium
QVPIETFIKAWATSHDFLVVTT

SEQ ID NO: 933871 - protein, 19 aa, Mycobacterium
QVPSAAMGRSIKVQFQSGG

SEQ ID NO: 933872 - protein, 19 aa, Mycobacterium
QVPSAGMGRNIKVQFQSGG

SEQ ID NO: 933873 - protein, 18 aa, Mycobacterium
QVRKAILGLLDIDLLAAV

SEQ ID NO: 933874 - protein, 24 aa, Mycobacterium
QVRLGEQMIDYWASFVKTGDPGFP

SEQ ID NO: 933875 - protein, 21 aa, Mycobacterium
QVRPAPWSMLQVWPAGPELSR

SEQ ID NO: 933876 - protein, 23 aa, Mycobacterium
QVSASTKFISWVTGAFYDGDYAL

SEQ ID NO: 933877 - protein, 23 aa, Mycobacterium
QVSNNLAERLIWQDPITGEYKPW

SEQ ID NO: 933878 - protein, 17 aa, Mycobacterium
QVSRFSSTALRAQQTVA

SEQ ID NO: 933879 - protein, 23 aa, Mycobacterium
QVSSALRKHGYTAGQVRDRQAGD

SEQ ID NO: 933880 - protein, 23 aa, Mycobacterium
QVTLEVFGAPGTVATINYLDVNA

SEQ ID NO: 933881 - protein, 27 aa, Mycobacterium
QVVADPTWASAHPAAQIAVTVTVTDTY

SEQ ID NO: 933882 - protein, 27 aa, Mycobacterium
QVVAEWRRIDGRWKLASKSLCNGIKTI

SEQ ID NO: 933883 - protein, 18 aa, Mycobacterium
QVVLDVFGAPGAVATINY

SEQ ID NO: 933884 - protein, 17 aa, Mycobacterium
QVWSMVMTLALDCGAVV

SEQ ID NO: 933885 - protein, 19 aa, Mycobacterium
QVYQRLSAQLATFHDQFVQ

SEQ ID NO: 933886 - protein, 22 aa, Mycobacterium
QWAAICNELGLLAAAGSEDINA

SEQ ID NO: 933887 - protein, 17 aa, Mycobacterium
QWAIVTASGGLRINPEF

SEQ ID NO: 933888 - protein, 26 aa, Mycobacterium
QWESIVSLLTTENWTGGGSAAAAAAA

SEQ ID NO: 933889 - protein, 18 aa, Mycobacterium
QWHSLVFDVSVWEICGAL

SEQ ID NO: 933890 - protein, 17 aa, Mycobacterium
QWIGGWVSFDGATVTVG

SEQ ID NO: 933891 - protein, 18 aa, Mycobacterium
QWIPGGRLPTGASEAVVD

SEQ ID NO: 933892 - protein, 19 aa, Mycobacterium
QWSWPAWTIPPGARASAAA

SEQ ID NO: 933893 - protein, 24 aa, Mycobacterium
QWWFDLPWSHGFVRPQRPIEMIRS

SEQ ID NO: 933894 - protein, 18 aa, Mycobacterium
QYEGMVVWFNTLLQSAGG

SEQ ID NO: 933895 - protein, 17 aa, Mycobacterium
QYGDGWIGQARDMTNPT

SEQ ID NO: 933896 - protein, 17 aa, Mycobacterium
QYGGIGVINKCDGPIQP

SEQ ID NO: 933897 - protein, 25 aa, Mycobacterium
QYLRYPGFRSASFVLDAPGVRGSAA

SEQ ID NO: 933898 - protein, 20 aa, Mycobacterium
QYLVPPISTFGTREQAASMD

SEQ ID NO: 933899 - protein, 25 aa, Mycobacterium
QYNEYLKKYIVLYGDQSNNIVMRTS

SEQ ID NO: 933900 - protein, 18 aa, Mycobacterium
QYNFLPFGQNLFVGASAR

SEQ ID NO: 933901 - protein, 31 aa, Mycobacterium
QYPPRRVTSTMTRFVIAAVEIYCPYDRGKIA

SEQ ID NO: 933902 - protein, 24 aa, Mycobacterium
QYRFGELREGVWLRPDNLDQALPG

SEQ ID NO: 933903 - protein, 18 aa, Mycobacterium
QYRHAVVMGVNKARVPGN

SEQ ID NO: 933904 - protein, 25 aa, Mycobacterium
QYTKEICNLMGLRQLGCSTGTIQDF

SEQ ID NO: 933905 - protein, 28 aa, Mycobacterium
QYTVEAQRLWAQAGFRPVDPAVVAEFRD

SEQ ID NO: 933906 - protein, 17 aa, Mycobacterium
RAAAAGFRGDVAETVAI

SEQ ID NO: 933907 - protein, 23 aa, Mycobacterium
RAAAEPNPSGWEGLSSALGGKVL

SEQ ID NO: 933908 - protein, 23 aa, Mycobacterium
RAAAHPCGGHPGRGRSARRDPAG

SEQ ID NO: 933909 - protein, 25 aa, Mycobacterium
RAAALLTAMCVVAACSNSDPLGAQV

SEQ ID NO: 933910 - protein, 17 aa, Mycobacterium
RAAAPRVVVLSRLVPHK

SEQ ID NO: 933911 - protein, 18 aa, Mycobacterium
RAAASGYMRAKIAQEKVI

SEQ ID NO: 933912 - protein, 22 aa, Mycobacterium
RAADAVACALQLQRAQLPPIRL

SEQ ID NO: 933913 - protein, 25 aa, Mycobacterium
RAAEPWEVAATIAFLASEYSSYLTG

SEQ ID NO: 933914 - protein, 20 aa, Mycobacterium
RAAEQAGFGHVWASDHIQPW

SEQ ID NO: 933915 - protein, 27 aa, Mycobacterium
RAAFEAIKQLHPEGGKVMVMGLDPGIS

SEQ ID NO: 933916 - protein, 19 aa, Mycobacterium
RAAGFEVGPLIGIQPDDLV

SEQ ID NO: 933917 - protein, 19 aa, Mycobacterium
RAAGLPVVLVGDIDRGGLL

SEQ ID NO: 933918 - protein, 19 aa, Mycobacterium
RAAGVRHHVALSIVGADRT

SEQ ID NO: 933919 - protein, 19 aa, Mycobacterium
RAAGYESLMVPSAAMGRDI

SEQ ID NO: 933920 - protein, 25 aa, Mycobacterium
RAAHLYVYAACRLQAAVDSRGHPFL

SEQ ID NO: 933921 - protein, 24 aa, Mycobacterium
RAAHPLYDFEFLGVEHWSNAVAQA

SEQ ID NO: 933922 - protein, 17 aa, Mycobacterium
RAAIAALAFTALPGAII

SEQ ID NO: 933923 - protein, 20 aa, Mycobacterium
RAAKLASLPAGIAGRAALGV

SEQ ID NO: 933924 - protein, 18 aa, Mycobacterium
RAALDGWATRVHRTEHPG

SEQ ID NO: 933925 - protein, 20 aa, Mycobacterium
RAAMVIGGKVILAGVEQTPG

SEQ ID NO: 933926 - protein, 27 aa, Mycobacterium
RAAPPGLPWEMVWSFHLIPRGDDQCRL

SEQ ID NO: 933927 - protein, 20 aa, Mycobacterium
RAAPVIGGLLGFDQRPPDEL

SEQ ID NO: 933928 - protein, 19 aa, Mycobacterium
RAAQFWIMKPTDWNNRWWI

SEQ ID NO: 933929 - protein, 17 aa, Mycobacterium
RAARASRTRATDATGTA

SEQ ID NO: 933930 - protein, 17 aa, Mycobacterium
RAARLGARIQQLEKRLS

SEQ ID NO: 933931 - protein, 22 aa, Mycobacterium
RAARWSDGRAVLIGDAAHPMRP

SEQ ID NO: 933932 - protein, 18 aa, Mycobacterium
RAASSWYLGANIEGKKRV

SEQ ID NO: 933933 - protein, 20 aa, Mycobacterium
RAASVFDRWTDLIAQRFVAD

SEQ ID NO: 933934 - protein, 20 aa, Mycobacterium
RAATAAALMASLACLGTATA

SEQ ID NO: 933935 - protein, 20 aa, Mycobacterium
RAATLRAVRALTGVPIDYFA

SEQ ID NO: 933936 - protein, 23 aa, Mycobacterium
RAATPRECRDPKPYVPAGTNPWY

SEQ ID NO: 933937 - protein, 19 aa, Mycobacterium
RAAVELALVDAAVVTGRTI

SEQ ID NO: 933938 - protein, 23 aa, Mycobacterium
RACVSELRYPHVATDAAGTTLEL

SEQ ID NO: 933939 - protein, 17 aa, Mycobacterium
RADAMLIAVPGIDLARF

SEQ ID NO: 933940 - protein, 17 aa, Mycobacterium
RADDVRLEWPLRPPPAI

SEQ ID NO: 933941 - protein, 21 aa, Mycobacterium
RADGLSVVPIMLARILDLPDQ

SEQ ID NO: 933942 - protein, 18 aa, Mycobacterium
RADHAVVVTGVDTANGVV

SEQ ID NO: 933943 - protein, 19 aa, Mycobacterium
RADIKRPGGDVSLIGYGRC

SEQ ID NO: 933944 - protein, 24 aa, Mycobacterium
RADLGIGPHQVWWLSELTADPAVT

SEQ ID NO: 933945 - protein, 20 aa, Mycobacterium
RADLPPCPGPGNGQGPEALR

SEQ ID NO: 933946 - protein, 20 aa, Mycobacterium
RADPQACVPGDVARPQGELF

SEQ ID NO: 933947 - protein, 17 aa, Mycobacterium
RADVFAAVAPVAGTLGV

SEQ ID NO: 933948 - protein, 22 aa, Mycobacterium
RAEALWRRWREGGVLFAKTFPD

SEQ ID NO: 933949 - protein, 18 aa, Mycobacterium
RAEPSSAVGLCREMRGAW

SEQ ID NO: 933950 - protein, 21 aa, Mycobacterium
RAETLVLCLALLHARTPDVPA

SEQ ID NO: 933951 - protein, 27 aa, Mycobacterium
RAFADPRPSGWEGLSTALGGKVLLPDS

SEQ ID NO: 933952 - protein, 22 aa, Mycobacterium
RAFCLAALAVGLAFVSPAVGAV

SEQ ID NO: 933953 - protein, 18 aa, Mycobacterium
RAFFDWMNAQKLSYCLDF

SEQ ID NO: 933954 - protein, 17 aa, Mycobacterium
RAFSGVKIACVGESTAD

SEQ ID NO: 933955 - protein, 21 aa, Mycobacterium
RAGDLVLRARKRCDVIHAKDP

SEQ ID NO: 933956 - protein, 20 aa, Mycobacterium
RAGELVAIAEPAAWFTYYYW

SEQ ID NO: 933957 - protein, 19 aa, Mycobacterium
RAGESVSYGHTWTAERDTT

SEQ ID NO: 933958 - protein, 19 aa, Mycobacterium
RAGGAAITSVAVRRGKVFI

SEQ ID NO: 933959 - protein, 20 aa, Mycobacterium
RAGGFTVAYRAGGRVVGTLD

SEQ ID NO: 933960 - protein, 28 aa, Mycobacterium
RAGKPVLGICGGFQMLCRRIDDAVESGA

SEQ ID NO: 933961 - protein, 20 aa, Mycobacterium
RAGLAPCPAAASGPGPEALR

SEQ ID NO: 933962 - protein, 24 aa, Mycobacterium
RAGLPDRGPNSWQEFDDWGPRLQR

SEQ ID NO: 933963 - protein, 24 aa, Mycobacterium
RAGNRGTDWFVWYEHGGLTYFWQA

SEQ ID NO: 933964 - protein, 28 aa, Mycobacterium
RAGPPEHLKWIGQWGIFDALRSGSEVVR

SEQ ID NO: 933965 - protein, 21 aa, Mycobacterium
RAGQKAELVLVIANESADISD

SEQ ID NO: 933966 - protein, 17 aa, Mycobacterium
RAGRPGLLSSLDIPTTL

SEQ ID NO: 933967 - protein, 20 aa, Mycobacterium
RAGSIGQLSVPPSWAAPSSG

SEQ ID NO: 933968 - protein, 25 aa, Mycobacterium
RAGVGKAAIYRRWASKAALMTDALV

SEQ ID NO: 933969 - protein, 19 aa, Mycobacterium
RAGYGMPGDHGSVFEDLTA

SEQ ID NO: 933970 - protein, 27 aa, Mycobacterium
RAHPPLPGDARTAGTTGTAVAEHPAVA

SEQ ID NO: 933971 - protein, 22 aa, Mycobacterium
RAHSAVTEFPGGSHLTLVSHPD

SEQ ID NO: 933972 - protein, 22 aa, Mycobacterium
RAIHFQEWWVRYRAELPTHSFV

SEQ ID NO: 933973 - protein, 19 aa, Mycobacterium
RAIPAALEIKGFEFHHKTV

SEQ ID NO: 933974 - protein, 21 aa, Mycobacterium
RAIWPEADWDALGAKPHLAVA

SEQ ID NO: 933975 - protein, 18 aa, Mycobacterium
RAKAGPAVDALNRSADLV

SEQ ID NO: 933976 - protein, 23 aa, Mycobacterium
RAKDLRSKPVWVLGSAETTSHML

SEQ ID NO: 933977 - protein, 25 aa, Mycobacterium
RAKDVLRDRGIRWALSTSAGFADRR

SEQ ID NO: 933978 - protein, 23 aa, Mycobacterium
RAKGYEPMNFFAPLSRLKELDAL

SEQ ID NO: 933979 - protein, 24 aa, Mycobacterium
RAKINPLLWRLLASPRITGLLEGV

SEQ ID NO: 933980 - protein, 23 aa, Mycobacterium
RAKKADGSWGPWYEAEALDGVGA

SEQ ID NO: 933981 - protein, 21 aa, Mycobacterium
RAKLERKGCDLLVVNAVGENR

SEQ ID NO: 933982 - protein, 26 aa, Mycobacterium
RAKLGFPVPIRHWLRSGELMDWAYAL

SEQ ID NO: 933983 - protein, 20 aa, Mycobacterium
RAKMTMAIDHDVPVPADAEA

SEQ ID NO: 933984 - protein, 19 aa, Mycobacterium
RAKQVWEFVAGRWVGHDSV

SEQ ID NO: 933985 - protein, 25 aa, Mycobacterium
RALADRGRLLLVDMREDLLDQARKA

SEQ ID NO: 933986 - protein, 26 aa, Mycobacterium
RALAILKSQGIKAFFGGSTGSVLPQS

SEQ ID NO: 933987 - protein, 17 aa, Mycobacterium
RALEAAIDWAGEPGADV

SEQ ID NO: 933988 - protein, 18 aa, Mycobacterium
RALFMFRSKQQLRYHHRD

SEQ ID NO: 933989 - protein, 20 aa, Mycobacterium
RALIACGMLALYDPELSQPY

SEQ ID NO: 933990 - protein, 27 aa, Mycobacterium
RALIVPKMVYRLGVLRAPRGYVEVTGP

SEQ ID NO: 933991 - protein, 25 aa, Mycobacterium
RALLRGEFDFGVTVGLPDDPRIDYL

SEQ ID NO: 933992 - protein, 27 aa, Mycobacterium
RALNIVLPMPRGWELIPDPNVPNAFAV

SEQ ID NO: 933993 - protein, 20 aa, Mycobacterium
RALPALLIFVVTACTSPPAP

SEQ ID NO: 933994 - protein, 25 aa, Mycobacterium
RALQAGADVALWLSTGEVPAVLDRL

SEQ ID NO: 933995 - protein, 23 aa, Mycobacterium
RALQAGTDVALWVTTDEVPAVLD

SEQ ID NO: 933996 - protein, 17 aa, Mycobacterium
RALTARRNVVIDVDVCR

SEQ ID NO: 933997 - protein, 24 aa, Mycobacterium
RAMKELKSDFTVFRAAVAEYIDAP

SEQ ID NO: 933998 - protein, 20 aa, Mycobacterium
RAMPGQAGQAVARAGAAGPA

SEQ ID NO: 933999 - protein, 20 aa, Mycobacterium
RAMSVLLYFLFDHRGRFLDA

SEQ ID NO: 934000 - protein, 20 aa, Mycobacterium
RANDVAVVWSPAGVSHVVAI

SEQ ID NO: 934001 - protein, 22 aa, Mycobacterium
RANSTYLLAPMGWINGDATHSI

SEQ ID NO: 934002 - protein, 19 aa, Mycobacterium
RAPCPAGTWDTALLSHIAP

SEQ ID NO: 934003 - protein, 23 aa, Mycobacterium
RAPDLRGYIWLVRNLSKRGWVVA

SEQ ID NO: 934004 - protein, 17 aa, Mycobacterium
RAPLKVAADYSPEFGCL

SEQ ID NO: 934005 - protein, 19 aa, Mycobacterium
RAPMHLGRGSGLGVGGARD

SEQ ID NO: 934006 - protein, 17 aa, Mycobacterium
RAPRPGVHNSGWVQSPG

SEQ ID NO: 934007 - protein, 21 aa, Mycobacterium
RAPTRRWGSLVGIQPNGLEVF

SEQ ID NO: 934008 - protein, 19 aa, Mycobacterium
RAPYFQYWADKGVDVSPFF

SEQ ID NO: 934009 - protein, 19 aa, Mycobacterium
RAQAFPRTVGVHGVNYPAS

SEQ ID NO: 934010 - protein, 20 aa, Mycobacterium
RAQALPPGRGLMVSVDGDVE

SEQ ID NO: 934011 - protein, 21 aa, Mycobacterium
RAQGFLLSRPLPGDAMEALLS

SEQ ID NO: 934012 - protein, 27 aa, Mycobacterium
RAQISVPGWLAFGWGLVDLFVPEPVER

SEQ ID NO: 934013 - protein, 17 aa, Mycobacterium
RAQLGGVGAEFVDTGTV

SEQ ID NO: 934014 - protein, 22 aa, Mycobacterium
RAQPCWSVRQFIDFNRDMQASL

SEQ ID NO: 934015 - protein, 19 aa, Mycobacterium
RAQPGLPVCQFRRAAGQRC

SEQ ID NO: 934016 - protein, 18 aa, Mycobacterium
RAQRWARQRAKRQARGQD

SEQ ID NO: 934017 - protein, 20 aa, Mycobacterium
RAQSWDLVRDGLFVGYQLDR

SEQ ID NO: 934018 - protein, 22 aa, Mycobacterium
RARASELVRLTSDFGIKESTLR

SEQ ID NO: 934019 - protein, 20 aa, Mycobacterium
RARIKEAGFQVADQNNFVNS

SEQ ID NO: 934020 - protein, 22 aa, Mycobacterium
RARLTFGALLAVPTLLLGGCTV

SEQ ID NO: 934021 - protein, 20 aa, Mycobacterium
RARQRWCTRLVQGGGIASPL

SEQ ID NO: 934022 - protein, 21 aa, Mycobacterium
RARRGVVLGVGGFEWDPGLVQ

SEQ ID NO: 934023 - protein, 27 aa, Mycobacterium
RARSPFWKSLAVFWLALSVAACSSSTT

SEQ ID NO: 934024 - protein, 23 aa, Mycobacterium
RARVKDPWLRRQLTPDFRPGCKR

SEQ ID NO: 934025 - protein, 19 aa, Mycobacterium
RARVPADVNTVLELTNEGL

SEQ ID NO: 934026 - protein, 19 aa, Mycobacterium
RARVTFALDGKTRLGQDTT

SEQ ID NO: 934027 - protein, 17 aa, Mycobacterium
RASAAGFHGQVAETVAI

SEQ ID NO: 934028 - protein, 23 aa, Mycobacterium
RASARLVGPLAAYLVVNVSSPNT

SEQ ID NO: 934029 - protein, 40 aa, Mycobacterium
RASDALACALELQRAPLAPIRLRIGIHTGEIQLRDEANYA

SEQ ID NO: 934030 - protein, 40 aa, Mycobacterium
RASDAVACALELQRAPLAPIRLRIGIHTGEIQLRDDANYA

SEQ ID NO: 934031 - protein, 24 aa, Mycobacterium
RASEPWITSHLELRSPEGKVLPGY

SEQ ID NO: 934032 - protein, 24 aa, Mycobacterium
RASLREVRDPELRRALTPDYTPMC

SEQ ID NO: 934033 - protein, 25 aa, Mycobacterium
RASRLDWLILRLGGVMSSTFSVDMD

SEQ ID NO: 934034 - protein, 17 aa, Mycobacterium
RATGQWLAGMKAGAEIY

SEQ ID NO: 934035 - protein, 23 aa, Mycobacterium
RATGWRLALAALDGIPRIVAEGV

SEQ ID NO: 934036 - protein, 18 aa, Mycobacterium
RATLELMTSPAQPGHNDG

SEQ ID NO: 934037 - protein, 26 aa, Mycobacterium
RATSLAEGWVPFGISLGEARDWLSRF

SEQ ID NO: 934038 - protein, 18 aa, Mycobacterium
RAVALGAAALVLTSCGSW

SEQ ID NO: 934039 - protein, 17 aa, Mycobacterium
RAVALGFDAVATGHYAR

SEQ ID NO: 934040 - protein, 19 aa, Mycobacterium
RAVAVLAVSAGIAACGPSG

SEQ ID NO: 934041 - protein, 20 aa, Mycobacterium
RAVDEYALAAAFQQLLLNSM

SEQ ID NO: 934042 - protein, 17 aa, Mycobacterium
RAVFLFRTKGELDYDHR

SEQ ID NO: 934043 - protein, 20 aa, Mycobacterium
RAVGELTPAVAALAALAKPG

SEQ ID NO: 934044 - protein, 19 aa, Mycobacterium
RAVGPLLDMIPPIHHNPLL

SEQ ID NO: 934045 - protein, 33 aa, Mycobacterium
RAVIRAAVWLTAICALAACSSADPLGAEVRNPR

SEQ ID NO: 934046 - protein, 25 aa, Mycobacterium
RAVIVSVNAEMIWGVTIDNKDEAGN

SEQ ID NO: 934047 - protein, 21 aa, Mycobacterium
RAVRLRFAGSVAVGVDAIGPD

SEQ ID NO: 934048 - protein, 18 aa, Mycobacterium
RAVSPLVVQMYMPNGAAA

SEQ ID NO: 934049 - protein, 19 aa, Mycobacterium
RAVSSWHLVDGSLRMTPDI

SEQ ID NO: 934050 - protein, 24 aa, Mycobacterium
RAVTLAALGPRPGELLWDVGSGSG

SEQ ID NO: 934051 - protein, 30 aa, Mycobacterium
RAVYEIDYRDGLRVARTFETSIPPGFMVEA

SEQ ID NO: 934052 - protein, 24 aa, Mycobacterium
RAWEAMLAAHLQWRTMLSRLPEGD

SEQ ID NO: 934053 - protein, 18 aa, Mycobacterium
RAWGRRLLVGTAAAVTLP

SEQ ID NO: 934054 - protein, 19 aa, Mycobacterium
RAWVLAAMTALMLPMTACV

SEQ ID NO: 934055 - protein, 21 aa, Mycobacterium
RCALPSRLLGLRFSRDTPGVY

SEQ ID NO: 934056 - protein, 30 aa, Mycobacterium
RCDGNPAWDLPLVFGPIALVYHLADVPALV

SEQ ID NO: 934057 - protein, 21 aa, Mycobacterium
RCHQSGWSWFIETPDEENGFV

SEQ ID NO: 934058 - protein, 26 aa, Mycobacterium
RCNERIKFSALAARALALGFDAVATG

SEQ ID NO: 934059 - protein, 26 aa, Mycobacterium
RCNQRIKFSALSARALALGFDAVATG

SEQ ID NO: 934060 - protein, 18 aa, Mycobacterium
RCPGVTGAVAMGREVVFG

SEQ ID NO: 934061 - protein, 27 aa, Mycobacterium
RCPRSRRARPTGWWESPRTRRSSRFAS

SEQ ID NO: 934062 - protein, 26 aa, Mycobacterium
RCRRTCPHRRCRVWPPERPRRRRPRP

SEQ ID NO: 934063 - protein, 24 aa, Mycobacterium
RCVDKVGLEFLANVGTVNVAKDMD

SEQ ID NO: 934064 - protein, 23 aa, Mycobacterium
RDAARRAGVPVTEVAETLPDGAD

SEQ ID NO: 934065 - protein, 18 aa, Mycobacterium
RDAARRAGVPVTNVSETL

SEQ ID NO: 934066 - protein, 25 aa, Mycobacterium
RDAGAVPSFLGYHGYPASICASVNE

SEQ ID NO: 934067 - protein, 20 aa, Mycobacterium
RDAGGMWAGYGSPKGNCDTT

SEQ ID NO: 934068 - protein, 22 aa, Mycobacterium
RDARIRIVDEFTRRHPDIKVRP

SEQ ID NO: 934069 - protein, 19 aa, Mycobacterium
RDAYLQSWVHRTAQFQYAL

SEQ ID NO: 934070 - protein, 19 aa, Mycobacterium
RDCTSQVYGNAAIPAAPGI

SEQ ID NO: 934071 - protein, 28 aa, Mycobacterium
RDDLTLGEALTLWLSDTEQLVPRDIIYP

SEQ ID NO: 934072 - protein, 22 aa, Mycobacterium
RDEFTLFVALRYLRQDQRFTPE

SEQ ID NO: 934073 - protein, 18 aa, Mycobacterium
RDEILLARNDRYWATQAV

SEQ ID NO: 934074 - protein, 19 aa, Mycobacterium
RDEILLARNDRYWGTPAKP

SEQ ID NO: 934075 - protein, 20 aa, Mycobacterium
RDEILLARNDRYWGVPATPD

SEQ ID NO: 934076 - protein, 27 aa, Mycobacterium
RDELTLGEALTLWLSGQEQLVPRDLIY

SEQ ID NO: 934077 - protein, 21 aa, Mycobacterium
RDFIIDRAITFPSIYDPPMRT

SEQ ID NO: 934078 - protein, 19 aa, Mycobacterium
RDGAKLIIPATRSDDGAFL

SEQ ID NO: 934079 - protein, 25 aa, Mycobacterium
RDGHTTDCRLHWVQVGLTDPQPNSV

SEQ ID NO: 934080 - protein, 20 aa, Mycobacterium
RDGKLWGVPQLSDAGIALYY

SEQ ID NO: 934081 - protein, 19 aa, Mycobacterium
RDGLLRLLVDVQYTRNDLS

SEQ ID NO: 934082 - protein, 19 aa, Mycobacterium
RDGLPDGYEVTPYTGSPAP

SEQ ID NO: 934083 - protein, 18 aa, Mycobacterium
RDGLPVREGQRVRLRFIN

SEQ ID NO: 934084 - protein, 24 aa, Mycobacterium
RDGNLWCGWGSNGLVADQPTDVGG

SEQ ID NO: 934085 - protein, 27 aa, Mycobacterium
RDGTWNALYRKWLSVLGPAPAPPSAKY

SEQ ID NO: 934086 - protein, 19 aa, Mycobacterium
RDGVRWHDGTPLTADDVVY

SEQ ID NO: 934087 - protein, 24 aa, Mycobacterium
RDHLARALSGWSAAELHEFNRLLS

SEQ ID NO: 934088 - protein, 17 aa, Mycobacterium
RDIKSAVSVAGHTVIEK

SEQ ID NO: 934089 - protein, 19 aa, Mycobacterium
RDIVVEFQPGGPHAVYLLD

SEQ ID NO: 934090 - protein, 17 aa, Mycobacterium
RDIWADGPVTFLGLMVP

SEQ ID NO: 934091 - protein, 25 aa, Mycobacterium
RDLAAELRTCWNIDFDDAGAIGRRY

SEQ ID NO: 934092 - protein, 24 aa, Mycobacterium
RDLAELLDLAPLVADNAYNMIDRA

SEQ ID NO: 934093 - protein, 18 aa, Mycobacterium
RDLAGFWVAEAVWVTHSA

SEQ ID NO: 934094 - protein, 26 aa, Mycobacterium
RDLAVLFRAAMAYPVFAQITAQPTAV

SEQ ID NO: 934095 - protein, 24 aa, Mycobacterium
RDLDLCGVTWVYNYAVAVYPDARG

SEQ ID NO: 934096 - protein, 18 aa, Mycobacterium
RDLKKATAGLRGVVKDIR

SEQ ID NO: 934097 - protein, 18 aa, Mycobacterium
RDLLGCLDPEWKRLLDGL

SEQ ID NO: 934098 - protein, 29 aa, Mycobacterium
RDLQRALLRIAYRLIVLFVVEDRDLLHGA

SEQ ID NO: 934099 - protein, 19 aa, Mycobacterium
RDNALWGATNAVRTAVADV

SEQ ID NO: 934100 - protein, 18 aa, Mycobacterium
RDNITFSGASNREITAHD

SEQ ID NO: 934101 - protein, 28 aa, Mycobacterium
RDNLSWWNRTWVPQLVPKGALLEVQLPS

SEQ ID NO: 934102 - protein, 24 aa, Mycobacterium
RDNSEARAALGFMDTELQIDYRDT

SEQ ID NO: 934103 - protein, 17 aa, Mycobacterium
RDPAVTIADTFAGLRAV

SEQ ID NO: 934104 - protein, 24 aa, Mycobacterium
RDPDLRLLGAVAMAPGGVDMGATV

SEQ ID NO: 934105 - protein, 25 aa, Mycobacterium
RDPGPGRPVYPCREASAIASGAAQM

SEQ ID NO: 934106 - protein, 18 aa, Mycobacterium
RDPMEFKPPSGFQLPTGM

SEQ ID NO: 934107 - protein, 17 aa, Mycobacterium
RDQRRWVYTSAKKENNY

SEQ ID NO: 934108 - protein, 19 aa, Mycobacterium
RDRGVAVLEGMRSGLAAMG

SEQ ID NO: 934109 - protein, 28 aa, Mycobacterium
RDRLLSAALRLFAAKGYAATSVADIQRE

SEQ ID NO: 934110 - protein, 18 aa, Mycobacterium
RDRLRSGNLQELIDTKSV

SEQ ID NO: 934111 - protein, 18 aa, Mycobacterium
RDRWSRATGPAFDLLADY

SEQ ID NO: 934112 - protein, 20 aa, Mycobacterium
RDTMYPGLTRKLVTADDAEM

SEQ ID NO: 934113 - protein, 18 aa, Mycobacterium
RDTVAAILRLWTVDAARL

SEQ ID NO: 934114 - protein, 20 aa, Mycobacterium
RDVAVLQMRGAGGLPAAAIG

SEQ ID NO: 934115 - protein, 30 aa, Mycobacterium
RDVKGPTARYGALFTDVFGLREGDDVRVAG

SEQ ID NO: 934116 - protein, 19 aa, Mycobacterium
RDVLAKTSSEWDITDAAAT

SEQ ID NO: 934117 - protein, 26 aa, Mycobacterium
RDVLRCAPALLGAAAFLGAPRATAGV

SEQ ID NO: 934118 - protein, 21 aa, Mycobacterium
RDVLYRPLGMDSTSSRFADYE

SEQ ID NO: 934119 - protein, 17 aa, Mycobacterium
RDVMMIHTLLWPDEIRD

SEQ ID NO: 934120 - protein, 17 aa, Mycobacterium
RDVWPYIGAKAGGLPGD

SEQ ID NO: 934121 - protein, 19 aa, Mycobacterium
RDWDAMVAEAARLHAAGQP

SEQ ID NO: 934122 - protein, 18 aa, Mycobacterium
RDYPDDKTVIMREYSRFA

SEQ ID NO: 934123 - protein, 17 aa, Mycobacterium
REAAALTTLAMPYLRNV

SEQ ID NO: 934124 - protein, 20 aa, Mycobacterium
REAARTGWRVVIHDDGAKGP

SEQ ID NO: 934125 - protein, 25 aa, Mycobacterium
REAASRPFAPSWVRTDRFRVTVDDG

SEQ ID NO: 934126 - protein, 17 aa, Mycobacterium
READFAKIIPSIQGGTF

SEQ ID NO: 934127 - protein, 23 aa, Mycobacterium
READLQPGEKWTGYHRLEKDLWV

SEQ ID NO: 934128 - protein, 24 aa, Mycobacterium
REAEADLFYGDFVARVAEGRNLST

SEQ ID NO: 934129 - protein, 25 aa, Mycobacterium
REAGRAATLRAVRSLTGVPIDYFAE

SEQ ID NO: 934130 - protein, 18 aa, Mycobacterium
REALGDSTIDGWEKRAES

SEQ ID NO: 934131 - protein, 25 aa, Mycobacterium
REAMFLNDLVHPMASLTLLSELMNY

SEQ ID NO: 934132 - protein, 20 aa, Mycobacterium
REAPDAASYVRRAISSSPYP

SEQ ID NO: 934133 - protein, 20 aa, Mycobacterium
RECAAGFAPYTGKAVDDSPY

SEQ ID NO: 934134 - protein, 21 aa, Mycobacterium
REELPAQLVVRSVGYRGVPTP

SEQ ID NO: 934135 - protein, 21 aa, Mycobacterium
REEMRLLAWELLANRGGSRPA

SEQ ID NO: 934136 - protein, 18 aa, Mycobacterium
REEVWPLGAGDAVLAGGT

SEQ ID NO: 934137 - protein, 17 aa, Mycobacterium
REFLQGKGVKFEPQRSQ

SEQ ID NO: 934138 - protein, 19 aa, Mycobacterium
REFSDLGWECERITDALDD

SEQ ID NO: 934139 - protein, 17 aa, Mycobacterium
REGDSWELLGNARWLPL

SEQ ID NO: 934140 - protein, 19 aa, Mycobacterium
REHNSLWGILSNGHRLRLL

SEQ ID NO: 934141 - protein, 18 aa, Mycobacterium
REHPQEWAAQYAGSAGID

SEQ ID NO: 934142 - protein, 17 aa, Mycobacterium
REIAPFMSYGSFTGDAP

SEQ ID NO: 934143 - protein, 17 aa, Mycobacterium
REIEVVEFIPAEQLDPL

SEQ ID NO: 934144 - protein, 24 aa, Mycobacterium
REIRLIGRNSLFPKVTETVEVIQN

SEQ ID NO: 934145 - protein, 32 aa, Mycobacterium
REKIHRMGTALPFVVQRLWLDRPVRGDRPAFL

SEQ ID NO: 934146 - protein, 24 aa, Mycobacterium
RELFCARDPFGIKPLFMATGPGGT

SEQ ID NO: 934147 - protein, 18 aa, Mycobacterium
RELGPWTLHGDLAYPTVT

SEQ ID NO: 934148 - protein, 17 aa, Mycobacterium
RELLRGAGLLTAAALAP

SEQ ID NO: 934149 - protein, 17 aa, Mycobacterium
RELRRLAEENGWQRVIV

SEQ ID NO: 934150 - protein, 20 aa, Mycobacterium
REMMIKVSIFAVAMLLVSAG

SEQ ID NO: 934151 - protein, 21 aa, Mycobacterium
RENADVFALTADWIKKCGQYD

SEQ ID NO: 934152 - protein, 27 aa, Mycobacterium
RENRCRPWLPIAHVFDRMAFIVERLGG

SEQ ID NO: 934153 - protein, 25 aa, Mycobacterium
REPLGLPGELSWRVPSLSLADEAIE

SEQ ID NO: 934154 - protein, 24 aa, Mycobacterium
REPLGVPGELSWWVPSLSVTGEAV

SEQ ID NO: 934155 - protein, 21 aa, Mycobacterium
REQLRLIAWELVGNRGGSRPR

SEQ ID NO: 934156 - protein, 23 aa, Mycobacterium
REREIAILVARGLSNRDIAQALS

SEQ ID NO: 934157 - protein, 21 aa, Mycobacterium
RERFARIGIGPDGDFDADKLS

SEQ ID NO: 934158 - protein, 19 aa, Mycobacterium
RERRQRRSAEQSGITVSQM

SEQ ID NO: 934159 - protein, 29 aa, Mycobacterium
RERTVRRFVEFTGGWPWSWTAGQLESWIA

SEQ ID NO: 934160 - protein, 22 aa, Mycobacterium
RESASGLVRARYGGRPGHPVVI

SEQ ID NO: 934161 - protein, 25 aa, Mycobacterium
RESGTELIRLFLGMFTDHRGYDNVD

SEQ ID NO: 934162 - protein, 26 aa, Mycobacterium
RESRGAPWRRGEFRAVDSVSFRLRRA

SEQ ID NO: 934163 - protein, 18 aa, Mycobacterium
RETTGTIPAGTRSARVTV

SEQ ID NO: 934164 - protein, 19 aa, Mycobacterium
RETWRGCVGTLTTYDIDQM

SEQ ID NO: 934165 - protein, 21 aa, Mycobacterium
REVADAVAFLVSEEASFITGA

SEQ ID NO: 934166 - protein, 20 aa, Mycobacterium
REVADRAGTVLASLPTPQVS

SEQ ID NO: 934167 - protein, 24 aa, Mycobacterium
REVAEFFDVLPLMADNLYNAIDQR

SEQ ID NO: 934168 - protein, 23 aa, Mycobacterium
REVFPALLADGLRIYGHVDASYW

SEQ ID NO: 934169 - protein, 17 aa, Mycobacterium
REVPAPAGLDAPLDAPG

SEQ ID NO: 934170 - protein, 18 aa, Mycobacterium
REVRRLEHDGSRWRIETS

SEQ ID NO: 934171 - protein, 26 aa, Mycobacterium
REWTFDIRPGVTFSDGTPFTAADAAF

SEQ ID NO: 934172 - protein, 20 aa, Mycobacterium
REYLVAGTFEGAVAGAGTAP

SEQ ID NO: 934173 - protein, 17 aa, Mycobacterium
REYRSGHSYSLEEFGLE

SEQ ID NO: 934174 - protein, 24 aa, Mycobacterium
RFAAPVPGRHGWHVPPVAAPPLER

SEQ ID NO: 934175 - protein, 17 aa, Mycobacterium
RFADWKFGSADVPAAPP

SEQ ID NO: 934176 - protein, 18 aa, Mycobacterium
RFAGAGWQSDALIAAARE

SEQ ID NO: 934177 - protein, 27 aa, Mycobacterium
RFAPGQLPPVNAFWSLTMYELPGSVLV

SEQ ID NO: 934178 - protein, 27 aa, Mycobacterium
RFAPLRWSVLRLALAFRTLLRTGQVGD

SEQ ID NO: 934179 - protein, 25 aa, Mycobacterium
RFEAFRKPRVGMLVREAQTLGRIVN

SEQ ID NO: 934180 - protein, 19 aa, Mycobacterium
RFEHYLPEMMALKDIVDAK

SEQ ID NO: 934181 - protein, 20 aa, Mycobacterium
RFFADLAVALGCDSGVSPYL

SEQ ID NO: 934182 - protein, 27 aa, Mycobacterium
RFFSRNCRTWLGLALCMQGNLTEAQDV

SEQ ID NO: 934183 - protein, 18 aa, Mycobacterium
RFGDGNTYYAEFSNVSNL

SEQ ID NO: 934184 - protein, 21 aa, Mycobacterium
RFGELREGVWMRPDNIDAELG

SEQ ID NO: 934185 - protein, 19 aa, Mycobacterium
RFGLLWFGFWSTLFDMPGL

SEQ ID NO: 934186 - protein, 20 aa, Mycobacterium
RFGPVDVLVNNAGYGYRAAV

SEQ ID NO: 934187 - protein, 20 aa, Mycobacterium
RFGSGNIGFGNRFGDGNFGS

SEQ ID NO: 934188 - protein, 20 aa, Mycobacterium
RFGSVSGLWNQVMAIFEGDA

SEQ ID NO: 934189 - protein, 23 aa, Mycobacterium
RFIRRAQHRLSFHLSGAQLGISI

SEQ ID NO: 934190 - protein, 21 aa, Mycobacterium
RFKLQDVIWRGTYYTPSGPQA

SEQ ID NO: 934191 - protein, 18 aa, Mycobacterium
RFLPVAGPVAMRSSTLMK

SEQ ID NO: 934192 - protein, 20 aa, Mycobacterium
RFLVAGLILAGWAGSAGVAA

SEQ ID NO: 934193 - protein, 22 aa, Mycobacterium
RFLVRKEARLHTTVATLGVDVS

SEQ ID NO: 934194 - protein, 18 aa, Mycobacterium
RFMTRWKGEPDPRHVEAI

SEQ ID NO: 934195 - protein, 19 aa, Mycobacterium
RFNLDFSDLGTVTASVNGR

SEQ ID NO: 934196 - protein, 20 aa, Mycobacterium
RFVACPFAADGSRMYRTGDL

SEQ ID NO: 934197 - protein, 17 aa, Mycobacterium
RFVESAFHGLGATADYA

SEQ ID NO: 934198 - protein, 20 aa, Mycobacterium
RFVEVAAKVNALLDIAQVNL

SEQ ID NO: 934199 - protein, 24 aa, Mycobacterium
RFVIVDECHYYRGVFGSNVAMVLR

SEQ ID NO: 934200 - protein, 24 aa, Mycobacterium
RFVTFARGAMYWSPETGPQPVTGA

SEQ ID NO: 934201 - protein, 20 aa, Mycobacterium
RGAAEFETLFPGLLDDMVAC

SEQ ID NO: 934202 - protein, 17 aa, Mycobacterium
RGAAIELARRGHQVVAT

SEQ ID NO: 934203 - protein, 27 aa, Mycobacterium
RGAAPVDRPAFWSANLCFSLGESLPQS

SEQ ID NO: 934204 - protein, 21 aa, Mycobacterium
RGADTLQLEWGRSVKGSLAAQ

SEQ ID NO: 934205 - protein, 27 aa, Mycobacterium
RGAEDPRVAGLIARVQLPPAPIGAVQE

SEQ ID NO: 934206 - protein, 19 aa, Mycobacterium
RGAGEFEYQMLYGIRDDEQ

SEQ ID NO: 934207 - protein, 17 aa, Mycobacterium
RGAKVRAAYVPDAELGT

SEQ ID NO: 934208 - protein, 24 aa, Mycobacterium
RGAPDMAASLWIGDLGQEAVQSAD

SEQ ID NO: 934209 - protein, 25 aa, Mycobacterium
RGARVHNCRLCKSLREATALEAGAC

SEQ ID NO: 934210 - protein, 27 aa, Mycobacterium
RGATVTVKVLRAMEPWSSDDDKLALTL

SEQ ID NO: 934211 - protein, 25 aa, Mycobacterium
RGCYNANCGPLVWTTYGAALAEPIG

SEQ ID NO: 934212 - protein, 19 aa, Mycobacterium
RGDAEAALSYGADLPATKE

SEQ ID NO: 934213 - protein, 19 aa, Mycobacterium
RGDDQCRLLIRSRLALRHP

SEQ ID NO: 934214 - protein, 25 aa, Mycobacterium
RGDERFAFCSTFKGLLGAAVLHRYP

SEQ ID NO: 934215 - protein, 20 aa, Mycobacterium
RGDRTLFLFILRSDDATVPG

SEQ ID NO: 934216 - protein, 22 aa, Mycobacterium
RGDVPGREFVSFWLDGDNRVLA

SEQ ID NO: 934217 - protein, 21 aa, Mycobacterium
RGEGPAGLPTPLPDLQQGAVN

SEQ ID NO: 934218 - protein, 27 aa, Mycobacterium
RGEPLPWQDLRAAFTERGWLDLTHTRR

SEQ ID NO: 934219 - protein, 20 aa, Mycobacterium
RGEVDAALIAAVGFAGTTSD

SEQ ID NO: 934220 - protein, 22 aa, Mycobacterium
RGEVKADLNVDVFRRMIGEDFT

SEQ ID NO: 934221 - protein, 17 aa, Mycobacterium
RGEYVRHAPASTIKTLL

SEQ ID NO: 934222 - protein, 18 aa, Mycobacterium
RGFDLATCDQFFLEDLRD

SEQ ID NO: 934223 - protein, 21 aa, Mycobacterium
RGFGWRVDMFGPQGPTRTELD

SEQ ID NO: 934224 - protein, 20 aa, Mycobacterium
RGFLDYGYLFAATSLMPSHV

SEQ ID NO: 934225 - protein, 17 aa, Mycobacterium
RGFSRVFLTTGRSGTSA

SEQ ID NO: 934226 - protein, 17 aa, Mycobacterium
RGGDGLEVLARTELSSP

SEQ ID NO: 934227 - protein, 24 aa, Mycobacterium
RGGGGRATGFFNAGAGFGVTGFFN

SEQ ID NO: 934228 - protein, 21 aa, Mycobacterium
RGGGPVERWRRGMAADLHLMI

SEQ ID NO: 934229 - protein, 20 aa, Mycobacterium
RGGLLAHLFGTVAVLEPGDQ

SEQ ID NO: 934230 - protein, 17 aa, Mycobacterium
RGGLMAHDVFDHTSQLR

SEQ ID NO: 934231 - protein, 18 aa, Mycobacterium
RGGLMVHDIFDHTSQLKL

SEQ ID NO: 934232 - protein, 27 aa, Mycobacterium
RGGPGGPPRAAGVWGPQHREHADPATV

SEQ ID NO: 934233 - protein, 18 aa, Mycobacterium
RGGPPIVRLSGHIATVAA

SEQ ID NO: 934234 - protein, 20 aa, Mycobacterium
RGGSGGLLFGNGGLGGQGGS

SEQ ID NO: 934235 - protein, 20 aa, Mycobacterium
RGGTSRRLLVVISDGLAYDH

SEQ ID NO: 934236 - protein, 21 aa, Mycobacterium
RGGVLAHLFGSVAVLEPADQR

SEQ ID NO: 934237 - protein, 19 aa, Mycobacterium
RGGYLIRTTLDPDVQVPVK

SEQ ID NO: 934238 - protein, 17 aa, Mycobacterium
RGGYLRLDIASGEVTSR

SEQ ID NO: 934239 - protein, 24 aa, Mycobacterium
RGHDWKFAVVEDGRHSITHYDTLE

SEQ ID NO: 934240 - protein, 20 aa, Mycobacterium
RGIADFPTRFPTVTASCLEA

SEQ ID NO: 934241 - protein, 20 aa, Mycobacterium
RGKAAMALGGHWRYQTFDRA

SEQ ID NO: 934242 - protein, 22 aa, Mycobacterium
RGLAGICASGLLGGMAAAVIAA

SEQ ID NO: 934243 - protein, 17 aa, Mycobacterium
RGLPARWIAIGVAEQDG

SEQ ID NO: 934244 - protein, 23 aa, Mycobacterium
RGLPRTPPFNAMAFALRSPTFRV

SEQ ID NO: 934245 - protein, 21 aa, Mycobacterium
RGLRDAGLLPVLKHFPGHGRA

SEQ ID NO: 934246 - protein, 19 aa, Mycobacterium
RGLRLARAQAHAVRAAGGV

SEQ ID NO: 934247 - protein, 17 aa, Mycobacterium
RGLRVFPTSAGRAAASQ

SEQ ID NO: 934248 - protein, 23 aa, Mycobacterium
RGMSQIGVPYSWGGGNAAGPSKG

SEQ ID NO: 934249 - protein, 19 aa, Mycobacterium
RGMTPRAAITKHLLDGDDS

SEQ ID NO: 934250 - protein, 19 aa, Mycobacterium
RGMTPRAALTKHLLDGDDS

SEQ ID NO: 934251 - protein, 17 aa, Mycobacterium
RGNCLVEVEVAFFNAAS

SEQ ID NO: 934252 - protein, 27 aa, Mycobacterium
RGNELIPTGPRFEWFDQTGAYHSSDLL

SEQ ID NO: 934253 - protein, 25 aa, Mycobacterium
RGNQKLRPGDSLPIGQSTTPYQIYD

SEQ ID NO: 934254 - protein, 18 aa, Mycobacterium
RGNRFWITLSSLVFAVML

SEQ ID NO: 934255 - protein, 24 aa, Mycobacterium
RGNTEARAALGFMDPDLRIDYRDK

SEQ ID NO: 934256 - protein, 20 aa, Mycobacterium
RGPAEHGWGEPLTPSASPAR

SEQ ID NO: 934257 - protein, 18 aa, Mycobacterium
RGPARKPGQLSWGTGSTP

SEQ ID NO: 934258 - protein, 18 aa, Mycobacterium
RGPFICTQALLPDMLDAG

SEQ ID NO: 934259 - protein, 22 aa, Mycobacterium
RGPGGEALQCRWIPNQWPPIYT

SEQ ID NO: 934260 - protein, 19 aa, Mycobacterium
RGPIKVSTIEPGYIQTDLS

SEQ ID NO: 934261 - protein, 29 aa, Mycobacterium
RGPMTLWADRIVLCAGAIGSAHLLMLSGI

SEQ ID NO: 934262 - protein, 17 aa, Mycobacterium
RGPRASRYAQLPVAPIG

SEQ ID NO: 934263 - protein, 20 aa, Mycobacterium
RGPVRHIVLRSAQTQVHLAQ

SEQ ID NO: 934264 - protein, 18 aa, Mycobacterium
RGQLLRRNIVVAMTPWLH

SEQ ID NO: 934265 - protein, 25 aa, Mycobacterium
RGQPGTRVPHVWVRDGVSTLDLLGP

SEQ ID NO: 934266 - protein, 25 aa, Mycobacterium
RGQTGTRVPHVWVRDGVSTLDLLGP

SEQ ID NO: 934267 - protein, 22 aa, Mycobacterium
RGREFASRWAELIFTGDPGIEV

SEQ ID NO: 934268 - protein, 20 aa, Mycobacterium
RGRLDHCFNAIGAQVSVTEL

SEQ ID NO: 934269 - protein, 25 aa, Mycobacterium
RGRNSVMWPTFTFRFRARTRSFDVI

SEQ ID NO: 934270 - protein, 24 aa, Mycobacterium
RGRSTWPPLRLVLDRLRPPDGRPV

SEQ ID NO: 934271 - protein, 24 aa, Mycobacterium
RGSAADCRLQWVVVSSGDQPDSPQ

SEQ ID NO: 934272 - protein, 21 aa, Mycobacterium
RGSADPAWRAKQIDGVPLKRE

SEQ ID NO: 934273 - protein, 18 aa, Mycobacterium
RGSDAPRLVDLVRETQSS

SEQ ID NO: 934274 - protein, 29 aa, Mycobacterium
RGSELDRWLRRGGARAALIRPDRTVMQTA

SEQ ID NO: 934275 - protein, 25 aa, Mycobacterium
RGSEVPRLAAMTQKAIDLLKNGKAG

SEQ ID NO: 934276 - protein, 20 aa, Mycobacterium
RGSEVRYGTEFVSFDMDEAG

SEQ ID NO: 934277 - protein, 21 aa, Mycobacterium
RGSGEPPGIGGIGGSFVDALR

SEQ ID NO: 934278 - protein, 25 aa, Mycobacterium
RGSGEPPGIGGIGRPFVDALRSEIG

SEQ ID NO: 934279 - protein, 21 aa, Mycobacterium
RGSPRSVLRVAPLSVADLLAR

SEQ ID NO: 934280 - protein, 22 aa, Mycobacterium
RGTLRELAAWAEGNEVLGEITV

SEQ ID NO: 934281 - protein, 21 aa, Mycobacterium
RGTPVPRWSTRCAGTAATGSS

SEQ ID NO: 934282 - protein, 22 aa, Mycobacterium
RGTRLPVWLSKWGYQRPAEQSM

SEQ ID NO: 934283 - protein, 24 aa, Mycobacterium
RGTSLALTGAWFLARALRDHPGDL

SEQ ID NO: 934284 - protein, 20 aa, Mycobacterium
RGVASSRPALWCNSDADNDR

SEQ ID NO: 934285 - protein, 17 aa, Mycobacterium
RGVEIIARRGPRGDEYD

SEQ ID NO: 934286 - protein, 24 aa, Mycobacterium
RGVELKAVHAWSDLEVVDLPGLDW

SEQ ID NO: 934287 - protein, 22 aa, Mycobacterium
RGVGGGVSFWAYRQSEASPPIV

SEQ ID NO: 934288 - protein, 20 aa, Mycobacterium
RGVGSSRPSIWCNSDADNDR

SEQ ID NO: 934289 - protein, 30 aa, Mycobacterium
RGVLDEATGRWGLRVARVELRSIDPPPSVQ

SEQ ID NO: 934290 - protein, 30 aa, Mycobacterium
RGVLDEATNRWGLRVARVELRSIDPPPSIQ

SEQ ID NO: 934291 - protein, 24 aa, Mycobacterium
RGVPGRGAGWIVIDVRDLADLHVA

SEQ ID NO: 934292 - protein, 23 aa, Mycobacterium
RGVPREIPPAAAVPTGAYPGLAP

SEQ ID NO: 934293 - protein, 19 aa, Mycobacterium
RGVRLRDGAKLIIPATRSD

SEQ ID NO: 934294 - protein, 19 aa, Mycobacterium
RGVRYAVGLLVAGASVGPT

SEQ ID NO: 934295 - protein, 24 aa, Mycobacterium
RGVTELLAAMGLRARRRDETEFVP

SEQ ID NO: 934296 - protein, 17 aa, Mycobacterium
RGYAHIGVINELRARGY

SEQ ID NO: 934297 - protein, 22 aa, Mycobacterium
RGYGYGPAFQGLRAVWRRGRDV

SEQ ID NO: 934298 - protein, 22 aa, Mycobacterium
RHDGKPGPAALLISESGPTDRN

SEQ ID NO: 934299 - protein, 19 aa, Mycobacterium
RHELPRGDLDRVVRQQVVM

SEQ ID NO: 934300 - protein, 25 aa, Mycobacterium
RHELPRGDLDRVVRQQVVMASLAHR

SEQ ID NO: 934301 - protein, 19 aa, Mycobacterium
RHGFDLDMAALVYFDDRTD

SEQ ID NO: 934302 - protein, 35 aa, Mycobacterium
RHGTFDGILSDGSFTYRPHAGYFGTDSFTYQINDV

SEQ ID NO: 934303 - protein, 17 aa, Mycobacterium
RHHRLVLSRGPYRYDEE

SEQ ID NO: 934304 - protein, 20 aa, Mycobacterium
RHIHDVKAAIAWARANVDKF

SEQ ID NO: 934305 - protein, 22 aa, Mycobacterium
RHIPIERRELWASRLDEAEASP

SEQ ID NO: 934306 - protein, 24 aa, Mycobacterium
RHIQDVKAAIAWARANVDKFGGDR

SEQ ID NO: 934307 - protein, 20 aa, Mycobacterium
RHLAGSKVASAVACEVQDSA

SEQ ID NO: 934308 - protein, 18 aa, Mycobacterium
RHLGKWPRSFASAIPKGT

SEQ ID NO: 934309 - protein, 19 aa, Mycobacterium
RHLGLPAPVPAPWPILAAL

SEQ ID NO: 934310 - protein, 17 aa, Mycobacterium
RHLRDIVLGVVRGGQLL

SEQ ID NO: 934311 - protein, 20 aa, Mycobacterium
RHPHCAWTVTIDESYPAVSG

SEQ ID NO: 934312 - protein, 22 aa, Mycobacterium
RHPISVDLRQDWSTILQESGFD

SEQ ID NO: 934313 - protein, 22 aa, Mycobacterium
RHRAWQTLVLLVAAMVLSSCGW

SEQ ID NO: 934314 - protein, 28 aa, Mycobacterium
RHRRDVSTLLTAWALTLGLAIALLSGAS

SEQ ID NO: 934315 - protein, 20 aa, Mycobacterium
RHRRPALHAVVAAFVLVCSA

SEQ ID NO: 934316 - protein, 22 aa, Mycobacterium
RHRRYLHRRGVHYGDSPAQLLD

SEQ ID NO: 934317 - protein, 27 aa, Mycobacterium
RHTRQFIPELGIYINTPHDWVSFADGV

SEQ ID NO: 934318 - protein, 19 aa, Mycobacterium
RIADLCVREPALAETLRVY

SEQ ID NO: 934319 - protein, 22 aa, Mycobacterium
RIAGALALAAALPFAMTACGGG

SEQ ID NO: 934320 - protein, 25 aa, Mycobacterium
RIAPDEIKGAGYAGVVNYVSESRPG

SEQ ID NO: 934321 - protein, 19 aa, Mycobacterium
RIAQADAYLATRPGTVGYV

SEQ ID NO: 934322 - protein, 20 aa, Mycobacterium
RIATDFPGLREAAWTATATR

SEQ ID NO: 934323 - protein, 20 aa, Mycobacterium
RIATQLASTMMACPRPVGDA

SEQ ID NO: 934324 - protein, 18 aa, Mycobacterium
RIDAFRVGILGDEARCLK

SEQ ID NO: 934325 - protein, 24 aa, Mycobacterium
RIDKLPNGVFLDWQQFQSTYKRNT

SEQ ID NO: 934326 - protein, 19 aa, Mycobacterium
RIDRARDGLPDGYEVTPYT

SEQ ID NO: 934327 - protein, 25 aa, Mycobacterium
RIDSLPNGVLLDWGQFQSTYRRYTV

SEQ ID NO: 934328 - protein, 23 aa, Mycobacterium
RIEKRLASTVPDGARADVGAVVG

SEQ ID NO: 934329 - protein, 20 aa, Mycobacterium
RIELSAATLANWAAKTGNLL

SEQ ID NO: 934330 - protein, 21 aa, Mycobacterium
RIELSAATLANWAAKTGNLLR

SEQ ID NO: 934331 - protein, 21 aa, Mycobacterium
RIEPKGGYVEVEFTVDGDVAV

SEQ ID NO: 934332 - protein, 23 aa, Mycobacterium
RIERQGWHALLTIRLNGDVDLPA

SEQ ID NO: 934333 - protein, 20 aa, Mycobacterium
RIEVLAALSLAVDLGLGQPM

SEQ ID NO: 934334 - protein, 18 aa, Mycobacterium
RIGAIEFATTIAPGLRDV

SEQ ID NO: 934335 - protein, 24 aa, Mycobacterium
RIGAKRPRRAPTIAASAIAALTPS

SEQ ID NO: 934336 - protein, 17 aa, Mycobacterium
RIGALALALGIGIGLGS

SEQ ID NO: 934337 - protein, 24 aa, Mycobacterium
RIGEIRPDGLIYTVWESKGPIEPD

SEQ ID NO: 934338 - protein, 20 aa, Mycobacterium
RIGGFGGVEGMRRWLRDEGI

SEQ ID NO: 934339 - protein, 21 aa, Mycobacterium
RIGTRSAWRRKLGSIATILLL

SEQ ID NO: 934340 - protein, 17 aa, Mycobacterium
RIIANSVVRCVGNTLLL

SEQ ID NO: 934341 - protein, 18 aa, Mycobacterium
RIIGPRYEDLMAPFYGMG

SEQ ID NO: 934342 - protein, 19 aa, Mycobacterium
RIKPLFVFFDSCWDPAPRA

SEQ ID NO: 934343 - protein, 17 aa, Mycobacterium
RIKVVPREEMISAGRQA

SEQ ID NO: 934344 - protein, 17 aa, Mycobacterium
RILAGGIGALAGIAGVL

SEQ ID NO: 934345 - protein, 21 aa, Mycobacterium
RILDRLFAGLMSYDATGHPSP

SEQ ID NO: 934346 - protein, 21 aa, Mycobacterium
RILDRLFAGLMSYDATGKPSP

SEQ ID NO: 934347 - protein, 17 aa, Mycobacterium
RILPRAAAVAASALVAV

SEQ ID NO: 934348 - protein, 17 aa, Mycobacterium
RIMPENLEDAGVSWKVY

SEQ ID NO: 934349 - protein, 19 aa, Mycobacterium
RIPALAGYPERPAAGRGTT

SEQ ID NO: 934350 - protein, 20 aa, Mycobacterium
RIPGPPGPHVDDWANWHQVP

SEQ ID NO: 934351 - protein, 33 aa, Mycobacterium
RIQLSYADGDIWDWAVPWDEWTSMSALSSADRT

SEQ ID NO: 934352 - protein, 20 aa, Mycobacterium
RIRALAVLSVLFLSTLPVGV

SEQ ID NO: 934353 - protein, 18 aa, Mycobacterium
RIREKILGADILVLSTPV

SEQ ID NO: 934354 - protein, 19 aa, Mycobacterium
RIRIAAGIAALAVAVSGCS

SEQ ID NO: 934355 - protein, 22 aa, Mycobacterium
RIRRALSALARRVAIRNAHVLS

SEQ ID NO: 934356 - protein, 22 aa, Mycobacterium
RIRRDAYELPDITLTADESAAV

SEQ ID NO: 934357 - protein, 17 aa, Mycobacterium
RIRRYRQTLIGVMTGLA

SEQ ID NO: 934358 - protein, 19 aa, Mycobacterium
RITERMPLPPNARRVEDPD

SEQ ID NO: 934359 - protein, 17 aa, Mycobacterium
RITGRRGDLVITDNLTA

SEQ ID NO: 934360 - protein, 27 aa, Mycobacterium
RITKTSDVSTVWTWPDKPGVAGCAAMD

SEQ ID NO: 934361 - protein, 18 aa, Mycobacterium
RIVAEGVYDDAGLDTALG

SEQ ID NO: 934362 - protein, 19 aa, Mycobacterium
RIVEGGFETTLWARRPASL

SEQ ID NO: 934363 - protein, 22 aa, Mycobacterium
RKAELGESFATFRTTFLNQAPT

SEQ ID NO: 934364 - protein, 20 aa, Mycobacterium
RKDTHAHAWALRMSPDGNVW

SEQ ID NO: 934365 - protein, 17 aa, Mycobacterium
RKECLNRNHWTSLLEAR

SEQ ID NO: 934366 - protein, 18 aa, Mycobacterium
RKLKEAGNFLPVDPTPAT

SEQ ID NO: 934367 - protein, 20 aa, Mycobacterium
RKNEPAGVVQITLGANKDRD

SEQ ID NO: 934368 - protein, 26 aa, Mycobacterium
RKQAFTLRIAELLTELGADDPHGLAE

SEQ ID NO: 934369 - protein, 18 aa, Mycobacterium
RKQEWLRELAQWEPDFVV

SEQ ID NO: 934370 - protein, 21 aa, Mycobacterium
RKRYCDHYMALAALLDSPGRT

SEQ ID NO: 934371 - protein, 21 aa, Mycobacterium
RKSGARRAWLASLAEEPRTCV

SEQ ID NO: 934372 - protein, 24 aa, Mycobacterium
RKSQALCLDIDWVVGGCMDVPDKW

SEQ ID NO: 934373 - protein, 24 aa, Mycobacterium
RKTFGNLLSAFGFDSPVRPAPELP

SEQ ID NO: 934374 - protein, 32 aa, Mycobacterium
RKVAGLKSDPFVAIVAFPFIPQAMRGRYNQVE

SEQ ID NO: 934375 - protein, 19 aa, Mycobacterium
RKVTFTGAGMRGLVEVVEA

SEQ ID NO: 934376 - protein, 20 aa, Mycobacterium
RKVTGMHLSLAVQGDVPNLR

SEQ ID NO: 934377 - protein, 25 aa, Mycobacterium
RKWGRRGNVELLRLSFGRYGDDLAR

SEQ ID NO: 934378 - protein, 20 aa, Mycobacterium
RLADLPALVAAAEVDGDVLA

SEQ ID NO: 934379 - protein, 19 aa, Mycobacterium
RLAEEGCRVVVGDVSEDAA

SEQ ID NO: 934380 - protein, 18 aa, Mycobacterium
RLAIKTDTILGKKIVDVE

SEQ ID NO: 934381 - protein, 18 aa, Mycobacterium
RLAIKYQALTGLRYVDVV

SEQ ID NO: 934382 - protein, 28 aa, Mycobacterium
RLALPLASALLYWSGMVLNDWADRERDA

SEQ ID NO: 934383 - protein, 18 aa, Mycobacterium
RLAPPVPSIPGRRSKPTI

SEQ ID NO: 934384 - protein, 17 aa, Mycobacterium
RLAQRRLTLEVSLPAKK

SEQ ID NO: 934385 - protein, 17 aa, Mycobacterium
RLAQWTFDPAVAPADAP

SEQ ID NO: 934386 - protein, 17 aa, Mycobacterium
RLARRGYGYGPAFQGLR

SEQ ID NO: 934387 - protein, 20 aa, Mycobacterium
RLARRYLAVEGHRALVANGH

SEQ ID NO: 934388 - protein, 18 aa, Mycobacterium
RLASRLAGLGIGPGDVVA

SEQ ID NO: 934389 - protein, 18 aa, Mycobacterium
RLATFQIAVNKVAAATYM

SEQ ID NO: 934390 - protein, 21 aa, Mycobacterium
RLATLGGGQFLLSRLDGEVPD

SEQ ID NO: 934391 - protein, 24 aa, Mycobacterium
RLAVVYRPMTFLDLDGPGYSAHVS

SEQ ID NO: 934392 - protein, 21 aa, Mycobacterium
RLCAVLGVVLLAGCSVSAPPA

SEQ ID NO: 934393 - protein, 27 aa, Mycobacterium
RLDFDAHGASLAWLIGAIPTGDPLLPN

SEQ ID NO: 934394 - protein, 18 aa, Mycobacterium
RLDGMPLAIELAAARIRA

SEQ ID NO: 934395 - protein, 29 aa, Mycobacterium
RLDKRWCGGDLLLQICADSPLLVAHAARV

SEQ ID NO: 934396 - protein, 21 aa, Mycobacterium
RLDSLPSCFSIKPQAIEPDPD

SEQ ID NO: 934397 - protein, 28 aa, Mycobacterium
RLDVRSLKAADGWAFLWSAMQEPDGSPV

SEQ ID NO: 934398 - protein, 25 aa, Mycobacterium
RLEAIGLQLQRSHSFFVGNPQIGKT

SEQ ID NO: 934399 - protein, 19 aa, Mycobacterium
RLEGYRRLAAAPDDAAVDA

SEQ ID NO: 934400 - protein, 17 aa, Mycobacterium
RLEKAVLTEADFPSGVV

SEQ ID NO: 934401 - protein, 24 aa, Mycobacterium
RLEPVDGKLVCLVRAASDAEARVR

SEQ ID NO: 934402 - protein, 30 aa, Mycobacterium
RLEQWLPAPTGLRFYVPVSHAAGDFVPITV

SEQ ID NO: 934403 - protein, 18 aa, Mycobacterium
RLESRKPSATRVDDEPTD

SEQ ID NO: 934404 - protein, 24 aa, Mycobacterium
RLEYARGPIKVSVIEPGYIESEMT

SEQ ID NO: 934405 - protein, 22 aa, Mycobacterium
RLFAVVVALSLATTVVVGCSSG

SEQ ID NO: 934406 - protein, 17 aa, Mycobacterium
RLFTEFITPGNFDIAQF

SEQ ID NO: 934407 - protein, 18 aa, Mycobacterium
RLGAERSAKLCVQYLAPI

SEQ ID NO: 934408 - protein, 30 aa, Mycobacterium
RLGGEQAAKLCVQYLAPILKNRQYNFPPLG

SEQ ID NO: 934409 - protein, 24 aa, Mycobacterium
RLGGNRWTFHTGFDPAREAVSDYT

SEQ ID NO: 934410 - protein, 38 aa, Mycobacterium
RLGVTELQFRPEVSDGLFLRLAVTSVESLACAYAAVLA

SEQ ID NO: 934411 - protein, 17 aa, Mycobacterium
RLIATSVPRCVGNTLLL

SEQ ID NO: 934412 - protein, 22 aa, Mycobacterium
RLIEHFALVVGLEILKQRHIVE

SEQ ID NO: 934413 - protein, 19 aa, Mycobacterium
RLIEKRFGVPVPNLTAWRR

SEQ ID NO: 934414 - protein, 19 aa, Mycobacterium
RLIETRFGVPVPNLTAWRR

SEQ ID NO: 934415 - protein, 29 aa, Mycobacterium
RLIETRFGVPVPNLTPWRRSVTEDMTSAF

SEQ ID NO: 934416 - protein, 17 aa, Mycobacterium
RLLADRLEFARLEEAPI

SEQ ID NO: 934417 - protein, 18 aa, Mycobacterium
RLLCVAVLSIGLGGVTAA

SEQ ID NO: 934418 - protein, 29 aa, Mycobacterium
RLLEKRFGVPVPNLSAWRRSVTGDMTSTF

SEQ ID NO: 934419 - protein, 18 aa, Mycobacterium
RLLELDAENDAAWHNVWR

SEQ ID NO: 934420 - protein, 29 aa, Mycobacterium
RLLEQRFGVPVPNLTTWRRGVTGDMTSTF

SEQ ID NO: 934421 - protein, 19 aa, Mycobacterium
RLLIFAFLGVTAAVGVDLM

SEQ ID NO: 934422 - protein, 20 aa, Mycobacterium
RLLLRSMGYRDALIGGLLAT

SEQ ID NO: 934423 - protein, 18 aa, Mycobacterium
RLLQLGLESLRLWREGGF

SEQ ID NO: 934424 - protein, 28 aa, Mycobacterium
RLLTRLSAFKVPHRFAVVERLPRTANGK

SEQ ID NO: 934425 - protein, 19 aa, Mycobacterium
RLMTWRGGYHGDTFTPMSI

SEQ ID NO: 934426 - protein, 21 aa, Mycobacterium
RLNPAEGRLLSALWVPHTHQL

SEQ ID NO: 934427 - protein, 20 aa, Mycobacterium
RLNRWSTGRIGLVGDAAYAP

SEQ ID NO: 934428 - protein, 29 aa, Mycobacterium
RLNSQQAAKLCVQYLAPIVKNRQYNFPPL

SEQ ID NO: 934429 - protein, 24 aa, Mycobacterium
RLPAPRPYRDFVGWLSAQDHDAAR

SEQ ID NO: 934430 - protein, 17 aa, Mycobacterium
RLPDGRQSVVLVSDDNF

SEQ ID NO: 934431 - protein, 22 aa, Mycobacterium
RLPDYAPHRAIRVLDSANQVEA

SEQ ID NO: 934432 - protein, 21 aa, Mycobacterium
RLPGAIRWTSGALRQARDYVS

SEQ ID NO: 934433 - protein, 19 aa, Mycobacterium
RLPGAIRWTSNALRQARDY

SEQ ID NO: 934434 - protein, 24 aa, Mycobacterium
RLPGDAGIVGPMFDHGFPCAEDDQ

SEQ ID NO: 934435 - protein, 19 aa, Mycobacterium
RLPLPLLAAAAVFGSPVAS

SEQ ID NO: 934436 - protein, 20 aa, Mycobacterium
RLPNPRYSRFTNITHRRFGW

SEQ ID NO: 934437 - protein, 22 aa, Mycobacterium
RLPRSALTFCIESEFASRNDGF

SEQ ID NO: 934438 - protein, 21 aa, Mycobacterium
RLPSLPSGITLPSLPSKITLP

SEQ ID NO: 934439 - protein, 23 aa, Mycobacterium
RLPVPGASVQRFMVRSTNTAGDA

SEQ ID NO: 934440 - protein, 18 aa, Mycobacterium
RLPVPRSPATVAYVAPLS

SEQ ID NO: 934441 - protein, 24 aa, Mycobacterium
RLRAAMPNTVWTTGCDSWYLNKDG

SEQ ID NO: 934442 - protein, 24 aa, Mycobacterium
RLRAKGFSVAACDRRADELAAAVR

SEQ ID NO: 934443 - protein, 24 aa, Mycobacterium
RLRDGGTGFVCWCVCHRLGCVGPS

SEQ ID NO: 934444 - protein, 18 aa, Mycobacterium
RLREAGFQVADQATPVNS

SEQ ID NO: 934445 - protein, 22 aa, Mycobacterium
RLRRRLLLFSAVPAVLVTLLAV

SEQ ID NO: 934446 - protein, 22 aa, Mycobacterium
RLRTVLLTALLIVALGLLLTRC

SEQ ID NO: 934447 - protein, 19 aa, Mycobacterium
RLSAQLATFHDQFVQALSA

SEQ ID NO: 934448 - protein, 19 aa, Mycobacterium
RLSLTDFPPNFNILHIDGN

SEQ ID NO: 934449 - protein, 20 aa, Mycobacterium
RLSSMLRERLAIGGHQITRT

SEQ ID NO: 934450 - protein, 25 aa, Mycobacterium
RLSSRSRRRLAIALSAVAVAAGLAV

SEQ ID NO: 934451 - protein, 25 aa, Mycobacterium
RLSVLSLPTTFIFDARGHQRYRTSG

SEQ ID NO: 934452 - protein, 20 aa, Mycobacterium
RLSVLSLPTTFIFDTDGRQR

SEQ ID NO: 934453 - protein, 19 aa, Mycobacterium
RLTAALSHRSPEVAVTRAN

SEQ ID NO: 934454 - protein, 24 aa, Mycobacterium
RLTANRTSRRRFLGGGAAAAAALA

SEQ ID NO: 934455 - protein, 24 aa, Mycobacterium
RLTDPKAGPLIAVKLHILTRKSLG

SEQ ID NO: 934456 - protein, 24 aa, Mycobacterium
RLTDPKAGPLIAVKLHILTRKTLG

SEQ ID NO: 934457 - protein, 17 aa, Mycobacterium
RLTGGLWTYTTNNREGL

SEQ ID NO: 934458 - protein, 19 aa, Mycobacterium
RLTGIAVQLPTWVRDEAGN

SEQ ID NO: 934459 - protein, 17 aa, Mycobacterium
RLTHGVATGDPRPDGAL

SEQ ID NO: 934460 - protein, 20 aa, Mycobacterium
RLTLLTARAGLVLDPGAKVT

SEQ ID NO: 934461 - protein, 25 aa, Mycobacterium
RLTNWGATCGVGYQGTVTCRGYGGH

SEQ ID NO: 934462 - protein, 21 aa, Mycobacterium
RLTRMRDFYAFMLDEIPALLE

SEQ ID NO: 934463 - protein, 20 aa, Mycobacterium
RLTSALVISQWCRLPSGADP

SEQ ID NO: 934464 - protein, 23 aa, Mycobacterium
RLTVELDKAFALWGGPPLVLRMD

SEQ ID NO: 934465 - protein, 20 aa, Mycobacterium
RLTVSAGLGPSVFAKTGLAD

SEQ ID NO: 934466 - protein, 21 aa, Mycobacterium
RLVAACIDAGITVTCLPGPSA

SEQ ID NO: 934467 - protein, 20 aa, Mycobacterium
RLVAHSIRFGVLSRFTAFVA

SEQ ID NO: 934468 - protein, 26 aa, Mycobacterium
RLVFWDCYRPHAVQARMFEVVPNPAW

SEQ ID NO: 934469 - protein, 20 aa, Mycobacterium
RLVGILGFPLLRMAVRSPLP

SEQ ID NO: 934470 - protein, 17 aa, Mycobacterium
RLVINRNKIELMCRAYA

SEQ ID NO: 934471 - protein, 20 aa, Mycobacterium
RLVKAGKVDENWNAGPNKGI

SEQ ID NO: 934472 - protein, 23 aa, Mycobacterium
RLVRAGKVAKDWDADATRGIPFE

SEQ ID NO: 934473 - protein, 20 aa, Mycobacterium
RLVVCAGRGTAALARGVGLA

SEQ ID NO: 934474 - protein, 25 aa, Mycobacterium
RMAENMKAYRAARERAVVAAQASEK

SEQ ID NO: 934475 - protein, 24 aa, Mycobacterium
RMAGEGWVRPQLLEYMRTAPDFYF

SEQ ID NO: 934476 - protein, 20 aa, Mycobacterium
RMAKHLGLNTVRVFLHDLLW

SEQ ID NO: 934477 - protein, 21 aa, Mycobacterium
RMAPTVLSPRFARPALDIDRI

SEQ ID NO: 934478 - protein, 24 aa, Mycobacterium
RMATGESRGAFSMSEPELGSDVAA

SEQ ID NO: 934479 - protein, 17 aa, Mycobacterium
RMEKGYRAWGTDMTAEH

SEQ ID NO: 934480 - protein, 18 aa, Mycobacterium
RMFALCSVVMLAVTGCAF

SEQ ID NO: 934481 - protein, 31 aa, Mycobacterium
RMGHARPLYGPGLRCLIPLVDKMIRVDQRVV

SEQ ID NO: 934482 - protein, 23 aa, Mycobacterium
RMHWRTREYYPAGATVHVDADLY

SEQ ID NO: 934483 - protein, 27 aa, Mycobacterium
RMNPVLRAKVDGAWHLHQLTRGLGLSM

SEQ ID NO: 934484 - protein, 28 aa, Mycobacterium
RMTKDSKISTVWTWPDRPGVAGCAALDG

SEQ ID NO: 934485 - protein, 22 aa, Mycobacterium
RMVPLRPAPSAVVAHFGTRAPA

SEQ ID NO: 934486 - protein, 17 aa, Mycobacterium
RMYNLLCWAYGADPDAN

SEQ ID NO: 934487 - protein, 26 aa, Mycobacterium
RNAGKRASGLVFQQFQGGVITAKNDE

SEQ ID NO: 934488 - protein, 17 aa, Mycobacterium
RNALCGLYDAVQDKRSD

SEQ ID NO: 934489 - protein, 23 aa, Mycobacterium
RNASEGYGVYSLTKFGVNGFTES

SEQ ID NO: 934490 - protein, 21 aa, Mycobacterium
RNATRELIELANEKTLAELGT

SEQ ID NO: 934491 - protein, 18 aa, Mycobacterium
RNDFPPLRIRNAGASHNL

SEQ ID NO: 934492 - protein, 19 aa, Mycobacterium
RNDLVALVISNLFGQNTPA

SEQ ID NO: 934493 - protein, 23 aa, Mycobacterium
RNDRFWSVPAKPDLVLFRRGGAP

SEQ ID NO: 934494 - protein, 19 aa, Mycobacterium
RNDRLWIVRMEDVLYGEME

SEQ ID NO: 934495 - protein, 24 aa, Mycobacterium
RNEFPPLRVRTAVVAQNLPAQLTS

SEQ ID NO: 934496 - protein, 20 aa, Mycobacterium
RNEKLMGFGHRVYRAEDPRA

SEQ ID NO: 934497 - protein, 18 aa, Mycobacterium
RNEWLFTEAWGIDVAVST

SEQ ID NO: 934498 - protein, 22 aa, Mycobacterium
RNFTGELKVLVSKLAILEETLV

SEQ ID NO: 934499 - protein, 28 aa, Mycobacterium
RNGDPFSREVYGIGLARGDTAAIEAIDR

SEQ ID NO: 934500 - protein, 23 aa, Mycobacterium
RNGGLRFAARADLATREEQIAVA

SEQ ID NO: 934501 - protein, 23 aa, Mycobacterium
RNGGLRFAARADLATREEQITVA

SEQ ID NO: 934502 - protein, 25 aa, Mycobacterium
RNGGLRYAPRADLATREEQIAIATV

SEQ ID NO: 934503 - protein, 26 aa, Mycobacterium
RNGRVYTVAGPTEWAQAVAVQGNAIT

SEQ ID NO: 934504 - protein, 24 aa, Mycobacterium
RNIYQARTGMRWSTDGTHAQIFAA

SEQ ID NO: 934505 - protein, 24 aa, Mycobacterium
RNKGLRFEFYANLDTAYSDLLSGN

SEQ ID NO: 934506 - protein, 20 aa, Mycobacterium
RNKIELMCRAYADADGRWLV

SEQ ID NO: 934507 - protein, 17 aa, Mycobacterium
RNLLKSLIVVKAEVQDI

SEQ ID NO: 934508 - protein, 26 aa, Mycobacterium
RNLLVPRLQYIPGLRSRIQHSGTPAL

SEQ ID NO: 934509 - protein, 21 aa, Mycobacterium
RNLRCPYHSWTYGLDGTLIAA

SEQ ID NO: 934510 - protein, 19 aa, Mycobacterium
RNMAWLADRFNGVPTSSNC

SEQ ID NO: 934511 - protein, 23 aa, Mycobacterium
RNNFDPRYPPLVTAVRTSANIDS

SEQ ID NO: 934512 - protein, 22 aa, Mycobacterium
RNNRFFRRWLGGSIAAASPSVA

SEQ ID NO: 934513 - protein, 19 aa, Mycobacterium
RNNWGRLVFCGSPRRYEPR

SEQ ID NO: 934514 - protein, 17 aa, Mycobacterium
RNPDAIVTLANYLRSKG

SEQ ID NO: 934515 - protein, 17 aa, Mycobacterium
RNPDVIVIYDYFGTPSV

SEQ ID NO: 934516 - protein, 18 aa, Mycobacterium
RNPKWWGQRPRLDSITYL

SEQ ID NO: 934517 - protein, 22 aa, Mycobacterium
RNQFLQGRMALFQSGTYNLAQI

SEQ ID NO: 934518 - protein, 19 aa, Mycobacterium
RNQGVAVADALAALQAGDS

SEQ ID NO: 934519 - protein, 21 aa, Mycobacterium
RNRATAALLRTAAVDTSDPAV

SEQ ID NO: 934520 - protein, 20 aa, Mycobacterium
RNRRAVALCTPRDAISRDAG

SEQ ID NO: 934521 - protein, 23 aa, Mycobacterium
RNSFYKPIWESFAKAGYASLSWN

SEQ ID NO: 934522 - protein, 24 aa, Mycobacterium
RNTFFRPTTITAYFPTATAIYPGD

SEQ ID NO: 934523 - protein, 21 aa, Mycobacterium
RNTSRLLGWVLGQSGVDPLGS

SEQ ID NO: 934524 - protein, 23 aa, Mycobacterium
RNTTLWASWAFAGPKHKVFFGGD

SEQ ID NO: 934525 - protein, 17 aa, Mycobacterium
RNVHIRPGVPPLVVAAP

SEQ ID NO: 934526 - protein, 18 aa, Mycobacterium
RNVHLRAPQQTDYVEPGT

SEQ ID NO: 934527 - protein, 21 aa, Mycobacterium
RNVKGDSVSIIAVDTKPVTVF

SEQ ID NO: 934528 - protein, 20 aa, Mycobacterium
RNVSHGCINLSPTNAKWFYD

SEQ ID NO: 934529 - protein, 19 aa, Mycobacterium
RPAAIQFGNVICRALRGGT

SEQ ID NO: 934530 - protein, 18 aa, Mycobacterium
RPAEAVEVLTRFTDYTGS

SEQ ID NO: 934531 - protein, 23 aa, Mycobacterium
RPAPPHRRWSQYLSWVADHVGMN

SEQ ID NO: 934532 - protein, 20 aa, Mycobacterium
RPATKELPFGQNISAVLISP

SEQ ID NO: 934533 - protein, 19 aa, Mycobacterium
RPAVNEFFTSLFAMDAEQR

SEQ ID NO: 934534 - protein, 20 aa, Mycobacterium
RPDCGSVVLASVSSYDRSPY

SEQ ID NO: 934535 - protein, 20 aa, Mycobacterium
RPDLAFDLVRPGVAVYGLSP

SEQ ID NO: 934536 - protein, 33 aa, Mycobacterium
RPDLVTVAVPAHWSGAAIGAFRSAAPHVTVVSE

SEQ ID NO: 934537 - protein, 17 aa, Mycobacterium
RPDRAIETNVEFWAAVI

SEQ ID NO: 934538 - protein, 21 aa, Mycobacterium
RPDSIFAPFYQARIDRLNAQL

SEQ ID NO: 934539 - protein, 17 aa, Mycobacterium
RPDWTRTVLARRVAAGG

SEQ ID NO: 934540 - protein, 20 aa, Mycobacterium
RPEAAANLRSYFTAHPQEYY

SEQ ID NO: 934541 - protein, 17 aa, Mycobacterium
RPEAQWTDNAPIGADDF

SEQ ID NO: 934542 - protein, 18 aa, Mycobacterium
RPELAGAVRNHLNGLRLR

SEQ ID NO: 934543 - protein, 25 aa, Mycobacterium
RPELALRPRLAIGIHQPAINPRRSP

SEQ ID NO: 934544 - protein, 25 aa, Mycobacterium
RPELGLRPRLAIGIHQPPVAARRPP

SEQ ID NO: 934545 - protein, 19 aa, Mycobacterium
RPELVNSVGSLAQTMRRLS

SEQ ID NO: 934546 - protein, 19 aa, Mycobacterium
RPEMPALLAELGLAGRQIA

SEQ ID NO: 934547 - protein, 27 aa, Mycobacterium
RPEPTLPVPAGWPFGEEFPRTCGAARL

SEQ ID NO: 934548 - protein, 17 aa, Mycobacterium
RPETAPWHYADIAENNC

SEQ ID NO: 934549 - protein, 18 aa, Mycobacterium
RPFAMPFATELSFYPDLP

SEQ ID NO: 934550 - protein, 19 aa, Mycobacterium
RPFDACEDIPFDAVQRLGL

SEQ ID NO: 934551 - protein, 17 aa, Mycobacterium
RPFDACEDIPFDVVQRL

SEQ ID NO: 934552 - protein, 21 aa, Mycobacterium
RPFPPNAGAFIALIQHGNQAG

SEQ ID NO: 934553 - protein, 24 aa, Mycobacterium
RPGAPDMASSLWVGPLGGNAAQVM

SEQ ID NO: 934554 - protein, 21 aa, Mycobacterium
RPGAQRLTLDVGHDYGDLFAD

SEQ ID NO: 934555 - protein, 19 aa, Mycobacterium
RPGAVLGILDLRRLCSTLL

SEQ ID NO: 934556 - protein, 20 aa, Mycobacterium
RPGEAFAEFCKVSLRDFVQG

SEQ ID NO: 934557 - protein, 23 aa, Mycobacterium
RPGEVFALELARPMISLGTRGLL

SEQ ID NO: 934558 - protein, 20 aa, Mycobacterium
RPGGGLFALATPFTNQFGLN

SEQ ID NO: 934559 - protein, 18 aa, Mycobacterium
RPGKTSWNLEPWRPVVDD

SEQ ID NO: 934560 - protein, 19 aa, Mycobacterium
RPGSAPIVVAIPGVPVVAP

SEQ ID NO: 934561 - protein, 19 aa, Mycobacterium
RPGTRGRALTYGRTHLLRL

SEQ ID NO: 934562 - protein, 17 aa, Mycobacterium
RPGVLGTLSAVVATVVL

SEQ ID NO: 934563 - protein, 19 aa, Mycobacterium
RPGVLSAVAAEFAKREVSI

SEQ ID NO: 934564 - protein, 19 aa, Mycobacterium
RPHLEWQLRRRVLELDNIE

SEQ ID NO: 934565 - protein, 29 aa, Mycobacterium
RPIYRRKGIVFRQALATAIRPEGTEDQPA

SEQ ID NO: 934566 - protein, 21 aa, Mycobacterium
RPKRLLIGTLLALALIGALTA

SEQ ID NO: 934567 - protein, 19 aa, Mycobacterium
RPLIGLATVLALAAVIAVA

SEQ ID NO: 934568 - protein, 20 aa, Mycobacterium
RPLLARRRGVGNGWVPGTLL

SEQ ID NO: 934569 - protein, 24 aa, Mycobacterium
RPLLLCGAVVLAAACTRVVDGAAV

SEQ ID NO: 934570 - protein, 22 aa, Mycobacterium
RPLLYEPGTNWNYAHTNYVLLG

SEQ ID NO: 934571 - protein, 20 aa, Mycobacterium
RPLTLRVGYQAPNPRRAAIV

SEQ ID NO: 934572 - protein, 23 aa, Mycobacterium
RPNYAKLVAFTQFVPVLSDMTDE

SEQ ID NO: 934573 - protein, 21 aa, Mycobacterium
RPPELAGLWELPGGKVTPPES

SEQ ID NO: 934574 - protein, 19 aa, Mycobacterium
RPPTWSRGAPPQWWLATPI

SEQ ID NO: 934575 - protein, 17 aa, Mycobacterium
RPPYAKRNAAVDAVAAD

SEQ ID NO: 934576 - protein, 19 aa, Mycobacterium
RPQDFWPSNTVVNIDAAGT

SEQ ID NO: 934577 - protein, 24 aa, Mycobacterium
RPQELPDAVPLVVMMHGGYGNGTQ

SEQ ID NO: 934578 - protein, 19 aa, Mycobacterium
RPQVPDMQLPGPRVVQNSG

SEQ ID NO: 934579 - protein, 28 aa, Mycobacterium
RPRKHWVLKGFHGFRLAELFEAYPDASL

SEQ ID NO: 934580 - protein, 20 aa, Mycobacterium
RPRLTHGVASGFPRTDGAVI

SEQ ID NO: 934581 - protein, 19 aa, Mycobacterium
RPRRLSVSSVAELDSASLS

SEQ ID NO: 934582 - protein, 19 aa, Mycobacterium
RPSPQWWFDDHTLHGPDGL

SEQ ID NO: 934583 - protein, 18 aa, Mycobacterium
RPSQMPLINTLKSVIATQ

SEQ ID NO: 934584 - protein, 20 aa, Mycobacterium
RPTGAFMFLGPTGVGKTELA

SEQ ID NO: 934585 - protein, 20 aa, Mycobacterium
RPVIEPPLWFHDLLHGDGTP

SEQ ID NO: 934586 - protein, 34 aa, Mycobacterium
RPVPAGWYSEPWWKPALVAGAWGVGSALLFNSLF

SEQ ID NO: 934587 - protein, 25 aa, Mycobacterium
RPYPIARAELQQMLMEAYGIDEIHF

SEQ ID NO: 934588 - protein, 23 aa, Mycobacterium
RQAALPWSVEFPITEATAMGNIT

SEQ ID NO: 934589 - protein, 24 aa, Mycobacterium
RQADGVMGISVWLPNAAFSDDLFG

SEQ ID NO: 934590 - protein, 17 aa, Mycobacterium
RQALCMLGADTPVLTIQ

SEQ ID NO: 934591 - protein, 18 aa, Mycobacterium
RQALTALGVRTAMSRGDD

SEQ ID NO: 934592 - protein, 22 aa, Mycobacterium
RQAWNDLALPWFRGINSVIGVQ

SEQ ID NO: 934593 - protein, 18 aa, Mycobacterium
RQDWRKLYADAFASMDGP

SEQ ID NO: 934594 - protein, 21 aa, Mycobacterium
RQEVMFQVKVCSPRDAERAAT

SEQ ID NO: 934595 - protein, 23 aa, Mycobacterium
RQGLWSWKCFRSEVFAVLAVSRR

SEQ ID NO: 934596 - protein, 25 aa, Mycobacterium
RQGQFKDLIPRLAELTAGLNKQVND

SEQ ID NO: 934597 - protein, 17 aa, Mycobacterium
RQGWGAWPVCSGRIGAR

SEQ ID NO: 934598 - protein, 17 aa, Mycobacterium
RQHRVAAVYLMALLAED

SEQ ID NO: 934599 - protein, 32 aa, Mycobacterium
RQHWKLLGAFVVFVAVVALVFGDVRIRPYITG

SEQ ID NO: 934600 - protein, 25 aa, Mycobacterium
RQILYHRTLTGLVIAQAFPQSPVIV

SEQ ID NO: 934601 - protein, 17 aa, Mycobacterium
RQIRALNEIAGVLDTGS

SEQ ID NO: 934602 - protein, 42 aa, Mycobacterium
RQIREVAPFFAYGGFTGFAPRDVCAFWPVPATSTARPVTGPG

SEQ ID NO: 934603 - protein, 24 aa, Mycobacterium
RQKLTGPQALAFVRQRHELPRGDL

SEQ ID NO: 934604 - protein, 21 aa, Mycobacterium
RQLADLGARVIKVERPGSGDF

SEQ ID NO: 934605 - protein, 17 aa, Mycobacterium
RQLGCSTGTLQDFGPDF

SEQ ID NO: 934606 - protein, 19 aa, Mycobacterium
RQLLAAQLIWTLSRSGING

SEQ ID NO: 934607 - protein, 18 aa, Mycobacterium
RQLLDGLLLVSGNDAANT

SEQ ID NO: 934608 - protein, 19 aa, Mycobacterium
RQLLDGLLLVSGNDAANTL

SEQ ID NO: 934609 - protein, 19 aa, Mycobacterium
RQLTPDFRPGCKRMLVSSD

SEQ ID NO: 934610 - protein, 33 aa, Mycobacterium
RQLWRSVSYPGMLRLARHHWRMGASEIVGSMSK

SEQ ID NO: 934611 - protein, 24 aa, Mycobacterium
RQPLLAALGETVGEVFATLHREHG

SEQ ID NO: 934612 - protein, 25 aa, Mycobacterium
RQQEDPRWTCSHAMALQDSVLAEAR

SEQ ID NO: 934613 - protein, 23 aa, Mycobacterium
RQRANYVASVMFCRIDPEDDKTE

SEQ ID NO: 934614 - protein, 17 aa, Mycobacterium
RQRSPLPLLAFAHDDEV

SEQ ID NO: 934615 - protein, 20 aa, Mycobacterium
RQSCDACDDGTLTTVGFQWQ

SEQ ID NO: 934616 - protein, 25 aa, Mycobacterium
RQSRFGEFREGVWLRPENLEVDLPP

SEQ ID NO: 934617 - protein, 18 aa, Mycobacterium
RQSYLGGRVGGWQDTLDD

SEQ ID NO: 934618 - protein, 31 aa, Mycobacterium
RQTLERLRYLPLAPFRISYAYTNYGITAGAE

SEQ ID NO: 934619 - protein, 24 aa, Mycobacterium
RQTTEIRPTNRLTYLDAHATGQFE

SEQ ID NO: 934620 - protein, 24 aa, Mycobacterium
RQTTEIRSSNRLAYLDAHADGQYE

SEQ ID NO: 934621 - protein, 24 aa, Mycobacterium
RQTTEIRSSNRLAYLDAHATSQFE

SEQ ID NO: 934622 - protein, 24 aa, Mycobacterium
RQTTEIRSSNRLAYLDAHATSQYE

SEQ ID NO: 934623 - protein, 18 aa, Mycobacterium
RQVAVSVYRADTGPASDV

SEQ ID NO: 934624 - protein, 18 aa, Mycobacterium
RQYYNLRALLARVDPQLR

SEQ ID NO: 934625 - protein, 17 aa, Mycobacterium
RQYYNLRGILSRIDPSL

SEQ ID NO: 934626 - protein, 24 aa, Mycobacterium
RRAACGFVATFLVLTFTIGAVQAD

SEQ ID NO: 934627 - protein, 18 aa, Mycobacterium
RRAAGATAVRVHARGDGK

SEQ ID NO: 934628 - protein, 18 aa, Mycobacterium
RRAATFALEIEKFDKSHI

SEQ ID NO: 934629 - protein, 18 aa, Mycobacterium
RRAATGWESLTPAEREVV

SEQ ID NO: 934630 - protein, 17 aa, Mycobacterium
RRAAVCRELTKVHEEVV

SEQ ID NO: 934631 - protein, 20 aa, Mycobacterium
RRAAVEISPARKLREIRIAL

SEQ ID NO: 934632 - protein, 19 aa, Mycobacterium
RRAAYAAGMTVSQMLQHIT

SEQ ID NO: 934633 - protein, 22 aa, Mycobacterium
RRAEPGASWAAGGMLAPHSEGW

SEQ ID NO: 934634 - protein, 18 aa, Mycobacterium
RRAGAIALATLTIAATVP

SEQ ID NO: 934635 - protein, 19 aa, Mycobacterium
RRALQLLGLAGGAAMLAPA

SEQ ID NO: 934636 - protein, 25 aa, Mycobacterium
RRALVSGVCVAGLLGAGVVPALADP

SEQ ID NO: 934637 - protein, 22 aa, Mycobacterium
RRAPRGVLVWSDRVADDEVTTV

SEQ ID NO: 934638 - protein, 19 aa, Mycobacterium
RRARALRLSDYCLGLYGSR

SEQ ID NO: 934639 - protein, 19 aa, Mycobacterium
RRASLIPSLVHTVQTFAAH

SEQ ID NO: 934640 - protein, 20 aa, Mycobacterium
RRATGLAGLSVQWGLWEQTS

SEQ ID NO: 934641 - protein, 17 aa, Mycobacterium
RRAVLRLGVGAAAGAAG

SEQ ID NO: 934642 - protein, 25 aa, Mycobacterium
RRAVREIAGELVALYAKRQASPGHA

SEQ ID NO: 934643 - protein, 29 aa, Mycobacterium
RRCGSPAWNLPVVFGPIAIAYRVNGRPSL

SEQ ID NO: 934644 - protein, 26 aa, Mycobacterium
RRCVPKRPAMPLPWPAVAPPPYCVRR

SEQ ID NO: 934645 - protein, 18 aa, Mycobacterium
RRDGTWNTLYRKWLTVLG

SEQ ID NO: 934646 - protein, 18 aa, Mycobacterium
RRDVAGLADLAAIYADSA

SEQ ID NO: 934647 - protein, 21 aa, Mycobacterium
RREIFPARPLAGAMGVLGRRS

SEQ ID NO: 934648 - protein, 18 aa, Mycobacterium
RRELEGLVVLPATTQARL

SEQ ID NO: 934649 - protein, 18 aa, Mycobacterium
RRETELYRLLQTAQRLLG

SEQ ID NO: 934650 - protein, 19 aa, Mycobacterium
RRFAVTVTRLAVVIATIAA

SEQ ID NO: 934651 - protein, 18 aa, Mycobacterium
RRFETALRSLPERQRQHS

SEQ ID NO: 934652 - protein, 26 aa, Mycobacterium
RRFNATVPQLIQWDDHEVINNWFPHE

SEQ ID NO: 934653 - protein, 25 aa, Mycobacterium
RRGGSQMGVPYSWGGGSLQGPSKGV

SEQ ID NO: 934654 - protein, 25 aa, Mycobacterium
RRGGTQMGVPYSWGGGKPNGPSRGI

SEQ ID NO: 934655 - protein, 25 aa, Mycobacterium
RRGIPDSAFCFSISPPQSVTMDPAG

SEQ ID NO: 934656 - protein, 17 aa, Mycobacterium
RRGLFAALVAVGLPGLA

SEQ ID NO: 934657 - protein, 24 aa, Mycobacterium
RRGMAQIGVPYSWGGGNAAGPSKG

SEQ ID NO: 934658 - protein, 24 aa, Mycobacterium
RRGMSQIGVPYSWGGGNAAGPSRG

SEQ ID NO: 934659 - protein, 25 aa, Mycobacterium
RRGMSQIGVPYSWGGGNAAGPSRGI

SEQ ID NO: 934660 - protein, 19 aa, Mycobacterium
RRGPLQSAFTTLELRELGE

SEQ ID NO: 934661 - protein, 19 aa, Mycobacterium
RRGWLEALLGHFCDPTVAL

SEQ ID NO: 934662 - protein, 18 aa, Mycobacterium
RRHLRVIAADIAQPRFGV

SEQ ID NO: 934663 - protein, 20 aa, Mycobacterium
RRIAILAGTLTVTALFAVGC

SEQ ID NO: 934664 - protein, 17 aa, Mycobacterium
RRIAVVFGAGGDRDPGK

SEQ ID NO: 934665 - protein, 18 aa, Mycobacterium
RRIAVYVPKENVQMITKL

SEQ ID NO: 934666 - protein, 19 aa, Mycobacterium
RRIEEDVVRAALADHDGVL

SEQ ID NO: 934667 - protein, 19 aa, Mycobacterium
RRIGDLPCHASLDDLDEVP

SEQ ID NO: 934668 - protein, 18 aa, Mycobacterium
RRIGEGSAVFAYTTAFLQ

SEQ ID NO: 934669 - protein, 20 aa, Mycobacterium
RRIGETFFTTAYFDPNMAHM

SEQ ID NO: 934670 - protein, 18 aa, Mycobacterium
RRIGETFFTTSYALDPNM

SEQ ID NO: 934671 - protein, 19 aa, Mycobacterium
RRIGMWGISQGGWVVPEVA

SEQ ID NO: 934672 - protein, 28 aa, Mycobacterium
RRIQPGDAWAAQLLAGWTDAEVTEFATA

SEQ ID NO: 934673 - protein, 18 aa, Mycobacterium
RRIRGGIERAVWHISSAA

SEQ ID NO: 934674 - protein, 27 aa, Mycobacterium
RRISFVPGPAGFRFYHTHVVPRSDLSR

SEQ ID NO: 934675 - protein, 21 aa, Mycobacterium
RRKHYAIQAVVAFPSAHDASA

SEQ ID NO: 934676 - protein, 19 aa, Mycobacterium
RRKQAWLRELAGWEPDLVV

SEQ ID NO: 934677 - protein, 18 aa, Mycobacterium
RRKRFRLINFAWITTVVT

SEQ ID NO: 934678 - protein, 17 aa, Mycobacterium
RRKVMAVSRVASLPVSH

SEQ ID NO: 934679 - protein, 23 aa, Mycobacterium
RRLAELRKSLQMLLAGSDAETPD

SEQ ID NO: 934680 - protein, 23 aa, Mycobacterium
RRLALLLTFPRFLPVAGPVAMRS

SEQ ID NO: 934681 - protein, 18 aa, Mycobacterium
RRLALLLTFQRFLPTTGP

SEQ ID NO: 934682 - protein, 17 aa, Mycobacterium
RRLALLLTYQRFLPTTG

SEQ ID NO: 934683 - protein, 17 aa, Mycobacterium
RRLEAAVQRSVVISAGW

SEQ ID NO: 934684 - protein, 20 aa, Mycobacterium
RRLGETFFTTAYFDPNMAHM

SEQ ID NO: 934685 - protein, 20 aa, Mycobacterium
RRLGVAFPVSAQIEVFPQPG

SEQ ID NO: 934686 - protein, 19 aa, Mycobacterium
RRLHARLAHHGIRAPETAR

SEQ ID NO: 934687 - protein, 20 aa, Mycobacterium
RRLILAGGFVVAAAAAPAIT

SEQ ID NO: 934688 - protein, 18 aa, Mycobacterium
RRLLNPVVVHAWNPQPSE

SEQ ID NO: 934689 - protein, 18 aa, Mycobacterium
RRLLRGAGALTVASLAPW

SEQ ID NO: 934690 - protein, 18 aa, Mycobacterium
RRLLVGAIGAGAVAGTLV

SEQ ID NO: 934691 - protein, 18 aa, Mycobacterium
RRLLVVISDGLAYDHGYE

SEQ ID NO: 934692 - protein, 23 aa, Mycobacterium
RRLPLAVGMACAAAAVAVAPVFS

SEQ ID NO: 934693 - protein, 21 aa, Mycobacterium
RRLPMRTGTALVAKLAVVTLC

SEQ ID NO: 934694 - protein, 19 aa, Mycobacterium
RRLRRATAVTAAAVCTAAL

SEQ ID NO: 934695 - protein, 21 aa, Mycobacterium
RRLRRWSVAAAAGVVAVAGCS

SEQ ID NO: 934696 - protein, 19 aa, Mycobacterium
RRLSGEVIDFIELDMPEQT

SEQ ID NO: 934697 - protein, 20 aa, Mycobacterium
RRLTACFAVLAVCATLATTT

SEQ ID NO: 934698 - protein, 21 aa, Mycobacterium
RRMGHPRFPMYQAGYDAAVTA

SEQ ID NO: 934699 - protein, 19 aa, Mycobacterium
RRMIMMAGFGALAAAIPAP

SEQ ID NO: 934700 - protein, 27 aa, Mycobacterium
RRMQPADAWAAQLLAGWTEAEVTGFVT

SEQ ID NO: 934701 - protein, 21 aa, Mycobacterium
RRMVVEVSQWPAIGQVLPVVY

SEQ ID NO: 934702 - protein, 27 aa, Mycobacterium
RRNIVVAMTPWLHRVGLDRLLRTERRE

SEQ ID NO: 934703 - protein, 23 aa, Mycobacterium
RRNPGAVVRYIMSRLQTPSQTPT

SEQ ID NO: 934704 - protein, 18 aa, Mycobacterium
RRNRLRRATVLTAAAAMV

SEQ ID NO: 934705 - protein, 18 aa, Mycobacterium
RRNVVIDVDVCRKDVGDL

SEQ ID NO: 934706 - protein, 20 aa, Mycobacterium
RRPELADAINRTHRNDNYLD

SEQ ID NO: 934707 - protein, 18 aa, Mycobacterium
RRPGPALAGRSVDEVLAD

SEQ ID NO: 934708 - protein, 21 aa, Mycobacterium
RRPLFVRAMNSYMDRVLTAAE

SEQ ID NO: 934709 - protein, 20 aa, Mycobacterium
RRPLSRLGMGLHRRHRQAQG

SEQ ID NO: 934710 - protein, 34 aa, Mycobacterium
RRPQFTFPARGILTSGFGARWGTLHAGLDIANAV

SEQ ID NO: 934711 - protein, 18 aa, Mycobacterium
RRQFWPISSVDIGVEITR

SEQ ID NO: 934712 - protein, 24 aa, Mycobacterium
RRQQTLRASVDWSHALLTEPEQVL

SEQ ID NO: 934713 - protein, 21 aa, Mycobacterium
RRQTLLSVLGAVVFNIYSVAL

SEQ ID NO: 934714 - protein, 22 aa, Mycobacterium
RRRACQGLVLLMATLVLSSCGW

SEQ ID NO: 934715 - protein, 21 aa, Mycobacterium
RRRAGLPYGRIAKALEDRLCR

SEQ ID NO: 934716 - protein, 17 aa, Mycobacterium
RRRCPPLTGVIHAAGVL

SEQ ID NO: 934717 - protein, 27 aa, Mycobacterium
RRREAHPTMWIRLWFSDGEKLHQRAYT

SEQ ID NO: 934718 - protein, 21 aa, Mycobacterium
RRRFSTVIEFFSYTPDELVAL

SEQ ID NO: 934719 - protein, 22 aa, Mycobacterium
RRRGVGNGWVPGTLLVTGVSPR

SEQ ID NO: 934720 - protein, 20 aa, Mycobacterium
RRRHGLWTTLALAAVSSASV

SEQ ID NO: 934721 - protein, 18 aa, Mycobacterium
RRRIDVVAYNPGLTLGTN

SEQ ID NO: 934722 - protein, 21 aa, Mycobacterium
RRRMRHPAVRAADLAFATIPA

SEQ ID NO: 934723 - protein, 18 aa, Mycobacterium
RRRPAITAITAMSVAAGL

SEQ ID NO: 934724 - protein, 20 aa, Mycobacterium
RRRRDLSVLLLLDVSGSAAE

SEQ ID NO: 934725 - protein, 19 aa, Mycobacterium
RRRRRRSAALRGYGDEFMD

SEQ ID NO: 934726 - protein, 20 aa, Mycobacterium
RRRRVYAAVEEFGRVTGRTV

SEQ ID NO: 934727 - protein, 18 aa, Mycobacterium
RRRTLRHRRHPSGRRIDL

SEQ ID NO: 934728 - protein, 23 aa, Mycobacterium
RRRYRPAWCTVREVDPEIKPSAT

SEQ ID NO: 934729 - protein, 18 aa, Mycobacterium
RRSDAPRLVDLVRHAQSS

SEQ ID NO: 934730 - protein, 17 aa, Mycobacterium
RRSDAPRLVDLVRQSQS

SEQ ID NO: 934731 - protein, 45 aa, Mycobacterium
RRSPWLRANLRLRMPIRGTRPTMKHEARKALALLGGATTLGLAIA

SEQ ID NO: 934732 - protein, 18 aa, Mycobacterium
RRSQLYWAARLTLVSRAE

SEQ ID NO: 934733 - protein, 17 aa, Mycobacterium
RRSSRFASPPGLLSPSI

SEQ ID NO: 934734 - protein, 18 aa, Mycobacterium
RRTAGVRLSNWLTGQVLA

SEQ ID NO: 934735 - protein, 26 aa, Mycobacterium
RRTASAGQRLAIWARDRGCTRPGCTA

SEQ ID NO: 934736 - protein, 20 aa, Mycobacterium
RRTGPWGRLTAYAAAVAALS

SEQ ID NO: 934737 - protein, 17 aa, Mycobacterium
RRTSTDDLVTWGMECPD

SEQ ID NO: 934738 - protein, 19 aa, Mycobacterium
RRVAAALGVANVMPATVVL

SEQ ID NO: 934739 - protein, 19 aa, Mycobacterium
RRVAVGIASGFGAARIAPG

SEQ ID NO: 934740 - protein, 25 aa, Mycobacterium
RRVDGRIVVDLVRFPGSVDYQDDPR

SEQ ID NO: 934741 - protein, 22 aa, Mycobacterium
RRVGIGSTRWRLPGRTPAYPVS

SEQ ID NO: 934742 - protein, 19 aa, Mycobacterium
RRVLRSAYVALRLRGPGTL

SEQ ID NO: 934743 - protein, 18 aa, Mycobacterium
RRVPGPSSNVYAASKHAV

SEQ ID NO: 934744 - protein, 20 aa, Mycobacterium
RRVVLNLWAYWCAPCAAELP

SEQ ID NO: 934745 - protein, 21 aa, Mycobacterium
RRWAGDLAETAPVYFYEFNDR

SEQ ID NO: 934746 - protein, 25 aa, Mycobacterium
RRWDGVWDPTLPMIPSANVPGDPIA

SEQ ID NO: 934747 - protein, 17 aa, Mycobacterium
RRWPLPIRVPAYQVPLP

SEQ ID NO: 934748 - protein, 21 aa, Mycobacterium
RRYGVEELVRYGREVRRLEHD

SEQ ID NO: 934749 - protein, 30 aa, Mycobacterium
RRYILEHLRALPLDPFRNSYAYTNFGLTAA

SEQ ID NO: 934750 - protein, 18 aa, Mycobacterium
RSAAAIGIDNFIAVSADT

SEQ ID NO: 934751 - protein, 19 aa, Mycobacterium
RSAGGGDRTAIVALAEGPP

SEQ ID NO: 934752 - protein, 20 aa, Mycobacterium
RSAIAVYRVPEPIVTGTAAN

SEQ ID NO: 934753 - protein, 20 aa, Mycobacterium
RSAINCFWRPTGTLFRWMLA

SEQ ID NO: 934754 - protein, 20 aa, Mycobacterium
RSAKELYRGAPYGVGYFAGA

SEQ ID NO: 934755 - protein, 25 aa, Mycobacterium
RSAKLCVQYLAPIVKNRQFNFPPFG

SEQ ID NO: 934756 - protein, 18 aa, Mycobacterium
RSAYPRFSGANFERNLAL

SEQ ID NO: 934757 - protein, 21 aa, Mycobacterium
RSAYVALRLRGPGTLPPFFAA

SEQ ID NO: 934758 - protein, 18 aa, Mycobacterium
RSCGLPVIMTPLSGDWGV

SEQ ID NO: 934759 - protein, 24 aa, Mycobacterium
RSDGQWGGAMLVAAKSATPSLDGL

SEQ ID NO: 934760 - protein, 22 aa, Mycobacterium
RSDGQWGGAMLVIAKSTVTDVD

SEQ ID NO: 934761 - protein, 20 aa, Mycobacterium
RSDGSVVAFGNNQWGQSTVP

SEQ ID NO: 934762 - protein, 34 aa, Mycobacterium
RSDGTAVAVGDNFRGQLNIPPLPTGMTYTQVANG

SEQ ID NO: 934763 - protein, 19 aa, Mycobacterium
RSDLRCRVVVDGQTRDDRS

SEQ ID NO: 934764 - protein, 19 aa, Mycobacterium
RSDVFSVRVGNLGPGEEAT

SEQ ID NO: 934765 - protein, 27 aa, Mycobacterium
RSDWDRRLRPMLARQFELAAGRRKAKD

SEQ ID NO: 934766 - protein, 20 aa, Mycobacterium
RSEFAYGSFMRSVTLPPGAD

SEQ ID NO: 934767 - protein, 17 aa, Mycobacterium
RSEYARGPIKVSTIEPG

SEQ ID NO: 934768 - protein, 23 aa, Mycobacterium
RSFSLAETEFFTAFDRLLTTTDL

SEQ ID NO: 934769 - protein, 18 aa, Mycobacterium
RSGGIVELGLLDTAGTPQ

SEQ ID NO: 934770 - protein, 23 aa, Mycobacterium
RSGGPRFVRMTPPGFALTPGPAA

SEQ ID NO: 934771 - protein, 27 aa, Mycobacterium
RSGGPVLGICGGFQMLATTIDDRVESG

SEQ ID NO: 934772 - protein, 31 aa, Mycobacterium
RSGITLRLVPIAGDSWGAFRAYLADKSNLDQ

SEQ ID NO: 934773 - protein, 20 aa, Mycobacterium
RSGLLLAMSALLVAGCSKVV

SEQ ID NO: 934774 - protein, 18 aa, Mycobacterium
RSGQLSWWAGPWPVDERW

SEQ ID NO: 934775 - protein, 25 aa, Mycobacterium
RSGVHAFAGSDAWFLIRAVTEPDSA

SEQ ID NO: 934776 - protein, 23 aa, Mycobacterium
RSHAVSAQWWLRENAKPLAVAAG

SEQ ID NO: 934777 - protein, 20 aa, Mycobacterium
RSIGVPGIVAMLAQVHAEHG

SEQ ID NO: 934778 - protein, 18 aa, Mycobacterium
RSITIFAAASLKTAFTQI

SEQ ID NO: 934779 - protein, 18 aa, Mycobacterium
RSKVKAVLAVALVGLVVV

SEQ ID NO: 934780 - protein, 19 aa, Mycobacterium
RSLAHWALLDPAARTHYVD

SEQ ID NO: 934781 - protein, 24 aa, Mycobacterium
RSLAYDRAWWFARFVADTYGAAKL

SEQ ID NO: 934782 - protein, 18 aa, Mycobacterium
RSLGPLGLAGRQRSQPVP

SEQ ID NO: 934783 - protein, 18 aa, Mycobacterium
RSLLAGVDVALWVTTDEV

SEQ ID NO: 934784 - protein, 24 aa, Mycobacterium
RSLQAGTDIALWVSTEEVPAVLDR

SEQ ID NO: 934785 - protein, 25 aa, Mycobacterium
RSLSGADARTVWRYLVTDTGVRFAI

SEQ ID NO: 934786 - protein, 20 aa, Mycobacterium
RSLSVMRIRRSIRYALAALC

SEQ ID NO: 934787 - protein, 18 aa, Mycobacterium
RSLTPALDAGRELARALG

SEQ ID NO: 934788 - protein, 19 aa, Mycobacterium
RSMAWVTDRFNGVTTSPNC

SEQ ID NO: 934789 - protein, 19 aa, Mycobacterium
RSMGPRRLAGRDGEVIELE

SEQ ID NO: 934790 - protein, 23 aa, Mycobacterium
RSMMSAVAPYVTWLSAAAAQTET

SEQ ID NO: 934791 - protein, 21 aa, Mycobacterium
RSNLARFGIAPTYPLDFAADV

SEQ ID NO: 934792 - protein, 20 aa, Mycobacterium
RSPAQLRWLGAAQLLATVRA

SEQ ID NO: 934793 - protein, 26 aa, Mycobacterium
RSPAVLRRLNKWAAHRLTDEQRADRH

SEQ ID NO: 934794 - protein, 23 aa, Mycobacterium
RSPKARAGFYGHGFTVSVSSAGR

SEQ ID NO: 934795 - protein, 18 aa, Mycobacterium
RSPLLRALVAALLVVIGA

SEQ ID NO: 934796 - protein, 18 aa, Mycobacterium
RSQESWHWVDSHEDAAAT

SEQ ID NO: 934797 - protein, 19 aa, Mycobacterium
RSQQPWSPEPLAGNYNQCA

SEQ ID NO: 934798 - protein, 20 aa, Mycobacterium
RSREIEVLEFVPAEEVDPML

SEQ ID NO: 934799 - protein, 22 aa, Mycobacterium
RSRPLISNMIRLLRLPIAVQRR

SEQ ID NO: 934800 - protein, 17 aa, Mycobacterium
RSRTPALDAGRELAEAL

SEQ ID NO: 934801 - protein, 17 aa, Mycobacterium
RSRTPALDAGRELAKAL

SEQ ID NO: 934802 - protein, 18 aa, Mycobacterium
RSRVPSVAQFDVHTRPAE

SEQ ID NO: 934803 - protein, 19 aa, Mycobacterium
RSSDRAVWQEAFYSAPAGM

SEQ ID NO: 934804 - protein, 19 aa, Mycobacterium
RSSFYSDWYGSANGQTYKW

SEQ ID NO: 934805 - protein, 21 aa, Mycobacterium
RSSGIPGMAVAVVHGGKTVYA

SEQ ID NO: 934806 - protein, 19 aa, Mycobacterium
RSSGYPIDIRGAAVEAVDR

SEQ ID NO: 934807 - protein, 18 aa, Mycobacterium
RSSLRVFPTPSGRLAAGR

SEQ ID NO: 934808 - protein, 19 aa, Mycobacterium
RSTWDVPALALIGIGNGAQ

SEQ ID NO: 934809 - protein, 24 aa, Mycobacterium
RSVISTLSGMYWWGPASAAMLAAT

SEQ ID NO: 934810 - protein, 18 aa, Mycobacterium
RSVLPIVMGPLVVSVQPA

SEQ ID NO: 934811 - protein, 31 aa, Mycobacterium
RSVTPAGVYLLPFPMCHIAGYNMLVQHAVGA

SEQ ID NO: 934812 - protein, 17 aa, Mycobacterium
RSVVFEMYENVGGAHPQ

SEQ ID NO: 934813 - protein, 21 aa, Mycobacterium
RSVVISSGWDVMDFVQQMQKL

SEQ ID NO: 934814 - protein, 28 aa, Mycobacterium
RTAANLNWDPSVAILGFPFITQARRHHF

SEQ ID NO: 934815 - protein, 17 aa, Mycobacterium
RTACLTGVATVKMSEEV

SEQ ID NO: 934816 - protein, 25 aa, Mycobacterium
RTADGVNYRVLWQASGPNTISGATI

SEQ ID NO: 934817 - protein, 37 aa, Mycobacterium
RTAERVFGRDAFTWSAAGVGYRGEFGLAALSLILGGN

SEQ ID NO: 934818 - protein, 23 aa, Mycobacterium
RTAETRYGRSFGIVDGYGGHGIG

SEQ ID NO: 934819 - protein, 18 aa, Mycobacterium
RTAFEYRAVVLGEDRQQL

SEQ ID NO: 934820 - protein, 25 aa, Mycobacterium
RTAIRRTNPATGFAATLVADDTPNV

SEQ ID NO: 934821 - protein, 19 aa, Mycobacterium
RTANGVVCDEYLRAVEASN

SEQ ID NO: 934822 - protein, 26 aa, Mycobacterium
RTAPATARDVRLIWSGDVAGQGFGIN

SEQ ID NO: 934823 - protein, 18 aa, Mycobacterium
RTAPDFYFDEMSQIKMDR

SEQ ID NO: 934824 - protein, 23 aa, Mycobacterium
RTAPGCAPVTYGTGQSVFIPAGV

SEQ ID NO: 934825 - protein, 18 aa, Mycobacterium
RTATYPVFLNRPADDPVD

SEQ ID NO: 934826 - protein, 28 aa, Mycobacterium
RTDGGKYGCYWARLRSFDTNDIIDNNVG

SEQ ID NO: 934827 - protein, 24 aa, Mycobacterium
RTDLIATMGMLRRKAQALPPTLYP

SEQ ID NO: 934828 - protein, 34 aa, Mycobacterium
RTDPMLAPRYPAISGQTLFGFGWDIDTPYSAPRG

SEQ ID NO: 934829 - protein, 17 aa, Mycobacterium
RTDPSFDVTTLLNGYEP

SEQ ID NO: 934830 - protein, 24 aa, Mycobacterium
RTDRWSRRRVTLVGDAGYCPGPAV

SEQ ID NO: 934831 - protein, 25 aa, Mycobacterium
RTDYTFPPECKYTIHAGLASEYADS

SEQ ID NO: 934832 - protein, 24 aa, Mycobacterium
RTEMCVAALLGKLGAEAPWSAIAR

SEQ ID NO: 934833 - protein, 25 aa, Mycobacterium
RTEQPRLGPGESWEVNLVMEDPQQA

SEQ ID NO: 934834 - protein, 24 aa, Mycobacterium
RTFLSNTWHPLRVNLRRPKPSAPA

SEQ ID NO: 934835 - protein, 17 aa, Mycobacterium
RTFVAVTAFGGVRRAAQ

SEQ ID NO: 934836 - protein, 17 aa, Mycobacterium
RTGARSGLSVHGQARLL

SEQ ID NO: 934837 - protein, 26 aa, Mycobacterium
RTGEALNLRRGCITRDPQLGLTFMSG

SEQ ID NO: 934838 - protein, 18 aa, Mycobacterium
RTGERVCAVVVPATADGV

SEQ ID NO: 934839 - protein, 21 aa, Mycobacterium
RTGETRSAGSLTCAGEPAAVT

SEQ ID NO: 934840 - protein, 19 aa, Mycobacterium
RTGGPLSGIAGVFGSRAID

SEQ ID NO: 934841 - protein, 20 aa, Mycobacterium
RTGIVKALYRGLGEPAAQLI

SEQ ID NO: 934842 - protein, 26 aa, Mycobacterium
RTGIYGHAQACGWAIRDGVIGNSSSP

SEQ ID NO: 934843 - protein, 26 aa, Mycobacterium
RTGIYGHARACGWAIGDDVIGHSTTA

SEQ ID NO: 934844 - protein, 19 aa, Mycobacterium
RTGPYVPMVMGYYTRQDIP

SEQ ID NO: 934845 - protein, 22 aa, Mycobacterium
RTGRSGLSVRGYCRLLAEEDRR

SEQ ID NO: 934846 - protein, 18 aa, Mycobacterium
RTHLLRLVAIKRLQGKGL

SEQ ID NO: 934847 - protein, 18 aa, Mycobacterium
RTHLLRLVAIKRLQGQGL

SEQ ID NO: 934848 - protein, 17 aa, Mycobacterium
RTIAPGGSISIGFQAEL

SEQ ID NO: 934849 - protein, 18 aa, Mycobacterium
RTIPKAWAIPPRADGVYS

SEQ ID NO: 934850 - protein, 20 aa, Mycobacterium
RTIRDRIIPFFKDGGPKYTV

SEQ ID NO: 934851 - protein, 22 aa, Mycobacterium
RTKPWAVTCLGAHAHLEIGPIS

SEQ ID NO: 934852 - protein, 20 aa, Mycobacterium
RTKTPVAFDRVLDMLDKVSK

SEQ ID NO: 934853 - protein, 22 aa, Mycobacterium
RTKTPVEFSRVLSVLDKVTKSL

SEQ ID NO: 934854 - protein, 17 aa, Mycobacterium
RTLAAYLDRAGKPARDT

SEQ ID NO: 934855 - protein, 22 aa, Mycobacterium
RTLDVMSLDVVWTAEFAEAGWA

SEQ ID NO: 934856 - protein, 17 aa, Mycobacterium
RTLFPKAASSWYLGANI

SEQ ID NO: 934857 - protein, 21 aa, Mycobacterium
RTLRGRPALDIAGNGRYARQL

SEQ ID NO: 934858 - protein, 19 aa, Mycobacterium
RTLTGFAYHGPDGQVVADH

SEQ ID NO: 934859 - protein, 24 aa, Mycobacterium
RTMSYLREIWHAMQTQDVSFNEAL

SEQ ID NO: 934860 - protein, 25 aa, Mycobacterium
RTNLARYGIAPTYPRDFVSDVRNNR

SEQ ID NO: 934861 - protein, 22 aa, Mycobacterium
RTNPGIPPRGTVAVCDFGGTGT

SEQ ID NO: 934862 - protein, 17 aa, Mycobacterium
RTQLLADFPNIKVAVAA

SEQ ID NO: 934863 - protein, 17 aa, Mycobacterium
RTQLLCEAVDYAGAHVA

SEQ ID NO: 934864 - protein, 17 aa, Mycobacterium
RTQRAPFFVPLGVGAHL

SEQ ID NO: 934865 - protein, 22 aa, Mycobacterium
RTRGRLSSVGWNKVGLLTSTGA

SEQ ID NO: 934866 - protein, 18 aa, Mycobacterium
RTRLKEAGFQVADQSNFV

SEQ ID NO: 934867 - protein, 22 aa, Mycobacterium
RTRQFLAAQVIWTLSRAGIAGP

SEQ ID NO: 934868 - protein, 24 aa, Mycobacterium
RTSSFPYAVTWMWCQVSQGCFDTS

SEQ ID NO: 934869 - protein, 27 aa, Mycobacterium
RTSTLLRLGIPFGLPAGMPATALAALT

SEQ ID NO: 934870 - protein, 20 aa, Mycobacterium
RTTGAIGHFILTVATPGDNL

SEQ ID NO: 934871 - protein, 18 aa, Mycobacterium
RTTIANIAAGPARAGGTT

SEQ ID NO: 934872 - protein, 19 aa, Mycobacterium
RTTNGIGIRHGGATTDWWA

SEQ ID NO: 934873 - protein, 17 aa, Mycobacterium
RTTVLLDEIITAIASDD

SEQ ID NO: 934874 - protein, 18 aa, Mycobacterium
RTTVLLDEIVTLVGNDAR

SEQ ID NO: 934875 - protein, 20 aa, Mycobacterium
RTTWDVPALALFGVGNGAQV

SEQ ID NO: 934876 - protein, 21 aa, Mycobacterium
RTVDMAVRLGLRSYALPGTAR

SEQ ID NO: 934877 - protein, 23 aa, Mycobacterium
RTVSGQLTLLVPFIDRIRARVDL

SEQ ID NO: 934878 - protein, 23 aa, Mycobacterium
RTVSGQLTLLVPFIDRVRARVDL

SEQ ID NO: 934879 - protein, 17 aa, Mycobacterium
RTYAQLFVLIGAANDVR

SEQ ID NO: 934880 - protein, 18 aa, Mycobacterium
RTYVQLFVVIAMANDVRC

SEQ ID NO: 934881 - protein, 17 aa, Mycobacterium
RTYWFAGERSLEAQRAP

SEQ ID NO: 934882 - protein, 26 aa, Mycobacterium
RVADPRLPVGDVRIGGFGGVDGLAAT

SEQ ID NO: 934883 - protein, 21 aa, Mycobacterium
RVAEVKSGFAPSYTVNTVGPA

SEQ ID NO: 934884 - protein, 18 aa, Mycobacterium
RVAGHMSYRELVDQVKAD

SEQ ID NO: 934885 - protein, 19 aa, Mycobacterium
RVALFDGGQYLLAKLDPAT

SEQ ID NO: 934886 - protein, 18 aa, Mycobacterium
RVALSPYPTTIVIGEYDG

SEQ ID NO: 934887 - protein, 18 aa, Mycobacterium
RVAPRDGERVVVKNYPNS

SEQ ID NO: 934888 - protein, 20 aa, Mycobacterium
RVASAAAFTGGLVLAGCATA

SEQ ID NO: 934889 - protein, 18 aa, Mycobacterium
RVASEISTSVAPIVSIEA

SEQ ID NO: 934890 - protein, 20 aa, Mycobacterium
RVATLSVVWSNYGAAGAIEK

SEQ ID NO: 934891 - protein, 25 aa, Mycobacterium
RVATSFPSFSRRTFNLLITNAPGAQ

SEQ ID NO: 934892 - protein, 18 aa, Mycobacterium
RVAVAAMNRKAAAVGARN

SEQ ID NO: 934893 - protein, 22 aa, Mycobacterium
RVCVARGTTSLRRIREIAPPPV

SEQ ID NO: 934894 - protein, 21 aa, Mycobacterium
RVDAVIYFKVIDPVRAVVDVQ

SEQ ID NO: 934895 - protein, 22 aa, Mycobacterium
RVDCGNFDRFYFATKQFVYQLK

SEQ ID NO: 934896 - protein, 25 aa, Mycobacterium
RVDDTLECLARLAINDNNHAYAVRL

SEQ ID NO: 934897 - protein, 18 aa, Mycobacterium
RVDFDVDRSIPLYQSTTA

SEQ ID NO: 934898 - protein, 22 aa, Mycobacterium
RVDGAHLPWSLEIKSTSASLTG

SEQ ID NO: 934899 - protein, 18 aa, Mycobacterium
RVDPCGFASALKEYGDPG

SEQ ID NO: 934900 - protein, 21 aa, Mycobacterium
RVDPQAAGIVLMLGDQPGVNP

SEQ ID NO: 934901 - protein, 30 aa, Mycobacterium
RVEPGARADRDFVLRFRLDRGALSSSALLV

SEQ ID NO: 934902 - protein, 24 aa, Mycobacterium
RVFAGGMAAGFVGVVLVAGGKASA

SEQ ID NO: 934903 - protein, 21 aa, Mycobacterium
RVGALALALGIGTAVATPAWA

SEQ ID NO: 934904 - protein, 21 aa, Mycobacterium
RVGALAVALGIGSAVAAMPGQ

SEQ ID NO: 934905 - protein, 26 aa, Mycobacterium
RVGALAVTLGVGWAIASSAGTAYADT

SEQ ID NO: 934906 - protein, 19 aa, Mycobacterium
RVGGDLLFQSPRPRRGRRD

SEQ ID NO: 934907 - protein, 26 aa, Mycobacterium
RVGYQAPNPRRAAIVSAMAQACEPAG

SEQ ID NO: 934908 - protein, 23 aa, Mycobacterium
RVHWRPREYYPAGTTVSVDAKLY

SEQ ID NO: 934909 - protein, 19 aa, Mycobacterium
RVIINAGIGKGARLGSGKL

SEQ ID NO: 934910 - protein, 29 aa, Mycobacterium
RVKWMLRARPADYLLAMSVAGASLPVVGK

SEQ ID NO: 934911 - protein, 22 aa, Mycobacterium
RVLEPYSYKGCRYLNDAEYGIT

SEQ ID NO: 934912 - protein, 28 aa, Mycobacterium
RVLLNLWAYWCAECTAELPALAEYQRRV

SEQ ID NO: 934913 - protein, 20 aa, Mycobacterium
RVLPELAQCGLGIGALTGTY

SEQ ID NO: 934914 - protein, 26 aa, Mycobacterium
RVLPQWRYCADGTPIEGLQIYKFYPV

SEQ ID NO: 934915 - protein, 27 aa, Mycobacterium
RVLQDLSECKRQFRAHGLPEPSYFAYP

SEQ ID NO: 934916 - protein, 23 aa, Mycobacterium
RVLSALLAAFVMPVSMAAAMTIN

SEQ ID NO: 934917 - protein, 27 aa, Mycobacterium
RVLTRATAKLGTWMPGLVNGVVARAER

SEQ ID NO: 934918 - protein, 21 aa, Mycobacterium
RVLVACAGAALIAMTAACGDG

SEQ ID NO: 934919 - protein, 20 aa, Mycobacterium
RVLVIGAGFGGLAAAHELSR

SEQ ID NO: 934920 - protein, 18 aa, Mycobacterium
RVLVPRGNAVLVGHSMGG

SEQ ID NO: 934921 - protein, 17 aa, Mycobacterium
RVMAVNLRGPFICTQAL

SEQ ID NO: 934922 - protein, 18 aa, Mycobacterium
RVMRELYGQAIAYWRTYA

SEQ ID NO: 934923 - protein, 17 aa, Mycobacterium
RVNDPRNEWLFTDAWGV

SEQ ID NO: 934924 - protein, 23 aa, Mycobacterium
RVNGFEVGMRLGIGSRETYIPAL

SEQ ID NO: 934925 - protein, 19 aa, Mycobacterium
RVPYLVVALLFGAASLILP

SEQ ID NO: 934926 - protein, 20 aa, Mycobacterium
RVQRPLWASTGVKNPDYSDT

SEQ ID NO: 934927 - protein, 19 aa, Mycobacterium
RVRDVFVGRVRKIELINWV

SEQ ID NO: 934928 - protein, 22 aa, Mycobacterium
RVREVATLIPGAMRGLVSERQL

SEQ ID NO: 934929 - protein, 18 aa, Mycobacterium
RVRLLERLVSGKVGNAAL

SEQ ID NO: 934930 - protein, 17 aa, Mycobacterium
RVRLRFINNSMMFHPMH

SEQ ID NO: 934931 - protein, 17 aa, Mycobacterium
RVRVADVYVGRVRAIEL

SEQ ID NO: 934932 - protein, 17 aa, Mycobacterium
RVRVGVVGPGTVDTEIF

SEQ ID NO: 934933 - protein, 26 aa, Mycobacterium
RVRVSGFAGWLAWGFIHIAFLTGMRN

SEQ ID NO: 934934 - protein, 17 aa, Mycobacterium
RVSRLSGLIGPQPSARV

SEQ ID NO: 934935 - protein, 18 aa, Mycobacterium
RVTAELADLVVVTDDNPR

SEQ ID NO: 934936 - protein, 17 aa, Mycobacterium
RVTARSALLPAVSISAE

SEQ ID NO: 934937 - protein, 22 aa, Mycobacterium
RVTELKSSFGPDFKVSEIPPRA

SEQ ID NO: 934938 - protein, 18 aa, Mycobacterium
RVTRAGVFNASRTELMSA

SEQ ID NO: 934939 - protein, 26 aa, Mycobacterium
RVTVSDARSGFHIHGAAGLLNLFTFG

SEQ ID NO: 934940 - protein, 29 aa, Mycobacterium
RVVALEPYGGAWLNSWLDRDLGLSGRLSV

SEQ ID NO: 934941 - protein, 21 aa, Mycobacterium
RVVGIPALIPVLVLSPGRVPR

SEQ ID NO: 934942 - protein, 25 aa, Mycobacterium
RVVLLRTGLVLARSGGLIGRLKPLF

SEQ ID NO: 934943 - protein, 22 aa, Mycobacterium
RVVRKAVALAVAGLVAASLSGC

SEQ ID NO: 934944 - protein, 17 aa, Mycobacterium
RVVSLFDRVEALRVGSL

SEQ ID NO: 934945 - protein, 18 aa, Mycobacterium
RVWLLTVLAVIGLAGCGW

SEQ ID NO: 934946 - protein, 33 aa, Mycobacterium
RVWSYDGQLRMARDEGRWRVRWTTTALHAKLGE

SEQ ID NO: 934947 - protein, 19 aa, Mycobacterium
RWAIKGTATGVDMSNPQQP

SEQ ID NO: 934948 - protein, 28 aa, Mycobacterium
RWAWQTRAWSGHRIYPAAVLYQRVVSTK

SEQ ID NO: 934949 - protein, 19 aa, Mycobacterium
RWDDPFRALDMLASLWSST

SEQ ID NO: 934950 - protein, 17 aa, Mycobacterium
RWEASGGVDGRVSIEVD

SEQ ID NO: 934951 - protein, 25 aa, Mycobacterium
RWECHLTELELQWGRTIGQFPSPCT

SEQ ID NO: 934952 - protein, 18 aa, Mycobacterium
RWFVGRPDLIGADGVHPN

SEQ ID NO: 934953 - protein, 26 aa, Mycobacterium
RWGTPEEMAELFAFCASDRAGYLTGT

SEQ ID NO: 934954 - protein, 19 aa, Mycobacterium
RWIALGSCCDGPHRRATYP

SEQ ID NO: 934955 - protein, 21 aa, Mycobacterium
RWLIEGVADFVARPAFRAPVD

SEQ ID NO: 934956 - protein, 21 aa, Mycobacterium
RWLSITLAFVFVAELVAAAAL

SEQ ID NO: 934957 - protein, 18 aa, Mycobacterium
RWLVCLAALTAAIFASGV

SEQ ID NO: 934958 - protein, 20 aa, Mycobacterium
RWPDAEAALAKRPHPDALRD

SEQ ID NO: 934959 - protein, 25 aa, Mycobacterium
RWQGWAAGASGGWGKPPTPLWPDAV

SEQ ID NO: 934960 - protein, 25 aa, Mycobacterium
RWQGWAVGPGGGWNKPPTPLWPDQV

SEQ ID NO: 934961 - protein, 19 aa, Mycobacterium
RWRAAAGLPTELSVHCLRH

SEQ ID NO: 934962 - protein, 18 aa, Mycobacterium
RWRTALHVAVSALIVVVL

SEQ ID NO: 934963 - protein, 18 aa, Mycobacterium
RWTPDTKIGDSAIIRQLS

SEQ ID NO: 934964 - protein, 25 aa, Mycobacterium
RWVKAKRATFKYGLGTEFIEVLKTL

SEQ ID NO: 934965 - protein, 18 aa, Mycobacterium
RWVLLPAGAACAAVVTGL

SEQ ID NO: 934966 - protein, 26 aa, Mycobacterium
RWVRADEIPSLPWVPADRAWLPDLVG

SEQ ID NO: 934967 - protein, 21 aa, Mycobacterium
RWWRRKSARISFVVIGTALII

SEQ ID NO: 934968 - protein, 17 aa, Mycobacterium
RYAEAKGTLYFGVPTVW

SEQ ID NO: 934969 - protein, 17 aa, Mycobacterium
RYAEAYRSIPQLSNKDA

SEQ ID NO: 934970 - protein, 18 aa, Mycobacterium
RYAGQGVLWVSINEPLAF

SEQ ID NO: 934971 - protein, 18 aa, Mycobacterium
RYALAALCAVTLVSSGCA

SEQ ID NO: 934972 - protein, 21 aa, Mycobacterium
RYARRFSRVHAGVHSVSSPLG

SEQ ID NO: 934973 - protein, 23 aa, Mycobacterium
RYDVPADAAAAILSPALVTARAI

SEQ ID NO: 934974 - protein, 19 aa, Mycobacterium
RYESLKGDGARVQRPLWAS

SEQ ID NO: 934975 - protein, 17 aa, Mycobacterium
RYFEAWVNQTVSMLSQY

SEQ ID NO: 934976 - protein, 21 aa, Mycobacterium
RYFGIPVNAHLPGVGRNLQDH

SEQ ID NO: 934977 - protein, 20 aa, Mycobacterium
RYGCPALQTTEVWEPTIPAN

SEQ ID NO: 934978 - protein, 17 aa, Mycobacterium
RYGIGLKKDDTELRNKI

SEQ ID NO: 934979 - protein, 17 aa, Mycobacterium
RYGLPYDGDIHILFYNA

SEQ ID NO: 934980 - protein, 17 aa, Mycobacterium
RYGVSPAALAAVATVGG

SEQ ID NO: 934981 - protein, 34 aa, Mycobacterium
RYKNKTAIIDDWHTAMAMVLLRNGITDVNTSSQT

SEQ ID NO: 934982 - protein, 17 aa, Mycobacterium
RYLGLSLGKTGDTNVLA

SEQ ID NO: 934983 - protein, 21 aa, Mycobacterium
RYLGTWFEVGSVKQFFSIGLV

SEQ ID NO: 934984 - protein, 19 aa, Mycobacterium
RYLMIPTDTLPLLYELSQT

SEQ ID NO: 934985 - protein, 19 aa, Mycobacterium
RYLRRLRSASAAAHMTDGA

SEQ ID NO: 934986 - protein, 21 aa, Mycobacterium
RYPGEVFVMELARPLVALGTR

SEQ ID NO: 934987 - protein, 19 aa, Mycobacterium
RYPGLPIYIVENGMVTDNG

SEQ ID NO: 934988 - protein, 22 aa, Mycobacterium
RYRAELPTHSFVFIGTETASAT

SEQ ID NO: 934989 - protein, 19 aa, Mycobacterium
RYRTVQVGPRHTARVLLAK

SEQ ID NO: 934990 - protein, 21 aa, Mycobacterium
RYVDTPSPFCAEWNAMVADYA

SEQ ID NO: 934991 - protein, 22 aa, Mycobacterium
RYWGPPAKPALILFRRAGAPAA

SEQ ID NO: 934992 - protein, 23 aa, Mycobacterium
RYWGPPAKPGLILFRRAGAPAAL

SEQ ID NO: 934993 - protein, 17 aa, Mycobacterium
SAAAAWAARAGRDVVVV

SEQ ID NO: 934994 - protein, 17 aa, Mycobacterium
SAAAAWAARSGREVVLV

SEQ ID NO: 934995 - protein, 23 aa, Mycobacterium
SAACALATVTACDRDAAEAPPRS

SEQ ID NO: 934996 - protein, 21 aa, Mycobacterium
SAADPAAVWAEHFPPTDEQMA

SEQ ID NO: 934997 - protein, 22 aa, Mycobacterium
SAADQPAHWRAMDVIPLGTGGQ

SEQ ID NO: 934998 - protein, 18 aa, Mycobacterium
SAAFLDPRVHALYITNYP

SEQ ID NO: 934999 - protein, 21 aa, Mycobacterium
SAAHYCPKYVTGEGRGPKPDG

SEQ ID NO: 935000 - protein, 19 aa, Mycobacterium
SAAIAKLFGTYGQQLQAAL

SEQ ID NO: 935001 - protein, 18 aa, Mycobacterium
SAAIATLLSGQGRQYQAI

SEQ ID NO: 935002 - protein, 20 aa, Mycobacterium
SAALGDTVGKVFADLHRDHG

SEQ ID NO: 935003 - protein, 22 aa, Mycobacterium
SAALLAGAGCARFDSAQSQPFT

SEQ ID NO: 935004 - protein, 18 aa, Mycobacterium
SAALLAVALQVLIRDGYD

SEQ ID NO: 935005 - protein, 18 aa, Mycobacterium
SAAMAMASAAAPYAGWLA

SEQ ID NO: 935006 - protein, 26 aa, Mycobacterium
SAAMGRDIPVAFLAGGPHAVYLLDAF

SEQ ID NO: 935007 - protein, 27 aa, Mycobacterium
SAAMGRDIPVAFLAGGPHAVYLLDAFN

SEQ ID NO: 935008 - protein, 23 aa, Mycobacterium
SAAPAGPGCAAYVQQVPEGPGSV

SEQ ID NO: 935009 - protein, 22 aa, Mycobacterium
SAAPCPDVEVVFARGSGEPPGI

SEQ ID NO: 935010 - protein, 24 aa, Mycobacterium
SAAQSFSAITVGLVGEAWQGAAAT

SEQ ID NO: 935011 - protein, 27 aa, Mycobacterium
SAARGGVRTEWRIARPPGVTGPIRPII

SEQ ID NO: 935012 - protein, 18 aa, Mycobacterium
SAARRAGDRAGRQARLGK

SEQ ID NO: 935013 - protein, 18 aa, Mycobacterium
SAARRAGDRAGRQARLGQ

SEQ ID NO: 935014 - protein, 22 aa, Mycobacterium
SAARRAGDRAGRRARLGPMQEL

SEQ ID NO: 935015 - protein, 22 aa, Mycobacterium
SAARRAGDRAGRRARLGSSPEL

SEQ ID NO: 935016 - protein, 17 aa, Mycobacterium
SAARTALAYARQKDEMY

SEQ ID NO: 935017 - protein, 25 aa, Mycobacterium
SAASDAAWAFISWITSPEIDAERVA

SEQ ID NO: 935018 - protein, 24 aa, Mycobacterium
SAATRAGALGMLAAGYKTVEAVEA

SEQ ID NO: 935019 - protein, 18 aa, Mycobacterium
SAATRAGGLGMLAAGYKT

SEQ ID NO: 935020 - protein, 24 aa, Mycobacterium
SAAVGVEGKVVWTGVRGIADLATG

SEQ ID NO: 935021 - protein, 18 aa, Mycobacterium
SAAWLIVDVRDLAALHAA

SEQ ID NO: 935022 - protein, 18 aa, Mycobacterium
SADDLLVLLAVGRTGKYT

SEQ ID NO: 935023 - protein, 24 aa, Mycobacterium
SADQRIRQAAPFLSYGQFTGDAPR

SEQ ID NO: 935024 - protein, 23 aa, Mycobacterium
SAELCAQYLTPVLDAIKFNGPPA

SEQ ID NO: 935025 - protein, 24 aa, Mycobacterium
SAELIRLTSDFGIREQTLRVALTR

SEQ ID NO: 935026 - protein, 18 aa, Mycobacterium
SAELRWVLEDQVADLPLH

SEQ ID NO: 935027 - protein, 18 aa, Mycobacterium
SAELVGVLDIDARAAESF

SEQ ID NO: 935028 - protein, 19 aa, Mycobacterium
SAEPCSDIEVVFARGTSEP

SEQ ID NO: 935029 - protein, 18 aa, Mycobacterium
SAEVRFGAPSAFATRPAG

SEQ ID NO: 935030 - protein, 31 aa, Mycobacterium
SAEVTIPQVPGMPIPLPQTVNIPGDLASLAP

SEQ ID NO: 935031 - protein, 19 aa, Mycobacterium
SAEYLRLLRRHNVAATISG

SEQ ID NO: 935032 - protein, 19 aa, Mycobacterium
SAEYLRLLRRHNVAATLSG

SEQ ID NO: 935033 - protein, 30 aa, Mycobacterium
SAFATRPAGLPGLRQKYGLDIRPGNFVAID

SEQ ID NO: 935034 - protein, 24 aa, Mycobacterium
SAFNVRGARNIPCATVPGKRAPSA

SEQ ID NO: 935035 - protein, 18 aa, Mycobacterium
SAFTAFYRWDVYYNSTAG

SEQ ID NO: 935036 - protein, 25 aa, Mycobacterium
SAFYPLPRAAFRDMSAFGQHPIGNG

SEQ ID NO: 935037 - protein, 38 aa, Mycobacterium
SAGADVMGALNAPTMAWLGRPLIGDGANGVDGTGGNGG

SEQ ID NO: 935038 - protein, 26 aa, Mycobacterium
SAGAFSRPGLPVEYLDVFSPSMNRDI

SEQ ID NO: 935039 - protein, 19 aa, Mycobacterium
SAGCATNGLASLPLPAPGL

SEQ ID NO: 935040 - protein, 17 aa, Mycobacterium
SAGCSTGGLADLPLPAP

SEQ ID NO: 935041 - protein, 19 aa, Mycobacterium
SAGEAFGRAAEPWEVAATI

SEQ ID NO: 935042 - protein, 19 aa, Mycobacterium
SAGEAFGRAAEPWEVAATV

SEQ ID NO: 935043 - protein, 35 aa, Mycobacterium
SAGEELRVPLPVGSLLRDRFLTLLATGGGELDWSA

SEQ ID NO: 935044 - protein, 21 aa, Mycobacterium
SAGIRPGDSLVFAIKILSASG

SEQ ID NO: 935045 - protein, 17 aa, Mycobacterium
SAGKLKAGDAIDAVNGT

SEQ ID NO: 935046 - protein, 23 aa, Mycobacterium
SAGTSVGHIGIWNTGKLYDQNNY

SEQ ID NO: 935047 - protein, 17 aa, Mycobacterium
SAIAVTIAIALVLFMGV

SEQ ID NO: 935048 - protein, 18 aa, Mycobacterium
SAIDADFVVVDGTLYATL

SEQ ID NO: 935049 - protein, 17 aa, Mycobacterium
SAIGWLYAGAACATHQP

SEQ ID NO: 935050 - protein, 26 aa, Mycobacterium
SAIPPRGTEAVVFKVVENTGAPKTTF

SEQ ID NO: 935051 - protein, 25 aa, Mycobacterium
SAIPPRGTQSLVLKVVQNVGSGQPT

SEQ ID NO: 935052 - protein, 19 aa, Mycobacterium
SAIRDRLGPVTILVNAAGL

SEQ ID NO: 935053 - protein, 17 aa, Mycobacterium
SAIRLALVVMCSALVTA

SEQ ID NO: 935054 - protein, 19 aa, Mycobacterium
SAISALVLPSAFRPVPDSA

SEQ ID NO: 935055 - protein, 21 aa, Mycobacterium
SAITRFFKGTINEIDLDPNSP

SEQ ID NO: 935056 - protein, 25 aa, Mycobacterium
SAKACAQYLGPALRLMNFNYLPMPF

SEQ ID NO: 935057 - protein, 21 aa, Mycobacterium
SAKRGGPMMLLASPTLPAPGL

SEQ ID NO: 935058 - protein, 27 aa, Mycobacterium
SALAAGLGGEGWVGAFGAVSAGAALAS

SEQ ID NO: 935059 - protein, 27 aa, Mycobacterium
SALAAIVAMAVGGAKVVDDHTLPGSGF

SEQ ID NO: 935060 - protein, 18 aa, Mycobacterium
SALARLGAVQNPIIPLLR

SEQ ID NO: 935061 - protein, 17 aa, Mycobacterium
SALCGAEATDISALATQ

SEQ ID NO: 935062 - protein, 19 aa, Mycobacterium
SALDAGLRISFHNDGNVSP

SEQ ID NO: 935063 - protein, 31 aa, Mycobacterium
SALDELMLLKGRRVVTAILRQAAARGEVAPD

SEQ ID NO: 935064 - protein, 17 aa, Mycobacterium
SALDTIATWAPRQPDAV

SEQ ID NO: 935065 - protein, 23 aa, Mycobacterium
SALELVNCLQWPSGSKPNPPQDL

SEQ ID NO: 935066 - protein, 22 aa, Mycobacterium
SALETLCGLKVEPTPIAQAVST

SEQ ID NO: 935067 - protein, 23 aa, Mycobacterium
SALIARWLAGPGVRIVRVDDSPD

SEQ ID NO: 935068 - protein, 20 aa, Mycobacterium
SALKRGGRRSGAPSGGPSPD

SEQ ID NO: 935069 - protein, 19 aa, Mycobacterium
SALLAGIYVAALRSYGFGA

SEQ ID NO: 935070 - protein, 20 aa, Mycobacterium
SALLPEWRMELPLRHLEDLI

SEQ ID NO: 935071 - protein, 18 aa, Mycobacterium
SALLRVFLLSAVPSEEAG

SEQ ID NO: 935072 - protein, 18 aa, Mycobacterium
SALLSRRDVVVVASVSCI

SEQ ID NO: 935073 - protein, 19 aa, Mycobacterium
SALNRPVAASGDARNQNTV

SEQ ID NO: 935074 - protein, 19 aa, Mycobacterium
SALPDWPFNGAGYTAYPVF

SEQ ID NO: 935075 - protein, 18 aa, Mycobacterium
SALPYKRRLFGQIVAAAV

SEQ ID NO: 935076 - protein, 32 aa, Mycobacterium
SALTAEAGRAPGARCAGSGTGRAAGSTLAAIA

SEQ ID NO: 935077 - protein, 20 aa, Mycobacterium
SALTLESWLGPASASMAAAA

SEQ ID NO: 935078 - protein, 19 aa, Mycobacterium
SALTRVAGDKLGYVAPAGI

SEQ ID NO: 935079 - protein, 17 aa, Mycobacterium
SALTVRLAAAYGDPSLL

SEQ ID NO: 935080 - protein, 25 aa, Mycobacterium
SAMMSGRVDGLIGFAHDQGPTIANK

SEQ ID NO: 935081 - protein, 17 aa, Mycobacterium
SAMPADDVAAWKERAGI

SEQ ID NO: 935082 - protein, 21 aa, Mycobacterium
SANKIRVAWRTAVGSDLMLPQ

SEQ ID NO: 935083 - protein, 23 aa, Mycobacterium
SAPAELPPAVSAYTGAGDVPPPA

SEQ ID NO: 935084 - protein, 17 aa, Mycobacterium
SAPDFYFDEMAQIVMDS

SEQ ID NO: 935085 - protein, 25 aa, Mycobacterium
SAPDVAYMFGSWSPNIAKIPQVVDM

SEQ ID NO: 935086 - protein, 22 aa, Mycobacterium
SAPGRMKYISGLTIDGRPTDKT

SEQ ID NO: 935087 - protein, 17 aa, Mycobacterium
SAPIRFNIYDSVNNQVV

SEQ ID NO: 935088 - protein, 23 aa, Mycobacterium
SAPTLAAATAWDGLAAELGEAAE

SEQ ID NO: 935089 - protein, 23 aa, Mycobacterium
SAPTLAAATAWDGLSAELSGAAG

SEQ ID NO: 935090 - protein, 24 aa, Mycobacterium
SAPTPTRRGLATALAAALANPDLG

SEQ ID NO: 935091 - protein, 18 aa, Mycobacterium
SAPTYHWCPGEFWNPIWG

SEQ ID NO: 935092 - protein, 19 aa, Mycobacterium
SAPYGWPVAKGSPLAQSLQ

SEQ ID NO: 935093 - protein, 19 aa, Mycobacterium
SAQAALFHEQFVQALNAGA

SEQ ID NO: 935094 - protein, 23 aa, Mycobacterium
SAQLTDWTVEFDLPADESISNVW

SEQ ID NO: 935095 - protein, 20 aa, Mycobacterium
SAQRWGRYRVPVEVRSVSAS

SEQ ID NO: 935096 - protein, 28 aa, Mycobacterium
SARALQCSIKLLSICERLTDSEGHQRVS

SEQ ID NO: 935097 - protein, 21 aa, Mycobacterium
SARAVLPALFLGSGLTEAAYR

SEQ ID NO: 935098 - protein, 21 aa, Mycobacterium
SARIFAGAGVGPTLAAAAAWD

SEQ ID NO: 935099 - protein, 24 aa, Mycobacterium
SARTPCLVTGWAIRADPSGTSLVP

SEQ ID NO: 935100 - protein, 19 aa, Mycobacterium
SARVTAPAMTWRRPGRSWC

SEQ ID NO: 935101 - protein, 20 aa, Mycobacterium
SASAGVGAWLLARNSGPQRP

SEQ ID NO: 935102 - protein, 17 aa, Mycobacterium
SASDVRAAAGLPEVKTI

SEQ ID NO: 935103 - protein, 18 aa, Mycobacterium
SASLPRHHRLVLSRGPYR

SEQ ID NO: 935104 - protein, 25 aa, Mycobacterium
SASLSFSSLSGWAQLGVRDRFIALT

SEQ ID NO: 935105 - protein, 25 aa, Mycobacterium
SASLSFSSLSGWAQRGLRERFIALT

SEQ ID NO: 935106 - protein, 17 aa, Mycobacterium
SASPEPVIKVWAGEVGI

SEQ ID NO: 935107 - protein, 26 aa, Mycobacterium
SASRRLPIPGADASGVHYLRTVDDAA

SEQ ID NO: 935108 - protein, 32 aa, Mycobacterium
SASTLSGFNAWQLGGTYVRDGKTRAVAQKTVV

SEQ ID NO: 935109 - protein, 31 aa, Mycobacterium
SASTLSGFQAWQLGGSYTKNGKQRAVAQKTV

SEQ ID NO: 935110 - protein, 26 aa, Mycobacterium
SASVDDMTRWLAMVLGDGVFEGERIV

SEQ ID NO: 935111 - protein, 19 aa, Mycobacterium
SATARFVARAAATGLSNDA

SEQ ID NO: 935112 - protein, 17 aa, Mycobacterium
SATARRALAEGADVVIS

SEQ ID NO: 935113 - protein, 23 aa, Mycobacterium
SATEAIEYSRFADWKFGSADVPA

SEQ ID NO: 935114 - protein, 19 aa, Mycobacterium
SATGSRLAFEFVPDTAVFN

SEQ ID NO: 935115 - protein, 25 aa, Mycobacterium
SATIGRTIAYAWLPAGLVIGETVSV

SEQ ID NO: 935116 - protein, 24 aa, Mycobacterium
SATLRFGHPYAVVAVTGARRRGDP

SEQ ID NO: 935117 - protein, 24 aa, Mycobacterium
SATPDFPIPAGRSVQILNSGGIFR

SEQ ID NO: 935118 - protein, 23 aa, Mycobacterium
SATSVSAPIEFDADDVDDDPLVY

SEQ ID NO: 935119 - protein, 32 aa, Mycobacterium
SATVSFASTPPMLWQYFSGRYPDISVQTAGNQ

SEQ ID NO: 935120 - protein, 19 aa, Mycobacterium
SAVAARYGLTSTTPPSDGR

SEQ ID NO: 935121 - protein, 25 aa, Mycobacterium
SAVARGAAALVVLSAPAGRGAPPSL

SEQ ID NO: 935122 - protein, 19 aa, Mycobacterium
SAVGVSELPLGAPVEVELI

SEQ ID NO: 935123 - protein, 17 aa, Mycobacterium
SAVNTARPWSYSTNNDH

SEQ ID NO: 935124 - protein, 19 aa, Mycobacterium
SAVPAELKGNMAALTATGA

SEQ ID NO: 935125 - protein, 19 aa, Mycobacterium
SAVPALVLRSTLPGCAPVK

SEQ ID NO: 935126 - protein, 27 aa, Mycobacterium
SAVPSRWRLMLQGWPGLTTRGLIQLAD

SEQ ID NO: 935127 - protein, 17 aa, Mycobacterium
SAVRPGRDVTELRESTR

SEQ ID NO: 935128 - protein, 24 aa, Mycobacterium
SAVSLAWRTGDDIAVARNDGSHPV

SEQ ID NO: 935129 - protein, 17 aa, Mycobacterium
SCAGAVRLNPLTRPSET

SEQ ID NO: 935130 - protein, 18 aa, Mycobacterium
SCATVTHSPMWGVTRNPW

SEQ ID NO: 935131 - protein, 21 aa, Mycobacterium
SCAVALMLLVSGCTVSPPPAP

SEQ ID NO: 935132 - protein, 19 aa, Mycobacterium
SCAVPGVWPPVTIGERRFM

SEQ ID NO: 935133 - protein, 18 aa, Mycobacterium
SCAVYGSSVLILPDASMD

SEQ ID NO: 935134 - protein, 24 aa, Mycobacterium
SCDIPSLLYSFSFVRNPKWSRTYS

SEQ ID NO: 935135 - protein, 25 aa, Mycobacterium
SCDVPSLLYSYSFVKNPTWSRTYSP

SEQ ID NO: 935136 - protein, 19 aa, Mycobacterium
SCLACSRSAPDRIYGAQSA

SEQ ID NO: 935137 - protein, 17 aa, Mycobacterium
SCNTTFAELSSRMPPRG

SEQ ID NO: 935138 - protein, 17 aa, Mycobacterium
SCPNTREVLGGYSQGAA

SEQ ID NO: 935139 - protein, 18 aa, Mycobacterium
SCTDGKCSTEQPGPYGGN

SEQ ID NO: 935140 - protein, 17 aa, Mycobacterium
SCVTVRPAGEAQGGQPV

SEQ ID NO: 935141 - protein, 20 aa, Mycobacterium
SDAARAAGFVDVRSVLPDAV

SEQ ID NO: 935142 - protein, 28 aa, Mycobacterium
SDALGAPGTETWTFAAMRPGTTTIVATY

SEQ ID NO: 935143 - protein, 28 aa, Mycobacterium
SDAPRIDAVLPMFLEFAGDAVLVAHNAG

SEQ ID NO: 935144 - protein, 29 aa, Mycobacterium
SDARVNSFLLPLLRSCNFNVVANQPGNYR

SEQ ID NO: 935145 - protein, 21 aa, Mycobacterium
SDAYRTFTFVGGRQVQLADLF

SEQ ID NO: 935146 - protein, 22 aa, Mycobacterium
SDDSSFGFGVWNLRSQQWDFLK

SEQ ID NO: 935147 - protein, 27 aa, Mycobacterium
SDEASEWHGHVAGFVRGHTSTATVSVT

SEQ ID NO: 935148 - protein, 20 aa, Mycobacterium
SDEAWECPLHGSRFAPDGTL

SEQ ID NO: 935149 - protein, 18 aa, Mycobacterium
SDEGPVFITFDCSPGDDG

SEQ ID NO: 935150 - protein, 19 aa, Mycobacterium
SDEIVRRRIDVVAYNPGLT

SEQ ID NO: 935151 - protein, 22 aa, Mycobacterium
SDERLLRVFTFQALYVGVPPRR

SEQ ID NO: 935152 - protein, 23 aa, Mycobacterium
SDFDYVLNFAVAKSGNWDKDLGA

SEQ ID NO: 935153 - protein, 23 aa, Mycobacterium
SDFLRPGHNVDLVLVAVNQSPDL

SEQ ID NO: 935154 - protein, 26 aa, Mycobacterium
SDGEPATEWTLNWAHELIDKAPHPKH

SEQ ID NO: 935155 - protein, 23 aa, Mycobacterium
SDGGFLPIIPILGGSGPQTQSPT

SEQ ID NO: 935156 - protein, 25 aa, Mycobacterium
SDGGRIVFIGTGFGTRVAFPGVADY

SEQ ID NO: 935157 - protein, 17 aa, Mycobacterium
SDGLKQLLFGPLDGPPR

SEQ ID NO: 935158 - protein, 24 aa, Mycobacterium
SDGPPVILLHGWPYDIHSYLDVVP

SEQ ID NO: 935159 - protein, 17 aa, Mycobacterium
SDGSPRYGKPVKVLRRR

SEQ ID NO: 935160 - protein, 18 aa, Mycobacterium
SDGTVVAVGDNFKGQIDI

SEQ ID NO: 935161 - protein, 27 aa, Mycobacterium
SDHSVCAADFQRYVSMTGAGAGDEGIP

SEQ ID NO: 935162 - protein, 26 aa, Mycobacterium
SDIERLRNLWDVPALALVGIGNGAQV

SEQ ID NO: 935163 - protein, 18 aa, Mycobacterium
SDIERLRSTWDVPALALI

SEQ ID NO: 935164 - protein, 19 aa, Mycobacterium
SDIGWVFDRDRMHGPRDDG

SEQ ID NO: 935165 - protein, 19 aa, Mycobacterium
SDLDGAVVKFRDNALWGAT

SEQ ID NO: 935166 - protein, 17 aa, Mycobacterium
SDLDSFLARLEPSLPAF

SEQ ID NO: 935167 - protein, 26 aa, Mycobacterium
SDLERLRNLWDVPALALVGIGNGAQV

SEQ ID NO: 935168 - protein, 17 aa, Mycobacterium
SDLFGGSGRDLLRSIVD

SEQ ID NO: 935169 - protein, 18 aa, Mycobacterium
SDLFWAIRGVGGGNFCIA

SEQ ID NO: 935170 - protein, 18 aa, Mycobacterium
SDLIAYGPVEYVWSDQYD

SEQ ID NO: 935171 - protein, 17 aa, Mycobacterium
SDLNWQQAALLAGMVQS

SEQ ID NO: 935172 - protein, 24 aa, Mycobacterium
SDLPPRGTQTVVFKVYQTGGNGQP

SEQ ID NO: 935173 - protein, 17 aa, Mycobacterium
SDLPSSVQLATWLNGPG

SEQ ID NO: 935174 - protein, 28 aa, Mycobacterium
SDLPSSVQLPVWLSRGGADVLQTHPIVA

SEQ ID NO: 935175 - protein, 22 aa, Mycobacterium
SDLPYSIVRATQFFEFVIGIAD

SEQ ID NO: 935176 - protein, 27 aa, Mycobacterium
SDLRECLRLSAKTGIYGARYVTAEDVA

SEQ ID NO: 935177 - protein, 21 aa, Mycobacterium
SDLSGRRVCVVDGTTSLQRIQ

SEQ ID NO: 935178 - protein, 25 aa, Mycobacterium
SDLTFASGWLEFRSAGYSGVTDDID

SEQ ID NO: 935179 - protein, 19 aa, Mycobacterium
SDLVKGLVYPVPDPRYPFL

SEQ ID NO: 935180 - protein, 19 aa, Mycobacterium
SDLVLRVAMEAMHDQQLAS

SEQ ID NO: 935181 - protein, 17 aa, Mycobacterium
SDNRPLLKDTIGYLDVI

SEQ ID NO: 935182 - protein, 18 aa, Mycobacterium
SDPAWARNDPFLHIDQLI

SEQ ID NO: 935183 - protein, 24 aa, Mycobacterium
SDPRLFGRRLADFFTGRDPRGGSV

SEQ ID NO: 935184 - protein, 23 aa, Mycobacterium
SDPSRPVDCIVRVRAKDGSETGR

SEQ ID NO: 935185 - protein, 17 aa, Mycobacterium
SDPWTHAPILWAAEEPR

SEQ ID NO: 935186 - protein, 23 aa, Mycobacterium
SDRKAVLSGLGYCYLDTGQHRAA

SEQ ID NO: 935187 - protein, 23 aa, Mycobacterium
SDRRPGGAWMLGKPIQIGEARDL

SEQ ID NO: 935188 - protein, 23 aa, Mycobacterium
SDRRPGGNWMLGKPIQIAEARDL

SEQ ID NO: 935189 - protein, 24 aa, Mycobacterium
SDRRPGGTWMLGKPIQLGEARDLS

SEQ ID NO: 935190 - protein, 20 aa, Mycobacterium
SDSQARCDAVKPLIDALAHT

SEQ ID NO: 935191 - protein, 19 aa, Mycobacterium
SDSSLRPGATVTAEAVALE

SEQ ID NO: 935192 - protein, 21 aa, Mycobacterium
SDSYSRFGISGADLGIMWDNG

SEQ ID NO: 935193 - protein, 17 aa, Mycobacterium
SDTEAFWGQELGLTGDK

SEQ ID NO: 935194 - protein, 17 aa, Mycobacterium
SDTLEHIDRTALQIHGS

SEQ ID NO: 935195 - protein, 29 aa, Mycobacterium
SDTPGCPKETWCVRNARAYSSPMNVTDAL

SEQ ID NO: 935196 - protein, 18 aa, Mycobacterium
SDVIPYPVVGTLWEATAT

SEQ ID NO: 935197 - protein, 18 aa, Mycobacterium
SDVKSSFGPDFKVTDIGE

SEQ ID NO: 935198 - protein, 18 aa, Mycobacterium
SDVPLPWSQTVSTSLPAV

SEQ ID NO: 935199 - protein, 29 aa, Mycobacterium
SDVPSSVQLPAWLSRAGADVLKTNPIVSV

SEQ ID NO: 935200 - protein, 21 aa, Mycobacterium
SDVQDGLGMIMQWQGNSVEDP

SEQ ID NO: 935201 - protein, 23 aa, Mycobacterium
SDWGGLWNYTWRTGLDEHGDPVH

SEQ ID NO: 935202 - protein, 23 aa, Mycobacterium
SDYRRVGGSNGHFDFPASGQHDW

SEQ ID NO: 935203 - protein, 18 aa, Mycobacterium
SDYVFPRTSNAIVKAYAQ

SEQ ID NO: 935204 - protein, 18 aa, Mycobacterium
SDYVGVYANDYWGPATVT

SEQ ID NO: 935205 - protein, 17 aa, Mycobacterium
SEAAAKFVAAVKAKDIA

SEQ ID NO: 935206 - protein, 20 aa, Mycobacterium
SEAAEGRWFASQVRANPNPF

SEQ ID NO: 935207 - protein, 26 aa, Mycobacterium
SEAAGFRALRRWASGFYPEPEAAAEP

SEQ ID NO: 935208 - protein, 20 aa, Mycobacterium
SEAARAAGLVDVRTVVPDAV

SEQ ID NO: 935209 - protein, 20 aa, Mycobacterium
SECAQLSAVIIKANTNQPNP

SEQ ID NO: 935210 - protein, 23 aa, Mycobacterium
SEDGRFYIEEMVAVYLSDFDAEG

SEQ ID NO: 935211 - protein, 22 aa, Mycobacterium
SEDGYRLSGRLLARQRRQDDVL

SEQ ID NO: 935212 - protein, 21 aa, Mycobacterium
SEDHTRWVLDEIVDGNPSGWR

SEQ ID NO: 935213 - protein, 23 aa, Mycobacterium
SEDLPTCVVKFIPLHTPAVTMSI

SEQ ID NO: 935214 - protein, 17 aa, Mycobacterium
SEELHWIPESGEFDPDA

SEQ ID NO: 935215 - protein, 17 aa, Mycobacterium
SEEVLYRPLGMTSTSSR

SEQ ID NO: 935216 - protein, 32 aa, Mycobacterium
SEFQTRYTGLVGLKEKYGLDIAPANFVAISDG

SEQ ID NO: 935217 - protein, 41 aa, Mycobacterium
SEGPSRKVLRRRLVALSVLPALLLLGFAVKLIVMVSTGYAA

SEQ ID NO: 935218 - protein, 21 aa, Mycobacterium
SEGRHGPFFPQCGGVSDQTVT

SEQ ID NO: 935219 - protein, 24 aa, Mycobacterium
SEGVWPLLVGIAMRDAGGFSATSM

SEQ ID NO: 935220 - protein, 20 aa, Mycobacterium
SEGWWPGLINISMGDAGGYK

SEQ ID NO: 935221 - protein, 21 aa, Mycobacterium
SEGWWPTLIGLAMNDAGGYNA

SEQ ID NO: 935222 - protein, 20 aa, Mycobacterium
SEGYMITASYAVRVTWSGVY

SEQ ID NO: 935223 - protein, 18 aa, Mycobacterium
SEHGHRVLHELADRADVV

SEQ ID NO: 935224 - protein, 28 aa, Mycobacterium
SEHLVSWLKAVIYGAAERWTDVIDEVKS

SEQ ID NO: 935225 - protein, 19 aa, Mycobacterium
SEHLVSWVRAVIYGAGQRW

SEQ ID NO: 935226 - protein, 25 aa, Mycobacterium
SEIDNLRAAYSWSLEKSDPEIALEL

SEQ ID NO: 935227 - protein, 20 aa, Mycobacterium
SEIRAAGAVGSIRYVSDRRP

SEQ ID NO: 935228 - protein, 23 aa, Mycobacterium
SELQAQCFSGMFLGSRRGGTITQ

SEQ ID NO: 935229 - protein, 20 aa, Mycobacterium
SELSAELQSAAAGFASLTSG

SEQ ID NO: 935230 - protein, 25 aa, Mycobacterium
SELTPAGLIVAEWAGRLLEVATEID

SEQ ID NO: 935231 - protein, 22 aa, Mycobacterium
SEPARASLFKPWGADRSSAQTV

SEQ ID NO: 935232 - protein, 24 aa, Mycobacterium
SEPFKGWLGGAAVELLDIDQDGRD

SEQ ID NO: 935233 - protein, 17 aa, Mycobacterium
SEPKLGQAVEWTPCRAA

SEQ ID NO: 935234 - protein, 24 aa, Mycobacterium
SEPLGYDMTYTWSGSAVGHDGKAV

SEQ ID NO: 935235 - protein, 26 aa, Mycobacterium
SERVLPRRRCFTFDDTHSIFVSDAAG

SEQ ID NO: 935236 - protein, 32 aa, Mycobacterium
SESGVAGTWNMRWADLSLPRQAAVIVAAAAAA

SEQ ID NO: 935237 - protein, 27 aa, Mycobacterium
SESGVGWNYLAAINFIETRFGSIVGAS

SEQ ID NO: 935238 - protein, 25 aa, Mycobacterium
SESNAMWALSIPIPFIKPVGAGAGG

SEQ ID NO: 935239 - protein, 22 aa, Mycobacterium
SETSGLTPDWVRSIGAVPYQLT

SEQ ID NO: 935240 - protein, 23 aa, Mycobacterium
SETSLSWGDCDGFTPENVTVPAS

SEQ ID NO: 935241 - protein, 17 aa, Mycobacterium
SETTWRFIQQIYAKDAQ

SEQ ID NO: 935242 - protein, 21 aa, Mycobacterium
SEVAAGLGGQGFEGVALDGDA

SEQ ID NO: 935243 - protein, 25 aa, Mycobacterium
SFADLARPGLGVVICQQPVPCGSAT

SEQ ID NO: 935244 - protein, 25 aa, Mycobacterium
SFAGQGVGFGGWYAPVALHVDTASV

SEQ ID NO: 935245 - protein, 26 aa, Mycobacterium
SFAGQGVGFGGWYSPIALRVDTASVD

SEQ ID NO: 935246 - protein, 24 aa, Mycobacterium
SFAKAGYASLSWNKPGIDGAAGNW

SEQ ID NO: 935247 - protein, 21 aa, Mycobacterium
SFAQAQKLNMAKIITSAGPDA

SEQ ID NO: 935248 - protein, 26 aa, Mycobacterium
SFASLESWPCIGEAGPGKRPRRFPLY

SEQ ID NO: 935249 - protein, 30 aa, Mycobacterium
SFDGVGVFRRGRIWLVAGVSADVAQRQQRV

SEQ ID NO: 935250 - protein, 18 aa, Mycobacterium
SFEFSVAVPGRVDVELHE

SEQ ID NO: 935251 - protein, 24 aa, Mycobacterium
SFFARAALEQGLRWAQQEIEWAKW

SEQ ID NO: 935252 - protein, 23 aa, Mycobacterium
SFFARAVLEQGLRWTRHEIEWAT

SEQ ID NO: 935253 - protein, 24 aa, Mycobacterium
SFFNIYFCSVTIKINGPAGGDILI

SEQ ID NO: 935254 - protein, 24 aa, Mycobacterium
SFFNIYFCSVTIKINGPAGGDILL

SEQ ID NO: 935255 - protein, 23 aa, Mycobacterium
SFGASPRASLGIIAASRSLALVR

SEQ ID NO: 935256 - protein, 18 aa, Mycobacterium
SFHESFVRVLSGAAASYV

SEQ ID NO: 935257 - protein, 21 aa, Mycobacterium
SFIDFRTSVRVAFTPAANQLG

SEQ ID NO: 935258 - protein, 23 aa, Mycobacterium
SFKYTLWRLQERVVGKGPDAPAI

SEQ ID NO: 935259 - protein, 23 aa, Mycobacterium
SFLCGAIQAASRLGYEQSAKLCV

SEQ ID NO: 935260 - protein, 19 aa, Mycobacterium
SFNSWWTGANGKAMIEAGF

SEQ ID NO: 935261 - protein, 19 aa, Mycobacterium
SFPNDLDPRIDLREADLEP

SEQ ID NO: 935262 - protein, 20 aa, Mycobacterium
SFSDHAEWVLPTDWTVAPGR

SEQ ID NO: 935263 - protein, 21 aa, Mycobacterium
SFSPIGIAVVDNFRDVVYKND

SEQ ID NO: 935264 - protein, 17 aa, Mycobacterium
SFWFSSCMVTFKTSYGV

SEQ ID NO: 935265 - protein, 21 aa, Mycobacterium
SGAAADWRVEKITTAGPGAQE

SEQ ID NO: 935266 - protein, 25 aa, Mycobacterium
SGAAKWNLLAPYAYASNGGQNPEAG

SEQ ID NO: 935267 - protein, 35 aa, Mycobacterium
SGAGTVGFDCSGLMLYMFAGVGIKLDHYSGSQYNA

SEQ ID NO: 935268 - protein, 21 aa, Mycobacterium
SGAKAAVRFLADRPATDPERI

SEQ ID NO: 935269 - protein, 21 aa, Mycobacterium
SGALPRWALANAATAEMSGDN

SEQ ID NO: 935270 - protein, 18 aa, Mycobacterium
SGAMVLDELIPMLGEQGL

SEQ ID NO: 935271 - protein, 18 aa, Mycobacterium
SGAMVLNEFIPLLAEQGL

SEQ ID NO: 935272 - protein, 20 aa, Mycobacterium
SGAPPHCFQDNTDPNPDRRR

SEQ ID NO: 935273 - protein, 20 aa, Mycobacterium
SGAQGFGAVVTEGDSPTVKS

SEQ ID NO: 935274 - protein, 19 aa, Mycobacterium
SGARALPLIEAQLNKVEEL

SEQ ID NO: 935275 - protein, 17 aa, Mycobacterium
SGARVRLCKGAYDEPAS

SEQ ID NO: 935276 - protein, 25 aa, Mycobacterium
SGCAFEGVNSLPLPGAEGRGGDAVT

SEQ ID NO: 935277 - protein, 18 aa, Mycobacterium
SGCIAAVDVVGWYNANPT

SEQ ID NO: 935278 - protein, 31 aa, Mycobacterium
SGDHPRYAAVPLRLHPDIHLYCAVPEERSLT

SEQ ID NO: 935279 - protein, 24 aa, Mycobacterium
SGDTRLPAGGMLFIGTPEGQKVAP

SEQ ID NO: 935280 - protein, 26 aa, Mycobacterium
SGELIREMLDWAACEHVPDDYLPLLA

SEQ ID NO: 935281 - protein, 19 aa, Mycobacterium
SGFAGLWAALGAARRLDEL

SEQ ID NO: 935282 - protein, 20 aa, Mycobacterium
SGFAGLWAALGAARRVEELA

SEQ ID NO: 935283 - protein, 27 aa, Mycobacterium
SGFDPSRPSAWLVEGLLFFLKSSAQDL

SEQ ID NO: 935284 - protein, 19 aa, Mycobacterium
SGFPALACEGLVDGTSGAP

SEQ ID NO: 935285 - protein, 27 aa, Mycobacterium
SGGAKGCPKDNWCVVNAGNYRGSMNVT

SEQ ID NO: 935286 - protein, 28 aa, Mycobacterium
SGGAKGCPKDTWCVINAGNYRGSMSVTD

SEQ ID NO: 935287 - protein, 26 aa, Mycobacterium
SGGAKGCPKDTWCVVNAGNYRGSMNV

SEQ ID NO: 935288 - protein, 21 aa, Mycobacterium
SGGATGLCGTGGAGGSGGVGG

SEQ ID NO: 935289 - protein, 18 aa, Mycobacterium
SGGDEIRRSDAPRLVDLV

SEQ ID NO: 935290 - protein, 20 aa, Mycobacterium
SGGDGGWLLGNGGNGAEGGT

SEQ ID NO: 935291 - protein, 19 aa, Mycobacterium
SGGDWFIDTMVIPYTTQNQ

SEQ ID NO: 935292 - protein, 23 aa, Mycobacterium
SGGEMPRGDSITAGKLSFPASAA

SEQ ID NO: 935293 - protein, 20 aa, Mycobacterium
SGGGTGFAIPIGQAMGIAGQ

SEQ ID NO: 935294 - protein, 24 aa, Mycobacterium
SGGIFRIYRVYRPRGLTGAAPLVV

SEQ ID NO: 935295 - protein, 25 aa, Mycobacterium
SGGIRGPIGLGYRVPGLVISPFSRG

SEQ ID NO: 935296 - protein, 23 aa, Mycobacterium
SGGKWCPPNPIDKVFDRHGKEVP

SEQ ID NO: 935297 - protein, 26 aa, Mycobacterium
SGGLIGRLKPLFSFGLGARLGNGRQY

SEQ ID NO: 935298 - protein, 24 aa, Mycobacterium
SGGMWCLPSPIDKVFDRHGNEVPL

SEQ ID NO: 935299 - protein, 30 aa, Mycobacterium
SGGNAWRSDPRFSYLAARADIAAIAKNNAA

SEQ ID NO: 935300 - protein, 20 aa, Mycobacterium
SGGYKAWALTPDELILYMPD

SEQ ID NO: 935301 - protein, 31 aa, Mycobacterium
SGHPLPEFLSTEVFQPLGLAMAVDPVGKIPD

SEQ ID NO: 935302 - protein, 26 aa, Mycobacterium
SGIAELRQAFPGGIVALSKWAATPNP

SEQ ID NO: 935303 - protein, 18 aa, Mycobacterium
SGIGARAAPTNVTVANST

SEQ ID NO: 935304 - protein, 17 aa, Mycobacterium
SGIGLAVAHRLRSDGID

SEQ ID NO: 935305 - protein, 18 aa, Mycobacterium
SGISCLSEAGGGGFTFSA

SEQ ID NO: 935306 - protein, 17 aa, Mycobacterium
SGITIMIQKGNPENITG

SEQ ID NO: 935307 - protein, 19 aa, Mycobacterium
SGITMFRGAGRMAAFLDGH

SEQ ID NO: 935308 - protein, 25 aa, Mycobacterium
SGKACAQYLGPALRLMNFNYLPMPF

SEQ ID NO: 935309 - protein, 22 aa, Mycobacterium
SGKLCGLYLSPALKVFNPLMYF

SEQ ID NO: 935310 - protein, 22 aa, Mycobacterium
SGKLCGLYLSPALRVFNPLLLF

SEQ ID NO: 935311 - protein, 18 aa, Mycobacterium
SGKLIVGVNIPYAPNEFK

SEQ ID NO: 935312 - protein, 22 aa, Mycobacterium
SGKRVACGVLAAASATTTSSAS

SEQ ID NO: 935313 - protein, 24 aa, Mycobacterium
SGKVGMLITGPWDLSQLSDIDYGV

SEQ ID NO: 935314 - protein, 23 aa, Mycobacterium
SGLDPRLMGLFLVTPDIFDSLPE

SEQ ID NO: 935315 - protein, 25 aa, Mycobacterium
SGLDSRAYRLPWPAGTTLFEVDQPK

SEQ ID NO: 935316 - protein, 22 aa, Mycobacterium
SGLDVMALDVVWTAEFAEAGWA

SEQ ID NO: 935317 - protein, 17 aa, Mycobacterium
SGLERLLTWGVVVAPVI

SEQ ID NO: 935318 - protein, 19 aa, Mycobacterium
SGLIDRIGFRDEVYARIAE

SEQ ID NO: 935319 - protein, 19 aa, Mycobacterium
SGLIEGRIAEFQVTAEGTV

SEQ ID NO: 935320 - protein, 19 aa, Mycobacterium
SGLPVVEVLDTEVIRGRTS

SEQ ID NO: 935321 - protein, 18 aa, Mycobacterium
SGLRGLREKYGLDISPQN

SEQ ID NO: 935322 - protein, 24 aa, Mycobacterium
SGMRLRVGRDAQPRQAQTRDGGNR

SEQ ID NO: 935323 - protein, 23 aa, Mycobacterium
SGNPLAAAGTLFFAPVNAVNSFL

SEQ ID NO: 935324 - protein, 29 aa, Mycobacterium
SGNPRRGNYRYAINNSFGFGGHNVALAFG

SEQ ID NO: 935325 - protein, 18 aa, Mycobacterium
SGPAGRVSVTNGIAAAGN

SEQ ID NO: 935326 - protein, 25 aa, Mycobacterium
SGPASSGQNWAVWDPTLPAIPSAFV

SEQ ID NO: 935327 - protein, 19 aa, Mycobacterium
SGPDRRLYAVAGSPGGSTI

SEQ ID NO: 935328 - protein, 20 aa, Mycobacterium
SGPFFKVVIHNLVPGQILQP

SEQ ID NO: 935329 - protein, 19 aa, Mycobacterium
SGPHHLKYISGLKVDGRPT

SEQ ID NO: 935330 - protein, 21 aa, Mycobacterium
SGPLCDRFAPSTVVDAADLFS

SEQ ID NO: 935331 - protein, 20 aa, Mycobacterium
SGPVLAYWLSRYGFDVTVVE

SEQ ID NO: 935332 - protein, 17 aa, Mycobacterium
SGQLTFGLPAARVPRTL

SEQ ID NO: 935333 - protein, 32 aa, Mycobacterium
SGQVQALSQFVAWPGLLVYQGKAKLLYDGAEL

SEQ ID NO: 935334 - protein, 21 aa, Mycobacterium
SGQVSCRMLVDGVVRDEQSDD

SEQ ID NO: 935335 - protein, 17 aa, Mycobacterium
SGRFLDRNTTLWASWAF

SEQ ID NO: 935336 - protein, 17 aa, Mycobacterium
SGRFLDRNTTLWASWVF

SEQ ID NO: 935337 - protein, 18 aa, Mycobacterium
SGRFLQRNTTLWASWVVI

SEQ ID NO: 935338 - protein, 28 aa, Mycobacterium
SGRLYKNVFDKLVPWIRDILNAYTPHIL

SEQ ID NO: 935339 - protein, 19 aa, Mycobacterium
SGRPACREPAPGQQECSKP

SEQ ID NO: 935340 - protein, 22 aa, Mycobacterium
SGRRVCAARGTTSLNRLSQITP

SEQ ID NO: 935341 - protein, 21 aa, Mycobacterium
SGRSAWRRALALSAATTLIVT

SEQ ID NO: 935342 - protein, 20 aa, Mycobacterium
SGSAFPWRRQSAVAQWYVET

SEQ ID NO: 935343 - protein, 20 aa, Mycobacterium
SGSAKWNLLAPYAAKSEGGK

SEQ ID NO: 935344 - protein, 23 aa, Mycobacterium
SGSAKWNLLAPYAAKSNGGQDPE

SEQ ID NO: 935345 - protein, 23 aa, Mycobacterium
SGSAKWNLLAPYAVESRGGQDGQ

SEQ ID NO: 935346 - protein, 24 aa, Mycobacterium
SGSAKWNLLAPYAVKSEGGRNTQA

SEQ ID NO: 935347 - protein, 21 aa, Mycobacterium
SGSGARYGRQGVEYWEHQGEV

SEQ ID NO: 935348 - protein, 27 aa, Mycobacterium
SGSIALPTPLALGIDALGPYYLATTAL

SEQ ID NO: 935349 - protein, 18 aa, Mycobacterium
SGSIVAWRGVDMEGEHAA

SEQ ID NO: 935350 - protein, 21 aa, Mycobacterium
SGSLPRWAFANAATGEMTGDS

SEQ ID NO: 935351 - protein, 20 aa, Mycobacterium
SGSLPRWALANSATGEMTGD

SEQ ID NO: 935352 - protein, 18 aa, Mycobacterium
SGSPLFAQKGWNPQTQSN

SEQ ID NO: 935353 - protein, 29 aa, Mycobacterium
SGSTPPRPMPRAAMEAVPLEPGQQAVNFS

SEQ ID NO: 935354 - protein, 23 aa, Mycobacterium
SGSYGCSGPLPAAPGGANLVTGN

SEQ ID NO: 935355 - protein, 23 aa, Mycobacterium
SGTARTANRIKIFARVDSLVTQG

SEQ ID NO: 935356 - protein, 24 aa, Mycobacterium
SGTCEPGDAMGIIGDEVLVLNHDI

SEQ ID NO: 935357 - protein, 18 aa, Mycobacterium
SGTLPWQATLHAKQLVVP

SEQ ID NO: 935358 - protein, 29 aa, Mycobacterium
SGTLRISNWPLYMADGFVAAFQTASGLTV

SEQ ID NO: 935359 - protein, 31 aa, Mycobacterium
SGTQAATLMLNWYPYGEHAPFYYGVQEGIFA

SEQ ID NO: 935360 - protein, 34 aa, Mycobacterium
SGTRTDVDMAFWFSDVRAPYFAGCCGASGVIADA

SEQ ID NO: 935361 - protein, 23 aa, Mycobacterium
SGVAWNYLAAINFVETAFGRISG

SEQ ID NO: 935362 - protein, 25 aa, Mycobacterium
SGVKAFAGSAAWFLIRAVTAPDDTV

SEQ ID NO: 935363 - protein, 17 aa, Mycobacterium
SGVSFDLDNDADLMKGA

SEQ ID NO: 935364 - protein, 30 aa, Mycobacterium
SGYDLLKRFKLSMDNVWPATQSQLYSELNK

SEQ ID NO: 935365 - protein, 30 aa, Mycobacterium
SGYDLLKRFQLSMNNVWPATQSQLYSELNK

SEQ ID NO: 935366 - protein, 27 aa, Mycobacterium
SGYGALPIFVVFIYFRAPWTKYVSNLA

SEQ ID NO: 935367 - protein, 27 aa, Mycobacterium
SGYGALPIFVVFVYFKAPWRRFVPDLL

SEQ ID NO: 935368 - protein, 32 aa, Mycobacterium
SGYGALPIYVVFIYFRAPWRHFVSHLNDGDAV

SEQ ID NO: 935369 - protein, 18 aa, Mycobacterium
SGYLRAKCAQEKLIKESD

SEQ ID NO: 935370 - protein, 17 aa, Mycobacterium
SGYSHWLGQYLAVASIP

SEQ ID NO: 935371 - protein, 24 aa, Mycobacterium
SHAQIQPGMPFCKIGAVTGETCGA

SEQ ID NO: 935372 - protein, 24 aa, Mycobacterium
SHAVALGATEIWVLPTGYACALTE

SEQ ID NO: 935373 - protein, 18 aa, Mycobacterium
SHDIDGRPGLSPTSTPTS

SEQ ID NO: 935374 - protein, 17 aa, Mycobacterium
SHGIKRLHHPVIGDIDL

SEQ ID NO: 935375 - protein, 39 aa, Mycobacterium
SHGPKRYNWAQLVGSFKYTLWRLQERVVGKGVYGEDVPM

SEQ ID NO: 935376 - protein, 18 aa, Mycobacterium
SHLYRAKNSVLISVGVLG

SEQ ID NO: 935377 - protein, 20 aa, Mycobacterium
SHPMLRGLSGIDWVDASTVL

SEQ ID NO: 935378 - protein, 19 aa, Mycobacterium
SHRRMVLMSSKTVASELER

SEQ ID NO: 935379 - protein, 20 aa, Mycobacterium
SHRSSAFLGFTNRYAAANYI

SEQ ID NO: 935380 - protein, 26 aa, Mycobacterium
SHSGVAGSWNVRWAELTPARQAAVIV

SEQ ID NO: 935381 - protein, 27 aa, Mycobacterium
SHSWFAGYRGDLAFAALIVGGGSSEYA

SEQ ID NO: 935382 - protein, 17 aa, Mycobacterium
SHTRLTVAASLTIAEQL

SEQ ID NO: 935383 - protein, 35 aa, Mycobacterium
SHTRPTRPPGWPGWPGWPPHHGHWPTKPTKPTKPT

SEQ ID NO: 935384 - protein, 18 aa, Mycobacterium
SHVDEWRSTMAVNVVGAV

SEQ ID NO: 935385 - protein, 24 aa, Mycobacterium
SIAGPVLAFWLAHYGFEVTVIERS

SEQ ID NO: 935386 - protein, 23 aa, Mycobacterium
SIAGPVLAYWLARYGFDVTVVER

SEQ ID NO: 935387 - protein, 30 aa, Mycobacterium
SIARYKLPKAVVFRPAIERSPAGKADYRWA

SEQ ID NO: 935388 - protein, 20 aa, Mycobacterium
SIATAFRAGWQGDYPSMIEF

SEQ ID NO: 935389 - protein, 25 aa, Mycobacterium
SIDAYPRVVWIAGGMLKGASVEDLV

SEQ ID NO: 935390 - protein, 17 aa, Mycobacterium
SIDGCGPPSASTSGVLT

SEQ ID NO: 935391 - protein, 25 aa, Mycobacterium
SIEDALRMMVNMGYQDVDPDTLERG

SEQ ID NO: 935392 - protein, 24 aa, Mycobacterium
SIHRGRLQMLLLAAVRERLGADAV

SEQ ID NO: 935393 - protein, 25 aa, Mycobacterium
SILDREWLHRGSIVVADNVKVPGAP

SEQ ID NO: 935394 - protein, 26 aa, Mycobacterium
SIMAAGRFLAAQGFARDRDHAIYRYN

SEQ ID NO: 935395 - protein, 23 aa, Mycobacterium
SINAHGYPNLFFMTGPNSGPGHN

SEQ ID NO: 935396 - protein, 17 aa, Mycobacterium
SINLAGELGRWVLRTAC

SEQ ID NO: 935397 - protein, 26 aa, Mycobacterium
SIPLSSLPLYLGIGPNNDFPLPDQVT

SEQ ID NO: 935398 - protein, 25 aa, Mycobacterium
SISAGCLLGELAIGFLGAPQAAAAA

SEQ ID NO: 935399 - protein, 24 aa, Mycobacterium
SITRRRALAAFAVGIVAPATLAAC

SEQ ID NO: 935400 - protein, 25 aa, Mycobacterium
SITYNEWSFAVGKQLHMAGIITSAG

SEQ ID NO: 935401 - protein, 22 aa, Mycobacterium
SIVAALGKWPPASGRASVIVDT

SEQ ID NO: 935402 - protein, 17 aa, Mycobacterium
SIVAFLRAGYASGAPAV

SEQ ID NO: 935403 - protein, 24 aa, Mycobacterium
SIVPAPGWTLGHRGPNWVALSNAD

SEQ ID NO: 935404 - protein, 23 aa, Mycobacterium
SIYDPPMRTMIAFGGKYPTTVIP

SEQ ID NO: 935405 - protein, 21 aa, Mycobacterium
SIYSSCAVPPLLGYLNDGKLP

SEQ ID NO: 935406 - protein, 19 aa, Mycobacterium
SIYVMGREELRLILWEFVG

SEQ ID NO: 935407 - protein, 22 aa, Mycobacterium
SKAAGDMLVRAWVRSYGVRATI

SEQ ID NO: 935408 - protein, 20 aa, Mycobacterium
SKAGLLSGAPRTFASNTLVI

SEQ ID NO: 935409 - protein, 20 aa, Mycobacterium
SKALGSIAMFGGTLDNLAPI

SEQ ID NO: 935410 - protein, 19 aa, Mycobacterium
SKDEVCSGQFAAMCSAAGV

SEQ ID NO: 935411 - protein, 26 aa, Mycobacterium
SKGGKYPTARLVVFKLRGDFNPADVA

SEQ ID NO: 935412 - protein, 24 aa, Mycobacterium
SKGLRAAVRYASFGMGLTRLLSGG

SEQ ID NO: 935413 - protein, 21 aa, Mycobacterium
SKGNIIAWLYSQRRFEVPSDQ

SEQ ID NO: 935414 - protein, 22 aa, Mycobacterium
SKHLRGTHVIVLINNRDIRVLA

SEQ ID NO: 935415 - protein, 25 aa, Mycobacterium
SKHSGKAYLERIVFKTVPEAGTRVG

SEQ ID NO: 935416 - protein, 21 aa, Mycobacterium
SKIHSVASFFVSRVDTEIDAR

SEQ ID NO: 935417 - protein, 21 aa, Mycobacterium
SKIHSVASFFVSRVDTEIDKR

SEQ ID NO: 935418 - protein, 20 aa, Mycobacterium
SKIHSVASFFVSRVDTEIDN

SEQ ID NO: 935419 - protein, 21 aa, Mycobacterium
SKIHSVASFFVSRVDTEVDKR

SEQ ID NO: 935420 - protein, 18 aa, Mycobacterium
SKPRGWMEALRAYNYSDA

SEQ ID NO: 935421 - protein, 22 aa, Mycobacterium
SKPWHPSGLAIDIMIPNHGSPE

SEQ ID NO: 935422 - protein, 21 aa, Mycobacterium
SKPWHPSGLAIDVMIPNPSSP

SEQ ID NO: 935423 - protein, 17 aa, Mycobacterium
SKRVMWQGIGHGASIYS

SEQ ID NO: 935424 - protein, 24 aa, Mycobacterium
SKTVSGQLTLLVPFIDRIRARVDL

SEQ ID NO: 935425 - protein, 20 aa, Mycobacterium
SKYAKLDFEGFRIADKPGLW

SEQ ID NO: 935426 - protein, 18 aa, Mycobacterium
SLAAIPPSAMPPGLGDPE

SEQ ID NO: 935427 - protein, 17 aa, Mycobacterium
SLAAQGFERQPWTRPDP

SEQ ID NO: 935428 - protein, 17 aa, Mycobacterium
SLACSRNAPGVATATPP

SEQ ID NO: 935429 - protein, 17 aa, Mycobacterium
SLADFVKRQNIGSFTLG

SEQ ID NO: 935430 - protein, 20 aa, Mycobacterium
SLALERRAGQSLATVEFSLD

SEQ ID NO: 935431 - protein, 21 aa, Mycobacterium
SLAPGQPICHYGVITGETCGT

SEQ ID NO: 935432 - protein, 23 aa, Mycobacterium
SLASRYGCPALEATAVPTTPGAP

SEQ ID NO: 935433 - protein, 24 aa, Mycobacterium
SLAVIRLDPSLLRAVQDAANSAAA

SEQ ID NO: 935434 - protein, 20 aa, Mycobacterium
SLCTQGEINAALLYASVSVI

SEQ ID NO: 935435 - protein, 17 aa, Mycobacterium
SLDDGLRALLDWIAERP

SEQ ID NO: 935436 - protein, 24 aa, Mycobacterium
SLDEWRAAICRDDVTTVSGTRHTV

SEQ ID NO: 935437 - protein, 26 aa, Mycobacterium
SLDGGPALRARRVLVATGVEDELPDI

SEQ ID NO: 935438 - protein, 22 aa, Mycobacterium
SLDPHGPVAFWGFASGAHASLS

SEQ ID NO: 935439 - protein, 25 aa, Mycobacterium
SLEGDGRGGGPIADVLNGGTAVVSG

SEQ ID NO: 935440 - protein, 24 aa, Mycobacterium
SLEKDFGGRIGVYALDTGSGDTVG

SEQ ID NO: 935441 - protein, 17 aa, Mycobacterium
SLEKVATGLRWAEGPVY

SEQ ID NO: 935442 - protein, 26 aa, Mycobacterium
SLEPKPGTTVAYWFSGLRTPSMAGCC

SEQ ID NO: 935443 - protein, 17 aa, Mycobacterium
SLFSIPDPFVVGRELVD

SEQ ID NO: 935444 - protein, 26 aa, Mycobacterium
SLFSRLMMLRPDWTRTVLARRVAAGG

SEQ ID NO: 935445 - protein, 28 aa, Mycobacterium
SLGGLMRATLPRAYRVGPDGSTTVNTDY

SEQ ID NO: 935446 - protein, 23 aa, Mycobacterium
SLGGYHPGFAFRTLAFDRTSRQA

SEQ ID NO: 935447 - protein, 22 aa, Mycobacterium
SLGPRGNDTFDHAKRGDCLTWP

SEQ ID NO: 935448 - protein, 24 aa, Mycobacterium
SLGTDWPAAGYFSTYKPLDSIQIG

SEQ ID NO: 935449 - protein, 18 aa, Mycobacterium
SLGVRVTDLAGRTAVFPV

SEQ ID NO: 935450 - protein, 23 aa, Mycobacterium
SLISETWIQPTFVLSDKGRDAAK

SEQ ID NO: 935451 - protein, 33 aa, Mycobacterium
SLKGKPVVLWFWAAYCPFCNGEGPHVSAVSAAN

SEQ ID NO: 935452 - protein, 21 aa, Mycobacterium
SLKMVACGGSAVPRSLMTAYD

SEQ ID NO: 935453 - protein, 17 aa, Mycobacterium
SLKNRLWECNTWLSDSS

SEQ ID NO: 935454 - protein, 22 aa, Mycobacterium
SLLAAGGLPYFLGGAPVPLLSL

SEQ ID NO: 935455 - protein, 25 aa, Mycobacterium
SLLESCYRRALKVADELGARIVAFP

SEQ ID NO: 935456 - protein, 18 aa, Mycobacterium
SLLGRPLIGNGSNATAPG

SEQ ID NO: 935457 - protein, 18 aa, Mycobacterium
SLLIAWLLTFHYRLRTRI

SEQ ID NO: 935458 - protein, 24 aa, Mycobacterium
SLLLQPGAGSGWHAHPGPEHSVVN

SEQ ID NO: 935459 - protein, 24 aa, Mycobacterium
SLLPAGNPLAGLLPGAATTAPATT

SEQ ID NO: 935460 - protein, 25 aa, Mycobacterium
SLLPHEIRPAALWRIETDHDANPVA

SEQ ID NO: 935461 - protein, 18 aa, Mycobacterium
SLLTCLTLASLTGCARSD

SEQ ID NO: 935462 - protein, 19 aa, Mycobacterium
SLLYSYSFEQNPQWSRAYS

SEQ ID NO: 935463 - protein, 20 aa, Mycobacterium
SLNDMAHWLTMVLANGEYNG

SEQ ID NO: 935464 - protein, 17 aa, Mycobacterium
SLNSLTIPVITGIADAM

SEQ ID NO: 935465 - protein, 17 aa, Mycobacterium
SLPAEPIHVVFRSDESG

SEQ ID NO: 935466 - protein, 25 aa, Mycobacterium
SLPDGRAALHLAMEPAYLDLIPANV

SEQ ID NO: 935467 - protein, 17 aa, Mycobacterium
SLPDVAQNFPVRQLIAN

SEQ ID NO: 935468 - protein, 18 aa, Mycobacterium
SLPDWPFNGPGYTVYPVF

SEQ ID NO: 935469 - protein, 22 aa, Mycobacterium
SLPEVGRLIAGISDNFAQALDN

SEQ ID NO: 935470 - protein, 34 aa, Mycobacterium
SLPKFRISWGPEEFKETLAAMGMPRAFDEKQGDF

SEQ ID NO: 935471 - protein, 25 aa, Mycobacterium
SLPLHEWNTEFSWRPIEGPSRLLDE

SEQ ID NO: 935472 - protein, 22 aa, Mycobacterium
SLPRGDLAAAIYATVEDKVETI

SEQ ID NO: 935473 - protein, 24 aa, Mycobacterium
SLPRRLADLVEVWERPVSWEGTST

SEQ ID NO: 935474 - protein, 25 aa, Mycobacterium
SLQQAFALSCNTAFVQLGMLTGSDA

SEQ ID NO: 935475 - protein, 18 aa, Mycobacterium
SLRIFKSEVKELQNEGNA

SEQ ID NO: 935476 - protein, 17 aa, Mycobacterium
SLRMEKGYRAWGTDMTA

SEQ ID NO: 935477 - protein, 17 aa, Mycobacterium
SLRRATSLAEGWVPFGI

SEQ ID NO: 935478 - protein, 22 aa, Mycobacterium
SLRRLFEAIGEFAAVACAAGDV

SEQ ID NO: 935479 - protein, 37 aa, Mycobacterium
SLRSAEPRWSAGVRWSTIDGIGARAVVCTDFPTQTLR

SEQ ID NO: 935480 - protein, 25 aa, Mycobacterium
SLSALRAGRSVLCEKPLALSRVEAK

SEQ ID NO: 935481 - protein, 24 aa, Mycobacterium
SLSDLQPGDVLTFYSDASHAGIYI

SEQ ID NO: 935482 - protein, 23 aa, Mycobacterium
SLSELQPGDVINFYGDASHTGIY

SEQ ID NO: 935483 - protein, 28 aa, Mycobacterium
SLSNFSNPVWFVCGLIGGIANTTAPETA

SEQ ID NO: 935484 - protein, 21 aa, Mycobacterium
SLSVVGCSDVRRKATDALESA

SEQ ID NO: 935485 - protein, 25 aa, Mycobacterium
SLTAYFRVREAVTLTFDVNEEDKPG

SEQ ID NO: 935486 - protein, 20 aa, Mycobacterium
SLTGLLWLAPTAHADPDPIS

SEQ ID NO: 935487 - protein, 18 aa, Mycobacterium
SLTPRGLQMLDWSGHTCI

SEQ ID NO: 935488 - protein, 25 aa, Mycobacterium
SLTRSLSLLATFPFPNETFQNFQRG

SEQ ID NO: 935489 - protein, 30 aa, Mycobacterium
SLTTWTCGRPQTYPPVVWQVSGDQIAQTNP

SEQ ID NO: 935490 - protein, 23 aa, Mycobacterium
SLTYRVSPSTGRGIVDVATDGTF

SEQ ID NO: 935491 - protein, 23 aa, Mycobacterium
SLVERLVPDFLWISTEHTAQVSL

SEQ ID NO: 935492 - protein, 18 aa, Mycobacterium
SLVGCSQAAPALNLPSLT

SEQ ID NO: 935493 - protein, 28 aa, Mycobacterium
SLVVTGLCRLLARKGIRVAPFKAQNMSN

SEQ ID NO: 935494 - protein, 18 aa, Mycobacterium
SLWLGGARVNPDRYLDFQ

SEQ ID NO: 935495 - protein, 29 aa, Mycobacterium
SMAFAYLRLPSLLFGVGRYQVTMKLQDAA

SEQ ID NO: 935496 - protein, 18 aa, Mycobacterium
SMAPNFPISHRVSWPDAA

SEQ ID NO: 935497 - protein, 24 aa, Mycobacterium
SMGKPSRPTPIGNFTALEKQRTVV

SEQ ID NO: 935498 - protein, 25 aa, Mycobacterium
SMGKPSRPTPIGSFTALSKERTVVM

SEQ ID NO: 935499 - protein, 25 aa, Mycobacterium
SMGKPSRPTPMGSFTALEKQRTVVM

SEQ ID NO: 935500 - protein, 25 aa, Mycobacterium
SMGKPSRPTPVGNFSALSKERTVVM

SEQ ID NO: 935501 - protein, 21 aa, Mycobacterium
SMGPAEKIYDPGIVLDKDKGL

SEQ ID NO: 935502 - protein, 17 aa, Mycobacterium
SMIDWARQKAAADPGDA

SEQ ID NO: 935503 - protein, 18 aa, Mycobacterium
SMINYNWQLPALNEPGSG

SEQ ID NO: 935504 - protein, 30 aa, Mycobacterium
SMKAAMPQTIWVTGCNSWYLGKDGLPELFP

SEQ ID NO: 935505 - protein, 18 aa, Mycobacterium
SMQMWLGPGRSFLIYPVS

SEQ ID NO: 935506 - protein, 25 aa, Mycobacterium
SMRPWKRPAAVLATAVLAFTAVPEV

SEQ ID NO: 935507 - protein, 18 aa, Mycobacterium
SMRRRRRVLAAIDQAAAA

SEQ ID NO: 935508 - protein, 25 aa, Mycobacterium
SMSAAAARYVAWATATAAQAEQVAT

SEQ ID NO: 935509 - protein, 25 aa, Mycobacterium
SMSMALSAAPYVVWMIETAAQCQEA

SEQ ID NO: 935510 - protein, 17 aa, Mycobacterium
SMYRYLWSNGPKECLEF

SEQ ID NO: 935511 - protein, 23 aa, Mycobacterium
SNAIEAYDGYLIPLFTPGEFEGG

SEQ ID NO: 935512 - protein, 22 aa, Mycobacterium
SNALNLPAHAKVKLAGADVGQL

SEQ ID NO: 935513 - protein, 26 aa, Mycobacterium
SNAMAGSVLRHVQTMFSDLSDVPKQN

SEQ ID NO: 935514 - protein, 25 aa, Mycobacterium
SNASNPDLFWALRGGGGGNFGVTTS

SEQ ID NO: 935515 - protein, 27 aa, Mycobacterium
SNCGGKIDPIYSYPRAGGAAITSVAVR

SEQ ID NO: 935516 - protein, 21 aa, Mycobacterium
SNDYWYLALNEARAPWNDVRV

SEQ ID NO: 935517 - protein, 21 aa, Mycobacterium
SNDYWYLALNQARAPWNDVRV

SEQ ID NO: 935518 - protein, 31 aa, Mycobacterium
SNFNARARSGQTYRVLFGVATPQGVNPSTLG

SEQ ID NO: 935519 - protein, 21 aa, Mycobacterium
SNFTASYDWLPAVLEGVLLAI

SEQ ID NO: 935520 - protein, 17 aa, Mycobacterium
SNGECKEIVMVQDQDGH

SEQ ID NO: 935521 - protein, 22 aa, Mycobacterium
SNGNPPLVHSVGLGTVNGVALG

SEQ ID NO: 935522 - protein, 21 aa, Mycobacterium
SNGVKCLNYLGLEQQTARLGG

SEQ ID NO: 935523 - protein, 22 aa, Mycobacterium
SNHPELQWKVGQVDNANGILST

SEQ ID NO: 935524 - protein, 17 aa, Mycobacterium
SNHVLPTAGCARHSSGL

SEQ ID NO: 935525 - protein, 17 aa, Mycobacterium
SNIAGMVVFIDPGHNGA

SEQ ID NO: 935526 - protein, 18 aa, Mycobacterium
SNIAGMVVFIDPGHNGSN

SEQ ID NO: 935527 - protein, 21 aa, Mycobacterium
SNINVAARGQGAADLGTVATV

SEQ ID NO: 935528 - protein, 22 aa, Mycobacterium
SNKRIACGVIAAASATTTSSTT

SEQ ID NO: 935529 - protein, 26 aa, Mycobacterium
SNLALDRFADFPTLPLDPSAMVAQVG

SEQ ID NO: 935530 - protein, 22 aa, Mycobacterium
SNLKVPYLLKSLPWSQFLPLQD

SEQ ID NO: 935531 - protein, 17 aa, Mycobacterium
SNLLAMLNSTAGFFFTH

SEQ ID NO: 935532 - protein, 18 aa, Mycobacterium
SNLMKFGPLLGELLARAV

SEQ ID NO: 935533 - protein, 17 aa, Mycobacterium
SNLTGICDRSIQSNIDA

SEQ ID NO: 935534 - protein, 17 aa, Mycobacterium
SNLTGLCDEELQASIDA

SEQ ID NO: 935535 - protein, 19 aa, Mycobacterium
SNPASLGFFAPKPLTVDKV

SEQ ID NO: 935536 - protein, 19 aa, Mycobacterium
SNPGAGLDPYACRFGAGPA

SEQ ID NO: 935537 - protein, 19 aa, Mycobacterium
SNPTPGTWTPPSTSTSTST

SEQ ID NO: 935538 - protein, 26 aa, Mycobacterium
SNQSVVFRPAFEFIESGWRELGVALQ

SEQ ID NO: 935539 - protein, 24 aa, Mycobacterium
SNRTVPLPPWLAKKLAAYLANTHE

SEQ ID NO: 935540 - protein, 20 aa, Mycobacterium
SNRVPVIVLLGSPRSEASAA

SEQ ID NO: 935541 - protein, 25 aa, Mycobacterium
SNSVTWWTGPGCHLVTYPIAGGSLL

SEQ ID NO: 935542 - protein, 26 aa, Mycobacterium
SNTIPDLRLPFGIAPTSQGARGSDII

SEQ ID NO: 935543 - protein, 18 aa, Mycobacterium
SNTPLDMCRVLAVHNPNR

SEQ ID NO: 935544 - protein, 26 aa, Mycobacterium
SNVFAVGDVCRWLNPRYGRATRVEHW

SEQ ID NO: 935545 - protein, 17 aa, Mycobacterium
SNVHLANAFDFAADTGG

SEQ ID NO: 935546 - protein, 21 aa, Mycobacterium
SNVPPAAIDRLMFSQREAERV

SEQ ID NO: 935547 - protein, 26 aa, Mycobacterium
SPAALRIVLRHELFHYAARSVTAYDA

SEQ ID NO: 935548 - protein, 20 aa, Mycobacterium
SPAALTGRFDFALVALKAPY

SEQ ID NO: 935549 - protein, 18 aa, Mycobacterium
SPAAPLVIDVTIAHGQVT

SEQ ID NO: 935550 - protein, 27 aa, Mycobacterium
SPAAVRRVVPYPGSFWPVTGLNSPTVN

SEQ ID NO: 935551 - protein, 25 aa, Mycobacterium
SPACGKAGCSTYKWETFLTQELPAY

SEQ ID NO: 935552 - protein, 25 aa, Mycobacterium
SPACGKAGCTTYKWETFLTSELPQW

SEQ ID NO: 935553 - protein, 25 aa, Mycobacterium
SPACGKAGCTTYKWETFLTSELPQY

SEQ ID NO: 935554 - protein, 29 aa, Mycobacterium
SPADLDAFLNLLSERGVDVLVYNTQTEGS

SEQ ID NO: 935555 - protein, 17 aa, Mycobacterium
SPADVQKAMAFAAAHNL

SEQ ID NO: 935556 - protein, 33 aa, Mycobacterium
SPAGDRDLLGWGNSVWDPLPWGTYGFSSLRMGR

SEQ ID NO: 935557 - protein, 24 aa, Mycobacterium
SPAGEVLPGYGWIFPLGNGEVNIG

SEQ ID NO: 935558 - protein, 21 aa, Mycobacterium
SPALWRHLTQALGEVKEGKGD

SEQ ID NO: 935559 - protein, 19 aa, Mycobacterium
SPATIPWVVTEETAHAVSV

SEQ ID NO: 935560 - protein, 22 aa, Mycobacterium
SPCQQRTLILSAFPAEADAVLA

SEQ ID NO: 935561 - protein, 18 aa, Mycobacterium
SPDGHKIAYIAGKPAQVF

SEQ ID NO: 935562 - protein, 29 aa, Mycobacterium
SPEAKAAWLPPLACGSLRATTAVWNARDA

SEQ ID NO: 935563 - protein, 28 aa, Mycobacterium
SPEDFWRSAGLPEYRFPDPNGTRFPNGA

SEQ ID NO: 935564 - protein, 23 aa, Mycobacterium
SPEEGWTLVSWAGQAVSADPSLA

SEQ ID NO: 935565 - protein, 20 aa, Mycobacterium
SPEEVPGVVMARKLAEQTGK

SEQ ID NO: 935566 - protein, 25 aa, Mycobacterium
SPEGDVLPGYGWIFPLGGGQINIGV

SEQ ID NO: 935567 - protein, 25 aa, Mycobacterium
SPEGEGWKLSKRTSDLLLKTGTSLA

SEQ ID NO: 935568 - protein, 24 aa, Mycobacterium
SPEGYKITAQYAVRVTWSGVYVHS

SEQ ID NO: 935569 - protein, 29 aa, Mycobacterium
SPEGYKITASYAVRVTWSGVYVHSAPWSV

SEQ ID NO: 935570 - protein, 18 aa, Mycobacterium
SPFLRSNIIGTYTLLEAV

SEQ ID NO: 935571 - protein, 33 aa, Mycobacterium
SPGPRAISPIDWNLPAAERYHRTATYPVFLNRP

SEQ ID NO: 935572 - protein, 40 aa, Mycobacterium
SPGREVREPPALDMASMSTAWRASTGIGTRRLPHVMDSSV

SEQ ID NO: 935573 - protein, 18 aa, Mycobacterium
SPGTFKLVGDTFSEERYG

SEQ ID NO: 935574 - protein, 17 aa, Mycobacterium
SPGTYPFVPERWTPDKV

SEQ ID NO: 935575 - protein, 18 aa, Mycobacterium
SPGWDWAEISGSWYPDGP

SEQ ID NO: 935576 - protein, 19 aa, Mycobacterium
SPGWDWAEISGSWYPDGPP

SEQ ID NO: 935577 - protein, 27 aa, Mycobacterium
SPHSERLFCVPATIDLAGAEIELVSMV

SEQ ID NO: 935578 - protein, 25 aa, Mycobacterium
SPLGTLEQRLLQAINAPTQTLLGRP

SEQ ID NO: 935579 - protein, 18 aa, Mycobacterium
SPLIPLTGVYVFEVPTDS

SEQ ID NO: 935580 - protein, 17 aa, Mycobacterium
SPLRLRGPVTRADGGKT

SEQ ID NO: 935581 - protein, 25 aa, Mycobacterium
SPLRTGGVRGLRIGLSVHLGDFPVA

SEQ ID NO: 935582 - protein, 17 aa, Mycobacterium
SPLTGYEIHHGRLARCA

SEQ ID NO: 935583 - protein, 19 aa, Mycobacterium
SPLVLACSAATAFAVAPLA

SEQ ID NO: 935584 - protein, 17 aa, Mycobacterium
SPLYAIAAGAAVGALLT

SEQ ID NO: 935585 - protein, 25 aa, Mycobacterium
SPNAAKLYIHYMLTEEGFALQLADG

SEQ ID NO: 935586 - protein, 25 aa, Mycobacterium
SPNIDLPVPDGWQLLPEGSGAPYGG

SEQ ID NO: 935587 - protein, 23 aa, Mycobacterium
SPPAAFAAKNGWVVAALQGALSA

SEQ ID NO: 935588 - protein, 17 aa, Mycobacterium
SPPALRINGVVPNVAPF

SEQ ID NO: 935589 - protein, 23 aa, Mycobacterium
SPPAWWRPAGALFDQFLGAAETD

SEQ ID NO: 935590 - protein, 20 aa, Mycobacterium
SPPPRRAQMAAQVQAMPGAA

SEQ ID NO: 935591 - protein, 21 aa, Mycobacterium
SPPQVKSVGLGNVNGVTLGYT

SEQ ID NO: 935592 - protein, 25 aa, Mycobacterium
SPQLAASLHYLRGTNIGGIPTDQQY

SEQ ID NO: 935593 - protein, 18 aa, Mycobacterium
SPQSVMWVADLCDTAGAA

SEQ ID NO: 935594 - protein, 25 aa, Mycobacterium
SPRGLNYAVPPDWTVNSCTSLVGWE

SEQ ID NO: 935595 - protein, 19 aa, Mycobacterium
SPRIESLALVVDGNALSVS

SEQ ID NO: 935596 - protein, 25 aa, Mycobacterium
SPRPRTEKWIALQVGECVADLPPAD

SEQ ID NO: 935597 - protein, 20 aa, Mycobacterium
SPRRRWGIRRHIQIAPWSDC

SEQ ID NO: 935598 - protein, 19 aa, Mycobacterium
SPTAMPVGALGADEISSAV

SEQ ID NO: 935599 - protein, 28 aa, Mycobacterium
SPTFRVRDLIRLDARAAAPLAAVSVPGT

SEQ ID NO: 935600 - protein, 24 aa, Mycobacterium
SPTIGRTIAYAWLPAESSIGDTVT

SEQ ID NO: 935601 - protein, 23 aa, Mycobacterium
SPTQELPGLPALSQLSPIIQQAA

SEQ ID NO: 935602 - protein, 26 aa, Mycobacterium
SPVRANGMAPYLVRVLGVPSAPVQAL

SEQ ID NO: 935603 - protein, 26 aa, Mycobacterium
SPWRAPEYLQTLPLRRLTRPAEVARS

SEQ ID NO: 935604 - protein, 18 aa, Mycobacterium
SPYMAAHSQALWDHPGWF

SEQ ID NO: 935605 - protein, 17 aa, Mycobacterium
SQACSIPVASRCEHALR

SEQ ID NO: 935606 - protein, 24 aa, Mycobacterium
SQADIATLLAHYGIDAVLTDLDNA

SEQ ID NO: 935607 - protein, 19 aa, Mycobacterium
SQALARGGTPVSLSELQPG

SEQ ID NO: 935608 - protein, 25 aa, Mycobacterium
SQARLPARYHVPLPIPAQLAPVATD

SEQ ID NO: 935609 - protein, 28 aa, Mycobacterium
SQAVASLMRAAGRPGAALVMDDATATLS

SEQ ID NO: 935610 - protein, 27 aa, Mycobacterium
SQDGGTFVISWEFHLADGRWTHSGTSQ

SEQ ID NO: 935611 - protein, 24 aa, Mycobacterium
SQGLWPTMIGFAMKDAGGYNSADM

SEQ ID NO: 935612 - protein, 22 aa, Mycobacterium
SQGPPPEQWHWTPPEPPEGAAP

SEQ ID NO: 935613 - protein, 18 aa, Mycobacterium
SQHLCGSAPMGVDADPTA

SEQ ID NO: 935614 - protein, 18 aa, Mycobacterium
SQHLCGTAPMGVDGDPRA

SEQ ID NO: 935615 - protein, 20 aa, Mycobacterium
SQIRSARDLIGKKVGMNTLG

SEQ ID NO: 935616 - protein, 17 aa, Mycobacterium
SQISDLLLLMGGAATEL

SEQ ID NO: 935617 - protein, 18 aa, Mycobacterium
SQKLPAWQPTNASMADFG

SEQ ID NO: 935618 - protein, 24 aa, Mycobacterium
SQLNIPVLPAGLVYTQAAASNHTV

SEQ ID NO: 935619 - protein, 24 aa, Mycobacterium
SQLPPELVKLLPPVADIGAPFNAT

SEQ ID NO: 935620 - protein, 27 aa, Mycobacterium
SQLVVPRWVLLSGVGWHTFGASGTIAR

SEQ ID NO: 935621 - protein, 18 aa, Mycobacterium
SQPWKSWERIAHDDTERG

SEQ ID NO: 935622 - protein, 18 aa, Mycobacterium
SQRGQVIPVEITVYEDRS

SEQ ID NO: 935623 - protein, 23 aa, Mycobacterium
SQSCPDIDVVFARGTAESPGVGG

SEQ ID NO: 935624 - protein, 18 aa, Mycobacterium
SQTGGQLICLVRGDNADQ

SEQ ID NO: 935625 - protein, 19 aa, Mycobacterium
SQTPAGCSLMEWENNDNGR

SEQ ID NO: 935626 - protein, 21 aa, Mycobacterium
SQVAIPFWWSIHNVVLQQLLR

SEQ ID NO: 935627 - protein, 20 aa, Mycobacterium
SQVCSPCLSERGSWRIDWRL

SEQ ID NO: 935628 - protein, 20 aa, Mycobacterium
SQVRGVYAYSPRDRIAETTV

SEQ ID NO: 935629 - protein, 25 aa, Mycobacterium
SQVRSGDAIERWAHNLNTLAAQTAK

SEQ ID NO: 935630 - protein, 22 aa, Mycobacterium
SQWPATCDSLGLPATSGEETSR

SEQ ID NO: 935631 - protein, 21 aa, Mycobacterium
SRAAEVLGFRAAVDPADGLRE

SEQ ID NO: 935632 - protein, 18 aa, Mycobacterium
SRAASGWSAQYADAANSS

SEQ ID NO: 935633 - protein, 21 aa, Mycobacterium
SRAASPLALLAAAVLLAGCGH

SEQ ID NO: 935634 - protein, 21 aa, Mycobacterium
SRADLDAGVFEHRCPVGEEPL

SEQ ID NO: 935635 - protein, 25 aa, Mycobacterium
SRAHRGVLFLDEFPEINSGALEALR

SEQ ID NO: 935636 - protein, 19 aa, Mycobacterium
SRAIALLIGPLVLGKLSTL

SEQ ID NO: 935637 - protein, 21 aa, Mycobacterium
SRALLAAQIIWTLARADIRGP

SEQ ID NO: 935638 - protein, 21 aa, Mycobacterium
SRCTFKTWANLLAGGAPTGFP

SEQ ID NO: 935639 - protein, 20 aa, Mycobacterium
SRDLLKAVTPRSGQVRQQAG

SEQ ID NO: 935640 - protein, 23 aa, Mycobacterium
SRDNTLWASWAFIGPRHRAYFGG

SEQ ID NO: 935641 - protein, 18 aa, Mycobacterium
SREIEVLEFVPAEEVDPM

SEQ ID NO: 935642 - protein, 19 aa, Mycobacterium
SREIEVLEFVPANEVDPMM

SEQ ID NO: 935643 - protein, 20 aa, Mycobacterium
SRERLRSGNLQELIDTKSVV

SEQ ID NO: 935644 - protein, 19 aa, Mycobacterium
SRESVRLALIAALQHLSPR

SEQ ID NO: 935645 - protein, 24 aa, Mycobacterium
SREYLARGTFFASLEGVEDPHGLL

SEQ ID NO: 935646 - protein, 17 aa, Mycobacterium
SRFLPDKAIDLVDEAAS

SEQ ID NO: 935647 - protein, 20 aa, Mycobacterium
SRFSSTALRAQQTVAVTPAS

SEQ ID NO: 935648 - protein, 25 aa, Mycobacterium
SRGAPPQWWLATPISLNTAGINAPG

SEQ ID NO: 935649 - protein, 19 aa, Mycobacterium
SRGLGGDLRRPWSDPEDLR

SEQ ID NO: 935650 - protein, 20 aa, Mycobacterium
SRGPAHISYFDPAPLFSVVD

SEQ ID NO: 935651 - protein, 19 aa, Mycobacterium
SRGPYELAGELALMRNHRT

SEQ ID NO: 935652 - protein, 17 aa, Mycobacterium
SRGRPGPLAGPDLADPA

SEQ ID NO: 935653 - protein, 17 aa, Mycobacterium
SRGRPGPLSGPDLADPA

SEQ ID NO: 935654 - protein, 22 aa, Mycobacterium
SRGRPGPLSGPDLRDPARTLSL

SEQ ID NO: 935655 - protein, 17 aa, Mycobacterium
SRGRVCLLGDAAWCASP

SEQ ID NO: 935656 - protein, 17 aa, Mycobacterium
SRHIYALFGERDRVPMA

SEQ ID NO: 935657 - protein, 25 aa, Mycobacterium
SRHWPQGRLSKAYAAYETPFWRADG

SEQ ID NO: 935658 - protein, 21 aa, Mycobacterium
SRIAICKVSGGGYEYRGVRLR

SEQ ID NO: 935659 - protein, 23 aa, Mycobacterium
SRIPTARCAKVKVPVNYDKLMGA

SEQ ID NO: 935660 - protein, 19 aa, Mycobacterium
SRLAFEFVPDTAVFNDERW

SEQ ID NO: 935661 - protein, 17 aa, Mycobacterium
SRLARTIGRPALTAVRV

SEQ ID NO: 935662 - protein, 20 aa, Mycobacterium
SRLDASFLTGTRFEGNLTEL

SEQ ID NO: 935663 - protein, 20 aa, Mycobacterium
SRLDASFLTGTRWEGNLTEL

SEQ ID NO: 935664 - protein, 17 aa, Mycobacterium
SRLEPILLADTRRRGGE

SEQ ID NO: 935665 - protein, 20 aa, Mycobacterium
SRLGWDQSAKLCVQYLAPII

SEQ ID NO: 935666 - protein, 19 aa, Mycobacterium
SRLLPAIAIAAESISAMEP

SEQ ID NO: 935667 - protein, 17 aa, Mycobacterium
SRMRPDVVTAFMDQFGD

SEQ ID NO: 935668 - protein, 21 aa, Mycobacterium
SRNGDAVSCKTTWKTAPAEVD

SEQ ID NO: 935669 - protein, 19 aa, Mycobacterium
SRNQFLAGRMALFQSGTYN

SEQ ID NO: 935670 - protein, 18 aa, Mycobacterium
SRPALWCNSDADNDRLRA

SEQ ID NO: 935671 - protein, 20 aa, Mycobacterium
SRPAVVVDHIVPIAALMYVP

SEQ ID NO: 935672 - protein, 25 aa, Mycobacterium
SRPIIERPAWLPGSVTLIPTAGVSL

SEQ ID NO: 935673 - protein, 17 aa, Mycobacterium
SRPPAFAGTIWVQQGAQ

SEQ ID NO: 935674 - protein, 18 aa, Mycobacterium
SRPSIWCNSDADNDRLRT

SEQ ID NO: 935675 - protein, 21 aa, Mycobacterium
SRQLLAAQLIWTLSRAGVAGP

SEQ ID NO: 935676 - protein, 18 aa, Mycobacterium
SRRAFGRVAAGAGMLGSV

SEQ ID NO: 935677 - protein, 21 aa, Mycobacterium
SRRAILAAAFDLVAAEGQDFT

SEQ ID NO: 935678 - protein, 17 aa, Mycobacterium
SRRGGDGLEVLARTELS

SEQ ID NO: 935679 - protein, 20 aa, Mycobacterium
SRRISVKGLEQGAVDAIAVI

SEQ ID NO: 935680 - protein, 19 aa, Mycobacterium
SRRNLVLDTMIEYVPDRAA

SEQ ID NO: 935681 - protein, 27 aa, Mycobacterium
SRRRARLLALRLRRLRYRQRRKMRGDQ

SEQ ID NO: 935682 - protein, 18 aa, Mycobacterium
SRRRDVGELVALLEGAHD

SEQ ID NO: 935683 - protein, 20 aa, Mycobacterium
SRRRFLYSAAGLTLLGVTAT

SEQ ID NO: 935684 - protein, 19 aa, Mycobacterium
SRRRVLVGAAALAALSVTA

SEQ ID NO: 935685 - protein, 19 aa, Mycobacterium
SRSDGCAVADYPPALPDNA

SEQ ID NO: 935686 - protein, 20 aa, Mycobacterium
SRSESDLVYGAQRARFGQAL

SEQ ID NO: 935687 - protein, 21 aa, Mycobacterium
SRSGLLPRAHRAFPAAPPPTF

SEQ ID NO: 935688 - protein, 17 aa, Mycobacterium
SRSSWLIGPTAELPVGK

SEQ ID NO: 935689 - protein, 22 aa, Mycobacterium
SRTAILPVFAQEGIRVRTGKPG

SEQ ID NO: 935690 - protein, 18 aa, Mycobacterium
SRTRFAFYTRYLTDVPSR

SEQ ID NO: 935691 - protein, 24 aa, Mycobacterium
SRTRTPVEFDRVLGMLDKLSGSLR

SEQ ID NO: 935692 - protein, 17 aa, Mycobacterium
SRVAFLLEDTTPLAVLT

SEQ ID NO: 935693 - protein, 24 aa, Mycobacterium
SRVHWRSREYFKAGTKVEVKANLY

SEQ ID NO: 935694 - protein, 18 aa, Mycobacterium
SRVIDIVQENGFAVDERD

SEQ ID NO: 935695 - protein, 23 aa, Mycobacterium
SRVPDAFAGVPCVVSGRYRGPVT

SEQ ID NO: 935696 - protein, 18 aa, Mycobacterium
SRVRVRDVFVGRVRKIEL

SEQ ID NO: 935697 - protein, 21 aa, Mycobacterium
SRWDMDPTLLVSAEVTGQSPF

SEQ ID NO: 935698 - protein, 17 aa, Mycobacterium
SRWEMDPTLLVSAEETS

SEQ ID NO: 935699 - protein, 20 aa, Mycobacterium
SRYGCRALEATPVATAVPGP

SEQ ID NO: 935700 - protein, 17 aa, Mycobacterium
SSAAAMRAAVAAGAGPA

SEQ ID NO: 935701 - protein, 19 aa, Mycobacterium
SSAIAALLAGHAQAYQRLG

SEQ ID NO: 935702 - protein, 21 aa, Mycobacterium
SSAKFNRKIIELNLIGALSVS

SEQ ID NO: 935703 - protein, 25 aa, Mycobacterium
SSALKLCGVEGCKVLSSFVRCGAVA

SEQ ID NO: 935704 - protein, 18 aa, Mycobacterium
SSALPEVQRFIGETRDQT

SEQ ID NO: 935705 - protein, 20 aa, Mycobacterium
SSAPDMLRFVEANISPEGLP

SEQ ID NO: 935706 - protein, 23 aa, Mycobacterium
SSARKEQAWEFVKFATGPAGQAL

SEQ ID NO: 935707 - protein, 19 aa, Mycobacterium
SSARPVIEQALADNGVETR

SEQ ID NO: 935708 - protein, 33 aa, Mycobacterium
SSAVSLRLGYLPRITHASALVALHDGFFAKQLG

SEQ ID NO: 935709 - protein, 19 aa, Mycobacterium
SSCNTTFAELASRMPPRGL

SEQ ID NO: 935710 - protein, 17 aa, Mycobacterium
SSDAASISAQFLGTPYG

SEQ ID NO: 935711 - protein, 31 aa, Mycobacterium
SSDALGAPGMEVWKFTALRPGTTTIGTSYTS

SEQ ID NO: 935712 - protein, 18 aa, Mycobacterium
SSDFPRTVIEGIRDASSH

SEQ ID NO: 935713 - protein, 26 aa, Mycobacterium
SSDKPDAAWKFISWMTDKDYIHLVGE

SEQ ID NO: 935714 - protein, 17 aa, Mycobacterium
SSDLMARHVCDDLGAAG

SEQ ID NO: 935715 - protein, 28 aa, Mycobacterium
SSDLRECLRLSAKTGIYGARYVTADDVA

SEQ ID NO: 935716 - protein, 24 aa, Mycobacterium
SSDRALAAMLRRSAELAAEADMNP

SEQ ID NO: 935717 - protein, 17 aa, Mycobacterium
SSDRPITAITWRDSLGH

SEQ ID NO: 935718 - protein, 22 aa, Mycobacterium
SSFAFLNFYSGGAITIDELSVR

SEQ ID NO: 935719 - protein, 18 aa, Mycobacterium
SSFRWWPDRTLSRRGVEV

SEQ ID NO: 935720 - protein, 17 aa, Mycobacterium
SSFYRPTQDGAYPIVLV

SEQ ID NO: 935721 - protein, 19 aa, Mycobacterium
SSFYSDWYKPACGKAGCTT

SEQ ID NO: 935722 - protein, 19 aa, Mycobacterium
SSGAHLDDWTFNDGDEKLM

SEQ ID NO: 935723 - protein, 25 aa, Mycobacterium
SSGDRLDPSLARRFMEAYGDVLYNL

SEQ ID NO: 935724 - protein, 18 aa, Mycobacterium
SSGGQWDTTLPMIASANV

SEQ ID NO: 935725 - protein, 22 aa, Mycobacterium
SSGKVILMLDCTEAAAQQAQDT

SEQ ID NO: 935726 - protein, 23 aa, Mycobacterium
SSGPFFKAYVVNLLPGQFVQPFI

SEQ ID NO: 935727 - protein, 27 aa, Mycobacterium
SSGRCRCPRRGKGRCRRTCPHRRCRVW

SEQ ID NO: 935728 - protein, 17 aa, Mycobacterium
SSGYGRFDAMVDAVRIA

SEQ ID NO: 935729 - protein, 19 aa, Mycobacterium
SSHVFTGKELAGAIAYAST

SEQ ID NO: 935730 - protein, 29 aa, Mycobacterium
SSKAAHPNCMYKWMDWIISPEVNAQVAEY

SEQ ID NO: 935731 - protein, 20 aa, Mycobacterium
SSKLCAQYLGPGLDTVNFNY

SEQ ID NO: 935732 - protein, 29 aa, Mycobacterium
SSLAGKKAVLWFWAPWCPTCQKEAPDLQK

SEQ ID NO: 935733 - protein, 36 aa, Mycobacterium
SSLAGKPAVLWFWTPWCPFCNAEAPSVGQVAAANPE

SEQ ID NO: 935734 - protein, 29 aa, Mycobacterium
SSLDQGGPCARTVLDTALLHQVIAGHDPR

SEQ ID NO: 935735 - protein, 26 aa, Mycobacterium
SSLEAFLKRRIRSHGLVTASIAAAVQ

SEQ ID NO: 935736 - protein, 19 aa, Mycobacterium
SSLLTAFVVFTTLTTKLSK

SEQ ID NO: 935737 - protein, 20 aa, Mycobacterium
SSLPPRFGIDSEHFAYDCSR

SEQ ID NO: 935738 - protein, 22 aa, Mycobacterium
SSLPRRAAASTVLIVPVVSTGD

SEQ ID NO: 935739 - protein, 25 aa, Mycobacterium
SSLWSRLGAMSRLWRRSTGVPAPVV

SEQ ID NO: 935740 - protein, 17 aa, Mycobacterium
SSPDQALMFHRGAFVGT

SEQ ID NO: 935741 - protein, 22 aa, Mycobacterium
SSPMCYPEGDFIVGDRDVLLGV

SEQ ID NO: 935742 - protein, 30 aa, Mycobacterium
SSPPVHNKLRFGFWGAEELGLIGSRNYVES

SEQ ID NO: 935743 - protein, 30 aa, Mycobacterium
SSPSGLCSYPLRKCGDGDLYGGTEPARTWY

SEQ ID NO: 935744 - protein, 19 aa, Mycobacterium
SSPSNFSRWFRGHRAMSPR

SEQ ID NO: 935745 - protein, 19 aa, Mycobacterium
SSQRFSLSTGEGLNNVLAG

SEQ ID NO: 935746 - protein, 23 aa, Mycobacterium
SSSDLRVGQPVVAIGSPLGLSGT

SEQ ID NO: 935747 - protein, 18 aa, Mycobacterium
SSSLNVLVAAAPTIPTPQ

SEQ ID NO: 935748 - protein, 21 aa, Mycobacterium
SSSPGHRWAWQTKSWSHGDRE

SEQ ID NO: 935749 - protein, 17 aa, Mycobacterium
SSTAFLYTQPDAVLTGS

SEQ ID NO: 935750 - protein, 24 aa, Mycobacterium
SSTDLPGFLHGIAVGPDGTAYIGT

SEQ ID NO: 935751 - protein, 20 aa, Mycobacterium
SSTFWGVTALVLVAVLALTA

SEQ ID NO: 935752 - protein, 18 aa, Mycobacterium
SSVGALSVPVGWTTAAPA

SEQ ID NO: 935753 - protein, 24 aa, Mycobacterium
SSVNDMTRWMAMVLAEGRHDGNAL

SEQ ID NO: 935754 - protein, 25 aa, Mycobacterium
SSVNLKTTWTGAGGVKGFFEKTFAP

SEQ ID NO: 935755 - protein, 17 aa, Mycobacterium
STAKFINYYSWGAITVE

SEQ ID NO: 935756 - protein, 22 aa, Mycobacterium
STANYTAVVTMRIRSDVEIPKR

SEQ ID NO: 935757 - protein, 34 aa, Mycobacterium
STAQFPRPAVRPGYSALGGRQWAAAGLTPLRPWR

SEQ ID NO: 935758 - protein, 23 aa, Mycobacterium
STARGEQSFTFWAARLDAADRHD

SEQ ID NO: 935759 - protein, 23 aa, Mycobacterium
STAVSSRFPGAITDLQLSRDGTR

SEQ ID NO: 935760 - protein, 17 aa, Mycobacterium
STDGFGAYAAFVPDKRI

SEQ ID NO: 935761 - protein, 17 aa, Mycobacterium
STDPRVQLVSNEEELLW

SEQ ID NO: 935762 - protein, 22 aa, Mycobacterium
STEGAISYVEWSFAREQHLDMA

SEQ ID NO: 935763 - protein, 24 aa, Mycobacterium
STEHCAPVITGARLRAGKTNSGKG

SEQ ID NO: 935764 - protein, 29 aa, Mycobacterium
STFCAGGKCPDVLMAWELSYAELADRGVF

SEQ ID NO: 935765 - protein, 18 aa, Mycobacterium
STFPLKRATLELMTSPAQ

SEQ ID NO: 935766 - protein, 19 aa, Mycobacterium
STGDEDLLAWSTRDLNTLF

SEQ ID NO: 935767 - protein, 26 aa, Mycobacterium
STGKELYFNLSLWSAYNVMLMRTVLP

SEQ ID NO: 935768 - protein, 30 aa, Mycobacterium
STGQRATMAISWRAIWRQIKSDIDRVGHAD

SEQ ID NO: 935769 - protein, 25 aa, Mycobacterium
STGVGVDWSAVFAGSGGRQVGLPTY

SEQ ID NO: 935770 - protein, 25 aa, Mycobacterium
STHAGRIPRVYGRQASEYVIRRGMS

SEQ ID NO: 935771 - protein, 20 aa, Mycobacterium
STHVGRYMGIPDLLIEAPTA

SEQ ID NO: 935772 - protein, 22 aa, Mycobacterium
STIAGMTVGSWLGPAAASMSAA

SEQ ID NO: 935773 - protein, 17 aa, Mycobacterium
STIKTLLALVVLDEVPL

SEQ ID NO: 935774 - protein, 17 aa, Mycobacterium
STIKVLLALVALDEVPM

SEQ ID NO: 935775 - protein, 17 aa, Mycobacterium
STLAPPMGRGWEAVVGN

SEQ ID NO: 935776 - protein, 20 aa, Mycobacterium
STLDDLRIWVPALATGVLLK

SEQ ID NO: 935777 - protein, 18 aa, Mycobacterium
STLDELRIFVSQWNNADP

SEQ ID NO: 935778 - protein, 19 aa, Mycobacterium
STLDFTVGRFQVVKAEASS

SEQ ID NO: 935779 - protein, 23 aa, Mycobacterium
STLDRLSIYVSQWNTDSRDHAPY

SEQ ID NO: 935780 - protein, 17 aa, Mycobacterium
STLGSLVNTAADNLRGQ

SEQ ID NO: 935781 - protein, 25 aa, Mycobacterium
STLLRARRGFGFRLAVSSGQELVTD

SEQ ID NO: 935782 - protein, 18 aa, Mycobacterium
STLSRFIPAVSAALLTAG

SEQ ID NO: 935783 - protein, 19 aa, Mycobacterium
STMDLLVRFFGDKKILLLL

SEQ ID NO: 935784 - protein, 19 aa, Mycobacterium
STMDLLVRFLGERKALLLL

SEQ ID NO: 935785 - protein, 18 aa, Mycobacterium
STMLCDRLTIGGHVISRT

SEQ ID NO: 935786 - protein, 28 aa, Mycobacterium
STNGGYPDGINWSTVYAAADRPLAGLGG

SEQ ID NO: 935787 - protein, 24 aa, Mycobacterium
STPGFARRLIALAVAGAAAGCLSG

SEQ ID NO: 935788 - protein, 24 aa, Mycobacterium
STPGFRAAPAAAVYAWSFGPGLWK

SEQ ID NO: 935789 - protein, 24 aa, Mycobacterium
STPPLGWNSWNVFGCNIDEQRIER

SEQ ID NO: 935790 - protein, 21 aa, Mycobacterium
STQCRLPITLSQAVGLAQAAQ

SEQ ID NO: 935791 - protein, 25 aa, Mycobacterium
STQYPGGIYAPFLHPWSTGKELYFN

SEQ ID NO: 935792 - protein, 25 aa, Mycobacterium
STRDDYWKRWSIRDRYQNVTVPVLH

SEQ ID NO: 935793 - protein, 23 aa, Mycobacterium
STRDLMAIMARVTWGAEPGDVSM

SEQ ID NO: 935794 - protein, 22 aa, Mycobacterium
STRLHRAWPRYDTMRTELAVGQ

SEQ ID NO: 935795 - protein, 27 aa, Mycobacterium
STRYISPRSATGFFRYGPGFVETPDGF

SEQ ID NO: 935796 - protein, 26 aa, Mycobacterium
STSPRKEQAWEFVKFATGPVGQALIG

SEQ ID NO: 935797 - protein, 21 aa, Mycobacterium
STSSQRWPACANRQDTVPADG

SEQ ID NO: 935798 - protein, 25 aa, Mycobacterium
STSSRFADFLARPNHAVNHIKVGDR

SEQ ID NO: 935799 - protein, 24 aa, Mycobacterium
STSSRFADFLARPNHAVNHVKVAD

SEQ ID NO: 935800 - protein, 25 aa, Mycobacterium
STSSRFADFLARPNHAVTHIKVADK

SEQ ID NO: 935801 - protein, 19 aa, Mycobacterium
STTIWARRVLAGAPFDDVD

SEQ ID NO: 935802 - protein, 19 aa, Mycobacterium
STVALSWPTVQQQIRNDIA

SEQ ID NO: 935803 - protein, 27 aa, Mycobacterium
STVARFAAALDRRGSGTVLTGRSGSAN

SEQ ID NO: 935804 - protein, 20 aa, Mycobacterium
STVARWPRRRSLRFESSPHG

SEQ ID NO: 935805 - protein, 22 aa, Mycobacterium
STVLPWTCEQIVLPRLQAASGL

SEQ ID NO: 935806 - protein, 20 aa, Mycobacterium
STWTMPALRGEVLERAVNSV

SEQ ID NO: 935807 - protein, 24 aa, Mycobacterium
STWYFGAGELDVWEVWARVAEQLG

SEQ ID NO: 935808 - protein, 24 aa, Mycobacterium
STYVTGWVKRGPVGLIGHTKSDAA

SEQ ID NO: 935809 - protein, 23 aa, Mycobacterium
SVADIEALITLASREFTPVDIYV

SEQ ID NO: 935810 - protein, 25 aa, Mycobacterium
SVAGTAAAFWLGRHGHSVTVVERHT

SEQ ID NO: 935811 - protein, 19 aa, Mycobacterium
SVANLRFEAEYVLVDVDAA

SEQ ID NO: 935812 - protein, 30 aa, Mycobacterium
SVAPGATAFPWRRHGALVQWYVENAGSPAA

SEQ ID NO: 935813 - protein, 21 aa, Mycobacterium
SVARLVGAPPGYIGYDQGGQL

SEQ ID NO: 935814 - protein, 21 aa, Mycobacterium
SVARLVGAPPGYVGYDQGGQL

SEQ ID NO: 935815 - protein, 17 aa, Mycobacterium
SVASGYAPRAIVAPIVG

SEQ ID NO: 935816 - protein, 25 aa, Mycobacterium
SVATDSRFRFLRVYPNPAVYAPVTG

SEQ ID NO: 935817 - protein, 20 aa, Mycobacterium
SVAVPTLWGMGSSSRDEIVE

SEQ ID NO: 935818 - protein, 18 aa, Mycobacterium
SVCARVAGHMSYRELVDQ

SEQ ID NO: 935819 - protein, 23 aa, Mycobacterium
SVDKHRFVAAYGRQGRLVGAVTV

SEQ ID NO: 935820 - protein, 18 aa, Mycobacterium
SVETCPNTKIVLGGYSQG

SEQ ID NO: 935821 - protein, 20 aa, Mycobacterium
SVEVGNGWFQRVVLKNPSGK

SEQ ID NO: 935822 - protein, 22 aa, Mycobacterium
SVFQRPAALFRYLISQGEPNAD

SEQ ID NO: 935823 - protein, 18 aa, Mycobacterium
SVFTEPFQAYAVDLPVCN

SEQ ID NO: 935824 - protein, 18 aa, Mycobacterium
SVFTEPFQAYSVDLPVCN

SEQ ID NO: 935825 - protein, 17 aa, Mycobacterium
SVGACLAAVGPVGLAER

SEQ ID NO: 935826 - protein, 25 aa, Mycobacterium
SVGAPDLRRAVALCTPRDAIAGIAG

SEQ ID NO: 935827 - protein, 29 aa, Mycobacterium
SVGPPPPPPWCRGGSVVVVVTGAVVDGAG

SEQ ID NO: 935828 - protein, 18 aa, Mycobacterium
SVGVSIFAVSAAAAVLAN

SEQ ID NO: 935829 - protein, 18 aa, Mycobacterium
SVIAELTSSPWLGPASRS

SEQ ID NO: 935830 - protein, 19 aa, Mycobacterium
SVIGFPGKTIPVIRVIGYR

SEQ ID NO: 935831 - protein, 23 aa, Mycobacterium
SVITPNLFPGVSISADLGNGPGI

SEQ ID NO: 935832 - protein, 24 aa, Mycobacterium
SVITPNLFPGVSISADLGNGPGIQ

SEQ ID NO: 935833 - protein, 33 aa, Mycobacterium
SVLGEAAAIVYGRPAERLRVVGVTGTSGKTTTT

SEQ ID NO: 935834 - protein, 19 aa, Mycobacterium
SVLLRSDGSVVAFGNNQWG

SEQ ID NO: 935835 - protein, 17 aa, Mycobacterium
SVLSLPTTFIFDAAGRQ

SEQ ID NO: 935836 - protein, 27 aa, Mycobacterium
SVMGPTWPNRMMWMTGTIDPDAAHGGP

SEQ ID NO: 935837 - protein, 19 aa, Mycobacterium
SVNGACPAKPAGQAPSSTT

SEQ ID NO: 935838 - protein, 17 aa, Mycobacterium
SVPAGFTRIAAFRAGVG

SEQ ID NO: 935839 - protein, 23 aa, Mycobacterium
SVPEAARLADTWIDEAHNTLCPT

SEQ ID NO: 935840 - protein, 20 aa, Mycobacterium
SVPGCGGGALTPESVVVNGG

SEQ ID NO: 935841 - protein, 22 aa, Mycobacterium
SVREIRALTTLFGISDTTVRVA

SEQ ID NO: 935842 - protein, 27 aa, Mycobacterium
SVRLKAPTVDFVLRLGHSSFYPLPNTA

SEQ ID NO: 935843 - protein, 23 aa, Mycobacterium
SVRWCDDCACAFSTQPAVVSTRV

SEQ ID NO: 935844 - protein, 20 aa, Mycobacterium
SVRYHAEFAEAGGLTAGNEV

SEQ ID NO: 935845 - protein, 26 aa, Mycobacterium
SVSNIVGAPIRWESEFTAPFQAFSVD

SEQ ID NO: 935846 - protein, 25 aa, Mycobacterium
SVSTDGRFRYLRVYPNPQAYAPVTG

SEQ ID NO: 935847 - protein, 28 aa, Mycobacterium
SVSVLLLAVGCSFFGAPRSGDWRAKTDD

SEQ ID NO: 935848 - protein, 19 aa, Mycobacterium
SVTCVKTGGKINIGSGSSG

SEQ ID NO: 935849 - protein, 21 aa, Mycobacterium
SVTEDGWLILIADVKDIGIAR

SEQ ID NO: 935850 - protein, 23 aa, Mycobacterium
SVTSELTSGSWLGPSAAAMMAVA

SEQ ID NO: 935851 - protein, 18 aa, Mycobacterium
SVVDRLRTGDYVGAYATD

SEQ ID NO: 935852 - protein, 18 aa, Mycobacterium
SVVGRAPLVLDYVINDNA

SEQ ID NO: 935853 - protein, 24 aa, Mycobacterium
SVVGRTPLILDYEIKPEAVYSDGK

SEQ ID NO: 935854 - protein, 18 aa, Mycobacterium
SVVPRRRVLVVSTGSERH

SEQ ID NO: 935855 - protein, 26 aa, Mycobacterium
SVVPRSWSGFFRPGPAVVVSPENFGQ

SEQ ID NO: 935856 - protein, 20 aa, Mycobacterium
SVVTGCWHAGGGGRAASSSS

SEQ ID NO: 935857 - protein, 25 aa, Mycobacterium
SVVVAALCRLLARRGTRVAPFKAQN

SEQ ID NO: 935858 - protein, 23 aa, Mycobacterium
SVVVADGRRVCVLIRQGYSAVEV

SEQ ID NO: 935859 - protein, 29 aa, Mycobacterium
SVVVAGLCRLLARSGVRVAPFKAQNMSNN

SEQ ID NO: 935860 - protein, 25 aa, Mycobacterium
SVYFGFENVGGWSVFGIAFPTPNPS

SEQ ID NO: 935861 - protein, 25 aa, Mycobacterium
SVYRLARPEVLAVFTAAEDLLAATG

SEQ ID NO: 935862 - protein, 17 aa, Mycobacterium
SWDANGFDGEFCGDTTY

SEQ ID NO: 935863 - protein, 19 aa, Mycobacterium
SWFRSPFLVTDNAYIPYKP

SEQ ID NO: 935864 - protein, 23 aa, Mycobacterium
SWINIKAAPGWSASYADAHNSSY

SEQ ID NO: 935865 - protein, 18 aa, Mycobacterium
SWLAAAIAAVAVFAVACG

SEQ ID NO: 935866 - protein, 19 aa, Mycobacterium
SWLAAILIPVAVLAVACGG

SEQ ID NO: 935867 - protein, 24 aa, Mycobacterium
SWLSVLKQPGLRIGNPLEDSVSAG

SEQ ID NO: 935868 - protein, 19 aa, Mycobacterium
SWNHCGGEYVWTDAKMAYF

SEQ ID NO: 935869 - protein, 17 aa, Mycobacterium
SWQAVMRQLYIDARSAG

SEQ ID NO: 935870 - protein, 24 aa, Mycobacterium
SYAFDFSVWEIWSALLHGGRLLVV

SEQ ID NO: 935871 - protein, 23 aa, Mycobacterium
SYGCGECVGGGKSLAAARAAVEK

SEQ ID NO: 935872 - protein, 25 aa, Mycobacterium
SYPPKPPVGAALWKLMERARQIGLH

SEQ ID NO: 935873 - protein, 23 aa, Mycobacterium
SYQFRTGERIRLEISSSDFPQYA

SEQ ID NO: 935874 - protein, 23 aa, Mycobacterium
SYREVSCGLDSGGTLTCVNNRWQ

SEQ ID NO: 935875 - protein, 19 aa, Mycobacterium
SYRFTDFRSPKSAPKDKGL

SEQ ID NO: 935876 - protein, 30 aa, Mycobacterium
SYVAPTPINSWSFDVLDFVSDVRNRGAITS

SEQ ID NO: 935877 - protein, 18 aa, Mycobacterium
SYVYLRISTASAHTEFAI

SEQ ID NO: 935878 - protein, 25 aa, Mycobacterium
TAAARLADVFAVIGGELLVPLRDAL

SEQ ID NO: 935879 - protein, 17 aa, Mycobacterium
TAACPGGEEEDLYTGVC

SEQ ID NO: 935880 - protein, 25 aa, Mycobacterium
TAADADALFARFVAQWQKCDGTTLI

SEQ ID NO: 935881 - protein, 24 aa, Mycobacterium
TAADLRSSSGSALILHQSVDNLGG

SEQ ID NO: 935882 - protein, 26 aa, Mycobacterium
TAADPAGWPRLDWSMDAALLLAALAS

SEQ ID NO: 935883 - protein, 23 aa, Mycobacterium
TAAELRYLEAHGYRRMGDNSLLP

SEQ ID NO: 935884 - protein, 18 aa, Mycobacterium
TAAELYRGAPYGVGYFAG

SEQ ID NO: 935885 - protein, 18 aa, Mycobacterium
TAAFPGLALAGVITSSAD

SEQ ID NO: 935886 - protein, 25 aa, Mycobacterium
TAAGRAMPGQAGKAGTRTDTTGPSG

SEQ ID NO: 935887 - protein, 25 aa, Mycobacterium
TAAKAGQITAGWAMQPFIADKQATE

SEQ ID NO: 935888 - protein, 24 aa, Mycobacterium
TAALHLRRWLPRAHEIVVISPNAD

SEQ ID NO: 935889 - protein, 17 aa, Mycobacterium
TAALMFAAIDGLVLHRV

SEQ ID NO: 935890 - protein, 21 aa, Mycobacterium
TAANHCQRHGDTIYVTLPAKT

SEQ ID NO: 935891 - protein, 17 aa, Mycobacterium
TAAPATVAGMVVFIDPG

SEQ ID NO: 935892 - protein, 22 aa, Mycobacterium
TAAQRAGFGWIADLNDVAAEPI

SEQ ID NO: 935893 - protein, 17 aa, Mycobacterium
TAAVAIASLSYVATLHA

SEQ ID NO: 935894 - protein, 26 aa, Mycobacterium
TAAVARAVGIGGNIATLGTTITDGNA

SEQ ID NO: 935895 - protein, 21 aa, Mycobacterium
TAAWCGPCASVRRVVEQVCGA

SEQ ID NO: 935896 - protein, 20 aa, Mycobacterium
TADDLATWIRALVGGKVLDS

SEQ ID NO: 935897 - protein, 29 aa, Mycobacterium
TADDLKGNYLYRMAGAVLGIYGNTAAEAL

SEQ ID NO: 935898 - protein, 24 aa, Mycobacterium
TADEKLVPSINSWQGAEQALMYGD

SEQ ID NO: 935899 - protein, 17 aa, Mycobacterium
TADEWRASFEVNVTGAV

SEQ ID NO: 935900 - protein, 23 aa, Mycobacterium
TADPEIPSHLVVLADRTSLIRAE

SEQ ID NO: 935901 - protein, 27 aa, Mycobacterium
TADTRAQLWLAIRAWQLLVSRERPGLS

SEQ ID NO: 935902 - protein, 21 aa, Mycobacterium
TAEPARAGWQTIPGSKRPASY

SEQ ID NO: 935903 - protein, 17 aa, Mycobacterium
TAFFDNFFTTTSDTGVR

SEQ ID NO: 935904 - protein, 18 aa, Mycobacterium
TAFSRRTALKAGAAAAAS

SEQ ID NO: 935905 - protein, 27 aa, Mycobacterium
TAGAFSRPGLPVEYLDVFSPSMNRDIR

SEQ ID NO: 935906 - protein, 25 aa, Mycobacterium
TAGAFSRPGLPVEYLMVPSAGMGRD

SEQ ID NO: 935907 - protein, 23 aa, Mycobacterium
TAGAFSRPGLPVEYLQVPSAAMG

SEQ ID NO: 935908 - protein, 23 aa, Mycobacterium
TAGAFSRPGLPVEYLQVPSAGMG

SEQ ID NO: 935909 - protein, 21 aa, Mycobacterium
TAGCGWRGLNSVALPGTAGRG

SEQ ID NO: 935910 - protein, 17 aa, Mycobacterium
TAGDAFISILAQRLQRG

SEQ ID NO: 935911 - protein, 19 aa, Mycobacterium
TAGGLMRPKEGGVVIPAHG

SEQ ID NO: 935912 - protein, 23 aa, Mycobacterium
TAGLAIKFAHGIFGSQDRTHSPG

SEQ ID NO: 935913 - protein, 17 aa, Mycobacterium
TAGLRRGSGRRCRDPGV

SEQ ID NO: 935914 - protein, 20 aa, Mycobacterium
TAGNGGWLIGNGGTGGQGGA

SEQ ID NO: 935915 - protein, 24 aa, Mycobacterium
TAGQATAVAAVFEAAQAAIVHPAA

SEQ ID NO: 935916 - protein, 17 aa, Mycobacterium
TAGRFTIVAIATYCPAL

SEQ ID NO: 935917 - protein, 24 aa, Mycobacterium
TAGRIPRVYGRQASEYVIRRGMSQ

SEQ ID NO: 935918 - protein, 23 aa, Mycobacterium
TAGRVCVTTRAASPGQPAGPTGP

SEQ ID NO: 935919 - protein, 23 aa, Mycobacterium
TAHIRTGSLLGQRVLTVESAGGH

SEQ ID NO: 935920 - protein, 23 aa, Mycobacterium
TAHIRTGTLLGQRVLTVEPKGSG

SEQ ID NO: 935921 - protein, 20 aa, Mycobacterium
TAHWRPEHYYAPGTTVTAEA

SEQ ID NO: 935922 - protein, 24 aa, Mycobacterium
TAIARRADGRLVLGSADGAVSTLS

SEQ ID NO: 935923 - protein, 24 aa, Mycobacterium
TAIGEGLRNPALRVLRTAVHYAPG

SEQ ID NO: 935924 - protein, 17 aa, Mycobacterium
TAIGRMQQIALRIGLPE

SEQ ID NO: 935925 - protein, 23 aa, Mycobacterium
TAIHELMHSFGFLSSLGEPGENL

SEQ ID NO: 935926 - protein, 18 aa, Mycobacterium
TAILRYNNSIAYARNVLG

SEQ ID NO: 935927 - protein, 25 aa, Mycobacterium
TAIPSAASPRVIWGLGDDPHPKPAK

SEQ ID NO: 935928 - protein, 19 aa, Mycobacterium
TAIRQRLGPVTILVNAAGL

SEQ ID NO: 935929 - protein, 26 aa, Mycobacterium
TAKLCAQYLGPALRLLNFNNVPFPVS

SEQ ID NO: 935930 - protein, 27 aa, Mycobacterium
TAKNSVGCVWLRGGSIVGPHFSFNWYR

SEQ ID NO: 935931 - protein, 25 aa, Mycobacterium
TAKPDPILPLRISFIEIVPHTTSVT

SEQ ID NO: 935932 - protein, 25 aa, Mycobacterium
TAKTGGLELPFVVVDGELFAQLGSA

SEQ ID NO: 935933 - protein, 22 aa, Mycobacterium
TALCDRWQPGATLLPVSNDRCE

SEQ ID NO: 935934 - protein, 18 aa, Mycobacterium
TALCGVGALFGGFASASR

SEQ ID NO: 935935 - protein, 19 aa, Mycobacterium
TALDGWKLEFDLPADESVT

SEQ ID NO: 935936 - protein, 20 aa, Mycobacterium
TALGLPRTVTITVTESDGDT

SEQ ID NO: 935937 - protein, 25 aa, Mycobacterium
TALHVFPHFAANALAIYEPAHGALT

SEQ ID NO: 935938 - protein, 17 aa, Mycobacterium
TALQRLGLAAPHEQFPR

SEQ ID NO: 935939 - protein, 22 aa, Mycobacterium
TALSPRRTWAEVVADIVDGLSA

SEQ ID NO: 935940 - protein, 17 aa, Mycobacterium
TALTWMVYVTLRRDVKG

SEQ ID NO: 935941 - protein, 27 aa, Mycobacterium
TAMAAAARPYASWLGTAAARAAVTAAQ

SEQ ID NO: 935942 - protein, 17 aa, Mycobacterium
TAMIACVALASAAGQPV

SEQ ID NO: 935943 - protein, 26 aa, Mycobacterium
TAMKSEAITLVRTCSGSVTAAEATLC

SEQ ID NO: 935944 - protein, 24 aa, Mycobacterium
TANALLGIVYVHGVPSFTTDPNDV

SEQ ID NO: 935945 - protein, 26 aa, Mycobacterium
TANEGDWKGGTRGWSIFDAGTGEVVW

SEQ ID NO: 935946 - protein, 21 aa, Mycobacterium
TANGKLLRSALRGQTPAKPIW

SEQ ID NO: 935947 - protein, 55 aa, Mycobacterium
TANLPMHEGCNFDCPDLPGMLGKMFKVPMSEFYSDEGYTFPVVRTPVNGVETPWS

SEQ ID NO: 935948 - protein, 18 aa, Mycobacterium
TANPLAWANAATGAVFLT

SEQ ID NO: 935949 - protein, 22 aa, Mycobacterium
TANTHFGRWRYLLGANSAMERT

SEQ ID NO: 935950 - protein, 19 aa, Mycobacterium
TAPAMTWRRPGRSWCPGCA

SEQ ID NO: 935951 - protein, 24 aa, Mycobacterium
TAPDPRIGVPRVPEGSAGIERTLA

SEQ ID NO: 935952 - protein, 24 aa, Mycobacterium
TAPHAGAFAPWFANSVGAATQVLA

SEQ ID NO: 935953 - protein, 29 aa, Mycobacterium
TAPMSDWRLEFDLPVGESIRHTWSSAITQ

SEQ ID NO: 935954 - protein, 26 aa, Mycobacterium
TAPPMSWDKVLQGLFLGRKDQETRNA

SEQ ID NO: 935955 - protein, 20 aa, Mycobacterium
TAPPPGTRIPGLGDDSQGPP

SEQ ID NO: 935956 - protein, 17 aa, Mycobacterium
TAPSDFRRGAAGGVADA

SEQ ID NO: 935957 - protein, 30 aa, Mycobacterium
TAPTELCSFPLRQCGSGNLFGGNEPARTWF

SEQ ID NO: 935958 - protein, 19 aa, Mycobacterium
TAPVSVTVTNGWFRDVKLV

SEQ ID NO: 935959 - protein, 17 aa, Mycobacterium
TAQATKLMQCVVNGPGY

SEQ ID NO: 935960 - protein, 23 aa, Mycobacterium
TAQCGTLAVPVDWNNPDPQGAQA

SEQ ID NO: 935961 - protein, 24 aa, Mycobacterium
TAQDGGDGWTCQRALTVRNNIAID

SEQ ID NO: 935962 - protein, 23 aa, Mycobacterium
TAQELATAWGRQDEAAFDAGQRK

SEQ ID NO: 935963 - protein, 17 aa, Mycobacterium
TAQRPGDVLTQYGGITV

SEQ ID NO: 935964 - protein, 23 aa, Mycobacterium
TARCGGVLGGLAILVASPATADD

SEQ ID NO: 935965 - protein, 17 aa, Mycobacterium
TARCLVHESLAGGLATA

SEQ ID NO: 935966 - protein, 19 aa, Mycobacterium
TARELGKFPSIAGTDTSGR

SEQ ID NO: 935967 - protein, 18 aa, Mycobacterium
TARIQLRLADPSESQMGH

SEQ ID NO: 935968 - protein, 20 aa, Mycobacterium
TARRAVRVATRLAALNAERI

SEQ ID NO: 935969 - protein, 18 aa, Mycobacterium
TARSEVIVSLGAINTPKV

SEQ ID NO: 935970 - protein, 23 aa, Mycobacterium
TASDLRNSSGTALIIHQTADNLT

SEQ ID NO: 935971 - protein, 26 aa, Mycobacterium
TASDPGGWPRLDWSMDAALLLAALAS

SEQ ID NO: 935972 - protein, 17 aa, Mycobacterium
TASFTVVGADPTSDIAV

SEQ ID NO: 935973 - protein, 22 aa, Mycobacterium
TATGVIWLQHGFLGNKSFVSAL

SEQ ID NO: 935974 - protein, 20 aa, Mycobacterium
TATLLLAGCSRGPDDEGATP

SEQ ID NO: 935975 - protein, 17 aa, Mycobacterium
TATQWESIVSLLTTENW

SEQ ID NO: 935976 - protein, 25 aa, Mycobacterium
TATTHWRASGLLNELGARYVPDRVV

SEQ ID NO: 935977 - protein, 26 aa, Mycobacterium
TATVGVRGGAVIPGPAVRAGPAETTG

SEQ ID NO: 935978 - protein, 23 aa, Mycobacterium
TAVACLLTACGGGSSSSGPVEIA

SEQ ID NO: 935979 - protein, 26 aa, Mycobacterium
TAVEPRLWNMWTVLPILQDTTIVAVG

SEQ ID NO: 935980 - protein, 17 aa, Mycobacterium
TAVERFGGLDIMVNNAG

SEQ ID NO: 935981 - protein, 25 aa, Mycobacterium
TAVKLCGYSDCKVLTTFTACGAVAA

SEQ ID NO: 935982 - protein, 25 aa, Mycobacterium
TAVKSCGYSDCKVLTSFTACGAVAA

SEQ ID NO: 935983 - protein, 20 aa, Mycobacterium
TAVLTRFPGGIAELQLSRDG

SEQ ID NO: 935984 - protein, 23 aa, Mycobacterium
TAVPSSAMTVVWLDVPSSGPPAA

SEQ ID NO: 935985 - protein, 18 aa, Mycobacterium
TAVPVSWDDFRVQLEKLT

SEQ ID NO: 935986 - protein, 22 aa, Mycobacterium
TAVPYRVPFPQVMPTQETQPAR

SEQ ID NO: 935987 - protein, 24 aa, Mycobacterium
TAVSARPVLLNGILVQGAPVFPGI

SEQ ID NO: 935988 - protein, 25 aa, Mycobacterium
TAVTALVGWGIRVPFAAAEPCPDVE

SEQ ID NO: 935989 - protein, 18 aa, Mycobacterium
TAVTTLRIMDGVRIPVGS

SEQ ID NO: 935990 - protein, 26 aa, Mycobacterium
TAVTTLRIREGVLLPVGSTAELRSAT

SEQ ID NO: 935991 - protein, 23 aa, Mycobacterium
TAVYVCGPSGMLESVRVARGRYA

SEQ ID NO: 935992 - protein, 19 aa, Mycobacterium
TAYFSFEVLENVFDTLVEP

SEQ ID NO: 935993 - protein, 22 aa, Mycobacterium
TAYGEWQGGWVTFDGMHLQVGA

SEQ ID NO: 935994 - protein, 18 aa, Mycobacterium
TAYGLAFAESFTKRRGVR

SEQ ID NO: 935995 - protein, 25 aa, Mycobacterium
TCAADAFRSLRCVVSAGEALELGLA

SEQ ID NO: 935996 - protein, 17 aa, Mycobacterium
TCATILVAVTALLAGCV

SEQ ID NO: 935997 - protein, 18 aa, Mycobacterium
TCERRKLVNFSTVYLDAN

SEQ ID NO: 935998 - protein, 39 aa, Mycobacterium
TCGASPLPVPQWWAKLCDAWWCTDTSLPANARDEARTDV

SEQ ID NO: 935999 - protein, 23 aa, Mycobacterium
TCGLPAETTYYIAPQMGSAPERP

SEQ ID NO: 936000 - protein, 23 aa, Mycobacterium
TCMSSSLPTLFRRAADYQRQITL

SEQ ID NO: 936001 - protein, 19 aa, Mycobacterium
TCPPMGRHHHHHLHLPHLP

SEQ ID NO: 936002 - protein, 18 aa, Mycobacterium
TCRELGIGITAYGVLSRG

SEQ ID NO: 936003 - protein, 20 aa, Mycobacterium
TCYVSGRYAGPFGEDDLEVG

SEQ ID NO: 936004 - protein, 23 aa, Mycobacterium
TDAETTWKLLLDRQSGIRELDDP

SEQ ID NO: 936005 - protein, 27 aa, Mycobacterium
TDAIAQGKCVWARGTMDSAGALQATSI

SEQ ID NO: 936006 - protein, 28 aa, Mycobacterium
TDAMTGKELWQVAADLPLVPASTNKVLT

SEQ ID NO: 936007 - protein, 20 aa, Mycobacterium
TDAPLLRNGDTIGLDSTAAA

SEQ ID NO: 936008 - protein, 19 aa, Mycobacterium
TDDLVTWGMECPDCLYTRA

SEQ ID NO: 936009 - protein, 23 aa, Mycobacterium
TDDVTGPVWSRCRLDCTNAARTD

SEQ ID NO: 936010 - protein, 22 aa, Mycobacterium
TDELRLARGTAHRIMTGAPMPS

SEQ ID NO: 936011 - protein, 22 aa, Mycobacterium
TDEMKRMLGAQLAILATVTDGT

SEQ ID NO: 936012 - protein, 17 aa, Mycobacterium
TDFTDYRHRVFAMHNGQ

SEQ ID NO: 936013 - protein, 23 aa, Mycobacterium
TDGAAVTVVRIGLPISPAASSPP

SEQ ID NO: 936014 - protein, 19 aa, Mycobacterium
TDGAIWARYNVPWQPAYVF

SEQ ID NO: 936015 - protein, 17 aa, Mycobacterium
TDGGLLVPIHWGTFRLA

SEQ ID NO: 936016 - protein, 21 aa, Mycobacterium
TDGKVKWSVPLGFLAQTPPTV

SEQ ID NO: 936017 - protein, 21 aa, Mycobacterium
TDGQWGGAMVVAAKSATSNLD

SEQ ID NO: 936018 - protein, 21 aa, Mycobacterium
TDGRIPALHLRLLEDDKHFFP

SEQ ID NO: 936019 - protein, 31 aa, Mycobacterium
TDGRTAAAFALACLQAGVGLQRYEHRADLPC

SEQ ID NO: 936020 - protein, 28 aa, Mycobacterium
TDGTWNTLYRKWLSVLGPAPVPPQPRYL

SEQ ID NO: 936021 - protein, 24 aa, Mycobacterium
TDHAEALAALALDMAAAVADLTDP

SEQ ID NO: 936022 - protein, 18 aa, Mycobacterium
TDHCRADLAGGPVVGPPP

SEQ ID NO: 936023 - protein, 28 aa, Mycobacterium
TDHRTGRPRYPGAAGTPVPAPTEQQRGA

SEQ ID NO: 936024 - protein, 24 aa, Mycobacterium
TDIDDFDVVYGISRDDYVLVTNPA

SEQ ID NO: 936025 - protein, 17 aa, Mycobacterium
TDIQVVFARGTDEPPGL

SEQ ID NO: 936026 - protein, 18 aa, Mycobacterium
TDLANCRRLFSRCGAYRA

SEQ ID NO: 936027 - protein, 23 aa, Mycobacterium
TDLDTWKSYLTFHAVHRSADALS

SEQ ID NO: 936028 - protein, 24 aa, Mycobacterium
TDLEKRVAAIVLIGNPKNWQVAGM

SEQ ID NO: 936029 - protein, 19 aa, Mycobacterium
TDLSIFKGPLADIAAKAGP

SEQ ID NO: 936030 - protein, 24 aa, Mycobacterium
TDLTALFLRRVFELGASAGGIDPI

SEQ ID NO: 936031 - protein, 17 aa, Mycobacterium
TDPDAWAVFGRDVLADH

SEQ ID NO: 936032 - protein, 17 aa, Mycobacterium
TDPDMTPILLARALGLF

SEQ ID NO: 936033 - protein, 23 aa, Mycobacterium
TDPKVEGSWYWVDDQTAHWRPEH

SEQ ID NO: 936034 - protein, 17 aa, Mycobacterium
TDPRPFDPCFDIPSSVI

SEQ ID NO: 936035 - protein, 22 aa, Mycobacterium
TDPSLECGLGYSLAEVVQYSGY

SEQ ID NO: 936036 - protein, 20 aa, Mycobacterium
TDPSSPVFRQILPTTPGPEG

SEQ ID NO: 936037 - protein, 30 aa, Mycobacterium
TDPVLAEWFLRRFSLLDSLYIVPPPRLIGR

SEQ ID NO: 936038 - protein, 26 aa, Mycobacterium
TDQQLRWKPTQFWPANTDVNVNAGGT

SEQ ID NO: 936039 - protein, 19 aa, Mycobacterium
TDQYAAWPADADEFVPSRF

SEQ ID NO: 936040 - protein, 26 aa, Mycobacterium
TDRAAALKFNYDFEMAKIGRPTDRSL

SEQ ID NO: 936041 - protein, 21 aa, Mycobacterium
TDRAAARPAGRVHASRLDVPD

SEQ ID NO: 936042 - protein, 20 aa, Mycobacterium
TDRGTPYADLLVPKLEASVT

SEQ ID NO: 936043 - protein, 25 aa, Mycobacterium
TDRHPGFADAWRRAVTAVNRDIQDN

SEQ ID NO: 936044 - protein, 18 aa, Mycobacterium
TDRLAGKSVDIYAVNYPA

SEQ ID NO: 936045 - protein, 22 aa, Mycobacterium
TDRMRMRFSPNVLVPLEPFPGI

SEQ ID NO: 936046 - protein, 19 aa, Mycobacterium
TDRPIRRLAIVRGATLGGC

SEQ ID NO: 936047 - protein, 25 aa, Mycobacterium
TDRRRIPAEEFFTGAFSTALAESEV

SEQ ID NO: 936048 - protein, 25 aa, Mycobacterium
TDSFALLALLCRRLSNEDVTTVATE

SEQ ID NO: 936049 - protein, 18 aa, Mycobacterium
TDSIAALIADVARANQRL

SEQ ID NO: 936050 - protein, 29 aa, Mycobacterium
TDTQLRWRPQDFWPAGTVVTIDAAGTKSS

SEQ ID NO: 936051 - protein, 19 aa, Mycobacterium
TDTQLRWRPQDFWPSNTVV

SEQ ID NO: 936052 - protein, 34 aa, Mycobacterium
TDVVIARGLSQRGVPFSWAGGGINGPTRGTGTGI

SEQ ID NO: 936053 - protein, 29 aa, Mycobacterium
TDVVIARGLSQRGVPFSWAGGGVTGPTRG

SEQ ID NO: 936054 - protein, 24 aa, Mycobacterium
TDWNNRWWITCMVAFQTSYGVIQQ

SEQ ID NO: 936055 - protein, 20 aa, Mycobacterium
TEAAEGRWFADQVRNHPNPF

SEQ ID NO: 936056 - protein, 31 aa, Mycobacterium
TEAAVLGRLCPVCWYATRAALAQRAIDTAES

SEQ ID NO: 936057 - protein, 18 aa, Mycobacterium
TEACRRLGAVGAVKAGLR

SEQ ID NO: 936058 - protein, 17 aa, Mycobacterium
TEADYAAMWAQDAAMMA

SEQ ID NO: 936059 - protein, 21 aa, Mycobacterium
TEAEYRAALADVNAREATMKE

SEQ ID NO: 936060 - protein, 23 aa, Mycobacterium
TEAGKDSWDVFVAEAEKAGIKLV

SEQ ID NO: 936061 - protein, 17 aa, Mycobacterium
TEAYLACLRVLMTGTGY

SEQ ID NO: 936062 - protein, 18 aa, Mycobacterium
TEDQSMLFFPFVGGAGPN

SEQ ID NO: 936063 - protein, 20 aa, Mycobacterium
TEGLEYSRFADWKLNPAGAP

SEQ ID NO: 936064 - protein, 20 aa, Mycobacterium
TEGLSSLPLPAPGGGSGGYT

SEQ ID NO: 936065 - protein, 19 aa, Mycobacterium
TEGPAPVSSGGQWDTTLPM

SEQ ID NO: 936066 - protein, 24 aa, Mycobacterium
TEIADAPTPLGYALAVTAPPVEPA

SEQ ID NO: 936067 - protein, 17 aa, Mycobacterium
TEIARRFDLVGIDPRGV

SEQ ID NO: 936068 - protein, 17 aa, Mycobacterium
TEIPALNVWTARTDVLA

SEQ ID NO: 936069 - protein, 17 aa, Mycobacterium
TEISWIRGFLPPWPPLP

SEQ ID NO: 936070 - protein, 17 aa, Mycobacterium
TELARGYLMRKVADPAL

SEQ ID NO: 936071 - protein, 19 aa, Mycobacterium
TELDTALGVTGTYSDPPKT

SEQ ID NO: 936072 - protein, 19 aa, Mycobacterium
TELELQWGRTIGQMPSPYT

SEQ ID NO: 936073 - protein, 18 aa, Mycobacterium
TELGRRYPLADFDGNVLG

SEQ ID NO: 936074 - protein, 21 aa, Mycobacterium
TELKRAFKYRRVEKRYHALVQ

SEQ ID NO: 936075 - protein, 25 aa, Mycobacterium
TELLDRLGAHLTRYIGPGVEYADIR

SEQ ID NO: 936076 - protein, 25 aa, Mycobacterium
TELNAGPNRPFMWAGNEPDFGVPWL

SEQ ID NO: 936077 - protein, 25 aa, Mycobacterium
TELPARFGGPEVLPPAFGAVTPANC

SEQ ID NO: 936078 - protein, 22 aa, Mycobacterium
TEMLSHLQTFVAVLRDSNEQIV

SEQ ID NO: 936079 - protein, 31 aa, Mycobacterium
TEMQPADGVTLPWKVDATVGDISRGAKTPNH

SEQ ID NO: 936080 - protein, 20 aa, Mycobacterium
TEPALTWYRAMKPIAEDFGP

SEQ ID NO: 936081 - protein, 24 aa, Mycobacterium
TEPELRAGQLLTARPLTTVAALPS

SEQ ID NO: 936082 - protein, 17 aa, Mycobacterium
TEPFQAYAVDLPVCNNW

SEQ ID NO: 936083 - protein, 17 aa, Mycobacterium
TEPFQAYSVDLPVCNNW

SEQ ID NO: 936084 - protein, 27 aa, Mycobacterium
TEPFSVPWLVGIDQGFFEKRGVEVGQI

SEQ ID NO: 936085 - protein, 24 aa, Mycobacterium
TEPGCPPKTWCVKNVSGFSGQMNV

SEQ ID NO: 936086 - protein, 19 aa, Mycobacterium
TEPGGVLDRLFAKDGPVDR

SEQ ID NO: 936087 - protein, 18 aa, Mycobacterium
TEPGQWAPAPPPGPVPPG

SEQ ID NO: 936088 - protein, 20 aa, Mycobacterium
TEPGRLMFCGSPRRYEPRWF

SEQ ID NO: 936089 - protein, 26 aa, Mycobacterium
TEPVRRLALILCWTLASASPAVADDF

SEQ ID NO: 936090 - protein, 21 aa, Mycobacterium
TEQTVPLKIIAGWRNNFDPRY

SEQ ID NO: 936091 - protein, 17 aa, Mycobacterium
TERARIRTPVGLAIGAK

SEQ ID NO: 936092 - protein, 26 aa, Mycobacterium
TERAWTILDSDSWRKLSANRDNRVFV

SEQ ID NO: 936093 - protein, 23 aa, Mycobacterium
TESGKLCGLFLGPGLRVANPLLL

SEQ ID NO: 936094 - protein, 20 aa, Mycobacterium
TESKKVPSWQVLVPENAPVA

SEQ ID NO: 936095 - protein, 21 aa, Mycobacterium
TETIGGYGGMGGLGGQSGVLF

SEQ ID NO: 936096 - protein, 22 aa, Mycobacterium
TETLKDIALYLNFDMLGSPNPG

SEQ ID NO: 936097 - protein, 19 aa, Mycobacterium
TEYQRTWMPNGKWLVLPVR

SEQ ID NO: 936098 - protein, 24 aa, Mycobacterium
TFAEPFSEWQGMFAGNTMLLPKSS

SEQ ID NO: 936099 - protein, 19 aa, Mycobacterium
TFAGPSFHSAQWRHDVDLA

SEQ ID NO: 936100 - protein, 31 aa, Mycobacterium
TFAQPYPAWKELFSNILPAHIVKDVPGGFAA

SEQ ID NO: 936101 - protein, 30 aa, Mycobacterium
TFAQPYPAWRELFNDILPAHIVKDVPGGFS

SEQ ID NO: 936102 - protein, 30 aa, Mycobacterium
TFAQPYPAWRELFNNLLPAHIVKDVPGGFA

SEQ ID NO: 936103 - protein, 25 aa, Mycobacterium
TFAYPGLGASPTWHGFAVDQSGIAF

SEQ ID NO: 936104 - protein, 17 aa, Mycobacterium
TFCANNFRADDPRPPEA

SEQ ID NO: 936105 - protein, 25 aa, Mycobacterium
TFCVGGKCPDVLMTWELSYAELADR

SEQ ID NO: 936106 - protein, 19 aa, Mycobacterium
TFEWAFRWLERNRPEPSAD

SEQ ID NO: 936107 - protein, 17 aa, Mycobacterium
TFEYVCSIHPMMRGTVV

SEQ ID NO: 936108 - protein, 23 aa, Mycobacterium
TFGLDRLEAGLAREQAPRQVRST

SEQ ID NO: 936109 - protein, 26 aa, Mycobacterium
TFGYAEHRELLAAAGALVAEFDPRSD

SEQ ID NO: 936110 - protein, 18 aa, Mycobacterium
TFHYRLRTRIVLKGLLRC

SEQ ID NO: 936111 - protein, 29 aa, Mycobacterium
TFILATGRPPRWVRPVVDALGFAPMAVCA

SEQ ID NO: 936112 - protein, 18 aa, Mycobacterium
TFIVSAILRRRLSEPGLL

SEQ ID NO: 936113 - protein, 20 aa, Mycobacterium
TFLDDGCIYLDMPVGPAAAA

SEQ ID NO: 936114 - protein, 23 aa, Mycobacterium
TFLFGQGRAGVWTINNKPYKPGT

SEQ ID NO: 936115 - protein, 24 aa, Mycobacterium
TFLTQELPAWLAANRDVKPTGSAV

SEQ ID NO: 936116 - protein, 21 aa, Mycobacterium
TFLTQEMPLWMQANKQISPAG

SEQ ID NO: 936117 - protein, 22 aa, Mycobacterium
TFLTREMPAWLQANKGVSPVGN

SEQ ID NO: 936118 - protein, 26 aa, Mycobacterium
TFNFPANGTHSWPYWNQQLVAMKPDI

SEQ ID NO: 936119 - protein, 20 aa, Mycobacterium
TFNLPGDFQLLGQQCDQPNA

SEQ ID NO: 936120 - protein, 21 aa, Mycobacterium
TFNYLDLVRYLAVGNLNPAPL

SEQ ID NO: 936121 - protein, 25 aa, Mycobacterium
TFRATRYGGGLLDVIGVTRTLSVYV

SEQ ID NO: 936122 - protein, 18 aa, Mycobacterium
TFSAPGTFDYVCSIHPMM

SEQ ID NO: 936123 - protein, 17 aa, Mycobacterium
TFSEERYGIGLKKDDTE

SEQ ID NO: 936124 - protein, 17 aa, Mycobacterium
TFSVEGLSHPFLVKQKQ

SEQ ID NO: 936125 - protein, 18 aa, Mycobacterium
TFTFPPAGNHAWPYWGAQ

SEQ ID NO: 936126 - protein, 20 aa, Mycobacterium
TFTNWRGVLAPPGISDDARD

SEQ ID NO: 936127 - protein, 20 aa, Mycobacterium
TFTNWRGVLAPPGISEEDRQ

SEQ ID NO: 936128 - protein, 22 aa, Mycobacterium
TFTVRLNTPFAIYPMTLGYTAF

SEQ ID NO: 936129 - protein, 27 aa, Mycobacterium
TFVGAAARGGRRLVIAMMYGLVKAGGP

SEQ ID NO: 936130 - protein, 27 aa, Mycobacterium
TFVGAAARNGRRLVIAMMYGLVKEGGP

SEQ ID NO: 936131 - protein, 26 aa, Mycobacterium
TFVGAAARNGRRLVIAMMYGMVKEGG

SEQ ID NO: 936132 - protein, 22 aa, Mycobacterium
TFWTNELPPLFNKLGTNLFLAP

SEQ ID NO: 936133 - protein, 28 aa, Mycobacterium
TGADIFNRGGPYLARGAADLVPSAQLLD

SEQ ID NO: 936134 - protein, 24 aa, Mycobacterium
TGAGRGGMPFLYRVVETAVADKSA

SEQ ID NO: 936135 - protein, 27 aa, Mycobacterium
TGAIYEAWGRLGFERGALGLPTSGEIH

SEQ ID NO: 936136 - protein, 25 aa, Mycobacterium
TGAKAVGIGGNIATLGTVIGDGNTT

SEQ ID NO: 936137 - protein, 23 aa, Mycobacterium
TGANGEAGGILFGSGGSGGSGGV

SEQ ID NO: 936138 - protein, 17 aa, Mycobacterium
TGARADRGLDIPGIDLP

SEQ ID NO: 936139 - protein, 21 aa, Mycobacterium
TGAVTRTSTYWTRITITNYES

SEQ ID NO: 936140 - protein, 22 aa, Mycobacterium
TGCADELVAVYATRETRSGATA

SEQ ID NO: 936141 - protein, 17 aa, Mycobacterium
TGDAAVSDFARHDIDAL

SEQ ID NO: 936142 - protein, 23 aa, Mycobacterium
TGDAQLPAGGMLFIGTPDGQLVA

SEQ ID NO: 936143 - protein, 18 aa, Mycobacterium
TGEFTDWPVQAVYRAVGY

SEQ ID NO: 936144 - protein, 24 aa, Mycobacterium
TGEVRWVPGGELGFGYRTSVFKRG

SEQ ID NO: 936145 - protein, 27 aa, Mycobacterium
TGFDCSGLMRYGFAGVGVLIPRFSGDQ

SEQ ID NO: 936146 - protein, 19 aa, Mycobacterium
TGFDFPFAAMGSVHTENHI

SEQ ID NO: 936147 - protein, 23 aa, Mycobacterium
TGGAAGGYSTWLISSTTATPFNT

SEQ ID NO: 936148 - protein, 23 aa, Mycobacterium
TGGACDKFTLSIAGMAEGTGEKI

SEQ ID NO: 936149 - protein, 21 aa, Mycobacterium
TGGAGGLFFGVGGAGGAAPLF

SEQ ID NO: 936150 - protein, 26 aa, Mycobacterium
TGGAGGRGGLVYGDGGRGGDGGLGGT

SEQ ID NO: 936151 - protein, 23 aa, Mycobacterium
TGGAGGRGGWLIGNGAGGGTGGS

SEQ ID NO: 936152 - protein, 20 aa, Mycobacterium
TGGARTARAAGPTVPAVTVE

SEQ ID NO: 936153 - protein, 26 aa, Mycobacterium
TGGDGGKGGDAWVIGNGGNGGSGGTG

SEQ ID NO: 936154 - protein, 18 aa, Mycobacterium
TGGDGWGYEEADAQGGNG

SEQ ID NO: 936155 - protein, 27 aa, Mycobacterium
TGGFNRDTWGVAMMGNFDAVPPTPIQL

SEQ ID NO: 936156 - protein, 26 aa, Mycobacterium
TGGGGIKGFFEKTFAPLGLKKIQAEV

SEQ ID NO: 936157 - protein, 24 aa, Mycobacterium
TGGIYAPMLHPWSPSTEGTGSTLY

SEQ ID NO: 936158 - protein, 26 aa, Mycobacterium
TGGNGGAGGLLFGKGGAGGAGGVGGL

SEQ ID NO: 936159 - protein, 26 aa, Mycobacterium
TGGNGGAGGLLFGNGGAGGVGGAGGV

SEQ ID NO: 936160 - protein, 25 aa, Mycobacterium
TGGNGGAGGLLWGNGGRGGSGAAGQ

SEQ ID NO: 936161 - protein, 18 aa, Mycobacterium
TGGPAGPADADWVKQEAG

SEQ ID NO: 936162 - protein, 21 aa, Mycobacterium
TGGPPGNFLSAGGHYNAPGHT

SEQ ID NO: 936163 - protein, 18 aa, Mycobacterium
TGGPQCVGLPKLPFNTAP

SEQ ID NO: 936164 - protein, 19 aa, Mycobacterium
TGGSARLIGAGGAGGEGGA

SEQ ID NO: 936165 - protein, 26 aa, Mycobacterium
TGGTGGRGGLIFGDAGAGGQGGLGFA

SEQ ID NO: 936166 - protein, 19 aa, Mycobacterium
TGIACGSLGDILIANQYLT

SEQ ID NO: 936167 - protein, 30 aa, Mycobacterium
TGIASVAPGFTGRVLRRFAPQQRPSGDEET

SEQ ID NO: 936168 - protein, 21 aa, Mycobacterium
TGKRADLIVVDRNIFEIDPHD

SEQ ID NO: 936169 - protein, 17 aa, Mycobacterium
TGKRARGPHTTITGQPT

SEQ ID NO: 936170 - protein, 21 aa, Mycobacterium
TGKRLGAQVNVISANDDVNQQ

SEQ ID NO: 936171 - protein, 23 aa, Mycobacterium
TGKRLPVPLYPGFDTLGTLEHIA

SEQ ID NO: 936172 - protein, 30 aa, Mycobacterium
TGKVVLINVWGSWCAPCRTETPELETVYAE

SEQ ID NO: 936173 - protein, 25 aa, Mycobacterium
TGLAPMPTCGFWPVPPTSKPHEISV

SEQ ID NO: 936174 - protein, 17 aa, Mycobacterium
TGLARTPGATAIAGTTA

SEQ ID NO: 936175 - protein, 26 aa, Mycobacterium
TGLDIRPNPGIAFPGYADYLPVTRGQ

SEQ ID NO: 936176 - protein, 23 aa, Mycobacterium
TGLDTWGALGFGYAEVGTVTARP

SEQ ID NO: 936177 - protein, 18 aa, Mycobacterium
TGLFDRLEMTPGPSQPAR

SEQ ID NO: 936178 - protein, 20 aa, Mycobacterium
TGLFNTGFRTAGIANSATNG

SEQ ID NO: 936179 - protein, 25 aa, Mycobacterium
TGLPYRIVKEAVDLTCLLTAVRQGY

SEQ ID NO: 936180 - protein, 24 aa, Mycobacterium
TGLRLDHYAEIGFGGFASLVDAVG

SEQ ID NO: 936181 - protein, 19 aa, Mycobacterium
TGLRVPETVGWDYGSISGL

SEQ ID NO: 936182 - protein, 17 aa, Mycobacterium
TGLRYRNNVPLTYPFVL

SEQ ID NO: 936183 - protein, 24 aa, Mycobacterium
TGLSAKGAKTFAIDAASAYCPQYV

SEQ ID NO: 936184 - protein, 26 aa, Mycobacterium
TGLSSKGAKTFAIDAASAYCPEYVTS

SEQ ID NO: 936185 - protein, 22 aa, Mycobacterium
TGLVLRLRSPYVTKDYLSDPAI

SEQ ID NO: 936186 - protein, 35 aa, Mycobacterium
TGLWPAGGCDVQWWFDLPWSYDFVRPQRPIDLIRA

SEQ ID NO: 936187 - protein, 19 aa, Mycobacterium
TGNARSLAHWALLDPAART

SEQ ID NO: 936188 - protein, 24 aa, Mycobacterium
TGNKPMPQCVATRVRKDLDVYGGT

SEQ ID NO: 936189 - protein, 23 aa, Mycobacterium
TGNPAGDLMDVWRARPNSDQFDM

SEQ ID NO: 936190 - protein, 19 aa, Mycobacterium
TGPAIVLAVGLGFANAGGV

SEQ ID NO: 936191 - protein, 26 aa, Mycobacterium
TGPAWRREFLTAMGLTVLDTDDEIPR

SEQ ID NO: 936192 - protein, 24 aa, Mycobacterium
TGPENYERLLARRNERTRAVLAAL

SEQ ID NO: 936193 - protein, 21 aa, Mycobacterium
TGPFIDWLEITGALASETANQ

SEQ ID NO: 936194 - protein, 22 aa, Mycobacterium
TGPFRSGWVMDYPSIYNFLESL

SEQ ID NO: 936195 - protein, 18 aa, Mycobacterium
TGPGWKGTLPQGVQEYKS

SEQ ID NO: 936196 - protein, 20 aa, Mycobacterium
TGPQRYWWTPGVAHVVPNWN

SEQ ID NO: 936197 - protein, 18 aa, Mycobacterium
TGPYVPMTMGYYTRQDIP

SEQ ID NO: 936198 - protein, 25 aa, Mycobacterium
TGQPWVVSFQLNWPRDHGPNVTGWM

SEQ ID NO: 936199 - protein, 26 aa, Mycobacterium
TGQPWVVSFQLNWPRDHGPTVTGWML

SEQ ID NO: 936200 - protein, 20 aa, Mycobacterium
TGRFKDAYTSLSRDVVIPGS

SEQ ID NO: 936201 - protein, 19 aa, Mycobacterium
TGRIVAPITYYGAIAYGPN

SEQ ID NO: 936202 - protein, 21 aa, Mycobacterium
TGRLYFDVRGGTAPDSVVYRD

SEQ ID NO: 936203 - protein, 18 aa, Mycobacterium
TGRRPRLYGAGANVRDWI

SEQ ID NO: 936204 - protein, 17 aa, Mycobacterium
TGRRWTLTDADGREHRF

SEQ ID NO: 936205 - protein, 21 aa, Mycobacterium
TGRRWYLMCFDRDRDDWRSLR

SEQ ID NO: 936206 - protein, 17 aa, Mycobacterium
TGRWTVRRTEVDLDGTL

SEQ ID NO: 936207 - protein, 19 aa, Mycobacterium
TGSDWYRWVHDPLNRLLGL

SEQ ID NO: 936208 - protein, 19 aa, Mycobacterium
TGSLEALAMHLGDVAYAPI

SEQ ID NO: 936209 - protein, 33 aa, Mycobacterium
TGSPFTFLKLFGVDLGWVPPFPNPVAEDINNTE

SEQ ID NO: 936210 - protein, 23 aa, Mycobacterium
TGSRWEMDPTLLVSADVTSENPF

SEQ ID NO: 936211 - protein, 24 aa, Mycobacterium
TGSTLLYPLFSEWGAAYRAKHPNV

SEQ ID NO: 936212 - protein, 24 aa, Mycobacterium
TGSTLYWNLSLWSEYNIMLMETDL

SEQ ID NO: 936213 - protein, 25 aa, Mycobacterium
TGTARRLRALIAIGYTPHLLSRELG

SEQ ID NO: 936214 - protein, 28 aa, Mycobacterium
TGTQVRVAAFGPRAANVVGLTDQTDLFF

SEQ ID NO: 936215 - protein, 29 aa, Mycobacterium
TGTWTIFPTCVPIVGDLREPLYLPVGCTL

SEQ ID NO: 936216 - protein, 19 aa, Mycobacterium
TGVGCSNMGDGRRLVGLQA

SEQ ID NO: 936217 - protein, 17 aa, Mycobacterium
TGVGVVRTVDCRDSTLF

SEQ ID NO: 936218 - protein, 24 aa, Mycobacterium
TGVHSRADYETALRAITFSAESLG

SEQ ID NO: 936219 - protein, 19 aa, Mycobacterium
TGVKGWINRWFYSVSGQVP

SEQ ID NO: 936220 - protein, 21 aa, Mycobacterium
TGVSCVRELTGKGFTFSGDGY

SEQ ID NO: 936221 - protein, 26 aa, Mycobacterium
TGVSQPWGIAFANGMILAVSADTQTV

SEQ ID NO: 936222 - protein, 24 aa, Mycobacterium
TGVTELLFALGLQDRMAGYFLDSG

SEQ ID NO: 936223 - protein, 19 aa, Mycobacterium
TGVYGGIDVCQWAAADGVI

SEQ ID NO: 936224 - protein, 19 aa, Mycobacterium
TGVYGGVNVCQWAIEDGVI

SEQ ID NO: 936225 - protein, 19 aa, Mycobacterium
TGYQKFILWGMDTVKERRI

SEQ ID NO: 936226 - protein, 20 aa, Mycobacterium
THAALPLVVRAGERERGVAD

SEQ ID NO: 936227 - protein, 21 aa, Mycobacterium
THAGACGLQPGIIDVPFTLSF

SEQ ID NO: 936228 - protein, 25 aa, Mycobacterium
THDGEMKTPMGIFTLDFAFGTAPNP

SEQ ID NO: 936229 - protein, 26 aa, Mycobacterium
THDSWARYLRWVANAVGLKVVRGEMV

SEQ ID NO: 936230 - protein, 41 aa, Mycobacterium
THGTLFFDGTNRAFSYRPNTGFTGQDSFTYKVNDGTVDSAI

SEQ ID NO: 936231 - protein, 27 aa, Mycobacterium
THLRRLFGSWAEPIPQLLAATDPADVL

SEQ ID NO: 936232 - protein, 25 aa, Mycobacterium
THLSSLRTTLVAANAAAAVPTTGLL

SEQ ID NO: 936233 - protein, 22 aa, Mycobacterium
THPEFILNNPLDYMTPELRALS

SEQ ID NO: 936234 - protein, 27 aa, Mycobacterium
THPGCDAPGYWCEVHHLADWAAGGPTD

SEQ ID NO: 936235 - protein, 23 aa, Mycobacterium
THPIGTGPFAFAGRKSGDSITLK

SEQ ID NO: 936236 - protein, 17 aa, Mycobacterium
THPVGTGPFSFLGQKSG

SEQ ID NO: 936237 - protein, 17 aa, Mycobacterium
THQRAFMSALFHRVSSP

SEQ ID NO: 936238 - protein, 17 aa, Mycobacterium
THSDGWPVVPVDGDAVL

SEQ ID NO: 936239 - protein, 17 aa, Mycobacterium
THVGRYMGIDDLLVEAP

SEQ ID NO: 936240 - protein, 23 aa, Mycobacterium
TIAKACAPAGITVQDAANADTGP

SEQ ID NO: 936241 - protein, 17 aa, Mycobacterium
TIAVSGIGARAAPTNVT

SEQ ID NO: 936242 - protein, 25 aa, Mycobacterium
TIAYRNAPMGFGWPDGIDEVPALQH

SEQ ID NO: 936243 - protein, 26 aa, Mycobacterium
TIDCGDGYEVPADWYVPDGPTPTRLI

SEQ ID NO: 936244 - protein, 26 aa, Mycobacterium
TIDGEGRRLLGLEIKLPTVVQTETGD

SEQ ID NO: 936245 - protein, 25 aa, Mycobacterium
TIDWYRANESWWRPLKDAAEARYEE

SEQ ID NO: 936246 - protein, 24 aa, Mycobacterium
TIDYKTYDAQGWTITSTADGTRFQ

SEQ ID NO: 936247 - protein, 24 aa, Mycobacterium
TIFAPEGLLHFGLGINAPPPCLTG

SEQ ID NO: 936248 - protein, 19 aa, Mycobacterium
TIFRPGTRLAVTIPPVDPH

SEQ ID NO: 936249 - protein, 21 aa, Mycobacterium
TIFRPNTRFAVTIPPVDPHRG

SEQ ID NO: 936250 - protein, 21 aa, Mycobacterium
TIGGRNWDVWQGSNGSNNVIS

SEQ ID NO: 936251 - protein, 17 aa, Mycobacterium
TIGLLLFDGVEELDFAG

SEQ ID NO: 936252 - protein, 19 aa, Mycobacterium
TIGRPALTAVRVRAEGLEI

SEQ ID NO: 936253 - protein, 23 aa, Mycobacterium
TIGRRVCETEWDLLDLLEGDPPA

SEQ ID NO: 936254 - protein, 19 aa, Mycobacterium
TIGTDFPGTDYLGADMFTS

SEQ ID NO: 936255 - protein, 18 aa, Mycobacterium
TIGTRRWRHSPIEAPEIV

SEQ ID NO: 936256 - protein, 25 aa, Mycobacterium
TIHLARFGPAPGAPWEVVGSRDDVL

SEQ ID NO: 936257 - protein, 17 aa, Mycobacterium
TILGLLTAVLIWGPNVG

SEQ ID NO: 936258 - protein, 17 aa, Mycobacterium
TIMPARVSTAGAVATNP

SEQ ID NO: 936259 - protein, 29 aa, Mycobacterium
TINGAVNTAAWWVMNAIPTAVSLGHTVGT

SEQ ID NO: 936260 - protein, 18 aa, Mycobacterium
TIPPGMVVTPMLEKAIAE

SEQ ID NO: 936261 - protein, 23 aa, Mycobacterium
TIPRARTAVPVEFDEFRQQLERL

SEQ ID NO: 936262 - protein, 24 aa, Mycobacterium
TIRARSTGVTDHRTGRPRYPGAAG

SEQ ID NO: 936263 - protein, 17 aa, Mycobacterium
TIREFLQSKGVKLEAQK

SEQ ID NO: 936264 - protein, 19 aa, Mycobacterium
TISDLKPSSDPIPYAVQGT

SEQ ID NO: 936265 - protein, 23 aa, Mycobacterium
TISEDTWSVAIHLTDGATDVDGD

SEQ ID NO: 936266 - protein, 23 aa, Mycobacterium
TITGWATSGGFCDKPNAYTVYFA

SEQ ID NO: 936267 - protein, 25 aa, Mycobacterium
TITMCAGCGMAAAARPMRGVSGLAA

SEQ ID NO: 936268 - protein, 18 aa, Mycobacterium
TIWAARAIGVLFPQIKTI

SEQ ID NO: 936269 - protein, 26 aa, Mycobacterium
TIWVEIGRGHTRNCRLSWVQIIPTIA

SEQ ID NO: 936270 - protein, 24 aa, Mycobacterium
TKATDWPALDAAYFTGAAIQAYCP

SEQ ID NO: 936271 - protein, 19 aa, Mycobacterium
TKDWAVALQDIYGGDDAAS

SEQ ID NO: 936272 - protein, 18 aa, Mycobacterium
TKERQCQFMPTIGSTVVP

SEQ ID NO: 936273 - protein, 17 aa, Mycobacterium
TKGIAFGSVVTLVVRAG

SEQ ID NO: 936274 - protein, 19 aa, Mycobacterium
TKGRIGWNVVTSALENSWR

SEQ ID NO: 936275 - protein, 17 aa, Mycobacterium
TKHQRLTSAVAASIVAT

SEQ ID NO: 936276 - protein, 17 aa, Mycobacterium
TKHTIVFDGNQCVDKAA

SEQ ID NO: 936277 - protein, 24 aa, Mycobacterium
TKIERQGWHALLTIRLDGDVELPA

SEQ ID NO: 936278 - protein, 19 aa, Mycobacterium
TKIPVPPTRVVSAGLTDAD

SEQ ID NO: 936279 - protein, 20 aa, Mycobacterium
TKKLAAPVGIRADCLGVQAP

SEQ ID NO: 936280 - protein, 17 aa, Mycobacterium
TKLMRWTGLSAEKVART

SEQ ID NO: 936281 - protein, 23 aa, Mycobacterium
TKLNIKVLRDYAARAPRPGHRRI

SEQ ID NO: 936282 - protein, 25 aa, Mycobacterium
TKLSIPDLIRLASQALHYLAVYDEH

SEQ ID NO: 936283 - protein, 25 aa, Mycobacterium
TKNSEVSTVWTWPDKPGVAGCAAMD

SEQ ID NO: 936284 - protein, 20 aa, Mycobacterium
TKNVRAMAVQRWRQAGFRNA

SEQ ID NO: 936285 - protein, 19 aa, Mycobacterium
TKPRCCAPAAVAASATTPA

SEQ ID NO: 936286 - protein, 19 aa, Mycobacterium
TKPTTEWLNRMMRSTSAVL

SEQ ID NO: 936287 - protein, 20 aa, Mycobacterium
TKQFVARCVGKMGKNFLENV

SEQ ID NO: 936288 - protein, 23 aa, Mycobacterium
TKSRARTVLCVTAIAALALSGCT

SEQ ID NO: 936289 - protein, 33 aa, Mycobacterium
TKSSVRWETKDRPALEAAFKKAGVDYTIQNAEG

SEQ ID NO: 936290 - protein, 23 aa, Mycobacterium
TKTARMNFLLSLTEQFTDTGEPA

SEQ ID NO: 936291 - protein, 18 aa, Mycobacterium
TKVGVLQANYIVDTLGVA

SEQ ID NO: 936292 - protein, 24 aa, Mycobacterium
TKVVPRQKLPFAIEPTTVGARGSD

SEQ ID NO: 936293 - protein, 23 aa, Mycobacterium
TKYHGALTCMLVGAKIALDTGYL

SEQ ID NO: 936294 - protein, 26 aa, Mycobacterium
TKYPVAITVAPLRWDLVRDGAPALGA

SEQ ID NO: 936295 - protein, 19 aa, Mycobacterium
TLAAKLGLERQWLHAKSLA

SEQ ID NO: 936296 - protein, 18 aa, Mycobacterium
TLAASVFVWRRLPYATDV

SEQ ID NO: 936297 - protein, 19 aa, Mycobacterium
TLAEDVRRLVEFDYPAELL

SEQ ID NO: 936298 - protein, 24 aa, Mycobacterium
TLAELGTSIGWVPFVGTGLYGASF

SEQ ID NO: 936299 - protein, 30 aa, Mycobacterium
TLAPACCRQTLPSALTWRRIAGDPLRRRTW

SEQ ID NO: 936300 - protein, 25 aa, Mycobacterium
TLAQFPKAVMLRLHGTGVTNPAVSN

SEQ ID NO: 936301 - protein, 23 aa, Mycobacterium
TLASSGTSYWSAEATNVEQTLLN

SEQ ID NO: 936302 - protein, 23 aa, Mycobacterium
TLASWTFQRIWDALARRLGDGIE

SEQ ID NO: 936303 - protein, 24 aa, Mycobacterium
TLDETACDAWVGRIRCGDTDRVTM

SEQ ID NO: 936304 - protein, 25 aa, Mycobacterium
TLDKVEKRITVLGMNNTITYKDGDP

SEQ ID NO: 936305 - protein, 19 aa, Mycobacterium
TLDLMGMDVVWTAEFAEAG

SEQ ID NO: 936306 - protein, 23 aa, Mycobacterium
TLDPIPGEGFFLVGTDIAPGLYT

SEQ ID NO: 936307 - protein, 21 aa, Mycobacterium
TLDVMGLDVMWTAEFAEAGWA

SEQ ID NO: 936308 - protein, 24 aa, Mycobacterium
TLEAFLRRRIRSSGLVTASIAAAV

SEQ ID NO: 936309 - protein, 25 aa, Mycobacterium
TLEFMRRLGAPWTFGTDAPASLVER

SEQ ID NO: 936310 - protein, 26 aa, Mycobacterium
TLELLPALRAARGHVVFINSGAGINA

SEQ ID NO: 936311 - protein, 34 aa, Mycobacterium
TLERLFPGIGAFGDRIAPGLGLDGPSYGESIDVG

SEQ ID NO: 936312 - protein, 23 aa, Mycobacterium
TLGDRTYRALGWTIVSSPAGMRF

SEQ ID NO: 936313 - protein, 22 aa, Mycobacterium
TLGRLRAVPVAGLDLRRDLRAV

SEQ ID NO: 936314 - protein, 18 aa, Mycobacterium
TLGSGVLAPALWSVVEAF

SEQ ID NO: 936315 - protein, 18 aa, Mycobacterium
TLGTAVFVGAEFSLTALD

SEQ ID NO: 936316 - protein, 17 aa, Mycobacterium
TLIAVIVSRHCRRVVLV

SEQ ID NO: 936317 - protein, 24 aa, Mycobacterium
TLIDLLRMRSGLYCYTNDSEFAAT

SEQ ID NO: 936318 - protein, 22 aa, Mycobacterium
TLIGRLIMRPAQTFAVPLVGLA

SEQ ID NO: 936319 - protein, 17 aa, Mycobacterium
TLIPPALVNGIPAAAAA

SEQ ID NO: 936320 - protein, 17 aa, Mycobacterium
TLISDRVGLVMNPDAKV

SEQ ID NO: 936321 - protein, 19 aa, Mycobacterium
TLIYIGWRAARSQTNRPKT

SEQ ID NO: 936322 - protein, 24 aa, Mycobacterium
TLKYTLWRLQERVVGRGPDSPQVP

SEQ ID NO: 936323 - protein, 19 aa, Mycobacterium
TLLGGLSIAVGDEVIDGTL

SEQ ID NO: 936324 - protein, 27 aa, Mycobacterium
TLLGQRLFPALLDRYLARNGYASQQTD

SEQ ID NO: 936325 - protein, 19 aa, Mycobacterium
TLLGRPLIGTGADGAPGRN

SEQ ID NO: 936326 - protein, 20 aa, Mycobacterium
TLLITSGWRSRAFQQQLLDD

SEQ ID NO: 936327 - protein, 20 aa, Mycobacterium
TLLRPLGMGVTSYRFEDYAS

SEQ ID NO: 936328 - protein, 20 aa, Mycobacterium
TLLRRSHPAALERVGDDGRR

SEQ ID NO: 936329 - protein, 18 aa, Mycobacterium
TLLSGCVRFDPTQDQPFT

SEQ ID NO: 936330 - protein, 21 aa, Mycobacterium
TLLYDGRAPAFWVLADPEGNE

SEQ ID NO: 936331 - protein, 17 aa, Mycobacterium
TLMNNWRAKGASMVQDS

SEQ ID NO: 936332 - protein, 17 aa, Mycobacterium
TLNRPGFGLTDSLHELR

SEQ ID NO: 936333 - protein, 26 aa, Mycobacterium
TLNVFANDGLIEWDAFDPDGDALTAG

SEQ ID NO: 936334 - protein, 17 aa, Mycobacterium
TLPAEPIHVVFRNDESG

SEQ ID NO: 936335 - protein, 23 aa, Mycobacterium
TLPAGKLRDALGIREVGYTRGET

SEQ ID NO: 936336 - protein, 25 aa, Mycobacterium
TLPKHCAGLVIGAVAGRPAPSAVGA

SEQ ID NO: 936337 - protein, 18 aa, Mycobacterium
TLPMTKRAEPGIPLVALW

SEQ ID NO: 936338 - protein, 23 aa, Mycobacterium
TLPNRLYWMSAWNDPAGTNGGPQ

SEQ ID NO: 936339 - protein, 19 aa, Mycobacterium
TLPTPALRDAGVEHPPACT

SEQ ID NO: 936340 - protein, 18 aa, Mycobacterium
TLQLPPGLVGLRAAEAIT

SEQ ID NO: 936341 - protein, 20 aa, Mycobacterium
TLRRAFRIGTELAALTHGHP

SEQ ID NO: 936342 - protein, 18 aa, Mycobacterium
TLSDLRFEADRVLVDVDA

SEQ ID NO: 936343 - protein, 20 aa, Mycobacterium
TLSDYAALVMRDPAAARTCV

SEQ ID NO: 936344 - protein, 23 aa, Mycobacterium
TLSENGWKTFFRGLANDGVQGPS

SEQ ID NO: 936345 - protein, 17 aa, Mycobacterium
TLSGCGRSAEGGGGGDG

SEQ ID NO: 936346 - protein, 17 aa, Mycobacterium
TLSKGYGLNNCTAQNID

SEQ ID NO: 936347 - protein, 19 aa, Mycobacterium
TLSPSRPLTPVPIVDLVSQ

SEQ ID NO: 936348 - protein, 24 aa, Mycobacterium
TLTARPGQRIRMRIINAASDTAFR

SEQ ID NO: 936349 - protein, 18 aa, Mycobacterium
TLTGMGLMRVISGQTVDA

SEQ ID NO: 936350 - protein, 17 aa, Mycobacterium
TLTRLTAALSHRSPEVA

SEQ ID NO: 936351 - protein, 17 aa, Mycobacterium
TLTVIVGGCSPEFDTGS

SEQ ID NO: 936352 - protein, 35 aa, Mycobacterium
TLVALVVLALFYLRLPTWAGLGMYKLNADLPNSGG

SEQ ID NO: 936353 - protein, 20 aa, Mycobacterium
TLVDRLVTDFGIPRDRVYAT

SEQ ID NO: 936354 - protein, 27 aa, Mycobacterium
TLVPHYDVYPAFAFRFDVKDPAVSITF

SEQ ID NO: 936355 - protein, 17 aa, Mycobacterium
TLWFPFATSAWPTLAGA

SEQ ID NO: 936356 - protein, 20 aa, Mycobacterium
TLYDELCWAPKHTDFEEGLG

SEQ ID NO: 936357 - protein, 20 aa, Mycobacterium
TLYDELCWAPKHTDFEEGLR

SEQ ID NO: 936358 - protein, 22 aa, Mycobacterium
TMAELWWDRPFTVEGVAIGASV

SEQ ID NO: 936359 - protein, 28 aa, Mycobacterium
TMLRQQGYRTWWWGKWHLGDWSDTNPEG

SEQ ID NO: 936360 - protein, 20 aa, Mycobacterium
TMMACPRPVGDADQWMSRFF

SEQ ID NO: 936361 - protein, 17 aa, Mycobacterium
TMNYPPVLFHPINSITA

SEQ ID NO: 936362 - protein, 23 aa, Mycobacterium
TMQVCKKAQCPFDTDPRSGTENL

SEQ ID NO: 936363 - protein, 22 aa, Mycobacterium
TMQVCQKAQCPFNTAESENLQI

SEQ ID NO: 936364 - protein, 17 aa, Mycobacterium
TMSCASGYWVVQYPRAQ

SEQ ID NO: 936365 - protein, 32 aa, Mycobacterium
TMSKAGDLVTWWTGDALMVFSGNDLRYKYTVA

SEQ ID NO: 936366 - protein, 25 aa, Mycobacterium
TMTGGVWWDCYRDLVSNVVLLDKLT

SEQ ID NO: 936367 - protein, 22 aa, Mycobacterium
TMVPGRVFEAMTVLPESQVANM

SEQ ID NO: 936368 - protein, 18 aa, Mycobacterium
TMYGLRVGAISTPDPHTP

SEQ ID NO: 936369 - protein, 21 aa, Mycobacterium
TNASPLEKAIGVFTAPAEGQA

SEQ ID NO: 936370 - protein, 20 aa, Mycobacterium
TNELPTWLATHRGQDPFGNA

SEQ ID NO: 936371 - protein, 18 aa, Mycobacterium
TNFINHGVLTPSRREFAD

SEQ ID NO: 936372 - protein, 28 aa, Mycobacterium
TNGCAPFCVPGRHLDTATGLCLKDAPPP

SEQ ID NO: 936373 - protein, 18 aa, Mycobacterium
TNGFEVGRRMGIGSRETY

SEQ ID NO: 936374 - protein, 25 aa, Mycobacterium
TNGWIGHSGITPGFETVVVGLPEAQ

SEQ ID NO: 936375 - protein, 17 aa, Mycobacterium
TNLDCATGKSLNVAGSD

SEQ ID NO: 936376 - protein, 24 aa, Mycobacterium
TNLDRLDSLMAVARKDVVLSAGWD

SEQ ID NO: 936377 - protein, 20 aa, Mycobacterium
TNLNPVWKVGFQIREALRAN

SEQ ID NO: 936378 - protein, 25 aa, Mycobacterium
TNPEDLPTLLAHYGVHGVNTDSDSA

SEQ ID NO: 936379 - protein, 19 aa, Mycobacterium
TNPLAGVTVPDAFTPLTVA

SEQ ID NO: 936380 - protein, 39 aa, Mycobacterium
TNPPVEGAFYWLNNREVRWRPEHFWKSGTAIDVAVNTYG

SEQ ID NO: 936381 - protein, 25 aa, Mycobacterium
TNPPVEGSWAWLPDEAKGARVHWRP

SEQ ID NO: 936382 - protein, 21 aa, Mycobacterium
TNTAQDWKLSAKESGDANDLP

SEQ ID NO: 936383 - protein, 19 aa, Mycobacterium
TNTAQDWRLSAKEDGDAND

SEQ ID NO: 936384 - protein, 28 aa, Mycobacterium
TNTQLLWYRADLMPAPPTTWDGMLDEAN

SEQ ID NO: 936385 - protein, 19 aa, Mycobacterium
TNTQLLWYRKDLVPEPPAT

SEQ ID NO: 936386 - protein, 23 aa, Mycobacterium
TNVRGARNLPCVTRPGKRAPTVK

SEQ ID NO: 936387 - protein, 18 aa, Mycobacterium
TPAADFDGTDAFTYTLND

SEQ ID NO: 936388 - protein, 18 aa, Mycobacterium
TPAAPAITSLMTSVAAAG

SEQ ID NO: 936389 - protein, 23 aa, Mycobacterium
TPACTARAAALLRHTASSVHTVS

SEQ ID NO: 936390 - protein, 19 aa, Mycobacterium
TPADALRYLRAQSLGSMDD

SEQ ID NO: 936391 - protein, 18 aa, Mycobacterium
TPAFEWYNQSGISTVMPV

SEQ ID NO: 936392 - protein, 18 aa, Mycobacterium
TPAFEWYNQSGISVAMPV

SEQ ID NO: 936393 - protein, 18 aa, Mycobacterium
TPAFEWYYQSGLSIIMPV

SEQ ID NO: 936394 - protein, 20 aa, Mycobacterium
TPAGCTWTPNGYWSVLPNVT

SEQ ID NO: 936395 - protein, 25 aa, Mycobacterium
TPAIYDPEWNRPAGSVTDDHFFDGR

SEQ ID NO: 936396 - protein, 17 aa, Mycobacterium
TPAMPVPFPRTGQGGEP

SEQ ID NO: 936397 - protein, 24 aa, Mycobacterium
TPAMVGPCRLPAAGEFPDGAAMFA

SEQ ID NO: 936398 - protein, 23 aa, Mycobacterium
TPDFRAGCKRMLMTSDYYAALEK

SEQ ID NO: 936399 - protein, 18 aa, Mycobacterium
TPDGRSVATATFDFTGGY

SEQ ID NO: 936400 - protein, 17 aa, Mycobacterium
TPDRMNPVLRAKVDGAW

SEQ ID NO: 936401 - protein, 26 aa, Mycobacterium
TPEADAMIADWLRGYQAVRVLSEEHL

SEQ ID NO: 936402 - protein, 27 aa, Mycobacterium
TPEFEHSRIITCTGWYLSSAKAAEVMA

SEQ ID NO: 936403 - protein, 22 aa, Mycobacterium
TPEGPTGFPPGLWARQTTEIRS

SEQ ID NO: 936404 - protein, 25 aa, Mycobacterium
TPFFDAWRQHGWRPPAESGPPSAHW

SEQ ID NO: 936405 - protein, 30 aa, Mycobacterium
TPFPTMYELFSVGWGKPDLRSQWQHGSPQV

SEQ ID NO: 936406 - protein, 26 aa, Mycobacterium
TPFPTMYELFSVGWGQPDLREQWKQA

SEQ ID NO: 936407 - protein, 26 aa, Mycobacterium
TPFPTMYELFSVGWGQPDVRDQWKHA

SEQ ID NO: 936408 - protein, 33 aa, Mycobacterium
TPFPTMYELFSVGWGRPDLRGQWEHGSPQVRAQ

SEQ ID NO: 936409 - protein, 17 aa, Mycobacterium
TPGGVYGPGGWGGPGGP

SEQ ID NO: 936410 - protein, 18 aa, Mycobacterium
TPGMPGDLALPGTTLPPT

SEQ ID NO: 936411 - protein, 21 aa, Mycobacterium
TPGPACYRLGGTEPTNTDANL

SEQ ID NO: 936412 - protein, 20 aa, Mycobacterium
TPGSYTYIYNNFPAVAPATV

SEQ ID NO: 936413 - protein, 24 aa, Mycobacterium
TPGTPAFAATAAFAADAALAAATR

SEQ ID NO: 936414 - protein, 19 aa, Mycobacterium
TPIAVGMVGNAKVTVAVDS

SEQ ID NO: 936415 - protein, 23 aa, Mycobacterium
TPISEAPVIHRVTSTPGVGNTWV

SEQ ID NO: 936416 - protein, 21 aa, Mycobacterium
TPKARTGFYGYGFNASVDSSG

SEQ ID NO: 936417 - protein, 19 aa, Mycobacterium
TPKVPGFDASGLMVYSYAA

SEQ ID NO: 936418 - protein, 19 aa, Mycobacterium
TPLDAAVVKANFDQHGFGD

SEQ ID NO: 936419 - protein, 18 aa, Mycobacterium
TPLGALSVPPGWTAAAVP

SEQ ID NO: 936420 - protein, 25 aa, Mycobacterium
TPMCKRLVMSGGFYRAMQRDDVDLV

SEQ ID NO: 936421 - protein, 25 aa, Mycobacterium
TPMCKRLVMSNGFYRAIQRDDVELV

SEQ ID NO: 936422 - protein, 26 aa, Mycobacterium
TPNEGPPQRWFVVWLGTSNDPVDKGA

SEQ ID NO: 936423 - protein, 20 aa, Mycobacterium
TPNPCVRCNERIKFSALAAR

SEQ ID NO: 936424 - protein, 20 aa, Mycobacterium
TPNPCVRCNQRIKFSALSAR

SEQ ID NO: 936425 - protein, 19 aa, Mycobacterium
TPNWRPGHRGVDLAGVPGE

SEQ ID NO: 936426 - protein, 22 aa, Mycobacterium
TPPHAWYIAFAPAQAPKVAVAV

SEQ ID NO: 936427 - protein, 23 aa, Mycobacterium
TPPHAWYIAFAPAQAPRVAIAVF

SEQ ID NO: 936428 - protein, 20 aa, Mycobacterium
TPPHAWYIAFAPAQTPKVAV

SEQ ID NO: 936429 - protein, 21 aa, Mycobacterium
TPPHAWYIAFAPAQTPKVAVA

SEQ ID NO: 936430 - protein, 22 aa, Mycobacterium
TPPHTWYLSFNMKDRYTSIPEV

SEQ ID NO: 936431 - protein, 18 aa, Mycobacterium
TPPLVLCHISHTYRTGAS

SEQ ID NO: 936432 - protein, 21 aa, Mycobacterium
TPPRPDTHFRIASNTKTMTAA

SEQ ID NO: 936433 - protein, 20 aa, Mycobacterium
TPPYRVPFPQVMPTQETTPA

SEQ ID NO: 936434 - protein, 21 aa, Mycobacterium
TPQGLRLVKVETLGQAVDALH

SEQ ID NO: 936435 - protein, 21 aa, Mycobacterium
TPRGIIWKAYVTIRPTKVPNA

SEQ ID NO: 936436 - protein, 28 aa, Mycobacterium
TPRGQRTPERWFVVWLGTATNPVPQGEA

SEQ ID NO: 936437 - protein, 27 aa, Mycobacterium
TPRTVTARFSLTVNSGVLAISPDGNTT

SEQ ID NO: 936438 - protein, 19 aa, Mycobacterium
TPSGLRLVKVETLGQAVDA

SEQ ID NO: 936439 - protein, 25 aa, Mycobacterium
TPSGNRLYISNGIAGTVSVLNTATE

SEQ ID NO: 936440 - protein, 23 aa, Mycobacterium
TPSKGAWQFIAPTFAAYHQPGTS

SEQ ID NO: 936441 - protein, 20 aa, Mycobacterium
TPSLWKAVADSGVFGLAVAE

SEQ ID NO: 936442 - protein, 17 aa, Mycobacterium
TPSRGAMTTGLYSHQTG

SEQ ID NO: 936443 - protein, 24 aa, Mycobacterium
TPTGWCSWQGLVALPDLADTQVAQ

SEQ ID NO: 936444 - protein, 21 aa, Mycobacterium
TPTIAALYRTRLKAVDSDRAL

SEQ ID NO: 936445 - protein, 25 aa, Mycobacterium
TPTLYRPAGGLSDPVVRQTAGQFGL

SEQ ID NO: 936446 - protein, 31 aa, Mycobacterium
TPTQQGRLGYFRELWHAMRTQEVSGSDALLL

SEQ ID NO: 936447 - protein, 20 aa, Mycobacterium
TPTTAFRLGEKVDDPLAMYQ

SEQ ID NO: 936448 - protein, 18 aa, Mycobacterium
TPVANFHGTDSFTYQVSD

SEQ ID NO: 936449 - protein, 18 aa, Mycobacterium
TPVRESLILLADEGLVQI

SEQ ID NO: 936450 - protein, 19 aa, Mycobacterium
TPVRVGLVQHRWLADPDQL

SEQ ID NO: 936451 - protein, 18 aa, Mycobacterium
TPYEAGVALARQLGGSLI

SEQ ID NO: 936452 - protein, 27 aa, Mycobacterium
TPYRGKEICGMPPPSSGGIAVAATLGM

SEQ ID NO: 936453 - protein, 17 aa, Mycobacterium
TPYRWTPDTKIGDSAII

SEQ ID NO: 936454 - protein, 18 aa, Mycobacterium
TQAIGAVVPVRMQVWAES

SEQ ID NO: 936455 - protein, 23 aa, Mycobacterium
TQALIGRPLIGNGTNGAPGTGQD

SEQ ID NO: 936456 - protein, 26 aa, Mycobacterium
TQCAADLPILPGLTTHAWTYGGTFPG

SEQ ID NO: 936457 - protein, 30 aa, Mycobacterium
TQDGRFLLTYPRRLGFGLGNSAVSLSWRTG

SEQ ID NO: 936458 - protein, 19 aa, Mycobacterium
TQDVKFVYVDGHLYSDLGQ

SEQ ID NO: 936459 - protein, 20 aa, Mycobacterium
TQELPAWLQANRDVRPTNNA

SEQ ID NO: 936460 - protein, 23 aa, Mycobacterium
TQGAFWLKVIGWSDGRQRIVIDH

SEQ ID NO: 936461 - protein, 17 aa, Mycobacterium
TQGARVLVVGVTYKPGV

SEQ ID NO: 936462 - protein, 19 aa, Mycobacterium
TQGCPAWTLDSGATASSTT

SEQ ID NO: 936463 - protein, 27 aa, Mycobacterium
TQGRGAWPVCGGPLSGPTPREVPAPAG

SEQ ID NO: 936464 - protein, 28 aa, Mycobacterium
TQIKGAAPDSVFFSGYYAEAAPFVQQLR

SEQ ID NO: 936465 - protein, 17 aa, Mycobacterium
TQIPVTVKFRIGIDDEH

SEQ ID NO: 936466 - protein, 22 aa, Mycobacterium
TQLLPALCEELGEFITGEPLAE

SEQ ID NO: 936467 - protein, 17 aa, Mycobacterium
TQLTLVRSLFAQTIAAS

SEQ ID NO: 936468 - protein, 23 aa, Mycobacterium
TQLTRQLRLELGHESVRQAGELV

SEQ ID NO: 936469 - protein, 23 aa, Mycobacterium
TQLTRQLRLELGHESVRQASELV

SEQ ID NO: 936470 - protein, 21 aa, Mycobacterium
TQMPGRLAVVQVQSGESLQHV

SEQ ID NO: 936471 - protein, 17 aa, Mycobacterium
TQMTRYWAQFVKTGNPN

SEQ ID NO: 936472 - protein, 18 aa, Mycobacterium
TQNGLPFLARLVYGRRVV

SEQ ID NO: 936473 - protein, 17 aa, Mycobacterium
TQPAGCAVGDYPSVLPK

SEQ ID NO: 936474 - protein, 24 aa, Mycobacterium
TQPALRPLVDLLPIAGGSGTLSNR

SEQ ID NO: 936475 - protein, 19 aa, Mycobacterium
TQQGWKTFFRGLANDGVQG

SEQ ID NO: 936476 - protein, 19 aa, Mycobacterium
TQQSVHLLLTVQGKVDGLP

SEQ ID NO: 936477 - protein, 30 aa, Mycobacterium; identical to SEQ ID NO: 739970

SEQ ID NO: 936478 - protein, 22 aa, Mycobacterium
TQTLLGRPLIGDGAAGTATNPN

SEQ ID NO: 936479 - protein, 21 aa, Mycobacterium
TQTRLTLKVDRGVPIPADAKA

SEQ ID NO: 936480 - protein, 25 aa, Mycobacterium
TQVAAGAWHTVLLRSDGTVVAVGDN

SEQ ID NO: 936481 - protein, 19 aa, Mycobacterium
TQVAARYGLTSTMPPSDGR

SEQ ID NO: 936482 - protein, 21 aa, Mycobacterium
TQVAGGAFHTVFLRSDGSVVG

SEQ ID NO: 936483 - protein, 24 aa, Mycobacterium
TQVFPKLGLSHSFIRVPQAQMDDY

SEQ ID NO: 936484 - protein, 24 aa, Mycobacterium
TRAAEARHGRKFGIVAGYGGHGIG

SEQ ID NO: 936485 - protein, 19 aa, Mycobacterium
TRAALSLLLVSTLVLAACG

SEQ ID NO: 936486 - protein, 23 aa, Mycobacterium
TRAAPRIVAAAALEGALLTQQQV

SEQ ID NO: 936487 - protein, 17 aa, Mycobacterium
TRAAQGWNIDTVKESLH

SEQ ID NO: 936488 - protein, 20 aa, Mycobacterium
TRAATPLILAIASLCALVAT

SEQ ID NO: 936489 - protein, 20 aa, Mycobacterium
TRAATSWVRGTMSAMRDELG

SEQ ID NO: 936490 - protein, 19 aa, Mycobacterium
TRAEYQWRSEGSVRAAMVV

SEQ ID NO: 936491 - protein, 21 aa, Mycobacterium
TRAGGLGMLAAGYKTVEAVEA

SEQ ID NO: 936492 - protein, 22 aa, Mycobacterium
TRAKAAYFMVVFSGPIPDDKWP

SEQ ID NO: 936493 - protein, 26 aa, Mycobacterium
TRALSFLPTYPFPKETLTNWMRGDYA

SEQ ID NO: 936494 - protein, 26 aa, Mycobacterium
TRAPLRPDFYHRIGSVTKTFTVTAVL

SEQ ID NO: 936495 - protein, 26 aa, Mycobacterium
TRASARIPASVFWRQLSSIAGYEAGN

SEQ ID NO: 936496 - protein, 25 aa, Mycobacterium
TRAVIKVMTILGSRYLELVPDGPGS

SEQ ID NO: 936497 - protein, 20 aa, Mycobacterium
TRDIPAGASPRLVFGLGANA

SEQ ID NO: 936498 - protein, 30 aa, Mycobacterium
TRESLPLASIFKLYVLHALADAVKDGTVSW

SEQ ID NO: 936499 - protein, 17 aa, Mycobacterium
TREYYPAGTTVSVEAKL

SEQ ID NO: 936500 - protein, 21 aa, Mycobacterium
TRFGVPVPNLTAWRRSVTGDM

SEQ ID NO: 936501 - protein, 20 aa, Mycobacterium
TRGATTLAIDTRNNLPALTT

SEQ ID NO: 936502 - protein, 20 aa, Mycobacterium
TRGGELLVYGVDPLILRQRY

SEQ ID NO: 936503 - protein, 17 aa, Mycobacterium
TRGGKAMMVVIKPSTGE

SEQ ID NO: 936504 - protein, 19 aa, Mycobacterium
TRGGQLLVYGVDPLILRQA

SEQ ID NO: 936505 - protein, 17 aa, Mycobacterium
TRGLGLSMFVLCSSIAG

SEQ ID NO: 936506 - protein, 35 aa, Mycobacterium
TRGPAAEIMVCRYADGIGHPFWLSRTIFGELAQLH

SEQ ID NO: 936507 - protein, 21 aa, Mycobacterium
TRGSMRPVLRVAPLSVAGLLR

SEQ ID NO: 936508 - protein, 18 aa, Mycobacterium
TRGSVVFRVADGDRDLVF

SEQ ID NO: 936509 - protein, 26 aa, Mycobacterium
TRGVSGDGRFAYLRGENALTVVDAGS

SEQ ID NO: 936510 - protein, 23 aa, Mycobacterium
TRIFVNFMPAKGLQAGESAPTIL

SEQ ID NO: 936511 - protein, 20 aa, Mycobacterium
TRIFVNFMPAKGLQAGETAP

SEQ ID NO: 936512 - protein, 26 aa, Mycobacterium
TRIGSTSEWWLQRYLAHNKVDTSKVE

SEQ ID NO: 936513 - protein, 20 aa, Mycobacterium
TRILPAGARIPVEQTAPALD

SEQ ID NO: 936514 - protein, 21 aa, Mycobacterium
TRIPAGFTGTVGYKAPYGRIP

SEQ ID NO: 936515 - protein, 24 aa, Mycobacterium
TRITWLSNEDQLWLLSREVGSAHV

SEQ ID NO: 936516 - protein, 27 aa, Mycobacterium
TRKDYGICPFAGWPVPIPNGAQPNTGS

SEQ ID NO: 936517 - protein, 20 aa, Mycobacterium
TRKHFPGAVQTHFWSAQDYT

SEQ ID NO: 936518 - protein, 24 aa, Mycobacterium
TRLEMWRSDMVRMLSYGALDAPIK

SEQ ID NO: 936519 - protein, 24 aa, Mycobacterium
TRLQWPLRPPAVVLRGFDAPTPNW

SEQ ID NO: 936520 - protein, 22 aa, Mycobacterium
TRLRILPEMATAAWTYNTSFPG

SEQ ID NO: 936521 - protein, 25 aa, Mycobacterium
TRLVKAGKVAEDWNAGATKGIPFGS

SEQ ID NO: 936522 - protein, 25 aa, Mycobacterium
TRLVKAGKVAKEWNADATKGIPFGS

SEQ ID NO: 936523 - protein, 25 aa, Mycobacterium
TRLVKAGKVSKDWNADATKGIAFGS

SEQ ID NO: 936524 - protein, 25 aa, Mycobacterium
TRMNAIPGVVPLEFGVVEAEVTARD

SEQ ID NO: 936525 - protein, 29 aa, Mycobacterium
TRNLPLLQPLRWFGLGFVADALNAPLKEI

SEQ ID NO: 936526 - protein, 18 aa, Mycobacterium
TRNPKWWGTPPLLDSMTY

SEQ ID NO: 936527 - protein, 20 aa, Mycobacterium
TRPAELLARARLYVERPGEA

SEQ ID NO: 936528 - protein, 22 aa, Mycobacterium
TRPFGTVRPGPFGVGGPDVDYL

SEQ ID NO: 936529 - protein, 21 aa, Mycobacterium
TRPTVGSVLRVEPRRFKMPRP

SEQ ID NO: 936530 - protein, 22 aa, Mycobacterium
TRPYSGAVCQYVLALESAPDAT

SEQ ID NO: 936531 - protein, 26 aa, Mycobacterium
TRQPYVVSFQLNWPRDHGPTVTGWML

SEQ ID NO: 936532 - protein, 24 aa, Mycobacterium
TRQSDGWFPQWCISSNPVRRTSSF

SEQ ID NO: 936533 - protein, 17 aa, Mycobacterium
TRRRKVMAVSRVASLPV

SEQ ID NO: 936534 - protein, 25 aa, Mycobacterium
TRRRQCSHWATLSGLFWLGRVGTPQ

SEQ ID NO: 936535 - protein, 21 aa, Mycobacterium
TRRTALRAAVALTLAAGAAAC

SEQ ID NO: 936536 - protein, 19 aa, Mycobacterium
TRSPPSRMSRPVLRTPSRT

SEQ ID NO: 936537 - protein, 23 aa, Mycobacterium
TRSSETLDAWTLHIYVRYELAIA

SEQ ID NO: 936538 - protein, 21 aa, Mycobacterium
TRSSTWYKAFNYNLGTKQPIT

SEQ ID NO: 936539 - protein, 23 aa, Mycobacterium
TRSTAYDRAWWFTRYVADAYGPA

SEQ ID NO: 936540 - protein, 23 aa, Mycobacterium
TRSVIRSAVSFLVALAALAAMAV

SEQ ID NO: 936541 - protein, 18 aa, Mycobacterium
TRTPRAFARHRRAEQRSE

SEQ ID NO: 936542 - protein, 31 aa, Mycobacterium
TRTTPRFRFEEICATPAFPDDIRKSAVAGRA

SEQ ID NO: 936543 - protein, 21 aa, Mycobacterium
TRTVEPWGVVTQKGRWYLVGH

SEQ ID NO: 936544 - protein, 21 aa, Mycobacterium
TRVAFPGVADYAGTKAAILGY

SEQ ID NO: 936545 - protein, 21 aa, Mycobacterium
TRVECNCAGVAPGTTYTTRQL

SEQ ID NO: 936546 - protein, 17 aa, Mycobacterium
TRVGPYMYCDVLRLDEC

SEQ ID NO: 936547 - protein, 25 aa, Mycobacterium
TRVHGRVCAVPLVVGMLLATALYGG

SEQ ID NO: 936548 - protein, 18 aa, Mycobacterium
TRVLAVVGAVFGVAVLCA

SEQ ID NO: 936549 - protein, 22 aa, Mycobacterium
TRVLRLRFAGTRAVGVDAVGPC

SEQ ID NO: 936550 - protein, 24 aa, Mycobacterium
TRVLRLTFAAGRVTGVLCVGPDGP

SEQ ID NO: 936551 - protein, 20 aa, Mycobacterium
TRWAAALVCAVLVAVAATWS

SEQ ID NO: 936552 - protein, 23 aa, Mycobacterium
TRYERLRMGLAEILGDYRSALRQ

SEQ ID NO: 936553 - protein, 19 aa, Mycobacterium
TRYLNLVAFGNGAFGVQDA

SEQ ID NO: 936554 - protein, 24 aa, Mycobacterium
TSAFRGVDAWFLIRAVTEPDAGTL

SEQ ID NO: 936555 - protein, 24 aa, Mycobacterium
TSAGKRGRHSSGLTAKPSDKESAP

SEQ ID NO: 936556 - protein, 18 aa, Mycobacterium
TSCINTFNQSGFVISPTG

SEQ ID NO: 936557 - protein, 18 aa, Mycobacterium
TSDIAVIRVQGMSGLTPI

SEQ ID NO: 936558 - protein, 18 aa, Mycobacterium
TSGADLVIVGGAVQSLAG

SEQ ID NO: 936559 - protein, 22 aa, Mycobacterium
TSGDGFGGFGGIGGTGGLFFGN

SEQ ID NO: 936560 - protein, 24 aa, Mycobacterium
TSGRGGYGLGAPRYGVKPTVMPKP

SEQ ID NO: 936561 - protein, 24 aa, Mycobacterium
TSGRKGWLAAFRDAALFKVCYGFG

SEQ ID NO: 936562 - protein, 18 aa, Mycobacterium
TSGRKWPVLFAGLMLGEP

SEQ ID NO: 936563 - protein, 17 aa, Mycobacterium
TSHLELRGPDGSTDKVL

SEQ ID NO: 936564 - protein, 17 aa, Mycobacterium
TSILRRLAAAACVGAVT

SEQ ID NO: 936565 - protein, 25 aa, Mycobacterium
TSIPEVRQAINLAVDREGMAKDMLR

SEQ ID NO: 936566 - protein, 24 aa, Mycobacterium
TSKPAPGYFYWYTDQQLRWKPTQF

SEQ ID NO: 936567 - protein, 23 aa, Mycobacterium
TSKTRWWQLGGMGLHIWTRAKIN

SEQ ID NO: 936568 - protein, 23 aa, Mycobacterium
TSLDPHGPVAFWGYSQGGGAAAS

SEQ ID NO: 936569 - protein, 23 aa, Mycobacterium
TSLDPHGPVAFWGYSQGGGATAS

SEQ ID NO: 936570 - protein, 18 aa, Mycobacterium
TSLGRFIDSTANAMAGNG

SEQ ID NO: 936571 - protein, 27 aa, Mycobacterium
TSLPETFVRTGGELAFSLAAYPDKRWG

SEQ ID NO: 936572 - protein, 28 aa, Mycobacterium
TSLQLTADMGRNFLVKLGILSPATAAAD

SEQ ID NO: 936573 - protein, 24 aa, Mycobacterium
TSLTRLTPVLAHRSAEVALDRANA

SEQ ID NO: 936574 - protein, 28 aa, Mycobacterium
TSMKVWYRAKAMWDWSQNVTDKNCLAVD

SEQ ID NO: 936575 - protein, 20 aa, Mycobacterium
TSMMSRVKWMLRARPADYLL

SEQ ID NO: 936576 - protein, 24 aa, Mycobacterium
TSMWGLGGSAAWKRNDPTVNVGKL

SEQ ID NO: 936577 - protein, 27 aa, Mycobacterium
TSNFLACDGCWVGGTPMHRAVADLFGD

SEQ ID NO: 936578 - protein, 25 aa, Mycobacterium
TSNPPVPGRFYWVTDTQLRWRPQDF

SEQ ID NO: 936579 - protein, 17 aa, Mycobacterium
TSPGFPPTAPVLAAAAD

SEQ ID NO: 936580 - protein, 21 aa, Mycobacterium
TSPKAVGSWNWIDDQTAHWRP

SEQ ID NO: 936581 - protein, 24 aa, Mycobacterium
TSPNRLYWISAWIDPDGVAGGPLL

SEQ ID NO: 936582 - protein, 25 aa, Mycobacterium
TSPNRLYWLSAWIDPAGTNGGPLVE

SEQ ID NO: 936583 - protein, 17 aa, Mycobacterium
TSPRGKRQFRRAVLDAG

SEQ ID NO: 936584 - protein, 21 aa, Mycobacterium
TSSAIKSFLTVAAGSGQADLP

SEQ ID NO: 936585 - protein, 29 aa, Mycobacterium
TSSFYRPTKAGAYPIVLVTYEIVCSKYPD

SEQ ID NO: 936586 - protein, 28 aa, Mycobacterium
TSSLTLPIGGGRSVQADWYFPEEYSSGQ

SEQ ID NO: 936587 - protein, 22 aa, Mycobacterium
TSSSTRYGIQGGVNPAAPASTT

SEQ ID NO: 936588 - protein, 25 aa, Mycobacterium
TSTSTPRWLTVTSTPEGAPATPNAL

SEQ ID NO: 936589 - protein, 18 aa, Mycobacterium
TSTYWTRITITNYESLLE

SEQ ID NO: 936590 - protein, 23 aa, Mycobacterium
TSVFKRGGAGGFEIPSVVLEVEF

SEQ ID NO: 936591 - protein, 18 aa, Mycobacterium
TSVHPGRISTPMQQELTE

SEQ ID NO: 936592 - protein, 24 aa, Mycobacterium
TSVPRCVGNTLLLNGRTYSPPYTI

SEQ ID NO: 936593 - protein, 17 aa, Mycobacterium
TSVRMPLTLNIPAGIPL

SEQ ID NO: 936594 - protein, 18 aa, Mycobacterium
TSVVNIWSAPAQQVAAAF

SEQ ID NO: 936595 - protein, 21 aa, Mycobacterium
TSVYANSGWVAMRGNQMTSPN

SEQ ID NO: 936596 - protein, 17 aa, Mycobacterium
TSWQVCTQSPSAGTVIP

SEQ ID NO: 936597 - protein, 37 aa, Mycobacterium
TTAAIAYRADERFAFCSTFKALLVAAVLHQYPLSHLD

SEQ ID NO: 936598 - protein, 21 aa, Mycobacterium
TTAALPWLVGVVGGEPKARAA

SEQ ID NO: 936599 - protein, 24 aa, Mycobacterium
TTAGYRWAWQTRAWSGGVREPAAV

SEQ ID NO: 936600 - protein, 26 aa, Mycobacterium
TTALEAWKSGIGDVVYSGAQPALLNY

SEQ ID NO: 936601 - protein, 23 aa, Mycobacterium
TTAQLRTATPLGDVFVAVTPPAT

SEQ ID NO: 936602 - protein, 25 aa, Mycobacterium
TTARVSVCYMGVDGRDGSVFDNSYE

SEQ ID NO: 936603 - protein, 23 aa, Mycobacterium
TTASLEIGNTVNYGSMGTTTNLD

SEQ ID NO: 936604 - protein, 27 aa, Mycobacterium
TTATAAKSGDDWLITWSPTVLHRDLTP

SEQ ID NO: 936605 - protein, 26 aa, Mycobacterium
TTAVMGGRMPHHWVNLGDRRISTLDL

SEQ ID NO: 936606 - protein, 20 aa, Mycobacterium
TTAWARSAIELAQRAADGLA

SEQ ID NO: 936607 - protein, 23 aa, Mycobacterium
TTCTAQGCVAHWLRVAELSDNPH

SEQ ID NO: 936608 - protein, 26 aa, Mycobacterium
TTDPKTRVCNAFALVRNAVSLQTNAN

SEQ ID NO: 936609 - protein, 18 aa, Mycobacterium
TTEAHRSSAFLGYTNNLA

SEQ ID NO: 936610 - protein, 25 aa, Mycobacterium
TTEANRSSAFLGFTNRYAAASYIYD

SEQ ID NO: 936611 - protein, 23 aa, Mycobacterium
TTEEVFAALGVVVNKGNVGALEE

SEQ ID NO: 936612 - protein, 23 aa, Mycobacterium
TTEEVFSALGVVVNKGNVGALED

SEQ ID NO: 936613 - protein, 18 aa, Mycobacterium
TTEEVLSALGVVVNKGNV

SEQ ID NO: 936614 - protein, 25 aa, Mycobacterium
TTEIWRFITEFHHPVHVHLNSFQVL

SEQ ID NO: 936615 - protein, 24 aa, Mycobacterium
TTEPELRPGPTTTPPPPPPLPAVP

SEQ ID NO: 936616 - protein, 25 aa, Mycobacterium
TTEPLGFDVKYTWKGSAVGLDGKAV

SEQ ID NO: 936617 - protein, 23 aa, Mycobacterium
TTEYGGRSGFFWNDENLAQCTGT

SEQ ID NO: 936618 - protein, 22 aa, Mycobacterium
TTFVRHVLDVMVGRGARTVEVT

SEQ ID NO: 936619 - protein, 18 aa, Mycobacterium
TTGDVVWDAGNTFEQLAV

SEQ ID NO: 936620 - protein, 18 aa, Mycobacterium
TTGEACGAIAGFGNGWFL

SEQ ID NO: 936621 - protein, 26 aa, Mycobacterium
TTGKELYFNLSLWSAYNVMLMRTTLP

SEQ ID NO: 936622 - protein, 18 aa, Mycobacterium
TTGKRARGPHTTITGQPT

SEQ ID NO: 936623 - protein, 20 aa, Mycobacterium
TTGLFPPGSTFKMVTAGAAV

SEQ ID NO: 936624 - protein, 21 aa, Mycobacterium
TTGLFPPGSTFKMVTAGAAVD

SEQ ID NO: 936625 - protein, 24 aa, Mycobacterium
TTGRIREAWNVPRDPNGVPAITTG

SEQ ID NO: 936626 - protein, 18 aa, Mycobacterium
TTIPLGQTIPSFDIAKLF

SEQ ID NO: 936627 - protein, 25 aa, Mycobacterium
TTITAGVDRLEWLDKIQPKATAPQV

SEQ ID NO: 936628 - protein, 17 aa, Mycobacterium
TTKGFRVLVPYLRGYGS

SEQ ID NO: 936629 - protein, 39 aa, Mycobacterium
TTKPPVEGAFYWLSNREVRWRPAEYWEPGTSVEVSVKAY

SEQ ID NO: 936630 - protein, 18 aa, Mycobacterium
TTKYALRRALEPIVPAHV

SEQ ID NO: 936631 - protein, 18 aa, Mycobacterium
TTLLRGASYLVFDGVRPD

SEQ ID NO: 936632 - protein, 17 aa, Mycobacterium
TTLPWSYTITTTQPAVF

SEQ ID NO: 936633 - protein, 18 aa, Mycobacterium
TTMFPGFATQFARQLRTV

SEQ ID NO: 936634 - protein, 34 aa, Mycobacterium
TTNPPVEGAFYWLSNREVRWRPAEYWEPGTHVEV

SEQ ID NO: 936635 - protein, 26 aa, Mycobacterium
TTNPPVEGSWAWLPDEAKGARVHWRP

SEQ ID NO: 936636 - protein, 25 aa, Mycobacterium
TTNPPVEGSWAWLPDEAQGARAHWR

SEQ ID NO: 936637 - protein, 25 aa, Mycobacterium
TTNPPVEGSWAWLPDEAQGARVHWR

SEQ ID NO: 936638 - protein, 24 aa, Mycobacterium
TTPHWLAVFAGEFGPKLDQVALTV

SEQ ID NO: 936639 - protein, 19 aa, Mycobacterium
TTPRTALDAGFGLGISTAS

SEQ ID NO: 936640 - protein, 17 aa, Mycobacterium
TTPVSLGTPAAEGTPAV

SEQ ID NO: 936641 - protein, 23 aa, Mycobacterium
TTPYRWAPDMKVGEPAVLKQISH

SEQ ID NO: 936642 - protein, 18 aa, Mycobacterium
TTQLKTADGIPVANATVE

SEQ ID NO: 936643 - protein, 25 aa, Mycobacterium
TTRKNARGDTEWLPPAHLDHGQPRT

SEQ ID NO: 936644 - protein, 25 aa, Mycobacterium
TTSALRVLLGLSLILTGCTARQDTP

SEQ ID NO: 936645 - protein, 17 aa, Mycobacterium
TTSPICAGLAYWQQTLA

SEQ ID NO: 936646 - protein, 24 aa, Mycobacterium
TTSRVAGAVWLPPRPADRASDTLA

SEQ ID NO: 936647 - protein, 23 aa, Mycobacterium
TTSWGRLVFCGSPRRYEPRYFRS

SEQ ID NO: 936648 - protein, 24 aa, Mycobacterium
TTTEGYRAGLLASIAASCTASYQV

SEQ ID NO: 936649 - protein, 18 aa, Mycobacterium
TTTIKWPVVPVTDPRPFD

SEQ ID NO: 936650 - protein, 23 aa, Mycobacterium
TTTPNVQAVRGWVELTKAPMQDL

SEQ ID NO: 936651 - protein, 25 aa, Mycobacterium
TTTPPVEGSWAWLPDEAGGSRMHWR

SEQ ID NO: 936652 - protein, 19 aa, Mycobacterium
TTTTPIWIVTAGQPTTLTV

SEQ ID NO: 936653 - protein, 24 aa, Mycobacterium
TTTVGVRGAALIPGATSRAGPAET

SEQ ID NO: 936654 - protein, 17 aa, Mycobacterium
TTVAYAAAFPVGVLPTN

SEQ ID NO: 936655 - protein, 19 aa, Mycobacterium
TTVAYPAAFPVGVLPTNSS

SEQ ID NO: 936656 - protein, 19 aa, Mycobacterium
TTWDLKRGVDLKHFPSSGP

SEQ ID NO: 936657 - protein, 21 aa, Mycobacterium
TTWMSGCRSWYLTKDGFNGSM

SEQ ID NO: 936658 - protein, 20 aa, Mycobacterium
TTWNSGCKSWYLTNDGYNGT

SEQ ID NO: 936659 - protein, 18 aa, Mycobacterium
TTYVALVAIYKRFQEMAT

SEQ ID NO: 936660 - protein, 21 aa, Mycobacterium
TVACCCAAAIALSPIAAADPD

SEQ ID NO: 936661 - protein, 25 aa, Mycobacterium
TVADEVPGVLIARGLAEESGKRIRL

SEQ ID NO: 936662 - protein, 17 aa, Mycobacterium
TVALVWLLIGAFAAWQR

SEQ ID NO: 936663 - protein, 23 aa, Mycobacterium
TVASCPNSRIVLGGYSQGSTVID

SEQ ID NO: 936664 - protein, 26 aa, Mycobacterium
TVCALTAFLLVAVFGQVRFGDGNTYY

SEQ ID NO: 936665 - protein, 17 aa, Mycobacterium
TVCSGLPGGDLVVAQNV

SEQ ID NO: 936666 - protein, 24 aa, Mycobacterium
TVDGTRYGVPFYNYALGYLYNADD

SEQ ID NO: 936667 - protein, 17 aa, Mycobacterium
TVDLVYQFIPVLKANGY

SEQ ID NO: 936668 - protein, 17 aa, Mycobacterium
TVDNCGRQVVVDASPRR

SEQ ID NO: 936669 - protein, 23 aa, Mycobacterium
TVELPTRIPAGAGAGASREPLAV

SEQ ID NO: 936670 - protein, 21 aa, Mycobacterium
TVEPWGVVTEKGRWYLVGHDR

SEQ ID NO: 936671 - protein, 25 aa, Mycobacterium
TVGAGAPAMMWCCEAAMGTSANTAM

SEQ ID NO: 936672 - protein, 20 aa, Mycobacterium
TVGIAAPVIIQFDAHIADKA

SEQ ID NO: 936673 - protein, 18 aa, Mycobacterium
TVGIAAPVIIQFDAPITD

SEQ ID NO: 936674 - protein, 26 aa, Mycobacterium
TVGIAMPTKSSERWVADGQNMVDQFK

SEQ ID NO: 936675 - protein, 24 aa, Mycobacterium
TVGRPVAGCPVRIFDRNGRPVGPR

SEQ ID NO: 936676 - protein, 22 aa, Mycobacterium
TVGSASDWTVWINNVPTQDSMC

SEQ ID NO: 936677 - protein, 25 aa, Mycobacterium
TVGSPVCTAGKYARKHVPWANFTNV

SEQ ID NO: 936678 - protein, 29 aa, Mycobacterium
TVGTRAPGCGRGQTLRSGNTVATGTAVTA

SEQ ID NO: 936679 - protein, 21 aa, Mycobacterium
TVGVCGATAPASRADSMQPVG

SEQ ID NO: 936680 - protein, 23 aa, Mycobacterium
TVHSEWGWTAPIYQKSGIWYVKH

SEQ ID NO: 936681 - protein, 27 aa, Mycobacterium
TVIAGGAAVIGMISFTAACGSEEEAPE

SEQ ID NO: 936682 - protein, 17 aa, Mycobacterium
TVIPRQRVLVVSTGSEL

SEQ ID NO: 936683 - protein, 23 aa, Mycobacterium
TVISAGVDRLQWLDKVQPKATAP

SEQ ID NO: 936684 - protein, 19 aa, Mycobacterium
TVKAIKGTVTPLVADFNAR

SEQ ID NO: 936685 - protein, 26 aa, Mycobacterium
TVKGTCAKANIGGADNKIDFERVETE

SEQ ID NO: 936686 - protein, 18 aa, Mycobacterium
TVLGRLGIETSLLDNPTR

SEQ ID NO: 936687 - protein, 19 aa, Mycobacterium
TVLLCVPAPAAAAEIGQRI

SEQ ID NO: 936688 - protein, 24 aa, Mycobacterium
TVMAESSVGLGIKQSFDELAQRAQ

SEQ ID NO: 936689 - protein, 19 aa, Mycobacterium
TVMARAGHRTILYDINEAN

SEQ ID NO: 936690 - protein, 18 aa, Mycobacterium
TVMPARVSNVGAVAADPN

SEQ ID NO: 936691 - protein, 17 aa, Mycobacterium
TVMPGAPTPPVLESPDG

SEQ ID NO: 936692 - protein, 19 aa, Mycobacterium
TVNGAVYWDVYRGPVRHIV

SEQ ID NO: 936693 - protein, 25 aa, Mycobacterium
TVNVPRPIIRIAPGTTRTVRVDLQR

SEQ ID NO: 936694 - protein, 19 aa, Mycobacterium
TVNVPRPIVTIAPGTTGTV

SEQ ID NO: 936695 - protein, 24 aa, Mycobacterium
TVPGFPNLFLIYGPGTHLAHGGSL

SEQ ID NO: 936696 - protein, 24 aa, Mycobacterium
TVPGFPNLFLMYGPNTNLGHSSIV

SEQ ID NO: 936697 - protein, 21 aa, Mycobacterium
TVPPLRPGLAESWDISDDGLE

SEQ ID NO: 936698 - protein, 19 aa, Mycobacterium
TVQAHIPLAALAPILQPRY

SEQ ID NO: 936699 - protein, 22 aa, Mycobacterium
TVRDVVAMLCRYESMYNESLRI

SEQ ID NO: 936700 - protein, 24 aa, Mycobacterium
TVRFRWPLDPRPAVTRAFDAPSPN

SEQ ID NO: 936701 - protein, 17 aa, Mycobacterium
TVRLKAPTIDFRMRLGH

SEQ ID NO: 936702 - protein, 23 aa, Mycobacterium
TVRLRAPTIDFMLSLGHSSFYPL

SEQ ID NO: 936703 - protein, 17 aa, Mycobacterium
TVRRLEAAVQRSVVISA

SEQ ID NO: 936704 - protein, 24 aa, Mycobacterium
TVRYLVPAETLPLVQSNPSLAPRE

SEQ ID NO: 936705 - protein, 22 aa, Mycobacterium
TVRYRVRRIEKLLSTSLADPDV

SEQ ID NO: 936706 - protein, 28 aa, Mycobacterium
TVSDAGARRTFFGIPLSRSATTATGIVT

SEQ ID NO: 936707 - protein, 19 aa, Mycobacterium
TVSDLKPSSDVIPYPVVGT

SEQ ID NO: 936708 - protein, 17 aa, Mycobacterium
TVSEAFFRVMNLVDPPT

SEQ ID NO: 936709 - protein, 17 aa, Mycobacterium
TVSLVNPHDICWWPKNP

SEQ ID NO: 936710 - protein, 17 aa, Mycobacterium
TVSRSLIGPVLRAASYS

SEQ ID NO: 936711 - protein, 24 aa, Mycobacterium
TVSRVTYTPGANFHGTDTFTYTLN

SEQ ID NO: 936712 - protein, 24 aa, Mycobacterium
TVSSGFYYNPFIPNLFTIQFFQWF

SEQ ID NO: 936713 - protein, 27 aa, Mycobacterium
TVTKIERRGWHALLTLALNGDVDLPAN

SEQ ID NO: 936714 - protein, 18 aa, Mycobacterium
TVTNGWFRDVKLVNADGK

SEQ ID NO: 936715 - protein, 18 aa, Mycobacterium
TVVAQVAPPHTWYRQSVS

SEQ ID NO: 936716 - protein, 22 aa, Mycobacterium
TVVAVGDNFKGQIDIPEPGLGV

SEQ ID NO: 936717 - protein, 18 aa, Mycobacterium
TVVIVSWVLTRPPPSTHE

SEQ ID NO: 936718 - protein, 20 aa, Mycobacterium
TVVLTGGMLLACSNNDKKDE

SEQ ID NO: 936719 - protein, 21 aa, Mycobacterium
TVVPDPRYVAVPDHDQLATEL

SEQ ID NO: 936720 - protein, 20 aa, Mycobacterium
TVVPDPRYVAVSEPDQLATE

SEQ ID NO: 936721 - protein, 18 aa, Mycobacterium
TVVPRIVARRQRRAAYAA

SEQ ID NO: 936722 - protein, 23 aa, Mycobacterium
TVVSPRAGLVMEEGGKVKFHGLQ

SEQ ID NO: 936723 - protein, 25 aa, Mycobacterium
TVVSPRAGLVMNPDAKVKMRGVEVG

SEQ ID NO: 936724 - protein, 24 aa, Mycobacterium
TVVSVRPGQTFSRTDSSVPGGRDT

SEQ ID NO: 936725 - protein, 20 aa, Mycobacterium
TVYFAMKFNQPFISYGAWDG

SEQ ID NO: 936726 - protein, 24 aa, Mycobacterium
TVYFAMKFSQPFTSYGAWDGNAVY

SEQ ID NO: 936727 - protein, 20 aa, Mycobacterium
TWGDPEIRWILSTLPTAMIF

SEQ ID NO: 936728 - protein, 35 aa, Mycobacterium
TWGMECPDCLYTRAVLRGGESYRLFGNRGTARYVG

SEQ ID NO: 936729 - protein, 22 aa, Mycobacterium
TWKANWPQHLAGAYIDAGMANQ

SEQ ID NO: 936730 - protein, 18 aa, Mycobacterium
TWMSGCRSWYLTKDGYNG

SEQ ID NO: 936731 - protein, 20 aa, Mycobacterium
TWNNLALPWFRGINSVIGVQ

SEQ ID NO: 936732 - protein, 21 aa, Mycobacterium
TWNTLYRKWLTVLGPAPAPPT

SEQ ID NO: 936733 - protein, 22 aa, Mycobacterium
TWNTLYRKWLTVLGPAPAPPTP

SEQ ID NO: 936734 - protein, 22 aa, Mycobacterium
TWNTLYRKWLTVLGPAPAPPVA

SEQ ID NO: 936735 - protein, 24 aa, Mycobacterium
TWPFDIPHAEAFYRDLLGCLDPEW

SEQ ID NO: 936736 - protein, 22 aa, Mycobacterium
TWRCTWTEAGLYFWMDYHDGME

SEQ ID NO: 936737 - protein, 25 aa, Mycobacterium
TWSAKVGFGRRWSDGLDRTGDTMNT

SEQ ID NO: 936738 - protein, 19 aa, Mycobacterium
TWTSLTTMIIPAGGAPYVL

SEQ ID NO: 936739 - protein, 18 aa, Mycobacterium
TYAAQGWTIIANVDGTRF

SEQ ID NO: 936740 - protein, 31 aa, Mycobacterium
TYARAMGPMQFLPGTWARYASDGDGDGKADV

SEQ ID NO: 936741 - protein, 31 aa, Mycobacterium
TYARAMGPMQFLPGTWARYASDGDSDGVPDP

SEQ ID NO: 936742 - protein, 25 aa, Mycobacterium
TYFIGFPDWLPIGASNSVDADADAI

SEQ ID NO: 936743 - protein, 17 aa, Mycobacterium
TYFSGKVQSLWRGGVGH

SEQ ID NO: 936744 - protein, 17 aa, Mycobacterium
TYGFNGIDTSQCTGDTV

SEQ ID NO: 936745 - protein, 18 aa, Mycobacterium
TYGIPQCIGPEVGVMLSG

SEQ ID NO: 936746 - protein, 28 aa, Mycobacterium
TYHNSYWFYSCMVVFKTSYGVLQQALYY

SEQ ID NO: 936747 - protein, 22 aa, Mycobacterium
TYKAWYPLTHRWLGFEDAHITF

SEQ ID NO: 936748 - protein, 17 aa, Mycobacterium
TYLADIICRHMGFPHLV

SEQ ID NO: 936749 - protein, 24 aa, Mycobacterium
TYLPVQVKGGLIWTGDSHAKQGNG

SEQ ID NO: 936750 - protein, 17 aa, Mycobacterium
TYMILIRAALAGVAAAG

SEQ ID NO: 936751 - protein, 20 aa, Mycobacterium
TYNPDDAYALIGGTDTFTYT

SEQ ID NO: 936752 - protein, 19 aa, Mycobacterium
TYPCDVLVFATGFDAMTGA

SEQ ID NO: 936753 - protein, 18 aa, Mycobacterium
TYPIAPDLVNWVVQVPQS

SEQ ID NO: 936754 - protein, 19 aa, Mycobacterium
TYRIDGWSLTLFGFQLTPQ

SEQ ID NO: 936755 - protein, 22 aa, Mycobacterium
TYSEDWLRPDYIPPGGPAPAPA

SEQ ID NO: 936756 - protein, 27 aa, Mycobacterium
TYSEDWLRPDYIPPQAIPPQAIPPQQA

SEQ ID NO: 936757 - protein, 20 aa, Mycobacterium
TYSEDWMRPDYVPPPSNSTA

SEQ ID NO: 936758 - protein, 18 aa, Mycobacterium
TYSEDWMRPDYVPPQPDM

SEQ ID NO: 936759 - protein, 18 aa, Mycobacterium
TYSEDWMRPDYVPPQPTL

SEQ ID NO: 936760 - protein, 18 aa, Mycobacterium
TYSEDWMRPDYVPPQQNP

SEQ ID NO: 936761 - protein, 31 aa, Mycobacterium
TYTSGDEDLLTWKAAPAAAPAQRSGGSTQSH

SEQ ID NO: 936762 - protein, 19 aa, Mycobacterium
TYYSAKLASVWEGGAGHTW

SEQ ID NO: 936763 - protein, 41 aa, Mycobacterium
VAAALTRIGAPYSWGGSGPNAFDCSGLVMWAYGQQGVSLPH

SEQ ID NO: 936764 - protein, 17 aa, Mycobacterium
VAAATGLSQARVKELVD

SEQ ID NO: 936765 - protein, 19 aa, Mycobacterium
VAAAVKGRVPARVYTVQLG

SEQ ID NO: 936766 - protein, 26 aa, Mycobacterium
VAACVAAGLPLTCLPGPSAVMTALAV

SEQ ID NO: 936767 - protein, 25 aa, Mycobacterium
VAADLGYKVPTLWSGSLSDSTLITE

SEQ ID NO: 936768 - protein, 27 aa, Mycobacterium
VAAEALVRWRHPIWGLLLPDSFIGVAE

SEQ ID NO: 936769 - protein, 18 aa, Mycobacterium
VAAEPMPLPAGAPHPGPL

SEQ ID NO: 936770 - protein, 27 aa, Mycobacterium
VAAGAGVLPACPAHSADAASATVAALA

SEQ ID NO: 936771 - protein, 19 aa, Mycobacterium
VAAGARPTALMSPNAAADA

SEQ ID NO: 936772 - protein, 18 aa, Mycobacterium
VAAGGYYGHTATAFSDPS

SEQ ID NO: 936773 - protein, 24 aa, Mycobacterium
VAAGHGWAVLPAICLSDEMTSGKF

SEQ ID NO: 936774 - protein, 31 aa, Mycobacterium
VAAGLVVVFGEFRFAAGQSYHATFSEASRLK

SEQ ID NO: 936775 - protein, 19 aa, Mycobacterium
VAAGNPWFANSVGNATQVV

SEQ ID NO: 936776 - protein, 25 aa, Mycobacterium
VAAGQIPEPIDWASTLDQQYLPDDA

SEQ ID NO: 936777 - protein, 31 aa, Mycobacterium
VAAGRYNSMLLRSDGTAIGFGQNASSQLNIP

SEQ ID NO: 936778 - protein, 24 aa, Mycobacterium
VAAGTRLSPKAAHRRQRVSTEWTG

SEQ ID NO: 936779 - protein, 19 aa, Mycobacterium
VAAHGAWLTLIRDGHPIRV

SEQ ID NO: 936780 - protein, 17 aa, Mycobacterium
VAAKAAVLRECGVDVPD

SEQ ID NO: 936781 - protein, 18 aa, Mycobacterium
VAAKGGAGASVFAAALAL

SEQ ID NO: 936782 - protein, 25 aa, Mycobacterium
VAAKRARIPLIWHVHDRISAEYFGA

SEQ ID NO: 936783 - protein, 23 aa, Mycobacterium
VAALGETVGEVFAGLHRDHGVDL

SEQ ID NO: 936784 - protein, 21 aa, Mycobacterium
VAALRGERLFQIPVAGDGTVG

SEQ ID NO: 936785 - protein, 23 aa, Mycobacterium
VAALSGLRDRCRAAKERLSVETA

SEQ ID NO: 936786 - protein, 27 aa, Mycobacterium
VAAMVLSSCGWKGISNVSIPGGPGSGA

SEQ ID NO: 936787 - protein, 20 aa, Mycobacterium
VAAPARVDGLLSIGTGATIN

SEQ ID NO: 936788 - protein, 25 aa, Mycobacterium
VAAQEWRKNTLFRSADRNLADGMSI

SEQ ID NO: 936789 - protein, 29 aa, Mycobacterium
VAAQVVPWQSVLKGLPGLASGLAGGAGAG

SEQ ID NO: 936790 - protein, 17 aa, Mycobacterium
VAAREFVAFWLDPESRV

SEQ ID NO: 936791 - protein, 22 aa, Mycobacterium
VAARFVPNPAAAALEAQVYPSP

SEQ ID NO: 936792 - protein, 23 aa, Mycobacterium
VAARRAAAAGLVLLAAVAAVRSD

SEQ ID NO: 936793 - protein, 24 aa, Mycobacterium
VAARREFAEEIGLPVPDGARIDLG

SEQ ID NO: 936794 - protein, 25 aa, Mycobacterium
VAASCAVPGAWPPVTIGDRRYIDGG

SEQ ID NO: 936795 - protein, 23 aa, Mycobacterium
VAASCPRTKLVIGGYSMGAEVID

SEQ ID NO: 936796 - protein, 20 aa, Mycobacterium
VAASKFRSGGAIDDPDREQQ

SEQ ID NO: 936797 - protein, 17 aa, Mycobacterium
VAATGGPQCTDLPKIPY

SEQ ID NO: 936798 - protein, 21 aa, Mycobacterium
VAATISMQWNAPAMFAPAIPA

SEQ ID NO: 936799 - protein, 25 aa, Mycobacterium
VAAVDRLATALAISGSWNENQPNNQ

SEQ ID NO: 936800 - protein, 19 aa, Mycobacterium
VAAYEVFVRVPWRKATVGA

SEQ ID NO: 936801 - protein, 21 aa, Mycobacterium
VAAYLAAPSYWQWHRAEERQQ

SEQ ID NO: 936802 - protein, 17 aa, Mycobacterium
VACALAAAPVVERYTAV

SEQ ID NO: 936803 - protein, 18 aa, Mycobacterium
VADAWCAAFVQPKTGATT

SEQ ID NO: 936804 - protein, 27 aa, Mycobacterium
VADEAYLHIPGLPPIVTLPNRPPSEHV

SEQ ID NO: 936805 - protein, 17 aa, Mycobacterium
VADELGARIVAFPLIST

SEQ ID NO: 936806 - protein, 21 aa, Mycobacterium
VADELRDASTMRVQVAEDPTF

SEQ ID NO: 936807 - protein, 19 aa, Mycobacterium
VADFVHARGLLFGIYASPG

SEQ ID NO: 936808 - protein, 18 aa, Mycobacterium
VADGRRVVLGAADTFRAA

SEQ ID NO: 936809 - protein, 19 aa, Mycobacterium
VADILPLTPLQQGLFFHSL

SEQ ID NO: 936810 - protein, 18 aa, Mycobacterium
VADIPMEGFLRVNPAGDD

SEQ ID NO: 936811 - protein, 23 aa, Mycobacterium
VADLPPADLSRIYVTVTDCATTH

SEQ ID NO: 936812 - protein, 24 aa, Mycobacterium
VADQLSAFMLLAPGADGKPYPNGV

SEQ ID NO: 936813 - protein, 24 aa, Mycobacterium
VADQLSAFMLLAPGADGTPYPNGV

SEQ ID NO: 936814 - protein, 17 aa, Mycobacterium
VADRAAVERSIRVTSPG

SEQ ID NO: 936815 - protein, 19 aa, Mycobacterium
VADRFGLRDRIRFGTEISD

SEQ ID NO: 936816 - protein, 24 aa, Mycobacterium
VADRLRTGVLAIRKGGKLPPPVHA

SEQ ID NO: 936817 - protein, 19 aa, Mycobacterium
VADVLGIPFYVWDFAERFQ

SEQ ID NO: 936818 - protein, 24 aa, Mycobacterium
VAELLHRAGSPAVWLDPRRWYSVP

SEQ ID NO: 936819 - protein, 23 aa, Mycobacterium
VAELLPEVFQWARSVDPSQPLTS

SEQ ID NO: 936820 - protein, 21 aa, Mycobacterium
VAELLPQVFQWAREVDPSQPL

SEQ ID NO: 936821 - protein, 21 aa, Mycobacterium
VAEMPGIFAYVVAQGDSPFIG

SEQ ID NO: 936822 - protein, 26 aa, Mycobacterium
VAEPNAFQNLHWAFGQLAAVGIATAS

SEQ ID NO: 936823 - protein, 27 aa, Mycobacterium
VAEQLLPRWLVSWREAVTRQGGPAPDL

SEQ ID NO: 936824 - protein, 24 aa, Mycobacterium
VAFAKPEQAVRCGLDIQHSLARRP

SEQ ID NO: 936825 - protein, 18 aa, Mycobacterium
VAFCLVMSVVTAPATGAD

SEQ ID NO: 936826 - protein, 27 aa, Mycobacterium
VAFHWWLVLATLRWGVICRYQAERHLS

SEQ ID NO: 936827 - protein, 25 aa, Mycobacterium
VAFPLISTGSFGWPRQDAIAAAIET

SEQ ID NO: 936828 - protein, 37 aa, Mycobacterium
VAGAAGSTIPAARASGDDLGAVAAVPASATVPADGAL

SEQ ID NO: 936829 - protein, 21 aa, Mycobacterium
VAGAGWPAAQLALGPAEPGKL

SEQ ID NO: 936830 - protein, 18 aa, Mycobacterium
VAGASRNGRHLVVAMMYG

SEQ ID NO: 936831 - protein, 22 aa, Mycobacterium
VAGCARVVVGRAVMSEPKLGQA

SEQ ID NO: 936832 - protein, 19 aa, Mycobacterium
VAGCTAMIACVALASAAGQ

SEQ ID NO: 936833 - protein, 18 aa, Mycobacterium
VAGDTLGYVAVEGNPITV

SEQ ID NO: 936834 - protein, 17 aa, Mycobacterium
VAGELDFGALGSSPVAR

SEQ ID NO: 936835 - protein, 27 aa, Mycobacterium
VAGFPHCVAAMSNLRNDRLWIVRMEDV

SEQ ID NO: 936836 - protein, 19 aa, Mycobacterium
VAGGPRTGELYDYSAQFGD

SEQ ID NO: 936837 - protein, 25 aa, Mycobacterium
VAGLLFPVVGGFGLVSNRASDVVAN

SEQ ID NO: 936838 - protein, 20 aa, Mycobacterium
VAGMAAEPVAVAASNNPMLT

SEQ ID NO: 936839 - protein, 24 aa, Mycobacterium
VAGPGRGGGGLNLDPPRELPPEFE

SEQ ID NO: 936840 - protein, 25 aa, Mycobacterium
VAGQPMFKRWCRLVGREELFDDPRF

SEQ ID NO: 936841 - protein, 17 aa, Mycobacterium
VAGREFVAFWLDGDHRV

SEQ ID NO: 936842 - protein, 18 aa, Mycobacterium
VAGREFVAFWLDGDNRVL

SEQ ID NO: 936843 - protein, 17 aa, Mycobacterium
VAGRIRSAGAIFVGAWS

SEQ ID NO: 936844 - protein, 18 aa, Mycobacterium
VAGSLLDLAGPYLPFDNP

SEQ ID NO: 936845 - protein, 19 aa, Mycobacterium
VAGSLRLAPRVADAIAAHL

SEQ ID NO: 936846 - protein, 18 aa, Mycobacterium
VAGVPEIFAAGDVAAAQM

SEQ ID NO: 936847 - protein, 20 aa, Mycobacterium
VAHAVSLISIELEKPARVVD

SEQ ID NO: 936848 - protein, 18 aa, Mycobacterium
VAHQACIGGIPGYIGLEL

SEQ ID NO: 936849 - protein, 23 aa, Mycobacterium
VAHTLRPGQSVTVQIVTSTAKFI

SEQ ID NO: 936850 - protein, 27 aa, Mycobacterium
VAHYRDVFAALRFHGLDPMVTVNHFTL

SEQ ID NO: 936851 - protein, 23 aa, Mycobacterium
VAIAPDAEWAPALAEGRAGYFTA

SEQ ID NO: 936852 - protein, 19 aa, Mycobacterium
VAIDIGDGHYAIYAHLREG

SEQ ID NO: 936853 - protein, 20 aa, Mycobacterium
VAIDLRDDWAAALQAAGFDE

SEQ ID NO: 936854 - protein, 21 aa, Mycobacterium
VAIEYTRLAQWTFDPAVAPAD

SEQ ID NO: 936855 - protein, 24 aa, Mycobacterium
VAIHEMMHAFGWGSTLQGPGENQG

SEQ ID NO: 936856 - protein, 25 aa, Mycobacterium
VAIMLPRCAQAIVAILAVLKTGAAY

SEQ ID NO: 936857 - protein, 19 aa, Mycobacterium
VALAEGKNSLARALLSTGA

SEQ ID NO: 936858 - protein, 18 aa, Mycobacterium
VALAGGAVMAFGYIQLPA

SEQ ID NO: 936859 - protein, 17 aa, Mycobacterium
VALAYAGSHPNKVARLL

SEQ ID NO: 936860 - protein, 21 aa, Mycobacterium
VALDGDAVWVAVQREVKTDPS

SEQ ID NO: 936861 - protein, 21 aa, Mycobacterium
VALELLASGTWSGRGVLGPEA

SEQ ID NO: 936862 - protein, 18 aa, Mycobacterium
VALGAPFALTAVQSAKNA

SEQ ID NO: 936863 - protein, 24 aa, Mycobacterium
VALGMTGAGYWVAHGALTGITISQ

SEQ ID NO: 936864 - protein, 22 aa, Mycobacterium
VALIFFSGFFLGRATHGPYGGR

SEQ ID NO: 936865 - protein, 25 aa, Mycobacterium
VALLAGCPRLTILATSREPLGVPGE

SEQ ID NO: 936866 - protein, 24 aa, Mycobacterium
VALMLSSCGWRGISNVSIPGGPGT

SEQ ID NO: 936867 - protein, 23 aa, Mycobacterium
VALRGARTMFLFIFRDEHDGADL

SEQ ID NO: 936868 - protein, 18 aa, Mycobacterium
VALRGDRTLFLFILRSDD

SEQ ID NO: 936869 - protein, 19 aa, Mycobacterium
VALVALPARSAHEVAAASL

SEQ ID NO: 936870 - protein, 24 aa, Mycobacterium
VALVPLPVPDRFATTFVADEEIVL

SEQ ID NO: 936871 - protein, 18 aa, Mycobacterium
VAMAGRYGNRSAGNALGA

SEQ ID NO: 936872 - protein, 17 aa, Mycobacterium
VAMNLVTGWPKPANARA

SEQ ID NO: 936873 - protein, 29 aa, Mycobacterium
VAMVLRRLLRLCARYSSAPTVVFASATTD

SEQ ID NO: 936874 - protein, 19 aa, Mycobacterium
VANARIKVVSAFDGGGPGD

SEQ ID NO: 936875 - protein, 22 aa, Mycobacterium
VANDKWWGNPPVTKRVTVWPSG

SEQ ID NO: 936876 - protein, 18 aa, Mycobacterium
VANGAALLAGESAAAAVS

SEQ ID NO: 936877 - protein, 24 aa, Mycobacterium
VANGGLRYAERADLATREEQIAVA

SEQ ID NO: 936878 - protein, 24 aa, Mycobacterium
VANKGVLMQPHLVDSLKGPDLSNL

SEQ ID NO: 936879 - protein, 20 aa, Mycobacterium
VANLPNVRFLEGHEVIEPLT

SEQ ID NO: 936880 - protein, 17 aa, Mycobacterium
VANSNPAVWCNSDADND

SEQ ID NO: 936881 - protein, 22 aa, Mycobacterium
VANVPVGSRPTSIAVNSTGTVA

SEQ ID NO: 936882 - protein, 25 aa, Mycobacterium
VANVSPEYTGTGWINYLGHADPIKD

SEQ ID NO: 936883 - protein, 23 aa, Mycobacterium
VANVWRVRPGPVAARHWQVEPDL

SEQ ID NO: 936884 - protein, 23 aa, Mycobacterium
VAPCDPPPGFGYTREGTYKGFPG

SEQ ID NO: 936885 - protein, 24 aa, Mycobacterium
VAPDVYWATGILARLVREAQDELE

SEQ ID NO: 936886 - protein, 17 aa, Mycobacterium
VAPEIYERLAAQTGESV

SEQ ID NO: 936887 - protein, 19 aa, Mycobacterium
VAPELMRVAASDLANIGST

SEQ ID NO: 936888 - protein, 17 aa, Mycobacterium
VAPEVYERLAATVDGPV

SEQ ID NO: 936889 - protein, 23 aa, Mycobacterium
VAPGNPKGIGAFGDLTRPGLDVV

SEQ ID NO: 936890 - protein, 21 aa, Mycobacterium
VAPPDRYCGRISATTDGESAE

SEQ ID NO: 936891 - protein, 21 aa, Mycobacterium
VAPRYPWDFAADVRANRLPQV

SEQ ID NO: 936892 - protein, 20 aa, Mycobacterium
VAPYLKAWETVLGHQRTGLY

SEQ ID NO: 936893 - protein, 18 aa, Mycobacterium
VAQACAFINYAMGRYGVA

SEQ ID NO: 936894 - protein, 18 aa, Mycobacterium
VAQAERFNGKGLRILSVS

SEQ ID NO: 936895 - protein, 26 aa, Mycobacterium
VAQAVARWLVLYLRRPGGQSQFAAPV

SEQ ID NO: 936896 - protein, 23 aa, Mycobacterium
VAQHSLAAIGVRLELQSRSGSGF

SEQ ID NO: 936897 - protein, 25 aa, Mycobacterium
VAQMLQRIVALMPMGVAVVDSHRDV

SEQ ID NO: 936898 - protein, 25 aa, Mycobacterium
VAQNRSGRALGFFGEPCVDVLQLNL

SEQ ID NO: 936899 - protein, 18 aa, Mycobacterium
VAQSVAWSMAPGKESAAV

SEQ ID NO: 936900 - protein, 27 aa, Mycobacterium
VARDATFRWGVAMLPIGPAGRVSVTNG

SEQ ID NO: 936901 - protein, 28 aa, Mycobacterium
VARDATFRWGVAMLPIGPVGRVSVTNGI

SEQ ID NO: 936902 - protein, 25 aa, Mycobacterium
VARGLSQRGVPFSWAGGGITGPSRG

SEQ ID NO: 936903 - protein, 28 aa, Mycobacterium
VARGMACRTRFYDRFFLEAAGSGIGQVV

SEQ ID NO: 936904 - protein, 18 aa, Mycobacterium
VARTILVFRRGEFALAHD

SEQ ID NO: 936905 - protein, 22 aa, Mycobacterium
VARYQCRIQLVLAANLCPCAPP

SEQ ID NO: 936906 - protein, 20 aa, Mycobacterium
VASAAAFGFIGAVGLAPMAS

SEQ ID NO: 936907 - protein, 25 aa, Mycobacterium
VASAGLCGAAFAFSPSAAATPLRTG

SEQ ID NO: 936908 - protein, 18 aa, Mycobacterium
VASALGFCLDSIACQTFR

SEQ ID NO: 936909 - protein, 27 aa, Mycobacterium
VASAPLTWPAGWTRWPKRVYGDTRLEL

SEQ ID NO: 936910 - protein, 17 aa, Mycobacterium
VASAVACEVQDSATVSF

SEQ ID NO: 936911 - protein, 20 aa, Mycobacterium
VASDIAERFGLDAWVSNAGI

SEQ ID NO: 936912 - protein, 17 aa, Mycobacterium
VASEQWLGSDGKPGNIA

SEQ ID NO: 936913 - protein, 26 aa, Mycobacterium
VASESGYRAGLLASIIASCTASYTVA

SEQ ID NO: 936914 - protein, 21 aa, Mycobacterium
VASKLVKVGGLLGPDGDQIGV

SEQ ID NO: 936915 - protein, 23 aa, Mycobacterium
VASRAEEAILIPGATVLKPINPF

SEQ ID NO: 936916 - protein, 33 aa, Mycobacterium
VASRAKLNWWESRALYGWTVLVPRTKDQAGEMS

SEQ ID NO: 936917 - protein, 19 aa, Mycobacterium
VASSCPNTKFVIGGYSMGA

SEQ ID NO: 936918 - protein, 18 aa, Mycobacterium
VASSSPAVWCNSDADNDR

SEQ ID NO: 936919 - protein, 25 aa, Mycobacterium
VATAKFDFADGFATVTIVTTGTGYL

SEQ ID NO: 936920 - protein, 18 aa, Mycobacterium
VATATFDFTGGYVTVTVK

SEQ ID NO: 936921 - protein, 24 aa, Mycobacterium
VATDNRFRFLRVYPNPATYAPVTG

SEQ ID NO: 936922 - protein, 27 aa, Mycobacterium
VATDSRFRFLRQYADPEVYAPVTGFYS

SEQ ID NO: 936923 - protein, 26 aa, Mycobacterium
VATGDPRPDGALVWARADEPARMIVE

SEQ ID NO: 936924 - protein, 19 aa, Mycobacterium
VATLLGWLLTRRSGSIREI

SEQ ID NO: 936925 - protein, 25 aa, Mycobacterium
VATLTLRLGKDVKLPRNATAKIGQT

SEQ ID NO: 936926 - protein, 28 aa, Mycobacterium
VATMAGWRTDFLNQMGLVISDSIKPFGN

SEQ ID NO: 936927 - protein, 18 aa, Mycobacterium
VAVAAGRPLTSFTGPQPA

SEQ ID NO: 936928 - protein, 17 aa, Mycobacterium
VAVAARYAAAVSADDAG

SEQ ID NO: 936929 - protein, 28 aa, Mycobacterium
VAVAGFCVLRLRTFFGVHDDQTMTSGIA

SEQ ID NO: 936930 - protein, 22 aa, Mycobacterium
VAVCLLVGCSPGASQSPKADIA

SEQ ID NO: 936931 - protein, 26 aa, Mycobacterium
VAVDMLEMLPTPWGLVRSGVAPDHPK

SEQ ID NO: 936932 - protein, 24 aa, Mycobacterium
VAVKQGWFCCWNGGNHLHVSTGVV

SEQ ID NO: 936933 - protein, 27 aa, Mycobacterium
VAVKQGWMCCIGADWMHLSTGIIGSDR

SEQ ID NO: 936934 - protein, 26 aa, Mycobacterium
VAVKQGWMCCIGADWMHLSTGVIGRD

SEQ ID NO: 936935 - protein, 25 aa, Mycobacterium
VAVKQGWMCCIGASWMHLSTGVVGS

SEQ ID NO: 936936 - protein, 26 aa, Mycobacterium
VAVKQGWMCCIGGDWMHLSTGVIGPD

SEQ ID NO: 936937 - protein, 25 aa, Mycobacterium
VAVLDAPWAPFVVDFHLANVGGPSA

SEQ ID NO: 936938 - protein, 24 aa, Mycobacterium
VAVLDAPWAPFVVDFNLANVGGPS

SEQ ID NO: 936939 - protein, 17 aa, Mycobacterium
VAVLGMPVGKITRITPR

SEQ ID NO: 936940 - protein, 20 aa, Mycobacterium
VAVLGMPVGKVVRIEPKGGY

SEQ ID NO: 936941 - protein, 24 aa, Mycobacterium
VAVLLPRSGRAIVAILAVLKAGAA

SEQ ID NO: 936942 - protein, 25 aa, Mycobacterium
VAVLQLRGAAGLPTAAIGGGVAVGE

SEQ ID NO: 936943 - protein, 19 aa, Mycobacterium
VAVNCALGPDPKGAVSALL

SEQ ID NO: 936944 - protein, 19 aa, Mycobacterium
VAVNCALGPDPKGAVSGLL

SEQ ID NO: 936945 - protein, 17 aa, Mycobacterium
VAVNSFGTVAYVTNSGD

SEQ ID NO: 936946 - protein, 19 aa, Mycobacterium
VAVQTIWARSVVRDLEDDY

SEQ ID NO: 936947 - protein, 36 aa, Mycobacterium
VAVRRGKVFIADTVKGWITVLTCTPGYTSCGEATTF

SEQ ID NO: 936948 - protein, 17 aa, Mycobacterium
VAVSELRPGEPPWTDGR

SEQ ID NO: 936949 - protein, 25 aa, Mycobacterium
VAVSPEPDTSWAFMTYLIEQDTLRD

SEQ ID NO: 936950 - protein, 34 aa, Mycobacterium
VAVTEWYGGFPFATWPWATERLGGATPEVLTLTD

SEQ ID NO: 936951 - protein, 21 aa, Mycobacterium
VAVVQLRIREGVRLPVGTTAQ

SEQ ID NO: 936952 - protein, 34 aa, Mycobacterium
VAWAETYPGTLSYYLATAFREIWMQPSGEAGLIG

SEQ ID NO: 936953 - protein, 23 aa, Mycobacterium
VCAPARRRPYLAVPTFWSAQFGV

SEQ ID NO: 936954 - protein, 19 aa, Mycobacterium
VCCPSVPMMLTLATVLGRL

SEQ ID NO: 936955 - protein, 18 aa, Mycobacterium
VCGAIHAQNARIYLIDTV

SEQ ID NO: 936956 - protein, 20 aa, Mycobacterium
VCGGVQTANAVVYMIDTVLM

SEQ ID NO: 936957 - protein, 18 aa, Mycobacterium
VCGRGLSGSTPRTAPAAN

SEQ ID NO: 936958 - protein, 26 aa, Mycobacterium
VCGRPKPANIAAVWGLTRGWIADMVA

SEQ ID NO: 936959 - protein, 24 aa, Mycobacterium
VCHWLLTTRLEFFADRERFPVADE

SEQ ID NO: 936960 - protein, 27 aa, Mycobacterium
VCLAEAGWPVRVWAAAMPQHTTSRVAG

SEQ ID NO: 936961 - protein, 18 aa, Mycobacterium
VCNMMGLRQLGCSTGTLQ

SEQ ID NO: 936962 - protein, 23 aa, Mycobacterium
VCQQARGGTDFDTIYPTVASNGY

SEQ ID NO: 936963 - protein, 22 aa, Mycobacterium
VCRSRYGRFMTMGYRRPHRTGV

SEQ ID NO: 936964 - protein, 20 aa, Mycobacterium
VCSTLARPGGSFNSAAATVV

SEQ ID NO: 936965 - protein, 17 aa, Mycobacterium
VCVLKGPLHDGVVVPGA

SEQ ID NO: 936966 - protein, 18 aa, Mycobacterium
VDAATAWHGRLHGAVHCA

SEQ ID NO: 936967 - protein, 21 aa, Mycobacterium
VDAAVGIYGRYDWQDRSTPER

SEQ ID NO: 936968 - protein, 18 aa, Mycobacterium
VDACRRDVGDLGVSIANQ

SEQ ID NO: 936969 - protein, 18 aa, Mycobacterium
VDADFVVFEGILYATLTP

SEQ ID NO: 936970 - protein, 17 aa, Mycobacterium
VDAEATVEIVARRTEDQ

SEQ ID NO: 936971 - protein, 19 aa, Mycobacterium
VDAHGWVTYRCRADDIEIV

SEQ ID NO: 936972 - protein, 26 aa, Mycobacterium
VDAKLRMAFSAGHCRGEGAVSDRDNN

SEQ ID NO: 936973 - protein, 18 aa, Mycobacterium
VDALLIGMGERYDVLITT

SEQ ID NO: 936974 - protein, 23 aa, Mycobacterium
VDALRPMMRLVVTNGTAKEIAGC

SEQ ID NO: 936975 - protein, 20 aa, Mycobacterium
VDAPLPWSFTITTTEPAVLG

SEQ ID NO: 936976 - protein, 22 aa, Mycobacterium
VDARTIVTLSGFAPPTLHAMGI

SEQ ID NO: 936977 - protein, 18 aa, Mycobacterium
VDAVVGWHPAGGDLATSL

SEQ ID NO: 936978 - protein, 18 aa, Mycobacterium
VDAWSGLDPFMAQTVQEQ

SEQ ID NO: 936979 - protein, 25 aa, Mycobacterium
VDCLGDRPANVVFLNGSPTDNNATL

SEQ ID NO: 936980 - protein, 25 aa, Mycobacterium
VDDFLRVIGVPAMFAAGDVAAARMD

SEQ ID NO: 936981 - protein, 24 aa, Mycobacterium
VDDKGVRTPVRWSLEPMQAALPAG

SEQ ID NO: 936982 - protein, 23 aa, Mycobacterium
VDDRELASVFLLLQRALGCQPDP

SEQ ID NO: 936983 - protein, 24 aa, Mycobacterium
VDDTRSDIFAGYWISEETSEGPDD

SEQ ID NO: 936984 - protein, 25 aa, Mycobacterium
VDDYLRVVGVPAVFAAGDVALAEVD

SEQ ID NO: 936985 - protein, 24 aa, Mycobacterium
VDEAISPANEWTMYVGDGKRVSAM

SEQ ID NO: 936986 - protein, 34 aa, Mycobacterium
VDEDFSHFLGFTLPWVMRGWREVESVPIRPNAES

SEQ ID NO: 936987 - protein, 20 aa, Mycobacterium
VDELVPVGAPVAFTTMVTSF

SEQ ID NO: 936988 - protein, 18 aa, Mycobacterium
VDFVRAMGATGYTPKAII

SEQ ID NO: 936989 - protein, 17 aa, Mycobacterium
VDFVTYFSAGSLWAQRV

SEQ ID NO: 936990 - protein, 20 aa, Mycobacterium
VDGACWGKLPGVSGDENLAT

SEQ ID NO: 936991 - protein, 20 aa, Mycobacterium
VDGALGWVPGLAIVGNQVSL

SEQ ID NO: 936992 - protein, 38 aa, Mycobacterium
VDGATLSPGFHGLHIHAFGRCEPNSPAPDGGPVGDFNS

SEQ ID NO: 936993 - protein, 27 aa, Mycobacterium
VDGDPLRRGYVTYPAIGSTFVDSDNLG

SEQ ID NO: 936994 - protein, 21 aa, Mycobacterium
VDGKCPPPVGFYGTVTSVSGD

SEQ ID NO: 936995 - protein, 24 aa, Mycobacterium
VDGLFGVLTNVVWTNFGPCAVEGF

SEQ ID NO: 936996 - protein, 17 aa, Mycobacterium
VDGLRRWLVDEHIDAVV

SEQ ID NO: 936997 - protein, 19 aa, Mycobacterium
VDGLVRLVGDAGGSVTGTV

SEQ ID NO: 936998 - protein, 19 aa, Mycobacterium
VDGPTPKDSAPWVAADKTL

SEQ ID NO: 936999 - protein, 17 aa, Mycobacterium
VDGRPLLRHRVELGHGS

SEQ ID NO: 937000 - protein, 17 aa, Mycobacterium
VDGRYEPQYVRNADAQT

SEQ ID NO: 937001 - protein, 22 aa, Mycobacterium
VDGWSLPILLKEIFGAYFEHRL

SEQ ID NO: 937002 - protein, 18 aa, Mycobacterium
VDGYDFAPSFSIWTTIEE

SEQ ID NO: 937003 - protein, 25 aa, Mycobacterium
VDGYPQRFGIPDGLYAEPVAVKQGW

SEQ ID NO: 937004 - protein, 17 aa, Mycobacterium
VDGYTAWLQNMAADERI

SEQ ID NO: 937005 - protein, 24 aa, Mycobacterium
VDHAVRFTRRGLFVHPAPWAENSI

SEQ ID NO: 937006 - protein, 24 aa, Mycobacterium
VDHYAEIGLLGFALIADALGGVDV

SEQ ID NO: 937007 - protein, 24 aa, Mycobacterium
VDHYAEIGLLGFALITDALGGVDV

SEQ ID NO: 937008 - protein, 23 aa, Mycobacterium
VDHYAEIGLLGFSLITDALGGVD

SEQ ID NO: 937009 - protein, 23 aa, Mycobacterium
VDHYAEIGLLGFSLITEALGGVD

SEQ ID NO: 937010 - protein, 17 aa, Mycobacterium
VDIGGLYERLARRGYGY

SEQ ID NO: 937011 - protein, 24 aa, Mycobacterium
VDIGPAAAYGWMLAHSTQFGLCQV

SEQ ID NO: 937012 - protein, 26 aa, Mycobacterium
VDKLAGYAYQAWREWQPVDPSEAVDG

SEQ ID NO: 937013 - protein, 28 aa, Mycobacterium
VDLAGCPSGICKGKVKQAYGFAYQAEME

SEQ ID NO: 937014 - protein, 18 aa, Mycobacterium
VDLAGRLLMPGFVEGHIH

SEQ ID NO: 937015 - protein, 24 aa, Mycobacterium
VDLAKRLAAAHAEARNQFVSAPVF

SEQ ID NO: 937016 - protein, 21 aa, Mycobacterium
VDLDPEYRWAVVTDPTGLSGF

SEQ ID NO: 937017 - protein, 18 aa, Mycobacterium
VDLDRYLGTWFEVGSVKQ

SEQ ID NO: 937018 - protein, 19 aa, Mycobacterium
VDLGKALAANLGLKPEFVQ

SEQ ID NO: 937019 - protein, 19 aa, Mycobacterium
VDLRCGVTVTELEDDGNGR

SEQ ID NO: 937020 - protein, 18 aa, Mycobacterium
VDLRDDWAAALQAAGFDK

SEQ ID NO: 937021 - protein, 17 aa, Mycobacterium
VDLYFEAAVAGAIPVIR

SEQ ID NO: 937022 - protein, 24 aa, Mycobacterium
VDMLEMLPTPWGLVRSGVAPDHPK

SEQ ID NO: 937023 - protein, 17 aa, Mycobacterium
VDMLKIDAGFVRDVGTD

SEQ ID NO: 937024 - protein, 17 aa, Mycobacterium
VDPGARIGLTAGHCALD

SEQ ID NO: 937025 - protein, 17 aa, Mycobacterium
VDPLCPFSGKMIQQQGA

SEQ ID NO: 937026 - protein, 21 aa, Mycobacterium
VDPRFVMSVFDGCFAAGVTYL

SEQ ID NO: 937027 - protein, 22 aa, Mycobacterium
VDPRQVADWVSGLLHEQEQGKT

SEQ ID NO: 937028 - protein, 17 aa, Mycobacterium
VDPVSQWGFGAGWGAAP

SEQ ID NO: 937029 - protein, 24 aa, Mycobacterium
VDQAKRIADEIIQTGSASRASLGV

SEQ ID NO: 937030 - protein, 24 aa, Mycobacterium
VDQFTRNGVLWAVPQLTDAGVAVF

SEQ ID NO: 937031 - protein, 24 aa, Mycobacterium
VDQFTRNGVLWGVPQLTDAGIAVF

SEQ ID NO: 937032 - protein, 27 aa, Mycobacterium
VDQLRIAPLLTGWRGGPVADIDALVDV

SEQ ID NO: 937033 - protein, 18 aa, Mycobacterium
VDRGRFIADNYRAVAALI

SEQ ID NO: 937034 - protein, 18 aa, Mycobacterium
VDRGWDVEGVFDPDPDAL

SEQ ID NO: 937035 - protein, 23 aa, Mycobacterium
VDRTLDWLDRHVKGEDIDTGAQF

SEQ ID NO: 937036 - protein, 22 aa, Mycobacterium
VDSEWGWSAPIYQKSGVWYVKH

SEQ ID NO: 937037 - protein, 22 aa, Mycobacterium
VDSIAVTAGVPFDIAASPDGTT

SEQ ID NO: 937038 - protein, 22 aa, Mycobacterium
VDSPCNFDQAMTAVRTENPMAA

SEQ ID NO: 937039 - protein, 29 aa, Mycobacterium
VDSSGRPMIGPGGWLIGNGIEPGQNGGLL

SEQ ID NO: 937040 - protein, 26 aa, Mycobacterium
VDTFGAENDFTFATAIGDNNGVAASA

SEQ ID NO: 937041 - protein, 21 aa, Mycobacterium
VDTGASGLLVRPQDVNLQSLG

SEQ ID NO: 937042 - protein, 18 aa, Mycobacterium
VDTRARWERLYRLVNHVF

SEQ ID NO: 937043 - protein, 27 aa, Mycobacterium
VDTTGGWLPDGRPLSPFESANPILSQM

SEQ ID NO: 937044 - protein, 26 aa, Mycobacterium
VDVANHFYCYSFEPNNDWTHFFAEQW

SEQ ID NO: 937045 - protein, 22 aa, Mycobacterium
VDVFDRLPAPYGLVRYGVAPDH

SEQ ID NO: 937046 - protein, 17 aa, Mycobacterium
VDVFRRMIGEDFTSLPR

SEQ ID NO: 937047 - protein, 20 aa, Mycobacterium
VDVLFPRDAVNSSWGTILPA

SEQ ID NO: 937048 - protein, 22 aa, Mycobacterium
VDVYSQPEWTALVVAKDSPVKS

SEQ ID NO: 937049 - protein, 17 aa, Mycobacterium
VDWKGTLTGLAGYASGD

SEQ ID NO: 937050 - protein, 25 aa, Mycobacterium
VDYAFTIFDVQGWRGHNGDIPGYAT

SEQ ID NO: 937051 - protein, 18 aa, Mycobacterium
VDYFSSGITIMIQKGNPE

SEQ ID NO: 937052 - protein, 24 aa, Mycobacterium
VDYLRGKPVPEYRVLDEDLVTKET

SEQ ID NO: 937053 - protein, 17 aa, Mycobacterium
VDYYSFFLSGGFQAPPG

SEQ ID NO: 937054 - protein, 21 aa, Mycobacterium
VEACGSFLPGAAAVDVAQQIA

SEQ ID NO: 937055 - protein, 19 aa, Mycobacterium
VEAEVANGAALLAGESAAA

SEQ ID NO: 937056 - protein, 17 aa, Mycobacterium
VEAFAALKKLAMVTSHV

SEQ ID NO: 937057 - protein, 23 aa, Mycobacterium
VEAFSSLKRLAMVTSNVLSKTKV

SEQ ID NO: 937058 - protein, 21 aa, Mycobacterium
VEAGLPVGCLPGPSAVTTALA

SEQ ID NO: 937059 - protein, 25 aa, Mycobacterium
VEATRAAAGIGLLPCFMADRHDDLV

SEQ ID NO: 937060 - protein, 20 aa, Mycobacterium
VEATYVFPLPARAGVTDFAA

SEQ ID NO: 937061 - protein, 17 aa, Mycobacterium
VEAYGGYLVPLRTSTIW

SEQ ID NO: 937062 - protein, 23 aa, Mycobacterium
VECNCAGVAPGRTYTARQLLEAA

SEQ ID NO: 937063 - protein, 20 aa, Mycobacterium
VEDKWAFLRSRPELAGVPAI

SEQ ID NO: 937064 - protein, 17 aa, Mycobacterium
VEDVLGRYERLDILVNN

SEQ ID NO: 937065 - protein, 22 aa, Mycobacterium
VEERARHLLDLLHRDLAETAES

SEQ ID NO: 937066 - protein, 17 aa, Mycobacterium
VEFHQGYGMTETGGNVT

SEQ ID NO: 937067 - protein, 17 aa, Mycobacterium
VEFPAGAVLEVRTAISY

SEQ ID NO: 937068 - protein, 19 aa, Mycobacterium
VEFPPGGLHNWTYWGNQLK

SEQ ID NO: 937069 - protein, 21 aa, Mycobacterium
VEFRTLPVVRYDNIDGQDVNI

SEQ ID NO: 937070 - protein, 18 aa, Mycobacterium
VEGARRGVAALADLETVA

SEQ ID NO: 937071 - protein, 20 aa, Mycobacterium
VEGHIHPFFGAFLSGGVNLQ

SEQ ID NO: 937072 - protein, 17 aa, Mycobacterium
VEGHIHPFLGSFLSTGV

SEQ ID NO: 937073 - protein, 26 aa, Mycobacterium
VEGQPEWPAYISGGAFQRLAPPAPRS

SEQ ID NO: 937074 - protein, 22 aa, Mycobacterium
VEHARRLGICAAVTFHGHVDDV

SEQ ID NO: 937075 - protein, 19 aa, Mycobacterium
VEHAVRTAGQLIWSNLKHS

SEQ ID NO: 937076 - protein, 17 aa, Mycobacterium
VEHLPWFALSDPVTTRM

SEQ ID NO: 937077 - protein, 24 aa, Mycobacterium
VEKFIPRQITNVLWGIRPRLYGEG

SEQ ID NO: 937078 - protein, 29 aa, Mycobacterium
VELPLSALVAGWLRGRVAPQAVVDARVYA

SEQ ID NO: 937079 - protein, 26 aa, Mycobacterium
VELTARLNSLGEAWTGGGSDKAIAAA

SEQ ID NO: 937080 - protein, 24 aa, Mycobacterium
VELTPPYRSGPVLKNHDTIGLTRT

SEQ ID NO: 937081 - protein, 19 aa, Mycobacterium
VELTRRASLIPSLVHTVQT

SEQ ID NO: 937082 - protein, 23 aa, Mycobacterium
VELTRRASLIPSLVHTVQTFAAH

SEQ ID NO: 937083 - protein, 23 aa, Mycobacterium
VEMPRWSTNRVVLVGDACSAVSP

SEQ ID NO: 937084 - protein, 23 aa, Mycobacterium
VEPDRRIGAIFIDGGPLHVCTGS

SEQ ID NO: 937085 - protein, 17 aa, Mycobacterium
VEPGGPIECQVQVRAHG

SEQ ID NO: 937086 - protein, 28 aa, Mycobacterium
VEPLGWYRRPGVLFAAAACLAAVATTGL

SEQ ID NO: 937087 - protein, 18 aa, Mycobacterium
VEPRARWERLYQLVNHVL

SEQ ID NO: 937088 - protein, 22 aa, Mycobacterium
VEPRLWNMATVLPILQDTTIVA

SEQ ID NO: 937089 - protein, 31 aa, Mycobacterium
VEPTVSLKRAFALSCNTAFVQLGMHTGSDAL

SEQ ID NO: 937090 - protein, 24 aa, Mycobacterium
VEQFTRNGALWGVPQLTDAGIAVY

SEQ ID NO: 937091 - protein, 25 aa, Mycobacterium
VEQFTRNGTLWGVPQLTDAGIALYY

SEQ ID NO: 937092 - protein, 26 aa, Mycobacterium
VERARPILDPMAGKIIHCGGSGTGQA

SEQ ID NO: 937093 - protein, 21 aa, Mycobacterium
VERIRAAGGIIHARTTSPEFS

SEQ ID NO: 937094 - protein, 20 aa, Mycobacterium
VERLKAKGVRGLAVKSDQAD

SEQ ID NO: 937095 - protein, 18 aa, Mycobacterium
VERPELNAALDGRWDRNW

SEQ ID NO: 937096 - protein, 24 aa, Mycobacterium
VERRREVFIYPKARNLSFRSLEIL

SEQ ID NO: 937097 - protein, 23 aa, Mycobacterium
VESGEPPGFLLLGPDALAIYRHV

SEQ ID NO: 937098 - protein, 21 aa, Mycobacterium
VESILTVLALRDGIIPPTRNL

SEQ ID NO: 937099 - protein, 19 aa, Mycobacterium
VESLACAYAAVLAEAKHYA

SEQ ID NO: 937100 - protein, 17 aa, Mycobacterium
VETADGVEYVRDFDDSD

SEQ ID NO: 937101 - protein, 17 aa, Mycobacterium
VETIVWRTYAQTLPPDA

SEQ ID NO: 937102 - protein, 25 aa, Mycobacterium
VEVRSVSASGLWAGTALTLPASELR

SEQ ID NO: 937103 - protein, 26 aa, Mycobacterium
VEVSCPHFEYALPAYYLILPSEVSSN

SEQ ID NO: 937104 - protein, 25 aa, Mycobacterium
VEVVGRIPLVLDYTINEKAVYSDGK

SEQ ID NO: 937105 - protein, 27 aa, Mycobacterium
VEYAQLRAQWGWRLVAAASTLPTPALR

SEQ ID NO: 937106 - protein, 22 aa, Mycobacterium
VEYGDRCLHDYCPPPCGETTPC

SEQ ID NO: 937107 - protein, 17 aa, Mycobacterium
VFAAFEIAETLPPGPER

SEQ ID NO: 937108 - protein, 17 aa, Mycobacterium
VFAAPSIERLRDRLERL

SEQ ID NO: 937109 - protein, 27 aa, Mycobacterium
VFADQGVEAWPKCGAASGLPIGWYSHP

SEQ ID NO: 937110 - protein, 18 aa, Mycobacterium
VFAPRSLYAPGYLENMRN

SEQ ID NO: 937111 - protein, 25 aa, Mycobacterium
VFAQLRFEREQRYTAVFANVSGLTS

SEQ ID NO: 937112 - protein, 17 aa, Mycobacterium
VFARRLLTTALAAALTI

SEQ ID NO: 937113 - protein, 27 aa, Mycobacterium
VFEHRCPLCAEPVRWRLVGEEAELRPR

SEQ ID NO: 937114 - protein, 21 aa, Mycobacterium
VFFDSCWDPAPRAGRQRAPRP

SEQ ID NO: 937115 - protein, 24 aa, Mycobacterium
VFFESPRRLAACLHDAVDQLGGAR

SEQ ID NO: 937116 - protein, 24 aa, Mycobacterium
VFFESPRRLAACLRDAVEQLGGAR

SEQ ID NO: 937117 - protein, 25 aa, Mycobacterium
VFFESPRRLPACLQDAVERLGGARR

SEQ ID NO: 937118 - protein, 24 aa, Mycobacterium
VFGDFRFGPENTYHATFTDVSRLK

SEQ ID NO: 937119 - protein, 20 aa, Mycobacterium
VFGQIRFNRTTEYSAIFKNV

SEQ ID NO: 937120 - protein, 17 aa, Mycobacterium
VFGQVRFGDGNTYYAEF

SEQ ID NO: 937121 - protein, 18 aa, Mycobacterium
VFGSCRYPKTGVQKLDDK

SEQ ID NO: 937122 - protein, 27 aa, Mycobacterium
VFGTTSWGRLVFCGSPRRYEPRYFRSP

SEQ ID NO: 937123 - protein, 18 aa, Mycobacterium
VFLRRARAYIPELTASDI

SEQ ID NO: 937124 - protein, 18 aa, Mycobacterium
VFNFPANGTHDWPYWGQQ

SEQ ID NO: 937125 - protein, 28 aa, Mycobacterium
VFNFPANGTHSWPYWNQQLMAMKPDMQQ

SEQ ID NO: 937126 - protein, 26 aa, Mycobacterium
VFNFPANGTHTWSYWGAQLQAMLPDL

SEQ ID NO: 937127 - protein, 26 aa, Mycobacterium
VFNFPPNGTHAWGYWGAQLQAMKPDL

SEQ ID NO: 937128 - protein, 26 aa, Mycobacterium
VFNFPPNGTHGWGYWGSQLNAMKPDI

SEQ ID NO: 937129 - protein, 24 aa, Mycobacterium
VFNFPPNGTHTWNYWGQQLLEMKP

SEQ ID NO: 937130 - protein, 20 aa, Mycobacterium
VFQRTPGWVLPRLDFQHPDW

SEQ ID NO: 937131 - protein, 27 aa, Mycobacterium
VFQRTPIWIAPRFDFPFTPEQQELFER

SEQ ID NO: 937132 - protein, 18 aa, Mycobacterium
VFRRIATDFPGLREAAWT

SEQ ID NO: 937133 - protein, 19 aa, Mycobacterium
VFSARHWNVLRGLRTPDGQ

SEQ ID NO: 937134 - protein, 22 aa, Mycobacterium
VFSGKPRPGAGPSAAPATAPSN

SEQ ID NO: 937135 - protein, 21 aa, Mycobacterium
VFTTLPWKLTITTTMTSVFAN

SEQ ID NO: 937136 - protein, 19 aa, Mycobacterium
VFVRVPWRKATVGATALGL

SEQ ID NO: 937137 - protein, 17 aa, Mycobacterium
VFVWRRLPYATDVAAPF

SEQ ID NO: 937138 - protein, 17 aa, Mycobacterium
VFWDCYRPHDVQVKMFE

SEQ ID NO: 937139 - protein, 18 aa, Mycobacterium
VGAARCMVEPQPRTFAQT

SEQ ID NO: 937140 - protein, 21 aa, Mycobacterium
VGADGVYLATFVEPGSEGPGT

SEQ ID NO: 937141 - protein, 27 aa, Mycobacterium
VGAEALVRWRHPVWGLLLPDSFIGVAE

SEQ ID NO: 937142 - protein, 24 aa, Mycobacterium
VGAGMGITTWWYRGSDMDTERDLE

SEQ ID NO: 937143 - protein, 20 aa, Mycobacterium
VGALAVALGVGSAVFAGQGM

SEQ ID NO: 937144 - protein, 20 aa, Mycobacterium
VGALCERVDLLPGADGRVFI

SEQ ID NO: 937145 - protein, 18 aa, Mycobacterium
VGALKLILTQPFDIDTVP

SEQ ID NO: 937146 - protein, 23 aa, Mycobacterium
VGALKLILTVPFNIDNIPKAIRG

SEQ ID NO: 937147 - protein, 27 aa, Mycobacterium
VGAPPEPRLWGAFTERGLSNMPMKPGM

SEQ ID NO: 937148 - protein, 20 aa, Mycobacterium
VGAQCQKLAGALDDFADEVA

SEQ ID NO: 937149 - protein, 30 aa, Mycobacterium
VGARAPRSNRGQPACSVDTVAAVAAGAAVA

SEQ ID NO: 937150 - protein, 21 aa, Mycobacterium
VGARIPIGGIYSRDITYPINS

SEQ ID NO: 937151 - protein, 22 aa, Mycobacterium
VGCAPLRGGGVGIRGDNAELRF

SEQ ID NO: 937152 - protein, 18 aa, Mycobacterium
VGCCVVLTATGCAFHGLN

SEQ ID NO: 937153 - protein, 19 aa, Mycobacterium
VGCGPGPFTGLRVGMATAA

SEQ ID NO: 937154 - protein, 18 aa, Mycobacterium
VGDAFPLSSLTQIYMSDG

SEQ ID NO: 937155 - protein, 19 aa, Mycobacterium
VGDAFPLSSLTQIYTSDGE

SEQ ID NO: 937156 - protein, 23 aa, Mycobacterium
VGDFDPKEAITHGYVDSQKLPAW

SEQ ID NO: 937157 - protein, 18 aa, Mycobacterium
VGDFEFRASAVIVASGGI

SEQ ID NO: 937158 - protein, 22 aa, Mycobacterium
VGDHEARILLAKNPAGWQEALS

SEQ ID NO: 937159 - protein, 25 aa, Mycobacterium
VGDKGYRTRADWYLPTQGDGTVTAT

SEQ ID NO: 937160 - protein, 20 aa, Mycobacterium
VGDPVPLVLADHSVHRPETL

SEQ ID NO: 937161 - protein, 18 aa, Mycobacterium
VGDQGKRNVSHGCINLSP

SEQ ID NO: 937162 - protein, 19 aa, Mycobacterium
VGDQGKRNVSHGCINLSPT

SEQ ID NO: 937163 - protein, 18 aa, Mycobacterium
VGDRAAVERSIRVTSPSN

SEQ ID NO: 937164 - protein, 21 aa, Mycobacterium
VGDTFGGPGMTGRHIYNSLFR

SEQ ID NO: 937165 - protein, 23 aa, Mycobacterium
VGDTTRLLARFPALGGTDTSGRS

SEQ ID NO: 937166 - protein, 17 aa, Mycobacterium
VGDVLRVILGANHSTPF

SEQ ID NO: 937167 - protein, 32 aa, Mycobacterium
VGEAIYRFYCGEMYRTGFFCADPHPGNIMLLP

SEQ ID NO: 937168 - protein, 19 aa, Mycobacterium
VGEIPRDLHLNAAEVGLLG

SEQ ID NO: 937169 - protein, 25 aa, Mycobacterium
VGEPYMKALQILKSQGLKATFGGSR

SEQ ID NO: 937170 - protein, 18 aa, Mycobacterium
VGEVCAGLPDVAHVEIDI

SEQ ID NO: 937171 - protein, 23 aa, Mycobacterium
VGEYPARVVAVGADRDCPATEIA

SEQ ID NO: 937172 - protein, 30 aa, Mycobacterium
VGFAAIVFLVWRYVVPPVRRLMSARQQTVR

SEQ ID NO: 937173 - protein, 31 aa, Mycobacterium
VGFAAIVFLVWRYVVPPVRRMMAARQDTVRQ

SEQ ID NO: 937174 - protein, 25 aa, Mycobacterium
VGFGVAPLPGFPFLRGFPIRCSAEE

SEQ ID NO: 937175 - protein, 24 aa, Mycobacterium
VGFRRIAADLARPVETVRGWLRRF

SEQ ID NO: 937176 - protein, 17 aa, Mycobacterium
VGFSGCNHFFGRYEMDG

SEQ ID NO: 937177 - protein, 22 aa, Mycobacterium
VGGAARPAPDLAPRSVHGQTLN

SEQ ID NO: 937178 - protein, 23 aa, Mycobacterium
VGGARYRYWHLVLAPGSAAVPLS

SEQ ID NO: 937179 - protein, 17 aa, Mycobacterium
VGGCLGHALGTPGAQSI

SEQ ID NO: 937180 - protein, 24 aa, Mycobacterium
VGGEMRSRMDSYRAAQTSADEAEQ

SEQ ID NO: 937181 - protein, 17 aa, Mycobacterium
VGGLGPDLARLVAGGSS

SEQ ID NO: 937182 - protein, 20 aa, Mycobacterium
VGGPELKAGGEAAWQGLKTL

SEQ ID NO: 937183 - protein, 20 aa, Mycobacterium
VGGQSSWYTDWYQPAKGKDG

SEQ ID NO: 937184 - protein, 20 aa, Mycobacterium
VGGVPVDFGATFVGPTQDAV

SEQ ID NO: 937185 - protein, 25 aa, Mycobacterium
VGGVVLRYGLIYGPGTYFERQLPPT

SEQ ID NO: 937186 - protein, 24 aa, Mycobacterium
VGHDLRYAIDPSLLYNELAWAPKH

SEQ ID NO: 937187 - protein, 17 aa, Mycobacterium
VGHPFNPPELMPLVEVV

SEQ ID NO: 937188 - protein, 26 aa, Mycobacterium
VGHSMGGLYSRAAFRVLQSLGSPIRI

SEQ ID NO: 937189 - protein, 26 aa, Mycobacterium
VGHYVKSRLDTMTVIAQFDSAAGLYE

SEQ ID NO: 937190 - protein, 17 aa, Mycobacterium
VGIAAPIIIQFDAPISD

SEQ ID NO: 937191 - protein, 19 aa, Mycobacterium
VGIAFLLSGVIGILTGAWS

SEQ ID NO: 937192 - protein, 17 aa, Mycobacterium
VGIEPQYAFLGDNLPIV

SEQ ID NO: 937193 - protein, 19 aa, Mycobacterium
VGIRADCLGVQAPLPEWAD

SEQ ID NO: 937194 - protein, 17 aa, Mycobacterium
VGITDPRDDLDAVVRAA

SEQ ID NO: 937195 - protein, 28 aa, Mycobacterium
VGIYSLRWGGKPAAMSWSAISAQMQSQL

SEQ ID NO: 937196 - protein, 18 aa, Mycobacterium
VGKARAAGYESLMVPSAA

SEQ ID NO: 937197 - protein, 26 aa, Mycobacterium
VGKITRITPRGGYVEVEFTVDRHVKI

SEQ ID NO: 937198 - protein, 27 aa, Mycobacterium
VGLALTCPVTLPVAFPVAFPVAQADPL

SEQ ID NO: 937199 - protein, 19 aa, Mycobacterium
VGLCTAWNLARAGAEVTVV

SEQ ID NO: 937200 - protein, 26 aa, Mycobacterium
VGLPLEYGKRLKFGDYQCRSDRMGLY

SEQ ID NO: 937201 - protein, 19 aa, Mycobacterium
VGLTDLRRVVVFDYRAETD

SEQ ID NO: 937202 - protein, 19 aa, Mycobacterium
VGLYPGDQVRVVGVPVGTI

SEQ ID NO: 937203 - protein, 18 aa, Mycobacterium
VGMVGNAKVTVAVDSSGR

SEQ ID NO: 937204 - protein, 23 aa, Mycobacterium
VGNGTCYWKRLGNPEGALLDNAL

SEQ ID NO: 937205 - protein, 24 aa, Mycobacterium
VGNIVGAPMGWESVFTEPFQAYAV

SEQ ID NO: 937206 - protein, 23 aa, Mycobacterium
VGNLLPQVFRWARAVDPSQPLTS

SEQ ID NO: 937207 - protein, 22 aa, Mycobacterium
VGNQVSLLWTYLGYPVANSVVL

SEQ ID NO: 937208 - protein, 17 aa, Mycobacterium
VGPARQALTSALFEGAS

SEQ ID NO: 937209 - protein, 23 aa, Mycobacterium
VGPDGSYPCSIRVEPLSAGYSHG

SEQ ID NO: 937210 - protein, 19 aa, Mycobacterium
VGPGCSEYAAANPTGPASV

SEQ ID NO: 937211 - protein, 18 aa, Mycobacterium
VGPGGAFLQPALGRANLT

SEQ ID NO: 937212 - protein, 19 aa, Mycobacterium
VGPIGGITHKMAAARAAGA

SEQ ID NO: 937213 - protein, 18 aa, Mycobacterium
VGPIGGITHKMFAAKDAG

SEQ ID NO: 937214 - protein, 24 aa, Mycobacterium
VGPYFRFGLTVLRMAIETRTHYLD

SEQ ID NO: 937215 - protein, 23 aa, Mycobacterium
VGQAGGDGGFLWGNGGNGGDSTS

SEQ ID NO: 937216 - protein, 25 aa, Mycobacterium
VGQFTRGGALWGVPQLTDAGIALYY

SEQ ID NO: 937217 - protein, 19 aa, Mycobacterium
VGQKLGAPVERRIAELADQ

SEQ ID NO: 937218 - protein, 17 aa, Mycobacterium
VGQKVLPSQALPGDLIF

SEQ ID NO: 937219 - protein, 23 aa, Mycobacterium
VGQMLECIVALMPVGAAVVDVHR

SEQ ID NO: 937220 - protein, 23 aa, Mycobacterium
VGREVALFPGSWSEWCSDPGRAV

SEQ ID NO: 937221 - protein, 17 aa, Mycobacterium
VGRGYGGVRVELEGDLT

SEQ ID NO: 937222 - protein, 25 aa, Mycobacterium
VGRYRVTVELPQAAGLYPSGNVTYR

SEQ ID NO: 937223 - protein, 17 aa, Mycobacterium
VGSAKWLGEQGKPGHIA

SEQ ID NO: 937224 - protein, 17 aa, Mycobacterium
VGSCPNSKIVLGGYSQG

SEQ ID NO: 937225 - protein, 25 aa, Mycobacterium
VGSEAAQAMGIRGGLPAGRPGNPDD

SEQ ID NO: 937226 - protein, 22 aa, Mycobacterium
VGSEHPSQCTVQGVSQQSGVQN

SEQ ID NO: 937227 - protein, 25 aa, Mycobacterium
VGSGGYRITAIFSNALNLPANAKVK

SEQ ID NO: 937228 - protein, 18 aa, Mycobacterium
VGSGPFVYQSHVPDQEVV

SEQ ID NO: 937229 - protein, 24 aa, Mycobacterium
VGSGSGSIAIEWCRSAPGCTAVAF

SEQ ID NO: 937230 - protein, 17 aa, Mycobacterium
VGSIPFALTDSVTPLAG

SEQ ID NO: 937231 - protein, 20 aa, Mycobacterium
VGTAKCPAAPTADDQAPPAD

SEQ ID NO: 937232 - protein, 24 aa, Mycobacterium
VGTDFGAAIYAEYRLARTVRSAAS

SEQ ID NO: 937233 - protein, 17 aa, Mycobacterium
VGTPFCVTVDFDSLEDN

SEQ ID NO: 937234 - protein, 17 aa, Mycobacterium
VGTPLPAAVQQAPAAPA

SEQ ID NO: 937235 - protein, 19 aa, Mycobacterium
VGTVSGLYVCEMVTARALV

SEQ ID NO: 937236 - protein, 34 aa, Mycobacterium
VGVAEYFKEGTFIPILNYRVKRVALSPYPTTIVI

SEQ ID NO: 937237 - protein, 25 aa, Mycobacterium
VGVAGGLCLSTGPAVTAGTAGPTVR

SEQ ID NO: 937238 - protein, 31 aa, Mycobacterium
VGVAMPVTIRFAAPVADRIAAERSIEFSAPK

SEQ ID NO: 937239 - protein, 26 aa, Mycobacterium
VGVASACGLAGCFGTGGKTARPTVSV

SEQ ID NO: 937240 - protein, 23 aa, Mycobacterium
VGVKMDTIWWDRPFKVTSVEIGA

SEQ ID NO: 937241 - protein, 21 aa, Mycobacterium
VGVNAEMIWNQPIENKGSDGQ

SEQ ID NO: 937242 - protein, 19 aa, Mycobacterium
VGVSACTSVDIGVPNINAV

SEQ ID NO: 937243 - protein, 20 aa, Mycobacterium
VGVTLAALFAVLTGALAGCS

SEQ ID NO: 937244 - protein, 24 aa, Mycobacterium
VGVVPDYLGNVWFATGSGVVGVAK

SEQ ID NO: 937245 - protein, 19 aa, Mycobacterium
VGWFTTKYPVAITVAPLRW

SEQ ID NO: 937246 - protein, 17 aa, Mycobacterium
VGWGQPDLREQWKQASA

SEQ ID NO: 937247 - protein, 19 aa, Mycobacterium
VGWSLGAAVREHGADVLVA

SEQ ID NO: 937248 - protein, 18 aa, Mycobacterium
VGYAPLLALLPRRVSDEE

SEQ ID NO: 937249 - protein, 24 aa, Mycobacterium
VGYRLAKIQSLLGLDLRKADVRLE

SEQ ID NO: 937250 - protein, 33 aa, Mycobacterium
VGYVLRVAAGPAFRIRLADCGGMMGAGHADMRL

SEQ ID NO: 937251 - protein, 19 aa, Mycobacterium
VHACGERTARVALDAFEAA

SEQ ID NO: 937252 - protein, 23 aa, Mycobacterium
VHGFPNYFFLCGPDVAAQISYVA

SEQ ID NO: 937253 - protein, 19 aa, Mycobacterium
VHGLWRGGIGTTWEARIKF

SEQ ID NO: 937254 - protein, 21 aa, Mycobacterium
VHGRMAPQLLMRIASATAVID

SEQ ID NO: 937255 - protein, 22 aa, Mycobacterium
VHGRTGPIPVRRTRDQTGVTQR

SEQ ID NO: 937256 - protein, 17 aa, Mycobacterium
VHGRVFVSLLAYELGRH

SEQ ID NO: 937257 - protein, 18 aa, Mycobacterium
VHHVCALNAILVDPTVGP

SEQ ID NO: 937258 - protein, 20 aa, Mycobacterium
VHKAVWKDGRVVAVKVQYPG

SEQ ID NO: 937259 - protein, 27 aa, Mycobacterium
VHLDDEIYRILAQLGIAEQFATISRPG

SEQ ID NO: 937260 - protein, 25 aa, Mycobacterium
VHNDSGDTARVFAIDAKSGATLGTY

SEQ ID NO: 937261 - protein, 24 aa, Mycobacterium
VHNQLRFAVTAMRGVASKVSRTRF

SEQ ID NO: 937262 - protein, 17 aa, Mycobacterium
VHQLVCSPVHNYVPAPL

SEQ ID NO: 937263 - protein, 19 aa, Mycobacterium
VHSSGCPQAFTGNPAAAEF

SEQ ID NO: 937264 - protein, 24 aa, Mycobacterium
VHVMCSAGGWIHGQRQSLLQNATA

SEQ ID NO: 937265 - protein, 18 aa, Mycobacterium
VHWRPRDYYPAGTTVNVD

SEQ ID NO: 937266 - protein, 25 aa, Mycobacterium
VIADASRIAGAWNDVVLAPGADLYS

SEQ ID NO: 937267 - protein, 26 aa, Mycobacterium
VIALPPDWANYGAIISAFSDKYGITV

SEQ ID NO: 937268 - protein, 25 aa, Mycobacterium
VIALPPDWANYGALISAFEDKYGIK

SEQ ID NO: 937269 - protein, 23 aa, Mycobacterium
VIATVVGAGWWYLGAGEDTITVT

SEQ ID NO: 937270 - protein, 24 aa, Mycobacterium
VIDGAGADALWFLPLFDQSALDLM

SEQ ID NO: 937271 - protein, 23 aa, Mycobacterium
VIDGWPTFVKNWELLVSDVERIL

SEQ ID NO: 937272 - protein, 26 aa, Mycobacterium
VIDLAGKLLMPGFVEGHIHPFLGSFL

SEQ ID NO: 937273 - protein, 20 aa, Mycobacterium
VIDVCLTGGFIVAKHAGRHL

SEQ ID NO: 937274 - protein, 23 aa, Mycobacterium
VIELDGLALLPAFVEAHSHPSQI

SEQ ID NO: 937275 - protein, 18 aa, Mycobacterium
VIFHLAAQIDVRHSVADP

SEQ ID NO: 937276 - protein, 23 aa, Mycobacterium
VIFRAAMANPVFARITAEPSAMF

SEQ ID NO: 937277 - protein, 23 aa, Mycobacterium
VIGPDRRFVMVIGALQPTDATTA

SEQ ID NO: 937278 - protein, 25 aa, Mycobacterium
VIGRSGTPGRVWAWQTRSWSNGQIY

SEQ ID NO: 937279 - protein, 26 aa, Mycobacterium
VIGVPYCYGAAFDPWTGRYLLVLEDL

SEQ ID NO: 937280 - protein, 26 aa, Mycobacterium
VIHNYRWRLGLARGESRYDAVEAKLA

SEQ ID NO: 937281 - protein, 24 aa, Mycobacterium
VIHRRYAESIPLGRIGVGDEVSAA

SEQ ID NO: 937282 - protein, 22 aa, Mycobacterium
VIIGGGFGGLFCARRLARVDVD

SEQ ID NO: 937283 - protein, 19 aa, Mycobacterium
VIIGRRGPLQSAFTTLELR

SEQ ID NO: 937284 - protein, 18 aa, Mycobacterium
VIILAGWAVIAGCASGRP

SEQ ID NO: 937285 - protein, 27 aa, Mycobacterium
VIKRMGSQMGVPYSWGGGSLDGPSKGV

SEQ ID NO: 937286 - protein, 18 aa, Mycobacterium
VIKYIPLHTPAVVQSFNA

SEQ ID NO: 937287 - protein, 25 aa, Mycobacterium
VILPARAGLYVDRRADGWDLTLRHL

SEQ ID NO: 937288 - protein, 18 aa, Mycobacterium
VINDLEFTVRLKAPTIDF

SEQ ID NO: 937289 - protein, 17 aa, Mycobacterium
VINGGVNTAAWYTTATI

SEQ ID NO: 937290 - protein, 18 aa, Mycobacterium
VINREGANGALAAAEVSK

SEQ ID NO: 937291 - protein, 22 aa, Mycobacterium
VIPDVLRHRLVLTYDALADEIS

SEQ ID NO: 937292 - protein, 19 aa, Mycobacterium
VIPEERTAVPVEWDDLRTQ

SEQ ID NO: 937293 - protein, 18 aa, Mycobacterium
VIQIPGLPPITVPVLGPP

SEQ ID NO: 937294 - protein, 26 aa, Mycobacterium
VIQTEFNVALPWSKEVSLPKSSLHPA

SEQ ID NO: 937295 - protein, 20 aa, Mycobacterium
VIRAALAVWGFDDWPGGLPA

SEQ ID NO: 937296 - protein, 17 aa, Mycobacterium
VIRFTFAPDPIWDYMHD

SEQ ID NO: 937297 - protein, 26 aa, Mycobacterium
VIRTYPIPLLMPLDPFLSDSAMAALD

SEQ ID NO: 937298 - protein, 20 aa, Mycobacterium
VISGFPVDRGWDVEGVFDPD

SEQ ID NO: 937299 - protein, 20 aa, Mycobacterium
VISRTRYNANLDYTYQTAPE

SEQ ID NO: 937300 - protein, 20 aa, Mycobacterium
VIVLVAAVVWWTSDARATRS

SEQ ID NO: 937301 - protein, 17 aa, Mycobacterium
VIVNAGIGKGARLGSGK

SEQ ID NO: 937302 - protein, 17 aa, Mycobacterium
VIVTRYLTVPAEDAAPR

SEQ ID NO: 937303 - protein, 18 aa, Mycobacterium
VIVVVSMVFGAATFNAGQ

SEQ ID NO: 937304 - protein, 19 aa, Mycobacterium
VKAAIAWARANVDKFGGDR

SEQ ID NO: 937305 - protein, 20 aa, Mycobacterium
VKAKAAAALAKKALGLRYTM

SEQ ID NO: 937306 - protein, 21 aa, Mycobacterium
VKAKRRYAVDHGRALTASTTT

SEQ ID NO: 937307 - protein, 19 aa, Mycobacterium
VKANLYGIPFGDGAFGNED

SEQ ID NO: 937308 - protein, 23 aa, Mycobacterium
VKANRLPKVSWLVPNFLQSEHPA

SEQ ID NO: 937309 - protein, 20 aa, Mycobacterium
VKARWERWLAPRRRQHPDLD

SEQ ID NO: 937310 - protein, 17 aa, Mycobacterium
VKCAMNLSDDPPGALGA

SEQ ID NO: 937311 - protein, 19 aa, Mycobacterium
VKDALADRKVVLITTPEAD

SEQ ID NO: 937312 - protein, 20 aa, Mycobacterium
VKDGVPLTIVLGVASNDPTS

SEQ ID NO: 937313 - protein, 17 aa, Mycobacterium
VKDIRDGLVKPKKPATK

SEQ ID NO: 937314 - protein, 30 aa, Mycobacterium
VKDVEAIKRIKYRYLRALDTKHWDDFADTL

SEQ ID NO: 937315 - protein, 17 aa, Mycobacterium
VKFDSGADVNTAFVADE

SEQ ID NO: 937316 - protein, 23 aa, Mycobacterium
VKGAVVLVDRGECQFAQKEDAAA

SEQ ID NO: 937317 - protein, 23 aa, Mycobacterium
VKGFFEKTFAPLGLRRIQDEVLE

SEQ ID NO: 937318 - protein, 23 aa, Mycobacterium
VKGNRLPQVSWLVPPFIQSEHPA

SEQ ID NO: 937319 - protein, 18 aa, Mycobacterium
VKGRVPARVYTVQLGGFD

SEQ ID NO: 937320 - protein, 24 aa, Mycobacterium
VKIPGGALCGKLAVPVDYRQPRGD

SEQ ID NO: 937321 - protein, 42 aa, Mycobacterium
VKLEAQRPQGFNALEITLPMPPRWTPVPDPNVPDAFAVIADR

SEQ ID NO: 937322 - protein, 24 aa, Mycobacterium
VKLIGEGGVEVALTGPIAAKYSSA

SEQ ID NO: 937323 - protein, 17 aa, Mycobacterium
VKLPADIAAQLGGQGLE

SEQ ID NO: 937324 - protein, 20 aa, Mycobacterium
VKPAAPFRANVASVPPLTPQ

SEQ ID NO: 937325 - protein, 21 aa, Mycobacterium
VKPRRVLTIGAGFIGSEIASV

SEQ ID NO: 937326 - protein, 20 aa, Mycobacterium
VKQHPDRLVAGWRVVALEPY

SEQ ID NO: 937327 - protein, 29 aa, Mycobacterium
VKQLSEMYDRCPLTSYVIIGFSQGAVIAG

SEQ ID NO: 937328 - protein, 24 aa, Mycobacterium
VKQTWLDPFVPWEHDVTMTTREAV

SEQ ID NO: 937329 - protein, 17 aa, Mycobacterium
VKTMKSRVIDVVEENGF

SEQ ID NO: 937330 - protein, 17 aa, Mycobacterium
VKVPVLLALGDDDLNVD

SEQ ID NO: 937331 - protein, 17 aa, Mycobacterium
VKVVLSGEGADELFGGY

SEQ ID NO: 937332 - protein, 20 aa, Mycobacterium
VKVVRLGGAGRGFSSGAGIS

SEQ ID NO: 937333 - protein, 17 aa, Mycobacterium
VKYPATWDFAQVAVGAN

SEQ ID NO: 937334 - protein, 22 aa, Mycobacterium
VLAATNWLGFNTPAIMDIEAAY

SEQ ID NO: 937335 - protein, 22 aa, Mycobacterium
VLAGAGAMIWVDTSLQRIPALA

SEQ ID NO: 937336 - protein, 19 aa, Mycobacterium
VLAGAWAYIEAHGLDTLTM

SEQ ID NO: 937337 - protein, 23 aa, Mycobacterium
VLAGLVYVGWRVIRMNANRPRTR

SEQ ID NO: 937338 - protein, 25 aa, Mycobacterium
VLAGQGPAAWPKCSSAGGLPPVPVV

SEQ ID NO: 937339 - protein, 17 aa, Mycobacterium
VLAGVAVVPLRLRGHDY

SEQ ID NO: 937340 - protein, 17 aa, Mycobacterium
VLAGVPVVPLRLHRYDY

SEQ ID NO: 937341 - protein, 20 aa, Mycobacterium
VLAKDTANWKRDEAVNKMKN

SEQ ID NO: 937342 - protein, 20 aa, Mycobacterium
VLAKSFFRFDRRGWTVDNAF

SEQ ID NO: 937343 - protein, 22 aa, Mycobacterium
VLANRARLLILIATNFFGQNTA

SEQ ID NO: 937344 - protein, 18 aa, Mycobacterium
VLAQFAGFGVKGIEGSFF

SEQ ID NO: 937345 - protein, 22 aa, Mycobacterium
VLARFGGADAFELRDVAVPHVG

SEQ ID NO: 937346 - protein, 23 aa, Mycobacterium
VLASCALVPLGAGVPVANADEST

SEQ ID NO: 937347 - protein, 20 aa, Mycobacterium
VLATEVLRMLRMVKEECEVD

SEQ ID NO: 937348 - protein, 23 aa, Mycobacterium
VLAVLLCLLLGVAIATQVRQTDS

SEQ ID NO: 937349 - protein, 18 aa, Mycobacterium
VLAWLHPPGIDFRPALLA

SEQ ID NO: 937350 - protein, 24 aa, Mycobacterium
VLCIACFGVATALRAAVARRGSDD

SEQ ID NO: 937351 - protein, 23 aa, Mycobacterium
VLCVAVGVGTWLLVRPSGPQRPE

SEQ ID NO: 937352 - protein, 18 aa, Mycobacterium
VLDGSGWSDDGMQSVVRV

SEQ ID NO: 937353 - protein, 21 aa, Mycobacterium
VLDVGDGVPVWISGPQFEAWK

SEQ ID NO: 937354 - protein, 18 aa, Mycobacterium
VLDWDWNRCHEWQHPGGP

SEQ ID NO: 937355 - protein, 20 aa, Mycobacterium
VLEKTFPVSMGKPGYDTKNG

SEQ ID NO: 937356 - protein, 25 aa, Mycobacterium
VLEPELPPGPFLTGVELNMFFGGPR

SEQ ID NO: 937357 - protein, 24 aa, Mycobacterium
VLEPMAGKIIHCGASGAGQAAKLC

SEQ ID NO: 937358 - protein, 24 aa, Mycobacterium
VLERLGMHAAVFLITGFVGTHQPY

SEQ ID NO: 937359 - protein, 18 aa, Mycobacterium
VLFARPCAIRDPATASLT

SEQ ID NO: 937360 - protein, 23 aa, Mycobacterium
VLFPQIKTIYGYREDALPWHPNG

SEQ ID NO: 937361 - protein, 23 aa, Mycobacterium
VLFPQIKTIYGYREDPLPWHPKG

SEQ ID NO: 937362 - protein, 17 aa, Mycobacterium
VLFRRGGAPAALADSIR

SEQ ID NO: 937363 - protein, 18 aa, Mycobacterium
VLGAVVFNIYSVALRVLG

SEQ ID NO: 937364 - protein, 18 aa, Mycobacterium
VLGEITVVLDGGRPAVPE

SEQ ID NO: 937365 - protein, 19 aa, Mycobacterium
VLGLTWLPFMDLRYTAILG

SEQ ID NO: 937366 - protein, 25 aa, Mycobacterium
VLGPEAFDSLPFLDRLNTFGAPWGI

SEQ ID NO: 937367 - protein, 18 aa, Mycobacterium
VLGPLLVTAIVGFIHVLP

SEQ ID NO: 937368 - protein, 17 aa, Mycobacterium
VLGRRLTVRLGDGDVRL

SEQ ID NO: 937369 - protein, 18 aa, Mycobacterium
VLGTLIYIGWRAARSQTN

SEQ ID NO: 937370 - protein, 18 aa, Mycobacterium
VLGWRAQHSQSHYAAAKA

SEQ ID NO: 937371 - protein, 37 aa, Mycobacterium
VLHRPKLGFPVPIRHWLRAGELLEWAYAMVTTSQAGH

SEQ ID NO: 937372 - protein, 17 aa, Mycobacterium
VLIGSLAVMAAAGVRMP

SEQ ID NO: 937373 - protein, 26 aa, Mycobacterium
VLIKERPRLTAALDHLRVFSNTANRL

SEQ ID NO: 937374 - protein, 22 aa, Mycobacterium
VLKFAAPVLLGLGATAAPGNEA

SEQ ID NO: 937375 - protein, 22 aa, Mycobacterium
VLKGLSRFYSEGAFINVYMCDL

SEQ ID NO: 937376 - protein, 18 aa, Mycobacterium
VLKYAAAIPAAALAGAVS

SEQ ID NO: 937377 - protein, 17 aa, Mycobacterium
VLLARPLLARRRGVGNG

SEQ ID NO: 937378 - protein, 17 aa, Mycobacterium
VLLCPTSAVTSLRADGD

SEQ ID NO: 937379 - protein, 20 aa, Mycobacterium
VLLGVWWIGAEVVLDGPADL

SEQ ID NO: 937380 - protein, 21 aa, Mycobacterium
VLLLLGLACGLPVATSGAAPG

SEQ ID NO: 937381 - protein, 24 aa, Mycobacterium
VLLSAVAVLIGFVSGYNKLRAADV

SEQ ID NO: 937382 - protein, 21 aa, Mycobacterium
VLLSGCEAHFSLGSSSPELAK

SEQ ID NO: 937383 - protein, 17 aa, Mycobacterium
VLNAIRAEPRWNVVLSF

SEQ ID NO: 937384 - protein, 30 aa, Mycobacterium
VLNATRPDLRWNAVWSFHLQPHWEDRVRLL

SEQ ID NO: 937385 - protein, 25 aa, Mycobacterium
VLNDGIRFFFDQGAILPDSYGALQV

SEQ ID NO: 937386 - protein, 17 aa, Mycobacterium
VLNLGQATRSFLGDEQK

SEQ ID NO: 937387 - protein, 17 aa, Mycobacterium
VLNRAKLGFPVPIRHWL

SEQ ID NO: 937388 - protein, 22 aa, Mycobacterium
VLPAPRAAAGVAGMSVFLDPGH

SEQ ID NO: 937389 - protein, 22 aa, Mycobacterium
VLPDMVAAGWGRIVNISSSSTH

SEQ ID NO: 937390 - protein, 22 aa, Mycobacterium
VLPGMRARGSGWIVNVSSVAGL

SEQ ID NO: 937391 - protein, 26 aa, Mycobacterium
VLPHVAGWRLDWLDVDSLIGSTPQIF

SEQ ID NO: 937392 - protein, 25 aa, Mycobacterium
VLPLGEPARPVWPPLLDAALTAVFD

SEQ ID NO: 937393 - protein, 22 aa, Mycobacterium
VLPMTAVGNSFYVVILAKPELA

SEQ ID NO: 937394 - protein, 25 aa, Mycobacterium
VLPQQAHKGDMIFYGPEGTQSVAMY

SEQ ID NO: 937395 - protein, 25 aa, Mycobacterium
VLPQQARKGDLIFYGPEGTQSVAMY

SEQ ID NO: 937396 - protein, 29 aa, Mycobacterium
VLQRLKYLPLAPFRISYAYTNFGVTAAAE

SEQ ID NO: 937397 - protein, 18 aa, Mycobacterium
VLQRVPSVEVVFIGHRRG

SEQ ID NO: 937398 - protein, 17 aa, Mycobacterium
VLRAALLGLAAVPVAAC

SEQ ID NO: 937399 - protein, 18 aa, Mycobacterium
VLRDYVIGVISQFRHDKR

SEQ ID NO: 937400 - protein, 21 aa, Mycobacterium
VLRGAAVLAARIMARLAARPS

SEQ ID NO: 937401 - protein, 20 aa, Mycobacterium
VLRLRPVEVVSAEALQLPLW

SEQ ID NO: 937402 - protein, 29 aa, Mycobacterium
VLRQFAARCLDRMGPEFLAGVGTATAARD

SEQ ID NO: 937403 - protein, 18 aa, Mycobacterium
VLRSEGFIPPSATSVSHE

SEQ ID NO: 937404 - protein, 18 aa, Mycobacterium
VLSDRAGLVMDRGGKVKL

SEQ ID NO: 937405 - protein, 25 aa, Mycobacterium
VLSGASVRISERFTTGDTLAYAAVA

SEQ ID NO: 937406 - protein, 26 aa, Mycobacterium
VLSIISLVGAVYMAFGVLDIASTSKT

SEQ ID NO: 937407 - protein, 17 aa, Mycobacterium
VLSLGLRAAMVATAGTA

SEQ ID NO: 937408 - protein, 24 aa, Mycobacterium
VLSQRAGLVMDADAKVKWHGAQVG

SEQ ID NO: 937409 - protein, 31 aa, Mycobacterium
VLSRNPKWWGPRPRLDNITYLVLDDAARLPA

SEQ ID NO: 937410 - protein, 18 aa, Mycobacterium
VLTDPVWSDRCSPSRVVG

SEQ ID NO: 937411 - protein, 20 aa, Mycobacterium
VLTEFPPLIQHFAETRDLFA

SEQ ID NO: 937412 - protein, 18 aa, Mycobacterium
VLTEFPPLLKHFADKQNL

SEQ ID NO: 937413 - protein, 28 aa, Mycobacterium
VLTNFGSALPEFAAQLSGAISATVGSSL

SEQ ID NO: 937414 - protein, 19 aa, Mycobacterium
VLTQRAGLVMNPDAKVKLH

SEQ ID NO: 937415 - protein, 18 aa, Mycobacterium
VLTRSAIGTLAGFTVLSG

SEQ ID NO: 937416 - protein, 23 aa, Mycobacterium
VLTSCAKWHGIANVPMPGGPGSG

SEQ ID NO: 937417 - protein, 17 aa, Mycobacterium
VLVCIVLAGVLGMCSFT

SEQ ID NO: 937418 - protein, 17 aa, Mycobacterium
VLVGGFAVVRVKSFFGA

SEQ ID NO: 937419 - protein, 19 aa, Mycobacterium
VLVGQSFRGAFDPKVRLTL

SEQ ID NO: 937420 - protein, 23 aa, Mycobacterium
VLVGRRGPLQAAFTTLELRELGE

SEQ ID NO: 937421 - protein, 24 aa, Mycobacterium
VLVIGGGFGGLFCARRLGRLDVDV

SEQ ID NO: 937422 - protein, 21 aa, Mycobacterium
VLVPLEPFPGILAVGRSDTTG

SEQ ID NO: 937423 - protein, 25 aa, Mycobacterium
VLVRDDCPLFAPGSHADRPGVVTGV

SEQ ID NO: 937424 - protein, 35 aa, Mycobacterium
VLVRPEAYLVYLLRRLSPTLLYAFSNLIFGSRTIT

SEQ ID NO: 937425 - protein, 18 aa, Mycobacterium
VLVVCGGAGALHGAALAK

SEQ ID NO: 937426 - protein, 23 aa, Mycobacterium
VLVVGGVGIWLVTRPKPAPPPKP

SEQ ID NO: 937427 - protein, 17 aa, Mycobacterium
VMAAEIERFAGPEEAAG

SEQ ID NO: 937428 - protein, 18 aa, Mycobacterium
VMALGLVSTVVSVAAAAA

SEQ ID NO: 937429 - protein, 23 aa, Mycobacterium
VMDRWSKGRVALVGDAAYCCSPL

SEQ ID NO: 937430 - protein, 19 aa, Mycobacterium
VMGAGAWGTALAKVLADAG

SEQ ID NO: 937431 - protein, 20 aa, Mycobacterium
VMGYNRIRSADVRVAEALSG

SEQ ID NO: 937432 - protein, 21 aa, Mycobacterium
VMLNTFLNGYVNPECEGSNCE

SEQ ID NO: 937433 - protein, 20 aa, Mycobacterium
VMRAEGLASIDVRPDAERTY

SEQ ID NO: 937434 - protein, 18 aa, Mycobacterium
VMRSACAEFSRWRKNGVG

SEQ ID NO: 937435 - protein, 22 aa, Mycobacterium
VMSPLGGFLPRRRPARPSGSPR

SEQ ID NO: 937436 - protein, 19 aa, Mycobacterium
VMSRYALAVQHERGLPMQS

SEQ ID NO: 937437 - protein, 20 aa, Mycobacterium
VMVLGCGRIGHGTGRGEEGP

SEQ ID NO: 937438 - protein, 21 aa, Mycobacterium
VMVLGCGRIGHGTGRGEEGPL

SEQ ID NO: 937439 - protein, 19 aa, Mycobacterium
VNAAFSMGGARLLVRTLEQ

SEQ ID NO: 937440 - protein, 17 aa, Mycobacterium
VNAEPAAALAAVADYQT

SEQ ID NO: 937441 - protein, 28 aa, Mycobacterium
VNAFFTSRCNMIAWDRGVFMPVAEKYFG

SEQ ID NO: 937442 - protein, 28 aa, Mycobacterium
VNAFFTSRCNMIAWDRGVFMPVAQEYFG

SEQ ID NO: 937443 - protein, 18 aa, Mycobacterium
VNAFPRGAGRMLAIMHAL

SEQ ID NO: 937444 - protein, 17 aa, Mycobacterium
VNAFWSLTIYELPSSQL

SEQ ID NO: 937445 - protein, 17 aa, Mycobacterium
VNAGAWPAVADELPESW

SEQ ID NO: 937446 - protein, 34 aa, Mycobacterium
VNAGYCYADRTIGWDRGELLPSLQRAHGDIGVVM

SEQ ID NO: 937447 - protein, 17 aa, Mycobacterium
VNAGYSRNDDPSTAPVQ

SEQ ID NO: 937448 - protein, 28 aa, Mycobacterium
VNASGGCHWPDCDSSNMPQIQCQIAVDG

SEQ ID NO: 937449 - protein, 21 aa, Mycobacterium
VNAVAGGIFVHIPVMYADLSK

SEQ ID NO: 937450 - protein, 22 aa, Mycobacterium
VNAVNSFLFGHETITQSMAAPA

SEQ ID NO: 937451 - protein, 17 aa, Mycobacterium
VNCRGPLMLAHHFGQQM

SEQ ID NO: 937452 - protein, 19 aa, Mycobacterium
VNDAAAWLLGRDLPFAYAG

SEQ ID NO: 937453 - protein, 21 aa, Mycobacterium
VNDTAKLVCGAIHAQNARIYL

SEQ ID NO: 937454 - protein, 23 aa, Mycobacterium
VNDYGGYMSIGFDSAKVPPVTTI

SEQ ID NO: 937455 - protein, 26 aa, Mycobacterium
VNFFAPMRMTLALLPRMLARGSGTIV

SEQ ID NO: 937456 - protein, 18 aa, Mycobacterium
VNFYSCDISLRINGLQPG

SEQ ID NO: 937457 - protein, 23 aa, Mycobacterium
VNGERRPGWVGVPIEGVRTRLVD

SEQ ID NO: 937458 - protein, 21 aa, Mycobacterium
VNGESSYFVWLNRSKESIALD

SEQ ID NO: 937459 - protein, 25 aa, Mycobacterium
VNGVTLSFWTPRGIYTVMDKANPVV

SEQ ID NO: 937460 - protein, 25 aa, Mycobacterium
VNGYHVGGIFIGSWTDLTIFQGPLA

SEQ ID NO: 937461 - protein, 17 aa, Mycobacterium
VNIPAQIIARLTGVTGA

SEQ ID NO: 937462 - protein, 24 aa, Mycobacterium
VNLGRPQPGLNLPVVLGGNMVQYD

SEQ ID NO: 937463 - protein, 23 aa, Mycobacterium
VNLNGPFFLSRAALPHLLQAGGN

SEQ ID NO: 937464 - protein, 20 aa, Mycobacterium
VNMTSTYVIRGRFTDAHPAD

SEQ ID NO: 937465 - protein, 18 aa, Mycobacterium
VNMWFSYYSAGLFAMNNG

SEQ ID NO: 937466 - protein, 27 aa, Mycobacterium
VNNAVGGFSFVVPAGWVESDASHLDYG

SEQ ID NO: 937467 - protein, 21 aa, Mycobacterium
VNNAVRFAFWGADEDGLNGVM

SEQ ID NO: 937468 - protein, 23 aa, Mycobacterium
VNNAVRFAFWGAGLTGAMDYVFG

SEQ ID NO: 937469 - protein, 20 aa, Mycobacterium
VNNAVRFVFWGAEAEGLNGV

SEQ ID NO: 937470 - protein, 24 aa, Mycobacterium
VNNLPAPTSVHWHGLALRNDMDGV

SEQ ID NO: 937471 - protein, 17 aa, Mycobacterium
VNNRYDPLVPWTQASQL

SEQ ID NO: 937472 - protein, 18 aa, Mycobacterium
VNPQISIMALALAVADEV

SEQ ID NO: 937473 - protein, 18 aa, Mycobacterium
VNPRYRRIGDLPCHASLD

SEQ ID NO: 937474 - protein, 25 aa, Mycobacterium
VNRNRIDLAAGIRHLLVLLAAGIDE

SEQ ID NO: 937475 - protein, 28 aa, Mycobacterium
VNRPTQALLGRPLIGNGSDAASGSGANG

SEQ ID NO: 937476 - protein, 26 aa, Mycobacterium
VNSANGYRTEVDWATQISYSGIYVHA

SEQ ID NO: 937477 - protein, 25 aa, Mycobacterium
VNSGTCFRPPLAVQQRWRDEFGLDL

SEQ ID NO: 937478 - protein, 24 aa, Mycobacterium
VNSTARGAFNLGYAPTVVAAATAT

SEQ ID NO: 937479 - protein, 21 aa, Mycobacterium
VPACASGTHGLVISFYTTAAD

SEQ ID NO: 937480 - protein, 25 aa, Mycobacterium
VPADSRLAGWDVVDYVELAKEPFVR

SEQ ID NO: 937481 - protein, 24 aa, Mycobacterium
VPADVKAAILSPSLVTPRSIQLTP

SEQ ID NO: 937482 - protein, 24 aa, Mycobacterium
VPAEGRVGLLRKVLDSAGSVNPIA

SEQ ID NO: 937483 - protein, 17 aa, Mycobacterium
VPAGFTRIAAFRGGVTG

SEQ ID NO: 937484 - protein, 18 aa, Mycobacterium
VPAKNCYEASSDNPSGLR

SEQ ID NO: 937485 - protein, 26 aa, Mycobacterium
VPANVKAVIVSPALVTSRAIQLTPAY

SEQ ID NO: 937486 - protein, 17 aa, Mycobacterium
VPARLPVASAAECPDAE

SEQ ID NO: 937487 - protein, 21 aa, Mycobacterium
VPARVNAVVMFQVVEPLKAIL

SEQ ID NO: 937488 - protein, 17 aa, Mycobacterium
VPASFKSRLLAAVDAIS

SEQ ID NO: 937489 - protein, 21 aa, Mycobacterium
VPATPLCRFVSAGASSDSVSV

SEQ ID NO: 937490 - protein, 26 aa, Mycobacterium
VPDDMCLRLRHAFVLEERGEVEVKGK

SEQ ID NO: 937491 - protein, 21 aa, Mycobacterium
VPDEILFRRAGAPTVLADSIR

SEQ ID NO: 937492 - protein, 21 aa, Mycobacterium
VPDLNRYEYWNSNTNSWVPRD

SEQ ID NO: 937493 - protein, 17 aa, Mycobacterium
VPDLVLLGVPDDALIDQ

SEQ ID NO: 937494 - protein, 19 aa, Mycobacterium
VPDPGRLSALVRGDSIASI

SEQ ID NO: 937495 - protein, 23 aa, Mycobacterium
VPDSRSALYWAARLTLVNRMEDL

SEQ ID NO: 937496 - protein, 18 aa, Mycobacterium
VPDTAAPTGSRWEMDPTL

SEQ ID NO: 937497 - protein, 24 aa, Mycobacterium
VPEGAPPRALWHLGAGATATPARC

SEQ ID NO: 937498 - protein, 20 aa, Mycobacterium
VPEIVRRATHGNVAKYTPKC

SEQ ID NO: 937499 - protein, 22 aa, Mycobacterium
VPENPSRVVTVGWTDQDFVLPF

SEQ ID NO: 937500 - protein, 28 aa, Mycobacterium
VPEPAPLCRRFGPDVGERVHKMLTDAGV

SEQ ID NO: 937501 - protein, 18 aa, Mycobacterium
VPEPVLALIGKDLPPVSG

SEQ ID NO: 937502 - protein, 17 aa, Mycobacterium
VPFPQVMPTQETTPARG

SEQ ID NO: 937503 - protein, 22 aa, Mycobacterium
VPFPVELLRFLDRVTPHESARN

SEQ ID NO: 937504 - protein, 20 aa, Mycobacterium
VPFTGVPGYNHIKIKEAYGL

SEQ ID NO: 937505 - protein, 17 aa, Mycobacterium
VPGALVLLQTPQGRFAA

SEQ ID NO: 937506 - protein, 19 aa, Mycobacterium
VPGANQWMMTAEVGVTNFV

SEQ ID NO: 937507 - protein, 17 aa, Mycobacterium
VPGAPWTPPAPSLAAVD

SEQ ID NO: 937508 - protein, 17 aa, Mycobacterium
VPGFPNMFLIYGPNTNL

SEQ ID NO: 937509 - protein, 18 aa, Mycobacterium
VPGIARAVRDAGLQDRTC

SEQ ID NO: 937510 - protein, 20 aa, Mycobacterium
VPGIRAALRATRAPIIGYSP

SEQ ID NO: 937511 - protein, 20 aa, Mycobacterium
VPGMAVAVVHQGKTVYAKGF

SEQ ID NO: 937512 - protein, 17 aa, Mycobacterium
VPGQSSGDLTSLQVRSD

SEQ ID NO: 937513 - protein, 22 aa, Mycobacterium
VPGRSAAWLVVDVRDLAALHTA

SEQ ID NO: 937514 - protein, 21 aa, Mycobacterium
VPGSATGVWALTRGARLVSLL

SEQ ID NO: 937515 - protein, 18 aa, Mycobacterium
VPHDWYWNSEGIVDVTTK

SEQ ID NO: 937516 - protein, 19 aa, Mycobacterium
VPIGAPVPGAAVFVLDSWL

SEQ ID NO: 937517 - protein, 25 aa, Mycobacterium
VPILKGDKGEPCWPDGVVGSLTHCQ

SEQ ID NO: 937518 - protein, 23 aa, Mycobacterium
VPKEAFAKIMAHFKEAGNNINGW

SEQ ID NO: 937519 - protein, 23 aa, Mycobacterium
VPKEIRDRFDFIGFDPRGVGSST

SEQ ID NO: 937520 - protein, 29 aa, Mycobacterium
VPKSEPPEGGWPVINWAHGTTGYADTCAP

SEQ ID NO: 937521 - protein, 21 aa, Mycobacterium
VPLHLADGALIDLVRAGDVVD

SEQ ID NO: 937522 - protein, 24 aa, Mycobacterium
VPLHLHPDIHLFSAIPEERSSTAE

SEQ ID NO: 937523 - protein, 17 aa, Mycobacterium
VPLHTAFARSCNTTMGR

SEQ ID NO: 937524 - protein, 25 aa, Mycobacterium
VPLRDGGYNVVTWDPRGEFASGGVL

SEQ ID NO: 937525 - protein, 19 aa, Mycobacterium
VPLTDWRLDFDMPAGQSVL

SEQ ID NO: 937526 - protein, 19 aa, Mycobacterium
VPMLLRAGLGVAMGNAHPD

SEQ ID NO: 937527 - protein, 24 aa, Mycobacterium
VPMMHKARVLRYVAASNFQAVELP

SEQ ID NO: 937528 - protein, 25 aa, Mycobacterium
VPNAYALLMALKLGGISPETGDAYE

SEQ ID NO: 937529 - protein, 21 aa, Mycobacterium
VPNPYIMATIFSFNGVTPNAD

SEQ ID NO: 937530 - protein, 26 aa, Mycobacterium
VPNRWRVRPGPVAARHWVVEPDLTNA

SEQ ID NO: 937531 - protein, 18 aa, Mycobacterium
VPNVMPATVVLRADGSVA

SEQ ID NO: 937532 - protein, 20 aa, Mycobacterium
VPPDAPRVAPPHGNAAPDAQ

SEQ ID NO: 937533 - protein, 23 aa, Mycobacterium
VPPGHKWARRGRVVTARELAETP

SEQ ID NO: 937534 - protein, 20 aa, Mycobacterium
VPPGHTWARRSRPIAPEELA

SEQ ID NO: 937535 - protein, 17 aa, Mycobacterium
VPPHTRLAVTIPTEDPE

SEQ ID NO: 937536 - protein, 19 aa, Mycobacterium
VPPTAPFVGGMTRVDVEPT

SEQ ID NO: 937537 - protein, 24 aa, Mycobacterium
VPPTDRFPLLALLRRTLTEEQVQE

SEQ ID NO: 937538 - protein, 19 aa, Mycobacterium
VPQTQEWPGGGAHHAQPEQ

SEQ ID NO: 937539 - protein, 23 aa, Mycobacterium
VPRAVDMAVRLGLRSYAEPGSAR

SEQ ID NO: 937540 - protein, 24 aa, Mycobacterium
VPRAVDMAVRLGLRSYAQPGSASA

SEQ ID NO: 937541 - protein, 18 aa, Mycobacterium
VPRDWPLTATSVAVLGAG

SEQ ID NO: 937542 - protein, 20 aa, Mycobacterium
VPRSALCEVITRGSANSKAL

SEQ ID NO: 937543 - protein, 18 aa, Mycobacterium
VPSAAMGRDIRVEFQSGG

SEQ ID NO: 937544 - protein, 18 aa, Mycobacterium
VPSAAMGRNIKVQFQSGG

SEQ ID NO: 937545 - protein, 20 aa, Mycobacterium
VPSAGGRLFTEFITPGNFDI

SEQ ID NO: 937546 - protein, 21 aa, Mycobacterium
VPSETRTVVTIGGLGSTPEEA

SEQ ID NO: 937547 - protein, 18 aa, Mycobacterium
VPSGFSRIDAFRVGVLGD

SEQ ID NO: 937548 - protein, 21 aa, Mycobacterium
VPSGLSVTGFVERVGDPVPLV

SEQ ID NO: 937549 - protein, 26 aa, Mycobacterium
VPTQAQDITFVWGGDVVGQGWGINKQ

SEQ ID NO: 937550 - protein, 22 aa, Mycobacterium
VPTQESMCSWFTYSTPDANKDH

SEQ ID NO: 937551 - protein, 22 aa, Mycobacterium
VPTSFNLIDRWWQAPASGLAAI

SEQ ID NO: 937552 - protein, 20 aa, Mycobacterium
VPTVEEFRIGVVVTAQNCDP

SEQ ID NO: 937553 - protein, 18 aa, Mycobacterium
VPVAVHLHGGHTPPDSDG

SEQ ID NO: 937554 - protein, 20 aa, Mycobacterium
VPVCNNWADIGLPDVYDDPD

SEQ ID NO: 937555 - protein, 21 aa, Mycobacterium
VPVDPPPGFGYTRSGVPVKSF

SEQ ID NO: 937556 - protein, 26 aa, Mycobacterium
VPVGTWLQPRGNIFHRWLDDTYLLPP

SEQ ID NO: 937557 - protein, 24 aa, Mycobacterium
VPVGYSVPVGTTITVYTTDGVQLY

SEQ ID NO: 937558 - protein, 24 aa, Mycobacterium
VPVKRCMLMGPALPPADPNFADPP

SEQ ID NO: 937559 - protein, 32 aa, Mycobacterium
VPVRTEAWLGYFMLRIAPAVNRRMTQPFSVEA

SEQ ID NO: 937560 - protein, 33 aa, Mycobacterium
VPVRTEAWLGYFMLRIAPGVNRRMMQPFSVDAF

SEQ ID NO: 937561 - protein, 21 aa, Mycobacterium
VPVWISGPQFEAWKHTQLVID

SEQ ID NO: 937562 - protein, 17 aa, Mycobacterium
VPYRDRPAAIQFGNVIC

SEQ ID NO: 937563 - protein, 25 aa, Mycobacterium
VPYVPDIRGAHRFRGRRFHSARWDH

SEQ ID NO: 937564 - protein, 17 aa, Mycobacterium
VQAPLPAFLGQAQEQGL

SEQ ID NO: 937565 - protein, 17 aa, Mycobacterium
VQCLPYGVNPVVGPAGP

SEQ ID NO: 937566 - protein, 19 aa, Mycobacterium
VQEEGAGAWACQRALTTTN

SEQ ID NO: 937567 - protein, 18 aa, Mycobacterium
VQFICGGTFDTGANPENY

SEQ ID NO: 937568 - protein, 21 aa, Mycobacterium
VQGAPVFPGIEMRMSEEGAAA

SEQ ID NO: 937569 - protein, 22 aa, Mycobacterium
VQGHTLERFFPGIGPIGEKILP

SEQ ID NO: 937570 - protein, 21 aa, Mycobacterium
VQGHVLERLFPGIGKLDEQFP

SEQ ID NO: 937571 - protein, 17 aa, Mycobacterium
VQIIRWLRPGALIAVAK

SEQ ID NO: 937572 - protein, 17 aa, Mycobacterium
VQIPRLVANNTRIWVYC

SEQ ID NO: 937573 - protein, 18 aa, Mycobacterium
VQKAMAFAAAHNLKVAAR

SEQ ID NO: 937574 - protein, 17 aa, Mycobacterium
VQKAMAFATAHNLKVAP

SEQ ID NO: 937575 - protein, 24 aa, Mycobacterium
VQKDFGVPAGHVFATGMSNGGFMS

SEQ ID NO: 937576 - protein, 26 aa, Mycobacterium
VQLAMDPICAKYRIPCIAGSAESPNV

SEQ ID NO: 937577 - protein, 17 aa, Mycobacterium
VQLANSLYIGRSVGGAV

SEQ ID NO: 937578 - protein, 26 aa, Mycobacterium
VQLVRPMLDRWVARGFAVVQTDYQGL

SEQ ID NO: 937579 - protein, 27 aa, Mycobacterium
VQLVSNEEELLWLTLDAGSDRAKTDSS

SEQ ID NO: 937580 - protein, 18 aa, Mycobacterium
VQMHLLFLGFSIAVRKRA

SEQ ID NO: 937581 - protein, 25 aa, Mycobacterium
VQNNRWGTSAAQCINVTATGFAITK

SEQ ID NO: 937582 - protein, 22 aa, Mycobacterium
VQPNLKVIVNLGYGDPAYGYST

SEQ ID NO: 937583 - protein, 18 aa, Mycobacterium
VQPTLPILLANLVSLGQV

SEQ ID NO: 937584 - protein, 26 aa, Mycobacterium
VQQAARDRIHWFFSMDYAGRRQYSEN

SEQ ID NO: 937585 - protein, 20 aa, Mycobacterium
VQRFVPRGPRGELLSGTLLV

SEQ ID NO: 937586 - protein, 24 aa, Mycobacterium
VQRRWRHEFGLDLADPDRLACHLD

SEQ ID NO: 937587 - protein, 18 aa, Mycobacterium
VQSTWRGGVGHTWEARIK

SEQ ID NO: 937588 - protein, 24 aa, Mycobacterium
VQSVPWEAGDMLLLGSGAAAQSAQ

SEQ ID NO: 937589 - protein, 17 aa, Mycobacterium
VQWNFEKFLIARDGSVV

SEQ ID NO: 937590 - protein, 19 aa, Mycobacterium
VQYTCKGANIAPPLSWSAP

SEQ ID NO: 937591 - protein, 17 aa, Mycobacterium
VRAAFKPEFINRLDDVI

SEQ ID NO: 937592 - protein, 18 aa, Mycobacterium
VRAARLLVPHWQSVGSGY

SEQ ID NO: 937593 - protein, 17 aa, Mycobacterium
VRAEAGAVWDDVVVSSI

SEQ ID NO: 937594 - protein, 19 aa, Mycobacterium
VRAGLGVSILPSAGLPDLP

SEQ ID NO: 937595 - protein, 22 aa, Mycobacterium
VRAGSALGALALGASLPACSGK

SEQ ID NO: 937596 - protein, 24 aa, Mycobacterium
VRAKRPDGSWGPWYQAEYETAAPD

SEQ ID NO: 937597 - protein, 19 aa, Mycobacterium
VRANCLVEVDVAYYSEPES

SEQ ID NO: 937598 - protein, 23 aa, Mycobacterium
VRAVSACAALMVVSCGSGDQTRV

SEQ ID NO: 937599 - protein, 23 aa, Mycobacterium
VRAYGDFFSYCLLAEGAIDIAAE

SEQ ID NO: 937600 - protein, 18 aa, Mycobacterium
VRDAAPFMAYGEFTGLAP

SEQ ID NO: 937601 - protein, 26 aa, Mycobacterium
VRDAVLALRARKGMVLDAADHDTWSV

SEQ ID NO: 937602 - protein, 26 aa, Mycobacterium
VRFGELRYRLLLQIGVPGQDPTNDPT

SEQ ID NO: 937603 - protein, 22 aa, Mycobacterium
VRFVPGNENFQMGAFVKANDGY

SEQ ID NO: 937604 - protein, 24 aa, Mycobacterium
VRGGQVGCRMLVNGVVRDEQSDDH

SEQ ID NO: 937605 - protein, 26 aa, Mycobacterium
VRGPDVFPDLGYRIIDVSQEYDMASD

SEQ ID NO: 937606 - protein, 18 aa, Mycobacterium
VRGSFDRLVMGSRPGTGA

SEQ ID NO: 937607 - protein, 21 aa, Mycobacterium
VRGSRNIPCVDVPGKRAATPR

SEQ ID NO: 937608 - protein, 18 aa, Mycobacterium
VRGTRVFFLAEWATLNDP

SEQ ID NO: 937609 - protein, 21 aa, Mycobacterium
VRIDGVLWRMRVLEMPPPEYT

SEQ ID NO: 937610 - protein, 19 aa, Mycobacterium
VRIGGGGAYQAQFTHHMYL

SEQ ID NO: 937611 - protein, 17 aa, Mycobacterium
VRISQAFQSLLYLPLYV

SEQ ID NO: 937612 - protein, 19 aa, Mycobacterium
VRKAIDFVIDLQVGYGEIC

SEQ ID NO: 937613 - protein, 25 aa, Mycobacterium
VRLAERLATPWGKRGGRTVAISPGL

SEQ ID NO: 937614 - protein, 19 aa, Mycobacterium
VRLEKRLATTLPDGALADV

SEQ ID NO: 937615 - protein, 19 aa, Mycobacterium
VRLLGNWITTVAFPARAGS

SEQ ID NO: 937616 - protein, 26 aa, Mycobacterium
VRLPPSVHGRGDYGFVPRLISIARER

SEQ ID NO: 937617 - protein, 18 aa, Mycobacterium
VRLYERQSYLGGRVGGWQ

SEQ ID NO: 937618 - protein, 22 aa, Mycobacterium
VRMPLTLNIPAGIPLEPGIYEW

SEQ ID NO: 937619 - protein, 18 aa, Mycobacterium
VRNNCLVEVSITYYRDTA

SEQ ID NO: 937620 - protein, 24 aa, Mycobacterium
VRNRGAITSSWYLTSIQAGFEPWN

SEQ ID NO: 937621 - protein, 18 aa, Mycobacterium
VRPGDLFAALPGSSTHGA

SEQ ID NO: 937622 - protein, 21 aa, Mycobacterium
VRPIADLQIEYSLMSRGIEND

SEQ ID NO: 937623 - protein, 25 aa, Mycobacterium
VRPTMAGAVPTIWTDVLHYLRDNPG

SEQ ID NO: 937624 - protein, 18 aa, Mycobacterium
VRQAAAFQQEFTRTLAVA

SEQ ID NO: 937625 - protein, 30 aa, Mycobacterium
VRQGMYGDFFAFYLCDVVLKVNGKGGQPVY

SEQ ID NO: 937626 - protein, 19 aa, Mycobacterium
VRQICRRLDGMPLALELAA

SEQ ID NO: 937627 - protein, 17 aa, Mycobacterium
VRQRHGLDNGDLDRTHR

SEQ ID NO: 937628 - protein, 23 aa, Mycobacterium
VRQRPRFTEALDALRRFSDTAGT

SEQ ID NO: 937629 - protein, 24 aa, Mycobacterium
VRRCLYGMCAGGVLSAGFTIPMAN

SEQ ID NO: 937630 - protein, 20 aa, Mycobacterium
VRRIGPPGAVAVPEGVDLRR

SEQ ID NO: 937631 - protein, 22 aa, Mycobacterium
VRRLERELGCRLVTAQGRGIGL

SEQ ID NO: 937632 - protein, 21 aa, Mycobacterium
VRRRPYTVVLFDEVEKAHPDV

SEQ ID NO: 937633 - protein, 17 aa, Mycobacterium
VRRVLAWMGSRQGNEYL

SEQ ID NO: 937634 - protein, 29 aa, Mycobacterium
VRSAASLNWDPWVAILGFPFIPQARDHRY

SEQ ID NO: 937635 - protein, 26 aa, Mycobacterium
VRSGARLAVCAPELACGAATARVAES

SEQ ID NO: 937636 - protein, 24 aa, Mycobacterium
VRSGELRALGVLSEERLPGLDVPT

SEQ ID NO: 937637 - protein, 21 aa, Mycobacterium
VRSSGMTPYLVRILGTQTAPG

SEQ ID NO: 937638 - protein, 19 aa, Mycobacterium
VRTAISYVGIDGARANLAA

SEQ ID NO: 937639 - protein, 19 aa, Mycobacterium
VRTAISYVGIEGARANLAA

SEQ ID NO: 937640 - protein, 18 aa, Mycobacterium
VRTAKIFVYDSGEDTAFT

SEQ ID NO: 937641 - protein, 18 aa, Mycobacterium
VRTETAPTPAARVVPVGA

SEQ ID NO: 937642 - protein, 17 aa, Mycobacterium
VRTLEIFGADGTHESLR

SEQ ID NO: 937643 - protein, 18 aa, Mycobacterium
VRTRAMVDHILFDSQHIK

SEQ ID NO: 937644 - protein, 20 aa, Mycobacterium
VRVATRLAALNAERIELAPE

SEQ ID NO: 937645 - protein, 17 aa, Mycobacterium
VRVGDTWHPVLNLASAR

SEQ ID NO: 937646 - protein, 20 aa, Mycobacterium
VRVGVPFPVAALEVMRYACG

SEQ ID NO: 937647 - protein, 18 aa, Mycobacterium
VRVKFHYSQSLVGADESL

SEQ ID NO: 937648 - protein, 18 aa, Mycobacterium
VRVLPPFLSRKHLPSRLA

SEQ ID NO: 937649 - protein, 23 aa, Mycobacterium
VRVPDGRIQLIASDEVAAEVARA

SEQ ID NO: 937650 - protein, 20 aa, Mycobacterium
VRVRQAISMAIDREAITQVI

SEQ ID NO: 937651 - protein, 25 aa, Mycobacterium
VRVYVPFGTQWYGYFMRRLAERPAN

SEQ ID NO: 937652 - protein, 21 aa, Mycobacterium
VRWSWLVAIVAVLGLGLATPP

SEQ ID NO: 937653 - protein, 17 aa, Mycobacterium
VSAAALTGGLAFAGSAP

SEQ ID NO: 937654 - protein, 24 aa, Mycobacterium
VSAAKPVLFRSWAALAEAFMARQI

SEQ ID NO: 937655 - protein, 18 aa, Mycobacterium
VSAALRWYERTRRRKVMA

SEQ ID NO: 937656 - protein, 19 aa, Mycobacterium
VSACQRPVAAWGDDEKHHM

SEQ ID NO: 937657 - protein, 19 aa, Mycobacterium
VSADSFAYRVNDNKGATSN

SEQ ID NO: 937658 - protein, 20 aa, Mycobacterium
VSAENWFPSVHVMATDIDGG

SEQ ID NO: 937659 - protein, 22 aa, Mycobacterium
VSAEPKVKMVIPVDPSGDGGLM

SEQ ID NO: 937660 - protein, 19 aa, Mycobacterium
VSAEPKVKVVIPVDPAGDG

SEQ ID NO: 937661 - protein, 27 aa, Mycobacterium
VSAGIASLFGAHAYNYQVLSAKAAEFH

SEQ ID NO: 937662 - protein, 20 aa, Mycobacterium
VSAILRRRLSEPGLLDQRIQ

SEQ ID NO: 937663 - protein, 19 aa, Mycobacterium
VSALNRPVSTTGEAGNQNT

SEQ ID NO: 937664 - protein, 19 aa, Mycobacterium
VSALNRPVSTTGESGNQNT

SEQ ID NO: 937665 - protein, 20 aa, Mycobacterium
VSALSRQGASLAVASAYVLS

SEQ ID NO: 937666 - protein, 17 aa, Mycobacterium
VSAPRAWAGDAPIGHIG

SEQ ID NO: 937667 - protein, 19 aa, Mycobacterium
VSAPTRLRLPDLLNTTDRA

SEQ ID NO: 937668 - protein, 27 aa, Mycobacterium
VSAQAAAFHDRFVQALTASAESYAGAE

SEQ ID NO: 937669 - protein, 18 aa, Mycobacterium
VSARAVLASGVFSADLAD

SEQ ID NO: 937670 - protein, 25 aa, Mycobacterium
VSASRWRVVDRTLPAGVAPERGLQV

SEQ ID NO: 937671 - protein, 22 aa, Mycobacterium
VSCSIGATLGNGGWSTLLNSAK

SEQ ID NO: 937672 - protein, 18 aa, Mycobacterium
VSCVLPSAVRTELASGAP

SEQ ID NO: 937673 - protein, 22 aa, Mycobacterium
VSDARTDPVLKYNPAVTDGTVV

SEQ ID NO: 937674 - protein, 20 aa, Mycobacterium
VSDDAPVSGRAGRTRAAVPT

SEQ ID NO: 937675 - protein, 18 aa, Mycobacterium
VSDGDLWATITAGGSLSN

SEQ ID NO: 937676 - protein, 17 aa, Mycobacterium
VSDIPFLAPGGGGGGDR

SEQ ID NO: 937677 - protein, 22 aa, Mycobacterium
VSDRKVNCEAPRQTATGDDLDF

SEQ ID NO: 937678 - protein, 25 aa, Mycobacterium
VSDRRPGGKWMLGKPIQVAEARDLH

SEQ ID NO: 937679 - protein, 24 aa, Mycobacterium
VSELRDRLGPVSAVVTSAGYYEMA

SEQ ID NO: 937680 - protein, 17 aa, Mycobacterium
VSEVSPLVLDVMTYASD

SEQ ID NO: 937681 - protein, 17 aa, Mycobacterium
VSFKSEPRPTCNFAYWG

SEQ ID NO: 937682 - protein, 24 aa, Mycobacterium
VSGALLRRRFRLGTEAMKPLRTAV

SEQ ID NO: 937683 - protein, 23 aa, Mycobacterium
VSGARAALLAALFDGHNPTPPVA

SEQ ID NO: 937684 - protein, 24 aa, Mycobacterium
VSGCGWRGLNSLPLPGTEGNGPGS

SEQ ID NO: 937685 - protein, 23 aa, Mycobacterium
VSGQLTLLLPFVDKIRARVDLRE

SEQ ID NO: 937686 - protein, 21 aa, Mycobacterium
VSGSDALLLLTQRPMSSGPQQ

SEQ ID NO: 937687 - protein, 25 aa, Mycobacterium
VSGYPGDGSNAWSAVHRVDAARVFR

SEQ ID NO: 937688 - protein, 21 aa, Mycobacterium
VSHAIALGADQVWVLPTGYSC

SEQ ID NO: 937689 - protein, 23 aa, Mycobacterium
VSHAVALGADRVWVLPTGYSCAL

SEQ ID NO: 937690 - protein, 26 aa, Mycobacterium
VSIATLCIAGAYIAHLRLSDIPDPAI

SEQ ID NO: 937691 - protein, 23 aa, Mycobacterium
VSIGAILAVPGIRAALRATRAPI

SEQ ID NO: 937692 - protein, 17 aa, Mycobacterium
VSIPADLIASVRSQSAV

SEQ ID NO: 937693 - protein, 23 aa, Mycobacterium
VSIPELFGAQVARTPRSVALTGV

SEQ ID NO: 937694 - protein, 17 aa, Mycobacterium
VSIPTPPGWSPYEGPKI

SEQ ID NO: 937695 - protein, 24 aa, Mycobacterium
VSKHAAVGFAEWLAVTYGDDGIGV

SEQ ID NO: 937696 - protein, 22 aa, Mycobacterium
VSLGKRKGKIVVEFGSVDDLQR

SEQ ID NO: 937697 - protein, 17 aa, Mycobacterium
VSLQCAVAGGIALENLN

SEQ ID NO: 937698 - protein, 28 aa, Mycobacterium
VSLRDWLARNGLKTNIQGGGDVSVKPTN

SEQ ID NO: 937699 - protein, 37 aa, Mycobacterium
VSLSLPKFRISWGPEEFKETLAAMGMPRAFDENRADF

SEQ ID NO: 937700 - protein, 18 aa, Mycobacterium
VSMFCPAMVSRLSQGVPP

SEQ ID NO: 937701 - protein, 22 aa, Mycobacterium
VSMPTPKGWEPYRNSNLSPGTR

SEQ ID NO: 937702 - protein, 17 aa, Mycobacterium
VSNGAIWDAIAGCEAGG

SEQ ID NO: 937703 - protein, 17 aa, Mycobacterium
VSNLRWSGDYVLVNVDA

SEQ ID NO: 937704 - protein, 33 aa, Mycobacterium
VSNRAKLNWWESRALYGWTVLVPRTKDQAGEMS

SEQ ID NO: 937705 - protein, 18 aa, Mycobacterium
VSPCDPPPGFGYTREGTY

SEQ ID NO: 937706 - protein, 19 aa, Mycobacterium
VSPDMPSAPPLGGANLGIG

SEQ ID NO: 937707 - protein, 21 aa, Mycobacterium
VSPDTSWLALNRMIPPMVKST

SEQ ID NO: 937708 - protein, 18 aa, Mycobacterium
VSPERKDVLYGLPDDTVT

SEQ ID NO: 937709 - protein, 23 aa, Mycobacterium
VSPTATVSVCYQGVNGRDGSIFD

SEQ ID NO: 937710 - protein, 17 aa, Mycobacterium
VSQVRFNDMAPYLVRVI

SEQ ID NO: 937711 - protein, 17 aa, Mycobacterium
VSQWPFGATPYILATKL

SEQ ID NO: 937712 - protein, 17 aa, Mycobacterium
VSSLKMVACGGSAVPRS

SEQ ID NO: 937713 - protein, 23 aa, Mycobacterium
VSSWRYWLLAGLGMTVISVAPAV

SEQ ID NO: 937714 - protein, 24 aa, Mycobacterium
VSTSRPVLFRSWAALAEAFISRQI

SEQ ID NO: 937715 - protein, 22 aa, Mycobacterium
VSVGAVAMWKVHDSSSPPPVFT

SEQ ID NO: 937716 - protein, 20 aa, Mycobacterium
VSVLVAAQFATHAQMYQTVC

SEQ ID NO: 937717 - protein, 20 aa, Mycobacterium
VSVQVSDGWFQHVTLSNSSG

SEQ ID NO: 937718 - protein, 26 aa, Mycobacterium
VSVTPAPGWTLGNRGPNWVALNNADT

SEQ ID NO: 937719 - protein, 18 aa, Mycobacterium
VSWPDIRGLDSYTGHKIH

SEQ ID NO: 937720 - protein, 17 aa, Mycobacterium
VSWPDTMMRAIYAAAEA

SEQ ID NO: 937721 - protein, 19 aa, Mycobacterium
VSYGPLLDVFLLDMRSYKD

SEQ ID NO: 937722 - protein, 18 aa, Mycobacterium
VSYPGSSLLDLLLPRMSS

SEQ ID NO: 937723 - protein, 23 aa, Mycobacterium
VTAAQRAGFGWIADLNDVGPDIA

SEQ ID NO: 937724 - protein, 17 aa, Mycobacterium
VTACGGGLLSPDVVLVN

SEQ ID NO: 937725 - protein, 17 aa, Mycobacterium
VTACVEAGLPVGCLPGP

SEQ ID NO: 937726 - protein, 20 aa, Mycobacterium
VTADDVAKCVDAFNECIHGG

SEQ ID NO: 937727 - protein, 25 aa, Mycobacterium
VTADLYPRYACDYGTPRHPPSAADY

SEQ ID NO: 937728 - protein, 26 aa, Mycobacterium
VTADLYPRYACDYGTPRVPPSSADFP

SEQ ID NO: 937729 - protein, 21 aa, Mycobacterium
VTADSFAYRIDDALGATSNEA

SEQ ID NO: 937730 - protein, 20 aa, Mycobacterium
VTAEDVAKCVEAFNACIHGG

SEQ ID NO: 937731 - protein, 24 aa, Mycobacterium
VTAGCGRPAAPVAVSAGAHGYPVT

SEQ ID NO: 937732 - protein, 17 aa, Mycobacterium
VTAGVTWFGSPQTRVYT

SEQ ID NO: 937733 - protein, 20 aa, Mycobacterium
VTAIAIRSAVTTGPAGPTGD

SEQ ID NO: 937734 - protein, 23 aa, Mycobacterium
VTALRDSCQWFNAQYDTLMSSVY

SEQ ID NO: 937735 - protein, 17 aa, Mycobacterium
VTARAIQLTPVYTGGPV

SEQ ID NO: 937736 - protein, 24 aa, Mycobacterium
VTARLRGAGIPILGKTNMDEFAMG

SEQ ID NO: 937737 - protein, 18 aa, Mycobacterium
VTARRSRGAVAAGATLTS

SEQ ID NO: 937738 - protein, 28 aa, Mycobacterium
VTASGGLRVNPEFHCEIAVDGQVVVSQN

SEQ ID NO: 937739 - protein, 21 aa, Mycobacterium
VTATVMTLFGFEPAEDTDGVS

SEQ ID NO: 937740 - protein, 26 aa, Mycobacterium
VTAVGLAGCGIIKPGSSNPTPGTWTP

SEQ ID NO: 937741 - protein, 19 aa, Mycobacterium
VTCVLDRGSGSYGCSGPLP

SEQ ID NO: 937742 - protein, 25 aa, Mycobacterium
VTDARRREVYWARYRDGVRTHGPAV

SEQ ID NO: 937743 - protein, 29 aa, Mycobacterium
VTDIPRMIFALARGEGRLAAAGIAETVPP

SEQ ID NO: 937744 - protein, 17 aa, Mycobacterium
VTDLKPSSDTIPYEVRG

SEQ ID NO: 937745 - protein, 29 aa, Mycobacterium
VTDLPGELMSALSQGLSQFGINLPPMPSL

SEQ ID NO: 937746 - protein, 23 aa, Mycobacterium
VTDRGGTVIGRLAAFRDNTPSGT

SEQ ID NO: 937747 - protein, 20 aa, Mycobacterium
VTEMSVGAGVRWTAGAVVRN

SEQ ID NO: 937748 - protein, 37 aa, Mycobacterium
VTERDGRLQLALGPRGVFELDAWDGNVFVFPVSSENA

SEQ ID NO: 937749 - protein, 20 aa, Mycobacterium
VTESAPWAEAVVVTGNSITF

SEQ ID NO: 937750 - protein, 24 aa, Mycobacterium
VTFADGRTAPFTVVGTDPTSDIAV

SEQ ID NO: 937751 - protein, 30 aa, Mycobacterium
VTFEARRSLDWKVKGARDIAGKTIGVGSGT

SEQ ID NO: 937752 - protein, 24 aa, Mycobacterium
VTFSDGRTAPFTVVGTDPTSDIAV

SEQ ID NO: 937753 - protein, 35 aa, Mycobacterium
VTGALRPVLRLLSAARPAFYPGRVETAGEALADLS

SEQ ID NO: 937754 - protein, 18 aa, Mycobacterium
VTGAVNLAAKFPAALPPE

SEQ ID NO: 937755 - protein, 27 aa, Mycobacterium
VTGELYKAWGALGFERGALGLPTSAEI

SEQ ID NO: 937756 - protein, 34 aa, Mycobacterium
VTGHGRIAICGARAATPFPNRRVAAADVAVELRG

SEQ ID NO: 937757 - protein, 19 aa, Mycobacterium
VTGPVARLALLGSGAQGAD

SEQ ID NO: 937758 - protein, 17 aa, Mycobacterium
VTHVYPQLVDIIRDRNL

SEQ ID NO: 937759 - protein, 18 aa, Mycobacterium
VTHVYPQLVEIIRARNLR

SEQ ID NO: 937760 - protein, 25 aa, Mycobacterium
VTIKRSGPAPAVYCRARITDGTHAW

SEQ ID NO: 937761 - protein, 17 aa, Mycobacterium
VTIMRWLRPGAVIAIAE

SEQ ID NO: 937762 - protein, 28 aa, Mycobacterium
VTISADRHRGWIWIYPIQPHVYVPHVST

SEQ ID NO: 937763 - protein, 17 aa, Mycobacterium
VTISYRINGGPEQTETN

SEQ ID NO: 937764 - protein, 25 aa, Mycobacterium
VTKMARATVFPALAVAATGFGMLAG

SEQ ID NO: 937765 - protein, 28 aa, Mycobacterium
VTKNGVRTPVRWRVVPDGNPTGTAAKDG

SEQ ID NO: 937766 - protein, 19 aa, Mycobacterium
VTLDRIWWDRPFTLTDVDV

SEQ ID NO: 937767 - protein, 24 aa, Mycobacterium
VTLDYRTYSALGWTIEATESGTRF

SEQ ID NO: 937768 - protein, 24 aa, Mycobacterium
VTLMADEWGKLHSPGCRAELDQAK

SEQ ID NO: 937769 - protein, 23 aa, Mycobacterium
VTLRCYKAEVAAAKKAAEEKAKS

SEQ ID NO: 937770 - protein, 19 aa, Mycobacterium
VTMIARLITEYYVVVTDAQ

SEQ ID NO: 937771 - protein, 18 aa, Mycobacterium
VTMTPYLVESLKGPDLAN

SEQ ID NO: 937772 - protein, 18 aa, Mycobacterium
VTNAVRFAFWGDGINGAM

SEQ ID NO: 937773 - protein, 17 aa, Mycobacterium
VTNGCINLSLGDAESYF

SEQ ID NO: 937774 - protein, 17 aa, Mycobacterium
VTPLPDRLVFVGHSAGA

SEQ ID NO: 937775 - protein, 20 aa, Mycobacterium
VTPRLPLRRATMQRIMVRST

SEQ ID NO: 937776 - protein, 19 aa, Mycobacterium
VTPVGLPVHTIGKAPVKLL

SEQ ID NO: 937777 - protein, 20 aa, Mycobacterium
VTRGAVWFSSSTDLTGRGRA

SEQ ID NO: 937778 - protein, 19 aa, Mycobacterium
VTRLRITDDVRLPRGSTAE

SEQ ID NO: 937779 - protein, 18 aa, Mycobacterium
VTSCRSVLALAASYDVEM

SEQ ID NO: 937780 - protein, 25 aa, Mycobacterium
VTSGGRMLLMLDCTQEAADQIKAMG

SEQ ID NO: 937781 - protein, 18 aa, Mycobacterium
VTSLYLVGSDYVFPQTAN

SEQ ID NO: 937782 - protein, 25 aa, Mycobacterium
VTSMGGLMAVPGMSAYCASKFAVEG

SEQ ID NO: 937783 - protein, 20 aa, Mycobacterium
VTTGGKVQWVLGNLGAIPTV

SEQ ID NO: 937784 - protein, 17 aa, Mycobacterium
VTTLRIMEGVRLPEGST

SEQ ID NO: 937785 - protein, 18 aa, Mycobacterium
VTTMKSRVIDIVEENGFE

SEQ ID NO: 937786 - protein, 18 aa, Mycobacterium
VTTMKSRVIDIVQENGFA

SEQ ID NO: 937787 - protein, 18 aa, Mycobacterium
VTTMKSRVIDIVQENGYS

SEQ ID NO: 937788 - protein, 17 aa, Mycobacterium
VTTSMTFATFPTADSDV

SEQ ID NO: 937789 - protein, 28 aa, Mycobacterium
VTVDCGSGLKAVEVGTTFDCTAADPQGE

SEQ ID NO: 937790 - protein, 20 aa, Mycobacterium
VTVDHPFLFAIVDKTGAVVF

SEQ ID NO: 937791 - protein, 20 aa, Mycobacterium
VTVGPRIGADVALSATTTLR

SEQ ID NO: 937792 - protein, 17 aa, Mycobacterium
VTVKQGSSFTCQVSVDG

SEQ ID NO: 937793 - protein, 18 aa, Mycobacterium
VTVKTAWNGAGGVKGFFE

SEQ ID NO: 937794 - protein, 18 aa, Mycobacterium
VTVPDAFTPLTVAPISRP

SEQ ID NO: 937795 - protein, 18 aa, Mycobacterium
VTVPGAGHLLNWEAVDEL

SEQ ID NO: 937796 - protein, 25 aa, Mycobacterium
VTVRSVGSPGLFSATVRGRLRASDP

SEQ ID NO: 937797 - protein, 18 aa, Mycobacterium
VTYHPTCHSLRMLGVGDK

SEQ ID NO: 937798 - protein, 19 aa, Mycobacterium
VTYIPPRVAISPEQASAIC

SEQ ID NO: 937799 - protein, 17 aa, Mycobacterium
VTYTIRPEAQWTDNAPI

SEQ ID NO: 937800 - protein, 23 aa, Mycobacterium
VVAAFVLVCSAFLAAPTAHAAAI

SEQ ID NO: 937801 - protein, 24 aa, Mycobacterium
VVAAHQRAGVTIVDPATTWIDVDV

SEQ ID NO: 937802 - protein, 19 aa, Mycobacterium
VVAALVFGLVRYRSRRISL

SEQ ID NO: 937803 - protein, 24 aa, Mycobacterium
VVAASLVLVVGCTRIVDGSMQPAA

SEQ ID NO: 937804 - protein, 25 aa, Mycobacterium
VVAEYSPEVIFHLAAQIDVRHSVAD

SEQ ID NO: 937805 - protein, 20 aa, Mycobacterium
VVAFSIPRDDWVPFTGVPGY

SEQ ID NO: 937806 - protein, 25 aa, Mycobacterium
VVALALLGGWAYRTANRLDRLHVRY

SEQ ID NO: 937807 - protein, 17 aa, Mycobacterium
VVANDLPLALVVPDGTT

SEQ ID NO: 937808 - protein, 22 aa, Mycobacterium
VVARLRSRDVAVVEISREQGVD

SEQ ID NO: 937809 - protein, 17 aa, Mycobacterium
VVARPDQFVGVTLAGGS

SEQ ID NO: 937810 - protein, 24 aa, Mycobacterium
VVAVDGPDIRCEVVDGGPVSDHKG

SEQ ID NO: 937811 - protein, 25 aa, Mycobacterium
VVAVSVPVMLGRFGARPARAAARAG

SEQ ID NO: 937812 - protein, 21 aa, Mycobacterium
VVCGLRPALVEGLRIDADRPA

SEQ ID NO: 937813 - protein, 25 aa, Mycobacterium
VVCPGRIQSPGPWRRNATPDQVSGT

SEQ ID NO: 937814 - protein, 23 aa, Mycobacterium
VVDDLRSAPGLVYGYTAELDTAA

SEQ ID NO: 937815 - protein, 23 aa, Mycobacterium
VVDGEALPPFGLYPLDVLNVDTL

SEQ ID NO: 937816 - protein, 18 aa, Mycobacterium
VVDLPGLDWSTVKAEAEQ

SEQ ID NO: 937817 - protein, 18 aa, Mycobacterium
VVDRLKDIIVTGGENVSS

SEQ ID NO: 937818 - protein, 21 aa, Mycobacterium
VVDRWAPDRVMVNAYGPTESA

SEQ ID NO: 937819 - protein, 23 aa, Mycobacterium
VVDSRGVENFTVMVSQTSVLMAL

SEQ ID NO: 937820 - protein, 26 aa, Mycobacterium
VVEAARLPLLGALGAEVAEVFAQLHR

SEQ ID NO: 937821 - protein, 26 aa, Mycobacterium
VVEEGIQCPFHGWVWNGAGRNVHIPY

SEQ ID NO: 937822 - protein, 24 aa, Mycobacterium
VVEGLRPMMRLVVTNGSAKDLAGS

SEQ ID NO: 937823 - protein, 18 aa, Mycobacterium
VVFGAPMPQDPATAANLP

SEQ ID NO: 937824 - protein, 17 aa, Mycobacterium
VVFGCADGAVRILKKAG

SEQ ID NO: 937825 - protein, 25 aa, Mycobacterium
VVFGDFRFGPESTYHATFTDVSRLK

SEQ ID NO: 937826 - protein, 21 aa, Mycobacterium
VVGCGPGPFTGLRAGMATGAA

SEQ ID NO: 937827 - protein, 27 aa, Mycobacterium
VVGCILLAGLVGMCSFQPGATNRGNVP

SEQ ID NO: 937828 - protein, 18 aa, Mycobacterium
VVGIHGRGRVRSVTVEHA

SEQ ID NO: 937829 - protein, 18 aa, Mycobacterium
VVGLWRGGIGTTWEARVK

SEQ ID NO: 937830 - protein, 27 aa, Mycobacterium
VVHFSAAWCGPCAVVRRVVGEVCAGLP

SEQ ID NO: 937831 - protein, 22 aa, Mycobacterium
VVHPGQRVRLTFSNEKAMYHPM

SEQ ID NO: 937832 - protein, 18 aa, Mycobacterium
VVHREMAEPIELPSGQQL

SEQ ID NO: 937833 - protein, 26 aa, Mycobacterium
VVIAGFAIYRLHGIFGSHNNASGANG

SEQ ID NO: 937834 - protein, 19 aa, Mycobacterium
VVIGRRGPLQTAFTTLELR

SEQ ID NO: 937835 - protein, 17 aa, Mycobacterium
VVIIGAGPTGVTAATLL

SEQ ID NO: 937836 - protein, 20 aa, Mycobacterium
VVIIGRRGPLQATFTPLELR

SEQ ID NO: 937837 - protein, 20 aa, Mycobacterium
VVILGRRGPLQTAFTTLELR

SEQ ID NO: 937838 - protein, 17 aa, Mycobacterium
VVIPGQDAVYVLQLNAD

SEQ ID NO: 937839 - protein, 18 aa, Mycobacterium
VVIPPGAEGYVYTYSQLV

SEQ ID NO: 937840 - protein, 17 aa, Mycobacterium
VVIPSQDGLFVLQLDAD

SEQ ID NO: 937841 - protein, 26 aa, Mycobacterium
VVISSEWGVTGWPGATAYAASKSGLI

SEQ ID NO: 937842 - protein, 19 aa, Mycobacterium
VVITAPVVDRAWPGNRGSG

SEQ ID NO: 937843 - protein, 23 aa, Mycobacterium
VVKVEGIPWFNRMAVGVENFASR

SEQ ID NO: 937844 - protein, 25 aa, Mycobacterium
VVLAGFPGTVASFWQQAGRSGRRGQ

SEQ ID NO: 937845 - protein, 18 aa, Mycobacterium
VVLARRFHNDAVRDTLVL

SEQ ID NO: 937846 - protein, 17 aa, Mycobacterium
VVLASWILAVSLPASAH

SEQ ID NO: 937847 - protein, 17 aa, Mycobacterium
VVLAVGFLPAGTAAADD

SEQ ID NO: 937848 - protein, 18 aa, Mycobacterium
VVLDDEWTVVTADGTRAA

SEQ ID NO: 937849 - protein, 18 aa, Mycobacterium
VVLIPGLPPITIPGAPPP

SEQ ID NO: 937850 - protein, 24 aa, Mycobacterium
VVLPDAPLKIFLTASAETRARRRN

SEQ ID NO: 937851 - protein, 25 aa, Mycobacterium
VVLPVSGLVVWRLHEKFGSEDLNAN

SEQ ID NO: 937852 - protein, 19 aa, Mycobacterium
VVLSAGWDQDLFRRMGELA

SEQ ID NO: 937853 - protein, 19 aa, Mycobacterium
VVLTKRPDYAWPPVNSPNQ

SEQ ID NO: 937854 - protein, 18 aa, Mycobacterium
VVLVLCLAGVTAVSMQIR

SEQ ID NO: 937855 - protein, 29 aa, Mycobacterium
VVLVSSCIPNWSADVFTWKGPEVESGSTP

SEQ ID NO: 937856 - protein, 25 aa, Mycobacterium
VVLYKQYVVRFGLGYREEVKSDVQV

SEQ ID NO: 937857 - protein, 26 aa, Mycobacterium
VVMFYWQQCALLAYEIYALPPDADDA

SEQ ID NO: 937858 - protein, 23 aa, Mycobacterium
VVMQPRWPHGCAAAADLVLIGRF

SEQ ID NO: 937859 - protein, 18 aa, Mycobacterium
VVMVARPPLPAGIATVGT

SEQ ID NO: 937860 - protein, 19 aa, Mycobacterium
VVNDDIWAFRGWSIDDYCE

SEQ ID NO: 937861 - protein, 18 aa, Mycobacterium
VVNDLEFSVRLKAPTVDF

SEQ ID NO: 937862 - protein, 21 aa, Mycobacterium
VVNPPEWLIGSMANLNGKETS

SEQ ID NO: 937863 - protein, 24 aa, Mycobacterium
VVNTTCSYEQVMAALNAQQPDLAA

SEQ ID NO: 937864 - protein, 18 aa, Mycobacterium
VVPAALPSFGMPSAAAAG

SEQ ID NO: 937865 - protein, 19 aa, Mycobacterium
VVPDPRYVAVSDPDQLATE

SEQ ID NO: 937866 - protein, 17 aa, Mycobacterium
VVPMLAPGSADPNGYEF

SEQ ID NO: 937867 - protein, 24 aa, Mycobacterium
VVQRIARASAWARAHPQEWYGKYA

SEQ ID NO: 937868 - protein, 17 aa, Mycobacterium
VVRCHQSGWSWFIETPD

SEQ ID NO: 937869 - protein, 18 aa, Mycobacterium
VVRLLFYDAQSTRQFGQV

SEQ ID NO: 937870 - protein, 18 aa, Mycobacterium
VVRYQGWAGQVEFQELAE

SEQ ID NO: 937871 - protein, 23 aa, Mycobacterium
VVSLSWRTGDDIVVTRNDATHPV

SEQ ID NO: 937872 - protein, 23 aa, Mycobacterium
VVSLSWRTGDDIVVTRNDVGHPV

SEQ ID NO: 937873 - protein, 23 aa, Mycobacterium
VVSLSWRTGDDIVVTRTDANHPV

SEQ ID NO: 937874 - protein, 23 aa, Mycobacterium
VVSLSWRTGDDIVVTRTDASHPV

SEQ ID NO: 937875 - protein, 23 aa, Mycobacterium
VVSSPRAGLVMEKGAKVKYRGIQ

SEQ ID NO: 937876 - protein, 24 aa, Mycobacterium
VVTASAAAFGFCPSAAADPATPQP

SEQ ID NO: 937877 - protein, 25 aa, Mycobacterium
VVTDRGGAVIGRLAAFRDNTPSGTT

SEQ ID NO: 937878 - protein, 28 aa, Mycobacterium
VVTFAKHYAEWRGMFAGNGMLLPASMTA

SEQ ID NO: 937879 - protein, 25 aa, Mycobacterium
VVTGCLLALVFIGLSAAGGWFYWAR

SEQ ID NO: 937880 - protein, 24 aa, Mycobacterium
VVTKDRPGFIVNRFLIPWENSCIE

SEQ ID NO: 937881 - protein, 18 aa, Mycobacterium
VVTLPTIFTHRDVGNTEC

SEQ ID NO: 937882 - protein, 24 aa, Mycobacterium
VVTNGFAGSGGFGGAGGDAQFLGF

SEQ ID NO: 937883 - protein, 23 aa, Mycobacterium
VVTSAAAFGLCPGAAADPAAPQP

SEQ ID NO: 937884 - protein, 24 aa, Mycobacterium
VVVAGRPSERWGQEVVAVVAVDDG

SEQ ID NO: 937885 - protein, 18 aa, Mycobacterium
VVVAPVIVVPAPTRRSAA

SEQ ID NO: 937886 - protein, 19 aa, Mycobacterium
VVVDGELFAQLGSAYSSMG

SEQ ID NO: 937887 - protein, 21 aa, Mycobacterium
VVVERDGRFVYTPTDAARQQA

SEQ ID NO: 937888 - protein, 26 aa, Mycobacterium
VVVFGDFRFGPKATYHATFTNASRLK

SEQ ID NO: 937889 - protein, 17 aa, Mycobacterium
VVVGLYPALGHAERVGR

SEQ ID NO: 937890 - protein, 19 aa, Mycobacterium
VVVGMLTWVTVFDDNVAAA

SEQ ID NO: 937891 - protein, 26 aa, Mycobacterium
VVVINIWGQWCGPCRAEVGQLQQVYD

SEQ ID NO: 937892 - protein, 28 aa, Mycobacterium
VVVINIWGQWCGPCRAEVTQLQQVYDAT

SEQ ID NO: 937893 - protein, 17 aa, Mycobacterium
VVVPPGHTWARRSRPIA

SEQ ID NO: 937894 - protein, 17 aa, Mycobacterium
VVVRRAAILALCVVLPA

SEQ ID NO: 937895 - protein, 17 aa, Mycobacterium
VVVRSAWVYTGGTGSDF

SEQ ID NO: 937896 - protein, 17 aa, Mycobacterium
VVWSMVMQLALDCGAVV

SEQ ID NO: 937897 - protein, 31 aa, Mycobacterium
VVYARAMGPMQFLPGTWSRYAADGDGDGKAD

SEQ ID NO: 937898 - protein, 26 aa, Mycobacterium
VVYNAGGKDLLVWDKPAASATAPSGT

SEQ ID NO: 937899 - protein, 25 aa, Mycobacterium
VVYNDGERDLLAWSQTAASTTSPRP

SEQ ID NO: 937900 - protein, 17 aa, Mycobacterium
VWAESDGSYYVHTKDPL

SEQ ID NO: 937901 - protein, 20 aa, Mycobacterium
VWANPFRWYPVATSTADAIT

SEQ ID NO: 937902 - protein, 24 aa, Mycobacterium
VWEICGALLHGNRLVVVPESIASS

SEQ ID NO: 937903 - protein, 17 aa, Mycobacterium
VWFSDLLRPNGRAYQDG

SEQ ID NO: 937904 - protein, 18 aa, Mycobacterium
VWGIARFTDATARADLEQ

SEQ ID NO: 937905 - protein, 19 aa, Mycobacterium
VWGMPALGSIPIRVDCGDS

SEQ ID NO: 937906 - protein, 20 aa, Mycobacterium
VWHYVPMLWEAGGDILTPDN

SEQ ID NO: 937907 - protein, 17 aa, Mycobacterium
VWLAVLLAALTVIGAGV

SEQ ID NO: 937908 - protein, 17 aa, Mycobacterium
VWLDPRRWYSVPRAAAD

SEQ ID NO: 937909 - protein, 23 aa, Mycobacterium
VWMPRARRSPIRDVQEVIESEPG

SEQ ID NO: 937910 - protein, 35 aa, Mycobacterium
VWPVFTNPWYDKEWRYTTPYTVYTTGIGWRTDQVP

SEQ ID NO: 937911 - protein, 19 aa, Mycobacterium
VWQAASLLLAYPDDGFTER

SEQ ID NO: 937912 - protein, 19 aa, Mycobacterium
VWQAASLLLAYPDDGLTER

SEQ ID NO: 937913 - protein, 23 aa, Mycobacterium
VWTAEFAEAGWALPLSDDPAGRA

SEQ ID NO: 937914 - protein, 24 aa, Mycobacterium
VWVFALLRAVTWAAPLRAALARLL

SEQ ID NO: 937915 - protein, 30 aa, Mycobacterium
VWWDTFRLPPFGRYTLRMYFRPDVTGMTVY

SEQ ID NO: 937916 - protein, 20 aa, Mycobacterium
VWWSWVVSVLAVVGVGLGLG

SEQ ID NO: 937917 - protein, 24 aa, Mycobacterium
VYAAGLFGGLAIFDPATELLETIS

SEQ ID NO: 937918 - protein, 18 aa, Mycobacterium
VYAGSGWTAVRGQRLDDS

SEQ ID NO: 937919 - protein, 19 aa, Mycobacterium
VYAGTGWTAVRDQIVREPG

SEQ ID NO: 937920 - protein, 18 aa, Mycobacterium
VYAPVTGFYSLNYSSTGL

SEQ ID NO: 937921 - protein, 18 aa, Mycobacterium
VYDGEWWHFDGPGAGVDR

SEQ ID NO: 937922 - protein, 17 aa, Mycobacterium
VYFAYWKAKGVDVTPFF

SEQ ID NO: 937923 - protein, 17 aa, Mycobacterium
VYFDYWSARGVDVTPFF

SEQ ID NO: 937924 - protein, 21 aa, Mycobacterium
VYFPRGGMRALPDAMAAAAAD

SEQ ID NO: 937925 - protein, 19 aa, Mycobacterium
VYGEGSWQSGSHIFYPPPR

SEQ ID NO: 937926 - protein, 18 aa, Mycobacterium
VYGRENVERVIARAGSAM

SEQ ID NO: 937927 - protein, 19 aa, Mycobacterium
VYGVCSLDAIGGLTTGDTL

SEQ ID NO: 937928 - protein, 29 aa, Mycobacterium
VYIVANSFTRWLPVVLYRATPEAFTDRSR

SEQ ID NO: 937929 - protein, 19 aa, Mycobacterium
VYLDPRWTASKDPTADYAV

SEQ ID NO: 937930 - protein, 24 aa, Mycobacterium
VYNAGGPDLAVWVQPPPVPQRPAT

SEQ ID NO: 937931 - protein, 23 aa, Mycobacterium
VYNDGMQDILIWTSNVPGNSAPG

SEQ ID NO: 937932 - protein, 17 aa, Mycobacterium
VYPQRFGIPEGLFAEPV

SEQ ID NO: 937933 - protein, 19 aa, Mycobacterium
VYQAPDHTGFPASGDLTAL

SEQ ID NO: 937934 - protein, 32 aa, Mycobacterium
VYSADGLGRWYQARFHEFSQITGISVNLVEAG

SEQ ID NO: 937935 - protein, 22 aa, Mycobacterium
VYSGAYKAWAMTPDELILYMPD

SEQ ID NO: 937936 - protein, 18 aa, Mycobacterium
VYSGEWWHFDGPGAGEGR

SEQ ID NO: 937937 - protein, 17 aa, Mycobacterium
VYSKLGLTSRVQLVQEA

SEQ ID NO: 937938 - protein, 24 aa, Mycobacterium
VYTPCAQPPALAYLGDGKLPDTDT

SEQ ID NO: 937939 - protein, 18 aa, Mycobacterium
VYTRGGGPVQRWRRGTPF

SEQ ID NO: 937940 - protein, 20 aa, Mycobacterium
VYTTGIGWRTDQVPEDIGAL

SEQ ID NO: 937941 - protein, 19 aa, Mycobacterium
VYVGAPLVRQIFVYGNSER

SEQ ID NO: 937942 - protein, 25 aa, Mycobacterium
VYVSELRPGADFDFKPVTRDYADGL

SEQ ID NO: 937943 - protein, 18 aa, Mycobacterium
WAAAGLTPLRPWRSALVA

SEQ ID NO: 937944 - protein, 21 aa, Mycobacterium
WAAEMLIKLVRQVKATAVDGK

SEQ ID NO: 937945 - protein, 19 aa, Mycobacterium
WAAESGRYAGFDAATQAGY

SEQ ID NO: 937946 - protein, 17 aa, Mycobacterium
WADLALQGGRLGYGALR

SEQ ID NO: 937947 - protein, 18 aa, Mycobacterium
WADPEPDPGPGPVFEDPG

SEQ ID NO: 937948 - protein, 20 aa, Mycobacterium
WADPPDRPWNLLATANALLG

SEQ ID NO: 937949 - protein, 19 aa, Mycobacterium
WAEISGSWYPDGPPRHQRV

SEQ ID NO: 937950 - protein, 19 aa, Mycobacterium
WAENGWLVDLSDYARNTPG

SEQ ID NO: 937951 - protein, 24 aa, Mycobacterium
WAGAKALAADGCRIVVADRDADAA

SEQ ID NO: 937952 - protein, 17 aa, Mycobacterium
WAGEVLLREAHDICGLP

SEQ ID NO: 937953 - protein, 17 aa, Mycobacterium
WAGEVLLREAHDLCGLP

SEQ ID NO: 937954 - protein, 25 aa, Mycobacterium
WAGRGLATICLRPDPIPDDVRVLGF

SEQ ID NO: 937955 - protein, 25 aa, Mycobacterium
WAGRGLATICLRPEPIPEDVRVLGF

SEQ ID NO: 937956 - protein, 25 aa, Mycobacterium
WAHGWANAELISWTFQGVNWTFDGS

SEQ ID NO: 937957 - protein, 21 aa, Mycobacterium
WAHKATLEFLASLGKTSVVTK

SEQ ID NO: 937958 - protein, 17 aa, Mycobacterium
WALNHPNAAVAVLAALP

SEQ ID NO: 937959 - protein, 19 aa, Mycobacterium
WALPTTWTVAAGRPVLEAV

SEQ ID NO: 937960 - protein, 28 aa, Mycobacterium
WALQDGLCSYFWQHNWGSPKGFVHPEAH

SEQ ID NO: 937961 - protein, 17 aa, Mycobacterium
WAPKHTDFEAGLTDTID

SEQ ID NO: 937962 - protein, 19 aa, Mycobacterium
WAQDVAAMVGYHGGASAVA

SEQ ID NO: 937963 - protein, 17 aa, Mycobacterium
WAQLGVRDRFIALTDAV

SEQ ID NO: 937964 - protein, 18 aa, Mycobacterium
WAQPGDIVLIAGKGHESG

SEQ ID NO: 937965 - protein, 17 aa, Mycobacterium
WAQRGLRERFIALTDAV

SEQ ID NO: 937966 - protein, 22 aa, Mycobacterium
WARDYWIPFDRFRRLDRVRTVH

SEQ ID NO: 937967 - protein, 23 aa, Mycobacterium
WARDYWIPFDRFRRLDRVRTVQA

SEQ ID NO: 937968 - protein, 19 aa, Mycobacterium
WAREYKCEFQIDNPGKDTI

SEQ ID NO: 937969 - protein, 25 aa, Mycobacterium
WASPLRSAGPWAQWAATARSARLAY

SEQ ID NO: 937970 - protein, 25 aa, Mycobacterium
WASRGVDVSPFFRVLQGPRIAAPGG

SEQ ID NO: 937971 - protein, 17 aa, Mycobacterium
WATFPLETAAKWAGLGG

SEQ ID NO: 937972 - protein, 17 aa, Mycobacterium
WATQMSYSGIYVHSAPW

SEQ ID NO: 937973 - protein, 18 aa, Mycobacterium
WATQMSYSGIYVHSAPWS

SEQ ID NO: 937974 - protein, 18 aa, Mycobacterium
WAVGRVRPNTGWLPPELL

SEQ ID NO: 937975 - protein, 19 aa, Mycobacterium
WAWTLGINLWGPIHGCHVF

SEQ ID NO: 937976 - protein, 19 aa, Mycobacterium
WAYWCGPCADELPAMAEYQ

SEQ ID NO: 937977 - protein, 17 aa, Mycobacterium
WCPGQPFDPAWGPQWDP

SEQ ID NO: 937978 - protein, 18 aa, Mycobacterium
WDALAQCEAGGNWAINTG

SEQ ID NO: 937979 - protein, 17 aa, Mycobacterium
WDALARRLGDGIEGWSL

SEQ ID NO: 937980 - protein, 25 aa, Mycobacterium
WDCYMGEGAAKVWAPARSWAYYAPQ

SEQ ID NO: 937981 - protein, 19 aa, Mycobacterium
WDDFDWLMNINFWGVAHGT

SEQ ID NO: 937982 - protein, 20 aa, Mycobacterium
WDDLLRPGVEVITPSPLSSG

SEQ ID NO: 937983 - protein, 21 aa, Mycobacterium
WDEVKESLTQLAVQLSPAAGE

SEQ ID NO: 937984 - protein, 17 aa, Mycobacterium
WDHPGWFTLVDQSVAVF

SEQ ID NO: 937985 - protein, 17 aa, Mycobacterium
WDHPYPTVPKVWFHDLL

SEQ ID NO: 937986 - protein, 20 aa, Mycobacterium
WDIPPRADGVYTRGGGPVER

SEQ ID NO: 937987 - protein, 17 aa, Mycobacterium
WDKDAFGGIPFGSVVTL

SEQ ID NO: 937988 - protein, 17 aa, Mycobacterium
WDKPFNMGRYVTDQEHV

SEQ ID NO: 937989 - protein, 23 aa, Mycobacterium
WDLIMRIAAPRGFMDVADVAKTI

SEQ ID NO: 937990 - protein, 17 aa, Mycobacterium
WDLPAWAQAGHRLLDDM

SEQ ID NO: 937991 - protein, 19 aa, Mycobacterium
WDMTLPQIPSAFVSGDPIQ

SEQ ID NO: 937992 - protein, 29 aa, Mycobacterium
WDQAEAIPARFVLAAAMVRHLLADPVLPD

SEQ ID NO: 937993 - protein, 19 aa, Mycobacterium
WDQAGSLFDWGFALNPQSG

SEQ ID NO: 937994 - protein, 20 aa, Mycobacterium
WDQDLFRRMGELAGGNVEFR

SEQ ID NO: 937995 - protein, 22 aa, Mycobacterium
WDQRLGGRLRRRIDALDERLFS

SEQ ID NO: 937996 - protein, 21 aa, Mycobacterium
WDRLANELSAAASSFGSVTAE

SEQ ID NO: 937997 - protein, 17 aa, Mycobacterium
WDTALRVRQELNALGVR

SEQ ID NO: 937998 - protein, 24 aa, Mycobacterium
WDTPVAAKLPWFTLGDPYVSSHVT

SEQ ID NO: 937999 - protein, 19 aa, Mycobacterium
WDTPVTTLIQWIAKANLRR

SEQ ID NO: 938000 - protein, 17 aa, Mycobacterium
WDTRARVAAPYRVIQFA

SEQ ID NO: 938001 - protein, 21 aa, Mycobacterium
WDVPPRADGVYSRGGGPVQRW

SEQ ID NO: 938002 - protein, 18 aa, Mycobacterium
WDYVRQFTEFTGYQHRVF

SEQ ID NO: 938003 - protein, 17 aa, Mycobacterium
WEFVKFATGPAGQALIG

SEQ ID NO: 938004 - protein, 17 aa, Mycobacterium
WEKAGLRGGGRAVKVQA

SEQ ID NO: 938005 - protein, 29 aa, Mycobacterium
WEKPCPEGPFGFCPVRSMSGSAMLPNKQC

SEQ ID NO: 938006 - protein, 17 aa, Mycobacterium
WEKRYPVYEKLESEVTA

SEQ ID NO: 938007 - protein, 19 aa, Mycobacterium
WEMDPTLLVSAEETSQEPF

SEQ ID NO: 938008 - protein, 19 aa, Mycobacterium
WEPLPIQYIDFALWQRAYL

SEQ ID NO: 938009 - protein, 20 aa, Mycobacterium
WEQTGRAAPYAAVLAAVRAQ

SEQ ID NO: 938010 - protein, 18 aa, Mycobacterium
WEQTLENWNATIAIDVTA

SEQ ID NO: 938011 - protein, 17 aa, Mycobacterium
WERPVIEPPLWFHDLLH

SEQ ID NO: 938012 - protein, 18 aa, Mycobacterium
WESSELAQYVRIRKLTPP

SEQ ID NO: 938013 - protein, 27 aa, Mycobacterium
WETFLTRELPAWLAANRGVEPTGNAVV

SEQ ID NO: 938014 - protein, 19 aa, Mycobacterium
WEVARASGIAVAVTDPIAH

SEQ ID NO: 938015 - protein, 17 aa, Mycobacterium
WEVWARVAEQLGTDPNR

SEQ ID NO: 938016 - protein, 17 aa, Mycobacterium
WFHDLLRPDGRPFQDTE

SEQ ID NO: 938017 - protein, 17 aa, Mycobacterium
WFHSGRAAYEVTGAGSD

SEQ ID NO: 938018 - protein, 17 aa, Mycobacterium
WFHTDWMDTTRAQEVLT

SEQ ID NO: 938019 - protein, 26 aa, Mycobacterium
WFLAPGLITDRVWKYACDNDIAMARP

SEQ ID NO: 938020 - protein, 18 aa, Mycobacterium
WFNGNMFGGAPLDKPDQS

SEQ ID NO: 938021 - protein, 19 aa, Mycobacterium
WFTDPLFGINGEWEGSRAE

SEQ ID NO: 938022 - protein, 26 aa, Mycobacterium
WFWTPWCPYCNAEAPGVSQVAAANPG

SEQ ID NO: 938023 - protein, 18 aa, Mycobacterium
WFYQQRRWIVPSERIADT

SEQ ID NO: 938024 - protein, 19 aa, Mycobacterium
WGADEALRCESPEYDRAVR

SEQ ID NO: 938025 - protein, 29 aa, Mycobacterium
WGADVLRRLRGMFAFALWDTVTRELFCAR

SEQ ID NO: 938026 - protein, 33 aa, Mycobacterium
WGALEAVGGPSTWRLGGAFNCGKAQPGQVAAVS

SEQ ID NO: 938027 - protein, 18 aa, Mycobacterium
WGEKTGVINNVFTPWTYD

SEQ ID NO: 938028 - protein, 17 aa, Mycobacterium
WGGDVVGQGWGINKQGG

SEQ ID NO: 938029 - protein, 18 aa, Mycobacterium
WGHGCINGICGGWDGQRG

SEQ ID NO: 938030 - protein, 18 aa, Mycobacterium
WGHGCYNGVCGGWDGQRG

SEQ ID NO: 938031 - protein, 20 aa, Mycobacterium
WGKDGIRCNAVAPGFTATDT

SEQ ID NO: 938032 - protein, 18 aa, Mycobacterium
WGKPGSPAWLRADPMLNI

SEQ ID NO: 938033 - protein, 18 aa, Mycobacterium
WGKVPYIDGVVFRPLPDP

SEQ ID NO: 938034 - protein, 22 aa, Mycobacterium
WGLGYEVACRMGIEPALREQGY

SEQ ID NO: 938035 - protein, 18 aa, Mycobacterium
WGLYDRKPLNRWTTDRIA

SEQ ID NO: 938036 - protein, 23 aa, Mycobacterium
WGMTEFPCATSPPLTAPPEVLDH

SEQ ID NO: 938037 - protein, 20 aa, Mycobacterium
WGPADAPGRYLLVFNGEIYN

SEQ ID NO: 938038 - protein, 19 aa, Mycobacterium
WGPDWPREIDIAVAGTPEQ

SEQ ID NO: 938039 - protein, 25 aa, Mycobacterium
WGPIHGCHVFTPILRDAESRAPRGI

SEQ ID NO: 938040 - protein, 24 aa, Mycobacterium
WGPIHGCHVFTPILRTAEPSRTPR

SEQ ID NO: 938041 - protein, 19 aa, Mycobacterium
WGPQWPRDIPIVVAGTTGQ

SEQ ID NO: 938042 - protein, 24 aa, Mycobacterium
WGQSGRWSTNYSGIAYSTDNGENF

SEQ ID NO: 938043 - protein, 29 aa, Mycobacterium
WGQTDIPALPAGVVYVNIAASRYHSVLLR

SEQ ID NO: 938044 - protein, 20 aa, Mycobacterium
WGQWCGPCRAEITQLQEVHN

SEQ ID NO: 938045 - protein, 20 aa, Mycobacterium
WGQWCGPCRAEITQLQQVYD

SEQ ID NO: 938046 - protein, 23 aa, Mycobacterium
WGQWCGPCRAEITQLQRVYDATH

SEQ ID NO: 938047 - protein, 17 aa, Mycobacterium
WGQWCGPCRSEFSALED

SEQ ID NO: 938048 - protein, 17 aa, Mycobacterium
WGQWCGPCRTEITELQK

SEQ ID NO: 938049 - protein, 26 aa, Mycobacterium
WGRYPIKARVDVVARGGLLMGDGTVE

SEQ ID NO: 938050 - protein, 17 aa, Mycobacterium
WGSGAWVNASSKVRLGY

SEQ ID NO: 938051 - protein, 18 aa, Mycobacterium
WGSTGPWADRKAYDLLVQ

SEQ ID NO: 938052 - protein, 25 aa, Mycobacterium
WGTAEEMADLLAFCASRKAGYLTGT

SEQ ID NO: 938053 - protein, 17 aa, Mycobacterium
WGTMAALRRMRPRDRGA

SEQ ID NO: 938054 - protein, 19 aa, Mycobacterium
WGVPSNIAGMVVFIDPGHN

SEQ ID NO: 938055 - protein, 17 aa, Mycobacterium
WGWGELAVCDGEKYPDG

SEQ ID NO: 938056 - protein, 25 aa, Mycobacterium
WHAKEELARYGVQPDWFQLGDRDLA

SEQ ID NO: 938057 - protein, 18 aa, Mycobacterium
WHDPCVHVALLAQNNTRV

SEQ ID NO: 938058 - protein, 25 aa, Mycobacterium
WHQLWASSFAKLSYRVKSVDVTGDN

SEQ ID NO: 938059 - protein, 18 aa, Mycobacterium
WHTWRCQWDEAGIRFWKD

SEQ ID NO: 938060 - protein, 29 aa, Mycobacterium
WHTWRMSWKPEGMYFWKDYAPGMEPFFSV

SEQ ID NO: 938061 - protein, 17 aa, Mycobacterium
WIAEGLLGYLPAEAQDR

SEQ ID NO: 938062 - protein, 22 aa, Mycobacterium
WIATLKLGIDKGVKLPRNATAK

SEQ ID NO: 938063 - protein, 18 aa, Mycobacterium
WIDLKPGECVADLPPPDL

SEQ ID NO: 938064 - protein, 29 aa, Mycobacterium
WIDRGRPAPTHGRWGQYLRWVAERIDMTV

SEQ ID NO: 938065 - protein, 22 aa, Mycobacterium
WIDVESFARYVATQNLLINGDD

SEQ ID NO: 938066 - protein, 18 aa, Mycobacterium
WIGAEAVLEPGGTDVALC

SEQ ID NO: 938067 - protein, 17 aa, Mycobacterium
WIGAEVVLDGAADVALC

SEQ ID NO: 938068 - protein, 20 aa, Mycobacterium
WIKDDVVQWVPNRYWPAHTH

SEQ ID NO: 938069 - protein, 19 aa, Mycobacterium
WIPLLILVVVAIAGFTVQR

SEQ ID NO: 938070 - protein, 17 aa, Mycobacterium
WIPLLLVVVVALGAYAI

SEQ ID NO: 938071 - protein, 19 aa, Mycobacterium
WIPLLLVVVVALGAYAVVR

SEQ ID NO: 938072 - protein, 17 aa, Mycobacterium
WIPLLLVVVVGIGGYAI

SEQ ID NO: 938073 - protein, 18 aa, Mycobacterium
WIPLVLVVVLALSALIVS

SEQ ID NO: 938074 - protein, 18 aa, Mycobacterium
WIPLVVVIALVAGGIAVD

SEQ ID NO: 938075 - protein, 20 aa, Mycobacterium
WIPNQWPPVSTGFWTYSYPL

SEQ ID NO: 938076 - protein, 17 aa, Mycobacterium
WIPPWEQPPRQPECVVF

SEQ ID NO: 938077 - protein, 19 aa, Mycobacterium
WIRCGRFREGLAGFDALLT

SEQ ID NO: 938078 - protein, 17 aa, Mycobacterium
WITLSSLVFAVMLTACD

SEQ ID NO: 938079 - protein, 19 aa, Mycobacterium
WITPGAEWAPGTDFTTVDG

SEQ ID NO: 938080 - protein, 24 aa, Mycobacterium
WKADAVYLDPRWVASKDPHADYAI

SEQ ID NO: 938081 - protein, 24 aa, Mycobacterium
WKAKGVDVTPFFAVLNGPRIPAPG

SEQ ID NO: 938082 - protein, 17 aa, Mycobacterium
WKAMTKTGLINHLLNPE

SEQ ID NO: 938083 - protein, 21 aa, Mycobacterium
WKDGRVVAVKVQYPGADEAVR

SEQ ID NO: 938084 - protein, 19 aa, Mycobacterium
WKEAPSAQRETLIQNGQVD

SEQ ID NO: 938085 - protein, 18 aa, Mycobacterium
WKGTLGGLAGYASGDEDT

SEQ ID NO: 938086 - protein, 19 aa, Mycobacterium
WKGTLTGLAGYARGDVDTR

SEQ ID NO: 938087 - protein, 17 aa, Mycobacterium
WKGTLTGLAGYASGDLD

SEQ ID NO: 938088 - protein, 18 aa, Mycobacterium
WKIDQVYFDPRWIANQDP

SEQ ID NO: 938089 - protein, 25 aa, Mycobacterium
WKLEFDLPAGESITNAWSSKLAQSG

SEQ ID NO: 938090 - protein, 17 aa, Mycobacterium
WKLSAKESGDANDLPFW

SEQ ID NO: 938091 - protein, 19 aa, Mycobacterium
WKLSNPSACVIARDVAGVD

SEQ ID NO: 938092 - protein, 18 aa, Mycobacterium
WKLTITTTMTSVFANVVA

SEQ ID NO: 938093 - protein, 20 aa, Mycobacterium
WKQNWPQHLAGAYIDAGMAN

SEQ ID NO: 938094 - protein, 17 aa, Mycobacterium
WKVHDSSSPPPVFTVNG

SEQ ID NO: 938095 - protein, 17 aa, Mycobacterium
WLAAWSLLGAAAAHADD

SEQ ID NO: 938096 - protein, 25 aa, Mycobacterium
WLACAGLLAPLACGCHAARHGAAPT

SEQ ID NO: 938097 - protein, 17 aa, Mycobacterium
WLACGDPSAARRFADEM

SEQ ID NO: 938098 - protein, 19 aa, Mycobacterium
WLADHLVGGAVLFPGTGFV

SEQ ID NO: 938099 - protein, 17 aa, Mycobacterium
WLAEIERTPTFYFDSIT

SEQ ID NO: 938100 - protein, 23 aa, Mycobacterium
WLAERTNSIVVAPTLSSNRYVRD

SEQ ID NO: 938101 - protein, 17 aa, Mycobacterium
WLARYGFDVTVVERAPQ

SEQ ID NO: 938102 - protein, 22 aa, Mycobacterium
WLAVGVGLHLTVPGLRRDGRSS

SEQ ID NO: 938103 - protein, 21 aa, Mycobacterium
WLDGRIAHRGLRMSGFGSDVE

SEQ ID NO: 938104 - protein, 20 aa, Mycobacterium
WLDRYVRGNELIPTGPRFEW

SEQ ID NO: 938105 - protein, 17 aa, Mycobacterium
WLDSILDAVAGKLPDAP

SEQ ID NO: 938106 - protein, 17 aa, Mycobacterium
WLFSVLLTPAIRLTNGA

SEQ ID NO: 938107 - protein, 17 aa, Mycobacterium
WLGAFGAGACIALGAGH

SEQ ID NO: 938108 - protein, 18 aa, Mycobacterium
WLGVSGRARVIVYNPTLV

SEQ ID NO: 938109 - protein, 23 aa, Mycobacterium
WLHPPGIDFRPALLADVEIAVSS

SEQ ID NO: 938110 - protein, 17 aa, Mycobacterium
WLIGSMANLNGKETSPF

SEQ ID NO: 938111 - protein, 17 aa, Mycobacterium
WLLMPRFKINQADLLEH

SEQ ID NO: 938112 - protein, 18 aa, Mycobacterium
WLLVRIPVGTVWSEESAF

SEQ ID NO: 938113 - protein, 19 aa, Mycobacterium
WLLVVGLFISVVGCSSSPD

SEQ ID NO: 938114 - protein, 18 aa, Mycobacterium
WLNHLPYQDLPPMQPGDP

SEQ ID NO: 938115 - protein, 20 aa, Mycobacterium
WLNSDFAPGGTWNGVTYHNP

SEQ ID NO: 938116 - protein, 23 aa, Mycobacterium
WLPGGWTTNTFGQWVSPTDQLAN

SEQ ID NO: 938117 - protein, 18 aa, Mycobacterium
WLPLLIVVVVVIAGATVS

SEQ ID NO: 938118 - protein, 17 aa, Mycobacterium
WLPPGAPGSHWAPGEPA

SEQ ID NO: 938119 - protein, 17 aa, Mycobacterium
WLQPRSNTFHRWLDDTY

SEQ ID NO: 938120 - protein, 17 aa, Mycobacterium
WLRGQARPDARVEARAY

SEQ ID NO: 938121 - protein, 20 aa, Mycobacterium
WLRGRGWAAERIALLDYMNT

SEQ ID NO: 938122 - protein, 17 aa, Mycobacterium
WLSAKVLGTITARDADR

SEQ ID NO: 938123 - protein, 19 aa, Mycobacterium
WLSRHGFGVTVVERAPALR

SEQ ID NO: 938124 - protein, 20 aa, Mycobacterium
WLTALLRATLTVVRGAAAEQ

SEQ ID NO: 938125 - protein, 17 aa, Mycobacterium
WLTEGVADFVARPQAPV

SEQ ID NO: 938126 - protein, 17 aa, Mycobacterium
WLTEGVADYVARPDAPR

SEQ ID NO: 938127 - protein, 26 aa, Mycobacterium
WLYEQRRWEVPSERIANTMKLAIVSI

SEQ ID NO: 938128 - protein, 17 aa, Mycobacterium
WMAANREAVNNGTAKVP

SEQ ID NO: 938129 - protein, 22 aa, Mycobacterium
WMAGGTYLVARRIRMLIESWDR

SEQ ID NO: 938130 - protein, 17 aa, Mycobacterium
WMGKKALLLQGRLWQGN

SEQ ID NO: 938131 - protein, 17 aa, Mycobacterium
WMGSRRGNEFVGRRGAA

SEQ ID NO: 938132 - protein, 20 aa, Mycobacterium
WMMTAEVGVTNFVASMDLTA

SEQ ID NO: 938133 - protein, 20 aa, Mycobacterium
WMPNGKWLVLPVRVLDHKLV

SEQ ID NO: 938134 - protein, 22 aa, Mycobacterium
WMSGREQLVPRDLVYPPDKSKD

SEQ ID NO: 938135 - protein, 24 aa, Mycobacterium
WMTSDRFIGLFSRNGNDAGVAALF

SEQ ID NO: 938136 - protein, 18 aa, Mycobacterium
WMVNPVFINPLPVSPPYR

SEQ ID NO: 938137 - protein, 18 aa, Mycobacterium
WNAALLRIAVAGRDPDEL

SEQ ID NO: 938138 - protein, 18 aa, Mycobacterium
WNAALSRISVAGRNVDDL

SEQ ID NO: 938139 - protein, 20 aa, Mycobacterium
WNADGIDKFYGLDWNEKYGP

SEQ ID NO: 938140 - protein, 17 aa, Mycobacterium
WNGAGGVKGFFEKTFAP

SEQ ID NO: 938141 - protein, 20 aa, Mycobacterium
WNGSPRWRAQGSPWRAPVTV

SEQ ID NO: 938142 - protein, 17 aa, Mycobacterium
WNHCGGEYVWTNAKMAY

SEQ ID NO: 938143 - protein, 19 aa, Mycobacterium
WNLEPWRPVVDDAEMIASG

SEQ ID NO: 938144 - protein, 17 aa, Mycobacterium
WNLLAPYAAKSEGGKNP

SEQ ID NO: 938145 - protein, 18 aa, Mycobacterium
WNNLVDVLFPRDAVNSSW

SEQ ID NO: 938146 - protein, 17 aa, Mycobacterium
WNPFAFSSLTSTDRYLQ

SEQ ID NO: 938147 - protein, 19 aa, Mycobacterium
WNPFVPKSYVWNPDMTPFA

SEQ ID NO: 938148 - protein, 22 aa, Mycobacterium
WNRAGSARAWWVLTAAGLPNVR

SEQ ID NO: 938149 - protein, 19 aa, Mycobacterium
WNRCHEWQHPGGPTAPSGW

SEQ ID NO: 938150 - protein, 17 aa, Mycobacterium
WNSGCKSWYLTEDGYNG

SEQ ID NO: 938151 - protein, 18 aa, Mycobacterium
WNTHGAIEDPVRVRQELA

SEQ ID NO: 938152 - protein, 18 aa, Mycobacterium
WNTSGVQWFRGINSVLGV

SEQ ID NO: 938153 - protein, 19 aa, Mycobacterium
WNYLPIPINPILASSADPQ

SEQ ID NO: 938154 - protein, 17 aa, Mycobacterium
WPADRRVIDAGTLTLDT

SEQ ID NO: 938155 - protein, 21 aa, Mycobacterium
WPAERANSWYQAQGWLVGANY

SEQ ID NO: 938156 - protein, 26 aa, Mycobacterium
WPASRLPQAIAALVRYRFDLANQIPL

SEQ ID NO: 938157 - protein, 17 aa, Mycobacterium
WPATERFNAKLRAAMPD

SEQ ID NO: 938158 - protein, 22 aa, Mycobacterium
WPDKPGVAGCAALDSSVMVNLV

SEQ ID NO: 938159 - protein, 28 aa, Mycobacterium
WPDRPGVAGCAALDGTVLLNLVDTKQTV

SEQ ID NO: 938160 - protein, 21 aa, Mycobacterium
WPDRPGVAGCAALDGTVLVNL

SEQ ID NO: 938161 - protein, 20 aa, Mycobacterium
WPDRRLSRRGLEVVSRRSPR

SEQ ID NO: 938162 - protein, 25 aa, Mycobacterium
WPEAEGRGGIEGMVDPVVEWGTGEA

SEQ ID NO: 938163 - protein, 20 aa, Mycobacterium
WPEPAESLPPPFDNRLAQPY

SEQ ID NO: 938164 - protein, 19 aa, Mycobacterium
WPGARLRAAYHDFAAELLG

SEQ ID NO: 938165 - protein, 19 aa, Mycobacterium
WPGARLRAAYHDFAAELLR

SEQ ID NO: 938166 - protein, 24 aa, Mycobacterium
WPGDGPRPLLVYAPLPNGMGEQCA

SEQ ID NO: 938167 - protein, 25 aa, Mycobacterium
WPGGGPRPLISYAPGTQGQGNQCAP

SEQ ID NO: 938168 - protein, 18 aa, Mycobacterium
WPGLTTRGLIQLADKVID

SEQ ID NO: 938169 - protein, 25 aa, Mycobacterium
WPGSGPRPLLSYAPGTVGQGDQCAL

SEQ ID NO: 938170 - protein, 20 aa, Mycobacterium
WPINPDTIGAVLAAASQVFP

SEQ ID NO: 938171 - protein, 17 aa, Mycobacterium
WPIQFPTTMTNPIDDDE

SEQ ID NO: 938172 - protein, 17 aa, Mycobacterium
WPPDHDAALVGMGRLIC

SEQ ID NO: 938173 - protein, 17 aa, Mycobacterium
WPREIDIAVAGTPEQFR

SEQ ID NO: 938174 - protein, 40 aa, Mycobacterium
WPRLNGLGYWFWGLVVRRIFGRAPIRPGFQRRLVQTLCRW

SEQ ID NO: 938175 - protein, 18 aa, Mycobacterium
WPTCGRGLSGATPRNVVA

SEQ ID NO: 938176 - protein, 20 aa, Mycobacterium
WPTEAELGLWEALSDIAPAQ

SEQ ID NO: 938177 - protein, 17 aa, Mycobacterium
WPTQRVLAGPGSARVQI

SEQ ID NO: 938178 - protein, 22 aa, Mycobacterium
WPTVEAPASWVAVGYDEDLDKA

SEQ ID NO: 938179 - protein, 20 aa, Mycobacterium
WPVAGPVLGRLGWFVESTLS

SEQ ID NO: 938180 - protein, 19 aa, Mycobacterium
WPYLTSGLLGLQRGTDPGD

SEQ ID NO: 938181 - protein, 17 aa, Mycobacterium
WQACGGWTDGQHRLGTS

SEQ ID NO: 938182 - protein, 18 aa, Mycobacterium
WQAGGGWTDGAQSLGTSP

SEQ ID NO: 938183 - protein, 19 aa, Mycobacterium
WQALALLMVALMLSSCGWR

SEQ ID NO: 938184 - protein, 18 aa, Mycobacterium
WQALGGMNSVLGAPTSPE

SEQ ID NO: 938185 - protein, 26 aa, Mycobacterium
WQASEIYPPLQAWQRMGQPTIAINAN

SEQ ID NO: 938186 - protein, 20 aa, Mycobacterium
WQAYLIATGQFAQWIDRGRP

SEQ ID NO: 938187 - protein, 19 aa, Mycobacterium
WQDCTREVLANANITTSPA

SEQ ID NO: 938188 - protein, 17 aa, Mycobacterium
WQECSQVGMPRAVVITK

SEQ ID NO: 938189 - protein, 20 aa, Mycobacterium
WQFPDDCVYAIGPGQAPVYA

SEQ ID NO: 938190 - protein, 24 aa, Mycobacterium
WQGESVPVPPAWPAVSPDRPVTSL

SEQ ID NO: 938191 - protein, 18 aa, Mycobacterium
WQGNVIATMAGWRTDFLN

SEQ ID NO: 938192 - protein, 17 aa, Mycobacterium
WQMVFRAASSRRNRSAF

SEQ ID NO: 938193 - protein, 19 aa, Mycobacterium
WQQALRTLQNRVAGATTAL

SEQ ID NO: 938194 - protein, 17 aa, Mycobacterium
WQQTIPLLSTPATANQP

SEQ ID NO: 938195 - protein, 19 aa, Mycobacterium
WQSAEIYTPIQAWQALGQP

SEQ ID NO: 938196 - protein, 18 aa, Mycobacterium
WQSPMPNLHVQGDVAYVS

SEQ ID NO: 938197 - protein, 17 aa, Mycobacterium
WQSRPFLLAAGNGMCND

SEQ ID NO: 938198 - protein, 17 aa, Mycobacterium
WRADGQLDYLGRADEQV

SEQ ID NO: 938199 - protein, 17 aa, Mycobacterium
WRAMDVIPLGTGGQQFT

SEQ ID NO: 938200 - protein, 27 aa, Mycobacterium
WRDALLDEWSVILGPTFSTSNVDPAGM

SEQ ID NO: 938201 - protein, 20 aa, Mycobacterium
WRDEFGLDLADPDRLAGRLD

SEQ ID NO: 938202 - protein, 25 aa, Mycobacterium
WRDVDAVLSRTGARYSYQVAKVTNG

SEQ ID NO: 938203 - protein, 27 aa, Mycobacterium
WRFGVPVVCALAGLLLAATHGVSGGAE

SEQ ID NO: 938204 - protein, 27 aa, Mycobacterium
WRFGVPVVCLLAGLLLAATHGVSGGAE

SEQ ID NO: 938205 - protein, 22 aa, Mycobacterium
WRFLNACPHRSIWLHVEGHTLH

SEQ ID NO: 938206 - protein, 17 aa, Mycobacterium
WRGLDVGSPFDHAKAGI

SEQ ID NO: 938207 - protein, 25 aa, Mycobacterium
WRIDRLPNGVFLDWQQFQATYKRHT

SEQ ID NO: 938208 - protein, 25 aa, Mycobacterium
WRIDRLPNGVFLDWQQFQATYKRNT

SEQ ID NO: 938209 - protein, 25 aa, Mycobacterium
WRIDRLPNGVFLDWQQFQSTYKRNT

SEQ ID NO: 938210 - protein, 17 aa, Mycobacterium
WRIETSIGERDEADVVI

SEQ ID NO: 938211 - protein, 26 aa, Mycobacterium
WRILLEDLNIAWAQRRAHQRVELPAE

SEQ ID NO: 938212 - protein, 18 aa, Mycobacterium
WRKGCMPLLQRVVRARVH

SEQ ID NO: 938213 - protein, 20 aa, Mycobacterium
WRKLYADAFASMDGPEGELV

SEQ ID NO: 938214 - protein, 19 aa, Mycobacterium
WRLDLDRLAATAQRCAEYR

SEQ ID NO: 938215 - protein, 28 aa, Mycobacterium
WRLGVPVICLLAGLLLAATHGVSGGDEI

SEQ ID NO: 938216 - protein, 21 aa, Mycobacterium
WRLNANVKCAMNLSDDPPGAL

SEQ ID NO: 938217 - protein, 19 aa, Mycobacterium
WRLQATKSRVRDVQVGVDV

SEQ ID NO: 938218 - protein, 19 aa, Mycobacterium
WRLQATKSRVRNVQVSVDV

SEQ ID NO: 938219 - protein, 22 aa, Mycobacterium
WRLTAALAITIVSLWQLMPTAR

SEQ ID NO: 938220 - protein, 18 aa, Mycobacterium
WRMELPLRHLEDLITRLS

SEQ ID NO: 938221 - protein, 25 aa, Mycobacterium
WRMHWGEEGFEFFRDGAQYYKVPNK

SEQ ID NO: 938222 - protein, 18 aa, Mycobacterium
WRPAEYWEPGTHVEVSVE

SEQ ID NO: 938223 - protein, 24 aa, Mycobacterium
WRQFGVPWQPAYLFINSNGTSDFV

SEQ ID NO: 938224 - protein, 17 aa, Mycobacterium
WRREEIIDFNASVVRSE

SEQ ID NO: 938225 - protein, 17 aa, Mycobacterium
WRRLHGRLTGLGVGVHP

SEQ ID NO: 938226 - protein, 18 aa, Mycobacterium
WRRQSAVAQWYVETPGSG

SEQ ID NO: 938227 - protein, 18 aa, Mycobacterium
WRSLHAASTRRALLLTAL

SEQ ID NO: 938228 - protein, 19 aa, Mycobacterium
WRSTGCSSPLGAFVDNTHG

SEQ ID NO: 938229 - protein, 17 aa, Mycobacterium
WRSTMAVNVVGAVALTL

SEQ ID NO: 938230 - protein, 19 aa, Mycobacterium
WRTWWAMVQLVRFEQDPAR

SEQ ID NO: 938231 - protein, 19 aa, Mycobacterium
WRYQKYDDCVIMSSADVIG

SEQ ID NO: 938232 - protein, 19 aa, Mycobacterium
WRYTHFSWWMTTMLHTTGD

SEQ ID NO: 938233 - protein, 22 aa, Mycobacterium
WSEGPKFAGAQCISTENTRTPV

SEQ ID NO: 938234 - protein, 18 aa, Mycobacterium
WSERARLGATLGGGTDVA

SEQ ID NO: 938235 - protein, 21 aa, Mycobacterium
WSFAQAQKLSMAKVITSAGPD

SEQ ID NO: 938236 - protein, 17 aa, Mycobacterium
WSGRGVLGPEAFDAVPF

SEQ ID NO: 938237 - protein, 20 aa, Mycobacterium
WSHRARPLVLVPDAAATLLA

SEQ ID NO: 938238 - protein, 19 aa, Mycobacterium
WSIFDAGTGEVVWDAGNSV

SEQ ID NO: 938239 - protein, 19 aa, Mycobacterium
WSKGRVALVGDAAYCCSPL

SEQ ID NO: 938240 - protein, 17 aa, Mycobacterium
WSNPRLNPTHLNFDDAA

SEQ ID NO: 938241 - protein, 17 aa, Mycobacterium
WSPVSLGDYCAGSNHVL

SEQ ID NO: 938242 - protein, 17 aa, Mycobacterium
WSQIEGLTFDKHAWAQA

SEQ ID NO: 938243 - protein, 18 aa, Mycobacterium
WSQYLSWVADHVGMNVVH

SEQ ID NO: 938244 - protein, 21 aa, Mycobacterium
WSSEFTAFGGQVFVLSAQGQG

SEQ ID NO: 938245 - protein, 17 aa, Mycobacterium
WSTAACRYHPEHVPPAP

SEQ ID NO: 938246 - protein, 20 aa, Mycobacterium
WSTEFTSFGGQVFVVSAQGV

SEQ ID NO: 938247 - protein, 20 aa, Mycobacterium
WSTLLRIVSFTVRNVAAFSG

SEQ ID NO: 938248 - protein, 20 aa, Mycobacterium
WSTRPFERISGWTLVCRGET

SEQ ID NO: 938249 - protein, 17 aa, Mycobacterium
WSVGGWVAGESFDHTSV

SEQ ID NO: 938250 - protein, 17 aa, Mycobacterium
WSVPLGFLAQTPPTVTP

SEQ ID NO: 938251 - protein, 22 aa, Mycobacterium
WSVRPFARISGWTLVCRGENAA

SEQ ID NO: 938252 - protein, 18 aa, Mycobacterium
WSVVEAFVGDLWPNGDVA

SEQ ID NO: 938253 - protein, 22 aa, Mycobacterium
WTAEFAEAGWALPLSDDPAGVT

SEQ ID NO: 938254 - protein, 22 aa, Mycobacterium
WTAEFAEAGWALPLSDDPEGRA

SEQ ID NO: 938255 - protein, 23 aa, Mycobacterium
WTAEFAEAGWTLPLSEDPAGLTE

SEQ ID NO: 938256 - protein, 17 aa, Mycobacterium
WTASTIKLAMVVDLLTR

SEQ ID NO: 938257 - protein, 22 aa, Mycobacterium
WTCFFPHPQRVVCGGISIPGRW

SEQ ID NO: 938258 - protein, 19 aa, Mycobacterium
WTFHLRDGVRWHDGTPLTA

SEQ ID NO: 938259 - protein, 17 aa, Mycobacterium
WTFKVEKSDGVSCPGGG

SEQ ID NO: 938260 - protein, 18 aa, Mycobacterium
WTFKVQKDNGVACPGGGT

SEQ ID NO: 938261 - protein, 20 aa, Mycobacterium
WTGIGFWPLVGAYGVGVGPW

SEQ ID NO: 938262 - protein, 19 aa, Mycobacterium
WTIFDATTGDVVWDAGNTF

SEQ ID NO: 938263 - protein, 25 aa, Mycobacterium
WTLARADIRGPYVINADGAPLDDRF

SEQ ID NO: 938264 - protein, 20 aa, Mycobacterium
WTLQSFPSAIAYASKTDSPN

SEQ ID NO: 938265 - protein, 21 aa, Mycobacterium
WTNDAKNILSYIRGSNTDAAA

SEQ ID NO: 938266 - protein, 18 aa, Mycobacterium
WTPPEPPEGAAPAAPGTP

SEQ ID NO: 938267 - protein, 19 aa, Mycobacterium
WTPVPDPNVPDAFLVIADR

SEQ ID NO: 938268 - protein, 17 aa, Mycobacterium
WTQASQLGRDWCAQGAQ

SEQ ID NO: 938269 - protein, 17 aa, Mycobacterium
WTRVGRRTAVLAAVALV

SEQ ID NO: 938270 - protein, 24 aa, Mycobacterium
WTSSSRKAMLPVFESANALLYYPV

SEQ ID NO: 938271 - protein, 24 aa, Mycobacterium
WTSSSRKAMLPVFESANSLLYYPV

SEQ ID NO: 938272 - protein, 19 aa, Mycobacterium
WTTFFRAGPAFVVSPKDFG

SEQ ID NO: 938273 - protein, 27 aa, Mycobacterium
WTTYDSWHYTNALGMYAAGTFHAVDPD

SEQ ID NO: 938274 - protein, 18 aa, Mycobacterium
WVANKFPSGMTKNFTSNV

SEQ ID NO: 938275 - protein, 17 aa, Mycobacterium
WVARKRPGSKAAAAAEA

SEQ ID NO: 938276 - protein, 17 aa, Mycobacterium
WVDAAFKKRGIDPENFW

SEQ ID NO: 938277 - protein, 26 aa, Mycobacterium
WVDAGVMWQGYVSDYGRTWIVGAGPN

SEQ ID NO: 938278 - protein, 33 aa, Mycobacterium
WVEHFDFQWDCYLGEGVAKVWAPARSWAFYTPQ

SEQ ID NO: 938279 - protein, 17 aa, Mycobacterium
WVLPRLDRTLGRLERAL

SEQ ID NO: 938280 - protein, 17 aa, Mycobacterium
WVLPVAWTPTHDLPPLE

SEQ ID NO: 938281 - protein, 17 aa, Mycobacterium
WVLPVSWAPTHGVPPLE

SEQ ID NO: 938282 - protein, 32 aa, Mycobacterium
WVLQRAVNRLAGWPGPAGQNFVDITNRVTDQT

SEQ ID NO: 938283 - protein, 23 aa, Mycobacterium
WVMPDLKGKVLFAAKQEVEADVE

SEQ ID NO: 938284 - protein, 18 aa, Mycobacterium
WVNARRVTFKYGLGAEFI

SEQ ID NO: 938285 - protein, 24 aa, Mycobacterium
WVNDYGGFMSIGFDTSKVPPVTSV

SEQ ID NO: 938286 - protein, 17 aa, Mycobacterium
WVNLPKRDKLAPPRYQA

SEQ ID NO: 938287 - protein, 19 aa, Mycobacterium
WVPIVVVIAVAIGGTAVDR

SEQ ID NO: 938288 - protein, 19 aa, Mycobacterium
WVPLVVVAAVALGGIAIDR

SEQ ID NO: 938289 - protein, 17 aa, Mycobacterium
WVRGPSLTAGYWNRPTQ

SEQ ID NO: 938290 - protein, 22 aa, Mycobacterium
WVSELHGPLNMEALRRALADVV

SEQ ID NO: 938291 - protein, 30 aa, Mycobacterium
WVVPNWPPGVLRPDLASTFLVNQAIGHVAA

SEQ ID NO: 938292 - protein, 19 aa, Mycobacterium
WWDRPFKVTSVEIGAGQAT

SEQ ID NO: 938293 - protein, 18 aa, Mycobacterium
WWDSHSHLSPVITVINLE

SEQ ID NO: 938294 - protein, 17 aa, Mycobacterium
WWESPRTRRSSRFASPP

SEQ ID NO: 938295 - protein, 17 aa, Mycobacterium
WWFHFALSGVISPLDKL

SEQ ID NO: 938296 - protein, 18 aa, Mycobacterium
WWMRCIDEPDLSALDHYS

SEQ ID NO: 938297 - protein, 17 aa, Mycobacterium
WWPDRTLSRRGVEVVSR

SEQ ID NO: 938298 - protein, 18 aa, Mycobacterium
WYAAPLLVAGGRGLIAFT

SEQ ID NO: 938299 - protein, 24 aa, Mycobacterium
WYFPTTPPLGLVWLQHGFVEGKKV

SEQ ID NO: 938300 - protein, 18 aa, Mycobacterium
WYFRDLGEVLLWRQSNKL

SEQ ID NO: 938301 - protein, 18 aa, Mycobacterium
WYGNGSWPSATTVHAKAN

SEQ ID NO: 938302 - protein, 24 aa, Mycobacterium
WYLGKDGLPELFPWTPERHRELLR

SEQ ID NO: 938303 - protein, 18 aa, Mycobacterium
WYLTSIQAGFEPWNGGIG

SEQ ID NO: 938304 - protein, 21 aa, Mycobacterium
WYPAAHARRRCCSLIECRQRR

SEQ ID NO: 938305 - protein, 18 aa, Mycobacterium
WYPALACDNVDVETQAIT

SEQ ID NO: 938306 - protein, 21 aa, Mycobacterium
WYQGWSFPSFEAGAQALRTLV

SEQ ID NO: 938307 - protein, 20 aa, Mycobacterium
WYRDNEAWWRPLKDAAEARY

SEQ ID NO: 938308 - protein, 17 aa, Mycobacterium
WYRGAARISDLVDQIRR

SEQ ID NO: 938309 - protein, 18 aa, Mycobacterium
WYRGAARISDLVEQIRRS

SEQ ID NO: 938310 - protein, 20 aa, Mycobacterium
WYRGAARISDLVEQIRRSGM

SEQ ID NO: 938311 - protein, 18 aa, Mycobacterium
WYRGSPIGREREGEERTR

SEQ ID NO: 938312 - protein, 17 aa, Mycobacterium
WYRPAVGNGGTWTYKWE

SEQ ID NO: 938313 - protein, 20 aa, Mycobacterium
WYRRNEEWWRPIKDNVESQY

SEQ ID NO: 938314 - protein, 20 aa, Mycobacterium
WYRTHEDWWTPAKEATEAFY

SEQ ID NO: 938315 - protein, 18 aa, Mycobacterium
WYYQSGISVAMPVGGQSS

SEQ ID NO: 938316 - protein, 19 aa, Mycobacterium
WYYQSGLSIIMPVGGQSSF

SEQ ID NO: 938317 - protein, 23 aa, Mycobacterium
YAAALKYAIPVMLEGGGGAIVNM

SEQ ID NO: 938318 - protein, 21 aa, Mycobacterium
YAALGYLKYPAAVTVAKVSDP

SEQ ID NO: 938319 - protein, 19 aa, Mycobacterium
YAALVEGPRNPDAIVTLAN

SEQ ID NO: 938320 - protein, 19 aa, Mycobacterium
YAAPFLICATGCLSAVNRP

SEQ ID NO: 938321 - protein, 22 aa, Mycobacterium
YAARAPRPGHRRIVFRFMTSPI

SEQ ID NO: 938322 - protein, 18 aa, Mycobacterium
YAATLAWGDIDPSVTPTP

SEQ ID NO: 938323 - protein, 25 aa, Mycobacterium
YAATRLDVHPDIKIVAAIPEEQSST

SEQ ID NO: 938324 - protein, 23 aa, Mycobacterium
YAATRPDKVARLILDSPVALGVN

SEQ ID NO: 938325 - protein, 18 aa, Mycobacterium
YAAVKLALDKNVVLPANA

SEQ ID NO: 938326 - protein, 18 aa, Mycobacterium
YAAVKLALDKQVVLPCNS

SEQ ID NO: 938327 - protein, 27 aa, Mycobacterium
YAAYEVDPRLDAVVALTRSGAVMQIPL

SEQ ID NO: 938328 - protein, 18 aa, Mycobacterium
YADLTERHEIAWLEPIPD

SEQ ID NO: 938329 - protein, 17 aa, Mycobacterium
YADPDLASFRGATTQDS

SEQ ID NO: 938330 - protein, 19 aa, Mycobacterium
YADPLRVAGMPAVDGPSGM

SEQ ID NO: 938331 - protein, 32 aa, Mycobacterium
YAEDTGTVGYRFSWQLPKNRTWTYDGQLKMAR

SEQ ID NO: 938332 - protein, 21 aa, Mycobacterium
YAFRHLQFWFNDDITHLAQLE

SEQ ID NO: 938333 - protein, 17 aa, Mycobacterium
YALAVQHERGLAMQSPW

SEQ ID NO: 938334 - protein, 17 aa, Mycobacterium
YALAVQHERGLPMQSPW

SEQ ID NO: 938335 - protein, 23 aa, Mycobacterium
YALLAVSGLVIAAVTLAGHHQSG

SEQ ID NO: 938336 - protein, 25 aa, Mycobacterium
YANAAAKGYFPLNFTVADIDQNGPV

SEQ ID NO: 938337 - protein, 19 aa, Mycobacterium
YANALVRGIAGFLAAQSQA

SEQ ID NO: 938338 - protein, 18 aa, Mycobacterium
YANGRIDAIISTLAVTTD

SEQ ID NO: 938339 - protein, 17 aa, Mycobacterium
YAPKLVHRTRGAARSLI

SEQ ID NO: 938340 - protein, 20 aa, Mycobacterium
YAPNEIKNLPGYDGEGSEGT

SEQ ID NO: 938341 - protein, 26 aa, Mycobacterium
YAQLSGLRLGRVLSISEATGNPPPVG

SEQ ID NO: 938342 - protein, 18 aa, Mycobacterium
YAQRRLWFIDQLEGPSPI

SEQ ID NO: 938343 - protein, 30 aa, Mycobacterium
YATDGRGAAAFALACERAGVPVQRYEHRAD

SEQ ID NO: 938344 - protein, 18 aa, Mycobacterium
YAVAYPATFDFLAAAGGA

SEQ ID NO: 938345 - protein, 17 aa, Mycobacterium
YAVDHGRALTASTTTHK

SEQ ID NO: 938346 - protein, 17 aa, Mycobacterium
YAVGCVDLHPGAAENTV

SEQ ID NO: 938347 - protein, 19 aa, Mycobacterium
YAVPEPGFREIIPAFNATE

SEQ ID NO: 938348 - protein, 18 aa, Mycobacterium
YAYEVEFLTGLTGIQTCP

SEQ ID NO: 938349 - protein, 24 aa, Mycobacterium
YAYGLRNPFRMTFTPTGELLVADV

SEQ ID NO: 938350 - protein, 25 aa, Mycobacterium
YDAFSRAGIPTGGIFSGAEDKMSDE

SEQ ID NO: 938351 - protein, 17 aa, Mycobacterium
YDAIHAWDTTSAVEGGP

SEQ ID NO: 938352 - protein, 25 aa, Mycobacterium
YDAQCLAGAIGRDIADPYALYEEAC

SEQ ID NO: 938353 - protein, 18 aa, Mycobacterium
YDASRLASRGDIVVVTVN

SEQ ID NO: 938354 - protein, 18 aa, Mycobacterium
YDDRVLVVPLELTDAAQV

SEQ ID NO: 938355 - protein, 25 aa, Mycobacterium
YDELGIRIVQAWGMTETSPLAAVAL

SEQ ID NO: 938356 - protein, 25 aa, Mycobacterium
YDELGIRIVQAWGMTETSPLASVAL

SEQ ID NO: 938357 - protein, 18 aa, Mycobacterium
YDGTKHTIVFDGNQCVDK

SEQ ID NO: 938358 - protein, 28 aa, Mycobacterium
YDGYLIPLFTPWEFKGGSSVLHVDDLTF

SEQ ID NO: 938359 - protein, 25 aa, Mycobacterium
YDIPPRSVVPIDFHIIRELAAHPNI

SEQ ID NO: 938360 - protein, 24 aa, Mycobacterium
YDKLARLPAGLIVFGDSICSFNPI

SEQ ID NO: 938361 - protein, 30 aa, Mycobacterium
YDKLPARGAVALVDRGSCEFAQKEDVAAQQ

SEQ ID NO: 938362 - protein, 20 aa, Mycobacterium
YDLPPGMTVNGAIARAWEAM

SEQ ID NO: 938363 - protein, 19 aa, Mycobacterium
YDLTARTAVKIMEDDAITG

SEQ ID NO: 938364 - protein, 18 aa, Mycobacterium
YDLTARTAVKIMEDTDIT

SEQ ID NO: 938365 - protein, 17 aa, Mycobacterium
YDPAMRTLIAFGGKYPT

SEQ ID NO: 938366 - protein, 18 aa, Mycobacterium
YDPAMRTLIAFGGKYPTT

SEQ ID NO: 938367 - protein, 18 aa, Mycobacterium
YDPLVPWTQASQLGRDWC

SEQ ID NO: 938368 - protein, 18 aa, Mycobacterium
YDPRDFVLVVCGGAGALH

SEQ ID NO: 938369 - protein, 23 aa, Mycobacterium
YDPRRAAALLDEAGWKVGGDGIR

SEQ ID NO: 938370 - protein, 25 aa, Mycobacterium
YDPRRIDTELGWARFYGHNTARVFL

SEQ ID NO: 938371 - protein, 25 aa, Mycobacterium
YDRIRRFPLGLLVTGDAICSFNPAY

SEQ ID NO: 938372 - protein, 17 aa, Mycobacterium
YDRSGGYSPTLIASIPA

SEQ ID NO: 938373 - protein, 18 aa, Mycobacterium
YDTTYSWSGAAVGHDGKA

SEQ ID NO: 938374 - protein, 25 aa, Mycobacterium
YDVEHIKYPASVFGMDRGIWEAAGA

SEQ ID NO: 938375 - protein, 17 aa, Mycobacterium
YDVKTGIALGPTGDTFV

SEQ ID NO: 938376 - protein, 17 aa, Mycobacterium
YDYRRAAFGAAWDDNND

SEQ ID NO: 938377 - protein, 20 aa, Mycobacterium
YDYRRAAFGDAWDDNNDAPG

SEQ ID NO: 938378 - protein, 18 aa, Mycobacterium
YDYRRAAFGDAWTDDNDA

SEQ ID NO: 938379 - protein, 20 aa, Mycobacterium
YDYTYRKAPETVYDTVEVTG

SEQ ID NO: 938380 - protein, 20 aa, Mycobacterium
YEAVGGLGPELRRLVNGSSQ

SEQ ID NO: 938381 - protein, 22 aa, Mycobacterium
YEDADFAEAVFAKNGDPDPVDS

SEQ ID NO: 938382 - protein, 17 aa, Mycobacterium
YEDKFGYVYLVCATGRS

SEQ ID NO: 938383 - protein, 18 aa, Mycobacterium
YEEAFAIEGQNEFAVQVR

SEQ ID NO: 938384 - protein, 20 aa, Mycobacterium
YEEARTWALEHPAELTTLLA

SEQ ID NO: 938385 - protein, 22 aa, Mycobacterium
YEGEGFPVVRAFAGVSTAALDP

SEQ ID NO: 938386 - protein, 24 aa, Mycobacterium
YEGNVVAVLGMPVGEVKKIRNRNG

SEQ ID NO: 938387 - protein, 24 aa, Mycobacterium
YEGNVVAVLGMPVGQVTKIRPKGG

SEQ ID NO: 938388 - protein, 22 aa, Mycobacterium
YEGRLRRAACMMMLGQLTADAG

SEQ ID NO: 938389 - protein, 19 aa, Mycobacterium
YEKGLRDVVKYHVSMTSSF

SEQ ID NO: 938390 - protein, 25 aa, Mycobacterium
YEKRVAESLAAWTQRNQEWVDSLDV

SEQ ID NO: 938391 - protein, 25 aa, Mycobacterium
YELDPASLLRYPAITDVTAEPTQMF

SEQ ID NO: 938392 - protein, 17 aa, Mycobacterium
YEPAGFTTTLGRKDVGL

SEQ ID NO: 938393 - protein, 19 aa, Mycobacterium
YEPGMPVWSMDGGAVEAHI

SEQ ID NO: 938394 - protein, 18 aa, Mycobacterium
YEQMWALDVAAMAAYHAE

SEQ ID NO: 938395 - protein, 23 aa, Mycobacterium
YESFPRSDIVTVVIGAERWREQL

SEQ ID NO: 938396 - protein, 20 aa, Mycobacterium
YESPCTVNSFVSLAKQQFFD

SEQ ID NO: 938397 - protein, 18 aa, Mycobacterium
YETPQWAENGWLVDLSDY

SEQ ID NO: 938398 - protein, 25 aa, Mycobacterium
YEVIGRPRFGGEVTVDADGNFVYRP

SEQ ID NO: 938399 - protein, 33 aa, Mycobacterium
YEYYKKASSGWFGGSPARWVGSPSSASAIIGKS

SEQ ID NO: 938400 - protein, 21 aa, Mycobacterium
YFAPGEMLPAFGGPAQAQVPR

SEQ ID NO: 938401 - protein, 22 aa, Mycobacterium
YFAQGELLPSFAGATQAQVPRN

SEQ ID NO: 938402 - protein, 20 aa, Mycobacterium
YFAQGELLPSYAGATQVQVP

SEQ ID NO: 938403 - protein, 19 aa, Mycobacterium
YFDAGYRLLELDAENDAAW

SEQ ID NO: 938404 - protein, 24 aa, Mycobacterium
YFDLGEAWNSLSPTERLAANQHVL

SEQ ID NO: 938405 - protein, 17 aa, Mycobacterium
YFFWPRSDAHLYAELKR

SEQ ID NO: 938406 - protein, 23 aa, Mycobacterium
YFGEGITVVGDRIWQLTYRDEKA

SEQ ID NO: 938407 - protein, 18 aa, Mycobacterium
YFGPRLKNPLNYVTNPSH

SEQ ID NO: 938408 - protein, 24 aa, Mycobacterium
YFIRMWTQAALAMDVYQAETLANT

SEQ ID NO: 938409 - protein, 23 aa, Mycobacterium
YFKAPWRRFVPDLLDGDGVQVKN

SEQ ID NO: 938410 - protein, 23 aa, Mycobacterium
YFTGAAIQAYCPQYGSLTPPSLP

SEQ ID NO: 938411 - protein, 19 aa, Mycobacterium
YGAAHGFSVTAMTAGDRVR

SEQ ID NO: 938412 - protein, 19 aa, Mycobacterium
YGADYEWSGSVVGEDGKAV

SEQ ID NO: 938413 - protein, 18 aa, Mycobacterium
YGAIAYSSNGSWGRSWAY

SEQ ID NO: 938414 - protein, 18 aa, Mycobacterium
YGDELAYHITVGDLQVVY

SEQ ID NO: 938415 - protein, 24 aa, Mycobacterium
YGDKVKAVITFASPLVRKADEYGY

SEQ ID NO: 938416 - protein, 26 aa, Mycobacterium
YGEENFEVFRHANLLSAVFHEDYHAD

SEQ ID NO: 938417 - protein, 22 aa, Mycobacterium
YGEENFEVFRHGNLLSAVFHED

SEQ ID NO: 938418 - protein, 17 aa, Mycobacterium
YGEGAWQAGDDIFYPPP

SEQ ID NO: 938419 - protein, 20 aa, Mycobacterium
YGGLQFKPGTWQRYGGVGNP

SEQ ID NO: 938420 - protein, 18 aa, Mycobacterium
YGGLQFKPSTWAAHGGVG

SEQ ID NO: 938421 - protein, 25 aa, Mycobacterium
YGHAVSRLSGLSGRDTPTLVAEQQA

SEQ ID NO: 938422 - protein, 25 aa, Mycobacterium
YGISFQRFGPEAAMYYHGGEMPGFN

SEQ ID NO: 938423 - protein, 23 aa, Mycobacterium
YGLPSNKRPGVFTTTTTTKTMYV

SEQ ID NO: 938424 - protein, 32 aa, Mycobacterium
YGNLPMRGAVVLVDRGTCPFAQKEDVAAQRGA

SEQ ID NO: 938425 - protein, 25 aa, Mycobacterium
YGNYFTFYLCDLLLKVNGKGGQPVY

SEQ ID NO: 938426 - protein, 17 aa, Mycobacterium
YGPDFGLTYILDGLSAM

SEQ ID NO: 938427 - protein, 17 aa, Mycobacterium
YGPDGTQSVAMYLGNNQ

SEQ ID NO: 938428 - protein, 17 aa, Mycobacterium
YGPMIHTTCSYDQAMRA

SEQ ID NO: 938429 - protein, 25 aa, Mycobacterium
YGQLEIPTLPPGVRYTQAAIGSVRS

SEQ ID NO: 938430 - protein, 17 aa, Mycobacterium
YGQMWAQDAAAMYGYAA

SEQ ID NO: 938431 - protein, 18 aa, Mycobacterium
YGQSGMVGAGGDAGSGGD

SEQ ID NO: 938432 - protein, 22 aa, Mycobacterium
YGRIPGLPPLAADWYRGDGPMG

SEQ ID NO: 938433 - protein, 28 aa, Mycobacterium
YGSSIYAEYRLSGSVRKVAGLKSDPFVA

SEQ ID NO: 938434 - protein, 18 aa, Mycobacterium
YGSTRFRSGDTFHNGQQA

SEQ ID NO: 938435 - protein, 17 aa, Mycobacterium
YGTAHGFTVTEMSVGAG

SEQ ID NO: 938436 - protein, 19 aa, Mycobacterium
YGTRIGASYAEQFPQNVRA

SEQ ID NO: 938437 - protein, 19 aa, Mycobacterium
YGTRIGATYAEQFPDKVRA

SEQ ID NO: 938438 - protein, 22 aa, Mycobacterium
YGTRIGTTYAEEFPQNVRALIL

SEQ ID NO: 938439 - protein, 25 aa, Mycobacterium
YGVDPLILRQAYPVPQAPYGLAGSR

SEQ ID NO: 938440 - protein, 17 aa, Mycobacterium
YGVGLVDGALGWVPGLA

SEQ ID NO: 938441 - protein, 19 aa, Mycobacterium
YHAGYFVGVSIKAYCPKYA

SEQ ID NO: 938442 - protein, 27 aa, Mycobacterium
YHGGLQFSPSTWRAHGGTEFAPAAYMA

SEQ ID NO: 938443 - protein, 17 aa, Mycobacterium
YHLTALFSNILNLPNNA

SEQ ID NO: 938444 - protein, 19 aa, Mycobacterium
YHLYGASGIRYYKGPTSPP

SEQ ID NO: 938445 - protein, 21 aa, Mycobacterium
YHPALSCGLGSLTVMANNPPL

SEQ ID NO: 938446 - protein, 21 aa, Mycobacterium
YHSAIRFGIEHGKRNMVQPDY

SEQ ID NO: 938447 - protein, 18 aa, Mycobacterium
YHSVAGIASELSWMAALR

SEQ ID NO: 938448 - protein, 17 aa, Mycobacterium
YHTPRPRPNIMLAAGNR

SEQ ID NO: 938449 - protein, 22 aa, Mycobacterium
YHVARAALRHGVQRVVHVSSTA

SEQ ID NO: 938450 - protein, 21 aa, Mycobacterium
YHVGGIMVGSWTDLSMLTDGS

SEQ ID NO: 938451 - protein, 18 aa, Mycobacterium
YHVVPGQLGPDMVAGSHK

SEQ ID NO: 938452 - protein, 17 aa, Mycobacterium
YHWCPGQPFDPAWGPQW

SEQ ID NO: 938453 - protein, 24 aa, Mycobacterium
YICDLNITGFFPGLNDVVPIIVNA

SEQ ID NO: 938454 - protein, 21 aa, Mycobacterium
YIPANGMRRISFVPGPAGFRF

SEQ ID NO: 938455 - protein, 21 aa, Mycobacterium
YIPNSSNWVRPRSPASGRSTT

SEQ ID NO: 938456 - protein, 18 aa, Mycobacterium
YIPPDVLAQFAGFGVKGI

SEQ ID NO: 938457 - protein, 24 aa, Mycobacterium
YIQPGTEVDLIFVAANTSADVADK

SEQ ID NO: 938458 - protein, 23 aa, Mycobacterium
YISKLPGYWPTVVQQKLQTGRDV

SEQ ID NO: 938459 - protein, 19 aa, Mycobacterium
YITARFLPDKAIDLVDEAA

SEQ ID NO: 938460 - protein, 19 aa, Mycobacterium
YITARFLPDKAIDLVDESA

SEQ ID NO: 938461 - protein, 26 aa, Mycobacterium
YIVDMARKYFNPQAIVIGHLNHPPVT

SEQ ID NO: 938462 - protein, 25 aa, Mycobacterium
YIYNNFPAVAPATVDARGVKIAANA

SEQ ID NO: 938463 - protein, 21 aa, Mycobacterium
YKAQAFEALNCLRSRENQKAT

SEQ ID NO: 938464 - protein, 21 aa, Mycobacterium
YKAWYPLTHRWLGFEDAHITF

SEQ ID NO: 938465 - protein, 19 aa, Mycobacterium
YKEADFAKIIPSIQGGTFD

SEQ ID NO: 938466 - protein, 30 aa, Mycobacterium
YKLINAFFSPRCNLIAWDRGVLIPTGKVYF

SEQ ID NO: 938467 - protein, 25 aa, Mycobacterium
YKPACGKAGCTTYKWETFLTSELPA

SEQ ID NO: 938468 - protein, 26 aa, Mycobacterium
YKPACGKAGCVTYKWETFLTSELPEY

SEQ ID NO: 938469 - protein, 27 aa, Mycobacterium
YKPAGLPRAAPLVVMLHGGFGSARQAE

SEQ ID NO: 938470 - protein, 20 aa, Mycobacterium
YKQYVLRFGLGYTEEPKAEV

SEQ ID NO: 938471 - protein, 20 aa, Mycobacterium
YKSNAQLLWYRKSAAAAAGV

SEQ ID NO: 938472 - protein, 22 aa, Mycobacterium
YKTNLWTWTWAMNANSRNKLPA

SEQ ID NO: 938473 - protein, 28 aa, Mycobacterium
YKWETFLTTELPQWLGVNKGISPAANAV

SEQ ID NO: 938474 - protein, 17 aa, Mycobacterium
YLAANGFANDRDRAIYG

SEQ ID NO: 938475 - protein, 19 aa, Mycobacterium
YLAPGFHGVHIHKVGKCEA

SEQ ID NO: 938476 - protein, 18 aa, Mycobacterium
YLEDELRDATAYSSALAT

SEQ ID NO: 938477 - protein, 17 aa, Mycobacterium
YLGAPWKTQRTVNRVRG

SEQ ID NO: 938478 - protein, 17 aa, Mycobacterium
YLGRYMVVVTVSPIAVG

SEQ ID NO: 938479 - protein, 25 aa, Mycobacterium
YLIPEKHLPLVIPLGYLGVPEDELN

SEQ ID NO: 938480 - protein, 21 aa, Mycobacterium
YLKQYVVLYCNGANDVVMRTA

SEQ ID NO: 938481 - protein, 19 aa, Mycobacterium
YLLAFGRVKEDLRRSQTER

SEQ ID NO: 938482 - protein, 18 aa, Mycobacterium
YLLYLDFKVDDTVHTASF

SEQ ID NO: 938483 - protein, 18 aa, Mycobacterium
YLNREHNSLWGILSNGHR

SEQ ID NO: 938484 - protein, 18 aa, Mycobacterium
YLNRINVKYIQHLFPGAI

SEQ ID NO: 938485 - protein, 26 aa, Mycobacterium
YLPGLPPRSRTVFYLPSALVSNGVIA

SEQ ID NO: 938486 - protein, 25 aa, Mycobacterium
YLPLAGRSMLAWSLDTLTRLPDVAR

SEQ ID NO: 938487 - protein, 19 aa, Mycobacterium
YLPRLELLGKREVTVCHGL

SEQ ID NO: 938488 - protein, 25 aa, Mycobacterium
YLQKMATVLGRRVWANAGSPEVDAR

SEQ ID NO: 938489 - protein, 20 aa, Mycobacterium
YLRHLGPYVAIWDIPTEMIA

SEQ ID NO: 938490 - protein, 23 aa, Mycobacterium
YLSADNGWWAQWFTLPADAGPIV

SEQ ID NO: 938491 - protein, 18 aa, Mycobacterium
YLSCASPAAAQRAATVLD

SEQ ID NO: 938492 - protein, 24 aa, Mycobacterium
YLSEARAPLYTDLQALQCPLKELG

SEQ ID NO: 938493 - protein, 28 aa, Mycobacterium
YLSPALRVFNPLLLFNWNYLPIPINPIL

SEQ ID NO: 938494 - protein, 17 aa, Mycobacterium
YLSRAGISKEQLARGGY

SEQ ID NO: 938495 - protein, 17 aa, Mycobacterium
YLSRAGISKEQVARGGY

SEQ ID NO: 938496 - protein, 25 aa, Mycobacterium
YLTLERARFGTALKVTLRVAPEVLN

SEQ ID NO: 938497 - protein, 17 aa, Mycobacterium
YLVLLALWEEDRATVSR

SEQ ID NO: 938498 - protein, 20 aa, Mycobacterium
YLVLRGGIRMEEGFTDWCDE

SEQ ID NO: 938499 - protein, 25 aa, Mycobacterium
YLVPFAVDHFSVFRSTLPSGTPVVS

SEQ ID NO: 938500 - protein, 17 aa, Mycobacterium
YLVQLTITGLANEAVAQ

SEQ ID NO: 938501 - protein, 31 aa, Mycobacterium
YLVSRRYGISVLRVIPTAGLGRTTLLPLGTD

SEQ ID NO: 938502 - protein, 19 aa, Mycobacterium
YLVYEVFGPPGTVATISYF

SEQ ID NO: 938503 - protein, 17 aa, Mycobacterium
YLWLVPQNVAGLVAALG

SEQ ID NO: 938504 - protein, 17 aa, Mycobacterium
YLYKARAKSRLEYAGPD

SEQ ID NO: 938505 - protein, 24 aa, Mycobacterium
YLYRGKLPEGWTWDSTATDVGAVF

SEQ ID NO: 938506 - protein, 20 aa, Mycobacterium
YLYTQRRFEVSADEIADTMK

SEQ ID NO: 938507 - protein, 18 aa, Mycobacterium
YMGIPDLLIEAPTAETED

SEQ ID NO: 938508 - protein, 24 aa, Mycobacterium
YMSIKSWDSAGEWTTNYSATAVSN

SEQ ID NO: 938509 - protein, 27 aa, Mycobacterium
YMVVRLIRMMVEFWDRVSINEQERMFG

SEQ ID NO: 938510 - protein, 19 aa, Mycobacterium
YNAGFRPFSHGGFDDLSYD

SEQ ID NO: 938511 - protein, 27 aa, Mycobacterium
YNARAAGQTGFVWKFLDSVQTVDDHTL

SEQ ID NO: 938512 - protein, 17 aa, Mycobacterium
YNAVAVITPAQFNSGEP

SEQ ID NO: 938513 - protein, 19 aa, Mycobacterium
YNFQFTGQRFFKITDGRLD

SEQ ID NO: 938514 - protein, 23 aa, Mycobacterium
YNHIKIKEAYGLTKQYVAQELID

SEQ ID NO: 938515 - protein, 24 aa, Mycobacterium
YNHIKIKEAYGLTKQYVAQQLANQ

SEQ ID NO: 938516 - protein, 17 aa, Mycobacterium
YNHRRIQPGDAWAAQLL

SEQ ID NO: 938517 - protein, 17 aa, Mycobacterium
YNLFKGRTGNLTQVLPK

SEQ ID NO: 938518 - protein, 26 aa, Mycobacterium
YNNSIAYARNVLGWAAAYATGVVPVD

SEQ ID NO: 938519 - protein, 26 aa, Mycobacterium
YNPDYLPGTLLPPGIRATPEAEEALS

SEQ ID NO: 938520 - protein, 20 aa, Mycobacterium
YNPMLTCLFVGAKTTLDTGY

SEQ ID NO: 938521 - protein, 26 aa, Mycobacterium
YNRAAADGKFPLTFTVNNVDQQGPVA

SEQ ID NO: 938522 - protein, 27 aa, Mycobacterium
YNRRADIAVLQLRGAGGLPTASIGDSR

SEQ ID NO: 938523 - protein, 26 aa, Mycobacterium
YNRRSRFPHRWWWVALTDEAFPRLAV

SEQ ID NO: 938524 - protein, 25 aa, Mycobacterium
YNTYLKKYLVMYGDKSGDVLLSTSP

SEQ ID NO: 938525 - protein, 18 aa, Mycobacterium
YNVNLFLSGLEQALNGDP

SEQ ID NO: 938526 - protein, 17 aa, Mycobacterium
YPAAFPVGVLPTNSSET

SEQ ID NO: 938527 - protein, 19 aa, Mycobacterium
YPAAMPKGAIAVVDDTRCS

SEQ ID NO: 938528 - protein, 18 aa, Mycobacterium
YPAAVSWQAASDQLRQDL

SEQ ID NO: 938529 - protein, 26 aa, Mycobacterium
YPALQRPNCKLIDWPIATLSPVGIRT

SEQ ID NO: 938530 - protein, 23 aa, Mycobacterium
YPALWQVASPYGIPAATIAQGHT

SEQ ID NO: 938531 - protein, 18 aa, Mycobacterium
YPASRLQLHGGDGANDVI

SEQ ID NO: 938532 - protein, 17 aa, Mycobacterium
YPDMKTHVQGHVQHHGE

SEQ ID NO: 938533 - protein, 19 aa, Mycobacterium
YPDRPATGSGTNWLLVGSD

SEQ ID NO: 938534 - protein, 23 aa, Mycobacterium
YPDRSGGVLPGYGGAKAALEHLT

SEQ ID NO: 938535 - protein, 24 aa, Mycobacterium
YPDSQVCPVFARYGYSAVDASPFA

SEQ ID NO: 938536 - protein, 30 aa, Mycobacterium
YPEDGAPRAWAWRTADGVRREGTVVGEGRI

SEQ ID NO: 938537 - protein, 17 aa, Mycobacterium
YPEPFLYTYCRDDDPAI

SEQ ID NO: 938538 - protein, 25 aa, Mycobacterium
YPFTVDRWTPDKVYSGAYKAWAVTP

SEQ ID NO: 938539 - protein, 25 aa, Mycobacterium
YPFVVDRWTPDKVYSGAYKAWAMTP

SEQ ID NO: 938540 - protein, 18 aa, Mycobacterium
YPGCACDVPTSLYSFSFA

SEQ ID NO: 938541 - protein, 20 aa, Mycobacterium
YPGCDAVALDAYVAAGARAI

SEQ ID NO: 938542 - protein, 26 aa, Mycobacterium
YPGGPYHLLGWSFGGIVVHELAVELR

SEQ ID NO: 938543 - protein, 43 aa, Mycobacterium
YPGGRVAGRPVPAGWYSEPWWKPALVAGAWGLGSVLLFDALFS

SEQ ID NO: 938544 - protein, 23 aa, Mycobacterium
YPGMPAKPGPAVADFTSGLYAAM

SEQ ID NO: 938545 - protein, 22 aa, Mycobacterium
YPHFRHPIPPPGRGAVTLLGDA

SEQ ID NO: 938546 - protein, 21 aa, Mycobacterium
YPHQPRPALGPVADEATGRRV

SEQ ID NO: 938547 - protein, 19 aa, Mycobacterium
YPILGDPSLGYGPGTSSLG

SEQ ID NO: 938548 - protein, 26 aa, Mycobacterium
YPKSPGNTWIPLVYPAAARQSSITQG

SEQ ID NO: 938549 - protein, 17 aa, Mycobacterium
YPLAAGLYEGVYGSLTP

SEQ ID NO: 938550 - protein, 17 aa, Mycobacterium
YPLNLVSTLNALAGAYY

SEQ ID NO: 938551 - protein, 18 aa, Mycobacterium
YPLVVHYGPMGWAYNSQT

SEQ ID NO: 938552 - protein, 22 aa, Mycobacterium
YPNVRLRVFTAFAGQLRSWLYD

SEQ ID NO: 938553 - protein, 20 aa, Mycobacterium
YPQRRAVAAIDALARAAHMK

SEQ ID NO: 938554 - protein, 17 aa, Mycobacterium
YPRDLPKVAAKSGGRDY

SEQ ID NO: 938555 - protein, 26 aa, Mycobacterium
YPSDARCLVHQSMAPGLAAAATALRP

SEQ ID NO: 938556 - protein, 23 aa, Mycobacterium
YPSMIEFLAPLFATGAGSNDVGY

SEQ ID NO: 938557 - protein, 21 aa, Mycobacterium
YPSMIEFLAPLYATGAGSNDV

SEQ ID NO: 938558 - protein, 25 aa, Mycobacterium
YPSMVELFGDFAFYMSTLVKDLPQP

SEQ ID NO: 938559 - protein, 36 aa, Mycobacterium
YPTKAFKTGWATLLGLDLLEAGARINSQIYPAIILG

SEQ ID NO: 938560 - protein, 17 aa, Mycobacterium
YPTVPKVWFHDLLYPDG

SEQ ID NO: 938561 - protein, 20 aa, Mycobacterium
YPVANSVVLDLVAPVVNAPL

SEQ ID NO: 938562 - protein, 18 aa, Mycobacterium
YPVRARLRLTGEHIPAPW

SEQ ID NO: 938563 - protein, 17 aa, Mycobacterium
YQAAMRNLLKSLIVVKA

SEQ ID NO: 938564 - protein, 17 aa, Mycobacterium
YQFLPQFGALLNENPSL

SEQ ID NO: 938565 - protein, 21 aa, Mycobacterium
YQGGLQFSPSTWINSGGGQYA

SEQ ID NO: 938566 - protein, 25 aa, Mycobacterium
YQGLTELSVRPGAPVLNEALALSLT

SEQ ID NO: 938567 - protein, 23 aa, Mycobacterium
YQGTVTCRGYGGHGFVLAANYGV

SEQ ID NO: 938568 - protein, 27 aa, Mycobacterium
YQINYLRCIGCGLCIEACPTRALTMTT

SEQ ID NO: 938569 - protein, 22 aa, Mycobacterium
YQMAVETFVWRTYEESLPPDAV

SEQ ID NO: 938570 - protein, 19 aa, Mycobacterium
YQMLYGIRDEEQWRLVGAG

SEQ ID NO: 938571 - protein, 20 aa, Mycobacterium
YQPFHVARTFASLDHLSGGR

SEQ ID NO: 938572 - protein, 17 aa, Mycobacterium
YQQATDVVIARGLSQRG

SEQ ID NO: 938573 - protein, 23 aa, Mycobacterium
YQSQRWKAVHTIENWQRCPDGST

SEQ ID NO: 938574 - protein, 24 aa, Mycobacterium
YQTACKPGMIGDGIRGDFTVTGDE

SEQ ID NO: 938575 - protein, 24 aa, Mycobacterium
YQTACKPGMIGDGIRGDLTITGAA

SEQ ID NO: 938576 - protein, 24 aa, Mycobacterium
YQTPNARLAAIVGAIAKACAPAGI

SEQ ID NO: 938577 - protein, 33 aa, Mycobacterium
YQVPEPSWWKEGYLGFSLSSIFGSWANQKINGQ

SEQ ID NO: 938578 - protein, 24 aa, Mycobacterium
YQYWYCLQHDDGLWYLHNSDQPTH

SEQ ID NO: 938579 - protein, 18 aa, Mycobacterium
YRADNAIEVKIHPTDAAS

SEQ ID NO: 938580 - protein, 18 aa, Mycobacterium
YRAPADVVARVFPAASVD

SEQ ID NO: 938581 - protein, 18 aa, Mycobacterium
YRASSILGKSTLEKDLNG

SEQ ID NO: 938582 - protein, 19 aa, Mycobacterium
YRDPSLLSFHLDDVGAAAG

SEQ ID NO: 938583 - protein, 30 aa, Mycobacterium
YREGYLALLAHLTWLLPLLEIIAKTQLRRQ

SEQ ID NO: 938584 - protein, 18 aa, Mycobacterium
YRELSRWIASSEGTDMRD

SEQ ID NO: 938585 - protein, 23 aa, Mycobacterium
YREVRPGHQVRWTVLLDGPVRIS

SEQ ID NO: 938586 - protein, 20 aa, Mycobacterium
YRGASRARGTWQAHRASAGY

SEQ ID NO: 938587 - protein, 17 aa, Mycobacterium
YRGDRFPYETGVVSAGE

SEQ ID NO: 938588 - protein, 21 aa, Mycobacterium
YRGLIPVERLDGVIDLNSMQM

SEQ ID NO: 938589 - protein, 17 aa, Mycobacterium
YRGSARIADLVEQIRRS

SEQ ID NO: 938590 - protein, 18 aa, Mycobacterium
YRHPDLLEKIHALQADPV

SEQ ID NO: 938591 - protein, 18 aa, Mycobacterium
YRIERVTERLPLLPDALR

SEQ ID NO: 938592 - protein, 21 aa, Mycobacterium
YRISPRNTVRAFAFDTDVAIA

SEQ ID NO: 938593 - protein, 21 aa, Mycobacterium
YRLVAACIEAGISVTCLPGPS

SEQ ID NO: 938594 - protein, 17 aa, Mycobacterium
YRLYKPAGLPRAAPLVV

SEQ ID NO: 938595 - protein, 23 aa, Mycobacterium
YRNPEFNSYGVLNVREDFSAAHP

SEQ ID NO: 938596 - protein, 20 aa, Mycobacterium
YRPASIEQPLTTGLDAILIS

SEQ ID NO: 938597 - protein, 17 aa, Mycobacterium
YRPDGTAALQLDMDPSQ

SEQ ID NO: 938598 - protein, 20 aa, Mycobacterium
YRPTQDGAYPIVLVTYEIVC

SEQ ID NO: 938599 - protein, 19 aa, Mycobacterium
YRPVIPAAKCSTTVGQDSC

SEQ ID NO: 938600 - protein, 26 aa, Mycobacterium
YRRADGRWGGAMLVAAKSATANVDAL

SEQ ID NO: 938601 - protein, 17 aa, Mycobacterium
YRRSRPLQASLPMGDAE

SEQ ID NO: 938602 - protein, 18 aa, Mycobacterium
YRSAILPGRNAEIDARMM

SEQ ID NO: 938603 - protein, 18 aa, Mycobacterium
YRSGHSYSLEEFGLEADG

SEQ ID NO: 938604 - protein, 17 aa, Mycobacterium
YRSLMAKRIPLYRRVAT

SEQ ID NO: 938605 - protein, 17 aa, Mycobacterium
YRSSLVPRRNAELDERM

SEQ ID NO: 938606 - protein, 17 aa, Mycobacterium
YRTFTFDMASGRRLQLA

SEQ ID NO: 938607 - protein, 18 aa, Mycobacterium
YRTFTFDMASGRRVQLAD

SEQ ID NO: 938608 - protein, 18 aa, Mycobacterium
YRTFTFDMSSGRRVQLSD

SEQ ID NO: 938609 - protein, 17 aa, Mycobacterium
YRTYRISPRNTVRAFAF

SEQ ID NO: 938610 - protein, 27 aa, Mycobacterium
YRVVANGRAGIRGEKTLALDFDGQAKI

SEQ ID NO: 938611 - protein, 19 aa, Mycobacterium
YRYDRLVLAAGSRLVKPDV

SEQ ID NO: 938612 - protein, 17 aa, Mycobacterium
YSAEFKNATGLKNGQFV

SEQ ID NO: 938613 - protein, 20 aa, Mycobacterium
YSANESWWGPIKDAVEAGYQ

SEQ ID NO: 938614 - protein, 23 aa, Mycobacterium
YSAPCALTGMTVGQVLDDAELGP

SEQ ID NO: 938615 - protein, 23 aa, Mycobacterium
YSAPCALTGMTVGQVMDDPEMAP

SEQ ID NO: 938616 - protein, 23 aa, Mycobacterium
YSAPCALTGMTVGQVMDDPEMGT

SEQ ID NO: 938617 - protein, 22 aa, Mycobacterium
YSAPEPGWRTVIPAFNASEEGR

SEQ ID NO: 938618 - protein, 27 aa, Mycobacterium
YSDGDIWDWAVDWDTWLSMSALPAPSA

SEQ ID NO: 938619 - protein, 20 aa, Mycobacterium
YSEFGRRVAANASQGTDHGT

SEQ ID NO: 938620 - protein, 24 aa, Mycobacterium
YSFDFSVWEMWGALLHGGRLVVVP

SEQ ID NO: 938621 - protein, 20 aa, Mycobacterium
YSGGYVEFPAGSVLEVRTAI

SEQ ID NO: 938622 - protein, 18 aa, Mycobacterium
YSHGSFVFLGPGFTPGSP

SEQ ID NO: 938623 - protein, 19 aa, Mycobacterium
YSHSGAFALGAATNFVVMP

SEQ ID NO: 938624 - protein, 27 aa, Mycobacterium
YSLRDDVRILKSWNIIDSYKAYFTEGD

SEQ ID NO: 938625 - protein, 23 aa, Mycobacterium
YSNEGQQLGEWVVEHYKGQEDVK

SEQ ID NO: 938626 - protein, 27 aa, Mycobacterium
YSNGSFTYRPAAGYSGTDTFTYTISDG

SEQ ID NO: 938627 - protein, 23 aa, Mycobacterium
YSPEIPCTLQAISKALVTFTPLI

SEQ ID NO: 938628 - protein, 30 aa, Mycobacterium
YSPIGAIIVPGGWWLLSLQALGLSQNAPGV

SEQ ID NO: 938629 - protein, 22 aa, Mycobacterium
YSQGRRAVSMVPVKRFDDHLDT

SEQ ID NO: 938630 - protein, 22 aa, Mycobacterium
YSRDSGVTWRFVEQIFSAEQQP

SEQ ID NO: 938631 - protein, 18 aa, Mycobacterium
YSSGEFDAALARAEAAPT

SEQ ID NO: 938632 - protein, 18 aa, Mycobacterium
YSVLSLPTTLIFDIDGRQ

SEQ ID NO: 938633 - protein, 33 aa, Mycobacterium
YSVSTEGRFRFLRVYPNPMAYAPVTGFYSLTYS

SEQ ID NO: 938634 - protein, 17 aa, Mycobacterium
YTAEFLQAATLRPGNPI

SEQ ID NO: 938635 - protein, 20 aa, Mycobacterium
YTAITTLRILDGVRLPKGST

SEQ ID NO: 938636 - protein, 30 aa, Mycobacterium
YTDSLNAWGSFLNKIMPPYKIADGAGTLDV

SEQ ID NO: 938637 - protein, 17 aa, Mycobacterium
YTDVRRVETADGVEYVR

SEQ ID NO: 938638 - protein, 17 aa, Mycobacterium
YTEASYGGALWDLLWAA

SEQ ID NO: 938639 - protein, 20 aa, Mycobacterium
YTGFIYRGGFYAKRIHDGIA

SEQ ID NO: 938640 - protein, 20 aa, Mycobacterium
YTGIVALFARLARQGLALEV

SEQ ID NO: 938641 - protein, 32 aa, Mycobacterium
YTGQITIPYTVWDGQVFSNWATITINVTPVND

SEQ ID NO: 938642 - protein, 23 aa, Mycobacterium
YTGSAVWRGLAGFHLVRDDEEDA

SEQ ID NO: 938643 - protein, 17 aa, Mycobacterium
YTGSYLLHCHNLEHEDM

SEQ ID NO: 938644 - protein, 20 aa, Mycobacterium
YTGTCTPVLVPNSPAPVAMP

SEQ ID NO: 938645 - protein, 17 aa, Mycobacterium
YTHPDLNGFYTGLQDQP

SEQ ID NO: 938646 - protein, 30 aa, Mycobacterium
YTLAVDVPDGLRCGNVYYGPVIPTHDVYEW

SEQ ID NO: 938647 - protein, 17 aa, Mycobacterium
YTLGAGVRVLGWNHTNG

SEQ ID NO: 938648 - protein, 27 aa, Mycobacterium
YTLTSGAPYEFDLYYLATQPADKAAYD

SEQ ID NO: 938649 - protein, 20 aa, Mycobacterium
YTLTVDVPDGLRCGNVYYGP

SEQ ID NO: 938650 - protein, 26 aa, Mycobacterium
YTPEAQRIWAKTGFRPVDPGVAAEFA

SEQ ID NO: 938651 - protein, 19 aa, Mycobacterium
YTPRYWKYLTSGLSGLADG

SEQ ID NO: 938652 - protein, 26 aa, Mycobacterium
YTSADIRALYAFKRLAWWPYSVAMRQ

SEQ ID NO: 938653 - protein, 21 aa, Mycobacterium
YTSANVGWWYAMNASNDVIVT

SEQ ID NO: 938654 - protein, 19 aa, Mycobacterium
YTSASRKAMLPVFEDNNAL

SEQ ID NO: 938655 - protein, 17 aa, Mycobacterium
YTSKLFCDIVFDIIGPD

SEQ ID NO: 938656 - protein, 19 aa, Mycobacterium
YTTPWPLLGAYSVTKSALD

SEQ ID NO: 938657 - protein, 20 aa, Mycobacterium
YTTQAAAFVASKLVGTGQSV

SEQ ID NO: 938658 - protein, 18 aa, Mycobacterium
YTTWEEWERLDAHEVALG

SEQ ID NO: 938659 - protein, 26 aa, Mycobacterium
YTVYFAMKFSRPFTSYGTWDGDAVYP

SEQ ID NO: 938660 - protein, 24 aa, Mycobacterium
YTYGLGIVISGHWLLQNPLFSGYA

SEQ ID NO: 938661 - protein, 18 aa, Mycobacterium
YTYHSKTLGWCDIAYNAL

SEQ ID NO: 938662 - protein, 17 aa, Mycobacterium
YTYSQLVVPRWVLLSGV

SEQ ID NO: 938663 - protein, 17 aa, Mycobacterium
YVAAGARAIVLEALGSG

SEQ ID NO: 938664 - protein, 22 aa, Mycobacterium
YVAAHVPYLAWLTRAGANSAAR

SEQ ID NO: 938665 - protein, 22 aa, Mycobacterium
YVAAHVPYLMWLMQAGTVSAAA

SEQ ID NO: 938666 - protein, 18 aa, Mycobacterium
YVAGAGVGCGYWRRPALT

SEQ ID NO: 938667 - protein, 18 aa, Mycobacterium
YVALSIVGCDALPDSGYM

SEQ ID NO: 938668 - protein, 18 aa, Mycobacterium
YVGYTAWRGIAAHPLDPE

SEQ ID NO: 938669 - protein, 17 aa, Mycobacterium
YVLEKFPTVVMDSSTYG

SEQ ID NO: 938670 - protein, 39 aa, Mycobacterium
YVPAPLKPFFRLVWSPRLARVTRRWARRAGSPDLPMSWR

SEQ ID NO: 938671 - protein, 20 aa, Mycobacterium
YVPDLPDWAATVTVAELMHQ

SEQ ID NO: 938672 - protein, 19 aa, Mycobacterium
YVPSRPHLEWQLRRRVLEL

SEQ ID NO: 938673 - protein, 26 aa, Mycobacterium
YVQYRQGFPPTFGLDGTGYVTSAELL

SEQ ID NO: 938674 - protein, 19 aa, Mycobacterium
YVSCASPAAAERAATVLDS

SEQ ID NO: 938675 - protein, 26 aa, Mycobacterium
YVSGGKCLRSTFVYLGWLCGAAPGEA

SEQ ID NO: 938676 - protein, 30 aa, Mycobacterium
YVTRTVEPWGVITDRGRWYLVGHDRDRDAT

SEQ ID NO: 938677 - protein, 19 aa, Mycobacterium
YVVRFGLGYREEVKPDVQI

SEQ ID NO: 938678 - protein, 27 aa, Mycobacterium
YVWNPDMTPFAYLARPLAKILCPTCNA

SEQ ID NO: 938679 - protein, 25 aa, Mycobacterium
YWADKGVDVSPFFEVLRGQQIAAPG

SEQ ID NO: 938680 - protein, 22 aa, Mycobacterium
YWAGPPGVAGVTFRFIPEPSTA

SEQ ID NO: 938681 - protein, 25 aa, Mycobacterium
YWATRGVDVTPFFTVLNGPRIAAPG

SEQ ID NO: 938682 - protein, 18 aa, Mycobacterium
YWPAHTHVSVGIQALTTG

SEQ ID NO: 938683 - protein, 24 aa, Mycobacterium
YWPDRPSTVDGWLHTGDIGRLDHT

SEQ ID NO: 938684 - protein, 25 aa, Mycobacterium
YWSARGVDVTPFFSVLNGPRIAAPG

SEQ ID NO: 938685 - protein, 18 aa, Mycobacterium
YYERIEPVAEAFPNDLDP

SEQ ID NO: 938686 - protein, 20 aa, Mycobacterium
YYEVEPLGVFLLEMITGTNI

SEQ ID NO: 938687 - protein, 23 aa, Mycobacterium
YYNFPAVAPAAVDARGIKISTNA

SEQ ID NO: 938688 - protein, 44 aa, Mycobacterium
YYPGGRVAGRPVPAGWYSEPWWKPALVAGAWGLGSALLFSTMFS

SEQ ID NO: 938689 - protein, 23 aa, Mycobacterium
YYSWARLVIDPRLPRLDYDPTLW

SEQ ID NO: 938690 - protein, 25 aa, Mycobacterium
YYSYSFRPNPNWSHLLPPGPEIQAY

SEQ ID NO: 938691 - protein, 21 aa, Mycobacterium
NPEIRPAHLLMALLTQADGIA

SEQ ID NO: 938692 - protein, 24 aa, Mycobacterium
TITARLNFQLAFGARVGQRLAEAR

SEQ ID NO: 938693 - protein, 25 aa, Mycobacterium
VLDEATGRWGLRVARVELRSIDPPP

SEQ ID NO: 938694 - protein, 18 aa, Mycobacterium
AKLCVQYLAPIIKNRQYN

SEQ ID NO: 938695 - protein, 19 aa, Mycobacterium
IDAPALWPGLPVRPVKGEV

SEQ ID NO: 938696 - protein, 21 aa, Mycobacterium
MLEMLPTPWGLVRSGVAPDHP

SEQ ID NO: 938697 - protein, 19 aa, Mycobacterium
RRPYTVILFDEIEKAHPDV

SEQ ID NO: 938698 - protein, 18 aa, Mycobacterium
TLELGYQIGFPWSLGVGI

SEQ ID NO: 938699 - protein, 18 aa, Mycobacterium
AAELRYGRIPEVEKKLDA

SEQ ID NO: 938700 - protein, 18 aa, Mycobacterium
AAFSAVKPSVAWAETYPG

SEQ ID NO: 938701 - protein, 19 aa, Mycobacterium
AAGYLCWRGKDLATPRGWI

SEQ ID NO: 938702 - protein, 24 aa, Mycobacterium
ADAVLKGDAWRKLSANRDNRVFVV

SEQ ID NO: 938703 - protein, 25 aa, Mycobacterium
AGGAGGRGGWLFSAGGNGGAGGAGG

SEQ ID NO: 938704 - protein, 27 aa, Mycobacterium
AISAQAAVFHGRFVAALNAAADSYAGA

SEQ ID NO: 938705 - protein, 23 aa, Mycobacterium
ALTYPRRLGFGLGTSVVSLSWRT

SEQ ID NO: 938706 - protein, 23 aa, Mycobacterium
ANAKRWGINHVIWRQKIYPGVGG

SEQ ID NO: 938707 - protein, 18 aa, Mycobacterium
ATDSRFRFLRVYPNPEVY

SEQ ID NO: 938708 - protein, 20 aa, Mycobacterium
CGGPCKGAVVALEPSTGKIL

SEQ ID NO: 938709 - protein, 19 aa, Mycobacterium
DALCALGLQSRVVGAALPD

SEQ ID NO: 938710 - protein, 17 aa, Mycobacterium
DEISAAIAQLFGTHAQI

SEQ ID NO: 938711 - protein, 22 aa, Mycobacterium
DMLEMLPTPWGLVRSGVAPDHP

SEQ ID NO: 938712 - protein, 17 aa, Mycobacterium
GAAAAQAAVIGSGVQTA

SEQ ID NO: 938713 - protein, 29 aa, Mycobacterium
GALNAPTMAWLGRPLIGDGANGVDGTGGN

SEQ ID NO: 938714 - protein, 23 aa, Mycobacterium
GDIWDWAVDWDTWVAMSALPPPT

SEQ ID NO: 938715 - protein, 20 aa, Mycobacterium
GGAGGLLWGNGGRGGSGAAG

SEQ ID NO: 938716 - protein, 19 aa, Mycobacterium
GGATGWFGSTGTTGAGGNG

SEQ ID NO: 938717 - protein, 17 aa, Mycobacterium
GGESWSALTTMILPSGG

SEQ ID NO: 938718 - protein, 20 aa, Mycobacterium
GGHGGNGGWVAGDGGAGGAG

SEQ ID NO: 938719 - protein, 17 aa, Mycobacterium
GRIRYKRVCEVCGEVVE

SEQ ID NO: 938720 - protein, 27 aa, Mycobacterium
GSGGGAGRGGWVFGDGGAGGAGGDGAT

SEQ ID NO: 938721 - protein, 17 aa, Mycobacterium
GVARHVLIPAGWCGYSG

SEQ ID NO: 938722 - protein, 19 aa, Mycobacterium
HLYGLDCSHIAPANVYGPR

SEQ ID NO: 938723 - protein, 20 aa, Mycobacterium
IAGFAVWRIRGIFGSHQLPT

SEQ ID NO: 938724 - protein, 18 aa, Mycobacterium
IDRLPNGVFLDWQQFQAT

SEQ ID NO: 938725 - protein, 19 aa, Mycobacterium
ISAAIAQLFGTHAQIYQRI

SEQ ID NO: 938726 - protein, 19 aa, Mycobacterium
ISAQAMAFHDQFARSLSAA

SEQ ID NO: 938727 - protein, 18 aa, Mycobacterium
ISLAAVFLALAIGVALGS

SEQ ID NO: 938728 - protein, 21 aa, Mycobacterium
KLREIRMALTLDKTFTKPEIL

SEQ ID NO: 938729 - protein, 21 aa, Mycobacterium
KQGWMCCIGSDWMHLSTGVIG

SEQ ID NO: 938730 - protein, 18 aa, Mycobacterium
LARADIRGPYVINADGAP

SEQ ID NO: 938731 - protein, 27 aa, Mycobacterium
LGYQIGFPWSLGVGINFSYTTPNILID

SEQ ID NO: 938732 - protein, 17 aa, Mycobacterium
LIPAGWCGYSGPRARGM

SEQ ID NO: 938733 - protein, 18 aa, Mycobacterium
LPPAVSAYTGLPGDTPEA

SEQ ID NO: 938734 - protein, 21 aa, Mycobacterium
LSDLQPGDVLTFYSDASHAGI

SEQ ID NO: 938735 - protein, 22 aa, Mycobacterium
LSEEDRRFAVVFAHDQSDYARM

SEQ ID NO: 938736 - protein, 19 aa, Mycobacterium
MGPMQFLPGTWARYASDGD

SEQ ID NO: 938737 - protein, 19 aa, Mycobacterium
NPDLFWALRGGGGGNFGVT

SEQ ID NO: 938738 - protein, 21 aa, Mycobacterium
NRDTWGVAMIGNFDDVAPTPL

SEQ ID NO: 938739 - protein, 18 aa, Mycobacterium
NTFRHLYGLDCSHIAPAN

SEQ ID NO: 938740 - protein, 19 aa, Mycobacterium
NWFGDQPFAVWPWAQPKLG

SEQ ID NO: 938741 - protein, 17 aa, Mycobacterium
PEAMGAVAVAFRANAQL

SEQ ID NO: 938742 - protein, 17 aa, Mycobacterium
PTQWIRWRKPVIGMPTT

SEQ ID NO: 938743 - protein, 23 aa, Mycobacterium
QDLGGAHPFTWYKAFNYNLGTKQ

SEQ ID NO: 938744 - protein, 21 aa, Mycobacterium
QFIPETWRLYGVDAHNDGRVS

SEQ ID NO: 938745 - protein, 22 aa, Mycobacterium
QVGYPWSLGVGLNFNYTTPNTS

SEQ ID NO: 938746 - protein, 20 aa, Mycobacterium
RSGGALAAFAAVAAESAGAA

SEQ ID NO: 938747 - protein, 20 aa, Mycobacterium
SGSIGLGFAIPVDQAKRIAD

SEQ ID NO: 938748 - protein, 20 aa, Mycobacterium
SRRAKRLIVFDVDSTLIQGE

SEQ ID NO: 938749 - protein, 18 aa, Mycobacterium
SWSALTTMILPSGGAPYV

SEQ ID NO: 938750 - protein, 21 aa, Mycobacterium
TFVGAICRWQAANPAGLIDIT

SEQ ID NO: 938751 - protein, 17 aa, Mycobacterium
VASDAAGVVGWWVNPQA

SEQ ID NO: 938752 - protein, 18 aa, Mycobacterium
VEGAFYWLNNREVRWRPE

SEQ ID NO: 938753 - protein, 21 aa, Mycobacterium
VGAAARGGRRLVIAMMYGLVK

SEQ ID NO: 938754 - protein, 19 aa, Mycobacterium
VGFAAIVFLVWRYVVPPVR

SEQ ID NO: 938755 - protein, 23 aa, Mycobacterium
VIGSGVQTAGAWAAGPTTALAGA

SEQ ID NO: 938756 - protein, 25 aa, Mycobacterium
VLDEATNRWGLRVARVELRSIDPPP

SEQ ID NO: 938757 - protein, 17 aa, Mycobacterium
YLDTVLFILGITRGEIE

SEQ ID NO: 938758 - protein, 19 aa, Mycobacterium
YRTEVEWATQMSYSGIYVH

SEQ ID NO: 938759 - protein, 21 aa, Mycobacterium
AAADGKFPLTFTVNNVDQQGP

SEQ ID NO: 938760 - protein, 18 aa, Mycobacterium
AAAGIGLLPCFMADRHDD

SEQ ID NO: 938761 - protein, 20 aa, Mycobacterium
AAAGYLCWRGKDLATPRGWI

SEQ ID NO: 938762 - protein, 18 aa, Mycobacterium
AAALDRRGSGTVLTGRSG

SEQ ID NO: 938763 - protein, 35 aa, Mycobacterium
AAALTRIGAPYSWGGSGPNAFDCSGLVMWAYGQQG

SEQ ID NO: 938764 - protein, 26 aa, Mycobacterium
AAALVLTSCGSWKGIANIPLPGGPGT

SEQ ID NO: 938765 - protein, 17 aa, Mycobacterium
AAALVVLSAPAGRGAPP

SEQ ID NO: 938766 - protein, 19 aa, Mycobacterium
AAAPLAWRPVIARGDLDGI

SEQ ID NO: 938767 - protein, 20 aa, Mycobacterium
AAASFELLHVFALLQDDVMD

SEQ ID NO: 938768 - protein, 19 aa, Mycobacterium
AACTFRLAELCERTASEAA

SEQ ID NO: 938769 - protein, 18 aa, Mycobacterium
AADAVACALQLQRAQLPP

SEQ ID NO: 938770 - protein, 25 aa, Mycobacterium
AADEISVAMASVFSDHALSYQQVAA

SEQ ID NO: 938771 - protein, 18 aa, Mycobacterium
AAECRRVGIADAHCALPL

SEQ ID NO: 938772 - protein, 19 aa, Mycobacterium
AAEFHDRFVEILQTSAQAY

SEQ ID NO: 938773 - protein, 19 aa, Mycobacterium
AAFGFPGFGGNGGLLFGKA

SEQ ID NO: 938774 - protein, 23 aa, Mycobacterium
AAGAAGCSWGGAVVGAVAAGSSG

SEQ ID NO: 938775 - protein, 18 aa, Mycobacterium
AAGRGRIAAAGYEAARAA

SEQ ID NO: 938776 - protein, 19 aa, Mycobacterium
AAGVPVEIDLPVGVDTIDH

SEQ ID NO: 938777 - protein, 19 aa, Mycobacterium
AAGYLCWRGKDLSKPRGWM

SEQ ID NO: 938778 - protein, 25 aa, Mycobacterium
AAIAYRADERFAFCSTFKALLVAAV

SEQ ID NO: 938779 - protein, 17 aa, Mycobacterium
AAICNELGLLAAAGSED

SEQ ID NO: 938780 - protein, 17 aa, Mycobacterium
AAILASIAFHTKVSADD

SEQ ID NO: 938781 - protein, 19 aa, Mycobacterium
AAKLCVQYLAPILKNRQYN

SEQ ID NO: 938782 - protein, 23 aa, Mycobacterium
AAKRARIPLIWHVHDRISAEYFG

SEQ ID NO: 938783 - protein, 18 aa, Mycobacterium
AAKWNLLAPYAYASNGGQ

SEQ ID NO: 938784 - protein, 17 aa, Mycobacterium
AALAAAGYLCWRGKDLA

SEQ ID NO: 938785 - protein, 18 aa, Mycobacterium
AALRLFAAKGYAATSVAD

SEQ ID NO: 938786 - protein, 24 aa, Mycobacterium
AALTRVGAPYSWGATGPDAFDCSG

SEQ ID NO: 938787 - protein, 21 aa, Mycobacterium
AAMELQRIGSVLVEANTAAAA

SEQ ID NO: 938788 - protein, 19 aa, Mycobacterium
AAMFLGFGAVAAWAEPTPP

SEQ ID NO: 938789 - protein, 24 aa, Mycobacterium
AANAGPLQPLLDLINAPTQALLAR

SEQ ID NO: 938790 - protein, 19 aa, Mycobacterium
AANITRLPVRYTFDNRYFS

SEQ ID NO: 938791 - protein, 18 aa, Mycobacterium
AANLNWDPSVAILGFPFI

SEQ ID NO: 938792 - protein, 20 aa, Mycobacterium
AANRSRLVSLVWSNVFGQNA

SEQ ID NO: 938793 - protein, 23 aa, Mycobacterium
AANSMPFSAFPMGNYASLPTVSF

SEQ ID NO: 938794 - protein, 25 aa, Mycobacterium
AAPLLGVLCSIYWQRPVPTVHVHAE

SEQ ID NO: 938795 - protein, 25 aa, Mycobacterium
AAPPGLPWEMVWSFHLIPRGDDQCR

SEQ ID NO: 938796 - protein, 19 aa, Mycobacterium
AAPVGRLSVPQGWATANPP

SEQ ID NO: 938797 - protein, 18 aa, Mycobacterium
AAQALAFVRQRHGLDNGD

SEQ ID NO: 938798 - protein, 19 aa, Mycobacterium
AAQALAFVRQRHGLDNGDL

SEQ ID NO: 938799 - protein, 26 aa, Mycobacterium
AAQAMAFAAIRYAEWLQVTAEQTRQT

SEQ ID NO: 938800 - protein, 19 aa, Mycobacterium
AARNSAGFGAPRYGVKPIV

SEQ ID NO: 938801 - protein, 23 aa, Mycobacterium
AARPLPLPDMCYGAVLSGDTELS

SEQ ID NO: 938802 - protein, 18 aa, Mycobacterium
AASPRVIWGLGDDPHPKP

SEQ ID NO: 938803 - protein, 22 aa, Mycobacterium
AASTRWCPRCAAELTVRDDEPH

SEQ ID NO: 938804 - protein, 19 aa, Mycobacterium
AATEARYGEMWAQDASAMY

SEQ ID NO: 938805 - protein, 22 aa, Mycobacterium
AATEKWKAAGLLALVGIGVEPG

SEQ ID NO: 938806 - protein, 17 aa, Mycobacterium
AAVEEIRTKGTVPDTLP

SEQ ID NO: 938807 - protein, 19 aa, Mycobacterium
AAVGFAEWLAVTYGDDGIG

SEQ ID NO: 938808 - protein, 17 aa, Mycobacterium
AAVGMVWDTPVTTLIQW

SEQ ID NO: 938809 - protein, 19 aa, Mycobacterium
AAVINRLPVRYTFDNRYFS

SEQ ID NO: 938810 - protein, 17 aa, Mycobacterium
AAVKVGFRLGAPGPGEF

SEQ ID NO: 938811 - protein, 19 aa, Mycobacterium
AAVSSRFPGAITDLQLSRD

SEQ ID NO: 938812 - protein, 19 aa, Mycobacterium
AAWCGPCAVVRRVVGEVCA

SEQ ID NO: 938813 - protein, 18 aa, Mycobacterium
AAWWVVVLALTAATMMAA

SEQ ID NO: 938814 - protein, 20 aa, Mycobacterium
ACGISWNLLAGIGRIESMHA

SEQ ID NO: 938815 - protein, 20 aa, Mycobacterium
ACGKAGCTTYKWETFLTSEL

SEQ ID NO: 938816 - protein, 19 aa, Mycobacterium
ACRLLGFNTVRVFLHDLLW

SEQ ID NO: 938817 - protein, 18 aa, Mycobacterium
ADAKAVIVAQNLVAARYV

SEQ ID NO: 938818 - protein, 20 aa, Mycobacterium
ADAKAVIVASNLVSARYVQL

SEQ ID NO: 938819 - protein, 20 aa, Mycobacterium
ADALFARFVAQWQKCDGTTL

SEQ ID NO: 938820 - protein, 17 aa, Mycobacterium
ADARPSPPASFCPATNT

SEQ ID NO: 938821 - protein, 18 aa, Mycobacterium
ADARTVWRYLVTDTGVRF

SEQ ID NO: 938822 - protein, 18 aa, Mycobacterium
ADCRLQWVVVSSGDQPDS

SEQ ID NO: 938823 - protein, 18 aa, Mycobacterium
ADDFWYLWHQMVSQPGVV

SEQ ID NO: 938824 - protein, 19 aa, Mycobacterium
ADEKLVPSINSWQGAEQAL

SEQ ID NO: 938825 - protein, 23 aa, Mycobacterium
ADEVSVAVAQLFDGHGQAYQAIS

SEQ ID NO: 938826 - protein, 17 aa, Mycobacterium
ADFPDRFNLTAISNAMA

SEQ ID NO: 938827 - protein, 18 aa, Mycobacterium
ADGLPFVFDSFRLDSRLT

SEQ ID NO: 938828 - protein, 19 aa, Mycobacterium
ADGNVWGGSINKDFGTATD

SEQ ID NO: 938829 - protein, 17 aa, Mycobacterium
ADGRPTLDLAVVANAFA

SEQ ID NO: 938830 - protein, 20 aa, Mycobacterium
ADIPGRFVVAAAMVRHLLTD

SEQ ID NO: 938831 - protein, 19 aa, Mycobacterium
ADLGYKVPTLWSGSLSDST

SEQ ID NO: 938832 - protein, 17 aa, Mycobacterium
ADLQRLGLLDAHPTSAP

SEQ ID NO: 938833 - protein, 20 aa, Mycobacterium
ADLYPRYACDYGTPRHPPSA

SEQ ID NO: 938834 - protein, 22 aa, Mycobacterium
ADLYPRYACDYGTPRVPPSSAD

SEQ ID NO: 938835 - protein, 22 aa, Mycobacterium
ADPAGWPRLDWSMDAALLLAAL

SEQ ID NO: 938836 - protein, 21 aa, Mycobacterium
ADPGLLRWLEDPEIGGVELKG

SEQ ID NO: 938837 - protein, 21 aa, Mycobacterium
ADSRLAGWDVVDYVELAKEPF

SEQ ID NO: 938838 - protein, 17 aa, Mycobacterium
ADVALWLSTGEVPAVLD

SEQ ID NO: 938839 - protein, 21 aa, Mycobacterium
ADVANFMFSYFVGVDENGHMF

SEQ ID NO: 938840 - protein, 26 aa, Mycobacterium
ADVLRRLRGMFAFALWDTVTRELFCA

SEQ ID NO: 938841 - protein, 21 aa, Mycobacterium
AEAGWPVQVWTAAMPQDTTSA

SEQ ID NO: 938842 - protein, 22 aa, Mycobacterium
AEAGWPVRVWAAAMPQHTTSRV

SEQ ID NO: 938843 - protein, 20 aa, Mycobacterium
AEALVRWRHPIWGLLLPDSF

SEQ ID NO: 938844 - protein, 18 aa, Mycobacterium
AEAPVPMPDPSNRQTDPA

SEQ ID NO: 938845 - protein, 21 aa, Mycobacterium
AEARLPEILTFLESKLGTYPH

SEQ ID NO: 938846 - protein, 21 aa, Mycobacterium
AEARRPGLFGVIQLVMHNIAI

SEQ ID NO: 938847 - protein, 17 aa, Mycobacterium
AECKYALHAALAPVYAD

SEQ ID NO: 938848 - protein, 23 aa, Mycobacterium
AEDPRVAGLIARVQLPPAPIGAV

SEQ ID NO: 938849 - protein, 18 aa, Mycobacterium
AEEMPVMSMCVGEEEVRS

SEQ ID NO: 938850 - protein, 18 aa, Mycobacterium
AEESLRILASWAADNGTG

SEQ ID NO: 938851 - protein, 19 aa, Mycobacterium
AEGRLGWRTLDFDVEVLPI

SEQ ID NO: 938852 - protein, 20 aa, Mycobacterium
AEGRLGWRTLDFELEVLPIG

SEQ ID NO: 938853 - protein, 20 aa, Mycobacterium
AEGRLGWRTLDFELEVLQTG

SEQ ID NO: 938854 - protein, 20 aa, Mycobacterium
AEGRLGWRTLDFEVEVLGDC

SEQ ID NO: 938855 - protein, 20 aa, Mycobacterium
AEGRLGWRTLDFEVEVLPIG

SEQ ID NO: 938856 - protein, 18 aa, Mycobacterium
AEHIGGWAARPLPLPDMC

SEQ ID NO: 938857 - protein, 17 aa, Mycobacterium
AEHYLHFGGVSPINGIN

SEQ ID NO: 938858 - protein, 20 aa, Mycobacterium
AEIAEPLWIVQNFQHGTLNF

SEQ ID NO: 938859 - protein, 21 aa, Mycobacterium
AEIYVPFSWFEPMWLENLGFV

SEQ ID NO: 938860 - protein, 17 aa, Mycobacterium
AELRYGRIPEVEKKLDA

SEQ ID NO: 938861 - protein, 18 aa, Mycobacterium
AENDFTFATAIGDNNGVA

SEQ ID NO: 938862 - protein, 23 aa, Mycobacterium
AENYLRLNALGAYGSFFNIFYCS

SEQ ID NO: 938863 - protein, 20 aa, Mycobacterium
AEPASTGWIGRWLDATGDDP

SEQ ID NO: 938864 - protein, 23 aa, Mycobacterium
AEPEVYNVLGPLLAPVQLLTDLT

SEQ ID NO: 938865 - protein, 17 aa, Mycobacterium
AEPGIPLVALWDETTWY

SEQ ID NO: 938866 - protein, 24 aa, Mycobacterium
AEQMRGGAIFARWESVGGPAGPLG

SEQ ID NO: 938867 - protein, 19 aa, Mycobacterium
AESEVIVSLAFPKPPELLR

SEQ ID NO: 938868 - protein, 23 aa, Mycobacterium
AEVQRLPLNVTWVNLTTGKSGSV

SEQ ID NO: 938869 - protein, 24 aa, Mycobacterium
AFADPRPSGWEGLSTALGGKVLLP

SEQ ID NO: 938870 - protein, 21 aa, Mycobacterium
AFARRELDTLFAARTSNSPRS

SEQ ID NO: 938871 - protein, 19 aa, Mycobacterium
AFARRRFWLDGSASAADVG

SEQ ID NO: 938872 - protein, 24 aa, Mycobacterium
AFEAIKQLHPEGGKVMVMGLDPGI

SEQ ID NO: 938873 - protein, 24 aa, Mycobacterium
AFFTSRCNMIAWDRGVFMPVAEKY

SEQ ID NO: 938874 - protein, 24 aa, Mycobacterium
AFFTSRCNMIAWDRGVFMPVAQEY

SEQ ID NO: 938875 - protein, 17 aa, Mycobacterium
AFNRVLTGFGFHGPDGQ

SEQ ID NO: 938876 - protein, 21 aa, Mycobacterium
AFPLGPGFVAPLWGFGQDGYD

SEQ ID NO: 938877 - protein, 17 aa, Mycobacterium
AFPRLAVVRAPRHDRAV

SEQ ID NO: 938878 - protein, 18 aa, Mycobacterium
AFSAPYALVCDFYGGPAP

SEQ ID NO: 938879 - protein, 21 aa, Mycobacterium
AFSEPWGRHVNWWVTANLPMH

SEQ ID NO: 938880 - protein, 22 aa, Mycobacterium
AFYPLPRAAFRDMSAFGQHPIG

SEQ ID NO: 938881 - protein, 21 aa, Mycobacterium
AGAAGCSWGGAVVGAVAAGAA

SEQ ID NO: 938882 - protein, 21 aa, Mycobacterium
AGAAGCSWGGAVVGAVASGSA

SEQ ID NO: 938883 - protein, 21 aa, Mycobacterium
AGAAGCSWGGAVVGAVSACAA

SEQ ID NO: 938884 - protein, 18 aa, Mycobacterium
AGADALWFLPLFDQSALD

SEQ ID NO: 938885 - protein, 19 aa, Mycobacterium
AGAPHPGPLVYRYGSTTLA

SEQ ID NO: 938886 - protein, 17 aa, Mycobacterium
AGAVALAIALPFAATAC

SEQ ID NO: 938887 - protein, 20 aa, Mycobacterium
AGAVPSFLGYHGYPASICAS

SEQ ID NO: 938888 - protein, 18 aa, Mycobacterium
AGAWSRPGLPVEYLEVPS

SEQ ID NO: 938889 - protein, 18 aa, Mycobacterium
AGCPSGICKGKVKQAYGF

SEQ ID NO: 938890 - protein, 19 aa, Mycobacterium
AGEDFGVAVNPEFLREGSS

SEQ ID NO: 938891 - protein, 23 aa, Mycobacterium
AGFCVLRLRTFFGVHDDQTMTSG

SEQ ID NO: 938892 - protein, 22 aa, Mycobacterium
AGGDGGRGGWLHGDGGDGGAGG

SEQ ID NO: 938893 - protein, 20 aa, Mycobacterium
AGGFSYVVPAGWKVSDATQL

SEQ ID NO: 938894 - protein, 20 aa, Mycobacterium
AGGFSYVVPEGWQVSDATQL

SEQ ID NO: 938895 - protein, 20 aa, Mycobacterium
AGGHALVIGNRVRYFSAPNF

SEQ ID NO: 938896 - protein, 19 aa, Mycobacterium
AGGKCPDVLMAWELSYAEL

SEQ ID NO: 938897 - protein, 19 aa, Mycobacterium
AGGNGGLLIGNGGAGGSGA

SEQ ID NO: 938898 - protein, 27 aa, Mycobacterium
AGGPGGAGGWLWGGGGAGGLGGAASGA

SEQ ID NO: 938899 - protein, 20 aa, Mycobacterium
AGGRCPDVLMAWDLTYAELA

SEQ ID NO: 938900 - protein, 17 aa, Mycobacterium
AGGRGGWLIGNGAGGGT

SEQ ID NO: 938901 - protein, 22 aa, Mycobacterium
AGGVGGRGGWLFGNGGAGGNGG

SEQ ID NO: 938902 - protein, 19 aa, Mycobacterium
AGHGALFTRAPWVVSVDDH

SEQ ID NO: 938903 - protein, 19 aa, Mycobacterium
AGIASLFGAHAYNYQVLSA

SEQ ID NO: 938904 - protein, 18 aa, Mycobacterium
AGISWKVYQNKLLGALNN

SEQ ID NO: 938905 - protein, 19 aa, Mycobacterium
AGKGFLAQLCEDWEAATLP

SEQ ID NO: 938906 - protein, 17 aa, Mycobacterium
AGKRGRHSSGLTAKPSD

SEQ ID NO: 938907 - protein, 18 aa, Mycobacterium
AGLAITLVALVVVGAAVA

SEQ ID NO: 938908 - protein, 18 aa, Mycobacterium
AGLVTPMVNDFIARGPNG

SEQ ID NO: 938909 - protein, 19 aa, Mycobacterium
AGMQVSIPWPYSGNVHCEI

SEQ ID NO: 938910 - protein, 17 aa, Mycobacterium
AGQATAVAAVFEAAQAA

SEQ ID NO: 938911 - protein, 20 aa, Mycobacterium
AGQTGFVWKFLDSVQTVDDH

SEQ ID NO: 938912 - protein, 17 aa, Mycobacterium
AGRQCLTTGATVTAGPA

SEQ ID NO: 938913 - protein, 18 aa, Mycobacterium
AGSLGGLSVPATWTAGAS

SEQ ID NO: 938914 - protein, 18 aa, Mycobacterium
AGSLPVPLWWAKICDAWW

SEQ ID NO: 938915 - protein, 19 aa, Mycobacterium
AGSWNARWADLTPARQAAV

SEQ ID NO: 938916 - protein, 17 aa, Mycobacterium
AGSYLRWVTQGDSPRFT

SEQ ID NO: 938917 - protein, 20 aa, Mycobacterium
AGTRSARVTVMFKDTHWAGG

SEQ ID NO: 938918 - protein, 17 aa, Mycobacterium
AGVFGAVAAVLAFSACG

SEQ ID NO: 938919 - protein, 23 aa, Mycobacterium
AGVPRLGSFEVMYRTIDIAQAAL

SEQ ID NO: 938920 - protein, 20 aa, Mycobacterium
AGWLVRDLVCHLIIDAQDVL

SEQ ID NO: 938921 - protein, 28 aa, Mycobacterium
AGWYSEPWWKPALVAGAWGLGSVLLFDA

SEQ ID NO: 938922 - protein, 27 aa, Mycobacterium
AGWYSEPWWKPALVAGAWGVGSALLFN

SEQ ID NO: 938923 - protein, 17 aa, Mycobacterium
AGYAYQAWREWQPVDPS

SEQ ID NO: 938924 - protein, 21 aa, Mycobacterium
AGYDEAVGWTRDNPQQAAAIW

SEQ ID NO: 938925 - protein, 17 aa, Mycobacterium
AHLKRYPDVMGHVMKLM

SEQ ID NO: 938926 - protein, 18 aa, Mycobacterium
AHSGLRFEVATGFPDYRP

SEQ ID NO: 938927 - protein, 18 aa, Mycobacterium
AHTLRPGQSVTVQIVTST

SEQ ID NO: 938928 - protein, 23 aa, Mycobacterium
AHYRDVFAALRFHGLDPMVTVNH

SEQ ID NO: 938929 - protein, 17 aa, Mycobacterium
AIAPAVWAGAVAQYCIL

SEQ ID NO: 938930 - protein, 19 aa, Mycobacterium
AIAQGKCVWARGTMDSAGA

SEQ ID NO: 938931 - protein, 24 aa, Mycobacterium
AIDLLKGVLMPSIMQAVQNGGAAA

SEQ ID NO: 938932 - protein, 18 aa, Mycobacterium
AIELWKIVDRPNLLIKIP

SEQ ID NO: 938933 - protein, 17 aa, Mycobacterium
AIHAKWESLGGMNSYLG

SEQ ID NO: 938934 - protein, 19 aa, Mycobacterium
AIKRIKYRYLRALDTKHWD

SEQ ID NO: 938935 - protein, 17 aa, Mycobacterium
AIKSCPPGHVEVIANYT

SEQ ID NO: 938936 - protein, 18 aa, Mycobacterium
AILIPRVNAGYSRNDDPS

SEQ ID NO: 938937 - protein, 25 aa, Mycobacterium
AILLPAHWQTAAALFGVWWIGAEAV

SEQ ID NO: 938938 - protein, 18 aa, Mycobacterium
AILQPRVDAGYSRNDDPA

SEQ ID NO: 938939 - protein, 19 aa, Mycobacterium
AIPIGRAMGVAGQIRSGAG

SEQ ID NO: 938940 - protein, 18 aa, Mycobacterium
AIPPRGTQSLVLKVVQNV

SEQ ID NO: 938941 - protein, 17 aa, Mycobacterium
AISGQTLFGFGWDIDTP

SEQ ID NO: 938942 - protein, 18 aa, Mycobacterium
AIVFAALMVTAGCAAPGA

SEQ ID NO: 938943 - protein, 20 aa, Mycobacterium
AIVFLVWRYVVPPVRRLMSA

SEQ ID NO: 938944 - protein, 20 aa, Mycobacterium
AIVFLVWRYVVPPVRRMMAA

SEQ ID NO: 938945 - protein, 18 aa, Mycobacterium
AIYQRWQELGAMNSVLGA

SEQ ID NO: 938946 - protein, 17 aa, Mycobacterium
AKACAPAGITVQDAGSE

SEQ ID NO: 938947 - protein, 19 aa, Mycobacterium
AKGEDGFFFAESSAGRSAT

SEQ ID NO: 938948 - protein, 19 aa, Mycobacterium
AKGEIAWRRDDLVPLSTSS

SEQ ID NO: 938949 - protein, 17 aa, Mycobacterium
AKGVWRYADPVLERLGM

SEQ ID NO: 938950 - protein, 19 aa, Mycobacterium
AKIKEVFPLASSDAVESFV

SEQ ID NO: 938951 - protein, 22 aa, Mycobacterium
AKLCVQYLAPIIKNRQVNFPPL

SEQ ID NO: 938952 - protein, 17 aa, Mycobacterium
AKLCVQYLAPIIKNRQY

SEQ ID NO: 938953 - protein, 18 aa, Mycobacterium
AKLSTFFCDKFRGVVASK

SEQ ID NO: 938954 - protein, 17 aa, Mycobacterium
AKLTVVFAHGFCLRMSA

SEQ ID NO: 938955 - protein, 23 aa, Mycobacterium
AKLWTIADLGGWDVVDPQLFDKG

SEQ ID NO: 938956 - protein, 20 aa, Mycobacterium
AKLWTVADLGGWEAVDPQLF

SEQ ID NO: 938957 - protein, 22 aa, Mycobacterium
AKRWPDQPGRYFTVRAGSLVAW

SEQ ID NO: 938958 - protein, 18 aa, Mycobacterium
AKTLPLVEPLRWVGLGQL

SEQ ID NO: 938959 - protein, 19 aa, Mycobacterium
AKTRFSAPMPVGRNLQISR

SEQ ID NO: 938960 - protein, 21 aa, Mycobacterium
AKVFAGCAIALGAALAGCGTN

SEQ ID NO: 938961 - protein, 17 aa, Mycobacterium
ALAAGAAGCSWGGAVVG

SEQ ID NO: 938962 - protein, 28 aa, Mycobacterium
ALAAGAAGCSWGGAVVGAVAAGAALASG

SEQ ID NO: 938963 - protein, 24 aa, Mycobacterium
ALAAGLGGEGWVGAFGAVSAGAAL

SEQ ID NO: 938964 - protein, 24 aa, Mycobacterium
ALAPWKQVLRNLGIDIGKNGQINL

SEQ ID NO: 938965 - protein, 18 aa, Mycobacterium
ALCRLALTARTGWQRWES

SEQ ID NO: 938966 - protein, 19 aa, Mycobacterium
ALEAWKSGIGDVVYSGAQP

SEQ ID NO: 938967 - protein, 18 aa, Mycobacterium
ALFGRPLIGDGADGQTVN

SEQ ID NO: 938968 - protein, 23 aa, Mycobacterium
ALGCTIKLLAICERLTSDEGKDR

SEQ ID NO: 938969 - protein, 23 aa, Mycobacterium
ALGRLRPLFRTGLGARLGSGRQY

SEQ ID NO: 938970 - protein, 24 aa, Mycobacterium
ALHRLRGMFAFAIWDTEKRELFCA

SEQ ID NO: 938971 - protein, 18 aa, Mycobacterium
ALKKRGGTFLVMTSPAGI

SEQ ID NO: 938972 - protein, 23 aa, Mycobacterium
ALLDEWSVILGPTFSTSNVDPAG

SEQ ID NO: 938973 - protein, 20 aa, Mycobacterium
ALLRIAYRLIVLFVVEDRDL

SEQ ID NO: 938974 - protein, 17 aa, Mycobacterium
ALMPLWLGAIALSLAIP

SEQ ID NO: 938975 - protein, 20 aa, Mycobacterium
ALNLVKCVHWPTGSPPAPPK

SEQ ID NO: 938976 - protein, 18 aa, Mycobacterium
ALPPDWANYGALISAFED

SEQ ID NO: 938977 - protein, 23 aa, Mycobacterium
ALQCSIKLLSICERLTDSEGHQR

SEQ ID NO: 938978 - protein, 20 aa, Mycobacterium
ALRDELGWRPAHSDFEAGLR

SEQ ID NO: 938979 - protein, 18 aa, Mycobacterium
ALRKAGYNVVTWDPRGEW

SEQ ID NO: 938980 - protein, 18 aa, Mycobacterium
ALSLSWRTGDDIVVTRTD

SEQ ID NO: 938981 - protein, 18 aa, Mycobacterium
ALTGQVLWQQLDDVPLVP

SEQ ID NO: 938982 - protein, 23 aa, Mycobacterium
ALTYPRRLGFGLGNSVVSLSWRT

SEQ ID NO: 938983 - protein, 24 aa, Mycobacterium
ALTYPRRLGFGLGNSVVSLSWRTG

SEQ ID NO: 938984 - protein, 17 aa, Mycobacterium
ALVGVALEEPVVTVVTA

SEQ ID NO: 938985 - protein, 24 aa, Mycobacterium
AMAAAARPYASWLGTAAARAAVTA

SEQ ID NO: 938986 - protein, 20 aa, Mycobacterium
AMNYGPWYGWGFGLGGISIG

SEQ ID NO: 938987 - protein, 19 aa, Mycobacterium
AMPQTIWVTGCNSWYLGKD

SEQ ID NO: 938988 - protein, 18 aa, Mycobacterium
AMQFIEVMRGYALPVDAP

SEQ ID NO: 938989 - protein, 20 aa, Mycobacterium
AMVIRCWRGSGSLTDRDATM

SEQ ID NO: 938990 - protein, 19 aa, Mycobacterium
ANAARFGLQDVIWRGTYYT

SEQ ID NO: 938991 - protein, 19 aa, Mycobacterium
ANGTHTWSYWGAQLQAMLP

SEQ ID NO: 938992 - protein, 17 aa, Mycobacterium
ANIEFIRVFLASPRDQR

SEQ ID NO: 938993 - protein, 18 aa, Mycobacterium
ANITRLPVRYTFDNRYFS

SEQ ID NO: 938994 - protein, 17 aa, Mycobacterium
ANMPRRLAIAAVGASLL

SEQ ID NO: 938995 - protein, 17 aa, Mycobacterium
ANPGVGVELDFAGSSEL

SEQ ID NO: 938996 - protein, 24 aa, Mycobacterium
ANSFTRWLPVVLYRATPEAFTDRS

SEQ ID NO: 938997 - protein, 23 aa, Mycobacterium
ANVKAVIVSPALVTSRAIQLTPA

SEQ ID NO: 938998 - protein, 18 aa, Mycobacterium
ANVSPEYTGTGWINYLGH

SEQ ID NO: 938999 - protein, 17 aa, Mycobacterium
ANYRAGQRVRLRMVNAG

SEQ ID NO: 939000 - protein, 19 aa, Mycobacterium
APALAMPGDLIFYGPEGTQ

SEQ ID NO: 939001 - protein, 17 aa, Mycobacterium
APAMMWCCEAAMGTSAN

SEQ ID NO: 939002 - protein, 18 aa, Mycobacterium
APAPCWSDQIAVTAAPTQ

SEQ ID NO: 939003 - protein, 17 aa, Mycobacterium
APATARDVRLIWSGDVA

SEQ ID NO: 939004 - protein, 18 aa, Mycobacterium
APGRAAWCSRRWARGTPV

SEQ ID NO: 939005 - protein, 17 aa, Mycobacterium
APGRNGGDGGLLWGDGG

SEQ ID NO: 939006 - protein, 20 aa, Mycobacterium
APGTETWTFAAMRPGTTTIV

SEQ ID NO: 939007 - protein, 17 aa, Mycobacterium
APIWGYRPLLDIDDQTA

SEQ ID NO: 939008 - protein, 22 aa, Mycobacterium
APKPKFRIGDIVVHGDAASATL

SEQ ID NO: 939009 - protein, 20 aa, Mycobacterium
APLKPFFRLVWSPRLARVTR

SEQ ID NO: 939010 - protein, 25 aa, Mycobacterium
APLSYPSVYLGCHYSNCSPGSRLPA

SEQ ID NO: 939011 - protein, 18 aa, Mycobacterium
APLVRLMRVLPPPLAKLF

SEQ ID NO: 939012 - protein, 21 aa, Mycobacterium
APPEPRLWGAFTERGLSNMPM

SEQ ID NO: 939013 - protein, 19 aa, Mycobacterium
APQHREFTQAALVTDLPGE

SEQ ID NO: 939014 - protein, 22 aa, Mycobacterium
APQPPFLWALMAFARRELDTLF

SEQ ID NO: 939015 - protein, 18 aa, Mycobacterium
APRDVCAFWPVPATSTAR

SEQ ID NO: 939016 - protein, 22 aa, Mycobacterium
APSGEVALCFDGDVRVSAWQAS

SEQ ID NO: 939017 - protein, 32 aa, Mycobacterium
APSQPPLLWVVLAWVRRELQRTFANSTPTTTP

SEQ ID NO: 939018 - protein, 19 aa, Mycobacterium
APTGIATVRFRIGDDGRLV

SEQ ID NO: 939019 - protein, 17 aa, Mycobacterium
APTSVHWHGLALRNDMD

SEQ ID NO: 939020 - protein, 25 aa, Mycobacterium
APVARDARFHWGVALMPSGPAGRVS

SEQ ID NO: 939021 - protein, 21 aa, Mycobacterium
APVEPRIPALAGQPPGVIVLV

SEQ ID NO: 939022 - protein, 17 aa, Mycobacterium
AQEWRKNTLFRSADRNL

SEQ ID NO: 939023 - protein, 19 aa, Mycobacterium
AQFPRPAVRPGYSALGGRQ

SEQ ID NO: 939024 - protein, 18 aa, Mycobacterium
AQIPYFFSQKGMLGVEPA

SEQ ID NO: 939025 - protein, 20 aa, Mycobacterium
AQLAEAFLKAGRCTAEATNA

SEQ ID NO: 939026 - protein, 19 aa, Mycobacterium
AQMLQRIVALMPMGVAVVD

SEQ ID NO: 939027 - protein, 17 aa, Mycobacterium
AQRCGSQAWDLPTVFGP

SEQ ID NO: 939028 - protein, 17 aa, Mycobacterium
AQRDWRVVVTDVNGEAA

SEQ ID NO: 939029 - protein, 18 aa, Mycobacterium
AQRLMKFFGGIPLLDGIG

SEQ ID NO: 939030 - protein, 22 aa, Mycobacterium
AQTFARWGVDYVKYDWCGPPAD

SEQ ID NO: 939031 - protein, 19 aa, Mycobacterium
AQYLGPALRLMNFNYLPMP

SEQ ID NO: 939032 - protein, 17 aa, Mycobacterium
ARAAELISAGWLDDMFT

SEQ ID NO: 939033 - protein, 18 aa, Mycobacterium
ARAALGFMDTELQIDYRD

SEQ ID NO: 939034 - protein, 17 aa, Mycobacterium
ARADIRGPYVINADGAP

SEQ ID NO: 939035 - protein, 23 aa, Mycobacterium
ARARSGQTYRVLFGVATPQGVNP

SEQ ID NO: 939036 - protein, 20 aa, Mycobacterium
ARAYPLFRLMGIDTVTPDTQ

SEQ ID NO: 939037 - protein, 19 aa, Mycobacterium
ARGLSQRGVPFSWAGGGIN

SEQ ID NO: 939038 - protein, 20 aa, Mycobacterium
ARGLSQRGVPFSWAGGGING

SEQ ID NO: 939039 - protein, 23 aa, Mycobacterium
ARIDRLNAQLARYGEVEMTSCVG

SEQ ID NO: 939040 - protein, 20 aa, Mycobacterium
ARLAKLFAHSAVVPRVVLVD

SEQ ID NO: 939041 - protein, 19 aa, Mycobacterium
ARLFADRGADVWIGDVDDV

SEQ ID NO: 939042 - protein, 22 aa, Mycobacterium
ARLLGEAGPILWADMPTLPLYR

SEQ ID NO: 939043 - protein, 20 aa, Mycobacterium
ARLLGEGAPILWNDVPTLPL

SEQ ID NO: 939044 - protein, 19 aa, Mycobacterium
ARNGLKTNIQGGGDVSVKP

SEQ ID NO: 939045 - protein, 20 aa, Mycobacterium
ARPLIQLGLPVAAAGWLSTE

SEQ ID NO: 939046 - protein, 19 aa, Mycobacterium
ARPSPPASFCPATNTIVVD

SEQ ID NO: 939047 - protein, 23 aa, Mycobacterium
ARPWYFGYNGFRPAPSPGGIEPT

SEQ ID NO: 939048 - protein, 20 aa, Mycobacterium
ARQAWFWAHEVMAVGMVWNT

SEQ ID NO: 939049 - protein, 19 aa, Mycobacterium
ARSGFHIHGAAGLLNLFTF

SEQ ID NO: 939050 - protein, 20 aa, Mycobacterium
ARSWPSRAWQALGARGSRVS

SEQ ID NO: 939051 - protein, 17 aa, Mycobacterium
ARVLRYVAASNFQAVEL

SEQ ID NO: 939052 - protein, 24 aa, Mycobacterium
ARVNSFLLPLLRSCNFNVVANQPG

SEQ ID NO: 939053 - protein, 18 aa, Mycobacterium
ARVSAAWIREHGGTEGVP

SEQ ID NO: 939054 - protein, 20 aa, Mycobacterium
ARVTVMFKDTHWAGGAYNHS

SEQ ID NO: 939055 - protein, 24 aa, Mycobacterium
ARYLPVILVHGTWGSTAREFAPTL

SEQ ID NO: 939056 - protein, 22 aa, Mycobacterium
ARYNVPWQPAWVFYRADGSSTF

SEQ ID NO: 939057 - protein, 20 aa, Mycobacterium
ASDAAWAFISWITSPEIDAE

SEQ ID NO: 939058 - protein, 24 aa, Mycobacterium
ASDPGGWPRLDWSMDAALLLAALA

SEQ ID NO: 939059 - protein, 19 aa, Mycobacterium
ASGFPRTDGAVIWARSDRP

SEQ ID NO: 939060 - protein, 23 aa, Mycobacterium
ASGGCHWPDCDSSNMPQIQCQIA

SEQ ID NO: 939061 - protein, 23 aa, Mycobacterium
ASGGLRINPEFHCEIAVDGQVVV

SEQ ID NO: 939062 - protein, 17 aa, Mycobacterium
ASLSVSAVLGWHLFAAH

SEQ ID NO: 939063 - protein, 19 aa, Mycobacterium
ASNITRLPVRYTFDNRYFS

SEQ ID NO: 939064 - protein, 19 aa, Mycobacterium
ASPGLPTRGVIALCDLGAG

SEQ ID NO: 939065 - protein, 25 aa, Mycobacterium
ASPLPVPQWWAKLCDAWWCTDTSLP

SEQ ID NO: 939066 - protein, 21 aa, Mycobacterium
ASRWRVLNIPKLLPAGRAPES

SEQ ID NO: 939067 - protein, 19 aa, Mycobacterium
ASSCTWQLSLFIPDGVPPP

SEQ ID NO: 939068 - protein, 18 aa, Mycobacterium
ATAAALWRFTAGAVDQPN

SEQ ID NO: 939069 - protein, 23 aa, Mycobacterium
ATAFPWRRQSALVQWYVETGDPA

SEQ ID NO: 939070 - protein, 23 aa, Mycobacterium
ATAFPWRRQYALVQWYVETGDVA

SEQ ID NO: 939071 - protein, 23 aa, Mycobacterium
ATAGEVPLAFALAAGSFRDGTRV

SEQ ID NO: 939072 - protein, 17 aa, Mycobacterium
ATAVAGRWSAERANTWY

SEQ ID NO: 939073 - protein, 17 aa, Mycobacterium
ATAWGRQDEAAFDAGQR

SEQ ID NO: 939074 - protein, 18 aa, Mycobacterium
ATDSRFRFLRVYPNPAVY

SEQ ID NO: 939075 - protein, 24 aa, Mycobacterium
ATGDPRPDGALVWARADEPARMIV

SEQ ID NO: 939076 - protein, 18 aa, Mycobacterium
ATGEARVSGMIASVAGNS

SEQ ID NO: 939077 - protein, 21 aa, Mycobacterium
ATGGPQCWDLPVVPFDVAPPF

SEQ ID NO: 939078 - protein, 23 aa, Mycobacterium
ATGLQLPGAHSFFVGNPRIGKTF

SEQ ID NO: 939079 - protein, 19 aa, Mycobacterium
ATGLRWAEGPVYFPDGGYL

SEQ ID NO: 939080 - protein, 22 aa, Mycobacterium
ATKRIGKVFGEFDSDSSAMVVL

SEQ ID NO: 939081 - protein, 17 aa, Mycobacterium
ATLLAAIGLGNNGYETL

SEQ ID NO: 939082 - protein, 22 aa, Mycobacterium
ATLLTARCPVLFAPAMHTEMWL

SEQ ID NO: 939083 - protein, 23 aa, Mycobacterium
ATLSPGFHGLHIHAFGRCEPNSP

SEQ ID NO: 939084 - protein, 18 aa, Mycobacterium
ATLVGSLSVPQGWATAAP

SEQ ID NO: 939085 - protein, 21 aa, Mycobacterium
ATPDAAWAFVSWITAKPNDVV

SEQ ID NO: 939086 - protein, 23 aa, Mycobacterium
ATPLRPGVWRAYADHRMAMAGAI

SEQ ID NO: 939087 - protein, 20 aa, Mycobacterium
ATTWPDKRIDLYFPGESALQ

SEQ ID NO: 939088 - protein, 23 aa, Mycobacterium
ATTWPRKRIDLYFPGRSALQGHH

SEQ ID NO: 939089 - protein, 22 aa, Mycobacterium
ATWSAACAIALATGALAGAAPA

SEQ ID NO: 939090 - protein, 21 aa, Mycobacterium
AVAIHELLHAFGFTSGTEEPG

SEQ ID NO: 939091 - protein, 20 aa, Mycobacterium
AVAIPFWWSIHNIVLQELLR

SEQ ID NO: 939092 - protein, 23 aa, Mycobacterium
AVCGVIGIFCPKAAPAAAASGEG

SEQ ID NO: 939093 - protein, 18 aa, Mycobacterium
AVEGAFYWLNNREVRWRP

SEQ ID NO: 939094 - protein, 19 aa, Mycobacterium
AVELGRSGAKVAISDVDLE

SEQ ID NO: 939095 - protein, 21 aa, Mycobacterium
AVFPAEGWVDIALLLTTLTAA

SEQ ID NO: 939096 - protein, 17 aa, Mycobacterium
AVGDNFKGQIDIPEPGL

SEQ ID NO: 939097 - protein, 21 aa, Mycobacterium
AVGGFSFVVPAGWVESDASHL

SEQ ID NO: 939098 - protein, 22 aa, Mycobacterium
AVGLAGCGIIKPGSSNPTPGTW

SEQ ID NO: 939099 - protein, 24 aa, Mycobacterium
AVGMPTCWDEWFPEVSRMYSLAGA

SEQ ID NO: 939100 - protein, 17 aa, Mycobacterium
AVHELMHSFGFLSSLGK

SEQ ID NO: 939101 - protein, 27 aa, Mycobacterium
AVLKSIKAGVDWALWVSTEKVGSVLDR

SEQ ID NO: 939102 - protein, 19 aa, Mycobacterium
AVNTAAWWVMNAIPTAVSL

SEQ ID NO: 939103 - protein, 19 aa, Mycobacterium
AVPTARCGTVAVPVDYADP

SEQ ID NO: 939104 - protein, 18 aa, Mycobacterium
AVRPGYSALGGRQWAAAG

SEQ ID NO: 939105 - protein, 19 aa, Mycobacterium
AVSNLRWDGDFVLVDVDAS

SEQ ID NO: 939106 - protein, 24 aa, Mycobacterium
AVTAAEVPLAFALAAGSFRDATRV

SEQ ID NO: 939107 - protein, 18 aa, Mycobacterium
AVTLAWLAIRNIRVVRQY

SEQ ID NO: 939108 - protein, 18 aa, Mycobacterium
AVVKRCYAEVLPAARSGA

SEQ ID NO: 939109 - protein, 19 aa, Mycobacterium
AVVLLMWAGILAYLDHAGY

SEQ ID NO: 939110 - protein, 20 aa, Mycobacterium
AVVPRWPWAPLTQVMRLLPP

SEQ ID NO: 939111 - protein, 19 aa, Mycobacterium
AVWCGPCAAVRRVVDQVSA

SEQ ID NO: 939112 - protein, 27 aa, Mycobacterium
AVWLPDLGRVLGLFVLTAIPGYSYTDS

SEQ ID NO: 939113 - protein, 20 aa, Mycobacterium
AWEAAVPWIDYGVGLVDGAL

SEQ ID NO: 939114 - protein, 18 aa, Mycobacterium
AWQLRALFAAGLSAMYAA

SEQ ID NO: 939115 - protein, 18 aa, Mycobacterium
AWWPMPFAHAARVTLINT

SEQ ID NO: 939116 - protein, 19 aa, Mycobacterium
AYDAGRRLLYWTSEGYIHD

SEQ ID NO: 939117 - protein, 17 aa, Mycobacterium
AYDRAWWFARFVADTYG

SEQ ID NO: 939118 - protein, 23 aa, Mycobacterium
AYEVDPRLDAVVALTRSGAVMQI

SEQ ID NO: 939119 - protein, 18 aa, Mycobacterium
AYKDFGVGMVRNDDREFS

SEQ ID NO: 939120 - protein, 23 aa, Mycobacterium
AYLAGSPMTGWAVGVFRSPSGTE

SEQ ID NO: 939121 - protein, 18 aa, Mycobacterium
AYLHIPGLPPIVTLPNRP

SEQ ID NO: 939122 - protein, 18 aa, Mycobacterium
AYLKASWERPFSKEDTRD

SEQ ID NO: 939123 - protein, 25 aa, Mycobacterium
AYTYILGFWMRPRRVLDAAGTGAMT

SEQ ID NO: 939124 - protein, 19 aa, Mycobacterium
CAGCGMAAAARPMRGVSGL

SEQ ID NO: 939125 - protein, 18 aa, Mycobacterium
CAKWHGIANVPMPGGPGS

SEQ ID NO: 939126 - protein, 17 aa, Mycobacterium
CALVLVTSGCARFNDAQ

SEQ ID NO: 939127 - protein, 20 aa, Mycobacterium
CAQYLGPALRLMNFNYLPMP

SEQ ID NO: 939128 - protein, 17 aa, Mycobacterium
CAVPGAWPPVTIAGRRY

SEQ ID NO: 939129 - protein, 18 aa, Mycobacterium
CAVPGAWPPVTIGDRRYI

SEQ ID NO: 939130 - protein, 17 aa, Mycobacterium
CCAVALTVACTRVVDGE

SEQ ID NO: 939131 - protein, 20 aa, Mycobacterium
CDGPCRGSVVALEPSTGKIL

SEQ ID NO: 939132 - protein, 20 aa, Mycobacterium
CDLESALALTSWLQPLWLSR

SEQ ID NO: 939133 - protein, 18 aa, Mycobacterium
CGARGCWDLSVDGRALAR

SEQ ID NO: 939134 - protein, 17 aa, Mycobacterium
CGFRGLNSFNLPGTKGG

SEQ ID NO: 939135 - protein, 19 aa, Mycobacterium
CGFRGLNSFRLPGTQGQGQ

SEQ ID NO: 939136 - protein, 17 aa, Mycobacterium
CGGCCQCAIGCPRNAKF

SEQ ID NO: 939137 - protein, 20 aa, Mycobacterium
CGGPPCKGAVVALEPSTGKI

SEQ ID NO: 939138 - protein, 21 aa, Mycobacterium
CGGPPCKGAVVALEPSTGKIL

SEQ ID NO: 939139 - protein, 17 aa, Mycobacterium
CGKAGCTTYKWETFLTS

SEQ ID NO: 939140 - protein, 24 aa, Mycobacterium
CGPFKEAVPEWKGLANLPVSTALA

SEQ ID NO: 939141 - protein, 24 aa, Mycobacterium
CGRPKPANIAAVWGLTRGWIADMV

SEQ ID NO: 939142 - protein, 22 aa, Mycobacterium
CGSEAWDLPVVFGPIAVTYNIN

SEQ ID NO: 939143 - protein, 21 aa, Mycobacterium
CGSGLKAVEVGTTFDCTAADP

SEQ ID NO: 939144 - protein, 19 aa, Mycobacterium
CGVIGTALWLDGRLHHVDA

SEQ ID NO: 939145 - protein, 18 aa, Mycobacterium
CGVSWNLLAGIGRIESMH

SEQ ID NO: 939146 - protein, 19 aa, Mycobacterium
CGVSWNLLAGIGRIESMHA

SEQ ID NO: 939147 - protein, 18 aa, Mycobacterium
CGYSDCKVLTTFTACGAV

SEQ ID NO: 939148 - protein, 17 aa, Mycobacterium
CLGDRPANVVFLNGSPT

SEQ ID NO: 939149 - protein, 22 aa, Mycobacterium
CLTAGCWPAWWLGNQDRGEIDI

SEQ ID NO: 939150 - protein, 17 aa, Mycobacterium
CLVALAILDAVGVSPEQ

SEQ ID NO: 939151 - protein, 21 aa, Mycobacterium
CLWGGLALLLSCCGRPTSQAP

SEQ ID NO: 939152 - protein, 19 aa, Mycobacterium
CPAKACLHWGAMWGPASDA

SEQ ID NO: 939153 - protein, 20 aa, Mycobacterium
CPDLPGMLGKMFKVPMSEFY

SEQ ID NO: 939154 - protein, 22 aa, Mycobacterium
CPEGPFGFCPVRSMSGSAMLPN

SEQ ID NO: 939155 - protein, 22 aa, Mycobacterium
CPGEFWNPIWGFNWEFGECHDD

SEQ ID NO: 939156 - protein, 17 aa, Mycobacterium
CPGGRWGWGELAVCDGE

SEQ ID NO: 939157 - protein, 19 aa, Mycobacterium
CPKETWCVRNARAYSSPMN

SEQ ID NO: 939158 - protein, 18 aa, Mycobacterium
CPTCNRWRAGGWARWASR

SEQ ID NO: 939159 - protein, 21 aa, Mycobacterium
CQELDGRTALGFVRTRATARA

SEQ ID NO: 939160 - protein, 17 aa, Mycobacterium
CQQISWGAPPAQLEGLA

SEQ ID NO: 939161 - protein, 17 aa, Mycobacterium
CRAARAWMDQQGGDPRS

SEQ ID NO: 939162 - protein, 17 aa, Mycobacterium
CRDRHGWRAPPQAAPPL

SEQ ID NO: 939163 - protein, 18 aa, Mycobacterium
CRLSLAFAQLWQGEVAEA

SEQ ID NO: 939164 - protein, 18 aa, Mycobacterium
CRNDCPRLAPGDFAQRPT

SEQ ID NO: 939165 - protein, 20 aa, Mycobacterium
CRQLDSALPWYGDVRQRLQA

SEQ ID NO: 939166 - protein, 19 aa, Mycobacterium
CRQTLPSALTWRRIAGDPL

SEQ ID NO: 939167 - protein, 17 aa, Mycobacterium
CRVRRILIAALSAVLLV

SEQ ID NO: 939168 - protein, 24 aa, Mycobacterium
CSDAGYRLAFGWQRAFADRLDDVV

SEQ ID NO: 939169 - protein, 20 aa, Mycobacterium
CSGLIKWAFLQNGKSLPRSS

SEQ ID NO: 939170 - protein, 21 aa, Mycobacterium
CSPGSRLPAQLSELTSANSSI

SEQ ID NO: 939171 - protein, 20 aa, Mycobacterium
CSVGLRVGRVVVTRADHVDV

SEQ ID NO: 939172 - protein, 21 aa, Mycobacterium
CWPRPGWGGGHGGGWGHGSWG

SEQ ID NO: 939173 - protein, 18 aa, Mycobacterium
CYLPAFVCLGIVPVVVGL

SEQ ID NO: 939174 - protein, 24 aa, Mycobacterium
DAARARRATGPARTGCAAGSADTA

SEQ ID NO: 939175 - protein, 19 aa, Mycobacterium
DAATALGWRAAPIPRNAPG

SEQ ID NO: 939176 - protein, 22 aa, Mycobacterium
DACALLPCLGEYEFAECAAGLR

SEQ ID NO: 939177 - protein, 21 aa, Mycobacterium
DADCPCCADMPAAKGGDDCCA

SEQ ID NO: 939178 - protein, 17 aa, Mycobacterium
DAFMLGAYFIWQYGPPG

SEQ ID NO: 939179 - protein, 23 aa, Mycobacterium
DAGARRTFFGIPLSRSATTATGI

SEQ ID NO: 939180 - protein, 19 aa, Mycobacterium
DAGGEVILWARRADVAEQI

SEQ ID NO: 939181 - protein, 22 aa, Mycobacterium
DAKLRRCDFSLVSFAVQVPHPS

SEQ ID NO: 939182 - protein, 18 aa, Mycobacterium
DALCALGLQSRVVGAAFP

SEQ ID NO: 939183 - protein, 17 aa, Mycobacterium
DALGWKLNGKFREKDGH

SEQ ID NO: 939184 - protein, 17 aa, Mycobacterium
DALRTAMRINLEPGTPV

SEQ ID NO: 939185 - protein, 18 aa, Mycobacterium
DAPLLKKILTYHVVPGQL

SEQ ID NO: 939186 - protein, 18 aa, Mycobacterium
DAQLPAGGMLFIGTPDGQ

SEQ ID NO: 939187 - protein, 23 aa, Mycobacterium
DAQPRLSILLGDYVAAPEGRVRL

SEQ ID NO: 939188 - protein, 23 aa, Mycobacterium
DAQPRLSILLGDYVVPAEGRVGL

SEQ ID NO: 939189 - protein, 19 aa, Mycobacterium
DARLRFMLHDAKPVAAVTT

SEQ ID NO: 939190 - protein, 17 aa, Mycobacterium
DATALRDELGWRPAHSD

SEQ ID NO: 939191 - protein, 20 aa, Mycobacterium
DAVLGMACDGGWWVLGVHDA

SEQ ID NO: 939192 - protein, 20 aa, Mycobacterium
DAYSAAALRRVWRYTHFSWW

SEQ ID NO: 939193 - protein, 22 aa, Mycobacterium
DCGDGYEVPADWYVPDGPTPTR

SEQ ID NO: 939194 - protein, 22 aa, Mycobacterium
DCRRTAPGSAMWVADLADTSAL

SEQ ID NO: 939195 - protein, 17 aa, Mycobacterium
DCSGLMRYGFAGVGVLI

SEQ ID NO: 939196 - protein, 23 aa, Mycobacterium
DCYLGEGVAKVWAPARSWAFYTP

SEQ ID NO: 939197 - protein, 18 aa, Mycobacterium
DDAGWRPGAGQIREKDGA

SEQ ID NO: 939198 - protein, 22 aa, Mycobacterium
DDDPRLGVLRVYGQCRNVGDHH

SEQ ID NO: 939199 - protein, 23 aa, Mycobacterium
DDFLRVIGVPAMFAAGDVAAARM

SEQ ID NO: 939200 - protein, 17 aa, Mycobacterium
DDFRWPFNIPGYWMTPM

SEQ ID NO: 939201 - protein, 17 aa, Mycobacterium
DDKGVRTPVRWSLEPMQ

SEQ ID NO: 939202 - protein, 22 aa, Mycobacterium
DDRYLVSLSVNWSAANQGISAA

SEQ ID NO: 939203 - protein, 19 aa, Mycobacterium
DDVRILKSWNIIDSYKAYF

SEQ ID NO: 939204 - protein, 30 aa, Mycobacterium
DDVSAAIAALFNAHAEQYQALSVRVAELHE

SEQ ID NO: 939205 - protein, 21 aa, Mycobacterium
DDWHTAMAMVLLRNGITDVNT

SEQ ID NO: 939206 - protein, 23 aa, Mycobacterium
DDYLRVVGVPAVFAAGDVALAEV

SEQ ID NO: 939207 - protein, 20 aa, Mycobacterium
DDYWKRWSIRDRYQNVTVPV

SEQ ID NO: 939208 - protein, 20 aa, Mycobacterium
DEDLLTWKAAPAAAPAQRSG

SEQ ID NO: 939209 - protein, 19 aa, Mycobacterium
DEGKPAIEIIPFDSQDAAT

SEQ ID NO: 939210 - protein, 23 aa, Mycobacterium
DELGIRIVQAWGMTETSPLAAVA

SEQ ID NO: 939211 - protein, 23 aa, Mycobacterium
DELGIRIVQAWGMTETSPLASVA

SEQ ID NO: 939212 - protein, 23 aa, Mycobacterium
DEVRGRLTFSWGVESAVLAPTEL

SEQ ID NO: 939213 - protein, 23 aa, Mycobacterium
DEVSAAIAALFSDHALQYQAVSA

SEQ ID NO: 939214 - protein, 21 aa, Mycobacterium
DEVSALVAVQFAAHAATYQAV

SEQ ID NO: 939215 - protein, 27 aa, Mycobacterium
DEVSTAIAALFGWHAQTYQSLSAQATS

SEQ ID NO: 939216 - protein, 22 aa, Mycobacterium
DEVSTAIAMLFSRHAQAYQQLS

SEQ ID NO: 939217 - protein, 23 aa, Mycobacterium
DEVSVAIAAGFRAYGQAYQALST

SEQ ID NO: 939218 - protein, 22 aa, Mycobacterium
DEVSVAVAQLFDGHGQAYQAIS

SEQ ID NO: 939219 - protein, 20 aa, Mycobacterium
DEVWTALATMVFSQGSAPEV

SEQ ID NO: 939220 - protein, 19 aa, Mycobacterium
DEYIMRTGADWFPGLDRQI

SEQ ID NO: 939221 - protein, 23 aa, Mycobacterium
DFDAHGASLAWLIGAIPTGDPLL

SEQ ID NO: 939222 - protein, 22 aa, Mycobacterium
DFDPAEAIAHGFVDSQKLLAWR

SEQ ID NO: 939223 - protein, 18 aa, Mycobacterium
DFPDRPDNMFALANTLLG

SEQ ID NO: 939224 - protein, 29 aa, Mycobacterium
DFSHFLGFTLPWVMRGWREVESVPIRPNA

SEQ ID NO: 939225 - protein, 18 aa, Mycobacterium
DFTAWAVPGWSWDDVLPH

SEQ ID NO: 939226 - protein, 18 aa, Mycobacterium
DGAPLPWTLVLSTTAPSV

SEQ ID NO: 939227 - protein, 17 aa, Mycobacterium
DGAVVWQVALVHRDGST

SEQ ID NO: 939228 - protein, 18 aa, Mycobacterium
DGCVRLPLNLSRNDVRAS

SEQ ID NO: 939229 - protein, 25 aa, Mycobacterium
DGDIWDWAVPWDEWTSMSALSSADR

SEQ ID NO: 939230 - protein, 27 aa, Mycobacterium
DGDKGLRFSFRWDLGRSRLIMVDSRNA

SEQ ID NO: 939231 - protein, 19 aa, Mycobacterium
DGEGRRLLGLEIKLPTVVQ

SEQ ID NO: 939232 - protein, 21 aa, Mycobacterium
DGFPGMAAAYGFDPARAQTPI

SEQ ID NO: 939233 - protein, 22 aa, Mycobacterium
DGGKYGCYWARLRSFDTNDIID

SEQ ID NO: 939234 - protein, 17 aa, Mycobacterium
DGLRWSTTEQLGYNRRY

SEQ ID NO: 939235 - protein, 18 aa, Mycobacterium
DGLSLGEAITLWLSGQEQ

SEQ ID NO: 939236 - protein, 19 aa, Mycobacterium
DGLSLGEALTLWLSGQEQL

SEQ ID NO: 939237 - protein, 17 aa, Mycobacterium
DGNTGWGFLPGGAGAQC

SEQ ID NO: 939238 - protein, 20 aa, Mycobacterium
DGRWDRNWLLGWRDITNASN

SEQ ID NO: 939239 - protein, 19 aa, Mycobacterium
DGTISWNFADHEWALDGEV

SEQ ID NO: 939240 - protein, 17 aa, Mycobacterium
DGWECQRAMSVANNVIV

SEQ ID NO: 939241 - protein, 17 aa, Mycobacterium
DGYRTEVEWATQMSYSG

SEQ ID NO: 939242 - protein, 19 aa, Mycobacterium
DHAVRFTRRGLFVHPAPWA

SEQ ID NO: 939243 - protein, 25 aa, Mycobacterium
DHCLDLPGLFVWRRYHPMPATTRGV

SEQ ID NO: 939244 - protein, 17 aa, Mycobacterium
DIPSLLYSYGFEQNPDW

SEQ ID NO: 939245 - protein, 23 aa, Mycobacterium
DISRAEEVLGWRPQVELADGVRR

SEQ ID NO: 939246 - protein, 17 aa, Mycobacterium
DKFPRMVDYVVPTGVRI

SEQ ID NO: 939247 - protein, 17 aa, Mycobacterium
DLAGKLLMPGFVEGHIH

SEQ ID NO: 939248 - protein, 18 aa, Mycobacterium
DLAKSWARERETFGRPLT

SEQ ID NO: 939249 - protein, 22 aa, Mycobacterium
DLCGLPVRVFRCDMILTDTTYS

SEQ ID NO: 939250 - protein, 20 aa, Mycobacterium
DLDVPWGIAFLPDGSALIAE

SEQ ID NO: 939251 - protein, 17 aa, Mycobacterium
DLFWALRGGGGGNFGVT

SEQ ID NO: 939252 - protein, 18 aa, Mycobacterium
DLNQGVLINTNLGYLQFG

SEQ ID NO: 939253 - protein, 18 aa, Mycobacterium
DLPAGESITNAWSSKLAQ

SEQ ID NO: 939254 - protein, 24 aa, Mycobacterium
DLPGELMSALSQGLSQFGINLPPM

SEQ ID NO: 939255 - protein, 19 aa, Mycobacterium
DLPTLLAHYGVHGVNTDSD

SEQ ID NO: 939256 - protein, 25 aa, Mycobacterium
DLQRSCLDIGLAERVLGWRPRVELA

SEQ ID NO: 939257 - protein, 25 aa, Mycobacterium
DLRECLRLSAKTGIYGARYVTADDV

SEQ ID NO: 939258 - protein, 17 aa, Mycobacterium
DLRHDWPQALRDAGFQT

SEQ ID NO: 939259 - protein, 25 aa, Mycobacterium
DLRRSCLDIGLAERVLGWRPRVALD

SEQ ID NO: 939260 - protein, 24 aa, Mycobacterium
DLTIPRLKKGLFLGTHWGQLDMPV

SEQ ID NO: 939261 - protein, 24 aa, Mycobacterium
DLTLGEALTLWLSDTEQLVPRDII

SEQ ID NO: 939262 - protein, 17 aa, Mycobacterium
DLVTWWTGDALMVFSGN

SEQ ID NO: 939263 - protein, 18 aa, Mycobacterium
DMLNGIYDPVQWEINIIK

SEQ ID NO: 939264 - protein, 24 aa, Mycobacterium
DMVGICLRGKPGWGEVLAPLDTVI

SEQ ID NO: 939265 - protein, 18 aa, Mycobacterium
DMYTRSSVQLRQLLIDNK

SEQ ID NO: 939266 - protein, 23 aa, Mycobacterium
DNDLRGVVMFDGFAFDGALADSL

SEQ ID NO: 939267 - protein, 18 aa, Mycobacterium
DPALRATVMYPRGTVIMA

SEQ ID NO: 939268 - protein, 18 aa, Mycobacterium
DPARPGAAPPFGIDDTVE

SEQ ID NO: 939269 - protein, 18 aa, Mycobacterium
DPICAKYRIPCIAGSAES

SEQ ID NO: 939270 - protein, 20 aa, Mycobacterium
DPIIKVFGGYGIRLGDYLDT

SEQ ID NO: 939271 - protein, 24 aa, Mycobacterium
DPNSRFSVSMLWSGDKAWRQSGER

SEQ ID NO: 939272 - protein, 19 aa, Mycobacterium
DPPSAAAWASFTAEHVKDH

SEQ ID NO: 939273 - protein, 21 aa, Mycobacterium
DPRVAPWYFDWIRHSTRDDYW

SEQ ID NO: 939274 - protein, 20 aa, Mycobacterium
DPTQLSWWINRFTEITQTLA

SEQ ID NO: 939275 - protein, 19 aa, Mycobacterium
DQGVEAWPKCGAASGLPIG

SEQ ID NO: 939276 - protein, 23 aa, Mycobacterium
DQLRIAPLLTGWRGGPVADIDAL

SEQ ID NO: 939277 - protein, 18 aa, Mycobacterium
DQPFAVWPWAQPKLGAAQ

SEQ ID NO: 939278 - protein, 19 aa, Mycobacterium
DQPFAVWPWAQPKLGAAQP

SEQ ID NO: 939279 - protein, 19 aa, Mycobacterium
DQPFAVWPWAQPKLGRAQP

SEQ ID NO: 939280 - protein, 19 aa, Mycobacterium
DQYRFPQNLPIVGAKGGPG

SEQ ID NO: 939281 - protein, 23 aa, Mycobacterium
DRAGFKGLCYFDPGARSFYTTDR

SEQ ID NO: 939282 - protein, 17 aa, Mycobacterium
DRDLLGWGNEVWDPLPW

SEQ ID NO: 939283 - protein, 20 aa, Mycobacterium
DRGGAVIGRLAAFRDNTPSG

SEQ ID NO: 939284 - protein, 17 aa, Mycobacterium
DRGGVVGACAAVAAESS

SEQ ID NO: 939285 - protein, 18 aa, Mycobacterium
DRHRGWIWIYPIQPHVYV

SEQ ID NO: 939286 - protein, 20 aa, Mycobacterium
DRLATALAISGSWNENQPNN

SEQ ID NO: 939287 - protein, 18 aa, Mycobacterium
DRLLRPGGVVDMLTSEGG

SEQ ID NO: 939288 - protein, 19 aa, Mycobacterium
DRLNRSFVYALNIGSPLYS

SEQ ID NO: 939289 - protein, 17 aa, Mycobacterium
DRLRLALETAVRGGGDT

SEQ ID NO: 939290 - protein, 25 aa, Mycobacterium
DRMIWEVGHSLPLFQAPGNVAVRSD

SEQ ID NO: 939291 - protein, 18 aa, Mycobacterium
DRPDNMFALANTLLGLAT

SEQ ID NO: 939292 - protein, 19 aa, Mycobacterium
DRPRLPAGEECSMFQLLIG

SEQ ID NO: 939293 - protein, 25 aa, Mycobacterium
DRPSGCAGWLIRDLVCHLIIDAQDV

SEQ ID NO: 939294 - protein, 21 aa, Mycobacterium
DRRPGGKWMLGKPIQVAEARD

SEQ ID NO: 939295 - protein, 20 aa, Mycobacterium
DRWSLCQTLAYLAVTNCYAG

SEQ ID NO: 939296 - protein, 23 aa, Mycobacterium
DSLRGGAIYDTWTRLGSAESDLG

SEQ ID NO: 939297 - protein, 22 aa, Mycobacterium
DSRAYRLDWPAGHTVYEVDQPR

SEQ ID NO: 939298 - protein, 26 aa, Mycobacterium
DSVLPDRPGFFFAIDGHSMWANSKAL

SEQ ID NO: 939299 - protein, 17 aa, Mycobacterium
DSYKMSGGQGFAIPIGR

SEQ ID NO: 939300 - protein, 17 aa, Mycobacterium
DTDRVTLFRAWYSRSNF

SEQ ID NO: 939301 - protein, 17 aa, Mycobacterium
DTLPAWRVQPPVPADEL

SEQ ID NO: 939302 - protein, 31 aa, Mycobacterium
DTLPRRPQFALLKGRRNYLCLNKIHNGGAEA

SEQ ID NO: 939303 - protein, 21 aa, Mycobacterium
DTRIACGVISPASTETSVSTS

SEQ ID NO: 939304 - protein, 18 aa, Mycobacterium
DTWVPRRVDFDVDAARAA

SEQ ID NO: 939305 - protein, 24 aa, Mycobacterium
DTYAKANNIELVWNSANNDVSTQA

SEQ ID NO: 939306 - protein, 18 aa, Mycobacterium
DVDMAFWFSDVRAPYFAG

SEQ ID NO: 939307 - protein, 20 aa, Mycobacterium
DVFPDLGYRIIDVSQEYDMA

SEQ ID NO: 939308 - protein, 17 aa, Mycobacterium
DVIPFDWANDSNTAATR

SEQ ID NO: 939309 - protein, 22 aa, Mycobacterium
DVKLDAGHWLDFWDSTFNNQGG

SEQ ID NO: 939310 - protein, 17 aa, Mycobacterium
DVPSLLYSYSFVKNPTW

SEQ ID NO: 939311 - protein, 24 aa, Mycobacterium
DVRSLKAADGWAFLWSAMQEPDGS

SEQ ID NO: 939312 - protein, 25 aa, Mycobacterium
DVVALRIPIVVGFQLGAFAAGAAYQ

SEQ ID NO: 939313 - protein, 18 aa, Mycobacterium
DVVQAWTISDLKVSTDQL

SEQ ID NO: 939314 - protein, 18 aa, Mycobacterium
DVVYSFAANPSWNPFAFS

SEQ ID NO: 939315 - protein, 22 aa, Mycobacterium
DWDRRLRPMLARQFELAAGRRK

SEQ ID NO: 939316 - protein, 17 aa, Mycobacterium
DWLARNGLKTNIQGGGD

SEQ ID NO: 939317 - protein, 18 aa, Mycobacterium
DWLRPDYIPPQAIPPQAI

SEQ ID NO: 939318 - protein, 18 aa, Mycobacterium
DWPDRPDNLFALANAIAG

SEQ ID NO: 939319 - protein, 21 aa, Mycobacterium
DWPLRPPPAVTRAFDAPVQDW

SEQ ID NO: 939320 - protein, 17 aa, Mycobacterium
DWYRANESWWRPLKDAA

SEQ ID NO: 939321 - protein, 19 aa, Mycobacterium
DYAFTIFDVQGWRGHNGDI

SEQ ID NO: 939322 - protein, 18 aa, Mycobacterium
DYFQACRAARAWMDQQGG

SEQ ID NO: 939323 - protein, 25 aa, Mycobacterium
DYLPRDEFFGGVLGWVDGQQVTQAS

SEQ ID NO: 939324 - protein, 18 aa, Mycobacterium
EAAEGRWFASQVRANPNP

SEQ ID NO: 939325 - protein, 17 aa, Mycobacterium
EAAYLLNFVKELVKVFG

SEQ ID NO: 939326 - protein, 21 aa, Mycobacterium
EAAYRLIPRLRDIAAGAANGE

SEQ ID NO: 939327 - protein, 19 aa, Mycobacterium
EAFRKPRVGMLVREAQTLG

SEQ ID NO: 939328 - protein, 21 aa, Mycobacterium
EAGAIPSFLGYHGYPASICAS

SEQ ID NO: 939329 - protein, 17 aa, Mycobacterium
EAGRAPGARCAGSGTGR

SEQ ID NO: 939330 - protein, 19 aa, Mycobacterium
EAHDGLGWLAQRGYVPLGY

SEQ ID NO: 939331 - protein, 18 aa, Mycobacterium
EALTLWLSGQEQLVPRDL

SEQ ID NO: 939332 - protein, 19 aa, Mycobacterium
EALVRWRHPVWGLLLPDSF

SEQ ID NO: 939333 - protein, 21 aa, Mycobacterium
EANRSSAFLGFTNRYAAASYI

SEQ ID NO: 939334 - protein, 18 aa, Mycobacterium
EAPPGYPAIHHLTSPLRK

SEQ ID NO: 939335 - protein, 19 aa, Mycobacterium
EARDVLKKAGFRVADQASS

SEQ ID NO: 939336 - protein, 18 aa, Mycobacterium
EARHGRKFGIVAGYGGHG

SEQ ID NO: 939337 - protein, 23 aa, Mycobacterium
EASEWHGHVAGFVRGHTSTATVS

SEQ ID NO: 939338 - protein, 23 aa, Mycobacterium
EDGAPRAWAWRTADGVRREGTVV

SEQ ID NO: 939339 - protein, 18 aa, Mycobacterium
EDLPGFLHGLAIGPDGTA

SEQ ID NO: 939340 - protein, 17 aa, Mycobacterium
EDWKVGLDVYPGAYIPP

SEQ ID NO: 939341 - protein, 17 aa, Mycobacterium
EECSMFQLLIGYRYQSA

SEQ ID NO: 939342 - protein, 19 aa, Mycobacterium
EELARYGVQPDWFQLGDRD

SEQ ID NO: 939343 - protein, 22 aa, Mycobacterium
EELQRRAAVRWAQVTAVRVDRD

SEQ ID NO: 939344 - protein, 25 aa, Mycobacterium
EEVAESFGGIGLRCDVTDPDQVDAT

SEQ ID NO: 939345 - protein, 17 aa, Mycobacterium
EFAEAGWALPLSDDPAG

SEQ ID NO: 939346 - protein, 17 aa, Mycobacterium
EFAEAGWAVPLSEDPAG

SEQ ID NO: 939347 - protein, 18 aa, Mycobacterium
EFAEAGWTLPLSEDPAGL

SEQ ID NO: 939348 - protein, 20 aa, Mycobacterium
EFPELVQIFGDFALYCAIRA

SEQ ID NO: 939349 - protein, 19 aa, Mycobacterium
EGAPPRALWHLGAGATATP

SEQ ID NO: 939350 - protein, 18 aa, Mycobacterium
EGGIIYHYYWFRDQSQTK

SEQ ID NO: 939351 - protein, 21 aa, Mycobacterium
EGHSMFPWLTLALVGNATGRI

SEQ ID NO: 939352 - protein, 19 aa, Mycobacterium
EGIQCPFHGWVWNGAGRNV

SEQ ID NO: 939353 - protein, 22 aa, Mycobacterium
EGISVNVTLIFSVDRHRGVMDA

SEQ ID NO: 939354 - protein, 23 aa, Mycobacterium
EGISVNVTLIFSVERHRLVMDAY

SEQ ID NO: 939355 - protein, 23 aa, Mycobacterium
EGISVNVTLIFSVERHRQVMDAY

SEQ ID NO: 939356 - protein, 24 aa, Mycobacterium
EGISVNVTLIFSVERYRAVMDAYL

SEQ ID NO: 939357 - protein, 23 aa, Mycobacterium
EGISVNVTLIFSVERYREVVDAY

SEQ ID NO: 939358 - protein, 18 aa, Mycobacterium
EGNPWFTPYDRYREDGEE

SEQ ID NO: 939359 - protein, 18 aa, Mycobacterium
EGNPWFTSYDRYRFDLDE

SEQ ID NO: 939360 - protein, 19 aa, Mycobacterium
EGWWPMLIGISMGDAGGYK

SEQ ID NO: 939361 - protein, 23 aa, Mycobacterium
EHRCPACGDPVRWRLVDEAAAVR

SEQ ID NO: 939362 - protein, 24 aa, Mycobacterium
EHRCPLCAEPVRWRLVGEEAELRP

SEQ ID NO: 939363 - protein, 18 aa, Mycobacterium
EICGMPPPSSGGIAVAAT

SEQ ID NO: 939364 - protein, 23 aa, Mycobacterium
EIDNLRAAYSWSLEKSDPEIALE

SEQ ID NO: 939365 - protein, 18 aa, Mycobacterium
EIIDRGGAVGGLLFDGTN

SEQ ID NO: 939366 - protein, 20 aa, Mycobacterium
EILRSWPSVHKWGNATWPQF

SEQ ID NO: 939367 - protein, 22 aa, Mycobacterium
EIQARYAAAPSHVFLVFLHHTY

SEQ ID NO: 939368 - protein, 21 aa, Mycobacterium
EIRASVLVAEWPPRRDVADPD

SEQ ID NO: 939369 - protein, 18 aa, Mycobacterium
EISWNWGDGNEWALGDEV

SEQ ID NO: 939370 - protein, 19 aa, Mycobacterium
EKAKSLLDAAGWKPGPDGI

SEQ ID NO: 939371 - protein, 21 aa, Mycobacterium
EKLRPMPHLLLIVDEFTQMFA

SEQ ID NO: 939372 - protein, 18 aa, Mycobacterium
EKLWTIADLGGWDTVDPQ

SEQ ID NO: 939373 - protein, 22 aa, Mycobacterium
EKLWTIDDLGGWKNVDTQLFDK

SEQ ID NO: 939374 - protein, 23 aa, Mycobacterium
EKQRFFLNYARIWRDKQRPEDAI

SEQ ID NO: 939375 - protein, 22 aa, Mycobacterium
ELALRPRLAIGIHQPAINPRRS

SEQ ID NO: 939376 - protein, 23 aa, Mycobacterium
ELCSFPLRQCGSGNLFGGNEPAR

SEQ ID NO: 939377 - protein, 17 aa, Mycobacterium
ELDPRYPPVSGRPPLPL

SEQ ID NO: 939378 - protein, 18 aa, Mycobacterium
ELFNNLLPAHIVKDVPGG

SEQ ID NO: 939379 - protein, 18 aa, Mycobacterium
ELGFRPGAHFEYSNSNYL

SEQ ID NO: 939380 - protein, 24 aa, Mycobacterium
ELGLRPRLAIGIFQPAPDERRAPT

SEQ ID NO: 939381 - protein, 20 aa, Mycobacterium
ELGLRPRLAIGIHQPPVAAR

SEQ ID NO: 939382 - protein, 20 aa, Mycobacterium
ELGTRWFADKAFWVKDGQNY

SEQ ID NO: 939383 - protein, 19 aa, Mycobacterium
ELLRRARLYVGRPGEAFAE

SEQ ID NO: 939384 - protein, 18 aa, Mycobacterium
ELPARLAKLFAHSAVVPR

SEQ ID NO: 939385 - protein, 19 aa, Mycobacterium
ELPDRLRRLFAGAGVVPRV

SEQ ID NO: 939386 - protein, 24 aa, Mycobacterium
ELPFNRILAVGGFRCNVQQASGIS

SEQ ID NO: 939387 - protein, 19 aa, Mycobacterium
ELRIDPRLQLAAEWHTNDV

SEQ ID NO: 939388 - protein, 23 aa, Mycobacterium
ELRLKGPQCFLGYADPSLDAEAF

SEQ ID NO: 939389 - protein, 18 aa, Mycobacterium
ELRNRLKAASGLSLSPTL

SEQ ID NO: 939390 - protein, 19 aa, Mycobacterium
ELRRLLGLHKVIWLPGIAG

SEQ ID NO: 939391 - protein, 23 aa, Mycobacterium
ELTLGEALTLWLSGQEQLVPRDL

SEQ ID NO: 939392 - protein, 19 aa, Mycobacterium
EMFKKAGGGHLVLISSVLG

SEQ ID NO: 939393 - protein, 25 aa, Mycobacterium
EMQPADGVTLPWKVDATVGDISRGA

SEQ ID NO: 939394 - protein, 20 aa, Mycobacterium
EMSSRLAGGIVAKAADEIAA

SEQ ID NO: 939395 - protein, 26 aa, Mycobacterium
ENFWRSAGLPEFRWPDPNGTRLPNGA

SEQ ID NO: 939396 - protein, 18 aa, Mycobacterium
ENGWKTFFRGLANDGVQG

SEQ ID NO: 939397 - protein, 17 aa, Mycobacterium
ENVGGWSVFGIAFPTPN

SEQ ID NO: 939398 - protein, 18 aa, Mycobacterium
EPARGGWQTVPGSRRDAS

SEQ ID NO: 939399 - protein, 23 aa, Mycobacterium
EPAWRECVRLLPALGDTKVDEGF

SEQ ID NO: 939400 - protein, 18 aa, Mycobacterium
EPDLRPGGPGTRSGPTAI

SEQ ID NO: 939401 - protein, 18 aa, Mycobacterium
EPELRPGPTTTPPPPPPL

SEQ ID NO: 939402 - protein, 22 aa, Mycobacterium
EPERVKISFWYDDRYDVPADAA

SEQ ID NO: 939403 - protein, 17 aa, Mycobacterium
EPFGCLRPGPAPDGVGV

SEQ ID NO: 939404 - protein, 17 aa, Mycobacterium
EPFGCLRPVPPPDGVGT

SEQ ID NO: 939405 - protein, 18 aa, Mycobacterium
EPFSEWQGMFAGNTMLLP

SEQ ID NO: 939406 - protein, 23 aa, Mycobacterium
EPLGLPGELSWRVPSLSLADEAI

SEQ ID NO: 939407 - protein, 22 aa, Mycobacterium
EPLGVPGELSWWVPSLSVTGEA

SEQ ID NO: 939408 - protein, 22 aa, Mycobacterium
EPLLAFRIPWYVTVLDLGPAGA

SEQ ID NO: 939409 - protein, 23 aa, Mycobacterium
EPLLALRIPWYVTVLDLGPAGAV

SEQ ID NO: 939410 - protein, 20 aa, Mycobacterium
EPLLRIPVPDGWERNTMMDN

SEQ ID NO: 939411 - protein, 19 aa, Mycobacterium
EPSSGFSTMLWGGQPLPTI

SEQ ID NO: 939412 - protein, 21 aa, Mycobacterium
EPVPDWREWQALIRGHYGNDI

SEQ ID NO: 939413 - protein, 18 aa, Mycobacterium
EQARTRFDAAWNHQAGDH

SEQ ID NO: 939414 - protein, 18 aa, Mycobacterium
EQFPRLSLIEIVGHDGDL

SEQ ID NO: 939415 - protein, 19 aa, Mycobacterium
EQLLPRWLVSWREAVTRQG

SEQ ID NO: 939416 - protein, 18 aa, Mycobacterium
EQPQQPWNPFAPQQPAPE

SEQ ID NO: 939417 - protein, 30 aa, Mycobacterium
EQYQALSVRVAELHESFTRALTAGSTAYAT

SEQ ID NO: 939418 - protein, 19 aa, Mycobacterium
ERELQTWIDWLVRNGGLEE

SEQ ID NO: 939419 - protein, 17 aa, Mycobacterium
ERLPAGVTVRWADLTNA

SEQ ID NO: 939420 - protein, 34 aa, Mycobacterium
ERRLNRLAPVYAYRRLKLYLGYDLRQIRSSHARS

SEQ ID NO: 939421 - protein, 22 aa, Mycobacterium
ERSHGRPALRFAQISDSHIGFT

SEQ ID NO: 939422 - protein, 23 aa, Mycobacterium
ERVLPRRRCFTFDDTHSIFVSDA

SEQ ID NO: 939423 - protein, 17 aa, Mycobacterium
ESALRFVGAATFEALSG

SEQ ID NO: 939424 - protein, 21 aa, Mycobacterium
ESGYRAGLLASIIASCTASYT

SEQ ID NO: 939425 - protein, 17 aa, Mycobacterium
ESLRPCGVREVVLVGRR

SEQ ID NO: 939426 - protein, 19 aa, Mycobacterium
ESRLPPIYPGTTVSIPPST

SEQ ID NO: 939427 - protein, 17 aa, Mycobacterium
ETIDWYRANESWWRPLK

SEQ ID NO: 939428 - protein, 20 aa, Mycobacterium
ETNVEFWAAVILDFAEVPPT

SEQ ID NO: 939429 - protein, 20 aa, Mycobacterium
ETQPVFGWLPGGWTTNTFGQ

SEQ ID NO: 939430 - protein, 20 aa, Mycobacterium
ETRKSFGIAGARVVDSIKLS

SEQ ID NO: 939431 - protein, 20 aa, Mycobacterium
EVFDKLAGVGIDLTDVFVVL

SEQ ID NO: 939432 - protein, 24 aa, Mycobacterium
EVGDHIRAIVTFGNIVNRFAPVQS

SEQ ID NO: 939433 - protein, 20 aa, Mycobacterium
EVLDAWLATVEEIRTKGTVP

SEQ ID NO: 939434 - protein, 22 aa, Mycobacterium
EVLRLRWRRGCMPVPRRVIRAR

SEQ ID NO: 939435 - protein, 19 aa, Mycobacterium
EVNSALMFTGAGSAPTLAA

SEQ ID NO: 939436 - protein, 19 aa, Mycobacterium
EVPRRLSLYESLRRDRTSR

SEQ ID NO: 939437 - protein, 19 aa, Mycobacterium
EVRGYRFAPSFSIWTTIEE

SEQ ID NO: 939438 - protein, 20 aa, Mycobacterium
EVSELIASLFRAYGQECQAV

SEQ ID NO: 939439 - protein, 26 aa, Mycobacterium
EVSGAIATLFCGYARDYQNLSTQLAD

SEQ ID NO: 939440 - protein, 19 aa, Mycobacterium
EVSTALALDRMVDRAQKWR

SEQ ID NO: 939441 - protein, 19 aa, Mycobacterium
EWGVTGWPGATAYAASKSG

SEQ ID NO: 939442 - protein, 18 aa, Mycobacterium
EWLKGGTLLVLRRITMNL

SEQ ID NO: 939443 - protein, 21 aa, Mycobacterium
EWVKGVPIGGGFRVPAIVISP

SEQ ID NO: 939444 - protein, 25 aa, Mycobacterium
EYAQLRAQWGWRLVAAASTLPTPAL

SEQ ID NO: 939445 - protein, 17 aa, Mycobacterium
FAAIPAQRRKLVTNHHV

SEQ ID NO: 939446 - protein, 17 aa, Mycobacterium
FAALPPEQLEILRTDPA

SEQ ID NO: 939447 - protein, 18 aa, Mycobacterium
FADFLARPNHAVTHIKVA

SEQ ID NO: 939448 - protein, 21 aa, Mycobacterium
FAEALPRWLGGGTDGDRYVNS

SEQ ID NO: 939449 - protein, 18 aa, Mycobacterium
FAGGYAISVCKTVTLTVD

SEQ ID NO: 939450 - protein, 18 aa, Mycobacterium
FAGHGEWRVPELLDAAIA

SEQ ID NO: 939451 - protein, 18 aa, Mycobacterium
FAGLTAFSVAACGTHGDT

SEQ ID NO: 939452 - protein, 23 aa, Mycobacterium
FAGPWEVFGAWAADFPQDKYKPV

SEQ ID NO: 939453 - protein, 25 aa, Mycobacterium
FAKPRAEMAFTYLVDLINVDRVAPS

SEQ ID NO: 939454 - protein, 22 aa, Mycobacterium
FAKPYAEWRGMFAGNGMLLPSS

SEQ ID NO: 939455 - protein, 17 aa, Mycobacterium
FALPPSFMFTGDQTAGP

SEQ ID NO: 939456 - protein, 20 aa, Mycobacterium
FAMKFSRPFTSYGTWDGDAV

SEQ ID NO: 939457 - protein, 20 aa, Mycobacterium
FAMTVSDGFGGTATQTVKVP

SEQ ID NO: 939458 - protein, 20 aa, Mycobacterium
FAPGELKNLPGYEGSNNGSA

SEQ ID NO: 939459 - protein, 18 aa, Mycobacterium
FAPTLLPALAAAGIQAFT

SEQ ID NO: 939460 - protein, 18 aa, Mycobacterium
FARERSRWLFSNPDMIHL

SEQ ID NO: 939461 - protein, 17 aa, Mycobacterium
FARIGIGPDGDFDADKL

SEQ ID NO: 939462 - protein, 21 aa, Mycobacterium
FARNDIDLHLGVTVDHIDVDT

SEQ ID NO: 939463 - protein, 19 aa, Mycobacterium
FASLESWPCIGEAGPGKRP

SEQ ID NO: 939464 - protein, 23 aa, Mycobacterium
FATIPAVLLRWGVSQFDADARPA

SEQ ID NO: 939465 - protein, 21 aa, Mycobacterium
FAVGDVCRWLNPRYGRATRVE

SEQ ID NO: 939466 - protein, 23 aa, Mycobacterium
FAYLRLPSLLFGVGRYQVTMKLQ

SEQ ID NO: 939467 - protein, 19 aa, Mycobacterium
FDAVFALNVRAPYFLVGAL

SEQ ID NO: 939468 - protein, 17 aa, Mycobacterium
FDAVPFLELLSAYGAPW

SEQ ID NO: 939469 - protein, 25 aa, Mycobacterium
FDAYGQCLIEHGMPAPPAGFGPPPG

SEQ ID NO: 939470 - protein, 28 aa, Mycobacterium
FDFTIPRLKSGILLGTRWGQPGASLVPA

SEQ ID NO: 939471 - protein, 17 aa, Mycobacterium
FDLPWSYDFVRPQRPID

SEQ ID NO: 939472 - protein, 17 aa, Mycobacterium
FDNWGWRYGGRDWRGEG

SEQ ID NO: 939473 - protein, 17 aa, Mycobacterium
FDPCFDIPSSVIAAAGL

SEQ ID NO: 939474 - protein, 19 aa, Mycobacterium
FDPREAISHGFVESQKLPA

SEQ ID NO: 939475 - protein, 17 aa, Mycobacterium
FDSLPFLDRLNTFGAPW

SEQ ID NO: 939476 - protein, 17 aa, Mycobacterium
FDVVQRLGLGFTPPEHE

SEQ ID NO: 939477 - protein, 17 aa, Mycobacterium
FEEGLRETIDWYRANES

SEQ ID NO: 939478 - protein, 24 aa, Mycobacterium
FEEGLRTTIDWYRANESWWRPLKD

SEQ ID NO: 939479 - protein, 21 aa, Mycobacterium
FEHSRIITCTGWYLSSAKAAE

SEQ ID NO: 939480 - protein, 17 aa, Mycobacterium
FEVFIRPALRNAMGLPD

SEQ ID NO: 939481 - protein, 17 aa, Mycobacterium
FEWVDSFVVQWIPDHYW

SEQ ID NO: 939482 - protein, 17 aa, Mycobacterium
FFAPMRMTLALLPRMLA

SEQ ID NO: 939483 - protein, 18 aa, Mycobacterium
FFDVLPLMADNLYNAVDQ

SEQ ID NO: 939484 - protein, 18 aa, Mycobacterium
FFPPPMVERMVAAGDLGR

SEQ ID NO: 939485 - protein, 22 aa, Mycobacterium
FGELRYRLLLQIGVPGQDPTND

SEQ ID NO: 939486 - protein, 19 aa, Mycobacterium
FGGGCGRHGASSKAPGPAQ

SEQ ID NO: 939487 - protein, 18 aa, Mycobacterium
FGGKGRAAIVIGDPDTAK

SEQ ID NO: 939488 - protein, 17 aa, Mycobacterium
FGGYGIRLGDYLDTRVF

SEQ ID NO: 939489 - protein, 19 aa, Mycobacterium
FGHVWASDHIQPWQDNEGH

SEQ ID NO: 939490 - protein, 17 aa, Mycobacterium
FGKVLAVAGFRCNVQEE

SEQ ID NO: 939491 - protein, 17 aa, Mycobacterium
FGPEVYGTVVARDQDRD

SEQ ID NO: 939492 - protein, 19 aa, Mycobacterium
FGQIRFDRTYGYSAEFSNV

SEQ ID NO: 939493 - protein, 18 aa, Mycobacterium
FGVDLGWVPPFPNPVAED

SEQ ID NO: 939494 - protein, 20 aa, Mycobacterium
FGVPLVCLLAGLLLAATHGV

SEQ ID NO: 939495 - protein, 22 aa, Mycobacterium
FGVPLVCLLAGLLLAATHGVSG

SEQ ID NO: 939496 - protein, 18 aa, Mycobacterium
FGYAEHRELLAAAGALVA

SEQ ID NO: 939497 - protein, 18 aa, Mycobacterium
FHGLQIHSVGKCEANSAA

SEQ ID NO: 939498 - protein, 21 aa, Mycobacterium
FHSLLPRPSRRVINKDATTHE

SEQ ID NO: 939499 - protein, 23 aa, Mycobacterium
FHVRPGVQILRTWLYEEAFAIEG

SEQ ID NO: 939500 - protein, 23 aa, Mycobacterium
FHWWLVLATLRWGVICRYQAERH

SEQ ID NO: 939501 - protein, 17 aa, Mycobacterium
FIPEPSTALSALQAGEV

SEQ ID NO: 939502 - protein, 19 aa, Mycobacterium
FKGDPAFHGPMRRDWNYMI

SEQ ID NO: 939503 - protein, 19 aa, Mycobacterium
FKYTLWRLQERVVGKGVYG

SEQ ID NO: 939504 - protein, 17 aa, Mycobacterium
FLAQLCEDWEAATLPAQ

SEQ ID NO: 939505 - protein, 22 aa, Mycobacterium
FLELTGRPLIGNGADGYTNAQG

SEQ ID NO: 939506 - protein, 20 aa, Mycobacterium
FLRRFSLLDSLYMVPSARLI

SEQ ID NO: 939507 - protein, 22 aa, Mycobacterium
FLTRELPAWLAANRGVEPTGNA

SEQ ID NO: 939508 - protein, 20 aa, Mycobacterium
FLTRELPAWLAANRNVSTTG

SEQ ID NO: 939509 - protein, 20 aa, Mycobacterium
FLTTELPQWLGVNKGISPAA

SEQ ID NO: 939510 - protein, 21 aa, Mycobacterium
FNGILNLAVAFADNVQATAGP

SEQ ID NO: 939511 - protein, 19 aa, Mycobacterium
FNVALPWSKEVSLPKSSLH

SEQ ID NO: 939512 - protein, 18 aa, Mycobacterium
FNYLDLVNYLAVGNLNPS

SEQ ID NO: 939513 - protein, 19 aa, Mycobacterium
FNYLDLVRYLAVNNLNPSP

SEQ ID NO: 939514 - protein, 18 aa, Mycobacterium
FPAAVSWGATSQQVREDL

SEQ ID NO: 939515 - protein, 17 aa, Mycobacterium
FPGIGAFGDRIAPGLGL

SEQ ID NO: 939516 - protein, 21 aa, Mycobacterium
FPIEPRSGQQFQFTVDVPGTV

SEQ ID NO: 939517 - protein, 22 aa, Mycobacterium
FPKECPAPGVMQGCLDSTSGLI

SEQ ID NO: 939518 - protein, 22 aa, Mycobacterium
FPLACAACWINGVPMREAVAGM

SEQ ID NO: 939519 - protein, 20 aa, Mycobacterium
FPMGLGLVAQFFGRYFTPDE

SEQ ID NO: 939520 - protein, 22 aa, Mycobacterium
FPPNGTHAWGYWGAQLQAMKPD

SEQ ID NO: 939521 - protein, 18 aa, Mycobacterium
FPQNLPIVGAKGGPGGKP

SEQ ID NO: 939522 - protein, 19 aa, Mycobacterium
FPVEWEFPPGWGPDARGQA

SEQ ID NO: 939523 - protein, 18 aa, Mycobacterium
FPYAVTWMWCQVSQGCFD

SEQ ID NO: 939524 - protein, 17 aa, Mycobacterium
FQAWQIGGTYQRDGKTR

SEQ ID NO: 939525 - protein, 17 aa, Mycobacterium
FQKRYLAAGGHNAVFNF

SEQ ID NO: 939526 - protein, 21 aa, Mycobacterium
FQQRLFGPLGMRNTLLPSPAE

SEQ ID NO: 939527 - protein, 17 aa, Mycobacterium
FQRTPCWVLPRLDVATP

SEQ ID NO: 939528 - protein, 17 aa, Mycobacterium
FREGVWLRPENLEVDLP

SEQ ID NO: 939529 - protein, 17 aa, Mycobacterium
FRFGPKATYHATFTNAS

SEQ ID NO: 939530 - protein, 22 aa, Mycobacterium
FRGELPLPCPFAMGHEMVGEIA

SEQ ID NO: 939531 - protein, 19 aa, Mycobacterium
FRHVQPWFKNDILQAVRQE

SEQ ID NO: 939532 - protein, 18 aa, Mycobacterium
FRLPPFGRYTLRMYFRPD

SEQ ID NO: 939533 - protein, 19 aa, Mycobacterium
FRPNPNWSHLLPPGPEIQA

SEQ ID NO: 939534 - protein, 19 aa, Mycobacterium
FRPSVLWRVAEHSQRRRRR

SEQ ID NO: 939535 - protein, 20 aa, Mycobacterium
FRVPCIVVSPFSRGGLMVHD

SEQ ID NO: 939536 - protein, 19 aa, Mycobacterium
FRVPCLVISPFSRGGLMVH

SEQ ID NO: 939537 - protein, 19 aa, Mycobacterium
FRWPFNIPGYWMTPMFTLA

SEQ ID NO: 939538 - protein, 20 aa, Mycobacterium
FSEPEVFDFPGGIGPVECVN

SEQ ID NO: 939539 - protein, 17 aa, Mycobacterium
FSGALARDKDNLGRALD

SEQ ID NO: 939540 - protein, 24 aa, Mycobacterium
FSGRARLSSVLWTFTVTKQDGVVC

SEQ ID NO: 939541 - protein, 17 aa, Mycobacterium
FSGVIPESTLASMQNQH

SEQ ID NO: 939542 - protein, 23 aa, Mycobacterium
FSRNCRTWLGLALCMQGNLTEAQ

SEQ ID NO: 939543 - protein, 18 aa, Mycobacterium
FSSKCTHKGCTVNEIADG

SEQ ID NO: 939544 - protein, 19 aa, Mycobacterium
FSSLSGWAQLGLRGQFVDL

SEQ ID NO: 939545 - protein, 19 aa, Mycobacterium
FSSLSGWAQLGLRNRFIEL

SEQ ID NO: 939546 - protein, 18 aa, Mycobacterium
FSSLSGWAQLGVRDRFIA

SEQ ID NO: 939547 - protein, 19 aa, Mycobacterium
FSVPWLVGIDQGFFEKRGV

SEQ ID NO: 939548 - protein, 17 aa, Mycobacterium
FSYLAARADIAAIAKNN

SEQ ID NO: 939549 - protein, 17 aa, Mycobacterium
FTAFVPFAARWPVEVHI

SEQ ID NO: 939550 - protein, 17 aa, Mycobacterium
FTEGRALATLQFDGPTD

SEQ ID NO: 939551 - protein, 19 aa, Mycobacterium
FTFLKLFGVDLGWVPPFPN

SEQ ID NO: 939552 - protein, 19 aa, Mycobacterium
FTFYLCDLLLKVNGKGGQP

SEQ ID NO: 939553 - protein, 18 aa, Mycobacterium
FTGFAPRDVCAMWPVPPT

SEQ ID NO: 939554 - protein, 27 aa, Mycobacterium
FTIQFFQWFIDYAFGFRAHGAPGQPPD

SEQ ID NO: 939555 - protein, 18 aa, Mycobacterium
FTPWTYDTWPSVFTQLEA

SEQ ID NO: 939556 - protein, 23 aa, Mycobacterium
FTQGRALVRLEFDSAIEDPVTEQ

SEQ ID NO: 939557 - protein, 19 aa, Mycobacterium
FTSPCFWRRGEYDCTTSPC

SEQ ID NO: 939558 - protein, 25 aa, Mycobacterium
FTSVPMIFARPSYYGQFTDSGGINN

SEQ ID NO: 939559 - protein, 21 aa, Mycobacterium
FTVLMDREWKHGVMAAVDVTL

SEQ ID NO: 939560 - protein, 21 aa, Mycobacterium
FVACPFGTPGQRMYRTGDLVR

SEQ ID NO: 939561 - protein, 17 aa, Mycobacterium
FVVPAGWVESDASHLDY

SEQ ID NO: 939562 - protein, 17 aa, Mycobacterium
FWAAVILDFAEVPPTMM

SEQ ID NO: 939563 - protein, 18 aa, Mycobacterium
FWFCGQCHACARGRSHAC

SEQ ID NO: 939564 - protein, 21 aa, Mycobacterium
FYGRAALEFGLRQAAMTADWA

SEQ ID NO: 939565 - protein, 25 aa, Mycobacterium
FYLWAEPWVQWGFSVASWAAGWVPY

SEQ ID NO: 939566 - protein, 22 aa, Mycobacterium
FYRPNLPGSYPIVLATYEIVCS

SEQ ID NO: 939567 - protein, 19 aa, Mycobacterium
FYSCMVVFKTSYGVLQQAL

SEQ ID NO: 939568 - protein, 18 aa, Mycobacterium
GAAARNGRRLVIAMMYGL

SEQ ID NO: 939569 - protein, 18 aa, Mycobacterium
GAAARNGRRLVIAMMYGM

SEQ ID NO: 939570 - protein, 18 aa, Mycobacterium
GAECRRVGIADAHCVLPL

SEQ ID NO: 939571 - protein, 19 aa, Mycobacterium
GAFGDRIAPGLGLDGPSYG

SEQ ID NO: 939572 - protein, 17 aa, Mycobacterium
GAFMWAWAPDAFETITA

SEQ ID NO: 939573 - protein, 17 aa, Mycobacterium
GAFRLGFVQPWAMGTIA

SEQ ID NO: 939574 - protein, 24 aa, Mycobacterium
GAGGAGGLMWGHGGSGGAGGDGGA

SEQ ID NO: 939575 - protein, 19 aa, Mycobacterium
GAGGFRSEAMWGPPTDPAW

SEQ ID NO: 939576 - protein, 26 aa, Mycobacterium
GAGGLGGGGFRVGHGGGGGNGGNGGV

SEQ ID NO: 939577 - protein, 24 aa, Mycobacterium
GAGGSGGWLWGAGGTGGDGGAGST

SEQ ID NO: 939578 - protein, 23 aa, Mycobacterium
GAGGYRLTAVFANALNLPERAKV

SEQ ID NO: 939579 - protein, 18 aa, Mycobacterium
GAGLPDLLSPVGANVGYR

SEQ ID NO: 939580 - protein, 18 aa, Mycobacterium
GAGLPWTVAIGMVVPLAL

SEQ ID NO: 939581 - protein, 25 aa, Mycobacterium
GAGSEPMLLAARGWSELSAELQSAA

SEQ ID NO: 939582 - protein, 21 aa, Mycobacterium
GAGVLPACPAHSADAASATVA

SEQ ID NO: 939583 - protein, 20 aa, Mycobacterium
GAGVPPRYGVRLTVMPRPPA

SEQ ID NO: 939584 - protein, 23 aa, Mycobacterium
GAIARLPAIFTHRDVGNTDCPGN

SEQ ID NO: 939585 - protein, 17 aa, Mycobacterium
GAICRWQAANPAGLIDI

SEQ ID NO: 939586 - protein, 18 aa, Mycobacterium
GAIYDHWQAIGGMNSVLG

SEQ ID NO: 939587 - protein, 24 aa, Mycobacterium
GAIYEAWGRLGFERGALGLPTSGE

SEQ ID NO: 939588 - protein, 18 aa, Mycobacterium
GAKELGCAQFTVTAKPSA

SEQ ID NO: 939589 - protein, 17 aa, Mycobacterium
GAKRPRRAPTIAASAIA

SEQ ID NO: 939590 - protein, 19 aa, Mycobacterium
GALASWYVWAALGLYPSTP

SEQ ID NO: 939591 - protein, 19 aa, Mycobacterium
GALGERFMPGLGLDGPSYG

SEQ ID NO: 939592 - protein, 23 aa, Mycobacterium
GALPRRPVFALLKGRGNYLCLNK

SEQ ID NO: 939593 - protein, 17 aa, Mycobacterium
GALRPMRPAFSVGLGAR

SEQ ID NO: 939594 - protein, 17 aa, Mycobacterium
GALSSWYVWAALGLYPI

SEQ ID NO: 939595 - protein, 17 aa, Mycobacterium
GAPGDFLSAGGHFNVPG

SEQ ID NO: 939596 - protein, 18 aa, Mycobacterium
GAPGDFLSAGGHFQVPGR

SEQ ID NO: 939597 - protein, 17 aa, Mycobacterium
GAPGQRGGAGGAGGLLL

SEQ ID NO: 939598 - protein, 18 aa, Mycobacterium
GAPPQWWLATPISLNTAG

SEQ ID NO: 939599 - protein, 22 aa, Mycobacterium
GATLKYTWTWGEGRDFGYDTTA

SEQ ID NO: 939600 - protein, 24 aa, Mycobacterium
GATVDEYGFNPGPPYGADGQAGAM

SEQ ID NO: 939601 - protein, 18 aa, Mycobacterium
GAVVIGVFGVVLTTIPPV

SEQ ID NO: 939602 - protein, 25 aa, Mycobacterium
GCKRPLMSRDWYPTFALPNVSLETA

SEQ ID NO: 939603 - protein, 18 aa, Mycobacterium
GCQTDIFAAIAPVAGTLL

SEQ ID NO: 939604 - protein, 19 aa, Mycobacterium
GDAGGPGGLLFGNGGNGGS

SEQ ID NO: 939605 - protein, 17 aa, Mycobacterium
GDALTRRRALTILGLTV

SEQ ID NO: 939606 - protein, 17 aa, Mycobacterium
GDCDAGFAFDTMVDKTM

SEQ ID NO: 939607 - protein, 17 aa, Mycobacterium
GDFPAAVSWGATSQQVR

SEQ ID NO: 939608 - protein, 18 aa, Mycobacterium
GDGFDVANGGGWGSSGGS

SEQ ID NO: 939609 - protein, 18 aa, Mycobacterium
GDGSNAWSAVHRVDAARV

SEQ ID NO: 939610 - protein, 24 aa, Mycobacterium
GDHPRYAAVPLRLHPDIHLYCAVP

SEQ ID NO: 939611 - protein, 19 aa, Mycobacterium
GDHQFGFGGFNSGSGNVGI

SEQ ID NO: 939612 - protein, 19 aa, Mycobacterium
GDKGYRTRADWYLPTQGDG

SEQ ID NO: 939613 - protein, 22 aa, Mycobacterium
GDLKNPRLLAAFAAGAAAAGRD

SEQ ID NO: 939614 - protein, 19 aa, Mycobacterium
GDLKPGQLKTVWKSDMIAG

SEQ ID NO: 939615 - protein, 21 aa, Mycobacterium
GDLLSIPGLFVFGSNDYFGPR

SEQ ID NO: 939616 - protein, 17 aa, Mycobacterium
GDMTFSWYAVDRSGQPW

SEQ ID NO: 939617 - protein, 19 aa, Mycobacterium
GDTAFPWRNQAAVLQWYVE

SEQ ID NO: 939618 - protein, 21 aa, Mycobacterium
GDVDAVYTWLPTVDQVRKNGR

SEQ ID NO: 939619 - protein, 20 aa, Mycobacterium
GDVLPGYGWIFPLGGGQINI

SEQ ID NO: 939620 - protein, 23 aa, Mycobacterium
GDYFSFYLCDLILKLNGKGGQPV

SEQ ID NO: 939621 - protein, 23 aa, Mycobacterium
GEATFRFPLVVAHRYTTGTPVPG

SEQ ID NO: 939622 - protein, 24 aa, Mycobacterium
GEDYLRLAALGAYGSFFNIYFCSV

SEQ ID NO: 939623 - protein, 24 aa, Mycobacterium
GEDYLRLAALGSYGAFFNIYFCTV

SEQ ID NO: 939624 - protein, 23 aa, Mycobacterium
GEDYLRLAALGSYGSFFNIYFCS

SEQ ID NO: 939625 - protein, 17 aa, Mycobacterium
GEIRSRLQAAWDQLFRV

SEQ ID NO: 939626 - protein, 24 aa, Mycobacterium
GELIREMLDWAACEHVPDDYLPLL

SEQ ID NO: 939627 - protein, 19 aa, Mycobacterium
GELPFRVVASYSVKSPPVD

SEQ ID NO: 939628 - protein, 23 aa, Mycobacterium
GELYKAWGALGFERGALGLPTSA

SEQ ID NO: 939629 - protein, 17 aa, Mycobacterium
GEMWAQDALAMYGYAAS

SEQ ID NO: 939630 - protein, 24 aa, Mycobacterium
GEVLRLRWRRGCLPVPRRVVRARV

SEQ ID NO: 939631 - protein, 18 aa, Mycobacterium
GEVLRPQNGYVFIQTKSG

SEQ ID NO: 939632 - protein, 19 aa, Mycobacterium
GEVPLAYALAAGSFRDGTR

SEQ ID NO: 939633 - protein, 17 aa, Mycobacterium
GEVSWQWEGAGAESYVA

SEQ ID NO: 939634 - protein, 17 aa, Mycobacterium
GEVYGWLAEEFSRNDDA

SEQ ID NO: 939635 - protein, 18 aa, Mycobacterium
GFADAWRRAVTAVNRDIQ

SEQ ID NO: 939636 - protein, 21 aa, Mycobacterium
GFDVSARLAAAIAAAAPKLAL

SEQ ID NO: 939637 - protein, 18 aa, Mycobacterium
GFGGNGGLLFGKAGADGP

SEQ ID NO: 939638 - protein, 18 aa, Mycobacterium
GFTGFAPRDVCAFWPVPA

SEQ ID NO: 939639 - protein, 20 aa, Mycobacterium
GGAAPGGFDCSGLVMWAFQQ

SEQ ID NO: 939640 - protein, 20 aa, Mycobacterium
GGAGGLLFGNGGAGGVGGAG

SEQ ID NO: 939641 - protein, 24 aa, Mycobacterium
GGAGGRGGLVYGDGGRGGDGGLGG

SEQ ID NO: 939642 - protein, 21 aa, Mycobacterium
GGAGGRGGWLYGDGGAGGTGG

SEQ ID NO: 939643 - protein, 21 aa, Mycobacterium
GGANQFFGHAGDGGHGGTGGT

SEQ ID NO: 939644 - protein, 17 aa, Mycobacterium
GGARGCPPATWCVQNAG

SEQ ID NO: 939645 - protein, 24 aa, Mycobacterium
GGDGGKGGDAWVIGNGGNGGSGGT

SEQ ID NO: 939646 - protein, 20 aa, Mycobacterium
GGDGYADFDQPFGGNGGDGG

SEQ ID NO: 939647 - protein, 19 aa, Mycobacterium
GGFFTRFPGITIPWLDITF

SEQ ID NO: 939648 - protein, 19 aa, Mycobacterium
GGFYTRDGVTRMLAQKTTV

SEQ ID NO: 939649 - protein, 23 aa, Mycobacterium
GGGGGAGGWLFGAGGQGGTGGNG

SEQ ID NO: 939650 - protein, 24 aa, Mycobacterium
GGGGGAGGWLFGAGGQGGTGGNGL

SEQ ID NO: 939651 - protein, 20 aa, Mycobacterium
GGGQGFAIPIGRAMGVAGQI

SEQ ID NO: 939652 - protein, 21 aa, Mycobacterium
GGGVPSFLGYHGFPATICASV

SEQ ID NO: 939653 - protein, 18 aa, Mycobacterium
GGGYAGPRYGFRPTVMPK

SEQ ID NO: 939654 - protein, 18 aa, Mycobacterium
GGHGVCLDPLNPIQTPLL

SEQ ID NO: 939655 - protein, 25 aa, Mycobacterium
GGILSRFPGFYIPFLDVPFNGATPP

SEQ ID NO: 939656 - protein, 24 aa, Mycobacterium
GGIRGPIGLGFRVPCLVISPFSRG

SEQ ID NO: 939657 - protein, 24 aa, Mycobacterium
GGIRGPIGLGYRVPCFIISPYSRG

SEQ ID NO: 939658 - protein, 23 aa, Mycobacterium
GGIRGPIGLGYRVPCFVISPYSR

SEQ ID NO: 939659 - protein, 23 aa, Mycobacterium
GGIRGPIGLGYRVPCIVISPYSR

SEQ ID NO: 939660 - protein, 18 aa, Mycobacterium
GGKCPDVLMAWELSYAGL

SEQ ID NO: 939661 - protein, 23 aa, Mycobacterium
GGLACGFGTCTITITTTDPDGDD

SEQ ID NO: 939662 - protein, 19 aa, Mycobacterium
GGLFERFVGLSLPSLGIEM

SEQ ID NO: 939663 - protein, 19 aa, Mycobacterium
GGLGGWLWGQAGAAGTGTP

SEQ ID NO: 939664 - protein, 23 aa, Mycobacterium
GGLIGRLKPLFSFGLGARLGNGR

SEQ ID NO: 939665 - protein, 19 aa, Mycobacterium
GGLRYAPRADLATREEQIA

SEQ ID NO: 939666 - protein, 17 aa, Mycobacterium
GGMAAGFVGVVLVAGGK

SEQ ID NO: 939667 - protein, 25 aa, Mycobacterium
GGMATARIPAGINFNVGGAGGHGGA

SEQ ID NO: 939668 - protein, 24 aa, Mycobacterium
GGMLSRLRLLFSLGLGARLGNGRQ

SEQ ID NO: 939669 - protein, 25 aa, Mycobacterium
GGNAWRSDPRFSYLAARADIAAIAK

SEQ ID NO: 939670 - protein, 22 aa, Mycobacterium
GGNGGAGGWLFGNGGAGGAGGA

SEQ ID NO: 939671 - protein, 17 aa, Mycobacterium
GGNRWTFHTGFDPAREA

SEQ ID NO: 939672 - protein, 20 aa, Mycobacterium
GGPGNEVWTFKALTVGTTTI

SEQ ID NO: 939673 - protein, 20 aa, Mycobacterium
GGPSTWRLGGAFNCGKAQPG

SEQ ID NO: 939674 - protein, 17 aa, Mycobacterium
GGSDLGFRIAFSEGHSH

SEQ ID NO: 939675 - protein, 24 aa, Mycobacterium
GGSQMAARGFVWRTDGNLQNGDIV

SEQ ID NO: 939676 - protein, 19 aa, Mycobacterium
GGSQMGVPYSWGGGSLQGP

SEQ ID NO: 939677 - protein, 24 aa, Mycobacterium
GGTGGRGGLIFGDAGAGGQGGLGF

SEQ ID NO: 939678 - protein, 17 aa, Mycobacterium
GGTPEVLDAWLATVEEI

SEQ ID NO: 939679 - protein, 23 aa, Mycobacterium
GGVDWSGVVPFGISEIGLEPAVA

SEQ ID NO: 939680 - protein, 18 aa, Mycobacterium
GGVRGLRIGLSVHLGDFP

SEQ ID NO: 939681 - protein, 19 aa, Mycobacterium
GGVSNRFAPVPAQAPAPAP

SEQ ID NO: 939682 - protein, 21 aa, Mycobacterium
GGVVLRYGLIYGPGTYFERQL

SEQ ID NO: 939683 - protein, 20 aa, Mycobacterium
GGVWWDCYRDLVSNVVLLDK

SEQ ID NO: 939684 - protein, 22 aa, Mycobacterium
GHGRSGFLLAPWTAKTIGAVLD

SEQ ID NO: 939685 - protein, 24 aa, Mycobacterium
GHHPGDVVSISWLSKSGVARTENV

SEQ ID NO: 939686 - protein, 17 aa, Mycobacterium
GICKGKVKQAYGFAYQA

SEQ ID NO: 939687 - protein, 19 aa, Mycobacterium
GIELLLGWRATRVDLACNE

SEQ ID NO: 939688 - protein, 18 aa, Mycobacterium
GIGGWLFGWLADRTGSLA

SEQ ID NO: 939689 - protein, 23 aa, Mycobacterium
GILCGSIVSGLRMRPGNWAGAYA

SEQ ID NO: 939690 - protein, 19 aa, Mycobacterium
GILPIPSRNLLAISSETDD

SEQ ID NO: 939691 - protein, 17 aa, Mycobacterium
GIRGDLALAVFVSDARS

SEQ ID NO: 939692 - protein, 23 aa, Mycobacterium
GITFSADGSRVFVADIAGSIRVL

SEQ ID NO: 939693 - protein, 17 aa, Mycobacterium
GITGFDCSGLVLYSFAG

SEQ ID NO: 939694 - protein, 23 aa, Mycobacterium
GIYGHARACGWAIGDDVIGHSTT

SEQ ID NO: 939695 - protein, 18 aa, Mycobacterium
GKKGFAQLILRSGDTPVR

SEQ ID NO: 939696 - protein, 20 aa, Mycobacterium
GKPAVLWFWTPWCPFCNAEA

SEQ ID NO: 939697 - protein, 17 aa, Mycobacterium
GKPGWPGFLSIPLAAYR

SEQ ID NO: 939698 - protein, 18 aa, Mycobacterium
GKPSRPTPIGSFTALSKE

SEQ ID NO: 939699 - protein, 18 aa, Mycobacterium
GKPSRPTPMGSFTALEKQ

SEQ ID NO: 939700 - protein, 17 aa, Mycobacterium
GKVRWALGLNKQRCPQV

SEQ ID NO: 939701 - protein, 17 aa, Mycobacterium
GKVSKDWNADATKGIAF

SEQ ID NO: 939702 - protein, 18 aa, Mycobacterium
GKVWKPATALGYGRTYTM

SEQ ID NO: 939703 - protein, 17 aa, Mycobacterium
GKWAWCQQPPPGLFTQW

SEQ ID NO: 939704 - protein, 19 aa, Mycobacterium
GLAALCAAAAFATLSVGTA

SEQ ID NO: 939705 - protein, 28 aa, Mycobacterium
GLAERWGRDVLHCVYCHGWEVRDRTIAV

SEQ ID NO: 939706 - protein, 18 aa, Mycobacterium
GLAGEGWVGAVGAGAADT

SEQ ID NO: 939707 - protein, 20 aa, Mycobacterium
GLAMLAPIWGYRPLLDIDDQ

SEQ ID NO: 939708 - protein, 20 aa, Mycobacterium
GLARLDWRGTSFRSRLFGHD

SEQ ID NO: 939709 - protein, 22 aa, Mycobacterium
GLARLIGFNSMRVFLHDQLWAS

SEQ ID NO: 939710 - protein, 20 aa, Mycobacterium
GLCRLLARSGVRVAPFKAQN

SEQ ID NO: 939711 - protein, 19 aa, Mycobacterium
GLCSYFWQHNWGSPKGFVH

SEQ ID NO: 939712 - protein, 20 aa, Mycobacterium
GLCSYPLRKCGDGDLYGGTE

SEQ ID NO: 939713 - protein, 17 aa, Mycobacterium
GLDDPFCSSGLNFPAHF

SEQ ID NO: 939714 - protein, 24 aa, Mycobacterium
GLDIRPNPGIAFPGYADYLPVTRG

SEQ ID NO: 939715 - protein, 25 aa, Mycobacterium
GLGTARFVGAMSVPAAWQGSMPAYV

SEQ ID NO: 939716 - protein, 18 aa, Mycobacterium
GLMAVPGMSAYCASKFAV

SEQ ID NO: 939717 - protein, 18 aa, Mycobacterium
GLPHIPVRLHARSWHRYA

SEQ ID NO: 939718 - protein, 17 aa, Mycobacterium
GLRDLRRVGAVGAGAAD

SEQ ID NO: 939719 - protein, 18 aa, Mycobacterium
GLRDLRRVGAVGAGAADT

SEQ ID NO: 939720 - protein, 25 aa, Mycobacterium
GLRKSILLGTHWGRLGAEGVPAPGD

SEQ ID NO: 939721 - protein, 22 aa, Mycobacterium
GLRTAPPFAVHRLWLDRPVTAD

SEQ ID NO: 939722 - protein, 20 aa, Mycobacterium
GLRVNPEFHCEIAVDGQVVV

SEQ ID NO: 939723 - protein, 17 aa, Mycobacterium
GLTLGQAITLWMSGREQ

SEQ ID NO: 939724 - protein, 17 aa, Mycobacterium
GLVGLKEKYGLDIAPAN

SEQ ID NO: 939725 - protein, 18 aa, Mycobacterium
GLVWGRTTVRLTRPELEA

SEQ ID NO: 939726 - protein, 18 aa, Mycobacterium
GLWNYTWRTGLDEHGDPV

SEQ ID NO: 939727 - protein, 18 aa, Mycobacterium
GLWPAGGCDVQWWFDLPW

SEQ ID NO: 939728 - protein, 20 aa, Mycobacterium
GLWPTMIGFAMKDAGGYNSA

SEQ ID NO: 939729 - protein, 18 aa, Mycobacterium
GLYWSLSIGNPWWETIHY

SEQ ID NO: 939730 - protein, 20 aa, Mycobacterium
GMECPDCLYTRAVLRGGESY

SEQ ID NO: 939731 - protein, 23 aa, Mycobacterium
GNANAVCNVGPYGPNSMSNPANP

SEQ ID NO: 939732 - protein, 18 aa, Mycobacterium
GNGWLRRDPAVPASAWTD

SEQ ID NO: 939733 - protein, 26 aa, Mycobacterium
GNLPLLEPFRVMPHLLNLIPGTNIPT

SEQ ID NO: 939734 - protein, 18 aa, Mycobacterium
GNLWCGWGSNGLVADQPT

SEQ ID NO: 939735 - protein, 17 aa, Mycobacterium
GNMGIPEQMAINFQQVV

SEQ ID NO: 939736 - protein, 24 aa, Mycobacterium
GNPAWDLPLVFGPIALVYHLADVP

SEQ ID NO: 939737 - protein, 17 aa, Mycobacterium
GNPGLSHYFCPIPDTDL

SEQ ID NO: 939738 - protein, 17 aa, Mycobacterium
GNPLAGLLPGAATTAPA

SEQ ID NO: 939739 - protein, 20 aa, Mycobacterium
GNVVAVLGMPVGKVSKVTSK

SEQ ID NO: 939740 - protein, 19 aa, Mycobacterium
GNYLYRMAGAVLGIYGNTA

SEQ ID NO: 939741 - protein, 20 aa, Mycobacterium
GPAELFWDWPGAKQSDCAGL

SEQ ID NO: 939742 - protein, 17 aa, Mycobacterium
GPDGPAWEHNVKIDLKP

SEQ ID NO: 939743 - protein, 17 aa, Mycobacterium
GPDGPAWEHNVRIDLRP

SEQ ID NO: 939744 - protein, 17 aa, Mycobacterium
GPDGTAYIGTWEGSNAY

SEQ ID NO: 939745 - protein, 18 aa, Mycobacterium
GPEKLSFADMARAVLAKH

SEQ ID NO: 939746 - protein, 23 aa, Mycobacterium
GPEQRFLRHLGFYVALADLPGYT

SEQ ID NO: 939747 - protein, 17 aa, Mycobacterium
GPGGLLFGNGGNGGSGS

SEQ ID NO: 939748 - protein, 26 aa, Mycobacterium
GPNGILRWIPFRIPIIGLTPVRPPDT

SEQ ID NO: 939749 - protein, 25 aa, Mycobacterium
GPPEHLKWIGQWGIFDALRSGSEVV

SEQ ID NO: 939750 - protein, 25 aa, Mycobacterium
GPPPPPPWCRGGSVVVVVTGAVVDG

SEQ ID NO: 939751 - protein, 18 aa, Mycobacterium
GPQALSFVRQRHELPRGD

SEQ ID NO: 939752 - protein, 25 aa, Mycobacterium
GPQRLSGPEALSFVRQRHELPRGDL

SEQ ID NO: 939753 - protein, 25 aa, Mycobacterium
GPSRKVLRRRLVALSVLPALLLLGF

SEQ ID NO: 939754 - protein, 20 aa, Mycobacterium
GPTLFLPLTSLRGLRRHSKK

SEQ ID NO: 939755 - protein, 19 aa, Mycobacterium
GPVLAFWLAHYGFEVTVIE

SEQ ID NO: 939756 - protein, 17 aa, Mycobacterium
GPWARRLGIATLAALLL

SEQ ID NO: 939757 - protein, 20 aa, Mycobacterium
GPYFRFGLTVLRMAIETRTH

SEQ ID NO: 939758 - protein, 24 aa, Mycobacterium
GQIKSAPRFGNWVDRRFAATAAET

SEQ ID NO: 939759 - protein, 18 aa, Mycobacterium
GQITAGWAMQPFIADKQA

SEQ ID NO: 939760 - protein, 23 aa, Mycobacterium
GQLEIPTLPPGVRYTQAAIGSVR

SEQ ID NO: 939761 - protein, 18 aa, Mycobacterium
GQLKTVWKSDMIAGSVFA

SEQ ID NO: 939762 - protein, 26 aa, Mycobacterium
GQLNIPRLPAGVTYTRIAAGNYGTVL

SEQ ID NO: 939763 - protein, 22 aa, Mycobacterium
GQNFLARLAIDWEAATTVASQS

SEQ ID NO: 939764 - protein, 17 aa, Mycobacterium
GQPEWPAYISGGAFQRL

SEQ ID NO: 939765 - protein, 21 aa, Mycobacterium
GQPMFKRWCRLVGREELFDDP

SEQ ID NO: 939766 - protein, 22 aa, Mycobacterium
GQRTPERWFVVWLGTANNPIDK

SEQ ID NO: 939767 - protein, 24 aa, Mycobacterium
GQRTPERWFVVWLGTATNPVPQGE

SEQ ID NO: 939768 - protein, 25 aa, Mycobacterium
GQTDIPALPAGVVYVNIAASRYHSV

SEQ ID NO: 939769 - protein, 17 aa, Mycobacterium
GQWGGAMLVAAKSATPS

SEQ ID NO: 939770 - protein, 17 aa, Mycobacterium
GRAAPYLIRALKLILVR

SEQ ID NO: 939771 - protein, 23 aa, Mycobacterium
GRAAVPWWPWAPLVQLMRVLPPQ

SEQ ID NO: 939772 - protein, 22 aa, Mycobacterium
GRAAVPWWPWAPLVQVMRVLPP

SEQ ID NO: 939773 - protein, 28 aa, Mycobacterium
GRAAVPWWPWRPMVQLMRVLPLPLIKRF

SEQ ID NO: 939774 - protein, 19 aa, Mycobacterium
GRAAWVVGVASFFPVVRTA

SEQ ID NO: 939775 - protein, 17 aa, Mycobacterium
GRALGFFGEPCVDVLQL

SEQ ID NO: 939776 - protein, 20 aa, Mycobacterium
GRAPGARCAGSGTGRAAGST

SEQ ID NO: 939777 - protein, 18 aa, Mycobacterium
GRFLLGIGAGHREHTVEY

SEQ ID NO: 939778 - protein, 21 aa, Mycobacterium
GRGAAAFALACERAGVPVQRY

SEQ ID NO: 939779 - protein, 27 aa, Mycobacterium
GRGDARWPWRLPLRLAWVHAELAMVSG

SEQ ID NO: 939780 - protein, 18 aa, Mycobacterium
GRGRWLAVAVSVALSAAM

SEQ ID NO: 939781 - protein, 17 aa, Mycobacterium
GRIPRVYGRQASEYVIR

SEQ ID NO: 939782 - protein, 20 aa, Mycobacterium
GRIRYKRVCEVCGEVVEYRD

SEQ ID NO: 939783 - protein, 19 aa, Mycobacterium
GRLAIAFAVAVLAVGAPGR

SEQ ID NO: 939784 - protein, 18 aa, Mycobacterium
GRLLGWRLGLDRIDPHGT

SEQ ID NO: 939785 - protein, 19 aa, Mycobacterium
GRLLGWRLGMDDVDPKGTV

SEQ ID NO: 939786 - protein, 18 aa, Mycobacterium
GRLPFRVVASYTVKAPPF

SEQ ID NO: 939787 - protein, 19 aa, Mycobacterium
GRPQTYPPVVWQVSGDQIA

SEQ ID NO: 939788 - protein, 19 aa, Mycobacterium
GRPSAHLRFARWHRERGLS

SEQ ID NO: 939789 - protein, 19 aa, Mycobacterium
GRPTLDLAVVANAFADAHP

SEQ ID NO: 939790 - protein, 20 aa, Mycobacterium
GRQAWFWGHELMAVGMVWDT

SEQ ID NO: 939791 - protein, 18 aa, Mycobacterium
GRRLLYWTSEGYIHDDAS

SEQ ID NO: 939792 - protein, 19 aa, Mycobacterium
GRSGFLLAPWTAEQIVSEL

SEQ ID NO: 939793 - protein, 18 aa, Mycobacterium
GRSGFLLAPWTVEKIAAE

SEQ ID NO: 939794 - protein, 23 aa, Mycobacterium
GRSTGYSCGVTWGPGQEPGTILN

SEQ ID NO: 939795 - protein, 18 aa, Mycobacterium
GRTGYYFTTPSGRWACAI

SEQ ID NO: 939796 - protein, 18 aa, Mycobacterium
GRVAGRPVPAGWYSEPWW

SEQ ID NO: 939797 - protein, 17 aa, Mycobacterium
GRVDGLIGFAHDQGPTI

SEQ ID NO: 939798 - protein, 17 aa, Mycobacterium
GRVYTVAGPTEWAQAVA

SEQ ID NO: 939799 - protein, 20 aa, Mycobacterium
GSALPEFAAQLSGAISATVG

SEQ ID NO: 939800 - protein, 24 aa, Mycobacterium
GSAYSGYVGIAFGQGGAGGIGGAA

SEQ ID NO: 939801 - protein, 25 aa, Mycobacterium
GSCVAFDFVGFAAAHGGAGGTGGAA

SEQ ID NO: 939802 - protein, 24 aa, Mycobacterium
GSDARRLEGSYAWGNALSAGYSAE

SEQ ID NO: 939803 - protein, 17 aa, Mycobacterium
GSDGGWLYGDGGAGGAG

SEQ ID NO: 939804 - protein, 21 aa, Mycobacterium
GSEAWDLPVVFGPIAVTYNLK

SEQ ID NO: 939805 - protein, 23 aa, Mycobacterium
GSETSRLSLRWIDAVVRVSPETM

SEQ ID NO: 939806 - protein, 20 aa, Mycobacterium
GSFFPVIPVCASTGVGTLEL

SEQ ID NO: 939807 - protein, 18 aa, Mycobacterium
GSFTYRPAAGYSGTDTFT

SEQ ID NO: 939808 - protein, 17 aa, Mycobacterium
GSGFLARLCEDWEAATL

SEQ ID NO: 939809 - protein, 20 aa, Mycobacterium
GSGPRPLLSYAPGTVGQGDQ

SEQ ID NO: 939810 - protein, 21 aa, Mycobacterium
GSIEFRADGTLGRTYTTEGNA

SEQ ID NO: 939811 - protein, 18 aa, Mycobacterium
GSIFAFPAVAAADPAPPP

SEQ ID NO: 939812 - protein, 17 aa, Mycobacterium
GSLRAAAALAVAVAVTC

SEQ ID NO: 939813 - protein, 21 aa, Mycobacterium
GSPAWDLPTVFGPIAVTYNVN

SEQ ID NO: 939814 - protein, 19 aa, Mycobacterium
GSPAWNLPVVFGPIAIAYR

SEQ ID NO: 939815 - protein, 23 aa, Mycobacterium
GSPAWNLPVVFGPIAVTYNISGV

SEQ ID NO: 939816 - protein, 20 aa, Mycobacterium
GSPLRLDYITTLWNGRFGIE

SEQ ID NO: 939817 - protein, 18 aa, Mycobacterium
GSPVWNLPLVFGPIAIAY

SEQ ID NO: 939818 - protein, 18 aa, Mycobacterium
GSQSYKLTARFANALNLP

SEQ ID NO: 939819 - protein, 17 aa, Mycobacterium
GSSCDRPGTSVFAMSTS

SEQ ID NO: 939820 - protein, 19 aa, Mycobacterium
GSTAREFAPTLLPALAAAG

SEQ ID NO: 939821 - protein, 18 aa, Mycobacterium
GTFIPILNYRVKRVALSP

SEQ ID NO: 939822 - protein, 24 aa, Mycobacterium
GTGKRATSVIPRYGVRLTVMARPP

SEQ ID NO: 939823 - protein, 26 aa, Mycobacterium
GTGLDWRPNPGIGFPGYANYFPVTRA

SEQ ID NO: 939824 - protein, 19 aa, Mycobacterium
GTGSLTWWVQYRKGGDSCA

SEQ ID NO: 939825 - protein, 18 aa, Mycobacterium
GTHWGRLGAELVPAPGDP

SEQ ID NO: 939826 - protein, 24 aa, Mycobacterium
GTKWSFKVGDAFVSTVDDATYTMT

SEQ ID NO: 939827 - protein, 18 aa, Mycobacterium
GTPLRLVSLVALDPAFGH

SEQ ID NO: 939828 - protein, 18 aa, Mycobacterium
GTPSFLGYHGFPASICAS

SEQ ID NO: 939829 - protein, 20 aa, Mycobacterium
GTPYAWGGAGPGGFDCSGLV

SEQ ID NO: 939830 - protein, 18 aa, Mycobacterium
GTQSLVLKVVQNVGSGQP

SEQ ID NO: 939831 - protein, 22 aa, Mycobacterium
GTRCLLRNGGAWGGRDDGYVGV

SEQ ID NO: 939832 - protein, 21 aa, Mycobacterium
GTRRWSGPEIFVFIDREETLA

SEQ ID NO: 939833 - protein, 19 aa, Mycobacterium
GTTRWLDGRSVQWEPAEFY

SEQ ID NO: 939834 - protein, 22 aa, Mycobacterium
GVAGGLCLSTGPAVTAGTAGPT

SEQ ID NO: 939835 - protein, 24 aa, Mycobacterium
GVAGRLCLTTGPTVTTTTAGPTVG

SEQ ID NO: 939836 - protein, 27 aa, Mycobacterium
GVEAGFWGPEWFPQAYPWIPSINPGLH

SEQ ID NO: 939837 - protein, 19 aa, Mycobacterium
GVGLRAFELAVRYAQQRHT

SEQ ID NO: 939838 - protein, 24 aa, Mycobacterium
GVGPRSWPARAWDLLAARGERISA

SEQ ID NO: 939839 - protein, 19 aa, Mycobacterium
GVHSWGYWGAQLAAMKPDM

SEQ ID NO: 939840 - protein, 18 aa, Mycobacterium
GVIYERWQALGGMNSVLG

SEQ ID NO: 939841 - protein, 27 aa, Mycobacterium
GVKLPRSSGAIYRVGQKILPQQARKGD

SEQ ID NO: 939842 - protein, 27 aa, Mycobacterium
GVLDEATGRWGLRVARVELRSIDPPPS

SEQ ID NO: 939843 - protein, 17 aa, Mycobacterium
GVLRPDLASTFLVNQAI

SEQ ID NO: 939844 - protein, 24 aa, Mycobacterium
GVNLMGVVHGCRFFGAQMVEHGGG

SEQ ID NO: 939845 - protein, 25 aa, Mycobacterium
GVPELPRLGSFEVMNRVIDIAQSAL

SEQ ID NO: 939846 - protein, 20 aa, Mycobacterium
GVPVAWPWTFTRFRDVMARP

SEQ ID NO: 939847 - protein, 19 aa, Mycobacterium
GVPVVCALAGLLLAATHGV

SEQ ID NO: 939848 - protein, 19 aa, Mycobacterium
GVPVVCLLAGLLLAATHGV

SEQ ID NO: 939849 - protein, 17 aa, Mycobacterium
GVQRYTVYDGYYRVTNG

SEQ ID NO: 939850 - protein, 18 aa, Mycobacterium
GVSPARVIELDWDQSHQL

SEQ ID NO: 939851 - protein, 22 aa, Mycobacterium
GVTELLAAMGLRARRRDETEFV

SEQ ID NO: 939852 - protein, 26 aa, Mycobacterium
GVVIGRGCLGRPWLFAELSAAFTGSP

SEQ ID NO: 939853 - protein, 17 aa, Mycobacterium
GVWPLLVGIAMRDAGGF

SEQ ID NO: 939854 - protein, 17 aa, Mycobacterium
GWFCCWNGGNHLHVSTG

SEQ ID NO: 939855 - protein, 23 aa, Mycobacterium
GWGNEVWDPLPWGTYGFGSLSMG

SEQ ID NO: 939856 - protein, 18 aa, Mycobacterium
GWITWNFADHKWALGDVV

SEQ ID NO: 939857 - protein, 18 aa, Mycobacterium
GWLTPLLRTGRRSPGADE

SEQ ID NO: 939858 - protein, 17 aa, Mycobacterium
GWMCCIGASWMHLSTGV

SEQ ID NO: 939859 - protein, 18 aa, Mycobacterium
GWWPMLIGLAMNDAGGFN

SEQ ID NO: 939860 - protein, 17 aa, Mycobacterium
GWWPMLIGLAMNDAGGY

SEQ ID NO: 939861 - protein, 19 aa, Mycobacterium
GWYRMMALLARAFIAMAQD

SEQ ID NO: 939862 - protein, 18 aa, Mycobacterium
GYASLSWNKPGIDGAAGN

SEQ ID NO: 939863 - protein, 21 aa, Mycobacterium
GYGALPIFVVFIYFRAPWTKY

SEQ ID NO: 939864 - protein, 24 aa, Mycobacterium
GYGALPIFVVFVYFKAPWRRFVPD

SEQ ID NO: 939865 - protein, 24 aa, Mycobacterium
GYHLALCDGMKPWTLQSFPSAIAY

SEQ ID NO: 939866 - protein, 18 aa, Mycobacterium
GYPQRFGIPDGLYAEPVA

SEQ ID NO: 939867 - protein, 19 aa, Mycobacterium
GYPQRFGIPDGLYAEPVAV

SEQ ID NO: 939868 - protein, 20 aa, Mycobacterium
GYPQRFGIPDGLYAEPVAVK

SEQ ID NO: 939869 - protein, 18 aa, Mycobacterium
GYPQRFGIPEGLYAEPVA

SEQ ID NO: 939870 - protein, 24 aa, Mycobacterium
GYQIGCGISLAWVKLNGGANITPA

SEQ ID NO: 939871 - protein, 18 aa, Mycobacterium
GYTYWSFVDNLEWSEGYD

SEQ ID NO: 939872 - protein, 23 aa, Mycobacterium
GYWRRPALTAARFVACPYGVGQR

SEQ ID NO: 939873 - protein, 23 aa, Mycobacterium
GYWRRPGLTGSRFVACPFGGTSA

SEQ ID NO: 939874 - protein, 21 aa, Mycobacterium
HAAAAGGAWLCYPLAAATPPG

SEQ ID NO: 939875 - protein, 18 aa, Mycobacterium
HAALDYGLRMHTMQAQWA

SEQ ID NO: 939876 - protein, 21 aa, Mycobacterium
HADAPLVYPGMRINQGTQSCT

SEQ ID NO: 939877 - protein, 22 aa, Mycobacterium
HADEAWVGVGYVLPNDRPTTAA

SEQ ID NO: 939878 - protein, 18 aa, Mycobacterium
HAFGQSFLTSFFPVGAVV

SEQ ID NO: 939879 - protein, 25 aa, Mycobacterium
HAGKIVFRQAFGWRKLPDEPGLNGS

SEQ ID NO: 939880 - protein, 19 aa, Mycobacterium
HAQACGWAIRDGVIGNSSS

SEQ ID NO: 939881 - protein, 21 aa, Mycobacterium
HDFWNRWERRATILQELVDTN

SEQ ID NO: 939882 - protein, 20 aa, Mycobacterium
HEDRGMMGLLMIDPPGQHAM

SEQ ID NO: 939883 - protein, 21 aa, Mycobacterium
HFSYADYPGFVAISSDGRTAF

SEQ ID NO: 939884 - protein, 18 aa, Mycobacterium
HGALTCMLVGAKIALDTG

SEQ ID NO: 939885 - protein, 23 aa, Mycobacterium
HGGAGGRGGWLLGDGGNGGAGGD

SEQ ID NO: 939886 - protein, 18 aa, Mycobacterium
HGGTRCTLGYTFTDPGTN

SEQ ID NO: 939887 - protein, 18 aa, Mycobacterium
HGLLGWLQFVPILGSFLN

SEQ ID NO: 939888 - protein, 27 aa, Mycobacterium
HGPKRYNWAQLVGSFKYTLWRLQERVV

SEQ ID NO: 939889 - protein, 18 aa, Mycobacterium
HIHAFGRCEPNSPAPDGG

SEQ ID NO: 939890 - protein, 18 aa, Mycobacterium
HKGDMIFYGPEGTQSVAM

SEQ ID NO: 939891 - protein, 18 aa, Mycobacterium
HKRREFLTDLSLLGGLII

SEQ ID NO: 939892 - protein, 24 aa, Mycobacterium
HLATMVLDCRIGRWTGGDKTVACM

SEQ ID NO: 939893 - protein, 17 aa, Mycobacterium
HLFTVLMDREWKHGVMA

SEQ ID NO: 939894 - protein, 17 aa, Mycobacterium
HLPWQWGARWFLDQLTD

SEQ ID NO: 939895 - protein, 22 aa, Mycobacterium
HLWAHRPLLMFAPGETDPRLVE

SEQ ID NO: 939896 - protein, 18 aa, Mycobacterium
HMTDRFAAIPAQRRKLVT

SEQ ID NO: 939897 - protein, 20 aa, Mycobacterium
HNAVRFGFWGAEELGLIGSR

SEQ ID NO: 939898 - protein, 23 aa, Mycobacterium
HPAAARLWQEFLFSDEGQNLYAA

SEQ ID NO: 939899 - protein, 27 aa, Mycobacterium
HPLPEFLSTEVFQPLGLAMAVDPVGKI

SEQ ID NO: 939900 - protein, 21 aa, Mycobacterium
HPNCMYKWMDWIISPEVNAQV

SEQ ID NO: 939901 - protein, 17 aa, Mycobacterium
HPNVLSIAEFWRRCAGP

SEQ ID NO: 939902 - protein, 26 aa, Mycobacterium
HRLALLWPEMYPRLLRIMDADPIYQD

SEQ ID NO: 939903 - protein, 19 aa, Mycobacterium
HRNGAVMGILWAGIFRYQQ

SEQ ID NO: 939904 - protein, 17 aa, Mycobacterium
HRPALGVSRVEWSPVPD

SEQ ID NO: 939905 - protein, 21 aa, Mycobacterium
HSAAVFRRWIDLIADKLVAVG

SEQ ID NO: 939906 - protein, 17 aa, Mycobacterium
HSALRFGIEHGKRNMVQ

SEQ ID NO: 939907 - protein, 17 aa, Mycobacterium
HSGSWAGFVTEFRVSSD

SEQ ID NO: 939908 - protein, 24 aa, Mycobacterium
HSGVAGSWNVRWAELTPARQAAVI

SEQ ID NO: 939909 - protein, 19 aa, Mycobacterium
HTAPGHWLPWGLLPDAIRS

SEQ ID NO: 939910 - protein, 21 aa, Mycobacterium
HVAGWRLDWLDVDSLIGSTPQ

SEQ ID NO: 939911 - protein, 21 aa, Mycobacterium
HVTELFKFFTKCPDWVTYAEQ

SEQ ID NO: 939912 - protein, 17 aa, Mycobacterium
HVWYRPSAVTEVVDAVT

SEQ ID NO: 939913 - protein, 19 aa, Mycobacterium
HWQTAAVLFGVWWIGAEVV

SEQ ID NO: 939914 - protein, 22 aa, Mycobacterium
HYPGDVVDLTWRDRGGFDRNGK

SEQ ID NO: 939915 - protein, 18 aa, Mycobacterium
IAAAPAPILSNIVRNQVN

SEQ ID NO: 939916 - protein, 17 aa, Mycobacterium
IAACLLSGCGHDTTGTA

SEQ ID NO: 939917 - protein, 17 aa, Mycobacterium
IAADNFGSLTAFYLSGG

SEQ ID NO: 939918 - protein, 21 aa, Mycobacterium
IAARCGYPNAIGLDMGGTSTD

SEQ ID NO: 939919 - protein, 17 aa, Mycobacterium
IAEPVPPQPTAQISTAP

SEQ ID NO: 939920 - protein, 18 aa, Mycobacterium
IAGALALAAALPFAMTAC

SEQ ID NO: 939921 - protein, 17 aa, Mycobacterium
IAGAYIAHLRLSDIPDP

SEQ ID NO: 939922 - protein, 20 aa, Mycobacterium
IAGPSPTGWQLSKQSAMALM

SEQ ID NO: 939923 - protein, 17 aa, Mycobacterium
IALAPWPARAFVILLAV

SEQ ID NO: 939924 - protein, 21 aa, Mycobacterium
IALPPDWANYGAIISAFSDKY

SEQ ID NO: 939925 - protein, 19 aa, Mycobacterium
IAPDEIKGAGYAGVVNYVS

SEQ ID NO: 939926 - protein, 25 aa, Mycobacterium
IAPEEARSGIAYALSKSFVRWYSVA

SEQ ID NO: 939927 - protein, 20 aa, Mycobacterium
IATLCIAGAYIAHLRLSDIP

SEQ ID NO: 939928 - protein, 23 aa, Mycobacterium
IAYRNAPMGFGWPDGIDEVPALQ

SEQ ID NO: 939929 - protein, 19 aa, Mycobacterium
ICGSGSLLKSVTDRFSGVI

SEQ ID NO: 939930 - protein, 19 aa, Mycobacterium
ICRALRGGTSFDTLVNMTT

SEQ ID NO: 939931 - protein, 19 aa, Mycobacterium
IDAAYTWLPTLNELRKTGK

SEQ ID NO: 939932 - protein, 17 aa, Mycobacterium
IDAFALYQPVGWQSQAV

SEQ ID NO: 939933 - protein, 17 aa, Mycobacterium
IDAVLKLSVDRQAALQT

SEQ ID NO: 939934 - protein, 19 aa, Mycobacterium
IDGAPLPWTLVLSTTAPSV

SEQ ID NO: 939935 - protein, 17 aa, Mycobacterium
IDLPVPDGWQLLPEGSG

SEQ ID NO: 939936 - protein, 17 aa, Mycobacterium
IDLSLPDGFKWGVAHSG

SEQ ID NO: 939937 - protein, 17 aa, Mycobacterium
IDRLPNGVFLDWQQFQA

SEQ ID NO: 939938 - protein, 23 aa, Mycobacterium
IDSLPNGVLLDWGQFQSTYRRYT

SEQ ID NO: 939939 - protein, 23 aa, Mycobacterium
IDWYRANESWWRPLKDTVEAKYQ

SEQ ID NO: 939940 - protein, 19 aa, Mycobacterium
IDYGVQVMPTFAGSSGAHQ

SEQ ID NO: 939941 - protein, 19 aa, Mycobacterium
IDYRDGLRVARTFETSIPP

SEQ ID NO: 939942 - protein, 25 aa, Mycobacterium
IEAKPGSGFFTDWIIPGNFDIAQFS

SEQ ID NO: 939943 - protein, 21 aa, Mycobacterium
IEDALRMMVNMGYQDVDPDTL

SEQ ID NO: 939944 - protein, 17 aa, Mycobacterium
IEHFALVVGLEILKQRH

SEQ ID NO: 939945 - protein, 20 aa, Mycobacterium
IEIPGLPPIVLPWPAPPPPP

SEQ ID NO: 939946 - protein, 18 aa, Mycobacterium
IEKESNWLPAPKGPFGLV

SEQ ID NO: 939947 - protein, 18 aa, Mycobacterium
IELGRSGAKLAICDVDTE

SEQ ID NO: 939948 - protein, 24 aa, Mycobacterium
IEPGIYFPGRWGARIEDIVVVTED

SEQ ID NO: 939949 - protein, 17 aa, Mycobacterium
IEQVEWEKLAQIALAAA

SEQ ID NO: 939950 - protein, 19 aa, Mycobacterium
IERFFKAFLRPPAEEETGD

SEQ ID NO: 939951 - protein, 18 aa, Mycobacterium
IFADLRFGERKQYTAQFS

SEQ ID NO: 939952 - protein, 18 aa, Mycobacterium
IFDVQGWRGHNGDIPGYA

SEQ ID NO: 939953 - protein, 29 aa, Mycobacterium
IFEGLRTSTRWDFELGNPLGTGGQWAIPW

SEQ ID NO: 939954 - protein, 18 aa, Mycobacterium
IFVVFIYFRAPWTKYVSN

SEQ ID NO: 939955 - protein, 22 aa, Mycobacterium
IGAPGTEVWTFTALKPGTTTIT

SEQ ID NO: 939956 - protein, 17 aa, Mycobacterium
IGARTWRLGDAPRQANV

SEQ ID NO: 939957 - protein, 19 aa, Mycobacterium
IGATVMQFPAKMAELGVQA

SEQ ID NO: 939958 - protein, 17 aa, Mycobacterium
IGCCVMLAVTGCAFNGL

SEQ ID NO: 939959 - protein, 22 aa, Mycobacterium
IGDFDPRAAISHGYVDSQKLLG

SEQ ID NO: 939960 - protein, 19 aa, Mycobacterium
IGDILHPVFGFPIDHNAPP

SEQ ID NO: 939961 - protein, 18 aa, Mycobacterium
IGLSLFVVFAIGVTTLVY

SEQ ID NO: 939962 - protein, 21 aa, Mycobacterium
IGRAGGLLVDIWIDTVPRGYR

SEQ ID NO: 939963 - protein, 22 aa, Mycobacterium
IGSLRIGNRFVHTGKPTPERYA

SEQ ID NO: 939964 - protein, 18 aa, Mycobacterium
IGTLCVWDTSPREWTSGH

SEQ ID NO: 939965 - protein, 17 aa, Mycobacterium
IHFQEWWVRYRAELPTH

SEQ ID NO: 939966 - protein, 18 aa, Mycobacterium
IHNYRWRLGLARGESRYD

SEQ ID NO: 939967 - protein, 17 aa, Mycobacterium
IIDDWHTAMAMVLLRNG

SEQ ID NO: 939968 - protein, 23 aa, Mycobacterium
IIPPFCYMRRELARKVNVDATES

SEQ ID NO: 939969 - protein, 18 aa, Mycobacterium
IKADATWEYDLLSDAPVT

SEQ ID NO: 939970 - protein, 17 aa, Mycobacterium
IKAGDQFLQQVLPTIVN

SEQ ID NO: 939971 - protein, 18 aa, Mycobacterium
IKDLGGWKSVDKELFDKN

SEQ ID NO: 939972 - protein, 23 aa, Mycobacterium
IKERPRLTAALDHLRVFSNTANR

SEQ ID NO: 939973 - protein, 26 aa, Mycobacterium
IKGGVPFLRLDRRPDLTGAIGDAGRF

SEQ ID NO: 939974 - protein, 19 aa, Mycobacterium
IKHPCCGDLTYGADPTLAA

SEQ ID NO: 939975 - protein, 18 aa, Mycobacterium
IKPTLPIVLANLISVGEV

SEQ ID NO: 939976 - protein, 21 aa, Mycobacterium
IKVPMPYRQSMRISVAANLEY

SEQ ID NO: 939977 - protein, 17 aa, Mycobacterium
ILDREWLHRGSIVVADN

SEQ ID NO: 939978 - protein, 17 aa, Mycobacterium
ILKGDKGEPCWPDGVVG

SEQ ID NO: 939979 - protein, 19 aa, Mycobacterium
ILLAGLVGMCSFQPGATNR

SEQ ID NO: 939980 - protein, 18 aa, Mycobacterium
ILLEDLNIAWAQRRAHQR

SEQ ID NO: 939981 - protein, 17 aa, Mycobacterium
ILLSLGLADRMVGTSTW

SEQ ID NO: 939982 - protein, 22 aa, Mycobacterium
ILNQRRAVVFSESLGGVTTSLA

SEQ ID NO: 939983 - protein, 24 aa, Mycobacterium
ILSDGSFTYRPHAGYFGTDSFTYQ

SEQ ID NO: 939984 - protein, 18 aa, Mycobacterium
ILVCTTCAVAMTACSSSV

SEQ ID NO: 939985 - protein, 20 aa, Mycobacterium
IMAAGRFLAANGFANDPAHA

SEQ ID NO: 939986 - protein, 17 aa, Mycobacterium
IMLADAIGYHSALRFGI

SEQ ID NO: 939987 - protein, 19 aa, Mycobacterium
IMRDCKYTAIGVWSENSLD

SEQ ID NO: 939988 - protein, 20 aa, Mycobacterium
INALIPFPAFSEPWGRHVNW

SEQ ID NO: 939989 - protein, 17 aa, Mycobacterium
INSALMLAGAGSAPMLE

SEQ ID NO: 939990 - protein, 17 aa, Mycobacterium
INWLPWILRGVYPPPAM

SEQ ID NO: 939991 - protein, 23 aa, Mycobacterium
INYLRCIGCGLCIEACPTRALTM

SEQ ID NO: 939992 - protein, 22 aa, Mycobacterium
IPDAVRYSVRFGKPVLLPATAG

SEQ ID NO: 939993 - protein, 21 aa, Mycobacterium
IPGDSGGPVWQFARDTTATVI

SEQ ID NO: 939994 - protein, 25 aa, Mycobacterium
IPGGKQVLGSWSWAIPANSATPDAA

SEQ ID NO: 939995 - protein, 20 aa, Mycobacterium
IPLLAYRAADEIGLVEGTTV

SEQ ID NO: 939996 - protein, 19 aa, Mycobacterium
IPPRGTEAVVFKVVENTGA

SEQ ID NO: 939997 - protein, 19 aa, Mycobacterium
IPQVPGMPIPLPQTVNIPG

SEQ ID NO: 939998 - protein, 18 aa, Mycobacterium
IPSLAGIGRYTLKAELPA

SEQ ID NO: 939999 - protein, 20 aa, Mycobacterium
IQDIEDFLGIGFVANVINGG

SEQ ID NO: 940000 - protein, 21 aa, Mycobacterium
IQPGDAWAAQLLAGWTDAEVT

SEQ ID NO: 940001 - protein, 18 aa, Mycobacterium
IQPGMPFCKIGAVTGETC

SEQ ID NO: 940002 - protein, 17 aa, Mycobacterium
IQPGTEVDLIFVAANTS

SEQ ID NO: 940003 - protein, 24 aa, Mycobacterium
IQVPRLRRTLAWHIVRRPGGTIAG

SEQ ID NO: 940004 - protein, 17 aa, Mycobacterium
IRAALAMDKLLSKTEIL

SEQ ID NO: 940005 - protein, 19 aa, Mycobacterium
IRAAVWLTAICALAACSSA

SEQ ID NO: 940006 - protein, 24 aa, Mycobacterium
IRAEPRWNVVLSFHLQPHWEDRVR

SEQ ID NO: 940007 - protein, 19 aa, Mycobacterium
IRALYAFKRLAWWPYSVAM

SEQ ID NO: 940008 - protein, 24 aa, Mycobacterium
IRERPRITAALDRLRVFSDTATRL

SEQ ID NO: 940009 - protein, 17 aa, Mycobacterium
IRGAHRFRGRRFHSARW

SEQ ID NO: 940010 - protein, 21 aa, Mycobacterium
IRGPIGLGYRVPCFVISPYSR

SEQ ID NO: 940011 - protein, 17 aa, Mycobacterium
IRPAALWRIETDHDANP

SEQ ID NO: 940012 - protein, 18 aa, Mycobacterium
IRPDGLIYTVWESKGPIE

SEQ ID NO: 940013 - protein, 18 aa, Mycobacterium
IRPDGLIYTVWESPAPIE

SEQ ID NO: 940014 - protein, 22 aa, Mycobacterium
IRPRRAGAVAAVLATAVAAALL

SEQ ID NO: 940015 - protein, 20 aa, Mycobacterium
IRRLAVPIVLLWLALAAITN

SEQ ID NO: 940016 - protein, 18 aa, Mycobacterium
IRSRLQAAWDQLFRVETI

SEQ ID NO: 940017 - protein, 17 aa, Mycobacterium
IRTGRPGTAIGLSEGAF

SEQ ID NO: 940018 - protein, 21 aa, Mycobacterium
IRTTKRWQVEYGFPICFPSIE

SEQ ID NO: 940019 - protein, 17 aa, Mycobacterium
IRYKRVCEVCGEVVEYG

SEQ ID NO: 940020 - protein, 18 aa, Mycobacterium
ISASLTWGAERYRYPTNL

SEQ ID NO: 940021 - protein, 20 aa, Mycobacterium
ISIPTPQGWAPFTSPNITPQ

SEQ ID NO: 940022 - protein, 17 aa, Mycobacterium
ISLAAVFLALAIGVVLG

SEQ ID NO: 940023 - protein, 17 aa, Mycobacterium
ISSIKWAPDETGIIPTS

SEQ ID NO: 940024 - protein, 17 aa, Mycobacterium
ISTPMGMTADWWARANL

SEQ ID NO: 940025 - protein, 17 aa, Mycobacterium
ITAIFSNALNLPANAKV

SEQ ID NO: 940026 - protein, 18 aa, Mycobacterium
ITYNEWSFAVGKQLNMAS

SEQ ID NO: 940027 - protein, 19 aa, Mycobacterium
IVAALGVPGCHKKQQAVDK

SEQ ID NO: 940028 - protein, 19 aa, Mycobacterium
IVLCAGAIESAHLLMLSGV

SEQ ID NO: 940029 - protein, 19 aa, Mycobacterium
IVLCGGAIETAHLLMLSGI

SEQ ID NO: 940030 - protein, 17 aa, Mycobacterium
IVLHFPYSANVHCEIDV

SEQ ID NO: 940031 - protein, 21 aa, Mycobacterium
IVLPMPRGWELIPDPNVPNAF

SEQ ID NO: 940032 - protein, 26 aa, Mycobacterium
IVPEEARSGIAYALSKSFVRWYSSSQ

SEQ ID NO: 940033 - protein, 25 aa, Mycobacterium
IVPEEARSGIAYAVSKSFVKWYSQS

SEQ ID NO: 940034 - protein, 18 aa, Mycobacterium
IVRYEIFGVPGATADINY

SEQ ID NO: 940035 - protein, 19 aa, Mycobacterium
IVTWRCWAEELGIAVDDIT

SEQ ID NO: 940036 - protein, 20 aa, Mycobacterium
IWDWAVDWDTWVSMSALPRP

SEQ ID NO: 940037 - protein, 17 aa, Mycobacterium
IWHCATVGGNICLSFPA

SEQ ID NO: 940038 - protein, 17 aa, Mycobacterium
IWIAPRFDFPFTPEQQE

SEQ ID NO: 940039 - protein, 18 aa, Mycobacterium
IWISPRFDIPFTAEQQDL

SEQ ID NO: 940040 - protein, 20 aa, Mycobacterium
IWYCGGHGACLSDFNDGEFV

SEQ ID NO: 940041 - protein, 20 aa, Mycobacterium
IYDPEWNRPAGSVTDDHFFD

SEQ ID NO: 940042 - protein, 18 aa, Mycobacterium
KAAARCGSEAWDLPVVFG

SEQ ID NO: 940043 - protein, 19 aa, Mycobacterium
KAAEAWIDYVYDRPNYAKL

SEQ ID NO: 940044 - protein, 21 aa, Mycobacterium
KAAELRYGRIPEMEKKLDAAV

SEQ ID NO: 940045 - protein, 17 aa, Mycobacterium
KAAHPNCMYKWMDWIIS

SEQ ID NO: 940046 - protein, 19 aa, Mycobacterium
KAAILASIAFHTRVTADDV

SEQ ID NO: 940047 - protein, 26 aa, Mycobacterium
KAARRLASDMGEFFMPYPGNRVNQED

SEQ ID NO: 940048 - protein, 17 aa, Mycobacterium
KACAQYLGPALRLMNFN

SEQ ID NO: 940049 - protein, 19 aa, Mycobacterium
KACPAPGVMQGCLESTSGL

SEQ ID NO: 940050 - protein, 22 aa, Mycobacterium
KACQAAGLPAVWEDDADVPFDY

SEQ ID NO: 940051 - protein, 21 aa, Mycobacterium
KAFAGSAAWFLIRAVTAPDDT

SEQ ID NO: 940052 - protein, 18 aa, Mycobacterium
KAKGVDVTPFFAVLNGPR

SEQ ID NO: 940053 - protein, 22 aa, Mycobacterium
KAPDWLAPRRARGETVSRIVDT

SEQ ID NO: 940054 - protein, 22 aa, Mycobacterium
KAVLPGMRARRSGSIVNISSIT

SEQ ID NO: 940055 - protein, 17 aa, Mycobacterium
KAVMLRLHGTGVTNPAV

SEQ ID NO: 940056 - protein, 19 aa, Mycobacterium
KCTHKGCTVNEIADGTIHC

SEQ ID NO: 940057 - protein, 21 aa, Mycobacterium
KDGKISTVWTWPDKPGVAGCA

SEQ ID NO: 940058 - protein, 18 aa, Mycobacterium
KDGRPLVIRDLFYDAQGS

SEQ ID NO: 940059 - protein, 19 aa, Mycobacterium
KDLKVRQAVNYSLNRADVV

SEQ ID NO: 940060 - protein, 19 aa, Mycobacterium
KDLLGRAGPLQVLQSPVAL

SEQ ID NO: 940061 - protein, 17 aa, Mycobacterium
KDNCKLITWPIATLSPN

SEQ ID NO: 940062 - protein, 22 aa, Mycobacterium
KDSKISTVWTWPDRPGVAGCAA

SEQ ID NO: 940063 - protein, 20 aa, Mycobacterium
KECPAPGVMQGCLDSTSGLI

SEQ ID NO: 940064 - protein, 20 aa, Mycobacterium
KECPAPGVMQGCLESTSGLI

SEQ ID NO: 940065 - protein, 19 aa, Mycobacterium
KEFAPLLGVRKAGLFTSSS

SEQ ID NO: 940066 - protein, 17 aa, Mycobacterium
KELPTHPAPVLLFVPGG

SEQ ID NO: 940067 - protein, 17 aa, Mycobacterium
KFCLAGALGIAALGIGV

SEQ ID NO: 940068 - protein, 21 aa, Mycobacterium
KGAAPDSVFFSGYYAEAAPFV

SEQ ID NO: 940069 - protein, 21 aa, Mycobacterium
KGCPKDNWCVVNAGNYRGSMN

SEQ ID NO: 940070 - protein, 20 aa, Mycobacterium
KGCPKDTWCVVNAGNYRGSM

SEQ ID NO: 940071 - protein, 20 aa, Mycobacterium
KGDKGEPCWPDGVVGSLTHC

SEQ ID NO: 940072 - protein, 17 aa, Mycobacterium
KGFHGFRLAELFEAYPD

SEQ ID NO: 940073 - protein, 22 aa, Mycobacterium
KGFPGRGRYCWPLTNRDRVSGA

SEQ ID NO: 940074 - protein, 17 aa, Mycobacterium
KGIPTWGSDSIDFEAIA

SEQ ID NO: 940075 - protein, 22 aa, Mycobacterium
KGKDRWFIVWLGTAASPVDKGV

SEQ ID NO: 940076 - protein, 18 aa, Mycobacterium
KGNCGPLPMLNEDTEIGP

SEQ ID NO: 940077 - protein, 20 aa, Mycobacterium
KGPFTLVLRLYWPKPDALNG

SEQ ID NO: 940078 - protein, 18 aa, Mycobacterium
KGTLYFGVPTVWSRVVNN

SEQ ID NO: 940079 - protein, 17 aa, Mycobacterium
KGVRTPVRWSLEPMQAA

SEQ ID NO: 940080 - protein, 17 aa, Mycobacterium
KGWHLGGGKSWANIQTI

SEQ ID NO: 940081 - protein, 18 aa, Mycobacterium
KHLPLVIPLGYLGVPEDE

SEQ ID NO: 940082 - protein, 20 aa, Mycobacterium
KIERRGWHALLTLALNGDVD

SEQ ID NO: 940083 - protein, 18 aa, Mycobacterium
KITASYAVRVTWSGVYVH

SEQ ID NO: 940084 - protein, 19 aa, Mycobacterium
KKARDAGVVVIALDTATDP

SEQ ID NO: 940085 - protein, 18 aa, Mycobacterium
KKAVLWFWAPWCPTCQKE

SEQ ID NO: 940086 - protein, 20 aa, Mycobacterium
KKAVPSWKALNDVPVSQALA

SEQ ID NO: 940087 - protein, 23 aa, Mycobacterium
KKQFKGANPWVMISNFHIKIDGC

SEQ ID NO: 940088 - protein, 20 aa, Mycobacterium
KLAAIGIDLPDVFRVLEDEG

SEQ ID NO: 940089 - protein, 19 aa, Mycobacterium
KLGFPVPIRHWLRAGELLE

SEQ ID NO: 940090 - protein, 18 aa, Mycobacterium
KLGFPVPIRHWLRSGELM

SEQ ID NO: 940091 - protein, 17 aa, Mycobacterium
KLMQCVVNGPGYANATP

SEQ ID NO: 940092 - protein, 23 aa, Mycobacterium
KLNNSQRFAIDWMHMDDQGNFYT

SEQ ID NO: 940093 - protein, 24 aa, Mycobacterium
KLNNSQRFAIDWMRTNDQGNFFAG

SEQ ID NO: 940094 - protein, 17 aa, Mycobacterium
KLREIRIALALDNALSK

SEQ ID NO: 940095 - protein, 23 aa, Mycobacterium
KLREIRMALRLDQTFTKQEILTR

SEQ ID NO: 940096 - protein, 19 aa, Mycobacterium
KLREIRMALTLDKTFTKPE

SEQ ID NO: 940097 - protein, 22 aa, Mycobacterium
KLRKSLLLGTHWGRLGAEEVPA

SEQ ID NO: 940098 - protein, 22 aa, Mycobacterium
KLTPGFHGLHIHSFKKCEANSV

SEQ ID NO: 940099 - protein, 20 aa, Mycobacterium
KMSGGQGFAIPIGRAMGVAN

SEQ ID NO: 940100 - protein, 18 aa, Mycobacterium
KMTGPRPGGFGELNDRTN

SEQ ID NO: 940101 - protein, 17 aa, Mycobacterium
KMTWKTSNVLAVLASVM

SEQ ID NO: 940102 - protein, 17 aa, Mycobacterium
KNDLAWHDCTSRVFADA

SEQ ID NO: 940103 - protein, 24 aa, Mycobacterium
KNLGEFANDVFLAAVWIVADEAYL

SEQ ID NO: 940104 - protein, 20 aa, Mycobacterium
KPDAAWKFISWMTDKDYIHL

SEQ ID NO: 940105 - protein, 23 aa, Mycobacterium
KPDYVHLWAGTGFRQATAEPATD

SEQ ID NO: 940106 - protein, 24 aa, Mycobacterium
KPPVEGAFYWLSNREVRWRPAEYW

SEQ ID NO: 940107 - protein, 21 aa, Mycobacterium
KQGWMCCIGADWMHLSTGVIG

SEQ ID NO: 940108 - protein, 21 aa, Mycobacterium
KQGWMCCIGGDWMHLSTGVIG

SEQ ID NO: 940109 - protein, 21 aa, Mycobacterium
KQLYIGFNFGESIIASAVFNG

SEQ ID NO: 940110 - protein, 20 aa, Mycobacterium
KRASGLVFQQFQGGVITAKN

SEQ ID NO: 940111 - protein, 24 aa, Mycobacterium
KRGAARLGTPYSWGGGKPTGPSLG

SEQ ID NO: 940112 - protein, 24 aa, Mycobacterium
KRKQASIDFVKWLTAPEQVKAFSL

SEQ ID NO: 940113 - protein, 21 aa, Mycobacterium
KRMGSQMGVPYSWGGGSLDGP

SEQ ID NO: 940114 - protein, 21 aa, Mycobacterium
KRNLVEFGFRLPSAVDNRPLQ

SEQ ID NO: 940115 - protein, 24 aa, Mycobacterium
KRSRRIWDEWGRRLGVELLCSDGV

SEQ ID NO: 940116 - protein, 20 aa, Mycobacterium
KRVAESLAAWTQRNQEWVDS

SEQ ID NO: 940117 - protein, 17 aa, Mycobacterium
KRVRERFDLVGFDPRGV

SEQ ID NO: 940118 - protein, 18 aa, Mycobacterium
KRVRERFDLVGFDPRGVG

SEQ ID NO: 940119 - protein, 20 aa, Mycobacterium
KTEALKHLWHGYQNGQYRGG

SEQ ID NO: 940120 - protein, 23 aa, Mycobacterium
KTMLRCALGFTVAATVLVTAPAC

SEQ ID NO: 940121 - protein, 22 aa, Mycobacterium
KTSDVSTVWTWPDKPGVAGCAA

SEQ ID NO: 940122 - protein, 25 aa, Mycobacterium
KTTFKSFNWDQTYRKAIVWTAASDD

SEQ ID NO: 940123 - protein, 18 aa, Mycobacterium
KTVEGFRCGIFVQGATES

SEQ ID NO: 940124 - protein, 18 aa, Mycobacterium
KVLAVAGFRCNVQEETGV

SEQ ID NO: 940125 - protein, 17 aa, Mycobacterium
KVNGMVVVGVWQPGAPA

SEQ ID NO: 940126 - protein, 25 aa, Mycobacterium
KVQLWDFFAPGGFTFTDPITPEYNP

SEQ ID NO: 940127 - protein, 18 aa, Mycobacterium
KVREVTCAIGQRQGADRL

SEQ ID NO: 940128 - protein, 20 aa, Mycobacterium
KVVACAGLCGAAIALSPDVA

SEQ ID NO: 940129 - protein, 22 aa, Mycobacterium
KYKAFNWDQGYRKPITYDTLWQ

SEQ ID NO: 940130 - protein, 19 aa, Mycobacterium
KYMQRWPFRFFAERKWFTI

SEQ ID NO: 940131 - protein, 18 aa, Mycobacterium
KYTLWRLQERVVGRGPDS

SEQ ID NO: 940132 - protein, 19 aa, Mycobacterium
KYWYCLQHDDGLWYLHNTD

SEQ ID NO: 940133 - protein, 21 aa, Mycobacterium
LAAELRTCWNIDFDDAGAIGR

SEQ ID NO: 940134 - protein, 19 aa, Mycobacterium
LAAHAAVFWLGRGRTASRE

SEQ ID NO: 940135 - protein, 18 aa, Mycobacterium
LAAIGGFRRWEPMVRRFL

SEQ ID NO: 940136 - protein, 17 aa, Mycobacterium
LAAMLRRSAELAAEADM

SEQ ID NO: 940137 - protein, 20 aa, Mycobacterium
LAAVPARRALAFCTPRDVIA

SEQ ID NO: 940138 - protein, 19 aa, Mycobacterium
LACDGCWVGGTPMHRAVAD

SEQ ID NO: 940139 - protein, 18 aa, Mycobacterium
LACPCGPATGAFAEEYTA

SEQ ID NO: 940140 - protein, 25 aa, Mycobacterium
LADGLTYRFTFTFEKAGEVTVAVPI

SEQ ID NO: 940141 - protein, 26 aa, Mycobacterium
LADPALRLAICKGIDRRTIAKVALYG

SEQ ID NO: 940142 - protein, 26 aa, Mycobacterium
LADPALRLAVCKGIDRRTIAKVALYG

SEQ ID NO: 940143 - protein, 23 aa, Mycobacterium
LAEIPRLGAPFIVAALDAAPPPH

SEQ ID NO: 940144 - protein, 18 aa, Mycobacterium
LAELRWDPDPEVDTLRPM

SEQ ID NO: 940145 - protein, 17 aa, Mycobacterium
LAGCPRLTILATSREPL

SEQ ID NO: 940146 - protein, 17 aa, Mycobacterium
LAGEGWVGAVGAVASGS

SEQ ID NO: 940147 - protein, 17 aa, Mycobacterium
LAGFPGTVASFWQQAGR

SEQ ID NO: 940148 - protein, 17 aa, Mycobacterium
LAGKPAVLWFWTPWCPF

SEQ ID NO: 940149 - protein, 23 aa, Mycobacterium
LAGMTVRIDWPYSANLHCEILVD

SEQ ID NO: 940150 - protein, 20 aa, Mycobacterium
LAGTVLRFVPPLAALAEAVV

SEQ ID NO: 940151 - protein, 20 aa, Mycobacterium
LAGTVLRFVPPLAALAESIV

SEQ ID NO: 940152 - protein, 20 aa, Mycobacterium
LAKACARAGAALIHVSTDYV

SEQ ID NO: 940153 - protein, 23 aa, Mycobacterium
LAKGLEMVGAFLPSLNESIASGP

SEQ ID NO: 940154 - protein, 17 aa, Mycobacterium
LALLAHLTWLLPLLEII

SEQ ID NO: 940155 - protein, 18 aa, Mycobacterium
LANYSYWKPGGMRIDTSR

SEQ ID NO: 940156 - protein, 25 aa, Mycobacterium
LAPELAAPMHAWSGDAYKLVVLMGL

SEQ ID NO: 940157 - protein, 17 aa, Mycobacterium
LASAFREIWLQPSGSVG

SEQ ID NO: 940158 - protein, 23 aa, Mycobacterium
LASDMGEFFMPFPGTRVNQQTVQ

SEQ ID NO: 940159 - protein, 17 aa, Mycobacterium
LATEVLRMLRMVKEECE

SEQ ID NO: 940160 - protein, 17 aa, Mycobacterium
LAYDRAWWFARFVAQTY

SEQ ID NO: 940161 - protein, 24 aa, Mycobacterium
LAYTFKLRSGVTFSDGTPLDAAVV

SEQ ID NO: 940162 - protein, 18 aa, Mycobacterium
LCGVEGCKVLSSFVRCGA

SEQ ID NO: 940163 - protein, 17 aa, Mycobacterium
LCRLLARKGIRVAPFKA

SEQ ID NO: 940164 - protein, 22 aa, Mycobacterium
LCSFPLRKCGDGNLYGGNEPAR

SEQ ID NO: 940165 - protein, 18 aa, Mycobacterium
LDAAIAYATLFPYTQNFV

SEQ ID NO: 940166 - protein, 23 aa, Mycobacterium
LDAGRELAEALGLDPAAVTIASA

SEQ ID NO: 940167 - protein, 18 aa, Mycobacterium
LDALGWKLNGKFREKNGR

SEQ ID NO: 940168 - protein, 23 aa, Mycobacterium
LDARAYRLPWPKGTVVYEVDMPE

SEQ ID NO: 940169 - protein, 22 aa, Mycobacterium
LDCLFPGLWPSFWGVNEDPLPD

SEQ ID NO: 940170 - protein, 23 aa, Mycobacterium
LDCLFPGLWPSFWGVNEDPLPDG

SEQ ID NO: 940171 - protein, 17 aa, Mycobacterium
LDDVLIFDALNPDELVQ

SEQ ID NO: 940172 - protein, 20 aa, Mycobacterium
LDIPIPPGWADAGADTPEWA

SEQ ID NO: 940173 - protein, 23 aa, Mycobacterium
LDLDAGNALTCPRYQVSSRTADE

SEQ ID NO: 940174 - protein, 17 aa, Mycobacterium
LDLLAAYIAVAATASLS

SEQ ID NO: 940175 - protein, 21 aa, Mycobacterium
LDMVKCLNWPSGSAPAEPSEL

SEQ ID NO: 940176 - protein, 17 aa, Mycobacterium
LDMVPGWTELVTAISKL

SEQ ID NO: 940177 - protein, 18 aa, Mycobacterium
LDNSFAWDRGQLFPFLRK

SEQ ID NO: 940178 - protein, 20 aa, Mycobacterium
LDPAEAISHGFVDSQNLLAW

SEQ ID NO: 940179 - protein, 18 aa, Mycobacterium
LDPSLARRFMEAYGDVLY

SEQ ID NO: 940180 - protein, 17 aa, Mycobacterium
LDRASVYGVKARITPTR

SEQ ID NO: 940181 - protein, 21 aa, Mycobacterium
LDRWLRRGGARAALIRPDRTV

SEQ ID NO: 940182 - protein, 17 aa, Mycobacterium
LDSDSWRKLSANRDNRV

SEQ ID NO: 940183 - protein, 22 aa, Mycobacterium
LDSLRAAGVFIHKDAEPYVIQA

SEQ ID NO: 940184 - protein, 19 aa, Mycobacterium
LDVHPDIKIVAAIPEEQSS

SEQ ID NO: 940185 - protein, 23 aa, Mycobacterium
LDVTLPMPPRWTPVPDPNVPDAF

SEQ ID NO: 940186 - protein, 20 aa, Mycobacterium
LDYDPTLWRAFVERARYRAD

SEQ ID NO: 940187 - protein, 19 aa, Mycobacterium
LEAIGIDLSDVFDVLESEG

SEQ ID NO: 940188 - protein, 24 aa, Mycobacterium
LEDWRRDRPGLGFGGNLFDVATLF

SEQ ID NO: 940189 - protein, 23 aa, Mycobacterium
LEEGLRATIDWYRDNEAWWRPLK

SEQ ID NO: 940190 - protein, 23 aa, Mycobacterium
LEHLRALPLDPFRNSYAYTNFGL

SEQ ID NO: 940191 - protein, 25 aa, Mycobacterium
LEKVFDCGDPLLLNRFRQLSTNRLQ

SEQ ID NO: 940192 - protein, 17 aa, Mycobacterium
LELPFVVVDGELFAQLG

SEQ ID NO: 940193 - protein, 22 aa, Mycobacterium
LEPELPPGPFLTGVELNMFFGG

SEQ ID NO: 940194 - protein, 17 aa, Mycobacterium
LEPMAGKIIHCGAAGAG

SEQ ID NO: 940195 - protein, 21 aa, Mycobacterium
LEPYGGAWVQTWLDRDLGLSG

SEQ ID NO: 940196 - protein, 25 aa, Mycobacterium
LERLKYLPLDPFRISYAYTNFGVTA

SEQ ID NO: 940197 - protein, 18 aa, Mycobacterium
LFCIHTAVGLSWPYHALG

SEQ ID NO: 940198 - protein, 18 aa, Mycobacterium
LFETHFFGSVAMIKAVLP

SEQ ID NO: 940199 - protein, 18 aa, Mycobacterium
LFGDFAFYMSTLVKDLPQ

SEQ ID NO: 940200 - protein, 17 aa, Mycobacterium
LFGVWWIGAEVVLDGAA

SEQ ID NO: 940201 - protein, 19 aa, Mycobacterium
LFQHLRFLGEYNVADNATL

SEQ ID NO: 940202 - protein, 17 aa, Mycobacterium
LFVVFAIGVTTLVYGTL

SEQ ID NO: 940203 - protein, 27 aa, Mycobacterium
LGADEISSAVAVMFGNHAQAYQAVSAQ

SEQ ID NO: 940204 - protein, 17 aa, Mycobacterium
LGAKGEDGFFFAESSAG

SEQ ID NO: 940205 - protein, 20 aa, Mycobacterium
LGAKLGPSRTAGICAISPAL

SEQ ID NO: 940206 - protein, 20 aa, Mycobacterium
LGALAAWYVWAALGVYPATP

SEQ ID NO: 940207 - protein, 17 aa, Mycobacterium
LGATEIWVLPTGYACAL

SEQ ID NO: 940208 - protein, 20 aa, Mycobacterium
LGCQSDLFAAIAPVAGTLLT

SEQ ID NO: 940209 - protein, 18 aa, Mycobacterium
LGESLALLGWNMSVSNLR

SEQ ID NO: 940210 - protein, 17 aa, Mycobacterium
LGFLGTFPFPAETLSKW

SEQ ID NO: 940211 - protein, 29 aa, Mycobacterium
LGGDGGRGGFGPLVGGWGGNGGDGGADGG

SEQ ID NO: 940212 - protein, 23 aa, Mycobacterium
LGGVGGPGGWIFGTGGAGGNGGL

SEQ ID NO: 940213 - protein, 17 aa, Mycobacterium
LGKLALRNIHLVGNSDP

SEQ ID NO: 940214 - protein, 17 aa, Mycobacterium
LGKQLYIGFNFGESIIA

SEQ ID NO: 940215 - protein, 20 aa, Mycobacterium
LGPVLRRLTANYPPFLFHPL

SEQ ID NO: 940216 - protein, 22 aa, Mycobacterium
LGRLRPLFRAGLGARLGSGRQY

SEQ ID NO: 940217 - protein, 25 aa, Mycobacterium
LGRYGVCANAICPRARTAMTADVFG

SEQ ID NO: 940218 - protein, 20 aa, Mycobacterium
LGSDMGEFFMPYPGTRINQE

SEQ ID NO: 940219 - protein, 20 aa, Mycobacterium
LGTLEQRLLQAINAPTQTLL

SEQ ID NO: 940220 - protein, 27 aa, Mycobacterium
LGVNTFRMGIEWSRIFPDSTASVDISD

SEQ ID NO: 940221 - protein, 22 aa, Mycobacterium
LGWYRRPGVLFAAAACLAAVAT

SEQ ID NO: 940222 - protein, 19 aa, Mycobacterium
LGYALAPVTWMLGARFVPV

SEQ ID NO: 940223 - protein, 26 aa, Mycobacterium
LGYQIGFPWSLGVGINFSYTTPNILI

SEQ ID NO: 940224 - protein, 23 aa, Mycobacterium
LHKHYRPGVWLPHCSLAPRATLA

SEQ ID NO: 940225 - protein, 17 aa, Mycobacterium
LHRGSIVVADNVKVPGA

SEQ ID NO: 940226 - protein, 24 aa, Mycobacterium
LHYIRRLDLVGGRGVTVCHGLGPD

SEQ ID NO: 940227 - protein, 17 aa, Mycobacterium
LIASLWAATAFLTALLV

SEQ ID NO: 940228 - protein, 24 aa, Mycobacterium
LIEAWGRNAAYHFVFTRQNRGKLD

SEQ ID NO: 940229 - protein, 17 aa, Mycobacterium
LILADAIVRACEDNPDY

SEQ ID NO: 940230 - protein, 24 aa, Mycobacterium
LILLGGPGWLCWVAAAVAGGSLTA

SEQ ID NO: 940231 - protein, 26 aa, Mycobacterium
LINAFFSPRCNLIAWDRGVLIPTGKV

SEQ ID NO: 940232 - protein, 21 aa, Mycobacterium
LIPKPVFRRLLSVVTGGAATV

SEQ ID NO: 940233 - protein, 20 aa, Mycobacterium
LIRMMVEFWDRVSINEQERM

SEQ ID NO: 940234 - protein, 17 aa, Mycobacterium
LISTGSFGWPRQDAIAA

SEQ ID NO: 940235 - protein, 23 aa, Mycobacterium
LKACQAVGLPAVWDDDADVPFPY

SEQ ID NO: 940236 - protein, 17 aa, Mycobacterium
LKATLLAAIGLGNNGYE

SEQ ID NO: 940237 - protein, 18 aa, Mycobacterium
LKDGRQWRIPMWQLNAGA

SEQ ID NO: 940238 - protein, 20 aa, Mycobacterium
LKDRNGCVVGSAIIGVDPQA

SEQ ID NO: 940239 - protein, 19 aa, Mycobacterium
LKFALELGADMIAMSFVRA

SEQ ID NO: 940240 - protein, 17 aa, Mycobacterium
LKFNYDFEMAKIGRPTD

SEQ ID NO: 940241 - protein, 26 aa, Mycobacterium
LKIIGRAGGIYGDFFNFYACDLTLKL

SEQ ID NO: 940242 - protein, 17 aa, Mycobacterium
LKIVSCYQYGKGNTADW

SEQ ID NO: 940243 - protein, 18 aa, Mycobacterium
LKIVSCYQYGKGNTADWL

SEQ ID NO: 940244 - protein, 22 aa, Mycobacterium
LKLAVILALWAAVVAAFVSVIY

SEQ ID NO: 940245 - protein, 20 aa, Mycobacterium
LKMRLSQPFSEFLRMLAQGG

SEQ ID NO: 940246 - protein, 18 aa, Mycobacterium
LKRFKLSMDNVWPATQSQ

SEQ ID NO: 940247 - protein, 23 aa, Mycobacterium
LKSPPRWRTAAALAVTTTLLAAC

SEQ ID NO: 940248 - protein, 18 aa, Mycobacterium
LLAARGASVFGIARDADR

SEQ ID NO: 940249 - protein, 17 aa, Mycobacterium
LLAFKLYGDFDVKAALR

SEQ ID NO: 940250 - protein, 18 aa, Mycobacterium
LLAHLTWLLPLLEIIAKT

SEQ ID NO: 940251 - protein, 23 aa, Mycobacterium
LLAPEWKGKIGFAPSNASWQAFV

SEQ ID NO: 940252 - protein, 23 aa, Mycobacterium
LLAPEWKGKIGFAPSNASWQSFV

SEQ ID NO: 940253 - protein, 20 aa, Mycobacterium
LLDAAGWKPGPDGIRVKDGK

SEQ ID NO: 940254 - protein, 18 aa, Mycobacterium
LLDRLGAHLTRYIGPGVE

SEQ ID NO: 940255 - protein, 23 aa, Mycobacterium
LLDSDFRAGCPIVAVSVEAGEQD

SEQ ID NO: 940256 - protein, 23 aa, Mycobacterium
LLEPLRALPVLGDPLADLVQPNL

SEQ ID NO: 940257 - protein, 17 aa, Mycobacterium
LLFALGLQDRMAGYFLD

SEQ ID NO: 940258 - protein, 17 aa, Mycobacterium
LLGGMAMGIVGAPSAAA

SEQ ID NO: 940259 - protein, 24 aa, Mycobacterium
LLGKYRKGDGFVFYDTVTQDQRIE

SEQ ID NO: 940260 - protein, 17 aa, Mycobacterium
LLGLRVVPMLAPGSADP

SEQ ID NO: 940261 - protein, 24 aa, Mycobacterium
LLHGCLRIGGRICGPPSFDPEFDM

SEQ ID NO: 940262 - protein, 17 aa, Mycobacterium
LLLALSRLGSMRAVADA

SEQ ID NO: 940263 - protein, 18 aa, Mycobacterium
LLPEVFQWARSVDPSQPL

SEQ ID NO: 940264 - protein, 25 aa, Mycobacterium
LLRHFPEGFRLPGFGVTVVETPETP

SEQ ID NO: 940265 - protein, 17 aa, Mycobacterium
LLRVCLIHPLAARAFIE

SEQ ID NO: 940266 - protein, 17 aa, Mycobacterium
LLVLLIVGLVVLGPERL

SEQ ID NO: 940267 - protein, 18 aa, Mycobacterium
LMAARGIRPTWAMNQAND

SEQ ID NO: 940268 - protein, 18 aa, Mycobacterium
LMLFDWPTHVAQIIQALS

SEQ ID NO: 940269 - protein, 23 aa, Mycobacterium
LMVDPRTGRMLIIDKTSSGNPAI

SEQ ID NO: 940270 - protein, 20 aa, Mycobacterium
LNDGIRFFFDQGAILPDSYG

SEQ ID NO: 940271 - protein, 19 aa, Mycobacterium
LNFVKELVKVFGGATTDGG

SEQ ID NO: 940272 - protein, 17 aa, Mycobacterium
LNIPYQVAFILDVAGDN

SEQ ID NO: 940273 - protein, 24 aa, Mycobacterium
LNLIRPGANYGWPEAEGRGGIEGM

SEQ ID NO: 940274 - protein, 17 aa, Mycobacterium
LNLPGFPFQFLLYKQIA

SEQ ID NO: 940275 - protein, 20 aa, Mycobacterium
LNLVKCVHWPSGSPPQLPKE

SEQ ID NO: 940276 - protein, 18 aa, Mycobacterium
LNLVKCVHWPSGSTTDAP

SEQ ID NO: 940277 - protein, 25 aa, Mycobacterium
LNTFRHLYGLECSHIAPANVYGPRQ

SEQ ID NO: 940278 - protein, 23 aa, Mycobacterium
LNVFANDGLIEWDAFDPDGDALT

SEQ ID NO: 940279 - protein, 25 aa, Mycobacterium
LNWWESRALYGWTVLVPRTKDQAGE

SEQ ID NO: 940280 - protein, 26 aa, Mycobacterium
LNWWESRALYGWTVLVPRTKDQAGEM

SEQ ID NO: 940281 - protein, 19 aa, Mycobacterium
LPALRAARGHVVFINSGAG

SEQ ID NO: 940282 - protein, 22 aa, Mycobacterium
LPAPTGLRFYVPVSHAAGDFVP

SEQ ID NO: 940283 - protein, 19 aa, Mycobacterium
LPDAVPLVVMMHGGYGNGT

SEQ ID NO: 940284 - protein, 22 aa, Mycobacterium
LPDGRAALHLAMEPAYLDLIPA

SEQ ID NO: 940285 - protein, 22 aa, Mycobacterium
LPDSSLWLARQMRATGAALDSA

SEQ ID NO: 940286 - protein, 18 aa, Mycobacterium
LPDWAEGLAVVWNPDLSA

SEQ ID NO: 940287 - protein, 19 aa, Mycobacterium
LPEGSGFEFLDKVVGGAVP

SEQ ID NO: 940288 - protein, 21 aa, Mycobacterium
LPFVFDSFRLDSRLTSATAGD

SEQ ID NO: 940289 - protein, 19 aa, Mycobacterium
LPGDARTAGTTGTAVAEHP

SEQ ID NO: 940290 - protein, 18 aa, Mycobacterium
LPGGEQWRTAMAAAPVFM

SEQ ID NO: 940291 - protein, 17 aa, Mycobacterium
LPGYGWIFPLGNGEVNI

SEQ ID NO: 940292 - protein, 18 aa, Mycobacterium
LPILPGLTTHAWTYGGTF

SEQ ID NO: 940293 - protein, 17 aa, Mycobacterium
LPIPIRLAPVASDAASD

SEQ ID NO: 940294 - protein, 18 aa, Mycobacterium
LPIPPGWEPAGPQTPEGA

SEQ ID NO: 940295 - protein, 23 aa, Mycobacterium
LPLAGRSMLAWSLDTLTRLPDVA

SEQ ID NO: 940296 - protein, 17 aa, Mycobacterium
LPLAQFRTSYAYTNFGL

SEQ ID NO: 940297 - protein, 17 aa, Mycobacterium
LPLARALVDGAGMPPEA

SEQ ID NO: 940298 - protein, 22 aa, Mycobacterium
LPLCALVAAWVRGQVRPEASAQ

SEQ ID NO: 940299 - protein, 18 aa, Mycobacterium
LPLHEWNTEFSWRPIEGP

SEQ ID NO: 940300 - protein, 20 aa, Mycobacterium
LPLLMAMAVLGSRVSGADPG

SEQ ID NO: 940301 - protein, 19 aa, Mycobacterium
LPLLRRACTVAATVCVLAG

SEQ ID NO: 940302 - protein, 20 aa, Mycobacterium
LPLRAMVMVLLFLGVVFLLV

SEQ ID NO: 940303 - protein, 18 aa, Mycobacterium
LPLTSLRGLRRHSKKRSG

SEQ ID NO: 940304 - protein, 18 aa, Mycobacterium
LPLYLGIGPNNDFPLPDQ

SEQ ID NO: 940305 - protein, 18 aa, Mycobacterium
LPPAVSAYTGLPGDTPDY

SEQ ID NO: 940306 - protein, 19 aa, Mycobacterium
LPQQAHKGDMIFYGPEGTQ

SEQ ID NO: 940307 - protein, 23 aa, Mycobacterium
LPQQARKGDLIFYGPDGTQSVAM

SEQ ID NO: 940308 - protein, 17 aa, Mycobacterium
LPQVFRWARAVDPSQPL

SEQ ID NO: 940309 - protein, 18 aa, Mycobacterium
LPRHCDGLVVGMLTGAHP

SEQ ID NO: 940310 - protein, 18 aa, Mycobacterium
LPVFEWFDQSGLSLVMPV

SEQ ID NO: 940311 - protein, 17 aa, Mycobacterium
LPVPARWTQVPDPNVPD

SEQ ID NO: 940312 - protein, 22 aa, Mycobacterium
LPVPLWWAKICDAWWCTDTSLP

SEQ ID NO: 940313 - protein, 17 aa, Mycobacterium
LPVVFGPIAVTYNINGV

SEQ ID NO: 940314 - protein, 19 aa, Mycobacterium
LPWTVAIGMVVPLALAALP

SEQ ID NO: 940315 - protein, 23 aa, Mycobacterium
LQAAGSYWAVLRAKQGITDENMR

SEQ ID NO: 940316 - protein, 18 aa, Mycobacterium
LQAARLVAWSSAGAEGPP

SEQ ID NO: 940317 - protein, 19 aa, Mycobacterium
LQAASGLRAGEDFGVAVNP

SEQ ID NO: 940318 - protein, 21 aa, Mycobacterium
LQAGTDIALWVSTEEVPAVLD

SEQ ID NO: 940319 - protein, 20 aa, Mycobacterium
LQIHSVGKCEGDFDSAGSVY

SEQ ID NO: 940320 - protein, 23 aa, Mycobacterium
LQLTADMGRNFLVKLGILSPATA

SEQ ID NO: 940321 - protein, 18 aa, Mycobacterium
LQPPPGFKDTTVPGIWAP

SEQ ID NO: 940322 - protein, 22 aa, Mycobacterium
LQRDNCKLVSWPIATLSPNGIR

SEQ ID NO: 940323 - protein, 18 aa, Mycobacterium
LQRPNCKLIDWPIATLSP

SEQ ID NO: 940324 - protein, 19 aa, Mycobacterium
LQTGVRWKDLGLVVVDEEQ

SEQ ID NO: 940325 - protein, 19 aa, Mycobacterium
LRAGLPPNLAVTGSYLDGI

SEQ ID NO: 940326 - protein, 20 aa, Mycobacterium
LRATVMYPRGTVIMATDGPN

SEQ ID NO: 940327 - protein, 17 aa, Mycobacterium
LRDDVRILKSWNIIDSY

SEQ ID NO: 940328 - protein, 22 aa, Mycobacterium
LRDERFRTALPMSENAKYGVGA

SEQ ID NO: 940329 - protein, 18 aa, Mycobacterium
LRDSCQWFNAQYDTLMSS

SEQ ID NO: 940330 - protein, 23 aa, Mycobacterium
LRECLRLSAKTGIYGARYVTAED

SEQ ID NO: 940331 - protein, 17 aa, Mycobacterium
LREGVWLRPDNLDLELP

SEQ ID NO: 940332 - protein, 18 aa, Mycobacterium
LREIRMALTLDKTFTKPE

SEQ ID NO: 940333 - protein, 18 aa, Mycobacterium
LRESPGLMILGRQGCGKT

SEQ ID NO: 940334 - protein, 19 aa, Mycobacterium
LREWLGYAWVCLAEDPPSF

SEQ ID NO: 940335 - protein, 18 aa, Mycobacterium
LRILPEMATAAWTYNTSF

SEQ ID NO: 940336 - protein, 21 aa, Mycobacterium
LRISNWPLYMADGFVAAFQTA

SEQ ID NO: 940337 - protein, 24 aa, Mycobacterium
LRITARYAQHWNFAGGTPEEFARK

SEQ ID NO: 940338 - protein, 20 aa, Mycobacterium
LRKVRLVAAFAMTVIVSGCA

SEQ ID NO: 940339 - protein, 19 aa, Mycobacterium
LRLAGRFDRTGLWPLASRG

SEQ ID NO: 940340 - protein, 23 aa, Mycobacterium
LRLGEYDVLVGINLLREGLDLPE

SEQ ID NO: 940341 - protein, 19 aa, Mycobacterium
LRLGTVLSISEGVGTRPSP

SEQ ID NO: 940342 - protein, 17 aa, Mycobacterium
LRLLLALSRLGSMRAVA

SEQ ID NO: 940343 - protein, 20 aa, Mycobacterium
LRLLLTTGLAAAVVATAAGC

SEQ ID NO: 940344 - protein, 17 aa, Mycobacterium
LRLPETVGWDYGSISRL

SEQ ID NO: 940345 - protein, 18 aa, Mycobacterium
LRLQMEFDGRTTVDSPLG

SEQ ID NO: 940346 - protein, 19 aa, Mycobacterium
LRMGIEIIDGTNAVPVYTG

SEQ ID NO: 940347 - protein, 30 aa, Mycobacterium
LRMLSEPAPWQWLVELWRGISPHLGTFRDI

SEQ ID NO: 940348 - protein, 18 aa, Mycobacterium
LRPALSLIAALTAVITAL

SEQ ID NO: 940349 - protein, 17 aa, Mycobacterium
LRPGDAIPLDRTAPALD

SEQ ID NO: 940350 - protein, 20 aa, Mycobacterium
LRPGQDVVITLAFQDGSTTP

SEQ ID NO: 940351 - protein, 17 aa, Mycobacterium
LRPHAIVSIHADGGPPT

SEQ ID NO: 940352 - protein, 21 aa, Mycobacterium
LRPIIGPGGWLIGDGLDAAAD

SEQ ID NO: 940353 - protein, 17 aa, Mycobacterium
LRPNPGYRGNRRPHNKG

SEQ ID NO: 940354 - protein, 18 aa, Mycobacterium
LRRFSLLDSLYIVPPPRL

SEQ ID NO: 940355 - protein, 20 aa, Mycobacterium
LRRLGATMKLEFNTLPFTLG

SEQ ID NO: 940356 - protein, 18 aa, Mycobacterium
LRSATPLGDVFIAIKPPA

SEQ ID NO: 940357 - protein, 18 aa, Mycobacterium
LRSATPLGDVFVAIKPPT

SEQ ID NO: 940358 - protein, 19 aa, Mycobacterium
LRSATPLGDVFVSIKPPPS

SEQ ID NO: 940359 - protein, 19 aa, Mycobacterium
LRTATPLGDVFVALKPPAA

SEQ ID NO: 940360 - protein, 19 aa, Mycobacterium
LRTATPLGDVFVALRPPAG

SEQ ID NO: 940361 - protein, 20 aa, Mycobacterium
LRTSDRLNYLWVQWADNPNT

SEQ ID NO: 940362 - protein, 20 aa, Mycobacterium
LRVAAGPAFRIRLADCGGMM

SEQ ID NO: 940363 - protein, 17 aa, Mycobacterium
LRVDFAWLGTVVQAYLR

SEQ ID NO: 940364 - protein, 18 aa, Mycobacterium
LRVPLPVGSLLRDRFLTL

SEQ ID NO: 940365 - protein, 21 aa, Mycobacterium
LRWRPVVALALIVAVLAGCGG

SEQ ID NO: 940366 - protein, 18 aa, Mycobacterium
LRYPGFRSASFVLDAPGV

SEQ ID NO: 940367 - protein, 17 aa, Mycobacterium
LSACSPGLAANPRYATD

SEQ ID NO: 940368 - protein, 17 aa, Mycobacterium
LSAFMLLAPGADGKPYP

SEQ ID NO: 940369 - protein, 18 aa, Mycobacterium
LSAGCLLGGLAIGIAGAP

SEQ ID NO: 940370 - protein, 18 aa, Mycobacterium
LSATWKFGPQKTTEWTYT

SEQ ID NO: 940371 - protein, 21 aa, Mycobacterium
LSEARAPLYTDLQALQCPLKE

SEQ ID NO: 940372 - protein, 17 aa, Mycobacterium
LSEIFALLNPRLTNDTM

SEQ ID NO: 940373 - protein, 21 aa, Mycobacterium
LSFSSLSGWAQRGLRERFIAL

SEQ ID NO: 940374 - protein, 25 aa, Mycobacterium
LSGAGGRGGLLAGLQGSTGSGGAGG

SEQ ID NO: 940375 - protein, 20 aa, Mycobacterium
LSGASVRISERFTTGDTLAY

SEQ ID NO: 940376 - protein, 20 aa, Mycobacterium
LSGLRLGKVLSISEGSGSTA

SEQ ID NO: 940377 - protein, 18 aa, Mycobacterium
LSGLRLGTVLSISEGVGT

SEQ ID NO: 940378 - protein, 22 aa, Mycobacterium
LSLPDGFKWGVAHSGFQAEGGP

SEQ ID NO: 940379 - protein, 17 aa, Mycobacterium
LSLVFLLVVSVTYLLVG

SEQ ID NO: 940380 - protein, 23 aa, Mycobacterium
LSPHRSYCLAFRVPGAVTRGMYI

SEQ ID NO: 940381 - protein, 17 aa, Mycobacterium
LSPTLLYAFSNLIFGSR

SEQ ID NO: 940382 - protein, 18 aa, Mycobacterium
LSSCGWRGISNVAIPGAP

SEQ ID NO: 940383 - protein, 19 aa, Mycobacterium
LSSCGWRGISNVAIPGGPG

SEQ ID NO: 940384 - protein, 18 aa, Mycobacterium
LSSCGWRGISNVSIPGGP

SEQ ID NO: 940385 - protein, 17 aa, Mycobacterium
LSSSVALAAGALALTAC

SEQ ID NO: 940386 - protein, 17 aa, Mycobacterium
LSSWYVWAALGLYPITA

SEQ ID NO: 940387 - protein, 18 aa, Mycobacterium
LSVGSWLGPASMLMAAAA

SEQ ID NO: 940388 - protein, 19 aa, Mycobacterium
LTAALAITIVSLWQLMPTA

SEQ ID NO: 940389 - protein, 17 aa, Mycobacterium
LTAEAGRAPGARCAGSG

SEQ ID NO: 940390 - protein, 17 aa, Mycobacterium
LTCPVTLPVAFPVAFPV

SEQ ID NO: 940391 - protein, 19 aa, Mycobacterium
LTDGCWPAWWLLNDNPERG

SEQ ID NO: 940392 - protein, 23 aa, Mycobacterium
LTEADFPSGVVFERITRDPADGD

SEQ ID NO: 940393 - protein, 17 aa, Mycobacterium
LTECLRLELGPRGIGVS

SEQ ID NO: 940394 - protein, 30 aa, Mycobacterium
LTEFLRARVAKWWLPERWAFVADVPLTSTG

SEQ ID NO: 940395 - protein, 29 aa, Mycobacterium
LTEFLRARVAKWWLPERWAFVTDIPLTST

SEQ ID NO: 940396 - protein, 25 aa, Mycobacterium
LTFAREHPRIFPVAIQGVLFGIAQQ

SEQ ID NO: 940397 - protein, 17 aa, Mycobacterium
LTGDRWLDINSCCDMTA

SEQ ID NO: 940398 - protein, 22 aa, Mycobacterium
LTGGARAARGVRAHPPLPGDAR

SEQ ID NO: 940399 - protein, 22 aa, Mycobacterium
LTGGARAARGVRAHPPLPGDPG

SEQ ID NO: 940400 - protein, 21 aa, Mycobacterium
LTGMRLALFASFDPATTPLAI

SEQ ID NO: 940401 - protein, 18 aa, Mycobacterium
LTGYRAGLLASIAASCTA

SEQ ID NO: 940402 - protein, 24 aa, Mycobacterium
LTILKLAGFCLLASVVATALLFPV

SEQ ID NO: 940403 - protein, 25 aa, Mycobacterium
LTLLKLSGFCLLASIVAAALMFPFA

SEQ ID NO: 940404 - protein, 23 aa, Mycobacterium
LTNWGATCGVGYQGTVTCRGYGG

SEQ ID NO: 940405 - protein, 18 aa, Mycobacterium
LTPAGLIVAEWAGRLLEV

SEQ ID NO: 940406 - protein, 18 aa, Mycobacterium
LTPPYRSGPVLKNHDTIG

SEQ ID NO: 940407 - protein, 19 aa, Mycobacterium
LTSRAWKVLAATLLAGSLI

SEQ ID NO: 940408 - protein, 20 aa, Mycobacterium
LTVKGRCAKVIIGGDDNKIS

SEQ ID NO: 940409 - protein, 21 aa, Mycobacterium
LTVSIPTPAGWTVASNPHIAK

SEQ ID NO: 940410 - protein, 24 aa, Mycobacterium
LTWTFRLRPGVTFHDGTPLAAEDV

SEQ ID NO: 940411 - protein, 18 aa, Mycobacterium
LVAACVRQGIPITCLPGP

SEQ ID NO: 940412 - protein, 17 aa, Mycobacterium
LVGLRAAEAITRATTAQ

SEQ ID NO: 940413 - protein, 17 aa, Mycobacterium
LVMSNGFYRAIQRDDVE

SEQ ID NO: 940414 - protein, 20 aa, Mycobacterium
LVNNRVDAVVGWRQAGGDLA

SEQ ID NO: 940415 - protein, 23 aa, Mycobacterium
LVPEYIGNLLLYFAPDSEATTLD

SEQ ID NO: 940416 - protein, 21 aa, Mycobacterium
LVPKSRLGLCTLVHGARILGH

SEQ ID NO: 940417 - protein, 19 aa, Mycobacterium
LVQRWAPGRVMLNAYGPTE

SEQ ID NO: 940418 - protein, 22 aa, Mycobacterium
LVRPMLDRWVARGFAVVQTDYQ

SEQ ID NO: 940419 - protein, 19 aa, Mycobacterium
LVRQPRGPVGVILGGPAAM

SEQ ID NO: 940420 - protein, 26 aa, Mycobacterium
LVSRRYGISVLRVIPTAGLGRTTLLP

SEQ ID NO: 940421 - protein, 24 aa, Mycobacterium
LVSWLKAVIYGAAERWTDVIDEVK

SEQ ID NO: 940422 - protein, 19 aa, Mycobacterium
LVSYLRLSGKIAQDTSFDG

SEQ ID NO: 940423 - protein, 24 aa, Mycobacterium
LVTLGVGIYQVWPSRGGLKLTAYF

SEQ ID NO: 940424 - protein, 19 aa, Mycobacterium
LVTTWRLVRPYAIATDPHQ

SEQ ID NO: 940425 - protein, 20 aa, Mycobacterium
LVVGGVGIWLVTRPKPAPPP

SEQ ID NO: 940426 - protein, 20 aa, Mycobacterium
LWASSFAKLSYRVKSVDVTG

SEQ ID NO: 940427 - protein, 22 aa, Mycobacterium
LWATNLPKLLPAGVQQTLIPPA

SEQ ID NO: 940428 - protein, 23 aa, Mycobacterium
LWERYRLGAVYAYTAPVITAGLG

SEQ ID NO: 940429 - protein, 20 aa, Mycobacterium
LWLRFRQGALYAYVAPLITA

SEQ ID NO: 940430 - protein, 21 aa, Mycobacterium
LWLRFRQGALYAYVAPLITTG

SEQ ID NO: 940431 - protein, 17 aa, Mycobacterium
LYDFEFLGVEHWSNAVA

SEQ ID NO: 940432 - protein, 17 aa, Mycobacterium
LYVLHALAGAIKNGTVS

SEQ ID NO: 940433 - protein, 17 aa, Mycobacterium
LYVLHALAGAIRDGTAS

SEQ ID NO: 940434 - protein, 18 aa, Mycobacterium
LYWNLSLWSEYNIMLMET

SEQ ID NO: 940435 - protein, 18 aa, Mycobacterium
MAAGRFLAAQGFARDRDH

SEQ ID NO: 940436 - protein, 17 aa, Mycobacterium
MAASLWIGDLGQEAVQS

SEQ ID NO: 940437 - protein, 17 aa, Mycobacterium
MACDGGWWVLGVHDAAA

SEQ ID NO: 940438 - protein, 20 aa, Mycobacterium
MAFGDTYGYCGMKSQQWRYN

SEQ ID NO: 940439 - protein, 18 aa, Mycobacterium
MAFSAGHCRGEGAVSDRD

SEQ ID NO: 940440 - protein, 21 aa, Mycobacterium
MAGSVLRHVQTMFSDLSDVPK

SEQ ID NO: 940441 - protein, 19 aa, Mycobacterium
MALSAAPYVVWMIETAAQC

SEQ ID NO: 940442 - protein, 20 aa, Mycobacterium
MAVSNLRWSGDYVLVDVDAS

SEQ ID NO: 940443 - protein, 20 aa, Mycobacterium
MDSRGRFTYTPAEAARHAAA

SEQ ID NO: 940444 - protein, 20 aa, Mycobacterium
METWRPGGFNGVKLDDSSHG

SEQ ID NO: 940445 - protein, 18 aa, Mycobacterium
MFGRAIALARQYGGALPA

SEQ ID NO: 940446 - protein, 20 aa, Mycobacterium
MFTEGRAFVTIQFDGPPDTL

SEQ ID NO: 940447 - protein, 18 aa, Mycobacterium
MGAGDFIATIGFSSPDYV

SEQ ID NO: 940448 - protein, 18 aa, Mycobacterium
MGANRWKHASAWPLPQTN

SEQ ID NO: 940449 - protein, 17 aa, Mycobacterium
MGLGLVSQFFGKYFSPA

SEQ ID NO: 940450 - protein, 19 aa, Mycobacterium
MGTALPFVVQRLWLDRPVR

SEQ ID NO: 940451 - protein, 26 aa, Mycobacterium
MGVNTFRFGLEWSRVMPEPGKWDEKE

SEQ ID NO: 940452 - protein, 17 aa, Mycobacterium
MGVPYSWGGGSLDGPSK

SEQ ID NO: 940453 - protein, 17 aa, Mycobacterium
MGVPYSWGGGSLQGPSK

SEQ ID NO: 940454 - protein, 18 aa, Mycobacterium
MIKRGWMLLVAVVVVAAA

SEQ ID NO: 940455 - protein, 17 aa, Mycobacterium
MKFQIGLAMGDAGGFSA

SEQ ID NO: 940456 - protein, 17 aa, Mycobacterium
MKFSRPFTSFGSWDGAT

SEQ ID NO: 940457 - protein, 20 aa, Mycobacterium
MKSEAITLVRTCSGSVTAAE

SEQ ID NO: 940458 - protein, 18 aa, Mycobacterium
MKTPMGIFTLDFAFGTAP

SEQ ID NO: 940459 - protein, 24 aa, Mycobacterium
MKVWYRAKAMWDWSQNVTDKNCLA

SEQ ID NO: 940460 - protein, 25 aa, Mycobacterium
MLLRCARPRLTPIVGLLTPDGLVTN

SEQ ID NO: 940461 - protein, 18 aa, Mycobacterium
MLPHNAVEYFVSYYDYYQ

SEQ ID NO: 940462 - protein, 18 aa, Mycobacterium
MLRLSWRPLVNRFIEATL

SEQ ID NO: 940463 - protein, 18 aa, Mycobacterium
MLYEAWLQFRGEAGQRQL

SEQ ID NO: 940464 - protein, 21 aa, Mycobacterium
MMVPKFPNFFIMYGPNTNSIP

SEQ ID NO: 940465 - protein, 18 aa, Mycobacterium
MNAIPGVVPLEFGVVEAE

SEQ ID NO: 940466 - protein, 17 aa, Mycobacterium
MPGASWAPSSLRDSALF

SEQ ID NO: 940467 - protein, 19 aa, Mycobacterium
MPGGIYAPMMHPWSTGKDV

SEQ ID NO: 940468 - protein, 17 aa, Mycobacterium
MPGQAGKAGTRTDTTGP

SEQ ID NO: 940469 - protein, 19 aa, Mycobacterium
MPRRVRRFFVTVGVVGSLA

SEQ ID NO: 940470 - protein, 17 aa, Mycobacterium
MPSRLRALFVGRSVTPQ

SEQ ID NO: 940471 - protein, 20 aa, Mycobacterium
MPVVRARLGPVTVLHSNAAD

SEQ ID NO: 940472 - protein, 23 aa, Mycobacterium
MPWMWKAAGTYRVFADFQPAQAG

SEQ ID NO: 940473 - protein, 18 aa, Mycobacterium
MQQGCGGPPCKGAVVALE

SEQ ID NO: 940474 - protein, 19 aa, Mycobacterium
MQQGCGGPPCKGAVVALEP

SEQ ID NO: 940475 - protein, 17 aa, Mycobacterium
MRAAGRPGAALVMDDAT

SEQ ID NO: 940476 - protein, 17 aa, Mycobacterium
MRAQGWGRILAIGSSGV

SEQ ID NO: 940477 - protein, 17 aa, Mycobacterium
MRDLHRFISGPAYARRL

SEQ ID NO: 940478 - protein, 24 aa, Mycobacterium
MRPGNWAGAYACWGTENREAAVRF

SEQ ID NO: 940479 - protein, 17 aa, Mycobacterium
MRTLPFPVGASHSLELR

SEQ ID NO: 940480 - protein, 17 aa, Mycobacterium
MSTAWRASTGIGTRRLP

SEQ ID NO: 940481 - protein, 24 aa, Mycobacterium
MTFAKPYAEWRGMFAGNGMLLPKS

SEQ ID NO: 940482 - protein, 18 aa, Mycobacterium
MTGAGYWVAHGALGGITI

SEQ ID NO: 940483 - protein, 18 aa, Mycobacterium
MVGPCRLPAAGEFPDGAA

SEQ ID NO: 940484 - protein, 24 aa, Mycobacterium
MVRCVRAALPLLRKAEWARIVNFS

SEQ ID NO: 940485 - protein, 19 aa, Mycobacterium
MYDRCPLTSYVIIGFSQGA

SEQ ID NO: 940486 - protein, 17 aa, Mycobacterium
MYFAYGLGNSVWFPLAT

SEQ ID NO: 940487 - protein, 18 aa, Mycobacterium
MYRKDLFEQAGIEMPRTP

SEQ ID NO: 940488 - protein, 21 aa, Mycobacterium
NAAFCPLDNSFAWDRGQLFPF

SEQ ID NO: 940489 - protein, 26 aa, Mycobacterium
NAAQPIWWLVRALEFSQDFQTFAKEL

SEQ ID NO: 940490 - protein, 19 aa, Mycobacterium
NAAYCKPDRTIGWDRGVLL

SEQ ID NO: 940491 - protein, 23 aa, Mycobacterium
NAEAARAATLWRFTAGAVDQPNP

SEQ ID NO: 940492 - protein, 19 aa, Mycobacterium
NALAGFWYVHGTYLAPDDD

SEQ ID NO: 940493 - protein, 25 aa, Mycobacterium
NALEITLPMPPRWTPVPDPNVPDAF

SEQ ID NO: 940494 - protein, 17 aa, Mycobacterium
NALYRKWLSVLGPAPAP

SEQ ID NO: 940495 - protein, 19 aa, Mycobacterium
NAPGCAGCCQCAIGCPSNA

SEQ ID NO: 940496 - protein, 19 aa, Mycobacterium
NAPGCGGCCQCAIGCPRNA

SEQ ID NO: 940497 - protein, 23 aa, Mycobacterium
NARARLAALSILIGSIAATGPGV

SEQ ID NO: 940498 - protein, 23 aa, Mycobacterium
NARLRKGLLLGTHWGRLGAELVP

SEQ ID NO: 940499 - protein, 22 aa, Mycobacterium
NASFHFPMEFTPFQGGWELSRR

SEQ ID NO: 940500 - protein, 22 aa, Mycobacterium
NASNPDLFWALRGGGGGNFGVT

SEQ ID NO: 940501 - protein, 17 aa, Mycobacterium
NDLPFWDGHSMDITRMY

SEQ ID NO: 940502 - protein, 25 aa, Mycobacterium
NDQGGFSFVVPQGWVQSDARRLTYG

SEQ ID NO: 940503 - protein, 19 aa, Mycobacterium
NEEELLWLTLDAGSDRAKT

SEQ ID NO: 940504 - protein, 22 aa, Mycobacterium
NEGPPQRWFVVWLGTSNDPVDK

SEQ ID NO: 940505 - protein, 18 aa, Mycobacterium
NEPTRWIATYTRDAVNVG

SEQ ID NO: 940506 - protein, 20 aa, Mycobacterium
NFSNPVWFVCGLIGGIANTT

SEQ ID NO: 940507 - protein, 20 aa, Mycobacterium
NGENYRVLFQVATPQGVNPS

SEQ ID NO: 940508 - protein, 21 aa, Mycobacterium
NGGAGGLLFGKGGAGGAGGVG

SEQ ID NO: 940509 - protein, 22 aa, Mycobacterium
NGGEGRGGFSVPQHGVGGQGGT

SEQ ID NO: 940510 - protein, 27 aa, Mycobacterium
NGGFVENFDFFGFGVAHGGDGGSGGAA

SEQ ID NO: 940511 - protein, 17 aa, Mycobacterium
NGGLRYAPRADLATREE

SEQ ID NO: 940512 - protein, 20 aa, Mycobacterium
NGGLYARFAPIYQELTGVNP

SEQ ID NO: 940513 - protein, 26 aa, Mycobacterium
NGLGYWFWGLVVRRIFGRAPIRPGFQ

SEQ ID NO: 940514 - protein, 22 aa, Mycobacterium
NGLKIVSCYQFGKGSTSDWLGG

SEQ ID NO: 940515 - protein, 18 aa, Mycobacterium
NGPCKGSVVALEPSTGKI

SEQ ID NO: 940516 - protein, 23 aa, Mycobacterium
NGSPFLWDRGRELGMTNRLQQVP

SEQ ID NO: 940517 - protein, 19 aa, Mycobacterium
NGTHSWPYWNQQLMAMKPD

SEQ ID NO: 940518 - protein, 18 aa, Mycobacterium
NGTHSWPYWNQQLVAMKP

SEQ ID NO: 940519 - protein, 17 aa, Mycobacterium
NGTITWSSDGIKQSIQD

SEQ ID NO: 940520 - protein, 22 aa, Mycobacterium
NGVRTPVRWRVVPDGNPTGTAA

SEQ ID NO: 940521 - protein, 25 aa, Mycobacterium
NGYLGRFLCLEWLQRLSQTGGQLIC

SEQ ID NO: 940522 - protein, 21 aa, Mycobacterium
NGYRTEVDWATQISYSGIYVH

SEQ ID NO: 940523 - protein, 21 aa, Mycobacterium
NHNTWGVAMLGNFEAVPPTPI

SEQ ID NO: 940524 - protein, 24 aa, Mycobacterium
NIQPQGRFSWRTMPDNLEDAGVSW

SEQ ID NO: 940525 - protein, 24 aa, Mycobacterium
NIQPQGRFSWRTMPDNLSDAGISW

SEQ ID NO: 940526 - protein, 19 aa, Mycobacterium
NKTRLAALRVKDFGKRDVM

SEQ ID NO: 940527 - protein, 24 aa, Mycobacterium
NLLVPRLQYIPGLRSRIQHSGTPA

SEQ ID NO: 940528 - protein, 19 aa, Mycobacterium
NLVPAFSLVTVLGLPVDAP

SEQ ID NO: 940529 - protein, 18 aa, Mycobacterium
NNRCPLTSYVLVGFSQGA

SEQ ID NO: 940530 - protein, 26 aa, Mycobacterium
NNREVRWRPAKYWKPGTTVEVEVNTY

SEQ ID NO: 940531 - protein, 20 aa, Mycobacterium
NPAWNLPLVFGPVAMAYNLE

SEQ ID NO: 940532 - protein, 24 aa, Mycobacterium
NPPVEGAFYWLSNREVRWRPAEYW

SEQ ID NO: 940533 - protein, 22 aa, Mycobacterium
NPPVEGSWAWLPDEAKGARVHW

SEQ ID NO: 940534 - protein, 22 aa, Mycobacterium
NPPVEGSWAWLPDEAQGARAHW

SEQ ID NO: 940535 - protein, 22 aa, Mycobacterium
NPPVEGSWAWLPDEAQGARVHW

SEQ ID NO: 940536 - protein, 24 aa, Mycobacterium
NPVPRPAAVPVLWLGAGERVSALV

SEQ ID NO: 940537 - protein, 17 aa, Mycobacterium
NPYRTVLAFGRDGTAYV

SEQ ID NO: 940538 - protein, 22 aa, Mycobacterium
NQKLRPGDSLPIGQSTTPYQIY

SEQ ID NO: 940539 - protein, 17 aa, Mycobacterium
NQRIKFSALSARALALG

SEQ ID NO: 940540 - protein, 18 aa, Mycobacterium
NRCRPWLPIAHVFDRMAF

SEQ ID NO: 940541 - protein, 21 aa, Mycobacterium
NRDTWGVAMMGNFDAVPPTPI

SEQ ID NO: 940542 - protein, 25 aa, Mycobacterium
NREVRWRPAEYWKPGTTVDVQVNTY

SEQ ID NO: 940543 - protein, 25 aa, Mycobacterium
NREVRWRPEHFWKPGTAVDVAVNTY

SEQ ID NO: 940544 - protein, 25 aa, Mycobacterium
NREVRWRPEHFWKSGTAIDVAVNTY

SEQ ID NO: 940545 - protein, 24 aa, Mycobacterium
NREVRWRPEHFWKSGTSVDVAVNT

SEQ ID NO: 940546 - protein, 18 aa, Mycobacterium
NRFFRRWLGGSIAAASPS

SEQ ID NO: 940547 - protein, 17 aa, Mycobacterium
NRLPVAITGGLVRLGEP

SEQ ID NO: 940548 - protein, 21 aa, Mycobacterium
NRLYWLSAWIDPAGTNGGPLV

SEQ ID NO: 940549 - protein, 21 aa, Mycobacterium
NRNTWGVSMIGNFDDVPPTPI

SEQ ID NO: 940550 - protein, 23 aa, Mycobacterium
NRWRVPLRPGVVFSDGTTFDPVD

SEQ ID NO: 940551 - protein, 17 aa, Mycobacterium
NSGHWRIPGVLTLTAYL

SEQ ID NO: 940552 - protein, 24 aa, Mycobacterium
NSHALRSALVWAAAVLVVAGCTTF

SEQ ID NO: 940553 - protein, 17 aa, Mycobacterium
NSLRPHAIVSIHADGGP

SEQ ID NO: 940554 - protein, 23 aa, Mycobacterium
NTFRHLYGLECSHIAPANVYGPR

SEQ ID NO: 940555 - protein, 18 aa, Mycobacterium
NTHFGRWRYLLGANSAME

SEQ ID NO: 940556 - protein, 17 aa, Mycobacterium
NTTLDWLDRYVRGNELI

SEQ ID NO: 940557 - protein, 19 aa, Mycobacterium
NTYLKKYLVMYGDKSGDVL

SEQ ID NO: 940558 - protein, 25 aa, Mycobacterium
NTYTVYFAMRFSRPFTSYGTWDGYA

SEQ ID NO: 940559 - protein, 17 aa, Mycobacterium
NVAAWRFLAPLSAFLEG

SEQ ID NO: 940560 - protein, 24 aa, Mycobacterium
NVNYRILLKPGWRFTDGSPVTAHS

SEQ ID NO: 940561 - protein, 18 aa, Mycobacterium
NVPDAFAVIADRRGSSIY

SEQ ID NO: 940562 - protein, 19 aa, Mycobacterium
NVPDAFAVIADRVGGNSVY

SEQ ID NO: 940563 - protein, 18 aa, Mycobacterium
NVPNAFAVIADRTSKDLY

SEQ ID NO: 940564 - protein, 19 aa, Mycobacterium
NVPNAFAVLADRVGGNGLY

SEQ ID NO: 940565 - protein, 19 aa, Mycobacterium
NVVAVLGMPVGEVKKIRNR

SEQ ID NO: 940566 - protein, 20 aa, Mycobacterium
PAAEIMVCRYADGIGHPFWL

SEQ ID NO: 940567 - protein, 22 aa, Mycobacterium
PADLGANCQYPSAPDTIVKPVS

SEQ ID NO: 940568 - protein, 18 aa, Mycobacterium
PAERLRVVGVTGTSGKTT

SEQ ID NO: 940569 - protein, 19 aa, Mycobacterium
PAFTQRGSGHFVFVSSISG

SEQ ID NO: 940570 - protein, 17 aa, Mycobacterium
PAGFRFYHTHVVPRSDL

SEQ ID NO: 940571 - protein, 19 aa, Mycobacterium
PAGKLRAGSLIPLTSAGAY

SEQ ID NO: 940572 - protein, 19 aa, Mycobacterium
PAGLPGLRQKYGLDIRPGN

SEQ ID NO: 940573 - protein, 18 aa, Mycobacterium
PAGLPRAAPLVVMLHGGF

SEQ ID NO: 940574 - protein, 24 aa, Mycobacterium
PAGQDFTYRFSVPNSGTYWAHPHT

SEQ ID NO: 940575 - protein, 30 aa, Mycobacterium
PAGWYSEPWWKPALVAGAWGLGSALLFSTM

SEQ ID NO: 940576 - protein, 18 aa, Mycobacterium
PALRARRVLVATGVEDEL

SEQ ID NO: 940577 - protein, 20 aa, Mycobacterium
PAMRSGFYGYGFNVGTTSAA

SEQ ID NO: 940578 - protein, 21 aa, Mycobacterium
PAPLCRRFGPDVGERVHKMLT

SEQ ID NO: 940579 - protein, 17 aa, Mycobacterium
PAPPIPFIPAVPAPLPA

SEQ ID NO: 940580 - protein, 17 aa, Mycobacterium
PAPTRWTAARGRGGDPV

SEQ ID NO: 940581 - protein, 17 aa, Mycobacterium
PASSGQNWAVWDPTLPA

SEQ ID NO: 940582 - protein, 19 aa, Mycobacterium
PATEWTLNWAHELIDKAPH

SEQ ID NO: 940583 - protein, 17 aa, Mycobacterium
PATRWRFANDPANLIAV

SEQ ID NO: 940584 - protein, 17 aa, Mycobacterium
PAVPLWYYIAVVGWSPQ

SEQ ID NO: 940585 - protein, 23 aa, Mycobacterium
PAWRREFLTAMGLTVLDTDDEIP

SEQ ID NO: 940586 - protein, 18 aa, Mycobacterium
PCLVTGWAIRADPSGTSL

SEQ ID NO: 940587 - protein, 17 aa, Mycobacterium
PDAEWAPALAEGRAGYF

SEQ ID NO: 940588 - protein, 18 aa, Mycobacterium
PDAPRFDRMLAMSGRDPG

SEQ ID NO: 940589 - protein, 19 aa, Mycobacterium
PDARVRTTASWFGPEVYGT

SEQ ID NO: 940590 - protein, 24 aa, Mycobacterium
PDDMCLRLRHAFVLEERGEVEVKG

SEQ ID NO: 940591 - protein, 17 aa, Mycobacterium
PDFDWRTVDTLHLDVGT

SEQ ID NO: 940592 - protein, 22 aa, Mycobacterium
PDGSVLWSLRAVDWNCDNLFVA

SEQ ID NO: 940593 - protein, 19 aa, Mycobacterium
PDGTLVVFSRRFISTTVST

SEQ ID NO: 940594 - protein, 18 aa, Mycobacterium
PDHKRYLVQLTITSMANQ

SEQ ID NO: 940595 - protein, 20 aa, Mycobacterium
PDLPTAFARFATLRRRRVTR

SEQ ID NO: 940596 - protein, 17 aa, Mycobacterium
PDLTGAIGDAGRFAPSE

SEQ ID NO: 940597 - protein, 20 aa, Mycobacterium
PDMRARRSGAIVNISSIAVA

SEQ ID NO: 940598 - protein, 18 aa, Mycobacterium
PDPILPLRISFIEIVPHT

SEQ ID NO: 940599 - protein, 19 aa, Mycobacterium
PDRSAGWVRRALRPGKATA

SEQ ID NO: 940600 - protein, 18 aa, Mycobacterium
PDTSWAFMTYLIEQDTLR

SEQ ID NO: 940601 - protein, 19 aa, Mycobacterium
PDVLMAWDLTYAELAARGV

SEQ ID NO: 940602 - protein, 22 aa, Mycobacterium
PDYLPGTLLPPGIRATPEAEEA

SEQ ID NO: 940603 - protein, 18 aa, Mycobacterium
PEAFLGMMVPKFPNFFIM

SEQ ID NO: 940604 - protein, 18 aa, Mycobacterium
PEAQRIWAKTGFRPVDPG

SEQ ID NO: 940605 - protein, 17 aa, Mycobacterium
PEARYGRARLSSRSRRR

SEQ ID NO: 940606 - protein, 21 aa, Mycobacterium
PEDLRFGLYGALVHPLEADGL

SEQ ID NO: 940607 - protein, 24 aa, Mycobacterium
PEERFDWVTVDAYSADGVPYSLRM

SEQ ID NO: 940608 - protein, 19 aa, Mycobacterium
PEFGCLFKGIGRGIKEFAP

SEQ ID NO: 940609 - protein, 18 aa, Mycobacterium
PEGYKITAQYAVRVTWSG

SEQ ID NO: 940610 - protein, 19 aa, Mycobacterium
PEHAFTWAVVALISESLNQ

SEQ ID NO: 940611 - protein, 26 aa, Mycobacterium
PEHIAARPGRIWLRISGYGEHSRRPA

SEQ ID NO: 940612 - protein, 19 aa, Mycobacterium
PEKHLPLVMPLKYVGIDED

SEQ ID NO: 940613 - protein, 18 aa, Mycobacterium
PELGIYINTPHDWVSFAD

SEQ ID NO: 940614 - protein, 20 aa, Mycobacterium
PELLGGLSIAVGDEVIDGTL

SEQ ID NO: 940615 - protein, 20 aa, Mycobacterium
PELPASPGQVWSQWHSLVFD

SEQ ID NO: 940616 - protein, 20 aa, Mycobacterium
PELRAGQLLTARPLTTVAAL

SEQ ID NO: 940617 - protein, 20 aa, Mycobacterium
PELRGAGVVVSFAGAVFEAL

SEQ ID NO: 940618 - protein, 17 aa, Mycobacterium
PEMPMSMGMAAWQEEDG

SEQ ID NO: 940619 - protein, 19 aa, Mycobacterium
PEQHLPLVMGFKYLGVPEE

SEQ ID NO: 940620 - protein, 17 aa, Mycobacterium
PEVPGLPFLQQLAANPA

SEQ ID NO: 940621 - protein, 24 aa, Mycobacterium
PEWKGRWGAPPVKPDFQAIVAAML

SEQ ID NO: 940622 - protein, 20 aa, Mycobacterium
PEYIGNLLLYFDPHATVTLL

SEQ ID NO: 940623 - protein, 21 aa, Mycobacterium
PFGLRCGDIYYGPTIPTHDVY

SEQ ID NO: 940624 - protein, 18 aa, Mycobacterium
PGAHFEYSNSNYLLLGEI

SEQ ID NO: 940625 - protein, 17 aa, Mycobacterium
PGALALPSHDEMFSAAH

SEQ ID NO: 940626 - protein, 17 aa, Mycobacterium
PGARPVNAYSFLENDGQ

SEQ ID NO: 940627 - protein, 25 aa, Mycobacterium
PGATAFPWRRHGALVQWYVENAGSP

SEQ ID NO: 940628 - protein, 17 aa, Mycobacterium
PGDAGIVGPMFDHGFPC

SEQ ID NO: 940629 - protein, 24 aa, Mycobacterium
PGDPSAWGLLAWVRRELFNSTPDE

SEQ ID NO: 940630 - protein, 18 aa, Mycobacterium
PGGDVSLIGYGRCVHDAL

SEQ ID NO: 940631 - protein, 22 aa, Mycobacterium
PGGGPRPLISYAPGTQGQGNQC

SEQ ID NO: 940632 - protein, 23 aa, Mycobacterium
PGGKSALGLWSWAIPANSAASDA

SEQ ID NO: 940633 - protein, 23 aa, Mycobacterium
PGGPPRAAGVWGPQHREHADPAT

SEQ ID NO: 940634 - protein, 17 aa, Mycobacterium
PGGWTTNTFGQWVSPTD

SEQ ID NO: 940635 - protein, 24 aa, Mycobacterium
PGHYTLRASVEWRQHKPGASHVVN

SEQ ID NO: 940636 - protein, 22 aa, Mycobacterium
PGISGSPAFTAVRAVRPGSSTA

SEQ ID NO: 940637 - protein, 24 aa, Mycobacterium
PGKDTIRVSIRWDQPSFNHVGVYA

SEQ ID NO: 940638 - protein, 17 aa, Mycobacterium
PGLPVEYLDVFSPSMNR

SEQ ID NO: 940639 - protein, 19 aa, Mycobacterium
PGMIAGVVPLRLMTPPSSS

SEQ ID NO: 940640 - protein, 17 aa, Mycobacterium
PGMPGFSAGLLGPQGVV

SEQ ID NO: 940641 - protein, 24 aa, Mycobacterium
PGPGARLAPIFAYPLLAACPSITQ

SEQ ID NO: 940642 - protein, 24 aa, Mycobacterium
PGRAAVPWWPWAPLVQLMRVLPPP

SEQ ID NO: 940643 - protein, 18 aa, Mycobacterium
PGRCRVLLVALVAAAAAL

SEQ ID NO: 940644 - protein, 19 aa, Mycobacterium
PGSSTARLVFAPKTSTSGT

SEQ ID NO: 940645 - protein, 17 aa, Mycobacterium
PGSTVAVLGMRVGSVEK

SEQ ID NO: 940646 - protein, 20 aa, Mycobacterium
PGTEVDLIFVAANTSADVAD

SEQ ID NO: 940647 - protein, 18 aa, Mycobacterium
PGTPIDWSPCETGPSDQK

SEQ ID NO: 940648 - protein, 18 aa, Mycobacterium
PGTPVQWLPCNGGAGNQT

SEQ ID NO: 940649 - protein, 22 aa, Mycobacterium
PGTYPFVFDRWLPDKVYSGAYK

SEQ ID NO: 940650 - protein, 17 aa, Mycobacterium
PGWPGFLSIPLAAYRRH

SEQ ID NO: 940651 - protein, 18 aa, Mycobacterium
PHEIRPAALWRIETDHDA

SEQ ID NO: 940652 - protein, 18 aa, Mycobacterium
PHELAAWADGYDDRVLVV

SEQ ID NO: 940653 - protein, 19 aa, Mycobacterium
PHPAVAVLPEFGRKRRDLG

SEQ ID NO: 940654 - protein, 24 aa, Mycobacterium
PHSERLFCVPATIDLAGAEIELVS

SEQ ID NO: 940655 - protein, 18 aa, Mycobacterium
PIEWRYTNDPAWVMRTKG

SEQ ID NO: 940656 - protein, 17 aa, Mycobacterium
PIIGYRVITTIGVDVDE

SEQ ID NO: 940657 - protein, 23 aa, Mycobacterium
PILKGDKGEPCWPDGVVGSLTHC

SEQ ID NO: 940658 - protein, 20 aa, Mycobacterium
PILKRPAMRMVLVGAAVIIG

SEQ ID NO: 940659 - protein, 17 aa, Mycobacterium
PILVPVWILVLVAALAG

SEQ ID NO: 940660 - protein, 19 aa, Mycobacterium
PINSWSFDVLDFVSDVRNR

SEQ ID NO: 940661 - protein, 24 aa, Mycobacterium
PIVIAAPMFHAWGFSQLLFAALLA

SEQ ID NO: 940662 - protein, 18 aa, Mycobacterium
PIVTRVAARYGLTSTKPP

SEQ ID NO: 940663 - protein, 19 aa, Mycobacterium
PKAGPLIAVKLHILTRKSL

SEQ ID NO: 940664 - protein, 19 aa, Mycobacterium
PKAGPLIAVKLHILTRKTL

SEQ ID NO: 940665 - protein, 20 aa, Mycobacterium
PKARRFDVLDVFSGQRSVQQ

SEQ ID NO: 940666 - protein, 18 aa, Mycobacterium
PKAVVFRPAIERSPAGKA

SEQ ID NO: 940667 - protein, 18 aa, Mycobacterium
PKDTWCVINAGNYRGSMS

SEQ ID NO: 940668 - protein, 21 aa, Mycobacterium
PKGPFGLVLRLYWPKPDALNG

SEQ ID NO: 940669 - protein, 18 aa, Mycobacterium
PKGVLWRQHDIFMTAFGG

SEQ ID NO: 940670 - protein, 23 aa, Mycobacterium
PKIVPAIGMPVCRSGVTTGEACG

SEQ ID NO: 940671 - protein, 18 aa, Mycobacterium
PKNDLSWHDCTSRVFGDA

SEQ ID NO: 940672 - protein, 20 aa, Mycobacterium
PKNSRLGYRETINYATRIST

SEQ ID NO: 940673 - protein, 21 aa, Mycobacterium
PKPGTTVAYWFSGLRTPSMAG

SEQ ID NO: 940674 - protein, 18 aa, Mycobacterium
PKWWGPRPRLDNITYLVL

SEQ ID NO: 940675 - protein, 18 aa, Mycobacterium
PLAELKDRKIELAADEAF

SEQ ID NO: 940676 - protein, 18 aa, Mycobacterium
PLAGCARSGGGAHPASTT

SEQ ID NO: 940677 - protein, 22 aa, Mycobacterium
PLARTRPALDLDELIGGFRPLF

SEQ ID NO: 940678 - protein, 17 aa, Mycobacterium
PLDDWQWVLGINLWGPI

SEQ ID NO: 940679 - protein, 22 aa, Mycobacterium
PLGEPARPVWPPLLDAALTAVF

SEQ ID NO: 940680 - protein, 18 aa, Mycobacterium
PLGRPILCTEYLARSEGS

SEQ ID NO: 940681 - protein, 21 aa, Mycobacterium
PLLALRIPWYVTVLDLGPAGA

SEQ ID NO: 940682 - protein, 21 aa, Mycobacterium
PLLQPLRWFGLGFVADALNAP

SEQ ID NO: 940683 - protein, 17 aa, Mycobacterium
PLLSYAPGTVGQGDQCA

SEQ ID NO: 940684 - protein, 18 aa, Mycobacterium
PLNIPYKVAFVLDVAGDN

SEQ ID NO: 940685 - protein, 19 aa, Mycobacterium
PLNIPYRVAFVLDVAGDNE

SEQ ID NO: 940686 - protein, 23 aa, Mycobacterium
PLNPRIVLVAAAIPQPAHIVIVV

SEQ ID NO: 940687 - protein, 19 aa, Mycobacterium
PLPSAWRLLTSRGPYELAG

SEQ ID NO: 940688 - protein, 21 aa, Mycobacterium
PLPSLKPAVAVPDSLTQLWAA

SEQ ID NO: 940689 - protein, 20 aa, Mycobacterium
PLRARRVVVCVDDEAGRAMA

SEQ ID NO: 940690 - protein, 22 aa, Mycobacterium
PLRSKISFWFDRKYKVPADAKA

SEQ ID NO: 940691 - protein, 21 aa, Mycobacterium
PLTITRLPGGAIQVDIDPTWA

SEQ ID NO: 940692 - protein, 17 aa, Mycobacterium
PLVTRSPLLTSLVSSIP

SEQ ID NO: 940693 - protein, 17 aa, Mycobacterium
PLYRTRLPIPIRLAPVA

SEQ ID NO: 940694 - protein, 23 aa, Mycobacterium
PMCKRLVMSGGFYRAMQRDDVDL

SEQ ID NO: 940695 - protein, 18 aa, Mycobacterium
PMGLGLVSQFFGKYFTPD

SEQ ID NO: 940696 - protein, 18 aa, Mycobacterium
PMGLGLVSQFFGRYFTPD

SEQ ID NO: 940697 - protein, 18 aa, Mycobacterium
PMLSAAFIGQGVESLLNP

SEQ ID NO: 940698 - protein, 19 aa, Mycobacterium
PMRPRPAVVRAFDAPAPNW

SEQ ID NO: 940699 - protein, 21 aa, Mycobacterium
PNAFQNLHWAFGQLAAVGIAT

SEQ ID NO: 940700 - protein, 19 aa, Mycobacterium
PNGTHGWGYWGSQLNAMKP

SEQ ID NO: 940701 - protein, 20 aa, Mycobacterium
PNGTHSWGYWGAQLQAMKPD

SEQ ID NO: 940702 - protein, 17 aa, Mycobacterium
PNIDLPVPDGWQLLPEG

SEQ ID NO: 940703 - protein, 17 aa, Mycobacterium
PPAAFAAKNGWVVAALQ

SEQ ID NO: 940704 - protein, 17 aa, Mycobacterium
PPAEGFWSLTMYDAGMF

SEQ ID NO: 940705 - protein, 18 aa, Mycobacterium
PPAHLVLGSDALRLVGAA

SEQ ID NO: 940706 - protein, 17 aa, Mycobacterium
PPAVSAYTGLPGDPVGP

SEQ ID NO: 940707 - protein, 26 aa, Mycobacterium
PPAWNGPRPHVWVSVCAPIPFVNICA

SEQ ID NO: 940708 - protein, 19 aa, Mycobacterium
PPEHLDWIAQWGIFDALRA

SEQ ID NO: 940709 - protein, 20 aa, Mycobacterium
PPEHLEWLAQWGIFDALRAS

SEQ ID NO: 940710 - protein, 19 aa, Mycobacterium
PPGCAIGWTMVGHVLIYVP

SEQ ID NO: 940711 - protein, 17 aa, Mycobacterium
PPGIDFRPALLADVEIA

SEQ ID NO: 940712 - protein, 19 aa, Mycobacterium
PPGLPGQWIGGWVSFDGAT

SEQ ID NO: 940713 - protein, 17 aa, Mycobacterium
PPIAVPYIAQFWPIPLP

SEQ ID NO: 940714 - protein, 18 aa, Mycobacterium
PPIRLRVGIHTGDVQLRD

SEQ ID NO: 940715 - protein, 17 aa, Mycobacterium
PPLPLGDSDWFQKCLGV

SEQ ID NO: 940716 - protein, 17 aa, Mycobacterium
PPMRTMIAFGGRYPTTV

SEQ ID NO: 940717 - protein, 20 aa, Mycobacterium
PPPFLRGVFTAVIMALGLGQ

SEQ ID NO: 940718 - protein, 19 aa, Mycobacterium
PPPPRRPRAAVPPPSPTGR

SEQ ID NO: 940719 - protein, 20 aa, Mycobacterium
PPTEGGWAWLPDEAQGSRVH

SEQ ID NO: 940720 - protein, 18 aa, Mycobacterium
PPTIVAILSKLTGNVEAA

SEQ ID NO: 940721 - protein, 21 aa, Mycobacterium
PPVEGSWAWLPDEAKGARVHW

SEQ ID NO: 940722 - protein, 18 aa, Mycobacterium
PPVQVVFARGRMETPGPG

SEQ ID NO: 940723 - protein, 20 aa, Mycobacterium
PQGAIAFSGLYPPGSTFKTI

SEQ ID NO: 940724 - protein, 19 aa, Mycobacterium
PQGWPAWADPDVVRAFTDR

SEQ ID NO: 940725 - protein, 17 aa, Mycobacterium
PQHLIVAAAAVLLTACT

SEQ ID NO: 940726 - protein, 24 aa, Mycobacterium
PQLGRWKWHDPWVHAALLAQNNTR

SEQ ID NO: 940727 - protein, 24 aa, Mycobacterium
PQPDGSLVLWDWWPMPFANSTRVT

SEQ ID NO: 940728 - protein, 24 aa, Mycobacterium
PQPRRVKITFWYESRYQVPADAKA

SEQ ID NO: 940729 - protein, 17 aa, Mycobacterium
PQQARKGDLIFYGPEGT

SEQ ID NO: 940730 - protein, 26 aa, Mycobacterium
PQRGYKIFEEWANWLFAAGGSIYDKD

SEQ ID NO: 940731 - protein, 27 aa, Mycobacterium
PQRGYKIFEEWGNWLFAAGGSIYDADG

SEQ ID NO: 940732 - protein, 24 aa, Mycobacterium
PQRLDGPEALSFVRQRHELPRGDL

SEQ ID NO: 940733 - protein, 21 aa, Mycobacterium
PQTWFKSFNWDVAKKAPITFD

SEQ ID NO: 940734 - protein, 19 aa, Mycobacterium
PQVELRFGATVSDVAQRDD

SEQ ID NO: 940735 - protein, 22 aa, Mycobacterium
PQWAAPPPFAWDYRLFAHPAPV

SEQ ID NO: 940736 - protein, 19 aa, Mycobacterium
PRAAPLVVMLHGGFGSARQ

SEQ ID NO: 940737 - protein, 17 aa, Mycobacterium
PRARSFRVTSFDGTRIF

SEQ ID NO: 940738 - protein, 24 aa, Mycobacterium
PRELPPEFEVMYLLCGCDELQIAD

SEQ ID NO: 940739 - protein, 22 aa, Mycobacterium
PRGVFELDAWDGNVFVFPVSSE

SEQ ID NO: 940740 - protein, 20 aa, Mycobacterium
PRIAATLVEHGWAEGLRPNN

SEQ ID NO: 940741 - protein, 17 aa, Mycobacterium
PRIPAELAEVYDRNVDA

SEQ ID NO: 940742 - protein, 19 aa, Mycobacterium
PRKHWVLKGFHGFRLAELF

SEQ ID NO: 940743 - protein, 23 aa, Mycobacterium
PRLAQDLIRLGLFVGYDPVAIAN

SEQ ID NO: 940744 - protein, 20 aa, Mycobacterium
PRLIGALAMATVRIALDDWL

SEQ ID NO: 940745 - protein, 20 aa, Mycobacterium
PRLPSIPGLNDFGGHAFHSA

SEQ ID NO: 940746 - protein, 17 aa, Mycobacterium
PRLTRILLVALVALTAA

SEQ ID NO: 940747 - protein, 20 aa, Mycobacterium
PRLWEMSTVLPILQDTTIVA

SEQ ID NO: 940748 - protein, 17 aa, Mycobacterium
PRLWNMSTVLPILQDTT

SEQ ID NO: 940749 - protein, 19 aa, Mycobacterium
PRPLRGADIARVLPGVDEL

SEQ ID NO: 940750 - protein, 22 aa, Mycobacterium
PRPRTEKWIALQVGECVADLPP

SEQ ID NO: 940751 - protein, 23 aa, Mycobacterium
PRQPECVVFCLGEQAPPAPAPGP

SEQ ID NO: 940752 - protein, 20 aa, Mycobacterium
PRRRSTICAIQLDNADVVTF

SEQ ID NO: 940753 - protein, 19 aa, Mycobacterium
PRSGQGWNPEPLAGNYSEC

SEQ ID NO: 940754 - protein, 17 aa, Mycobacterium
PRSRTVFYLPSALVSNG

SEQ ID NO: 940755 - protein, 19 aa, Mycobacterium
PRSVVPIDFHIIRELAAHP

SEQ ID NO: 940756 - protein, 19 aa, Mycobacterium
PRTAFSLAEVHDCFTPTEI

SEQ ID NO: 940757 - protein, 19 aa, Mycobacterium
PRVLVKFTVAKNIRLGDRT

SEQ ID NO: 940758 - protein, 20 aa, Mycobacterium
PRWRLGILATVLATTACSTN

SEQ ID NO: 940759 - protein, 19 aa, Mycobacterium
PRYPFLGVHFTRGIDGHVH

SEQ ID NO: 940760 - protein, 17 aa, Mycobacterium
PRYPINVLADLNAFMGI

SEQ ID NO: 940761 - protein, 20 aa, Mycobacterium
PRYSAVPVRLHPDIRLFPAV

SEQ ID NO: 940762 - protein, 20 aa, Mycobacterium
PSALVGPVWRREEIIDFNAS

SEQ ID NO: 940763 - protein, 17 aa, Mycobacterium
PSARIGRPLTLLSPDFG

SEQ ID NO: 940764 - protein, 17 aa, Mycobacterium
PSAWLVEGLLFFLKSSA

SEQ ID NO: 940765 - protein, 21 aa, Mycobacterium
PSAWVPIHLVGAGIDLDTKTP

SEQ ID NO: 940766 - protein, 19 aa, Mycobacterium
PSFDIAKLFNGFRPIFETL

SEQ ID NO: 940767 - protein, 20 aa, Mycobacterium
PSGEIWQWALGKSMLTDPTL

SEQ ID NO: 940768 - protein, 25 aa, Mycobacterium
PSPVADAVLAWVRRLITHTFFNKTP

SEQ ID NO: 940769 - protein, 21 aa, Mycobacterium
PSSAQLPVWLSRAGADVLAAH

SEQ ID NO: 940770 - protein, 24 aa, Mycobacterium
PSSVQLPAWLSRAGADVLKTNPIV

SEQ ID NO: 940771 - protein, 20 aa, Mycobacterium
PSSVQLPVWLSRGGADVLQT

SEQ ID NO: 940772 - protein, 17 aa, Mycobacterium
PSTVDGWLHTGDIGRLD

SEQ ID NO: 940773 - protein, 17 aa, Mycobacterium
PSYRLTHLWYRDNPPMF

SEQ ID NO: 940774 - protein, 19 aa, Mycobacterium
PTAFDLRGAVTYVVDLAVS

SEQ ID NO: 940775 - protein, 24 aa, Mycobacterium
PTALPLCALICGWLRGQARPDARV

SEQ ID NO: 940776 - protein, 17 aa, Mycobacterium
PTARCAKVKVPVNYDKL

SEQ ID NO: 940777 - protein, 24 aa, Mycobacterium
PTDNGACYWKRMGNPDGNIIDNSM

SEQ ID NO: 940778 - protein, 22 aa, Mycobacterium
PTEPAMRPGFYGYGFNVGTTSA

SEQ ID NO: 940779 - protein, 24 aa, Mycobacterium
PTFPEPWPPFGLGGTRFSPCPAPP

SEQ ID NO: 940780 - protein, 20 aa, Mycobacterium
PTGLRLQSKPGFRVQPGARV

SEQ ID NO: 940781 - protein, 20 aa, Mycobacterium
PTGPCLEGWTTLTALAQATT

SEQ ID NO: 940782 - protein, 25 aa, Mycobacterium
PTGWKIARPPGVDWPVRPVIMLHGR

SEQ ID NO: 940783 - protein, 17 aa, Mycobacterium
PTINLPMPNGWQTANDS

SEQ ID NO: 940784 - protein, 17 aa, Mycobacterium
PTLPVPAGWPFGEEFPR

SEQ ID NO: 940785 - protein, 17 aa, Mycobacterium
PTMAGAVPTIWTDVLHY

SEQ ID NO: 940786 - protein, 18 aa, Mycobacterium
PTMAGAVPTIWTDVLHYL

SEQ ID NO: 940787 - protein, 24 aa, Mycobacterium
PTMKHEARKALALLGGATTLGLAI

SEQ ID NO: 940788 - protein, 28 aa, Mycobacterium
PTMYELFSVGWGRPDLRGQWEHGSPQVR

SEQ ID NO: 940789 - protein, 21 aa, Mycobacterium
PTPDRVRELFVAWGKLYPQFG

SEQ ID NO: 940790 - protein, 27 aa, Mycobacterium
PTPEQWLRIVTELAPVFKAAGFRPNNA

SEQ ID NO: 940791 - protein, 19 aa, Mycobacterium
PTQHRRYITVTAQFDSAAG

SEQ ID NO: 940792 - protein, 29 aa, Mycobacterium
PTQQGRLGYFRELWHAMRTQEVSGSDALL

SEQ ID NO: 940793 - protein, 23 aa, Mycobacterium
PTQVRWRPLQFWPANTAVNIDAA

SEQ ID NO: 940794 - protein, 26 aa, Mycobacterium
PTVPGDPPLLLGVLAFVRREIQRTFF

SEQ ID NO: 940795 - protein, 25 aa, Mycobacterium
PTVSLKRAFALSCNTAFVQLGMHTG

SEQ ID NO: 940796 - protein, 17 aa, Mycobacterium
PTWELPGGYGLPGGDPT

SEQ ID NO: 940797 - protein, 20 aa, Mycobacterium
PTWPNRMMWMTGTIDPDAAH

SEQ ID NO: 940798 - protein, 18 aa, Mycobacterium
PTYYRWDVYYVTTAGDVL

SEQ ID NO: 940799 - protein, 20 aa, Mycobacterium
PVAACGPALVTTRPRLTHGV

SEQ ID NO: 940800 - protein, 24 aa, Mycobacterium
PVARDARFRWGVAMMPAGPVARVS

SEQ ID NO: 940801 - protein, 18 aa, Mycobacterium
PVEPRIPALSGEPPGVIV

SEQ ID NO: 940802 - protein, 24 aa, Mycobacterium
PVGSRLGYRTTIPYATRISVDGIY

SEQ ID NO: 940803 - protein, 25 aa, Mycobacterium
PVHNKLRFGFWGAEELGLIGSRNYV

SEQ ID NO: 940804 - protein, 17 aa, Mycobacterium
PVLAEWFLRRFSLLDSL

SEQ ID NO: 940805 - protein, 17 aa, Mycobacterium
PVLTEFLAIPWVVPNWP

SEQ ID NO: 940806 - protein, 20 aa, Mycobacterium
PVQVKGGLIWTGDSHAKQGN

SEQ ID NO: 940807 - protein, 18 aa, Mycobacterium
PWAQPKLGAAQPVVLNLD

SEQ ID NO: 940808 - protein, 21 aa, Mycobacterium
PYETIGGLVLRQLGHIPVAGE

SEQ ID NO: 940809 - protein, 18 aa, Mycobacterium
PYGGAWLNSWLDRDLGLS

SEQ ID NO: 940810 - protein, 17 aa, Mycobacterium
PYLLLGILPSERVEATP

SEQ ID NO: 940811 - protein, 21 aa, Mycobacterium
QAAAFHDRFVQALTASAESYA

SEQ ID NO: 940812 - protein, 19 aa, Mycobacterium
QAAFDRIHWFFSLDPVGRR

SEQ ID NO: 940813 - protein, 35 aa, Mycobacterium
QAALSRIGSPYSWGGSGPGAFDCSGLVMWSFQQAG

SEQ ID NO: 940814 - protein, 22 aa, Mycobacterium
QAARDRIHWFFSMDYAGRRQYS

SEQ ID NO: 940815 - protein, 21 aa, Mycobacterium
QAATLMLNWYPYGEHAPFYYG

SEQ ID NO: 940816 - protein, 24 aa, Mycobacterium
QAATLRPGNPITIAGIEVGHVTSM

SEQ ID NO: 940817 - protein, 23 aa, Mycobacterium
QAEAIPARFVLAAAMVRHLLADP

SEQ ID NO: 940818 - protein, 23 aa, Mycobacterium
QAIDLLKGMVLPAITQAIQSGAQ

SEQ ID NO: 940819 - protein, 21 aa, Mycobacterium
QALLGRPLIGNGSDAASGSGA

SEQ ID NO: 940820 - protein, 23 aa, Mycobacterium
QARNRFNAAWNRRDGGHPINDSA

SEQ ID NO: 940821 - protein, 18 aa, Mycobacterium
QAVARWLVLYLRRPGGQS

SEQ ID NO: 940822 - protein, 25 aa, Mycobacterium
QAVQRCLCAAAALLTLVTACSSNPL

SEQ ID NO: 940823 - protein, 24 aa, Mycobacterium
QAYQRLGAQVAMFHQQFVQSLNVG

SEQ ID NO: 940824 - protein, 19 aa, Mycobacterium
QCAVFCIQDLPAAPAPAPG

SEQ ID NO: 940825 - protein, 19 aa, Mycobacterium
QCEWIPPQLLDRGQHRTNT

SEQ ID NO: 940826 - protein, 19 aa, Mycobacterium
QCQNRWVVCGGTYNPPSSS

SEQ ID NO: 940827 - protein, 24 aa, Mycobacterium
QDFFGRLSGFWDWYKANPDEVTQT

SEQ ID NO: 940828 - protein, 19 aa, Mycobacterium
QDITFVWGGDVVGQGWGIN

SEQ ID NO: 940829 - protein, 17 aa, Mycobacterium
QDLKATLLAAIGLGNNG

SEQ ID NO: 940830 - protein, 17 aa, Mycobacterium
QDLRAAFTERGWLDMTH

SEQ ID NO: 940831 - protein, 18 aa, Mycobacterium
QDSMCLWFTYSTPDTNKD

SEQ ID NO: 940832 - protein, 19 aa, Mycobacterium
QDSMCMWFTYSTPDANKDN

SEQ ID NO: 940833 - protein, 18 aa, Mycobacterium
QDSMCVWFTYSTPDANKD

SEQ ID NO: 940834 - protein, 18 aa, Mycobacterium
QEDPRWTCSHAMALQDSV

SEQ ID NO: 940835 - protein, 21 aa, Mycobacterium
QETYLRLTVIGNHFPPPQTQI

SEQ ID NO: 940836 - protein, 22 aa, Mycobacterium
QEYKSPTALVWLLGRIYCTGTP

SEQ ID NO: 940837 - protein, 24 aa, Mycobacterium
QFIKRLGTFAAIFTVPNFLELDYW

SEQ ID NO: 940838 - protein, 23 aa, Mycobacterium
QFIKRLGTYAAIFTVPNFLELDY

SEQ ID NO: 940839 - protein, 20 aa, Mycobacterium
QFIPETWRLYGVDANNDGDV

SEQ ID NO: 940840 - protein, 24 aa, Mycobacterium
QFRPEVSDGLFLRLAVTSVESLAC

SEQ ID NO: 940841 - protein, 22 aa, Mycobacterium
QFTRGGALWGVPQLTDAGIALY

SEQ ID NO: 940842 - protein, 19 aa, Mycobacterium
QFVILVGAAVNWLRQGEFN

SEQ ID NO: 940843 - protein, 17 aa, Mycobacterium
QGARVSAAWIREHGGTE

SEQ ID NO: 940844 - protein, 17 aa, Mycobacterium
QGFYPGIGAPSWTADYG

SEQ ID NO: 940845 - protein, 20 aa, Mycobacterium
QGGPCARTVLDTALLHQVIA

SEQ ID NO: 940846 - protein, 21 aa, Mycobacterium
QGGSIGLGFAIPVDQAKRIAD

SEQ ID NO: 940847 - protein, 21 aa, Mycobacterium
QGHSMFPWLTLALVGSATSRI

SEQ ID NO: 940848 - protein, 23 aa, Mycobacterium
QGIKAWPKCGAKGMAAQVWGNPA

SEQ ID NO: 940849 - protein, 23 aa, Mycobacterium
QGNGWGLSFARLFDMTNDSGLFH

SEQ ID NO: 940850 - protein, 18 aa, Mycobacterium
QGPAAWPKCSSAGGLPPV

SEQ ID NO: 940851 - protein, 17 aa, Mycobacterium
QGPRWGAGDVVAYLESS

SEQ ID NO: 940852 - protein, 18 aa, Mycobacterium
QGRVDVWAVWDPYTAQAE

SEQ ID NO: 940853 - protein, 17 aa, Mycobacterium
QGYRLRVKMARDEDGLY

SEQ ID NO: 940854 - protein, 21 aa, Mycobacterium
QIATLRWDGGLAQSRMDNLLS

SEQ ID NO: 940855 - protein, 17 aa, Mycobacterium
QIFPKLGSFVARIDPER

SEQ ID NO: 940856 - protein, 19 aa, Mycobacterium
QIHSVGKCEANSAAPGGGA

SEQ ID NO: 940857 - protein, 20 aa, Mycobacterium
QISVPGWLAFGWGLVDLFVP

SEQ ID NO: 940858 - protein, 23 aa, Mycobacterium
QKTHFWKNISILGGLIIAGIDTE

SEQ ID NO: 940859 - protein, 23 aa, Mycobacterium
QLAGLRLGKVLSISEATEPPAPG

SEQ ID NO: 940860 - protein, 17 aa, Mycobacterium
QLARLAAIGGFRRWEPM

SEQ ID NO: 940861 - protein, 23 aa, Mycobacterium
QLAWMWPNWAKLFFNNKGVAANT

SEQ ID NO: 940862 - protein, 17 aa, Mycobacterium
QLGRWKWHDPYVHASLL

SEQ ID NO: 940863 - protein, 17 aa, Mycobacterium
QLIVFAVLTVVSLLVLG

SEQ ID NO: 940864 - protein, 20 aa, Mycobacterium
QLPIETFNALGFTLPKESVQ

SEQ ID NO: 940865 - protein, 17 aa, Mycobacterium
QLQIALMLVQGEKIETG

SEQ ID NO: 940866 - protein, 18 aa, Mycobacterium
QLRWKPTQFWPANTDVNV

SEQ ID NO: 940867 - protein, 21 aa, Mycobacterium
QLSGLRLGRVLSISEATGNPP

SEQ ID NO: 940868 - protein, 24 aa, Mycobacterium
QLVVPRWVLLSGVGWHTFGASGTI

SEQ ID NO: 940869 - protein, 25 aa, Mycobacterium
QLYADFRLLFLILHASRFAPRLDEH

SEQ ID NO: 940870 - protein, 19 aa, Mycobacterium
QPADAWAAQLLAGWTEAEV

SEQ ID NO: 940871 - protein, 22 aa, Mycobacterium
QPDLRVLVDLGYSDWGNGQDYA

SEQ ID NO: 940872 - protein, 22 aa, Mycobacterium
QPERVKITFSYDAKYQVPADAK

SEQ ID NO: 940873 - protein, 19 aa, Mycobacterium
QPGPPVAVRAVWAARVAPP

SEQ ID NO: 940874 - protein, 22 aa, Mycobacterium
QPPSLRKALGIKGHPVRDLVKS

SEQ ID NO: 940875 - protein, 25 aa, Mycobacterium
QPQRVKITFWYDRKYKVPANVKAVI

SEQ ID NO: 940876 - protein, 23 aa, Mycobacterium
QPRFARGALLAFAGLTAFSVAAC

SEQ ID NO: 940877 - protein, 19 aa, Mycobacterium
QPYVVSFQLNWPRDHGPTV

SEQ ID NO: 940878 - protein, 17 aa, Mycobacterium
QQAFALSCNTAFVQLGM

SEQ ID NO: 940879 - protein, 25 aa, Mycobacterium
QRAARLGVHPSLFIEHVYFWGDPLI

SEQ ID NO: 940880 - protein, 24 aa, Mycobacterium
QRATMAISWRAIWRQIKSDIDRVG

SEQ ID NO: 940881 - protein, 27 aa, Mycobacterium
QRCGSPAWNLPVVFGPIAITYNVKGLS

SEQ ID NO: 940882 - protein, 18 aa, Mycobacterium
QRDNCKLIDWPIATLSPA

SEQ ID NO: 940883 - protein, 20 aa, Mycobacterium
QRIRWVIGLFLGLQLVLAST

SEQ ID NO: 940884 - protein, 20 aa, Mycobacterium
QRLPLVGSWVRQGIDELSQR

SEQ ID NO: 940885 - protein, 22 aa, Mycobacterium
QRLRAVVLFATWAGRVLDGAPQ

SEQ ID NO: 940886 - protein, 21 aa, Mycobacterium
QRLSEEITRVLNVTGAPQVNL

SEQ ID NO: 940887 - protein, 20 aa, Mycobacterium
QRPSTMWAQYGLAGVLEYEH

SEQ ID NO: 940888 - protein, 17 aa, Mycobacterium
QRRLVQTLCRWNLRLSV

SEQ ID NO: 940889 - protein, 20 aa, Mycobacterium
QRTDAAVGWAVLAETATGPE

SEQ ID NO: 940890 - protein, 18 aa, Mycobacterium
QSEFSVPAGHVFATGMSN

SEQ ID NO: 940891 - protein, 18 aa, Mycobacterium
QSFRFASIGGFAATRSSG

SEQ ID NO: 940892 - protein, 21 aa, Mycobacterium
QSGSIGLGFAIPVDQAKRIAD

SEQ ID NO: 940893 - protein, 19 aa, Mycobacterium
QSRFGEFREGVWLRPENLE

SEQ ID NO: 940894 - protein, 19 aa, Mycobacterium
QSRGRPGLIRGPDLMYPNR

SEQ ID NO: 940895 - protein, 19 aa, Mycobacterium
QSTFVGALCRWQAMSKSGG

SEQ ID NO: 940896 - protein, 22 aa, Mycobacterium
QSVVFRPAFEFIESGWRELGVA

SEQ ID NO: 940897 - protein, 20 aa, Mycobacterium
QTACKPGMIGDGIRGDFTVT

SEQ ID NO: 940898 - protein, 18 aa, Mycobacterium
QTACKPGMIGDGIRGDLT

SEQ ID NO: 940899 - protein, 17 aa, Mycobacterium
QTLLSVLGAVVFNIYSV

SEQ ID NO: 940900 - protein, 22 aa, Mycobacterium
QTQEWISYLGVWARGMQDGVGM

SEQ ID NO: 940901 - protein, 28 aa, Mycobacterium
QTRVAVLLPAHWQTAAVLFGIWWIGAEI

SEQ ID NO: 940902 - protein, 18 aa, Mycobacterium
QVAAGAWHTVLLRSDGTV

SEQ ID NO: 940903 - protein, 19 aa, Mycobacterium
QVAARMAAFHDQFVAALHS

SEQ ID NO: 940904 - protein, 17 aa, Mycobacterium
QVGCRMLVNGVVRDEQS

SEQ ID NO: 940905 - protein, 25 aa, Mycobacterium
QVQALSQFVAWPGLLVYQGKAKLLY

SEQ ID NO: 940906 - protein, 18 aa, Mycobacterium
QVVLEVFGAPGAVATINY

SEQ ID NO: 940907 - protein, 20 aa, Mycobacterium
QWAGTFAAMSARDRAGPAGA

SEQ ID NO: 940908 - protein, 18 aa, Mycobacterium
QWAIPWGFENNVVAYNKA

SEQ ID NO: 940909 - protein, 18 aa, Mycobacterium
QYGSIPLPSSFQAKLAKA

SEQ ID NO: 940910 - protein, 19 aa, Mycobacterium
QYWYCLQHDDGLWYLHNSD

SEQ ID NO: 940911 - protein, 19 aa, Mycobacterium
RAAALKFNYDFEMAKIGRP

SEQ ID NO: 940912 - protein, 21 aa, Mycobacterium
RAADVHARFVQALAAGADRYA

SEQ ID NO: 940913 - protein, 19 aa, Mycobacterium
RAAPQWPELEAGALRRIRG

SEQ ID NO: 940914 - protein, 18 aa, Mycobacterium
RAASRSKVLPPWATGQGA

SEQ ID NO: 940915 - protein, 27 aa, Mycobacterium
RAAVPRWPWEPVMAVMRLLPPRLAGRL

SEQ ID NO: 940916 - protein, 22 aa, Mycobacterium
RADGRWGGAMLVAAKSATANVD

SEQ ID NO: 940917 - protein, 17 aa, Mycobacterium
RADRDFVLRFRLDRGAL

SEQ ID NO: 940918 - protein, 17 aa, Mycobacterium
RAFSYRPNTGFTGQDSF

SEQ ID NO: 940919 - protein, 17 aa, Mycobacterium
RAGAALIHVSTDYVFDG

SEQ ID NO: 940920 - protein, 17 aa, Mycobacterium
RAGFSLRGHVRRLSDAD

SEQ ID NO: 940921 - protein, 20 aa, Mycobacterium
RAGSQMGVPYSWGGGTLEGP

SEQ ID NO: 940922 - protein, 18 aa, Mycobacterium
RAKVTFWVDKEFQVPADA

SEQ ID NO: 940923 - protein, 25 aa, Mycobacterium
RALFVLRAAGLIALKGGRVTPSTAD

SEQ ID NO: 940924 - protein, 17 aa, Mycobacterium
RALPALLIFVVTACTSP

SEQ ID NO: 940925 - protein, 18 aa, Mycobacterium
RANESWWRPLKDAAEARY

SEQ ID NO: 940926 - protein, 18 aa, Mycobacterium
RANESWWRPLKDASEARY

SEQ ID NO: 940927 - protein, 21 aa, Mycobacterium
RANGGLFARAYPLFRLMGIDT

SEQ ID NO: 940928 - protein, 20 aa, Mycobacterium
RANGMAPYLVRVLGVPSAPV

SEQ ID NO: 940929 - protein, 17 aa, Mycobacterium
RANYVASVMFCRIDPED

SEQ ID NO: 940930 - protein, 17 aa, Mycobacterium
RAPARWRPRRRRRRRRY

SEQ ID NO: 940931 - protein, 18 aa, Mycobacterium
RAPLGYPALHHLTSPLRK

SEQ ID NO: 940932 - protein, 19 aa, Mycobacterium
RARLLELFELFDPADPAVI

SEQ ID NO: 940933 - protein, 20 aa, Mycobacterium
RARMSSMLWTFKVEKSDGVS

SEQ ID NO: 940934 - protein, 20 aa, Mycobacterium
RARMSSMLWTFKVQKDNGVA

SEQ ID NO: 940935 - protein, 26 aa, Mycobacterium
RARSPFWKSLAVFWLALSVAACSSST

SEQ ID NO: 940936 - protein, 19 aa, Mycobacterium
RATAKLGTWMPGLVNGVVA

SEQ ID NO: 940937 - protein, 19 aa, Mycobacterium
RAVGIGGNIATLGTTITDG

SEQ ID NO: 940938 - protein, 20 aa, Mycobacterium
RAVIPRDHVKTVLDSADVII

SEQ ID NO: 940939 - protein, 18 aa, Mycobacterium
RAVIRAAVWLTAICALAA

SEQ ID NO: 940940 - protein, 20 aa, Mycobacterium
RAVVLPQWLFSVLLTPAIRL

SEQ ID NO: 940941 - protein, 19 aa, Mycobacterium
RAYRLDWPAGTVVYEVDMP

SEQ ID NO: 940942 - protein, 18 aa, Mycobacterium
RAYRLDWPGGTTVYEIDL

SEQ ID NO: 940943 - protein, 17 aa, Mycobacterium
RAYRLPWPAGTTLFEVD

SEQ ID NO: 940944 - protein, 25 aa, Mycobacterium
RCGSPAWNLPVVFGPIAITYHVAGV

SEQ ID NO: 940945 - protein, 26 aa, Mycobacterium
RCGSPAWNLPVVFGPIAITYNVTGLN

SEQ ID NO: 940946 - protein, 25 aa, Mycobacterium
RCGSPAWNLPVVFGPLAVTYNLAGV

SEQ ID NO: 940947 - protein, 23 aa, Mycobacterium
RCGSQAWDLPTVFGPIAVTYHLT

SEQ ID NO: 940948 - protein, 18 aa, Mycobacterium
RCLFARGRYVTWVEGTRS

SEQ ID NO: 940949 - protein, 17 aa, Mycobacterium
RCTQIEWYRTIQIGDQA

SEQ ID NO: 940950 - protein, 17 aa, Mycobacterium
RDAFTWSAAGVGYRGEF

SEQ ID NO: 940951 - protein, 21 aa, Mycobacterium
RDATFRWGVAMLPIGPAGRVS

SEQ ID NO: 940952 - protein, 23 aa, Mycobacterium
RDATFRWGVAMLPIGPVGRVSVT

SEQ ID NO: 940953 - protein, 23 aa, Mycobacterium
RDGRLQLALGPRGVFELDAWDGN

SEQ ID NO: 940954 - protein, 17 aa, Mycobacterium
RDIDAVLKLSVDRQAAL

SEQ ID NO: 940955 - protein, 17 aa, Mycobacterium
RDIRVMVGREFDPSGFD

SEQ ID NO: 940956 - protein, 17 aa, Mycobacterium
RDLPLRLVHAVTATGDG

SEQ ID NO: 940957 - protein, 24 aa, Mycobacterium
RDLWNMRNSPEFMQSVGPGQMDPS

SEQ ID NO: 940958 - protein, 17 aa, Mycobacterium
RDPRSGQGWNPEPLAGN

SEQ ID NO: 940959 - protein, 17 aa, Mycobacterium
RDRLTRTFTRFVAAAVQ

SEQ ID NO: 940960 - protein, 24 aa, Mycobacterium
RDVLRCAPALLGAAAFLGAPRATA

SEQ ID NO: 940961 - protein, 17 aa, Mycobacterium
RDVMVIHTLLWPDEIRD

SEQ ID NO: 940962 - protein, 24 aa, Mycobacterium
REAHPTMWIRLWFSDGEKLHQRAY

SEQ ID NO: 940963 - protein, 20 aa, Mycobacterium
REFLTDLSLLGGLIIASADT

SEQ ID NO: 940964 - protein, 18 aa, Mycobacterium
REHRVAAVFLRELLAQDL

SEQ ID NO: 940965 - protein, 19 aa, Mycobacterium
RELFNDILPAHIVKDIPGG

SEQ ID NO: 940966 - protein, 19 aa, Mycobacterium
RELFVAWGKLYPQFGTVAA

SEQ ID NO: 940967 - protein, 21 aa, Mycobacterium
REPARCWARGPVVLAGDAAHP

SEQ ID NO: 940968 - protein, 17 aa, Mycobacterium
REPGISGSPAFTAVRAV

SEQ ID NO: 940969 - protein, 20 aa, Mycobacterium
REYLARGTFFASLEGVEDPH

SEQ ID NO: 940970 - protein, 20 aa, Mycobacterium
RFAPVPAQVPAPMQVPAATA

SEQ ID NO: 940971 - protein, 18 aa, Mycobacterium
RFGALRCRLSLAFAQLWQ

SEQ ID NO: 940972 - protein, 20 aa, Mycobacterium
RFGGLDIRNMWGLPQLGRWK

SEQ ID NO: 940973 - protein, 18 aa, Mycobacterium
RFGLLWFGFWSTLFDMPG

SEQ ID NO: 940974 - protein, 18 aa, Mycobacterium
RFGVPIPNLTAWRDGVVG

SEQ ID NO: 940975 - protein, 18 aa, Mycobacterium
RFGVPVPNISAWRNGLVG

SEQ ID NO: 940976 - protein, 19 aa, Mycobacterium
RFGVPVPNLSAWRRSVTGD

SEQ ID NO: 940977 - protein, 25 aa, Mycobacterium
RFLLTYPRRLGFGLGNSAVSLSWRT

SEQ ID NO: 940978 - protein, 20 aa, Mycobacterium
RFNVYGTDVGVMWDNGMVDD

SEQ ID NO: 940979 - protein, 20 aa, Mycobacterium
RFRFEEICATPAFPDDIRKS

SEQ ID NO: 940980 - protein, 21 aa, Mycobacterium
RFRFEELCATPATARDPRDSA

SEQ ID NO: 940981 - protein, 22 aa, Mycobacterium
RFYCGEMYRTGFFCADPHPGNI

SEQ ID NO: 940982 - protein, 19 aa, Mycobacterium
RGAERWPDKFLAAAAGVAH

SEQ ID NO: 940983 - protein, 20 aa, Mycobacterium
RGAVALVDRGSCEFAQKEDV

SEQ ID NO: 940984 - protein, 19 aa, Mycobacterium
RGGDPYLRRPGCAAPAKFS

SEQ ID NO: 940985 - protein, 23 aa, Mycobacterium
RGGNGGTGGWLFGNGGVGGAGGT

SEQ ID NO: 940986 - protein, 18 aa, Mycobacterium
RGGPYLARGAADLVPSAQ

SEQ ID NO: 940987 - protein, 22 aa, Mycobacterium
RGGTQMGVPYSWGGGKPNGPSR

SEQ ID NO: 940988 - protein, 24 aa, Mycobacterium
RGHPRLDDLVGIFVNIMLLRTEVT

SEQ ID NO: 940989 - protein, 21 aa, Mycobacterium
RGKVFIADTVKGWITVLTCTP

SEQ ID NO: 940990 - protein, 23 aa, Mycobacterium
RGMSQMGVPYSWGGGNAAGPSRG

SEQ ID NO: 940991 - protein, 17 aa, Mycobacterium
RGPLQWEAPYGHTLISK

SEQ ID NO: 940992 - protein, 18 aa, Mycobacterium
RGSLPMAVAVWAGDGTQV

SEQ ID NO: 940993 - protein, 22 aa, Mycobacterium
RGVIPRDHIKEVLDSADVLIWL

SEQ ID NO: 940994 - protein, 18 aa, Mycobacterium
RHRAWQTLVLLVAAMVLS

SEQ ID NO: 940995 - protein, 19 aa, Mycobacterium
RHRRYLHRGGVHYGNSPAQ

SEQ ID NO: 940996 - protein, 20 aa, Mycobacterium
RIDTELGWARFYGHNTARVF

SEQ ID NO: 940997 - protein, 19 aa, Mycobacterium
RILPILKHHYANFIAEVPG

SEQ ID NO: 940998 - protein, 18 aa, Mycobacterium
RIPWLPINLVEPYDAGGE

SEQ ID NO: 940999 - protein, 19 aa, Mycobacterium
RISFVPGPAGFRFYHTHVV

SEQ ID NO: 941000 - protein, 18 aa, Mycobacterium
RITALMCTADVLALSAMD

SEQ ID NO: 941001 - protein, 21 aa, Mycobacterium
RKATVVATAWGIRVAREAERK

SEQ ID NO: 941002 - protein, 25 aa, Mycobacterium
RKDYGICPFAGWPVPIPNGAQPNTG

SEQ ID NO: 941003 - protein, 19 aa, Mycobacterium
RKEQAWEFVKFATGPVGQA

SEQ ID NO: 941004 - protein, 20 aa, Mycobacterium
RKLREIRAALAMDKLLSKTE

SEQ ID NO: 941005 - protein, 19 aa, Mycobacterium
RKSLWCGIGGLVPFAQSPP

SEQ ID NO: 941006 - protein, 17 aa, Mycobacterium
RKVLQCLVFDDPAAAAL

SEQ ID NO: 941007 - protein, 18 aa, Mycobacterium
RKVLQRWGLEDEAVAKSE

SEQ ID NO: 941008 - protein, 24 aa, Mycobacterium
RLAILRRLACGEARVVDLTGELGL

SEQ ID NO: 941009 - protein, 25 aa, Mycobacterium
RLASDMGEFFMPFPGTRVNQQVVPL

SEQ ID NO: 941010 - protein, 19 aa, Mycobacterium
RLCAVLGVVLLAGCSVSAP

SEQ ID NO: 941011 - protein, 18 aa, Mycobacterium
RLCPVCWYATRAALAQRA

SEQ ID NO: 941012 - protein, 17 aa, Mycobacterium
RLDDVRVVLIAPPEVGV

SEQ ID NO: 941013 - protein, 25 aa, Mycobacterium
RLEWPLRPPPAIARGFDAPSPDWHP

SEQ ID NO: 941014 - protein, 17 aa, Mycobacterium
RLGLARGESRYDAVEAK

SEQ ID NO: 941015 - protein, 17 aa, Mycobacterium
RLGPARTAAICAVSPAL

SEQ ID NO: 941016 - protein, 19 aa, Mycobacterium
RLGPGESWEVNLVMEDPQQ

SEQ ID NO: 941017 - protein, 22 aa, Mycobacterium
RLGSNPDLMGWNFRRVALTPED

SEQ ID NO: 941018 - protein, 25 aa, Mycobacterium
RLGVPVICLLAGLLLAATHGVSGGD

SEQ ID NO: 941019 - protein, 20 aa, Mycobacterium
RLHPDIRLFPAVPQQRSSTA

SEQ ID NO: 941020 - protein, 19 aa, Mycobacterium
RLIDCSMELGGKNALLVLD

SEQ ID NO: 941021 - protein, 18 aa, Mycobacterium
RLKIEFSSVLNLPGRAKV

SEQ ID NO: 941022 - protein, 22 aa, Mycobacterium
RLKYLPLAPFRISYAYTNFGVT

SEQ ID NO: 941023 - protein, 19 aa, Mycobacterium
RLNTYGGMINWRVENPVLN

SEQ ID NO: 941024 - protein, 21 aa, Mycobacterium
RLRPWIYRWGATYEESVAGLP

SEQ ID NO: 941025 - protein, 21 aa, Mycobacterium
RLRRRLLLFSAVPAVLVTLLA

SEQ ID NO: 941026 - protein, 19 aa, Mycobacterium
RLSAFKVPHRFAVVERLPR

SEQ ID NO: 941027 - protein, 19 aa, Mycobacterium
RLTANYPPFLFHPLNTITA

SEQ ID NO: 941028 - protein, 17 aa, Mycobacterium
RLTEFFGGIPILDGVGS

SEQ ID NO: 941029 - protein, 18 aa, Mycobacterium
RLVKAGKVAEDWNAGATK

SEQ ID NO: 941030 - protein, 23 aa, Mycobacterium
RLVKAGKVAKEWNADATKGIPFG

SEQ ID NO: 941031 - protein, 18 aa, Mycobacterium
RLVKAGKVSKDWNADATK

SEQ ID NO: 941032 - protein, 21 aa, Mycobacterium
RLVPIAGDSWGAFRAYLADKS

SEQ ID NO: 941033 - protein, 21 aa, Mycobacterium
RLVQTLCRWNLRLSVRDPQLR

SEQ ID NO: 941034 - protein, 19 aa, Mycobacterium
RLVTRPKFGTVVFDDDGGY

SEQ ID NO: 941035 - protein, 19 aa, Mycobacterium
RLYWISAWIDPDGVAGGPL

SEQ ID NO: 941036 - protein, 19 aa, Mycobacterium
RLYWMSAWIDPNGEQGGPL

SEQ ID NO: 941037 - protein, 25 aa, Mycobacterium
RMAKDLPPQCGWVFAETQVFGSEVE

SEQ ID NO: 941038 - protein, 20 aa, Mycobacterium
RMGSQMGVPYSWGGGSLDGP

SEQ ID NO: 941039 - protein, 20 aa, Mycobacterium
RNKSRLAALRVKDFSKRDVM

SEQ ID NO: 941040 - protein, 21 aa, Mycobacterium
RNKTRLAALRVKDFGKRDVMM

SEQ ID NO: 941041 - protein, 21 aa, Mycobacterium
RNKTRLAALRVKDFSKRDVMV

SEQ ID NO: 941042 - protein, 17 aa, Mycobacterium
RNPKWWGPRPRLDNITY

SEQ ID NO: 941043 - protein, 17 aa, Mycobacterium
RNPVEWDKPFNMGRYVT

SEQ ID NO: 941044 - protein, 19 aa, Mycobacterium
RNSELPLARALVDGAGMPP

SEQ ID NO: 941045 - protein, 17 aa, Mycobacterium
RNTTLWASWVFRGPTHR

SEQ ID NO: 941046 - protein, 17 aa, Mycobacterium
RPAFWSANLCFSLGESL

SEQ ID NO: 941047 - protein, 18 aa, Mycobacterium
RPAFYPGRVETAGEALAD

SEQ ID NO: 941048 - protein, 18 aa, Mycobacterium
RPANVVFLNGSPTDNNAT

SEQ ID NO: 941049 - protein, 19 aa, Mycobacterium
RPGFFFAVDAHSMWANSKS

SEQ ID NO: 941050 - protein, 18 aa, Mycobacterium
RPGGNWMLGKPIQIAEAR

SEQ ID NO: 941051 - protein, 18 aa, Mycobacterium
RPGGTWMLGKPIQLGEAR

SEQ ID NO: 941052 - protein, 23 aa, Mycobacterium
RPGQRLKQAWLRELAQWQPDLVI

SEQ ID NO: 941053 - protein, 23 aa, Mycobacterium
RPGRLPGVIAYPGLDFQHTPAVE

SEQ ID NO: 941054 - protein, 17 aa, Mycobacterium
RPGTFGVIFALIAVLAS

SEQ ID NO: 941055 - protein, 22 aa, Mycobacterium
RPHAAELWARMIADERAVFLRK

SEQ ID NO: 941056 - protein, 19 aa, Mycobacterium
RPLLLCGAVVLAAACTRVV

SEQ ID NO: 941057 - protein, 20 aa, Mycobacterium
RPLYGPGLRCLIPLVDKMIR

SEQ ID NO: 941058 - protein, 19 aa, Mycobacterium
RPNQPGAYPIVLATYEIVC

SEQ ID NO: 941059 - protein, 19 aa, Mycobacterium
RPPECLYAPFSKSFSRTPD

SEQ ID NO: 941060 - protein, 20 aa, Mycobacterium
RPQDFWPAGTVVTIDAAGTK

SEQ ID NO: 941061 - protein, 17 aa, Mycobacterium
RPSERWGQEVVAVVAVD

SEQ ID NO: 941062 - protein, 31 aa, Mycobacterium
RPTRPPGWPGWPGWPPHHGHWPTKPTKPTKP

SEQ ID NO: 941063 - protein, 17 aa, Mycobacterium
RPVYPCREASAIASGAA

SEQ ID NO: 941064 - protein, 18 aa, Mycobacterium
RPYTVILFDEIEKAHPDV

SEQ ID NO: 941065 - protein, 18 aa, Mycobacterium
RQALKIQRWRSRVRNHTV

SEQ ID NO: 941066 - protein, 18 aa, Mycobacterium
RQHRVAAVFLRELLAEDL

SEQ ID NO: 941067 - protein, 17 aa, Mycobacterium
RQHRVAAVFLREMLAGD

SEQ ID NO: 941068 - protein, 26 aa, Mycobacterium
RQHWKLLGAFVVFVAVVALVFGDVRI

SEQ ID NO: 941069 - protein, 18 aa, Mycobacterium
RQNNCKLITWPIATISPI

SEQ ID NO: 941070 - protein, 20 aa, Mycobacterium
RQPWVVSFQLTWPRDHGPTV

SEQ ID NO: 941071 - protein, 24 aa, Mycobacterium
RQQGYRTWWWGKWHLGDWSDTNPE

SEQ ID NO: 941072 - protein, 21 aa, Mycobacterium
RQQTLRASVDWSHALLTEPEQ

SEQ ID NO: 941073 - protein, 21 aa, Mycobacterium
RQQTLRASVDWSHALLTEPER

SEQ ID NO: 941074 - protein, 17 aa, Mycobacterium
RQWARCLDMYLWLQQQV

SEQ ID NO: 941075 - protein, 18 aa, Mycobacterium
RRAACGFVATFLVLTFTI

SEQ ID NO: 941076 - protein, 24 aa, Mycobacterium
RRAAIPVLLCNDATLAGLAEARSG

SEQ ID NO: 941077 - protein, 22 aa, Mycobacterium
RRAGLRFTWRPLINRFVETTLA

SEQ ID NO: 941078 - protein, 21 aa, Mycobacterium
RRARLLALRLRRLRYRQRRKM

SEQ ID NO: 941079 - protein, 23 aa, Mycobacterium
RRDVSTLLTAWALTLGLAIALLS

SEQ ID NO: 941080 - protein, 17 aa, Mycobacterium
RRDWNYMIGSIKYVLWR

SEQ ID NO: 941081 - protein, 24 aa, Mycobacterium
RRGDPWAGVPVFAAWVCEPADVAA

SEQ ID NO: 941082 - protein, 17 aa, Mycobacterium
RRGEFRAVDSVSFRLRR

SEQ ID NO: 941083 - protein, 17 aa, Mycobacterium
RRHQLVLSRGPYRYDDE

SEQ ID NO: 941084 - protein, 24 aa, Mycobacterium
RRHQTLRASLDWSYGLLSEPERIL

SEQ ID NO: 941085 - protein, 19 aa, Mycobacterium
RRIAILAGTLTVTALFAVG

SEQ ID NO: 941086 - protein, 17 aa, Mycobacterium
RRIAVYVPKENVQMITK

SEQ ID NO: 941087 - protein, 17 aa, Mycobacterium
RRIPAEEFFTGAFSTAL

SEQ ID NO: 941088 - protein, 17 aa, Mycobacterium
RRLFVIGCCVMLAVTGC

SEQ ID NO: 941089 - protein, 19 aa, Mycobacterium
RRLGAGWFPGLKREIVNYP

SEQ ID NO: 941090 - protein, 19 aa, Mycobacterium
RRLILAGGFVVAAAAAPAI

SEQ ID NO: 941091 - protein, 19 aa, Mycobacterium
RRLLRACATLGLVTSADGE

SEQ ID NO: 941092 - protein, 18 aa, Mycobacterium
RRLLRLCARYSSAPTVVF

SEQ ID NO: 941093 - protein, 21 aa, Mycobacterium
RRLPLAVGMACAAAAVAVAPV

SEQ ID NO: 941094 - protein, 20 aa, Mycobacterium
RRLRRWSVAAAAGVVAVAGC

SEQ ID NO: 941095 - protein, 17 aa, Mycobacterium
RRLTACFAVLAVCATLA

SEQ ID NO: 941096 - protein, 18 aa, Mycobacterium
RRMLCGLQLPGPNNQQLA

SEQ ID NO: 941097 - protein, 19 aa, Mycobacterium
RRPGGAWMLGKPIQIGEAR

SEQ ID NO: 941098 - protein, 18 aa, Mycobacterium
RRPGRSWCPGCARPRRAF

SEQ ID NO: 941099 - protein, 17 aa, Mycobacterium
RRSPVFAGVIWVQQGTQ

SEQ ID NO: 941100 - protein, 26 aa, Mycobacterium
RRSPWLRANLRLRMPIRGTRPTMKHE

SEQ ID NO: 941101 - protein, 23 aa, Mycobacterium
RRSRFPHRWWWVALTDEAFPRLA

SEQ ID NO: 941102 - protein, 20 aa, Mycobacterium
RRTALKLPLLLAAGTAVATA

SEQ ID NO: 941103 - protein, 20 aa, Mycobacterium
RRTNPATGFAATLVADDTPN

SEQ ID NO: 941104 - protein, 17 aa, Mycobacterium
RRVTSTMTRFVIAAVEI

SEQ ID NO: 941105 - protein, 17 aa, Mycobacterium
RRVWPDARWDDIGAQPH

SEQ ID NO: 941106 - protein, 19 aa, Mycobacterium
RSAEPRWSAGVRWSTIDGI

SEQ ID NO: 941107 - protein, 18 aa, Mycobacterium
RSEGPSWIALQGKQYEGL

SEQ ID NO: 941108 - protein, 19 aa, Mycobacterium
RSGRGPLGWLYSASGDDTS

SEQ ID NO: 941109 - protein, 17 aa, Mycobacterium
RSLDWKVKGARDIAGKT

SEQ ID NO: 941110 - protein, 19 aa, Mycobacterium
RSNLARYGIAPGYPVDFAA

SEQ ID NO: 941111 - protein, 22 aa, Mycobacterium
RSPRIGIPMSVLRAGARVNDAA

SEQ ID NO: 941112 - protein, 20 aa, Mycobacterium
RSRCAHLLLEFSISSPYRCG

SEQ ID NO: 941113 - protein, 23 aa, Mycobacterium
RTEALKFVVHFVGDIHQPMHDAY

SEQ ID NO: 941114 - protein, 20 aa, Mycobacterium
RTEAWLGYFMLRIAPAVNRR

SEQ ID NO: 941115 - protein, 21 aa, Mycobacterium
RTGELYNYVATFGNFIVIVTA

SEQ ID NO: 941116 - protein, 23 aa, Mycobacterium
RTGRPRYPGAAGTPVPAPTEQQR

SEQ ID NO: 941117 - protein, 18 aa, Mycobacterium
RTMTGWLAARGHPVTEIA

SEQ ID NO: 941118 - protein, 20 aa, Mycobacterium
RTRRAGAVGLVITEPLNYSF

SEQ ID NO: 941119 - protein, 24 aa, Mycobacterium
RTTARWKWRLSLFSEPSAPKSDWR

SEQ ID NO: 941120 - protein, 22 aa, Mycobacterium
RTVTARFSLTVNSGVLAISPDG

SEQ ID NO: 941121 - protein, 17 aa, Mycobacterium
RTYPIPLLMPLDPFLSD

SEQ ID NO: 941122 - protein, 19 aa, Mycobacterium
RVAVPSFLLLFLVACGGSG

SEQ ID NO: 941123 - protein, 19 aa, Mycobacterium
RVFNPLLLFNWNYLPIPIN

SEQ ID NO: 941124 - protein, 18 aa, Mycobacterium
RVGALALALGIGTAVATP

SEQ ID NO: 941125 - protein, 19 aa, Mycobacterium
RVGIADAHCALPLAHKVTQ

SEQ ID NO: 941126 - protein, 17 aa, Mycobacterium
RVLAMAWEKQSESNAMW

SEQ ID NO: 941127 - protein, 17 aa, Mycobacterium
RVMPARLALGVLSVELV

SEQ ID NO: 941128 - protein, 19 aa, Mycobacterium
RVPFEKHPPFVITDVNANP

SEQ ID NO: 941129 - protein, 17 aa, Mycobacterium
RVPLADLLGAERAVSTA

SEQ ID NO: 941130 - protein, 18 aa, Mycobacterium
RVSDALTGQVLWQQLDDV

SEQ ID NO: 941131 - protein, 21 aa, Mycobacterium
RVSGFAGWLAWGFIHIAFLTG

SEQ ID NO: 941132 - protein, 20 aa, Mycobacterium
RVTEVLSRIYGHPVTVQLQT

SEQ ID NO: 941133 - protein, 21 aa, Mycobacterium
RVVMPWIVRWGMYRGVRENDP

SEQ ID NO: 941134 - protein, 22 aa, Mycobacterium
RVVMPWIVRWGMYRGVRQNNPL

SEQ ID NO: 941135 - protein, 18 aa, Mycobacterium
RVVPYPGSFWPVTGLNSP

SEQ ID NO: 941136 - protein, 17 aa, Mycobacterium
RWARLCGLNSVRVFLHD

SEQ ID NO: 941137 - protein, 17 aa, Mycobacterium
RWFGDQPFAVWPWAQPK

SEQ ID NO: 941138 - protein, 19 aa, Mycobacterium
RWGNWAKLFFNNKGVVAHA

SEQ ID NO: 941139 - protein, 17 aa, Mycobacterium
RWLSITLAFVFVAELVA

SEQ ID NO: 941140 - protein, 18 aa, Mycobacterium
RWRVRPGPVAARHWVVEP

SEQ ID NO: 941141 - protein, 17 aa, Mycobacterium
RYDWAKLVGSFKYTLWR

SEQ ID NO: 941142 - protein, 18 aa, Mycobacterium
RYDWRKFIGSLKFTLWRL

SEQ ID NO: 941143 - protein, 24 aa, Mycobacterium
RYIPFSILGVYPWPTPTDEGVDIV

SEQ ID NO: 941144 - protein, 20 aa, Mycobacterium
SAAAARYVAWATATAAQAEQ

SEQ ID NO: 941145 - protein, 18 aa, Mycobacterium
SAAPDCPDLHWIGVAGSG

SEQ ID NO: 941146 - protein, 25 aa, Mycobacterium
SAASLNWDPWVAILGFPFIPQARDH

SEQ ID NO: 941147 - protein, 18 aa, Mycobacterium
SACAIGFIDTRRRIAYSA

SEQ ID NO: 941148 - protein, 19 aa, Mycobacterium
SADLAWFPLIERVKTIPTS

SEQ ID NO: 941149 - protein, 18 aa, Mycobacterium
SADNGWWAQWFTLPADAG

SEQ ID NO: 941150 - protein, 17 aa, Mycobacterium
SAGCLLGELAIGFLGAP

SEQ ID NO: 941151 - protein, 21 aa, Mycobacterium
SAGLCGAAFAFSPSAAATPLR

SEQ ID NO: 941152 - protein, 20 aa, Mycobacterium
SAIPSWAMTLTFVRHAESLA

SEQ ID NO: 941153 - protein, 18 aa, Mycobacterium
SAKAVCWCLDGGESGLEL

SEQ ID NO: 941154 - protein, 20 aa, Mycobacterium
SAKLCVQYLAPIIKNRQYNF

SEQ ID NO: 941155 - protein, 19 aa, Mycobacterium
SAKLCVQYLAPIVKNRQFN

SEQ ID NO: 941156 - protein, 17 aa, Mycobacterium
SALAAIVAMAVGGAKVV

SEQ ID NO: 941157 - protein, 18 aa, Mycobacterium
SALKRKFALVTERADADA

SEQ ID NO: 941158 - protein, 17 aa, Mycobacterium
SANGYRTEVDWATQISY

SEQ ID NO: 941159 - protein, 19 aa, Mycobacterium
SAPLTWPAGWTRWPKRVYG

SEQ ID NO: 941160 - protein, 23 aa, Mycobacterium
SAPVFRVPLAVAEMVKYADNGFH

SEQ ID NO: 941161 - protein, 18 aa, Mycobacterium
SARGVDVTPFFSVLNGPR

SEQ ID NO: 941162 - protein, 17 aa, Mycobacterium
SASLSFSSLSGWAQLGL

SEQ ID NO: 941163 - protein, 17 aa, Mycobacterium
SCAVALMLLVSGCTVSP

SEQ ID NO: 941164 - protein, 19 aa, Mycobacterium
SCGYSDCKVLTSFTACGAV

SEQ ID NO: 941165 - protein, 17 aa, Mycobacterium
SCIPNWSADVFTWKGPE

SEQ ID NO: 941166 - protein, 29 aa, Mycobacterium
SDALGAPGMEVWKFTALRPGTTTIGTSYT

SEQ ID NO: 941167 - protein, 25 aa, Mycobacterium
SDGTAVAVGDNFRGQLNIPPLPTGM

SEQ ID NO: 941168 - protein, 25 aa, Mycobacterium
SDIRATLWRKFMLISSYGGVGVLCR

SEQ ID NO: 941169 - protein, 17 aa, Mycobacterium
SDLRWDLLQNLPIDATK

SEQ ID NO: 941170 - protein, 19 aa, Mycobacterium
SDPFVAIVAFPFIPQAMRG

SEQ ID NO: 941171 - protein, 17 aa, Mycobacterium
SDPTGVVRIGRYTPEGD

SEQ ID NO: 941172 - protein, 19 aa, Mycobacterium
SDRLDAITVTAQFDSAAGL

SEQ ID NO: 941173 - protein, 23 aa, Mycobacterium
SEDLAVYRAHWLVARTAEHIGGW

SEQ ID NO: 941174 - protein, 20 aa, Mycobacterium
SEEDRRFTVVFAYDQSDYAR

SEQ ID NO: 941175 - protein, 19 aa, Mycobacterium
SEGWWPFLINISMGDAGGY

SEQ ID NO: 941176 - protein, 19 aa, Mycobacterium
SEHVPGWRRPLSPQPGRDL

SEQ ID NO: 941177 - protein, 20 aa, Mycobacterium
SELEIPTLLLGVANDPIVGN

SEQ ID NO: 941178 - protein, 17 aa, Mycobacterium
SELPEWLAANRDVAATG

SEQ ID NO: 941179 - protein, 17 aa, Mycobacterium
SELQPGDVINFYGDASH

SEQ ID NO: 941180 - protein, 21 aa, Mycobacterium
SELSRLMFPVGIEDRPRDHRQ

SEQ ID NO: 941181 - protein, 18 aa, Mycobacterium
SEVPRLAAMTQKAIDLLK

SEQ ID NO: 941182 - protein, 20 aa, Mycobacterium
SFAANPSWNPFAFSSLTSTD

SEQ ID NO: 941183 - protein, 18 aa, Mycobacterium
SFFDVIGARTWRLGDAPR

SEQ ID NO: 941184 - protein, 19 aa, Mycobacterium
SFPDVEWAKVPGDVVTQLV

SEQ ID NO: 941185 - protein, 20 aa, Mycobacterium
SFRSLEILRGLGLRDEVHAV

SEQ ID NO: 941186 - protein, 19 aa, Mycobacterium
SFRSLEILRGLGLSDQVHA

SEQ ID NO: 941187 - protein, 19 aa, Mycobacterium
SFVLGEVSWQWEGAGAESY

SEQ ID NO: 941188 - protein, 23 aa, Mycobacterium
SFYRPTKAGAYPIVLVTYEIVCS

SEQ ID NO: 941189 - protein, 20 aa, Mycobacterium
SGAFYCARAAFGPMTDQGYG

SEQ ID NO: 941190 - protein, 17 aa, Mycobacterium
SGAVLRYGRAVGVTTPI

SEQ ID NO: 941191 - protein, 19 aa, Mycobacterium
SGCGWRGLNSLPLPGTEGN

SEQ ID NO: 941192 - protein, 19 aa, Mycobacterium
SGCSGWRGLNSLPLPGVQG

SEQ ID NO: 941193 - protein, 17 aa, Mycobacterium
SGDDWLITWSPTVLHRD

SEQ ID NO: 941194 - protein, 26 aa, Mycobacterium
SGFNAWQLGGTYVRDGKTRAVAQKTV

SEQ ID NO: 941195 - protein, 25 aa, Mycobacterium
SGFQAWQLGGSYTKNGKQRAVAQKT

SEQ ID NO: 941196 - protein, 25 aa, Mycobacterium
SGGIRGPIGLGFRVPCLVISPFSRG

SEQ ID NO: 941197 - protein, 25 aa, Mycobacterium
SGGIRGPLGLGFRVPCIVVSPFSRG

SEQ ID NO: 941198 - protein, 20 aa, Mycobacterium
SGGMCQRALIAIGLAGRPAL

SEQ ID NO: 941199 - protein, 18 aa, Mycobacterium
SGGYRITAIFSNALNLPA

SEQ ID NO: 941200 - protein, 19 aa, Mycobacterium
SGIHYGRFISLTDILGNIA

SEQ ID NO: 941201 - protein, 17 aa, Mycobacterium
SGLPGLRQKYGLDIRPG

SEQ ID NO: 941202 - protein, 18 aa, Mycobacterium
SGLVVWRLHEKFGSEDLN

SEQ ID NO: 941203 - protein, 24 aa, Mycobacterium
SGNRLGSLNFGFGNAVGDANFGWG

SEQ ID NO: 941204 - protein, 18 aa, Mycobacterium
SGPAPAVYCRARITDGTH

SEQ ID NO: 941205 - protein, 19 aa, Mycobacterium
SGPGWNGCGGWNPVQGGWG

SEQ ID NO: 941206 - protein, 20 aa, Mycobacterium
SGPKFAGPVQKHLVFVNQGG

SEQ ID NO: 941207 - protein, 19 aa, Mycobacterium
SGPQLRGGIEVVDAPQIDG

SEQ ID NO: 941208 - protein, 22 aa, Mycobacterium
SGPVRWRLLLTVGEQQDPVTDA

SEQ ID NO: 941209 - protein, 24 aa, Mycobacterium
SGRPMIGPGGWLIGNGIEPGQNGG

SEQ ID NO: 941210 - protein, 18 aa, Mycobacterium
SGSIAIEWCRSAPGCTAV

SEQ ID NO: 941211 - protein, 22 aa, Mycobacterium
SGTCFRPPLAVQQRWRDEFGLD

SEQ ID NO: 941212 - protein, 23 aa, Mycobacterium
SGVAGTWNMRWADLSLPRQAAVI

SEQ ID NO: 941213 - protein, 17 aa, Mycobacterium
SGVPWKLLQRSAVHAVS

SEQ ID NO: 941214 - protein, 20 aa, Mycobacterium
SHKFAIEYWTLMNAKNAKDS

SEQ ID NO: 941215 - protein, 20 aa, Mycobacterium
SHVDEWRATFNVNLFGAVAL

SEQ ID NO: 941216 - protein, 20 aa, Mycobacterium
SIALPTPLALGIDALGPYYL

SEQ ID NO: 941217 - protein, 17 aa, Mycobacterium
SIRRAGLRFTWRPLINR

SEQ ID NO: 941218 - protein, 18 aa, Mycobacterium
SITNRFAPVPAQVPAPMQ

SEQ ID NO: 941219 - protein, 20 aa, Mycobacterium
SIYAEYRLSASVRKAANLGS

SEQ ID NO: 941220 - protein, 18 aa, Mycobacterium
SIYAEYRLSTSVRKAANL

SEQ ID NO: 941221 - protein, 18 aa, Mycobacterium
SIYIRPTPTQTWGTDPSD

SEQ ID NO: 941222 - protein, 17 aa, Mycobacterium
SKLALKWTRSVKGSLAA

SEQ ID NO: 941223 - protein, 17 aa, Mycobacterium
SKLRGLLDVTKQNVALD

SEQ ID NO: 941224 - protein, 20 aa, Mycobacterium
SKLWTIKDLGGWKSVDKELF

SEQ ID NO: 941225 - protein, 20 aa, Mycobacterium
SLCANFRDGSGLYKGNKVLL

SEQ ID NO: 941226 - protein, 24 aa, Mycobacterium
SLDIAKGGLLGGVYAYLDNNNQLV

SEQ ID NO: 941227 - protein, 19 aa, Mycobacterium
SLDVMALDVVWTAEFAEAG

SEQ ID NO: 941228 - protein, 21 aa, Mycobacterium
SLKLDNCWLERWRRTAIDDGA

SEQ ID NO: 941229 - protein, 17 aa, Mycobacterium
SLYLVGSDYVFPRTSNA

SEQ ID NO: 941230 - protein, 21 aa, Mycobacterium
SMGGLYSRAAFRVLQSLGSPI

SEQ ID NO: 941231 - protein, 19 aa, Mycobacterium
SMPTPPGWHPYNNPNLAPF

SEQ ID NO: 941232 - protein, 17 aa, Mycobacterium
SNGHTWDALAQCEAGGN

SEQ ID NO: 941233 - protein, 18 aa, Mycobacterium
SNITRLPVRYTFDNRYFN

SEQ ID NO: 941234 - protein, 19 aa, Mycobacterium
SNLRLGLPVATGRVVGSSV

SEQ ID NO: 941235 - protein, 17 aa, Mycobacterium
SNMSVAYVFPGWLDIGS

SEQ ID NO: 941236 - protein, 20 aa, Mycobacterium
SNPDLFWALRGGGGGNFGVT

SEQ ID NO: 941237 - protein, 20 aa, Mycobacterium
SNPPTARRVMMWPSADGSCV

SEQ ID NO: 941238 - protein, 18 aa, Mycobacterium
SNVPLPWTLSVTSTLPSV

SEQ ID NO: 941239 - protein, 17 aa, Mycobacterium
SPDQARRGDLIFYGPGG

SEQ ID NO: 941240 - protein, 18 aa, Mycobacterium
SPDTSWLALNRMIPPMVK

SEQ ID NO: 941241 - protein, 20 aa, Mycobacterium
SPEFRRGWADHRVFELSHGI

SEQ ID NO: 941242 - protein, 20 aa, Mycobacterium
SPEPPGFLLLGPDALALYRY

SEQ ID NO: 941243 - protein, 18 aa, Mycobacterium
SPEVYQFVVLFPAPDQAN

SEQ ID NO: 941244 - protein, 25 aa, Mycobacterium
SPIGAIIVPGGWWLLSLQALGLSQN

SEQ ID NO: 941245 - protein, 22 aa, Mycobacterium
SPLRSAGPWAQWAATARSARLA

SEQ ID NO: 941246 - protein, 18 aa, Mycobacterium
SPLSWAMAAAARREALVA

SEQ ID NO: 941247 - protein, 18 aa, Mycobacterium
SPLVLACSAATAFAVAPL

SEQ ID NO: 941248 - protein, 17 aa, Mycobacterium
SPNRLYWMSAWIDPNGE

SEQ ID NO: 941249 - protein, 19 aa, Mycobacterium
SPPYYRLVLGMPPLDDRAI

SEQ ID NO: 941250 - protein, 24 aa, Mycobacterium
SPQVRNAVRFGFWGAEELGLIGSR

SEQ ID NO: 941251 - protein, 22 aa, Mycobacterium
SPWGTWEWMGPAALGAVLPAGG

SEQ ID NO: 941252 - protein, 19 aa, Mycobacterium
SQADHILGWIQRWRRGEFD

SEQ ID NO: 941253 - protein, 17 aa, Mycobacterium
SQALCLDIDWVVGGCMD

SEQ ID NO: 941254 - protein, 25 aa, Mycobacterium
SQGGNACYWERLRGLGGTVDDIIAN

SEQ ID NO: 941255 - protein, 18 aa, Mycobacterium
SQPPRTDVPAAYPRTSPA

SEQ ID NO: 941256 - protein, 17 aa, Mycobacterium
SRAASPLALLAAAVLLA

SEQ ID NO: 941257 - protein, 19 aa, Mycobacterium
SRAKLNWWESRALYGWTVL

SEQ ID NO: 941258 - protein, 19 aa, Mycobacterium
SRAYLRPGFAFGGSCLPKD

SEQ ID NO: 941259 - protein, 17 aa, Mycobacterium
SRFDGFAGVVVEADDPA

SEQ ID NO: 941260 - protein, 20 aa, Mycobacterium
SRNCRAWLSTALMIQGNLDH

SEQ ID NO: 941261 - protein, 21 aa, Mycobacterium
SRNKLPAWLFIQWATGKESMN

SEQ ID NO: 941262 - protein, 20 aa, Mycobacterium
SRRLPIPGADAAGVHYLRTF

SEQ ID NO: 941263 - protein, 23 aa, Mycobacterium
SRRLWTLLIFMLWHAIFIERSIT

SEQ ID NO: 941264 - protein, 23 aa, Mycobacterium
SRRLWTVLIFMLWHAIFVEHSVT

SEQ ID NO: 941265 - protein, 19 aa, Mycobacterium
SRRTAEMLLALGKSPAAPA

SEQ ID NO: 941266 - protein, 18 aa, Mycobacterium
SSAARLVATYALIVPGTG

SEQ ID NO: 941267 - protein, 18 aa, Mycobacterium
SSAWSRRGLPIEYLMVPS

SEQ ID NO: 941268 - protein, 18 aa, Mycobacterium
SSCTWQLSLFIPEGVPPP

SEQ ID NO: 941269 - protein, 23 aa, Mycobacterium
SSGGLLIRCAIRFDITVSTAQAA

SEQ ID NO: 941270 - protein, 20 aa, Mycobacterium
SSGQNWAVWDPTLPAIPSAF

SEQ ID NO: 941271 - protein, 24 aa, Mycobacterium
SSGWFGGSPARWVGSPSSASAIIG

SEQ ID NO: 941272 - protein, 18 aa, Mycobacterium
SSIPPVPGKFYWMSPTQV

SEQ ID NO: 941273 - protein, 21 aa, Mycobacterium
SSIYAEYRLSGSVRKVAGLKS

SEQ ID NO: 941274 - protein, 17 aa, Mycobacterium
SSMLSWQPSVYVAHAVV

SEQ ID NO: 941275 - protein, 17 aa, Mycobacterium
SSSLLWFLGAAGRRQTD

SEQ ID NO: 941276 - protein, 17 aa, Mycobacterium
SSTAAGWLLQIAKRAFA

SEQ ID NO: 941277 - protein, 20 aa, Mycobacterium
SSTQLPVWLSHAGADILRSH

SEQ ID NO: 941278 - protein, 20 aa, Mycobacterium
SSTQLPVWLSHAGADVLRTH

SEQ ID NO: 941279 - protein, 18 aa, Mycobacterium
SSYVASWYAAPLLVAGGR

SEQ ID NO: 941280 - protein, 17 aa, Mycobacterium
STAELRSATPLGDVFVA

SEQ ID NO: 941281 - protein, 17 aa, Mycobacterium
STAELRSATPLGDVFVS

SEQ ID NO: 941282 - protein, 23 aa, Mycobacterium
STAELRSATPLGDVFVSIRPPAG

SEQ ID NO: 941283 - protein, 24 aa, Mycobacterium
STAGCALAFCGAGMAAAAPDVVGQ

SEQ ID NO: 941284 - protein, 17 aa, Mycobacterium
STFALDRFADYPSLPLD

SEQ ID NO: 941285 - protein, 22 aa, Mycobacterium
STFVGAICRWQAANPAGLVDIT

SEQ ID NO: 941286 - protein, 17 aa, Mycobacterium
STLLYPLFSEWGAAYRA

SEQ ID NO: 941287 - protein, 18 aa, Mycobacterium
STMWTDYTIEFDVSGFAP

SEQ ID NO: 941288 - protein, 25 aa, Mycobacterium
STPPRPMPRAAMEAVPLEPGQQAVN

SEQ ID NO: 941289 - protein, 20 aa, Mycobacterium
STSTPRWLTVTSTPEGAPAT

SEQ ID NO: 941290 - protein, 24 aa, Mycobacterium
STVARFASGLARHGSGTVLVGREG

SEQ ID NO: 941291 - protein, 24 aa, Mycobacterium
STWGTFPAAISWEVASRQAQADTI

SEQ ID NO: 941292 - protein, 18 aa, Mycobacterium
SVAAYCFDGNNLLSEADA

SEQ ID NO: 941293 - protein, 25 aa, Mycobacterium
SVAPGFTGRVLRRFAPQQRPSGDEE

SEQ ID NO: 941294 - protein, 19 aa, Mycobacterium
SVAVPTLWGMGSSSRDEIV

SEQ ID NO: 941295 - protein, 21 aa, Mycobacterium
SVAVSSRFPGPITDLQLSRDS

SEQ ID NO: 941296 - protein, 21 aa, Mycobacterium
SVCAADFQRYVSMTGAGAGDE

SEQ ID NO: 941297 - protein, 20 aa, Mycobacterium
SVGCVWLRGGSIVGPHFSFN

SEQ ID NO: 941298 - protein, 17 aa, Mycobacterium
SVGVSIFAVSAAAAVLA

SEQ ID NO: 941299 - protein, 17 aa, Mycobacterium
SVLEARTAISYVSVDGA

SEQ ID NO: 941300 - protein, 17 aa, Mycobacterium
SVLPDRPGFFFAVDAHS

SEQ ID NO: 941301 - protein, 18 aa, Mycobacterium
SVPRCVGNTLLLNGRTYS

SEQ ID NO: 941302 - protein, 19 aa, Mycobacterium
SVQRWPACANRQFTTPAGQ

SEQ ID NO: 941303 - protein, 20 aa, Mycobacterium
SVTCPADLPAKVGAQLNCEM

SEQ ID NO: 941304 - protein, 18 aa, Mycobacterium
SVVKFRWNGNGVELISNK

SEQ ID NO: 941305 - protein, 20 aa, Mycobacterium
SVVLSSGWDIMDFVKQMQSL

SEQ ID NO: 941306 - protein, 18 aa, Mycobacterium
SVVRCVGNTLLLNGRTYS

SEQ ID NO: 941307 - protein, 25 aa, Mycobacterium
SWGIMIKRGLALAAVTALTVAGLNS

SEQ ID NO: 941308 - protein, 17 aa, Mycobacterium
SWGRLVFCGSPRRYEPR

SEQ ID NO: 941309 - protein, 18 aa, Mycobacterium
SWRIDWRLPLAAVCTHHG

SEQ ID NO: 941310 - protein, 18 aa, Mycobacterium
TAAARAAVTAAQANAAAA

SEQ ID NO: 941311 - protein, 19 aa, Mycobacterium
TAADFLVAIPTGWDNAIED

SEQ ID NO: 941312 - protein, 25 aa, Mycobacterium
TAAHPRFRFFGNIEVGAKITAEELA

SEQ ID NO: 941313 - protein, 24 aa, Mycobacterium
TAEIPKRLAALISEHIVLDSPVQL

SEQ ID NO: 941314 - protein, 18 aa, Mycobacterium
TAFGSFPDVEWAKVPGDV

SEQ ID NO: 941315 - protein, 18 aa, Mycobacterium
TAGSLVVICLDRSGHFEY

SEQ ID NO: 941316 - protein, 17 aa, Mycobacterium
TAHFGWLGGFFAVDANL

SEQ ID NO: 941317 - protein, 19 aa, Mycobacterium
TAILPVFAQEGIRVRTGKP

SEQ ID NO: 941318 - protein, 18 aa, Mycobacterium
TAIRRTNPATGFAATLVA

SEQ ID NO: 941319 - protein, 19 aa, Mycobacterium
TAITAQWAGTFAAMSARDR

SEQ ID NO: 941320 - protein, 23 aa, Mycobacterium
TALPRRPQFALLKGRGNYLCLNK

SEQ ID NO: 941321 - protein, 17 aa, Mycobacterium
TAMGVGFAGPAAAVAPP

SEQ ID NO: 941322 - protein, 24 aa, Mycobacterium
TANAAYPGVVEWYAQAQEHFTNTA

SEQ ID NO: 941323 - protein, 23 aa, Mycobacterium
TARLRWARRPGWGGVEVDAAVVG

SEQ ID NO: 941324 - protein, 21 aa, Mycobacterium
TASAAAFGFCPSAAADPATPQ

SEQ ID NO: 941325 - protein, 17 aa, Mycobacterium
TASAGQRLAIWARDRGC

SEQ ID NO: 941326 - protein, 18 aa, Mycobacterium
TAVAAVFEAAQAAIVHPA

SEQ ID NO: 941327 - protein, 24 aa, Mycobacterium
TAVMGGRMPHHWVNLGDRRISTLD

SEQ ID NO: 941328 - protein, 19 aa, Mycobacterium
TAVQSRGAAPVTPVGAAGT

SEQ ID NO: 941329 - protein, 24 aa, Mycobacterium
TAYKAFNWDQSYRKPVLYTVPKDD

SEQ ID NO: 941330 - protein, 17 aa, Mycobacterium
TAYPGRFLLGIGAGHRE

SEQ ID NO: 941331 - protein, 17 aa, Mycobacterium
TDGFATSCINTFNQSGF

SEQ ID NO: 941332 - protein, 24 aa, Mycobacterium
TDGRFRRRNCCLFYQVPGGGYCGD

SEQ ID NO: 941333 - protein, 24 aa, Mycobacterium
TDPKTRVCNAFALVRNAVSLQTNA

SEQ ID NO: 941334 - protein, 22 aa, Mycobacterium
TDSRFRFLRQYADPEVYAPVTG

SEQ ID NO: 941335 - protein, 18 aa, Mycobacterium
TDVPAAYPRTSPAIQAPA

SEQ ID NO: 941336 - protein, 19 aa, Mycobacterium
TDVPARFVVAAGIVRHLLV

SEQ ID NO: 941337 - protein, 25 aa, Mycobacterium
TDWFGAEPFGVWPWARPQLGAAQPV

SEQ ID NO: 941338 - protein, 18 aa, Mycobacterium
TDWGRLVFCGSPRRYEPR

SEQ ID NO: 941339 - protein, 17 aa, Mycobacterium
TDYAFRHVQPWFKNDIL

SEQ ID NO: 941340 - protein, 21 aa, Mycobacterium
TEFPRSLLLNVSRPISEKFDK

SEQ ID NO: 941341 - protein, 19 aa, Mycobacterium
TEGRPGLSWRARRAARDAV

SEQ ID NO: 941342 - protein, 17 aa, Mycobacterium
TEHCAPVITGARLRAGK

SEQ ID NO: 941343 - protein, 21 aa, Mycobacterium
TELDWRPKWTLDEGLPALLEW

SEQ ID NO: 941344 - protein, 18 aa, Mycobacterium
TEQPRIEPYLAMVQASES

SEQ ID NO: 941345 - protein, 17 aa, Mycobacterium
TESWWDTLVRDVRYTFF

SEQ ID NO: 941346 - protein, 21 aa, Mycobacterium
TETRKLPSWTVVVPPQGVVAG

SEQ ID NO: 941347 - protein, 23 aa, Mycobacterium
TFHPDRYRFAGSLSGFLTPSATA

SEQ ID NO: 941348 - protein, 23 aa, Mycobacterium
TFLKAGPGSAVFNVEEHSLPGAK

SEQ ID NO: 941349 - protein, 17 aa, Mycobacterium
TFNALGFTLPKESVQSM

SEQ ID NO: 941350 - protein, 17 aa, Mycobacterium
TFPFPAETLSKWIRGDY

SEQ ID NO: 941351 - protein, 22 aa, Mycobacterium
TFPNRLYWVSAWLDPDGANGGP

SEQ ID NO: 941352 - protein, 24 aa, Mycobacterium
TFTLRSDGSFTYTPVANFHGTDSF

SEQ ID NO: 941353 - protein, 20 aa, Mycobacterium
TFVGAICRWQAANPAGLIDI

SEQ ID NO: 941354 - protein, 21 aa, Mycobacterium
TFYTCLYRSLLHPNIFNDADG

SEQ ID NO: 941355 - protein, 23 aa, Mycobacterium
TGFLGRFLVLEWLQRLEPVDGKL

SEQ ID NO: 941356 - protein, 25 aa, Mycobacterium
TGGNGGRAGLFFGVGGTGGNGGATS

SEQ ID NO: 941357 - protein, 18 aa, Mycobacterium
TGIYAGIRPCQWATADGV

SEQ ID NO: 941358 - protein, 20 aa, Mycobacterium
TGIYGHAQACGWAIRDGVIG

SEQ ID NO: 941359 - protein, 23 aa, Mycobacterium
TGLPLRAMVMVLLFLGVIFLLLG

SEQ ID NO: 941360 - protein, 21 aa, Mycobacterium
TGLRLRIEFDGRTLVDAPLGE

SEQ ID NO: 941361 - protein, 21 aa, Mycobacterium
TGPKFAGPVTKHLAFVNQGGN

SEQ ID NO: 941362 - protein, 19 aa, Mycobacterium
TGPRFEWFDQTGAYHSSDL

SEQ ID NO: 941363 - protein, 23 aa, Mycobacterium
TGSITYRYTWHLPKDRTWTYDGQ

SEQ ID NO: 941364 - protein, 25 aa, Mycobacterium
TGTVGYRFAWHLPKNRVWSYDGQLR

SEQ ID NO: 941365 - protein, 26 aa, Mycobacterium
TGTVGYRFSWQLPKNRTWTYDGQLKM

SEQ ID NO: 941366 - protein, 25 aa, Mycobacterium
TGVAEFNYFFGWLIPPVALTTPTET

SEQ ID NO: 941367 - protein, 19 aa, Mycobacterium
TGVGVDWSAVFAGSGGRQV

SEQ ID NO: 941368 - protein, 17 aa, Mycobacterium
TGWCSWQGLATVPEIAD

SEQ ID NO: 941369 - protein, 17 aa, Mycobacterium
TIAAPRCLAWFGNQADG

SEQ ID NO: 941370 - protein, 19 aa, Mycobacterium
TIATWRAAVEEIRTKGTVP

SEQ ID NO: 941371 - protein, 18 aa, Mycobacterium
TIELRLTGPLAFEDGEAT

SEQ ID NO: 941372 - protein, 25 aa, Mycobacterium
TIENGARLNLPWRRDFNALVYALSG

SEQ ID NO: 941373 - protein, 24 aa, Mycobacterium
TIGKPGGAPALWLPDSSLWLARQM

SEQ ID NO: 941374 - protein, 21 aa, Mycobacterium
TIHTELRWSPPVPTLVELSAE

SEQ ID NO: 941375 - protein, 22 aa, Mycobacterium
TIPDLRLPFGIAPTSQGARGSD

SEQ ID NO: 941376 - protein, 24 aa, Mycobacterium
TIPFPKDGFIGFSLANRSSDVDGD

SEQ ID NO: 941377 - protein, 24 aa, Mycobacterium
TIPVIRVIGYRAGLPPAARSAPLS

SEQ ID NO: 941378 - protein, 23 aa, Mycobacterium
TITAGVDRLEWLDKIQPKATAPQ

SEQ ID NO: 941379 - protein, 24 aa, Mycobacterium
TITARLNFQLAFGARVGQRLSEAR

SEQ ID NO: 941380 - protein, 18 aa, Mycobacterium
TIWAERAISVLFPQIKTI

SEQ ID NO: 941381 - protein, 17 aa, Mycobacterium
TKAFKTGWATLLGLDLL

SEQ ID NO: 941382 - protein, 26 aa, Mycobacterium
TKGIFTSNFGYRWGVLHAGIDLANSI

SEQ ID NO: 941383 - protein, 17 aa, Mycobacterium
TKLRPGDAIPLDRTAPA

SEQ ID NO: 941384 - protein, 17 aa, Mycobacterium
TKNGVRTPVRWRVVPDG

SEQ ID NO: 941385 - protein, 17 aa, Mycobacterium
TKPAVEGAFYWLNNREV

SEQ ID NO: 941386 - protein, 18 aa, Mycobacterium
TKPGDVVVIDFRRKNEAP

SEQ ID NO: 941387 - protein, 17 aa, Mycobacterium
TKSSERWVADGQNMVDQ

SEQ ID NO: 941388 - protein, 18 aa, Mycobacterium
TKVAPAYRQSVSASVSAS

SEQ ID NO: 941389 - protein, 18 aa, Mycobacterium
TLDVMAMDVVWTAEFAEA

SEQ ID NO: 941390 - protein, 18 aa, Mycobacterium
TLDYRTYSALGWTIEATE

SEQ ID NO: 941391 - protein, 23 aa, Mycobacterium
TLEKARLAALYPYGEGPDVSFIL

SEQ ID NO: 941392 - protein, 30 aa, Mycobacterium
TLELGYQVGFPWSLGVGINFSYTTPNIAFD

SEQ ID NO: 941393 - protein, 25 aa, Mycobacterium
TLERLRYLPLAPFRISYAYTNYGIT

SEQ ID NO: 941394 - protein, 20 aa, Mycobacterium
TLLGRDGRFSGAAHLADTAD

SEQ ID NO: 941395 - protein, 23 aa, Mycobacterium
TLLRASPAWARLMRDVIRFDDSL

SEQ ID NO: 941396 - protein, 24 aa, Mycobacterium
TLNGEVFDQLWLQSMIAHHQGAIA

SEQ ID NO: 941397 - protein, 24 aa, Mycobacterium
TLNRMVGSIPWMYVASVAGVSERE

SEQ ID NO: 941398 - protein, 23 aa, Mycobacterium
TLPDGRAALHLDMDPGQLRLIPG

SEQ ID NO: 941399 - protein, 21 aa, Mycobacterium
TLPRHCADLVLGTVAGHRAPS

SEQ ID NO: 941400 - protein, 19 aa, Mycobacterium
TLRIAELLTELGADDPHGL

SEQ ID NO: 941401 - protein, 18 aa, Mycobacterium
TLTLRLGKDVKLPRNATA

SEQ ID NO: 941402 - protein, 19 aa, Mycobacterium
TLVSWNGKPAWPGWAAKRY

SEQ ID NO: 941403 - protein, 24 aa, Mycobacterium
TLVTRCVADFGLPYTRGVVERLRR

SEQ ID NO: 941404 - protein, 21 aa, Mycobacterium
TLWPDRLWLAIARTTAAEVDL

SEQ ID NO: 941405 - protein, 18 aa, Mycobacterium
TLWRARLIAPMRPDRYLR

SEQ ID NO: 941406 - protein, 22 aa, Mycobacterium
TLYKRYAVRFGLGYTEETRDVE

SEQ ID NO: 941407 - protein, 25 aa, Mycobacterium
TMSAEGRWSIPWAWNAAGTYRVFAD

SEQ ID NO: 941408 - protein, 20 aa, Mycobacterium
TMTGPRPGGFGALDDRTNEI

SEQ ID NO: 941409 - protein, 21 aa, Mycobacterium
TMTVTSGWRSPAFQQTLLDNA

SEQ ID NO: 941410 - protein, 18 aa, Mycobacterium
TMYELFSVGWGKPDLRSQ

SEQ ID NO: 941411 - protein, 19 aa, Mycobacterium
TNVDLRFGTSVSEVTHGDD

SEQ ID NO: 941412 - protein, 17 aa, Mycobacterium
TPAHWKYLTSGLLGLQR

SEQ ID NO: 941413 - protein, 21 aa, Mycobacterium
TPDPRPAPVVPDVNVPGVNVP

SEQ ID NO: 941414 - protein, 23 aa, Mycobacterium
TPEVEGAFYWLNNREVRWRPAKY

SEQ ID NO: 941415 - protein, 23 aa, Mycobacterium
TPFAAPPVWGGCAQWVADPARIP

SEQ ID NO: 941416 - protein, 23 aa, Mycobacterium
TPGVLVLVGFEWGAERYRYPVNL

SEQ ID NO: 941417 - protein, 22 aa, Mycobacterium
TPIHGGWQLSQRTSEMLLALGN

SEQ ID NO: 941418 - protein, 17 aa, Mycobacterium
TPLILDYEIKPEAVYSD

SEQ ID NO: 941419 - protein, 17 aa, Mycobacterium
TPMGMTADWWARANLPM

SEQ ID NO: 941420 - protein, 26 aa, Mycobacterium
TPTGSWIFRECAAWGLGRSDTADRLS

SEQ ID NO: 941421 - protein, 20 aa, Mycobacterium
TPVDEWPDALLLLGDQVYAD

SEQ ID NO: 941422 - protein, 18 aa, Mycobacterium
TPVLDIPIPPGWADAGAD

SEQ ID NO: 941423 - protein, 18 aa, Mycobacterium
TPYDVEWAILAGPAANLS

SEQ ID NO: 941424 - protein, 22 aa, Mycobacterium
TQALLARPLIGDGSNGAPGTGQ

SEQ ID NO: 941425 - protein, 18 aa, Mycobacterium
TRAFTVAHDALWVIESKT

SEQ ID NO: 941426 - protein, 21 aa, Mycobacterium
TRANAGWKRYPLGLAAPLIRA

SEQ ID NO: 941427 - protein, 21 aa, Mycobacterium
TRAPGCGRGQTLRSGNTVATG

SEQ ID NO: 941428 - protein, 20 aa, Mycobacterium
TRAPVEFDRVLGMLDRLASS

SEQ ID NO: 941429 - protein, 19 aa, Mycobacterium
TRHQMHWFYGLGVADRRAY

SEQ ID NO: 941430 - protein, 17 aa, Mycobacterium
TRKTLILDDGWTVVTAD

SEQ ID NO: 941431 - protein, 25 aa, Mycobacterium
TRPDLRWNAVWSFHLQPHWEDRVRL

SEQ ID NO: 941432 - protein, 17 aa, Mycobacterium
TRSVIRSAVSFLVALAA

SEQ ID NO: 941433 - protein, 21 aa, Mycobacterium
TRTGTKYAVRWQDYDTGAPIT

SEQ ID NO: 941434 - protein, 20 aa, Mycobacterium
TRTPVEFDRVLGMLDKLSGS

SEQ ID NO: 941435 - protein, 23 aa, Mycobacterium
TRVAVLLPAHWQTAAVLLGVWWI

SEQ ID NO: 941436 - protein, 17 aa, Mycobacterium
TRVPHVWVRDGVSTLDL

SEQ ID NO: 941437 - protein, 18 aa, Mycobacterium
TRVPHVWVRDGVSTLDLL

SEQ ID NO: 941438 - protein, 17 aa, Mycobacterium
TRYSFRAAGQFTTLSDE

SEQ ID NO: 941439 - protein, 17 aa, Mycobacterium
TSFRDVLAPAWQEATGG

SEQ ID NO: 941440 - protein, 18 aa, Mycobacterium
TSLAEGWVPFGISLGEAR

SEQ ID NO: 941441 - protein, 23 aa, Mycobacterium
TSLARPGRRLAVVFGAGGERDPG

SEQ ID NO: 941442 - protein, 17 aa, Mycobacterium
TSLSWGDCDGFTPENVT

SEQ ID NO: 941443 - protein, 18 aa, Mycobacterium
TSNRGWCRYVFNLGLDER

SEQ ID NO: 941444 - protein, 20 aa, Mycobacterium
TSPDDFDAVFALNVRAPYFL

SEQ ID NO: 941445 - protein, 17 aa, Mycobacterium
TSPFYPRQCELGASFYE

SEQ ID NO: 941446 - protein, 17 aa, Mycobacterium
TSSPWLGPASRSMMSAV

SEQ ID NO: 941447 - protein, 24 aa, Mycobacterium
TSTLLRLGIPFGLPAGMPATALAA

SEQ ID NO: 941448 - protein, 17 aa, Mycobacterium
TTLPWKLTITTTMTSVF

SEQ ID NO: 941449 - protein, 23 aa, Mycobacterium
TTPPVEGSWAWLPDEAGGSRMHW

SEQ ID NO: 941450 - protein, 18 aa, Mycobacterium
TTQWVRWRKPVIGLPLTA

SEQ ID NO: 941451 - protein, 18 aa, Mycobacterium
TTTKVVWYCGGHGACLSS

SEQ ID NO: 941452 - protein, 20 aa, Mycobacterium
TTWYPGSPWLGGVDPAIVSD

SEQ ID NO: 941453 - protein, 23 aa, Mycobacterium
TVCALTAFLLVAVFGQVRFGDGN

SEQ ID NO: 941454 - protein, 20 aa, Mycobacterium
TVEPWGVITDRGRWYLVGHD

SEQ ID NO: 941455 - protein, 24 aa, Mycobacterium
TVFMAVALALTWLVYATLRRDVAG

SEQ ID NO: 941456 - protein, 26 aa, Mycobacterium
TVGFDCSGLMLYMFAGVGIKLDHYSG

SEQ ID NO: 941457 - protein, 17 aa, Mycobacterium
TVKFRIGPDGKLQTVGK

SEQ ID NO: 941458 - protein, 17 aa, Mycobacterium
TVLAFGRDGTAYVTLYF

SEQ ID NO: 941459 - protein, 19 aa, Mycobacterium
TVYVFPGWIDVGTTNPYIT

SEQ ID NO: 941460 - protein, 21 aa, Mycobacterium
TWSNGRPVTWEDLAAQINATS

SEQ ID NO: 941461 - protein, 22 aa, Mycobacterium
TYLAVDVINLFTGLNLNNPIGT

SEQ ID NO: 941462 - protein, 27 aa, Mycobacterium
TYPRLKKTLLLGTRWGDENAKLIPAPG

SEQ ID NO: 941463 - protein, 18 aa, Mycobacterium
TYPTAMLIVFELNGDFDV

SEQ ID NO: 941464 - protein, 21 aa, Mycobacterium
VAAGETFSTLTAGTAVHTGTY

SEQ ID NO: 941465 - protein, 17 aa, Mycobacterium
VAAKLPWFTLGDPYVSS

SEQ ID NO: 941466 - protein, 17 aa, Mycobacterium
VACAGLCGAAIALSPQA

SEQ ID NO: 941467 - protein, 21 aa, Mycobacterium
VADALECLVRLAAGVGTHSYG

SEQ ID NO: 941468 - protein, 23 aa, Mycobacterium
VADDFRLQWPLRPAPAVVRGYDA

SEQ ID NO: 941469 - protein, 22 aa, Mycobacterium
VADSRIKAVFAMAPGMVRDFGM

SEQ ID NO: 941470 - protein, 18 aa, Mycobacterium
VAEAQLRLAGERLARLLN

SEQ ID NO: 941471 - protein, 22 aa, Mycobacterium
VAEMRLPFSWRGVSLHAAGAAG

SEQ ID NO: 941472 - protein, 17 aa, Mycobacterium
VAGAVWLPPRPADRASD

SEQ ID NO: 941473 - protein, 17 aa, Mycobacterium
VAGRAGSLGGLSVPATW

SEQ ID NO: 941474 - protein, 17 aa, Mycobacterium
VAHDALWVIESKTGQAT

SEQ ID NO: 941475 - protein, 21 aa, Mycobacterium
VAILLPAHWQTAAVLFGVWWI

SEQ ID NO: 941476 - protein, 23 aa, Mycobacterium
VAKETRPAVVVAISGSTGGILAA

SEQ ID NO: 941477 - protein, 21 aa, Mycobacterium
VAKLPWFELGDAYVTSHVTIA

SEQ ID NO: 941478 - protein, 23 aa, Mycobacterium
VAMPVTIRFAAPVADRIAAERSI

SEQ ID NO: 941479 - protein, 23 aa, Mycobacterium
VANARGVPFLGIRGISDGPGDPL

SEQ ID NO: 941480 - protein, 21 aa, Mycobacterium
VANAVRFAFWGAEEDGLRGSN

SEQ ID NO: 941481 - protein, 23 aa, Mycobacterium
VANMRVSIEWPYSANLHCEILID

SEQ ID NO: 941482 - protein, 19 aa, Mycobacterium
VAPFFAYGGFTGFAPRDVC

SEQ ID NO: 941483 - protein, 17 aa, Mycobacterium
VAQTLALAARFQTALDG

SEQ ID NO: 941484 - protein, 22 aa, Mycobacterium
VAQYCILASWVGIPAELGQAQE

SEQ ID NO: 941485 - protein, 21 aa, Mycobacterium
VAQYGKPAWPMVFAPVESPDS

SEQ ID NO: 941486 - protein, 18 aa, Mycobacterium
VARNCPNTQFVLGGFSQG

SEQ ID NO: 941487 - protein, 22 aa, Mycobacterium
VASACGLAGCFGTGGKTARPTV

SEQ ID NO: 941488 - protein, 17 aa, Mycobacterium
VASDAAGVVGWWVNPQG

SEQ ID NO: 941489 - protein, 17 aa, Mycobacterium
VASDAAGVVGWWVNPQT

SEQ ID NO: 941490 - protein, 21 aa, Mycobacterium
VASPCAYFLVYESTTETKPTE

SEQ ID NO: 941491 - protein, 18 aa, Mycobacterium
VASVSMWKVHQMSAPEPV

SEQ ID NO: 941492 - protein, 23 aa, Mycobacterium
VATAKFEFGNGFATVTIVTTGTG

SEQ ID NO: 941493 - protein, 19 aa, Mycobacterium
VAVATRFPGPITDLQLSRD

SEQ ID NO: 941494 - protein, 17 aa, Mycobacterium
VAVDGPDIRCEVVDGGP

SEQ ID NO: 941495 - protein, 19 aa, Mycobacterium
VAVPAHWSGAAIGAFRSAA

SEQ ID NO: 941496 - protein, 18 aa, Mycobacterium
VDDMTRWLAMVLGDGVFE

SEQ ID NO: 941497 - protein, 23 aa, Mycobacterium
VDGLNRFAGILARDKDNLGRALD

SEQ ID NO: 941498 - protein, 24 aa, Mycobacterium
VDGLNRFSAILARDKDNLGRALDT

SEQ ID NO: 941499 - protein, 21 aa, Mycobacterium
VDGLNRFSGALARDKDNLGRA

SEQ ID NO: 941500 - protein, 18 aa, Mycobacterium
VDGLRRWLRDEGIDAVVD

SEQ ID NO: 941501 - protein, 18 aa, Mycobacterium
VDGRIVVDLVRFPGSVDY

SEQ ID NO: 941502 - protein, 20 aa, Mycobacterium
VDLLNRFLGLGLRFISAGTD

SEQ ID NO: 941503 - protein, 17 aa, Mycobacterium
VDLWATNLPKLLPAGVQ

SEQ ID NO: 941504 - protein, 19 aa, Mycobacterium
VEALLRMARRSAASGTALA

SEQ ID NO: 941505 - protein, 19 aa, Mycobacterium
VEAQRLWAQAGFRPVDPAV

SEQ ID NO: 941506 - protein, 19 aa, Mycobacterium
VEGAFYWLNNREVRWRPAE

SEQ ID NO: 941507 - protein, 19 aa, Mycobacterium
VEGRVAVTVPADWPTQRVL

SEQ ID NO: 941508 - protein, 21 aa, Mycobacterium
VEHIKYPASVFGMDRGIWEAA

SEQ ID NO: 941509 - protein, 22 aa, Mycobacterium
VELRRRGCVVGRLIVLDATPRA

SEQ ID NO: 941510 - protein, 21 aa, Mycobacterium
VELRTATPLGDVFVALKPPRP

SEQ ID NO: 941511 - protein, 21 aa, Mycobacterium
VEPQMRIAFSAGRCNGDPMVT

SEQ ID NO: 941512 - protein, 22 aa, Mycobacterium
VEPRLWNMWTVLPILQDTTIVA

SEQ ID NO: 941513 - protein, 19 aa, Mycobacterium
VESGCVRFSAVAAIAPGAP

SEQ ID NO: 941514 - protein, 17 aa, Mycobacterium
VESRAGLALTLGVTPPP

SEQ ID NO: 941515 - protein, 20 aa, Mycobacterium
VETRLRIAVSAGRCDEGSTV

SEQ ID NO: 941516 - protein, 19 aa, Mycobacterium
VFGDFRFGPESTYHATFTD

SEQ ID NO: 941517 - protein, 19 aa, Mycobacterium
VFGDFRFGPKATYHATFTN

SEQ ID NO: 941518 - protein, 17 aa, Mycobacterium
VFIRPALRNAMGLPDPF

SEQ ID NO: 941519 - protein, 23 aa, Mycobacterium
VFMTVALTLGWLVYATLLREVSG

SEQ ID NO: 941520 - protein, 17 aa, Mycobacterium
VFTNPWYDKEWRYTTPY

SEQ ID NO: 941521 - protein, 22 aa, Mycobacterium
VFYKNGAPFVWDRGRELGMTNQ

SEQ ID NO: 941522 - protein, 22 aa, Mycobacterium
VGALAVTLGVGWAIASSAGTAY

SEQ ID NO: 941523 - protein, 18 aa, Mycobacterium
VGALCRWQAMSKSGGLVD

SEQ ID NO: 941524 - protein, 19 aa, Mycobacterium
VGAPIRWESEFTAPFQAFS

SEQ ID NO: 941525 - protein, 25 aa, Mycobacterium
VGCKRPLMSRDWYPTFSLPNVSLET

SEQ ID NO: 941526 - protein, 25 aa, Mycobacterium
VGFDCSGLMLYMFAGVGIKLDHYSG

SEQ ID NO: 941527 - protein, 18 aa, Mycobacterium
VGFGGWYSPIALRVDTAS

SEQ ID NO: 941528 - protein, 18 aa, Mycobacterium
VGIGGNIATLGTVIGDGN

SEQ ID NO: 941529 - protein, 17 aa, Mycobacterium
VGPLRCRILLDGNVVAD

SEQ ID NO: 941530 - protein, 17 aa, Mycobacterium
VGQKVLPQQAHKGDMIF

SEQ ID NO: 941531 - protein, 21 aa, Mycobacterium
VGRLLGWRLGIDGVDPKGTVQ

SEQ ID NO: 941532 - protein, 25 aa, Mycobacterium
VGVAGRLCLSAGPAVTAVAAGPTGR

SEQ ID NO: 941533 - protein, 25 aa, Mycobacterium
VGVARRRFRVVAAWLACAGLLAPLA

SEQ ID NO: 941534 - protein, 24 aa, Mycobacterium
VGYARRSALTASRFVACPFGTPGQ

SEQ ID NO: 941535 - protein, 17 aa, Mycobacterium
VHLRGHFLLTRNAATYW

SEQ ID NO: 941536 - protein, 26 aa, Mycobacterium
VIGNRVRYFSAPNFHGTETFTYTLNG

SEQ ID NO: 941537 - protein, 17 aa, Mycobacterium
VISSEWGVTGWPGATAY

SEQ ID NO: 941538 - protein, 18 aa, Mycobacterium
VIVSLAFPKPPELLRAAY

SEQ ID NO: 941539 - protein, 18 aa, Mycobacterium
VKDGKWAIWHAVGSNPKL

SEQ ID NO: 941540 - protein, 18 aa, Mycobacterium
VKLFDDWTNLGSVSELAA

SEQ ID NO: 941541 - protein, 23 aa, Mycobacterium
VKLPWSVTVAWPYKDTVKQVTAI

SEQ ID NO: 941542 - protein, 22 aa, Mycobacterium
VKLSGLSGWIGWGFIHIAFLTG

SEQ ID NO: 941543 - protein, 19 aa, Mycobacterium
VKMDTIWWDRPFKVTSVEI

SEQ ID NO: 941544 - protein, 17 aa, Mycobacterium
VKNAIDWLSRPFGDGAL

SEQ ID NO: 941545 - protein, 22 aa, Mycobacterium
VKNAVRFAFWGAEEEGLIGSTD

SEQ ID NO: 941546 - protein, 23 aa, Mycobacterium
VKQGWMCCIGADWMHLSTGIIGS

SEQ ID NO: 941547 - protein, 20 aa, Mycobacterium
VKSRLDTMTVIAQFDSAAGL

SEQ ID NO: 941548 - protein, 17 aa, Mycobacterium
VKTPGGWRIDRLPNGVF

SEQ ID NO: 941549 - protein, 22 aa, Mycobacterium
VKVRGGVVLGEFATLVDPERSI

SEQ ID NO: 941550 - protein, 18 aa, Mycobacterium
VLAGAWAYIEAHGLDTLT

SEQ ID NO: 941551 - protein, 27 aa, Mycobacterium
VLALFYLRLPTWAGLGMYKLNADLPNS

SEQ ID NO: 941552 - protein, 17 aa, Mycobacterium
VLARPLIQLGLPVAAAG

SEQ ID NO: 941553 - protein, 24 aa, Mycobacterium
VLASEVPPGWGWNGSPRWRAQGSP

SEQ ID NO: 941554 - protein, 17 aa, Mycobacterium
VLASSVAVYGTRNPHRI

SEQ ID NO: 941555 - protein, 22 aa, Mycobacterium
VLCIACFGVATALRAAVARRGS

SEQ ID NO: 941556 - protein, 19 aa, Mycobacterium
VLEPMAGKVIHCGAAGAGQ

SEQ ID NO: 941557 - protein, 20 aa, Mycobacterium
VLKFAAPVLLGLGATAAPGN

SEQ ID NO: 941558 - protein, 17 aa, Mycobacterium
VLLRTGLVLARSGGLIG

SEQ ID NO: 941559 - protein, 18 aa, Mycobacterium
VLPGYGWIFPLGNGEVNI

SEQ ID NO: 941560 - protein, 18 aa, Mycobacterium
VLPIALAPWPARAFVILL

SEQ ID NO: 941561 - protein, 28 aa, Mycobacterium
VLQRAVNRLAGWPGPAGQNFVDITNRVT

SEQ ID NO: 941562 - protein, 20 aa, Mycobacterium
VLSSCGWKGISNVSIPGGPG

SEQ ID NO: 941563 - protein, 18 aa, Mycobacterium
VLTGFGFHGPDGQVIADH

SEQ ID NO: 941564 - protein, 20 aa, Mycobacterium
VLTSCGQWRGIANVPLPGGP

SEQ ID NO: 941565 - protein, 22 aa, Mycobacterium
VMKGADLLPMMPFSERFSSTTI

SEQ ID NO: 941566 - protein, 17 aa, Mycobacterium
VNAEMIWGVTIDNKDEA

SEQ ID NO: 941567 - protein, 17 aa, Mycobacterium
VNAEMIWNQPIENKGSD

SEQ ID NO: 941568 - protein, 26 aa, Mycobacterium
VNAFYTSRCNLIAWDRGVFMPVAQKY

SEQ ID NO: 941569 - protein, 24 aa, Mycobacterium
VNAPAAAVLGRPLIGNGTNGAPGS

SEQ ID NO: 941570 - protein, 17 aa, Mycobacterium
VNAVGYPLAADVALITV

SEQ ID NO: 941571 - protein, 19 aa, Mycobacterium
VNDMTRWMAMVLAEGRHDG

SEQ ID NO: 941572 - protein, 18 aa, Mycobacterium
VNDYGGFMSIGFDTSKVP

SEQ ID NO: 941573 - protein, 18 aa, Mycobacterium
VNGLKFMYYELLKKDGES

SEQ ID NO: 941574 - protein, 17 aa, Mycobacterium
VNIGAVLPPLAVGEKHT

SEQ ID NO: 941575 - protein, 23 aa, Mycobacterium
VNWTIKLKPGWTFHNGEPVTAQS

SEQ ID NO: 941576 - protein, 20 aa, Mycobacterium
VNYPASFDWVRAGDGANDMS

SEQ ID NO: 941577 - protein, 23 aa, Mycobacterium
VNYRILLEPGWKFTDGSPVTAHS

SEQ ID NO: 941578 - protein, 19 aa, Mycobacterium
VNYRIVLKPGWKFTDGSPV

SEQ ID NO: 941579 - protein, 24 aa, Mycobacterium
VPAEKLPLVRLFPSLANREAELKA

SEQ ID NO: 941580 - protein, 23 aa, Mycobacterium
VPDDIRYGLGIFDARGWIGHSGS

SEQ ID NO: 941581 - protein, 18 aa, Mycobacterium
VPDGRIQLIASDEVAAEV

SEQ ID NO: 941582 - protein, 20 aa, Mycobacterium
VPDPRIGALFLGGGPVHTCT

SEQ ID NO: 941583 - protein, 17 aa, Mycobacterium
VPDPRYVAVADHDQLAT

SEQ ID NO: 941584 - protein, 17 aa, Mycobacterium
VPDPRYVAVNDPDLLAT

SEQ ID NO: 941585 - protein, 17 aa, Mycobacterium
VPDPRYVAVPDHDQLAT

SEQ ID NO: 941586 - protein, 28 aa, Mycobacterium
VPEPSWWKEGYLGFSLSSIFGSWANQKI

SEQ ID NO: 941587 - protein, 21 aa, Mycobacterium
VPEYIGNLLLYFAPESTATLL

SEQ ID NO: 941588 - protein, 17 aa, Mycobacterium
VPGKFYWMSPTQVRWRP

SEQ ID NO: 941589 - protein, 17 aa, Mycobacterium
VPGLPFLQQLAANPAAA

SEQ ID NO: 941590 - protein, 24 aa, Mycobacterium
VPHYDVYPAFAFRFDVKDPAVSIT

SEQ ID NO: 941591 - protein, 17 aa, Mycobacterium
VPLAFALAAGSFRDGTR

SEQ ID NO: 941592 - protein, 19 aa, Mycobacterium
VPLDAVYHWPALAGQAVQT

SEQ ID NO: 941593 - protein, 17 aa, Mycobacterium
VPQLIQWDDHEVINNWF

SEQ ID NO: 941594 - protein, 18 aa, Mycobacterium
VPRRVRRLFMVLGGLVSL

SEQ ID NO: 941595 - protein, 21 aa, Mycobacterium
VPVEMIWACGGHGVCLDPLNP

SEQ ID NO: 941596 - protein, 19 aa, Mycobacterium
VPWWPWAPLVRLMRVLPPP

SEQ ID NO: 941597 - protein, 18 aa, Mycobacterium
VPYCYGAAFDPWTGRYLL

SEQ ID NO: 941598 - protein, 19 aa, Mycobacterium
VQIEPKLAFLGGNLPLLLK

SEQ ID NO: 941599 - protein, 25 aa, Mycobacterium
VQPNLRYLVNWGYGDPAYGWSTSPP

SEQ ID NO: 941600 - protein, 17 aa, Mycobacterium
VRISERFTTGDTLAYAA

SEQ ID NO: 941601 - protein, 19 aa, Mycobacterium
VRITFWLNDKYKVPADVKA

SEQ ID NO: 941602 - protein, 23 aa, Mycobacterium
VRPEPFGALLYHFGTRKLSFLKN

SEQ ID NO: 941603 - protein, 23 aa, Mycobacterium
VRTEAHAGATLAARTTGPGPKPP

SEQ ID NO: 941604 - protein, 21 aa, Mycobacterium
VRTEAWLGYFMLRIAPGVNRR

SEQ ID NO: 941605 - protein, 23 aa, Mycobacterium
VRTFARRRIDTILGDLTIGAPQD

SEQ ID NO: 941606 - protein, 18 aa, Mycobacterium
VRTPVRWSLEPMQAALPA

SEQ ID NO: 941607 - protein, 22 aa, Mycobacterium
VRVAAFGPRAANVVGLTDQTDL

SEQ ID NO: 941608 - protein, 19 aa, Mycobacterium
VRWSWLVAIVAVLGLGLAT

SEQ ID NO: 941609 - protein, 17 aa, Mycobacterium
VRYRFDLANQIPLRTEL

SEQ ID NO: 941610 - protein, 24 aa, Mycobacterium
VSAEAVAFHGRFVQALTGGVQMYA

SEQ ID NO: 941611 - protein, 18 aa, Mycobacterium
VSAVLGWHLFAAHHANVA

SEQ ID NO: 941612 - protein, 19 aa, Mycobacterium
VSAVVAALFDAHAQAYQSL

SEQ ID NO: 941613 - protein, 25 aa, Mycobacterium
VSFASTPPMLWQYFSGRYPDISVQT

SEQ ID NO: 941614 - protein, 17 aa, Mycobacterium
VSFEVFIRPALRNAMGL

SEQ ID NO: 941615 - protein, 18 aa, Mycobacterium
VSGDGRFAYLRGENALTV

SEQ ID NO: 941616 - protein, 17 aa, Mycobacterium
VSIRGTGFYGNLSNKKY

SEQ ID NO: 941617 - protein, 17 aa, Mycobacterium
VSNEEELLWLTLDAGSD

SEQ ID NO: 941618 - protein, 22 aa, Mycobacterium
VSRRAWQGLALLMVALVLSSCG

SEQ ID NO: 941619 - protein, 19 aa, Mycobacterium
VSTDGRFRYLRVYPNPQAY

SEQ ID NO: 941620 - protein, 25 aa, Mycobacterium
VSTEGRFRFLRVYPNPMAYAPVTGF

SEQ ID NO: 941621 - protein, 19 aa, Mycobacterium
VSTVWTWPDRPGVAGCAAL

SEQ ID NO: 941622 - protein, 23 aa, Mycobacterium
VSYYRRPIYTAAMAGVLVAPEIL

SEQ ID NO: 941623 - protein, 23 aa, Mycobacterium
VTASEVPLAFALAAGSFRDATRV

SEQ ID NO: 941624 - protein, 19 aa, Mycobacterium
VTCPGDLPAKVGAQLNCEM

SEQ ID NO: 941625 - protein, 19 aa, Mycobacterium
VTDRFSGVIPESTLASMQN

SEQ ID NO: 941626 - protein, 22 aa, Mycobacterium
VTFYSCLYRSLLHPNTFNDADG

SEQ ID NO: 941627 - protein, 19 aa, Mycobacterium
VTGGFDWRKASGSTINILQ

SEQ ID NO: 941628 - protein, 18 aa, Mycobacterium
VTGLEWGNWGPFAFTSNY

SEQ ID NO: 941629 - protein, 18 aa, Mycobacterium
VTIYPTRFGDWLASQAPS

SEQ ID NO: 941630 - protein, 17 aa, Mycobacterium
VTPVVVYLCHRSCDRTA

SEQ ID NO: 941631 - protein, 18 aa, Mycobacterium
VTQWTRWRQPVIGMPSTP

SEQ ID NO: 941632 - protein, 17 aa, Mycobacterium
VTRARFGALDLHVDTKP

SEQ ID NO: 941633 - protein, 19 aa, Mycobacterium
VTTLRIREGVLLPVGSTAE

SEQ ID NO: 941634 - protein, 21 aa, Mycobacterium
VTTPIHWCIYASQLPAEIAAR

SEQ ID NO: 941635 - protein, 18 aa, Mycobacterium
VTVEPAFAAVAAVPAGRV

SEQ ID NO: 941636 - protein, 19 aa, Mycobacterium
VTVSDARSGFHIHGAAGLL

SEQ ID NO: 941637 - protein, 23 aa, Mycobacterium
VVAGEVPLAFALAAGSFRDGTRV

SEQ ID NO: 941638 - protein, 17 aa, Mycobacterium
VVCGGISIPGRWDTTAE

SEQ ID NO: 941639 - protein, 17 aa, Mycobacterium
VVCGTVFASAALALSSS

SEQ ID NO: 941640 - protein, 22 aa, Mycobacterium
VVDSSYFARAWVNWNNTTRTTG

SEQ ID NO: 941641 - protein, 24 aa, Mycobacterium
VVFGEFRFAAGQSYHATFSEASRL

SEQ ID NO: 941642 - protein, 17 aa, Mycobacterium
VVGAGWWYLGAGEDTIT

SEQ ID NO: 941643 - protein, 17 aa, Mycobacterium
VVGRIPLVLDYTINEKA

SEQ ID NO: 941644 - protein, 21 aa, Mycobacterium
VVGRYVRWEVLPGVRDVGLVD

SEQ ID NO: 941645 - protein, 18 aa, Mycobacterium
VVISSGWDVMDFVQQMQK

SEQ ID NO: 941646 - protein, 18 aa, Mycobacterium
VVKANSFGAENIGTVATA

SEQ ID NO: 941647 - protein, 19 aa, Mycobacterium
VVLSSGWNIIDFVQQLQQL

SEQ ID NO: 941648 - protein, 17 aa, Mycobacterium
VVPAEWRFIDGRWKLAS

SEQ ID NO: 941649 - protein, 17 aa, Mycobacterium
VVPAGWKVSDATQLSYG

SEQ ID NO: 941650 - protein, 18 aa, Mycobacterium
VVQAWTISDLKPSSDPIP

SEQ ID NO: 941651 - protein, 17 aa, Mycobacterium
VVQAWTVTDLKPSSDTI

SEQ ID NO: 941652 - protein, 17 aa, Mycobacterium
VVRHELFHYAARADTAA

SEQ ID NO: 941653 - protein, 19 aa, Mycobacterium
VVVPKMIYRVGFFRPPKGA

SEQ ID NO: 941654 - protein, 17 aa, Mycobacterium
VVYADGLPYVFDSFDVT

SEQ ID NO: 941655 - protein, 17 aa, Mycobacterium
VWAKTVFILNYDENDGL

SEQ ID NO: 941656 - protein, 23 aa, Mycobacterium
VWDDGFRTWGFWLFGIWIPLVSV

SEQ ID NO: 941657 - protein, 17 aa, Mycobacterium
VWGDFPAAVSWGATSQQ

SEQ ID NO: 941658 - protein, 23 aa, Mycobacterium
VWGEFPAAVSWRATSEEVREDLG

SEQ ID NO: 941659 - protein, 19 aa, Mycobacterium
VWRRGRDVFAEVGLPNDEG

SEQ ID NO: 941660 - protein, 20 aa, Mycobacterium
VWYCGGHGACLSSVNNGDLV

SEQ ID NO: 941661 - protein, 17 aa, Mycobacterium
VYAGTGWTAMRGQRMDD

SEQ ID NO: 941662 - protein, 23 aa, Mycobacterium
VYNAGGKDLLVWDKPAASATAPS

SEQ ID NO: 941663 - protein, 20 aa, Mycobacterium
WADFPDRPWNLIATANALLG

SEQ ID NO: 941664 - protein, 20 aa, Mycobacterium
WADFPRYLWNPVAIANAIAG

SEQ ID NO: 941665 - protein, 18 aa, Mycobacterium
WAEGPVYFPDGGYLLCSD

SEQ ID NO: 941666 - protein, 18 aa, Mycobacterium
WALGKSMLTDPTLRDYLN

SEQ ID NO: 941667 - protein, 20 aa, Mycobacterium
WALQDGLCSYFWQHNWGSPK

SEQ ID NO: 941668 - protein, 17 aa, Mycobacterium
WANYGAIISAFSDKYGI

SEQ ID NO: 941669 - protein, 17 aa, Mycobacterium
WAQAGFRPVDPAVVAEF

SEQ ID NO: 941670 - protein, 19 aa, Mycobacterium
WCQQPPPGLFTQWTTSSAA

SEQ ID NO: 941671 - protein, 17 aa, Mycobacterium
WDGGLAQSRMDNLLSQA

SEQ ID NO: 941672 - protein, 20 aa, Mycobacterium
WDLPVVPFDVAPPFVVADVG

SEQ ID NO: 941673 - protein, 19 aa, Mycobacterium
WDMGAYGWPAPERLRFAND

SEQ ID NO: 941674 - protein, 18 aa, Mycobacterium
WDPSVAILGFPFITQARR

SEQ ID NO: 941675 - protein, 17 aa, Mycobacterium
WDQAYRKPITWDKLWQP

SEQ ID NO: 941676 - protein, 19 aa, Mycobacterium
WDWAVDWDTWLSMSALPAP

SEQ ID NO: 941677 - protein, 20 aa, Mycobacterium
WDWVVDWPTWQSMSALPPNP

SEQ ID NO: 941678 - protein, 19 aa, Mycobacterium
WEDAFAMTVSDGFGGTATQ

SEQ ID NO: 941679 - protein, 17 aa, Mycobacterium
WEFASYVAGVYGEDTLR

SEQ ID NO: 941680 - protein, 19 aa, Mycobacterium
WEICGALLHGNRLVVVPES

SEQ ID NO: 941681 - protein, 19 aa, Mycobacterium
WEISEFFGLALTKVAPLAR

SEQ ID NO: 941682 - protein, 18 aa, Mycobacterium
WERGDIDAAYTWLPTLNE

SEQ ID NO: 941683 - protein, 21 aa, Mycobacterium
WESIVSLLTTENWTGGGSAAA

SEQ ID NO: 941684 - protein, 25 aa, Mycobacterium
WETKDRPALEAAFKKAGVDYTIQNA

SEQ ID NO: 941685 - protein, 17 aa, Mycobacterium
WFCCPACRTAFSDRNGG

SEQ ID NO: 941686 - protein, 23 aa, Mycobacterium
WFRCSEFPCAPTAPGNIMGSGAA

SEQ ID NO: 941687 - protein, 21 aa, Mycobacterium
WFVTLEIAEPVPPQPTAQIST

SEQ ID NO: 941688 - protein, 20 aa, Mycobacterium
WGDVELAWRLDRSGRFGPPR

SEQ ID NO: 941689 - protein, 21 aa, Mycobacterium
WGGAGPGGFDCSGLVMWAFQQ

SEQ ID NO: 941690 - protein, 17 aa, Mycobacterium
WGGAVVGAVAAGSSGAS

SEQ ID NO: 941691 - protein, 21 aa, Mycobacterium
WGQSWLQICHNAFAGIDVDPD

SEQ ID NO: 941692 - protein, 24 aa, Mycobacterium
WGRPEEMAELLAFCASDKAGYLTG

SEQ ID NO: 941693 - protein, 18 aa, Mycobacterium
WGTAVFHCPFCHGWEMRD

SEQ ID NO: 941694 - protein, 24 aa, Mycobacterium
WGTPEEMAELFAFCASDRAGYLTG

SEQ ID NO: 941695 - protein, 17 aa, Mycobacterium
WHLGGGKSWANIQTIET

SEQ ID NO: 941696 - protein, 17 aa, Mycobacterium
WHTWRMTWQPTGLYFWK

SEQ ID NO: 941697 - protein, 17 aa, Mycobacterium
WIPLLILVVVAIAGFTV

SEQ ID NO: 941698 - protein, 17 aa, Mycobacterium
WIPLLLVVVVALGAYAV

SEQ ID NO: 941699 - protein, 17 aa, Mycobacterium
WIPLVLVVVLALSALIV

SEQ ID NO: 941700 - protein, 17 aa, Mycobacterium
WIPLVVVIALVAGGIAV

SEQ ID NO: 941701 - protein, 18 aa, Mycobacterium
WIPVCYPAAIPTPVPGSP

SEQ ID NO: 941702 - protein, 17 aa, Mycobacterium
WKAAPAAAPAQRSGGST

SEQ ID NO: 941703 - protein, 18 aa, Mycobacterium
WKDIPSWYFISTGDEIIT

SEQ ID NO: 941704 - protein, 24 aa, Mycobacterium
WKGRITIAVPLPWNGYRGAEGIRL

SEQ ID NO: 941705 - protein, 17 aa, Mycobacterium
WLAQWGIFDALRASSEV

SEQ ID NO: 941706 - protein, 17 aa, Mycobacterium
WLDEHIRYRGLRLHGFG

SEQ ID NO: 941707 - protein, 18 aa, Mycobacterium
WLEDPEIGGVELKGFSRV

SEQ ID NO: 941708 - protein, 17 aa, Mycobacterium
WLSRFDIGSGFEVVLSS

SEQ ID NO: 941709 - protein, 17 aa, Mycobacterium
WMGPAALGAVLPAGGTV

SEQ ID NO: 941710 - protein, 19 aa, Mycobacterium
WMLGARFVPVPGGEDGNAF

SEQ ID NO: 941711 - protein, 17 aa, Mycobacterium
WNGCGGWNPVQGGWGHG

SEQ ID NO: 941712 - protein, 20 aa, Mycobacterium
WNGKPAWPGWAAKRYDRDAN

SEQ ID NO: 941713 - protein, 17 aa, Mycobacterium
WPAYISGGAFQRLAPPA

SEQ ID NO: 941714 - protein, 18 aa, Mycobacterium
WPDALLLLGDQVYADELT

SEQ ID NO: 941715 - protein, 22 aa, Mycobacterium
WPELEAGALRRIRGPRVGAPSD

SEQ ID NO: 941716 - protein, 17 aa, Mycobacterium
WPQFRSSTAAGWLLQIA

SEQ ID NO: 941717 - protein, 17 aa, Mycobacterium
WPVRVWADTMPKRTTSA

SEQ ID NO: 941718 - protein, 18 aa, Mycobacterium
WPWAPLTQVMRLLPPKYT

SEQ ID NO: 941719 - protein, 18 aa, Mycobacterium
WQGPRPAPKWDGVRDATA

SEQ ID NO: 941720 - protein, 18 aa, Mycobacterium
WQGWAAGASGGWGKPPTP

SEQ ID NO: 941721 - protein, 18 aa, Mycobacterium
WQGWAVGPGGGWNKPPTP

SEQ ID NO: 941722 - protein, 17 aa, Mycobacterium
WQTAAVLLGVWWIGAEV

SEQ ID NO: 941723 - protein, 18 aa, Mycobacterium
WQVEYGFPICFPSIEVLT

SEQ ID NO: 941724 - protein, 20 aa, Mycobacterium
WQVTDAVAWPASRLPQAIAA

SEQ ID NO: 941725 - protein, 18 aa, Mycobacterium
WRAAICRDDVTTVSGTRH

SEQ ID NO: 941726 - protein, 17 aa, Mycobacterium
WRASGLLNELGARYVPD

SEQ ID NO: 941727 - protein, 20 aa, Mycobacterium
WRATFNVNLFGAVALTLALL

SEQ ID NO: 941728 - protein, 17 aa, Mycobacterium
WRIPGVLTLTAYLRDAG

SEQ ID NO: 941729 - protein, 21 aa, Mycobacterium
WRKFIGSLKFTLWRLQERVVG

SEQ ID NO: 941730 - protein, 17 aa, Mycobacterium
WRQHGWRPPAESGPPSA

SEQ ID NO: 941731 - protein, 18 aa, Mycobacterium
WRQPELKAAGAAMATTAL

SEQ ID NO: 941732 - protein, 17 aa, Mycobacterium
WRRPLSPQPGRDLVVPV

SEQ ID NO: 941733 - protein, 17 aa, Mycobacterium
WRRQSALVQWYVETPGS

SEQ ID NO: 941734 - protein, 17 aa, Mycobacterium
WRTDFLNQMGLVISDSI

SEQ ID NO: 941735 - protein, 18 aa, Mycobacterium
WRTWWAMVQLVRFEQDPA

SEQ ID NO: 941736 - protein, 21 aa, Mycobacterium
WRVNCFGAFLGIHVALEHLRA

SEQ ID NO: 941737 - protein, 20 aa, Mycobacterium
WRVNCLGAFLGMRATLEHLR

SEQ ID NO: 941738 - protein, 19 aa, Mycobacterium
WSDCVEVYWAPDARVNAEA

SEQ ID NO: 941739 - protein, 19 aa, Mycobacterium
WSFLSDRLDAITVTAQFDS

SEQ ID NO: 941740 - protein, 25 aa, Mycobacterium
WSGDAYKLVVLMGLRIGQDSVNGKA

SEQ ID NO: 941741 - protein, 25 aa, Mycobacterium
WSPRLARVTRRWARRAGSPDLPMSW

SEQ ID NO: 941742 - protein, 21 aa, Mycobacterium
WTFDIRPGVTFSDGTPFTAAD

SEQ ID NO: 941743 - protein, 18 aa, Mycobacterium
WTHEAAAVGMVWDTPVTT

SEQ ID NO: 941744 - protein, 25 aa, Mycobacterium
WTPPLEWLQRIPVLGPLLVTAIVGF

SEQ ID NO: 941745 - protein, 30 aa, Mycobacterium
WTPPLEWLQTIPLFGRFVMTPLVGLLHNIP

SEQ ID NO: 941746 - protein, 19 aa, Mycobacterium
WTPWCPFCNAEAPSVGQVA

SEQ ID NO: 941747 - protein, 21 aa, Mycobacterium
WTQDSPKGWVYIVSDGFDRSH

SEQ ID NO: 941748 - protein, 19 aa, Mycobacterium
WVLRTACAEFSRWRANGVG

SEQ ID NO: 941749 - protein, 17 aa, Mycobacterium
WVPIVVVIAVAIGGTAV

SEQ ID NO: 941750 - protein, 18 aa, Mycobacterium
WVPLVVVAAVALGGIAID

SEQ ID NO: 941751 - protein, 18 aa, Mycobacterium
WVVGCGSPSRPADGARSI

SEQ ID NO: 941752 - protein, 20 aa, Mycobacterium
WYDKEWRYTTPYTVYTTGIG

SEQ ID NO: 941753 - protein, 18 aa, Mycobacterium
WYGGFPFATWPWATERLG

SEQ ID NO: 941754 - protein, 18 aa, Mycobacterium
WYRADLMPAPPTTWDGML

SEQ ID NO: 941755 - protein, 17 aa, Mycobacterium
WYRANESWWRPLKDASE

SEQ ID NO: 941756 - protein, 17 aa, Mycobacterium
YAPRADLATREEQIAIA

SEQ ID NO: 941757 - protein, 25 aa, Mycobacterium
YDDLAWFCIRAWRFGAPAGLGAGGL

SEQ ID NO: 941758 - protein, 19 aa, Mycobacterium
YDQRISVNWPAEARPYTGE

SEQ ID NO: 941759 - protein, 19 aa, Mycobacterium
YDRAWEFASYVAGVYGEDT

SEQ ID NO: 941760 - protein, 18 aa, Mycobacterium
YEDGRIVRDFVYIDAVVD

SEQ ID NO: 941761 - protein, 17 aa, Mycobacterium
YEDGRIVRDFVYIDDVV

SEQ ID NO: 941762 - protein, 17 aa, Mycobacterium
YEEMWAADVAVMSAYHT

SEQ ID NO: 941763 - protein, 18 aa, Mycobacterium
YEQRRWEVPSERIANTMK

SEQ ID NO: 941764 - protein, 18 aa, Mycobacterium
YFAMKFSRPFTSFGSWDG

SEQ ID NO: 941765 - protein, 27 aa, Mycobacterium
YFIKDLEFLPTFPFHYKYLRNAVRGDY

SEQ ID NO: 941766 - protein, 18 aa, Mycobacterium
YFTLSRWSDYSVMLMRTS

SEQ ID NO: 941767 - protein, 18 aa, Mycobacterium
YGALFTDVFGLREGDDVR

SEQ ID NO: 941768 - protein, 19 aa, Mycobacterium
YGALPIYVVFIYFRAPWRH

SEQ ID NO: 941769 - protein, 17 aa, Mycobacterium
YGALRLGAKLGPSRTAG

SEQ ID NO: 941770 - protein, 20 aa, Mycobacterium
YGDFFAFYLCDVVLKVNGKG

SEQ ID NO: 941771 - protein, 17 aa, Mycobacterium
YGGRLVVVGGGFIGAEI

SEQ ID NO: 941772 - protein, 17 aa, Mycobacterium
YGRWYRFLLLWPGADKG

SEQ ID NO: 941773 - protein, 22 aa, Mycobacterium
YIKVPMPYRRSMRISVASHLEY

SEQ ID NO: 941774 - protein, 25 aa, Mycobacterium
YKGGQPFLWDRGRELGMTNRLQQVP

SEQ ID NO: 941775 - protein, 27 aa, Mycobacterium
YKRAEICRQRMGPVLKRITMNYPPVLF

SEQ ID NO: 941776 - protein, 17 aa, Mycobacterium
YLLPFPMCHIAGYNMLV

SEQ ID NO: 941777 - protein, 22 aa, Mycobacterium
YLPDSDTWEWFGYPLESTDVDG

SEQ ID NO: 941778 - protein, 18 aa, Mycobacterium
YLPLVVRRRITFLAKAEY

SEQ ID NO: 941779 - protein, 17 aa, Mycobacterium
YLQHGYLGIGPMYSYTA

SEQ ID NO: 941780 - protein, 25 aa, Mycobacterium
YLQRMSTILSRRVWENAGSPEVDSD

SEQ ID NO: 941781 - protein, 17 aa, Mycobacterium
YLQTLPLRRLTRPAEVA

SEQ ID NO: 941782 - protein, 19 aa, Mycobacterium
YLRAWKSYDRFEGKSSVRT

SEQ ID NO: 941783 - protein, 20 aa, Mycobacterium
YLRYLGFHFAAFVFDASDMD

SEQ ID NO: 941784 - protein, 17 aa, Mycobacterium
YMFGSWSPNIAKIPQVV

SEQ ID NO: 941785 - protein, 17 aa, Mycobacterium
YNDGERDLLAWSQTAAS

SEQ ID NO: 941786 - protein, 22 aa, Mycobacterium
YNEYLKKYIVLYGDQSNNIVMR

SEQ ID NO: 941787 - protein, 19 aa, Mycobacterium
YNSMLLRSDGTAIGFGQNA

SEQ ID NO: 941788 - protein, 24 aa, Mycobacterium
YNTLRSAGILPDLSVPISSVTNML

SEQ ID NO: 941789 - protein, 24 aa, Mycobacterium
YPAWKELFSNILPAHIVKDVPGGF

SEQ ID NO: 941790 - protein, 20 aa, Mycobacterium
YPGNVVAVLGMPVGQVSKIT

SEQ ID NO: 941791 - protein, 17 aa, Mycobacterium
YPGRFLLGIGAGHREHT

SEQ ID NO: 941792 - protein, 25 aa, Mycobacterium
YPLFVWCVAQLPGLREHAEGSILTA

SEQ ID NO: 941793 - protein, 24 aa, Mycobacterium
YPSWKELFSNILPAHIVKDVPGGF

SEQ ID NO: 941794 - protein, 18 aa, Mycobacterium
YPVAITVAPLRWDLVRDG

SEQ ID NO: 941795 - protein, 19 aa, Mycobacterium
YRANESWWRPLKDAAEARY

SEQ ID NO: 941796 - protein, 22 aa, Mycobacterium
YREYRWPRLAGLAVTTVSPRFR

SEQ ID NO: 941797 - protein, 18 aa, Mycobacterium
YRFGELREGVWLRPDNLD

SEQ ID NO: 941798 - protein, 22 aa, Mycobacterium
YRKELFAGIGPYNLRYRLWADW

SEQ ID NO: 941799 - protein, 19 aa, Mycobacterium
YRLRVKMARDEDGLYKVAR

SEQ ID NO: 941800 - protein, 17 aa, Mycobacterium
YRLSASVRKAANLGSDP

SEQ ID NO: 941801 - protein, 19 aa, Mycobacterium
YRLSGSVRKVAGLKSDPFV

SEQ ID NO: 941802 - protein, 20 aa, Mycobacterium
YRLTHLWYRDNPPMFPFLSA

SEQ ID NO: 941803 - protein, 17 aa, Mycobacterium
YRQGFPPTFGLDGTGYV

SEQ ID NO: 941804 - protein, 17 aa, Mycobacterium
YRQSMRISVAANLEYYH

SEQ ID NO: 941805 - protein, 19 aa, Mycobacterium
YRTDVDWATQISYSGVFVH

SEQ ID NO: 941806 - protein, 19 aa, Mycobacterium
YRTEVDWATQMSYSGVFVH

SEQ ID NO: 941807 - protein, 17 aa, Mycobacterium
YRTRADWYLPTQGDGTV

SEQ ID NO: 941808 - protein, 17 aa, Mycobacterium
YRTVLAFGRDGTAYVTL

SEQ ID NO: 941809 - protein, 18 aa, Mycobacterium
YRVPCFIISPYSRGPLMV

SEQ ID NO: 941810 - protein, 20 aa, Mycobacterium
YRVTVELPQAAGLYPSGNVT

SEQ ID NO: 941811 - protein, 20 aa, Mycobacterium
YSEPRLQPPPGFKDTTVPGI

SEQ ID NO: 941812 - protein, 17 aa, Mycobacterium
YSFRPNPNWSHLLPPGP

SEQ ID NO: 941813 - protein, 17 aa, Mycobacterium
YSLRMGIEIIDGTNAVP

SEQ ID NO: 941814 - protein, 23 aa, Mycobacterium
YTAPPAMTDLRFGGAEPGHVVAH

SEQ ID NO: 941815 - protein, 19 aa, Mycobacterium
YTLKAELPASGGLYPTANV

SEQ ID NO: 941816 - protein, 19 aa, Mycobacterium
YVPDIRGAHRFRGRRFHSA

SEQ ID NO: 941817 - protein, 23 aa, Mycobacterium
YVSELRPGADFDFKPVTRDYADG

SEQ ID NO: 941818 - protein, 18 aa, Mycobacterium
YVVFIYFRAPWRHFVSHL

SEQ ID NO: 941819 - protein, 18 aa, Mycobacterium
YVVPEGWQVSDATQLSYG

SEQ ID NO: 941820 - protein, 17 aa, Mycobacterium
YVVPPVRRMMAARQDTV

SEQ ID NO: 941821 - protein, 20 aa, Mycobacterium
YVVRLPEKFVLVGHSAGGSL

SEQ ID NO: 941822 - protein, 17 aa, Mycobacterium
YVYACPRYAESFAAGAA

SEQ ID NO: 941823 - protein, 20 aa, Mycobacterium
YWQQCALLAYEIYALPPDAD

SEQ ID NO: 941824 - protein, 21 aa, Mycobacterium
FSLPALAAQISAALQASFGAS

SEQ ID NO: 941825 - protein, 17 aa, Mycobacterium
GASFPEVVAAFTGGLNG

SEQ ID NO: 941826 - protein, 18 aa, Mycobacterium
RGEFEERLKAVLDDIKNS

SEQ ID NO: 941827 - protein, 24 aa, Mycobacterium
HGEAGVVAIFAQALLSGKPTKVFG

SEQ ID NO: 941828 - protein, 33 aa, Mycobacterium; identical to SEQ ID NO: 146912

SEQ ID NO: 941829 - protein, 25 aa, Mycobacterium
ANGIDAPALWPGLPVRPVKGEVLRL

SEQ ID NO: 941830 - protein, 18 aa, Mycobacterium
DRYFDYAEGRLGWRTLDF

SEQ ID NO: 941831 - protein, 24 aa, Mycobacterium
EAAFYRLSSLRLWPDRRLSRRGVE

SEQ ID NO: 941832 - protein, 26 aa, Mycobacterium
EAVRRRPYTVILFDEIEKAHPDVFDV

SEQ ID NO: 941833 - protein, 23 aa, Mycobacterium
EVENPKCHIAWTTLAGIGQVESH

SEQ ID NO: 941834 - protein, 21 aa, Mycobacterium
GFYSLRYSSTGLERAEDPLLN

SEQ ID NO: 941835 - protein, 30 aa, Mycobacterium; identical to SEQ ID NO: 146813

SEQ ID NO: 941836 - protein, 17 aa, Mycobacterium
NITRLPVRYTFDNRYFS

SEQ ID NO: 941837 - protein, 25 aa, Mycobacterium
PIAADDFWYLWRQMVSQPGVVDPAG

SEQ ID NO: 941838 - protein, 27 aa, Mycobacterium
RTVSGQLTLLVPFIDRVRARVDLRERV

SEQ ID NO: 941839 - protein, 23 aa, Mycobacterium
RYITARFLPDKAIDLVDEAASRL

SEQ ID NO: 941840 - protein, 24 aa, Mycobacterium
SRNEYVVGWIKRGPTGVIGTNKKD

SEQ ID NO: 941841 - protein, 24 aa, Mycobacterium
TNTDTIILIRIPNNGKSATAISIP

SEQ ID NO: 941842 - protein, 17 aa, Mycobacterium
TVVYFQVTVPQAAVYEI

SEQ ID NO: 941843 - protein, 17 aa, Mycobacterium
VAGPNWMLIGDAAACVN

SEQ ID NO: 941844 - protein, 26 aa, Mycobacterium
VAVDMLEMLPTPWGLVRSGVAPDHPK

SEQ ID NO: 941845 - protein, 23 aa, Mycobacterium
YTYHSKTLGWCDIAYNALVDKYG

SEQ ID NO: 941846 - protein, 18 aa, Mycobacterium
AAALTLMQHGCHRAQGFL

SEQ ID NO: 941847 - protein, 20 aa, Mycobacterium
AASNPDLFWALRGGGGGNFG

SEQ ID NO: 941848 - protein, 26 aa, Mycobacterium
AGGAGGATGWFGSTGTTGAGGNGGTG

SEQ ID NO: 941849 - protein, 22 aa, Mycobacterium
AGSVFKIFTTAAALDMGMGINA

SEQ ID NO: 941850 - protein, 18 aa, Mycobacterium
AHLVLTVNGKIPGLSMKT

SEQ ID NO: 941851 - protein, 23 aa, Mycobacterium
APRGSAYHYFPGGRTQLLCEAVD

SEQ ID NO: 941852 - protein, 27 aa, Mycobacterium
APVLVGLNYRPGQKPLLTQAWTSDAAG

SEQ ID NO: 941853 - protein, 18 aa, Mycobacterium
AQLQKRLAQRRLTLEVSL

SEQ ID NO: 941854 - protein, 24 aa, Mycobacterium
ATSAAGSALAAGLAGEGWVGAVGA

SEQ ID NO: 941855 - protein, 23 aa, Mycobacterium
DAKGNTIAWLYSQRRFEVPSDKI

SEQ ID NO: 941856 - protein, 49 aa, Mycobacterium
DEVSVAVAQLFDGHGQAYQAISAQAAVFHGRFVAALNAAADSYAGAEAA

SEQ ID NO: 941857 - protein, 18 aa, Mycobacterium
DHGPFDLTLLPIGAYNTA

SEQ ID NO: 941858 - protein, 25 aa, Mycobacterium
DLGGAHPFTWYKAFNYNLGTKQPIT

SEQ ID NO: 941859 - protein, 26 aa, Mycobacterium
DPMEAAYVSVYLWKNTVEKAQSFDVK

SEQ ID NO: 941860 - protein, 28 aa, Mycobacterium
DPRHTPPHAWYIAFAPAQTPKVAVAVLV

SEQ ID NO: 941861 - protein, 20 aa, Mycobacterium
EIYLNTFRHLYGLDCSHIAP

SEQ ID NO: 941862 - protein, 24 aa, Mycobacterium
EKLDDVVFPLFPQGGGFPRNNDDK

SEQ ID NO: 941863 - protein, 27 aa, Mycobacterium
EMAHTVRNLLAPPLRLRGPVTRADGGK

SEQ ID NO: 941864 - protein, 23 aa, Mycobacterium
FAESLHRRVATLAGLPASVLDEV

SEQ ID NO: 941865 - protein, 25 aa, Mycobacterium
FKPGSRPLDVIFPIVARELETQAGI

SEQ ID NO: 941866 - protein, 20 aa, Mycobacterium
FSLPTLAAQISAALQASFGA

SEQ ID NO: 941867 - protein, 17 aa, Mycobacterium
FTHAFKRWTGRSPRHFR

SEQ ID NO: 941868 - protein, 30 aa, Mycobacterium
GAGGAGGRGGWLFSAGGNGGAGGAGGAGGA

SEQ ID NO: 941869 - protein, 18 aa, Mycobacterium
GDVLAAVGLDRPAAQRFT

SEQ ID NO: 941870 - protein, 17 aa, Mycobacterium
GFAFAEHAKLTSFGALS

SEQ ID NO: 941871 - protein, 20 aa, Mycobacterium
GFAVWRIRGIFGSHQLPTYA

SEQ ID NO: 941872 - protein, 32 aa, Mycobacterium
GFDCSGLVLYSFAGVGIKLPHYSGSQYNLGRK

SEQ ID NO: 941873 - protein, 25 aa, Mycobacterium
GGGAGRGGWVFGDGGAGGAGGDGAT

SEQ ID NO: 941874 - protein, 26 aa, Mycobacterium
GGGILGPHFSFSWYRGSPIGRERKTE

SEQ ID NO: 941875 - protein, 25 aa, Mycobacterium
GGIMGPHFSFSWYRGSPIGRERKTE

SEQ ID NO: 941876 - protein, 25 aa, Mycobacterium
GGNGATGALGTAPPAAGDPGGNGGN

SEQ ID NO: 941877 - protein, 23 aa, Mycobacterium
GRPTPEMLAYQYLQTLPEMARGD

SEQ ID NO: 941878 - protein, 32 aa, Mycobacterium; identical to SEQ ID NO: 146788

SEQ ID NO: 941879 - protein, 17 aa, Mycobacterium
GTALIAAAASLISGCGT

SEQ ID NO: 941880 - protein, 27 aa, Mycobacterium
GTGGNGGAGGLLWGNGGRGGSGAAGQA

SEQ ID NO: 941881 - protein, 18 aa, Mycobacterium
GVNLFGFDQLLPEDGRIQ

SEQ ID NO: 941882 - protein, 20 aa, Mycobacterium
GYRVPCFVISPYSRGPLMVH

SEQ ID NO: 941883 - protein, 24 aa, Mycobacterium
HDEVLAGRIFFDAPSSFVHVPAAT

SEQ ID NO: 941884 - protein, 19 aa, Mycobacterium
HTIVVLGRPITAEAFGVVA

SEQ ID NO: 941885 - protein, 17 aa, Mycobacterium
IALEDYTLSRRAKRLIV

SEQ ID NO: 941886 - protein, 32 aa, Mycobacterium
IGSGVQTAGAWAAGPTTALAGALGADEVSVAV

SEQ ID NO: 941887 - protein, 17 aa, Mycobacterium
INASDLNWQQAALLAGM

SEQ ID NO: 941888 - protein, 24 aa, Mycobacterium
KDQEGNDLPWSILKHLHAGDSDQG

SEQ ID NO: 941889 - protein, 22 aa, Mycobacterium
LDRLHVRYDLSWQALDGALARR

SEQ ID NO: 941890 - protein, 24 aa, Mycobacterium
LGERFLDRATNLGPAGWLRAKTGS

SEQ ID NO: 941891 - protein, 24 aa, Mycobacterium
LHAEQLLVATGRRPVTAGLNLDAV

SEQ ID NO: 941892 - protein, 29 aa, Mycobacterium
LTMQDYLDAPPISTPFRLFDCSLETDGAA

SEQ ID NO: 941893 - protein, 19 aa, Mycobacterium
MDLDRLPESMIVLGGGYVG

SEQ ID NO: 941894 - protein, 20 aa, Mycobacterium
MLRPGGVVDLLTAPGGLLDR

SEQ ID NO: 941895 - protein, 19 aa, Mycobacterium
MTRYSWQSYLIATASFAEW

SEQ ID NO: 941896 - protein, 28 aa, Mycobacterium
NCLAVTYGGLALLRLLDMLAGAVPNIEL

SEQ ID NO: 941897 - protein, 18 aa, Mycobacterium
NDPQGIYLNYIGSAGGVF

SEQ ID NO: 941898 - protein, 20 aa, Mycobacterium
NLGPAGWLRAKTGSLTAINS

SEQ ID NO: 941899 - protein, 27 aa, Mycobacterium
NPEIRPAHLLMALLTQADGIAAPLLEA

SEQ ID NO: 941900 - protein, 18 aa, Mycobacterium
PARHFSGRFLDRNTTLWA

SEQ ID NO: 941901 - protein, 23 aa, Mycobacterium
PEVYAPVTGFYSLRYSSTGLERA

SEQ ID NO: 941902 - protein, 39 aa, Mycobacterium
PGAMLSFPPTQWIRWRKPVIGMPTTPRLLADGQLLVVTH

SEQ ID NO: 941903 - protein, 24 aa, Mycobacterium
PGDTPEAPPPPPPPARIPGAAMPE

SEQ ID NO: 941904 - protein, 28 aa, Mycobacterium
PGGFDCSGLVMWAFQQAGIALPHSSQAL

SEQ ID NO: 941905 - protein, 17 aa, Mycobacterium
PHRPVFVMSVAEGRPFP

SEQ ID NO: 941906 - protein, 26 aa, Mycobacterium
PTPTITARLNFQLAFGARVGQRLAEA

SEQ ID NO: 941907 - protein, 18 aa, Mycobacterium
PTVFTAAPGAAWEDNLRG

SEQ ID NO: 941908 - protein, 22 aa, Mycobacterium
QANLVEITLPDDTPWGGKPVKR

SEQ ID NO: 941909 - protein, 29 aa, Mycobacterium
QFQDDFIEWSISFSQKPFPPPCDIAKELA

SEQ ID NO: 941910 - protein, 25 aa, Mycobacterium
QPETWYKSFNYDLVKRAPITFDTLF

SEQ ID NO: 941911 - protein, 22 aa, Mycobacterium
QPYVNDYVWAMTLRDERVARVT

SEQ ID NO: 941912 - protein, 25 aa, Mycobacterium
QSGSIGLGFAIPVDQAKRIADELIS

SEQ ID NO: 941913 - protein, 18 aa, Mycobacterium
QWDTFLNGVFPLDRNRLT

SEQ ID NO: 941914 - protein, 21 aa, Mycobacterium
QWDTFLNGVFPLDRNRLTREW

SEQ ID NO: 941915 - protein, 23 aa, Mycobacterium
RAADPDLILGSAALTPGAFGELS

SEQ ID NO: 941916 - protein, 22 aa, Mycobacterium
RAMGPMQFIPETWRLYGVDAHN

SEQ ID NO: 941917 - protein, 17 aa, Mycobacterium
RPTGSFMFLGPTGVGKT

SEQ ID NO: 941918 - protein, 18 aa, Mycobacterium
RPTGSFMFLGPTGVGKTE

SEQ ID NO: 941919 - protein, 22 aa, Mycobacterium
RPTPEMLAYQYLQTLPEMARGD

SEQ ID NO: 941920 - protein, 22 aa, Mycobacterium
RSGGALAAFAAVAAESAGAAVA

SEQ ID NO: 941921 - protein, 18 aa, Mycobacterium
RTKGISIRRAPAPSWSHF

SEQ ID NO: 941922 - protein, 25 aa, Mycobacterium
RTLDYTALPRVVFTSPAVASVGMTD

SEQ ID NO: 941923 - protein, 21 aa, Mycobacterium
RVFGADNFPGDVLAAVGLDRP

SEQ ID NO: 941924 - protein, 26 aa, Mycobacterium
RVTAYLDFVVLDELLTRVTPADGATA

SEQ ID NO: 941925 - protein, 24 aa, Mycobacterium
RVVLARTGLVFSPAGGALGRLRPL

SEQ ID NO: 941926 - protein, 21 aa, Mycobacterium
SADDIFWLSNAYLAAYADSGR

SEQ ID NO: 941927 - protein, 36 aa, Mycobacterium
SAGADVMGALNAPTMAWLGRPLIGDGANGVDGTGGN

SEQ ID NO: 941928 - protein, 26 aa, Mycobacterium
SGQTNIVVLSLWQPGAEAPVLVGLNY

SEQ ID NO: 941929 - protein, 24 aa, Mycobacterium
SGRQYMSWITLEDEVRALLFAISN

SEQ ID NO: 941930 - protein, 19 aa, Mycobacterium
SLPTLAAQISAALQASFGA

SEQ ID NO: 941931 - protein, 27 aa, Mycobacterium
SMGAVLHTLNLRLPPEQLTWIANHAED

SEQ ID NO: 941932 - protein, 26 aa, Mycobacterium
SNNSGLPLPGLGLLGLANHGTFNEGF

SEQ ID NO: 941933 - protein, 19 aa, Mycobacterium
SPDFTPTDPITLFGGLGIA

SEQ ID NO: 941934 - protein, 23 aa, Mycobacterium
SRRAKRLIVFDVDSTLIQGEVIE

SEQ ID NO: 941935 - protein, 20 aa, Mycobacterium
STVLPILQDTTIVAAGPSVQ

SEQ ID NO: 941936 - protein, 17 aa, Mycobacterium
SVPLDYLAQTPPSVAPD

SEQ ID NO: 941937 - protein, 27 aa, Mycobacterium
SVTVMALIVLLLLNATMTQVFTADGLR

SEQ ID NO: 941938 - protein, 22 aa, Mycobacterium
TDSRFRFLRVYPNPEVYAPVTG

SEQ ID NO: 941939 - protein, 26 aa, Mycobacterium
TLELGYQIGFPWSLGVGINFSYTTPN

SEQ ID NO: 941940 - protein, 19 aa, Mycobacterium
TQRLALHAEQLLVATGRRP

SEQ ID NO: 941941 - protein, 24 aa, Mycobacterium
TRQDIPIHHLLADTFTICDGYHCS

SEQ ID NO: 941942 - protein, 23 aa, Mycobacterium
TTIRTLRRLGYYCGVVSGGFRQV

SEQ ID NO: 941943 - protein, 25 aa, Mycobacterium
TTVLLAQMFAAGVRRLVLASSMVVY

SEQ ID NO: 941944 - protein, 27 aa, Mycobacterium
TVEQLAHTWAPYLTMAESLKLAAQAYT

SEQ ID NO: 941945 - protein, 26 aa, Mycobacterium
TVGFDCSGLMLYMFAGVGIKLDHYSG

SEQ ID NO: 941946 - protein, 19 aa, Mycobacterium
VAAVFLRELLAEDLQPVVQ

SEQ ID NO: 941947 - protein, 31 aa, Mycobacterium
VADASLSHPYLDTVLFILGITRGEIEAADAL

SEQ ID NO: 941948 - protein, 28 aa, Mycobacterium
VFGVLLAVVTVPFVSLGPGPTFDTLGEV

SEQ ID NO: 941949 - protein, 22 aa, Mycobacterium
VFLAVLVIFAIIVVAKSVALIP

SEQ ID NO: 941950 - protein, 24 aa, Mycobacterium
VFQRTPCWVLPRLDVATPPAVQAL

SEQ ID NO: 941951 - protein, 26 aa, Mycobacterium
VGGGGGAGGWLFGAGGQGGTGGNGLT

SEQ ID NO: 941952 - protein, 20 aa, Mycobacterium
VGLLCMYKVHQFSEPEPVIT

SEQ ID NO: 941953 - protein, 26 aa, Mycobacterium
VKRAPITFDTLFKPGSRPLDVIFPIV

SEQ ID NO: 941954 - protein, 24 aa, Mycobacterium
VPSHLYSYSFAPNPRWSKTYANQP

SEQ ID NO: 941955 - protein, 25 aa, Mycobacterium
VTEGDKLVAFWRGTATARDGQPYVN

SEQ ID NO: 941956 - protein, 25 aa, Mycobacterium
VVELLAYLPVITTALSPSFHSTERG

SEQ ID NO: 941957 - protein, 18 aa, Mycobacterium
VWDTPLTSLVARLGRAHL

SEQ ID NO: 941958 - protein, 25 aa, Mycobacterium
VWRVRAFGDFLSYCLVAEGAVDIAA

SEQ ID NO: 941959 - protein, 25 aa, Mycobacterium
WDINTPAFEWFYQSGLSTIMPVGGQ

SEQ ID NO: 941960 - protein, 17 aa, Mycobacterium
WGAMWGPASGAHYVDPL

SEQ ID NO: 941961 - protein, 17 aa, Mycobacterium
WGNGGRGGSGAAGQAGG

SEQ ID NO: 941962 - protein, 19 aa, Mycobacterium
WHQWMRTYMTGPQFYYDCV

SEQ ID NO: 941963 - protein, 21 aa, Mycobacterium
WQSYLIATASFAEWIDRGRPA

SEQ ID NO: 941964 - protein, 19 aa, Mycobacterium
YAQGLRDAGLLPVLKHFPG

SEQ ID NO: 941965 - protein, 29 aa, Mycobacterium
YEDRSFTFALKTPPAAKLLLKAAGVAKGS

SEQ ID NO: 941966 - protein, 24 aa, Mycobacterium
AAAAGPPKATGAPGAPPGGPPGGP

SEQ ID NO: 941967 - protein, 20 aa, Mycobacterium
AAAAIRRWLSRTETLISWSE

SEQ ID NO: 941968 - protein, 23 aa, Mycobacterium
AAAAISHLPHLLAEALAVVAGEV

SEQ ID NO: 941969 - protein, 27 aa, Mycobacterium
AAAAKYWRYQKYDDCLIMAVADVVGQV

SEQ ID NO: 941970 - protein, 20 aa, Mycobacterium
AAAALAIGLLAGCVSRADQS

SEQ ID NO: 941971 - protein, 18 aa, Mycobacterium
AAAALFLIDKAGATDAVI

SEQ ID NO: 941972 - protein, 26 aa, Mycobacterium
AAAALSAAFLGLAAPALAAPTGGDAQ

SEQ ID NO: 941973 - protein, 27 aa, Mycobacterium
AAAALSAAFLGLAAPALAAPTGGDAQA

SEQ ID NO: 941974 - protein, 24 aa, Mycobacterium
AAAALSIPVLMVARPPLPAAVTSV

SEQ ID NO: 941975 - protein, 22 aa, Mycobacterium
AAAAMFLGFGAVAAWAEPTPPP

SEQ ID NO: 941976 - protein, 25 aa, Mycobacterium
AAAAVTLAWLAIRNIRVVRQYERGV

SEQ ID NO: 941977 - protein, 37 aa, Mycobacterium
AAADDVSAAIAALFNAHAEQYQALSVRVAELHESFTR

SEQ ID NO: 941978 - protein, 20 aa, Mycobacterium
AAADQLLTGLRLRIEFDGRT

SEQ ID NO: 941979 - protein, 25 aa, Mycobacterium
AAADTYFPRIAATLVEHGWAEGLRP

SEQ ID NO: 941980 - protein, 19 aa, Mycobacterium
AAAFHRIDTAYPGRFLLGI

SEQ ID NO: 941981 - protein, 26 aa, Mycobacterium
AAAGGAWLCYPLAAATPPGQARTTTP

SEQ ID NO: 941982 - protein, 25 aa, Mycobacterium
AAAGIPGILTYLVVPAGRGPPSVPV

SEQ ID NO: 941983 - protein, 25 aa, Mycobacterium
AAAGTLFFAPVNAVNSFLFGHETIT

SEQ ID NO: 941984 - protein, 23 aa, Mycobacterium
AAAILVLAGCSSTANPPAGSSTT

SEQ ID NO: 941985 - protein, 22 aa, Mycobacterium
AAAISHLPHLLAEALAVVAGDV

SEQ ID NO: 941986 - protein, 19 aa, Mycobacterium
AAAKGYFPLNFTVADIDQN

SEQ ID NO: 941987 - protein, 20 aa, Mycobacterium
AAAKHQPAVAPAATVTVHTT

SEQ ID NO: 941988 - protein, 24 aa, Mycobacterium
AAAKSGLISLVKSLGRELAPEHII

SEQ ID NO: 941989 - protein, 25 aa, Mycobacterium
AAAKYWRHQNYDDCAIMSSADVVGQ

SEQ ID NO: 941990 - protein, 25 aa, Mycobacterium
AAALALLSDEPILCKSVDAAASSSG

SEQ ID NO: 941991 - protein, 19 aa, Mycobacterium
AAALFAVALALSGCSPAIN

SEQ ID NO: 941992 - protein, 17 aa, Mycobacterium
AAALPFAMTACGGGGDS

SEQ ID NO: 941993 - protein, 24 aa, Mycobacterium
AAALPYCDLFLPAHSLTGVQQLLR

SEQ ID NO: 941994 - protein, 17 aa, Mycobacterium
AAALRRELLRDGQVFYV

SEQ ID NO: 941995 - protein, 25 aa, Mycobacterium
AAALSAAFLGLAAPARAAPTGGDAQ

SEQ ID NO: 941996 - protein, 17 aa, Mycobacterium
AAALWAGLALRHLHTGN

SEQ ID NO: 941997 - protein, 34 aa, Mycobacterium
AAAMKYMQRWPFRFFAERKWFTIAESIELPRYPR

SEQ ID NO: 941998 - protein, 27 aa, Mycobacterium
AAAMMAVATQYMAWLGAAAAQAEQAAA

SEQ ID NO: 941999 - protein, 33 aa, Mycobacterium
AAAMRALIWEISEFFGLALTKVAPLARVIGVVA

SEQ ID NO: 942000 - protein, 18 aa, Mycobacterium
AAANLRSYFTAHPQEYYD

SEQ ID NO: 942001 - protein, 26 aa, Mycobacterium
AAAPLVTLYRQYVVRFGLGYREEVKP

SEQ ID NO: 942002 - protein, 26 aa, Mycobacterium
AAAPNMPILLYHGSRDRFLGDQFIPE

SEQ ID NO: 942003 - protein, 34 aa, Mycobacterium
AAAPPKLVPLSYAQRRLWFIDQLEGPSPIYNMAL

SEQ ID NO: 942004 - protein, 30 aa, Mycobacterium
AAAPSHVFLVFLHHTYSYRDLGWQQSAPIM

SEQ ID NO: 942005 - protein, 25 aa, Mycobacterium
AAAQSIVAALGKWPPASGRASVIVD

SEQ ID NO: 942006 - protein, 17 aa, Mycobacterium
AAAQYRIHKAMLAQLQY

SEQ ID NO: 942007 - protein, 26 aa, Mycobacterium
AAARGWGITVIPLPSASMAQGLAALA

SEQ ID NO: 942008 - protein, 23 aa, Mycobacterium
AAASEFIEFVTGPQGRDVLAAAG

SEQ ID NO: 942009 - protein, 25 aa, Mycobacterium
AAASLGWQAAPIPRNAPGCAGCCQC

SEQ ID NO: 942010 - protein, 18 aa, Mycobacterium
AAATIVRHLLTDPVLPDE

SEQ ID NO: 942011 - protein, 26 aa, Mycobacterium
AAATKPYGFMPFYPGPGVGGHCIPCD

SEQ ID NO: 942012 - protein, 25 aa, Mycobacterium
AAAVAIPLLALPVGGASASAATTYE

SEQ ID NO: 942013 - protein, 23 aa, Mycobacterium
AAAVGAELFLRHLAGSKVASAVA

SEQ ID NO: 942014 - protein, 23 aa, Mycobacterium
AAAVLGRPLIGNGTNGAPGSGDA

SEQ ID NO: 942015 - protein, 28 aa, Mycobacterium
AACAATVAMLFATAGWAAADVPADEPEP

SEQ ID NO: 942016 - protein, 18 aa, Mycobacterium
AADALPPVVIDRLRHPGA

SEQ ID NO: 942017 - protein, 24 aa, Mycobacterium
AADAVTAFWGPDWPREIDIAVAGT

SEQ ID NO: 942018 - protein, 36 aa, Mycobacterium
AADDALIVLAVPMPALGLMLGHIRAAAANCALTDVI

SEQ ID NO: 942019 - protein, 25 aa, Mycobacterium
AADDDRLDWPLRPPPAVTRAFDAPV

SEQ ID NO: 942020 - protein, 22 aa, Mycobacterium
AADGLARMDVPFLGYHSAPGIN

SEQ ID NO: 942021 - protein, 19 aa, Mycobacterium
AADGQWLPPGAPGSHWAPG

SEQ ID NO: 942022 - protein, 28 aa, Mycobacterium
AADGTNYRALFQVATPQGVNPSTIPQGE

SEQ ID NO: 942023 - protein, 21 aa, Mycobacterium
AADLLVRAWVRSYGVRATISN

SEQ ID NO: 942024 - protein, 26 aa, Mycobacterium
AADPATFTAYYRWDVYCRTTAGDVVL

SEQ ID NO: 942025 - protein, 25 aa, Mycobacterium
AADPKPYLLLGILPSERVEATPAAD

SEQ ID NO: 942026 - protein, 27 aa, Mycobacterium
AADPPGIPFVPGVPAPLPATPGSYTYI

SEQ ID NO: 942027 - protein, 27 aa, Mycobacterium
AADSFIAEMTFLDAMKFMGGCTTLTVA

SEQ ID NO: 942028 - protein, 28 aa, Mycobacterium
AADTDPWHVTAIYLDPRWLADQDEQADF

SEQ ID NO: 942029 - protein, 25 aa, Mycobacterium
AADTGLRLPFGEILRTVFDEALAGG

SEQ ID NO: 942030 - protein, 26 aa, Mycobacterium
AAEAFAVPKFRRVLRSAYVALRLRGP

SEQ ID NO: 942031 - protein, 25 aa, Mycobacterium
AAEEFTYQPLWPFASQTDADTWLRE

SEQ ID NO: 942032 - protein, 18 aa, Mycobacterium
AAEKFFRALAVGDTATAA

SEQ ID NO: 942033 - protein, 24 aa, Mycobacterium
AAELAPFGIRVNAVFPGPIATPML

SEQ ID NO: 942034 - protein, 24 aa, Mycobacterium
AAELATMFHIYFLGSSEGLVFDVA

SEQ ID NO: 942035 - protein, 21 aa, Mycobacterium
AAELPARWVSVGTGAADATFG

SEQ ID NO: 942036 - protein, 22 aa, Mycobacterium
AAELPFNRILAVGGFRCNVQQA

SEQ ID NO: 942037 - protein, 25 aa, Mycobacterium
AAEQGLAPAEYAFMRLRATMSAQHA

SEQ ID NO: 942038 - protein, 28 aa, Mycobacterium
AAERAGISRLQLVERDLLGVINAPSQAL

SEQ ID NO: 942039 - protein, 25 aa, Mycobacterium
AAERGRWLNHLPYQDLPPMQPGDPR

SEQ ID NO: 942040 - protein, 26 aa, Mycobacterium
AAERIAQVWNTTWNLGPDLDLKKFPS

SEQ ID NO: 942041 - protein, 25 aa, Mycobacterium
AAEVADIVDLPLLASMRPQPGLDEA

SEQ ID NO: 942042 - protein, 19 aa, Mycobacterium
AAEVLGFRAAVEPLEGLRG

SEQ ID NO: 942043 - protein, 17 aa, Mycobacterium
AAFIAALVFAVGPAVAE

SEQ ID NO: 942044 - protein, 19 aa, Mycobacterium
AAFLAAVCGPALCISTPGT

SEQ ID NO: 942045 - protein, 20 aa, Mycobacterium
AAFPLGWVHDVVRAPGPVIG

SEQ ID NO: 942046 - protein, 25 aa, Mycobacterium
AAFTDFDPFWEFVSGPLNAGAGKES

SEQ ID NO: 942047 - protein, 30 aa, Mycobacterium
AAGADVAEMRLPFSWRGVSLHAAGAAGLRA

SEQ ID NO: 942048 - protein, 17 aa, Mycobacterium
AAGAKKVVVFAAASLKP

SEQ ID NO: 942049 - protein, 24 aa, Mycobacterium
AAGALAMAVVGLGAAQGLAEPDDT

SEQ ID NO: 942050 - protein, 25 aa, Mycobacterium
AAGAPISAVIAWIEAGRPADPTRYH

SEQ ID NO: 942051 - protein, 25 aa, Mycobacterium
AAGDRAFFCDYALDYLARAGISKDQ

SEQ ID NO: 942052 - protein, 24 aa, Mycobacterium
AAGDRAFFCDYVLDYLAKSGISKD

SEQ ID NO: 942053 - protein, 39 aa, Mycobacterium
AAGGHPAHSWWLGPSTVLAAFSAFNTLAGPASLASNFSR

SEQ ID NO: 942054 - protein, 25 aa, Mycobacterium
AAGGQLQMNLGILNGLLAPNGQQVP

SEQ ID NO: 942055 - protein, 32 aa, Mycobacterium
AAGGTLLYDGRAPAFWVLADPEGNEACICTWQ

SEQ ID NO: 942056 - protein, 21 aa, Mycobacterium
AAGGVLLRPFARLIASTGDSV

SEQ ID NO: 942057 - protein, 17 aa, Mycobacterium
AAGGYSTWLISSTTATP

SEQ ID NO: 942058 - protein, 25 aa, Mycobacterium
AAGIDEVLLFDPHPVLSVRRTSTDD

SEQ ID NO: 942059 - protein, 19 aa, Mycobacterium
AAGIPNFTPGLTSASAPAP

SEQ ID NO: 942060 - protein, 23 aa, Mycobacterium
AAGITVFLDFQCPFCQRFEAQYG

SEQ ID NO: 942061 - protein, 18 aa, Mycobacterium
AAGLAVAFVAYQRIGTNA

SEQ ID NO: 942062 - protein, 25 aa, Mycobacterium
AAGLPNVRILDGGLAAWRSDGGRLE

SEQ ID NO: 942063 - protein, 25 aa, Mycobacterium
AAGLPSGVIVTKLDDRAISSADALV

SEQ ID NO: 942064 - protein, 25 aa, Mycobacterium
AAGNPIAWFYQQRRWIVPSERIADT

SEQ ID NO: 942065 - protein, 30 aa, Mycobacterium
AAGPDQPALRPLLDLLPIAGGSGTLGERFL

SEQ ID NO: 942066 - protein, 30 aa, Mycobacterium
AAGPDQPPLRALLDLLPIAAGSGTLGDRFT

SEQ ID NO: 942067 - protein, 19 aa, Mycobacterium
AAGPLVMAGCRFLDVMLGA

SEQ ID NO: 942068 - protein, 18 aa, Mycobacterium
AAGRIVVTVRLWAEPIAF

SEQ ID NO: 942069 - protein, 22 aa, Mycobacterium
AAGRLFDALAADAPLPPTTAEG

SEQ ID NO: 942070 - protein, 26 aa, Mycobacterium
AAGSGVLAWWVQYRGRESAGDPCAEA

SEQ ID NO: 942071 - protein, 19 aa, Mycobacterium
AAGSWLVRALHGAPAALGA

SEQ ID NO: 942072 - protein, 20 aa, Mycobacterium
AAGTVQWVLGNLGAIPTVTI

SEQ ID NO: 942073 - protein, 24 aa, Mycobacterium
AAGVRRFVFSSVIHPSLGLQNHAA

SEQ ID NO: 942074 - protein, 18 aa, Mycobacterium
AAGVVALALPMAACTSSK

SEQ ID NO: 942075 - protein, 19 aa, Mycobacterium
AAGWLVERAGFAKGYPEPG

SEQ ID NO: 942076 - protein, 19 aa, Mycobacterium
AAGYINFYLANGGVIAPQF

SEQ ID NO: 942077 - protein, 22 aa, Mycobacterium
AAGYLINGFIYAYPELADAIHE

SEQ ID NO: 942078 - protein, 26 aa, Mycobacterium
AAHADPLIYPGMEIIQRPPGKESLSC

SEQ ID NO: 942079 - protein, 17 aa, Mycobacterium
AAHPDLILGSEALTPNL

SEQ ID NO: 942080 - protein, 21 aa, Mycobacterium
AAHSLPDWPFNDPGYTVFPVL

SEQ ID NO: 942081 - protein, 21 aa, Mycobacterium
AAIAAFAFAFAAAPVIGLGAP

SEQ ID NO: 942082 - protein, 20 aa, Mycobacterium
AAIALLTKSWAAEYGPSGVR

SEQ ID NO: 942083 - protein, 21 aa, Mycobacterium
AAIASLVLPSSFRPVPDPTSP

SEQ ID NO: 942084 - protein, 25 aa, Mycobacterium
AAIDPSMYRPLSPGQKITYGLKATD

SEQ ID NO: 942085 - protein, 17 aa, Mycobacterium
AAIGFLSFRAPWETYRA

SEQ ID NO: 942086 - protein, 28 aa, Mycobacterium
AAIGGFRRWEPMVRRFLSDERLLRVFTF

SEQ ID NO: 942087 - protein, 18 aa, Mycobacterium
AAIGIDLPDVFRVLEDEG

SEQ ID NO: 942088 - protein, 17 aa, Mycobacterium
AAIGVRRPLSRLGMGLH

SEQ ID NO: 942089 - protein, 22 aa, Mycobacterium
AAIRERMGHARFALYREGYDSA

SEQ ID NO: 942090 - protein, 25 aa, Mycobacterium
AAIRGSLRFLDYHLFIAAGDSPTPL

SEQ ID NO: 942091 - protein, 21 aa, Mycobacterium
AAISALVLPSSFRPIPDSQTP

SEQ ID NO: 942092 - protein, 19 aa, Mycobacterium
AAISIPTPVGELDLLAAYI

SEQ ID NO: 942093 - protein, 17 aa, Mycobacterium
AAIVHPAAVAANRNDLV

SEQ ID NO: 942094 - protein, 23 aa, Mycobacterium
AAKAEPLGILPQPNELPRGCIAA

SEQ ID NO: 942095 - protein, 25 aa, Mycobacterium
AAKAQPLGVLPRPAPLPQGCIAAGD

SEQ ID NO: 942096 - protein, 24 aa, Mycobacterium
AAKATPLGVLPRPDPLPQGCIGAR

SEQ ID NO: 942097 - protein, 25 aa, Mycobacterium
AAKELAYLGVRVNAIAPGLIRSAMT

SEQ ID NO: 942098 - protein, 20 aa, Mycobacterium
AAKFTYLSAAHYCPKYVTGE

SEQ ID NO: 942099 - protein, 24 aa, Mycobacterium
AAKQSGYRAGLLASISAACSCAAE

SEQ ID NO: 942100 - protein, 18 aa, Mycobacterium
AALAAGALDAAGAGSGCA

SEQ ID NO: 942101 - protein, 19 aa, Mycobacterium
AALAAVIALAGGCSTVVTG

SEQ ID NO: 942102 - protein, 20 aa, Mycobacterium
AALAFTALPQVLAVMAPSGA

SEQ ID NO: 942103 - protein, 21 aa, Mycobacterium
AALAHWLHRTGHTPTLIEQAA

SEQ ID NO: 942104 - protein, 29 aa, Mycobacterium
AALALARDGWWVDLLECSSDILTGASGCN

SEQ ID NO: 942105 - protein, 23 aa, Mycobacterium
AALAPTHTLLLAGRPSARLDEVA

SEQ ID NO: 942106 - protein, 19 aa, Mycobacterium
AALARLPGQILGRVAFQVL

SEQ ID NO: 942107 - protein, 21 aa, Mycobacterium
AALAVIALTAFSTGCSHRSGS

SEQ ID NO: 942108 - protein, 26 aa, Mycobacterium
AALDGRWDRNWLLGWRDITNASNERT

SEQ ID NO: 942109 - protein, 17 aa, Mycobacterium
AALEGYLHMQKRQFPAP

SEQ ID NO: 942110 - protein, 22 aa, Mycobacterium
AALFVTTTLLTPPLASCGSHGS

SEQ ID NO: 942111 - protein, 21 aa, Mycobacterium
AALGALALISTLAGCSGEAER

SEQ ID NO: 942112 - protein, 25 aa, Mycobacterium
AALGEFFALPVAGDSWRPVDTLCGD

SEQ ID NO: 942113 - protein, 23 aa, Mycobacterium
AALHLRRWLARKHEIVVISPNAD

SEQ ID NO: 942114 - protein, 21 aa, Mycobacterium
AALHLRRWLPRAHEIVVISPN

SEQ ID NO: 942115 - protein, 24 aa, Mycobacterium
AALITALIFLVGCTRSISGTAVKA

SEQ ID NO: 942116 - protein, 23 aa, Mycobacterium
AALLAAGLIAVPLVPSLLVEVSP

SEQ ID NO: 942117 - protein, 17 aa, Mycobacterium
AALLDWARASVEGLISR

SEQ ID NO: 942118 - protein, 34 aa, Mycobacterium
AALLHRAASPAVWLNPWRWYAVPHAAAGALTVDQ

SEQ ID NO: 942119 - protein, 18 aa, Mycobacterium
AALLTLDRQARISTRVVA

SEQ ID NO: 942120 - protein, 20 aa, Mycobacterium
AALMSWVRAAARGARRVVSV

SEQ ID NO: 942121 - protein, 19 aa, Mycobacterium
AALNLVKCVHWPSGSPPQL

SEQ ID NO: 942122 - protein, 18 aa, Mycobacterium
AALQMHVIPGRSGAWLIV

SEQ ID NO: 942123 - protein, 29 aa, Mycobacterium
AALSAQYRRAFAMAIPTFALPDIHLDNTA

SEQ ID NO: 942124 - protein, 35 aa, Mycobacterium
AALTGRFDFALVALKAPYLQAALGPLVERGLVDTY

SEQ ID NO: 942125 - protein, 17 aa, Mycobacterium
AALTVDPMFANSPAADE

SEQ ID NO: 942126 - protein, 18 aa, Mycobacterium
AALTVELLARVHAAFWGR

SEQ ID NO: 942127 - protein, 17 aa, Mycobacterium
AALVGGLYVLFSGGESG

SEQ ID NO: 942128 - protein, 17 aa, Mycobacterium
AALVVALVAGMLTAPNA

SEQ ID NO: 942129 - protein, 29 aa, Mycobacterium
AAMAAAAAPYAGWLSAAATRALGAATQAK

SEQ ID NO: 942130 - protein, 28 aa, Mycobacterium
AAMAAAATPYTAWLTTAATAAAEAAGRG

SEQ ID NO: 942131 - protein, 28 aa, Mycobacterium
AAMAIRTRFFDDFFLDATASGIRQAVIL

SEQ ID NO: 942132 - protein, 19 aa, Mycobacterium
AAMGYLQRVPFPGAPRDVP

SEQ ID NO: 942133 - protein, 21 aa, Mycobacterium
AAMMKATLPRAFVIGPDGSTT

SEQ ID NO: 942134 - protein, 27 aa, Mycobacterium
AAMQFLVELMLFDWPTHVAQIIQALSQ

SEQ ID NO: 942135 - protein, 25 aa, Mycobacterium
AAMQWEKLICNVAYSAPCALTGMTV

SEQ ID NO: 942136 - protein, 25 aa, Mycobacterium
AANDGAWYVFSALDGVTCVLDRGSG

SEQ ID NO: 942137 - protein, 20 aa, Mycobacterium
AANLGLFTEADRRLTEANDT

SEQ ID NO: 942138 - protein, 26 aa, Mycobacterium
AANLNVVHYSLFPPNADLAPVAQVVA

SEQ ID NO: 942139 - protein, 25 aa, Mycobacterium
AANNLPLLRAFPKSGVPMVVIGNQP

SEQ ID NO: 942140 - protein, 23 aa, Mycobacterium
AANRLLGALNWLVEQKPGIYDGL

SEQ ID NO: 942141 - protein, 36 aa, Mycobacterium
AANVTPLQMLLDMVNAPTLALVGRPLIGNGANGAPG

SEQ ID NO: 942142 - protein, 33 aa, Mycobacterium
AAPADQLPPPGPLLLPPPPPPPAPVAGPPAEPL

SEQ ID NO: 942143 - protein, 21 aa, Mycobacterium
AAPALNLPSLTLAPPTPAGME

SEQ ID NO: 942144 - protein, 18 aa, Mycobacterium
AAPALVPLSGLSNLTLRV

SEQ ID NO: 942145 - protein, 19 aa, Mycobacterium
AAPEWTLPGTTGSVAVTGS

SEQ ID NO: 942146 - protein, 26 aa, Mycobacterium
AAPGRITTILALHDLINGGHPGQYGT

SEQ ID NO: 942147 - protein, 22 aa, Mycobacterium
AAPIDCLGVVAPAMRIVYEPGH

SEQ ID NO: 942148 - protein, 27 aa, Mycobacterium
AAPILWGDMPTLPLYRQQRTLLMSKKM

SEQ ID NO: 942149 - protein, 30 aa, Mycobacterium
AAPNARVFTVGYLPILPPDAKGCLVGLINT

SEQ ID NO: 942150 - protein, 23 aa, Mycobacterium
AAPPGVDTWYRGSARIADLVEQI

SEQ ID NO: 942151 - protein, 23 aa, Mycobacterium
AAPRACVSELRYPHVATDAAGTT

SEQ ID NO: 942152 - protein, 17 aa, Mycobacterium
AAPYGIPEALTAQFMDL

SEQ ID NO: 942153 - protein, 31 aa, Mycobacterium
AAPYLVGALKLILTVPFNIDNIPKAIRGDYI

SEQ ID NO: 942154 - protein, 20 aa, Mycobacterium
AAQFTMIAASAYCPQHLGQP

SEQ ID NO: 942155 - protein, 30 aa, Mycobacterium
AAQGPEIATMQGWLTQWGVPASSGHEGHDM

SEQ ID NO: 942156 - protein, 30 aa, Mycobacterium
AAQLQYQLRPFPPNAGAFIALIQHGNQAGD

SEQ ID NO: 942157 - protein, 17 aa, Mycobacterium
AAQPPPPPPPPPAPDIN

SEQ ID NO: 942158 - protein, 27 aa, Mycobacterium
AAQVLTGWQTWLAAADRNTWGLVDMSV

SEQ ID NO: 942159 - protein, 18 aa, Mycobacterium
AARDALGGAPLTLRIGYH

SEQ ID NO: 942160 - protein, 22 aa, Mycobacterium
AARGHSLIVTARREDLLNQLAA

SEQ ID NO: 942161 - protein, 23 aa, Mycobacterium
AARHWVVEPDLTNAVPFLAAAVV

SEQ ID NO: 942162 - protein, 18 aa, Mycobacterium
AARKGLLRVVPPGGTAVC

SEQ ID NO: 942163 - protein, 26 aa, Mycobacterium
AARLAAHAAVFWLGRGRTASRETAIA

SEQ ID NO: 942164 - protein, 18 aa, Mycobacterium
AARPGRIWLRISGYGEHS

SEQ ID NO: 942165 - protein, 20 aa, Mycobacterium
AARRHGLRVSLSPTPFADNV

SEQ ID NO: 942166 - protein, 25 aa, Mycobacterium
AARRYLAVFIPKTNLGIAFRDLCMR

SEQ ID NO: 942167 - protein, 26 aa, Mycobacterium
AARTPDTPPQWIPVESPRGLNYAVPP

SEQ ID NO: 942168 - protein, 35 aa, Mycobacterium
AARTRTLAILLAAVPIPLWDPVRLAEEMSVLDLIS

SEQ ID NO: 942169 - protein, 22 aa, Mycobacterium
AARWIAPFLTVAAVAGFAVAAQ

SEQ ID NO: 942170 - protein, 26 aa, Mycobacterium
AASAHKLVPLRWALAAMLAGLPTPDE

SEQ ID NO: 942171 - protein, 25 aa, Mycobacterium
AASDAAWAFISWITSPEIDAERVAK

SEQ ID NO: 942172 - protein, 32 aa, Mycobacterium
AASIIEAIYPITAALRPFFAAVTGAYSPIGAI

SEQ ID NO: 942173 - protein, 24 aa, Mycobacterium
AASISTALFGAGIAAAAPDVVGET

SEQ ID NO: 942174 - protein, 21 aa, Mycobacterium
AASIVVGLLLGAAAVFGVTLM

SEQ ID NO: 942175 - protein, 22 aa, Mycobacterium
AASIVVGLLLGAAAVFGVTLMV

SEQ ID NO: 942176 - protein, 25 aa, Mycobacterium
AASKSGLISLVKTLGRELAREHIIV

SEQ ID NO: 942177 - protein, 22 aa, Mycobacterium
AASNPDLFWALRGGGGGNFGVT

SEQ ID NO: 942178 - protein, 20 aa, Mycobacterium
AASSMFYPVPGLTLGGLVVD

SEQ ID NO: 942179 - protein, 19 aa, Mycobacterium
AASVLIGLLLGAAAVFGLT

SEQ ID NO: 942180 - protein, 23 aa, Mycobacterium
AASVRPIADLQIEYSLMSRGIEN

SEQ ID NO: 942181 - protein, 27 aa, Mycobacterium
AATAIRNLLVPRLQYIPGLRSRIQHSG

SEQ ID NO: 942182 - protein, 25 aa, Mycobacterium
AATALGWRAAPIPRNAPGCGGCCQC

SEQ ID NO: 942183 - protein, 30 aa, Mycobacterium
AATAMAAAARPYASWLGTAAARAAVTAAQA

SEQ ID NO: 942184 - protein, 23 aa, Mycobacterium
AATATHLSSLRTTLVAANAAAAV

SEQ ID NO: 942185 - protein, 28 aa, Mycobacterium
AATAVTALVGWGIRVPFAAAEPCPDVEV

SEQ ID NO: 942186 - protein, 23 aa, Mycobacterium
AATDLLPTGLRLQSKPGFRVQPG

SEQ ID NO: 942187 - protein, 22 aa, Mycobacterium
AATFPVIDGVRYAIPGDRARQL

SEQ ID NO: 942188 - protein, 25 aa, Mycobacterium
AATGRLDILVANHAYMTMAPLLDHD

SEQ ID NO: 942189 - protein, 20 aa, Mycobacterium
AATHSLLLGGRPSLRLDTLA

SEQ ID NO: 942190 - protein, 20 aa, Mycobacterium
AATLFRRQGYAATGLKQILD

SEQ ID NO: 942191 - protein, 21 aa, Mycobacterium
AATLWYHDHRMGYTGQAVWRG

SEQ ID NO: 942192 - protein, 17 aa, Mycobacterium
AATLWYHDHRMGYTGSA

SEQ ID NO: 942193 - protein, 31 aa, Mycobacterium
AATPGTPAFAATAAFAADAALAAATRRTTIA

SEQ ID NO: 942194 - protein, 25 aa, Mycobacterium
AATSGFALIKMAAGERVRWSPGVTV

SEQ ID NO: 942195 - protein, 27 aa, Mycobacterium
AATTPQPFRSPWLNPQVSASTKFISWV

SEQ ID NO: 942196 - protein, 26 aa, Mycobacterium
AATTSGLPALDLPAPNLGIGNAGVGN

SEQ ID NO: 942197 - protein, 34 aa, Mycobacterium
AATVHPELVLANRNQLVSLVLSNLFGQNAPAIAA

SEQ ID NO: 942198 - protein, 25 aa, Mycobacterium
AATVPPAEVAANRALLAALVATNIL

SEQ ID NO: 942199 - protein, 24 aa, Mycobacterium
AATVPPPVIAANRSLLMTLIATNI

SEQ ID NO: 942200 - protein, 26 aa, Mycobacterium
AATVPPPVIAANRTLLATLVATNFLG

SEQ ID NO: 942201 - protein, 20 aa, Mycobacterium
AAVAAFPVLIAACGTHDPAP

SEQ ID NO: 942202 - protein, 23 aa, Mycobacterium
AAVAALLVPIPASAGPAMMAYPG

SEQ ID NO: 942203 - protein, 21 aa, Mycobacterium
AAVAQLTPWELTSEGIVIPLP

SEQ ID NO: 942204 - protein, 22 aa, Mycobacterium
AAVAVLLSPGFLAVGCGSDSTK

SEQ ID NO: 942205 - protein, 27 aa, Mycobacterium
AAVDRTFLYRHPDLLEKIHALQADPVP

SEQ ID NO: 942206 - protein, 25 aa, Mycobacterium
AAVEGLILGSYRFTDFRSPKSAPKD

SEQ ID NO: 942207 - protein, 25 aa, Mycobacterium
AAVGAPLPMDPALAADVPTADQLTG

SEQ ID NO: 942208 - protein, 24 aa, Mycobacterium
AAVGLTHTVLLRSDGTAVALGDNA

SEQ ID NO: 942209 - protein, 24 aa, Mycobacterium
AAVGVLGVGLILAGGVAGAPSALA

SEQ ID NO: 942210 - protein, 20 aa, Mycobacterium
AAVIGMISFTAACGSEEEAP

SEQ ID NO: 942211 - protein, 23 aa, Mycobacterium
AAVINRLPVRYTFDNRYFSDTYE

SEQ ID NO: 942212 - protein, 18 aa, Mycobacterium
AAVKLALDKNVVLPANAT

SEQ ID NO: 942213 - protein, 18 aa, Mycobacterium
AAVLLLLAAPTGCAHTVD

SEQ ID NO: 942214 - protein, 27 aa, Mycobacterium
AAVNGQLFIVYGPQVTLVAAPTAEHKF

SEQ ID NO: 942215 - protein, 24 aa, Mycobacterium
AAVTANAPLAARAGITTGATSATS

SEQ ID NO: 942216 - protein, 17 aa, Mycobacterium
AAVTVVRIGLPISPAAS

SEQ ID NO: 942217 - protein, 19 aa, Mycobacterium
AAVWPWLVQMGQDRGGFYG

SEQ ID NO: 942218 - protein, 26 aa, Mycobacterium
AAVWRRYDHMTRLPRGLLVIGDALCS

SEQ ID NO: 942219 - protein, 28 aa, Mycobacterium
AAVYAWSFGPGLWKAWRQPTAEVLRSAV

SEQ ID NO: 942220 - protein, 23 aa, Mycobacterium
AAWWVVVLALTAATMMAAALGGW

SEQ ID NO: 942221 - protein, 25 aa, Mycobacterium
AAYEAAFAATVPPALVIANRDQLAT

SEQ ID NO: 942222 - protein, 25 aa, Mycobacterium
AAYEVFVRVPWRKATVGATALGLRA

SEQ ID NO: 942223 - protein, 27 aa, Mycobacterium
AAYIPVVLALIAVLLAACGSSNPLGGG

SEQ ID NO: 942224 - protein, 21 aa, Mycobacterium
ACFAVLAVCATLATTTGRPLA

SEQ ID NO: 942225 - protein, 19 aa, Mycobacterium
ACHPGQRGLFLLVEAARQL

SEQ ID NO: 942226 - protein, 19 aa, Mycobacterium
ACHVFQPLLYQCATGTLSI

SEQ ID NO: 942227 - protein, 23 aa, Mycobacterium
ACLAITFAFMLGGLDAPAHSVAD

SEQ ID NO: 942228 - protein, 17 aa, Mycobacterium
ACNGTDDEAWFFGTQSD

SEQ ID NO: 942229 - protein, 20 aa, Mycobacterium
ACSTPQYASSVPGTTPAIWT

SEQ ID NO: 942230 - protein, 18 aa, Mycobacterium
ACTGPPRPGAQRLTLDVG

SEQ ID NO: 942231 - protein, 18 aa, Mycobacterium
ADAAALLQRARQDWQGCA

SEQ ID NO: 942232 - protein, 25 aa, Mycobacterium
ADAALAAATRRTTIANIAAGPARAG

SEQ ID NO: 942233 - protein, 25 aa, Mycobacterium
ADAALRPLLNYYTGLRRAEWGFEGD

SEQ ID NO: 942234 - protein, 32 aa, Mycobacterium
ADADGRWLVNPMFIDPLPAHPPYPCATQGFDD

SEQ ID NO: 942235 - protein, 23 aa, Mycobacterium
ADADSFRYYPGFAGPALNTLRDN

SEQ ID NO: 942236 - protein, 25 aa, Mycobacterium
ADAGHSIRFLVRNPGKLKTSVAQLG

SEQ ID NO: 942237 - protein, 24 aa, Mycobacterium
ADALGLARFPLAHALLEQAEPLSG

SEQ ID NO: 942238 - protein, 23 aa, Mycobacterium
ADAMMSGFAAALSARITSYTGKV

SEQ ID NO: 942239 - protein, 17 aa, Mycobacterium
ADAPDVPFPFAGGVRLP

SEQ ID NO: 942240 - protein, 25 aa, Mycobacterium
ADAPTPLGYALAVTAPPVEPAPAPL

SEQ ID NO: 942241 - protein, 31 aa, Mycobacterium
ADATGTCWVAQYGKPAWPMVFAPVESPDSRL

SEQ ID NO: 942242 - protein, 23 aa, Mycobacterium
ADATIATIVSIGTGLLTGTTGGA

SEQ ID NO: 942243 - protein, 25 aa, Mycobacterium
ADATTAAVAALAPGAAGSAVAAQAA

SEQ ID NO: 942244 - protein, 18 aa, Mycobacterium
ADAWLNRQLSGYANWAVA

SEQ ID NO: 942245 - protein, 23 aa, Mycobacterium
ADDGLIYQVWQSPAPIEPDPYLK

SEQ ID NO: 942246 - protein, 38 aa, Mycobacterium
ADDHRLFAGIPYAAPPVGALRWQGPRPAPKWDGVRDAT

SEQ ID NO: 942247 - protein, 23 aa, Mycobacterium
ADDLLSMLVARRQAIVRLLASTS

SEQ ID NO: 942248 - protein, 31 aa, Mycobacterium; identical to SEQ ID NO: 788428

SEQ ID NO: 942249 - protein, 22 aa, Mycobacterium
ADDLVAYFRVTRPVTLTFEVEG

SEQ ID NO: 942250 - protein, 23 aa, Mycobacterium
ADDPLVRGLRELGHKVDLADQSS

SEQ ID NO: 942251 - protein, 24 aa, Mycobacterium
ADDPVTKWVIPDAARRARALPRMF

SEQ ID NO: 942252 - protein, 19 aa, Mycobacterium
ADDSLVLKNILHAAPNALV

SEQ ID NO: 942253 - protein, 24 aa, Mycobacterium
ADDTRLQWPLRPPAVVLRGFDAPT

SEQ ID NO: 942254 - protein, 27 aa, Mycobacterium
ADDVARAVAFLLSDDARFITGEALAVN

SEQ ID NO: 942255 - protein, 30 aa, Mycobacterium
ADEAYLHIPGLPPIVTLPNRPPSEHVPGWR

SEQ ID NO: 942256 - protein, 23 aa, Mycobacterium
ADELWERYRLGAVYAYTAPVITA

SEQ ID NO: 942257 - protein, 32 aa, Mycobacterium
ADEMLAVVPGWYRMMALLARAFIAMAQDEPEL

SEQ ID NO: 942258 - protein, 24 aa, Mycobacterium
ADERRTCVFFESPRRLPACLQDAV

SEQ ID NO: 942259 - protein, 29 aa, Mycobacterium
ADEVSTAIAALFGWHAQTYQSLSAQATSF

SEQ ID NO: 942260 - protein, 32 aa, Mycobacterium
ADEVSYIYLYNPSVIQAWNPALSGYEARRDGA

SEQ ID NO: 942261 - protein, 20 aa, Mycobacterium
ADFLCFSIYSANLAFGKAYK

SEQ ID NO: 942262 - protein, 25 aa, Mycobacterium
ADFPAGLQRLDAAQALAFVRQRHGL

SEQ ID NO: 942263 - protein, 23 aa, Mycobacterium
ADFSTLPWTRTITTTIPAIIANI

SEQ ID NO: 942264 - protein, 30 aa, Mycobacterium
ADGAIWARYNVPWQPAWVFYRADGSSTFVN

SEQ ID NO: 942265 - protein, 26 aa, Mycobacterium
ADGNMPVRWSGPPAVRHGYLQPAAKC

SEQ ID NO: 942266 - protein, 20 aa, Mycobacterium
ADGRYLGFDGLIHTVAQGHT

SEQ ID NO: 942267 - protein, 20 aa, Mycobacterium
ADGSINWNWGKGWEIGDEVP

SEQ ID NO: 942268 - protein, 29 aa, Mycobacterium
ADGSIWARYNVPWQPAYVFYRADGSSTFV

SEQ ID NO: 942269 - protein, 28 aa, Mycobacterium
ADGSPWQGNIFTSFPYLDTAATRRMGLE

SEQ ID NO: 942270 - protein, 24 aa, Mycobacterium
ADGSYWTGLVFADGKRWPEERTTW

SEQ ID NO: 942271 - protein, 29 aa, Mycobacterium
ADHCLDLPGLFVWRRYHPMPATTRGVLYG

SEQ ID NO: 942272 - protein, 24 aa, Mycobacterium
ADIALYVRSFPANVIAQYKRTDPD

SEQ ID NO: 942273 - protein, 18 aa, Mycobacterium
ADIARVAVFLASDAAAMI

SEQ ID NO: 942274 - protein, 24 aa, Mycobacterium
ADIELRPEQWYRDQQVRLISESTV

SEQ ID NO: 942275 - protein, 32 aa, Mycobacterium
ADIFFLLGVTDHEALRWIDGQAGTPVAIFVKQ

SEQ ID NO: 942276 - protein, 19 aa, Mycobacterium
ADIGLPEVFNDPDLASFGG

SEQ ID NO: 942277 - protein, 17 aa, Mycobacterium
ADIRQRCHWTPLVGQPG

SEQ ID NO: 942278 - protein, 28 aa, Mycobacterium
ADLAFATIPAVLLRWGVSQFDADARPAQ

SEQ ID NO: 942279 - protein, 27 aa, Mycobacterium
ADLFAAFGMLPVGYYDLRCAASPVPVV

SEQ ID NO: 942280 - protein, 26 aa, Mycobacterium
ADLILDNGLNLEAWFARFVDGIDVPH

SEQ ID NO: 942281 - protein, 24 aa, Mycobacterium
ADLLITSMRPTALQRLGLAAPHEQ

SEQ ID NO: 942282 - protein, 27 aa, Mycobacterium
ADMGRNFLVKLGILSPATAAADPGITN

SEQ ID NO: 942283 - protein, 26 aa, Mycobacterium
ADMGRSFLQKLGILPTPTGFTNGAIP

SEQ ID NO: 942284 - protein, 23 aa, Mycobacterium
ADNAKWFYDFSVPGDVVEVRNSG

SEQ ID NO: 942285 - protein, 26 aa, Mycobacterium
ADNCLLMSILMIEGQFTGQVPTRALE

SEQ ID NO: 942286 - protein, 25 aa, Mycobacterium
ADNDKPTAWLFVPCGSDCTLATSQD

SEQ ID NO: 942287 - protein, 24 aa, Mycobacterium
ADNFGSLTAFYLSGGGSVKPPNLD

SEQ ID NO: 942288 - protein, 25 aa, Mycobacterium
ADNFTALNIVLPMPTNWTKVPDPNV

SEQ ID NO: 942289 - protein, 24 aa, Mycobacterium
ADNPGQWLTHCHNIYHGETGMMAV

SEQ ID NO: 942290 - protein, 20 aa, Mycobacterium
ADPDVRLLFSLGLRVTERSG

SEQ ID NO: 942291 - protein, 20 aa, Mycobacterium
ADPDVRLVFSLGLRATDRSS

SEQ ID NO: 942292 - protein, 34 aa, Mycobacterium
ADPGDAPQPPFLWALMAFARRELDTLFAARTSNS

SEQ ID NO: 942293 - protein, 26 aa, Mycobacterium
ADPGHITFAWYPQLVRADLGIGPHQV

SEQ ID NO: 942294 - protein, 17 aa, Mycobacterium
ADPGPWDPTLPATASAG

SEQ ID NO: 942295 - protein, 17 aa, Mycobacterium
ADPTAFFCGMLGALANV

SEQ ID NO: 942296 - protein, 30 aa, Mycobacterium
ADPTAPLPAPLPIDGLQAPGLPAVQSLGPV

SEQ ID NO: 942297 - protein, 25 aa, Mycobacterium
ADQAPFPWGVAMLPIGPKGRVSVTN

SEQ ID NO: 942298 - protein, 19 aa, Mycobacterium
ADQFACGRVFFAGDAAHTM

SEQ ID NO: 942299 - protein, 24 aa, Mycobacterium
ADQFGCGRVFLVGDAPHTMPPFKA

SEQ ID NO: 942300 - protein, 20 aa, Mycobacterium
ADQLVLARIIIGRAARRHGL

SEQ ID NO: 942301 - protein, 27 aa, Mycobacterium
ADQSILVYPVPDVALRSAGRLLDVVGP

SEQ ID NO: 942302 - protein, 23 aa, Mycobacterium
ADRDTLTYLASPTAKGGTVTIGN

SEQ ID NO: 942303 - protein, 17 aa, Mycobacterium
ADRIPLPGRRRPASRAV

SEQ ID NO: 942304 - protein, 22 aa, Mycobacterium
ADRKAYDLLVQCETGLVSLTGT

SEQ ID NO: 942305 - protein, 24 aa, Mycobacterium
ADRLTACIDPILNRGFVLQSAGSW

SEQ ID NO: 942306 - protein, 28 aa, Mycobacterium
ADRREWPSPMLPALPTLFDDFGGDVHVV

SEQ ID NO: 942307 - protein, 18 aa, Mycobacterium
ADSLPPPYDNRLAQPYGG

SEQ ID NO: 942308 - protein, 23 aa, Mycobacterium
ADSLWFAPLFSQDALDLLELGLG

SEQ ID NO: 942309 - protein, 22 aa, Mycobacterium
ADSTFRSLMAFYFVDDKGVRTP

SEQ ID NO: 942310 - protein, 25 aa, Mycobacterium
ADTGGAVPAPPAGPSGAVEPPAGAA

SEQ ID NO: 942311 - protein, 30 aa, Mycobacterium
ADTKLNISRAYLRPGFAFGGSCLPKDLRAL

SEQ ID NO: 942312 - protein, 24 aa, Mycobacterium
ADTTWKLLLDSQSGIRKLDDPFVE

SEQ ID NO: 942313 - protein, 26 aa, Mycobacterium
ADVDGRPLLRHRVELGHGSYADDDIA

SEQ ID NO: 942314 - protein, 21 aa, Mycobacterium
ADVEIPWPGPSFPATSSAVPR

SEQ ID NO: 942315 - protein, 33 aa, Mycobacterium
ADVRGLLAYLDRQDPLQLTPRVPVLIAQGTEDV

SEQ ID NO: 942316 - protein, 25 aa, Mycobacterium
ADWDRHLRPMLARRYEIATGQRQAK

SEQ ID NO: 942317 - protein, 23 aa, Mycobacterium
ADWTRPYVLELSYTSWRLKRYAE

SEQ ID NO: 942318 - protein, 17 aa, Mycobacterium
ADYLSWQRNTVERLLAA

SEQ ID NO: 942319 - protein, 22 aa, Mycobacterium
AEAAGVSVLQSAGADVMGALNA

SEQ ID NO: 942320 - protein, 23 aa, Mycobacterium
AEALPPAAEPLAAPAPAPAPEAA

SEQ ID NO: 942321 - protein, 30 aa, Mycobacterium
AEAVAPPVLLPVVVAPVIVPPALAAPQPDG

SEQ ID NO: 942322 - protein, 19 aa, Mycobacterium
AEDICRVHLALQADAVGPA

SEQ ID NO: 942323 - protein, 18 aa, Mycobacterium
AEDLLFKDLPAAPLFYEV

SEQ ID NO: 942324 - protein, 17 aa, Mycobacterium
AEDLPGFLHGLAIGPDG

SEQ ID NO: 942325 - protein, 24 aa, Mycobacterium
AEDPRFRFFGNILVGEHVSPVELA

SEQ ID NO: 942326 - protein, 23 aa, Mycobacterium
AEDQHYIALLAQRQIGAALGNTD

SEQ ID NO: 942327 - protein, 25 aa, Mycobacterium
AEELGIELLLGWRATRVDLACNEVE

SEQ ID NO: 942328 - protein, 34 aa, Mycobacterium
AEEPIVIAAPMFHAWGFSQLLFAALLACPIVTRR

SEQ ID NO: 942329 - protein, 32 aa, Mycobacterium
AEEVRAVTGLPRLLKVWDPVDSMFGSTDPSLE

SEQ ID NO: 942330 - protein, 23 aa, Mycobacterium
AEGDTLMFDGPRNAFYLVTDERD

SEQ ID NO: 942331 - protein, 21 aa, Mycobacterium
AEGISVNVTLIFSVDRHRGVM

SEQ ID NO: 942332 - protein, 34 aa, Mycobacterium
AEGISVNVTLIFSVERYRAVMDAYLAGMEKAREG

SEQ ID NO: 942333 - protein, 23 aa, Mycobacterium
AEGRLLSALWVPHTHQLVLMIHH

SEQ ID NO: 942334 - protein, 20 aa, Mycobacterium
AEGVTSCRSVLALAASYDVE

SEQ ID NO: 942335 - protein, 19 aa, Mycobacterium
AEILSDPVYGYGANDVAAV

SEQ ID NO: 942336 - protein, 26 aa, Mycobacterium
AEKRRRGTRYWDPLATLGYLAARTQR

SEQ ID NO: 942337 - protein, 22 aa, Mycobacterium
AELAKLFDKRLAKTTPQRAAQI

SEQ ID NO: 942338 - protein, 22 aa, Mycobacterium
AELATMFHIYFLGSSEGLVFDV

SEQ ID NO: 942339 - protein, 40 aa, Mycobacterium
AELDHLDFDYVFVDCPPSLGLLTINALVAAPEVLIPIQCE

SEQ ID NO: 942340 - protein, 17 aa, Mycobacterium
AELERPQRFTLTDTRTG

SEQ ID NO: 942341 - protein, 27 aa, Mycobacterium
AELRQAFPGGIVALSKWAATPNPELGD

SEQ ID NO: 942342 - protein, 21 aa, Mycobacterium
AELRRTGYLARMSTVVNRRAW

SEQ ID NO: 942343 - protein, 20 aa, Mycobacterium
AELVGDLRRRMDSVSGTRTD

SEQ ID NO: 942344 - protein, 30 aa, Mycobacterium
AENLVRASRLDWLILRLGGVMSSTFSVDMD

SEQ ID NO: 942345 - protein, 27 aa, Mycobacterium
AENPNTRAVLFHLGKFIPTGVPDTYGF

SEQ ID NO: 942346 - protein, 24 aa, Mycobacterium
AENVVPLYRRNALNERQLLAVNEV

SEQ ID NO: 942347 - protein, 28 aa, Mycobacterium
AEPEVYNVLGPLLAPVQLLTDLTDAVGA

SEQ ID NO: 942348 - protein, 21 aa, Mycobacterium
AEPVAYLDWAPVQPSPTCGGT

SEQ ID NO: 942349 - protein, 22 aa, Mycobacterium
AEPVLPMPPAPVPSPVVQQAAP

SEQ ID NO: 942350 - protein, 19 aa, Mycobacterium
AEQPPAPRISPDQLLMMIS

SEQ ID NO: 942351 - protein, 36 aa, Mycobacterium
AEQRCGSPVWNLPLVFGPIAIAYRVNGLTSLNLDGP

SEQ ID NO: 942352 - protein, 23 aa, Mycobacterium
AERAMRVLHTTHEPLPRPHQRRL

SEQ ID NO: 942353 - protein, 23 aa, Mycobacterium
AERLDGWLAGHTWARAGAPDYEG

SEQ ID NO: 942354 - protein, 23 aa, Mycobacterium
AERLTEFFGGIPILDGVGSTEVG

SEQ ID NO: 942355 - protein, 18 aa, Mycobacterium
AERLTTQLKTADGIPVAN

SEQ ID NO: 942356 - protein, 20 aa, Mycobacterium
AESEVIVSLAFPKPPELLRA

SEQ ID NO: 942357 - protein, 28 aa, Mycobacterium
AESRGPAHISYFDPAPLFSVVDPARADV

SEQ ID NO: 942358 - protein, 46 aa, Mycobacterium
AETANASPLGTLEQRLLQAINAPTQTLLGRPLIGDGAAGTATNPNG

SEQ ID NO: 942359 - protein, 21 aa, Mycobacterium
AETPVPYLQWQNAPGVTPPQI

SEQ ID NO: 942360 - protein, 18 aa, Mycobacterium
AETTWKLLLDRQSGIREL

SEQ ID NO: 942361 - protein, 26 aa, Mycobacterium
AETVRFRWPLDPRPAVTRAFDAPSPN

SEQ ID NO: 942362 - protein, 19 aa, Mycobacterium
AEVLGWRPKVELTEGVRRT

SEQ ID NO: 942363 - protein, 28 aa, Mycobacterium
AEVNGQLFIVYGPQVTLVAAPTAERRFS

SEQ ID NO: 942364 - protein, 25 aa, Mycobacterium
AEVQVDWVIDLILTARRLGVTEVEP

SEQ ID NO: 942365 - protein, 27 aa, Mycobacterium
AEVRDLFETHFFGTVALIKAVLPDMRA

SEQ ID NO: 942366 - protein, 23 aa, Mycobacterium
AEYAALGYLKYPAAVTVAKVSDP

SEQ ID NO: 942367 - protein, 17 aa, Mycobacterium
AEYEYLRIHKKEKLRPM

SEQ ID NO: 942368 - protein, 17 aa, Mycobacterium
AFAGSDAWFLIRAVTEP

SEQ ID NO: 942369 - protein, 18 aa, Mycobacterium
AFALGGAGLIALAVAGCN

SEQ ID NO: 942370 - protein, 20 aa, Mycobacterium
AFAPDLLLHELTDLPDNLKD

SEQ ID NO: 942371 - protein, 18 aa, Mycobacterium
AFCTPGIRPAVVLGAPCA

SEQ ID NO: 942372 - protein, 25 aa, Mycobacterium
AFDAVPFLELLSAYGAPWGLQEVPA

SEQ ID NO: 942373 - protein, 20 aa, Mycobacterium
AFDEGGAPRWWFTVGGEVGK

SEQ ID NO: 942374 - protein, 28 aa, Mycobacterium
AFDFRVMTPTAWWRVPMQTVVGGLPTDA

SEQ ID NO: 942375 - protein, 27 aa, Mycobacterium
AFDTAMRRYAVLALPSRMLAVLDVSGS

SEQ ID NO: 942376 - protein, 26 aa, Mycobacterium
AFDTLSFYRPNQPGAYPIVLATYEIV

SEQ ID NO: 942377 - protein, 19 aa, Mycobacterium
AFEFVPDTAVFNDERWRSH

SEQ ID NO: 942378 - protein, 17 aa, Mycobacterium
AFEFVPDTKIFADERWR

SEQ ID NO: 942379 - protein, 22 aa, Mycobacterium
AFEKIRSWHLIPGPQNVARAIE

SEQ ID NO: 942380 - protein, 25 aa, Mycobacterium
AFELGAATNVLFLPSADVAIIALTN

SEQ ID NO: 942381 - protein, 24 aa, Mycobacterium
AFERVSAFQFGFTDGPMACKRIDS

SEQ ID NO: 942382 - protein, 17 aa, Mycobacterium
AFEWFYNSGISVVMPVG

SEQ ID NO: 942383 - protein, 21 aa, Mycobacterium
AFEYRAVVLGEDRQQLISGLT

SEQ ID NO: 942384 - protein, 19 aa, Mycobacterium
AFFCGMLGALANVTAPESS

SEQ ID NO: 942385 - protein, 22 aa, Mycobacterium
AFFLLGVTDDEALRWIDGQAGA

SEQ ID NO: 942386 - protein, 26 aa, Mycobacterium
AFFTSRCNMIAWDRGVFMPVAQEYFG

SEQ ID NO: 942387 - protein, 17 aa, Mycobacterium
AFGRVKEDLRRSQTERA

SEQ ID NO: 942388 - protein, 18 aa, Mycobacterium
AFGSFHMVDGFLLNNQLT

SEQ ID NO: 942389 - protein, 17 aa, Mycobacterium
AFINVYMCDLNLTGFFP

SEQ ID NO: 942390 - protein, 23 aa, Mycobacterium
AFKVPHRFAVVERLPRTANGKLL

SEQ ID NO: 942391 - protein, 18 aa, Mycobacterium
AFPASKWRRYDKLDRFPA

SEQ ID NO: 942392 - protein, 21 aa, Mycobacterium
AFRHVQPWFKNDILQAVRQEP

SEQ ID NO: 942393 - protein, 18 aa, Mycobacterium
AFRLGFVQPWAMGTIATT

SEQ ID NO: 942394 - protein, 21 aa, Mycobacterium
AFSAALLFGSAAIAVADPPAN

SEQ ID NO: 942395 - protein, 19 aa, Mycobacterium
AFSYLARDAGLTEKYIWAV

SEQ ID NO: 942396 - protein, 21 aa, Mycobacterium
AFTAVRAVRPGSSTARLVFAP

SEQ ID NO: 942397 - protein, 24 aa, Mycobacterium
AFTPLTIAPISRPTFPFPGTDGKY

SEQ ID NO: 942398 - protein, 25 aa, Mycobacterium
AFTPLTVAPISRPTFPFPGSDGKYH

SEQ ID NO: 942399 - protein, 24 aa, Mycobacterium
AFTPTRWLLNRLCAPTDPILGTEV

SEQ ID NO: 942400 - protein, 20 aa, Mycobacterium
AFVAAVVAAAAFFTVGGRAA

SEQ ID NO: 942401 - protein, 27 aa, Mycobacterium
AFVLDKFLRPVLDGVIGELYIAGAGVA

SEQ ID NO: 942402 - protein, 20 aa, Mycobacterium
AFVVLLSAALLAGAGCARFD

SEQ ID NO: 942403 - protein, 25 aa, Mycobacterium
AFYEGIPINNVLPNGLVLESNPKIV

SEQ ID NO: 942404 - protein, 41 aa, Mycobacterium
AGAARFIGFFATRTRFGLWFRNIAMRTMNIGPLATLFAGSV

SEQ ID NO: 942405 - protein, 25 aa, Mycobacterium
AGAARLALQAWQAMGGIDVLINNAA

SEQ ID NO: 942406 - protein, 20 aa, Mycobacterium
AGAAVGARAPWGDRGQPACS

SEQ ID NO: 942407 - protein, 26 aa, Mycobacterium
AGAAVNGKRWAIKGTATGVDMSNPQQ

SEQ ID NO: 942408 - protein, 28 aa, Mycobacterium
AGAAYDYIVKTWLKPINIDPVNYTFDRT

SEQ ID NO: 942409 - protein, 28 aa, Mycobacterium
AGAEDVHRWWTSLTPQQRQRFIAQSPDQ

SEQ ID NO: 942410 - protein, 25 aa, Mycobacterium
AGAEGPPPGAMWDPGARPGNGRRWD

SEQ ID NO: 942411 - protein, 27 aa, Mycobacterium
AGAGLPWTVAIGMVVPLALAALPRFVL

SEQ ID NO: 942412 - protein, 18 aa, Mycobacterium
AGAGLVGGGLMMAATANA

SEQ ID NO: 942413 - protein, 24 aa, Mycobacterium
AGAHGFGLLSGTAGAGGAGGAASA

SEQ ID NO: 942414 - protein, 17 aa, Mycobacterium
AGAIALALVSGGIGGGV

SEQ ID NO: 942415 - protein, 22 aa, Mycobacterium
AGAIMALRLGCQSDKFAAIAPV

SEQ ID NO: 942416 - protein, 25 aa, Mycobacterium
AGALPAALVLLAAAIAPTGCESPAH

SEQ ID NO: 942417 - protein, 18 aa, Mycobacterium
AGALRTLSLFGKPASNMS

SEQ ID NO: 942418 - protein, 28 aa, Mycobacterium
AGAPHRLVDPAALPPTPGHRLGQIVNPR

SEQ ID NO: 942419 - protein, 23 aa, Mycobacterium
AGAQAFNRVLTGFGFHGPDGQVI

SEQ ID NO: 942420 - protein, 20 aa, Mycobacterium
AGATPSFLGYHGYPASICVS

SEQ ID NO: 942421 - protein, 24 aa, Mycobacterium
AGAVALAIALPFAATACGGGDSGG

SEQ ID NO: 942422 - protein, 24 aa, Mycobacterium
AGAVFLVRQVFFGPTTITAYFPTA

SEQ ID NO: 942423 - protein, 23 aa, Mycobacterium
AGAVLGGSLLFTAGLGMAQAQPV

SEQ ID NO: 942424 - protein, 24 aa, Mycobacterium
AGAVMVPRLPPSQARVLLMAALAA

SEQ ID NO: 942425 - protein, 24 aa, Mycobacterium
AGAWGLGSALLFSTMFSGMAGVGY

SEQ ID NO: 942426 - protein, 17 aa, Mycobacterium
AGAWGVGSALLFNSLFS

SEQ ID NO: 942427 - protein, 17 aa, Mycobacterium
AGAWNDVVLAPGADLYS

SEQ ID NO: 942428 - protein, 19 aa, Mycobacterium
AGAWPAFWLGNTGEGELDI

SEQ ID NO: 942429 - protein, 24 aa, Mycobacterium
AGCLLGELAIGFLGAPQAAAAADC

SEQ ID NO: 942430 - protein, 18 aa, Mycobacterium
AGDDVLILGVPVGKVKEI

SEQ ID NO: 942431 - protein, 21 aa, Mycobacterium
AGDTVTCKVTFQGTILADQST

SEQ ID NO: 942432 - protein, 28 aa, Mycobacterium
AGEACARAIAWYLAMARRSQGNEDAAVA

SEQ ID NO: 942433 - protein, 33 aa, Mycobacterium
AGEALELGLAQRLMKFFGGIPLLDGIGSTEVGQ

SEQ ID NO: 942434 - protein, 23 aa, Mycobacterium
AGEHLARFFTHLHDVYGVSELDV

SEQ ID NO: 942435 - protein, 19 aa, Mycobacterium
AGEVPLAFALAAGSFRDGT

SEQ ID NO: 942436 - protein, 27 aa, Mycobacterium
AGEYGHIPFGDPALTCLCGARGCWDLS

SEQ ID NO: 942437 - protein, 28 aa, Mycobacterium
AGFDPTERTAWIAEGLLGYLPAEAQDRL

SEQ ID NO: 942438 - protein, 18 aa, Mycobacterium
AGFDVHIHACGERTARTA

SEQ ID NO: 942439 - protein, 22 aa, Mycobacterium
AGFPSFPCEGLVDGTSGAPWVS

SEQ ID NO: 942440 - protein, 26 aa, Mycobacterium
AGFRTGGYMIDFWGVGYQVAKRMGVE

SEQ ID NO: 942441 - protein, 20 aa, Mycobacterium
AGFSLRGHVRRLSDADTRWV

SEQ ID NO: 942442 - protein, 20 aa, Mycobacterium
AGFVVAGMLAATPALADPED

SEQ ID NO: 942443 - protein, 28 aa, Mycobacterium
AGGAGGSGGWLWGAGGTGGDGGAGSTVA

SEQ ID NO: 942444 - protein, 25 aa, Mycobacterium
AGGAIAFMDVLRILLSNPAVWEKTA

SEQ ID NO: 942445 - protein, 22 aa, Mycobacterium
AGGGAPMMLPPGSMGPPAAAIP

SEQ ID NO: 942446 - protein, 25 aa, Mycobacterium
AGGIFVHIPVMYADLSKVPARNISV

SEQ ID NO: 942447 - protein, 17 aa, Mycobacterium
AGGIVAGAMFLGAAGFA

SEQ ID NO: 942448 - protein, 37 aa, Mycobacterium
AGGKTTTYLIPTEKLPLLQPLRDLGFPESFVAALEAP

SEQ ID NO: 942449 - protein, 20 aa, Mycobacterium
AGGLFFGVGGAGGAAPLFGG

SEQ ID NO: 942450 - protein, 18 aa, Mycobacterium
AGGLLFGVGGAGGAAALS

SEQ ID NO: 942451 - protein, 18 aa, Mycobacterium
AGGLLIVAAADTGSVLSP

SEQ ID NO: 942452 - protein, 27 aa, Mycobacterium
AGGLVDLRRVPLTSLLLLNSTVPDQLR

SEQ ID NO: 942453 - protein, 25 aa, Mycobacterium
AGGNAGLIFGFGGAGGTGGSGINSF

SEQ ID NO: 942454 - protein, 22 aa, Mycobacterium
AGGNGGWLYGNGGAGGAGGADG

SEQ ID NO: 942455 - protein, 20 aa, Mycobacterium
AGGNSFYYGNDGGAGGNGGA

SEQ ID NO: 942456 - protein, 30 aa, Mycobacterium
AGGPDLAVWVQPPPVPQRPATRSGSGSGAS

SEQ ID NO: 942457 - protein, 27 aa, Mycobacterium
AGGPGGAGGWLWGGGGAGGLGGAASGA

SEQ ID NO: 942458 - protein, 22 aa, Mycobacterium
AGGPHAVYLLDAFNAAPDVSNW

SEQ ID NO: 942459 - protein, 25 aa, Mycobacterium
AGGRLFTEFITPGNFDIAQFAWGGD

SEQ ID NO: 942460 - protein, 26 aa, Mycobacterium
AGGSAILWWEQPNRLMRLDLADPTSA

SEQ ID NO: 942461 - protein, 32 aa, Mycobacterium
AGGSEVQWWFDLPWSHGFVRPQRPIEMIRSHF

SEQ ID NO: 942462 - protein, 34 aa, Mycobacterium
AGGSMAFAYLRLPSLLFGVGRYQVTMKLQDAASL

SEQ ID NO: 942463 - protein, 19 aa, Mycobacterium
AGGVLLRPFARLIASTGDS

SEQ ID NO: 942464 - protein, 20 aa, Mycobacterium
AGGVLLRPFARLISSTGDSV

SEQ ID NO: 942465 - protein, 19 aa, Mycobacterium
AGHGALFTRAPWVVSVDDH

SEQ ID NO: 942466 - protein, 26 aa, Mycobacterium
AGHGRSGFLLAPWTAKTIGAVLDGGE

SEQ ID NO: 942467 - protein, 22 aa, Mycobacterium
AGHLFQPLLYQCATGTLSIGHI

SEQ ID NO: 942468 - protein, 29 aa, Mycobacterium
AGHTQPALRPLVDLLPIAGGSGTLSNRYL

SEQ ID NO: 942469 - protein, 25 aa, Mycobacterium
AGIAGPALAFWLTEAGWEVTVIERA

SEQ ID NO: 942470 - protein, 25 aa, Mycobacterium
AGIAGPALAFWLTHSGYQVVVTELA

SEQ ID NO: 942471 - protein, 19 aa, Mycobacterium
AGIDKIEYSFFQSGSDVVS

SEQ ID NO: 942472 - protein, 24 aa, Mycobacterium
AGIERTLVAYLKSAGKTAQDTAFD

SEQ ID NO: 942473 - protein, 24 aa, Mycobacterium
AGIERTLVAYLKSAGKTAQDTSFD

SEQ ID NO: 942474 - protein, 24 aa, Mycobacterium
AGIERTLVSYLRLSGKIAQDTSFD

SEQ ID NO: 942475 - protein, 43 aa, Mycobacterium
AGIFNGMPQFSLAGLAYLLAPVAWLLGLRVVPMLAPGSADPNG

SEQ ID NO: 942476 - protein, 18 aa, Mycobacterium
AGIHYRDWITATLLSRLV

SEQ ID NO: 942477 - protein, 26 aa, Mycobacterium
AGIRIKVPGLPPVTVGPRTPAIYDPE

SEQ ID NO: 942478 - protein, 17 aa, Mycobacterium
AGKKRVFMPYAGGFGTY

SEQ ID NO: 942479 - protein, 20 aa, Mycobacterium
AGKLRAGSLIPLTSAGAYPS

SEQ ID NO: 942480 - protein, 24 aa, Mycobacterium
AGKPDYVHLWAGTGFRQATAEPAT

SEQ ID NO: 942481 - protein, 18 aa, Mycobacterium
AGKQILRKGLSPLVTTIS

SEQ ID NO: 942482 - protein, 25 aa, Mycobacterium
AGKSTRAGLLDWVRNYQGQGVAREY

SEQ ID NO: 942483 - protein, 24 aa, Mycobacterium
AGKSVDIYAVNYPASFDWVRAGDG

SEQ ID NO: 942484 - protein, 21 aa, Mycobacterium
AGKYAFFEPWKDQAKAIGQAV

SEQ ID NO: 942485 - protein, 23 aa, Mycobacterium
AGLCDFIDASPSPFHVCATVAAR

SEQ ID NO: 942486 - protein, 24 aa, Mycobacterium
AGLDPLAVIPPLAEPFVAAALDRA

SEQ ID NO: 942487 - protein, 24 aa, Mycobacterium
AGLEQLLVLLPQAVATIQAINVPN

SEQ ID NO: 942488 - protein, 23 aa, Mycobacterium
AGLGRNFLQQLGILKPDDTGITN

SEQ ID NO: 942489 - protein, 31 aa, Mycobacterium
AGLKSDPFVAIVAFPFIPQAMRGRYNQVEIK

SEQ ID NO: 942490 - protein, 26 aa, Mycobacterium
AGLLVPVHWGTFRLAPHPWSEPVERL

SEQ ID NO: 942491 - protein, 18 aa, Mycobacterium
AGLRRILTRELGFARLED

SEQ ID NO: 942492 - protein, 26 aa, Mycobacterium
AGMGAALLGFSLMGPSTGTAAADSPT

SEQ ID NO: 942493 - protein, 18 aa, Mycobacterium
AGMPLISDPGYRLVAACV

SEQ ID NO: 942494 - protein, 18 aa, Mycobacterium
AGMTVRVLPPYGVGLHCE

SEQ ID NO: 942495 - protein, 21 aa, Mycobacterium
AGMYAFSGILAALYRREITGE

SEQ ID NO: 942496 - protein, 17 aa, Mycobacterium
AGNGMLLPKSMTATPEA

SEQ ID NO: 942497 - protein, 24 aa, Mycobacterium
AGNPDNLLYKAFGPGTHVPIIDYT

SEQ ID NO: 942498 - protein, 26 aa, Mycobacterium
AGNSSGGAVFPYTSGLFNSGNGSSGV

SEQ ID NO: 942499 - protein, 26 aa, Mycobacterium
AGPDHGVFLLFVNQTTIVGAAAPAYT

SEQ ID NO: 942500 - protein, 29 aa, Mycobacterium
AGPDKPKLRPLLDVLPIAGGSGTLSERFV

SEQ ID NO: 942501 - protein, 29 aa, Mycobacterium
AGPDQPALRPLLDLLPIAGGSGTLGERFL

SEQ ID NO: 942502 - protein, 29 aa, Mycobacterium
AGPDQPSLRALLDLLPIAAGSGTLGDRFL

SEQ ID NO: 942503 - protein, 24 aa, Mycobacterium
AGPEILPFTQTWRRCDHSKFDYIG

SEQ ID NO: 942504 - protein, 27 aa, Mycobacterium
AGPGQNYYLWYDLGTKKFTVVSWDLNL

SEQ ID NO: 942505 - protein, 40 aa, Mycobacterium
AGPGSRVAILLPAHWQTAAALFGVWWIGAEAVLEPGGTDV

SEQ ID NO: 942506 - protein, 22 aa, Mycobacterium
AGPLTAQFYNEFDPPAAVLNWK

SEQ ID NO: 942507 - protein, 39 aa, Mycobacterium
AGPQSRVAILLPAHWQTAAVLFGVWWIGAEVVLDGAADV

SEQ ID NO: 942508 - protein, 17 aa, Mycobacterium
AGPRRSLAYDRAWWFAR

SEQ ID NO: 942509 - protein, 39 aa, Mycobacterium
AGPSTRVAVLLPAHWQTAAVLLGVWWIGAEVVLDGPADL

SEQ ID NO: 942510 - protein, 27 aa, Mycobacterium
AGPTPPPSTFAPGLPPGPPAPPGPGPQ

SEQ ID NO: 942511 - protein, 25 aa, Mycobacterium
AGQAYQFPMGLGLVSQFFGRYFTPD

SEQ ID NO: 942512 - protein, 20 aa, Mycobacterium
AGQLLTARPLTTVAALPSAD

SEQ ID NO: 942513 - protein, 24 aa, Mycobacterium
AGRAGRYTVVIRSTVLPWTCEQIV

SEQ ID NO: 942514 - protein, 23 aa, Mycobacterium
AGRALAIMHALDGALATVAPGAT

SEQ ID NO: 942515 - protein, 26 aa, Mycobacterium
AGRETRITWLSNEDQLWLLSREVGSA

SEQ ID NO: 942516 - protein, 18 aa, Mycobacterium
AGRHLFVYEPLRGYDLQP

SEQ ID NO: 942517 - protein, 17 aa, Mycobacterium
AGRIPRVYGRQASEYVI

SEQ ID NO: 942518 - protein, 28 aa, Mycobacterium
AGRIRSAGAIFVGAWSPVSLGDYCAGSN

SEQ ID NO: 942519 - protein, 19 aa, Mycobacterium
AGRLALQAWHTLGGIDVLV

SEQ ID NO: 942520 - protein, 19 aa, Mycobacterium
AGRLLMDGPVLTGSRVVGI

SEQ ID NO: 942521 - protein, 18 aa, Mycobacterium
AGRLMFYGQGAGGAPTAS

SEQ ID NO: 942522 - protein, 26 aa, Mycobacterium
AGRLSRLLVVATAGAALLASAPAFAD

SEQ ID NO: 942523 - protein, 24 aa, Mycobacterium
AGRMLAIMHALDGALADVAPGATA

SEQ ID NO: 942524 - protein, 24 aa, Mycobacterium
AGRMLAIMHALDGALATVAPGATA

SEQ ID NO: 942525 - protein, 23 aa, Mycobacterium
AGRMLAIMHALDGTLASVAPGAT

SEQ ID NO: 942526 - protein, 23 aa, Mycobacterium
AGRNELWIGFFRFREYPIRRERG

SEQ ID NO: 942527 - protein, 26 aa, Mycobacterium
AGRVAAEPMPLPAGAPHPGPLVYRYG

SEQ ID NO: 942528 - protein, 19 aa, Mycobacterium
AGRYLLYLDFKVDDTVHTA

SEQ ID NO: 942529 - protein, 25 aa, Mycobacterium
AGSAALTLAIYYPQQFQYAGSMSGF

SEQ ID NO: 942530 - protein, 25 aa, Mycobacterium
AGSAAWFLIRAVTAPDDTVLPRRHQ

SEQ ID NO: 942531 - protein, 19 aa, Mycobacterium
AGSALGALALGASLPACSG

SEQ ID NO: 942532 - protein, 27 aa, Mycobacterium
AGSAPATLLDYFPEDFLLVIDESHVTV

SEQ ID NO: 942533 - protein, 26 aa, Mycobacterium
AGSARYLPVILVHGTWGSTAREFAPT

SEQ ID NO: 942534 - protein, 22 aa, Mycobacterium
AGSIFKIFTVAAAMDMGMGINT

SEQ ID NO: 942535 - protein, 26 aa, Mycobacterium
AGSLLDLAGPYLPFDNPFTAAGMQYY

SEQ ID NO: 942536 - protein, 33 aa, Mycobacterium
AGSLTGYRAGLLASIAASCTASFTVALAGAGST

SEQ ID NO: 942537 - protein, 38 aa, Mycobacterium
AGSQVRVYVPFGTQWYGYFMRRLAERPANLGFFLRALV

SEQ ID NO: 942538 - protein, 23 aa, Mycobacterium
AGSSGPFRGGPGGPPRAAGVWGP

SEQ ID NO: 942539 - protein, 23 aa, Mycobacterium
AGTALATAGLSAALVLGPGAGTA

SEQ ID NO: 942540 - protein, 25 aa, Mycobacterium
AGTASFGMLLTGVLVAAPTAGAQTS

SEQ ID NO: 942541 - protein, 18 aa, Mycobacterium
AGTASLAGGGWLLRALHG

SEQ ID NO: 942542 - protein, 22 aa, Mycobacterium
AGTFTPGLLETFNSGFGNLGNQ

SEQ ID NO: 942543 - protein, 24 aa, Mycobacterium
AGTLDVPVLVHPAPRSVLGEAAAI

SEQ ID NO: 942544 - protein, 31 aa, Mycobacterium
AGTLQFGGLKRTYIVHTPPGAPVGLVLNLHG

SEQ ID NO: 942545 - protein, 24 aa, Mycobacterium
AGTPGPVAVLYLDLDRLKSINDYL

SEQ ID NO: 942546 - protein, 21 aa, Mycobacterium
AGTTGYILRGLFASYPELEQP

SEQ ID NO: 942547 - protein, 19 aa, Mycobacterium
AGVAFLPDARRILQLAEGA

SEQ ID NO: 942548 - protein, 20 aa, Mycobacterium
AGVAGTLGLLNGLLGGGQGG

SEQ ID NO: 942549 - protein, 19 aa, Mycobacterium
AGVAMLFTGAVTAAGPVGA

SEQ ID NO: 942550 - protein, 26 aa, Mycobacterium
AGVDRTFLYRYRDLLEKIHALQTDPV

SEQ ID NO: 942551 - protein, 18 aa, Mycobacterium
AGVFGAVAAVLAFSACGS

SEQ ID NO: 942552 - protein, 20 aa, Mycobacterium
AGVGCGYWRRPALTAARFVA

SEQ ID NO: 942553 - protein, 22 aa, Mycobacterium
AGVGYVLRVAAGPAFRIRLADC

SEQ ID NO: 942554 - protein, 19 aa, Mycobacterium
AGVISFRDPLLNEGDPDAG

SEQ ID NO: 942555 - protein, 17 aa, Mycobacterium
AGVLELLIVHPGGPFWA

SEQ ID NO: 942556 - protein, 17 aa, Mycobacterium
AGVRDLLDDACALLPCL

SEQ ID NO: 942557 - protein, 17 aa, Mycobacterium
AGVRTPALFGPLGVDFA

SEQ ID NO: 942558 - protein, 20 aa, Mycobacterium
AGVVPLRLMTPPSSSVAELC

SEQ ID NO: 942559 - protein, 20 aa, Mycobacterium
AGVWRAYADHRMAMAGAIVG

SEQ ID NO: 942560 - protein, 28 aa, Mycobacterium
AGWQGDYPSMIEFLAPLFATGAGSNDVG

SEQ ID NO: 942561 - protein, 31 aa, Mycobacterium
AGYLRRETELYRLLQTAQRLLGTAALEELLG

SEQ ID NO: 942562 - protein, 26 aa, Mycobacterium
AGYQEHTFTWDTALRVRAELTALGVR

SEQ ID NO: 942563 - protein, 26 aa, Mycobacterium
AGYQIGCGISLAWVKLNGGANITPAI

SEQ ID NO: 942564 - protein, 17 aa, Mycobacterium
AGYVPLPDKVKERLVAA

SEQ ID NO: 942565 - protein, 20 aa, Mycobacterium
AHAQAYQSLSAQAALFHEQF

SEQ ID NO: 942566 - protein, 25 aa, Mycobacterium
AHCLAGAAKITFVPGFSGDAPPAPG

SEQ ID NO: 942567 - protein, 17 aa, Mycobacterium
AHDDEVRGRLTFSWGVE

SEQ ID NO: 942568 - protein, 18 aa, Mycobacterium
AHDVPMYADALQAFLELP

SEQ ID NO: 942569 - protein, 26 aa, Mycobacterium
AHGATIMFWVMMNVDNPDLLLMLRHQ

SEQ ID NO: 942570 - protein, 18 aa, Mycobacterium
AHKGLMNIALAISAQQVN

SEQ ID NO: 942571 - protein, 18 aa, Mycobacterium
AHLTMPYVSPADGEVVGV

SEQ ID NO: 942572 - protein, 24 aa, Mycobacterium
AHPQTWFKSFNWDVAKKAPITFDT

SEQ ID NO: 942573 - protein, 19 aa, Mycobacterium
AHPRFRFFGNIEVGAKITA

SEQ ID NO: 942574 - protein, 25 aa, Mycobacterium
AHPTKVARLVLDSPLPLGVSAEAAT

SEQ ID NO: 942575 - protein, 19 aa, Mycobacterium
AHSHQPLRWGPADAPGRYL

SEQ ID NO: 942576 - protein, 24 aa, Mycobacterium
AHVAPKLFLPNLSGLTQGPGFPNL

SEQ ID NO: 942577 - protein, 18 aa, Mycobacterium
AHVDLYFEAAVAGAIPVI

SEQ ID NO: 942578 - protein, 27 aa, Mycobacterium
AIAEPAAWFTYYYWLDDTRAPEFAPCV

SEQ ID NO: 942579 - protein, 17 aa, Mycobacterium
AIAPRGYAQGSGKIRRL

SEQ ID NO: 942580 - protein, 19 aa, Mycobacterium
AIASATALGLGLTACGAGD

SEQ ID NO: 942581 - protein, 19 aa, Mycobacterium
AIASFADLAGPGVQLVVCA

SEQ ID NO: 942582 - protein, 23 aa, Mycobacterium
AIASVVKLFIADDLLLQEAKGQT

SEQ ID NO: 942583 - protein, 25 aa, Mycobacterium
AIDDLTRMVLLNAAYLKASWESPFP

SEQ ID NO: 942584 - protein, 32 aa, Mycobacterium
AIDNGLPLFPENAQIGLWAFSIDKGGPGQDWK

SEQ ID NO: 942585 - protein, 18 aa, Mycobacterium
AIDVGHLVQLMGLARGQV

SEQ ID NO: 942586 - protein, 20 aa, Mycobacterium
AIEQFVYAYIHACPGHTLDY

SEQ ID NO: 942587 - protein, 18 aa, Mycobacterium
AIERTLAGYLNLAGKRPA

SEQ ID NO: 942588 - protein, 18 aa, Mycobacterium
AIFAVAAALLSACGSNDS

SEQ ID NO: 942589 - protein, 25 aa, Mycobacterium
AIGAAVRGPWFSADGQWYYPDMKTH

SEQ ID NO: 942590 - protein, 26 aa, Mycobacterium
AIGAPLPQDPPPPPPAPGTLPTAEQL

SEQ ID NO: 942591 - protein, 32 aa, Mycobacterium
AIGDAPLDDWAWTLGINLWGPIHGCHVFTPIL

SEQ ID NO: 942592 - protein, 28 aa, Mycobacterium
AIGLLKPLDISGLYEPGPLNKVLAEPAS

SEQ ID NO: 942593 - protein, 21 aa, Mycobacterium
AIGRLLFEAGAAEVLTGLPGA

SEQ ID NO: 942594 - protein, 19 aa, Mycobacterium
AIGRWKALIVASGAVEMIE

SEQ ID NO: 942595 - protein, 18 aa, Mycobacterium
AIGWLLTPAAAQADPHNP

SEQ ID NO: 942596 - protein, 19 aa, Mycobacterium
AIHEMFASTLTISSGSYAA

SEQ ID NO: 942597 - protein, 26 aa, Mycobacterium
AIHFQEWWVRYRAELPTHSFVFIGTE

SEQ ID NO: 942598 - protein, 19 aa, Mycobacterium
AIIIAVLIVINSRGDNQPQ

SEQ ID NO: 942599 - protein, 31 aa, Mycobacterium
AIITRGLAEIMRLGIALGAKPATLAGLAGIG

SEQ ID NO: 942600 - protein, 21 aa, Mycobacterium
AILIALITWGIVALFTGGQGG

SEQ ID NO: 942601 - protein, 38 aa, Mycobacterium
AILIPGATVLKPINPFYPLIALNYPKIGIHFHEDGQPL

SEQ ID NO: 942602 - protein, 18 aa, Mycobacterium
AILLVAGAVFLVRQVFFG

SEQ ID NO: 942603 - protein, 26 aa, Mycobacterium
AILMATNFFGINTVPIAFNEMDYFIR

SEQ ID NO: 942604 - protein, 21 aa, Mycobacterium
AILVLFAALLAFRPDPADDRA

SEQ ID NO: 942605 - protein, 28 aa, Mycobacterium
AINHAIADGTYRKVLQRWGLEDEAVAKS

SEQ ID NO: 942606 - protein, 25 aa, Mycobacterium
AINRPTPFMVPGFAVRAALGEFADE

SEQ ID NO: 942607 - protein, 17 aa, Mycobacterium
AIPAAHWRLGDACEITM

SEQ ID NO: 942608 - protein, 23 aa, Mycobacterium
AIPALMLTFLPSPTSAAASNTAT

SEQ ID NO: 942609 - protein, 19 aa, Mycobacterium
AIPAVTLDYRTYSALGWTI

SEQ ID NO: 942610 - protein, 19 aa, Mycobacterium
AIPFVGKPIADLVQPNLRY

SEQ ID NO: 942611 - protein, 19 aa, Mycobacterium
AIPLVLTRRTVSASSYMVA

SEQ ID NO: 942612 - protein, 24 aa, Mycobacterium
AIQGIPSIVMKPPDQPGACGVASD

SEQ ID NO: 942613 - protein, 23 aa, Mycobacterium
AIQNASLFTITPLAVSPGEVTDI

SEQ ID NO: 942614 - protein, 26 aa, Mycobacterium
AIQVPRLRRTLAWHIVRRPGGTIAGA

SEQ ID NO: 942615 - protein, 17 aa, Mycobacterium
AIRAARAYLPDRISRVV

SEQ ID NO: 942616 - protein, 19 aa, Mycobacterium
AIRCVDAVFPTDPAVWADA

SEQ ID NO: 942617 - protein, 37 aa, Mycobacterium
AIRITSNPPVPGRFYWVTDTQLRWRPQDFWPSNTVVN

SEQ ID NO: 942618 - protein, 25 aa, Mycobacterium
AIRNTFFRPKTITAYFTTATAIYPG

SEQ ID NO: 942619 - protein, 24 aa, Mycobacterium
AIRRLGEILLDGPPTAMVATDTRA

SEQ ID NO: 942620 - protein, 17 aa, Mycobacterium
AIRWRDGTWVRRPSVRR

SEQ ID NO: 942621 - protein, 17 aa, Mycobacterium
AISAALIIVSACTSVVE

SEQ ID NO: 942622 - protein, 18 aa, Mycobacterium
AISHLPHLLAEALAVTAS

SEQ ID NO: 942623 - protein, 19 aa, Mycobacterium
AISKALVTFTPLIGGVRPG

SEQ ID NO: 942624 - protein, 27 aa, Mycobacterium
AISSGPFFKVVLHNLAPYQILQPWVDA

SEQ ID NO: 942625 - protein, 25 aa, Mycobacterium
AITDDQLIFYFAPGEMLPAFSGPVQ

SEQ ID NO: 942626 - protein, 26 aa, Mycobacterium
AITGGLVRLGEPLLRPLRTALSAESP

SEQ ID NO: 942627 - protein, 20 aa, Mycobacterium
AITPLAEPYLLEGFDRAAWA

SEQ ID NO: 942628 - protein, 18 aa, Mycobacterium
AITQALRKIPPALDVLIS

SEQ ID NO: 942629 - protein, 22 aa, Mycobacterium
AITRKPVLTLYPERAPEVGIPA

SEQ ID NO: 942630 - protein, 18 aa, Mycobacterium
AIVAFALGVDLLNVAREA

SEQ ID NO: 942631 - protein, 18 aa, Mycobacterium
AIVAVPRPGTPVQWLPCN

SEQ ID NO: 942632 - protein, 18 aa, Mycobacterium
AIVNILRTLLSNPAVWEK

SEQ ID NO: 942633 - protein, 20 aa, Mycobacterium
AIVTRLWRRPVPVVGGPVAI

SEQ ID NO: 942634 - protein, 17 aa, Mycobacterium
AIWLIIGAIAVAQRGYF

SEQ ID NO: 942635 - protein, 21 aa, Mycobacterium
AIYDAWASLSYERGPLGLPTS

SEQ ID NO: 942636 - protein, 23 aa, Mycobacterium
AIYQRWQELGAMNSVLGAPTSPE

SEQ ID NO: 942637 - protein, 26 aa, Mycobacterium
AIYVYAPDLIPRLKDQAARQLPGQPA

SEQ ID NO: 942638 - protein, 19 aa, Mycobacterium
AKAAILASIAFHTKVSADD

SEQ ID NO: 942639 - protein, 27 aa, Mycobacterium
AKAVARWLVLSLRRPGGQAQFAAPIWT

SEQ ID NO: 942640 - protein, 27 aa, Mycobacterium
AKAWDHGRFDAPYLRDALIDAGAVVET

SEQ ID NO: 942641 - protein, 25 aa, Mycobacterium
AKDGPNWMFEALAQRVRFGELRYRL

SEQ ID NO: 942642 - protein, 24 aa, Mycobacterium
AKFNRKIIELNLIGALSVSQHAND

SEQ ID NO: 942643 - protein, 21 aa, Mycobacterium
AKGIPLVPVNAALDSKDIAGN

SEQ ID NO: 942644 - protein, 20 aa, Mycobacterium
AKGQWLLFLGADDTLYEAET

SEQ ID NO: 942645 - protein, 18 aa, Mycobacterium
AKKVVVFAAASLKPAFTQ

SEQ ID NO: 942646 - protein, 21 aa, Mycobacterium
AKLAVVTLCAMLAAVAVAPPA

SEQ ID NO: 942647 - protein, 23 aa, Mycobacterium
AKLGLERQWLHAKSLAFAHPGDG

SEQ ID NO: 942648 - protein, 22 aa, Mycobacterium
AKLLAGVYVAALRSYGFAAHAE

SEQ ID NO: 942649 - protein, 22 aa, Mycobacterium
AKNSAMAYCKTLGNEKSKIKEA

SEQ ID NO: 942650 - protein, 20 aa, Mycobacterium
AKPVLFRSWAALAEAFMARQ

SEQ ID NO: 942651 - protein, 24 aa, Mycobacterium
AKRARIPLIWHVHDRISAEYFGAA

SEQ ID NO: 942652 - protein, 22 aa, Mycobacterium
AKRRGFVFPSGEIYGGTRSAWD

SEQ ID NO: 942653 - protein, 26 aa, Mycobacterium
AKSGDDWLITWSPTVLHRDLTPDLRF

SEQ ID NO: 942654 - protein, 18 aa, Mycobacterium
AKSLPLLEPTYLAVDVIN

SEQ ID NO: 942655 - protein, 23 aa, Mycobacterium
AKVFAGCAIALGAALAGCGTNND

SEQ ID NO: 942656 - protein, 19 aa, Mycobacterium
AKVLIPLKPIYQRKGIVFH

SEQ ID NO: 942657 - protein, 26 aa, Mycobacterium
AKVRRGLLGLLDVGLLAAVAAGNENS

SEQ ID NO: 942658 - protein, 19 aa, Mycobacterium
AKVWALYDVTHQPAFAFLG

SEQ ID NO: 942659 - protein, 19 aa, Mycobacterium
AKVWAPARSWAYYAPQPDG

SEQ ID NO: 942660 - protein, 31 aa, Mycobacterium
AKVYSLPINAPVRVIPQRPAPAPPQSAALML

SEQ ID NO: 942661 - protein, 17 aa, Mycobacterium
AKWKDLLSQISAAEAQY

SEQ ID NO: 942662 - protein, 36 aa, Mycobacterium
AKWTQLQALQRTPWRCFFDFRNKNNVLFGAYLCQYG

SEQ ID NO: 942663 - protein, 20 aa, Mycobacterium
ALAAAALMALSPAVAGCSNS

SEQ ID NO: 942664 - protein, 24 aa, Mycobacterium
ALAADQLLLALRDALRGKIARPRV

SEQ ID NO: 942665 - protein, 20 aa, Mycobacterium
ALAAGLSLGLASQADASVGG

SEQ ID NO: 942666 - protein, 17 aa, Mycobacterium
ALAAICAAVVAGCTVAT

SEQ ID NO: 942667 - protein, 24 aa, Mycobacterium
ALAANLGLKPEFVQSAFAAVIPTL

SEQ ID NO: 942668 - protein, 19 aa, Mycobacterium
ALAARHKLAEHENPGEATL

SEQ ID NO: 942669 - protein, 19 aa, Mycobacterium
ALADVLDVGLRSSYVASWY

SEQ ID NO: 942670 - protein, 21 aa, Mycobacterium
ALAGALAMGPMVLSPATAAAD

SEQ ID NO: 942671 - protein, 25 aa, Mycobacterium
ALAGLPLTPMSLADSALVLIDCQNT

SEQ ID NO: 942672 - protein, 33 aa, Mycobacterium
ALAGVLRTFLSNTWHPLRVNLRRPKPSAPAMHH

SEQ ID NO: 942673 - protein, 23 aa, Mycobacterium
ALAGWAAGWVAAATAPIAPVAEA

SEQ ID NO: 942674 - protein, 21 aa, Mycobacterium
ALAKAPWRKATVVATAWGIRV

SEQ ID NO: 942675 - protein, 25 aa, Mycobacterium
ALAKLLDQPFQPYPHYSEFGGGDKL

SEQ ID NO: 942676 - protein, 20 aa, Mycobacterium
ALALLALSALTAGCTVTTEG

SEQ ID NO: 942677 - protein, 22 aa, Mycobacterium
ALALSSARLLVSGSAPLPVPVF

SEQ ID NO: 942678 - protein, 18 aa, Mycobacterium
ALALTVTLAGCGLRSASG

SEQ ID NO: 942679 - protein, 23 aa, Mycobacterium
ALAQQYFADPFPITGAILRNQGV

SEQ ID NO: 942680 - protein, 26 aa, Mycobacterium
ALASGKLPRISAWVLAGTLVPATLTD

SEQ ID NO: 942681 - protein, 18 aa, Mycobacterium
ALATGSVITVAGLLLAGC

SEQ ID NO: 942682 - protein, 23 aa, Mycobacterium
ALAVALTAPWLFPGTANAEPVAY

SEQ ID NO: 942683 - protein, 20 aa, Mycobacterium
ALAVLTAALVVGACGGSPQA

SEQ ID NO: 942684 - protein, 20 aa, Mycobacterium
ALAVVSLIEGALMLSRVAGD

SEQ ID NO: 942685 - protein, 21 aa, Mycobacterium
ALDEAATLLDRARTAGIAVVH

SEQ ID NO: 942686 - protein, 30 aa, Mycobacterium
ALDGNPVPRPAAVPVLWLGAGERVSALVTM

SEQ ID NO: 942687 - protein, 34 aa, Mycobacterium
ALDHGVWLRPFRNLVYAMPPYICPPAEIAQITSA

SEQ ID NO: 942688 - protein, 21 aa, Mycobacterium
ALDHSGLFRTIAKLSGASTEP

SEQ ID NO: 942689 - protein, 26 aa, Mycobacterium
ALDKGALTAFLSWLESRPSPRARRRS

SEQ ID NO: 942690 - protein, 34 aa, Mycobacterium
ALDKRPSQMPLINTLKSVIATQTQFLKAAQKPQQ

SEQ ID NO: 942691 - protein, 23 aa, Mycobacterium
ALDPIVFPALRRTDVRQPVFVVG

SEQ ID NO: 942692 - protein, 20 aa, Mycobacterium
ALDPKWVQWYNPNLGGLDLS

SEQ ID NO: 942693 - protein, 25 aa, Mycobacterium
ALDQGALTAFLSWLESRPSPRAQKR

SEQ ID NO: 942694 - protein, 19 aa, Mycobacterium
ALDRVSAFQMGFLSGTPAC

SEQ ID NO: 942695 - protein, 25 aa, Mycobacterium
ALEAVAALLPRTPGLHLDIVGDGWW

SEQ ID NO: 942696 - protein, 19 aa, Mycobacterium
ALEDVSIPTLLLSLVHITG

SEQ ID NO: 942697 - protein, 20 aa, Mycobacterium
ALEEGLLPVLPQLSAKHHVV

SEQ ID NO: 942698 - protein, 19 aa, Mycobacterium
ALEGRWPSVVWHLGEEPEA

SEQ ID NO: 942699 - protein, 23 aa, Mycobacterium
ALEKELALPLLVRERGGVSLTEA

SEQ ID NO: 942700 - protein, 23 aa, Mycobacterium
ALERGGLRLTRRSPLATAARRVL

SEQ ID NO: 942701 - protein, 22 aa, Mycobacterium
ALFIAMMTFAPAFAGADPADPD

SEQ ID NO: 942702 - protein, 19 aa, Mycobacterium
ALFILKLRASDIPDEAAGT

SEQ ID NO: 942703 - protein, 19 aa, Mycobacterium
ALFLAPAERVHVWVFALLR

SEQ ID NO: 942704 - protein, 17 aa, Mycobacterium
ALFLIDKAGATDAVILG

SEQ ID NO: 942705 - protein, 17 aa, Mycobacterium
ALFTPEQFWPVTPQLGN

SEQ ID NO: 942706 - protein, 19 aa, Mycobacterium
ALGADTWHWHPMASFASSS

SEQ ID NO: 942707 - protein, 25 aa, Mycobacterium
ALGAPGMEVWKFTALRPGTTTIGTS

SEQ ID NO: 942708 - protein, 19 aa, Mycobacterium
ALGERFMPGLGLDGPSYGE

SEQ ID NO: 942709 - protein, 24 aa, Mycobacterium
ALGGWQMLAKNRQLPPVAGPALVA

SEQ ID NO: 942710 - protein, 26 aa, Mycobacterium
ALGNIDGVSLGYTPGVPGGSAEATKD

SEQ ID NO: 942711 - protein, 19 aa, Mycobacterium
ALGVFQTLPKRVHERFDLV

SEQ ID NO: 942712 - protein, 40 aa, Mycobacterium
ALGVVPIAVTRWFGDQPFAVWPWAQPKLGAAQPVVLSLDD

SEQ ID NO: 942713 - protein, 20 aa, Mycobacterium
ALGYGVLAKSFFRFDRRGWT

SEQ ID NO: 942714 - protein, 17 aa, Mycobacterium
ALGYLEPDPLPAGGVSL

SEQ ID NO: 942715 - protein, 25 aa, Mycobacterium
ALHRLRGMFAFAIWDTEKRELFCAR

SEQ ID NO: 942716 - protein, 18 aa, Mycobacterium
ALHVTLLALMVAIPGLAI

SEQ ID NO: 942717 - protein, 17 aa, Mycobacterium
ALIAGLAIITSGAAAGC

SEQ ID NO: 942718 - protein, 32 aa, Mycobacterium
ALIAGRWQLIAFAAPLLGVLCSIYWQRPVPTV

SEQ ID NO: 942719 - protein, 24 aa, Mycobacterium
ALIGHLYAAALRYYGSPAEVVETD

SEQ ID NO: 942720 - protein, 17 aa, Mycobacterium
ALIIHQTADNLTGSATG

SEQ ID NO: 942721 - protein, 21 aa, Mycobacterium
ALILAAFHPAQFRFAGSLSGF

SEQ ID NO: 942722 - protein, 28 aa, Mycobacterium
ALIVLAVPMPALPLMLRHVRAVAPACAL

SEQ ID NO: 942723 - protein, 21 aa, Mycobacterium
ALIVLAVPMPALPNMLAHIRE

SEQ ID NO: 942724 - protein, 20 aa, Mycobacterium
ALIVVTLAAALGLGLLLLSP

SEQ ID NO: 942725 - protein, 26 aa, Mycobacterium
ALKVLAGTGFAAVALLAGCSGVVNLG

SEQ ID NO: 942726 - protein, 17 aa, Mycobacterium
ALLAALAMAMTLSGCGR

SEQ ID NO: 942727 - protein, 24 aa, Mycobacterium
ALLAASVVFMAFVAAAPPMAYDGE

SEQ ID NO: 942728 - protein, 17 aa, Mycobacterium
ALLAEMIGLSRSGIALL

SEQ ID NO: 942729 - protein, 19 aa, Mycobacterium
ALLALTQRPLTTPDVPGGA

SEQ ID NO: 942730 - protein, 19 aa, Mycobacterium
ALLALVAMVGLAAPAHADP

SEQ ID NO: 942731 - protein, 18 aa, Mycobacterium
ALLAVTVLAAGGCSQVID

SEQ ID NO: 942732 - protein, 18 aa, Mycobacterium
ALLGLRAVEAKSALEHAR

SEQ ID NO: 942733 - protein, 18 aa, Mycobacterium
ALLINRDLLAIDQDSLRA

SEQ ID NO: 942734 - protein, 19 aa, Mycobacterium
ALLLAGALAAPVAGCSSGA

SEQ ID NO: 942735 - protein, 18 aa, Mycobacterium
ALLLARVRRDLTPLDVVH

SEQ ID NO: 942736 - protein, 19 aa, Mycobacterium
ALLLLTQRPMSSGPQQAMS

SEQ ID NO: 942737 - protein, 20 aa, Mycobacterium
ALLPTLGGAYYTSAAVFAAE

SEQ ID NO: 942738 - protein, 22 aa, Mycobacterium
ALLRAFCLAALAVGLAFVSPAV

SEQ ID NO: 942739 - protein, 17 aa, Mycobacterium
ALLVSALTVLAGLTAPH

SEQ ID NO: 942740 - protein, 24 aa, Mycobacterium
ALMLSNAFLIERELLRIDKPRMGN

SEQ ID NO: 942741 - protein, 25 aa, Mycobacterium
ALMPLWLGAIALSLAIPAVAAAAPA

SEQ ID NO: 942742 - protein, 18 aa, Mycobacterium
ALNDLWIRDSGPVYVHNE

SEQ ID NO: 942743 - protein, 17 aa, Mycobacterium
ALNLVKCVHWPSGSTTD

SEQ ID NO: 942744 - protein, 17 aa, Mycobacterium
ALNQWTTAIGSSVFVIL

SEQ ID NO: 942745 - protein, 19 aa, Mycobacterium
ALNREMVTLMADEWGKLHS

SEQ ID NO: 942746 - protein, 28 aa, Mycobacterium
ALPAPTYHWCPGEFWNPIWGFNWEFGEC

SEQ ID NO: 942747 - protein, 24 aa, Mycobacterium
ALPNPYDALWDPRYKNKTAIIDDW

SEQ ID NO: 942748 - protein, 23 aa, Mycobacterium
ALPRRALLLAMATCVPLAGCARS

SEQ ID NO: 942749 - protein, 19 aa, Mycobacterium
ALPRRPQFALLKGRGNYLC

SEQ ID NO: 942750 - protein, 18 aa, Mycobacterium
ALPRWALANAATAEMSGD

SEQ ID NO: 942751 - protein, 30 aa, Mycobacterium
ALPSAPTYHWCPGEFWNPIWGFNMNWGECH

SEQ ID NO: 942752 - protein, 18 aa, Mycobacterium
ALPVGTLATGVAAADDYA

SEQ ID NO: 942753 - protein, 19 aa, Mycobacterium
ALQAWHTLGGIDVLVNNAA

SEQ ID NO: 942754 - protein, 26 aa, Mycobacterium
ALQDFFGRLSGFWDWYKANPDEVTQT

SEQ ID NO: 942755 - protein, 17 aa, Mycobacterium
ALQLALGPKFKARLTHW

SEQ ID NO: 942756 - protein, 17 aa, Mycobacterium
ALQLSPDGNVWGATVNK

SEQ ID NO: 942757 - protein, 18 aa, Mycobacterium
ALQNSLGLRWAATGLFEG

SEQ ID NO: 942758 - protein, 17 aa, Mycobacterium
ALRALPNRTLDATFTTH

SEQ ID NO: 942759 - protein, 19 aa, Mycobacterium
ALRAQISPHFIYNALNTIA

SEQ ID NO: 942760 - protein, 17 aa, Mycobacterium
ALRAVLTSLARPGRRLA

SEQ ID NO: 942761 - protein, 24 aa, Mycobacterium
ALRDKGFEVLTPQFDRLYAVSPGK

SEQ ID NO: 942762 - protein, 26 aa, Mycobacterium
ALRDNGYLPMSFVARDIAWSDKTPSN

SEQ ID NO: 942763 - protein, 20 aa, Mycobacterium
ALRGARTMFLFIFRDEHDGA

SEQ ID NO: 942764 - protein, 29 aa, Mycobacterium
ALRNTFFRPTTITAYFPTATAIYPGDDVR

SEQ ID NO: 942765 - protein, 28 aa, Mycobacterium
ALRPQGHLLVFWDCYRPHDVQVKMFELV

SEQ ID NO: 942766 - protein, 28 aa, Mycobacterium
ALRPQGHLLVFWDCYRPHDVQVKMFSLV

SEQ ID NO: 942767 - protein, 19 aa, Mycobacterium
ALRRLFVIGCCVMLAVTGC

SEQ ID NO: 942768 - protein, 19 aa, Mycobacterium
ALRVKDFGKRDVMMVHTLL

SEQ ID NO: 942769 - protein, 22 aa, Mycobacterium
ALRVKVVTDKLLFDNQLIKEVC

SEQ ID NO: 942770 - protein, 18 aa, Mycobacterium
ALRWHDGTWLRHPAAERI

SEQ ID NO: 942771 - protein, 20 aa, Mycobacterium
ALRYTTALAGLGAASAACGM

SEQ ID NO: 942772 - protein, 17 aa, Mycobacterium
ALSLVLNGGGLGQVQDI

SEQ ID NO: 942773 - protein, 20 aa, Mycobacterium
ALSMLAAGTLLLSACGSDNN

SEQ ID NO: 942774 - protein, 20 aa, Mycobacterium
ALSVLASGALVLSACGSDNN

SEQ ID NO: 942775 - protein, 20 aa, Mycobacterium
ALSVVAAVALALAGCGDNNS

SEQ ID NO: 942776 - protein, 32 aa, Mycobacterium
ALSYQQVAARMAAFHDQFVAALHSGAGAYLTA

SEQ ID NO: 942777 - protein, 17 aa, Mycobacterium
ALTEAAYDQLWAQDVAA

SEQ ID NO: 942778 - protein, 18 aa, Mycobacterium
ALTEVWEHRLPKGVVGII

SEQ ID NO: 942779 - protein, 19 aa, Mycobacterium
ALTGAWFLARALRDHPGDL

SEQ ID NO: 942780 - protein, 17 aa, Mycobacterium
ALTGLLVISSTACSGGR

SEQ ID NO: 942781 - protein, 17 aa, Mycobacterium
ALTLPAAACGPKTPDYQ

SEQ ID NO: 942782 - protein, 20 aa, Mycobacterium
ALTPLLPTAAAAPSNIAGMV

SEQ ID NO: 942783 - protein, 31 aa, Mycobacterium
ALTVFMAVALALTWLVYATLRRDVAGGTTSY

SEQ ID NO: 942784 - protein, 26 aa, Mycobacterium
ALTYGRTHLLRLVAIKRLQGQGLSLG

SEQ ID NO: 942785 - protein, 20 aa, Mycobacterium
ALVAKGRFPFYFDYSSEVVG

SEQ ID NO: 942786 - protein, 21 aa, Mycobacterium
ALVAKLLVGAAIAVGFGASAA

SEQ ID NO: 942787 - protein, 18 aa, Mycobacterium
ALVALPARSAHEVAAASL

SEQ ID NO: 942788 - protein, 25 aa, Mycobacterium
ALVARIRTYFGAVPVIVTPVIFGED

SEQ ID NO: 942789 - protein, 20 aa, Mycobacterium
ALVASALRAVKAAAAPGVST

SEQ ID NO: 942790 - protein, 19 aa, Mycobacterium
ALVAVVAVIALCVAMCGSN

SEQ ID NO: 942791 - protein, 23 aa, Mycobacterium
ALVDGELGAPFAWPLVANAARSP

SEQ ID NO: 942792 - protein, 18 aa, Mycobacterium
ALVITEWCQLPEGTSPRS

SEQ ID NO: 942793 - protein, 22 aa, Mycobacterium
ALVLAAYYPQQFPYAASLSGFL

SEQ ID NO: 942794 - protein, 24 aa, Mycobacterium
ALVNGPFLELTGRPLIGNGADGYT

SEQ ID NO: 942795 - protein, 22 aa, Mycobacterium
ALVNHVLPYNQLFGPNVFGTAE

SEQ ID NO: 942796 - protein, 20 aa, Mycobacterium
ALVPLFFIAREARKHVKVVL

SEQ ID NO: 942797 - protein, 19 aa, Mycobacterium
ALVTLMRGIHLIVPGPDEA

SEQ ID NO: 942798 - protein, 21 aa, Mycobacterium
ALVVLERIPVPVLATGDDGSI

SEQ ID NO: 942799 - protein, 19 aa, Mycobacterium
ALYADPFRQWTPQELLAQI

SEQ ID NO: 942800 - protein, 23 aa, Mycobacterium
AMAGCDVVYYCVVDARMCLRDPA

SEQ ID NO: 942801 - protein, 20 aa, Mycobacterium
AMGLLAAGAVVVGCSNDKPA

SEQ ID NO: 942802 - protein, 22 aa, Mycobacterium
AMGPMQFIPETWRIYGVRAAGD

SEQ ID NO: 942803 - protein, 24 aa, Mycobacterium
AMGSAVAPYLAWATATGAQAEQAA

SEQ ID NO: 942804 - protein, 19 aa, Mycobacterium
AMHDMFVNTLGASAGTYGA

SEQ ID NO: 942805 - protein, 23 aa, Mycobacterium
AMHLSNFTTQVWTFTAGPTSAAD

SEQ ID NO: 942806 - protein, 24 aa, Mycobacterium
AMKPDLLRVLGVGAPAPAAPAAPA

SEQ ID NO: 942807 - protein, 22 aa, Mycobacterium
AMLAIAVGVASACGLAGCFGTG

SEQ ID NO: 942808 - protein, 17 aa, Mycobacterium
AMLLAASPIGLSAPRAV

SEQ ID NO: 942809 - protein, 17 aa, Mycobacterium
AMLPLAGPTAPVTVPLV

SEQ ID NO: 942810 - protein, 18 aa, Mycobacterium
AMMSGRVDGLIGFAHDQG

SEQ ID NO: 942811 - protein, 19 aa, Mycobacterium
AMPAERMIRYYTARGLLPR

SEQ ID NO: 942812 - protein, 28 aa, Mycobacterium
AMPASAEYLAILRRCGIAAVLSGAGPSV

SEQ ID NO: 942813 - protein, 30 aa, Mycobacterium
AMPVADDRFYFFFDVVEPEGLPFEKGTARE

SEQ ID NO: 942814 - protein, 32 aa, Mycobacterium
AMQCKWIPNQWPPVSTGFWTYSYPLHGVQDIG

SEQ ID NO: 942815 - protein, 31 aa, Mycobacterium
AMQPQRGYKIFEEWANWLFAAGGSIYDKDGN

SEQ ID NO: 942816 - protein, 33 aa, Mycobacterium
AMQPQRGYKIFEEWGNWLFAAGGSIYDADGKIT

SEQ ID NO: 942817 - protein, 24 aa, Mycobacterium
AMQTIACLLLLAGSAYLYTIVPQR

SEQ ID NO: 942818 - protein, 23 aa, Mycobacterium
AMRALRRTFFNQAPTVDPVQIEG

SEQ ID NO: 942819 - protein, 20 aa, Mycobacterium
AMRSGFYGYGFNVGTTSAAR

SEQ ID NO: 942820 - protein, 23 aa, Mycobacterium
AMRSYVQAPMRYGRLFLAGDAAH

SEQ ID NO: 942821 - protein, 19 aa, Mycobacterium
AMRTVFSELAKRFQIDHPG

SEQ ID NO: 942822 - protein, 26 aa, Mycobacterium
AMSALLVIHLLPWPRTFSTKHCPRTT

SEQ ID NO: 942823 - protein, 24 aa, Mycobacterium
AMTVPPIVVAANRALLVALVASNF

SEQ ID NO: 942824 - protein, 25 aa, Mycobacterium
AMTVPPPVITANRTLLAALVASNIV

SEQ ID NO: 942825 - protein, 21 aa, Mycobacterium
AMTVPPPVVAANRSLLAALVA

SEQ ID NO: 942826 - protein, 25 aa, Mycobacterium
AMVDALNVVFKPKNPPRLSFAARDA

SEQ ID NO: 942827 - protein, 20 aa, Mycobacterium
AMVELMLFDAQNPRSLLYQL

SEQ ID NO: 942828 - protein, 17 aa, Mycobacterium
AMVFGYRAGYAAATGKS

SEQ ID NO: 942829 - protein, 18 aa, Mycobacterium
AMVLYPTADSWQRGDRTV

SEQ ID NO: 942830 - protein, 23 aa, Mycobacterium
AMVNALRILLSNPAVWEKTALII

SEQ ID NO: 942831 - protein, 28 aa, Mycobacterium
AMYGDYFSFYLCDLILKLNGKGGQPVYV

SEQ ID NO: 942832 - protein, 21 aa, Mycobacterium
ANAAAAVPTTGLLAAADDEVS

SEQ ID NO: 942833 - protein, 36 aa, Mycobacterium
ANAFAGSPAVWLPDLGRVLGLFVLTAIPGYSYTDSL

SEQ ID NO: 942834 - protein, 31 aa, Mycobacterium
ANAGWKRYPLGLAAPLIRAFLRSKSAYKNYP

SEQ ID NO: 942835 - protein, 17 aa, Mycobacterium
ANAITVALGFPSGGRVN

SEQ ID NO: 942836 - protein, 25 aa, Mycobacterium
ANALRTPVWYYDIGDDRLSGPVTGS

SEQ ID NO: 942837 - protein, 24 aa, Mycobacterium
ANCGPLVWTTYGAALAEPIGVIHW

SEQ ID NO: 942838 - protein, 19 aa, Mycobacterium
ANDAVLLGCPGTDAANSAA

SEQ ID NO: 942839 - protein, 23 aa, Mycobacterium
ANDGIAMRPYLVESLKGPDLATI

SEQ ID NO: 942840 - protein, 24 aa, Mycobacterium
ANDNPDLFWALRGGGGGNFGVTTS

SEQ ID NO: 942841 - protein, 23 aa, Mycobacterium
ANEQWIPGGRLPTGASEAVVDGG

SEQ ID NO: 942842 - protein, 24 aa, Mycobacterium
ANESTPQQLLFFDHNRPLGTATPN

SEQ ID NO: 942843 - protein, 25 aa, Mycobacterium
ANEVDKLIWAEGFSLPLTQSPGTIA

SEQ ID NO: 942844 - protein, 27 aa, Mycobacterium
ANGSVRARFLTDRLLFDSQYTKEICNL

SEQ ID NO: 942845 - protein, 25 aa, Mycobacterium
ANGTHSWPYWNQQLVAMKPDIQQVL

SEQ ID NO: 942846 - protein, 17 aa, Mycobacterium
ANHRATLLQGPRFVGTG

SEQ ID NO: 942847 - protein, 21 aa, Mycobacterium
ANIAPPLSWSAPLGAALVVDD

SEQ ID NO: 942848 - protein, 24 aa, Mycobacterium
ANIEFIRVFLASPRDQRVNLLNQI

SEQ ID NO: 942849 - protein, 21 aa, Mycobacterium
ANLTRFLGGYLAVVSAPKALA

SEQ ID NO: 942850 - protein, 26 aa, Mycobacterium
ANLVGAFNAPALLAGLNSGLNGLVQT

SEQ ID NO: 942851 - protein, 23 aa, Mycobacterium
ANMRVSIEWPYSANLHCEILIDD

SEQ ID NO: 942852 - protein, 26 aa, Mycobacterium
ANNDFKPGFATALMNKDLGLAMAAVE

SEQ ID NO: 942853 - protein, 25 aa, Mycobacterium
ANNDFKPGFATALMNKDLGLAMDAV

SEQ ID NO: 942854 - protein, 26 aa, Mycobacterium
ANNDFKPGFATALMNKDLGLAMDAVT

SEQ ID NO: 942855 - protein, 26 aa, Mycobacterium
ANNDFKPGFATSLMNKDLGLAMAAVS

SEQ ID NO: 942856 - protein, 19 aa, Mycobacterium
ANPAGLIDITRFWFEQGSL

SEQ ID NO: 942857 - protein, 23 aa, Mycobacterium
ANPAGLIDITRYWFEQGSLSNER

SEQ ID NO: 942858 - protein, 17 aa, Mycobacterium
ANPAGLVDITRFWFETG

SEQ ID NO: 942859 - protein, 22 aa, Mycobacterium
ANPSWNPFAFSSLTSTDRYLQQ

SEQ ID NO: 942860 - protein, 23 aa, Mycobacterium
ANRARLAELMATNIFGQNVPAIA

SEQ ID NO: 942861 - protein, 18 aa, Mycobacterium
ANRDAIRRGIANGNKSIQ

SEQ ID NO: 942862 - protein, 29 aa, Mycobacterium
ANRIASADLAWFPLIERVKTIPTSDRVTN

SEQ ID NO: 942863 - protein, 23 aa, Mycobacterium
ANSMPFSAFPMGNYASLPTVSFV

SEQ ID NO: 942864 - protein, 23 aa, Mycobacterium
ANSPMDFDWLSRRKPPGVVVRDI

SEQ ID NO: 942865 - protein, 23 aa, Mycobacterium
ANSTLVTTWTVAPAGPGSSVTTK

SEQ ID NO: 942866 - protein, 27 aa, Mycobacterium
ANTATRAPLRPDFYHRIGSVTKTFTVT

SEQ ID NO: 942867 - protein, 23 aa, Mycobacterium
ANTPHAYWMDNVSTFAVDAKYIQ

SEQ ID NO: 942868 - protein, 19 aa, Mycobacterium
APAAIFIGGGVTGPGVLEA

SEQ ID NO: 942869 - protein, 17 aa, Mycobacterium
APAGAPHRLVDPAALPP

SEQ ID NO: 942870 - protein, 22 aa, Mycobacterium
APAKVIFDKGTPFADLLVPKLT

SEQ ID NO: 942871 - protein, 20 aa, Mycobacterium
APALFDYRWNGDRWESSADY

SEQ ID NO: 942872 - protein, 17 aa, Mycobacterium
APALKADGPVPGTAWIT

SEQ ID NO: 942873 - protein, 29 aa, Mycobacterium
APAMPASAEYLRLLRRHNVAATISGAGPA

SEQ ID NO: 942874 - protein, 18 aa, Mycobacterium
APAPILLSATNVAAEAPR

SEQ ID NO: 942875 - protein, 25 aa, Mycobacterium
APARRMLSRWLGPTDPVLASTVFGV

SEQ ID NO: 942876 - protein, 23 aa, Mycobacterium
APATPSPALYPGAPIPGPPNILS

SEQ ID NO: 942877 - protein, 17 aa, Mycobacterium
APAVYLLDGLRARDDRS

SEQ ID NO: 942878 - protein, 21 aa, Mycobacterium
APDAPWVFETTLADPQWAIFT

SEQ ID NO: 942879 - protein, 27 aa, Mycobacterium
APDDVIDALIAWAPRHLVTAYDAVAAG

SEQ ID NO: 942880 - protein, 21 aa, Mycobacterium
APDFRLFWDNAYAVHTLTHDF

SEQ ID NO: 942881 - protein, 25 aa, Mycobacterium
APDGAPLYPGLPPAPPPGAPREPGP

SEQ ID NO: 942882 - protein, 19 aa, Mycobacterium
APDGVKLAAGWLLERAGFG

SEQ ID NO: 942883 - protein, 23 aa, Mycobacterium
APDLSRLWPSLLHDHYARGFSVA

SEQ ID NO: 942884 - protein, 18 aa, Mycobacterium
APDPAATLWIGPLGGSTV

SEQ ID NO: 942885 - protein, 24 aa, Mycobacterium
APDQLPPVNAFWSLTIYELPSSQL

SEQ ID NO: 942886 - protein, 24 aa, Mycobacterium
APDSVFFSGYYAEAAPFVQQLRDG

SEQ ID NO: 942887 - protein, 18 aa, Mycobacterium
APDTVPMVIDFGGGVLGA

SEQ ID NO: 942888 - protein, 22 aa, Mycobacterium
APDWDAVLRLCRPSQIVHLAAE

SEQ ID NO: 942889 - protein, 34 aa, Mycobacterium
APEAPRRRRSVFGVLAVLLCLLLGVAIATQVRQT

SEQ ID NO: 942890 - protein, 18 aa, Mycobacterium
APEITIGPLYADKTLKLC

SEQ ID NO: 942891 - protein, 37 aa, Mycobacterium
APELAAPMHAWSGDAYKLVVLMGLRIGQDSVNGKAGD

SEQ ID NO: 942892 - protein, 23 aa, Mycobacterium
APELEAPLIQTLQALASGGSFSG

SEQ ID NO: 942893 - protein, 18 aa, Mycobacterium
APELRSHQLPLLLAIATF

SEQ ID NO: 942894 - protein, 28 aa, Mycobacterium
APELVKLRQYFDHPLFVEMFADAVADAA

SEQ ID NO: 942895 - protein, 26 aa, Mycobacterium
APEVLNVVVPFLALQPLVENAVRHGL

SEQ ID NO: 942896 - protein, 27 aa, Mycobacterium
APGADLYSLNRLMPPFIKSTTSNAIAV

SEQ ID NO: 942897 - protein, 18 aa, Mycobacterium
APGDPWYSSYTLDPLKAP

SEQ ID NO: 942898 - protein, 30 aa, Mycobacterium
APGFATPAVYDWLMPIPAPSPDARAVVTGA

SEQ ID NO: 942899 - protein, 24 aa, Mycobacterium
APGKPWTMQVMLANPDQWAVVTAS

SEQ ID NO: 942900 - protein, 20 aa, Mycobacterium
APGPAQITITPGPDARDVDP

SEQ ID NO: 942901 - protein, 19 aa, Mycobacterium
APGPIPYPGAPPYGAPQYA

SEQ ID NO: 942902 - protein, 23 aa, Mycobacterium
APGQIELFVDPLCPFSGKMIQQQ

SEQ ID NO: 942903 - protein, 31 aa, Mycobacterium
APGQLPPVNAFWSLTMYELPGSVLVANPMNR

SEQ ID NO: 942904 - protein, 30 aa, Mycobacterium
APGQPGPVAVMFFDLDRLKAINDYLGHTAG

SEQ ID NO: 942905 - protein, 26 aa, Mycobacterium
APGSPGPVAVFYLDLDRLKPINDYLG

SEQ ID NO: 942906 - protein, 18 aa, Mycobacterium
APGTLIIDFSSIRPDVSM

SEQ ID NO: 942907 - protein, 18 aa, Mycobacterium
APGVLSAWRHSNPAAPRS

SEQ ID NO: 942908 - protein, 18 aa, Mycobacterium
APHLALAQPAQADGIARL

SEQ ID NO: 942909 - protein, 22 aa, Mycobacterium
APHRIHIHLCQSPAAVLGIDRV

SEQ ID NO: 942910 - protein, 21 aa, Mycobacterium
APIIKNRQYNFPPIGVNPFVG

SEQ ID NO: 942911 - protein, 21 aa, Mycobacterium
APIIKNRQYNFPPLGLNQLVG

SEQ ID NO: 942912 - protein, 21 aa, Mycobacterium
APILTPVIYRLAVSARALIDQ

SEQ ID NO: 942913 - protein, 20 aa, Mycobacterium
APKSLKVNVLLLGVQNDPIV

SEQ ID NO: 942914 - protein, 18 aa, Mycobacterium
APLFDRIAIALPGGKTIR

SEQ ID NO: 942915 - protein, 18 aa, Mycobacterium
APLLGTWVGQGAGKYPTI

SEQ ID NO: 942916 - protein, 27 aa, Mycobacterium
APLLHQCCGALLASFKIWHCATVGGNI

SEQ ID NO: 942917 - protein, 21 aa, Mycobacterium
APLTLRIGYHGPNARLAAIIG

SEQ ID NO: 942918 - protein, 35 aa, Mycobacterium
APMPPQLPAQPPPPAHILIPPRAPAPTPQPQLRPP

SEQ ID NO: 942919 - protein, 21 aa, Mycobacterium
APNLSSFPLACAACWINGVPM

SEQ ID NO: 942920 - protein, 17 aa, Mycobacterium
APPDRYCGRISATTDGE

SEQ ID NO: 942921 - protein, 26 aa, Mycobacterium
APPEPPRWIPPWEQPPRQPECVVFCL

SEQ ID NO: 942922 - protein, 25 aa, Mycobacterium
APPGNYWIVDLDPEYRWAVVTDPTG

SEQ ID NO: 942923 - protein, 24 aa, Mycobacterium
APPGRDLLYVLAPAPNTDVGHRDW

SEQ ID NO: 942924 - protein, 21 aa, Mycobacterium
APPKSLKVDVLLLGVQNDPIV

SEQ ID NO: 942925 - protein, 21 aa, Mycobacterium
APPLVIGPAYAAKTLQLCNTG

SEQ ID NO: 942926 - protein, 25 aa, Mycobacterium
APPPTWVPPWVQQPAPQKPAQCAVF

SEQ ID NO: 942927 - protein, 17 aa, Mycobacterium
APPRALWHLGAGATATP

SEQ ID NO: 942928 - protein, 21 aa, Mycobacterium
APRGSAYHYFPGGRTQLLSEA

SEQ ID NO: 942929 - protein, 22 aa, Mycobacterium
APRTVGVYAVNYPAGSNFGDRE

SEQ ID NO: 942930 - protein, 22 aa, Mycobacterium
APSAGIEQLIFAPEGALAAVPA

SEQ ID NO: 942931 - protein, 28 aa, Mycobacterium
APSALPVPPAAPLPPPEALVDVLSRLAD

SEQ ID NO: 942932 - protein, 20 aa, Mycobacterium
APSEPAQFTAPGAPGTLGSG

SEQ ID NO: 942933 - protein, 28 aa, Mycobacterium
APSGGMLSRLRLLFSLGLGARLGNGRQY

SEQ ID NO: 942934 - protein, 19 aa, Mycobacterium
APSQALTGRPLIGNGADGA

SEQ ID NO: 942935 - protein, 26 aa, Mycobacterium
APSSLRDSALFIRDPWRQDVLEDLPD

SEQ ID NO: 942936 - protein, 23 aa, Mycobacterium
APTLAAATAWDGLAAELGEAAEA

SEQ ID NO: 942937 - protein, 31 aa, Mycobacterium
APTPLQIRAVGRLLGWRLGIAEVDPKSMVEL

SEQ ID NO: 942938 - protein, 20 aa, Mycobacterium
APTYPFTQNLIDRAIRGDFV

SEQ ID NO: 942939 - protein, 19 aa, Mycobacterium
APVIHRVTSTPGVGNTWVL

SEQ ID NO: 942940 - protein, 27 aa, Mycobacterium
APVKAEKLYPVLPPRQAELADRLLSAS

SEQ ID NO: 942941 - protein, 25 aa, Mycobacterium
APVKDILSFLPGIDLDRAEWPYIGA

SEQ ID NO: 942942 - protein, 20 aa, Mycobacterium
APVMAPILPGPPVAGAVPVA

SEQ ID NO: 942943 - protein, 17 aa, Mycobacterium
APVTGFYSLTYSSSGLE

SEQ ID NO: 942944 - protein, 18 aa, Mycobacterium
APVVAAMLVVASLAGCGG

SEQ ID NO: 942945 - protein, 22 aa, Mycobacterium
APYTIVRATQFFEFVAGIADSM

SEQ ID NO: 942946 - protein, 20 aa, Mycobacterium
AQAGLTDRVTWIGSGKLGLP

SEQ ID NO: 942947 - protein, 25 aa, Mycobacterium
AQAHDRLLTLLLPGTRIDAVAETVN

SEQ ID NO: 942948 - protein, 20 aa, Mycobacterium
AQALFTMRVSPVSGGPMRGQ

SEQ ID NO: 942949 - protein, 18 aa, Mycobacterium
AQALHRPLGITAAHADFV

SEQ ID NO: 942950 - protein, 17 aa, Mycobacterium
AQALLDRLAGRPSTFPL

SEQ ID NO: 942951 - protein, 23 aa, Mycobacterium
AQALQALAAAPELGFRPGAHFEY

SEQ ID NO: 942952 - protein, 21 aa, Mycobacterium
AQAPAPELIAAPAPEAPVVDE

SEQ ID NO: 942953 - protein, 27 aa, Mycobacterium
AQAVARWLVLYLRRPGGQSQFAAPVWM

SEQ ID NO: 942954 - protein, 20 aa, Mycobacterium
AQAWRNIVFGEADIAICGGV

SEQ ID NO: 942955 - protein, 24 aa, Mycobacterium
AQDMTTLERLVLRGFPGSGIYVRG

SEQ ID NO: 942956 - protein, 26 aa, Mycobacterium
AQDRGFLDYGYLFAATSLMPSHVIAD

SEQ ID NO: 942957 - protein, 22 aa, Mycobacterium
AQEHYALAWAVAVGGSVVALRY

SEQ ID NO: 942958 - protein, 26 aa, Mycobacterium
AQERGGIRPLFTDKALFGAFSYGTYV

SEQ ID NO: 942959 - protein, 34 aa, Mycobacterium
AQFATNVFGVAATLQAALPYLRERRKGHLMAVTS

SEQ ID NO: 942960 - protein, 23 aa, Mycobacterium
AQGCLLVDIRHDLSAMFQRIASH

SEQ ID NO: 942961 - protein, 24 aa, Mycobacterium
AQGDFSIAFARFHTLMAPYAARCQ

SEQ ID NO: 942962 - protein, 23 aa, Mycobacterium
AQGFLLSRPLPGDAMEALLSARW

SEQ ID NO: 942963 - protein, 20 aa, Mycobacterium
AQGFSWPPDHDAALVGMGRL

SEQ ID NO: 942964 - protein, 24 aa, Mycobacterium
AQGPIALTGLYPPGSTFKTVTVSA

SEQ ID NO: 942965 - protein, 22 aa, Mycobacterium
AQGPMQFLPSTFATYGQGGDIN

SEQ ID NO: 942966 - protein, 18 aa, Mycobacterium
AQIEPYLASLQAPDAAPG

SEQ ID NO: 942967 - protein, 27 aa, Mycobacterium
AQKPQNFKALDITLPVPARWTQVPDPN

SEQ ID NO: 942968 - protein, 29 aa, Mycobacterium
AQKVSFAGPYLITYQGLLVRKADDSLTTL

SEQ ID NO: 942969 - protein, 21 aa, Mycobacterium
AQLDQLLTPALSLAVTPGKPL

SEQ ID NO: 942970 - protein, 17 aa, Mycobacterium
AQLRLAGERLARLLNAT

SEQ ID NO: 942971 - protein, 18 aa, Mycobacterium
AQLTITLTPAPDSPPWTA

SEQ ID NO: 942972 - protein, 23 aa, Mycobacterium
AQNRPRVKVASRSELLRIGGCQE

SEQ ID NO: 942973 - protein, 23 aa, Mycobacterium
AQPAYDLIVVDNPWMDDFADAGF

SEQ ID NO: 942974 - protein, 21 aa, Mycobacterium
AQPLYARYWLHNRGPAPLGGL

SEQ ID NO: 942975 - protein, 17 aa, Mycobacterium
AQQQLMQQGMQAIDGLV

SEQ ID NO: 942976 - protein, 18 aa, Mycobacterium
AQQYAQLSGLRLGKVLSI

SEQ ID NO: 942977 - protein, 24 aa, Mycobacterium
AQQYDGMSPIRGYLTPEARATFEP

SEQ ID NO: 942978 - protein, 32 aa, Mycobacterium
AQRPQGFNALEITLPMPPRWTPVPDPNVPDAF

SEQ ID NO: 942979 - protein, 25 aa, Mycobacterium
AQSAPGHMLGGLPLGPTPSGGGSGV

SEQ ID NO: 942980 - protein, 23 aa, Mycobacterium
AQSNRVPVIVLLGSPRSEASAAL

SEQ ID NO: 942981 - protein, 20 aa, Mycobacterium
AQSPYRTLADVMTAIRSDPG

SEQ ID NO: 942982 - protein, 19 aa, Mycobacterium
AQTMKLINNLIAATTLAVT

SEQ ID NO: 942983 - protein, 17 aa, Mycobacterium
AQTSLLGSQHIELAPPA

SEQ ID NO: 942984 - protein, 30 aa, Mycobacterium; identical to SEQ ID NO: 146672

SEQ ID NO: 942985 - protein, 19 aa, Mycobacterium
AQVLIPLKPIYQRKGIIFH

SEQ ID NO: 942986 - protein, 19 aa, Mycobacterium
AQVLLEWLQANFPEPKVTA

SEQ ID NO: 942987 - protein, 19 aa, Mycobacterium
AQVRPIHRPPRNPADRHPH

SEQ ID NO: 942988 - protein, 34 aa, Mycobacterium
AQWMPPNTAFACQYAMQFIAVLRGYALPVDQPST

SEQ ID NO: 942989 - protein, 36 aa, Mycobacterium
AQYLGPALRLMNFNYLPMPFNAYLGPAPQNVIYSEP

SEQ ID NO: 942990 - protein, 17 aa, Mycobacterium
AQYNTYLKQYLVMYTNG

SEQ ID NO: 942991 - protein, 17 aa, Mycobacterium
AQYWQMQHLPDNCVLMS

SEQ ID NO: 942992 - protein, 24 aa, Mycobacterium
ARAAIVHPLQVAANRTQLVSLVVS

SEQ ID NO: 942993 - protein, 19 aa, Mycobacterium
ARAAIYAESFRRRARETPA

SEQ ID NO: 942994 - protein, 37 aa, Mycobacterium
ARAATVHPMLVAANRSRLVSLVWSNVFGQNAPAIAAI

SEQ ID NO: 942995 - protein, 32 aa, Mycobacterium
ARALAGRRVVLNLWAYWCAPCAAELPAMAEYQ

SEQ ID NO: 942996 - protein, 22 aa, Mycobacterium
ARALLREVLIDELQPELDRSIK

SEQ ID NO: 942997 - protein, 21 aa, Mycobacterium
ARATVVFGAPRQLALLDDTVI

SEQ ID NO: 942998 - protein, 21 aa, Mycobacterium
ARAVALLGIGLLGTGCTNTVA

SEQ ID NO: 942999 - protein, 18 aa, Mycobacterium
ARCQAHVLPLTRMATDLA

SEQ ID NO: 943000 - protein, 23 aa, Mycobacterium
ARDRAFFCEYALQYLANAGISPD

SEQ ID NO: 943001 - protein, 23 aa, Mycobacterium
ARDRIHWFFSMDYAGRRQYSENT

SEQ ID NO: 943002 - protein, 25 aa, Mycobacterium
AREHPRIFPVAIQGVLFGIAQQSDI

SEQ ID NO: 943003 - protein, 25 aa, Mycobacterium
AREPGPPPLLSPIDLPASTAVDPGA

SEQ ID NO: 943004 - protein, 31 aa, Mycobacterium; identical to SEQ ID NO: 924769

SEQ ID NO: 943005 - protein, 21 aa, Mycobacterium
ARFFMASPAFLLRCATVAQVN

SEQ ID NO: 943006 - protein, 25 aa, Mycobacterium
ARFGEALALLGWNMAVSNLRWDGDF

SEQ ID NO: 943007 - protein, 23 aa, Mycobacterium
ARFGLQDVIWRGTYYTPAGPQAS

SEQ ID NO: 943008 - protein, 19 aa, Mycobacterium
ARFLLGAQRLLGLGQFATP

SEQ ID NO: 943009 - protein, 28 aa, Mycobacterium
ARFNVSRTALLVVALTERPDLLMAATED

SEQ ID NO: 943010 - protein, 23 aa, Mycobacterium
ARFYRLSSLRLWPDRRLSRRGVE

SEQ ID NO: 943011 - protein, 33 aa, Mycobacterium
ARGFSVARRLALLLTFPRFLPVAGPVAMRSSTL

SEQ ID NO: 943012 - protein, 32 aa, Mycobacterium
ARGFSVARRLALLLTLPRFLQVTGPVAMRSAT

SEQ ID NO: 943013 - protein, 22 aa, Mycobacterium
ARGGRRLVIAMMYGLVKEGGPS

SEQ ID NO: 943014 - protein, 25 aa, Mycobacterium
ARGPSTWYFGAGELDVWEVWARVAE

SEQ ID NO: 943015 - protein, 25 aa, Mycobacterium
ARGTAVRPIYGPALDGTLPGNEIIV

SEQ ID NO: 943016 - protein, 33 aa, Mycobacterium
ARHLGLPAPVPAPWPILAALPQGPELGRQQASI

SEQ ID NO: 943017 - protein, 17 aa, Mycobacterium
ARIALTNAAAMLDNADG

SEQ ID NO: 943018 - protein, 24 aa, Mycobacterium
ARIKLNCLTAGAWPAYWLGNDDQG

SEQ ID NO: 943019 - protein, 25 aa, Mycobacterium
ARINSQIYPAIILGDLLGFITETQE

SEQ ID NO: 943020 - protein, 20 aa, Mycobacterium
ARKRALKELLKLVEKGLAGG

SEQ ID NO: 943021 - protein, 20 aa, Mycobacterium
ARLAALYPYGEGPDVSFILT

SEQ ID NO: 943022 - protein, 25 aa, Mycobacterium
ARLGESLALLGWNMSVSNLRWDGDY

SEQ ID NO: 943023 - protein, 17 aa, Mycobacterium
ARLLLRSMGYRDALIGG

SEQ ID NO: 943024 - protein, 18 aa, Mycobacterium
ARLSAIRQKYDPGRVMFS

SEQ ID NO: 943025 - protein, 31 aa, Mycobacterium
ARLTGVTGASIFPLVRPAPPSFPESPEESST

SEQ ID NO: 943026 - protein, 21 aa, Mycobacterium
ARMFEVVPNPAWVARPGPYAR

SEQ ID NO: 943027 - protein, 17 aa, Mycobacterium
ARMLAGEQSLDVLAGAW

SEQ ID NO: 943028 - protein, 24 aa, Mycobacterium
ARNEVFTAFVPFAARWPVEVHIYP

SEQ ID NO: 943029 - protein, 18 aa, Mycobacterium
ARNPLPCLRVVISSGDRL

SEQ ID NO: 943030 - protein, 27 aa, Mycobacterium
ARNPLRFAPPCRDRHGWRAPPQAAPPL

SEQ ID NO: 943031 - protein, 23 aa, Mycobacterium
ARPTEVKLIGEGGVEVALTGPIA

SEQ ID NO: 943032 - protein, 24 aa, Mycobacterium
ARQWARCLDMYLWLQQQVDAQIGR

SEQ ID NO: 943033 - protein, 21 aa, Mycobacterium
ARRDDVLIDWITAIAPHARRV

SEQ ID NO: 943034 - protein, 18 aa, Mycobacterium
ARRGAMNPQLPWGKDITW

SEQ ID NO: 943035 - protein, 23 aa, Mycobacterium
ARRPRKPRVVGLAALCAAAAFAT

SEQ ID NO: 943036 - protein, 28 aa, Mycobacterium
ARRVADVLGIPFYVWDFAEKFNEDVIDD

SEQ ID NO: 943037 - protein, 19 aa, Mycobacterium
ARRVAIGERIVFAPGAANM

SEQ ID NO: 943038 - protein, 23 aa, Mycobacterium
ARRYQRMVIGPWDHLAWGRESSS

SEQ ID NO: 943039 - protein, 31 aa, Mycobacterium
ARSASQPWTWPLYQLLMPTVTNPAVPNPTVP

SEQ ID NO: 943040 - protein, 27 aa, Mycobacterium
ARSGGLIGRLKPLFSFGLGARLGNGRQ

SEQ ID NO: 943041 - protein, 20 aa, Mycobacterium
ARSKLIGKIPMKRVGRPDDI

SEQ ID NO: 943042 - protein, 20 aa, Mycobacterium
ARSLLAIGAVPVAGLLSAMT

SEQ ID NO: 943043 - protein, 33 aa, Mycobacterium
ARSRDARVVLLSLDSINGDAWIVGAKGGPATIG

SEQ ID NO: 943044 - protein, 24 aa, Mycobacterium
ARSRWLSELVAEPRTCVFFESPRR

SEQ ID NO: 943045 - protein, 19 aa, Mycobacterium
ARTGLVLAPAGGALRPMRP

SEQ ID NO: 943046 - protein, 19 aa, Mycobacterium
ARVHWRPRDYYPAGTTVNV

SEQ ID NO: 943047 - protein, 18 aa, Mycobacterium
ARVIVYNPTLVPDPPDTI

SEQ ID NO: 943048 - protein, 23 aa, Mycobacterium
ARVKAIYRVALPTGAGATGAAAP

SEQ ID NO: 943049 - protein, 30 aa, Mycobacterium
ARVKDPWLRRQLTPDFRPGCKRMLVSSDYY

SEQ ID NO: 943050 - protein, 18 aa, Mycobacterium
ARVLVYNPDIAPNPPDTI

SEQ ID NO: 943051 - protein, 28 aa, Mycobacterium
ARVNDLRNEWLFTEAWGIDVAVSTPRAM

SEQ ID NO: 943052 - protein, 24 aa, Mycobacterium
ARYPSMLTALRRAVAENAIRLRGL

SEQ ID NO: 943053 - protein, 25 aa, Mycobacterium
ARYQALKERGARVQRPLWASTGVKN

SEQ ID NO: 943054 - protein, 28 aa, Mycobacterium
ARYVAAHVPYLAWLTRAGANSAARAAQH

SEQ ID NO: 943055 - protein, 20 aa, Mycobacterium
ASAAAFTGGLVLAGCATAVA

SEQ ID NO: 943056 - protein, 25 aa, Mycobacterium
ASAAALSALALLVAPAASAQPDATL

SEQ ID NO: 943057 - protein, 25 aa, Mycobacterium
ASADPLYPQPPSPAPAPAQAAVPPV

SEQ ID NO: 943058 - protein, 26 aa, Mycobacterium
ASAEYLQLLRRHKVAATLSGAGPALI

SEQ ID NO: 943059 - protein, 19 aa, Mycobacterium
ASALATRISWRRPYEVTDA

SEQ ID NO: 943060 - protein, 25 aa, Mycobacterium
ASAPLTWPAGWTRWPKRVYGDTRLE

SEQ ID NO: 943061 - protein, 32 aa, Mycobacterium
ASATRAIPTTWYFPTTPPLGLVWLQHGFVEGK

SEQ ID NO: 943062 - protein, 26 aa, Mycobacterium
ASAVAAQLAPWQQALRTLQNRVAGAT

SEQ ID NO: 943063 - protein, 25 aa, Mycobacterium
ASAVPTLVHPAPRGVLGALAATVYG

SEQ ID NO: 943064 - protein, 26 aa, Mycobacterium
ASAVTAAVTVLLAPAAHAGPGGLGDA

SEQ ID NO: 943065 - protein, 23 aa, Mycobacterium
ASDAAGVVGWWVNPQGRGGDSCT

SEQ ID NO: 943066 - protein, 23 aa, Mycobacterium
ASDMLVRAWVRSYRLTATLSNCS

SEQ ID NO: 943067 - protein, 25 aa, Mycobacterium
ASETAPCDLVRFLDTLYTDLDALVE

SEQ ID NO: 943068 - protein, 30 aa, Mycobacterium
ASFLVKDLHLPWQWGARWFLDQLTDGDMAN

SEQ ID NO: 943069 - protein, 25 aa, Mycobacterium
ASGKPAILQPWIRVAGLDGAYQGEF

SEQ ID NO: 943070 - protein, 28 aa, Mycobacterium
ASGLDARAYRLPWPKGTVVYEVDMPEVI

SEQ ID NO: 943071 - protein, 27 aa, Mycobacterium
ASGLDSRAYRLPWPAGTTLFEVDQPKV

SEQ ID NO: 943072 - protein, 28 aa, Mycobacterium
ASGLDTRPYRLWWPPGTTVFEIDRPEVL

SEQ ID NO: 943073 - protein, 23 aa, Mycobacterium
ASGPKPVIVGILRGLNGGQVAAV

SEQ ID NO: 943074 - protein, 24 aa, Mycobacterium
ASGPPGFVVTPDGWELTVSAKDEF

SEQ ID NO: 943075 - protein, 22 aa, Mycobacterium
ASGRVAYLLGLEGPAVSVDTAC

SEQ ID NO: 943076 - protein, 26 aa, Mycobacterium
ASGSRIEVLLRQQEDPRWTCSHAMAL

SEQ ID NO: 943077 - protein, 23 aa, Mycobacterium
ASGWSTRPFERISGWTLVCRGET

SEQ ID NO: 943078 - protein, 18 aa, Mycobacterium
ASGYWVVQYPRAQHLDFY

SEQ ID NO: 943079 - protein, 20 aa, Mycobacterium
ASHWRDRNVFILGDAAHLTP

SEQ ID NO: 943080 - protein, 20 aa, Mycobacterium
ASIAIPGLITPHVLGGRLLA

SEQ ID NO: 943081 - protein, 26 aa, Mycobacterium
ASIDAYPRVVWIAGGMLKGASVEDLV

SEQ ID NO: 943082 - protein, 17 aa, Mycobacterium
ASIGTGVLVWQLSRDHG

SEQ ID NO: 943083 - protein, 25 aa, Mycobacterium
ASISWQAMLLRCARPRLTPIVGLLT

SEQ ID NO: 943084 - protein, 29 aa, Mycobacterium
ASIYSSCAVPPLIGYVNSGKLPGTDTYCP

SEQ ID NO: 943085 - protein, 17 aa, Mycobacterium
ASLAHRVISGKTLSSPA

SEQ ID NO: 943086 - protein, 24 aa, Mycobacterium
ASLGGLMRATLPRAYRVGPDGSTT

SEQ ID NO: 943087 - protein, 29 aa, Mycobacterium
ASLQTLGQDLLGMVNAPAAAVLGRPLIGN

SEQ ID NO: 943088 - protein, 17 aa, Mycobacterium
ASLSGFLNPSEGWWPML

SEQ ID NO: 943089 - protein, 30 aa, Mycobacterium
ASLSMAAAAQPLLAWLSYTAESSALAAAQA

SEQ ID NO: 943090 - protein, 26 aa, Mycobacterium
ASLTAAWDALLPARVFAFTAQATTPF

SEQ ID NO: 943091 - protein, 30 aa, Mycobacterium
ASMAMIAAAQPYLAWLTYTSEAAMHAGAQA

SEQ ID NO: 943092 - protein, 18 aa, Mycobacterium
ASMSSGMWQSMHGSDMAS

SEQ ID NO: 943093 - protein, 17 aa, Mycobacterium
ASPAAIYIADARGVLQL

SEQ ID NO: 943094 - protein, 29 aa, Mycobacterium
ASPDPVLEAFPLWSTPWGLGVPSSEVTAG

SEQ ID NO: 943095 - protein, 18 aa, Mycobacterium
ASPDRLVRSIASHGADAV

SEQ ID NO: 943096 - protein, 20 aa, Mycobacterium
ASQKVLGFAPYPGVVPGRPA

SEQ ID NO: 943097 - protein, 19 aa, Mycobacterium
ASQQVFGFAPYPGVAPGRP

SEQ ID NO: 943098 - protein, 25 aa, Mycobacterium
ASQRDIITQALYKVPPALDVLIRER

SEQ ID NO: 943099 - protein, 30 aa, Mycobacterium
ASRAKLNWWESRALYGWTVLVPRTKDQAGE

SEQ ID NO: 943100 - protein, 30 aa, Mycobacterium
ASRDKFPRAVLPRTFDYGFATGLMTKDVLL

SEQ ID NO: 943101 - protein, 26 aa, Mycobacterium
ASREELVDLLWRMGIRTIGQFAELSR

SEQ ID NO: 943102 - protein, 19 aa, Mycobacterium
ASREYLVGGTFTGSVTGSG

SEQ ID NO: 943103 - protein, 24 aa, Mycobacterium
ASRLEAIGLQLQRSHSFFVGNPQI

SEQ ID NO: 943104 - protein, 18 aa, Mycobacterium
ASRRNQVVRLYSVYHVDI

SEQ ID NO: 943105 - protein, 19 aa, Mycobacterium
ASRYHSVLLRSDGTSVAAG

SEQ ID NO: 943106 - protein, 20 aa, Mycobacterium
ASRYHTRSRFLPAGVAPEQG

SEQ ID NO: 943107 - protein, 23 aa, Mycobacterium
ASSLPDWPFDQPGYTMFVVLNLA

SEQ ID NO: 943108 - protein, 22 aa, Mycobacterium
ASSMSGFLNLSAGKWPSLVSVA

SEQ ID NO: 943109 - protein, 24 aa, Mycobacterium
ASSQLNIPVLPAGLVYTQAAASNH

SEQ ID NO: 943110 - protein, 24 aa, Mycobacterium
ASTALWFVAALLGGCASVPSSSAP

SEQ ID NO: 943111 - protein, 31 aa, Mycobacterium
ASTFFADGSIDKIFFWDPAMAAEAQLQIALM

SEQ ID NO: 943112 - protein, 24 aa, Mycobacterium
ASTVFGVRFPGPLGLAAGFDKDGT

SEQ ID NO: 943113 - protein, 19 aa, Mycobacterium
ASTVWLAELGYRVTLLESN

SEQ ID NO: 943114 - protein, 25 aa, Mycobacterium
ASVIVAGLLFPVVGGFGLVSNRASD

SEQ ID NO: 943115 - protein, 18 aa, Mycobacterium
ASVPPLPGVKLDCASYDA

SEQ ID NO: 943116 - protein, 24 aa, Mycobacterium
ASWATPHELIANLLAVFAAGASLV

SEQ ID NO: 943117 - protein, 19 aa, Mycobacterium
ASYDWLPAVLEGVLLAIAQ

SEQ ID NO: 943118 - protein, 22 aa, Mycobacterium
ASYVRRAISSSPYPYVARVRYR

SEQ ID NO: 943119 - protein, 25 aa, Mycobacterium
ATAAALMGSFAYLGIGIGTASAEPD

SEQ ID NO: 943120 - protein, 19 aa, Mycobacterium
ATAALPPASPLAAPSAAAA

SEQ ID NO: 943121 - protein, 20 aa, Mycobacterium
ATAAPWPQGTHTEKWIDLKP

SEQ ID NO: 943122 - protein, 35 aa, Mycobacterium
ATADAALDFWMGSPGHRAIILNCAFAAAGFATASD

SEQ ID NO: 943123 - protein, 26 aa, Mycobacterium
ATAFETAFAVVVPPPLIAANRSQVAS

SEQ ID NO: 943124 - protein, 24 aa, Mycobacterium
ATAFKNFQYTVEAQRLWAQAGFRP

SEQ ID NO: 943125 - protein, 18 aa, Mycobacterium
ATAGILMASPALADPQVV

SEQ ID NO: 943126 - protein, 18 aa, Mycobacterium
ATAGKIDFAITGNTPPIF

SEQ ID NO: 943127 - protein, 27 aa, Mycobacterium
ATAIALGWGQSLFRNVQRLPLVGSWVR

SEQ ID NO: 943128 - protein, 24 aa, Mycobacterium
ATALAVVVVLGTGLAWTNVRSFEG

SEQ ID NO: 943129 - protein, 19 aa, Mycobacterium
ATALVLFGSAGVAAAAPPK

SEQ ID NO: 943130 - protein, 36 aa, Mycobacterium
ATAQAPLLPIHWATFNLALHPWAEPIERVLAAAEEQ

SEQ ID NO: 943131 - protein, 22 aa, Mycobacterium
ATARLGLSPADLAERHPQVIPV

SEQ ID NO: 943132 - protein, 24 aa, Mycobacterium
ATASPPALPLDPSAMVGQVGPQVV

SEQ ID NO: 943133 - protein, 23 aa, Mycobacterium
ATAVKLCGYSDCKVLTTFTACGA

SEQ ID NO: 943134 - protein, 25 aa, Mycobacterium
ATDALVRQAIPSLALLASQIADPQV

SEQ ID NO: 943135 - protein, 24 aa, Mycobacterium
ATDLCEFVEFPSQLLQVCGDSFAG

SEQ ID NO: 943136 - protein, 24 aa, Mycobacterium
ATDLCEFVEFPTELLQVCGDSFAG

SEQ ID NO: 943137 - protein, 27 aa, Mycobacterium
ATDNRFRFLRVYPNPATYAPVTGFYSL

SEQ ID NO: 943138 - protein, 27 aa, Mycobacterium
ATDVDGDPLRRGYVTYPAIGSTFVDSD

SEQ ID NO: 943139 - protein, 24 aa, Mycobacterium
ATDVTYLGFVWGTMAALRRMRPRD

SEQ ID NO: 943140 - protein, 17 aa, Mycobacterium
ATELPRGIRINCVSPTV

SEQ ID NO: 943141 - protein, 21 aa, Mycobacterium
ATEPVGYYLLAASGLIDRTPS

SEQ ID NO: 943142 - protein, 17 aa, Mycobacterium
ATESPAIAAQWPDTGHF

SEQ ID NO: 943143 - protein, 25 aa, Mycobacterium
ATETPMLLWRSGLGGHPRLGRNLAL

SEQ ID NO: 943144 - protein, 26 aa, Mycobacterium
ATETRKLPSWTVVVPPQGVVAGYYYQ

SEQ ID NO: 943145 - protein, 23 aa, Mycobacterium
ATFILATGRPPRWVRPVVDALGF

SEQ ID NO: 943146 - protein, 17 aa, Mycobacterium
ATFPLETAAKWAGLGGL

SEQ ID NO: 943147 - protein, 23 aa, Mycobacterium
ATFRFPLVVAHRYTTGTPVPGDQ

SEQ ID NO: 943148 - protein, 19 aa, Mycobacterium
ATGIAPRLSGYRAGLAGSI

SEQ ID NO: 943149 - protein, 24 aa, Mycobacterium
ATGKRLPVPLYPGFDTLGTLEHIA

SEQ ID NO: 943150 - protein, 27 aa, Mycobacterium
ATGLRWAEGPVYFPDGGYLLCSDTPNN

SEQ ID NO: 943151 - protein, 19 aa, Mycobacterium
ATGLVWGRTTVRLTRPELE

SEQ ID NO: 943152 - protein, 18 aa, Mycobacterium
ATGNAVALCPNYGHPDGH

SEQ ID NO: 943153 - protein, 20 aa, Mycobacterium
ATGRRKIAFVGGPGTLRQIR

SEQ ID NO: 943154 - protein, 23 aa, Mycobacterium
ATHRALPPQPPAPPSRPAAALGA

SEQ ID NO: 943155 - protein, 20 aa, Mycobacterium
ATIDAALHDPVWSYHDHELL

SEQ ID NO: 943156 - protein, 26 aa, Mycobacterium
ATIGRTIAYAWLPAGLVIGETVSVAY

SEQ ID NO: 943157 - protein, 18 aa, Mycobacterium
ATIPLPGPGPGQTAYVFT

SEQ ID NO: 943158 - protein, 26 aa, Mycobacterium
ATKFGIRGFALCLRDDLRPAGVGVSV

SEQ ID NO: 943159 - protein, 25 aa, Mycobacterium
ATKLPVCVIKYIPLHTPTTTYSINT

SEQ ID NO: 943160 - protein, 19 aa, Mycobacterium
ATLAAIFVTAGCGGSTNSQ

SEQ ID NO: 943161 - protein, 22 aa, Mycobacterium
ATLAMIRFPATGDKIGSLVINP

SEQ ID NO: 943162 - protein, 29 aa, Mycobacterium
ATLAPVGATYIVPLGLYSQKHKTLADIPR

SEQ ID NO: 943163 - protein, 17 aa, Mycobacterium
ATLKLADGTPVATAAFV

SEQ ID NO: 943164 - protein, 17 aa, Mycobacterium
ATLMLAATAATACGGRQ

SEQ ID NO: 943165 - protein, 21 aa, Mycobacterium
ATLQMDPWMRFQNSAKVAQLY

SEQ ID NO: 943166 - protein, 23 aa, Mycobacterium
ATMAGWRTDFLNQMGLVISDSIK

SEQ ID NO: 943167 - protein, 23 aa, Mycobacterium
ATMAGWRTDFLNQMGLVVSDAIK

SEQ ID NO: 943168 - protein, 25 aa, Mycobacterium
ATMKLEFNTLPFTLGMREPAEGFRN

SEQ ID NO: 943169 - protein, 19 aa, Mycobacterium
ATMTPVREVPLAGEGWGLC

SEQ ID NO: 943170 - protein, 34 aa, Mycobacterium
ATNPQFRQMLPATPGPEGILPVPARDLLVISSES

SEQ ID NO: 943171 - protein, 18 aa, Mycobacterium
ATPDPFALALDDGTRCLL

SEQ ID NO: 943172 - protein, 21 aa, Mycobacterium
ATPEPLWSAITLAVGGPELKA

SEQ ID NO: 943173 - protein, 26 aa, Mycobacterium
ATPKVTSLGLVYDGAALAVSEGMGAK

SEQ ID NO: 943174 - protein, 17 aa, Mycobacterium
ATPLLSAAIFGATLGMA

SEQ ID NO: 943175 - protein, 18 aa, Mycobacterium
ATQLPRFAPATNSTNESG

SEQ ID NO: 943176 - protein, 23 aa, Mycobacterium
ATRFGIQDAIWRGVYYTPGGAQA

SEQ ID NO: 943177 - protein, 23 aa, Mycobacterium
ATRLYEQLRDPKFFPPPMVERMV

SEQ ID NO: 943178 - protein, 22 aa, Mycobacterium
ATRSMLMTYIKPGSVVLFHNTY

SEQ ID NO: 943179 - protein, 30 aa, Mycobacterium
ATRSPLLRALVAALLVVIGAGGGYAIAAHK

SEQ ID NO: 943180 - protein, 23 aa, Mycobacterium
ATRTFRLSRIGAEVRRIGPPGAV

SEQ ID NO: 943181 - protein, 28 aa, Mycobacterium
ATSAAGSALAAGLGGEGWVGAFGAVSAG

SEQ ID NO: 943182 - protein, 26 aa, Mycobacterium
ATSAYLFTHPEVNTFFSNLHGAPRAQ

SEQ ID NO: 943183 - protein, 23 aa, Mycobacterium
ATSGRPVGLRPAGALGAEAMRPQ

SEQ ID NO: 943184 - protein, 25 aa, Mycobacterium
ATSIRPSWFNTVPGVPFVWGDQNFQ

SEQ ID NO: 943185 - protein, 17 aa, Mycobacterium
ATSLMPSHVIADELGLG

SEQ ID NO: 943186 - protein, 23 aa, Mycobacterium
ATSSPAHLTMPYVSPVDGEVVGI

SEQ ID NO: 943187 - protein, 18 aa, Mycobacterium
ATTAAFRAAGPTGTVATA

SEQ ID NO: 943188 - protein, 21 aa, Mycobacterium
ATTAWLIERLQRPTLVMAPNK

SEQ ID NO: 943189 - protein, 22 aa, Mycobacterium
ATTSQMLYVRTPAINAFFPNYR

SEQ ID NO: 943190 - protein, 26 aa, Mycobacterium
ATTVLLAQMFAAGVRRLVLASSMVVY

SEQ ID NO: 943191 - protein, 25 aa, Mycobacterium
ATTVPGRHFSYADYPGFVAISSDGR

SEQ ID NO: 943192 - protein, 27 aa, Mycobacterium
ATTWPRKRIDLYFPGRSALQGHHPRIW

SEQ ID NO: 943193 - protein, 19 aa, Mycobacterium
ATVKALRIIKSVATAPGAD

SEQ ID NO: 943194 - protein, 17 aa, Mycobacterium
ATVPLPVLATGGLATPA

SEQ ID NO: 943195 - protein, 21 aa, Mycobacterium
ATVVIVAAALLPLTACSSDTT

SEQ ID NO: 943196 - protein, 27 aa, Mycobacterium
ATYPIDGRWYIAQRYAIDFNLLDAQNR

SEQ ID NO: 943197 - protein, 24 aa, Mycobacterium
ATYSAPGYAFFWNADEKKAEILGS

SEQ ID NO: 943198 - protein, 25 aa, Mycobacterium
AVAAPAITAVIPPAADPVSVRNAAG

SEQ ID NO: 943199 - protein, 17 aa, Mycobacterium
AVAAVSLALAGCGSKTE

SEQ ID NO: 943200 - protein, 25 aa, Mycobacterium
AVACALELQRAPLAPIRLRIGIHTG

SEQ ID NO: 943201 - protein, 24 aa, Mycobacterium
AVADDFRLQWPLRPAPAVVRGYDA

SEQ ID NO: 943202 - protein, 31 aa, Mycobacterium
AVAEFPGFAFFEIQLRLPIDGRWELVASSDT

SEQ ID NO: 943203 - protein, 30 aa, Mycobacterium
AVAEFPGFAFFEIQLRLPVDGRWVLVVTAD

SEQ ID NO: 943204 - protein, 18 aa, Mycobacterium
AVAEVTRQRQGWGAWPVC

SEQ ID NO: 943205 - protein, 20 aa, Mycobacterium
AVAGGARRPNGGSGAALTGR

SEQ ID NO: 943206 - protein, 30 aa, Mycobacterium
AVAGRPVVLNLWAYWCGPCADELPAMAEYQ

SEQ ID NO: 943207 - protein, 29 aa, Mycobacterium
AVAGRRVVLNLWAYWCAPCAAELPAMAEY

SEQ ID NO: 943208 - protein, 19 aa, Mycobacterium
AVAHCYIYEALRAAWEQTG

SEQ ID NO: 943209 - protein, 19 aa, Mycobacterium
AVAIHELLHAFGFTSGTEE

SEQ ID NO: 943210 - protein, 23 aa, Mycobacterium
AVAIMVLIVLLLANATVTQVFAA

SEQ ID NO: 943211 - protein, 28 aa, Mycobacterium
AVALFIASLLVLVVALKRPKTAAPPGSR

SEQ ID NO: 943212 - protein, 19 aa, Mycobacterium
AVALREWLGYAWVCLAEDP

SEQ ID NO: 943213 - protein, 27 aa, Mycobacterium
AVAPGPIDTPLWSALAPEGRDALYAQY

SEQ ID NO: 943214 - protein, 22 aa, Mycobacterium
AVARGSFFPVIPVCASTGVGTL

SEQ ID NO: 943215 - protein, 17 aa, Mycobacterium
AVASPCAYFLVYESTTE

SEQ ID NO: 943216 - protein, 24 aa, Mycobacterium
AVATATVILFGAAILRGNSAAADP

SEQ ID NO: 943217 - protein, 24 aa, Mycobacterium
AVATLLGWLLTRRSGSIREIDPGP

SEQ ID NO: 943218 - protein, 27 aa, Mycobacterium
AVATVPALATIWRVLSRRGFITAQPQK

SEQ ID NO: 943219 - protein, 28 aa, Mycobacterium
AVAVVLAIAALVLLASLTTGASTAHQLQ

SEQ ID NO: 943220 - protein, 18 aa, Mycobacterium
AVCPACAVGLVICGGDVN

SEQ ID NO: 943221 - protein, 17 aa, Mycobacterium
AVDAKYIQTAQAAGTMP

SEQ ID NO: 943222 - protein, 26 aa, Mycobacterium
AVDDSPYAVTWLIDSRQDRTGADPTP

SEQ ID NO: 943223 - protein, 35 aa, Mycobacterium
AVDGRLYRKVSYGPLLDVFVLDMRTYKNPNPQAWA

SEQ ID NO: 943224 - protein, 22 aa, Mycobacterium
AVDIGPAAAYGWMLAHSTQFGL

SEQ ID NO: 943225 - protein, 27 aa, Mycobacterium
AVDLGCSVVLVDPVRPPLVAAVGADMA

SEQ ID NO: 943226 - protein, 25 aa, Mycobacterium
AVDPRFVMPIFEGALAAGADYLDMA

SEQ ID NO: 943227 - protein, 25 aa, Mycobacterium
AVDSRGHPFLFDLQNLRGHGTGVGC

SEQ ID NO: 943228 - protein, 18 aa, Mycobacterium
AVEFIPPQTPSPTSLRPD

SEQ ID NO: 943229 - protein, 17 aa, Mycobacterium
AVEHQHFRRIFLTTGRS

SEQ ID NO: 943230 - protein, 31 aa, Mycobacterium
AVESILTVLALRDGIIPPTRNLNNLDPEIDL

SEQ ID NO: 943231 - protein, 24 aa, Mycobacterium
AVESILTVLALRDQVVPPTLNLEN

SEQ ID NO: 943232 - protein, 25 aa, Mycobacterium
AVESILTVLALRDQVVPPTLNLENL

SEQ ID NO: 943233 - protein, 20 aa, Mycobacterium
AVFDRLMRTKFFTAVRESPT

SEQ ID NO: 943234 - protein, 18 aa, Mycobacterium
AVFGNPTSPLANSLAGTV

SEQ ID NO: 943235 - protein, 17 aa, Mycobacterium
AVFHCPFCHGWEMRDRK

SEQ ID NO: 943236 - protein, 17 aa, Mycobacterium
AVFLALAIGVVLGSGFF

SEQ ID NO: 943237 - protein, 21 aa, Mycobacterium
AVFLDRLQKVGITSSNPYATI

SEQ ID NO: 943238 - protein, 23 aa, Mycobacterium
AVGALLPQVFGWARSVNAAQPLT

SEQ ID NO: 943239 - protein, 31 aa, Mycobacterium
AVGAPLPQDPPPPPPPPPGAPGQLPTADQLA

SEQ ID NO: 943240 - protein, 18 aa, Mycobacterium
AVGDAMIRLQPKAPTVSK

SEQ ID NO: 943241 - protein, 17 aa, Mycobacterium
AVGFDRPLPPNAPDFIA

SEQ ID NO: 943242 - protein, 19 aa, Mycobacterium
AVGMLSVPPTWAGSATLVS

SEQ ID NO: 943243 - protein, 23 aa, Mycobacterium
AVGREVALFPGSWSEWCSDPGRA

SEQ ID NO: 943244 - protein, 28 aa, Mycobacterium
AVGVTTPIHWCIYASQLPAEIAARKPTE

SEQ ID NO: 943245 - protein, 21 aa, Mycobacterium
AVHHALIFRQLSDNVTLLRHN

SEQ ID NO: 943246 - protein, 25 aa, Mycobacterium
AVHNADTIVLRRSRPLEISLDGHQV

SEQ ID NO: 943247 - protein, 30 aa, Mycobacterium
AVHPRGIGRVFPRRLLLGDHVIHELDIAFA

SEQ ID NO: 943248 - protein, 29 aa, Mycobacterium
AVIAASAVFMTFIAAAPPKGYDGPPVFVA

SEQ ID NO: 943249 - protein, 17 aa, Mycobacterium
AVIATCVVVPLAACSTI

SEQ ID NO: 943250 - protein, 18 aa, Mycobacterium
AVICGVGALWPTQHRRYI

SEQ ID NO: 943251 - protein, 26 aa, Mycobacterium
AVIRDGGGVPSFLGYHGFPATICASV

SEQ ID NO: 943252 - protein, 21 aa, Mycobacterium
AVIRLNGVFPGPGLPKPDPRD

SEQ ID NO: 943253 - protein, 17 aa, Mycobacterium
AVKAFMQAAIGPGQEGL

SEQ ID NO: 943254 - protein, 17 aa, Mycobacterium
AVKLHILTRKTLGGLET

SEQ ID NO: 943255 - protein, 24 aa, Mycobacterium
AVKQTWLDPFVPWEHDVTMTTREA

SEQ ID NO: 943256 - protein, 27 aa, Mycobacterium
AVLAAAALLPARWIVVGVGERDDVLGP

SEQ ID NO: 943257 - protein, 17 aa, Mycobacterium
AVLAALGTATALVAGCS

SEQ ID NO: 943258 - protein, 18 aa, Mycobacterium
AVLADPALRLAVCKGIDR

SEQ ID NO: 943259 - protein, 24 aa, Mycobacterium
AVLALGIAVFALIRTFDAEPDYTE

SEQ ID NO: 943260 - protein, 19 aa, Mycobacterium
AVLASLTLATALIAGCSSG

SEQ ID NO: 943261 - protein, 19 aa, Mycobacterium
AVLASLTLATALVAGCSSG

SEQ ID NO: 943262 - protein, 31 aa, Mycobacterium
AVLDPQGLPLAAAPLAWRPVIARGDLDGIAA

SEQ ID NO: 943263 - protein, 21 aa, Mycobacterium
AVLFALTLLTASCTRVVDGRS

SEQ ID NO: 943264 - protein, 18 aa, Mycobacterium
AVLFHLGQFIPQGVPDTY

SEQ ID NO: 943265 - protein, 28 aa, Mycobacterium
AVLGYDGYLIPLFTPWEFKGGSSVLHVD

SEQ ID NO: 943266 - protein, 21 aa, Mycobacterium
AVLLAFPLVPKAAAACPDVQV

SEQ ID NO: 943267 - protein, 20 aa, Mycobacterium
AVLLAKIRPGFLARKGYEPT

SEQ ID NO: 943268 - protein, 17 aa, Mycobacterium
AVLLIAGPQVSAPVPAV

SEQ ID NO: 943269 - protein, 19 aa, Mycobacterium
AVLLRSDGVAVAFGANDWG

SEQ ID NO: 943270 - protein, 28 aa, Mycobacterium
AVLLVLVIALCYRLWKLRQVGGTAAILR

SEQ ID NO: 943271 - protein, 36 aa, Mycobacterium
AVLRDDAIIVVPAWWKAFWYLERLSPALSMRAAKAM

SEQ ID NO: 943272 - protein, 19 aa, Mycobacterium
AVLRYLGFQPDDEVVVLLL

SEQ ID NO: 943273 - protein, 27 aa, Mycobacterium
AVLSAQPVYFAYWKAKGVDVTPFFAVL

SEQ ID NO: 943274 - protein, 18 aa, Mycobacterium
AVLTAQPVYFDYWSARGV

SEQ ID NO: 943275 - protein, 31 aa, Mycobacterium
AVMDQAGRFLPFDTPFTWAGMQYYTQMPASD

SEQ ID NO: 943276 - protein, 24 aa, Mycobacterium
AVMLFIASIIVLTVALRRPKTPAR

SEQ ID NO: 943277 - protein, 21 aa, Mycobacterium
AVNEFFTSLFAMDAEQRKAAV

SEQ ID NO: 943278 - protein, 18 aa, Mycobacterium
AVNGGYFCRALPADVDGW

SEQ ID NO: 943279 - protein, 36 aa, Mycobacterium
AVNGGYFCRGLPTDFTAWAVPGWSWDDVLPHFRAIE

SEQ ID NO: 943280 - protein, 23 aa, Mycobacterium
AVNKMKNWISGFGPQIDGVVAQN

SEQ ID NO: 943281 - protein, 23 aa, Mycobacterium
AVNKMKNWISSFGPQIDGVVAQN

SEQ ID NO: 943282 - protein, 28 aa, Mycobacterium
AVNNGFFYNGFASNLLPGPAIQPFLDYA

SEQ ID NO: 943283 - protein, 17 aa, Mycobacterium
AVNPIYGPALDGTLPGN

SEQ ID NO: 943284 - protein, 27 aa, Mycobacterium
AVNRPTPLMLPGFAVRAGLGEFADEGL

SEQ ID NO: 943285 - protein, 25 aa, Mycobacterium
AVNTAAWFVMATIPNAVFLGHALDV

SEQ ID NO: 943286 - protein, 19 aa, Mycobacterium
AVNVYPIAVLKNAPQPTLA

SEQ ID NO: 943287 - protein, 17 aa, Mycobacterium
AVPASWSSAAPALPSGT

SEQ ID NO: 943288 - protein, 23 aa, Mycobacterium
AVPDPRIGALFLGGGPVHTCTGT

SEQ ID NO: 943289 - protein, 22 aa, Mycobacterium
AVPEWKGLANLPVSTALASIPE

SEQ ID NO: 943290 - protein, 17 aa, Mycobacterium
AVPPTPIQLRTTGRLLG

SEQ ID NO: 943291 - protein, 28 aa, Mycobacterium
AVPQVPQAPPIPPVPGLGEPIPGMDRVN

SEQ ID NO: 943292 - protein, 23 aa, Mycobacterium
AVPSWKALNDVPVSQALAAIPEI

SEQ ID NO: 943293 - protein, 25 aa, Mycobacterium
AVPTVEVSFLHLLFTIQTCGVTAEL

SEQ ID NO: 943294 - protein, 17 aa, Mycobacterium
AVPTVTTGTALAADAAG

SEQ ID NO: 943295 - protein, 23 aa, Mycobacterium
AVQKRLPIWVGGRTLRSLRRATS

SEQ ID NO: 943296 - protein, 20 aa, Mycobacterium
AVQLLRNGVGYKGPPFTGPV

SEQ ID NO: 943297 - protein, 28 aa, Mycobacterium
AVRATFKPEFINRLDDVLIFEGLNPEEL

SEQ ID NO: 943298 - protein, 25 aa, Mycobacterium
AVRDENFIVLPYAALVEGPRNPDAI

SEQ ID NO: 943299 - protein, 26 aa, Mycobacterium
AVRGDYLNVFVTFDLTARRLGETLFT

SEQ ID NO: 943300 - protein, 18 aa, Mycobacterium
AVRGGILDVFPPTAEHPV

SEQ ID NO: 943301 - protein, 30 aa, Mycobacterium
AVRISQAFQSLLYLPLYVAKEKGYFEEQNI

SEQ ID NO: 943302 - protein, 30 aa, Mycobacterium
AVRLVEGAALAPFGLIPVAQGLATSATTGD

SEQ ID NO: 943303 - protein, 25 aa, Mycobacterium
AVRRRPYTVILFDEIEKAHPDVFDV

SEQ ID NO: 943304 - protein, 22 aa, Mycobacterium
AVRTHFFDSYFIDAVAAGIRQV

SEQ ID NO: 943305 - protein, 20 aa, Mycobacterium
AVSAQWWLRENAKPLAVAAG

SEQ ID NO: 943306 - protein, 17 aa, Mycobacterium
AVSLLGTGSFEASWPAL

SEQ ID NO: 943307 - protein, 23 aa, Mycobacterium
AVSLLLIASGALLATLYVTQYRI

SEQ ID NO: 943308 - protein, 18 aa, Mycobacterium
AVSSAQPVYFHYWATRGV

SEQ ID NO: 943309 - protein, 27 aa, Mycobacterium
AVSSDTYFIGFPDWLPIGASNSVDADA

SEQ ID NO: 943310 - protein, 23 aa, Mycobacterium
AVTAAPVALLPGCGVPGAVGVLA

SEQ ID NO: 943311 - protein, 19 aa, Mycobacterium
AVTAEPVVLVAPPGLVARR

SEQ ID NO: 943312 - protein, 31 aa, Mycobacterium
AVTDAMPALHLLPLAGVLGALPVLATEVLRM

SEQ ID NO: 943313 - protein, 17 aa, Mycobacterium
AVTLAVVLAIGGCSSNG

SEQ ID NO: 943314 - protein, 19 aa, Mycobacterium
AVTLFRGDFTKTEPVTLIS

SEQ ID NO: 943315 - protein, 24 aa, Mycobacterium
AVTNDGVIFFFDQGRMVPDATQVL

SEQ ID NO: 943316 - protein, 22 aa, Mycobacterium
AVTPNLYPQLAAIAPTVFTAAP

SEQ ID NO: 943317 - protein, 26 aa, Mycobacterium
AVTRRRQAVLLGSLRRRLSRTVFDCA

SEQ ID NO: 943318 - protein, 26 aa, Mycobacterium
AVVAASWAFLGWRHLRTGQARTGALR

SEQ ID NO: 943319 - protein, 22 aa, Mycobacterium
AVVADDWRDGLSASVRAGVRAA

SEQ ID NO: 943320 - protein, 32 aa, Mycobacterium
AVVAEFRDQFPLPEKLWTIADLGGWDTVDPQL

SEQ ID NO: 943321 - protein, 25 aa, Mycobacterium
AVVFGGKLWHLMLGAGNDYTGTGKH

SEQ ID NO: 943322 - protein, 21 aa, Mycobacterium
AVVKFRDNALWGATNAVRTAV

SEQ ID NO: 943323 - protein, 27 aa, Mycobacterium
AVVLFGTPSPFFLGLVDHSAPPLVIGP

SEQ ID NO: 943324 - protein, 22 aa, Mycobacterium
AVVMMFLALVGCAPKQSISNPP

SEQ ID NO: 943325 - protein, 27 aa, Mycobacterium
AVVNTARPWYFGYNGFRPAPSPGGIEP

SEQ ID NO: 943326 - protein, 18 aa, Mycobacterium
AVVPVRMQVWAESRGPAH

SEQ ID NO: 943327 - protein, 27 aa, Mycobacterium
AVVPWWPWAPLVRLMRVLPPPLAKLFA

SEQ ID NO: 943328 - protein, 29 aa, Mycobacterium
AVVSFPPTQWIRWRKPVIGAPTTPKIVEP

SEQ ID NO: 943329 - protein, 26 aa, Mycobacterium
AVVSPPYYRLVLGMPPLDDRAIDGLV

SEQ ID NO: 943330 - protein, 22 aa, Mycobacterium
AVVTFNYRLGTLGFLAAPGLSG

SEQ ID NO: 943331 - protein, 24 aa, Mycobacterium
AVVTTLHRYGVSPAALAAVATVGG

SEQ ID NO: 943332 - protein, 20 aa, Mycobacterium
AVVVTSAAAFGLCPGAAADP

SEQ ID NO: 943333 - protein, 29 aa, Mycobacterium
AVVVVAALVFGLVRYRSRRISLTRSDKNT

SEQ ID NO: 943334 - protein, 29 aa, Mycobacterium
AVWRVRAYGDFFSYCLLAEGAIDIAAEPE

SEQ ID NO: 943335 - protein, 19 aa, Mycobacterium
AVYVDAGHSRWVNAEDMAA

SEQ ID NO: 943336 - protein, 19 aa, Mycobacterium
AVYVPKENVQMITKLLISA

SEQ ID NO: 943337 - protein, 25 aa, Mycobacterium
AWALTPDELILYMPDYPVGHDSPIQ

SEQ ID NO: 943338 - protein, 19 aa, Mycobacterium
AWFLARALRDHPGDLGHAC

SEQ ID NO: 943339 - protein, 22 aa, Mycobacterium
AWHRLTAAMRPDWTRTVAARRA

SEQ ID NO: 943340 - protein, 18 aa, Mycobacterium
AWLVVDVRDLAALHTALL

SEQ ID NO: 943341 - protein, 19 aa, Mycobacterium
AWPNPFTMTNNVAAALFPT

SEQ ID NO: 943342 - protein, 21 aa, Mycobacterium
AWQHHGRGRPAKRFQLTADGR

SEQ ID NO: 943343 - protein, 20 aa, Mycobacterium
AWQLRALFAAGLSAMYAAEV

SEQ ID NO: 943344 - protein, 28 aa, Mycobacterium
AWVLDGDSLLLFLPSVRLGPVGAGLFEV

SEQ ID NO: 943345 - protein, 27 aa, Mycobacterium
AWVSNAGISFMHRFLDAPIERFDQTMD

SEQ ID NO: 943346 - protein, 17 aa, Mycobacterium
AWYLQYAGKKSIGPDKI

SEQ ID NO: 943347 - protein, 23 aa, Mycobacterium
AYAEPPLVFPGMEIHQDIHICTL

SEQ ID NO: 943348 - protein, 29 aa, Mycobacterium
AYARGLRDAGLLPVLKHFPGHGRASGDSH

SEQ ID NO: 943349 - protein, 46 aa, Mycobacterium
AYATAEAANAGPLQPLLDLINAPTQALLARPLIGDGSNGAPGTGQA

SEQ ID NO: 943350 - protein, 18 aa, Mycobacterium
AYAWDMGAYGWPAPERLR

SEQ ID NO: 943351 - protein, 22 aa, Mycobacterium
AYDAGRRLLYWTSEGYIHDDAS

SEQ ID NO: 943352 - protein, 17 aa, Mycobacterium
AYEEAIRVPLYIRDPQG

SEQ ID NO: 943353 - protein, 18 aa, Mycobacterium
AYEQMWALDVAAMAAYHA

SEQ ID NO: 943354 - protein, 17 aa, Mycobacterium
AYERWDGSGLPGGAAGA

SEQ ID NO: 943355 - protein, 21 aa, Mycobacterium
AYGDLLNGAIIIVKPGEPTTI

SEQ ID NO: 943356 - protein, 17 aa, Mycobacterium
AYGGYVPIFTPDPWDEG

SEQ ID NO: 943357 - protein, 17 aa, Mycobacterium
AYGQAYQALSTRAADVH

SEQ ID NO: 943358 - protein, 22 aa, Mycobacterium
AYGSSVLILPDASLDAVHVSAS

SEQ ID NO: 943359 - protein, 33 aa, Mycobacterium
AYLARLHTLGLTWPADHDLPLTTMGRLICDDIA

SEQ ID NO: 943360 - protein, 21 aa, Mycobacterium
AYLVADILGLRVDLRSADWAQ

SEQ ID NO: 943361 - protein, 17 aa, Mycobacterium
AYNFPVYVTPDRDLRQP

SEQ ID NO: 943362 - protein, 24 aa, Mycobacterium
AYQAQFTHHMYLPMDADAVADDAP

SEQ ID NO: 943363 - protein, 26 aa, Mycobacterium
AYQGEFALPPSFMFTGDQTAGPRPNG

SEQ ID NO: 943364 - protein, 25 aa, Mycobacterium
AYRTLFMTVRRLVLGRRLTVRLGDG

SEQ ID NO: 943365 - protein, 18 aa, Mycobacterium
AYSLLISRYMVARQHERG

SEQ ID NO: 943366 - protein, 26 aa, Mycobacterium
AYSSPIALVALLAVGKIISTMLTGDA

SEQ ID NO: 943367 - protein, 18 aa, Mycobacterium
AYTFKLRSGVTFSDGTPL

SEQ ID NO: 943368 - protein, 24 aa, Mycobacterium
AYYVHTDYLFLTPAQIDAAVHLTN

SEQ ID NO: 943369 - protein, 23 aa, Mycobacterium
CADYCVAVYRLMLADAVDYHSAI

SEQ ID NO: 943370 - protein, 21 aa, Mycobacterium
CAGWLIRDLVCHLIIDAQDVL

SEQ ID NO: 943371 - protein, 24 aa, Mycobacterium
CAIGFIDTRRRIAYSAGHCATTQT

SEQ ID NO: 943372 - protein, 24 aa, Mycobacterium
CAISALPAVFPPATHAAAAFGPLA

SEQ ID NO: 943373 - protein, 29 aa, Mycobacterium
CALMAALPMRLLLATMLVAGSLVIAVGVA

SEQ ID NO: 943374 - protein, 29 aa, Mycobacterium
CAQSLTVPLLAPVIRRWHRRHPDVAISLR

SEQ ID NO: 943375 - protein, 21 aa, Mycobacterium
CAQYLTPVLDAIKFNGPPAGI

SEQ ID NO: 943376 - protein, 26 aa, Mycobacterium
CARDPFGIKPLFMATGPGGTALASEK

SEQ ID NO: 943377 - protein, 25 aa, Mycobacterium
CARDPFGIKPLFMATGPGGTAVGSE

SEQ ID NO: 943378 - protein, 18 aa, Mycobacterium
CATAAVGPPLPPGLQGNM

SEQ ID NO: 943379 - protein, 17 aa, Mycobacterium
CATLDRYPTLAGVDGLL

SEQ ID NO: 943380 - protein, 19 aa, Mycobacterium
CATYGASVLILPDASRDAV

SEQ ID NO: 943381 - protein, 18 aa, Mycobacterium
CAVAPLNGYLSSGKLPNT

SEQ ID NO: 943382 - protein, 22 aa, Mycobacterium
CAVPGVWPPVTIGERRFMDGGV

SEQ ID NO: 943383 - protein, 23 aa, Mycobacterium
CCASGVPWKLLQRSAVHAVSVDV

SEQ ID NO: 943384 - protein, 17 aa, Mycobacterium
CCRQTLPSALTWRRIAG

SEQ ID NO: 943385 - protein, 17 aa, Mycobacterium
CDAWLARMLAGEQSLDV

SEQ ID NO: 943386 - protein, 21 aa, Mycobacterium
CEALPYAYERWDGSGLPGGAA

SEQ ID NO: 943387 - protein, 19 aa, Mycobacterium
CEFDILICDAPPGRRHDRT

SEQ ID NO: 943388 - protein, 18 aa, Mycobacterium
CEIDYQRRGIPDSAFCFS

SEQ ID NO: 943389 - protein, 26 aa, Mycobacterium
CELPDRLRRLFAGAGVVPRVVLVDRN

SEQ ID NO: 943390 - protein, 25 aa, Mycobacterium
CERNNLTVMRTILKLMGRDPDDFDH

SEQ ID NO: 943391 - protein, 25 aa, Mycobacterium
CERRGTWVYYWVVPEALQQLSSVLH

SEQ ID NO: 943392 - protein, 23 aa, Mycobacterium
CFDLMFFDDRLAMPGVYGGSVGE

SEQ ID NO: 943393 - protein, 23 aa, Mycobacterium
CGAASGLPIGWYSHPAQGIKEII

SEQ ID NO: 943394 - protein, 27 aa, Mycobacterium
CGAGSLPVPLWWAKICDAWWCTDTSLP

SEQ ID NO: 943395 - protein, 26 aa, Mycobacterium
CGELGIPHLVLARPAWDPGSAIVVES

SEQ ID NO: 943396 - protein, 26 aa, Mycobacterium
CGELNKPYLVLARPPWDPGDAIVVAS

SEQ ID NO: 943397 - protein, 20 aa, Mycobacterium
CGGDYEWTRAKAAYFMVVFS

SEQ ID NO: 943398 - protein, 33 aa, Mycobacterium
CGGNEAWNLPVVFGPIALAYNLPGVDKLVLNAD

SEQ ID NO: 943399 - protein, 29 aa, Mycobacterium
CGGSPAWNLPVVFGPIAVTYNISGVSSLN

SEQ ID NO: 943400 - protein, 17 aa, Mycobacterium
CGLAALPADFHGVVVVT

SEQ ID NO: 943401 - protein, 25 aa, Mycobacterium
CGLAGTVLRFVPPLAALAEAVVEFD

SEQ ID NO: 943402 - protein, 29 aa, Mycobacterium
CGLAPAIHRFPFTLTFKEPLPIPVKTYPL

SEQ ID NO: 943403 - protein, 35 aa, Mycobacterium
CGLQPGIIDVPFTLSFKAPLPIPVDQYPLICEPGG

SEQ ID NO: 943404 - protein, 19 aa, Mycobacterium
CGNFDIADKWTSASGTFVA

SEQ ID NO: 943405 - protein, 17 aa, Mycobacterium
CGRFREGLAGFDALLTD

SEQ ID NO: 943406 - protein, 27 aa, Mycobacterium
CGSEAWDLPVVFGPIAVTYNLKGVSAL

SEQ ID NO: 943407 - protein, 25 aa, Mycobacterium
CGTMVVALLAGCPRLTILATSREPL

SEQ ID NO: 943408 - protein, 17 aa, Mycobacterium
CGVIGTALWLDGRLHHV

SEQ ID NO: 943409 - protein, 18 aa, Mycobacterium
CHHWYWVPVGGMGNVGQF

SEQ ID NO: 943410 - protein, 22 aa, Mycobacterium
CHQHQLLDWQPTPQPTTLTDPN

SEQ ID NO: 943411 - protein, 24 aa, Mycobacterium
CIGGIPGYIGLELAAQGVVGPGAQ

SEQ ID NO: 943412 - protein, 29 aa, Mycobacterium
CKRPLMSRDWYPTFALPNVSLETAAIAEL

SEQ ID NO: 943413 - protein, 24 aa, Mycobacterium
CKTYKWETFLTQELPAWLAANRDV

SEQ ID NO: 943414 - protein, 23 aa, Mycobacterium
CLADALFPPAAIATVQLLERLGH

SEQ ID NO: 943415 - protein, 19 aa, Mycobacterium
CLAILLLAACGAPDGSDGR

SEQ ID NO: 943416 - protein, 17 aa, Mycobacterium
CLLSVGGLLVGCHSAIE

SEQ ID NO: 943417 - protein, 21 aa, Mycobacterium
CLNPPLIWERGKGFFTTEPFS

SEQ ID NO: 943418 - protein, 26 aa, Mycobacterium
CLTDGAWPAFWLLNDNPVRGGEVDLV

SEQ ID NO: 943419 - protein, 25 aa, Mycobacterium
CLTYNWETFLTQELPAWLQANRDVR

SEQ ID NO: 943420 - protein, 18 aa, Mycobacterium
CLVEVDVAYYSEPESRQK

SEQ ID NO: 943421 - protein, 18 aa, Mycobacterium
CLVTSGLFMAGLGGALAF

SEQ ID NO: 943422 - protein, 19 aa, Mycobacterium
CLWGGLALLLSCCGRPTSQ

SEQ ID NO: 943423 - protein, 18 aa, Mycobacterium
CMGLPHIGFGQRSKYLVT

SEQ ID NO: 943424 - protein, 17 aa, Mycobacterium
CMRVVNAVPWTDRLLAR

SEQ ID NO: 943425 - protein, 23 aa, Mycobacterium
CPDLGFISAIPQPLRSLAHERCL

SEQ ID NO: 943426 - protein, 18 aa, Mycobacterium
CPFHGWVWNGAGRNVHIP

SEQ ID NO: 943427 - protein, 18 aa, Mycobacterium
CPGAAAYALLPEVRNIAA

SEQ ID NO: 943428 - protein, 25 aa, Mycobacterium
CPGEAAYRLIPRLRDIAAGAANGEP

SEQ ID NO: 943429 - protein, 19 aa, Mycobacterium
CPGFTLNYTSSGSGAGVSE

SEQ ID NO: 943430 - protein, 21 aa, Mycobacterium
CPPVYVPWTPDFAGRNDFRGE

SEQ ID NO: 943431 - protein, 19 aa, Mycobacterium
CPQSRLEPILLADTRRRGG

SEQ ID NO: 943432 - protein, 26 aa, Mycobacterium
CPRTTARWKWRLSLFSEPSAPKSDWR

SEQ ID NO: 943433 - protein, 18 aa, Mycobacterium
CRAAIAVVFVLVSVETPA

SEQ ID NO: 943434 - protein, 17 aa, Mycobacterium
CRAANPKVKLPAGALCG

SEQ ID NO: 943435 - protein, 19 aa, Mycobacterium
CRIGRWTGGDKTVACMVPK

SEQ ID NO: 943436 - protein, 19 aa, Mycobacterium
CRLALAPAAIMMFIGAPGW

SEQ ID NO: 943437 - protein, 19 aa, Mycobacterium
CRRLDGMPLAIELAAARIR

SEQ ID NO: 943438 - protein, 19 aa, Mycobacterium
CRRLDGMPLALELAAARVR

SEQ ID NO: 943439 - protein, 29 aa, Mycobacterium
CRSRHHVSSWRYWLLAGLGMTVISVAPAV

SEQ ID NO: 943440 - protein, 17 aa, Mycobacterium
CRTLAADPGWYGDNRDR

SEQ ID NO: 943441 - protein, 29 aa, Mycobacterium
CRVRRILIAALSAVLLVLVSAIPSWAMTL

SEQ ID NO: 943442 - protein, 23 aa, Mycobacterium
CSAPGLYTAALGLANVFADASED

SEQ ID NO: 943443 - protein, 20 aa, Mycobacterium
CSHWATLSGLFWLGRVGTPQ

SEQ ID NO: 943444 - protein, 30 aa, Mycobacterium
CSTFKGLLGAAVLHRYPIAHLGTVITYNSA

SEQ ID NO: 943445 - protein, 27 aa, Mycobacterium
CSVIGPTFPNRLYWVSAWLDPDGANGG

SEQ ID NO: 943446 - protein, 17 aa, Mycobacterium
CTDLPRVPFEKHPPFVI

SEQ ID NO: 943447 - protein, 19 aa, Mycobacterium
CTEHVLVTEYLDGVPFDHL

SEQ ID NO: 943448 - protein, 17 aa, Mycobacterium
CTILAAAAAGVAVTLAA

SEQ ID NO: 943449 - protein, 22 aa, Mycobacterium
CTLGYVDPALKVAFTAGHCRGG

SEQ ID NO: 943450 - protein, 25 aa, Mycobacterium
CTTYKWETFLTSELPQYLQSNKSVK

SEQ ID NO: 943451 - protein, 18 aa, Mycobacterium
CVAVVLTGCSLFGGGQKG

SEQ ID NO: 943452 - protein, 19 aa, Mycobacterium
CVCPLGVKTPLLQGIRGID

SEQ ID NO: 943453 - protein, 17 aa, Mycobacterium
CVFFESPRRLAACLRDA

SEQ ID NO: 943454 - protein, 25 aa, Mycobacterium
CVGQTLLDFMFRHIQPYFTEDINQL

SEQ ID NO: 943455 - protein, 23 aa, Mycobacterium
CVIGFVEPQMRIAFSAGRCNGDP

SEQ ID NO: 943456 - protein, 28 aa, Mycobacterium
CVLALILATFWIVVIANSFKDRGDSRKA

SEQ ID NO: 943457 - protein, 28 aa, Mycobacterium
CVLLLVVVALFYRLWKLRQVGGTAAILR

SEQ ID NO: 943458 - protein, 18 aa, Mycobacterium
CVQYLAPIVKNRQFNFPP

SEQ ID NO: 943459 - protein, 25 aa, Mycobacterium
CVRRAQARPWWRPGGAIWPVSELQI

SEQ ID NO: 943460 - protein, 17 aa, Mycobacterium
CVTNPPEAVPPPAPMPF

SEQ ID NO: 943461 - protein, 25 aa, Mycobacterium
CVTYKWETFLTSELPEWLAANRDVA

SEQ ID NO: 943462 - protein, 17 aa, Mycobacterium
CVVPKKPDAPPAPDLPI

SEQ ID NO: 943463 - protein, 17 aa, Mycobacterium
CWDPFPKLGQQRAPRPG

SEQ ID NO: 943464 - protein, 18 aa, Mycobacterium
CWSVVSAIALVASGCTST

SEQ ID NO: 943465 - protein, 26 aa, Mycobacterium
CYPYREPLPAPPPGGPPPGPPAVSPP

SEQ ID NO: 943466 - protein, 19 aa, Mycobacterium
CYRMLPPPGAIAAGGLYTA

SEQ ID NO: 943467 - protein, 26 aa, Mycobacterium
DAAARIANYLDWLSRCGSYRVTNYFF

SEQ ID NO: 943468 - protein, 27 aa, Mycobacterium
DAAGPALAKYILFATPDDMNGSFKASI

SEQ ID NO: 943469 - protein, 28 aa, Mycobacterium
DAAKQPWPAGWQFPDDCVYAIGPGQAPV

SEQ ID NO: 943470 - protein, 26 aa, Mycobacterium
DAAPGRITAILALHDLINGGRPAHYG

SEQ ID NO: 943471 - protein, 18 aa, Mycobacterium
DAAPPPAAAPAPPILALP

SEQ ID NO: 943472 - protein, 23 aa, Mycobacterium
DAARIRTAPPPIPNLVPVQPFQE

SEQ ID NO: 943473 - protein, 25 aa, Mycobacterium
DAARLRQYLAVKPRRVLTIGAGFIG

SEQ ID NO: 943474 - protein, 21 aa, Mycobacterium
DAATDPALTAALTVLCDTLTR

SEQ ID NO: 943475 - protein, 28 aa, Mycobacterium
DAAYAMAFAWHREFLHRIDTLVTRCVAD

SEQ ID NO: 943476 - protein, 18 aa, Mycobacterium
DACQLQVHPITEAAPQSG

SEQ ID NO: 943477 - protein, 32 aa, Mycobacterium
DADFVVFEGILYATLTPNKWSDFGPAADIYDP

SEQ ID NO: 943478 - protein, 24 aa, Mycobacterium
DADGFWAAVLHRTAERRADVFAAV

SEQ ID NO: 943479 - protein, 28 aa, Mycobacterium
DADGSLWRQFGVPWQPAYLFINSNGTSD

SEQ ID NO: 943480 - protein, 19 aa, Mycobacterium
DADHWLIANGRQFGLCQIY

SEQ ID NO: 943481 - protein, 25 aa, Mycobacterium
DADLAQRFFLMAARGIRPTWAMNQA

SEQ ID NO: 943482 - protein, 17 aa, Mycobacterium
DADLMKGARERAFNDAK

SEQ ID NO: 943483 - protein, 38 aa, Mycobacterium
DADSNTHYYVIRTYPIPLLMPLDPFLSDSAMAALDAPL

SEQ ID NO: 943484 - protein, 26 aa, Mycobacterium
DAEALKIPIRLPVLPDGWQANSGGRS

SEQ ID NO: 943485 - protein, 31 aa, Mycobacterium
DAEGLPHIPVRLHARSWHRYAEPPPESTAII

SEQ ID NO: 943486 - protein, 19 aa, Mycobacterium
DAERRSMTAGWFLGQLTGQ

SEQ ID NO: 943487 - protein, 18 aa, Mycobacterium
DAERRTMTAGWLLGQIIG

SEQ ID NO: 943488 - protein, 23 aa, Mycobacterium
DAETRLLSMLPAGYAASACKAVE

SEQ ID NO: 943489 - protein, 25 aa, Mycobacterium
DAEVQRKVFRALLTGDDDGAFELAV

SEQ ID NO: 943490 - protein, 28 aa, Mycobacterium
DAFDERFKPVAELISWDANGFDGEFCGD

SEQ ID NO: 943491 - protein, 25 aa, Mycobacterium
DAGATLKYTWTWGEGRDFGYDTTAT

SEQ ID NO: 943492 - protein, 27 aa, Mycobacterium
DAGDQAGFPLGWVHDVVWAPRPVTVPV

SEQ ID NO: 943493 - protein, 29 aa, Mycobacterium
DAGDWSGIAPLQLFGHCLGAVVAFEFARI

SEQ ID NO: 943494 - protein, 17 aa, Mycobacterium
DAGGMWAGYGSPKGNCD

SEQ ID NO: 943495 - protein, 23 aa, Mycobacterium
DAGHWLDFWDSTFNNQGGLRIHL

SEQ ID NO: 943496 - protein, 23 aa, Mycobacterium
DAGKIVLRRSRPLQISLDGHDTK

SEQ ID NO: 943497 - protein, 21 aa, Mycobacterium
DAGLPVINDPGYRLVAACIDA

SEQ ID NO: 943498 - protein, 39 aa, Mycobacterium; identical to SEQ ID NO: 147856

SEQ ID NO: 943499 - protein, 17 aa, Mycobacterium
DAGVLPVLKHFPGHGSG

SEQ ID NO: 943500 - protein, 18 aa, Mycobacterium
DAIIGTIMVMYSPTLWEA

SEQ ID NO: 943501 - protein, 17 aa, Mycobacterium
DAILIPRVNAGYSRNDD

SEQ ID NO: 943502 - protein, 21 aa, Mycobacterium
DAITDLFLKAMTIPDATREQK

SEQ ID NO: 943503 - protein, 21 aa, Mycobacterium
DAITLIDLLRMRSGLYCYTND

SEQ ID NO: 943504 - protein, 24 aa, Mycobacterium
DAKGNTIAWLYSQRRFEVPSDKIA

SEQ ID NO: 943505 - protein, 25 aa, Mycobacterium
DAKLLDILVRLTGSGYQQLFGPVMG

SEQ ID NO: 943506 - protein, 25 aa, Mycobacterium
DALEAAIRYWMENKYMVGGLVDAEH

SEQ ID NO: 943507 - protein, 18 aa, Mycobacterium
DALETWYPELNITVNVIK

SEQ ID NO: 943508 - protein, 22 aa, Mycobacterium
DALGPITILVNNAAFTAPGRPP

SEQ ID NO: 943509 - protein, 22 aa, Mycobacterium
DALKPYFDEMFLGRGQVATILR

SEQ ID NO: 943510 - protein, 24 aa, Mycobacterium
DALNLMVIKPWTVAYLDTLRRDMD

SEQ ID NO: 943511 - protein, 17 aa, Mycobacterium
DALQPYFDEMFLGRGDV

SEQ ID NO: 943512 - protein, 18 aa, Mycobacterium
DALQPYFDEMFLGRGDVA

SEQ ID NO: 943513 - protein, 17 aa, Mycobacterium
DALWVIESKTGQATPVY

SEQ ID NO: 943514 - protein, 22 aa, Mycobacterium
DAMEILFEPQNPPALSFEPADA

SEQ ID NO: 943515 - protein, 17 aa, Mycobacterium
DANFVVVDGTLYATLTP

SEQ ID NO: 943516 - protein, 26 aa, Mycobacterium
DANLGSALTRQRLGWEPTGPGLLADL

SEQ ID NO: 943517 - protein, 22 aa, Mycobacterium
DANRMWGPPQFGRWKWHDPAVH

SEQ ID NO: 943518 - protein, 24 aa, Mycobacterium
DANSSMIINWTVAPAGPGCSVTVK

SEQ ID NO: 943519 - protein, 22 aa, Mycobacterium
DANYRYFNAHVPQLVQWDDHEV

SEQ ID NO: 943520 - protein, 18 aa, Mycobacterium
DANYYSPAAVRRVVPYPG

SEQ ID NO: 943521 - protein, 25 aa, Mycobacterium
DAPARGLQIPLFAIAANPSTVYVAA

SEQ ID NO: 943522 - protein, 26 aa, Mycobacterium
DAPARGLQIPLFAIAANPSTVYVAGP

SEQ ID NO: 943523 - protein, 35 aa, Mycobacterium
DAPKVHSLGLFQPLPGRYLDIITNRVTADGTPETI

SEQ ID NO: 943524 - protein, 18 aa, Mycobacterium
DAPLTAGGIPTLVPAANP

SEQ ID NO: 943525 - protein, 20 aa, Mycobacterium
DAPQVRRLVYTYAPDDNARA

SEQ ID NO: 943526 - protein, 26 aa, Mycobacterium
DAPRIDAVLPMFLEFAGDAVLVAHNA

SEQ ID NO: 943527 - protein, 19 aa, Mycobacterium
DAPWAPFDIEFNLANIGGP

SEQ ID NO: 943528 - protein, 17 aa, Mycobacterium
DAQKFLTFITSKAGQEV

SEQ ID NO: 943529 - protein, 25 aa, Mycobacterium
DAQTPSRVITLPGPATALTCDDHGT

SEQ ID NO: 943530 - protein, 24 aa, Mycobacterium
DARDAAIILLDPSVGVPLGHVGGR

SEQ ID NO: 943531 - protein, 17 aa, Mycobacterium
DARFHWGVALMPSGPAG

SEQ ID NO: 943532 - protein, 20 aa, Mycobacterium
DARGIADFPTRFPTVTASCL

SEQ ID NO: 943533 - protein, 24 aa, Mycobacterium
DARQHPLFKKYAAVARGRVVAYLG

SEQ ID NO: 943534 - protein, 25 aa, Mycobacterium
DARRQLIALTPVRDTLPAWRIEPPA

SEQ ID NO: 943535 - protein, 30 aa, Mycobacterium
DARRVADILGIPFYVWDFADRFKDDVIDDF

SEQ ID NO: 943536 - protein, 30 aa, Mycobacterium
DARRVADMLGIPFYVWDFADRFKEDVIDDF

SEQ ID NO: 943537 - protein, 34 aa, Mycobacterium
DASAILWNDLPTLPLYRQPRVLIAPKSMYAATPS

SEQ ID NO: 943538 - protein, 22 aa, Mycobacterium
DASGLIQYAYAGAGIKLPRSSG

SEQ ID NO: 943539 - protein, 23 aa, Mycobacterium
DASKKVFGFAPYPGVNPDEPARV

SEQ ID NO: 943540 - protein, 24 aa, Mycobacterium
DASVRRWFACANRKFVDRPPGKPE

SEQ ID NO: 943541 - protein, 31 aa, Mycobacterium
DATDDAFLAQMHKLGFTWPAGDDSDIVSMGH

SEQ ID NO: 943542 - protein, 19 aa, Mycobacterium
DATFRWGVAMLPIGPAGRV

SEQ ID NO: 943543 - protein, 24 aa, Mycobacterium
DATLLVNGSFLTVTALGNCYAVTV

SEQ ID NO: 943544 - protein, 21 aa, Mycobacterium
DATLVQIIRWLRPGALIAVAK

SEQ ID NO: 943545 - protein, 21 aa, Mycobacterium
DATLVQIIRWLRPGAVIAIAK

SEQ ID NO: 943546 - protein, 21 aa, Mycobacterium
DATLVTIMRWLRPGAVIAIAE

SEQ ID NO: 943547 - protein, 24 aa, Mycobacterium
DATTIDVVYSWFDAGTLQRERDLA

SEQ ID NO: 943548 - protein, 29 aa, Mycobacterium
DATVGTILPLYSPNLWRHLTDALTALKKG

SEQ ID NO: 943549 - protein, 24 aa, Mycobacterium
DAVELELYRRLPGDLSVLTPSPAS

SEQ ID NO: 943550 - protein, 19 aa, Mycobacterium
DAVIAVHLSGAFNVTRAVW

SEQ ID NO: 943551 - protein, 23 aa, Mycobacterium
DAVIPIERTAVPVSWDDFRVQLE

SEQ ID NO: 943552 - protein, 18 aa, Mycobacterium
DAVNAPSQALTGRPLIGN

SEQ ID NO: 943553 - protein, 26 aa, Mycobacterium
DAVNNLTWLPPAPMNNTYAFAIREAE

SEQ ID NO: 943554 - protein, 38 aa, Mycobacterium
DAVNVPVILYDIPPRSVVPIDFHIIRELAAHPNIVAVK

SEQ ID NO: 943555 - protein, 22 aa, Mycobacterium
DAVRYDVKFGKPVLLPAAVGVW

SEQ ID NO: 943556 - protein, 21 aa, Mycobacterium
DAVVPKVRPIVDAVAQRGAQA

SEQ ID NO: 943557 - protein, 17 aa, Mycobacterium
DAYEQRTFISVAKDPDA

SEQ ID NO: 943558 - protein, 25 aa, Mycobacterium
DCFSGAYMRWVAEDSSQRFSLSTGE

SEQ ID NO: 943559 - protein, 33 aa, Mycobacterium
DCGNFDRFYFATKQFVYQLKTPPAGSFSLGGHD

SEQ ID NO: 943560 - protein, 19 aa, Mycobacterium
DCLGITTMLAKSAYQSARR

SEQ ID NO: 943561 - protein, 26 aa, Mycobacterium
DCPNYSAVPLHLHPDIHLFSAIPEER

SEQ ID NO: 943562 - protein, 20 aa, Mycobacterium
DCSGFTMFSYAAAGVKLPKY

SEQ ID NO: 943563 - protein, 28 aa, Mycobacterium
DDAEVRALFETHFFGTVAMIKAVLPGMR

SEQ ID NO: 943564 - protein, 23 aa, Mycobacterium
DDAFLKYWYCLQHDDGLWYLHNT

SEQ ID NO: 943565 - protein, 31 aa, Mycobacterium
DDALHPNPVYLFAYDPMAFGGKGRAAIVIGD

SEQ ID NO: 943566 - protein, 17 aa, Mycobacterium
DDALLRQALQDAIAMYG

SEQ ID NO: 943567 - protein, 17 aa, Mycobacterium
DDARFNVSRTALLVVAL

SEQ ID NO: 943568 - protein, 23 aa, Mycobacterium
DDDARYYGAILDDRSIVPIDGED

SEQ ID NO: 943569 - protein, 22 aa, Mycobacterium
DDDVLNFFTTSTRNLLDAERAA

SEQ ID NO: 943570 - protein, 20 aa, Mycobacterium
DDDVYAWRGVLQSAAVHEFH

SEQ ID NO: 943571 - protein, 25 aa, Mycobacterium
DDDYLAILDIRPFTRGHTLVLPKRH

SEQ ID NO: 943572 - protein, 23 aa, Mycobacterium
DDDYNVNFKTIDTLYDLPTVADT

SEQ ID NO: 943573 - protein, 27 aa, Mycobacterium
DDEVRGRLTFSWGVESAVLAPTELAES

SEQ ID NO: 943574 - protein, 23 aa, Mycobacterium
DDEVRRMWGADETLARITAYVER

SEQ ID NO: 943575 - protein, 20 aa, Mycobacterium
DDGAEQWLRAFKAQDPQAFE

SEQ ID NO: 943576 - protein, 19 aa, Mycobacterium
DDGARQWLEAFKAQDPQPY

SEQ ID NO: 943577 - protein, 29 aa, Mycobacterium
DDGRLEWPMRPRPAVVRAFDAPAPNWQRG

SEQ ID NO: 943578 - protein, 23 aa, Mycobacterium
DDGVPINNVLPNGLRLGVDPAVV

SEQ ID NO: 943579 - protein, 23 aa, Mycobacterium
DDHEVINNWFPHESLVGQGRAGY

SEQ ID NO: 943580 - protein, 23 aa, Mycobacterium
DDLAYGLGLWYGVMRERNAGALK

SEQ ID NO: 943581 - protein, 30 aa, Mycobacterium
DDLGALASWYVWAALGLYPSTPGTPILTVA

SEQ ID NO: 943582 - protein, 24 aa, Mycobacterium
DDLTTFYTSLYRSLLHPNMFNDAD

SEQ ID NO: 943583 - protein, 21 aa, Mycobacterium
DDMTRWLAMVLGDGVFEGERI

SEQ ID NO: 943584 - protein, 17 aa, Mycobacterium
DDNPRDLAARLWDLPGW

SEQ ID NO: 943585 - protein, 17 aa, Mycobacterium
DDPAPEFGVIRAGKVLT

SEQ ID NO: 943586 - protein, 25 aa, Mycobacterium
DDPAPFLHTNVVGTFTILEAVRRHG

SEQ ID NO: 943587 - protein, 24 aa, Mycobacterium
DDPEFHPPRLGDLKRSCLDISRAE

SEQ ID NO: 943588 - protein, 22 aa, Mycobacterium
DDPEFHPPRLGDLRQSCLDVGL

SEQ ID NO: 943589 - protein, 25 aa, Mycobacterium
DDPLQRCLFARGRYVTWVEGTRSVI

SEQ ID NO: 943590 - protein, 23 aa, Mycobacterium
DDPLRAVNIGAVLPPLAVGEKHT

SEQ ID NO: 943591 - protein, 18 aa, Mycobacterium
DDPVPLVSFTFGIPAGAV

SEQ ID NO: 943592 - protein, 26 aa, Mycobacterium
DDQRGINLTGWLNSGSGNIGLFNSGT

SEQ ID NO: 943593 - protein, 30 aa, Mycobacterium
DDRAKVRARLLELFELFDPADPAVIAGRRK

SEQ ID NO: 943594 - protein, 25 aa, Mycobacterium
DDRELASVFLLLQRALGCQPDPAGS

SEQ ID NO: 943595 - protein, 20 aa, Mycobacterium
DDRRAFAVTLTDKGRRLLPT

SEQ ID NO: 943596 - protein, 23 aa, Mycobacterium
DDTGPLTPLVYAAAQRLQIAEPV

SEQ ID NO: 943597 - protein, 24 aa, Mycobacterium
DDTSLLTGTLLKTSTRRLAERADI

SEQ ID NO: 943598 - protein, 18 aa, Mycobacterium
DDVKLPYVQIDSGAGAVA

SEQ ID NO: 943599 - protein, 19 aa, Mycobacterium
DDVLNFFTTSTRNLLEAER

SEQ ID NO: 943600 - protein, 21 aa, Mycobacterium
DDVMNFFTTSTRNLTEAATKT

SEQ ID NO: 943601 - protein, 25 aa, Mycobacterium
DDYGGCNVLKLFSRFQRSRPGEPLY

SEQ ID NO: 943602 - protein, 23 aa, Mycobacterium
DDYTTYFMLINPLLDRWGLRVLP

SEQ ID NO: 943603 - protein, 23 aa, Mycobacterium
DEAWFAVTGLAPDGALLVRPDDF

SEQ ID NO: 943604 - protein, 18 aa, Mycobacterium
DEAWRQVLALSPDADIAG

SEQ ID NO: 943605 - protein, 32 aa, Mycobacterium
DEFAEWACTLTQRAVLRLLDPSLSAAGILRAE

SEQ ID NO: 943606 - protein, 30 aa, Mycobacterium
DEFTLWATSLTQRAVLRLLDPSISSPGVLR

SEQ ID NO: 943607 - protein, 18 aa, Mycobacterium
DEGKPAIEIIPFDSQDAA

SEQ ID NO: 943608 - protein, 25 aa, Mycobacterium
DEGLPRPWNPLPCAGGGIGPFGGPG

SEQ ID NO: 943609 - protein, 24 aa, Mycobacterium
DEGNPHVWYRPSAVTEVVDAVTAE

SEQ ID NO: 943610 - protein, 18 aa, Mycobacterium
DEGRWEVRWSATGLHPRL

SEQ ID NO: 943611 - protein, 27 aa, Mycobacterium
DEICVQMHLLFLGFSIAVRKRAADAEL

SEQ ID NO: 943612 - protein, 27 aa, Mycobacterium
DEISSAVAVMFGNHAQAYQAVSAQAAA

SEQ ID NO: 943613 - protein, 19 aa, Mycobacterium
DEKLTYLGYSYGTRIGASY

SEQ ID NO: 943614 - protein, 17 aa, Mycobacterium
DELASYLTVLRDSAHAA

SEQ ID NO: 943615 - protein, 24 aa, Mycobacterium
DELDGFVAIYLDVLRRFDRMYSTP

SEQ ID NO: 943616 - protein, 22 aa, Mycobacterium
DELHRRLPIYADFDGVAVLDER

SEQ ID NO: 943617 - protein, 19 aa, Mycobacterium
DELILYMPDYPVGHDSPIN

SEQ ID NO: 943618 - protein, 18 aa, Mycobacterium
DELITSPAFERLGVVRDG

SEQ ID NO: 943619 - protein, 24 aa, Mycobacterium
DELIVRLRVPLRGVARGQTLVLYR

SEQ ID NO: 943620 - protein, 18 aa, Mycobacterium
DELLGYYRKAEAASGVAW

SEQ ID NO: 943621 - protein, 18 aa, Mycobacterium
DELRRLIIEGQVVGRLAE

SEQ ID NO: 943622 - protein, 28 aa, Mycobacterium
DELSGQGFQVMWQSRPFLLAAGNGMCND

SEQ ID NO: 943623 - protein, 22 aa, Mycobacterium
DELTLGEALTLWLSGQEQLVPR

SEQ ID NO: 943624 - protein, 26 aa, Mycobacterium
DELVIVVPPGHKWARRGRVVTARELA

SEQ ID NO: 943625 - protein, 24 aa, Mycobacterium
DEPQYAEFYTPPDPLPPGRPGDLI

SEQ ID NO: 943626 - protein, 24 aa, Mycobacterium
DERAQPCWSVRQFIDFNRDMQASL

SEQ ID NO: 943627 - protein, 20 aa, Mycobacterium
DERIWKTQAAQWFRGINSVL

SEQ ID NO: 943628 - protein, 17 aa, Mycobacterium
DERRTCVFFESPRRLAA

SEQ ID NO: 943629 - protein, 26 aa, Mycobacterium
DESLRELFDLIQKYPFWTDDGGLSDD

SEQ ID NO: 943630 - protein, 25 aa, Mycobacterium
DESRYWQFYTPPEPLPAGALGDLIR

SEQ ID NO: 943631 - protein, 24 aa, Mycobacterium
DETAALPTIAPLPSLVICGDTDML

SEQ ID NO: 943632 - protein, 26 aa, Mycobacterium
DETERTYLFDLLSRRDARIPRAPKAS

SEQ ID NO: 943633 - protein, 30 aa, Mycobacterium
DEVSAAIAALFSDHALQYQAVSAEAVAFHG

SEQ ID NO: 943634 - protein, 24 aa, Mycobacterium
DEVSVAIAAGFRAYGQAYQALSTR

SEQ ID NO: 943635 - protein, 18 aa, Mycobacterium
DEYGRRLGAGWFPGLKRE

SEQ ID NO: 943636 - protein, 24 aa, Mycobacterium
DFDDCGWGWHLADLAAVVSWLEDT

SEQ ID NO: 943637 - protein, 30 aa, Mycobacterium
DFDTALQLILSLRPLWLRGGRVQEALAGLS

SEQ ID NO: 943638 - protein, 25 aa, Mycobacterium
DFENAWRVNCFGAFLGIHVALEHLR

SEQ ID NO: 943639 - protein, 21 aa, Mycobacterium
DFFEGVMMPELFMADAMGATG

SEQ ID NO: 943640 - protein, 18 aa, Mycobacterium
DFGPDFGLTYVLDGMAAM

SEQ ID NO: 943641 - protein, 24 aa, Mycobacterium
DFGTGYSVLSLLKSLPVDTLKIDR

SEQ ID NO: 943642 - protein, 21 aa, Mycobacterium
DFGVITAIPQPLRSLAHTRAT

SEQ ID NO: 943643 - protein, 27 aa, Mycobacterium
DFGVITAIPQPLRWVARSRGLRLAHAQ

SEQ ID NO: 943644 - protein, 30 aa, Mycobacterium
DFGVITAIPQPLRWYARSRGLRLARAQAHA

SEQ ID NO: 943645 - protein, 25 aa, Mycobacterium
DFIIDRAITFPSIYDPPMRTMIAFG

SEQ ID NO: 943646 - protein, 23 aa, Mycobacterium
DFPAGPQRLDGPEALSFVRQRHE

SEQ ID NO: 943647 - protein, 18 aa, Mycobacterium
DFSAALQGFTKLLGTPGQ

SEQ ID NO: 943648 - protein, 26 aa, Mycobacterium
DFSAGKLVFLVTSQPFRCPVAPYEGA

SEQ ID NO: 943649 - protein, 18 aa, Mycobacterium
DFSVWEIWSALLHGGRLV

SEQ ID NO: 943650 - protein, 21 aa, Mycobacterium
DFSYLWQQMLTQPGTVDPAGY

SEQ ID NO: 943651 - protein, 26 aa, Mycobacterium
DFVADNLAFFLQFGVAASPNGFLPPI

SEQ ID NO: 943652 - protein, 21 aa, Mycobacterium
DFVGWYNAHPNFEHAAPDLSG

SEQ ID NO: 943653 - protein, 21 aa, Mycobacterium
DFVLDVFGPAVGRMRALDPVT

SEQ ID NO: 943654 - protein, 32 aa, Mycobacterium
DFVSSLQLLLTFPFPNFGIKQAVRGDYLNVFT

SEQ ID NO: 943655 - protein, 18 aa, Mycobacterium
DGAALPWSLTLETTEPSA

SEQ ID NO: 943656 - protein, 27 aa, Mycobacterium
DGADNPLNPQFLPKDQRPIPTGTALGP

SEQ ID NO: 943657 - protein, 20 aa, Mycobacterium
DGAERPLVFLVDAHGAGVTV

SEQ ID NO: 943658 - protein, 23 aa, Mycobacterium
DGAEWVHLVDLDAAFGRGSNREL

SEQ ID NO: 943659 - protein, 28 aa, Mycobacterium
DGAGADALWFLPLFDQSALDLMELKLGA

SEQ ID NO: 943660 - protein, 23 aa, Mycobacterium
DGAIIDFRDNVLWVATDNARTQI

SEQ ID NO: 943661 - protein, 19 aa, Mycobacterium
DGALARRAVVARAVAIEAY

SEQ ID NO: 943662 - protein, 17 aa, Mycobacterium
DGALDHSGLFRTIAKLS

SEQ ID NO: 943663 - protein, 19 aa, Mycobacterium
DGALYFGAGLPDLLSPVGA

SEQ ID NO: 943664 - protein, 31 aa, Mycobacterium
DGARSITIFAAASLKTAFTQIGERFKTANPG

SEQ ID NO: 943665 - protein, 23 aa, Mycobacterium
DGASLPWSLTLQTTAPSAAPNIL

SEQ ID NO: 943666 - protein, 24 aa, Mycobacterium
DGATQLLLLSQQTPFTAPSYFAEK

SEQ ID NO: 943667 - protein, 32 aa, Mycobacterium
DGAWHLHQLTRGLGLSMFVLCSSIAGVMGSPG

SEQ ID NO: 943668 - protein, 23 aa, Mycobacterium
DGDAVWVALQRELKSDPTGVVRI

SEQ ID NO: 943669 - protein, 36 aa, Mycobacterium
DGDEPPQRLIYLQHGYLGIGPMYSYTASWLAERTNS

SEQ ID NO: 943670 - protein, 25 aa, Mycobacterium
DGDGPAHISYFDPAPEFTAVDPALG

SEQ ID NO: 943671 - protein, 33 aa, Mycobacterium
DGDIWDWAVDWDTWVAMSALPPPTAHAPATQIP

SEQ ID NO: 943672 - protein, 34 aa, Mycobacterium; identical to SEQ ID NO: 146697

SEQ ID NO: 943673 - protein, 34 aa, Mycobacterium
DGDIWDWAVDWDTWVSMSALPRPTSRPPGTQIPV

SEQ ID NO: 943674 - protein, 28 aa, Mycobacterium
DGDIWDWAVPWDEWTSMSALSSADRTDD

SEQ ID NO: 943675 - protein, 17 aa, Mycobacterium
DGDRLRYVITRAPATGT

SEQ ID NO: 943676 - protein, 28 aa, Mycobacterium
DGEALPPFGLYPLDVLNVDTLMLDQARM

SEQ ID NO: 943677 - protein, 21 aa, Mycobacterium
DGEAPLYRASVTAASEEAAAS

SEQ ID NO: 943678 - protein, 28 aa, Mycobacterium
DGELTHLRRLFGSWAEPIPQLLAATDPA

SEQ ID NO: 943679 - protein, 17 aa, Mycobacterium
DGEWFNGNMFGGAPLDK

SEQ ID NO: 943680 - protein, 23 aa, Mycobacterium
DGFGGFGGIGGTGGLFFGNGGDG

SEQ ID NO: 943681 - protein, 21 aa, Mycobacterium
DGFGGTWRHNTFPGAACDVPS

SEQ ID NO: 943682 - protein, 29 aa, Mycobacterium
DGFGHLDAGLFFIAFVRNPQTQFIPMQRK

SEQ ID NO: 943683 - protein, 29 aa, Mycobacterium
DGFGHLDAGLFFIAFVRSPEKQFIPMLSE

SEQ ID NO: 943684 - protein, 28 aa, Mycobacterium
DGGLLVPIHWGTFRLAPHPWAEPVERLL

SEQ ID NO: 943685 - protein, 24 aa, Mycobacterium
DGGMHSLWTDILARQVFAPQVPRD

SEQ ID NO: 943686 - protein, 25 aa, Mycobacterium
DGGRIVFIGTGFGTRVAFPGVADYA

SEQ ID NO: 943687 - protein, 26 aa, Mycobacterium
DGGVVRSVHLPAANVAALLSAAGAPL

SEQ ID NO: 943688 - protein, 17 aa, Mycobacterium
DGITFFFSPGELLPEAA

SEQ ID NO: 943689 - protein, 22 aa, Mycobacterium
DGLALPAVVLEVEFALDASGRS

SEQ ID NO: 943690 - protein, 25 aa, Mycobacterium
DGLGSYFWQHNWGSPKGFTHPAANL

SEQ ID NO: 943691 - protein, 24 aa, Mycobacterium
DGLLATTGLFPPGSTFKMVTAGAA

SEQ ID NO: 943692 - protein, 19 aa, Mycobacterium
DGLPVDGAIVLVDRGSCPF

SEQ ID NO: 943693 - protein, 21 aa, Mycobacterium
DGLVNLTVGDLTLLESVSADT

SEQ ID NO: 943694 - protein, 31 aa, Mycobacterium
DGMADFPDRLNLLAIVNAVAGGIFVHIPVMY

SEQ ID NO: 943695 - protein, 22 aa, Mycobacterium
DGPGVLLGFTDPRSFDPLPGEQ

SEQ ID NO: 943696 - protein, 20 aa, Mycobacterium
DGPPFRWHPERRALLRADLD

SEQ ID NO: 943697 - protein, 23 aa, Mycobacterium
DGPPLISVSPDGTQLYWAEFGGT

SEQ ID NO: 943698 - protein, 20 aa, Mycobacterium
DGPPPPPPGGTPPGGPPGDG

SEQ ID NO: 943699 - protein, 18 aa, Mycobacterium
DGPRVLVKFTVAKNIRLG

SEQ ID NO: 943700 - protein, 22 aa, Mycobacterium
DGQHMQLLCVQRLHGGLTIGDT

SEQ ID NO: 943701 - protein, 20 aa, Mycobacterium
DGQLPNMRAIVGFAAETGDA

SEQ ID NO: 943702 - protein, 17 aa, Mycobacterium
DGQVWANVWPSNEIVRI

SEQ ID NO: 943703 - protein, 24 aa, Mycobacterium
DGRALSILNDPFRVGGLPATNGPS

SEQ ID NO: 943704 - protein, 21 aa, Mycobacterium
DGRFQWVVFTSTNAVRAVWEK

SEQ ID NO: 943705 - protein, 23 aa, Mycobacterium
DGRFRYLRVYPNPQAYAPVTGFY

SEQ ID NO: 943706 - protein, 22 aa, Mycobacterium
DGRGPLGWLYTPSGDVTSLLTG

SEQ ID NO: 943707 - protein, 22 aa, Mycobacterium
DGRIQASLWSWAPDEPRAGAGE

SEQ ID NO: 943708 - protein, 17 aa, Mycobacterium
DGRYGGAGGKAGLYFGD

SEQ ID NO: 943709 - protein, 23 aa, Mycobacterium
DGSEYFLGLGYATLAIAAFAGGD

SEQ ID NO: 943710 - protein, 24 aa, Mycobacterium
DGSGILIGYHAAPVRIEIFAEPQC

SEQ ID NO: 943711 - protein, 27 aa, Mycobacterium
DGSIARYKLPKAVVFRPAIERSPAGKA

SEQ ID NO: 943712 - protein, 33 aa, Mycobacterium
DGSKQWDTFLSSELPNWLAANKGLAPGGHAAVG

SEQ ID NO: 943713 - protein, 29 aa, Mycobacterium
DGSPYKVFTPFFDAWRQHGWRPPAESGPP

SEQ ID NO: 943714 - protein, 25 aa, Mycobacterium
DGSSHLVQIQIVPAPNSSVTLTMSD

SEQ ID NO: 943715 - protein, 22 aa, Mycobacterium
DGSSILLHEGADMPGAEQGADT

SEQ ID NO: 943716 - protein, 18 aa, Mycobacterium
DGSTFTFARPYNTERAQL

SEQ ID NO: 943717 - protein, 17 aa, Mycobacterium
DGTARLRWARRPGWGGV

SEQ ID NO: 943718 - protein, 23 aa, Mycobacterium
DGTPIAWGALGALSADPADENRL

SEQ ID NO: 943719 - protein, 27 aa, Mycobacterium
DGTRYGVPFYNYALGYLYNADDLAAAN

SEQ ID NO: 943720 - protein, 20 aa, Mycobacterium
DGTVFEFWRAARDGGAWTTE

SEQ ID NO: 943721 - protein, 24 aa, Mycobacterium
DGTVHTVLLPGTLVVGRRAIRDGG

SEQ ID NO: 943722 - protein, 26 aa, Mycobacterium
DGTWNTLYRKWLSVLGPAPVPPQPRY

SEQ ID NO: 943723 - protein, 23 aa, Mycobacterium
DGTWQRCVAVARLIPNGASSYLV

SEQ ID NO: 943724 - protein, 24 aa, Mycobacterium
DGTWQRCVAVTRLIPNGASSYLVP

SEQ ID NO: 943725 - protein, 20 aa, Mycobacterium
DGTYRVGVDIRPGTYRSQGG

SEQ ID NO: 943726 - protein, 22 aa, Mycobacterium
DGVFLVARVSVDAPLPGFTIAA

SEQ ID NO: 943727 - protein, 27 aa, Mycobacterium
DGVFTYKWETFLTQELPAFLANQGLSK

SEQ ID NO: 943728 - protein, 22 aa, Mycobacterium
DGVKVGLITKTDSNPYFVHLRE

SEQ ID NO: 943729 - protein, 23 aa, Mycobacterium
DGVLGEITVVLAGAAPLHVDLQS

SEQ ID NO: 943730 - protein, 26 aa, Mycobacterium
DGVNQMEIMIWFNRQGSIQPVGAQVG

SEQ ID NO: 943731 - protein, 19 aa, Mycobacterium
DGVTGFPPGLWARQTTEIR

SEQ ID NO: 943732 - protein, 23 aa, Mycobacterium
DGVYAFYAHLQPGSLKVKPGDQL

SEQ ID NO: 943733 - protein, 24 aa, Mycobacterium
DGVYALYAHLIKGSLLVKPGDKVT

SEQ ID NO: 943734 - protein, 29 aa, Mycobacterium
DGWGMDGWSWDDVLPHFRAIETDLDFATP

SEQ ID NO: 943735 - protein, 19 aa, Mycobacterium
DGWLDGDPLPPHSVLVTFD

SEQ ID NO: 943736 - protein, 25 aa, Mycobacterium
DGYPEHAFTWAVVALISESLNQMGV

SEQ ID NO: 943737 - protein, 21 aa, Mycobacterium
DHADKLADWLASRQPKLVTSA

SEQ ID NO: 943738 - protein, 17 aa, Mycobacterium
DHAIIHRMFPIAADRTI

SEQ ID NO: 943739 - protein, 17 aa, Mycobacterium
DHDAALVGMGRLICDDL

SEQ ID NO: 943740 - protein, 23 aa, Mycobacterium
DHDAVAPALRSLPGVVITPQPEM

SEQ ID NO: 943741 - protein, 24 aa, Mycobacterium
DHDGYPTDFLLPDAGQPFAADMAR

SEQ ID NO: 943742 - protein, 22 aa, Mycobacterium
DHEARILLAKNPAGWQEALSMV

SEQ ID NO: 943743 - protein, 31 aa, Mycobacterium
DHHTFNYLDLVRYLAVGNLNPAPLGYVGGSD

SEQ ID NO: 943744 - protein, 25 aa, Mycobacterium
DHHVGGIFVGSWTKKEMLTDGSLHD

SEQ ID NO: 943745 - protein, 24 aa, Mycobacterium
DHIRAIVTFGNIVNRFAPVQSLAG

SEQ ID NO: 943746 - protein, 24 aa, Mycobacterium
DHPVRRIPILRGATLGGSGAVNGG

SEQ ID NO: 943747 - protein, 29 aa, Mycobacterium
DHPYPTVPKVWFHDLLYPDGRPYQDSEIR

SEQ ID NO: 943748 - protein, 29 aa, Mycobacterium
DHPYTAIPKVWFHDLLRPDGRPFQDTEAL

SEQ ID NO: 943749 - protein, 43 aa, Mycobacterium
DHTGQPWVVSFQLNWPQFRSSTAAGWLLQIAKRAFALAPVGRL

SEQ ID NO: 943750 - protein, 23 aa, Mycobacterium
DHTGRLFVVDRLKDIIVTGGENV

SEQ ID NO: 943751 - protein, 24 aa, Mycobacterium
DHTVRPLFGQHVVLTNPGLQQLFL

SEQ ID NO: 943752 - protein, 24 aa, Mycobacterium
DHVAFIRDNLVLEAPIIEEQVTSG

SEQ ID NO: 943753 - protein, 24 aa, Mycobacterium
DHVDPVVWSMVMQLALDCGAVVVP

SEQ ID NO: 943754 - protein, 28 aa, Mycobacterium
DHYAEIGLLGFSLITEALGGVDVCLKEP

SEQ ID NO: 943755 - protein, 23 aa, Mycobacterium
DIASAIVYMVTRPAHAAVNEILI

SEQ ID NO: 943756 - protein, 23 aa, Mycobacterium
DIATLLAHYGIDAVLTDLDNAPS

SEQ ID NO: 943757 - protein, 21 aa, Mycobacterium
DIDAFALYQPVGWQSQAVSGD

SEQ ID NO: 943758 - protein, 17 aa, Mycobacterium
DIDERIWKTQAAQWFRG

SEQ ID NO: 943759 - protein, 19 aa, Mycobacterium
DIDIVVIDGPFVSLSPYGR

SEQ ID NO: 943760 - protein, 18 aa, Mycobacterium
DIDQMPLEWVVGEVTAEE

SEQ ID NO: 943761 - protein, 26 aa, Mycobacterium
DIDVRGLELDLHYLPRLELLGKREVT

SEQ ID NO: 943762 - protein, 17 aa, Mycobacterium
DIDYIPVVTRRSITVSL

SEQ ID NO: 943763 - protein, 19 aa, Mycobacterium
DIEDFWTQFYGDSFANFRP

SEQ ID NO: 943764 - protein, 19 aa, Mycobacterium
DIEDLKFALELGADMIAMS

SEQ ID NO: 943765 - protein, 25 aa, Mycobacterium
DIEDLVAHRITFGDVWGLLVDGRFG

SEQ ID NO: 943766 - protein, 25 aa, Mycobacterium
DIERLRNLWDVPALALVGIGNGAQV

SEQ ID NO: 943767 - protein, 22 aa, Mycobacterium
DIERLRTLWDVPAVALVGVGNG

SEQ ID NO: 943768 - protein, 28 aa, Mycobacterium
DIERLRTTWDVPALALFGVGNGAQVALA

SEQ ID NO: 943769 - protein, 25 aa, Mycobacterium
DIGAPPIVIGPRYVDKTLNLCAPGD

SEQ ID NO: 943770 - protein, 28 aa, Mycobacterium
DIGHALQARILPILKHHYANFIAEVPGQ

SEQ ID NO: 943771 - protein, 29 aa, Mycobacterium
DIGKRIERGLWLTALLRATLTVVRGAAAE

SEQ ID NO: 943772 - protein, 25 aa, Mycobacterium
DIGYATNYYMLTHDLVLQPANQDWH

SEQ ID NO: 943773 - protein, 17 aa, Mycobacterium
DIILGKPDIDPRVTDLA

SEQ ID NO: 943774 - protein, 18 aa, Mycobacterium
DILFRKIAAALVPDDAPP

SEQ ID NO: 943775 - protein, 19 aa, Mycobacterium
DILSALPGIDLDPAKWTYI

SEQ ID NO: 943776 - protein, 27 aa, Mycobacterium
DILSIADILVHCSVIAEPFGQVVVEGL

SEQ ID NO: 943777 - protein, 17 aa, Mycobacterium
DINIIDVPTIRKIVHDL

SEQ ID NO: 943778 - protein, 18 aa, Mycobacterium
DINTPAFEWYLDSGLAVV

SEQ ID NO: 943779 - protein, 23 aa, Mycobacterium
DINTPAFEWYYQSGISVVMPVGG

SEQ ID NO: 943780 - protein, 17 aa, Mycobacterium
DIPALPAGVVYVNIAAS

SEQ ID NO: 943781 - protein, 20 aa, Mycobacterium
DIPEVPQAEQPPWVVFGNPG

SEQ ID NO: 943782 - protein, 23 aa, Mycobacterium
DIPSLLYSYGFEQNPDWSRAYSG

SEQ ID NO: 943783 - protein, 24 aa, Mycobacterium
DIPVDGFVRLNSAADGRHVLVSQT

SEQ ID NO: 943784 - protein, 17 aa, Mycobacterium
DIQLAQLQKRLAQRRLT

SEQ ID NO: 943785 - protein, 17 aa, Mycobacterium
DIQPVFLQPADAFTALS

SEQ ID NO: 943786 - protein, 23 aa, Mycobacterium
DIREQKYLYRGKLPEGWTWDSTA

SEQ ID NO: 943787 - protein, 25 aa, Mycobacterium
DIRLENWIATLKLGIDKGVKLPRNA

SEQ ID NO: 943788 - protein, 25 aa, Mycobacterium
DIRRNHVALDLILDGGAIAGVTVLS

SEQ ID NO: 943789 - protein, 22 aa, Mycobacterium
DIRYGLGIFDARGWIGHSGSIP

SEQ ID NO: 943790 - protein, 17 aa, Mycobacterium
DISMLPTTAPIGPRPWD

SEQ ID NO: 943791 - protein, 24 aa, Mycobacterium
DISRAEEVLGWRPQVELADGVRRT

SEQ ID NO: 943792 - protein, 20 aa, Mycobacterium
DITRMYNWECWIYGSDPAAN

SEQ ID NO: 943793 - protein, 20 aa, Mycobacterium
DIWTALAQPAVAGPTPNESQ

SEQ ID NO: 943794 - protein, 21 aa, Mycobacterium
DIYHELLVHTLATDPTPSVGT

SEQ ID NO: 943795 - protein, 27 aa, Mycobacterium
DKAIAAALPMVTWLQTASTQAKTRGLQ

SEQ ID NO: 943796 - protein, 26 aa, Mycobacterium
DKALAVFMFRSPWIDYDYHDLAAQKR

SEQ ID NO: 943797 - protein, 23 aa, Mycobacterium
DKAPYVLAPYVSGFVSASEEWYD

SEQ ID NO: 943798 - protein, 25 aa, Mycobacterium
DKAQSFFDVIGARTWRLGDAPRQAN

SEQ ID NO: 943799 - protein, 20 aa, Mycobacterium
DKATLLNLGTYTAGGLPLQF

SEQ ID NO: 943800 - protein, 23 aa, Mycobacterium
DKEPALWMPPNAAFHCQYAMQFI

SEQ ID NO: 943801 - protein, 19 aa, Mycobacterium
DKGQFPPAEGFWSLTMYDA

SEQ ID NO: 943802 - protein, 23 aa, Mycobacterium
DKGVQFVAVSGLKLLLPGFTEQL

SEQ ID NO: 943803 - protein, 26 aa, Mycobacterium
DKLIPLSVFGPERIDYLPEVPTAKEQ

SEQ ID NO: 943804 - protein, 25 aa, Mycobacterium
DKQRVAAQLRKFLTRLLAPAESGRP

SEQ ID NO: 943805 - protein, 17 aa, Mycobacterium
DKRIDLYFPGESALQEY

SEQ ID NO: 943806 - protein, 17 aa, Mycobacterium
DKSALAAGLSRLTKRNA

SEQ ID NO: 943807 - protein, 36 aa, Mycobacterium
DKSAYEYFTPFGWIKGFPFLALQVVWAPGSEMSVAW

SEQ ID NO: 943808 - protein, 23 aa, Mycobacterium
DKSVLFKYYTFFGGAAHPNTALA

SEQ ID NO: 943809 - protein, 40 aa, Mycobacterium
DKTILQAIELWKIVDRPNLLIKIPATMAGLPAISAVIAEG

SEQ ID NO: 943810 - protein, 20 aa, Mycobacterium
DKVLPGYGWIFPLGNGEVNI

SEQ ID NO: 943811 - protein, 23 aa, Mycobacterium
DKVRPVFATYADPVVRLGGVGSG

SEQ ID NO: 943812 - protein, 23 aa, Mycobacterium
DLADPAHPLSLDDPIFAGRVVVI

SEQ ID NO: 943813 - protein, 18 aa, Mycobacterium
DLAEILDLAPLVADNGYN

SEQ ID NO: 943814 - protein, 19 aa, Mycobacterium
DLAGFWVAEAVWVTHSAGV

SEQ ID NO: 943815 - protein, 30 aa, Mycobacterium
DLAGTAVAIPFWWSIHNIVLQELLRAHGLR

SEQ ID NO: 943816 - protein, 27 aa, Mycobacterium
DLAVNSVTPKLFLPGLAGLNQGPGFPN

SEQ ID NO: 943817 - protein, 27 aa, Mycobacterium
DLAVQGLHPKLFLPNLSGFNAGPGFPN

SEQ ID NO: 943818 - protein, 17 aa, Mycobacterium
DLAVVPVRTEAWLGYFM

SEQ ID NO: 943819 - protein, 26 aa, Mycobacterium
DLAVYRAHWLVARTAEHIGGWAARPL

SEQ ID NO: 943820 - protein, 21 aa, Mycobacterium
DLCEFVEFPTELLQVCGDSFA

SEQ ID NO: 943821 - protein, 22 aa, Mycobacterium
DLCELFDPQYLPEGASTTAAEN

SEQ ID NO: 943822 - protein, 17 aa, Mycobacterium
DLDAILGPDARWGNWRD

SEQ ID NO: 943823 - protein, 26 aa, Mycobacterium
DLDELIGGFRPLFKALDPDQVNALST

SEQ ID NO: 943824 - protein, 31 aa, Mycobacterium
DLDELKNIALYLNFDMLASPNPGYFTYDGDQ

SEQ ID NO: 943825 - protein, 26 aa, Mycobacterium
DLDFDFAMLLPPFRGASLAAYDNAGN

SEQ ID NO: 943826 - protein, 26 aa, Mycobacterium
DLDFDFAMLLPPFRGASLAAYDRDGN

SEQ ID NO: 943827 - protein, 18 aa, Mycobacterium
DLDLCGVTWVYNYAVAVY

SEQ ID NO: 943828 - protein, 22 aa, Mycobacterium
DLDTWKSYLTFHAVHRSADALS

SEQ ID NO: 943829 - protein, 23 aa, Mycobacterium
DLEEGLALLNRQLGQRKPTIGRD

SEQ ID NO: 943830 - protein, 25 aa, Mycobacterium
DLERLRNLWDVPALALVGIGNGAQV

SEQ ID NO: 943831 - protein, 18 aa, Mycobacterium
DLFSTVKNLSILVSALHD

SEQ ID NO: 943832 - protein, 31 aa, Mycobacterium
DLGALSSWYVWAALGLYPITAGTPILTVNTP

SEQ ID NO: 943833 - protein, 29 aa, Mycobacterium
DLGAMSSWYVWAALGLYPSTPGTAILTVN

SEQ ID NO: 943834 - protein, 28 aa, Mycobacterium
DLGHREIGLLTMRLGRDWPHGPGPALAD

SEQ ID NO: 943835 - protein, 18 aa, Mycobacterium
DLGLLSRHPLGNTGHAVV

SEQ ID NO: 943836 - protein, 24 aa, Mycobacterium
DLGVEMPLEQIPLVQRRAIALCRQ

SEQ ID NO: 943837 - protein, 23 aa, Mycobacterium
DLGYTVVLPQQPPYAPAALIGFV

SEQ ID NO: 943838 - protein, 40 aa, Mycobacterium
DLHWDRILFCAKEATYKAWYPLTHRWLGFEDAHITFEVDG

SEQ ID NO: 943839 - protein, 20 aa, Mycobacterium
DLKASYDPLIKMLEKQTGSK

SEQ ID NO: 943840 - protein, 19 aa, Mycobacterium
DLKMEPLALCGHTIGAPKG

SEQ ID NO: 943841 - protein, 18 aa, Mycobacterium
DLKNLQLITKLAAKKMPA

SEQ ID NO: 943842 - protein, 17 aa, Mycobacterium
DLLATELVYKLLSGPRP

SEQ ID NO: 943843 - protein, 21 aa, Mycobacterium
DLLDLLELLSPIEAGIKGPLP

SEQ ID NO: 943844 - protein, 20 aa, Mycobacterium
DLLDRFGSVSGLWNQVMAIF

SEQ ID NO: 943845 - protein, 27 aa, Mycobacterium
DLLGRAGPLQVLQSPVALVGSAAHLAV

SEQ ID NO: 943846 - protein, 19 aa, Mycobacterium
DLLKVMLREPDALGDLDEK

SEQ ID NO: 943847 - protein, 19 aa, Mycobacterium
DLLKVMLREPDELGDLDEK

SEQ ID NO: 943848 - protein, 17 aa, Mycobacterium
DLLLLADEYQRRDRDGH

SEQ ID NO: 943849 - protein, 18 aa, Mycobacterium
DLLLMLRHQLDNVESVVV

SEQ ID NO: 943850 - protein, 18 aa, Mycobacterium
DLLRMRSGLYCYTNDSEF

SEQ ID NO: 943851 - protein, 25 aa, Mycobacterium
DLLTLEVATWDRAFAVAARGSMLSA

SEQ ID NO: 943852 - protein, 20 aa, Mycobacterium
DLLTSLASLAAVAVAAVRRH

SEQ ID NO: 943853 - protein, 17 aa, Mycobacterium
DLLVPKLQASVTDGAIG

SEQ ID NO: 943854 - protein, 17 aa, Mycobacterium
DLNMLIVLPAEGQLQAV

SEQ ID NO: 943855 - protein, 30 aa, Mycobacterium
DLNPDGSFTYTPDFGFIGDDSFRYTVTDGA

SEQ ID NO: 943856 - protein, 21 aa, Mycobacterium
DLPDYSHSIVSLPDGTRAFTV

SEQ ID NO: 943857 - protein, 17 aa, Mycobacterium
DLPGFLHGIAVGPDGTA

SEQ ID NO: 943858 - protein, 17 aa, Mycobacterium
DLPLRDILAALPADIVI

SEQ ID NO: 943859 - protein, 17 aa, Mycobacterium
DLPLVQPIRDIPYAGPP

SEQ ID NO: 943860 - protein, 26 aa, Mycobacterium
DLPQPPTGFVQLLDLAGAPDTWVPRR

SEQ ID NO: 943861 - protein, 17 aa, Mycobacterium
DLPTAFARFATLRRRRV

SEQ ID NO: 943862 - protein, 23 aa, Mycobacterium
DLPTCVVKFIPLHTPAVTMSINT

SEQ ID NO: 943863 - protein, 18 aa, Mycobacterium
DLQMRWRIEGYNSPPRPS

SEQ ID NO: 943864 - protein, 26 aa, Mycobacterium
DLQSVDLVPYRTLVTAAPVAVMLGHL

SEQ ID NO: 943865 - protein, 21 aa, Mycobacterium
DLQVVYRPLTFLDDSYDGYSA

SEQ ID NO: 943866 - protein, 17 aa, Mycobacterium
DLRALIHRARTSDVPLP

SEQ ID NO: 943867 - protein, 20 aa, Mycobacterium
DLRATLRIYAREHPLHGFRR

SEQ ID NO: 943868 - protein, 26 aa, Mycobacterium
DLRAVAAARPDLILGSVAVTPNLYPQ

SEQ ID NO: 943869 - protein, 18 aa, Mycobacterium
DLRNEFPPLRVRTAVVAQ

SEQ ID NO: 943870 - protein, 31 aa, Mycobacterium
DLRQSCLDVGLAKRVLGWEPRVPLADGIRRT

SEQ ID NO: 943871 - protein, 20 aa, Mycobacterium
DLRSLLPKLESGMIPKIEAC

SEQ ID NO: 943872 - protein, 18 aa, Mycobacterium
DLRYAIDPSPLYDELAWA

SEQ ID NO: 943873 - protein, 28 aa, Mycobacterium
DLSHQAFPYFRLLQTYLEAIPVTMLRVS

SEQ ID NO: 943874 - protein, 27 aa, Mycobacterium
DLSVNGLTPKLILPTLSGLTQGPGFPN

SEQ ID NO: 943875 - protein, 31 aa, Mycobacterium
DLTALKSIALYLNFDMLASPNPGYFTYDGDQ

SEQ ID NO: 943876 - protein, 23 aa, Mycobacterium
DLVATLRTWLVEGFSAAATGNRL

SEQ ID NO: 943877 - protein, 19 aa, Mycobacterium
DLVGVFAANLFTAEGSATG

SEQ ID NO: 943878 - protein, 20 aa, Mycobacterium
DLVLLLGDTARELGKFPSIA

SEQ ID NO: 943879 - protein, 24 aa, Mycobacterium
DLVQPNLRYLVNWGYGDPAYGWST

SEQ ID NO: 943880 - protein, 22 aa, Mycobacterium
DLVRYYDMLLSGAGGLPRAQAD

SEQ ID NO: 943881 - protein, 17 aa, Mycobacterium
DLWTVTGDYWHQQTSLN

SEQ ID NO: 943882 - protein, 20 aa, Mycobacterium
DMANPMAGAVTKPFELEITC

SEQ ID NO: 943883 - protein, 28 aa, Mycobacterium
DMEWDDFDWLMNINFWGVAHGTKAFLPH

SEQ ID NO: 943884 - protein, 20 aa, Mycobacterium
DMGEFFMPFPGTRVNQQTVQ

SEQ ID NO: 943885 - protein, 23 aa, Mycobacterium
DMGNGWLRRDPAVPASAWTDEQR

SEQ ID NO: 943886 - protein, 19 aa, Mycobacterium
DMGVCHHWYWVPVGGMGNV

SEQ ID NO: 943887 - protein, 17 aa, Mycobacterium
DMHMAIASALNMYDNVL

SEQ ID NO: 943888 - protein, 27 aa, Mycobacterium
DMKILCKPLVKSLAVGGFVAASIASST

SEQ ID NO: 943889 - protein, 21 aa, Mycobacterium
DMMPYLVRIIGASQAPLQQTP

SEQ ID NO: 943890 - protein, 21 aa, Mycobacterium
DMPHYLDYLTRRLAAAGCEIE

SEQ ID NO: 943891 - protein, 23 aa, Mycobacterium
DMRDPLTIAFHKAKLRADFLRPV

SEQ ID NO: 943892 - protein, 18 aa, Mycobacterium
DMTHWLTMVLANGTYNGQ

SEQ ID NO: 943893 - protein, 25 aa, Mycobacterium
DNADGKWLITPMFIDPDPQRMDPYP

SEQ ID NO: 943894 - protein, 26 aa, Mycobacterium
DNADWDLIMRIAAPRGFMDVADVAKT

SEQ ID NO: 943895 - protein, 37 aa, Mycobacterium
DNADYFIKDLEFLPTFPFHYKYLRNAVRGDYLNVYTT

SEQ ID NO: 943896 - protein, 18 aa, Mycobacterium
DNAQLSMRFAACADLNGF

SEQ ID NO: 943897 - protein, 34 aa, Mycobacterium
DNAWHTWRMTWQPTGLYFWKDYQPGMEPFFTVPA

SEQ ID NO: 943898 - protein, 24 aa, Mycobacterium
DNCKLIDWPIATLSPAGIRTSDGI

SEQ ID NO: 943899 - protein, 25 aa, Mycobacterium
DNCKLIDWPIATLSPAGIRTSDGIE

SEQ ID NO: 943900 - protein, 22 aa, Mycobacterium
DNGPYVVFAPTNEAFAKLAPGQ

SEQ ID NO: 943901 - protein, 18 aa, Mycobacterium
DNGRIYVAYIAAETTRNT

SEQ ID NO: 943902 - protein, 17 aa, Mycobacterium
DNGTTQVWSFDGGPPTA

SEQ ID NO: 943903 - protein, 23 aa, Mycobacterium
DNLDYAVIKFDPAKVTPVANFNG

SEQ ID NO: 943904 - protein, 18 aa, Mycobacterium
DNLGWKLAAVLQGWAHTQ

SEQ ID NO: 943905 - protein, 20 aa, Mycobacterium
DNLMLAQRLAQQEVLAKAVD

SEQ ID NO: 943906 - protein, 24 aa, Mycobacterium
DNLRVAFLCCREYCDLESALALTS

SEQ ID NO: 943907 - protein, 20 aa, Mycobacterium
DNLSVLRTLLRMMDRDPDDF

SEQ ID NO: 943908 - protein, 26 aa, Mycobacterium
DNLSWWNRTWVPQLVPKGALLEVQLP

SEQ ID NO: 943909 - protein, 23 aa, Mycobacterium
DNLYQYWYCLQHDDGLWYLHNSD

SEQ ID NO: 943910 - protein, 25 aa, Mycobacterium
DNMVAVNVQGVLYATRAALPHLIDA

SEQ ID NO: 943911 - protein, 24 aa, Mycobacterium
DNMWGPPWDPAWRRNDPTVQAQAL

SEQ ID NO: 943912 - protein, 19 aa, Mycobacterium
DNPDLFTSPVGGGGFIGKW

SEQ ID NO: 943913 - protein, 25 aa, Mycobacterium
DNPGYLAIMRNCAYTQMGVWSENSL

SEQ ID NO: 943914 - protein, 24 aa, Mycobacterium
DNPTTRAVLFHQGKFIPQGVPDTY

SEQ ID NO: 943915 - protein, 36 aa, Mycobacterium
DNRKNFVTSLQLLLTFPFPNFGIKQAVRGDYLNVFT

SEQ ID NO: 943916 - protein, 18 aa, Mycobacterium
DNRPLTVRIGYQTPNARL

SEQ ID NO: 943917 - protein, 28 aa, Mycobacterium
DNSPAYAVLYYAVPLGGRVLTLINQRLS

SEQ ID NO: 943918 - protein, 24 aa, Mycobacterium
DNVAAVVLFGTPAGWSATKYGAAD

SEQ ID NO: 943919 - protein, 23 aa, Mycobacterium
DNVRKFFTVADRLNKWLVDNTDE

SEQ ID NO: 943920 - protein, 24 aa, Mycobacterium
DNVVPLIVNLYTFGARDFDVKTAL

SEQ ID NO: 943921 - protein, 20 aa, Mycobacterium
DNVVQWVPDDYWPAHSTVAL

SEQ ID NO: 943922 - protein, 28 aa, Mycobacterium
DPAALTSLDYYHAFLGLLGNDDVKGQRP

SEQ ID NO: 943923 - protein, 21 aa, Mycobacterium
DPAEAPVYRASVSASIEASSL

SEQ ID NO: 943924 - protein, 26 aa, Mycobacterium
DPAGWPRLDWSMDAALLLAALASRAG

SEQ ID NO: 943925 - protein, 33 aa, Mycobacterium
DPAIKLTREKWLLPLLYELGWGRPEVVGGGLSV

SEQ ID NO: 943926 - protein, 32 aa, Mycobacterium
DPAKPTVQPVPYTGVQFLAIPEFQDLGTRVSQ

SEQ ID NO: 943927 - protein, 23 aa, Mycobacterium
DPALRATVMYPRGTVIMATDGPN

SEQ ID NO: 943928 - protein, 21 aa, Mycobacterium
DPALRRALTPDFRIGCKRILL

SEQ ID NO: 943929 - protein, 19 aa, Mycobacterium
DPAPLFRTNVEGLRHVLDA

SEQ ID NO: 943930 - protein, 18 aa, Mycobacterium
DPAPYFRPPYGKHNAATD

SEQ ID NO: 943931 - protein, 27 aa, Mycobacterium
DPAQAGMRIVLHFPYSANVHCEIDVDD

SEQ ID NO: 943932 - protein, 24 aa, Mycobacterium
DPARAADVLGFRAAVAPVEGLRDF

SEQ ID NO: 943933 - protein, 22 aa, Mycobacterium
DPARIRAAIVDSLLTDGVNQDQ

SEQ ID NO: 943934 - protein, 24 aa, Mycobacterium
DPASMTPFPTMYELFSVGWGQPDV

SEQ ID NO: 943935 - protein, 19 aa, Mycobacterium
DPCPAVEVVFARGTGQASG

SEQ ID NO: 943936 - protein, 24 aa, Mycobacterium
DPDAQYYGAVLDERMIVPVEGEEV

SEQ ID NO: 943937 - protein, 23 aa, Mycobacterium
DPDCLGAVYGAEAPVYEGTDWTA

SEQ ID NO: 943938 - protein, 24 aa, Mycobacterium
DPDELVTFYSCLYRSLLHPNTFND

SEQ ID NO: 943939 - protein, 29 aa, Mycobacterium
DPDLTSTAFFDRLIAVNARGVFLGIKHGA

SEQ ID NO: 943940 - protein, 24 aa, Mycobacterium
DPDVPAPRWWFTVGGAVQKGEDLA

SEQ ID NO: 943941 - protein, 23 aa, Mycobacterium
DPDVWARVMRLALDCGAFVVPAR

SEQ ID NO: 943942 - protein, 22 aa, Mycobacterium
DPEFHPDRLGDLQRSCLDIGLA

SEQ ID NO: 943943 - protein, 29 aa, Mycobacterium
DPENFWRSAGLPEFRWPDPNGTRLPNGAP

SEQ ID NO: 943944 - protein, 17 aa, Mycobacterium
DPEPFLHSNVVGTYTIL

SEQ ID NO: 943945 - protein, 28 aa, Mycobacterium
DPEPFLHTNVIGTYTILEAVRRYGVRLH

SEQ ID NO: 943946 - protein, 19 aa, Mycobacterium
DPEQLVCRTAPEDDIWVIT

SEQ ID NO: 943947 - protein, 25 aa, Mycobacterium
DPEVEQVLVLFPTAKEANAFYTTSV

SEQ ID NO: 943948 - protein, 17 aa, Mycobacterium
DPFLPNEGSPGRGPLLA

SEQ ID NO: 943949 - protein, 21 aa, Mycobacterium
DPFRALDMLASLWSSTGLPSV

SEQ ID NO: 943950 - protein, 26 aa, Mycobacterium
DPGGWPRLDWSMDAALLLAALASRAG

SEQ ID NO: 943951 - protein, 21 aa, Mycobacterium
DPGPDRPWTATYGMWSRELPD

SEQ ID NO: 943952 - protein, 26 aa, Mycobacterium
DPGPFIQGVGLPLEYGKRLKFGDYQC

SEQ ID NO: 943953 - protein, 26 aa, Mycobacterium
DPGSPNIDLPVPDGWQLLPEGSGAPY

SEQ ID NO: 943954 - protein, 23 aa, Mycobacterium
DPGTQVIGLLLETPRAAPRLRNV

SEQ ID NO: 943955 - protein, 25 aa, Mycobacterium
DPGVPVFALGRYAGARRRAIVAAKE

SEQ ID NO: 943956 - protein, 21 aa, Mycobacterium
DPGYTVFPVLNLAVAGSGGGD

SEQ ID NO: 943957 - protein, 24 aa, Mycobacterium
DPHGPVAFWGYSQGGGAAASAAEL

SEQ ID NO: 943958 - protein, 24 aa, Mycobacterium
DPHGPVAFWGYSQGGGATASAAEL

SEQ ID NO: 943959 - protein, 28 aa, Mycobacterium
DPHSRQLLAAQIIWTLARADIRGPYVIN

SEQ ID NO: 943960 - protein, 29 aa, Mycobacterium
DPHSRQLLAAQIIWTLARADIRGPYVINA

SEQ ID NO: 943961 - protein, 27 aa, Mycobacterium
DPHSRQLLAAQLIWTLSRAGVAGPYVI

SEQ ID NO: 943962 - protein, 30 aa, Mycobacterium
DPHSRQLLAAQLIWTLSRSGINGPYVINAD

SEQ ID NO: 943963 - protein, 17 aa, Mycobacterium
DPIPGEGFFLVGTDIAP

SEQ ID NO: 943964 - protein, 22 aa, Mycobacterium
DPIWQVMAPSRELGPWTLHGDL

SEQ ID NO: 943965 - protein, 25 aa, Mycobacterium
DPKAIPFNADALYFESLLPTDNRVH

SEQ ID NO: 943966 - protein, 17 aa, Mycobacterium
DPLATLGYLAARTQRIR

SEQ ID NO: 943967 - protein, 21 aa, Mycobacterium
DPLLLNRFRQLSTNRLQVVAG

SEQ ID NO: 943968 - protein, 21 aa, Mycobacterium
DPLMYDKSYFLEPDSKSSKSY

SEQ ID NO: 943969 - protein, 20 aa, Mycobacterium
DPLNPTEFPRSLLLNVSRPI

SEQ ID NO: 943970 - protein, 27 aa, Mycobacterium
DPMESAYAAVLLWKATVEKANSFAVPD

SEQ ID NO: 943971 - protein, 20 aa, Mycobacterium
DPMMFDRSYFLEPDSKSSKS

SEQ ID NO: 943972 - protein, 18 aa, Mycobacterium
DPMYSVFRAIEEPLRIHR

SEQ ID NO: 943973 - protein, 23 aa, Mycobacterium
DPNARYFGAVLDGHSIVPTDGED

SEQ ID NO: 943974 - protein, 20 aa, Mycobacterium
DPNQWAFVNASGGCHWPDCD

SEQ ID NO: 943975 - protein, 24 aa, Mycobacterium
DPNTWKANWPQHLAGAYIDAGMAN

SEQ ID NO: 943976 - protein, 23 aa, Mycobacterium
DPNTWKQNWPQHLAGAYIDAGMA

SEQ ID NO: 943977 - protein, 20 aa, Mycobacterium
DPNVPAPSPILTAGSDKPEC

SEQ ID NO: 943978 - protein, 30 aa, Mycobacterium
DPPAPGPVPILPPLAPGQVLRMGPTAGTGT

SEQ ID NO: 943979 - protein, 24 aa, Mycobacterium
DPPPPPPLPPPPPPLVWSPPTPDP

SEQ ID NO: 943980 - protein, 26 aa, Mycobacterium
DPPQRSSALLRVFLLSAVPSEEAGKY

SEQ ID NO: 943981 - protein, 25 aa, Mycobacterium
DPPVGGRPVALPPPKPAGAPAEPTP

SEQ ID NO: 943982 - protein, 27 aa, Mycobacterium
DPPVRNAALLRVFLLGQLDPSQARSYL

SEQ ID NO: 943983 - protein, 25 aa, Mycobacterium
DPPYQGAIYLTFSLPAAAAADTYFP

SEQ ID NO: 943984 - protein, 27 aa, Mycobacterium
DPQFQAKYPMYTIIRRQLTDAAVRPAT

SEQ ID NO: 943985 - protein, 32 aa, Mycobacterium
DPQPDGSLVLWDWWPMPFANSTRVTLVNTTAA

SEQ ID NO: 943986 - protein, 17 aa, Mycobacterium
DPQQRLLLECSWEALED

SEQ ID NO: 943987 - protein, 21 aa, Mycobacterium
DPQRMVPWLAMPGCEFEVLEP

SEQ ID NO: 943988 - protein, 35 aa, Mycobacterium
DPRFSYVLLWEMFFPSLIEKKVLRAVLRWDQRLGG

SEQ ID NO: 943989 - protein, 27 aa, Mycobacterium
DPRHTPPHAWYIAFAPAQAPKVAVAVL

SEQ ID NO: 943990 - protein, 22 aa, Mycobacterium
DPRNLHLAAFHPTGTAAAGADS

SEQ ID NO: 943991 - protein, 27 aa, Mycobacterium
DPRNTPPHAWYIAFAPAQAPTVAVAVL

SEQ ID NO: 943992 - protein, 26 aa, Mycobacterium
DPRNTPPHAWYIAFAPAQGTTTDPQA

SEQ ID NO: 943993 - protein, 25 aa, Mycobacterium
DPSANPYLASAAILGLALDGIQRKV

SEQ ID NO: 943994 - protein, 20 aa, Mycobacterium
DPSAWGLLAWVRRELFNSTP

SEQ ID NO: 943995 - protein, 21 aa, Mycobacterium
DPSNLLAMLNSTAGFFFTHQT

SEQ ID NO: 943996 - protein, 25 aa, Mycobacterium
DPSPAVWQPVPTWFQRLKEAGVSAR

SEQ ID NO: 943997 - protein, 33 aa, Mycobacterium
DPTGPNGILRWIPFRIPIIGLTPVRPPDTPYET

SEQ ID NO: 943998 - protein, 22 aa, Mycobacterium
DPTLPFRRLIRAGNRDADWFVW

SEQ ID NO: 943999 - protein, 23 aa, Mycobacterium
DPTRAWNVTLPTWTEAQVNPYTI

SEQ ID NO: 944000 - protein, 23 aa, Mycobacterium
DPTTMITLLPGRLTPEPIEIGPA

SEQ ID NO: 944001 - protein, 37 aa, Mycobacterium
DPVLAEWFLRRFSLLDSLYIVPPPRLIGRTIAHNVGL

SEQ ID NO: 944002 - protein, 19 aa, Mycobacterium
DPVTWAFQCALNIASTTPQ

SEQ ID NO: 944003 - protein, 26 aa, Mycobacterium
DQADYVLWWINRIREGRIVAAAPTKL

SEQ ID NO: 944004 - protein, 18 aa, Mycobacterium
DQAYRKPITWDKLWQPET

SEQ ID NO: 944005 - protein, 22 aa, Mycobacterium
DQDDHAWDLARLGWALHGPTAT

SEQ ID NO: 944006 - protein, 22 aa, Mycobacterium
DQDGLPFIRDYTSKVVGNYVIP

SEQ ID NO: 944007 - protein, 24 aa, Mycobacterium
DQGARPMIAKSVRITNLGGFTGMY

SEQ ID NO: 944008 - protein, 23 aa, Mycobacterium
DQGLGDLFVVRTGAQDYDALIEG

SEQ ID NO: 944009 - protein, 23 aa, Mycobacterium
DQGQDLLGHLVARQATFHAMFAA

SEQ ID NO: 944010 - protein, 23 aa, Mycobacterium
DQIMAYAMANAARFGLQDVIWRG

SEQ ID NO: 944011 - protein, 17 aa, Mycobacterium
DQLAWLGKITCDRIDHG

SEQ ID NO: 944012 - protein, 22 aa, Mycobacterium
DQLGYNRRYTLSAKALGLGGAA

SEQ ID NO: 944013 - protein, 20 aa, Mycobacterium
DQLRRWLDSILDAVAGKLPD

SEQ ID NO: 944014 - protein, 28 aa, Mycobacterium
DQLYADFRLLFLILHASRFAPRLDEHAA

SEQ ID NO: 944015 - protein, 24 aa, Mycobacterium
DQPHLGVTLMRPLSRGRVTICSAD

SEQ ID NO: 944016 - protein, 25 aa, Mycobacterium
DQRAPLHSCGRLRMLPPSHEIPPDY

SEQ ID NO: 944017 - protein, 17 aa, Mycobacterium
DQRIRQAAPFLSYGQFT

SEQ ID NO: 944018 - protein, 19 aa, Mycobacterium
DQRPPWGWAPPPRAEWRGP

SEQ ID NO: 944019 - protein, 23 aa, Mycobacterium
DQRRDLAELLDLAPLVADNAYNM

SEQ ID NO: 944020 - protein, 27 aa, Mycobacterium
DQRTRQFLAAQVIWTLSRAGIAGPYVL

SEQ ID NO: 944021 - protein, 23 aa, Mycobacterium
DQSYVLAVLTARQLRHALFPIGD

SEQ ID NO: 944022 - protein, 23 aa, Mycobacterium
DQSYVLGVLTPEQLRRAMFPVGD

SEQ ID NO: 944023 - protein, 18 aa, Mycobacterium
DQTRLRENVLLQAKVCQS

SEQ ID NO: 944024 - protein, 26 aa, Mycobacterium
DQTVLYKGGQPFLWDRGRELGMTNRL

SEQ ID NO: 944025 - protein, 19 aa, Mycobacterium
DQVADLPLHPGFAASWQRL

SEQ ID NO: 944026 - protein, 20 aa, Mycobacterium
DQVINVHLKGTWNGTRLAAA

SEQ ID NO: 944027 - protein, 19 aa, Mycobacterium
DQVMAAVRAAFKPEFINRL

SEQ ID NO: 944028 - protein, 22 aa, Mycobacterium
DQVYFDPRWIANQDPRADYAIA

SEQ ID NO: 944029 - protein, 24 aa, Mycobacterium
DQYPLVVHYGPMGWAYNSQTYDSC

SEQ ID NO: 944030 - protein, 28 aa, Mycobacterium
DRAGGRYSVYVWALLAMAAARLGVGPLR

SEQ ID NO: 944031 - protein, 19 aa, Mycobacterium
DRAIHRLRRRPMDPTEAIA

SEQ ID NO: 944032 - protein, 29 aa, Mycobacterium
DRAIRGDFVNGFFVLDLTNARLRKGLLLG

SEQ ID NO: 944033 - protein, 25 aa, Mycobacterium
DRARELILEFADFTRYSFRAAGQYT

SEQ ID NO: 944034 - protein, 19 aa, Mycobacterium
DRDGGLLPSWTPGAHIDVR

SEQ ID NO: 944035 - protein, 23 aa, Mycobacterium
DRDRAIGWLPGQLDTAGNHVAGG

SEQ ID NO: 944036 - protein, 35 aa, Mycobacterium
DRDYGFLGVAVLTAPWAPFVVDFNLANVGGPSAGL

SEQ ID NO: 944037 - protein, 26 aa, Mycobacterium
DRDYGFMGVAVLDAPWAPFVVDFHLA

SEQ ID NO: 944038 - protein, 26 aa, Mycobacterium
DRDYGFMGVAVLDAPWAPFVVDFNLA

SEQ ID NO: 944039 - protein, 18 aa, Mycobacterium
DRDYGYLGIAVLDAPWAP

SEQ ID NO: 944040 - protein, 26 aa, Mycobacterium
DREESRLPPIYPGTTVSIPPSTTPVG

SEQ ID NO: 944041 - protein, 17 aa, Mycobacterium
DRELGLARLIGFNSMRV

SEQ ID NO: 944042 - protein, 17 aa, Mycobacterium
DRFCVLAFDDRIDTPTD

SEQ ID NO: 944043 - protein, 19 aa, Mycobacterium
DRFLFKINVGYPSPEEERE

SEQ ID NO: 944044 - protein, 34 aa, Mycobacterium
DRGAQRIVLTRNPKWWGTPPLLDSMTYTVLDDAA

SEQ ID NO: 944045 - protein, 23 aa, Mycobacterium
DRGFFCEYAMRYLARAGLSMKDV

SEQ ID NO: 944046 - protein, 39 aa, Mycobacterium
DRLVAGWRVVALEPYGGAWLNSWLDRDLGLSGRLSVRDG

SEQ ID NO: 944047 - protein, 20 aa, Mycobacterium
DRLVYLDPKTGEVYGWLAEE

SEQ ID NO: 944048 - protein, 20 aa, Mycobacterium
DRMAYRCYSFGFDLFAAGLT

SEQ ID NO: 944049 - protein, 23 aa, Mycobacterium
DRNLPRRFYGKSANKIRVAWRTA

SEQ ID NO: 944050 - protein, 22 aa, Mycobacterium
DRNWQVCSSTPPPGARFTVDTD

SEQ ID NO: 944051 - protein, 19 aa, Mycobacterium
DRPFPFLDSHFRVGNALLG

SEQ ID NO: 944052 - protein, 24 aa, Mycobacterium
DRPNYAKLVAFTQFVPVLSDMTDE

SEQ ID NO: 944053 - protein, 30 aa, Mycobacterium
DRPTAWALEGLLPYLPGPAQDALFARLHEL

SEQ ID NO: 944054 - protein, 23 aa, Mycobacterium
DRQWHVNVLGTVAVTRAAAQKLS

SEQ ID NO: 944055 - protein, 18 aa, Mycobacterium
DRRIREVAPFQDYGEFTG

SEQ ID NO: 944056 - protein, 27 aa, Mycobacterium
DRRQVLDRLRQLPLAQFRTSYAYTNFG

SEQ ID NO: 944057 - protein, 34 aa, Mycobacterium
DRRWLAMTRRYRWLTAALLRGSGIRPVRACITPV

SEQ ID NO: 944058 - protein, 34 aa, Mycobacterium
DRSAQRIVLTRNPKWWGKKPRLDSITYLVLDDAA

SEQ ID NO: 944059 - protein, 19 aa, Mycobacterium
DRSVLRQLGTGRRTVIVTG

SEQ ID NO: 944060 - protein, 24 aa, Mycobacterium
DRSYRLYKPAGVAASAPLVVMMHG

SEQ ID NO: 944061 - protein, 26 aa, Mycobacterium
DRTIGWDRGVLLPSLRKQNGDMGVVM

SEQ ID NO: 944062 - protein, 24 aa, Mycobacterium
DRTRDVAVLQMRGAGGLPAAAIGG

SEQ ID NO: 944063 - protein, 18 aa, Mycobacterium
DRTVDIEYKFGFAGNPWG

SEQ ID NO: 944064 - protein, 17 aa, Mycobacterium
DRTYMVAPVSWIDGNVE

SEQ ID NO: 944065 - protein, 17 aa, Mycobacterium
DRVALYAYYSQGRRAVS

SEQ ID NO: 944066 - protein, 30 aa, Mycobacterium
DRVRELFVAWGKLYPQFGTVAALNMVKCVH

SEQ ID NO: 944067 - protein, 23 aa, Mycobacterium
DRVRFHDVLLTDPAARAALSGGS

SEQ ID NO: 944068 - protein, 21 aa, Mycobacterium
DRVTPRLPLRRATMQRIMVRS

SEQ ID NO: 944069 - protein, 19 aa, Mycobacterium
DRVTVWPRSPDIQDRVNEG

SEQ ID NO: 944070 - protein, 24 aa, Mycobacterium
DRVVTPYFWFCGQCHACARGRSHA

SEQ ID NO: 944071 - protein, 18 aa, Mycobacterium
DRWQPGATLLPVSNDRCE

SEQ ID NO: 944072 - protein, 20 aa, Mycobacterium
DRWSHGRVVLVGDAGYCCSP

SEQ ID NO: 944073 - protein, 20 aa, Mycobacterium
DRWTDLIAQRFIADGIARER

SEQ ID NO: 944074 - protein, 34 aa, Mycobacterium
DRYQALVRQGMYGDFFAFYLCDVVLKVNGKGGQP

SEQ ID NO: 944075 - protein, 31 aa, Mycobacterium
DSALGATSMKVWFNAKAMWDWSKNISDKNCL

SEQ ID NO: 944076 - protein, 24 aa, Mycobacterium
DSAPYGWPVAKGSPLAQSLQQALQ

SEQ ID NO: 944077 - protein, 29 aa, Mycobacterium
DSATRLVYLQHGFLASGPLYSYTAARLAE

SEQ ID NO: 944078 - protein, 21 aa, Mycobacterium
DSENIVLRRSRPLEISLDGHD

SEQ ID NO: 944079 - protein, 25 aa, Mycobacterium
DSEWGWSAPIYQKSGVWYVKHTVEN

SEQ ID NO: 944080 - protein, 20 aa, Mycobacterium
DSFDPLLRQYSQAVLEPPER

SEQ ID NO: 944081 - protein, 18 aa, Mycobacterium
DSGAAMPPLIGTGTPRQV

SEQ ID NO: 944082 - protein, 19 aa, Mycobacterium
DSGAYSVTYLIDSNQDRTG

SEQ ID NO: 944083 - protein, 26 aa, Mycobacterium
DSGDPALPALAALFSSVLSAGREATN

SEQ ID NO: 944084 - protein, 36 aa, Mycobacterium
DSGSIALPTPLALGIDALGPYYLATTALQNSAMAFG

SEQ ID NO: 944085 - protein, 21 aa, Mycobacterium
DSIAVTAGVPFDIAASPDGTT

SEQ ID NO: 944086 - protein, 24 aa, Mycobacterium
DSITAGKLSFPASAAPSGWTVFSD

SEQ ID NO: 944087 - protein, 22 aa, Mycobacterium
DSLDYAVIKFDPAKVTPVANFN

SEQ ID NO: 944088 - protein, 23 aa, Mycobacterium
DSLLNSHPIPNIGRVVITGNPVT

SEQ ID NO: 944089 - protein, 26 aa, Mycobacterium
DSLRRRRDLSVLLLLDVSGSAAEPGT

SEQ ID NO: 944090 - protein, 20 aa, Mycobacterium
DSMCLWFTYSTPDTNKDNVV

SEQ ID NO: 944091 - protein, 20 aa, Mycobacterium
DSMCVWFTYSTPDANKDHVV

SEQ ID NO: 944092 - protein, 25 aa, Mycobacterium
DSNLLTNILTYHVVPGQAAPDQVVG

SEQ ID NO: 944093 - protein, 23 aa, Mycobacterium
DSNNPWLNQLYPQVKVPKVDTRV

SEQ ID NO: 944094 - protein, 26 aa, Mycobacterium
DSPASSSLLWFLGAAGRRQTDQQAGP

SEQ ID NO: 944095 - protein, 38 aa, Mycobacterium
DSPPAGWMPPNAAFACQYAMQFIAVLRGYALPVDRASS

SEQ ID NO: 944096 - protein, 24 aa, Mycobacterium
DSPTGWVYIVANSFTRWLPVVLYR

SEQ ID NO: 944097 - protein, 24 aa, Mycobacterium
DSQRAVVTPLLLASAYHARTDIPE

SEQ ID NO: 944098 - protein, 18 aa, Mycobacterium
DSSYFARAWVNWNNTTRT

SEQ ID NO: 944099 - protein, 24 aa, Mycobacterium
DSTHVGRYMGIPDLLIEAPTAETE

SEQ ID NO: 944100 - protein, 17 aa, Mycobacterium
DSTNRLLVYVGRRSDVL

SEQ ID NO: 944101 - protein, 22 aa, Mycobacterium
DTAFPWRNQAAVLQWYVEPSSS

SEQ ID NO: 944102 - protein, 20 aa, Mycobacterium
DTGFLTYGTERIGAADTALI

SEQ ID NO: 944103 - protein, 25 aa, Mycobacterium
DTGNPMVDAFLWVKRPGESDGACRG

SEQ ID NO: 944104 - protein, 27 aa, Mycobacterium
DTGTVGYRFSWQLPKNRTWTYDGQLKM

SEQ ID NO: 944105 - protein, 26 aa, Mycobacterium
DTKKFTLDWTSLIVGGPFNSFTGVWH

SEQ ID NO: 944106 - protein, 21 aa, Mycobacterium
DTLASWTFQRIWDALARRLGD

SEQ ID NO: 944107 - protein, 26 aa, Mycobacterium
DTLEETALWLDLTYSGDTPVVITGAM

SEQ ID NO: 944108 - protein, 26 aa, Mycobacterium
DTLLSRLLEALPPNAALLVTADHGGL

SEQ ID NO: 944109 - protein, 23 aa, Mycobacterium
DTLRPMLHRLTAPGHWGYNAAND

SEQ ID NO: 944110 - protein, 23 aa, Mycobacterium
DTLTTLMELLGKIFSPTDPPTLS

SEQ ID NO: 944111 - protein, 17 aa, Mycobacterium
DTLWLETMLGHHQGGVD

SEQ ID NO: 944112 - protein, 18 aa, Mycobacterium
DTMYAMFAHAALITGDGA

SEQ ID NO: 944113 - protein, 30 aa, Mycobacterium
DTPATQAAWKDIPSWYFISTGDEIITPTAE

SEQ ID NO: 944114 - protein, 21 aa, Mycobacterium
DTPEWAWSAMVSTDPAFADDP

SEQ ID NO: 944115 - protein, 31 aa, Mycobacterium
DTPNTPAESPLWLVAAAALRRQIDPATTYQA

SEQ ID NO: 944116 - protein, 23 aa, Mycobacterium
DTPYSGVAAIFRSSLEKGEPPKV

SEQ ID NO: 944117 - protein, 24 aa, Mycobacterium
DTPYSGVAAIFRSSLEKGEPPRVF

SEQ ID NO: 944118 - protein, 25 aa, Mycobacterium
DTPYSGVAAIFRSSLERGEPPRVFE

SEQ ID NO: 944119 - protein, 23 aa, Mycobacterium
DTRLPAGGMLFIGTPEGQKVAPG

SEQ ID NO: 944120 - protein, 24 aa, Mycobacterium
DTSSFYRPTKAGAYPIVLVTYEIV

SEQ ID NO: 944121 - protein, 22 aa, Mycobacterium
DTSVLLGRLDLKLFAGAEPDNN

SEQ ID NO: 944122 - protein, 21 aa, Mycobacterium
DTSVLLGRLDLKLFAGAETDN

SEQ ID NO: 944123 - protein, 24 aa, Mycobacterium
DTTATFEWAFRWLERNRPEPSADA

SEQ ID NO: 944124 - protein, 27 aa, Mycobacterium
DTTDNVNYRILLKPGWRFTDGSPVTAH

SEQ ID NO: 944125 - protein, 26 aa, Mycobacterium
DTTGTLPPLLPYISAPVNGAMSVGMK

SEQ ID NO: 944126 - protein, 32 aa, Mycobacterium
DTTIMIPEEHLPLVLPFKYLGVDKDTLNKLDG

SEQ ID NO: 944127 - protein, 19 aa, Mycobacterium
DTTRLLARFPALGGTDTSG

SEQ ID NO: 944128 - protein, 26 aa, Mycobacterium
DTVINTFGGRWFDMDWNAQLTSPEVR

SEQ ID NO: 944129 - protein, 25 aa, Mycobacterium
DTVLAALRDTGFITYQPAEHMGAAN

SEQ ID NO: 944130 - protein, 24 aa, Mycobacterium
DTVRPLFGQHVVLTNPGLRQLFLE

SEQ ID NO: 944131 - protein, 21 aa, Mycobacterium
DTVRSLMFAAIPGPQGSLALS

SEQ ID NO: 944132 - protein, 24 aa, Mycobacterium
DTVWQQTMTFLRQQRTSLSGGPKP

SEQ ID NO: 944133 - protein, 17 aa, Mycobacterium
DTWHWHPMASFASSSKV

SEQ ID NO: 944134 - protein, 17 aa, Mycobacterium
DTWVPRRVDFDVDAARA

SEQ ID NO: 944135 - protein, 23 aa, Mycobacterium
DTYLVHHPAALLGKPVERVVIDP

SEQ ID NO: 944136 - protein, 24 aa, Mycobacterium
DVAALALIRFPATGDKIGSLVINP

SEQ ID NO: 944137 - protein, 26 aa, Mycobacterium
DVAEAMLTHRLTLGGPLDDAFIGRLV

SEQ ID NO: 944138 - protein, 35 aa, Mycobacterium
DVAFSVPVGGLLSPLQPFTLTLTPTSGTPTSIALG

SEQ ID NO: 944139 - protein, 19 aa, Mycobacterium
DVALVPLPVPDRFATTFVA

SEQ ID NO: 944140 - protein, 30 aa, Mycobacterium
DVAPAAIVHLAAIIPPFCYMRRELARKVNV

SEQ ID NO: 944141 - protein, 24 aa, Mycobacterium
DVAPRRGWLEALLGHFCDPTVALV

SEQ ID NO: 944142 - protein, 25 aa, Mycobacterium
DVASRIRGIATFGNIDRRGGGMTGP

SEQ ID NO: 944143 - protein, 23 aa, Mycobacterium
DVAVMSAYHTGVSAAAAQLAPLQ

SEQ ID NO: 944144 - protein, 17 aa, Mycobacterium
DVCAFWPVPATSTARPV

SEQ ID NO: 944145 - protein, 25 aa, Mycobacterium
DVDAIILCTGYQHHFPFIDPELRLT

SEQ ID NO: 944146 - protein, 17 aa, Mycobacterium
DVEALACEPGVVVRWVA

SEQ ID NO: 944147 - protein, 27 aa, Mycobacterium
DVEDPPPPLPDPPPPPPPDGCALAAIW

SEQ ID NO: 944148 - protein, 27 aa, Mycobacterium
DVFAVELSSFQLHWAPSLRPEAGAVLN

SEQ ID NO: 944149 - protein, 18 aa, Mycobacterium
DVFDRLPAPYGLVRYGVA

SEQ ID NO: 944150 - protein, 23 aa, Mycobacterium
DVGAVVALAPWWIGGDGDVIPAR

SEQ ID NO: 944151 - protein, 26 aa, Mycobacterium
DVGDAFLRPFGDFWVNHREEFIEKVR

SEQ ID NO: 944152 - protein, 20 aa, Mycobacterium
DVGFPYRSAILPGRNAEIDA

SEQ ID NO: 944153 - protein, 29 aa, Mycobacterium
DVGPDLNLALLWTSAFPYGPTFADRVTKG

SEQ ID NO: 944154 - protein, 25 aa, Mycobacterium
DVGSATFFWMINNSKVRQPAGGSWS

SEQ ID NO: 944155 - protein, 21 aa, Mycobacterium
DVITELFLDALREPRIPGVDK

SEQ ID NO: 944156 - protein, 19 aa, Mycobacterium
DVITQALQKIPPALDVLIR

SEQ ID NO: 944157 - protein, 18 aa, Mycobacterium
DVLTRRGVGTPKGQVPLA

SEQ ID NO: 944158 - protein, 32 aa, Mycobacterium
DVPDVVVLDDIWWFHFALSGVISPLDKLFRQI

SEQ ID NO: 944159 - protein, 17 aa, Mycobacterium
DVPFPFAGGVRLPDQAQ

SEQ ID NO: 944160 - protein, 22 aa, Mycobacterium
DVPSVLLTPKSITKDNINVVFD

SEQ ID NO: 944161 - protein, 23 aa, Mycobacterium
DVPTSLYSFSFAPSAKWSHTFAR

SEQ ID NO: 944162 - protein, 28 aa, Mycobacterium
DVQAGLAMLAPIWGYRPLLDIDDQTARD

SEQ ID NO: 944163 - protein, 17 aa, Mycobacterium
DVQRLWVSASEAPSAVA

SEQ ID NO: 944164 - protein, 27 aa, Mycobacterium
DVRALELDLHYIRRLDLVGGRGVTVCH

SEQ ID NO: 944165 - protein, 19 aa, Mycobacterium
DVRTFGRYGWGVDLDLALR

SEQ ID NO: 944166 - protein, 28 aa, Mycobacterium
DVSFNEALFLLTQRPLDPGTPPPAGLAP

SEQ ID NO: 944167 - protein, 21 aa, Mycobacterium
DVSYPFYLANGRIPAAPTTLT

SEQ ID NO: 944168 - protein, 23 aa, Mycobacterium
DVTKVPLPRKLAKASLARVPGLY

SEQ ID NO: 944169 - protein, 31 aa, Mycobacterium
DVTLTSVFRATRAALRYFREAPHGGVIVNNA

SEQ ID NO: 944170 - protein, 23 aa, Mycobacterium
DVTPKLFLPNLSGLTQGPGFPNL

SEQ ID NO: 944171 - protein, 32 aa, Mycobacterium
DVTPRALERLPLDFPIYNLAARSYFWNMSGTT

SEQ ID NO: 944172 - protein, 31 aa, Mycobacterium
DVTRQYDGWADFPRYLWNPVAIANAIAGIAL

SEQ ID NO: 944173 - protein, 24 aa, Mycobacterium
DVVALRIPIVVGFQLGAFAAGAAY

SEQ ID NO: 944174 - protein, 19 aa, Mycobacterium
DVVGTTWRFAEVMGAATPT

SEQ ID NO: 944175 - protein, 32 aa, Mycobacterium
DVVHLAAQNDYLPRDEFFGGVLGWVDGQQVTQ

SEQ ID NO: 944176 - protein, 17 aa, Mycobacterium
DVVITMLPNGELVKRCY

SEQ ID NO: 944177 - protein, 17 aa, Mycobacterium
DVVLPIGYDASSPIPAA

SEQ ID NO: 944178 - protein, 19 aa, Mycobacterium
DVVNPPEWLIGSMANLNGK

SEQ ID NO: 944179 - protein, 65 aa, Mycobacterium
DVVVTEWTPPLEWLQTIPLFGRFVMTPLVGLLHNIPLIGDILHPVFGFPIDHNAPPGTPRARSFR

SEQ ID NO: 944180 - protein, 21 aa, Mycobacterium
DVVYSFAANPSWNPFAFSSLT

SEQ ID NO: 944181 - protein, 25 aa, Mycobacterium
DWATQISYSGIYVHAAPWSVGSQGE

SEQ ID NO: 944182 - protein, 30 aa, Mycobacterium
DWAVGDGLGSYFWQHNWGSPKGYTHPAANL

SEQ ID NO: 944183 - protein, 17 aa, Mycobacterium
DWDLISAAVRQAASAET

SEQ ID NO: 944184 - protein, 24 aa, Mycobacterium
DWDTYRCLAALQALLFPAQASDMA

SEQ ID NO: 944185 - protein, 19 aa, Mycobacterium
DWHTAMAMVLLRNGITDVN

SEQ ID NO: 944186 - protein, 20 aa, Mycobacterium
DWIDVESFARYVATQNLLIN

SEQ ID NO: 944187 - protein, 18 aa, Mycobacterium
DWPAALRRVGFDATAPTV

SEQ ID NO: 944188 - protein, 20 aa, Mycobacterium
DWPHLGVALMRPRSRARVTL

SEQ ID NO: 944189 - protein, 17 aa, Mycobacterium
DWRAMISAILRRTRRRS

SEQ ID NO: 944190 - protein, 19 aa, Mycobacterium
DWSTLLRIVSFTVRNVAAF

SEQ ID NO: 944191 - protein, 26 aa, Mycobacterium
DWTQLFTATTMLPWHVVADKLGGNID

SEQ ID NO: 944192 - protein, 23 aa, Mycobacterium
DYARLLIQASDISAPVPFAAAPP

SEQ ID NO: 944193 - protein, 33 aa, Mycobacterium
DYCVAVYRIMLADAIGYHSALRFGIEHGKRNMV

SEQ ID NO: 944194 - protein, 26 aa, Mycobacterium
DYDGAHIWVRYQSDVALYAVSVDRRD

SEQ ID NO: 944195 - protein, 22 aa, Mycobacterium
DYDGFTLAGVPAGGLFSGAEVK

SEQ ID NO: 944196 - protein, 27 aa, Mycobacterium
DYDVEFTVLLADWLLDATPPQVFSALK

SEQ ID NO: 944197 - protein, 27 aa, Mycobacterium
DYERMMAMLTGFWVTQIVRAAAVFNLA

SEQ ID NO: 944198 - protein, 25 aa, Mycobacterium
DYGICPFAGWPVPIPNGAQPNTGSD

SEQ ID NO: 944199 - protein, 20 aa, Mycobacterium
DYGLRMHTMQAQWARDVIAR

SEQ ID NO: 944200 - protein, 18 aa, Mycobacterium
DYGPDFGLTYMLDGLAAM

SEQ ID NO: 944201 - protein, 18 aa, Mycobacterium
DYGPDFGLTYVLDGLAAM

SEQ ID NO: 944202 - protein, 21 aa, Mycobacterium
DYISKLPGYWPTVVQQKLQTG

SEQ ID NO: 944203 - protein, 22 aa, Mycobacterium
DYLFNHPDVNDFFTGLRGQDRD

SEQ ID NO: 944204 - protein, 22 aa, Mycobacterium
DYPSIYNFLESLYGTVALPPNG

SEQ ID NO: 944205 - protein, 21 aa, Mycobacterium
DYSQLWPQLLRDRYGRSFSIA

SEQ ID NO: 944206 - protein, 28 aa, Mycobacterium
DYSRDVLKLIPVMWDNVPPPGAPDTPLP

SEQ ID NO: 944207 - protein, 24 aa, Mycobacterium
DYVEPGTTVELLFVAANDSTEGSN

SEQ ID NO: 944208 - protein, 33 aa, Mycobacterium
DYYVIRTEDLPLLEPLRALPVLGDPLADLVQPN

SEQ ID NO: 944209 - protein, 27 aa, Mycobacterium
EAAAMRNLLLMLGFPANRIIVEDRANS

SEQ ID NO: 944210 - protein, 26 aa, Mycobacterium
EAAEGVRWVLLTRSVPGRSAAWLVVD

SEQ ID NO: 944211 - protein, 22 aa, Mycobacterium
EAAPFVQQLRDGGFEGTFASAD

SEQ ID NO: 944212 - protein, 22 aa, Mycobacterium
EAAPLVQQLRNGGVTATFVSSD

SEQ ID NO: 944213 - protein, 18 aa, Mycobacterium
EAAQVVVFPLTPPQPTAI

SEQ ID NO: 944214 - protein, 25 aa, Mycobacterium
EAASRPFAPSWVRTDRFRVTVDDGH

SEQ ID NO: 944215 - protein, 26 aa, Mycobacterium
EAAVAGAIPVIRPLTQSLAGDSVIRV

SEQ ID NO: 944216 - protein, 26 aa, Mycobacterium
EAAVAGAIPVIRPLTQSLAGDTVRRV

SEQ ID NO: 944217 - protein, 19 aa, Mycobacterium
EADLTFAEPLLAATKTLVL

SEQ ID NO: 944218 - protein, 21 aa, Mycobacterium
EADPALSAALPPAIAQSKTIN

SEQ ID NO: 944219 - protein, 37 aa, Mycobacterium
EADSPWATGLRRLGLWSLRLPGIRQLVARQALKVGRS

SEQ ID NO: 944220 - protein, 30 aa, Mycobacterium
EADVEPLGWYRRPGVLFAAAACLAAVATTG

SEQ ID NO: 944221 - protein, 18 aa, Mycobacterium
EAFDADRPFPFLDSHFRV

SEQ ID NO: 944222 - protein, 19 aa, Mycobacterium
EAFVLAEKLGLSAQSLFDV

SEQ ID NO: 944223 - protein, 33 aa, Mycobacterium
EAGFWGPEWFPQAYPWIPSINPGLHFYIGQPEV

SEQ ID NO: 944224 - protein, 25 aa, Mycobacterium
EAGFYRLSSIRWWPDRRLSRRGLEV

SEQ ID NO: 944225 - protein, 19 aa, Mycobacterium
EAGLYFWMDYHDGMEPYLT

SEQ ID NO: 944226 - protein, 30 aa, Mycobacterium
EAGPILWADMPTLPLYRQQRTLLTSTKMSA

SEQ ID NO: 944227 - protein, 20 aa, Mycobacterium
EAGPNQVLSPGFHGLQIHSV

SEQ ID NO: 944228 - protein, 21 aa, Mycobacterium
EAHYPLTAFSSVALAYAATVT

SEQ ID NO: 944229 - protein, 18 aa, Mycobacterium
EAIDLIRRLWSGSRISFS

SEQ ID NO: 944230 - protein, 22 aa, Mycobacterium
EAIIAILAVLKSGAAYLPMDTA

SEQ ID NO: 944231 - protein, 19 aa, Mycobacterium
EAIKLIRQLWSGERISFDG

SEQ ID NO: 944232 - protein, 25 aa, Mycobacterium
EAIKRIKYRYLRALDTKHWDDFADT

SEQ ID NO: 944233 - protein, 21 aa, Mycobacterium
EAIRRRMGHPRFPMYQAGYDA

SEQ ID NO: 944234 - protein, 21 aa, Mycobacterium
EALACEPGVLVRWITEPADLA

SEQ ID NO: 944235 - protein, 19 aa, Mycobacterium
EALACEPGVVVRWVADPAG

SEQ ID NO: 944236 - protein, 19 aa, Mycobacterium
EALNLRRGCITRDPQLGLT

SEQ ID NO: 944237 - protein, 26 aa, Mycobacterium
EALRAQWDVPALALLGVGSGARVALA

SEQ ID NO: 944238 - protein, 18 aa, Mycobacterium
EALYGQMWAQDAAAMYGY

SEQ ID NO: 944239 - protein, 22 aa, Mycobacterium
EAMRRFPAGLLVLGDAICSFNP

SEQ ID NO: 944240 - protein, 26 aa, Mycobacterium
EANFMLIGAAFYRDEYRRTADGWRIS

SEQ ID NO: 944241 - protein, 23 aa, Mycobacterium
EANKVWLIPSDFGSALQGFTKLL

SEQ ID NO: 944242 - protein, 43 aa, Mycobacterium
EANPAMLMESINALIPFPAFSEPWGRHVNWWVTANLPMHEGCN

SEQ ID NO: 944243 - protein, 33 aa, Mycobacterium
EANWLPAPKGPFTLVLRLYWPKPDALNGTWQAP

SEQ ID NO: 944244 - protein, 26 aa, Mycobacterium
EARALRFWEVMYPSPPPGLAEPGDER

SEQ ID NO: 944245 - protein, 32 aa, Mycobacterium; identical to SEQ ID NO: 237566

SEQ ID NO: 944246 - protein, 24 aa, Mycobacterium
EARIKFNCLTAGAWPAFWLGNTGE

SEQ ID NO: 944247 - protein, 24 aa, Mycobacterium
EARIKLNCLTAGAWPAYWLGNEDQ

SEQ ID NO: 944248 - protein, 28 aa, Mycobacterium
EARLRRPQFTFPARGILTSGFGARWGTL

SEQ ID NO: 944249 - protein, 18 aa, Mycobacterium
EARRPGLFGVIQLVMHNI

SEQ ID NO: 944250 - protein, 25 aa, Mycobacterium
EASPSGLAFYGGSLWVAALRGERLF

SEQ ID NO: 944251 - protein, 23 aa, Mycobacterium
EATRAAAGIGLLPCFMADRHDDL

SEQ ID NO: 944252 - protein, 25 aa, Mycobacterium
EATRHQMHWFYGLGVADRRAYSEQF

SEQ ID NO: 944253 - protein, 18 aa, Mycobacterium
EATVFITITPVDDAPVAV

SEQ ID NO: 944254 - protein, 26 aa, Mycobacterium
EAVAFHGRFVQALTGGVQMYAAAETA

SEQ ID NO: 944255 - protein, 18 aa, Mycobacterium
EAVGLQPFTLTVPPRREE

SEQ ID NO: 944256 - protein, 29 aa, Mycobacterium
EAVNNGFYYYGFASNLLPGPAIQPFLDYA

SEQ ID NO: 944257 - protein, 20 aa, Mycobacterium
EAVPIAAFAQMRIVMSTKND

SEQ ID NO: 944258 - protein, 25 aa, Mycobacterium
EAVQIDHIVPLAYAWDMGAYAWPAD

SEQ ID NO: 944259 - protein, 17 aa, Mycobacterium
EAVWTTRLPGPAQIAIT

SEQ ID NO: 944260 - protein, 25 aa, Mycobacterium
EAWNHYYNHWFPNAVIDGWIDLDFD

SEQ ID NO: 944261 - protein, 23 aa, Mycobacterium
ECDLYRFEDFARSPRFIDETCAQ

SEQ ID NO: 944262 - protein, 21 aa, Mycobacterium
ECVQLHPLVDRDRILGGFHTP

SEQ ID NO: 944263 - protein, 29 aa, Mycobacterium
ECVSLVKRFLLDVHGITAGAWGDAVDYRD

SEQ ID NO: 944264 - protein, 18 aa, Mycobacterium
EDAAILARFLELADDVPT

SEQ ID NO: 944265 - protein, 31 aa, Mycobacterium
EDAATFTLSATWKFGPQKTTEWTYTAAGRAR

SEQ ID NO: 944266 - protein, 24 aa, Mycobacterium
EDALPVPRKVAVSTPFYTFAVDML

SEQ ID NO: 944267 - protein, 25 aa, Mycobacterium
EDAPLTVVFAHGFCLRMGSFHFQRV

SEQ ID NO: 944268 - protein, 22 aa, Mycobacterium
EDCLLLTVTMPRHTQGKVPVLV

SEQ ID NO: 944269 - protein, 22 aa, Mycobacterium
EDDFYSPWMWPGDDGFGVGYGY

SEQ ID NO: 944270 - protein, 17 aa, Mycobacterium
EDELLELGIESLGIWRD

SEQ ID NO: 944271 - protein, 19 aa, Mycobacterium
EDEYSKMDYGWATLLAPYV

SEQ ID NO: 944272 - protein, 18 aa, Mycobacterium
EDFAAWAPGMKTLDDALS

SEQ ID NO: 944273 - protein, 25 aa, Mycobacterium
EDIDTIGDLLLKTHVRLVKAVLPHM

SEQ ID NO: 944274 - protein, 18 aa, Mycobacterium
EDIRRWEELSRSTDFADG

SEQ ID NO: 944275 - protein, 28 aa, Mycobacterium
EDIYYVSRHYAQRYPGLPIYIVENGMVT

SEQ ID NO: 944276 - protein, 19 aa, Mycobacterium
EDLVLGVTLIADGRRQPGV

SEQ ID NO: 944277 - protein, 23 aa, Mycobacterium
EDLYEGGWYFKDGTHFSDPLNGQ

SEQ ID NO: 944278 - protein, 17 aa, Mycobacterium
EDLYEGGWYFKDGTRFS

SEQ ID NO: 944279 - protein, 32 aa, Mycobacterium
EDPPIRNAALLRVFLLGHLPPGQARKYLESLL

SEQ ID NO: 944280 - protein, 24 aa, Mycobacterium
EDRRFTVVFAYDQSDYARMEATRR

SEQ ID NO: 944281 - protein, 17 aa, Mycobacterium
EDRVRLLARARIALRYP

SEQ ID NO: 944282 - protein, 26 aa, Mycobacterium
EDSRVMPIIPALFGSGPNPLIVTRGL

SEQ ID NO: 944283 - protein, 26 aa, Mycobacterium
EDVADQLSAFMLLAPGADGKPYPNGV

SEQ ID NO: 944284 - protein, 28 aa, Mycobacterium
EDVADQLSAFMLLAPGADGTPYPNGVRI

SEQ ID NO: 944285 - protein, 19 aa, Mycobacterium
EDVAPIREQLAALPGVQLR

SEQ ID NO: 944286 - protein, 18 aa, Mycobacterium
EDVYAWRGVLQSAAVHEF

SEQ ID NO: 944287 - protein, 19 aa, Mycobacterium
EDWMRPDYVPPQQNPAAAP

SEQ ID NO: 944288 - protein, 20 aa, Mycobacterium
EEAAFTAVPTVTTGTALAAD

SEQ ID NO: 944289 - protein, 25 aa, Mycobacterium
EEAAVRLLEWLQASHPTPEVAAALK

SEQ ID NO: 944290 - protein, 26 aa, Mycobacterium
EEAGLTRFLGGYLSVLSAPKALVRAG

SEQ ID NO: 944291 - protein, 17 aa, Mycobacterium
EEAVAVGDLVRLMEFRR

SEQ ID NO: 944292 - protein, 18 aa, Mycobacterium
EEAVAVGDVVRLMEFRKG

SEQ ID NO: 944293 - protein, 19 aa, Mycobacterium
EECSMFQLLIGYRYQSAAV

SEQ ID NO: 944294 - protein, 18 aa, Mycobacterium
EEDIFSHTDLWDFSANLQ

SEQ ID NO: 944295 - protein, 27 aa, Mycobacterium
EEGLGATIDWYRANESWWRPLKDAAEA

SEQ ID NO: 944296 - protein, 31 aa, Mycobacterium
EEGLRATIDWYRDNEAWWRPLKDAAEARYEQ

SEQ ID NO: 944297 - protein, 20 aa, Mycobacterium
EELRALKPWEGARHFVLIDD

SEQ ID NO: 944298 - protein, 17 aa, Mycobacterium
EELVFAYDGMRSKGLRA

SEQ ID NO: 944299 - protein, 18 aa, Mycobacterium
EELVFTRDTLRARGVKAV

SEQ ID NO: 944300 - protein, 29 aa, Mycobacterium
EELVSYVRGVLYFRTGRWPDVLNQFSEGK

SEQ ID NO: 944301 - protein, 17 aa, Mycobacterium
EEQGNYVILNRVGNLPL

SEQ ID NO: 944302 - protein, 23 aa, Mycobacterium
EEQRQRFLPRMATGESRGAFSMS

SEQ ID NO: 944303 - protein, 22 aa, Mycobacterium
EETPWDVQLLTTGKALGKEAEA

SEQ ID NO: 944304 - protein, 29 aa, Mycobacterium
EETRALFDRIKPTLPIVLANLISVGEVAV

SEQ ID NO: 944305 - protein, 18 aa, Mycobacterium
EEVLYRPLGMTSTSSRFA

SEQ ID NO: 944306 - protein, 21 aa, Mycobacterium
EFADYPAMLTALRAGQLTAGW

SEQ ID NO: 944307 - protein, 20 aa, Mycobacterium
EFAPPRLGDLKRSCLDIGSA

SEQ ID NO: 944308 - protein, 17 aa, Mycobacterium
EFDDLRVPLSELQRLRG

SEQ ID NO: 944309 - protein, 20 aa, Mycobacterium
EFEDYVARIARSCGLPVIMT

SEQ ID NO: 944310 - protein, 23 aa, Mycobacterium
EFGHTLDSLITPVARALGVRANC

SEQ ID NO: 944311 - protein, 18 aa, Mycobacterium
EFLVTGKYWPKTFRVRLD

SEQ ID NO: 944312 - protein, 28 aa, Mycobacterium
EFPEVDRVGWFPVATARGKLLRGQRDFL

SEQ ID NO: 944313 - protein, 23 aa, Mycobacterium
EFPSAGDYRLYFDFKHDDVVRTA

SEQ ID NO: 944314 - protein, 23 aa, Mycobacterium
EFSNTIPDLRLPFGIAPTSQGAR

SEQ ID NO: 944315 - protein, 28 aa, Mycobacterium
EFTFPMEFTPIHGGWQLSQRTSEMLLAL

SEQ ID NO: 944316 - protein, 30 aa, Mycobacterium
EFTGDAPLGTCAFWPVPPTSEPHELKVEGL

SEQ ID NO: 944317 - protein, 26 aa, Mycobacterium
EFTTVLEPIVAPLRDVKLDAGHWLDF

SEQ ID NO: 944318 - protein, 29 aa, Mycobacterium
EGAPATPNALYGAILPSTSPGSVTSTGSG

SEQ ID NO: 944319 - protein, 26 aa, Mycobacterium
EGAPILWNDVPTLPLYRQQRTVLTSN

SEQ ID NO: 944320 - protein, 23 aa, Mycobacterium
EGARFWLDYTDGAQPYFEVAASS

SEQ ID NO: 944321 - protein, 30 aa, Mycobacterium
EGDSWELLGNARWLPLVIAHGLLDELVPFP

SEQ ID NO: 944322 - protein, 24 aa, Mycobacterium
EGDVLPGYGWIFPLGGGQINIGVG

SEQ ID NO: 944323 - protein, 22 aa, Mycobacterium
EGEGLVVWFNTLLASGGGQVLS

SEQ ID NO: 944324 - protein, 20 aa, Mycobacterium
EGEPIPFARVFPVGRYVGAD

SEQ ID NO: 944325 - protein, 26 aa, Mycobacterium
EGFENSWRVNCLGAFLGMRATLEHLR

SEQ ID NO: 944326 - protein, 21 aa, Mycobacterium
EGFVFNRLQGALLREAYCLLR

SEQ ID NO: 944327 - protein, 26 aa, Mycobacterium
EGGKWAWCQQPPPGLFTQWTTSSAAQ

SEQ ID NO: 944328 - protein, 23 aa, Mycobacterium
EGGSFTKFPFGAPTTLPAIFTHR

SEQ ID NO: 944329 - protein, 35 aa, Mycobacterium
EGGTTTHYLVPAEKLPLVRLFPSLANREAELKAKI

SEQ ID NO: 944330 - protein, 24 aa, Mycobacterium
EGHRLFAGIPYAAPPVGSLRFAAP

SEQ ID NO: 944331 - protein, 25 aa, Mycobacterium
EGIEQLNPQRFLIDPQGAAETWKAM

SEQ ID NO: 944332 - protein, 30 aa, Mycobacterium
EGIVIPLPDHIGVLNFTPGNIGSLNLGIGN

SEQ ID NO: 944333 - protein, 23 aa, Mycobacterium
EGKSSVRTWLYRIATNTCLTALD

SEQ ID NO: 944334 - protein, 17 aa, Mycobacterium
EGLMVWFNTVLSSVGGQ

SEQ ID NO: 944335 - protein, 17 aa, Mycobacterium
EGLPRRPGVYLFRGPSG

SEQ ID NO: 944336 - protein, 17 aa, Mycobacterium
EGLYTDWPDRESLVTEI

SEQ ID NO: 944337 - protein, 23 aa, Mycobacterium
EGPSPIYNMALALRLCGPLDVEA

SEQ ID NO: 944338 - protein, 21 aa, Mycobacterium
EGRDMSHIISFLATLPEVALD

SEQ ID NO: 944339 - protein, 21 aa, Mycobacterium
EGRTWFETILVEPDAHHGEVS

SEQ ID NO: 944340 - protein, 21 aa, Mycobacterium
EGRVGLLRKVLDSAGSVNPIA

SEQ ID NO: 944341 - protein, 26 aa, Mycobacterium
EGTGSTLYWNLSLWSEYNIMLMETDL

SEQ ID NO: 944342 - protein, 28 aa, Mycobacterium
EGVPPTDRFPLLALLRRTLTEEQVQEVV

SEQ ID NO: 944343 - protein, 18 aa, Mycobacterium
EGVWLRPDNLDLELPPGI

SEQ ID NO: 944344 - protein, 17 aa, Mycobacterium
EHELDCIVFATGFDVCK

SEQ ID NO: 944345 - protein, 24 aa, Mycobacterium
EHGLAATIEWYRTHEDWWTPAKEA

SEQ ID NO: 944346 - protein, 24 aa, Mycobacterium
EHLEWLAQWGIFDALRASSEVVRV

SEQ ID NO: 944347 - protein, 25 aa, Mycobacterium
EHLVSWVRAVIYGAGQRWTEVIDQV

SEQ ID NO: 944348 - protein, 27 aa, Mycobacterium
EHPEPGDWLYFVTIDAQGTTLFTKDYQ

SEQ ID NO: 944349 - protein, 32 aa, Mycobacterium
EHRLPKGVVGIISPWNYPLTLGISDALPAIVA

SEQ ID NO: 944350 - protein, 29 aa, Mycobacterium
EHRNGAVMGILWAGIFRYQQMTEHQYAIG

SEQ ID NO: 944351 - protein, 18 aa, Mycobacterium
EHRTQWTAAPLLHQCCGA

SEQ ID NO: 944352 - protein, 28 aa, Mycobacterium
EHVGVTLDRIWWDRPFTLTDVDVGAGWA

SEQ ID NO: 944353 - protein, 18 aa, Mycobacterium
EHVNVPITFKIENPVAVV

SEQ ID NO: 944354 - protein, 22 aa, Mycobacterium
EIAGEVPLAYALAAGSFRDGTR

SEQ ID NO: 944355 - protein, 30 aa, Mycobacterium
EIAIDALDIAAVRPFWQAITDYVDHTVSDG

SEQ ID NO: 944356 - protein, 25 aa, Mycobacterium
EIARHPLIVPVRGNALRSLVDEAAA

SEQ ID NO: 944357 - protein, 17 aa, Mycobacterium
EIDARMMRLSWQSYLVA

SEQ ID NO: 944358 - protein, 27 aa, Mycobacterium
EIDSRTYTFIAYLGDYYAFTTLTTDPG

SEQ ID NO: 944359 - protein, 30 aa, Mycobacterium
EIDSRVYTFTAYLGDFYAFTTLTTDPGSAL

SEQ ID NO: 944360 - protein, 22 aa, Mycobacterium
EIEALYYLHPLTGDVVRQVDSL

SEQ ID NO: 944361 - protein, 32 aa, Mycobacterium
EIETAFMEYLDMFYNLGLAGRAMKRIGAIEFA

SEQ ID NO: 944362 - protein, 28 aa, Mycobacterium
EIEYLARKFGNWADPIPRLLRQSRESSV

SEQ ID NO: 944363 - protein, 17 aa, Mycobacterium
EIHLENMHYLARAGAVI

SEQ ID NO: 944364 - protein, 25 aa, Mycobacterium
EIIGAAVRFVSGPPVTPPGSNVTVR

SEQ ID NO: 944365 - protein, 18 aa, Mycobacterium
EILFDADLAHRPALETDR

SEQ ID NO: 944366 - protein, 36 aa, Mycobacterium; identical to SEQ ID NO: 22051

SEQ ID NO: 944367 - protein, 36 aa, Mycobacterium
EILLARNDRFWSVPAKPDLVLFRRGGAPAALADSIR

SEQ ID NO: 944368 - protein, 19 aa, Mycobacterium
EILLARNDRYWATQAVPDE

SEQ ID NO: 944369 - protein, 37 aa, Mycobacterium
EILLARNDRYWGTPAKPALILFRRAGAPAALADSVRN

SEQ ID NO: 944370 - protein, 17 aa, Mycobacterium
EILSKYKIPAAAKVRVA

SEQ ID NO: 944371 - protein, 25 aa, Mycobacterium
EIPGLPPITIPLLAPPPPPPGQPPP

SEQ ID NO: 944372 - protein, 26 aa, Mycobacterium
EIPGLPPITIPLMAPPPPAPPGAPPP

SEQ ID NO: 944373 - protein, 17 aa, Mycobacterium
EIPPGASAIFLTELHRA

SEQ ID NO: 944374 - protein, 19 aa, Mycobacterium
EIPRLGAPFIVAALDAAPP

SEQ ID NO: 944375 - protein, 18 aa, Mycobacterium
EIPSVVLEVEFALDASGR

SEQ ID NO: 944376 - protein, 21 aa, Mycobacterium
EIQIRGPWITQSYYEYDSPAV

SEQ ID NO: 944377 - protein, 19 aa, Mycobacterium
EIRRDGAFAIARVTARSAL

SEQ ID NO: 944378 - protein, 17 aa, Mycobacterium
EISAKMGVLPRIEALAT

SEQ ID NO: 944379 - protein, 18 aa, Mycobacterium
EISPAYEEGLIPATTYQL

SEQ ID NO: 944380 - protein, 19 aa, Mycobacterium
EIVGFLALFAYVAIHPGVA

SEQ ID NO: 944381 - protein, 18 aa, Mycobacterium
EIVGVRIALAGRTINVRA

SEQ ID NO: 944382 - protein, 17 aa, Mycobacterium
EIVIARALSQRGVPFTY

SEQ ID NO: 944383 - protein, 19 aa, Mycobacterium
EIVWYLDEPVADPALVPLF

SEQ ID NO: 944384 - protein, 18 aa, Mycobacterium
EIYLNTFRHLYGLECSHI

SEQ ID NO: 944385 - protein, 18 aa, Mycobacterium
EKDVGFPYRSALVPGRNA

SEQ ID NO: 944386 - protein, 27 aa, Mycobacterium
EKILGADILVLSTPVWVGHPSSITQRV

SEQ ID NO: 944387 - protein, 23 aa, Mycobacterium
EKNRPRVLIGPDARVFDAIPRII

SEQ ID NO: 944388 - protein, 21 aa, Mycobacterium
EKVFDCGDPLLLNRFRQLSTN

SEQ ID NO: 944389 - protein, 25 aa, Mycobacterium
ELAAFDVLLAIARTGSLGAAGRELG

SEQ ID NO: 944390 - protein, 23 aa, Mycobacterium
ELAAGTRRWSGPEIFVFIDREET

SEQ ID NO: 944391 - protein, 24 aa, Mycobacterium
ELAKVWLSLSRKEVFPTHPVAGLL

SEQ ID NO: 944392 - protein, 18 aa, Mycobacterium
ELALVDRTLSVVGVGFGV

SEQ ID NO: 944393 - protein, 23 aa, Mycobacterium
ELARPMISLGTRGLLLGIKHRVE

SEQ ID NO: 944394 - protein, 20 aa, Mycobacterium
ELARSYLLRKVADPELRAKL

SEQ ID NO: 944395 - protein, 24 aa, Mycobacterium
ELASFEIFLAIAQTGSLGGAAREL

SEQ ID NO: 944396 - protein, 22 aa, Mycobacterium
ELATKLMRWTGLSAEKVARTCL

SEQ ID NO: 944397 - protein, 23 aa, Mycobacterium
ELCPAQIWQLRQSAAGYTYSASI

SEQ ID NO: 944398 - protein, 26 aa, Mycobacterium
ELDFDFAMLLPPFRGAALTAYDKRGN

SEQ ID NO: 944399 - protein, 22 aa, Mycobacterium
ELDKAFALWGGPPLVLRMDNGP

SEQ ID NO: 944400 - protein, 30 aa, Mycobacterium
ELDRDDLWLRFRQGALYAYVAPLITAGMGG

SEQ ID NO: 944401 - protein, 29 aa, Mycobacterium
ELDRDDLWLRFRQGALYAYVAPLITTGMG

SEQ ID NO: 944402 - protein, 19 aa, Mycobacterium
ELDVAKLLDFPLMTDMRDP

SEQ ID NO: 944403 - protein, 30 aa, Mycobacterium
ELEDQLFRFSRILDAQPRLSILLGDYVVPA

SEQ ID NO: 944404 - protein, 19 aa, Mycobacterium
ELEIPTLLLGVANDPIVGN

SEQ ID NO: 944405 - protein, 25 aa, Mycobacterium
ELEQLGYGTLWIGGSPEADLTFAEP

SEQ ID NO: 944406 - protein, 18 aa, Mycobacterium
ELFEPYDWSLSDCGPGCL

SEQ ID NO: 944407 - protein, 23 aa, Mycobacterium
ELGARIVAFPLISTGSFGWPRQD

SEQ ID NO: 944408 - protein, 29 aa, Mycobacterium
ELGATSMKVWYRAKAMWDWSQNVTDKNCL

SEQ ID NO: 944409 - protein, 17 aa, Mycobacterium
ELGLPAAVFLATGPMGT

SEQ ID NO: 944410 - protein, 20 aa, Mycobacterium
ELGSNYTTPYRWTPDTKIGD

SEQ ID NO: 944411 - protein, 26 aa, Mycobacterium
ELGYQVGYPWSLGVGLNFNYTTPNTS

SEQ ID NO: 944412 - protein, 23 aa, Mycobacterium
ELHRLPHLVELPARGLGADMIGR

SEQ ID NO: 944413 - protein, 20 aa, Mycobacterium
ELHSVGWFARNDIDLHLGVT

SEQ ID NO: 944414 - protein, 17 aa, Mycobacterium
ELILYMPDYPVGHDEPL

SEQ ID NO: 944415 - protein, 17 aa, Mycobacterium
ELIYQIGTGYFGCRDEH

SEQ ID NO: 944416 - protein, 17 aa, Mycobacterium
ELKVLVSKLAILEETLV

SEQ ID NO: 944417 - protein, 26 aa, Mycobacterium
ELLDGQAIAFRSGPRTGFLSGLGLIT

SEQ ID NO: 944418 - protein, 22 aa, Mycobacterium
ELLELGIESLGIWRDGFIDDVE

SEQ ID NO: 944419 - protein, 21 aa, Mycobacterium
ELLIVILPLAGATVAAVRAFG

SEQ ID NO: 944420 - protein, 17 aa, Mycobacterium
ELLQRYPGAIGGKTGFT

SEQ ID NO: 944421 - protein, 18 aa, Mycobacterium
ELLRDAFTGMHDQVDGWL

SEQ ID NO: 944422 - protein, 19 aa, Mycobacterium
ELLVLAAPVIGVIYAGIRA

SEQ ID NO: 944423 - protein, 26 aa, Mycobacterium
ELLVLLIVGLVVLGPERLPGAIRWTT

SEQ ID NO: 944424 - protein, 24 aa, Mycobacterium
ELNPPYRVPYPQAMPAQETTPARG

SEQ ID NO: 944425 - protein, 23 aa, Mycobacterium
ELNSARIFAGAGTAPMLSAAAAW

SEQ ID NO: 944426 - protein, 25 aa, Mycobacterium
ELPPPAPVDMLAAPMPAPEGLPPAP

SEQ ID NO: 944427 - protein, 25 aa, Mycobacterium
ELQHKGFPLIDSLSRHGLGYTGTNI

SEQ ID NO: 944428 - protein, 27 aa, Mycobacterium
ELQKYAHRLMGWINPDGKLKDGERARK

SEQ ID NO: 944429 - protein, 21 aa, Mycobacterium
ELRHRLDTRQLLVSGGTKAVK

SEQ ID NO: 944430 - protein, 19 aa, Mycobacterium
ELRIVGAYYTLDTGVVSWL

SEQ ID NO: 944431 - protein, 20 aa, Mycobacterium
ELRLILWEFVGNRGGSRPAK

SEQ ID NO: 944432 - protein, 42 aa, Mycobacterium
ELRLLAAHAPPYNRRSRFPHRWWWVALTDEAFPRLAVVRAPR

SEQ ID NO: 944433 - protein, 34 aa, Mycobacterium
ELRPGPTTTPPPPPPLPAVPFPKECPAPGVMQGC

SEQ ID NO: 944434 - protein, 31 aa, Mycobacterium
ELRVPLPVGSLLRDRFLTLLATGGGELDWSA

SEQ ID NO: 944435 - protein, 34 aa, Mycobacterium; identical to SEQ ID NO: 926631

SEQ ID NO: 944436 - protein, 35 aa, Mycobacterium
ELTEFLRARVAKWWLPERWAFVTDIPLTSTGKFDK

SEQ ID NO: 944437 - protein, 22 aa, Mycobacterium
ELVDRLEELLADPVLRDQLGAK

SEQ ID NO: 944438 - protein, 17 aa, Mycobacterium
ELVLYLPDYPVGHDEPI

SEQ ID NO: 944439 - protein, 19 aa, Mycobacterium
ELVPKYLAVARPLPTARAV

SEQ ID NO: 944440 - protein, 24 aa, Mycobacterium
ELWQVAADLPLVPASTNKVLTSAA

SEQ ID NO: 944441 - protein, 17 aa, Mycobacterium
ELYARCFNPMAEAALAC

SEQ ID NO: 944442 - protein, 27 aa, Mycobacterium
EMAPIVHRWLTFMAGAPDELWTTLHAI

SEQ ID NO: 944443 - protein, 18 aa, Mycobacterium
EMGIRVRYLHSEVDTLRR

SEQ ID NO: 944444 - protein, 25 aa, Mycobacterium
EMKKQPFSLQLAGPPPSPIERYPLY

SEQ ID NO: 944445 - protein, 21 aa, Mycobacterium
EMKRMLGAQLAILATVTDGTT

SEQ ID NO: 944446 - protein, 32 aa, Mycobacterium
EMLVLVIAGLVILGPERLPGAIRWTSGALRQA

SEQ ID NO: 944447 - protein, 24 aa, Mycobacterium
EMTRAFVDFLVAIPSISTPMGMTA

SEQ ID NO: 944448 - protein, 19 aa, Mycobacterium
ENAGDINTGFWNGRDTNTG

SEQ ID NO: 944449 - protein, 21 aa, Mycobacterium
ENAIRLRGLMSHMVFADQPDN

SEQ ID NO: 944450 - protein, 25 aa, Mycobacterium
ENAPVAGYYYQAINSGAPHPAAARL

SEQ ID NO: 944451 - protein, 25 aa, Mycobacterium
ENARKLLAYLLSVPVQRTIPREALG

SEQ ID NO: 944452 - protein, 22 aa, Mycobacterium
ENARWFYEQFGSGDPVVIKNSK

SEQ ID NO: 944453 - protein, 34 aa, Mycobacterium
ENEGLGRLGYALAPVTWMLGARFVPVPGGEDGNA

SEQ ID NO: 944454 - protein, 18 aa, Mycobacterium
ENGWWWDPVGNVCRPPMI

SEQ ID NO: 944455 - protein, 18 aa, Mycobacterium
ENHRLVGTRLCWSDEPRA

SEQ ID NO: 944456 - protein, 31 aa, Mycobacterium
ENHTFNYLDLVRYLAVNNLNPSPLGYVGGSD

SEQ ID NO: 944457 - protein, 22 aa, Mycobacterium
ENIKRQWWRSVVTGRDDVVGID

SEQ ID NO: 944458 - protein, 18 aa, Mycobacterium
ENLVAPLIEKFTSDTGIE

SEQ ID NO: 944459 - protein, 27 aa, Mycobacterium
ENLWVVDGSILPLIPSRGPHATIVMLG

SEQ ID NO: 944460 - protein, 26 aa, Mycobacterium
ENNLGILAKPLAAAPALAAPALSSTT

SEQ ID NO: 944461 - protein, 27 aa, Mycobacterium
ENRCRPWLPIAHVFDRMAFIVERLGGN

SEQ ID NO: 944462 - protein, 36 aa, Mycobacterium
ENRDVLIDSLDLLPTFPFSTKYLRNAVRGDYLNVFV

SEQ ID NO: 944463 - protein, 22 aa, Mycobacterium
ENVARETWWNSAGPAKVISVAE

SEQ ID NO: 944464 - protein, 24 aa, Mycobacterium
ENVRALDLLTKWGDVPAAPPAQPL

SEQ ID NO: 944465 - protein, 23 aa, Mycobacterium
ENVVPLYRRNTLTDRQRLAINEV

SEQ ID NO: 944466 - protein, 35 aa, Mycobacterium
ENVWPVFTNPWYDKEWRYTTPYTVYTTGIGWRTDQ

SEQ ID NO: 944467 - protein, 24 aa, Mycobacterium
ENYRKLVRIGSYGSFVNYYICSLG

SEQ ID NO: 944468 - protein, 23 aa, Mycobacterium
ENYRVLFQVATPQGVNPSTLAPG

SEQ ID NO: 944469 - protein, 21 aa, Mycobacterium
EPAESLPPPFDNRLAQPYGGY

SEQ ID NO: 944470 - protein, 21 aa, Mycobacterium
EPAESLPPPYDNRLAQPYGGY

SEQ ID NO: 944471 - protein, 25 aa, Mycobacterium
EPAMRPGFYGYGFNVGTTSAARTQL

SEQ ID NO: 944472 - protein, 27 aa, Mycobacterium
EPAPAPAAAPEIPLPAGVPDAADIGFA

SEQ ID NO: 944473 - protein, 19 aa, Mycobacterium
EPAPAPLVRQPRGPVGVIL

SEQ ID NO: 944474 - protein, 26 aa, Mycobacterium
EPATASRWRVLNIPKLLPAGRAPESG

SEQ ID NO: 944475 - protein, 27 aa, Mycobacterium
EPDNPWPGSGPRPLLSYAPGTVGQGDQ

SEQ ID NO: 944476 - protein, 24 aa, Mycobacterium
EPDPIVARWWRLERSRMYRNIAVT

SEQ ID NO: 944477 - protein, 25 aa, Mycobacterium
EPDRMRFTLLGNPSRRLGSNPDLMG

SEQ ID NO: 944478 - protein, 28 aa, Mycobacterium
EPEPDRVRITFWLNDKYKVPADVKAAIL

SEQ ID NO: 944479 - protein, 20 aa, Mycobacterium
EPEQVLFRRLAAFAGGFDLD

SEQ ID NO: 944480 - protein, 17 aa, Mycobacterium
EPGFVSHLNTVEPQLAF

SEQ ID NO: 944481 - protein, 17 aa, Mycobacterium
EPGLRQLQAMTGRPTYG

SEQ ID NO: 944482 - protein, 31 aa, Mycobacterium
EPGPPPPPPLPWELPPPPPPPAPDAPPPAEV

SEQ ID NO: 944483 - protein, 29 aa, Mycobacterium
EPGQKWTGFHRLEKDLWVTGLQPDTDAIA

SEQ ID NO: 944484 - protein, 28 aa, Mycobacterium
EPGQKWTGYHRLEKDLWVTGPQPDTNAI

SEQ ID NO: 944485 - protein, 31 aa, Mycobacterium
EPGRAAVPWWPWAPLVQLMRVLPPQLTKMFA

SEQ ID NO: 944486 - protein, 20 aa, Mycobacterium
EPGTYQTACKPGMIGDGIRG

SEQ ID NO: 944487 - protein, 20 aa, Mycobacterium
EPHLRTWMAFGASAEIWGKR

SEQ ID NO: 944488 - protein, 21 aa, Mycobacterium
EPILPPLAPGQVLRIGPTAGT

SEQ ID NO: 944489 - protein, 27 aa, Mycobacterium
EPKPGTTVAYWFSGLRTPSMAGCCSAP

SEQ ID NO: 944490 - protein, 17 aa, Mycobacterium
EPLPWQDLRAAFTERGW

SEQ ID NO: 944491 - protein, 21 aa, Mycobacterium
EPLTRYGFTLAAYESPTLSRP

SEQ ID NO: 944492 - protein, 17 aa, Mycobacterium
EPMLLADTRRRGSEVRY

SEQ ID NO: 944493 - protein, 27 aa, Mycobacterium
EPNAFQNLHWAFGQLAAVGIATASEHS

SEQ ID NO: 944494 - protein, 25 aa, Mycobacterium
EPNTAPARYFGPNLARLTAIRQRYD

SEQ ID NO: 944495 - protein, 30 aa, Mycobacterium
EPPQGLYWSLSIGNPWWETIHYGRHQSSLN

SEQ ID NO: 944496 - protein, 17 aa, Mycobacterium
EPPVPLWQHLESNGIVG

SEQ ID NO: 944497 - protein, 17 aa, Mycobacterium
EPQNPPALSFEPADADN

SEQ ID NO: 944498 - protein, 29 aa, Mycobacterium
EPQPQRVKITFWYDRKYKVPANVKAVIVS

SEQ ID NO: 944499 - protein, 30 aa, Mycobacterium
EPQPTQVRITFWFDAKYPVPADAKAVILSP

SEQ ID NO: 944500 - protein, 23 aa, Mycobacterium
EPQVIRQAALPWSVEFPITEATA

SEQ ID NO: 944501 - protein, 17 aa, Mycobacterium
EPRLWNMSTVLPILQDT

SEQ ID NO: 944502 - protein, 25 aa, Mycobacterium
EPRSPAQLRWLGAAQLLATVRAAPG

SEQ ID NO: 944503 - protein, 30 aa, Mycobacterium
EPRYSAVPVRLHPDIRLFPAVPQQRSSTAE

SEQ ID NO: 944504 - protein, 19 aa, Mycobacterium
EPVAAPPYPAGPVTMTAGA

SEQ ID NO: 944505 - protein, 18 aa, Mycobacterium
EPYQPLGTNPWYGDPDQI

SEQ ID NO: 944506 - protein, 20 aa, Mycobacterium
EQAIVLCYEDADFAEAVFAK

SEQ ID NO: 944507 - protein, 28 aa, Mycobacterium
EQARARPIAPLLDALRGLGVPIEGAGLP

SEQ ID NO: 944508 - protein, 26 aa, Mycobacterium
EQARARPIAPLLDALRGLGVRIDGSG

SEQ ID NO: 944509 - protein, 24 aa, Mycobacterium
EQDRRYFAITVKPTVFINLVPDHA

SEQ ID NO: 944510 - protein, 20 aa, Mycobacterium
EQFLRVMSMLDPPTRLFRPS

SEQ ID NO: 944511 - protein, 32 aa, Mycobacterium
EQGKAALEVNWPYVLPSLLENAVKGGVSFLPL

SEQ ID NO: 944512 - protein, 18 aa, Mycobacterium
EQGLRWAQQEIEWAKWVI

SEQ ID NO: 944513 - protein, 24 aa, Mycobacterium
EQIFKTLVVSLPRGLGVAVLPVPS

SEQ ID NO: 944514 - protein, 24 aa, Mycobacterium
EQKQRLLYGLVQYGIDLQGMIRLG

SEQ ID NO: 944515 - protein, 26 aa, Mycobacterium
EQLNNIAMYLNFDMLGSPNAGFFTDD

SEQ ID NO: 944516 - protein, 17 aa, Mycobacterium
EQLTWIANHAEDRVIIV

SEQ ID NO: 944517 - protein, 24 aa, Mycobacterium
EQMLVSSWQMPGGIYAPMMHPWST

SEQ ID NO: 944518 - protein, 18 aa, Mycobacterium
EQMWAQDAAAMSGYHALA

SEQ ID NO: 944519 - protein, 20 aa, Mycobacterium
EQMYGLPKTGYAASAAPITD

SEQ ID NO: 944520 - protein, 33 aa, Mycobacterium
EQQLLAAINAPTQTLLGRPLIGNGANGAPGQNG

SEQ ID NO: 944521 - protein, 23 aa, Mycobacterium
EQQPEWELALGRLGHAIAAHPEA

SEQ ID NO: 944522 - protein, 23 aa, Mycobacterium
EQQPVLDRALATIPDALTVLNDE

SEQ ID NO: 944523 - protein, 24 aa, Mycobacterium
EQQPYIPIAFKYQTADHLYDLRVD

SEQ ID NO: 944524 - protein, 22 aa, Mycobacterium
EQRVYGLLVSPVGEDLNRLVAL

SEQ ID NO: 944525 - protein, 23 aa, Mycobacterium
EQSGAFPRWPLANSSTGMMTGDN

SEQ ID NO: 944526 - protein, 26 aa, Mycobacterium
EQTAPALDLDLLLGGLKPVIKGLDAQ

SEQ ID NO: 944527 - protein, 31 aa, Mycobacterium
EQTAQDVDWVYLSPAPLIEPGKRTGSYRVAG

SEQ ID NO: 944528 - protein, 20 aa, Mycobacterium
EQTLAALSLVLNGGGLGQVQ

SEQ ID NO: 944529 - protein, 21 aa, Mycobacterium
EQTLAAVSLLLNGGGIGQIQD

SEQ ID NO: 944530 - protein, 24 aa, Mycobacterium
EQTLASLAIVLRGGGIPNLEVLQN

SEQ ID NO: 944531 - protein, 25 aa, Mycobacterium
EQTLASLSLILRGGGIPNLEVLQNE

SEQ ID NO: 944532 - protein, 17 aa, Mycobacterium
EQTYPPGGPTRITGYNA

SEQ ID NO: 944533 - protein, 21 aa, Mycobacterium
EQVDFVTYFSAGTAWAQPAGG

SEQ ID NO: 944534 - protein, 24 aa, Mycobacterium
EQVFKTLVIALPKGLAVAVVPVPT

SEQ ID NO: 944535 - protein, 18 aa, Mycobacterium
EQVGFDVTVDCGSGLKAV

SEQ ID NO: 944536 - protein, 18 aa, Mycobacterium
EQYAQLAGLRLGKVLSIS

SEQ ID NO: 944537 - protein, 25 aa, Mycobacterium
EQYGRALAILKSQGIKAFFGGSTGS

SEQ ID NO: 944538 - protein, 19 aa, Mycobacterium
EQYGSIPLPSSFQAKLAKA

SEQ ID NO: 944539 - protein, 19 aa, Mycobacterium
ERALDFYERLWRPTVEEKQ

SEQ ID NO: 944540 - protein, 17 aa, Mycobacterium
ERDLARIRRSGLAPMSV

SEQ ID NO: 944541 - protein, 26 aa, Mycobacterium
ERDNLTVLRTLLRMMGRDPDDFDHVT

SEQ ID NO: 944542 - protein, 27 aa, Mycobacterium
ERDPQTGDLLPLLATGWHQTSPREWTF

SEQ ID NO: 944543 - protein, 20 aa, Mycobacterium
EREKVVDFVPYVYSGTGIAV

SEQ ID NO: 944544 - protein, 26 aa, Mycobacterium
ERELQTWIDWLVRNGGLEEGKLKAKD

SEQ ID NO: 944545 - protein, 33 aa, Mycobacterium
EREPGRAAVPWWPWRPMVQLMRVLPLPLIKRFA

SEQ ID NO: 944546 - protein, 20 aa, Mycobacterium
ERFDLIRYAVDTLTRNPATA

SEQ ID NO: 944547 - protein, 17 aa, Mycobacterium
ERFLFASPNGSERVASV

SEQ ID NO: 944548 - protein, 20 aa, Mycobacterium
ERFRARTVILASGPLSDVSF

SEQ ID NO: 944549 - protein, 25 aa, Mycobacterium
ERGGPYLLRGAADLLPTSRLLDDYR

SEQ ID NO: 944550 - protein, 26 aa, Mycobacterium
ERGLPVGVPSWMRADHYARLMSGGLR

SEQ ID NO: 944551 - protein, 24 aa, Mycobacterium
ERIGDRAFVRLIGRHDKSVRKFVD

SEQ ID NO: 944552 - protein, 18 aa, Mycobacterium
ERILRIAAIDIATGELVG

SEQ ID NO: 944553 - protein, 17 aa, Mycobacterium
ERIMMLTAEWIRQRGHD

SEQ ID NO: 944554 - protein, 24 aa, Mycobacterium
ERKPHAWKMITIALAVGAAMTARG

SEQ ID NO: 944555 - protein, 17 aa, Mycobacterium
ERLASALVITEWCQLPE

SEQ ID NO: 944556 - protein, 19 aa, Mycobacterium
ERLLARRNERTRAVLAALR

SEQ ID NO: 944557 - protein, 23 aa, Mycobacterium
ERLVNLVIALLSTRGYISAEKIR

SEQ ID NO: 944558 - protein, 24 aa, Mycobacterium
ERNDMVWLEPGPMDDTYALAASAQ

SEQ ID NO: 944559 - protein, 17 aa, Mycobacterium
ERPDLARLSLNGRLTIM

SEQ ID NO: 944560 - protein, 34 aa, Mycobacterium
ERPGIETYLRFGYAPFTLVFGRNGWIADASITLE

SEQ ID NO: 944561 - protein, 23 aa, Mycobacterium
ERQTVIIGRYNAERSRILVRADD

SEQ ID NO: 944562 - protein, 23 aa, Mycobacterium
ERQVLPWPTGFFAAVELAAGAAL

SEQ ID NO: 944563 - protein, 26 aa, Mycobacterium
ERRREVFIYPKARNLSFRSLEILRGL

SEQ ID NO: 944564 - protein, 17 aa, Mycobacterium
ERSAQVNTLLLNANDLL

SEQ ID NO: 944565 - protein, 22 aa, Mycobacterium
ERTRIVRFDGPRGRDRLVPVVV

SEQ ID NO: 944566 - protein, 22 aa, Mycobacterium
ERTRRRKVMAVSWVASLPVSHG

SEQ ID NO: 944567 - protein, 18 aa, Mycobacterium
ERVGLPYETAPAPPGPRD

SEQ ID NO: 944568 - protein, 20 aa, Mycobacterium
ERVIPQWVKIRNVDGFNGSF

SEQ ID NO: 944569 - protein, 17 aa, Mycobacterium
ERWGRDVLHCVYCHGWE

SEQ ID NO: 944570 - protein, 18 aa, Mycobacterium
ERWVEVRPLMVPQAIPVL

SEQ ID NO: 944571 - protein, 24 aa, Mycobacterium
ESAAPLAALLAPFDPTTTTESVTA

SEQ ID NO: 944572 - protein, 17 aa, Mycobacterium
ESAKLCVQYLAPIIKNR

SEQ ID NO: 944573 - protein, 30 aa, Mycobacterium
ESALALTSWLQPLWLSRGRIREGRTWFETI

SEQ ID NO: 944574 - protein, 28 aa, Mycobacterium
ESDLPYSIVRATQFFEFVIGIADSATDG

SEQ ID NO: 944575 - protein, 24 aa, Mycobacterium
ESDNRLRWHLVTPALRRRLPSNDQ

SEQ ID NO: 944576 - protein, 18 aa, Mycobacterium
ESFEPVGMRLDPAPDAPK

SEQ ID NO: 944577 - protein, 26 aa, Mycobacterium
ESGEPPGFLLLGPDALAIYRHVADAR

SEQ ID NO: 944578 - protein, 25 aa, Mycobacterium
ESGGPNSPALYLLDGMRAQDDFNGW

SEQ ID NO: 944579 - protein, 21 aa, Mycobacterium
ESGKRLTFGHLVIATGARALP

SEQ ID NO: 944580 - protein, 29 aa, Mycobacterium
ESGLLVPIHWATFRLAPHPWAEPVRRLLA

SEQ ID NO: 944581 - protein, 28 aa, Mycobacterium
ESGVAGTWNMRWADLSLPRQAAVIVAAA

SEQ ID NO: 944582 - protein, 28 aa, Mycobacterium
ESIPAVPSSMYYPLNGQLLPDVSIKPGE

SEQ ID NO: 944583 - protein, 21 aa, Mycobacterium
ESIRPWTPPTPPTPSAAPPAD

SEQ ID NO: 944584 - protein, 17 aa, Mycobacterium
ESLGITQDPFWTDYAGT

SEQ ID NO: 944585 - protein, 17 aa, Mycobacterium
ESLGRISNAAVAALEPA

SEQ ID NO: 944586 - protein, 33 aa, Mycobacterium
ESNWLPAPKGPFGLVLRLYWPKPDALNGTWTAP

SEQ ID NO: 944587 - protein, 26 aa, Mycobacterium
ESPDVYQFVVLYPSPEQANAFFSTSS

SEQ ID NO: 944588 - protein, 26 aa, Mycobacterium
ESPEVYQFVVLFPAPDQANAFFNTSS

SEQ ID NO: 944589 - protein, 36 aa, Mycobacterium
ESPMHGYELRKRLTGLLGAFRAFSYGSLYPALRRMQ

SEQ ID NO: 944590 - protein, 19 aa, Mycobacterium
ESPQTTLALPLGDSLHGAH

SEQ ID NO: 944591 - protein, 17 aa, Mycobacterium
ESQLQQLDGFIGQAVEL

SEQ ID NO: 944592 - protein, 21 aa, Mycobacterium
ESSFLMYRKDLFEQAGIEMPR

SEQ ID NO: 944593 - protein, 24 aa, Mycobacterium
ESTEDDYFQACRAARAWMDQQGGD

SEQ ID NO: 944594 - protein, 17 aa, Mycobacterium
ESTVARWPRRRSLRFES

SEQ ID NO: 944595 - protein, 26 aa, Mycobacterium
ESVPPADLYTLKYILHDWDDESCVRI

SEQ ID NO: 944596 - protein, 26 aa, Mycobacterium
ESVQIDHIVPLAYAWDMGAREWQPAT

SEQ ID NO: 944597 - protein, 28 aa, Mycobacterium
ESVQTTMEALWWDRPFTLDGVDIGASVA

SEQ ID NO: 944598 - protein, 21 aa, Mycobacterium
ESYQLLDQLSLLVDKSLVVAD

SEQ ID NO: 944599 - protein, 20 aa, Mycobacterium
ETAKLCAQYLGPALRLLNFN

SEQ ID NO: 944600 - protein, 19 aa, Mycobacterium
ETAPRWRGLPARNERNTNK

SEQ ID NO: 944601 - protein, 24 aa, Mycobacterium
ETARPADLLVLLDSLQQREAALNT

SEQ ID NO: 944602 - protein, 22 aa, Mycobacterium
ETARRYSVLSLPTTLIFDIDGR

SEQ ID NO: 944603 - protein, 35 aa, Mycobacterium
ETDGKLVIWVPPGCVGVWSVKLMFGLSGPDLVLTP

SEQ ID NO: 944604 - protein, 25 aa, Mycobacterium
ETDLYLRRDIFVNHFAKDLPQDQAT

SEQ ID NO: 944605 - protein, 25 aa, Mycobacterium
ETEAAYLLNFVKELVKVFGGATTDG

SEQ ID NO: 944606 - protein, 23 aa, Mycobacterium
ETERMAIVHFTLRSKTRLAALRV

SEQ ID NO: 944607 - protein, 30 aa, Mycobacterium
ETFRVATLIFIADFVPRVLAGLSSLGVGVG

SEQ ID NO: 944608 - protein, 25 aa, Mycobacterium
ETGSTLLYPLFSEWGAAYRAKHPNV

SEQ ID NO: 944609 - protein, 24 aa, Mycobacterium
ETKDSFSHLITQRVLLYPSRDDAT

SEQ ID NO: 944610 - protein, 25 aa, Mycobacterium
ETLHSYGIYAPPDKTAYLGKITCHR

SEQ ID NO: 944611 - protein, 21 aa, Mycobacterium
ETMCRISMQPLIEQVGQRPYP

SEQ ID NO: 944612 - protein, 20 aa, Mycobacterium
ETMRQHPNAIPLVLTRRTVS

SEQ ID NO: 944613 - protein, 22 aa, Mycobacterium
ETPVPELTWIPAHPAPQPAPGN

SEQ ID NO: 944614 - protein, 26 aa, Mycobacterium
ETPVWVITPVLPPEGAPLQPELPDWA

SEQ ID NO: 944615 - protein, 30 aa, Mycobacterium
ETQKFDGPYFVMQWLLRQPRRAILPVAGDP

SEQ ID NO: 944616 - protein, 22 aa, Mycobacterium
ETRLAILRRLACGEARVVDLTG

SEQ ID NO: 944617 - protein, 25 aa, Mycobacterium
ETTLTLVAYAVPEPGWSKIIPAFTA

SEQ ID NO: 944618 - protein, 18 aa, Mycobacterium
ETTYYIAPQMGSAPERPV

SEQ ID NO: 944619 - protein, 24 aa, Mycobacterium
ETVDYFSHPTFYLTDHCRADLAGG

SEQ ID NO: 944620 - protein, 26 aa, Mycobacterium
ETVNGVTLSFWTPRGIYTVMDKANPV

SEQ ID NO: 944621 - protein, 18 aa, Mycobacterium
ETVTAFANLAAALQITGH

SEQ ID NO: 944622 - protein, 18 aa, Mycobacterium
ETYLRLTVIGNHFPPPQT

SEQ ID NO: 944623 - protein, 25 aa, Mycobacterium
ETYPTAMLIVFELNGDFDVAQALSH

SEQ ID NO: 944624 - protein, 19 aa, Mycobacterium
EVAAKVNALLDIAQVNLGD

SEQ ID NO: 944625 - protein, 25 aa, Mycobacterium
EVAPAVIIHLAAIIPPAIYKNRALA

SEQ ID NO: 944626 - protein, 24 aa, Mycobacterium
EVDPMLFDRSYFLEPDSKSSKSYV

SEQ ID NO: 944627 - protein, 18 aa, Mycobacterium
EVDQPRVLAFKQQVLDRQ

SEQ ID NO: 944628 - protein, 17 aa, Mycobacterium
EVDRFIDPWTPEQDTLV

SEQ ID NO: 944629 - protein, 30 aa, Mycobacterium
EVEAELRRLLGLHKVIWLPGIAGMDITDGH

SEQ ID NO: 944630 - protein, 17 aa, Mycobacterium
EVEALLQRYREGDGFVT

SEQ ID NO: 944631 - protein, 29 aa, Mycobacterium
EVEDQLFRFSRILDAQPRLSILLGDYVAA

SEQ ID NO: 944632 - protein, 29 aa, Mycobacterium
EVELTKPITNGLLYDFTFTFEDGETTVAV

SEQ ID NO: 944633 - protein, 24 aa, Mycobacterium
EVETLPFGKVLAVAGFRCNVQEET

SEQ ID NO: 944634 - protein, 17 aa, Mycobacterium
EVFAFSTSLTRLTPVLA

SEQ ID NO: 944635 - protein, 25 aa, Mycobacterium
EVFTRSVAPLPEAWLACGDPSAARR

SEQ ID NO: 944636 - protein, 28 aa, Mycobacterium
EVFVMELARPLVALGTRALLLATKRRAE

SEQ ID NO: 944637 - protein, 28 aa, Mycobacterium
EVGFDLAKGWLTPLLRTGRRSPGADEGG

SEQ ID NO: 944638 - protein, 23 aa, Mycobacterium
EVGPGAPWVLTVQLADPDRWAMV

SEQ ID NO: 944639 - protein, 20 aa, Mycobacterium
EVGSLFVQAADWPDPPDPAR

SEQ ID NO: 944640 - protein, 19 aa, Mycobacterium
EVIPMHYFGRDLVAFRQLD

SEQ ID NO: 944641 - protein, 19 aa, Mycobacterium
EVISGELEILWGDLARILH

SEQ ID NO: 944642 - protein, 35 aa, Mycobacterium
EVISTFPQLQVLPLALPIAAPGLLGGFAGLSGLGG

SEQ ID NO: 944643 - protein, 17 aa, Mycobacterium
EVKDQLMRLATDLGPNS

SEQ ID NO: 944644 - protein, 24 aa, Mycobacterium
EVKIRPPDAASRLLELIVNTGGDA

SEQ ID NO: 944645 - protein, 27 aa, Mycobacterium
EVKQPPAPAPPWLRERKTWDDVVADVL

SEQ ID NO: 944646 - protein, 17 aa, Mycobacterium
EVLERLRAQGCSRYVVT

SEQ ID NO: 944647 - protein, 18 aa, Mycobacterium
EVLGLPRVGIDESFFDLG

SEQ ID NO: 944648 - protein, 19 aa, Mycobacterium
EVLLMPRWVKAKRATFKYG

SEQ ID NO: 944649 - protein, 26 aa, Mycobacterium
EVLRLRWRKGCMPLLQRVVRARVHGR

SEQ ID NO: 944650 - protein, 27 aa, Mycobacterium
EVLRLRWRKGCMPVPQRVIRARVHGRQ

SEQ ID NO: 944651 - protein, 19 aa, Mycobacterium
EVLRRLYRRVGDRLVLISV

SEQ ID NO: 944652 - protein, 17 aa, Mycobacterium
EVLVAMNFFGVNVAPIA

SEQ ID NO: 944653 - protein, 26 aa, Mycobacterium
EVNFPEVNGYFRLPDTQIPPGQLMTE

SEQ ID NO: 944654 - protein, 25 aa, Mycobacterium
EVNFSSVYLMNYQRILTSRDSGITN

SEQ ID NO: 944655 - protein, 24 aa, Mycobacterium
EVNSALMFTGAGSAPTLAAATAWD

SEQ ID NO: 944656 - protein, 25 aa, Mycobacterium
EVPLAGEGWGLCYDGNRLVKSDGSD

SEQ ID NO: 944657 - protein, 22 aa, Mycobacterium
EVPVVIDGSIWDAIAGCEAGGN

SEQ ID NO: 944658 - protein, 23 aa, Mycobacterium
EVRDPELRRALTPDYTPMCKRLV

SEQ ID NO: 944659 - protein, 24 aa, Mycobacterium
EVRDPELRRALTPDYTPMCKRLVM

SEQ ID NO: 944660 - protein, 18 aa, Mycobacterium
EVRNTRKLGPAGPIEFPP

SEQ ID NO: 944661 - protein, 24 aa, Mycobacterium
EVRRVIRALGAQSLQLPKIGADLE

SEQ ID NO: 944662 - protein, 18 aa, Mycobacterium
EVSDGLFLRLAVTSVESL

SEQ ID NO: 944663 - protein, 21 aa, Mycobacterium
EVSGTLPWQATLHAKQLVVPV

SEQ ID NO: 944664 - protein, 40 aa, Mycobacterium
EVSLPAKEWLAQRGFDPVYGARPLRRLVQQAIGDQLAKML

SEQ ID NO: 944665 - protein, 41 aa, Mycobacterium
EVSLPAKQWLAQRGFDPVYGARPLRRLVQQAIGDQLAKQLL

SEQ ID NO: 944666 - protein, 26 aa, Mycobacterium
EVSRTTIYKWWPSAPAIVLEGLLDSV

SEQ ID NO: 944667 - protein, 24 aa, Mycobacterium
EVTELRSEHFRGLRIGPTILGFSA

SEQ ID NO: 944668 - protein, 17 aa, Mycobacterium
EVTINGHQWLTAVRIDD

SEQ ID NO: 944669 - protein, 20 aa, Mycobacterium
EVTRERQGWGAWPVCSGRAG

SEQ ID NO: 944670 - protein, 25 aa, Mycobacterium
EVVRELHLFQRTPQWILPVDNPPVD

SEQ ID NO: 944671 - protein, 19 aa, Mycobacterium
EVWDPLPWGTYGFGSLSMG

SEQ ID NO: 944672 - protein, 17 aa, Mycobacterium
EVWIADRQIGPAREFAQ

SEQ ID NO: 944673 - protein, 18 aa, Mycobacterium
EWAEDNVVQWVPDDYWPA

SEQ ID NO: 944674 - protein, 18 aa, Mycobacterium
EWAFHYAYQTAGYVRAML

SEQ ID NO: 944675 - protein, 20 aa, Mycobacterium
EWDATRRRYRPAWCTVREVD

SEQ ID NO: 944676 - protein, 17 aa, Mycobacterium
EWEVESAIYVYAPEVIP

SEQ ID NO: 944677 - protein, 23 aa, Mycobacterium
EYAAATYAYLVSDAARDVTGRIF

SEQ ID NO: 944678 - protein, 19 aa, Mycobacterium
EYAPGELQNLPGYQGSGNG

SEQ ID NO: 944679 - protein, 20 aa, Mycobacterium
EYAPIWTGPGYFGLGVEALR

SEQ ID NO: 944680 - protein, 18 aa, Mycobacterium
EYDKLPFFSGGGQYAAYL

SEQ ID NO: 944681 - protein, 18 aa, Mycobacterium
EYDVLVGINLLREGLDLP

SEQ ID NO: 944682 - protein, 25 aa, Mycobacterium
EYKSPTALVWLLGRIYCTGTPEDYA

SEQ ID NO: 944683 - protein, 21 aa, Mycobacterium
EYRTRRLVLEAYDRMAYAIAH

SEQ ID NO: 944684 - protein, 24 aa, Mycobacterium
EYSPEVIFHLAAQIDVRHSVADPQ

SEQ ID NO: 944685 - protein, 28 aa, Mycobacterium
EYTEQVIMGYILQFTLAAAGADVRDLTG

SEQ ID NO: 944686 - protein, 18 aa, Mycobacterium
EYVIRRGMAQIGVPYSWG

SEQ ID NO: 944687 - protein, 18 aa, Mycobacterium
EYVIRRGMSQIGVPYSWG

SEQ ID NO: 944688 - protein, 19 aa, Mycobacterium
FAAASLKPAFTQIAGRFKD

SEQ ID NO: 944689 - protein, 20 aa, Mycobacterium
FAALFAAVALLAGCSSSSTE

SEQ ID NO: 944690 - protein, 26 aa, Mycobacterium
FAANRLVIVTPPGNPNHVFTFNDAVR

SEQ ID NO: 944691 - protein, 25 aa, Mycobacterium
FADPLTLAWPNHAKLFFNNKGVAAH

SEQ ID NO: 944692 - protein, 25 aa, Mycobacterium
FADQKPIIDKALKTIPQALTVLKDE

SEQ ID NO: 944693 - protein, 18 aa, Mycobacterium
FAELMRLVEQFQLPPIAY

SEQ ID NO: 944694 - protein, 24 aa, Mycobacterium
FAEVNLAGFYDLAQALGGVEVCLN

SEQ ID NO: 944695 - protein, 32 aa, Mycobacterium
FAGIGPYNLRYRLWADWDFNIRCFSNPALITR

SEQ ID NO: 944696 - protein, 20 aa, Mycobacterium
FAGYYWERTVKLDGARPILR

SEQ ID NO: 944697 - protein, 46 aa, Mycobacterium
FAMNVGNWTLVLSGFLFTASGITPLLGGLYGLALPAEAAAAAEVAP

SEQ ID NO: 944698 - protein, 19 aa, Mycobacterium
FANPIAFLCGAIQAASRLG

SEQ ID NO: 944699 - protein, 21 aa, Mycobacterium
FAPAMHTEMWLHPATVDNVAT

SEQ ID NO: 944700 - protein, 20 aa, Mycobacterium
FAQIGMKLWADGSPWQGNIF

SEQ ID NO: 944701 - protein, 32 aa, Mycobacterium
FARTLLVWTAFAAVALLLAGCVRVVAGRALLA

SEQ ID NO: 944702 - protein, 17 aa, Mycobacterium
FARVLTRSAIGTLAGFT

SEQ ID NO: 944703 - protein, 17 aa, Mycobacterium
FASLDHLSGGRAAWNVV

SEQ ID NO: 944704 - protein, 20 aa, Mycobacterium
FATLLLPAAPAAAEPADPLA

SEQ ID NO: 944705 - protein, 17 aa, Mycobacterium
FATWGTPAALLTDNGAV

SEQ ID NO: 944706 - protein, 19 aa, Mycobacterium
FAVLAVLALATGCGGGGDE

SEQ ID NO: 944707 - protein, 19 aa, Mycobacterium
FAVLNDGIRFFFDQGAILP

SEQ ID NO: 944708 - protein, 21 aa, Mycobacterium
FAVLTYLSYTAAFASIDTVTV

SEQ ID NO: 944709 - protein, 18 aa, Mycobacterium
FCANDLLAIGVLQALSLT

SEQ ID NO: 944710 - protein, 17 aa, Mycobacterium
FCGHPVCRIPAPISELC

SEQ ID NO: 944711 - protein, 27 aa, Mycobacterium
FCSTFKALLVAAVLHQYPLSHLDKMVT

SEQ ID NO: 944712 - protein, 25 aa, Mycobacterium
FDAGHSVRFLVRNPAKLQTTVAKLG

SEQ ID NO: 944713 - protein, 19 aa, Mycobacterium
FDAQNPRSLLYQLDRLRTD

SEQ ID NO: 944714 - protein, 17 aa, Mycobacterium
FDAVQRLGLAYTPPEHE

SEQ ID NO: 944715 - protein, 29 aa, Mycobacterium
FDEGNAAQYVWWVPHNVAGLVTALGGRQA

SEQ ID NO: 944716 - protein, 29 aa, Mycobacterium
FDEGNAEQYLWWVPHNVAGLVTALGGRKA

SEQ ID NO: 944717 - protein, 31 aa, Mycobacterium
FDGAAIPGWSWSQVLPHFRAIETDLDFDTPV

SEQ ID NO: 944718 - protein, 17 aa, Mycobacterium
FDGIPYYEGKRAAKNIV

SEQ ID NO: 944719 - protein, 23 aa, Mycobacterium
FDGTRIFVNFMPAKGLQAGESAP

SEQ ID NO: 944720 - protein, 23 aa, Mycobacterium
FDGTRIFVNFMPAKGLQAGETAP

SEQ ID NO: 944721 - protein, 26 aa, Mycobacterium
FDHKYPAWRELFNDLLPAHIVKDIPG

SEQ ID NO: 944722 - protein, 25 aa, Mycobacterium
FDKGALTAFLSWLESRPSPRSRRRS

SEQ ID NO: 944723 - protein, 18 aa, Mycobacterium
FDKLAAIGIDLPDVFRVL

SEQ ID NO: 944724 - protein, 22 aa, Mycobacterium
FDLDYDYLVIAAGMRQSYFGNE

SEQ ID NO: 944725 - protein, 19 aa, Mycobacterium
FDLMRYAVDTLTRNPATAL

SEQ ID NO: 944726 - protein, 31 aa, Mycobacterium
FDMTGTIFGVPRFWMTSDRFIGLFSRNGNDA

SEQ ID NO: 944727 - protein, 18 aa, Mycobacterium
FDPMPFLDSLAVELLNRG

SEQ ID NO: 944728 - protein, 25 aa, Mycobacterium
FDQTRLRENVLLQAKVCQPGNAGPA

SEQ ID NO: 944729 - protein, 25 aa, Mycobacterium
FDSAPYGWPVEKGSPLAQSLLQALQ

SEQ ID NO: 944730 - protein, 22 aa, Mycobacterium
FDSARALQCSIKLLSICERLTD

SEQ ID NO: 944731 - protein, 22 aa, Mycobacterium
FDSLPFLDRLNTFGAPWGIQER

SEQ ID NO: 944732 - protein, 24 aa, Mycobacterium
FDTHAFFRPMRLIGRDGIAADDVW

SEQ ID NO: 944733 - protein, 19 aa, Mycobacterium
FDTLFPPGTTPLDAIFPIV

SEQ ID NO: 944734 - protein, 27 aa, Mycobacterium
FDVHVDMLEMLPTPWGLVRSGVAPDHP

SEQ ID NO: 944735 - protein, 17 aa, Mycobacterium
FDVNAQPRRVDGAHLPW

SEQ ID NO: 944736 - protein, 28 aa, Mycobacterium
FDVQTPEFSFKYFQAKSLDLTVGPKKVD

SEQ ID NO: 944737 - protein, 21 aa, Mycobacterium
FDYEFAVPHAGTYWFHPHVGT

SEQ ID NO: 944738 - protein, 20 aa, Mycobacterium
FDYGTWLAHGGGKYAPRADL

SEQ ID NO: 944739 - protein, 22 aa, Mycobacterium
FEGPGLGDWDLRALVGHASRSL

SEQ ID NO: 944740 - protein, 22 aa, Mycobacterium
FEHSRIITCTGWYLSSAKAAEV

SEQ ID NO: 944741 - protein, 25 aa, Mycobacterium
FENVGGWSVFGIAFPTPNPSIATKA

SEQ ID NO: 944742 - protein, 21 aa, Mycobacterium
FETAFAAVVPPPLIATNRAEL

SEQ ID NO: 944743 - protein, 30 aa, Mycobacterium
FEWVDSFVVQWIPDHYWPAHSHISVGVQEL

SEQ ID NO: 944744 - protein, 22 aa, Mycobacterium
FEYQMLYGIRDEEQWRLVGAGS

SEQ ID NO: 944745 - protein, 18 aa, Mycobacterium
FFGAACFTALHTLNVRCA

SEQ ID NO: 944746 - protein, 18 aa, Mycobacterium
FFWGFFMGRASGDSYGWH

SEQ ID NO: 944747 - protein, 21 aa, Mycobacterium
FGALRCRLSLAFAQLWQGEVA

SEQ ID NO: 944748 - protein, 25 aa, Mycobacterium
FGAQAVLYSGILLDAYQAANVQVQV

SEQ ID NO: 944749 - protein, 17 aa, Mycobacterium
FGATLVLACALAGCAAP

SEQ ID NO: 944750 - protein, 26 aa, Mycobacterium
FGDREWLPAELNALKAIASLFAQVQA

SEQ ID NO: 944751 - protein, 18 aa, Mycobacterium
FGDRIAPGLGLDGPSYGE

SEQ ID NO: 944752 - protein, 25 aa, Mycobacterium
FGDVFLVIDGWPTFVKNWELLVSDV

SEQ ID NO: 944753 - protein, 17 aa, Mycobacterium
FGFAPYPGVAPGHPAKV

SEQ ID NO: 944754 - protein, 27 aa, Mycobacterium
FGGGDRFRALKTHGARVQRPLWASTGV

SEQ ID NO: 944755 - protein, 24 aa, Mycobacterium
FGGPAELFWDWPGAKQSDCAGLSK

SEQ ID NO: 944756 - protein, 24 aa, Mycobacterium
FGGPDTLYAIRGPGAPAPLGQVDA

SEQ ID NO: 944757 - protein, 17 aa, Mycobacterium
FGGTWRHNTFPGAACDV

SEQ ID NO: 944758 - protein, 18 aa, Mycobacterium
FGHPVGASGLRMLYEAWL

SEQ ID NO: 944759 - protein, 17 aa, Mycobacterium
FGIGAVPNDQWLASSGL

SEQ ID NO: 944760 - protein, 28 aa, Mycobacterium
FGITVDPVDWHIQRWIDAMPQYGPGHLD

SEQ ID NO: 944761 - protein, 22 aa, Mycobacterium
FGLAEILWDVIPFDWANDSNTA

SEQ ID NO: 944762 - protein, 20 aa, Mycobacterium
FGLGYVLRNMIDIPVSRAQP

SEQ ID NO: 944763 - protein, 17 aa, Mycobacterium
FGLMGIPSQSAYNAAKF

SEQ ID NO: 944764 - protein, 23 aa, Mycobacterium
FGMFAGGLLAFGTAAIVAPVAGA

SEQ ID NO: 944765 - protein, 17 aa, Mycobacterium
FGNFGQANYGAAKMGLV

SEQ ID NO: 944766 - protein, 19 aa, Mycobacterium
FGNLLSAFGFDSPVRPAPE

SEQ ID NO: 944767 - protein, 17 aa, Mycobacterium
FGQGRAGVWTINNKPYK

SEQ ID NO: 944768 - protein, 26 aa, Mycobacterium
FGQTVIPALPTGLKYTQVAAGDLHSV

SEQ ID NO: 944769 - protein, 27 aa, Mycobacterium
FGRDGTAYVTLYFTPDDPGVYAVTATG

SEQ ID NO: 944770 - protein, 20 aa, Mycobacterium
FGRLPILQSAARQAWFWAHE

SEQ ID NO: 944771 - protein, 18 aa, Mycobacterium
FGTAVGLLPTAQAKSLEL

SEQ ID NO: 944772 - protein, 35 aa, Mycobacterium
FGTPSDQFLARYGAPPITIGPLYRPKTIELCANGD

SEQ ID NO: 944773 - protein, 26 aa, Mycobacterium
FGTPSEAFMRRFGAPEITIGPLYADK

SEQ ID NO: 944774 - protein, 17 aa, Mycobacterium
FGTSGLVLTGTDGLAAA

SEQ ID NO: 944775 - protein, 23 aa, Mycobacterium
FGTSLPELVAAFTGGLNGLVQAG

SEQ ID NO: 944776 - protein, 17 aa, Mycobacterium
FGTTSWGRLVFCGSPRR

SEQ ID NO: 944777 - protein, 17 aa, Mycobacterium
FGTVRPGPFGVGGPDVD

SEQ ID NO: 944778 - protein, 24 aa, Mycobacterium
FGVLPLLMAMAVLGSRVSGADPGA

SEQ ID NO: 944779 - protein, 29 aa, Mycobacterium
FGVLSGVVVLALFVFVPGPVSGILKANNA

SEQ ID NO: 944780 - protein, 19 aa, Mycobacterium
FGYFRYQLYDEGLGFDPVE

SEQ ID NO: 944781 - protein, 18 aa, Mycobacterium
FHGPKQADWGYLVGSFKY

SEQ ID NO: 944782 - protein, 18 aa, Mycobacterium
FHQLVNPLAVRPAATSDP

SEQ ID NO: 944783 - protein, 17 aa, Mycobacterium
FIAIGGVGGDGGAASSG

SEQ ID NO: 944784 - protein, 20 aa, Mycobacterium
FIAQLPTPPAGGFSPGGHDG

SEQ ID NO: 944785 - protein, 17 aa, Mycobacterium
FIDPIAEHWFVGRPDLI

SEQ ID NO: 944786 - protein, 21 aa, Mycobacterium
FIGSWTDLTIFQGPLADISAK

SEQ ID NO: 944787 - protein, 26 aa, Mycobacterium
FINERSDWKTIYTYDTKSFSKDPITR

SEQ ID NO: 944788 - protein, 17 aa, Mycobacterium
FINYAMGRYGVAPDASN

SEQ ID NO: 944789 - protein, 30 aa, Mycobacterium
FIQQLDKAGIPYVNPYLAIGRATAMCLYLN

SEQ ID NO: 944790 - protein, 17 aa, Mycobacterium
FITYPPADHFGVANAAI

SEQ ID NO: 944791 - protein, 19 aa, Mycobacterium
FIVALIFFSGFFLGRATHG

SEQ ID NO: 944792 - protein, 17 aa, Mycobacterium
FKDTTVPGIWAPDSPLS

SEQ ID NO: 944793 - protein, 17 aa, Mycobacterium
FKIFTTAAALDMGMGIN

SEQ ID NO: 944794 - protein, 25 aa, Mycobacterium
FKQGRVDVWAVWDPYTAQAEKELPV

SEQ ID NO: 944795 - protein, 21 aa, Mycobacterium
FKVVACAGLCGAAIALSPQAA

SEQ ID NO: 944796 - protein, 18 aa, Mycobacterium
FLAALVSALRQSGALSSP

SEQ ID NO: 944797 - protein, 18 aa, Mycobacterium
FLAVVLLSAGCSTGGLAD

SEQ ID NO: 944798 - protein, 18 aa, Mycobacterium
FLDALREPRIPGVDKIRL

SEQ ID NO: 944799 - protein, 17 aa, Mycobacterium
FLGAPRATAGVAGSAVF

SEQ ID NO: 944800 - protein, 18 aa, Mycobacterium
FLGLGHMGAPMSANLIGA

SEQ ID NO: 944801 - protein, 19 aa, Mycobacterium
FLLAAGCSWQLGGRNPLPQ

SEQ ID NO: 944802 - protein, 19 aa, Mycobacterium
FLLLLDNASAQPALDGARR

SEQ ID NO: 944803 - protein, 18 aa, Mycobacterium
FLLLLDNASAQPGLDRRR

SEQ ID NO: 944804 - protein, 27 aa, Mycobacterium
FLLLLWLFIWSVLRILRTDIYAPTGAV

SEQ ID NO: 944805 - protein, 17 aa, Mycobacterium
FLNGVFPLDRNRLTREW

SEQ ID NO: 944806 - protein, 17 aa, Mycobacterium
FLRNGDVIWVDAGVMWQ

SEQ ID NO: 944807 - protein, 17 aa, Mycobacterium
FLRSYAVLTSSTDAADD

SEQ ID NO: 944808 - protein, 18 aa, Mycobacterium
FLTHLLSRIAAAGIKHVV

SEQ ID NO: 944809 - protein, 17 aa, Mycobacterium
FLVAYPDGLDRAWNAGT

SEQ ID NO: 944810 - protein, 19 aa, Mycobacterium
FLVSGAAVGLMASAGACSC

SEQ ID NO: 944811 - protein, 17 aa, Mycobacterium
FLVTASLASYLVTALPS

SEQ ID NO: 944812 - protein, 23 aa, Mycobacterium
FMAGFSGPIPDDKWPQAVQIVKD

SEQ ID NO: 944813 - protein, 17 aa, Mycobacterium
FMEAYGDVLYNLYGSTE

SEQ ID NO: 944814 - protein, 26 aa, Mycobacterium
FNAGSFNFGLFPVAARDLPFADWERD

SEQ ID NO: 944815 - protein, 21 aa, Mycobacterium
FNAVFSMTVPPPVIAENRAML

SEQ ID NO: 944816 - protein, 30 aa, Mycobacterium
FNDAMSQQIKDAFNAYIDAAHSVANAIGTH

SEQ ID NO: 944817 - protein, 17 aa, Mycobacterium
FNLNLNVPPPCTTGFLP

SEQ ID NO: 944818 - protein, 18 aa, Mycobacterium
FNWDQAYRKPITWDKLWQ

SEQ ID NO: 944819 - protein, 19 aa, Mycobacterium
FPAIGRLPGIVVTPQPEML

SEQ ID NO: 944820 - protein, 20 aa, Mycobacterium
FPAPEKLWTIDDLGGWKNVD

SEQ ID NO: 944821 - protein, 19 aa, Mycobacterium
FPAPEKLWTVDDLGGWDAV

SEQ ID NO: 944822 - protein, 24 aa, Mycobacterium
FPDRPDNMFALANTLLGLATGHTA

SEQ ID NO: 944823 - protein, 21 aa, Mycobacterium
FPFERLMPEPFHLADVNAAFA

SEQ ID NO: 944824 - protein, 23 aa, Mycobacterium
FPHFAANALAIYEPAHGALTGAI

SEQ ID NO: 944825 - protein, 25 aa, Mycobacterium
FPPAEGFWSLTMYDAGMFFVDNPLG

SEQ ID NO: 944826 - protein, 30 aa, Mycobacterium
FPPESFAQVLLGWQQWLRTADRNNWALADA

SEQ ID NO: 944827 - protein, 27 aa, Mycobacterium
FPPESFAQVLVGWQNWLRTADRNSWAL

SEQ ID NO: 944828 - protein, 22 aa, Mycobacterium
FPPLGENLFVGAAARPNELTYS

SEQ ID NO: 944829 - protein, 28 aa, Mycobacterium
FPPQDAAWLVTTWRLVRPYAIATDPHQL

SEQ ID NO: 944830 - protein, 27 aa, Mycobacterium
FPTKDDLVVEFLQYVYRSGLTVESALY

SEQ ID NO: 944831 - protein, 18 aa, Mycobacterium
FPTYILRNQSIPGVITDL

SEQ ID NO: 944832 - protein, 30 aa, Mycobacterium
FPVTQWTRWRQPVIGMPSTPRFLGNGHLLV

SEQ ID NO: 944833 - protein, 26 aa, Mycobacterium
FQAGDLLGISLLIDKDPRATPVGDAE

SEQ ID NO: 944834 - protein, 18 aa, Mycobacterium
FQAKYPMYEIIRQQLTDA

SEQ ID NO: 944835 - protein, 27 aa, Mycobacterium
FQDDFIEWSVSFNQKPFPPPCDVAKEL

SEQ ID NO: 944836 - protein, 25 aa, Mycobacterium
FQDDFIEWSVSFNQKPFPPPCDVAR

SEQ ID NO: 944837 - protein, 20 aa, Mycobacterium
FQMAAYLRHNGYVYAYSTGA

SEQ ID NO: 944838 - protein, 18 aa, Mycobacterium
FQMAGSLALREAAAATRV

SEQ ID NO: 944839 - protein, 25 aa, Mycobacterium
FQRPAALFRYLISQGEPNADAQAVM

SEQ ID NO: 944840 - protein, 24 aa, Mycobacterium
FQRTAQWVLRLPNPRYSRFTNITH

SEQ ID NO: 944841 - protein, 22 aa, Mycobacterium
FQRTKQWRGIATRYDKHNLNYR

SEQ ID NO: 944842 - protein, 24 aa, Mycobacterium
FQRVRLTEHWGAQVRMVFFDQRGH

SEQ ID NO: 944843 - protein, 26 aa, Mycobacterium
FQSDQGMFMVNWPYVLAAARSAAEEG

SEQ ID NO: 944844 - protein, 18 aa, Mycobacterium
FRALRRWASGFYPEPEAA

SEQ ID NO: 944845 - protein, 21 aa, Mycobacterium
FRGAFDPKVRLTLLTARAGLV

SEQ ID NO: 944846 - protein, 18 aa, Mycobacterium
FRGDLTPKTKLTMLASRA

SEQ ID NO: 944847 - protein, 30 aa, Mycobacterium
FRIAYLASQKVFGFAPYPAVLPGRPARVTI

SEQ ID NO: 944848 - protein, 27 aa, Mycobacterium
FRLLGIAARVFVLFDTGRWVVEGLRGR

SEQ ID NO: 944849 - protein, 26 aa, Mycobacterium
FRRERAMGRYLLNPAVGALAKLGVRT

SEQ ID NO: 944850 - protein, 19 aa, Mycobacterium
FRRKGVALGSSLLTCLTLA

SEQ ID NO: 944851 - protein, 20 aa, Mycobacterium
FRSRILIDPAAESGPPLTAL

SEQ ID NO: 944852 - protein, 22 aa, Mycobacterium
FRVPAIVISPWSVGGWVAGESF

SEQ ID NO: 944853 - protein, 23 aa, Mycobacterium
FSALWAVRLLEEAGMPQGLVQSV

SEQ ID NO: 944854 - protein, 24 aa, Mycobacterium
FSARAQELLLADERIRHLRGRVAD

SEQ ID NO: 944855 - protein, 26 aa, Mycobacterium
FSARARLTSVLWTFQVNQAEGVLCPD

SEQ ID NO: 944856 - protein, 19 aa, Mycobacterium
FSAYGAWYQQVSAQAKAIH

SEQ ID NO: 944857 - protein, 24 aa, Mycobacterium
FSDGVWYVDLAPITIPEVAPVTVA

SEQ ID NO: 944858 - protein, 27 aa, Mycobacterium
FSDNLPTCVIKYIPLHTPAVVQSFNAV

SEQ ID NO: 944859 - protein, 24 aa, Mycobacterium
FSDSLPTCITKYIPLHTPAVVMSM

SEQ ID NO: 944860 - protein, 25 aa, Mycobacterium
FSENLPGCVTKYIPLHTPAVVMSIN

SEQ ID NO: 944861 - protein, 18 aa, Mycobacterium
FSFPIREPSLPEGWRANS

SEQ ID NO: 944862 - protein, 18 aa, Mycobacterium
FSGLVAGFMIVGCSPAVT

SEQ ID NO: 944863 - protein, 18 aa, Mycobacterium
FSHAGAIMTWVAMNVDNP

SEQ ID NO: 944864 - protein, 26 aa, Mycobacterium
FSHGGAIMIWTLMNIREPDLSLPARQ

SEQ ID NO: 944865 - protein, 23 aa, Mycobacterium
FSKQIISSIKWAPDETGIIPTSG

SEQ ID NO: 944866 - protein, 25 aa, Mycobacterium
FSLAETEFFTAFDRLLTTTDLDTWK

SEQ ID NO: 944867 - protein, 19 aa, Mycobacterium
FSNPVWFVCGLIGGIANTT

SEQ ID NO: 944868 - protein, 20 aa, Mycobacterium
FSNTFTLVWPRGSGTVREFP

SEQ ID NO: 944869 - protein, 29 aa, Mycobacterium
FSPAGGALGRLRPLFRAGLGARLGSGRQY

SEQ ID NO: 944870 - protein, 24 aa, Mycobacterium
FSQGTAIMVWTLMNVKNPKTNLLN

SEQ ID NO: 944871 - protein, 19 aa, Mycobacterium
FSVITAIPQPLRSLAHTRG

SEQ ID NO: 944872 - protein, 18 aa, Mycobacterium
FSVIVSRYALAAQKAAGL

SEQ ID NO: 944873 - protein, 24 aa, Mycobacterium
FTAALAAPALIFLGAATANAESSV

SEQ ID NO: 944874 - protein, 24 aa, Mycobacterium
FTAHGPYVFFQFAGTKESAEATAE

SEQ ID NO: 944875 - protein, 18 aa, Mycobacterium
FTALGAAALFSAATANAE

SEQ ID NO: 944876 - protein, 24 aa, Mycobacterium
FTASYDWLPAVLEGILLAIAQSHE

SEQ ID NO: 944877 - protein, 22 aa, Mycobacterium
FTATAAALLLLGAVACAPPEKD

SEQ ID NO: 944878 - protein, 25 aa, Mycobacterium
FTDRHPGFADAWRRAVTAVNRDIQD

SEQ ID NO: 944879 - protein, 19 aa, Mycobacterium
FTDWPVQAVYRAVGYLSSH

SEQ ID NO: 944880 - protein, 24 aa, Mycobacterium
FTEDLDPQWRTSLPRRLADLVEVW

SEQ ID NO: 944881 - protein, 24 aa, Mycobacterium
FTEGRAFVTIQFDGPPDTLAPADF

SEQ ID NO: 944882 - protein, 25 aa, Mycobacterium
FTELFEAQRWPGHSGDYFVVRSGSI

SEQ ID NO: 944883 - protein, 30 aa, Mycobacterium; identical to SEQ ID NO: 147254

SEQ ID NO: 944884 - protein, 17 aa, Mycobacterium
FTGNAWINYLGHEKPIP

SEQ ID NO: 944885 - protein, 18 aa, Mycobacterium
FTGNGYMLLGLAADALAT

SEQ ID NO: 944886 - protein, 20 aa, Mycobacterium
FTGYLIDALYRDPALGELSG

SEQ ID NO: 944887 - protein, 19 aa, Mycobacterium
FTHPDVNDYFTSLRGQPRA

SEQ ID NO: 944888 - protein, 19 aa, Mycobacterium
FTLARNGIPVIPPNSHIAL

SEQ ID NO: 944889 - protein, 22 aa, Mycobacterium
FTLTHWDADTFTFPLSTENALP

SEQ ID NO: 944890 - protein, 18 aa, Mycobacterium
FTRNGVLWAVPQLTDAGV

SEQ ID NO: 944891 - protein, 21 aa, Mycobacterium
FTRRDPVLLYRATPQTFIDRS

SEQ ID NO: 944892 - protein, 19 aa, Mycobacterium
FTTLTTDPGSMLPPLPPRF

SEQ ID NO: 944893 - protein, 28 aa, Mycobacterium
FTTVTGLEWGNWGPFAFTSNYSTQQHGL

SEQ ID NO: 944894 - protein, 23 aa, Mycobacterium
FTVILASPIAHAAAVTATLAVTS

SEQ ID NO: 944895 - protein, 25 aa, Mycobacterium
FTVWRLRNMFASHPLPTYAGSMSAD

SEQ ID NO: 944896 - protein, 18 aa, Mycobacterium
FVAAVVAAAAFFTTGSHG

SEQ ID NO: 944897 - protein, 25 aa, Mycobacterium
FVAAYSRLGVFKLGPTGAEEAMRIS

SEQ ID NO: 944898 - protein, 42 aa, Mycobacterium
FVAGKTQTFLPWDSWERPVIEPPLWFHDLLHGDGTPYRAGEV

SEQ ID NO: 944899 - protein, 17 aa, Mycobacterium
FVAPFAPQALRAALDAA

SEQ ID NO: 944900 - protein, 17 aa, Mycobacterium
FVARKDWADGHPGEVAA

SEQ ID NO: 944901 - protein, 18 aa, Mycobacterium
FVASALARLGPLLVVTAT

SEQ ID NO: 944902 - protein, 20 aa, Mycobacterium
FVGQPPFVPPSFNPVNGSIA

SEQ ID NO: 944903 - protein, 24 aa, Mycobacterium
FVGTHQPYYMTWDEIGRLHSSGRW

SEQ ID NO: 944904 - protein, 24 aa, Mycobacterium
FVGYQLDRVFAPRLGVGRSNGCSY

SEQ ID NO: 944905 - protein, 25 aa, Mycobacterium
FVHTNVLGTFTILEAVRRHGVRLHH

SEQ ID NO: 944906 - protein, 26 aa, Mycobacterium
FVKDNLTKWWRGDYANITTIVDLTLS

SEQ ID NO: 944907 - protein, 20 aa, Mycobacterium
FVLDLIARRQVAALLINPQT

SEQ ID NO: 944908 - protein, 19 aa, Mycobacterium
FVLRVPLTSRRTLDLRWGR

SEQ ID NO: 944909 - protein, 20 aa, Mycobacterium
FVMVAITTMALAGSGALASA

SEQ ID NO: 944910 - protein, 19 aa, Mycobacterium
FVMVAITVLAVVAAGSPAT

SEQ ID NO: 944911 - protein, 17 aa, Mycobacterium
FVMVAITVMGLVGSAAR

SEQ ID NO: 944912 - protein, 24 aa, Mycobacterium
FVNTPPSHLFPDEFAKRARALGES

SEQ ID NO: 944913 - protein, 28 aa, Mycobacterium
FVPAKTLPLVEPLRWVGLGQLADELTPG

SEQ ID NO: 944914 - protein, 18 aa, Mycobacterium
FVQAADWPDPPDPARIWY

SEQ ID NO: 944915 - protein, 24 aa, Mycobacterium
FVRSNIVGTFTILEAVRHAAASRP

SEQ ID NO: 944916 - protein, 28 aa, Mycobacterium
FVSYYRRPIYTAAMAGVLVAPEILTATA

SEQ ID NO: 944917 - protein, 20 aa, Mycobacterium
FVTFARGAMYWSPETGPQPV

SEQ ID NO: 944918 - protein, 19 aa, Mycobacterium
FVVAAARRIAAALATVRTG

SEQ ID NO: 944919 - protein, 18 aa, Mycobacterium
FVVAAATELPRGIRINCV

SEQ ID NO: 944920 - protein, 25 aa, Mycobacterium
FVVDAWEAAVPWIDYGVGLVDGALG

SEQ ID NO: 944921 - protein, 17 aa, Mycobacterium
FWAIRGVGGGNFCIATE

SEQ ID NO: 944922 - protein, 18 aa, Mycobacterium
FWEEALAVTREAPAGCFN

SEQ ID NO: 944923 - protein, 21 aa, Mycobacterium
FWEKPLALADVLDVGLRSSYV

SEQ ID NO: 944924 - protein, 17 aa, Mycobacterium
FWNPIWGFNWEFGECHD

SEQ ID NO: 944925 - protein, 18 aa, Mycobacterium
FWRSAGLPEYRFPDPNGT

SEQ ID NO: 944926 - protein, 20 aa, Mycobacterium
FWTQFYGDSFANFRPVSRLI

SEQ ID NO: 944927 - protein, 25 aa, Mycobacterium
FYANYQLIIPDRYDFHTWTWAVSYC

SEQ ID NO: 944928 - protein, 18 aa, Mycobacterium
FYGYGFNVGTTSAARTQL

SEQ ID NO: 944929 - protein, 26 aa, Mycobacterium
GAAAAFGFPGFGGNGGLLFGKAGADG

SEQ ID NO: 944930 - protein, 25 aa, Mycobacterium
GAAGAGGPLVTPGHAGNTGTGGTGG

SEQ ID NO: 944931 - protein, 22 aa, Mycobacterium
GAAGLLLAGWAGSMGVAAADPQ

SEQ ID NO: 944932 - protein, 29 aa, Mycobacterium
GAAIYSPCALPPVLDYLTSGELPSTDTYC

SEQ ID NO: 944933 - protein, 24 aa, Mycobacterium
GAAKAGITALTLSAARALGRYGVC

SEQ ID NO: 944934 - protein, 24 aa, Mycobacterium
GAAKAGITALTLSAARALGRYGVR

SEQ ID NO: 944935 - protein, 22 aa, Mycobacterium
GAAKWNLLAPYAYASNGGQNPE

SEQ ID NO: 944936 - protein, 23 aa, Mycobacterium
GAALAVLYAARRYYRNWGTTKQE

SEQ ID NO: 944937 - protein, 21 aa, Mycobacterium
GAASFTRSFARYEPMPESAAA

SEQ ID NO: 944938 - protein, 21 aa, Mycobacterium
GAATTMIWTASTIKLAMVVDL

SEQ ID NO: 944939 - protein, 27 aa, Mycobacterium
GAAVVDMLLGIPPLGNKVGNFGSAPPL

SEQ ID NO: 944940 - protein, 26 aa, Mycobacterium
GAAYLDKLVVRVIGEPGLRAGAVQSG

SEQ ID NO: 944941 - protein, 29 aa, Mycobacterium
GADGPAPWWYRPVGALFDQFLGAAESDPV

SEQ ID NO: 944942 - protein, 19 aa, Mycobacterium
GADPLWSQLLDDGLVRPGP

SEQ ID NO: 944943 - protein, 22 aa, Mycobacterium
GADRRYIMVVQSLQASDDATAR

SEQ ID NO: 944944 - protein, 20 aa, Mycobacterium
GADRRYIMVVQSLQTSDDAT

SEQ ID NO: 944945 - protein, 23 aa, Mycobacterium
GAEAAGVSVLQSAGADVMGALNA

SEQ ID NO: 944946 - protein, 25 aa, Mycobacterium
GAEAQYLRYLGFHFAAFVFDASDMD

SEQ ID NO: 944947 - protein, 17 aa, Mycobacterium
GAFAPWFANSVGAATQV

SEQ ID NO: 944948 - protein, 20 aa, Mycobacterium
GAFIALIQHGNQAGDAAFSV

SEQ ID NO: 944949 - protein, 20 aa, Mycobacterium
GAFYDGDYALLANTLKRFNV

SEQ ID NO: 944950 - protein, 28 aa, Mycobacterium
GAGAKAFNGILNLAVAFADNVQATAGPG

SEQ ID NO: 944951 - protein, 28 aa, Mycobacterium
GAGAVVGPFTYLRPGTALGADGKLGAFV

SEQ ID NO: 944952 - protein, 27 aa, Mycobacterium
GAGDALRGLLAQKFPTVPPDVISAVVD

SEQ ID NO: 944953 - protein, 25 aa, Mycobacterium
GAGDPVRLHVLAAASLRKAFTEIGR

SEQ ID NO: 944954 - protein, 18 aa, Mycobacterium
GAGFGVTGFFNSGSGALS

SEQ ID NO: 944955 - protein, 26 aa, Mycobacterium
GAGFPAGFEALTPYFAEMFLGRRDVA

SEQ ID NO: 944956 - protein, 21 aa, Mycobacterium
GAGGAAGLWGAGGNGGQGGSG

SEQ ID NO: 944957 - protein, 24 aa, Mycobacterium
GAGGAGGLMWGHGGSGGAGGDGGA

SEQ ID NO: 944958 - protein, 22 aa, Mycobacterium
GAGGSGGLLWGNGGAGGAGGNG

SEQ ID NO: 944959 - protein, 17 aa, Mycobacterium
GAGILGGALWLDTSLRR

SEQ ID NO: 944960 - protein, 27 aa, Mycobacterium
GAGKSTFIAFTLAPLLPGSPVVNADEI

SEQ ID NO: 944961 - protein, 26 aa, Mycobacterium
GAGKYPTIPPFDYLEEVTFAHVGKPF

SEQ ID NO: 944962 - protein, 17 aa, Mycobacterium
GAGMARAFAAKGRDLAL

SEQ ID NO: 944963 - protein, 18 aa, Mycobacterium
GAGMARAFAAKGRDLALC

SEQ ID NO: 944964 - protein, 18 aa, Mycobacterium
GAGMARAFAARGRDLALC

SEQ ID NO: 944965 - protein, 18 aa, Mycobacterium
GAGMARQFAARGRNLALC

SEQ ID NO: 944966 - protein, 40 aa, Mycobacterium
GAGNHVRVYLPFGTQWYGYFMRRLAERPANLTFFLRALVG

SEQ ID NO: 944967 - protein, 23 aa, Mycobacterium
GAGNTATVATAFIGGGNSATASA

SEQ ID NO: 944968 - protein, 32 aa, Mycobacterium
GAGPNPLIITRGLIATLLGLPSGAPAVNAVNL

SEQ ID NO: 944969 - protein, 23 aa, Mycobacterium
GAGSIFKIFTTAAALDMGMGINA

SEQ ID NO: 944970 - protein, 31 aa, Mycobacterium
GAGTPFPIASVVKLFIADDVLLRESRGEMEL

SEQ ID NO: 944971 - protein, 24 aa, Mycobacterium
GAHADAYLWVKRPGESDGACNGHP

SEQ ID NO: 944972 - protein, 18 aa, Mycobacterium
GAHAVYLLDGLRAQDDYN

SEQ ID NO: 944973 - protein, 23 aa, Mycobacterium
GAHGLLVVTPYYSRPSQAGLLAH

SEQ ID NO: 944974 - protein, 24 aa, Mycobacterium
GAIAGFGNGWFLVDGVPAEHGDSG

SEQ ID NO: 944975 - protein, 32 aa, Mycobacterium
GAIGPAPSATAITAQWAGTFAAMSARDRAGPA

SEQ ID NO: 944976 - protein, 27 aa, Mycobacterium
GAIGSAHLLLLSGIGPAGDLAAHGIAV

SEQ ID NO: 944977 - protein, 20 aa, Mycobacterium
GAIHAQNARIYLIDTVLDPN

SEQ ID NO: 944978 - protein, 19 aa, Mycobacterium
GAIIGCCRLLPPQGYQAAG

SEQ ID NO: 944979 - protein, 25 aa, Mycobacterium
GAIRPFPHHAAYGSAKWALRGLTQN

SEQ ID NO: 944980 - protein, 20 aa, Mycobacterium
GAIRPFPQHGAYGSSKWALR

SEQ ID NO: 944981 - protein, 24 aa, Mycobacterium
GAITRPALLDFVRNYQGQGVAREY

SEQ ID NO: 944982 - protein, 22 aa, Mycobacterium
GAIYDAWASLSYERGPLGLPTS

SEQ ID NO: 944983 - protein, 20 aa, Mycobacterium
GALFLSAGMGIANAQPRDGQ

SEQ ID NO: 944984 - protein, 18 aa, Mycobacterium
GALLAAVLVLAGCGDAED

SEQ ID NO: 944985 - protein, 18 aa, Mycobacterium
GALLLGGRLGPARTAAIC

SEQ ID NO: 944986 - protein, 20 aa, Mycobacterium
GALLLGSRLGAGRTAAICAV

SEQ ID NO: 944987 - protein, 21 aa, Mycobacterium
GALLRRRFRLGTEAMKPLRTA

SEQ ID NO: 944988 - protein, 18 aa, Mycobacterium
GALNCLVNLATPAPAPAT

SEQ ID NO: 944989 - protein, 21 aa, Mycobacterium
GALRETGFITYQPSDHIGAAN

SEQ ID NO: 944990 - protein, 25 aa, Mycobacterium
GALVSTVLAPFSGGAPAAPSQPPLL

SEQ ID NO: 944991 - protein, 18 aa, Mycobacterium
GALYPGAPVPPGVPSPPP

SEQ ID NO: 944992 - protein, 20 aa, Mycobacterium
GAMGRDIPVAFLAGGPHAAY

SEQ ID NO: 944993 - protein, 19 aa, Mycobacterium
GAMGRDIPVAFLGGGPHAV

SEQ ID NO: 944994 - protein, 27 aa, Mycobacterium
GAMTETFRWGLYDRKPLNRWTTDRIAL

SEQ ID NO: 944995 - protein, 25 aa, Mycobacterium
GAMVAEAAVPRWGRPEEMAELLAFC

SEQ ID NO: 944996 - protein, 18 aa, Mycobacterium
GANGLFGAAGSGGSGGAG

SEQ ID NO: 944997 - protein, 17 aa, Mycobacterium
GANGLGGAAFDGARGAD

SEQ ID NO: 944998 - protein, 19 aa, Mycobacterium
GANLMKFGPLLGELLARAV

SEQ ID NO: 944999 - protein, 20 aa, Mycobacterium
GANLPLLLKGVARTTQEGAF

SEQ ID NO: 945000 - protein, 18 aa, Mycobacterium
GANRWKHASAWPLPQTNW

SEQ ID NO: 945001 - protein, 24 aa, Mycobacterium
GAPAGLGWLGTAFVDSLRAKVGGR

SEQ ID NO: 945002 - protein, 20 aa, Mycobacterium
GAPALPLPAAAPQAPGAPAV

SEQ ID NO: 945003 - protein, 17 aa, Mycobacterium
GAPGTPGWPGGIAGPTA

SEQ ID NO: 945004 - protein, 23 aa, Mycobacterium
GAPISDVVAWIEAGRPADPGHFH

SEQ ID NO: 945005 - protein, 18 aa, Mycobacterium
GAPLRERSGMRLRVGRDA

SEQ ID NO: 945006 - protein, 18 aa, Mycobacterium
GAPQLGRWKWHDPYVHAS

SEQ ID NO: 945007 - protein, 24 aa, Mycobacterium
GAPSEFLHRSVGLAGLKANYGLDI

SEQ ID NO: 945008 - protein, 26 aa, Mycobacterium
GAPVRMVPRRVLLERLLDGFDAERIR

SEQ ID NO: 945009 - protein, 17 aa, Mycobacterium
GAQAYLRELAFRDFYAA

SEQ ID NO: 945010 - protein, 27 aa, Mycobacterium
GAQGFSLGHFPQSFRFASIGGFAATRS

SEQ ID NO: 945011 - protein, 26 aa, Mycobacterium
GAQGTPPLVLCHISHTYRTGASLYFT

SEQ ID NO: 945012 - protein, 23 aa, Mycobacterium
GARHTPEFFAARAKDLFTPGINV

SEQ ID NO: 945013 - protein, 26 aa, Mycobacterium
GARKDTLMVLPGQKLLAVLVADNPGV

SEQ ID NO: 945014 - protein, 26 aa, Mycobacterium
GARMVITVLSWRLDLDRLAATAQRCA

SEQ ID NO: 945015 - protein, 20 aa, Mycobacterium
GARVALAYAGSHPNKVARLL

SEQ ID NO: 945016 - protein, 19 aa, Mycobacterium
GASFPEVVAAFTGGLSGLV

SEQ ID NO: 945017 - protein, 26 aa, Mycobacterium
GASGCNIFRLHRGYHYPRSLATAVEC

SEQ ID NO: 945018 - protein, 22 aa, Mycobacterium
GASIYNVSVLLDPDKGLANVLA

SEQ ID NO: 945019 - protein, 22 aa, Mycobacterium
GASIYNVSVLLDPNQGLANLLA

SEQ ID NO: 945020 - protein, 20 aa, Mycobacterium
GASLITFVPGFVGDAAPAPT

SEQ ID NO: 945021 - protein, 17 aa, Mycobacterium
GASPRIAFSAPYALVCD

SEQ ID NO: 945022 - protein, 19 aa, Mycobacterium
GASVLILPDASRDAVHVDA

SEQ ID NO: 945023 - protein, 31 aa, Mycobacterium
GATAFPWRRHGALVQWYVENAGSPAAATGWL

SEQ ID NO: 945024 - protein, 26 aa, Mycobacterium
GATAFPWRRQSALVQWYVETGDPAAA

SEQ ID NO: 945025 - protein, 32 aa, Mycobacterium
GATAFPWRRQSALVQWYVETPGSPAAASGWLN

SEQ ID NO: 945026 - protein, 23 aa, Mycobacterium
GATDLCEFMVFTGGMLQVCGDSF

SEQ ID NO: 945027 - protein, 19 aa, Mycobacterium
GATFAHTFSAPGTFDYVCS

SEQ ID NO: 945028 - protein, 30 aa, Mycobacterium
GATGAAAPPLLPKALARDLLPDLQATRGYT

SEQ ID NO: 945029 - protein, 30 aa, Mycobacterium
GATGFLGRFLVLEWLQRLEPVDGKLVCLVR

SEQ ID NO: 945030 - protein, 33 aa, Mycobacterium; identical to SEQ ID NO: 784453

SEQ ID NO: 945031 - protein, 21 aa, Mycobacterium
GATLPWSIEIITTAPSMTGNI

SEQ ID NO: 945032 - protein, 25 aa, Mycobacterium
GATPVLALYAIPHRDCGSFAAGGFG

SEQ ID NO: 945033 - protein, 18 aa, Mycobacterium
GATRIPRVYGRQASEYVI

SEQ ID NO: 945034 - protein, 28 aa, Mycobacterium
GAVAVVGTGLFLLNVSRQPEPTASGNTP

SEQ ID NO: 945035 - protein, 28 aa, Mycobacterium
GAVDAAWHQLWASSFAKLSYRVKSVDVT

SEQ ID NO: 945036 - protein, 17 aa, Mycobacterium
GAVIAIDLRRMSGLLSL

SEQ ID NO: 945037 - protein, 18 aa, Mycobacterium
GAVLAACALATALSACGS

SEQ ID NO: 945038 - protein, 26 aa, Mycobacterium
GAVNTAAWWVMNAIPTAVSLGHTVGT

SEQ ID NO: 945039 - protein, 24 aa, Mycobacterium
GAVNVYPIAVLNKAAHPSQAQKFV

SEQ ID NO: 945040 - protein, 28 aa, Mycobacterium
GAVVAPSLRPPQARVLLMAALATGAPIG

SEQ ID NO: 945041 - protein, 19 aa, Mycobacterium
GAWPVCGGPLSGPTPREVP

SEQ ID NO: 945042 - protein, 18 aa, Mycobacterium
GAWQKVLSIATPLPETQP

SEQ ID NO: 945043 - protein, 18 aa, Mycobacterium
GCALAFCGAGMAAAAPDV

SEQ ID NO: 945044 - protein, 21 aa, Mycobacterium
GCDRRLSWLAPCRGEPEGFPT

SEQ ID NO: 945045 - protein, 21 aa, Mycobacterium
GCHLPAAWRTAPPPLNMRPPN

SEQ ID NO: 945046 - protein, 23 aa, Mycobacterium
GCKRLIISGNFYQAIQRPNAHLV

SEQ ID NO: 945047 - protein, 29 aa, Mycobacterium
GCKRPLMSRDWYPTFSLPNVSLETTAIAE

SEQ ID NO: 945048 - protein, 18 aa, Mycobacterium
GCRILVNDVVRDEKFDDH

SEQ ID NO: 945049 - protein, 24 aa, Mycobacterium
GCRQLDSALPWYGDVRQRLQAAID

SEQ ID NO: 945050 - protein, 25 aa, Mycobacterium
GCSGQTATLILDDGRREVWTFTGPA

SEQ ID NO: 945051 - protein, 25 aa, Mycobacterium
GCSTYKWETFLTQELPAYLAANKGV

SEQ ID NO: 945052 - protein, 25 aa, Mycobacterium
GCTTYKWETFLTSELPAYLQSQKQV

SEQ ID NO: 945053 - protein, 26 aa, Mycobacterium
GCTTYKWETFLTSELPQWLSANRSVK

SEQ ID NO: 945054 - protein, 26 aa, Mycobacterium
GCTTYKWETFLTSELPQYLSANKGVK

SEQ ID NO: 945055 - protein, 26 aa, Mycobacterium
GCTTYKWETFLTSELPQYLSANRQVK

SEQ ID NO: 945056 - protein, 21 aa, Mycobacterium
GCVGPSFRLLGIAARVFVLFD

SEQ ID NO: 945057 - protein, 26 aa, Mycobacterium
GCVTYKWETFLTSELPEYLSSQKQVK

SEQ ID NO: 945058 - protein, 18 aa, Mycobacterium
GCVWLRGGSIVGPHFSFN

SEQ ID NO: 945059 - protein, 24 aa, Mycobacterium
GCWQQITHSLWPTPELIMDTGNSI

SEQ ID NO: 945060 - protein, 21 aa, Mycobacterium
GDACVLWCTTIRRAVRTGELD

SEQ ID NO: 945061 - protein, 26 aa, Mycobacterium
GDADQWMSRFFDAQPSWSLDGDTLVL

SEQ ID NO: 945062 - protein, 24 aa, Mycobacterium
GDAGGPGGLLFGNGGNGGSGSAGM

SEQ ID NO: 945063 - protein, 22 aa, Mycobacterium
GDAGLFSGAIGGAGGSAGRSVG

SEQ ID NO: 945064 - protein, 18 aa, Mycobacterium
GDAIPLDRTAPALDLDAV

SEQ ID NO: 945065 - protein, 28 aa, Mycobacterium
GDALTRRRALTILGLTVPAVAAACTTVG

SEQ ID NO: 945066 - protein, 27 aa, Mycobacterium
GDAMEALLSARWMPMPFLADRESSSLG

SEQ ID NO: 945067 - protein, 32 aa, Mycobacterium
GDCLRALPVDRLRKPVWYFNIGSDQMTTPVTG

SEQ ID NO: 945068 - protein, 29 aa, Mycobacterium
GDDADIRALFETHFFGSVAMIKAVLPGMR

SEQ ID NO: 945069 - protein, 20 aa, Mycobacterium
GDDLYWCNPSGRALGVRPTT

SEQ ID NO: 945070 - protein, 18 aa, Mycobacterium
GDDQCRLLIRSRLALRHP

SEQ ID NO: 945071 - protein, 24 aa, Mycobacterium
GDDTLRPLFGQHVVMANPGLQQIF

SEQ ID NO: 945072 - protein, 23 aa, Mycobacterium
GDEDLLTWKAAPAAAPAQRSGGS

SEQ ID NO: 945073 - protein, 24 aa, Mycobacterium
GDEELDVWLISWVPGHPTELHDHG

SEQ ID NO: 945074 - protein, 23 aa, Mycobacterium
GDELLVRLHAPLRGVARGQTAVL

SEQ ID NO: 945075 - protein, 24 aa, Mycobacterium
GDELSFLDCLYYSAVTLSTTGYGD

SEQ ID NO: 945076 - protein, 21 aa, Mycobacterium
GDERLFVDTPWVLSVDDHVDP

SEQ ID NO: 945077 - protein, 17 aa, Mycobacterium
GDFAFYMSTLVKDLPQP

SEQ ID NO: 945078 - protein, 27 aa, Mycobacterium
GDFDLAQFGWLGDAFPLSSLTQIYKSD

SEQ ID NO: 945079 - protein, 32 aa, Mycobacterium
GDFFNLHFDFDLTIPRLKKGLFLGTHWGQLDM

SEQ ID NO: 945080 - protein, 32 aa, Mycobacterium
GDFLQKYHAPPLAIGPLYQPKTLELCAQGDPV

SEQ ID NO: 945081 - protein, 22 aa, Mycobacterium
GDGDGPAWLTGGTYLLTRRIRM

SEQ ID NO: 945082 - protein, 21 aa, Mycobacterium
GDGNLMLALADLYMGRDAKGH

SEQ ID NO: 945083 - protein, 26 aa, Mycobacterium
GDHPRYAAVPLRLHPDIHLYCAVPEE

SEQ ID NO: 945084 - protein, 22 aa, Mycobacterium
GDIASRYRTAASPTGTAGTTST

SEQ ID NO: 945085 - protein, 28 aa, Mycobacterium
GDIDSEGLLLHYLPEVDLWTGAIVGAEA

SEQ ID NO: 945086 - protein, 20 aa, Mycobacterium
GDIPPPPGWGAPPGPRGIYQ

SEQ ID NO: 945087 - protein, 23 aa, Mycobacterium
GDITAHPPRIALVSNLTGELAGP

SEQ ID NO: 945088 - protein, 23 aa, Mycobacterium
GDIVKSCYAEVLPAAPTGTLFID

SEQ ID NO: 945089 - protein, 39 aa, Mycobacterium
GDKEPALWMPPNAAFHCQYAMQFIAVLRGYRLPVDAPSV

SEQ ID NO: 945090 - protein, 26 aa, Mycobacterium
GDKGLRFSFRWDLGRSRLIMVDSRNA

SEQ ID NO: 945091 - protein, 25 aa, Mycobacterium
GDLATVRLVWTLTVRDSAGAVLETV

SEQ ID NO: 945092 - protein, 25 aa, Mycobacterium
GDLDVLALYISAIGTASLSLAVVNT

SEQ ID NO: 945093 - protein, 21 aa, Mycobacterium
GDLFAALPGASAHGARFAADA

SEQ ID NO: 945094 - protein, 27 aa, Mycobacterium
GDLGVHLLDLLTYISGGRILVDECQAR

SEQ ID NO: 945095 - protein, 17 aa, Mycobacterium
GDLLFQSPRPRRGRRDD

SEQ ID NO: 945096 - protein, 17 aa, Mycobacterium
GDLLSIPGLFVFGSNDY

SEQ ID NO: 945097 - protein, 22 aa, Mycobacterium
GDLLTALLGNKISAGTSGLGEY

SEQ ID NO: 945098 - protein, 22 aa, Mycobacterium
GDLPLSFDVTNIQPAAPGTATA

SEQ ID NO: 945099 - protein, 17 aa, Mycobacterium
GDLVRLMEFRKGQANLV

SEQ ID NO: 945100 - protein, 20 aa, Mycobacterium
GDMPNDVPMLLRAGLGVAMG

SEQ ID NO: 945101 - protein, 25 aa, Mycobacterium
GDNAVPLIVNLYTFGAKDFDVHTAL

SEQ ID NO: 945102 - protein, 26 aa, Mycobacterium
GDNFRGQLNIPPLPTGMTYTQVANGT

SEQ ID NO: 945103 - protein, 22 aa, Mycobacterium
GDNLRILLKNRIVPVGIPTNNV

SEQ ID NO: 945104 - protein, 18 aa, Mycobacterium
GDPAFHGPMRRDWNYMIG

SEQ ID NO: 945105 - protein, 28 aa, Mycobacterium
GDPEYLQFKFGAPIPPGPPPADAPPPGD

SEQ ID NO: 945106 - protein, 23 aa, Mycobacterium
GDPGFAVFGLRDGALVGAASVNQ

SEQ ID NO: 945107 - protein, 27 aa, Mycobacterium
GDPGSPTINLPMPNGWQTANDSSTSYG

SEQ ID NO: 945108 - protein, 18 aa, Mycobacterium
GDPVLLGLLCRCYACVNL

SEQ ID NO: 945109 - protein, 29 aa, Mycobacterium
GDPYDDLAWFCIRAWRFGAPAGLGAGGLG

SEQ ID NO: 945110 - protein, 20 aa, Mycobacterium
GDPYKSATFIQRNLPRGTTQ

SEQ ID NO: 945111 - protein, 27 aa, Mycobacterium
GDRFFSRNCRAWLSTALMIQGNLDHAA

SEQ ID NO: 945112 - protein, 26 aa, Mycobacterium
GDRFFSRNCRTWLGLALCMQGNLTEA

SEQ ID NO: 945113 - protein, 24 aa, Mycobacterium
GDRFVTEICLALSAGTPVPQWARE

SEQ ID NO: 945114 - protein, 17 aa, Mycobacterium
GDRNMGFGNAGAANMGA

SEQ ID NO: 945115 - protein, 27 aa, Mycobacterium
GDRTYRALGWTIVSSPAGMRFTNDRTG

SEQ ID NO: 945116 - protein, 25 aa, Mycobacterium
GDSTTPLLASFNLGSGNLGDANLGS

SEQ ID NO: 945117 - protein, 28 aa, Mycobacterium
GDTDRVTLFRAWYSRSNFGQLAGAAEIS

SEQ ID NO: 945118 - protein, 26 aa, Mycobacterium
GDTDRVTMFRAWYSRNNFGQLASAAE

SEQ ID NO: 945119 - protein, 24 aa, Mycobacterium
GDTSISLYWYRGSSAQKEASVARN

SEQ ID NO: 945120 - protein, 27 aa, Mycobacterium
GDVAAREFVAFWLDPESRVLAGMNVNI

SEQ ID NO: 945121 - protein, 25 aa, Mycobacterium
GDVETFYTALYRSLLHPNTFNDADG

SEQ ID NO: 945122 - protein, 25 aa, Mycobacterium
GDVLAYAPPTPGLITASWNGTDTLT

SEQ ID NO: 945123 - protein, 24 aa, Mycobacterium
GDVTVKPLFGPAGSANAFGGQLTF

SEQ ID NO: 945124 - protein, 19 aa, Mycobacterium
GDVWGLLVDGRFGDGLTPA

SEQ ID NO: 945125 - protein, 21 aa, Mycobacterium
GEAFVLAEKLGLSAQSLFDVI

SEQ ID NO: 945126 - protein, 24 aa, Mycobacterium
GEAIKDVLLDSAALAKILGQDFTA

SEQ ID NO: 945127 - protein, 22 aa, Mycobacterium
GEALIEPYLAMVQTSHSGVAGS

SEQ ID NO: 945128 - protein, 25 aa, Mycobacterium
GEDHLLRSLAQSLGRIRIYCVGIDR

SEQ ID NO: 945129 - protein, 25 aa, Mycobacterium
GEFARPTPGFLGFRDHHTSPPWTAD

SEQ ID NO: 945130 - protein, 34 aa, Mycobacterium
GEFTGLAPMPTCGFWPVPPTSKPHEISVTGLPPI

SEQ ID NO: 945131 - protein, 23 aa, Mycobacterium
GEGWVRPQLLEYMRTAPDFYFDE

SEQ ID NO: 945132 - protein, 24 aa, Mycobacterium
GEHDELPYFFTDQYDLGMEYVGHA

SEQ ID NO: 945133 - protein, 24 aa, Mycobacterium
GEHLVSWVKAVIYAAAERWTDVID

SEQ ID NO: 945134 - protein, 19 aa, Mycobacterium
GEHVLLTDQLAQGTPVLLC

SEQ ID NO: 945135 - protein, 24 aa, Mycobacterium
GEIDGHLVAILPLADPHAAATDVA

SEQ ID NO: 945136 - protein, 34 aa, Mycobacterium
GEIRTTKRWQVEYGFPICFPSIEVLTIGAGGGSL

SEQ ID NO: 945137 - protein, 21 aa, Mycobacterium
GEIYLNTFRHLYGLECSHIAP

SEQ ID NO: 945138 - protein, 24 aa, Mycobacterium
GEKRSWLRARGLQTFPLVGWAERG

SEQ ID NO: 945139 - protein, 17 aa, Mycobacterium
GELMFYGQGAGGAPTAS

SEQ ID NO: 945140 - protein, 19 aa, Mycobacterium
GELRYRLLLQIGVPGQDPT

SEQ ID NO: 945141 - protein, 18 aa, Mycobacterium
GELVGCYRMLPPPGAIAA

SEQ ID NO: 945142 - protein, 17 aa, Mycobacterium
GENLIVGAVARPNEVTY

SEQ ID NO: 945143 - protein, 29 aa, Mycobacterium
GEPGAPTIQLPIPPGWEPAGPQTPEGAYD

SEQ ID NO: 945144 - protein, 37 aa, Mycobacterium
GEPSSGFSSMLWGGQPLPTINPLYGAKTINLCAADDP

SEQ ID NO: 945145 - protein, 36 aa, Mycobacterium
GEPSSGFSSMLWGGQPLPTLNPLYSSKVINLCAADD

SEQ ID NO: 945146 - protein, 33 aa, Mycobacterium
GEPSSGFSTMLWGGQPLPTINPAYGAKTISLCA

SEQ ID NO: 945147 - protein, 23 aa, Mycobacterium
GEPTGQLWILDATGSQIGQPVDL

SEQ ID NO: 945148 - protein, 27 aa, Mycobacterium
GEQDVVMFYWQQCALLAYEIYALPPDA

SEQ ID NO: 945149 - protein, 22 aa, Mycobacterium
GEQRREIALAGFSALFGAAAAH

SEQ ID NO: 945150 - protein, 18 aa, Mycobacterium
GERQGFWSGSLHADVDGR

SEQ ID NO: 945151 - protein, 22 aa, Mycobacterium
GESSLFVPVLQSALNSAGFADA

SEQ ID NO: 945152 - protein, 17 aa, Mycobacterium
GETAAELSALGLGRVES

SEQ ID NO: 945153 - protein, 36 aa, Mycobacterium
GETFDLARRLAPSARLLVIGPPWPTAEVPDWVLQIR

SEQ ID NO: 945154 - protein, 27 aa, Mycobacterium
GETNDIAVIWPPGRAPIVMAVLTVPED

SEQ ID NO: 945155 - protein, 21 aa, Mycobacterium
GEVAGWLWVITEPSEPDAGRQ

SEQ ID NO: 945156 - protein, 42 aa, Mycobacterium
GEVIVRERGHWFSTGADFKRPSPQWWFDDHTLHGPDGLSLPM

SEQ ID NO: 945157 - protein, 23 aa, Mycobacterium
GEVRQDWRKLYADAFASMDGPEG

SEQ ID NO: 945158 - protein, 18 aa, Mycobacterium
GEYVWTDAKMAYLMVVFS

SEQ ID NO: 945159 - protein, 24 aa, Mycobacterium
GFAGSLSGFLYPSSTNYNGAILAG

SEQ ID NO: 945160 - protein, 25 aa, Mycobacterium
GFATGLRVSLLPILRELGRTHPSVE

SEQ ID NO: 945161 - protein, 19 aa, Mycobacterium
GFDEGNAEQYLWMVPQNIA

SEQ ID NO: 945162 - protein, 17 aa, Mycobacterium
GFDQLLPEDGRIQASLW

SEQ ID NO: 945163 - protein, 17 aa, Mycobacterium
GFFGTSGLVLTGTDGLA

SEQ ID NO: 945164 - protein, 26 aa, Mycobacterium
GFGAVATLWLAALGPGAATARADVRC

SEQ ID NO: 945165 - protein, 26 aa, Mycobacterium
GFGPEVKRRIMIGTYALSAGYYDAYY

SEQ ID NO: 945166 - protein, 20 aa, Mycobacterium
GFGSGEELVFTRDTLRARGV

SEQ ID NO: 945167 - protein, 25 aa, Mycobacterium
GFGTRVAFPGVADYAGTKAAILGYA

SEQ ID NO: 945168 - protein, 27 aa, Mycobacterium
GFGVAPLPGFPFLRGFPIRCSAEETTC

SEQ ID NO: 945169 - protein, 18 aa, Mycobacterium
GFILEISAILDLVNAIEP

SEQ ID NO: 945170 - protein, 21 aa, Mycobacterium
GFKIAAASFGAAGALAMAVVG

SEQ ID NO: 945171 - protein, 24 aa, Mycobacterium
GFLARGPKGVTIPLGTPGGGVTFN

SEQ ID NO: 945172 - protein, 19 aa, Mycobacterium
GFLLAPWTAEQIVSELAPV

SEQ ID NO: 945173 - protein, 19 aa, Mycobacterium
GFLLAPWTAEQIVSELVPI

SEQ ID NO: 945174 - protein, 27 aa, Mycobacterium
GFLNPSEGWWPFLINISMGDAGGYKAN

SEQ ID NO: 945175 - protein, 17 aa, Mycobacterium
GFLQVAAATGLLASGVA

SEQ ID NO: 945176 - protein, 17 aa, Mycobacterium
GFLQVAGATGLVAAGIS

SEQ ID NO: 945177 - protein, 18 aa, Mycobacterium
GFLSGIAELRQAFPGGIV

SEQ ID NO: 945178 - protein, 25 aa, Mycobacterium
GFNEHSWGIALIGDFTRDEPSPAML

SEQ ID NO: 945179 - protein, 26 aa, Mycobacterium
GFNEKQRFFLNYARIWRDKQRPEDAI

SEQ ID NO: 945180 - protein, 24 aa, Mycobacterium
GFNQAILAVILASLSVSAVLGWHL

SEQ ID NO: 945181 - protein, 26 aa, Mycobacterium
GFNSGFINTGYFNSGPLNTGLANSGG

SEQ ID NO: 945182 - protein, 26 aa, Mycobacterium
GFNTVRVFLHDLLWAQDRAGFQNRLA

SEQ ID NO: 945183 - protein, 18 aa, Mycobacterium
GFPGYANYFPVTRAVPEP

SEQ ID NO: 945184 - protein, 18 aa, Mycobacterium
GFPNLFMLNGPNGPVGNF

SEQ ID NO: 945185 - protein, 34 aa, Mycobacterium
GFQTSLPTAWLAEGLLPFLPAAAQHALFTAIDAN

SEQ ID NO: 945186 - protein, 18 aa, Mycobacterium
GFRRAWAHLKHDQGVLVN

SEQ ID NO: 945187 - protein, 19 aa, Mycobacterium
GFRVPCIVVSPFSRGGLMV

SEQ ID NO: 945188 - protein, 18 aa, Mycobacterium
GFRVSAPAPAPAAPPAAP

SEQ ID NO: 945189 - protein, 17 aa, Mycobacterium
GFSAPYNMEQFVSGIIG

SEQ ID NO: 945190 - protein, 19 aa, Mycobacterium
GFTGLLQTGQSLAGNLVGS

SEQ ID NO: 945191 - protein, 22 aa, Mycobacterium
GFTGVTLWLDPGSDTYVVVLAN

SEQ ID NO: 945192 - protein, 22 aa, Mycobacterium
GFTNTGFFNSGDLNTGMGSPED

SEQ ID NO: 945193 - protein, 23 aa, Mycobacterium
GFVATFLVLTFTIGAVQADPAAD

SEQ ID NO: 945194 - protein, 21 aa, Mycobacterium
GFVPRLISIARERGVSGYPGD

SEQ ID NO: 945195 - protein, 22 aa, Mycobacterium
GFVQTILQPGVITDLPLANMAL

SEQ ID NO: 945196 - protein, 23 aa, Mycobacterium
GGADALALGIRFARTLGAELEIC

SEQ ID NO: 945197 - protein, 25 aa, Mycobacterium
GGAGGAGGLLLGNGGAGGAGGVGAL

SEQ ID NO: 945198 - protein, 24 aa, Mycobacterium
GGAGGRGGWLLGDGGNGGAGGDGA

SEQ ID NO: 945199 - protein, 25 aa, Mycobacterium
GGAGYLGGIGGAGGNGGWLYGNGGA

SEQ ID NO: 945200 - protein, 35 aa, Mycobacterium
GGAGYTDRLVPALSAAFEAMFSYPGPTVAAVNGAA

SEQ ID NO: 945201 - protein, 17 aa, Mycobacterium
GGAIQVDIDPTWARAHP

SEQ ID NO: 945202 - protein, 23 aa, Mycobacterium
GGALRPMRPAFSVGLGARLGSGR

SEQ ID NO: 945203 - protein, 35 aa, Mycobacterium
GGAPAAPSQPPLLWVVLAWVRRELQRTFANSTPTT

SEQ ID NO: 945204 - protein, 33 aa, Mycobacterium
GGAPDDFRWPFNIPGYWMTPMFTLAVGGVGAGD

SEQ ID NO: 945205 - protein, 34 aa, Mycobacterium; identical to SEQ ID NO: 126783

SEQ ID NO: 945206 - protein, 23 aa, Mycobacterium
GGAPLTVRIGYQGPNARLAVNVG

SEQ ID NO: 945207 - protein, 19 aa, Mycobacterium
GGAPPPVPMQAPRAMEAAV

SEQ ID NO: 945208 - protein, 26 aa, Mycobacterium
GGARRWDGVWDPTLPMIPSANVPGDP

SEQ ID NO: 945209 - protein, 28 aa, Mycobacterium
GGATVDEYGFNPGPPYGADGQAGAMGAT

SEQ ID NO: 945210 - protein, 25 aa, Mycobacterium
GGAVYGARLAPIPPALSATDGDCPT

SEQ ID NO: 945211 - protein, 24 aa, Mycobacterium
GGAWDPLLPMRPSAGAPGDALAIA

SEQ ID NO: 945212 - protein, 20 aa, Mycobacterium
GGAYLIGNGGWGGVGGAGDG

SEQ ID NO: 945213 - protein, 34 aa, Mycobacterium
GGCEPPIAVPYIAQFWPIPLPGWGGLEGAKWNVS

SEQ ID NO: 945214 - protein, 23 aa, Mycobacterium
GGDAGAIGLFGNGAAGGDGGIGG

SEQ ID NO: 945215 - protein, 31 aa, Mycobacterium
GGDAGEIAYPYYLINGRIPAAPMTFSAKPGQ

SEQ ID NO: 945216 - protein, 22 aa, Mycobacterium
GGDAQFLGFGGTGGSGGGIGAG

SEQ ID NO: 945217 - protein, 20 aa, Mycobacterium
GGDGGLNYYGDGGVAGAGGD

SEQ ID NO: 945218 - protein, 23 aa, Mycobacterium
GGDLRLALTAFPPNFNILHIDGN

SEQ ID NO: 945219 - protein, 17 aa, Mycobacterium
GGDPYLRRPGCAAPAKF

SEQ ID NO: 945220 - protein, 21 aa, Mycobacterium
GGELDWSALGALPAWEAGAPH

SEQ ID NO: 945221 - protein, 31 aa, Mycobacterium
GGELLVYGVDPLILRQRYPVPDAPYGLAGST

SEQ ID NO: 945222 - protein, 23 aa, Mycobacterium
GGERLVFWDCYRPHAVQARMFEV

SEQ ID NO: 945223 - protein, 17 aa, Mycobacterium
GGFIPLSRTSPALDLDA

SEQ ID NO: 945224 - protein, 23 aa, Mycobacterium
GGFNHNTWGVAMLGNFEAVPPTP

SEQ ID NO: 945225 - protein, 18 aa, Mycobacterium
GGFTAWRPALPVTQWSVV

SEQ ID NO: 945226 - protein, 18 aa, Mycobacterium
GGGAALIGFGGAGGTGGT

SEQ ID NO: 945227 - protein, 18 aa, Mycobacterium
GGGAPLAGFVGTSGGNGG

SEQ ID NO: 945228 - protein, 24 aa, Mycobacterium
GGGDLLTALLGKKIAAGTTGLGEF

SEQ ID NO: 945229 - protein, 26 aa, Mycobacterium
GGGFIGKWLKRMLSSARKTGSGGGPP

SEQ ID NO: 945230 - protein, 24 aa, Mycobacterium
GGGFTYTPPALWDPQAQGAAFRHR

SEQ ID NO: 945231 - protein, 24 aa, Mycobacterium
GGGGRKGLPPHLGITYEGTLVNDC

SEQ ID NO: 945232 - protein, 24 aa, Mycobacterium
GGGGYLLNAVFSNALNLPAHAKVK

SEQ ID NO: 945233 - protein, 26 aa, Mycobacterium
GGGLLAACAPWRPPSARPPPPDTLPD

SEQ ID NO: 945234 - protein, 21 aa, Mycobacterium
GGGPHAVYLLDGLRAQDDYNG

SEQ ID NO: 945235 - protein, 17 aa, Mycobacterium
GGGPKAVYLLDGLRAQD

SEQ ID NO: 945236 - protein, 22 aa, Mycobacterium
GGGPRAVYLLDGLRARDDNSGW

SEQ ID NO: 945237 - protein, 20 aa, Mycobacterium
GGGSALPYKRRLFGQIVAAA

SEQ ID NO: 945238 - protein, 28 aa, Mycobacterium
GGHYPTARLVVFLLRGNFDPADVARRGN

SEQ ID NO: 945239 - protein, 17 aa, Mycobacterium
GGIAKLIDPAIVDEAFA

SEQ ID NO: 945240 - protein, 27 aa, Mycobacterium
GGIDRTYLLHVPPGSPVGLVLSLHGGG

SEQ ID NO: 945241 - protein, 24 aa, Mycobacterium
GGIGMLRTLPPADGDVRRWMRRTA

SEQ ID NO: 945242 - protein, 25 aa, Mycobacterium
GGIKGFFEKTFAPLGLKKIQAEVLA

SEQ ID NO: 945243 - protein, 30 aa, Mycobacterium
GGILSRFPGFYIPFLDVPFNGATPPNSPYA

SEQ ID NO: 945244 - protein, 19 aa, Mycobacterium
GGIPTGWKIARPPGVDWPV

SEQ ID NO: 945245 - protein, 21 aa, Mycobacterium
GGISVFALSFVVAGCGSDTTA

SEQ ID NO: 945246 - protein, 22 aa, Mycobacterium
GGKSISLWTPSGVYTVLDKGNP

SEQ ID NO: 945247 - protein, 21 aa, Mycobacterium
GGKTFPLPNPFLVMATQNPIE

SEQ ID NO: 945248 - protein, 20 aa, Mycobacterium
GGLAGIAWETGVLLGIADES

SEQ ID NO: 945249 - protein, 21 aa, Mycobacterium
GGLAGIAWETGVLLGILEEAP

SEQ ID NO: 945250 - protein, 27 aa, Mycobacterium
GGLGGVGGPGGWIFGTGGAGGNGGLGG

SEQ ID NO: 945251 - protein, 26 aa, Mycobacterium
GGLKRTYILHVPPGPPTGLVLNLHGG

SEQ ID NO: 945252 - protein, 23 aa, Mycobacterium
GGLLRHFPEGFRLPGFGVTVVET

SEQ ID NO: 945253 - protein, 24 aa, Mycobacterium
GGLPAGFGPILRLARDEKWEELTE

SEQ ID NO: 945254 - protein, 17 aa, Mycobacterium
GGLPLQFPPEITDDAQM

SEQ ID NO: 945255 - protein, 23 aa, Mycobacterium
GGLSAYLGEWWHFDGPGAGTDLP

SEQ ID NO: 945256 - protein, 17 aa, Mycobacterium
GGLVWKFTSGGDDDTDA

SEQ ID NO: 945257 - protein, 20 aa, Mycobacterium
GGMKAFVAPFAPQALRAALD

SEQ ID NO: 945258 - protein, 23 aa, Mycobacterium
GGNAGLVINGTYEASPYGNGGNG

SEQ ID NO: 945259 - protein, 26 aa, Mycobacterium
GGNGGAGGLLFGKGGAGGAGGVGGLG

SEQ ID NO: 945260 - protein, 26 aa, Mycobacterium
GGNGGAGGLLFGNGGAGGVGGAGGVG

SEQ ID NO: 945261 - protein, 24 aa, Mycobacterium
GGNGGIGYYDAQNALGGNGGDGGI

SEQ ID NO: 945262 - protein, 19 aa, Mycobacterium
GGNPLPQYFQSRPSAAGAG

SEQ ID NO: 945263 - protein, 20 aa, Mycobacterium
GGNWVLQHDAAIALIQAATA

SEQ ID NO: 945264 - protein, 17 aa, Mycobacterium
GGNYWWSGDDHSATFNS

SEQ ID NO: 945265 - protein, 24 aa, Mycobacterium
GGPGSGVYALFSNSTNLGSAFSST

SEQ ID NO: 945266 - protein, 20 aa, Mycobacterium
GGPHAVYLLDGLRAQEDYNG

SEQ ID NO: 945267 - protein, 21 aa, Mycobacterium
GGPLIHAQPTLRGYMGGLPAS

SEQ ID NO: 945268 - protein, 19 aa, Mycobacterium
GGPPIVRLSGHIATVAARM

SEQ ID NO: 945269 - protein, 25 aa, Mycobacterium
GGPRFVRMTPPGFALTPGPAAELPF

SEQ ID NO: 945270 - protein, 19 aa, Mycobacterium
GGRNPLPQGVPPPAGDPVP

SEQ ID NO: 945271 - protein, 25 aa, Mycobacterium
GGRRAVWSIWGIDNAILLGDALQTA

SEQ ID NO: 945272 - protein, 24 aa, Mycobacterium
GGRVSRLKDLIGPAPSARELAATQ

SEQ ID NO: 945273 - protein, 23 aa, Mycobacterium
GGSAESLFFSIGGAGGAGGDAST

SEQ ID NO: 945274 - protein, 25 aa, Mycobacterium
GGSALIMAAYYPQQFPYAASLSGFL

SEQ ID NO: 945275 - protein, 17 aa, Mycobacterium
GGSALVLAAYYPQQFPY

SEQ ID NO: 945276 - protein, 29 aa, Mycobacterium
GGSGPNAFDCSGLVMWAYGQQGVSLPHSS

SEQ ID NO: 945277 - protein, 26 aa, Mycobacterium
GGSILGPHFSFSWFRGSPIGRERKTM

SEQ ID NO: 945278 - protein, 25 aa, Mycobacterium
GGSPLADFLALIYNESRSEAATWLR

SEQ ID NO: 945279 - protein, 25 aa, Mycobacterium
GGSVKPPNLDWLRNSPTASSTAVTT

SEQ ID NO: 945280 - protein, 17 aa, Mycobacterium
GGTFFLVQSVLPYMREA

SEQ ID NO: 945281 - protein, 24 aa, Mycobacterium
GGTFVISWEFHLADGRWTHSGTSQ

SEQ ID NO: 945282 - protein, 25 aa, Mycobacterium
GGTGGAGGLLFGLGGAGGNAPVFGG

SEQ ID NO: 945283 - protein, 24 aa, Mycobacterium
GGTGGLGGWLWGQAGAAGTGTPLP

SEQ ID NO: 945284 - protein, 20 aa, Mycobacterium
GGTGGVLFGAGGDGGSGGAG

SEQ ID NO: 945285 - protein, 17 aa, Mycobacterium
GGTLDNLAPIAGALLQK

SEQ ID NO: 945286 - protein, 23 aa, Mycobacterium
GGTLPNRLYWMSATIDPAGTNGG

SEQ ID NO: 945287 - protein, 19 aa, Mycobacterium
GGTLTFSLAAYPDKRWGTS

SEQ ID NO: 945288 - protein, 27 aa, Mycobacterium
GGTTTLTVRVPIAPTGYVNQAPTDGKY

SEQ ID NO: 945289 - protein, 27 aa, Mycobacterium
GGTYMVVRLIRMMVEFWDRVSINEQER

SEQ ID NO: 945290 - protein, 19 aa, Mycobacterium
GGVAYTVGLYAQSIDGRNG

SEQ ID NO: 945291 - protein, 18 aa, Mycobacterium
GGVIGLSVARRAALDGWT

SEQ ID NO: 945292 - protein, 25 aa, Mycobacterium
GGVKGFFEKTFAPLGLKKIQGEVLA

SEQ ID NO: 945293 - protein, 27 aa, Mycobacterium
GGVKGFFEKTFAPLGLKRIQGEVLANL

SEQ ID NO: 945294 - protein, 28 aa, Mycobacterium
GGVKGFFEKTFAPLGLKRIQGEVLANLK

SEQ ID NO: 945295 - protein, 26 aa, Mycobacterium
GGVKGFFEKTFAPLGLRRIQDEVLEN

SEQ ID NO: 945296 - protein, 25 aa, Mycobacterium
GGVLLATGRLPRLASAALALTVIPG

SEQ ID NO: 945297 - protein, 18 aa, Mycobacterium
GGVLLRPFARLIASTGDS

SEQ ID NO: 945298 - protein, 23 aa, Mycobacterium
GGVPVPLAHLLAPQFRAAPEGMF

SEQ ID NO: 945299 - protein, 30 aa, Mycobacterium
GGVQRSYRLYKPAGLPRAAPLVVMLHGGFG

SEQ ID NO: 945300 - protein, 21 aa, Mycobacterium
GGVSFWAYRQSEASPPIVFSN

SEQ ID NO: 945301 - protein, 25 aa, Mycobacterium
GGVVLRYGLIYGPGTYFERQLPPTP

SEQ ID NO: 945302 - protein, 24 aa, Mycobacterium
GGVYIKVPMPYRRSMRISVASHLE

SEQ ID NO: 945303 - protein, 22 aa, Mycobacterium
GGYAAIVGGWGGDGGAGGDGGG

SEQ ID NO: 945304 - protein, 18 aa, Mycobacterium
GGYSTWLISSTTATPFNT

SEQ ID NO: 945305 - protein, 22 aa, Mycobacterium
GGYTLTAVFSNALNLPAMAKVK

SEQ ID NO: 945306 - protein, 19 aa, Mycobacterium
GHALDIPVYGVCSLDAIGG

SEQ ID NO: 945307 - protein, 17 aa, Mycobacterium
GHAPSQDQILAALGSSA

SEQ ID NO: 945308 - protein, 29 aa, Mycobacterium
GHCIPCDPHYLLWQLRARRFDSPLMRTAM

SEQ ID NO: 945309 - protein, 19 aa, Mycobacterium
GHEVVGVHLALSAAPGTLR

SEQ ID NO: 945310 - protein, 21 aa, Mycobacterium
GHGGGTGLFGAGGAGGTGGIS

SEQ ID NO: 945311 - protein, 22 aa, Mycobacterium
GHGGGTGLFGAGGAGGTGGISG

SEQ ID NO: 945312 - protein, 20 aa, Mycobacterium
GHHPGDVVSISWLSKSGVAR

SEQ ID NO: 945313 - protein, 20 aa, Mycobacterium
GHLDIGHRTIPNYGGFDLGV

SEQ ID NO: 945314 - protein, 18 aa, Mycobacterium
GHMPGMVDAPVLDRMKTL

SEQ ID NO: 945315 - protein, 29 aa, Mycobacterium
GHQPGAYTYILGFWMRPRRVLDAAGTGAM

SEQ ID NO: 945316 - protein, 28 aa, Mycobacterium
GHRAAQYWVLKPTYHNSFWYSSCMVTFK

SEQ ID NO: 945317 - protein, 23 aa, Mycobacterium
GHRALNLIFSLAGGAVPCTLTGY

SEQ ID NO: 945318 - protein, 25 aa, Mycobacterium
GHSKDFVQVLKWLNQPLDAAISVMD

SEQ ID NO: 945319 - protein, 19 aa, Mycobacterium
GHSLSRPTWSLDDVVWVVV

SEQ ID NO: 945320 - protein, 23 aa, Mycobacterium
GHTLERFFPGIGPIGEKILPGLG

SEQ ID NO: 945321 - protein, 27 aa, Mycobacterium
GHTVGTVGSIPFALTDSVTPLAGGMVQ

SEQ ID NO: 945322 - protein, 21 aa, Mycobacterium
GHVARIERQGWHALVTIRLDA

SEQ ID NO: 945323 - protein, 31 aa, Mycobacterium
GHVHHNAMKAMRFGAYSSLPHETVERIAHAW

SEQ ID NO: 945324 - protein, 29 aa, Mycobacterium
GHVHHNAMRAMRFGAHSSLPHATVETIAR

SEQ ID NO: 945325 - protein, 18 aa, Mycobacterium
GHWARRMTVAAVAALLLP

SEQ ID NO: 945326 - protein, 17 aa, Mycobacterium
GHWRIPGVLTLTAYLRD

SEQ ID NO: 945327 - protein, 20 aa, Mycobacterium
GHYPVLWQVATDQGLPATTL

SEQ ID NO: 945328 - protein, 17 aa, Mycobacterium
GHYVALSIVGCDALPDS

SEQ ID NO: 945329 - protein, 23 aa, Mycobacterium
GIALDRNYWPYIGAKAGGLPGDL

SEQ ID NO: 945330 - protein, 27 aa, Mycobacterium
GIATFPDLPALLATPLGAAGSPSLLSG

SEQ ID NO: 945331 - protein, 19 aa, Mycobacterium
GIDLDRAEWPYIGAKAGNL

SEQ ID NO: 945332 - protein, 29 aa, Mycobacterium
GIDLPWTTAQIRDTIFAHFGHILAPAMQR

SEQ ID NO: 945333 - protein, 23 aa, Mycobacterium
GIDLTFTNWRGVLAPPGISEEDR

SEQ ID NO: 945334 - protein, 24 aa, Mycobacterium
GIDMTFTNWRGVLAPPGISDDARD

SEQ ID NO: 945335 - protein, 23 aa, Mycobacterium
GIDQLSVYILDKQQGPFTITLRA

SEQ ID NO: 945336 - protein, 17 aa, Mycobacterium
GIENLWVVDGSILPLIP

SEQ ID NO: 945337 - protein, 18 aa, Mycobacterium
GIERTLAGYLNLAGKRPA

SEQ ID NO: 945338 - protein, 26 aa, Mycobacterium
GIFIGSWTDLSIFKGPLADIAAKAGP

SEQ ID NO: 945339 - protein, 23 aa, Mycobacterium
GIGGGLLGLIGTGETLASSLAGG

SEQ ID NO: 945340 - protein, 18 aa, Mycobacterium
GIGPHQVWWLSELTADPA

SEQ ID NO: 945341 - protein, 21 aa, Mycobacterium
GIGRHMHMDPFLPNEGSPGRG

SEQ ID NO: 945342 - protein, 18 aa, Mycobacterium
GIGTVKFEIGPDGKLKTL

SEQ ID NO: 945343 - protein, 18 aa, Mycobacterium
GIGTVKFRIGPDGKLQTV

SEQ ID NO: 945344 - protein, 25 aa, Mycobacterium
GIKEFAPLLGVRKAGLFTSSSFVLG

SEQ ID NO: 945345 - protein, 30 aa, Mycobacterium
GIKSVDLLNRFLGLGLRFISAGTDVGMMTE

SEQ ID NO: 945346 - protein, 20 aa, Mycobacterium
GILAALYRREITGEGAVIEV

SEQ ID NO: 945347 - protein, 26 aa, Mycobacterium
GILPAQVFFQPYRPGATYTATGRGCA

SEQ ID NO: 945348 - protein, 19 aa, Mycobacterium
GILPQVKVPVLLALGDDDL

SEQ ID NO: 945349 - protein, 26 aa, Mycobacterium
GILSSALAHTGGLNPALAGGLTPTAA

SEQ ID NO: 945350 - protein, 19 aa, Mycobacterium
GINATDLNWQQAALLAGMV

SEQ ID NO: 945351 - protein, 23 aa, Mycobacterium
GINPGFMSGFVNSSGTFISGFFN

SEQ ID NO: 945352 - protein, 23 aa, Mycobacterium
GIPMPSRRYVQLANSLYIGRSVG

SEQ ID NO: 945353 - protein, 24 aa, Mycobacterium
GIPPAPPPAPASPSPAPSAGGHAA

SEQ ID NO: 945354 - protein, 22 aa, Mycobacterium
GIPPAPPPPPEGAPPPVGSQVV

SEQ ID NO: 945355 - protein, 17 aa, Mycobacterium
GIPSVNLYLTTSSRIDL

SEQ ID NO: 945356 - protein, 24 aa, Mycobacterium
GIRGTWVFDVPASTTSLKLLAIIF

SEQ ID NO: 945357 - protein, 18 aa, Mycobacterium
GISIVSTGTARSAATTGS

SEQ ID NO: 945358 - protein, 20 aa, Mycobacterium
GISLPNIPVSVPPLSDKDIE

SEQ ID NO: 945359 - protein, 17 aa, Mycobacterium
GISRARRLTWMSAAALL

SEQ ID NO: 945360 - protein, 26 aa, Mycobacterium
GISRKLIVQFTEPGTYQTACKPGMIG

SEQ ID NO: 945361 - protein, 18 aa, Mycobacterium
GITRNRFPWLDRGAYRGY

SEQ ID NO: 945362 - protein, 34 aa, Mycobacterium
GIVRHLLVDPVLPDDLLPASWPGAALRAAYNDFA

SEQ ID NO: 945363 - protein, 22 aa, Mycobacterium
GIVVTPQPEMLPTDPHFAPAVV

SEQ ID NO: 945364 - protein, 27 aa, Mycobacterium
GIYGDFFNFYACDLTLKLNGLQPGGPV

SEQ ID NO: 945365 - protein, 25 aa, Mycobacterium
GIYSRDITYPINSPLAITMGFAVHE

SEQ ID NO: 945366 - protein, 24 aa, Mycobacterium
GKAAFEINWPFVMASMMENAIKGG

SEQ ID NO: 945367 - protein, 22 aa, Mycobacterium
GKAWAWQTRSWSKGKIHPAAVL

SEQ ID NO: 945368 - protein, 24 aa, Mycobacterium
GKDNVGILAGYFRDPHDYEPEEIE

SEQ ID NO: 945369 - protein, 24 aa, Mycobacterium
GKKALLMQGTLWQGTVVATMAGWR

SEQ ID NO: 945370 - protein, 22 aa, Mycobacterium
GKMVHVTLRCYKAEVAAAKKAA

SEQ ID NO: 945371 - protein, 18 aa, Mycobacterium
GKPESLVFRWLVSLCSRC

SEQ ID NO: 945372 - protein, 32 aa, Mycobacterium
GKPGDPRYPYRPPLPQPPPGGPPPGPPAGYEP

SEQ ID NO: 945373 - protein, 17 aa, Mycobacterium
GKPPTPLWPDAVGEMCI

SEQ ID NO: 945374 - protein, 19 aa, Mycobacterium
GKQLHMAGIITSAGPDPVL

SEQ ID NO: 945375 - protein, 26 aa, Mycobacterium
GKRDVMMVHTLLWPDEIRDPDFPVLD

SEQ ID NO: 945376 - protein, 24 aa, Mycobacterium
GKRLQLVDILKPGLGLDAITPLAE

SEQ ID NO: 945377 - protein, 19 aa, Mycobacterium
GKRRVGLLGLAFKSGTDDL

SEQ ID NO: 945378 - protein, 25 aa, Mycobacterium
GKSLAYLVPAIVRAVGDDGPVVVST

SEQ ID NO: 945379 - protein, 23 aa, Mycobacterium
GKTIPLDAHIRLANPRTGDTDNQ

SEQ ID NO: 945380 - protein, 29 aa, Mycobacterium
GKTIPVIRVIGYRAGLPPAARSAPLSGMA

SEQ ID NO: 945381 - protein, 26 aa, Mycobacterium
GKTTALLVMGLLLTPVSGLVRIGGRD

SEQ ID NO: 945382 - protein, 26 aa, Mycobacterium
GKVKWSVPLGFLAQTPPTVTPEGLIV

SEQ ID NO: 945383 - protein, 32 aa, Mycobacterium
GKVVWTSSMGGILVIPFVGVYCATKHAIEAIA

SEQ ID NO: 945384 - protein, 22 aa, Mycobacterium
GKYGCYWARLRSFDTNDIIDNN

SEQ ID NO: 945385 - protein, 19 aa, Mycobacterium
GKYSLVRYAAVKSGTSMAA

SEQ ID NO: 945386 - protein, 31 aa, Mycobacterium
GLAAALAAHRRGLRVVLLSKAAETATFYAQG

SEQ ID NO: 945387 - protein, 21 aa, Mycobacterium
GLAALGGWFGYQTYQSHQAQQ

SEQ ID NO: 945388 - protein, 23 aa, Mycobacterium
GLAALLALSFLAGVATVWHSSTA

SEQ ID NO: 945389 - protein, 21 aa, Mycobacterium
GLADLPLPAPGLGAGGYRLTA

SEQ ID NO: 945390 - protein, 25 aa, Mycobacterium
GLADNGYIPIPDAFKARLSSSINAI

SEQ ID NO: 945391 - protein, 25 aa, Mycobacterium
GLADNGYIPIPDSFKSRLSASINAI

SEQ ID NO: 945392 - protein, 25 aa, Mycobacterium
GLADNGYIPVPASFKSRLLAAVDAI

SEQ ID NO: 945393 - protein, 21 aa, Mycobacterium
GLADVGYAPLPAQFKSRLETA

SEQ ID NO: 945394 - protein, 17 aa, Mycobacterium
GLAGLVITPGYDLRYLV

SEQ ID NO: 945395 - protein, 22 aa, Mycobacterium
GLAGTVLRFVPPLAALAESIVE

SEQ ID NO: 945396 - protein, 19 aa, Mycobacterium
GLARIFRVAHRRPALCRLA

SEQ ID NO: 945397 - protein, 25 aa, Mycobacterium
GLASLPLPAPGIGGGGYLLNAVFSN

SEQ ID NO: 945398 - protein, 23 aa, Mycobacterium
GLASLPLPAPGLGSGGYSLNAVF

SEQ ID NO: 945399 - protein, 24 aa, Mycobacterium
GLASLPLPAPGMTGGSYGLTAVFT

SEQ ID NO: 945400 - protein, 21 aa, Mycobacterium
GLAVLDLYAGSGALGLEALSR

SEQ ID NO: 945401 - protein, 19 aa, Mycobacterium
GLAVTAALGLSFATATTAS

SEQ ID NO: 945402 - protein, 17 aa, Mycobacterium
GLCQVFANEKWHYELTA

SEQ ID NO: 945403 - protein, 22 aa, Mycobacterium
GLDARAYRLDWPAGTVVYEVDM

SEQ ID NO: 945404 - protein, 25 aa, Mycobacterium
GLDEYGYIPLPESFRSKLIPVVNAI

SEQ ID NO: 945405 - protein, 17 aa, Mycobacterium
GLDLQWRGPAAQAMAFA

SEQ ID NO: 945406 - protein, 27 aa, Mycobacterium
GLDLRRALRAVWLGTRTPPAGAARDLL

SEQ ID NO: 945407 - protein, 22 aa, Mycobacterium
GLDQYGSIPLPSSFTAKLSGAV

SEQ ID NO: 945408 - protein, 25 aa, Mycobacterium
GLEIFADMILAFPKDVPPPSVQQMN

SEQ ID NO: 945409 - protein, 26 aa, Mycobacterium
GLESLRLWHEQFLGSLPAQVVTARES

SEQ ID NO: 945410 - protein, 26 aa, Mycobacterium
GLESLRLWHESGFLDGLPPQVVTARE

SEQ ID NO: 945411 - protein, 26 aa, Mycobacterium
GLESLRLWREGGFLDGLPPQVITARE

SEQ ID NO: 945412 - protein, 20 aa, Mycobacterium
GLFGLMIPEQYGGLGESLLT

SEQ ID NO: 945413 - protein, 18 aa, Mycobacterium
GLFVPLIAASPTAYDGEP

SEQ ID NO: 945414 - protein, 19 aa, Mycobacterium
GLGGWLDRSLTAAGVHTET

SEQ ID NO: 945415 - protein, 17 aa, Mycobacterium
GLGGYIPNSSNWVRPRS

SEQ ID NO: 945416 - protein, 29 aa, Mycobacterium
GLGNMGFPMMGRLLSAGHPVVVFDTDPAA

SEQ ID NO: 945417 - protein, 29 aa, Mycobacterium
GLGQFNSLLSPFMSFMNPGMFGGGTASTL

SEQ ID NO: 945418 - protein, 19 aa, Mycobacterium
GLGRLAFGALFSEPRQLVE

SEQ ID NO: 945419 - protein, 20 aa, Mycobacterium
GLGRSGFLLAPWTAEQIVSE

SEQ ID NO: 945420 - protein, 18 aa, Mycobacterium
GLGSTEELVFAYDGMRSK

SEQ ID NO: 945421 - protein, 37 aa, Mycobacterium
GLHGPKRYNWHQLVGSLRYTLLRLQERVVGKGPGVPQ

SEQ ID NO: 945422 - protein, 30 aa, Mycobacterium
GLHIWTRAKINPLLWRLLASPRITGLLEGV

SEQ ID NO: 945423 - protein, 29 aa, Mycobacterium
GLHVHGLLGWLQFVPILGSFLNPGGGHGI

SEQ ID NO: 945424 - protein, 18 aa, Mycobacterium
GLIDITRFWFEQGSLGNE

SEQ ID NO: 945425 - protein, 18 aa, Mycobacterium
GLIGTALVYALRATDHRV

SEQ ID NO: 945426 - protein, 20 aa, Mycobacterium
GLKLLLPGFTEQLNDPGPAA

SEQ ID NO: 945427 - protein, 19 aa, Mycobacterium
GLKPGQPYTTRQLLDALLM

SEQ ID NO: 945428 - protein, 23 aa, Mycobacterium
GLLAAALMFPFVGGAGTVVMRVS

SEQ ID NO: 945429 - protein, 40 aa, Mycobacterium
GLLATLWRARLIAPMRPDRYLRMGLAMRRAGLTATVGFAA

SEQ ID NO: 945430 - protein, 18 aa, Mycobacterium
GLLGDRLLDDRAWVAAQR

SEQ ID NO: 945431 - protein, 35 aa, Mycobacterium
GLLHRAASPAVWLNPLRWSPMMRAATGTLAVDEDA

SEQ ID NO: 945432 - protein, 17 aa, Mycobacterium
GLLLGAAAVFGLTLSVE

SEQ ID NO: 945433 - protein, 17 aa, Mycobacterium
GLLPSWTPGAHIDVRLP

SEQ ID NO: 945434 - protein, 18 aa, Mycobacterium
GLLRDFILNGWSTPDVVS

SEQ ID NO: 945435 - protein, 22 aa, Mycobacterium
GLLRRIFTVAGIFDRYELLLID

SEQ ID NO: 945436 - protein, 31 aa, Mycobacterium
GLLRRREAHPTMWIRLWFSDGEKLHQRAYTL

SEQ ID NO: 945437 - protein, 21 aa, Mycobacterium
GLLSGAPRTFASNTLVIVTAP

SEQ ID NO: 945438 - protein, 22 aa, Mycobacterium
GLLVDIWIDTVPRGYRIASGRS

SEQ ID NO: 945439 - protein, 17 aa, Mycobacterium
GLLVGIFNSVWGEFPAA

SEQ ID NO: 945440 - protein, 20 aa, Mycobacterium
GLMIAALPFMPGVGANTLMP

SEQ ID NO: 945441 - protein, 19 aa, Mycobacterium
GLMMFPTTVAVTSAEPNDM

SEQ ID NO: 945442 - protein, 21 aa, Mycobacterium
GLMRYAFAGVGVLIPRFSGDQ

SEQ ID NO: 945443 - protein, 22 aa, Mycobacterium
GLMRYAFAGVGVLIPRYSGDQY

SEQ ID NO: 945444 - protein, 20 aa, Mycobacterium
GLMTALSPHFGGKILNLCNT

SEQ ID NO: 945445 - protein, 20 aa, Mycobacterium
GLNLAQYPSILVELGNMKSP

SEQ ID NO: 945446 - protein, 18 aa, Mycobacterium
GLNLDPPRELPPEFEVMY

SEQ ID NO: 945447 - protein, 27 aa, Mycobacterium
GLNTVRVFLHDLLWVQDRAGFQRRLAR

SEQ ID NO: 945448 - protein, 22 aa, Mycobacterium
GLPAPVAGLGAPGGPLSAEGPL

SEQ ID NO: 945449 - protein, 23 aa, Mycobacterium
GLPATTGLFPPGSTFKMVTAGAA

SEQ ID NO: 945450 - protein, 22 aa, Mycobacterium
GLPGDLTFSWYAVDKTRQPWVV

SEQ ID NO: 945451 - protein, 21 aa, Mycobacterium
GLPGDLTFSWYAVDKTRQPYV

SEQ ID NO: 945452 - protein, 17 aa, Mycobacterium
GLPGIAVAGVLAALLSG

SEQ ID NO: 945453 - protein, 24 aa, Mycobacterium
GLPGLPGMPDIEIPNLPLPTRNTD

SEQ ID NO: 945454 - protein, 22 aa, Mycobacterium
GLPITPAWPKVHALMDRNFGPV

SEQ ID NO: 945455 - protein, 19 aa, Mycobacterium
GLPNLFTISGPGSPSVLAN

SEQ ID NO: 945456 - protein, 20 aa, Mycobacterium
GLPTLLRASPAWARLMRDVI

SEQ ID NO: 945457 - protein, 37 aa, Mycobacterium
GLPVDAPPSLLAAGGLPYFLGGAPVPLLSLAQIVDVD

SEQ ID NO: 945458 - protein, 30 aa, Mycobacterium
GLPVGDLEFIQFHPTMLYAGAGIGRRPLIT

SEQ ID NO: 945459 - protein, 23 aa, Mycobacterium
GLPVLEVPASTPFIAIARVVIDA

SEQ ID NO: 945460 - protein, 21 aa, Mycobacterium
GLQPAAPLPVAPPATPGPQPG

SEQ ID NO: 945461 - protein, 17 aa, Mycobacterium
GLQVFRFKPMTPNGAMN

SEQ ID NO: 945462 - protein, 23 aa, Mycobacterium
GLRAAAVLLAVLVSITGCSRSIS

SEQ ID NO: 945463 - protein, 25 aa, Mycobacterium
GLRETIDWYRANESWWRPLKDASEA

SEQ ID NO: 945464 - protein, 19 aa, Mycobacterium
GLRHIPIERRELWASRLDE

SEQ ID NO: 945465 - protein, 22 aa, Mycobacterium
GLRIHLGVPEWPQPDPHQTAPG

SEQ ID NO: 945466 - protein, 17 aa, Mycobacterium
GLRLVKVETLGQAVDAL

SEQ ID NO: 945467 - protein, 18 aa, Mycobacterium
GLRLVKVETLGQAVDALH

SEQ ID NO: 945468 - protein, 25 aa, Mycobacterium
GLRTTIDWYRANESWWRPLKDAAEA

SEQ ID NO: 945469 - protein, 25 aa, Mycobacterium
GLRTYAQLFVLIGAANDVRCDIATN

SEQ ID NO: 945470 - protein, 17 aa, Mycobacterium
GLSAMIWLAAPAHAHPD

SEQ ID NO: 945471 - protein, 19 aa, Mycobacterium
GLSAPLNIPYRVAFVLDVA

SEQ ID NO: 945472 - protein, 33 aa, Mycobacterium
GLSIARMYFAYGLGNSVWFPLATGSSAVISRSP

SEQ ID NO: 945473 - protein, 17 aa, Mycobacterium
GLSIIMPVGGQSSFYSD

SEQ ID NO: 945474 - protein, 23 aa, Mycobacterium
GLSSFGINLPPVPSLTGGTGTGM

SEQ ID NO: 945475 - protein, 31 aa, Mycobacterium
GLSVFMVIALAMTWLVYATLRREVAGSTNDY

SEQ ID NO: 945476 - protein, 27 aa, Mycobacterium
GLSVQVGAFHNQFVQALTGAGGAYAAA

SEQ ID NO: 945477 - protein, 28 aa, Mycobacterium
GLTDTIDWYRANESWWRPLKDTVEAKYQ

SEQ ID NO: 945478 - protein, 17 aa, Mycobacterium
GLTFNNPLPTDLEKRVA

SEQ ID NO: 945479 - protein, 33 aa, Mycobacterium
GLTVFMTVALTLGWLVYATLLREVSGSTTAYSA

SEQ ID NO: 945480 - protein, 17 aa, Mycobacterium
GLTVSIPTPPGWSPYEG

SEQ ID NO: 945481 - protein, 18 aa, Mycobacterium
GLTYLCRDLDGVPMCGVL

SEQ ID NO: 945482 - protein, 23 aa, Mycobacterium
GLVDITRFWFETGSLEAEKATAN

SEQ ID NO: 945483 - protein, 20 aa, Mycobacterium
GLVFQQFQGGVITAKNDEPG

SEQ ID NO: 945484 - protein, 18 aa, Mycobacterium
GLVIGFYTPSADATTFAA

SEQ ID NO: 945485 - protein, 17 aa, Mycobacterium
GLVISPFSRGGLVAHDV

SEQ ID NO: 945486 - protein, 19 aa, Mycobacterium
GLVLPLVPMAHQYAKTGQV

SEQ ID NO: 945487 - protein, 19 aa, Mycobacterium
GLVLPLVPMAHQYARTGQI

SEQ ID NO: 945488 - protein, 18 aa, Mycobacterium
GLVLVALLVVGVALLVRT

SEQ ID NO: 945489 - protein, 24 aa, Mycobacterium
GLVSQFFGRYFTPDEARALIREQA

SEQ ID NO: 945490 - protein, 18 aa, Mycobacterium
GLVVLDIGNPFFTDIARA

SEQ ID NO: 945491 - protein, 19 aa, Mycobacterium
GLVVLFNTLLSSAGGSVLA

SEQ ID NO: 945492 - protein, 18 aa, Mycobacterium
GLVVLGPERLPGAIRWSS

SEQ ID NO: 945493 - protein, 20 aa, Mycobacterium
GLVVVFGEFRFAAGQSYHAT

SEQ ID NO: 945494 - protein, 18 aa, Mycobacterium
GLVVWFNTLLVSGGGQVL

SEQ ID NO: 945495 - protein, 19 aa, Mycobacterium
GLYGDTMYAMFAHAALITG

SEQ ID NO: 945496 - protein, 18 aa, Mycobacterium
GMAAAVIAAPTASAAPDC

SEQ ID NO: 945497 - protein, 23 aa, Mycobacterium
GMDARAYRLPWQPDTTVYEVDQP

SEQ ID NO: 945498 - protein, 21 aa, Mycobacterium
GMDDFVRMGLAAHGDSRQVRT

SEQ ID NO: 945499 - protein, 24 aa, Mycobacterium
GMDRTYMLHVPAGDPIGLVLSLHG

SEQ ID NO: 945500 - protein, 23 aa, Mycobacterium
GMDYFIRTRFAATGDGRRVVTDD

SEQ ID NO: 945501 - protein, 27 aa, Mycobacterium
GMKDGSIDAMFWSGGLPTPGITDLFTS

SEQ ID NO: 945502 - protein, 26 aa, Mycobacterium
GMPKGVLWRQHDIFMTAFGGRNMMTG

SEQ ID NO: 945503 - protein, 20 aa, Mycobacterium
GMQAIRMVVVVLAAAFAVAS

SEQ ID NO: 945504 - protein, 31 aa, Mycobacterium; identical to SEQ ID NO: 120340

SEQ ID NO: 945505 - protein, 18 aa, Mycobacterium
GMRRISFVPGPAGFRFYH

SEQ ID NO: 945506 - protein, 19 aa, Mycobacterium
GMTGAGYWVAHGALTGITI

SEQ ID NO: 945507 - protein, 22 aa, Mycobacterium
GMTGPLAGRWIDQCNPGDPVCQ

SEQ ID NO: 945508 - protein, 27 aa, Mycobacterium
GMTKKPFSLQFVKPLDVPVERFPQYCD

SEQ ID NO: 945509 - protein, 32 aa, Mycobacterium
GMVLSHTAPGHWLPWGLLPDAIRSGERQIKAA

SEQ ID NO: 945510 - protein, 20 aa, Mycobacterium
GMWGAPQLGRWKWHDPCVHV

SEQ ID NO: 945511 - protein, 27 aa, Mycobacterium
GMWGAPQLGRWKWHDPWVHAALLAQNN

SEQ ID NO: 945512 - protein, 17 aa, Mycobacterium
GMYINTAPLLPGTTISQ

SEQ ID NO: 945513 - protein, 20 aa, Mycobacterium
GNACYWERLRGLGGTVDDII

SEQ ID NO: 945514 - protein, 23 aa, Mycobacterium
GNAFEVVPGPPIEGGPYGIGFNK

SEQ ID NO: 945515 - protein, 17 aa, Mycobacterium
GNALIDPQALLPAISPQ

SEQ ID NO: 945516 - protein, 25 aa, Mycobacterium
GNARSLAHWALLDPAARTHYVDWDT

SEQ ID NO: 945517 - protein, 29 aa, Mycobacterium
GNDLDSEHPFIYITTITNPRHGTFDGILS

SEQ ID NO: 945518 - protein, 18 aa, Mycobacterium
GNDNGMLQNCDVVTITEG

SEQ ID NO: 945519 - protein, 25 aa, Mycobacterium
GNEPARTWFSAMQPIATAFGDVTLP

SEQ ID NO: 945520 - protein, 25 aa, Mycobacterium
GNEPARTWFTAMKPIATNFGPVQLP

SEQ ID NO: 945521 - protein, 25 aa, Mycobacterium
GNEPARTWFTAMKPIATSFGPVQLP

SEQ ID NO: 945522 - protein, 28 aa, Mycobacterium
GNGGFVENFDFFGFGVAHGGDGGSGGAA

SEQ ID NO: 945523 - protein, 24 aa, Mycobacterium
GNGGGAGLLYGYGGAGGAGGTGGV

SEQ ID NO: 945524 - protein, 20 aa, Mycobacterium
GNGGLGLGTSALPGQGGEGG

SEQ ID NO: 945525 - protein, 20 aa, Mycobacterium
GNGGLLIGNGGAGGSGAPGQ

SEQ ID NO: 945526 - protein, 24 aa, Mycobacterium
GNGGTGGWLFGNGGVGGAGGTGAD

SEQ ID NO: 945527 - protein, 19 aa, Mycobacterium
GNIVILQGPLGGSGEINRG

SEQ ID NO: 945528 - protein, 23 aa, Mycobacterium
GNLDGYRAGYFVGLSVAAYCPRH

SEQ ID NO: 945529 - protein, 18 aa, Mycobacterium
GNLFFRNGEAGLLDWQAV

SEQ ID NO: 945530 - protein, 18 aa, Mycobacterium
GNLYATLTPNKWSDFGKA

SEQ ID NO: 945531 - protein, 28 aa, Mycobacterium
GNPEIRPAHLLMALLTQADGIAAPLLEA

SEQ ID NO: 945532 - protein, 28 aa, Mycobacterium
GNPEIRPAHLLMALLTQADGIAGPLLEA

SEQ ID NO: 945533 - protein, 17 aa, Mycobacterium
GNPLAAAGTLFFAPVNA

SEQ ID NO: 945534 - protein, 23 aa, Mycobacterium
GNPPPRMFRLPADRALLNRMGFN

SEQ ID NO: 945535 - protein, 23 aa, Mycobacterium
GNQAPFLTSLQWLADQSRKETQQ

SEQ ID NO: 945536 - protein, 23 aa, Mycobacterium
GNRAVVMVFVNQTTIVGADPPTS

SEQ ID NO: 945537 - protein, 24 aa, Mycobacterium
GNRGTDWFVWYEHGGLTYFWQAVV

SEQ ID NO: 945538 - protein, 26 aa, Mycobacterium
GNSVPRFHITWGTGPALVEIFARRIR

SEQ ID NO: 945539 - protein, 18 aa, Mycobacterium
GNVAFATIPVLDGAGWSD

SEQ ID NO: 945540 - protein, 18 aa, Mycobacterium
GNVLDWDWNRCHEWQHPG

SEQ ID NO: 945541 - protein, 22 aa, Mycobacterium
GNVPALPAGVSYTQVAGGAFHT

SEQ ID NO: 945542 - protein, 23 aa, Mycobacterium
GNWNNFWCIPDRNVNGNWKLVLS

SEQ ID NO: 945543 - protein, 18 aa, Mycobacterium
GNYLYYNKRLFAEAGIRP

SEQ ID NO: 945544 - protein, 20 aa, Mycobacterium
GPAAATTAITFLATEQPGGS

SEQ ID NO: 945545 - protein, 23 aa, Mycobacterium
GPAERWHRGVPFDLSLMIFGDST

SEQ ID NO: 945546 - protein, 24 aa, Mycobacterium
GPAIAADPAILTGGARAARGVRAH

SEQ ID NO: 945547 - protein, 30 aa, Mycobacterium
GPATEHLRLAGADYWFCCPACRTAFSDRNG

SEQ ID NO: 945548 - protein, 22 aa, Mycobacterium
GPATMFTGLAISIFCPRAVDAM

SEQ ID NO: 945549 - protein, 23 aa, Mycobacterium
GPAVGAVAAGAGVLPACPAHSAD

SEQ ID NO: 945550 - protein, 22 aa, Mycobacterium
GPAVPAVAVGPAGPAIPAGPAT

SEQ ID NO: 945551 - protein, 27 aa, Mycobacterium
GPDGALYQLIYQPGSLVRIELADAAPE

SEQ ID NO: 945552 - protein, 26 aa, Mycobacterium
GPDGLSLPMRLTLPGAVNRGNAAQAV

SEQ ID NO: 945553 - protein, 23 aa, Mycobacterium
GPDGSVLWSLRAVDWNCDNLFVA

SEQ ID NO: 945554 - protein, 29 aa, Mycobacterium
GPDPLAADGLPFVFDSFRLDSRLTSATAG

SEQ ID NO: 945555 - protein, 18 aa, Mycobacterium
GPEHDYEHYLGCKVAACV

SEQ ID NO: 945556 - protein, 24 aa, Mycobacterium
GPEHLVVRAIRHGLRAVGAQAGGL

SEQ ID NO: 945557 - protein, 29 aa, Mycobacterium
GPEPFLHTNVVGTFTILEAVRRYGVRLHH

SEQ ID NO: 945558 - protein, 20 aa, Mycobacterium
GPEQLLVPSTQYPGGIYAPF

SEQ ID NO: 945559 - protein, 29 aa, Mycobacterium
GPEQTETNVFLPWEKRYPVYEKLESEVTA

SEQ ID NO: 945560 - protein, 25 aa, Mycobacterium
GPGARLAPIFAYPLLAACPSITQGT

SEQ ID NO: 945561 - protein, 24 aa, Mycobacterium
GPGARLVPLRLADSALIELVRVGD

SEQ ID NO: 945562 - protein, 22 aa, Mycobacterium
GPGDWAPTPHGALLALVAKGRF

SEQ ID NO: 945563 - protein, 21 aa, Mycobacterium
GPGGAFLQPALGRANLTVLTD

SEQ ID NO: 945564 - protein, 26 aa, Mycobacterium
GPGKADPGLLRWLEDPEIGGVELKGF

SEQ ID NO: 945565 - protein, 23 aa, Mycobacterium
GPGKRPRRFPLYDSRRVGPAVGT

SEQ ID NO: 945566 - protein, 18 aa, Mycobacterium
GPGPFERPFAASSPWRHE

SEQ ID NO: 945567 - protein, 19 aa, Mycobacterium
GPHAKPEDIRFGLYGALSH

SEQ ID NO: 945568 - protein, 18 aa, Mycobacterium
GPHALYLLDGLRAQDDAN

SEQ ID NO: 945569 - protein, 20 aa, Mycobacterium
GPHAVFLLDAFNAAPDVSNW

SEQ ID NO: 945570 - protein, 19 aa, Mycobacterium
GPHAVYLLDAFNAAPDVSN

SEQ ID NO: 945571 - protein, 19 aa, Mycobacterium
GPHAVYLLDAFNAGPDVSN

SEQ ID NO: 945572 - protein, 25 aa, Mycobacterium
GPHRAWLICDDPRHTWLRSSWEHQE

SEQ ID NO: 945573 - protein, 18 aa, Mycobacterium
GPHSVYLLDGLRAQDDYS

SEQ ID NO: 945574 - protein, 18 aa, Mycobacterium
GPKAVYLLDGLRAQDDFN

SEQ ID NO: 945575 - protein, 24 aa, Mycobacterium
GPKQAYFHWRNLTTGAAGEAHGDG

SEQ ID NO: 945576 - protein, 33 aa, Mycobacterium
GPKRYNWAQLVGSFKYTLWRLQERVVGKGVYGE

SEQ ID NO: 945577 - protein, 19 aa, Mycobacterium
GPLAPPNPFMAPNGLASMH

SEQ ID NO: 945578 - protein, 27 aa, Mycobacterium
GPLESARWKGKLYAAPLSTNTQLLWYR

SEQ ID NO: 945579 - protein, 19 aa, Mycobacterium
GPLIHAEPTPRGYMGGLPG

SEQ ID NO: 945580 - protein, 32 aa, Mycobacterium
GPLQILRVAVPSFLLLFLVACGGSGRVSHPAA

SEQ ID NO: 945581 - protein, 21 aa, Mycobacterium
GPLRSLYHFNPAMQPQIDANY

SEQ ID NO: 945582 - protein, 27 aa, Mycobacterium
GPMGLFGLPFIFDDADHMWRFLDAEDG

SEQ ID NO: 945583 - protein, 24 aa, Mycobacterium
GPMMLLASPTLPAPGLNPACATYG

SEQ ID NO: 945584 - protein, 25 aa, Mycobacterium
GPNFTEIPFAFRDGGIYSAAAPGGT

SEQ ID NO: 945585 - protein, 22 aa, Mycobacterium
GPNPYIYPENLPRVNSRGGPGG

SEQ ID NO: 945586 - protein, 26 aa, Mycobacterium
GPPGIPLPGPTGCYPYREPLPAPPPG

SEQ ID NO: 945587 - protein, 23 aa, Mycobacterium
GPPLTEVLRLLAPTTELLRDYHP

SEQ ID NO: 945588 - protein, 21 aa, Mycobacterium
GPPPEQWHWTPPEPPEGAAPA

SEQ ID NO: 945589 - protein, 21 aa, Mycobacterium
GPPQIEALTAGKIDFAVTGNT

SEQ ID NO: 945590 - protein, 22 aa, Mycobacterium
GPPTLTWYILPDNGGSVARAEQ

SEQ ID NO: 945591 - protein, 24 aa, Mycobacterium
GPPVPNVNAFWRNVDQCAAPSATT

SEQ ID NO: 945592 - protein, 17 aa, Mycobacterium
GPQAFARVLTGFSYHGP

SEQ ID NO: 945593 - protein, 22 aa, Mycobacterium
GPQGQRILLALMVRTRGDDPNA

SEQ ID NO: 945594 - protein, 28 aa, Mycobacterium
GPQPSYGVQFPLPPPGAPLPPPIPQRPV

SEQ ID NO: 945595 - protein, 18 aa, Mycobacterium
GPQRLSGPEALSFVRQRH

SEQ ID NO: 945596 - protein, 27 aa, Mycobacterium
GPRKDTVIVLPMQKLTVALAADNPGVW

SEQ ID NO: 945597 - protein, 26 aa, Mycobacterium
GPRLITTALGLMLVAALPIPATHNTA

SEQ ID NO: 945598 - protein, 19 aa, Mycobacterium
GPSFLDKVHFQPLPAEVVT

SEQ ID NO: 945599 - protein, 28 aa, Mycobacterium
GPSLSLVLIDRIPFPRPDDPLLGARQRS

SEQ ID NO: 945600 - protein, 28 aa, Mycobacterium
GPSLSLVLIDRIPFPRPDDPLLSARQRA

SEQ ID NO: 945601 - protein, 28 aa, Mycobacterium
GPSLSLVLIDRIPFPRPDDPLLTARQRA

SEQ ID NO: 945602 - protein, 17 aa, Mycobacterium
GPSLSYTPAADFDGTDA

SEQ ID NO: 945603 - protein, 17 aa, Mycobacterium
GPSPFTDRLLAILRANG

SEQ ID NO: 945604 - protein, 34 aa, Mycobacterium
GPSQSAIRRAMLRLSWRPLVNRFIEATLAGEPTA

SEQ ID NO: 945605 - protein, 32 aa, Mycobacterium
GPTAPQALLPPPPLSARIPLPGGGALMKLPGE

SEQ ID NO: 945606 - protein, 24 aa, Mycobacterium
GPTLAYWLMRAGHEPTLIEAAPRL

SEQ ID NO: 945607 - protein, 26 aa, Mycobacterium
GPTSTPPPPPPLPAKPFPKECPAPGV

SEQ ID NO: 945608 - protein, 30 aa, Mycobacterium
GPTSTSYYMIPTQNLPLLDPVRAIPFVGKP

SEQ ID NO: 945609 - protein, 17 aa, Mycobacterium
GPTYPYTDSLYSAPSAF

SEQ ID NO: 945610 - protein, 17 aa, Mycobacterium
GPVGLAERAACSELAVT

SEQ ID NO: 945611 - protein, 19 aa, Mycobacterium
GPVLAYWLSRHGFGVTVVE

SEQ ID NO: 945612 - protein, 21 aa, Mycobacterium
GPVLAYWLSRYGFDVTVVERA

SEQ ID NO: 945613 - protein, 24 aa, Mycobacterium
GPVPGQSYLYLGDIGDNGLSRSAI

SEQ ID NO: 945614 - protein, 21 aa, Mycobacterium
GPVPTYLDLIRHDATTIAAAL

SEQ ID NO: 945615 - protein, 33 aa, Mycobacterium
GPVQKHLVFVNQGGNWILQHDAAIALIQAATAT

SEQ ID NO: 945616 - protein, 22 aa, Mycobacterium
GPWARRLGIATLAALLLPGVVG

SEQ ID NO: 945617 - protein, 30 aa, Mycobacterium
GPYVTAFAMFGPFGACLRTASATPSPTCSS

SEQ ID NO: 945618 - protein, 18 aa, Mycobacterium
GQALRQIAGMYSAVDNSW

SEQ ID NO: 945619 - protein, 28 aa, Mycobacterium
GQDPRTDFAVGPFFTILGGFMAMDVEGF

SEQ ID NO: 945620 - protein, 29 aa, Mycobacterium
GQFLQKYNAPPLTIGPLYAPKTIQLCAPG

SEQ ID NO: 945621 - protein, 18 aa, Mycobacterium
GQGGLGFAPNPNGGGGGA

SEQ ID NO: 945622 - protein, 22 aa, Mycobacterium
GQGVGFGGWYAPVALHVDTASV

SEQ ID NO: 945623 - protein, 17 aa, Mycobacterium
GQIDIPEPGLGVSYTGV

SEQ ID NO: 945624 - protein, 19 aa, Mycobacterium
GQLISWFAGGTPNLFERQS

SEQ ID NO: 945625 - protein, 20 aa, Mycobacterium
GQLLLALDATLVRLVEAPRG

SEQ ID NO: 945626 - protein, 31 aa, Mycobacterium
GQLLVYGVDPLILRQAYPVPQAPYGLAGSRE

SEQ ID NO: 945627 - protein, 22 aa, Mycobacterium
GQLNIPRLPAGVTYTRIAAGNY

SEQ ID NO: 945628 - protein, 20 aa, Mycobacterium
GQLVGMIHGAATKLPVCVIK

SEQ ID NO: 945629 - protein, 24 aa, Mycobacterium
GQNWAVWDPTLPAIPSAFVSGDPI

SEQ ID NO: 945630 - protein, 20 aa, Mycobacterium
GQPAAPPPNAPITGTAAVTT

SEQ ID NO: 945631 - protein, 30 aa, Mycobacterium
GQPEALAGFTYYEAPTRWLQGDRTARIPGS

SEQ ID NO: 945632 - protein, 24 aa, Mycobacterium
GQPGSVMFIVSMEQGFPGAPSPSL

SEQ ID NO: 945633 - protein, 24 aa, Mycobacterium
GQQLHGQFPVFAQAFDAVVEQLDR

SEQ ID NO: 945634 - protein, 20 aa, Mycobacterium
GQRLAAFVVLTDGSGLTPED

SEQ ID NO: 945635 - protein, 22 aa, Mycobacterium
GQRLFPALLDRYLARNGYASQQ

SEQ ID NO: 945636 - protein, 17 aa, Mycobacterium
GQRVRLRFINNSMMFHP

SEQ ID NO: 945637 - protein, 24 aa, Mycobacterium
GQSFTSVPMIFARPSYYGQFTDSG

SEQ ID NO: 945638 - protein, 22 aa, Mycobacterium
GQSTVPALPAGLRYTQVAAGRY

SEQ ID NO: 945639 - protein, 18 aa, Mycobacterium
GQSWHGPAAAAMAAAATP

SEQ ID NO: 945640 - protein, 27 aa, Mycobacterium
GQSYTYKWETFLTREMPAWLQANKGVS

SEQ ID NO: 945641 - protein, 23 aa, Mycobacterium
GQTLNRVLVGKSALSRIVRQPME

SEQ ID NO: 945642 - protein, 24 aa, Mycobacterium
GQTRAAVVRLLLESGPITAGEIGE

SEQ ID NO: 945643 - protein, 23 aa, Mycobacterium
GQTYRVLFGVATPQGVNPSTLGQ

SEQ ID NO: 945644 - protein, 26 aa, Mycobacterium
GQVAKILNNLLFSANLGAAMSALELG

SEQ ID NO: 945645 - protein, 27 aa, Mycobacterium
GQVEGGIIYHYYWFRDQSQTKEISGNT

SEQ ID NO: 945646 - protein, 26 aa, Mycobacterium
GQVKDRWLRRQLTPDFRPGCKRMLVS

SEQ ID NO: 945647 - protein, 31 aa, Mycobacterium
GQVQALSQFVAWPGLLVYQGKAKLLYDGAEL

SEQ ID NO: 945648 - protein, 34 aa, Mycobacterium
GQYGDTRYLMIPTDTLPLLYELSQTPIVGSFLAD

SEQ ID NO: 945649 - protein, 26 aa, Mycobacterium
GQYGQLEIPTLPPGVRYTQAAIGSVR

SEQ ID NO: 945650 - protein, 23 aa, Mycobacterium
GRAALAVNWPYALASMLENAVKG

SEQ ID NO: 945651 - protein, 29 aa, Mycobacterium
GRAAWVVGVASFFPVVRTASIRHLIDHLS

SEQ ID NO: 945652 - protein, 21 aa, Mycobacterium
GRAEYWWTHPQVVDPNRAKRA

SEQ ID NO: 945653 - protein, 27 aa, Mycobacterium
GRAHEQTRRWLLMPRFKINQADLLEHH

SEQ ID NO: 945654 - protein, 29 aa, Mycobacterium
GRALNRPTPLMLPGFAVRAALGEFADEVL

SEQ ID NO: 945655 - protein, 20 aa, Mycobacterium
GRALSILNDPFRVGGLPATN

SEQ ID NO: 945656 - protein, 17 aa, Mycobacterium
GRAPDPEHYLGCLVAAA

SEQ ID NO: 945657 - protein, 19 aa, Mycobacterium
GRAPLPTYFEIAERPHALV

SEQ ID NO: 945658 - protein, 29 aa, Mycobacterium
GRATALIPERMVTAHLAWIAAGSAFVLPT

SEQ ID NO: 945659 - protein, 18 aa, Mycobacterium
GRATGTAGAALAAGAAGC

SEQ ID NO: 945660 - protein, 29 aa, Mycobacterium
GRAVVPRWPWAPLTQVMRLLPPKYTKRFA

SEQ ID NO: 945661 - protein, 18 aa, Mycobacterium
GRDGRFSGAAHLADTADV

SEQ ID NO: 945662 - protein, 17 aa, Mycobacterium
GRDIGTVVLPDAPLKIF

SEQ ID NO: 945663 - protein, 26 aa, Mycobacterium
GREFASRWAELIFTGDPGIEVARNHY

SEQ ID NO: 945664 - protein, 27 aa, Mycobacterium
GREFRYSDINYILLGALLEKIAGEAED

SEQ ID NO: 945665 - protein, 22 aa, Mycobacterium
GREVLQFFVTLAPLLDPKDNVE

SEQ ID NO: 945666 - protein, 17 aa, Mycobacterium
GRFATRLAFAALRAATG

SEQ ID NO: 945667 - protein, 17 aa, Mycobacterium
GRFLQRNTTLWASWVVI

SEQ ID NO: 945668 - protein, 20 aa, Mycobacterium
GRFQWVVFTSTNAVRAVWEK

SEQ ID NO: 945669 - protein, 26 aa, Mycobacterium
GRGAASPLLPSLWQTNCFAPVGENRM

SEQ ID NO: 945670 - protein, 25 aa, Mycobacterium
GRGGFGPLVGGWGGNGGDGGADGGA

SEQ ID NO: 945671 - protein, 29 aa, Mycobacterium
GRGLAVPLGAFMWAWAPDAFETITADGAA

SEQ ID NO: 945672 - protein, 21 aa, Mycobacterium
GRGLTYPAQKLHTLGAHAAWG

SEQ ID NO: 945673 - protein, 29 aa, Mycobacterium
GRGLVRLARAIWPEADWDALGAKPHLAVA

SEQ ID NO: 945674 - protein, 23 aa, Mycobacterium
GRGNRFVVIALETSKALPLNDPG

SEQ ID NO: 945675 - protein, 24 aa, Mycobacterium
GRGPYLAPGSVLAIEPMLTLGTTK

SEQ ID NO: 945676 - protein, 22 aa, Mycobacterium
GRGRWLAILGSLALAAGMIYAQ

SEQ ID NO: 945677 - protein, 23 aa, Mycobacterium
GRGTRLPTWLSQWGFERPREDTV

SEQ ID NO: 945678 - protein, 31 aa, Mycobacterium
GRHWGAPSPAQWSWPAWTIPPGARASAAASA

SEQ ID NO: 945679 - protein, 21 aa, Mycobacterium
GRIDILVNNAGFLANAPAVEA

SEQ ID NO: 945680 - protein, 21 aa, Mycobacterium
GRIQATLWSWAPDEPRPTAGS

SEQ ID NO: 945681 - protein, 19 aa, Mycobacterium
GRIQFLGGYLAVLSVPKTL

SEQ ID NO: 945682 - protein, 27 aa, Mycobacterium
GRIRAMQMALLPERLTAADALSWGLVT

SEQ ID NO: 945683 - protein, 20 aa, Mycobacterium
GRNALFVADANFTNPRKLAD

SEQ ID NO: 945684 - protein, 24 aa, Mycobacterium
GRNGFLLAPWTAERVAAELEVGVG

SEQ ID NO: 945685 - protein, 18 aa, Mycobacterium
GRNLPVYFGNRNWEPYVE

SEQ ID NO: 945686 - protein, 27 aa, Mycobacterium
GRPAEYAELPYFFTDQYDLGMEYAGHA

SEQ ID NO: 945687 - protein, 19 aa, Mycobacterium
GRPISILQVAGALCDARGG

SEQ ID NO: 945688 - protein, 21 aa, Mycobacterium
GRPLGREIAFSRILSATKDVR

SEQ ID NO: 945689 - protein, 25 aa, Mycobacterium
GRPPRTIEAYFRELARRGYPDGTNT

SEQ ID NO: 945690 - protein, 28 aa, Mycobacterium
GRPRPDIGPYFYEPTILSGVREGMAAFA

SEQ ID NO: 945691 - protein, 23 aa, Mycobacterium
GRPTPEMLAYQYLQTLPQMAKGE

SEQ ID NO: 945692 - protein, 18 aa, Mycobacterium
GRQCLTTGATVTAGPAGP

SEQ ID NO: 945693 - protein, 19 aa, Mycobacterium
GRQKLTGPQALAFVRQRHE

SEQ ID NO: 945694 - protein, 23 aa, Mycobacterium
GRQRLIEHFALVVGLEILKQRHI

SEQ ID NO: 945695 - protein, 21 aa, Mycobacterium
GRQYLSWISLEDQVRALLFAI

SEQ ID NO: 945696 - protein, 17 aa, Mycobacterium
GRRLLVGAAAAAALPGL

SEQ ID NO: 945697 - protein, 17 aa, Mycobacterium
GRRLVIAMMYGLVKEGG

SEQ ID NO: 945698 - protein, 24 aa, Mycobacterium
GRRRAKIIGYRRVIHPELSRGGTC

SEQ ID NO: 945699 - protein, 34 aa, Mycobacterium
GRSTMDLLVRFFGDKKILLLLDNCEHLLDACGAM

SEQ ID NO: 945700 - protein, 24 aa, Mycobacterium
GRTDTILLVHIPAFYDGGAATMVS

SEQ ID NO: 945701 - protein, 19 aa, Mycobacterium
GRTEPLRPVILLHGKDSSA

SEQ ID NO: 945702 - protein, 21 aa, Mycobacterium
GRTHLAYELLLTNVAPAEVNV

SEQ ID NO: 945703 - protein, 17 aa, Mycobacterium
GRTPALLESLGYGRPAE

SEQ ID NO: 945704 - protein, 17 aa, Mycobacterium
GRTPVIGRFSFGGSDPH

SEQ ID NO: 945705 - protein, 19 aa, Mycobacterium
GRVLTFAFISNDAGPNGRN

SEQ ID NO: 945706 - protein, 21 aa, Mycobacterium
GRVRGLGLPTLLRASPAWARL

SEQ ID NO: 945707 - protein, 18 aa, Mycobacterium
GRVSRLKTLIGTSPPARE

SEQ ID NO: 945708 - protein, 18 aa, Mycobacterium
GRVSRLRSLIGASPSPRE

SEQ ID NO: 945709 - protein, 18 aa, Mycobacterium
GRWVSAPCTDAHPAACVT

SEQ ID NO: 945710 - protein, 21 aa, Mycobacterium
GRYHWSQLSMMPTLLTGLSVT

SEQ ID NO: 945711 - protein, 19 aa, Mycobacterium
GRYVAIVDNYLTFIANPAA

SEQ ID NO: 945712 - protein, 24 aa, Mycobacterium
GSAAAAWTALAALGAGAAVDAADD

SEQ ID NO: 945713 - protein, 24 aa, Mycobacterium
GSAAMPLDLLRRAIEALGVEFHQG

SEQ ID NO: 945714 - protein, 23 aa, Mycobacterium
GSADDIFWLSNAYLAAYADSGRL

SEQ ID NO: 945715 - protein, 21 aa, Mycobacterium
GSAEDICRVHLALQGDAVGPA

SEQ ID NO: 945716 - protein, 24 aa, Mycobacterium
GSAKWALRGLTQNAAAELAPFGIR

SEQ ID NO: 945717 - protein, 18 aa, Mycobacterium
GSAKWNLLAPYAVESRGG

SEQ ID NO: 945718 - protein, 18 aa, Mycobacterium
GSATLPLYATMKGALRGF

SEQ ID NO: 945719 - protein, 20 aa, Mycobacterium
GSAVVALALGAAAPAAGADP

SEQ ID NO: 945720 - protein, 21 aa, Mycobacterium
GSDFVAIMRRLAAGEGPVDVV

SEQ ID NO: 945721 - protein, 28 aa, Mycobacterium
GSDLMLPQVPGRRPLFVRAMNSYMDRVL

SEQ ID NO: 945722 - protein, 23 aa, Mycobacterium
GSDRRYIMVIESLQASDDATARE

SEQ ID NO: 945723 - protein, 23 aa, Mycobacterium
GSDRRYIMVIESLQASDEATARE

SEQ ID NO: 945724 - protein, 24 aa, Mycobacterium
GSEDTVWHYVPMLWEAGGDILTPD

SEQ ID NO: 945725 - protein, 21 aa, Mycobacterium
GSFQDWQVAQLDSLAEALGVG

SEQ ID NO: 945726 - protein, 20 aa, Mycobacterium
GSFTILPMVLIDNPGRANGG

SEQ ID NO: 945727 - protein, 18 aa, Mycobacterium
GSFTYRPAAGYSGTDTFT

SEQ ID NO: 945728 - protein, 23 aa, Mycobacterium
GSGAAYLLPALGRPNLTLLEETR

SEQ ID NO: 945729 - protein, 24 aa, Mycobacterium
GSGETVLGPFKPPTGGPSYIDVAQ

SEQ ID NO: 945730 - protein, 19 aa, Mycobacterium
GSGFFSDTLLSSLRNEKRD

SEQ ID NO: 945731 - protein, 26 aa, Mycobacterium
GSGHALRQVIMALAARHKLAEHENPG

SEQ ID NO: 945732 - protein, 19 aa, Mycobacterium
GSGNRLGSLNFGFGNAVGD

SEQ ID NO: 945733 - protein, 24 aa, Mycobacterium
GSGPDFLHWSLQSSAVKNDPCKAV

SEQ ID NO: 945734 - protein, 24 aa, Mycobacterium
GSGRPAVVAAIRKALDIKGIHDPA

SEQ ID NO: 945735 - protein, 24 aa, Mycobacterium
GSGTAYLIPALSRPNLRLHARTRA

SEQ ID NO: 945736 - protein, 22 aa, Mycobacterium
GSGTIWGRQWPTSPYQVIDVAQ

SEQ ID NO: 945737 - protein, 27 aa, Mycobacterium
GSHSWFAGYRGDLAFAALIVGGGSSEY

SEQ ID NO: 945738 - protein, 20 aa, Mycobacterium
GSIFAFPAVAAADPAPPPAP

SEQ ID NO: 945739 - protein, 23 aa, Mycobacterium
GSIKAINLKNWVATLTLGLDKHT

SEQ ID NO: 945740 - protein, 24 aa, Mycobacterium
GSIKSIQLKNWIATLTLGVDKNTK

SEQ ID NO: 945741 - protein, 27 aa, Mycobacterium
GSIWARYNVPWQPAWVFYRADGSSTFV

SEQ ID NO: 945742 - protein, 32 aa, Mycobacterium
GSKQWETFLADELPNWLAANKGLAPGGHGIVG

SEQ ID NO: 945743 - protein, 32 aa, Mycobacterium
GSKQWETFLSSELPDWLAANKGLAPGGHAAVG

SEQ ID NO: 945744 - protein, 25 aa, Mycobacterium
GSKQWETFLTAELPGWLAANKGLAP

SEQ ID NO: 945745 - protein, 18 aa, Mycobacterium
GSKSRPFRGGFPSGPSIG

SEQ ID NO: 945746 - protein, 17 aa, Mycobacterium
GSLALAAGMIYAQDTKP

SEQ ID NO: 945747 - protein, 17 aa, Mycobacterium
GSLGKVLPPYQIRVVAP

SEQ ID NO: 945748 - protein, 18 aa, Mycobacterium
GSLGNIAWYLQYAGKKSI

SEQ ID NO: 945749 - protein, 25 aa, Mycobacterium
GSLHVNLRFVNFLERLSASGTYDSR

SEQ ID NO: 945750 - protein, 17 aa, Mycobacterium
GSLPAPPRSADDARWVY

SEQ ID NO: 945751 - protein, 21 aa, Mycobacterium
GSLSGFLYPSSTTTNGAILAG

SEQ ID NO: 945752 - protein, 26 aa, Mycobacterium
GSNFGAKPITLPYAKQLTAAGLVIVS

SEQ ID NO: 945753 - protein, 20 aa, Mycobacterium
GSPFAVYRGLARGLAGLMMS

SEQ ID NO: 945754 - protein, 26 aa, Mycobacterium
GSPTIVVPAEWRFIDGRWKLASKSMC

SEQ ID NO: 945755 - protein, 24 aa, Mycobacterium
GSPYSIVRATQFFEFVDGIADSMA

SEQ ID NO: 945756 - protein, 28 aa, Mycobacterium
GSQERYPALWQVASPYGIPAATIAQGHT

SEQ ID NO: 945757 - protein, 21 aa, Mycobacterium
GSQFSLVFRDSELAPQSTVFG

SEQ ID NO: 945758 - protein, 23 aa, Mycobacterium
GSQKWSLPLGFNATTPPSVAPDG

SEQ ID NO: 945759 - protein, 25 aa, Mycobacterium
GSQVAIPFWWSIHNVVLQQLLRAHG

SEQ ID NO: 945760 - protein, 24 aa, Mycobacterium
GSQVLSWDWNVPHDWYWNSEGIVD

SEQ ID NO: 945761 - protein, 21 aa, Mycobacterium
GSQWVGPITNFSPLYNDRTIE

SEQ ID NO: 945762 - protein, 25 aa, Mycobacterium
GSRALIVPKMVYRLGVLRAPRGYVE

SEQ ID NO: 945763 - protein, 17 aa, Mycobacterium
GSRLRVDYKRIDGKWLI

SEQ ID NO: 945764 - protein, 21 aa, Mycobacterium
GSRVPLAGMALPVVSAKNVQI

SEQ ID NO: 945765 - protein, 22 aa, Mycobacterium
GSRVPLAGMALPVVSAKTVRIN

SEQ ID NO: 945766 - protein, 25 aa, Mycobacterium
GSSHLVQIKILPTPATSVTLTMSDW

SEQ ID NO: 945767 - protein, 24 aa, Mycobacterium
GSSKWALRGLTQTAAAELAPSGIR

SEQ ID NO: 945768 - protein, 21 aa, Mycobacterium
GSTALDGWKLEFDLPADESVT

SEQ ID NO: 945769 - protein, 50 aa, Mycobacterium
GSTAREFAPTLLPALAAAGIQAFTYDYGRIPWLPINLVEPYDAGGEVPVQ

SEQ ID NO: 945770 - protein, 19 aa, Mycobacterium
GSTGPWADRKAYDLLVQCE

SEQ ID NO: 945771 - protein, 21 aa, Mycobacterium
GSTPAPFLSLYQGVRVECAQT

SEQ ID NO: 945772 - protein, 23 aa, Mycobacterium
GSTQQIAWVRYYSQMRDLVATLQ

SEQ ID NO: 945773 - protein, 25 aa, Mycobacterium
GSTRGPLLERLGLPEPSTALDATET

SEQ ID NO: 945774 - protein, 17 aa, Mycobacterium
GSTRWRLPGRTPAYPVS

SEQ ID NO: 945775 - protein, 22 aa, Mycobacterium
GSVLAIEPMLTLGTGRTVVLDD

SEQ ID NO: 945776 - protein, 26 aa, Mycobacterium
GSVLAIEPMLTLGTRKTLILDDGWTV

SEQ ID NO: 945777 - protein, 26 aa, Mycobacterium
GSVRITDALLPLVNPGSSAILIGSIA

SEQ ID NO: 945778 - protein, 19 aa, Mycobacterium
GSWGPWYQAEYETAAPDAP

SEQ ID NO: 945779 - protein, 17 aa, Mycobacterium
GTAGFLGFGVAAADDTK

SEQ ID NO: 945780 - protein, 20 aa, Mycobacterium
GTAHRIMTGAPMPSGATAVV

SEQ ID NO: 945781 - protein, 28 aa, Mycobacterium
GTAKPDPILPLRISFIEIVPHTTSVTEK

SEQ ID NO: 945782 - protein, 17 aa, Mycobacterium
GTALIIHQTADNLTGSA

SEQ ID NO: 945783 - protein, 26 aa, Mycobacterium
GTALPFVVQRLWLDRPVRGDRPAFLG

SEQ ID NO: 945784 - protein, 24 aa, Mycobacterium
GTAPNRLYWLSAWIDPDGTNGGPL

SEQ ID NO: 945785 - protein, 25 aa, Mycobacterium
GTAPPMSWDKVLQGLFLGRKDQETR

SEQ ID NO: 945786 - protein, 23 aa, Mycobacterium
GTARFVGAMSVPAAWQGSMPAYV

SEQ ID NO: 945787 - protein, 17 aa, Mycobacterium
GTASMSSGMWQSMHGSD

SEQ ID NO: 945788 - protein, 24 aa, Mycobacterium
GTAVTAIAIRSAVTTGPAGPTGDI

SEQ ID NO: 945789 - protein, 32 aa, Mycobacterium
GTDEVSGAIATLFCGYARDYQNLSTQLADFHQ

SEQ ID NO: 945790 - protein, 23 aa, Mycobacterium
GTDPGLFGFITDLASDGGIPGLF

SEQ ID NO: 945791 - protein, 20 aa, Mycobacterium
GTDRAILATASLAGLMPWHP

SEQ ID NO: 945792 - protein, 20 aa, Mycobacterium
GTEVWTFTALKPGTTTITTG

SEQ ID NO: 945793 - protein, 20 aa, Mycobacterium
GTFARVGGWGPWLGDEGGGA

SEQ ID NO: 945794 - protein, 26 aa, Mycobacterium
GTFGAGMGISTWWYRGSDMDTERTLE

SEQ ID NO: 945795 - protein, 29 aa, Mycobacterium
GTGATFTHTFTAPGTFEYVCSIHPMMRGT

SEQ ID NO: 945796 - protein, 19 aa, Mycobacterium
GTGFYGNLSNKKYWAEQNH

SEQ ID NO: 945797 - protein, 26 aa, Mycobacterium
GTGGAGGLGGGGFRVGHGGGGGNGGN

SEQ ID NO: 945798 - protein, 19 aa, Mycobacterium
GTGGGGFHGPGGAAGDGGT

SEQ ID NO: 945799 - protein, 33 aa, Mycobacterium
GTGKHDAFMLGAYFIWQYGPPGWIEDLNPWLQN

SEQ ID NO: 945800 - protein, 32 aa, Mycobacterium
GTGNALYSPRYWPFLTSGLLGLERGTDAEDLL

SEQ ID NO: 945801 - protein, 18 aa, Mycobacterium
GTGPFKFKERIRGERIDL

SEQ ID NO: 945802 - protein, 21 aa, Mycobacterium
GTGSLTWWVQYRKGGDSCAAA

SEQ ID NO: 945803 - protein, 21 aa, Mycobacterium
GTHAQIYQRISAQAMAFHDQF

SEQ ID NO: 945804 - protein, 20 aa, Mycobacterium
GTHTEKWIDLKPGECVADLP

SEQ ID NO: 945805 - protein, 18 aa, Mycobacterium
GTHYVLTPANWNRSIAPG

SEQ ID NO: 945806 - protein, 23 aa, Mycobacterium
GTIDAPIGRHRGHDWKFAVVEDG

SEQ ID NO: 945807 - protein, 24 aa, Mycobacterium
GTILPAVLALTFAREHPRIFPVAI

SEQ ID NO: 945808 - protein, 25 aa, Mycobacterium
GTIMALYSPTLWHHLTDGLSELVNH

SEQ ID NO: 945809 - protein, 17 aa, Mycobacterium
GTINIAIGGAATGIAAV

SEQ ID NO: 945810 - protein, 24 aa, Mycobacterium
GTIRVIRTLDYRAGLPSGPVASAP

SEQ ID NO: 945811 - protein, 27 aa, Mycobacterium
GTLELGYQIGFPWSLGVGINFSYTTPN

SEQ ID NO: 945812 - protein, 29 aa, Mycobacterium
GTLRISNWPLYMADGFVAAFQTASGLTVD

SEQ ID NO: 945813 - protein, 18 aa, Mycobacterium
GTLSLWQGVDVPGPSLSL

SEQ ID NO: 945814 - protein, 22 aa, Mycobacterium
GTLVVFSRRFISTTVSTVSSDG

SEQ ID NO: 945815 - protein, 24 aa, Mycobacterium
GTLYATLTPNKWSDFGKASDIYDV

SEQ ID NO: 945816 - protein, 24 aa, Mycobacterium
GTLYATLTPNKWSDFGPAADIYDP

SEQ ID NO: 945817 - protein, 24 aa, Mycobacterium
GTNHLAGIVLLDGAPPAGVLAGAL

SEQ ID NO: 945818 - protein, 19 aa, Mycobacterium
GTNQVAWFPGDWRAHFDAT

SEQ ID NO: 945819 - protein, 21 aa, Mycobacterium
GTPEPALQAAWTWAPSAVDEA

SEQ ID NO: 945820 - protein, 27 aa, Mycobacterium
GTPETAERFPLPASAWFLYGTVARPQS

SEQ ID NO: 945821 - protein, 35 aa, Mycobacterium
GTPGRRWAWQTRAWSGHRIYPAAVLYQRVVSTKSS

SEQ ID NO: 945822 - protein, 23 aa, Mycobacterium
GTPILTVAAPLFDRIAIALPGGK

SEQ ID NO: 945823 - protein, 24 aa, Mycobacterium
GTPPHTWYLSFNMKDRYTSIPEVR

SEQ ID NO: 945824 - protein, 18 aa, Mycobacterium
GTPYADLLVPKLEASVTD

SEQ ID NO: 945825 - protein, 39 aa, Mycobacterium
GTQAATLMLNWYPYGEHAPFYYGVQEGIFAKHGIDLTID

SEQ ID NO: 945826 - protein, 23 aa, Mycobacterium
GTQLGAVYASRYPQRVRTMVLDG

SEQ ID NO: 945827 - protein, 18 aa, Mycobacterium
GTQLYWAEFGGTRVNVIA

SEQ ID NO: 945828 - protein, 18 aa, Mycobacterium
GTRAVIVCPLGFVADHIE

SEQ ID NO: 945829 - protein, 26 aa, Mycobacterium
GTRGLTIQQAWYPGMEAFLGVAVHGF

SEQ ID NO: 945830 - protein, 19 aa, Mycobacterium
GTRLTVLRRLAHPEDARLG

SEQ ID NO: 945831 - protein, 26 aa, Mycobacterium
GTSAFRGVDAWFLIRAVTEPDAGTLP

SEQ ID NO: 945832 - protein, 23 aa, Mycobacterium
GTSRGWPTEAELGLWEALSDIAP

SEQ ID NO: 945833 - protein, 18 aa, Mycobacterium
GTSVGHIGIWNTGKLYDQ

SEQ ID NO: 945834 - protein, 24 aa, Mycobacterium
GTTLLAGCQFGGLNSLPLPGTAGH

SEQ ID NO: 945835 - protein, 24 aa, Mycobacterium
GTTPLEFAAPLPGQTYTVVVACRA

SEQ ID NO: 945836 - protein, 25 aa, Mycobacterium
GTTTYKWETFLTRELPAWLAANRGV

SEQ ID NO: 945837 - protein, 25 aa, Mycobacterium
GTTVVLDNYLRRCDFSRVSVAPQVP

SEQ ID NO: 945838 - protein, 30 aa, Mycobacterium
GTVDHLLIGSSLPWLLPPALGDVQTINEIA

SEQ ID NO: 945839 - protein, 25 aa, Mycobacterium
GTVDTFRHDGFLEGFGLTDNSPEIV

SEQ ID NO: 945840 - protein, 23 aa, Mycobacterium
GTVEVVGRIPLVLDYTINEKAVY

SEQ ID NO: 945841 - protein, 17 aa, Mycobacterium
GTVRGLVAEGHRLFAGI

SEQ ID NO: 945842 - protein, 33 aa, Mycobacterium
GTVSALYSQRFWPYLTSGLLGLQRGTDPGDLLL

SEQ ID NO: 945843 - protein, 19 aa, Mycobacterium
GTVVLTGGMLLACSNNDKK

SEQ ID NO: 945844 - protein, 21 aa, Mycobacterium
GTYLRLLSEGPTKLPSLAKVV

SEQ ID NO: 945845 - protein, 21 aa, Mycobacterium
GTYPFVVDRWTPDKVYSGAYK

SEQ ID NO: 945846 - protein, 26 aa, Mycobacterium
GVAAAAALLAGFSLAGCQAKESATSG

SEQ ID NO: 945847 - protein, 17 aa, Mycobacterium
GVAAANLGLFTEADRRL

SEQ ID NO: 945848 - protein, 23 aa, Mycobacterium
GVAAMLVLTFIAGVVVVWQGAAA

SEQ ID NO: 945849 - protein, 19 aa, Mycobacterium
GVAGPNWMLIGDAAACVNP

SEQ ID NO: 945850 - protein, 20 aa, Mycobacterium
GVAGPNWMLIGDAAACVNPL

SEQ ID NO: 945851 - protein, 22 aa, Mycobacterium
GVAKVWAPARSWAFYTPQSDGS

SEQ ID NO: 945852 - protein, 34 aa, Mycobacterium
GVAPIGRPLPGTALFVLDPWLRQVPIGVVGEIYV

SEQ ID NO: 945853 - protein, 26 aa, Mycobacterium
GVAQGKWVKAALGNTPPQVVMLDGTP

SEQ ID NO: 945854 - protein, 28 aa, Mycobacterium
GVARRRFRVVAAWLACAGLLAPLACGCH

SEQ ID NO: 945855 - protein, 25 aa, Mycobacterium
GVAVHGFPNYFFLCGPDVAAQISYV

SEQ ID NO: 945856 - protein, 22 aa, Mycobacterium
GVDALLPAAHGPNPVLPQGCHR

SEQ ID NO: 945857 - protein, 18 aa, Mycobacterium
GVDGVWVADASILPSCAE

SEQ ID NO: 945858 - protein, 17 aa, Mycobacterium
GVDKIEYSFFQSGSDVA

SEQ ID NO: 945859 - protein, 34 aa, Mycobacterium
GVDKQQYLELLTSTLFDAPVYRTYGGLLVDEQFT

SEQ ID NO: 945860 - protein, 19 aa, Mycobacterium
GVDPLTAIPPLAEPFIQEA

SEQ ID NO: 945861 - protein, 27 aa, Mycobacterium
GVDQLLRWNLIERPVTLVPAPTRWTAA

SEQ ID NO: 945862 - protein, 22 aa, Mycobacterium
GVDVLLPAAHGPNPVLPPGCHR

SEQ ID NO: 945863 - protein, 34 aa, Mycobacterium
GVDVTTIYFALVRTRMIAPTPLLGRFPGLSPDDA

SEQ ID NO: 945864 - protein, 19 aa, Mycobacterium
GVDWKGTLTGLAGYASGDL

SEQ ID NO: 945865 - protein, 38 aa, Mycobacterium
GVENPFFGIPPGQLKKLPTVNGLVNPFFDERPGHWVIP

SEQ ID NO: 945866 - protein, 20 aa, Mycobacterium
GVFGSRAIDLCNQGDPICMA

SEQ ID NO: 945867 - protein, 18 aa, Mycobacterium
GVFMPVAQKYFGDMSVTG

SEQ ID NO: 945868 - protein, 25 aa, Mycobacterium
GVGDIMLIAYALAWNEFRGGGSASI

SEQ ID NO: 945869 - protein, 20 aa, Mycobacterium
GVGLATICAALLSAPLIIAS

SEQ ID NO: 945870 - protein, 20 aa, Mycobacterium
GVGSGPRYGFKPTVMARPLP

SEQ ID NO: 945871 - protein, 20 aa, Mycobacterium
GVGVLTRRFGLTCDQLISAR

SEQ ID NO: 945872 - protein, 26 aa, Mycobacterium
GVGYRGEFGLAALSLILGGNVRVGLE

SEQ ID NO: 945873 - protein, 25 aa, Mycobacterium
GVHLRGHFLLTRNAATYWRQKAKAA

SEQ ID NO: 945874 - protein, 24 aa, Mycobacterium
GVIAAARLFPPTTLTAIFANANAI

SEQ ID NO: 945875 - protein, 22 aa, Mycobacterium
GVIFLLLGWQALDSSGKAVDDS

SEQ ID NO: 945876 - protein, 22 aa, Mycobacterium
GVIFLLLGWQALGSSGKSDDDS

SEQ ID NO: 945877 - protein, 23 aa, Mycobacterium
GVIFLLLGWQALGTSGSSDDDSA

SEQ ID NO: 945878 - protein, 20 aa, Mycobacterium
GVISPLDKLFRQIGVDTSDY

SEQ ID NO: 945879 - protein, 24 aa, Mycobacterium
GVKAGHTYTARQLLDGLLLVSGND

SEQ ID NO: 945880 - protein, 20 aa, Mycobacterium
GVLASPEHRSGRRRGHLRVL

SEQ ID NO: 945881 - protein, 17 aa, Mycobacterium
GVLEGLSLTPDGRYLFA

SEQ ID NO: 945882 - protein, 23 aa, Mycobacterium
GVLEPPFNLQFVLGVLGANAAEP

SEQ ID NO: 945883 - protein, 28 aa, Mycobacterium
GVLGGIQNLLHAVARFFRLAQPDNYTQT

SEQ ID NO: 945884 - protein, 17 aa, Mycobacterium
GVLPVLKHFPGHGSGSG

SEQ ID NO: 945885 - protein, 18 aa, Mycobacterium
GVLSVLGLAIGVAAGTRL

SEQ ID NO: 945886 - protein, 20 aa, Mycobacterium
GVLVNVAFTLGIERYRYPQN

SEQ ID NO: 945887 - protein, 17 aa, Mycobacterium
GVLVWQLSRDHGPGSPE

SEQ ID NO: 945888 - protein, 18 aa, Mycobacterium
GVNAPIPGLTAPAPAAPA

SEQ ID NO: 945889 - protein, 20 aa, Mycobacterium
GVPEVWPFTPGEHRAMLAKT

SEQ ID NO: 945890 - protein, 18 aa, Mycobacterium
GVPLPGSTFDGSSTLRRL

SEQ ID NO: 945891 - protein, 17 aa, Mycobacterium
GVPTLIACGDRDLLTPV

SEQ ID NO: 945892 - protein, 21 aa, Mycobacterium
GVPVLSLGRYAGVRRQAIVTM

SEQ ID NO: 945893 - protein, 18 aa, Mycobacterium
GVQFDQGTWVANGGLRYA

SEQ ID NO: 945894 - protein, 27 aa, Mycobacterium
GVRADSLRWHPNGLALDVMIPNPSSPA

SEQ ID NO: 945895 - protein, 28 aa, Mycobacterium
GVRGLRTYVQLFVLIAAANDVRCDVASN

SEQ ID NO: 945896 - protein, 25 aa, Mycobacterium
GVRPDALRWHPNGLALDVMIPNPGS

SEQ ID NO: 945897 - protein, 26 aa, Mycobacterium
GVRPGLFLTNSFPLGAPVYTYPDSLP

SEQ ID NO: 945898 - protein, 26 aa, Mycobacterium
GVRSDALRWHPNGLALDVMIPNPTSQ

SEQ ID NO: 945899 - protein, 46 aa, Mycobacterium
GVSAAAAQLAPLQQALALPAAVDFSISIFGLQLVQGGTANANSTFG

SEQ ID NO: 945900 - protein, 22 aa, Mycobacterium
GVSFAILFATRGFPVAVFDPDP

SEQ ID NO: 945901 - protein, 24 aa, Mycobacterium
GVSKQTIYRWWPTKGDILLESLAA

SEQ ID NO: 945902 - protein, 20 aa, Mycobacterium
GVSNGFWRQPALQSAAEIGA

SEQ ID NO: 945903 - protein, 23 aa, Mycobacterium
GVSPIYDGLYRPSATTDAVIPEL

SEQ ID NO: 945904 - protein, 17 aa, Mycobacterium
GVSYLKDIVFAMQTQDV

SEQ ID NO: 945905 - protein, 19 aa, Mycobacterium
GVTANAYLRWLRTQGEAPV

SEQ ID NO: 945906 - protein, 24 aa, Mycobacterium
GVTGFPPDLWARQTTEIRPTNRLT

SEQ ID NO: 945907 - protein, 18 aa, Mycobacterium
GVTGFPPGLWARQTTEIR

SEQ ID NO: 945908 - protein, 21 aa, Mycobacterium
GVTIPYRFDTTRGPLLNGACV

SEQ ID NO: 945909 - protein, 18 aa, Mycobacterium
GVTLLITSGWRSRAFQQQ

SEQ ID NO: 945910 - protein, 24 aa, Mycobacterium
GVTPILPMIRLAHQHGIDWRAVYA

SEQ ID NO: 945911 - protein, 29 aa, Mycobacterium
GVTQTVDLWATNLPKLLPAGVQQTLIPPA

SEQ ID NO: 945912 - protein, 17 aa, Mycobacterium
GVTSCEAVLALASSYDV

SEQ ID NO: 945913 - protein, 31 aa, Mycobacterium
GVTTSIPLSSLPLYLGIGPNNDFPLPDQVTA

SEQ ID NO: 945914 - protein, 27 aa, Mycobacterium
GVTTSYLVRTERLPLLQPARDLGVPEK

SEQ ID NO: 945915 - protein, 20 aa, Mycobacterium
GVTWVYNYAVAVYPDARGCG

SEQ ID NO: 945916 - protein, 19 aa, Mycobacterium
GVVAIFAQALLSGRSTKVF

SEQ ID NO: 945917 - protein, 25 aa, Mycobacterium
GVVDFPAYPLNLLATANALAGFWYV

SEQ ID NO: 945918 - protein, 20 aa, Mycobacterium
GVVMLYKEGLLDDSPGGTGK

SEQ ID NO: 945919 - protein, 18 aa, Mycobacterium
GVVNGTKAFLPHLIASGD

SEQ ID NO: 945920 - protein, 19 aa, Mycobacterium
GVWALTRGAQLVSALPGSL

SEQ ID NO: 945921 - protein, 17 aa, Mycobacterium
GVWIDRPGGPGTAWDIA

SEQ ID NO: 945922 - protein, 18 aa, Mycobacterium
GVWRAYADHRMAMAGAIV

SEQ ID NO: 945923 - protein, 26 aa, Mycobacterium
GVWTYKWETFLTDELPLWLATNKAVS

SEQ ID NO: 945924 - protein, 27 aa, Mycobacterium
GVWTYKWETFLTTELPQWLGVNKGISP

SEQ ID NO: 945925 - protein, 24 aa, Mycobacterium
GVYLPGLPVVARTVTYIPSDAVDA

SEQ ID NO: 945926 - protein, 18 aa, Mycobacterium
GVYSLDFAFGTRPDPGSG

SEQ ID NO: 945927 - protein, 24 aa, Mycobacterium
GWAARPLPLPDMCYGAVLSGDTEL

SEQ ID NO: 945928 - protein, 30 aa, Mycobacterium
GWADFPDRPWNLIATANALLGIIYVHGRYE

SEQ ID NO: 945929 - protein, 17 aa, Mycobacterium
GWAPPPRAEWRGPLPDR

SEQ ID NO: 945930 - protein, 18 aa, Mycobacterium
GWCQAVLDSGPLSAKHYD

SEQ ID NO: 945931 - protein, 26 aa, Mycobacterium
GWDETVFFHNGDPFIWDRGRELGMVN

SEQ ID NO: 945932 - protein, 25 aa, Mycobacterium
GWDIELPTFEWFLNSGISVVMPVGG

SEQ ID NO: 945933 - protein, 17 aa, Mycobacterium
GWGNEVWDPLPWGTYGF

SEQ ID NO: 945934 - protein, 24 aa, Mycobacterium
GWGTILSTALILTLARPNERVLPA

SEQ ID NO: 945935 - protein, 19 aa, Mycobacterium
GWHRWRTQWDAEGARFWLD

SEQ ID NO: 945936 - protein, 18 aa, Mycobacterium
GWLRAKTGSLTAINSLVG

SEQ ID NO: 945937 - protein, 20 aa, Mycobacterium
GWMEALRAYNYSDAYARNVR

SEQ ID NO: 945938 - protein, 27 aa, Mycobacterium
GWQGDFPSMIEFLAPLYGTGAGSNDVG

SEQ ID NO: 945939 - protein, 20 aa, Mycobacterium
GWRIDRLPNGVFLDWQQFQS

SEQ ID NO: 945940 - protein, 23 aa, Mycobacterium
GWTAGYAGLFAEAPWVVSVDDHV

SEQ ID NO: 945941 - protein, 18 aa, Mycobacterium
GWVARKRPGSKAAAAAEA

SEQ ID NO: 945942 - protein, 24 aa, Mycobacterium
GWVRAQLLHYMKSAPDFYFDEMSQ

SEQ ID NO: 945943 - protein, 20 aa, Mycobacterium
GYADFDQPFGGNGGDGGIGG

SEQ ID NO: 945944 - protein, 31 aa, Mycobacterium
GYCYADRTIGWDRGELLPSLQRAHGDIGVVM

SEQ ID NO: 945945 - protein, 35 aa, Mycobacterium
GYDRRQTLERLRYLPLAPFRISYAYTNYGITAGAE

SEQ ID NO: 945946 - protein, 24 aa, Mycobacterium
GYFHVELMSIRRSASKLKYLAASE

SEQ ID NO: 945947 - protein, 30 aa, Mycobacterium
GYGALPIFVVFIYFRAPWTKYVSNLADGDA

SEQ ID NO: 945948 - protein, 19 aa, Mycobacterium
GYGRHPLFPTNYTGREART

SEQ ID NO: 945949 - protein, 29 aa, Mycobacterium
GYGSRYIPFSILGVYPWPTPTDEGVDIVD

SEQ ID NO: 945950 - protein, 23 aa, Mycobacterium
GYHRIRVWPGVSPSGMYWRVAIN

SEQ ID NO: 945951 - protein, 28 aa, Mycobacterium
GYKAPYGRIPGLPPLAADWYRGDGPMGR

SEQ ID NO: 945952 - protein, 33 aa, Mycobacterium
GYKGAFLSFNLRLNLPPPCLTGFLPAQQQRVPS

SEQ ID NO: 945953 - protein, 24 aa, Mycobacterium
GYLTEPLVDALPHPALTAIGISDQ

SEQ ID NO: 945954 - protein, 28 aa, Mycobacterium
GYRAMPQWVKIRNIDGFTGSFWEGGVGD

SEQ ID NO: 945955 - protein, 21 aa, Mycobacterium
GYRLVAACVAAGLPLTCLPGP

SEQ ID NO: 945956 - protein, 20 aa, Mycobacterium
GYSHWLGQYLAVASIPNYLD

SEQ ID NO: 945957 - protein, 24 aa, Mycobacterium
GYSNYASFFYNTEGLPYFSVGMGN

SEQ ID NO: 945958 - protein, 18 aa, Mycobacterium
GYTAYPVFNLAVAGSGGG

SEQ ID NO: 945959 - protein, 34 aa, Mycobacterium
GYTGPITFRPPYGKKLWSLPRYLAEHDRISVTWD

SEQ ID NO: 945960 - protein, 18 aa, Mycobacterium
GYTVLINALVLSGGGALL

SEQ ID NO: 945961 - protein, 25 aa, Mycobacterium
GYVALTLVMLAVSACGWSPPAPAPT

SEQ ID NO: 945962 - protein, 33 aa, Mycobacterium
GYVYTYSQLVVPRWVLLSGVGWHTFGASGTIAR

SEQ ID NO: 945963 - protein, 19 aa, Mycobacterium
GYWLSQVPQALGWIAPILA

SEQ ID NO: 945964 - protein, 18 aa, Mycobacterium
GYYDPLWTQDSPKGWVYI

SEQ ID NO: 945965 - protein, 18 aa, Mycobacterium
GYYSTYQAKALIGAAVAG

SEQ ID NO: 945966 - protein, 25 aa, Mycobacterium
HAAGALLCLVNLTSPPPAPPTSYGD

SEQ ID NO: 945967 - protein, 17 aa, Mycobacterium
HAALLLAQGAGRLLRRV

SEQ ID NO: 945968 - protein, 20 aa, Mycobacterium
HAALPHLLAAAEDGPREVAD

SEQ ID NO: 945969 - protein, 19 aa, Mycobacterium
HAAVFLITGFVGTHQPYYM

SEQ ID NO: 945970 - protein, 18 aa, Mycobacterium
HADQLAEWLASRQPKLVT

SEQ ID NO: 945971 - protein, 19 aa, Mycobacterium
HADTFVAYLGDHVCYIVVV

SEQ ID NO: 945972 - protein, 26 aa, Mycobacterium
HAEHGRTPWRDLFSPAVTLADDGFDV

SEQ ID NO: 945973 - protein, 22 aa, Mycobacterium
HAEPFFANYSLNIQGRYDFHTW

SEQ ID NO: 945974 - protein, 27 aa, Mycobacterium
HAFGESFLTQMFPVGSVVPSLDYRIPA

SEQ ID NO: 945975 - protein, 20 aa, Mycobacterium
HAGYFVGVSIKAYCPKYAAA

SEQ ID NO: 945976 - protein, 19 aa, Mycobacterium
HAHAWALRMSPDGNVWGAT

SEQ ID NO: 945977 - protein, 23 aa, Mycobacterium
HAKVRLPLPIAQLVERDHQRLGM

SEQ ID NO: 945978 - protein, 24 aa, Mycobacterium
HALVIGNRVRYFSAPNFHGTETFT

SEQ ID NO: 945979 - protein, 25 aa, Mycobacterium
HANAWGLPYAAMMAGAQLLLPDRFL

SEQ ID NO: 945980 - protein, 31 aa, Mycobacterium
HAPGRSGQLSWWAGPWPVDERWWDPSSKSGR

SEQ ID NO: 945981 - protein, 19 aa, Mycobacterium
HAQAYQGLSVQVGAFHNQF

SEQ ID NO: 945982 - protein, 24 aa, Mycobacterium
HAQKTLLAALSAFTVLFAGSAVGT

SEQ ID NO: 945983 - protein, 20 aa, Mycobacterium
HARNPLRFAAPVPGRHGWHV

SEQ ID NO: 945984 - protein, 20 aa, Mycobacterium
HARQYPQRYPTRVVGAALIS

SEQ ID NO: 945985 - protein, 17 aa, Mycobacterium
HARSVTEFVIRHADAGS

SEQ ID NO: 945986 - protein, 17 aa, Mycobacterium
HASLPLPQPVPAVASVL

SEQ ID NO: 945987 - protein, 25 aa, Mycobacterium
HASTTPGTTPSIWTGSPAPSEGNGH

SEQ ID NO: 945988 - protein, 18 aa, Mycobacterium
HATLLSVIVAIAALAGCS

SEQ ID NO: 945989 - protein, 19 aa, Mycobacterium
HAVPVLRELGLPAAVFLAT

SEQ ID NO: 945990 - protein, 25 aa, Mycobacterium
HAVRFTRRGLFVHPAPWAENSIGYE

SEQ ID NO: 945991 - protein, 21 aa, Mycobacterium
HAVRVPNPFIMATNFSFDGVT

SEQ ID NO: 945992 - protein, 25 aa, Mycobacterium
HAVVAAFVLVCSAFLAAPTAHAAAI

SEQ ID NO: 945993 - protein, 23 aa, Mycobacterium
HAYMTMAPLLDHDEGDWWRVVDT

SEQ ID NO: 945994 - protein, 18 aa, Mycobacterium
HCHQQIHMDYGLMLLLNS

SEQ ID NO: 945995 - protein, 19 aa, Mycobacterium
HCLAGASLITFVPGFVGDA

SEQ ID NO: 945996 - protein, 19 aa, Mycobacterium
HDALLTVLRRHPNLVARFC

SEQ ID NO: 945997 - protein, 33 aa, Mycobacterium
HDEPDERWALLPLVPLIPKPVFRRLLSVVTGGA

SEQ ID NO: 945998 - protein, 24 aa, Mycobacterium
HDGLGWLAQRGYVPLGYKGDAAKT

SEQ ID NO: 945999 - protein, 22 aa, Mycobacterium
HDGWTLVSWNGKPAWPGWAAKR

SEQ ID NO: 946000 - protein, 17 aa, Mycobacterium
HDLAVIFRAAMANPVFA

SEQ ID NO: 946001 - protein, 22 aa, Mycobacterium
HDLAVIFRAAMANPVFAHITAE

SEQ ID NO: 946002 - protein, 22 aa, Mycobacterium
HDLAVIFRAAMANPVFARITAE

SEQ ID NO: 946003 - protein, 22 aa, Mycobacterium
HDLAVIFRTAMANPVFAHITAE

SEQ ID NO: 946004 - protein, 23 aa, Mycobacterium
HDLRYAIDPSLLYNELAWAPKHT

SEQ ID NO: 946005 - protein, 18 aa, Mycobacterium
HDPKYLVYEVFGPPGTVA

SEQ ID NO: 946006 - protein, 17 aa, Mycobacterium
HDPPYPEQLVPGEFAGY

SEQ ID NO: 946007 - protein, 18 aa, Mycobacterium
HDRFVEILQTSAQAYGST

SEQ ID NO: 946008 - protein, 21 aa, Mycobacterium
HDTPIATLVEFLHALEVHDET

SEQ ID NO: 946009 - protein, 25 aa, Mycobacterium
HDVQVKMFELVPNPAWVARPGPYAR

SEQ ID NO: 946010 - protein, 21 aa, Mycobacterium
HDVVGVHLALSSAPGALRTGS

SEQ ID NO: 946011 - protein, 20 aa, Mycobacterium
HDYAALRAACHDGHEAASSL

SEQ ID NO: 946012 - protein, 17 aa, Mycobacterium
HDYRKSLWCGIGGLVPF

SEQ ID NO: 946013 - protein, 24 aa, Mycobacterium
HEAMYLGDGMMLEAPYTGSVVKIS

SEQ ID NO: 946014 - protein, 33 aa, Mycobacterium
HEDEPDERWALLPLVPLIPERVMRRLIGVVTGS

SEQ ID NO: 946015 - protein, 17 aa, Mycobacterium
HELALQDWLGTAGFDRA

SEQ ID NO: 946016 - protein, 17 aa, Mycobacterium
HERGLPMQSPWTALRTA

SEQ ID NO: 946017 - protein, 20 aa, Mycobacterium
HEVDGLPNQPIAPGAQATGR

SEQ ID NO: 946018 - protein, 24 aa, Mycobacterium
HEVQVRMFQVVPNPNWVAKPGQYA

SEQ ID NO: 946019 - protein, 26 aa, Mycobacterium
HEWRSRLRHGVLAHLVGFVGPRRREL

SEQ ID NO: 946020 - protein, 21 aa, Mycobacterium
HFEWIKDDVVQWVPNRYWPAH

SEQ ID NO: 946021 - protein, 18 aa, Mycobacterium
HFPPPQTQIPVWDCGALV

SEQ ID NO: 946022 - protein, 24 aa, Mycobacterium
HFVEVTLGAFFEIAKAVAPITVCL

SEQ ID NO: 946023 - protein, 25 aa, Mycobacterium
HFVNALQPIEWRYTNDPAWVMRTKG

SEQ ID NO: 946024 - protein, 25 aa, Mycobacterium
HGAAGLLLRAPMPGGAAAVLLQHRA

SEQ ID NO: 946025 - protein, 20 aa, Mycobacterium
HGASLAWLIGAIPTGDPLLP

SEQ ID NO: 946026 - protein, 32 aa, Mycobacterium
HGDTIYVTLPAKTLPIMQPLLDLGAATGTSAL

SEQ ID NO: 946027 - protein, 17 aa, Mycobacterium
HGEQLAAWLASRQPQLV

SEQ ID NO: 946028 - protein, 27 aa, Mycobacterium
HGETGWPTFLYVIPLGGGQVLVEETSL

SEQ ID NO: 946029 - protein, 17 aa, Mycobacterium
HGHTFAVRDGKGAFRAR

SEQ ID NO: 946030 - protein, 23 aa, Mycobacterium
HGITVNVVSPLAYSPAMTLAISA

SEQ ID NO: 946031 - protein, 19 aa, Mycobacterium
HGLHIHSFKKCEANSVAPA

SEQ ID NO: 946032 - protein, 21 aa, Mycobacterium
HGLQIHSVGKCEANSAAPGGG

SEQ ID NO: 946033 - protein, 26 aa, Mycobacterium
HGNSVPRFHITWGTGPALVDIFARRL

SEQ ID NO: 946034 - protein, 35 aa, Mycobacterium
HGPKRHDWHQLVGTLKYTLLRLQERVVGQGPGVPQ

SEQ ID NO: 946035 - protein, 33 aa, Mycobacterium
HGPMRRDWNYMIGSIKYVLWRLQERVVGRGPQT

SEQ ID NO: 946036 - protein, 28 aa, Mycobacterium
HGRGSNGLFYAWLAQALASKGYLVAALN

SEQ ID NO: 946037 - protein, 17 aa, Mycobacterium
HGRSGFLLAPWTAEQIV

SEQ ID NO: 946038 - protein, 17 aa, Mycobacterium
HGRSGFLLAPWTVEKIA

SEQ ID NO: 946039 - protein, 23 aa, Mycobacterium
HGSSGLFDASPLRRMAGDIAIGA

SEQ ID NO: 946040 - protein, 23 aa, Mycobacterium
HGSSMLYDPFHVGGLPAVDGPSG

SEQ ID NO: 946041 - protein, 18 aa, Mycobacterium
HGSVPPPPPPMGKRAPMQ

SEQ ID NO: 946042 - protein, 18 aa, Mycobacterium
HGTRLFVVGGAGTLRVNG

SEQ ID NO: 946043 - protein, 18 aa, Mycobacterium
HGTYRHRAEGEPAPAALL

SEQ ID NO: 946044 - protein, 21 aa, Mycobacterium
HGVLVATNFFGINTIPIALNE

SEQ ID NO: 946045 - protein, 17 aa, Mycobacterium
HGYMYGETLYAMVDETY

SEQ ID NO: 946046 - protein, 18 aa, Mycobacterium
HHAAFRTVPGFAAAMRAL

SEQ ID NO: 946047 - protein, 26 aa, Mycobacterium
HHDETAGLWTLLRVPTLIACGDHDLL

SEQ ID NO: 946048 - protein, 28 aa, Mycobacterium
HHIAADRWSLSPLLRDLATAYTARCAGA

SEQ ID NO: 946049 - protein, 25 aa, Mycobacterium
HHMYYLNVMAGSGPHRAWLICDDPR

SEQ ID NO: 946050 - protein, 18 aa, Mycobacterium
HHPVRPAPMGLFRTAGRG

SEQ ID NO: 946051 - protein, 17 aa, Mycobacterium
HHRHFYLGAIAGKRVIV

SEQ ID NO: 946052 - protein, 21 aa, Mycobacterium
HHRLVARLVVLAAGAAVFALS

SEQ ID NO: 946053 - protein, 17 aa, Mycobacterium
HHRWPRHIHDVKAAIAW

SEQ ID NO: 946054 - protein, 18 aa, Mycobacterium
HHVRAFAPDLLLHELTDL

SEQ ID NO: 946055 - protein, 28 aa, Mycobacterium
HHYRFTLYQLPATLQLPPGLVGLRAAEA

SEQ ID NO: 946056 - protein, 18 aa, Mycobacterium
HIAKETLMISKGGKYPTA

SEQ ID NO: 946057 - protein, 31 aa, Mycobacterium
HIGAAYYVHYWQYQFLPQFGALLNENPSLAV

SEQ ID NO: 946058 - protein, 17 aa, Mycobacterium
HIGFGQRSKYLVTDTNA

SEQ ID NO: 946059 - protein, 32 aa, Mycobacterium
HIGGAAMLATALLTGMRLALFASFDPATTPLA

SEQ ID NO: 946060 - protein, 32 aa, Mycobacterium
HILANKDQFAFLGSNLPLLLKGLARTTQDGAY

SEQ ID NO: 946061 - protein, 36 aa, Mycobacterium
HISSNPPVPGRFYWVTDTQLRWRPQDFWPAGTVVTI

SEQ ID NO: 946062 - protein, 24 aa, Mycobacterium
HIVDRSWRYLQFHSTIEFWDQDGG

SEQ ID NO: 946063 - protein, 19 aa, Mycobacterium
HKAKLRADFLRPVKAEDLL

SEQ ID NO: 946064 - protein, 19 aa, Mycobacterium
HKGVEQVLVFLPQGASIAQ

SEQ ID NO: 946065 - protein, 26 aa, Mycobacterium
HKRREFLTDLSLLGGLIIASADTAGK

SEQ ID NO: 946066 - protein, 18 aa, Mycobacterium
HKRWADYLTWVANTVDMK

SEQ ID NO: 946067 - protein, 18 aa, Mycobacterium
HLDGFSSYRRSNPGAGLD

SEQ ID NO: 946068 - protein, 27 aa, Mycobacterium
HLGALLNQPYAVEGFFLIAISPVLAGV

SEQ ID NO: 946069 - protein, 23 aa, Mycobacterium
HLISPWGTWEWMGPAALGAVLPA

SEQ ID NO: 946070 - protein, 25 aa, Mycobacterium
HLKGTWNGTRLAAAIMRENKRGAII

SEQ ID NO: 946071 - protein, 20 aa, Mycobacterium
HLLMALLTQNDGIAAPLLEA

SEQ ID NO: 946072 - protein, 26 aa, Mycobacterium
HLLPEEMIPTGLFPQAMQAPEVFLKD

SEQ ID NO: 946073 - protein, 26 aa, Mycobacterium
HLNGAWEGQYLFPVENQPAYGREIAR

SEQ ID NO: 946074 - protein, 25 aa, Mycobacterium
HLNGPLRRRYAGYTAWRGIAAHPLD

SEQ ID NO: 946075 - protein, 18 aa, Mycobacterium
HLNTVEPQLAFAGANLPL

SEQ ID NO: 946076 - protein, 17 aa, Mycobacterium
HLQLLESVGLVTSSRRG

SEQ ID NO: 946077 - protein, 17 aa, Mycobacterium
HLVLMSPADYERVQRGE

SEQ ID NO: 946078 - protein, 21 aa, Mycobacterium
HLYTHWDCRLGSDGFWHVWLL

SEQ ID NO: 946079 - protein, 20 aa, Mycobacterium
HMPLIDFAPPQMPAPPPPMF

SEQ ID NO: 946080 - protein, 24 aa, Mycobacterium
HNAVEYFVSYYDYYQPEAYIAQTD

SEQ ID NO: 946081 - protein, 19 aa, Mycobacterium
HNLAWKLAAVLQGTAGPGL

SEQ ID NO: 946082 - protein, 29 aa, Mycobacterium
HNPVVFSHKFAIEYWTLMNAKNAKDSLLN

SEQ ID NO: 946083 - protein, 24 aa, Mycobacterium
HNQNVDTVLPWQEALRTVEPSLVT

SEQ ID NO: 946084 - protein, 22 aa, Mycobacterium
HNSYWFYSCMVVFKTSYGVLQQ

SEQ ID NO: 946085 - protein, 29 aa, Mycobacterium
HNVTRLFDAPYPGLTFGSGQVWTQCHSTG

SEQ ID NO: 946086 - protein, 19 aa, Mycobacterium
HPAAAWQHHGRGRPAKRFQ

SEQ ID NO: 946087 - protein, 18 aa, Mycobacterium
HPALSFDGLDARVKQAAA

SEQ ID NO: 946088 - protein, 19 aa, Mycobacterium
HPALYPGAPVPPATSPPPA

SEQ ID NO: 946089 - protein, 27 aa, Mycobacterium
HPDADIYLSLPGLGVILGARVLGEFGD

SEQ ID NO: 946090 - protein, 17 aa, Mycobacterium
HPDEPHWYLAVIGSDPV

SEQ ID NO: 946091 - protein, 30 aa, Mycobacterium
HPDRAAFGDFTPFWEFVSGPLNAGAFPQSP

SEQ ID NO: 946092 - protein, 27 aa, Mycobacterium
HPGEVAAFLDLWDRGLAEWRQHRDDMI

SEQ ID NO: 946093 - protein, 23 aa, Mycobacterium
HPHQVDFTTLPWTHTETTTLTVA

SEQ ID NO: 946094 - protein, 19 aa, Mycobacterium
HPIHAAGLPKLLVVSTTYD

SEQ ID NO: 946095 - protein, 18 aa, Mycobacterium
HPIVAIDRRGMGMSSPID

SEQ ID NO: 946096 - protein, 24 aa, Mycobacterium
HPNCMYKWMDWIISPEVNAQVAEY

SEQ ID NO: 946097 - protein, 18 aa, Mycobacterium
HPRTWRRIRARLSELGVG

SEQ ID NO: 946098 - protein, 25 aa, Mycobacterium
HPSAPAYALAADALLLALCDALGEK

SEQ ID NO: 946099 - protein, 26 aa, Mycobacterium
HPYRTPPKVWFSDLLRPNGRAYQDGE

SEQ ID NO: 946100 - protein, 23 aa, Mycobacterium
HQETALTFEYLPQGAPRADAMLI

SEQ ID NO: 946101 - protein, 18 aa, Mycobacterium
HQLNRYPDGLEKCIGCEL

SEQ ID NO: 946102 - protein, 27 aa, Mycobacterium
HQPGTYPFVFDRWLPDKVYSGAYKAWA

SEQ ID NO: 946103 - protein, 17 aa, Mycobacterium
HQQIYRTLRRMEDDSWL

SEQ ID NO: 946104 - protein, 22 aa, Mycobacterium
HQSNLKIVPLVQIAQDGSEVPA

SEQ ID NO: 946105 - protein, 18 aa, Mycobacterium
HQVADWVGGLLHEQDEGK

SEQ ID NO: 946106 - protein, 27 aa, Mycobacterium
HQVNAAPLPWSFTISTTLPSVSANIMA

SEQ ID NO: 946107 - protein, 23 aa, Mycobacterium
HQVRWTVLLDGPVRISLGCQSRP

SEQ ID NO: 946108 - protein, 17 aa, Mycobacterium
HQYRTALRGLRTSPFYP

SEQ ID NO: 946109 - protein, 27 aa, Mycobacterium
HRAAQYWVLKPTYHNSYWFYSCMVVFK

SEQ ID NO: 946110 - protein, 27 aa, Mycobacterium
HRAAQYWVLKPTYHNSYWYYSCMVAFK

SEQ ID NO: 946111 - protein, 18 aa, Mycobacterium
HRAVLTVGFAVAGTVAPA

SEQ ID NO: 946112 - protein, 19 aa, Mycobacterium
HREPGISGSPAFTAVRAVR

SEQ ID NO: 946113 - protein, 21 aa, Mycobacterium
HRIDTAYPGRFLLGIGAGHRE

SEQ ID NO: 946114 - protein, 17 aa, Mycobacterium
HRIKPLFVLFDSCWDPH

SEQ ID NO: 946115 - protein, 30 aa, Mycobacterium
HRLPEETWYQGWSFPSFEAGAQALRTLVQS

SEQ ID NO: 946116 - protein, 22 aa, Mycobacterium
HRNNRFFRRWLGGSIAAASPSV

SEQ ID NO: 946117 - protein, 23 aa, Mycobacterium
HRSVLPIVMGPLVVSVQPARGDF

SEQ ID NO: 946118 - protein, 26 aa, Mycobacterium
HRVAAVYLMALLAEDLRPLLRSADHR

SEQ ID NO: 946119 - protein, 24 aa, Mycobacterium
HRVAQFQYALQDELPLRQAQWLGT

SEQ ID NO: 946120 - protein, 28 aa, Mycobacterium
HRVIDPRLRTLAIRPALRRLAGLPTAQT

SEQ ID NO: 946121 - protein, 24 aa, Mycobacterium
HSAAWWRHGSLKNRLWECNTWLSD

SEQ ID NO: 946122 - protein, 18 aa, Mycobacterium
HSALLVIASLCCAAALVA

SEQ ID NO: 946123 - protein, 21 aa, Mycobacterium
HSALYGMVREIAAQRGRVVGV

SEQ ID NO: 946124 - protein, 28 aa, Mycobacterium
HSEVDTLRRVELLRQLRLGEYDVLVGIN

SEQ ID NO: 946125 - protein, 24 aa, Mycobacterium
HSEWGWTAPIYQKSGIWYVKHTIP

SEQ ID NO: 946126 - protein, 24 aa, Mycobacterium
HSGKAYLERIVFKTVPEAGTRVGA

SEQ ID NO: 946127 - protein, 18 aa, Mycobacterium
HSHQPLRWGPPEAPDRYV

SEQ ID NO: 946128 - protein, 30 aa, Mycobacterium
HSIDLVPEYIGNLLLYFAPDSEATTLDVVE

SEQ ID NO: 946129 - protein, 31 aa, Mycobacterium
HSIDLVPEYIGNLLLYFAPESTATLLDAVEL

SEQ ID NO: 946130 - protein, 17 aa, Mycobacterium
HSKLLPALDIAAKAVSA

SEQ ID NO: 946131 - protein, 27 aa, Mycobacterium
HSQALWDHPGWFTLVDQSVAVFSTDQE

SEQ ID NO: 946132 - protein, 27 aa, Mycobacterium
HSVSSPLGAWLLLALAAPVARGRVRDD

SEQ ID NO: 946133 - protein, 21 aa, Mycobacterium
HTATAHQLWNGLSGPIIVEGD

SEQ ID NO: 946134 - protein, 23 aa, Mycobacterium
HTDGYVPVYTTQAAVFAAAKLRA

SEQ ID NO: 946135 - protein, 19 aa, Mycobacterium
HTEGHRRVVFRFRTSPIEL

SEQ ID NO: 946136 - protein, 28 aa, Mycobacterium
HTFNYLDLVNYLAVGNLNPSPLGYVGGS

SEQ ID NO: 946137 - protein, 17 aa, Mycobacterium
HTGGFNRNTWGVSMIGN

SEQ ID NO: 946138 - protein, 24 aa, Mycobacterium
HTHGGQLCLPFYGAIVTNCDLDRS

SEQ ID NO: 946139 - protein, 25 aa, Mycobacterium
HTKNCRLYWVQIIPTIASESTPQQL

SEQ ID NO: 946140 - protein, 25 aa, Mycobacterium
HTQGKVPVLVWIHGGAFIAGNGVDY

SEQ ID NO: 946141 - protein, 25 aa, Mycobacterium
HTQPALDLDALLGGLRPVLKGLDAD

SEQ ID NO: 946142 - protein, 25 aa, Mycobacterium
HTRRDIPIHYLLADTFTVCDHYFCS

SEQ ID NO: 946143 - protein, 19 aa, Mycobacterium
HTRVLLPQAVTHVDARFNI

SEQ ID NO: 946144 - protein, 21 aa, Mycobacterium
HTRWVLDEIVDGNPSGWRCMA

SEQ ID NO: 946145 - protein, 25 aa, Mycobacterium
HTSITLVAYSAPEPGWRTVIPAFNA

SEQ ID NO: 946146 - protein, 22 aa, Mycobacterium
HTVALTHWDGDTFTFPLTDENA

SEQ ID NO: 946147 - protein, 25 aa, Mycobacterium
HVAELPPRTGRPQGWPAWADPDVVR

SEQ ID NO: 946148 - protein, 23 aa, Mycobacterium
HVAMYLGDGQMLEAPYTGSVVKI

SEQ ID NO: 946149 - protein, 22 aa, Mycobacterium
HVAMYLGNGQMLEAPYTGSHVK

SEQ ID NO: 946150 - protein, 19 aa, Mycobacterium
HVAQTLALAARFQTALDGT

SEQ ID NO: 946151 - protein, 18 aa, Mycobacterium
HVAYLRDSLSAPGPAPDD

SEQ ID NO: 946152 - protein, 25 aa, Mycobacterium
HVDASYWRDMGTPEDFVRGSADLVR

SEQ ID NO: 946153 - protein, 17 aa, Mycobacterium
HVELAGFDVILVHRMLK

SEQ ID NO: 946154 - protein, 19 aa, Mycobacterium
HVELAPPTGAPPRGRLREG

SEQ ID NO: 946155 - protein, 23 aa, Mycobacterium
HVGGIMVGSWTDLSMLTDGSLPD

SEQ ID NO: 946156 - protein, 20 aa, Mycobacterium
HVGQPVVAIGSPLGLSGTVT

SEQ ID NO: 946157 - protein, 20 aa, Mycobacterium
HVHNAVRVAFWGAEELGLIG

SEQ ID NO: 946158 - protein, 19 aa, Mycobacterium
HVLAADYLVFGIGAVPNDQ

SEQ ID NO: 946159 - protein, 22 aa, Mycobacterium
HVLERLFPGIGRLDEAFPGLGV

SEQ ID NO: 946160 - protein, 19 aa, Mycobacterium
HVLGIPYDEYIRMTGKDWF

SEQ ID NO: 946161 - protein, 25 aa, Mycobacterium
HVMPVLRKRGLARLDWRGTSFRSRL

SEQ ID NO: 946162 - protein, 17 aa, Mycobacterium
HVNTVGYRLAKIQSLLG

SEQ ID NO: 946163 - protein, 20 aa, Mycobacterium
HVPLGPDHTYWFATERTAEG

SEQ ID NO: 946164 - protein, 22 aa, Mycobacterium
HVPWANFTNVPPADSLPFSAFP

SEQ ID NO: 946165 - protein, 24 aa, Mycobacterium
HVTAAPGSILNYLARHRKGIRLAV

SEQ ID NO: 946166 - protein, 20 aa, Mycobacterium
HVTADMFAIPWVVNWIRRKL

SEQ ID NO: 946167 - protein, 17 aa, Mycobacterium
HVTAGVTWFGSPQTRVY

SEQ ID NO: 946168 - protein, 24 aa, Mycobacterium
HVVTPSLYSLYDPASAPAEWIERL

SEQ ID NO: 946169 - protein, 19 aa, Mycobacterium
HVYPQLVEIIRARNLRTVT

SEQ ID NO: 946170 - protein, 18 aa, Mycobacterium
HWARVVWSRTAVQLAAEA

SEQ ID NO: 946171 - protein, 19 aa, Mycobacterium
HWIEQVVVLFTSDLHARDF

SEQ ID NO: 946172 - protein, 18 aa, Mycobacterium
HYARLMSGGLRVLRRLPG

SEQ ID NO: 946173 - protein, 25 aa, Mycobacterium
HYGAPPITIGPLYQPRTVELCASGD

SEQ ID NO: 946174 - protein, 31 aa, Mycobacterium
HYNVNLLVGTLKYTLWRLQERVVGRGPDSPQ

SEQ ID NO: 946175 - protein, 17 aa, Mycobacterium
HYQNMQDAFTAIRCVDD

SEQ ID NO: 946176 - protein, 23 aa, Mycobacterium
HYSDWRGMFAGNGLLYPKEMTQD

SEQ ID NO: 946177 - protein, 23 aa, Mycobacterium
IAAAGFAAALPLSAGIASAQPDF

SEQ ID NO: 946178 - protein, 23 aa, Mycobacterium
IAAAVVFLCSPGTSWMTGEVLDI

SEQ ID NO: 946179 - protein, 24 aa, Mycobacterium
IAADDFWYLWHQMVSQPGVVDPAG

SEQ ID NO: 946180 - protein, 27 aa, Mycobacterium
IAADGSVLDTWFPAPELTDTPGTPGTE

SEQ ID NO: 946181 - protein, 18 aa, Mycobacterium
IAAFGFKNPLPDGVDRHI

SEQ ID NO: 946182 - protein, 25 aa, Mycobacterium
IAAHNPTFLGTATPFFVAFLEAQRA

SEQ ID NO: 946183 - protein, 29 aa, Mycobacterium
IAAHPSAFTAFYRWDVYYNSTAGDVVLPA

SEQ ID NO: 946184 - protein, 18 aa, Mycobacterium
IAAIFPDGPQRYFDTIYN

SEQ ID NO: 946185 - protein, 20 aa, Mycobacterium
IAAKLFGFPTVIAHGMFSAA

SEQ ID NO: 946186 - protein, 24 aa, Mycobacterium
IAALMYVPGFLNLPAEYMYIVANS

SEQ ID NO: 946187 - protein, 21 aa, Mycobacterium
IAALVLAYVIGRVLTRRSGRV

SEQ ID NO: 946188 - protein, 27 aa, Mycobacterium
IAAMQWEKLICNVAYSAPCALTGMTVG

SEQ ID NO: 946189 - protein, 25 aa, Mycobacterium
IAARIPFAVVPWETGVFDPLGGSLR

SEQ ID NO: 946190 - protein, 40 aa, Mycobacterium
IAASHPDLILGSQGLTPALYPQLDAIAPTVFTAAPGAAWQ

SEQ ID NO: 946191 - protein, 20 aa, Mycobacterium
IAAVAVGLWMRGEAGGPRLD

SEQ ID NO: 946192 - protein, 22 aa, Mycobacterium
IAAVGGITMALSAGAGLASADP

SEQ ID NO: 946193 - protein, 20 aa, Mycobacterium
IAAVGLIGASLGSASVALAG

SEQ ID NO: 946194 - protein, 24 aa, Mycobacterium
IAAVKVIFRVSLRMAPTVLSPRFA

SEQ ID NO: 946195 - protein, 17 aa, Mycobacterium
IAAWVLCAGAVVGAPPV

SEQ ID NO: 946196 - protein, 17 aa, Mycobacterium
IADGHLIRYMSTSGATG

SEQ ID NO: 946197 - protein, 23 aa, Mycobacterium
IADGTIHCPCHGSEFNLDGTVAK

SEQ ID NO: 946198 - protein, 18 aa, Mycobacterium
IADNYGPTVLPPTEPRYV

SEQ ID NO: 946199 - protein, 23 aa, Mycobacterium
IADYDELFEPIRAARLKASGNQL

SEQ ID NO: 946200 - protein, 20 aa, Mycobacterium
IAEHLLGAARRRAFRVWLDG

SEQ ID NO: 946201 - protein, 25 aa, Mycobacterium
IAELQNHPLVYFIDSMLQVDDLDLA

SEQ ID NO: 946202 - protein, 23 aa, Mycobacterium
IAELVAPRLPRLAPQDPRPRLIG

SEQ ID NO: 946203 - protein, 18 aa, Mycobacterium
IAFLIRATGQPQDAVLTA

SEQ ID NO: 946204 - protein, 19 aa, Mycobacterium
IAGLGYTAPLPRAVVPHVA

SEQ ID NO: 946205 - protein, 18 aa, Mycobacterium
IAGPEKQGMDYFIRTRFA

SEQ ID NO: 946206 - protein, 24 aa, Mycobacterium
IAGPVLAFWLAHYGFEVTVIERSP

SEQ ID NO: 946207 - protein, 24 aa, Mycobacterium
IAGPVLAYWLARYGFDVTVVERAP

SEQ ID NO: 946208 - protein, 20 aa, Mycobacterium
IAHVVAFMDVSLFRKFGLPE

SEQ ID NO: 946209 - protein, 21 aa, Mycobacterium
IAIALVVLTAPAPAAAKPGVT

SEQ ID NO: 946210 - protein, 19 aa, Mycobacterium
IAILAVVAALTAALVAELR

SEQ ID NO: 946211 - protein, 19 aa, Mycobacterium
IAILAVVVALIAALVAQLR

SEQ ID NO: 946212 - protein, 19 aa, Mycobacterium
IAISVLLSSACSASQVINT

SEQ ID NO: 946213 - protein, 17 aa, Mycobacterium
IAKLIDPAIVDEAFAPI

SEQ ID NO: 946214 - protein, 17 aa, Mycobacterium
IAKRRNVGAFNWGLVAG

SEQ ID NO: 946215 - protein, 17 aa, Mycobacterium
IALAAALALTPCTTETP

SEQ ID NO: 946216 - protein, 22 aa, Mycobacterium
IALARQYGGALPALPTRDLAEM

SEQ ID NO: 946217 - protein, 23 aa, Mycobacterium
IALFGLFAAAIPAAAAPAAGADD

SEQ ID NO: 946218 - protein, 17 aa, Mycobacterium
IALGRPAVILPMGRAVG

SEQ ID NO: 946219 - protein, 26 aa, Mycobacterium
IALLAEAIIFLEAYGVDTTAAVKVLG

SEQ ID NO: 946220 - protein, 19 aa, Mycobacterium
IALLATPAAILSGCSNQSG

SEQ ID NO: 946221 - protein, 36 aa, Mycobacterium
IAMRHDSHFIDWSGAPYRRFLLGNLGRGSTLPKRAQ

SEQ ID NO: 946222 - protein, 23 aa, Mycobacterium
IANHYYLYELINAKGADAVTARN

SEQ ID NO: 946223 - protein, 17 aa, Mycobacterium
IAPFMSYGSFTGDAPLG

SEQ ID NO: 946224 - protein, 22 aa, Mycobacterium
IAPGFVHTPLTAPAAMIPGVVE

SEQ ID NO: 946225 - protein, 28 aa, Mycobacterium
IAPNAAAYRVLWYVASPTNISGATIPDG

SEQ ID NO: 946226 - protein, 33 aa, Mycobacterium
IAQAVELWKIVDRPNLFIKIPATEAGIPAITAV

SEQ ID NO: 946227 - protein, 19 aa, Mycobacterium
IARAAAVDRTFLYRHPDLL

SEQ ID NO: 946228 - protein, 22 aa, Mycobacterium
IARAPWMLSRIYAPTGDVDHKR

SEQ ID NO: 946229 - protein, 26 aa, Mycobacterium
IARAWEAMLAAHLQWRTMLSRLPEGD

SEQ ID NO: 946230 - protein, 29 aa, Mycobacterium
IARDLRAEFPWLGVALQAYLRRTPGDCEE

SEQ ID NO: 946231 - protein, 18 aa, Mycobacterium
IARYLRRQLTALEDFTPT

SEQ ID NO: 946232 - protein, 33 aa, Mycobacterium
IASDPATFPTYYRWDVYYVTTAGDVLLPVGYAE

SEQ ID NO: 946233 - protein, 25 aa, Mycobacterium
IASDRLRLEGYRRLAAAPDDAAVDA

SEQ ID NO: 946234 - protein, 23 aa, Mycobacterium
IASEWGVIGWPEATAYAAAKSGL

SEQ ID NO: 946235 - protein, 24 aa, Mycobacterium
IASLWAATAFLTALLVVAGCTTIV

SEQ ID NO: 946236 - protein, 20 aa, Mycobacterium
IATITAPIAFAAYPITGKFG

SEQ ID NO: 946237 - protein, 29 aa, Mycobacterium
IATRIGSTSEWWLQRYLAHNKVDTSKVEI

SEQ ID NO: 946238 - protein, 19 aa, Mycobacterium
IAVDSAWHTWRCQWDEAGI

SEQ ID NO: 946239 - protein, 18 aa, Mycobacterium
IAVDTKPVTVFIGSTPIG

SEQ ID NO: 946240 - protein, 27 aa, Mycobacterium
IAVHLRGHFLLTRNAAAYWRAKAKDTP

SEQ ID NO: 946241 - protein, 20 aa, Mycobacterium
IAVKLHILTRKSLGGLQTDL

SEQ ID NO: 946242 - protein, 18 aa, Mycobacterium
IAVLGRLTTIDKLIGEWT

SEQ ID NO: 946243 - protein, 17 aa, Mycobacterium
IAVPIAAFGFKNPLPDG

SEQ ID NO: 946244 - protein, 19 aa, Mycobacterium
IAVPLPWNGYRGAEGIRLV

SEQ ID NO: 946245 - protein, 17 aa, Mycobacterium
IAVPLVPSLLVEVSPAD

SEQ ID NO: 946246 - protein, 17 aa, Mycobacterium
IAVVSYHRLGTGAVTGT

SEQ ID NO: 946247 - protein, 18 aa, Mycobacterium
ICAALLSAPLIIASASAA

SEQ ID NO: 946248 - protein, 19 aa, Mycobacterium
ICAGLAYWQQTLAGLPERL

SEQ ID NO: 946249 - protein, 17 aa, Mycobacterium
ICDLNITGFFPGLNDVV

SEQ ID NO: 946250 - protein, 33 aa, Mycobacterium
IDAAEIYVPFSWFEPMWLENLGFVAEGEGWKLT

SEQ ID NO: 946251 - protein, 24 aa, Mycobacterium
IDAAVIDPLVPQLGKGGGTLPITL

SEQ ID NO: 946252 - protein, 18 aa, Mycobacterium
IDALNHAGIDFGEPGNAM

SEQ ID NO: 946253 - protein, 23 aa, Mycobacterium
IDDLTRMVLLNAAYLKASWERPF

SEQ ID NO: 946254 - protein, 23 aa, Mycobacterium
IDEFATGLWWMNPEGVPPSHQPD

SEQ ID NO: 946255 - protein, 27 aa, Mycobacterium
IDELPADAWLIDLGIQPLRDLPRPERV

SEQ ID NO: 946256 - protein, 23 aa, Mycobacterium
IDERARPFAWRPGSDPSVADVVG

SEQ ID NO: 946257 - protein, 22 aa, Mycobacterium
IDEWEIQYPTMLTNPLDESGPS

SEQ ID NO: 946258 - protein, 17 aa, Mycobacterium
IDGFAEALPRWLGGGTD

SEQ ID NO: 946259 - protein, 24 aa, Mycobacterium
IDGINGLADLWRSLSRKDVFPTNL

SEQ ID NO: 946260 - protein, 19 aa, Mycobacterium
IDHVRSAIAAFKRPREVLF

SEQ ID NO: 946261 - protein, 25 aa, Mycobacterium
IDIGSAVAYLIGPAARYVTGQTLGV

SEQ ID NO: 946262 - protein, 19 aa, Mycobacterium
IDIWPVSYQFRTGERIRLE

SEQ ID NO: 946263 - protein, 21 aa, Mycobacterium
IDKIVYLSQYQAQALFTMRVS

SEQ ID NO: 946264 - protein, 23 aa, Mycobacterium
IDLSRTVGWFTTKYPVAITVAPL

SEQ ID NO: 946265 - protein, 30 aa, Mycobacterium
IDLVPEYIGNLLLYFDPHATVTLLDAVELE

SEQ ID NO: 946266 - protein, 22 aa, Mycobacterium
IDMPQYLDYLTRRLAAAGCEVE

SEQ ID NO: 946267 - protein, 20 aa, Mycobacterium
IDNVPIGWGALGALSADPKN

SEQ ID NO: 946268 - protein, 19 aa, Mycobacterium
IDPQALLPAISPQVTSAPP

SEQ ID NO: 946269 - protein, 18 aa, Mycobacterium
IDPQWHVNSVWSGELGFE

SEQ ID NO: 946270 - protein, 17 aa, Mycobacterium
IDRDVAFAELGFDSRMT

SEQ ID NO: 946271 - protein, 18 aa, Mycobacterium
IDRGGAVGGLLFDGTNNF

SEQ ID NO: 946272 - protein, 17 aa, Mycobacterium
IDRLPNGVFLDWQQFQA

SEQ ID NO: 946273 - protein, 27 aa, Mycobacterium
IDRQAWNDLALPWFRGINSVIGVQRTG

SEQ ID NO: 946274 - protein, 27 aa, Mycobacterium
IDRQTWNNLALPWFRGINSVIGVQRTG

SEQ ID NO: 946275 - protein, 25 aa, Mycobacterium
IDSDALVLHYLPEVDLWTGAVVAAE

SEQ ID NO: 946276 - protein, 26 aa, Mycobacterium
IDSGLHVNLLNPFRGIGTSAFNLINQ

SEQ ID NO: 946277 - protein, 24 aa, Mycobacterium
IDSNHLGRFIGINDLAVEPPPREQ

SEQ ID NO: 946278 - protein, 30 aa, Mycobacterium
IDTNYDGAVVWQVALVHRDGSTLQIDVDAK

SEQ ID NO: 946279 - protein, 22 aa, Mycobacterium
IDVCLNGAFIVTKHAGRHLRRG

SEQ ID NO: 946280 - protein, 20 aa, Mycobacterium
IDVCLTGGFIVAKHAGRHLP

SEQ ID NO: 946281 - protein, 19 aa, Mycobacterium
IDYAFRHLQFWFNDDITHL

SEQ ID NO: 946282 - protein, 23 aa, Mycobacterium
IDYTADVLAPQGPIPVIGTFTEL

SEQ ID NO: 946283 - protein, 27 aa, Mycobacterium
IEDLLSAPAIKLLIRKTGATSAEMVAQ

SEQ ID NO: 946284 - protein, 19 aa, Mycobacterium
IEEAVAVGDLVRLMEFRKG

SEQ ID NO: 946285 - protein, 20 aa, Mycobacterium
IEELIERFLRVLAAMIDDPE

SEQ ID NO: 946286 - protein, 17 aa, Mycobacterium
IEFDGRTLVDAPLGEFF

SEQ ID NO: 946287 - protein, 18 aa, Mycobacterium
IEFSTFTFGPPQIEALTA

SEQ ID NO: 946288 - protein, 24 aa, Mycobacterium
IEGGALVLHYLPEIDMRTGEVLAA

SEQ ID NO: 946289 - protein, 18 aa, Mycobacterium
IEGNKLSGTWFKMVQPGG

SEQ ID NO: 946290 - protein, 19 aa, Mycobacterium
IELTPAYRGGPTLRNHDTI

SEQ ID NO: 946291 - protein, 24 aa, Mycobacterium
IEMPPQQLAAYVAPFRASMVLASR

SEQ ID NO: 946292 - protein, 24 aa, Mycobacterium
IENAPLPWSFTIVTTLPSMSANIV

SEQ ID NO: 946293 - protein, 21 aa, Mycobacterium
IEPGIYFPGRWGARIEDIVVV

SEQ ID NO: 946294 - protein, 30 aa, Mycobacterium
IEPQPLRSKISFWFDRKYKVPADAKAAILS

SEQ ID NO: 946295 - protein, 29 aa, Mycobacterium
IEQTQDGRFLLTYPRRLGFGLGNSAVSLS

SEQ ID NO: 946296 - protein, 22 aa, Mycobacterium
IERHYRDCRILGIGGGTNEIMN

SEQ ID NO: 946297 - protein, 26 aa, Mycobacterium
IERLRSTWDVPALALIGIGNGAQVAL

SEQ ID NO: 946298 - protein, 17 aa, Mycobacterium
IERRRGDLPTGLRVDSS

SEQ ID NO: 946299 - protein, 17 aa, Mycobacterium
IERTLAGYLNLAGKRPA

SEQ ID NO: 946300 - protein, 26 aa, Mycobacterium
IESGVANPNIYWVHNDSGDTARVFAI

SEQ ID NO: 946301 - protein, 24 aa, Mycobacterium
IESTYVTGWVKRGPVGLIGHTKSD

SEQ ID NO: 946302 - protein, 24 aa, Mycobacterium
IEYGINWLPWILRGVYPPPAMPPE

SEQ ID NO: 946303 - protein, 19 aa, Mycobacterium
IEYSFFQSGSDVASALFAG

SEQ ID NO: 946304 - protein, 24 aa, Mycobacterium
IEYSFFQSGSDVVSALFAGAIDVA

SEQ ID NO: 946305 - protein, 19 aa, Mycobacterium
IFAGAGVGPTLAAAAAWDG

SEQ ID NO: 946306 - protein, 28 aa, Mycobacterium
IFAPEGLLHFGLGINAPPPCLTGFLPAS

SEQ ID NO: 946307 - protein, 20 aa, Mycobacterium
IFEKAPALGGTWWYNRYPGA

SEQ ID NO: 946308 - protein, 18 aa, Mycobacterium
IFGTHWHGVLDNDDFRRA

SEQ ID NO: 946309 - protein, 18 aa, Mycobacterium
IFLTLKEFEPTFSRGGDM

SEQ ID NO: 946310 - protein, 24 aa, Mycobacterium
IFMGWLFTLLGRPKVEGLEHIPSS

SEQ ID NO: 946311 - protein, 25 aa, Mycobacterium
IFRASDLRWDLLQNLPIDATKYPVP

SEQ ID NO: 946312 - protein, 18 aa, Mycobacterium
IFRDVAPDVYWATGILAR

SEQ ID NO: 946313 - protein, 26 aa, Mycobacterium
IFTVPNFLELDYWQKWHYGDATMAGV

SEQ ID NO: 946314 - protein, 29 aa, Mycobacterium
IFTVPNFLELDYWQKWHYGDNTMAGVYSA

SEQ ID NO: 946315 - protein, 18 aa, Mycobacterium
IGAALYYSVPAGADPDPV

SEQ ID NO: 946316 - protein, 21 aa, Mycobacterium
IGAFGDLTRPGLDVVVCAPQV

SEQ ID NO: 946317 - protein, 18 aa, Mycobacterium
IGAFGFDSPLPPGVDQHI

SEQ ID NO: 946318 - protein, 18 aa, Mycobacterium
IGALALALGIGIGLGSAA

SEQ ID NO: 946319 - protein, 24 aa, Mycobacterium
IGATALLMASSCSWQMGIRVPDGV

SEQ ID NO: 946320 - protein, 33 aa, Mycobacterium
IGATAMLLASSCTWQLSLFIPDGVPPPPGDPVP

SEQ ID NO: 946321 - protein, 24 aa, Mycobacterium
IGATAMLLASSCTWQLSLFIPEGV

SEQ ID NO: 946322 - protein, 22 aa, Mycobacterium
IGAVEAFWGVDWSREIALVAAH

SEQ ID NO: 946323 - protein, 24 aa, Mycobacterium
IGDGHVRVIRGFFANLPSGVDPCI

SEQ ID NO: 946324 - protein, 17 aa, Mycobacterium
IGDIDAFALYQPVGWQS

SEQ ID NO: 946325 - protein, 25 aa, Mycobacterium
IGEAFVLAEKLGLPAQSLFDVITGA

SEQ ID NO: 946326 - protein, 25 aa, Mycobacterium
IGEAHLICYDLTWGWTPQQIADDVH

SEQ ID NO: 946327 - protein, 19 aa, Mycobacterium
IGEKILPGLGLDGPSIGES

SEQ ID NO: 946328 - protein, 21 aa, Mycobacterium
IGETFFTTAYFDPNMAHMDEI

SEQ ID NO: 946329 - protein, 20 aa, Mycobacterium
IGHAPRPLAPGALAGLLLDT

SEQ ID NO: 946330 - protein, 17 aa, Mycobacterium
IGIFQPAPDERRAPTFA

SEQ ID NO: 946331 - protein, 19 aa, Mycobacterium
IGILTGAWSPPRATAAPAT

SEQ ID NO: 946332 - protein, 19 aa, Mycobacterium
IGLAAALLGLTGCAPTTST

SEQ ID NO: 946333 - protein, 21 aa, Mycobacterium
IGLAILVPTYAAIELTTAPTS

SEQ ID NO: 946334 - protein, 19 aa, Mycobacterium
IGLALLGAPMVVPTVATAD

SEQ ID NO: 946335 - protein, 24 aa, Mycobacterium
IGLAMLAAPMIAAAIASADPGTRP

SEQ ID NO: 946336 - protein, 20 aa, Mycobacterium
IGLAMMVSPMAAVPGLAAAD

SEQ ID NO: 946337 - protein, 17 aa, Mycobacterium
IGLSFLGGVGIAYPPQV

SEQ ID NO: 946338 - protein, 25 aa, Mycobacterium
IGLSLFVVFAIGVTTLVYGTLRRDT

SEQ ID NO: 946339 - protein, 19 aa, Mycobacterium
IGLVMMAAPMAAAPGIAAA

SEQ ID NO: 946340 - protein, 24 aa, Mycobacterium
IGNATLFWMIRNSKVRQPAAGDWT

SEQ ID NO: 946341 - protein, 22 aa, Mycobacterium
IGNDGRFTYTPTAAARHAAANA

SEQ ID NO: 946342 - protein, 18 aa, Mycobacterium
IGNGGMGGAGLRGGDGGT

SEQ ID NO: 946343 - protein, 23 aa, Mycobacterium
IGNPTPADILLDLARKQDAAVKA

SEQ ID NO: 946344 - protein, 17 aa, Mycobacterium
IGPTTRALDGSEAIAQF

SEQ ID NO: 946345 - protein, 35 aa, Mycobacterium
IGRAAPYLIRALKLILVRPFDIDAVPKAFRGDYFN

SEQ ID NO: 946346 - protein, 18 aa, Mycobacterium
IGRAGLAAYLKTLASEVA

SEQ ID NO: 946347 - protein, 26 aa, Mycobacterium
IGRGCLGRPWLFAELSAAFTGSPPPT

SEQ ID NO: 946348 - protein, 17 aa, Mycobacterium
IGRIVNLRPAVLSAAAS

SEQ ID NO: 946349 - protein, 21 aa, Mycobacterium
IGRQLEEGCFDLMFFDDRLAM

SEQ ID NO: 946350 - protein, 19 aa, Mycobacterium
IGRQMHMDPFLPNEGSPGR

SEQ ID NO: 946351 - protein, 20 aa, Mycobacterium
IGRRPLITEALRGEGAKLVD

SEQ ID NO: 946352 - protein, 17 aa, Mycobacterium
IGRTGERQGFWSGSLHA

SEQ ID NO: 946353 - protein, 18 aa, Mycobacterium
IGTFTVLEAVRRHGRRLH

SEQ ID NO: 946354 - protein, 23 aa, Mycobacterium
IGTHRLLQTGVRWKDLGLVVVDE

SEQ ID NO: 946355 - protein, 17 aa, Mycobacterium
IGTVSNAVFFGHNIYGQ

SEQ ID NO: 946356 - protein, 21 aa, Mycobacterium
IGTVVLPDAPLKIFLTASAET

SEQ ID NO: 946357 - protein, 20 aa, Mycobacterium
IGVDFMVPGLTTVTGRVPNA

SEQ ID NO: 946358 - protein, 26 aa, Mycobacterium
IGVDGVSWRILLEDLNIAWAQRRAHQ

SEQ ID NO: 946359 - protein, 17 aa, Mycobacterium
IGVYAVNYPASRLQLHG

SEQ ID NO: 946360 - protein, 18 aa, Mycobacterium
IGWAQLQRRRLGPGPGRA

SEQ ID NO: 946361 - protein, 29 aa, Mycobacterium
IGWDTPVVEHLPWFALSDPVTTRMVTVGD

SEQ ID NO: 946362 - protein, 26 aa, Mycobacterium
IHCGNSSFIPYLTLAPRASDAVKELR

SEQ ID NO: 946363 - protein, 20 aa, Mycobacterium
IHHGALVSCVFRPATAACLP

SEQ ID NO: 946364 - protein, 22 aa, Mycobacterium
IHICTLAYVDAKLRMAFSAGHC

SEQ ID NO: 946365 - protein, 18 aa, Mycobacterium
IHLVTLLEALPMQETAEA

SEQ ID NO: 946366 - protein, 19 aa, Mycobacterium
IHLVTLLEALPMQETLEAI

SEQ ID NO: 946367 - protein, 19 aa, Mycobacterium
IHNWTYWGNQLRAMKADLV

SEQ ID NO: 946368 - protein, 19 aa, Mycobacterium
IHSYLDVVPLLTTKGFRVL

SEQ ID NO: 946369 - protein, 18 aa, Mycobacterium
IHTVRMGGRLFPDKYWPV

SEQ ID NO: 946370 - protein, 17 aa, Mycobacterium
IIALAAQLREGSGPAGH

SEQ ID NO: 946371 - protein, 18 aa, Mycobacterium
IIDDLLILTQPPAQDPRA

SEQ ID NO: 946372 - protein, 28 aa, Mycobacterium
IIGPRYEDLMAPFYGMGRYGIGKKIAGR

SEQ ID NO: 946373 - protein, 19 aa, Mycobacterium
IIKNRQYNFPPLGENLVVG

SEQ ID NO: 946374 - protein, 36 aa, Mycobacterium
IILVDRSFDGVLGLSLLWVLRGWRRPDEVRFRASPT

SEQ ID NO: 946375 - protein, 17 aa, Mycobacterium
IINPLLDVLWETDPLDL

SEQ ID NO: 946376 - protein, 18 aa, Mycobacterium
IIPALDYLKEQGVKSLYL

SEQ ID NO: 946377 - protein, 23 aa, Mycobacterium
IITLWLGLVAHFGEMANGGSANV

SEQ ID NO: 946378 - protein, 30 aa, Mycobacterium
IITRGLAEIMRLGIALGAKGATLAGLAGVG

SEQ ID NO: 946379 - protein, 17 aa, Mycobacterium
IIVQSLLADDFGLPYPP

SEQ ID NO: 946380 - protein, 20 aa, Mycobacterium
IKEFAPLIGVRKAGLFTSSS

SEQ ID NO: 946381 - protein, 27 aa, Mycobacterium
IKFDCLTAGCWPAWWLGNQDRGEIDII

SEQ ID NO: 946382 - protein, 29 aa, Mycobacterium
IKFNCLTDGCWPAWWLLNDNPERGGEIDM

SEQ ID NO: 946383 - protein, 23 aa, Mycobacterium
IKRRWDDFVVGGLGIRCVADRPW

SEQ ID NO: 946384 - protein, 35 aa, Mycobacterium
IKVRHYRPRFFGKPFFALAQALLRGPSPWTVGERE

SEQ ID NO: 946385 - protein, 26 aa, Mycobacterium
IKVSIFAAAMLLVSAALVVVFGDFRF

SEQ ID NO: 946386 - protein, 40 aa, Mycobacterium
IKVSIFALAMLLVAAALVVVFGDFRFGPKATYHATFTNAS

SEQ ID NO: 946387 - protein, 19 aa, Mycobacterium
ILAAPVAVAVTLGWAAHRG

SEQ ID NO: 946388 - protein, 21 aa, Mycobacterium
ILALWAAVAGAFVSVLYRRQA

SEQ ID NO: 946389 - protein, 17 aa, Mycobacterium
ILAYFDGVARRYGVEEL

SEQ ID NO: 946390 - protein, 20 aa, Mycobacterium
ILDRLFAGLMSYDATGHPSP

SEQ ID NO: 946391 - protein, 20 aa, Mycobacterium
ILDRLFAGLMSYDATGKPSP

SEQ ID NO: 946392 - protein, 20 aa, Mycobacterium
ILDRLFAGLVSYDAAGKPSP

SEQ ID NO: 946393 - protein, 23 aa, Mycobacterium
ILGAAAVLPAPRAAAGVAGMSVF

SEQ ID NO: 946394 - protein, 17 aa, Mycobacterium
ILGHLSLRIDDDRLLIR

SEQ ID NO: 946395 - protein, 17 aa, Mycobacterium
ILGLLDVDLLAAVGAGS

SEQ ID NO: 946396 - protein, 35 aa, Mycobacterium
ILIARNDRYWGPPAKPSLILFRRAGAPAALADSVR

SEQ ID NO: 946397 - protein, 18 aa, Mycobacterium
ILIMLAVIGIVATVSSVH

SEQ ID NO: 946398 - protein, 27 aa, Mycobacterium
ILLADEGLVQIFPKLGSFVARIDPERV

SEQ ID NO: 946399 - protein, 17 aa, Mycobacterium
ILLSLGLADRMVGTSTW

SEQ ID NO: 946400 - protein, 20 aa, Mycobacterium
ILPAQALPGDLIFYGPNGSQ

SEQ ID NO: 946401 - protein, 17 aa, Mycobacterium
ILPVPARLSLKAAAAAL

SEQ ID NO: 946402 - protein, 25 aa, Mycobacterium
ILRVAPLSVAGLLRSRLFGHSTAVL

SEQ ID NO: 946403 - protein, 24 aa, Mycobacterium
ILSFTKRNTLKLTGARLSRDQWVR

SEQ ID NO: 946404 - protein, 29 aa, Mycobacterium
ILTDKLGTFPLFQYWGPTADITSSRWLVD

SEQ ID NO: 946405 - protein, 26 aa, Mycobacterium
ILTDRQIELTPPYRGGPTLQNNATIG

SEQ ID NO: 946406 - protein, 19 aa, Mycobacterium
ILTGGARAARGVRAHPPLP

SEQ ID NO: 946407 - protein, 36 aa, Mycobacterium
ILVARNDRYWGPPAKPALILFRRAGAPAALADSVRN

SEQ ID NO: 946408 - protein, 29 aa, Mycobacterium
ILVSNGIPPVVYRPPPPPSAPPPPPPGDA

SEQ ID NO: 946409 - protein, 19 aa, Mycobacterium
ILVSPFALATLLTWAAHRS

SEQ ID NO: 946410 - protein, 17 aa, Mycobacterium
ILVVAVLVLIGFVMGYN

SEQ ID NO: 946411 - protein, 17 aa, Mycobacterium
IMDFVKQMQSLSGGNVA

SEQ ID NO: 946412 - protein, 21 aa, Mycobacterium
IMIRLPLLRRACTVAATVCVL

SEQ ID NO: 946413 - protein, 17 aa, Mycobacterium
IMLMDLTAPLQPGADVE

SEQ ID NO: 946414 - protein, 18 aa, Mycobacterium
IMQTGIDYAFRHLQFWFN

SEQ ID NO: 946415 - protein, 26 aa, Mycobacterium
IMVMYSPTLWEAFTKALRQLSEGSGD

SEQ ID NO: 946416 - protein, 25 aa, Mycobacterium
IMVPEKHLPLVMPLKYVGIDEDTLN

SEQ ID NO: 946417 - protein, 31 aa, Mycobacterium
INALYTPAHWKYLTSGLLGLQRGTDAGDLLL

SEQ ID NO: 946418 - protein, 19 aa, Mycobacterium
INAPIPFTATPPTGNPNGQ

SEQ ID NO: 946419 - protein, 19 aa, Mycobacterium
INCFWRPTGTLFRWMLALM

SEQ ID NO: 946420 - protein, 26 aa, Mycobacterium
INDTAWIPVCYPAAIPTPVPGSPMPK

SEQ ID NO: 946421 - protein, 19 aa, Mycobacterium
INFAWITAVVAGLTLAVAA

SEQ ID NO: 946422 - protein, 30 aa, Mycobacterium
INGGYFCRGLPRDFDRIGLPGWGWSEVLDS

SEQ ID NO: 946423 - protein, 17 aa, Mycobacterium
INGHQWLTAVRIDDGLL

SEQ ID NO: 946424 - protein, 24 aa, Mycobacterium
INGPAGGDILIPFGGPVDPSKGRC

SEQ ID NO: 946425 - protein, 18 aa, Mycobacterium
INHVIWRQKIYPGVGGGN

SEQ ID NO: 946426 - protein, 22 aa, Mycobacterium
INLAWITAMVTGLLVAVAAPAD

SEQ ID NO: 946427 - protein, 25 aa, Mycobacterium
INNTGSFNTGLFNTGFRTAGIANSA

SEQ ID NO: 946428 - protein, 21 aa, Mycobacterium
INPQAPPMVLPPAPSDDRPSG

SEQ ID NO: 946429 - protein, 19 aa, Mycobacterium
INQPPPCLTGFIPASEWRS

SEQ ID NO: 946430 - protein, 26 aa, Mycobacterium
INTDITRFIDWFNRAVAPAVDHPLIP

SEQ ID NO: 946431 - protein, 23 aa, Mycobacterium
INTNLGYLQFGANPLTPVASVTG

SEQ ID NO: 946432 - protein, 17 aa, Mycobacterium
INTPAFEWFYNSGISVV

SEQ ID NO: 946433 - protein, 23 aa, Mycobacterium
INVFGHIQLAQGIVPKMVARKSG

SEQ ID NO: 946434 - protein, 18 aa, Mycobacterium
INVLRTLHLVGLDSTAPV

SEQ ID NO: 946435 - protein, 17 aa, Mycobacterium
INVWGQWCGPCRSEFSA

SEQ ID NO: 946436 - protein, 25 aa, Mycobacterium
INWSTVYAAADRPLAGLGGDGRAIV

SEQ ID NO: 946437 - protein, 19 aa, Mycobacterium
IPAAHWRLGDACELSLLES

SEQ ID NO: 946438 - protein, 26 aa, Mycobacterium
IPAERMIRYYTARGLLPRPGTRGRAL

SEQ ID NO: 946439 - protein, 18 aa, Mycobacterium
IPALHLRLLEDDKHFFPL

SEQ ID NO: 946440 - protein, 22 aa, Mycobacterium
IPALLILTTLGLGRLEVALSDD

SEQ ID NO: 946441 - protein, 35 aa, Mycobacterium
IPAVPDIVGIYGVGPIFWAADLLGLTPTGVIQAAA

SEQ ID NO: 946442 - protein, 25 aa, Mycobacterium
IPEGNPWFTSYDRYRFDLDESKRLL

SEQ ID NO: 946443 - protein, 20 aa, Mycobacterium
IPGFFDVFFGLPEHHRWTYL

SEQ ID NO: 946444 - protein, 28 aa, Mycobacterium
IPGGKSALGLWSWAIPANSAASDAAWAF

SEQ ID NO: 946445 - protein, 19 aa, Mycobacterium
IPGLPAAAPAPAAPAPGAP

SEQ ID NO: 946446 - protein, 23 aa, Mycobacterium
IPGLPPITVPVLGPPPPPPPPPG

SEQ ID NO: 946447 - protein, 25 aa, Mycobacterium
IPGRNAAWLIIDVRDVAAVHAALLE

SEQ ID NO: 946448 - protein, 26 aa, Mycobacterium
IPGVDKIRLRLQRIGSVALATETVSE

SEQ ID NO: 946449 - protein, 17 aa, Mycobacterium
IPGYTPKGTLYQADVTA

SEQ ID NO: 946450 - protein, 17 aa, Mycobacterium
IPKDIVYEIFGPAGTKG

SEQ ID NO: 946451 - protein, 22 aa, Mycobacterium
IPNQWPPIYTGFWQTSYELFGV

SEQ ID NO: 946452 - protein, 18 aa, Mycobacterium
IPPALDTLVRQRPRFTEA

SEQ ID NO: 946453 - protein, 21 aa, Mycobacterium
IPQIDRALIAKYIADLRAHRL

SEQ ID NO: 946454 - protein, 26 aa, Mycobacterium
IPSGDTRAFLGARIGVRRGLVVDADG

SEQ ID NO: 946455 - protein, 18 aa, Mycobacterium
IPTGPRFEWFDQTGAYHS

SEQ ID NO: 946456 - protein, 21 aa, Mycobacterium
IPTVVVPPHPGITSAQGCLLV

SEQ ID NO: 946457 - protein, 19 aa, Mycobacterium
IQAQYWWTRPRVQNPKPTR

SEQ ID NO: 946458 - protein, 21 aa, Mycobacterium
IQDFWQHNYGQFFPGEFRPVE

SEQ ID NO: 946459 - protein, 18 aa, Mycobacterium
IQFGNVICRALRGGTSFD

SEQ ID NO: 946460 - protein, 24 aa, Mycobacterium
IQGKIPGLPIKTLNGDLTTAPATA

SEQ ID NO: 946461 - protein, 24 aa, Mycobacterium
IQGLNPGVVFPAEPIRVIFRNDQS

SEQ ID NO: 946462 - protein, 22 aa, Mycobacterium
IQLDRDVWPYIGAKAGGLPGDL

SEQ ID NO: 946463 - protein, 22 aa, Mycobacterium
IQLDRNVWPYIGAKAGGLPGDL

SEQ ID NO: 946464 - protein, 28 aa, Mycobacterium
IQLRTTGRLLGWRLGLDRIDPHGTVVLA

SEQ ID NO: 946465 - protein, 20 aa, Mycobacterium
IQLSYADGDIWDWAVPWDEW

SEQ ID NO: 946466 - protein, 37 aa, Mycobacterium
IQQAVELWKIVDRPNLLIKIPATKAGLPAIAAVLAEG

SEQ ID NO: 946467 - protein, 19 aa, Mycobacterium
IQQSLFYSPIYSEPDPDCM

SEQ ID NO: 946468 - protein, 22 aa, Mycobacterium
IQQVTERIPLPPNARRIEDPEM

SEQ ID NO: 946469 - protein, 17 aa, Mycobacterium
IQSDKLIPLSVFGPERI

SEQ ID NO: 946470 - protein, 23 aa, Mycobacterium
IQSTFVGALCRWQAMSKSGGLVD

SEQ ID NO: 946471 - protein, 18 aa, Mycobacterium
IQSVTRGAVWFSSSTDLT

SEQ ID NO: 946472 - protein, 18 aa, Mycobacterium
IQVHDGALLVLERDKLNG

SEQ ID NO: 946473 - protein, 26 aa, Mycobacterium
IQWIAKANLRRQISDPWVRRQLTPDF

SEQ ID NO: 946474 - protein, 32 aa, Mycobacterium
IRARSTGVTDHRTGRPRYPGAAGTPVPAPTEQ

SEQ ID NO: 946475 - protein, 31 aa, Mycobacterium
IRCGDLDRVTLFRAWYSRRNFGRLAGSAQIS

SEQ ID NO: 946476 - protein, 19 aa, Mycobacterium
IRDFEPIGLFLNEVQGFMS

SEQ ID NO: 946477 - protein, 24 aa, Mycobacterium
IRDGGGTPSFLGYHGFPASICASV

SEQ ID NO: 946478 - protein, 18 aa, Mycobacterium
IREQLAALPGVQLRPQTR

SEQ ID NO: 946479 - protein, 37 aa, Mycobacterium
IRGDFMNQFIVFDFTIPRLKSGILLGTRWGQPGASLV

SEQ ID NO: 946480 - protein, 18 aa, Mycobacterium
IRGYTYWSFVDNLEWSEG

SEQ ID NO: 946481 - protein, 26 aa, Mycobacterium
IRHGGATTDWWAFRSACTTNGCAATG

SEQ ID NO: 946482 - protein, 24 aa, Mycobacterium
IRIDQPILRVPNLAIHMVSAEERK

SEQ ID NO: 946483 - protein, 22 aa, Mycobacterium
IRIQALQRTSDFLRPGHNVDLV

SEQ ID NO: 946484 - protein, 18 aa, Mycobacterium
IRQPMTDFRARCGLPPAG

SEQ ID NO: 946485 - protein, 19 aa, Mycobacterium
IRRLMVRGQKYLTLTFATD

SEQ ID NO: 946486 - protein, 26 aa, Mycobacterium
IRSAVSFLVALAALAAMAVASFTSSA

SEQ ID NO: 946487 - protein, 24 aa, Mycobacterium
IRSGPVRWRLLLTVGEQQDPVTDA

SEQ ID NO: 946488 - protein, 25 aa, Mycobacterium
IRSTAAFPGLALAGVITSSADKAGR

SEQ ID NO: 946489 - protein, 22 aa, Mycobacterium
IRTHSGIVLRVAAALASVAMVT

SEQ ID NO: 946490 - protein, 19 aa, Mycobacterium
IRYYTARGLLPRPGTRGRA

SEQ ID NO: 946491 - protein, 30 aa, Mycobacterium
ISAEYFGAALAFLIRILGKLVADGYIANSR

SEQ ID NO: 946492 - protein, 18 aa, Mycobacterium
ISAFGFDSPLPPGADQHI

SEQ ID NO: 946493 - protein, 20 aa, Mycobacterium
ISAIAMLTVAAGVAVVALLG

SEQ ID NO: 946494 - protein, 20 aa, Mycobacterium
ISAPVPFAAAPPTSNPNGKP

SEQ ID NO: 946495 - protein, 24 aa, Mycobacterium
ISAQAMAFHDQFARSLSAASGSYA

SEQ ID NO: 946496 - protein, 20 aa, Mycobacterium
ISAVLISPPQAPAGTHWTPP

SEQ ID NO: 946497 - protein, 20 aa, Mycobacterium
ISAVLLIRERGARATAISDV

SEQ ID NO: 946498 - protein, 25 aa, Mycobacterium
ISDDLVDPKPFWEKPLALADVLDVG

SEQ ID NO: 946499 - protein, 19 aa, Mycobacterium
ISDPWVRRQLTPDFRAGCK

SEQ ID NO: 946500 - protein, 17 aa, Mycobacterium
ISELFVDAMLTPGTTKA

SEQ ID NO: 946501 - protein, 34 aa, Mycobacterium
ISELLGEPLLALRIPWYVTVLDLGPAGAVYTEGW

SEQ ID NO: 946502 - protein, 17 aa, Mycobacterium
ISEPFKGWLGGAAVELL

SEQ ID NO: 946503 - protein, 28 aa, Mycobacterium
ISGIEILNQWYYRPDYMAIMSNCANTEI

SEQ ID NO: 946504 - protein, 24 aa, Mycobacterium
ISGQTLFGFGWDIDTPYSAPRGVV

SEQ ID NO: 946505 - protein, 26 aa, Mycobacterium
ISGVELLNQWYYNPAYFAIMSDCANT

SEQ ID NO: 946506 - protein, 17 aa, Mycobacterium
ISGWTLVCRGENAAALK

SEQ ID NO: 946507 - protein, 26 aa, Mycobacterium
ISLAAVFLALAIGVALGSGLLSNTVL

SEQ ID NO: 946508 - protein, 27 aa, Mycobacterium
ISLAAVFLALAIGVALGSGLLSNTVLS

SEQ ID NO: 946509 - protein, 22 aa, Mycobacterium
ISLAAVFLALAIGVVLGSGFFS

SEQ ID NO: 946510 - protein, 21 aa, Mycobacterium
ISLAAVFLALAVGVILGSGLL

SEQ ID NO: 946511 - protein, 24 aa, Mycobacterium
ISRAPWRLLQLYDDPTNTTAVIFR

SEQ ID NO: 946512 - protein, 23 aa, Mycobacterium
ISRAPWRLLQLYEDPADAAATIF

SEQ ID NO: 946513 - protein, 19 aa, Mycobacterium
ISRRTLLRASLAGALLVPA

SEQ ID NO: 946514 - protein, 19 aa, Mycobacterium
ISSDCVAAVFGGWTSSSRK

SEQ ID NO: 946515 - protein, 41 aa, Mycobacterium
ISSIPPVPGKFYWMSPTQVRWRPLQFWPANTAVNIDAAGTR

SEQ ID NO: 946516 - protein, 27 aa, Mycobacterium
ISTLDDLRIWVPALATGVLLKPDSQQQ

SEQ ID NO: 946517 - protein, 23 aa, Mycobacterium
ISVDGIYLHQLNDTIWAQGNTNV

SEQ ID NO: 946518 - protein, 18 aa, Mycobacterium
ISVLRVIPTAGLGRTTLL

SEQ ID NO: 946519 - protein, 25 aa, Mycobacterium
ISWGIMIKRGLALAAVTALTVAGLN

SEQ ID NO: 946520 - protein, 24 aa, Mycobacterium
ITAATLALAPLGCALGTAAAQNDG

SEQ ID NO: 946521 - protein, 20 aa, Mycobacterium
ITAGAIIGAALYYSVPAGAD

SEQ ID NO: 946522 - protein, 24 aa, Mycobacterium
ITAHDFVYAVKRFPDPNAQVSAIT

SEQ ID NO: 946523 - protein, 18 aa, Mycobacterium
ITAIGDPAAMQAALEAAP

SEQ ID NO: 946524 - protein, 23 aa, Mycobacterium
ITALVPGLTWRTDMDTWTGCGGD

SEQ ID NO: 946525 - protein, 17 aa, Mycobacterium
ITAMVAAIGRQIPLDTT

SEQ ID NO: 946526 - protein, 17 aa, Mycobacterium
ITASAFAVAAMGLAGTA

SEQ ID NO: 946527 - protein, 25 aa, Mycobacterium
ITDDQLIFYFAPGEMLPAFGGPAQA

SEQ ID NO: 946528 - protein, 17 aa, Mycobacterium
ITDRFPIEEAVLKSIKA

SEQ ID NO: 946529 - protein, 26 aa, Mycobacterium
ITELAQQVLLPRLPPKGLSQEELRAL

SEQ ID NO: 946530 - protein, 17 aa, Mycobacterium
ITFFFSPGELLPEAAGA

SEQ ID NO: 946531 - protein, 19 aa, Mycobacterium
ITGATCCIGVWGPAARDLV

SEQ ID NO: 946532 - protein, 29 aa, Mycobacterium
ITGTIQAMYTPRYWKYLTSGLSGLADGSG

SEQ ID NO: 946533 - protein, 18 aa, Mycobacterium
ITIFDYHLLPGPSDDYWA

SEQ ID NO: 946534 - protein, 26 aa, Mycobacterium
ITIHTELRWSPPVPTLVELSAEAELV

SEQ ID NO: 946535 - protein, 17 aa, Mycobacterium
ITIPAAILQAPFYDAKG

SEQ ID NO: 946536 - protein, 22 aa, Mycobacterium
ITKIDDLWDPAFKGRVSLLSDV

SEQ ID NO: 946537 - protein, 28 aa, Mycobacterium
ITMLPNGELVKRCYADILPAATAGTLFI

SEQ ID NO: 946538 - protein, 17 aa, Mycobacterium
ITMNLDGWDQLDRKLRD

SEQ ID NO: 946539 - protein, 25 aa, Mycobacterium
ITNCKFDWPQARLTLALSPATLPKT

SEQ ID NO: 946540 - protein, 17 aa, Mycobacterium
ITPAAWGVPSNIAGMVV

SEQ ID NO: 946541 - protein, 35 aa, Mycobacterium
ITPHVLGGRLLADGGILDPLPMAPIAAAPADITIA

SEQ ID NO: 946542 - protein, 25 aa, Mycobacterium
ITPTGSWIFRECAAWGLGRSDTADR

SEQ ID NO: 946543 - protein, 24 aa, Mycobacterium
ITRSHLQIEILPGLAATSAVPTYA

SEQ ID NO: 946544 - protein, 25 aa, Mycobacterium
ITSGRKWPVLFAGLMLGEPSFIPEP

SEQ ID NO: 946545 - protein, 38 aa, Mycobacterium
ITTKPAVEGAFYWLNNREVRWRPEHFWKSGTSVDVAVN

SEQ ID NO: 946546 - protein, 24 aa, Mycobacterium
ITTTQLALPGGMQPLWGPDVRRVM

SEQ ID NO: 946547 - protein, 23 aa, Mycobacterium
ITVAQMLQRIVALMPMGVAVVDS

SEQ ID NO: 946548 - protein, 33 aa, Mycobacterium
ITVIDTLKGAVLQTISLRYTPTNLAVTPSGNRL

SEQ ID NO: 946549 - protein, 17 aa, Mycobacterium
ITVPIKPANARPTGKAT

SEQ ID NO: 946550 - protein, 32 aa, Mycobacterium
ITVYGWDQTVFFKNGDPFIWDRGRELGMVNRL

SEQ ID NO: 946551 - protein, 24 aa, Mycobacterium
ITYNEWSFAQAQKLNMAKIITSAG

SEQ ID NO: 946552 - protein, 26 aa, Mycobacterium
ITYNVAGVDGLVLDGPTLGKIFNGTV

SEQ ID NO: 946553 - protein, 17 aa, Mycobacterium
IVAAITGTLVTVPSGTA

SEQ ID NO: 946554 - protein, 17 aa, Mycobacterium
IVAAITGTLVTVPTAAT

SEQ ID NO: 946555 - protein, 18 aa, Mycobacterium
IVADLKGLYPVVRALAEN

SEQ ID NO: 946556 - protein, 20 aa, Mycobacterium
IVAFNPKYVRYEVFGPPGTV

SEQ ID NO: 946557 - protein, 20 aa, Mycobacterium
IVAGYLLAVAFVGLSAAAGW

SEQ ID NO: 946558 - protein, 24 aa, Mycobacterium
IVAVAGAGFSLTMAGLAHAGGPTD

SEQ ID NO: 946559 - protein, 29 aa, Mycobacterium
IVAVAVVLTLIIVNALRTPVNGPVRHYDA

SEQ ID NO: 946560 - protein, 19 aa, Mycobacterium
IVAVVVFSGKPRPGAGPSA

SEQ ID NO: 946561 - protein, 17 aa, Mycobacterium
IVDFLRALEQHDETAAL

SEQ ID NO: 946562 - protein, 25 aa, Mycobacterium
IVDIQLAQLQKRLAQRRLQLEVSLQ

SEQ ID NO: 946563 - protein, 23 aa, Mycobacterium
IVFSLVLAPVAWNAGAPAVQAAP

SEQ ID NO: 946564 - protein, 18 aa, Mycobacterium
IVFSLVVAGLIGAELYVR

SEQ ID NO: 946565 - protein, 17 aa, Mycobacterium
IVGLFEGMWGSAPAMES

SEQ ID NO: 946566 - protein, 29 aa, Mycobacterium
IVGNGWYFRDLGEVLLWRQSNKLVAGEKV

SEQ ID NO: 946567 - protein, 33 aa, Mycobacterium; identical to SEQ ID NO: 827976

SEQ ID NO: 946568 - protein, 17 aa, Mycobacterium
IVHFSAVWCGPCAAVRR

SEQ ID NO: 946569 - protein, 25 aa, Mycobacterium
IVHVSSFTALFRPDLETLTADLPVV

SEQ ID NO: 946570 - protein, 17 aa, Mycobacterium
IVIVFGQIRFDRTYGYS

SEQ ID NO: 946571 - protein, 19 aa, Mycobacterium
IVKNRQFNFPPFGENTFVG

SEQ ID NO: 946572 - protein, 17 aa, Mycobacterium
IVLLVAGLGFFVATNSG

SEQ ID NO: 946573 - protein, 18 aa, Mycobacterium
IVLLVVLVVFGAWGYQRA

SEQ ID NO: 946574 - protein, 19 aa, Mycobacterium
IVLVIGAIAFAVYSSSRAT

SEQ ID NO: 946575 - protein, 19 aa, Mycobacterium
IVMLCLVVAVATSVTSCKR

SEQ ID NO: 946576 - protein, 17 aa, Mycobacterium
IVNILRILLSNPQVWEK

SEQ ID NO: 946577 - protein, 26 aa, Mycobacterium
IVNKFRGDPALLEPGLRQLQAMTGRP

SEQ ID NO: 946578 - protein, 18 aa, Mycobacterium
IVPAPGWTLGHRGPNWVA

SEQ ID NO: 946579 - protein, 19 aa, Mycobacterium
IVQLTRDSMRIYGSRNFAA

SEQ ID NO: 946580 - protein, 25 aa, Mycobacterium
IVRDFVYIDAVVDALFAAVQRPATQ

SEQ ID NO: 946581 - protein, 17 aa, Mycobacterium
IVRDQGHWYSTGADFKR

SEQ ID NO: 946582 - protein, 34 aa, Mycobacterium
IVREQQADCFAGVYLYWVAAGKSPRFTLSTADGL

SEQ ID NO: 946583 - protein, 28 aa, Mycobacterium
IVREQQADCFAGVYLYWVAEGKSPRFRL

SEQ ID NO: 946584 - protein, 19 aa, Mycobacterium
IVRRRGDLPTGLRVDSSGN

SEQ ID NO: 946585 - protein, 19 aa, Mycobacterium
IVRTAFVGVTLAALGLVMG

SEQ ID NO: 946586 - protein, 23 aa, Mycobacterium
IVSAVPALVLRSTLPGCAPVKSD

SEQ ID NO: 946587 - protein, 20 aa, Mycobacterium
IVSLAFPKPPELLRAAYVRL

SEQ ID NO: 946588 - protein, 23 aa, Mycobacterium
IVSRYIAPFFPVDPNFVQSLFTP

SEQ ID NO: 946589 - protein, 17 aa, Mycobacterium
IVTLALAPGASLSENEL

SEQ ID NO: 946590 - protein, 25 aa, Mycobacterium
IVTNAWDAPFMRDVGGEFGHADGEV

SEQ ID NO: 946591 - protein, 19 aa, Mycobacterium
IVTPPLFPGVSISADLGNG

SEQ ID NO: 946592 - protein, 21 aa, Mycobacterium
IVTPRVMQLTLRANVPKLADT

SEQ ID NO: 946593 - protein, 27 aa, Mycobacterium
IVTQIRRGMYFFWPRSDAHLYAELKRL

SEQ ID NO: 946594 - protein, 17 aa, Mycobacterium
IVYGRPAERLRVVGVTG

SEQ ID NO: 946595 - protein, 25 aa, Mycobacterium
IWGDVELAWRLDRSGRFGPPRQWLV

SEQ ID NO: 946596 - protein, 17 aa, Mycobacterium
IWKAYVTIRPTKVPNAY

SEQ ID NO: 946597 - protein, 20 aa, Mycobacterium
IWYVKHTIPDWVPCPDGTAA

SEQ ID NO: 946598 - protein, 21 aa, Mycobacterium
IYAPYIHPWSEGKDLYFTLSR

SEQ ID NO: 946599 - protein, 18 aa, Mycobacterium
IYAREHPLHGFRRAWAHL

SEQ ID NO: 946600 - protein, 25 aa, Mycobacterium
IYAYGLRNPFRMTFTPTGELLVADV

SEQ ID NO: 946601 - protein, 26 aa, Mycobacterium
IYAYHTKTLKWCDIAYNVLVDKYGQI

SEQ ID NO: 946602 - protein, 25 aa, Mycobacterium
IYDPPMRTMIAFGGRYPTTVIPSTV

SEQ ID NO: 946603 - protein, 20 aa, Mycobacterium
IYEAWGRLGFERGALGLPTS

SEQ ID NO: 946604 - protein, 26 aa, Mycobacterium
IYEGPPPSIYPPYYPFGIGGYTVMHG

SEQ ID NO: 946605 - protein, 18 aa, Mycobacterium
IYFGRTPVYGLSGIFAQP

SEQ ID NO: 946606 - protein, 22 aa, Mycobacterium
IYGYPYLTPRTVAMLEQARAHR

SEQ ID NO: 946607 - protein, 20 aa, Mycobacterium
IYQNFFGALCYWVAADDAGN

SEQ ID NO: 946608 - protein, 24 aa, Mycobacterium
IYREPLSLKPFDYLPRPLRRSMGK

SEQ ID NO: 946609 - protein, 17 aa, Mycobacterium
IYSGARLHPLPQGTLQG

SEQ ID NO: 946610 - protein, 28 aa, Mycobacterium
IYTEASYGGALWDLLWAAGAGHQAIAAG

SEQ ID NO: 946611 - protein, 27 aa, Mycobacterium
KAAGTPLRLVSLVALDPAFGHLRSDDD

SEQ ID NO: 946612 - protein, 28 aa, Mycobacterium
KAALEVNWPYVFASLLENAVKGGVPFLP

SEQ ID NO: 946613 - protein, 19 aa, Mycobacterium
KAALGELAKALRLSSDGGA

SEQ ID NO: 946614 - protein, 20 aa, Mycobacterium
KAANQLIVAGNIALLAEAII

SEQ ID NO: 946615 - protein, 21 aa, Mycobacterium
KAASMVGYNWNLPALNDPAGA

SEQ ID NO: 946616 - protein, 18 aa, Mycobacterium
KACAQYLGPALRLMNFNY

SEQ ID NO: 946617 - protein, 39 aa, Mycobacterium
KACAQYLGPALRLMNFNYLPMPFNAYLGPAPKNVIYSEP

SEQ ID NO: 946618 - protein, 20 aa, Mycobacterium
KACIKSGWRRATAGGPDSMC

SEQ ID NO: 946619 - protein, 28 aa, Mycobacterium
KADAAALGFPIRLPVLPDGWKANSGGRG

SEQ ID NO: 946620 - protein, 17 aa, Mycobacterium
KADAVYLDPRWVASKDP

SEQ ID NO: 946621 - protein, 25 aa, Mycobacterium
KADGPVRGFGWRVDMFGPQGPTRTE

SEQ ID NO: 946622 - protein, 22 aa, Mycobacterium
KAELEKIRQPLTSLKNSCGADT

SEQ ID NO: 946623 - protein, 25 aa, Mycobacterium
KAFADSDAWFLIRAVTRPDAAALPR

SEQ ID NO: 946624 - protein, 20 aa, Mycobacterium
KAFRGDYFNLSLTLDLTMSA

SEQ ID NO: 946625 - protein, 22 aa, Mycobacterium
KAGDLVTWWTGDALMVFSGNDL

SEQ ID NO: 946626 - protein, 23 aa, Mycobacterium
KAGMQVSIPWPYSGNVHCEIDVD

SEQ ID NO: 946627 - protein, 26 aa, Mycobacterium
KAGRPTPELLAYQYLQTLPQMAKGEA

SEQ ID NO: 946628 - protein, 21 aa, Mycobacterium
KAGSDLLVRAWTRSFGVAATI

SEQ ID NO: 946629 - protein, 20 aa, Mycobacterium
KAILGLLDVDLLAAVGAGSD

SEQ ID NO: 946630 - protein, 19 aa, Mycobacterium
KAKIPAGALCGKLAVPVDY

SEQ ID NO: 946631 - protein, 25 aa, Mycobacterium
KAKIPPLLHGCLRIGGRICGPPSFD

SEQ ID NO: 946632 - protein, 24 aa, Mycobacterium
KAKSLLDAAGWKPGPDGIRVKDGK

SEQ ID NO: 946633 - protein, 21 aa, Mycobacterium
KANFTTLPWSKTIVAEMPGIF

SEQ ID NO: 946634 - protein, 17 aa, Mycobacterium
KANLVLSLLAKTEFAVA

SEQ ID NO: 946635 - protein, 20 aa, Mycobacterium
KAQAFVDFQFTPEGQKLWAE

SEQ ID NO: 946636 - protein, 29 aa, Mycobacterium
KAQPQRAVFTTLPWKLTITTTMTSVFANV

SEQ ID NO: 946637 - protein, 19 aa, Mycobacterium
KARGARILARLMGAGVTSD

SEQ ID NO: 946638 - protein, 18 aa, Mycobacterium
KARTGFYGYGFNASVDSS

SEQ ID NO: 946639 - protein, 25 aa, Mycobacterium
KASADLLVRAWIRSFGISATISNCS

SEQ ID NO: 946640 - protein, 28 aa, Mycobacterium
KASAEPLYPQPPLPAPVPMQPAAPPVQN

SEQ ID NO: 946641 - protein, 26 aa, Mycobacterium
KASKTPIFRDLAPDVFWAAEMLIKLV

SEQ ID NO: 946642 - protein, 25 aa, Mycobacterium
KASNVPLPWTLSVTSTLPSVSVNIV

SEQ ID NO: 946643 - protein, 23 aa, Mycobacterium
KATDWPALDAAYFTGAAIQAYCP

SEQ ID NO: 946644 - protein, 32 aa, Mycobacterium
KATEFKNFLYTPEAQRIWAKTGFRPVDPGVAA

SEQ ID NO: 946645 - protein, 17 aa, Mycobacterium
KATLPRAFIIGPDGSTT

SEQ ID NO: 946646 - protein, 22 aa, Mycobacterium
KATPLGVLPQPNELPRGCIAAG

SEQ ID NO: 946647 - protein, 22 aa, Mycobacterium
KAVAGAMWPGVPLVPTMSTGAT

SEQ ID NO: 946648 - protein, 24 aa, Mycobacterium
KAVEVYHSLVWPLVDEPAETSDPR

SEQ ID NO: 946649 - protein, 18 aa, Mycobacterium
KAVLDRTPWRAEEPIVIA

SEQ ID NO: 946650 - protein, 30 aa, Mycobacterium
KAVLGLLAGPPPQLPYLVSELRVYGGAVDG

SEQ ID NO: 946651 - protein, 24 aa, Mycobacterium
KAVTKRVTVWPQGPDIQDRVNNRS

SEQ ID NO: 946652 - protein, 27 aa, Mycobacterium
KAWALTPSELILYLPDYPVAHDNPINY

SEQ ID NO: 946653 - protein, 27 aa, Mycobacterium
KCLRSTFVYLGWLCGAAPGEAALRAAA

SEQ ID NO: 946654 - protein, 23 aa, Mycobacterium
KCPAAPFEAAFLMAAQLGDRFAS

SEQ ID NO: 946655 - protein, 26 aa, Mycobacterium
KDAAVGKLCLAKNLVVGHCYQQGGPG

SEQ ID NO: 946656 - protein, 24 aa, Mycobacterium
KDETQLPIPPLTTSLASREYLVGG

SEQ ID NO: 946657 - protein, 21 aa, Mycobacterium
KDFGPDFGLTYILDGLAAMGQ

SEQ ID NO: 946658 - protein, 23 aa, Mycobacterium
KDGKISTVWTWPDKPGVAGCAAL

SEQ ID NO: 946659 - protein, 26 aa, Mycobacterium
KDKVAHIISNKLYQKVGQRPDSVTCP

SEQ ID NO: 946660 - protein, 21 aa, Mycobacterium
KDLHLIVVRDDLTGYQHLHPA

SEQ ID NO: 946661 - protein, 26 aa, Mycobacterium
KDLVVSHILHLLLTGKLRSGDRVDRN

SEQ ID NO: 946662 - protein, 25 aa, Mycobacterium
KDNCKLITWPIATLSPNGIRTADGI

SEQ ID NO: 946663 - protein, 20 aa, Mycobacterium
KDNYLYRMAGAVLGIYGNTA

SEQ ID NO: 946664 - protein, 22 aa, Mycobacterium
KDQVARIISNKLAQQVGRRPDA

SEQ ID NO: 946665 - protein, 30 aa, Mycobacterium
KDRVSARVYPALVPLTHPLAAVNGAFNAVV

SEQ ID NO: 946666 - protein, 17 aa, Mycobacterium
KDTLPAWRVQPPVPADE

SEQ ID NO: 946667 - protein, 21 aa, Mycobacterium
KDVYDVGLILDPNKGLANLLA

SEQ ID NO: 946668 - protein, 17 aa, Mycobacterium
KDWKSYGGTAYFGCPDK

SEQ ID NO: 946669 - protein, 27 aa, Mycobacterium
KDYIHLVGEELGWARVPPGSRLSTYEI

SEQ ID NO: 946670 - protein, 33 aa, Mycobacterium
KEFVTAQQLLLTFPFPNFGIKQAVRGDYLNVFT

SEQ ID NO: 946671 - protein, 17 aa, Mycobacterium
KEGILTDELKSAGIDKI

SEQ ID NO: 946672 - protein, 17 aa, Mycobacterium
KEGTVTPVLSNFNARTA

SEQ ID NO: 946673 - protein, 26 aa, Mycobacterium
KEHALRRNFPLVARARYLLESIGPEL

SEQ ID NO: 946674 - protein, 24 aa, Mycobacterium
KEIEPLPERAKVTFWVDKEFQVPA

SEQ ID NO: 946675 - protein, 18 aa, Mycobacterium
KEIFGAYFEHRLPAPRPY

SEQ ID NO: 946676 - protein, 21 aa, Mycobacterium
KEIIKALRRVLSRDEIRFIGN

SEQ ID NO: 946677 - protein, 21 aa, Mycobacterium
KEQHGHVRALKLSADGNVWGG

SEQ ID NO: 946678 - protein, 22 aa, Mycobacterium
KEQPIQALSRIYPNYTQVIART

SEQ ID NO: 946679 - protein, 26 aa, Mycobacterium
KESCRALMVPLTIDIGDKWTTYRNVW

SEQ ID NO: 946680 - protein, 21 aa, Mycobacterium
KESLMNTHPLPNTGRVVITGN

SEQ ID NO: 946681 - protein, 18 aa, Mycobacterium
KFDFRAVAIHELLHAFGF

SEQ ID NO: 946682 - protein, 18 aa, Mycobacterium
KFIDKAHRLGLKVIPWTI

SEQ ID NO: 946683 - protein, 25 aa, Mycobacterium
KFIPRQITNVLWGIRPRLYGEGRNV

SEQ ID NO: 946684 - protein, 23 aa, Mycobacterium
KFKFWRTATALAATGILAVGCGG

SEQ ID NO: 946685 - protein, 26 aa, Mycobacterium
KFPQAAPAVNVYPIAVLSNAPQPGLA

SEQ ID NO: 946686 - protein, 24 aa, Mycobacterium
KFPTARLVVFQLNGDFDPAEVIKH

SEQ ID NO: 946687 - protein, 17 aa, Mycobacterium
KFTLPDGGPLVGRRVRD

SEQ ID NO: 946688 - protein, 24 aa, Mycobacterium
KGADLLPMMPFSERFSSTTITMCA

SEQ ID NO: 946689 - protein, 24 aa, Mycobacterium
KGAMFTEWTVTRFWSSGAAPNRDT

SEQ ID NO: 946690 - protein, 24 aa, Mycobacterium
KGDIRYQIVMGERRWRAAQQAGLT

SEQ ID NO: 946691 - protein, 26 aa, Mycobacterium
KGDTYPTAMLLAFKLYGDFDVKAALR

SEQ ID NO: 946692 - protein, 35 aa, Mycobacterium
KGDYINLYAIFDITYPRLKKTLLLGTRWGDENAKL

SEQ ID NO: 946693 - protein, 23 aa, Mycobacterium
KGEVLRLRQRPGAMPPPANVIRA

SEQ ID NO: 946694 - protein, 29 aa, Mycobacterium
KGEVLRLRWRRGCLPVPRRVVRARVRGRQ

SEQ ID NO: 946695 - protein, 22 aa, Mycobacterium
KGGFDNLFFADLIGVYSDHRGS

SEQ ID NO: 946696 - protein, 25 aa, Mycobacterium
KGGIVFHVQRELGVPVKLVGLGEGP

SEQ ID NO: 946697 - protein, 26 aa, Mycobacterium
KGLLHLEDWRRDRPGLGFGGNLFDVA

SEQ ID NO: 946698 - protein, 24 aa, Mycobacterium
KGNDGYIYIFGTPSGRSGSGFVSR

SEQ ID NO: 946699 - protein, 25 aa, Mycobacterium
KGPAQAKYVLFTSAENLATAFRATI

SEQ ID NO: 946700 - protein, 22 aa, Mycobacterium
KGQDVFLRALANTRVRPQRVYL

SEQ ID NO: 946701 - protein, 18 aa, Mycobacterium
KGQLTFPDPAPLARDDRA

SEQ ID NO: 946702 - protein, 25 aa, Mycobacterium
KGVMEKRTLLRLDPRLAPVKAAVLP

SEQ ID NO: 946703 - protein, 17 aa, Mycobacterium
KGWLAAFRDAALFKVCY

SEQ ID NO: 946704 - protein, 18 aa, Mycobacterium
KHFGSKRELLEAAITHRI

SEQ ID NO: 946705 - protein, 18 aa, Mycobacterium
KHFGSKRELLEAAVAYRI

SEQ ID NO: 946706 - protein, 21 aa, Mycobacterium
KHITSFADLTKPGISVVVCAP

SEQ ID NO: 946707 - protein, 35 aa, Mycobacterium
KHMVQIEPKLAFLGGNLPLLLKGLARITGDGAYGN

SEQ ID NO: 946708 - protein, 21 aa, Mycobacterium
KHQLRRFIKFGVDVTGLTFDD

SEQ ID NO: 946709 - protein, 24 aa, Mycobacterium
KHTVARLIGAPPGYVGYEAGGQLT

SEQ ID NO: 946710 - protein, 30 aa, Mycobacterium
KHVDTPQPVVDAIVRFLISADTNPHIDSKI

SEQ ID NO: 946711 - protein, 28 aa, Mycobacterium
KHYRPGVWLPHCSLAPRATLAQLPDVVA

SEQ ID NO: 946712 - protein, 31 aa, Mycobacterium
KIAVTKGTDPYFFLLQALDANGLSASDVEIV

SEQ ID NO: 946713 - protein, 20 aa, Mycobacterium
KIDQALADNPLINPPAEMAA

SEQ ID NO: 946714 - protein, 22 aa, Mycobacterium
KIERQGWHALLTIRLDGDVELP

SEQ ID NO: 946715 - protein, 33 aa, Mycobacterium
KIHTLGLGWRQCQTPTPPFALVLFVDIDWNETN

SEQ ID NO: 946716 - protein, 25 aa, Mycobacterium
KILDVIVRITGSGYQRLFSAVAAKA

SEQ ID NO: 946717 - protein, 20 aa, Mycobacterium
KILEYAPNETIALPGFEGAT

SEQ ID NO: 946718 - protein, 19 aa, Mycobacterium
KINVLILGGQHDPISGSEG

SEQ ID NO: 946719 - protein, 27 aa, Mycobacterium
KIPARGDLLLWTEEYRRFPKLRAVQDG

SEQ ID NO: 946720 - protein, 19 aa, Mycobacterium
KIQLPKFSRTAIIVGSLVI

SEQ ID NO: 946721 - protein, 41 aa, Mycobacterium; identical to SEQ ID NO: 236557

SEQ ID NO: 946722 - protein, 24 aa, Mycobacterium
KIVFRQAFGWRKLPDEPGLNGSPA

SEQ ID NO: 946723 - protein, 19 aa, Mycobacterium
KIVYQLSVSRGRNALFVAD

SEQ ID NO: 946724 - protein, 30 aa, Mycobacterium
KKAAVLAGALPWLKKLHGTIVVIKYGGNAM

SEQ ID NO: 946725 - protein, 24 aa, Mycobacterium
KKAPITFDTLFKPGSEPLAVIFPI

SEQ ID NO: 946726 - protein, 22 aa, Mycobacterium
KKRVFMPYIGGFGTYRRHCDDV

SEQ ID NO: 946727 - protein, 23 aa, Mycobacterium
KKSNVRQFIAFDTAVRRVSFDDR

SEQ ID NO: 946728 - protein, 25 aa, Mycobacterium
KKVPSWQVLVPENAPVAGYYYQAIN

SEQ ID NO: 946729 - protein, 19 aa, Mycobacterium
KLARVLVADGRRVVLGAAD

SEQ ID NO: 946730 - protein, 41 aa, Mycobacterium
KLCGLFLGPGLRVANPLLLFNFNYLPIPLNPIMAASADPQN

SEQ ID NO: 946731 - protein, 18 aa, Mycobacterium
KLCNLLTARSFAASDEIV

SEQ ID NO: 946732 - protein, 19 aa, Mycobacterium
KLCVQYLAPIIKNRQVNFP

SEQ ID NO: 946733 - protein, 21 aa, Mycobacterium
KLCVQYLAPIIKNRQYNFPPL

SEQ ID NO: 946734 - protein, 22 aa, Mycobacterium
KLCVQYLAPILKNRQYNFPPLG

SEQ ID NO: 946735 - protein, 21 aa, Mycobacterium
KLCVQYLAPIVKNRQYNFPPL

SEQ ID NO: 946736 - protein, 30 aa, Mycobacterium
KLDFEGFRIADKPGLWFSTPFGLDCGIWED

SEQ ID NO: 946737 - protein, 34 aa, Mycobacterium
KLGIFSLVLLTFTALIFVVFGQIRFNRTTEYSAI

SEQ ID NO: 946738 - protein, 25 aa, Mycobacterium
KLGIVSLVLLLITVSIVVVFAQMRF

SEQ ID NO: 946739 - protein, 23 aa, Mycobacterium
KLGPAGPIEFPPGGQPRASINGV

SEQ ID NO: 946740 - protein, 20 aa, Mycobacterium
KLGSNYTTPYRWAPDMKVGE

SEQ ID NO: 946741 - protein, 20 aa, Mycobacterium
KLIALIAASATVAVLSGCSS

SEQ ID NO: 946742 - protein, 17 aa, Mycobacterium
KLINNLIAATTLAVTAE

SEQ ID NO: 946743 - protein, 34 aa, Mycobacterium
KLLRSQVPLPPLYRTRLPIPIRLAPVASDAASDY

SEQ ID NO: 946744 - protein, 18 aa, Mycobacterium
KLLSPQKLPEGVKFEPAD

SEQ ID NO: 946745 - protein, 18 aa, Mycobacterium
KLPLLLAAGAALAQPPRA

SEQ ID NO: 946746 - protein, 22 aa, Mycobacterium
KLPNSRTAWLPPPQLRRGARTN

SEQ ID NO: 946747 - protein, 21 aa, Mycobacterium
KLQPHVANYLRPTKARISLAS

SEQ ID NO: 946748 - protein, 19 aa, Mycobacterium
KLSTFFCDKFRGVVASKTA

SEQ ID NO: 946749 - protein, 17 aa, Mycobacterium
KLTAHLLGCGGVRDGED

SEQ ID NO: 946750 - protein, 24 aa, Mycobacterium
KLTKPVWLIILGVGLLLLLLLRDA

SEQ ID NO: 946751 - protein, 19 aa, Mycobacterium
KLTYLGYSYGTRIGATYAE

SEQ ID NO: 946752 - protein, 19 aa, Mycobacterium
KLVRARRLGVGAAAAVGAC

SEQ ID NO: 946753 - protein, 24 aa, Mycobacterium
KLVTNHHVLGYLADRFGFTVIGAV

SEQ ID NO: 946754 - protein, 20 aa, Mycobacterium
KLWEATATVKAIKGTVTPLV

SEQ ID NO: 946755 - protein, 17 aa, Mycobacterium
KLWHTMFGAGDDYTGNG

SEQ ID NO: 946756 - protein, 18 aa, Mycobacterium
KMGVLPRIEALATGTTRL

SEQ ID NO: 946757 - protein, 24 aa, Mycobacterium
KNAARETWWNTHGPAKVINVAEGV

SEQ ID NO: 946758 - protein, 23 aa, Mycobacterium
KNAMEQFVYAYIHACPGHTLDYN

SEQ ID NO: 946759 - protein, 25 aa, Mycobacterium
KNNTYTVYFAMRFSRPFTSYGTWDG

SEQ ID NO: 946760 - protein, 26 aa, Mycobacterium
KPAAKFTLDVYPRYLSLIPSNVNADI

SEQ ID NO: 946761 - protein, 23 aa, Mycobacterium
KPAKLKPMTVFPNDFPEAAWSHG

SEQ ID NO: 946762 - protein, 31 aa, Mycobacterium
KPALDLDALIGGFRPLFRALDPHQVNALSDQ

SEQ ID NO: 946763 - protein, 22 aa, Mycobacterium
KPANIAAVWGLTRGWIADMVAG

SEQ ID NO: 946764 - protein, 25 aa, Mycobacterium
KPDAAWKFISWMTDKDYIHLVGEEL

SEQ ID NO: 946765 - protein, 24 aa, Mycobacterium
KPDDVHLVFLQPADALSGFRNGQV

SEQ ID NO: 946766 - protein, 25 aa, Mycobacterium
KPDGTMRQILYHRTLTGLVIAQAFP

SEQ ID NO: 946767 - protein, 24 aa, Mycobacterium
KPEFINRLDDVLIFDALNPDELVQ

SEQ ID NO: 946768 - protein, 24 aa, Mycobacterium
KPGEAQRWRFLNACPHRSIWLHVE

SEQ ID NO: 946769 - protein, 29 aa, Mycobacterium
KPGELLTIHLPEDVPLAPAQWGPDGDATY

SEQ ID NO: 946770 - protein, 29 aa, Mycobacterium
KPGGAPALWLPDSSLWLARQMRATGAALD

SEQ ID NO: 946771 - protein, 39 aa, Mycobacterium
KPGSGFFTDWIIPGNFDIAQFSWVGDAFSLCCLNQIYTT

SEQ ID NO: 946772 - protein, 19 aa, Mycobacterium
KPHNKGLRFEFYANLDTAY

SEQ ID NO: 946773 - protein, 25 aa, Mycobacterium
KPITNGLMYNFTFNFEKAGQGSVMV

SEQ ID NO: 946774 - protein, 21 aa, Mycobacterium
KPITNGLTYSFTFNFEKAGQG

SEQ ID NO: 946775 - protein, 25 aa, Mycobacterium
KPLFETDMQSVLWTGADPAQCQGVV

SEQ ID NO: 946776 - protein, 23 aa, Mycobacterium
KPLIATIAAVCALALAATGTDFG

SEQ ID NO: 946777 - protein, 17 aa, Mycobacterium
KPLVVAGAVATAIAAAP

SEQ ID NO: 946778 - protein, 24 aa, Mycobacterium
KPNAYTVYFAMKFSRPFTSFGSWD

SEQ ID NO: 946779 - protein, 19 aa, Mycobacterium
KPPKVWFSDLLQPDGRPYR

SEQ ID NO: 946780 - protein, 18 aa, Mycobacterium
KPRNKGLRFEFYANLETA

SEQ ID NO: 946781 - protein, 25 aa, Mycobacterium
KPRRPYRYHDLGSAAYIRRGDALLQ

SEQ ID NO: 946782 - protein, 26 aa, Mycobacterium
KPSSDTIPYEVRGKLWEVTATDEAVQ

SEQ ID NO: 946783 - protein, 26 aa, Mycobacterium
KPSSDVIPYPVVGTLWEATATDTAVE

SEQ ID NO: 946784 - protein, 25 aa, Mycobacterium
KPVGHAFQLLKYPTAQSDPAPEPQG

SEQ ID NO: 946785 - protein, 25 aa, Mycobacterium
KPVKRLELPRDAALVTILRGARVIV

SEQ ID NO: 946786 - protein, 22 aa, Mycobacterium
KPVLGICGGFQMLCRRIDDAVE

SEQ ID NO: 946787 - protein, 27 aa, Mycobacterium
KQADWGYLVGSFKYSLYRLQERVVGQG

SEQ ID NO: 946788 - protein, 24 aa, Mycobacterium
KQGRVPFLADYVASKFGVVGLTQA

SEQ ID NO: 946789 - protein, 25 aa, Mycobacterium
KQIIPPIKWAAQERGIIPTAAISVG

SEQ ID NO: 946790 - protein, 18 aa, Mycobacterium
KQIRVLVAVALAIPLLLG

SEQ ID NO: 946791 - protein, 22 aa, Mycobacterium
KQLKAIHQPASALETLCGLKVE

SEQ ID NO: 946792 - protein, 21 aa, Mycobacterium
KQPQYHLYVVQPPGTGTVAEL

SEQ ID NO: 946793 - protein, 27 aa, Mycobacterium
KQVGCTPTMPPHPVSIAWDPPGFTPGV

SEQ ID NO: 946794 - protein, 36 aa, Mycobacterium
KRAEPGIPLVALWDETTWYPGSPWLGGVDPAIVSDP

SEQ ID NO: 946795 - protein, 19 aa, Mycobacterium
KRASGLVFQQFQGGVITAK

SEQ ID NO: 946796 - protein, 25 aa, Mycobacterium
KRDVMMIHTLLWPDEIRDPDFPILD

SEQ ID NO: 946797 - protein, 25 aa, Mycobacterium
KRDVMVIHTLLWPDEIRDPDFPVLD

SEQ ID NO: 946798 - protein, 25 aa, Mycobacterium
KRDVMVVHTLLWPDEIRDPDFPVLD

SEQ ID NO: 946799 - protein, 25 aa, Mycobacterium
KREVMVVHTLLWPDEIRDPDFPVLD

SEQ ID NO: 946800 - protein, 17 aa, Mycobacterium
KRFGIQDAIWRGTYYTP

SEQ ID NO: 946801 - protein, 25 aa, Mycobacterium
KRHETFTYPKARNLSFRSLEILRGL

SEQ ID NO: 946802 - protein, 19 aa, Mycobacterium
KRLRRWQSPLTGYEIHHGR

SEQ ID NO: 946803 - protein, 25 aa, Mycobacterium
KRREVFIYPKARNLSFRSLEILRGL

SEQ ID NO: 946804 - protein, 17 aa, Mycobacterium
KRRNVGAFNWGLVAGKT

SEQ ID NO: 946805 - protein, 18 aa, Mycobacterium
KRRYGPWALIAGASVGLG

SEQ ID NO: 946806 - protein, 27 aa, Mycobacterium
KRSNRTVPLPPWLAKKLAAYLANTHEA

SEQ ID NO: 946807 - protein, 23 aa, Mycobacterium
KRVAAIVLIGNPKNWQVAGMNLD

SEQ ID NO: 946808 - protein, 24 aa, Mycobacterium
KRVRALLVGVAGLAVLAVGGCDAS

SEQ ID NO: 946809 - protein, 22 aa, Mycobacterium
KRYCDHYMALAALLDSPGRTDY

SEQ ID NO: 946810 - protein, 25 aa, Mycobacterium
KRYDHIVWQSVVLFPDPKSAASQLQ

SEQ ID NO: 946811 - protein, 30 aa, Mycobacterium
KRYDWAKLVGSFKYTLWRLQERVVGKGPDA

SEQ ID NO: 946812 - protein, 17 aa, Mycobacterium
KSFNWDQTYRKAIVWTA

SEQ ID NO: 946813 - protein, 19 aa, Mycobacterium
KSGAKWPDKFLAGAAGVAH

SEQ ID NO: 946814 - protein, 26 aa, Mycobacterium
KSGKPTPELLAYQYLQTLPKMAEGEA

SEQ ID NO: 946815 - protein, 18 aa, Mycobacterium
KSGLLTIGPGPRAGELQV

SEQ ID NO: 946816 - protein, 18 aa, Mycobacterium
KSILLGTHWGRLGAEGVP

SEQ ID NO: 946817 - protein, 24 aa, Mycobacterium
KSIRQPGLTMLIPIADRLQKVNMQ

SEQ ID NO: 946818 - protein, 27 aa, Mycobacterium
KSLVVTGLCRLLARKGIRVAPFKAQNM

SEQ ID NO: 946819 - protein, 23 aa, Mycobacterium
KSTIAAALALALAAGGRKVLLVE

SEQ ID NO: 946820 - protein, 23 aa, Mycobacterium
KSTIAAALALTLAAGGRKVLLIE

SEQ ID NO: 946821 - protein, 22 aa, Mycobacterium
KSTTPTTPLPPPLPAEVGGSAA

SEQ ID NO: 946822 - protein, 20 aa, Mycobacterium
KSVEFIPPKTPSPTSLHPNA

SEQ ID NO: 946823 - protein, 21 aa, Mycobacterium
KSVHLVLSIQGKIQGLPIKTL

SEQ ID NO: 946824 - protein, 32 aa, Mycobacterium
KSVQTTMEALWWDRPFTLDGVDLRASVATLHL

SEQ ID NO: 946825 - protein, 17 aa, Mycobacterium
KSYFLEPDSKSSKSYVL

SEQ ID NO: 946826 - protein, 26 aa, Mycobacterium
KTAGGWRIDRLPNGVFLDWQQFQATY

SEQ ID NO: 946827 - protein, 21 aa, Mycobacterium
KTAMAMAFTAGFALAGSVAAA

SEQ ID NO: 946828 - protein, 30 aa, Mycobacterium
KTAPLVISGWALTAWVLMSLGTRATQLASL

SEQ ID NO: 946829 - protein, 28 aa, Mycobacterium
KTDSHLLTSILTYHVVPGQLGPDMVAGS

SEQ ID NO: 946830 - protein, 22 aa, Mycobacterium
KTGKLYFDVVGPNPDNVVYNAG

SEQ ID NO: 946831 - protein, 32 aa, Mycobacterium
KTIDWALHDGLGSYFWQHNWGSPKGYAHPAAH

SEQ ID NO: 946832 - protein, 24 aa, Mycobacterium
KTISAAWFIGEGNDLAFDTISFYR

SEQ ID NO: 946833 - protein, 20 aa, Mycobacterium
KTMLRCALGFTVAATVLVTA

SEQ ID NO: 946834 - protein, 21 aa, Mycobacterium
KTNLLNTHPLPNIGRVVISGN

SEQ ID NO: 946835 - protein, 21 aa, Mycobacterium
KTPELLFSEDMFHPSAAGYAL

SEQ ID NO: 946836 - protein, 26 aa, Mycobacterium
KTPMGIFTLDFAFGTAPNPGGGLKYV

SEQ ID NO: 946837 - protein, 23 aa, Mycobacterium
KTPVGAMALLAEALLASADDPET

SEQ ID NO: 946838 - protein, 23 aa, Mycobacterium
KTPVGAMALLAEALLASADDSET

SEQ ID NO: 946839 - protein, 26 aa, Mycobacterium
KTRQPWVVSFQLTWPRDHGPTVTGWM

SEQ ID NO: 946840 - protein, 27 aa, Mycobacterium
KTSGGWRIDKLPNGVFLDWQQFQSTYK

SEQ ID NO: 946841 - protein, 23 aa, Mycobacterium
KTSPQFFEILNAALRYAPVKPEE

SEQ ID NO: 946842 - protein, 34 aa, Mycobacterium
KTTPEVEGAFYWLNNREVRWRPAKYWKPGTTVEV

SEQ ID NO: 946843 - protein, 25 aa, Mycobacterium
KTTTSDWYLTYERDAWRYCNPVITV

SEQ ID NO: 946844 - protein, 24 aa, Mycobacterium
KTVLGPFLGLGFEVALLADAVTLA

SEQ ID NO: 946845 - protein, 27 aa, Mycobacterium
KTVSGQLTLLVPFIDRIRARVDLRERV

SEQ ID NO: 946846 - protein, 22 aa, Mycobacterium
KTVWQTANILRKDGFGAAVRSS

SEQ ID NO: 946847 - protein, 20 aa, Mycobacterium
KTYTFHLRDNITFSGASNRE

SEQ ID NO: 946848 - protein, 24 aa, Mycobacterium
KVCCPSVPMMLTLATVLGRLGIET

SEQ ID NO: 946849 - protein, 19 aa, Mycobacterium
KVEGIPWFNRMAVGVENFA

SEQ ID NO: 946850 - protein, 25 aa, Mycobacterium
KVGIFTMVMLLVAAGLVVVFGEFRF

SEQ ID NO: 946851 - protein, 18 aa, Mycobacterium
KVGNAFAVLALPATEPIA

SEQ ID NO: 946852 - protein, 26 aa, Mycobacterium
KVIDDQLALILWDEVQVHAAAPNVHV

SEQ ID NO: 946853 - protein, 23 aa, Mycobacterium
KVKAVITFASPLVRKADEYGYGV

SEQ ID NO: 946854 - protein, 20 aa, Mycobacterium
KVKLPAGALCGKLAVPVDYD

SEQ ID NO: 946855 - protein, 22 aa, Mycobacterium
KVKRPQFNVFKPKKTRVTVPKA

SEQ ID NO: 946856 - protein, 27 aa, Mycobacterium
KVLAESIRPWMPPPAPAPAPGEPAPQP

SEQ ID NO: 946857 - protein, 18 aa, Mycobacterium
KVLLDDGELAKLLGQSFG

SEQ ID NO: 946858 - protein, 18 aa, Mycobacterium
KVLPPYVRPYLQKKIDEL

SEQ ID NO: 946859 - protein, 20 aa, Mycobacterium
KVLSGRKLPEGLTFDPAHCA

SEQ ID NO: 946860 - protein, 25 aa, Mycobacterium
KVPVTYPFTLQFPSVMSLVASLDFP

SEQ ID NO: 946861 - protein, 22 aa, Mycobacterium
KVRVLPPFLSRKHLPSRLAKLR

SEQ ID NO: 946862 - protein, 22 aa, Mycobacterium
KVSEIFAAQLSDVTAGSCIAAM

SEQ ID NO: 946863 - protein, 25 aa, Mycobacterium
KVSRTRFAFYTRYLTDVPSRRFELA

SEQ ID NO: 946864 - protein, 24 aa, Mycobacterium
KVSTDQLPYQPKGTLWEATATDEA

SEQ ID NO: 946865 - protein, 19 aa, Mycobacterium
KVVDTNLGGTFFLVQSVLP

SEQ ID NO: 946866 - protein, 30 aa, Mycobacterium
KWAVNPMFMDPLPQHPPYPCGQAFVNSDGS

SEQ ID NO: 946867 - protein, 24 aa, Mycobacterium
KWDKLLLKVGFPDKNRDFSKLKLA

SEQ ID NO: 946868 - protein, 32 aa, Mycobacterium
KYAEDTGSITYRYTWHLPKDRTWTYDGQLNLV

SEQ ID NO: 946869 - protein, 18 aa, Mycobacterium
KYANALVRGIAGFLAAQS

SEQ ID NO: 946870 - protein, 25 aa, Mycobacterium
KYEDKFGYVYLVCATGRSAEDLLET

SEQ ID NO: 946871 - protein, 19 aa, Mycobacterium
KYLTSVHTPITGGQPLVYT

SEQ ID NO: 946872 - protein, 22 aa, Mycobacterium
KYNTLVRLPSPLGSPGPTMPKF

SEQ ID NO: 946873 - protein, 20 aa, Mycobacterium
KYPMYEIIRQQLTDAAVRPA

SEQ ID NO: 946874 - protein, 24 aa, Mycobacterium
KYPTARLVVFKLHGDFDPAQVIQH

SEQ ID NO: 946875 - protein, 24 aa, Mycobacterium
KYPTARLVVFKLRGDFNPADVARR

SEQ ID NO: 946876 - protein, 19 aa, Mycobacterium
KYQDPLSCLPGLRNAQPRP

SEQ ID NO: 946877 - protein, 20 aa, Mycobacterium
KYVLHFDKGQFPPAEGFWSL

SEQ ID NO: 946878 - protein, 23 aa, Mycobacterium
LAAAALLPERWVIIGTGPADEEF

SEQ ID NO: 946879 - protein, 19 aa, Mycobacterium
LAAAAPYAGWLNTAATHAS

SEQ ID NO: 946880 - protein, 17 aa, Mycobacterium
LAAAGHRAIALDLPGYG

SEQ ID NO: 946881 - protein, 24 aa, Mycobacterium
LAAALGLGLLLLSPAGAHLYDDSI

SEQ ID NO: 946882 - protein, 20 aa, Mycobacterium
LAAALSLGALLAGCGAPDRP

SEQ ID NO: 946883 - protein, 27 aa, Mycobacterium
LAAAPLVTLYKQYVVRFGLGYHEEVKS

SEQ ID NO: 946884 - protein, 28 aa, Mycobacterium
LAAAPLVVLYKQYVVRFGLGYREEVKSD

SEQ ID NO: 946885 - protein, 26 aa, Mycobacterium
LAAASTPPVLQLPGPVPQAPGPAPQA

SEQ ID NO: 946886 - protein, 17 aa, Mycobacterium
LAAAVLSAGCSASRPAA

SEQ ID NO: 946887 - protein, 27 aa, Mycobacterium
LAACCTALLACFTLAATNGLPLARAAD

SEQ ID NO: 946888 - protein, 24 aa, Mycobacterium
LAAGAITLWLGLVGNVGQVLNGGS

SEQ ID NO: 946889 - protein, 20 aa, Mycobacterium
LAAGGWLVRALHGAPAALGA

SEQ ID NO: 946890 - protein, 20 aa, Mycobacterium
LAAGWLLERAGFGKGYPGDP

SEQ ID NO: 946891 - protein, 31 aa, Mycobacterium
LAAGWLVERAGFAKGFPFDPAARCRLSTKHA

SEQ ID NO: 946892 - protein, 21 aa, Mycobacterium
LAAIVALLALAIGVAIGVRAV

SEQ ID NO: 946893 - protein, 17 aa, Mycobacterium
LAALARRRLCDDEISAI

SEQ ID NO: 946894 - protein, 17 aa, Mycobacterium
LAALAVGAALGVWYSRR

SEQ ID NO: 946895 - protein, 17 aa, Mycobacterium
LAALLLPGVVGLTGGSV

SEQ ID NO: 946896 - protein, 17 aa, Mycobacterium
LAALLVLTGCSRSIGGN

SEQ ID NO: 946897 - protein, 25 aa, Mycobacterium
LAAMGHLAAWPLPVDTEPVVVDQVR

SEQ ID NO: 946898 - protein, 20 aa, Mycobacterium
LAAPSPPVPPGPPPGYDGLP

SEQ ID NO: 946899 - protein, 24 aa, Mycobacterium
LAAQLWDLPAWAQAGHRLLDDMAA

SEQ ID NO: 946900 - protein, 18 aa, Mycobacterium
LAAQLWDLPAWARTGHRL

SEQ ID NO: 946901 - protein, 23 aa, Mycobacterium
LAASVFVWRRLPYATDVAAPFEV

SEQ ID NO: 946902 - protein, 27 aa, Mycobacterium
LAATIDWYRRNEEWWRPIKDNVESQYA

SEQ ID NO: 946903 - protein, 19 aa, Mycobacterium
LAAVIAVAVGLFRGSFTST

SEQ ID NO: 946904 - protein, 25 aa, Mycobacterium
LAAVLRTLPSHLPSLGPAADRFAAV

SEQ ID NO: 946905 - protein, 23 aa, Mycobacterium
LACALELQRAPLAPIRLRIGIHT

SEQ ID NO: 946906 - protein, 17 aa, Mycobacterium
LACLAAVALAAGCTVDG

SEQ ID NO: 946907 - protein, 27 aa, Mycobacterium
LADAYGQAVVALRRAWIACESYGKKVG

SEQ ID NO: 946908 - protein, 31 aa, Mycobacterium
LADGKFNYIVECNPLLGPELMDLAKKVAAGE

SEQ ID NO: 946909 - protein, 25 aa, Mycobacterium
LADGRDLLFFSLPGHRPAPVEDRRS

SEQ ID NO: 946910 - protein, 19 aa, Mycobacterium
LADINWDVIPFDWANDSNT

SEQ ID NO: 946911 - protein, 17 aa, Mycobacterium
LADLGAELNRRVVAAHQ

SEQ ID NO: 946912 - protein, 20 aa, Mycobacterium
LADLPLPAPGLGSGGYRITA

SEQ ID NO: 946913 - protein, 23 aa, Mycobacterium
LADNGYIPIPDEFKSRLSTAVNA

SEQ ID NO: 946914 - protein, 22 aa, Mycobacterium
LADPAHTLSLDDPIFAGRVVVI

SEQ ID NO: 946915 - protein, 30 aa, Mycobacterium
LADPSPFLRSNIIGTYTLLEAVRRHQVRLH

SEQ ID NO: 946916 - protein, 24 aa, Mycobacterium
LADRMVGTSTWFDPVLPALAEDNA

SEQ ID NO: 946917 - protein, 17 aa, Mycobacterium
LADSIVTPPLFPGVSIS

SEQ ID NO: 946918 - protein, 25 aa, Mycobacterium
LADYVRQHILVPLKLTHTSIPTSPA

SEQ ID NO: 946919 - protein, 25 aa, Mycobacterium
LAEAGWPVRVWADTMPKRTTSAVAG

SEQ ID NO: 946920 - protein, 28 aa, Mycobacterium
LAEAPLVTLYKQYVLRFGLGYTEEPKAE

SEQ ID NO: 946921 - protein, 20 aa, Mycobacterium
LAEDAGMRVLLALAADGSSV

SEQ ID NO: 946922 - protein, 28 aa, Mycobacterium
LAEQFQQRLFGPLGMRNTLLPSPAEASE

SEQ ID NO: 946923 - protein, 24 aa, Mycobacterium
LAERLPAYMVPAAVVVLDSLPLTV

SEQ ID NO: 946924 - protein, 27 aa, Mycobacterium
LAESPLVTLYKRYAVRFGLGYTEETRD

SEQ ID NO: 946925 - protein, 18 aa, Mycobacterium
LAETLGAQGTPPLVLCHI

SEQ ID NO: 946926 - protein, 19 aa, Mycobacterium
LAFAGANLPLLLKGVARTT

SEQ ID NO: 946927 - protein, 18 aa, Mycobacterium
LAFTIDCSDASRLARFYA

SEQ ID NO: 946928 - protein, 23 aa, Mycobacterium
LAGANLAIVGGIGAGAKAFNGIL

SEQ ID NO: 946929 - protein, 25 aa, Mycobacterium
LAGKPGLTFIFDSLGGAVRRISPDA

SEQ ID NO: 946930 - protein, 20 aa, Mycobacterium
LAGMSLLASAIGLAAFVAAG

SEQ ID NO: 946931 - protein, 24 aa, Mycobacterium
LAGMTVRIDWPYSANLHCEILVDD

SEQ ID NO: 946932 - protein, 28 aa, Mycobacterium
LAGRPVVLNLWAYWCGPCADELPAMAEY

SEQ ID NO: 946933 - protein, 24 aa, Mycobacterium
LAGSPFPHFRHPIPGPGHGPVTLL

SEQ ID NO: 946934 - protein, 19 aa, Mycobacterium
LAGVLSVLALAAGVAVGVR

SEQ ID NO: 946935 - protein, 18 aa, Mycobacterium
LAGYLNLAGKRPADMPLN

SEQ ID NO: 946936 - protein, 18 aa, Mycobacterium
LAGYLNLAGKRPADMPLS

SEQ ID NO: 946937 - protein, 22 aa, Mycobacterium
LAIADVALLAPALSALVRRNQA

SEQ ID NO: 946938 - protein, 31 aa, Mycobacterium
LAIARELDVPALLALALVGRGALALYEVDKL

SEQ ID NO: 946939 - protein, 34 aa, Mycobacterium
LAIDIEAAFLEYLDMFYNLGIAGRAMRRVGAIEF

SEQ ID NO: 946940 - protein, 24 aa, Mycobacterium
LAIEITKVALWLEAFDADRPFPFL

SEQ ID NO: 946941 - protein, 17 aa, Mycobacterium
LAILLVGSCARSPAPVI

SEQ ID NO: 946942 - protein, 18 aa, Mycobacterium
LAINLPGPAACARLAEFG

SEQ ID NO: 946943 - protein, 31 aa, Mycobacterium
LAIVGNQVSLLWTYLGYPVANSVVLDLVAPV

SEQ ID NO: 946944 - protein, 32 aa, Mycobacterium
LAKASLARVPGLYRLMRIPPETVDYFSHPTFY

SEQ ID NO: 946945 - protein, 17 aa, Mycobacterium
LAKIFQGQITKWNDPAI

SEQ ID NO: 946946 - protein, 18 aa, Mycobacterium
LAKYPDIKVLAKDTANWK

SEQ ID NO: 946947 - protein, 28 aa, Mycobacterium
LALATAGFFLGGLLAPPLGHAAGSCPHR

SEQ ID NO: 946948 - protein, 20 aa, Mycobacterium
LALAVVLGTGLAWSNVRSFE

SEQ ID NO: 946949 - protein, 18 aa, Mycobacterium
LALFDWDNTMVRNDVGSA

SEQ ID NO: 946950 - protein, 33 aa, Mycobacterium
LALGMLSFVLALPILAPLLLIPIGLSYAIARYR

SEQ ID NO: 946951 - protein, 20 aa, Mycobacterium
LALGPKFKARLTHWDGDVFT

SEQ ID NO: 946952 - protein, 21 aa, Mycobacterium
LALHALRRTIGDKAFLEILRS

SEQ ID NO: 946953 - protein, 17 aa, Mycobacterium
LALIGTLVSACGGSGPS

SEQ ID NO: 946954 - protein, 19 aa, Mycobacterium
LALLGIACAQPAPPPPAAA

SEQ ID NO: 946955 - protein, 18 aa, Mycobacterium
LALLIAALMVAGCSAAPV

SEQ ID NO: 946956 - protein, 19 aa, Mycobacterium
LALLVALAVFVAYQTISAS

SEQ ID NO: 946957 - protein, 24 aa, Mycobacterium
LALRAQISPHFIYNALNTIASFVR

SEQ ID NO: 946958 - protein, 19 aa, Mycobacterium
LALTFSGVALAEPEDPAPA

SEQ ID NO: 946959 - protein, 25 aa, Mycobacterium
LALVADLLPQVFRWARAVDPAQPLT

SEQ ID NO: 946960 - protein, 17 aa, Mycobacterium
LALVCSLKRSPAESSSD

SEQ ID NO: 946961 - protein, 18 aa, Mycobacterium
LALVCVLVLGCGSSGSGG

SEQ ID NO: 946962 - protein, 17 aa, Mycobacterium
LANDPRFSYVLLWEMFF

SEQ ID NO: 946963 - protein, 20 aa, Mycobacterium
LANEGAPGRGPYLAPGSVLA

SEQ ID NO: 946964 - protein, 20 aa, Mycobacterium
LANFYNIYNPAQGTVGGLLS

SEQ ID NO: 946965 - protein, 24 aa, Mycobacterium
LANRARLLILIATNFFGQNTAAIA

SEQ ID NO: 946966 - protein, 20 aa, Mycobacterium
LANSLAGTVFPPIGPPYAAK

SEQ ID NO: 946967 - protein, 19 aa, Mycobacterium
LANYVQTLRRDLLKVSEAA

SEQ ID NO: 946968 - protein, 20 aa, Mycobacterium
LAPARPLDPPPPAQAAPTMT

SEQ ID NO: 946969 - protein, 17 aa, Mycobacterium
LAPGFHGVHIHKVGKCE

SEQ ID NO: 946970 - protein, 19 aa, Mycobacterium
LAPGSVLAIEPMLTLGTGK

SEQ ID NO: 946971 - protein, 20 aa, Mycobacterium
LAPHFYKTPELLFSPDMFHP

SEQ ID NO: 946972 - protein, 23 aa, Mycobacterium
LAPLTTLRVGPVARTLVTCDTTD

SEQ ID NO: 946973 - protein, 20 aa, Mycobacterium
LAPTHTLLLAGRPSSQLDAV

SEQ ID NO: 946974 - protein, 24 aa, Mycobacterium
LAQGGFQVIPVAAPILTANIVGFR

SEQ ID NO: 946975 - protein, 17 aa, Mycobacterium
LAQMFEAGCTRLVLASS

SEQ ID NO: 946976 - protein, 24 aa, Mycobacterium
LAQRGLNLVLIARRPGPLESRSTE

SEQ ID NO: 946977 - protein, 18 aa, Mycobacterium
LARLLAPRDPILASTVFG

SEQ ID NO: 946978 - protein, 27 aa, Mycobacterium
LARMLLIWTAIASVALVLTGCIRVVGG

SEQ ID NO: 946979 - protein, 33 aa, Mycobacterium
LARNDRYWGVPATPDLILFRRGGAPAALADSIR

SEQ ID NO: 946980 - protein, 29 aa, Mycobacterium
LARQYRFFHWHLEFPGIFTVPDDGSADPA

SEQ ID NO: 946981 - protein, 17 aa, Mycobacterium
LASARWKGKLYAAPVIT

SEQ ID NO: 946982 - protein, 27 aa, Mycobacterium
LASESAFFMLAFTKIGLMPDGGASALI

SEQ ID NO: 946983 - protein, 22 aa, Mycobacterium
LASGSWQGPAAAAMAAAAAPYA

SEQ ID NO: 946984 - protein, 23 aa, Mycobacterium
LASKLIRWTGFSAAKVARVCLDA

SEQ ID NO: 946985 - protein, 19 aa, Mycobacterium
LASSYPLTIQLAESGGLLP

SEQ ID NO: 946986 - protein, 22 aa, Mycobacterium
LASTPPLGWNSWNVFGCNIDEQ

SEQ ID NO: 946987 - protein, 25 aa, Mycobacterium
LASVVATALLFPVAGGIGLVSNRAS

SEQ ID NO: 946988 - protein, 20 aa, Mycobacterium
LASYLTVLRDSAHAARTAVD

SEQ ID NO: 946989 - protein, 20 aa, Mycobacterium
LATANALAGFWYVHGTYLAP

SEQ ID NO: 946990 - protein, 20 aa, Mycobacterium
LATHQDFVAALLASGRSYAA

SEQ ID NO: 946991 - protein, 17 aa, Mycobacterium
LATIAGALAVAPLALAG

SEQ ID NO: 946992 - protein, 26 aa, Mycobacterium
LATIGAPLPQDPPPAQPIAGANVPTP

SEQ ID NO: 946993 - protein, 18 aa, Mycobacterium
LATLQFDGPTDTLAPPDF

SEQ ID NO: 946994 - protein, 18 aa, Mycobacterium
LATVASVLLLAAGVTACG

SEQ ID NO: 946995 - protein, 18 aa, Mycobacterium
LAVFVALPSFLSVSSVMP

SEQ ID NO: 946996 - protein, 27 aa, Mycobacterium
LAVINAPTQTLLGRPLIGTGADGAPGR

SEQ ID NO: 946997 - protein, 20 aa, Mycobacterium
LAVLLIIASALAGLGTAGSA

SEQ ID NO: 946998 - protein, 20 aa, Mycobacterium
LAVLLVGLLAAGVVVLLRTT

SEQ ID NO: 946999 - protein, 20 aa, Mycobacterium
LAVLSIISLVGAVYMAFGVL

SEQ ID NO: 947000 - protein, 28 aa, Mycobacterium
LAVMTGRWQLVVFAAPFVGALAGASRRP

SEQ ID NO: 947001 - protein, 17 aa, Mycobacterium
LAVMTRSASDDPDAPSL

SEQ ID NO: 947002 - protein, 19 aa, Mycobacterium
LAVPAPALPALIEHVAPRT

SEQ ID NO: 947003 - protein, 26 aa, Mycobacterium
LAVSHAFHSPLMEPMLADFALAAGDI

SEQ ID NO: 947004 - protein, 23 aa, Mycobacterium
LAVTAPFALADPGDPPAPVQPVA

SEQ ID NO: 947005 - protein, 33 aa, Mycobacterium
LAVVAAVLAVVALAGAGWWRMGADDDPMTVTAQ

SEQ ID NO: 947006 - protein, 17 aa, Mycobacterium
LAYWQQTLAGLPERLEL

SEQ ID NO: 947007 - protein, 17 aa, Mycobacterium
LCAIAVAGLLTAPHAGA

SEQ ID NO: 947008 - protein, 18 aa, Mycobacterium
LCALLAGCSLDFGPTDVE

SEQ ID NO: 947009 - protein, 41 aa, Mycobacterium
LCGLYLSPALRVFNPLLLFNWNYLPIPINPILASSADPQNI

SEQ ID NO: 947010 - protein, 20 aa, Mycobacterium
LCHRSCDRTAHIYSVGAGKV

SEQ ID NO: 947011 - protein, 22 aa, Mycobacterium
LCISVERIYVPDALWDEFTERF

SEQ ID NO: 947012 - protein, 17 aa, Mycobacterium
LCLGERGWQPGVFTGDG

SEQ ID NO: 947013 - protein, 19 aa, Mycobacterium
LCNQGDPICMAGPNNSWDA

SEQ ID NO: 947014 - protein, 18 aa, Mycobacterium
LCPKRRQGVLLALTEVWE

SEQ ID NO: 947015 - protein, 28 aa, Mycobacterium
LCQIYANESWHFELVADPLGNCPPLLPD

SEQ ID NO: 947016 - protein, 18 aa, Mycobacterium
LCSIYWQRPVPTVHVHAE

SEQ ID NO: 947017 - protein, 20 aa, Mycobacterium
LCVQYLAPIIKNRQYNFLPF

SEQ ID NO: 947018 - protein, 19 aa, Mycobacterium
LCVQYLAPIIKNRQYNFPP

SEQ ID NO: 947019 - protein, 18 aa, Mycobacterium
LCVTWLPAQSGRPDLAFL

SEQ ID NO: 947020 - protein, 17 aa, Mycobacterium
LDAITIVNPLDSRVTLQ

SEQ ID NO: 947021 - protein, 17 aa, Mycobacterium
LDALLAEMIGLSRSGIA

SEQ ID NO: 947022 - protein, 19 aa, Mycobacterium
LDAPRLVLPGDLNGSRYVS

SEQ ID NO: 947023 - protein, 24 aa, Mycobacterium
LDAPWAPFVVDFHLANVGGPSAGL

SEQ ID NO: 947024 - protein, 25 aa, Mycobacterium
LDAPWAPFVVDFNLANIGGPSAGLM

SEQ ID NO: 947025 - protein, 25 aa, Mycobacterium
LDAPWAPFVVDFNLANVGGPSAGLM

SEQ ID NO: 947026 - protein, 28 aa, Mycobacterium
LDAQEKATLIYARALRRVDPCGFASALK

SEQ ID NO: 947027 - protein, 27 aa, Mycobacterium
LDAQIAVTIPIWGTKTHNIYWVEQDGA

SEQ ID NO: 947028 - protein, 24 aa, Mycobacterium
LDATPRGRFTPTPLAPHLSDRVAA

SEQ ID NO: 947029 - protein, 33 aa, Mycobacterium
LDAYEPFPCVVVTRGWWILQTNAGAGVLLDGVA

SEQ ID NO: 947030 - protein, 18 aa, Mycobacterium
LDCIVFATGFDVCKAGTP

SEQ ID NO: 947031 - protein, 27 aa, Mycobacterium
LDCLTDGAWPAFWLVNENPVRGGEVDL

SEQ ID NO: 947032 - protein, 18 aa, Mycobacterium
LDCRAYRLQWPAETEVYE

SEQ ID NO: 947033 - protein, 34 aa, Mycobacterium
LDDMHAHRLALLWPEMYPRLLRIMDADPIYQDRI

SEQ ID NO: 947034 - protein, 18 aa, Mycobacterium
LDDMRVWAQKLSSGELLS

SEQ ID NO: 947035 - protein, 25 aa, Mycobacterium
LDDVWGQRPFAYLSVSVPGFPNLFM

SEQ ID NO: 947036 - protein, 23 aa, Mycobacterium
LDEFTVAAPAWYRDHDVTLRLGT

SEQ ID NO: 947037 - protein, 18 aa, Mycobacterium
LDEGLMAVLPQLSARHQI

SEQ ID NO: 947038 - protein, 25 aa, Mycobacterium
LDEVSALQAALFTAYGTYYQQVSAD

SEQ ID NO: 947039 - protein, 23 aa, Mycobacterium
LDFHPTMADYFEAKARLFDPQSP

SEQ ID NO: 947040 - protein, 17 aa, Mycobacterium
LDFPLMTDMRDPLTIAF

SEQ ID NO: 947041 - protein, 20 aa, Mycobacterium
LDGALARRAVVARAVAIDAY

SEQ ID NO: 947042 - protein, 25 aa, Mycobacterium
LDGDALLFSFEPYRVAAYAEGPMQS

SEQ ID NO: 947043 - protein, 31 aa, Mycobacterium
LDIDIAFEPVKTLRRWGPPGLTGYEIHHGTV

SEQ ID NO: 947044 - protein, 25 aa, Mycobacterium
LDIRNMWGLPQLGRWKWHDPDVHSQ

SEQ ID NO: 947045 - protein, 20 aa, Mycobacterium
LDIVVNNAGLMLLGPVAGAD

SEQ ID NO: 947046 - protein, 24 aa, Mycobacterium
LDKGALTAFLSWLESRPSPRARRR

SEQ ID NO: 947047 - protein, 32 aa, Mycobacterium
LDLAALKNIALYLNFDMLASPNPGYFTYDGDQ

SEQ ID NO: 947048 - protein, 21 aa, Mycobacterium
LDLDAVIGGFRPLLNALDPTQ

SEQ ID NO: 947049 - protein, 18 aa, Mycobacterium
LDLDHWQMWHYGDSTMAG

SEQ ID NO: 947050 - protein, 20 aa, Mycobacterium
LDLDPFHTWVKGRVAVLGDA

SEQ ID NO: 947051 - protein, 18 aa, Mycobacterium
LDNDADLMKGARERAFND

SEQ ID NO: 947052 - protein, 24 aa, Mycobacterium
LDNGATQVWSFDGGPPGPADASWT

SEQ ID NO: 947053 - protein, 19 aa, Mycobacterium
LDNGTTQVWSFDGPAPTAT

SEQ ID NO: 947054 - protein, 17 aa, Mycobacterium
LDNLLNTLPDRYQALVR

SEQ ID NO: 947055 - protein, 32 aa, Mycobacterium
LDPETSLLSLNRLYAPFIKITAGSAISGRAGI

SEQ ID NO: 947056 - protein, 18 aa, Mycobacterium
LDPYTYDVKTGIALGPTG

SEQ ID NO: 947057 - protein, 20 aa, Mycobacterium
LDQNGILAGALRTLSLFGKP

SEQ ID NO: 947058 - protein, 19 aa, Mycobacterium
LDREIVVTRYLTVPAEDAT

SEQ ID NO: 947059 - protein, 18 aa, Mycobacterium
LDRISAFQMGFLTGASAC

SEQ ID NO: 947060 - protein, 17 aa, Mycobacterium
LDRSHRVAAVFLRALLA

SEQ ID NO: 947061 - protein, 20 aa, Mycobacterium
LDRVLTDIPPLIKHFADTKN

SEQ ID NO: 947062 - protein, 21 aa, Mycobacterium
LDRVSAFQMGFVSGASACAAI

SEQ ID NO: 947063 - protein, 19 aa, Mycobacterium
LDRYFDYAEGRLGWRTLDF

SEQ ID NO: 947064 - protein, 23 aa, Mycobacterium
LDSLPLPAPTLGSGGYTLTAVFA

SEQ ID NO: 947065 - protein, 26 aa, Mycobacterium
LDSVITTHGLSWGFDRIFAASANHSI

SEQ ID NO: 947066 - protein, 32 aa, Mycobacterium
LDTETLKDIALYLNFDMLGSPNPGYFTYDGNQ

SEQ ID NO: 947067 - protein, 23 aa, Mycobacterium
LDTLEAFLRRRIRSSGLVTASIA

SEQ ID NO: 947068 - protein, 19 aa, Mycobacterium
LDTMVLRKALWDLDRGDVA

SEQ ID NO: 947069 - protein, 20 aa, Mycobacterium
LDVCRLLTLVAGLDPKLMGV

SEQ ID NO: 947070 - protein, 18 aa, Mycobacterium
LDVDRFTLVGNSLGALVG

SEQ ID NO: 947071 - protein, 17 aa, Mycobacterium
LDVNQIDSALGATSMKV

SEQ ID NO: 947072 - protein, 30 aa, Mycobacterium
LDVPGVEVLAGFFWGQDRYRYPADLPRVAA

SEQ ID NO: 947073 - protein, 23 aa, Mycobacterium
LDVRLSLRAIPSDGITIAGFPAG

SEQ ID NO: 947074 - protein, 19 aa, Mycobacterium
LDVRWRLDEPDGRPAYLAG

SEQ ID NO: 947075 - protein, 21 aa, Mycobacterium
LDVTVVPWPRATFSSRVGMST

SEQ ID NO: 947076 - protein, 18 aa, Mycobacterium
LDVWRRDDLPTEPAPVLI

SEQ ID NO: 947077 - protein, 22 aa, Mycobacterium
LDYKRYSALGWTIDASSDGTRF

SEQ ID NO: 947078 - protein, 19 aa, Mycobacterium
LDYYLMGANRWKHASAWPL

SEQ ID NO: 947079 - protein, 24 aa, Mycobacterium
LEAAPDVGGTWYWNRYPGARCDVE

SEQ ID NO: 947080 - protein, 25 aa, Mycobacterium
LEAAPDVGGTWYWNRYPGARCDVES

SEQ ID NO: 947081 - protein, 28 aa, Mycobacterium
LEAAPLVVLYKQYVVRFGLGYREEAKSD

SEQ ID NO: 947082 - protein, 17 aa, Mycobacterium
LEADAVPYVLDNFSYQG

SEQ ID NO: 947083 - protein, 20 aa, Mycobacterium
LEAEGYYVNIDRVGSAPLGE

SEQ ID NO: 947084 - protein, 24 aa, Mycobacterium
LEAVRGLPARWIAIGVAEQDGVYG

SEQ ID NO: 947085 - protein, 17 aa, Mycobacterium
LEAVRRHGRRLHHVSTD

SEQ ID NO: 947086 - protein, 24 aa, Mycobacterium
LEENGYIPVPEAFKTRLTEAVDAI

SEQ ID NO: 947087 - protein, 19 aa, Mycobacterium
LEETLVLYGKGFGEALKGM

SEQ ID NO: 947088 - protein, 17 aa, Mycobacterium
LEGAKLPNRAFLAAVRA

SEQ ID NO: 947089 - protein, 19 aa, Mycobacterium
LEGLSLTPDGRYLFAAMEQ

SEQ ID NO: 947090 - protein, 20 aa, Mycobacterium
LEGYLHMQKRQFPAPDQLSG

SEQ ID NO: 947091 - protein, 18 aa, Mycobacterium
LEHFASITPVRRAGRPED

SEQ ID NO: 947092 - protein, 21 aa, Mycobacterium
LEIWEFGGEPVVWTSGRVPGQ

SEQ ID NO: 947093 - protein, 17 aa, Mycobacterium
LEKVLLDNLPPQVELRF

SEQ ID NO: 947094 - protein, 17 aa, Mycobacterium
LELDRRLPGDLAILTPS

SEQ ID NO: 947095 - protein, 25 aa, Mycobacterium
LELGYQVGFPWSLGVGINFSYTTPN

SEQ ID NO: 947096 - protein, 26 aa, Mycobacterium
LEMEHLLLERAATATALLLATRHAIS

SEQ ID NO: 947097 - protein, 17 aa, Mycobacterium
LEMWRSDMVRMLSYGAL

SEQ ID NO: 947098 - protein, 18 aa, Mycobacterium
LENAVKGGVSFLPLDGDP

SEQ ID NO: 947099 - protein, 19 aa, Mycobacterium
LEPILLADTRRRGGEVRYG

SEQ ID NO: 947100 - protein, 23 aa, Mycobacterium
LEPSLPAFRHDLAVLPVVSNAYA

SEQ ID NO: 947101 - protein, 25 aa, Mycobacterium
LEPSVRFNPILLKPGSDRTSQLVIR

SEQ ID NO: 947102 - protein, 25 aa, Mycobacterium
LEPSVRFNPVLLKPGSDRTSQLVIK

SEQ ID NO: 947103 - protein, 25 aa, Mycobacterium
LEPSVRFNPVLLKPGSDRTSQLVVR

SEQ ID NO: 947104 - protein, 30 aa, Mycobacterium
LEPYGGAWVQTWLDRDLGLSGRVLVRDGDA

SEQ ID NO: 947105 - protein, 26 aa, Mycobacterium
LEQRKDWLDLFPFNTTRRPDTYARLA

SEQ ID NO: 947106 - protein, 24 aa, Mycobacterium
LERALYRRIPLSQRLVRGMVYIYR

SEQ ID NO: 947107 - protein, 18 aa, Mycobacterium
LERGLVDELGGFRTAVRR

SEQ ID NO: 947108 - protein, 19 aa, Mycobacterium
LERGLVDELGGFRTAVRRA

SEQ ID NO: 947109 - protein, 21 aa, Mycobacterium
LESLLDSQWPATCDSLGLPAT

SEQ ID NO: 947110 - protein, 24 aa, Mycobacterium
LESSLDFHLLDLYGLTEVGGVFRD

SEQ ID NO: 947111 - protein, 23 aa, Mycobacterium
LETAVGFRFWTGQPGDVLRSPYY

SEQ ID NO: 947112 - protein, 20 aa, Mycobacterium
LEVFLPSGHAFRFPSWSVER

SEQ ID NO: 947113 - protein, 20 aa, Mycobacterium
LEVFLPSGHSFRFPSWSVER

SEQ ID NO: 947114 - protein, 23 aa, Mycobacterium
LEVIQQWYDNPGYLAIMRNCAYT

SEQ ID NO: 947115 - protein, 25 aa, Mycobacterium
LEVNTLFQSLIDLLHKIDPVELNGT

SEQ ID NO: 947116 - protein, 24 aa, Mycobacterium
LEVNTLFQSLIDLLHKVDPVELNG

SEQ ID NO: 947117 - protein, 20 aa, Mycobacterium
LEWQLRRRVLELDNIEIVRG

SEQ ID NO: 947118 - protein, 22 aa, Mycobacterium
LEWTLHHLDLIAHLPELATPPT

SEQ ID NO: 947119 - protein, 20 aa, Mycobacterium
LEYRYKFSEIPFLGQSVAEA

SEQ ID NO: 947120 - protein, 22 aa, Mycobacterium
LEYSRFADWKLNPAGAPRESAD

SEQ ID NO: 947121 - protein, 17 aa, Mycobacterium
LFAAAFAVVPACSSEAL

SEQ ID NO: 947122 - protein, 18 aa, Mycobacterium
LFAAIAPVAGTLGSNVGC

SEQ ID NO: 947123 - protein, 17 aa, Mycobacterium
LFDRLEMTPGPSQPARG

SEQ ID NO: 947124 - protein, 23 aa, Mycobacterium
LFEALAEWVGQPAHFTAGAGRQP

SEQ ID NO: 947125 - protein, 20 aa, Mycobacterium
LFFLVSPERVHTLVFAALRA

SEQ ID NO: 947126 - protein, 23 aa, Mycobacterium
LFGAPLLAGLVWASPAQADAASF

SEQ ID NO: 947127 - protein, 37 aa, Mycobacterium
LFGQNTPAIAATEGLYEEMWAADVAVMSAYHTGVSAA

SEQ ID NO: 947128 - protein, 24 aa, Mycobacterium
LFGVIQLVMHNIAIGLGLSQRDTV

SEQ ID NO: 947129 - protein, 19 aa, Mycobacterium
LFGVLAVVALGVTSCSFRT

SEQ ID NO: 947130 - protein, 26 aa, Mycobacterium
LFHGVQLWVNLPKRDKLAPPRYQAIE

SEQ ID NO: 947131 - protein, 21 aa, Mycobacterium
LFKYAAAAPALLGLGAAGASL

SEQ ID NO: 947132 - protein, 19 aa, Mycobacterium
LFPLDGPNQLETRTVLNCF

SEQ ID NO: 947133 - protein, 34 aa, Mycobacterium
LFQDGRDMFWSMAPLVLVCIVLAGVLGMCSFTPS

SEQ ID NO: 947134 - protein, 21 aa, Mycobacterium
LFTSPVGGGGFIGKWLKRMLS

SEQ ID NO: 947135 - protein, 25 aa, Mycobacterium
LFVTVDLTLGRFKRGLLAGTSFGDE

SEQ ID NO: 947136 - protein, 17 aa, Mycobacterium
LGAAMRLPGAWATPPAP

SEQ ID NO: 947137 - protein, 27 aa, Mycobacterium
LGAARRRAFRVWLDGRRAALVQLAPGY

SEQ ID NO: 947138 - protein, 24 aa, Mycobacterium
LGADAVLGMACDGGWWVLGVHDAA

SEQ ID NO: 947139 - protein, 21 aa, Mycobacterium
LGAGVLLLAGCAREATPREAE

SEQ ID NO: 947140 - protein, 19 aa, Mycobacterium
LGAIAPAMRISYEVAPVRA

SEQ ID NO: 947141 - protein, 18 aa, Mycobacterium
LGALAAIPLLSGCATTTH

SEQ ID NO: 947142 - protein, 18 aa, Mycobacterium
LGALALGASLPACSGKES

SEQ ID NO: 947143 - protein, 20 aa, Mycobacterium
LGALLIAAGLIASAPPAGAG

SEQ ID NO: 947144 - protein, 23 aa, Mycobacterium
LGALLSLNDRGWRWVHARAGEIA

SEQ ID NO: 947145 - protein, 19 aa, Mycobacterium
LGALPVSLAPVAGAEPQCA

SEQ ID NO: 947146 - protein, 18 aa, Mycobacterium
LGANPRFATYSGAKPQGA

SEQ ID NO: 947147 - protein, 29 aa, Mycobacterium
LGAQSSWYVWAALGLFPSTPGTPILTVNT

SEQ ID NO: 947148 - protein, 23 aa, Mycobacterium
LGARGFAEAPRYGFRPTVMVHPP

SEQ ID NO: 947149 - protein, 29 aa, Mycobacterium
LGASNPILTEIWFLLTGQTVLPNNLGTFM

SEQ ID NO: 947150 - protein, 24 aa, Mycobacterium
LGAVRFLCITTANRYAFKVTAAQE

SEQ ID NO: 947151 - protein, 25 aa, Mycobacterium
LGAYGSFFNIFYCSVRLKVNGPAGS

SEQ ID NO: 947152 - protein, 27 aa, Mycobacterium
LGAYGSFFNIYFCSVTIKINGPAGGDI

SEQ ID NO: 947153 - protein, 22 aa, Mycobacterium
LGDILIANQYLTTGMAPSIPGD

SEQ ID NO: 947154 - protein, 20 aa, Mycobacterium
LGDLCLIWSEQMLRESGVDS

SEQ ID NO: 947155 - protein, 25 aa, Mycobacterium
LGDNHKFLFPTYSISKIAGEVVVRS

SEQ ID NO: 947156 - protein, 17 aa, Mycobacterium
LGDRVALYAYYSQGRRA

SEQ ID NO: 947157 - protein, 25 aa, Mycobacterium
LGDSDWFQKCLGVAVIMQGAAYRSA

SEQ ID NO: 947158 - protein, 19 aa, Mycobacterium
LGEAAAIVYGRPAERLRVV

SEQ ID NO: 947159 - protein, 20 aa, Mycobacterium
LGEAITLWLSGQEQLVPRDL

SEQ ID NO: 947160 - protein, 22 aa, Mycobacterium
LGEALTLWLSGQEQLVPRDLVY

SEQ ID NO: 947161 - protein, 18 aa, Mycobacterium
LGEDYLRLAALGAYGSFF

SEQ ID NO: 947162 - protein, 19 aa, Mycobacterium
LGEDYLRLAALGSYGAFFN

SEQ ID NO: 947163 - protein, 19 aa, Mycobacterium
LGEDYLRLAALGSYGSFFN

SEQ ID NO: 947164 - protein, 31 aa, Mycobacterium
LGEIGRMYRPTLPRAFFIKPDGEMTVNSDYF

SEQ ID NO: 947165 - protein, 23 aa, Mycobacterium
LGEPPAAPPPPPAAQKPIRCTGG

SEQ ID NO: 947166 - protein, 30 aa, Mycobacterium
LGERERGTVFYTGLVMWIGCHADSHEYARW

SEQ ID NO: 947167 - protein, 24 aa, Mycobacterium
LGESLPVLGWNMAVSNLRWSGDYV

SEQ ID NO: 947168 - protein, 20 aa, Mycobacterium
LGETFFTTAYFDPNMAHMDE

SEQ ID NO: 947169 - protein, 22 aa, Mycobacterium
LGETLFTTSFFDPNMQHFNDVV

SEQ ID NO: 947170 - protein, 19 aa, Mycobacterium
LGFRPGAHFEYSNSNYLLL

SEQ ID NO: 947171 - protein, 35 aa, Mycobacterium
LGFRVTPPAWLEPGQWWALVRIGCAGRLVYSPAVR

SEQ ID NO: 947172 - protein, 21 aa, Mycobacterium
LGGAALVIAGLSGCGGSDKSE

SEQ ID NO: 947173 - protein, 18 aa, Mycobacterium
LGGFWVAEAVWVTHSAGV

SEQ ID NO: 947174 - protein, 18 aa, Mycobacterium
LGGKGNIVILQGPLGGSG

SEQ ID NO: 947175 - protein, 24 aa, Mycobacterium
LGGKGNIVILQGPLGQSGELDRSK

SEQ ID NO: 947176 - protein, 20 aa, Mycobacterium
LGGLIQADAPIRPGDSGGPM

SEQ ID NO: 947177 - protein, 18 aa, Mycobacterium
LGGLRRFPRRISDLDAGC

SEQ ID NO: 947178 - protein, 24 aa, Mycobacterium
LGGTLRCALADRLRITKSEAGRRV

SEQ ID NO: 947179 - protein, 27 aa, Mycobacterium
LGHNAGDWFIRLFAQRLRGCVGGQSMI

SEQ ID NO: 947180 - protein, 20 aa, Mycobacterium
LGHPMGPFRLLDIVGMDIHQ

SEQ ID NO: 947181 - protein, 23 aa, Mycobacterium
LGHRGPNWVALSNADLSAQMRVT

SEQ ID NO: 947182 - protein, 19 aa, Mycobacterium
LGHSAFYPLPDMAFRDMAA

SEQ ID NO: 947183 - protein, 17 aa, Mycobacterium
LGIALLLVTPGLASADV

SEQ ID NO: 947184 - protein, 18 aa, Mycobacterium
LGIITRAATPLILAIASL

SEQ ID NO: 947185 - protein, 24 aa, Mycobacterium
LGIPYDEYIMRTGADWFPGLDREI

SEQ ID NO: 947186 - protein, 25 aa, Mycobacterium
LGIPYDEYIMRTGADWFPGLDRQIV

SEQ ID NO: 947187 - protein, 27 aa, Mycobacterium
LGITVPGFPNLFLMYGPNTNLGHSSIV

SEQ ID NO: 947188 - protein, 26 aa, Mycobacterium
LGIVISGHWLLQNPLFSGYAATEAYL

SEQ ID NO: 947189 - protein, 22 aa, Mycobacterium
LGLAWITLAVAALLVVVSAPAD

SEQ ID NO: 947190 - protein, 27 aa, Mycobacterium
LGLCYLPAFVCLGIVPVVVGLAGDVLG

SEQ ID NO: 947191 - protein, 20 aa, Mycobacterium
LGLMVPGLPNMFTISGPGSP

SEQ ID NO: 947192 - protein, 21 aa, Mycobacterium
LGLPGELSWRVPSLSLADEAI

SEQ ID NO: 947193 - protein, 23 aa, Mycobacterium
LGLRPRLAIGIFQPAPDERRAPT

SEQ ID NO: 947194 - protein, 26 aa, Mycobacterium
LGLTLPEMVAPLAAYVPAVRTGNLVY

SEQ ID NO: 947195 - protein, 20 aa, Mycobacterium
LGLVAIAPPVLGIAACGAHA

SEQ ID NO: 947196 - protein, 17 aa, Mycobacterium
LGLVWLQHGFVEGKKVW

SEQ ID NO: 947197 - protein, 21 aa, Mycobacterium
LGLWLALAQRNWEAVKTFLDD

SEQ ID NO: 947198 - protein, 28 aa, Mycobacterium
LGMAVPGFPNMFLIYGPNTNLGSSSIIL

SEQ ID NO: 947199 - protein, 25 aa, Mycobacterium
LGMDAGDVTYPYYLINGRVAADPQA

SEQ ID NO: 947200 - protein, 24 aa, Mycobacterium
LGMTGAGYWVAHGALGGITISQAL

SEQ ID NO: 947201 - protein, 25 aa, Mycobacterium
LGNSPQVRNAVRFGFWGAEELGLIG

SEQ ID NO: 947202 - protein, 25 aa, Mycobacterium
LGPCTTAIAVPLPPGSHTEKWIDLR

SEQ ID NO: 947203 - protein, 18 aa, Mycobacterium
LGPDLDLKKFPSSGPYKL

SEQ ID NO: 947204 - protein, 17 aa, Mycobacterium
LGPFLGPFTGLVTAPIG

SEQ ID NO: 947205 - protein, 25 aa, Mycobacterium
LGPGRIAMIYTARPLDDARALFMFR

SEQ ID NO: 947206 - protein, 18 aa, Mycobacterium
LGPQGVVAGLLTLRDMVA

SEQ ID NO: 947207 - protein, 20 aa, Mycobacterium
LGPRDPMEFKPPSGFQLPTG

SEQ ID NO: 947208 - protein, 24 aa, Mycobacterium
LGPSWVRVNSIRPGLIRTDLVDAS

SEQ ID NO: 947209 - protein, 34 aa, Mycobacterium
LGPVKLSGLSGWIGWGFIHIAFLTGVRNRFSTVG

SEQ ID NO: 947210 - protein, 23 aa, Mycobacterium
LGQINGLPATLLITTTLQELEKA

SEQ ID NO: 947211 - protein, 17 aa, Mycobacterium
LGQLDTLMRSLRAAKDA

SEQ ID NO: 947212 - protein, 31 aa, Mycobacterium
LGRAGPPEHLKWIGQWGIFDALRSGSEVVRV

SEQ ID NO: 947213 - protein, 25 aa, Mycobacterium
LGRDWRSWALVDRDPVRQWSDGRVV

SEQ ID NO: 947214 - protein, 17 aa, Mycobacterium
LGRKFLASLGLVEDTPA

SEQ ID NO: 947215 - protein, 17 aa, Mycobacterium
LGRLRAVDVTGLDLRRA

SEQ ID NO: 947216 - protein, 17 aa, Mycobacterium
LGRRDTFRGLPRTPPFN

SEQ ID NO: 947217 - protein, 25 aa, Mycobacterium
LGRTTLLPLGTDPSAPVLGPDGTAH

SEQ ID NO: 947218 - protein, 17 aa, Mycobacterium
LGRYERLDILVNNAGIS

SEQ ID NO: 947219 - protein, 18 aa, Mycobacterium
LGRYGVCANAICPRARTA

SEQ ID NO: 947220 - protein, 25 aa, Mycobacterium
LGSDMGEFFMPYPGTRINQETIPLN

SEQ ID NO: 947221 - protein, 28 aa, Mycobacterium
LGSDPFVAIVAFPFIPQAMRGNYDQVEI

SEQ ID NO: 947222 - protein, 17 aa, Mycobacterium
LGSPIFVDYVWGRQIGE

SEQ ID NO: 947223 - protein, 30 aa, Mycobacterium
LGSSPPVHNKLRFGFWGAEELGLIGSRNYV

SEQ ID NO: 947224 - protein, 27 aa, Mycobacterium
LGSYGAFFNIYFCTVTIKINGPAGSDI

SEQ ID NO: 947225 - protein, 27 aa, Mycobacterium
LGSYGSFFNIYFCSVTIKINGPAGGDI

SEQ ID NO: 947226 - protein, 20 aa, Mycobacterium
LGTAYLERFGGHVRTMVLDG

SEQ ID NO: 947227 - protein, 26 aa, Mycobacterium
LGTEVFGVHFPAPLGLAAGFDKDGEG

SEQ ID NO: 947228 - protein, 33 aa, Mycobacterium
LGTLEHICRSGQDYTWFILNARIIAKEFALSGQ

SEQ ID NO: 947229 - protein, 20 aa, Mycobacterium
LGTLRWQGFARDSSPPWYDE

SEQ ID NO: 947230 - protein, 22 aa, Mycobacterium
LGTSFPELMAGFTGGFTGLLQT

SEQ ID NO: 947231 - protein, 17 aa, Mycobacterium
LGTTAAAVAVLGLAACG

SEQ ID NO: 947232 - protein, 17 aa, Mycobacterium
LGVAFWSELDAQDPASP

SEQ ID NO: 947233 - protein, 23 aa, Mycobacterium
LGVASVSMWKVHQMSAPEPVITV

SEQ ID NO: 947234 - protein, 19 aa, Mycobacterium
LGVAVLDAPWAPFVVDFNL

SEQ ID NO: 947235 - protein, 18 aa, Mycobacterium
LGVDTFRVMAIDAGLHVN

SEQ ID NO: 947236 - protein, 24 aa, Mycobacterium
LGVETHLVLSDWARATIKLETDTS

SEQ ID NO: 947237 - protein, 17 aa, Mycobacterium
LGVGPLSTEFFTSGEFN

SEQ ID NO: 947238 - protein, 20 aa, Mycobacterium
LGVITAIPQPLRSLAHERCM

SEQ ID NO: 947239 - protein, 19 aa, Mycobacterium
LGVKTPLLQGIRGIDDPDA

SEQ ID NO: 947240 - protein, 20 aa, Mycobacterium
LGVSTAGCALAFCGAGMAAA

SEQ ID NO: 947241 - protein, 21 aa, Mycobacterium
LGVVGMLVGCAHAPAPPPVGF

SEQ ID NO: 947242 - protein, 32 aa, Mycobacterium
LGYDRRYILEHLRALPLDPFRNSYAYTNFGLT

SEQ ID NO: 947243 - protein, 17 aa, Mycobacterium
LGYLPPPGHGGPMPQNV

SEQ ID NO: 947244 - protein, 21 aa, Mycobacterium
LGYQPFPYRSFTQRLVESMHD

SEQ ID NO: 947245 - protein, 24 aa, Mycobacterium
LGYQVGYPWSLGVGLNFNYTTPNT

SEQ ID NO: 947246 - protein, 20 aa, Mycobacterium
LGYRVPGLVISPFSRGGLVA

SEQ ID NO: 947247 - protein, 18 aa, Mycobacterium
LHAAAGHWRDFAAALNGV

SEQ ID NO: 947248 - protein, 31 aa, Mycobacterium
LHAAEHPAPGDWLYFVTIDSQGTTLFTRDYQ

SEQ ID NO: 947249 - protein, 26 aa, Mycobacterium
LHAAMRDVLALPYTALSDADLLDVCA

SEQ ID NO: 947250 - protein, 18 aa, Mycobacterium
LHAFATRVPNQRLPFGVA

SEQ ID NO: 947251 - protein, 18 aa, Mycobacterium
LHARTRAVRLRFAGSVAV

SEQ ID NO: 947252 - protein, 20 aa, Mycobacterium
LHATFWDRLPRDGRGPLGWL

SEQ ID NO: 947253 - protein, 31 aa, Mycobacterium
LHATIRASQNLIPRLFWTTYQGGREEILPFY

SEQ ID NO: 947254 - protein, 20 aa, Mycobacterium
LHDRRRVLVALTPRGRTLRN

SEQ ID NO: 947255 - protein, 20 aa, Mycobacterium
LHGHTFAVARPDWAGPRKDT

SEQ ID NO: 947256 - protein, 37 aa, Mycobacterium
LHGPHRYNWNQFIGSLKYTLWRLQERVVGRGPGSPQL

SEQ ID NO: 947257 - protein, 21 aa, Mycobacterium
LHIFRGELPLPCPFAMGHEMV

SEQ ID NO: 947258 - protein, 34 aa, Mycobacterium
LHNPLRPPWVDPDALPLPPPPPGAVPGPGNYGPR

SEQ ID NO: 947259 - protein, 20 aa, Mycobacterium
LHNWTYWGNQLKAMKSDMVG

SEQ ID NO: 947260 - protein, 23 aa, Mycobacterium
LHSPYPHFRHPIPPPGRGAVTLL

SEQ ID NO: 947261 - protein, 19 aa, Mycobacterium
LIACGDRDLLTPVEYSREM

SEQ ID NO: 947262 - protein, 19 aa, Mycobacterium
LIAFGKKFPTGAIPATLVL

SEQ ID NO: 947263 - protein, 27 aa, Mycobacterium
LIASVIAPVIALAGICAGLGAGAASAQ

SEQ ID NO: 947264 - protein, 21 aa, Mycobacterium
LIAVFAQLRFEREQRYTAVFA

SEQ ID NO: 947265 - protein, 19 aa, Mycobacterium
LICLGLALAATTAGAAWSV

SEQ ID NO: 947266 - protein, 22 aa, Mycobacterium
LICTIIMEGDMLVSFKSEPRPT

SEQ ID NO: 947267 - protein, 37 aa, Mycobacterium
LIDTAGNRLQLVTLPPSVSYSFRSLARGPHAEALILG

SEQ ID NO: 947268 - protein, 29 aa, Mycobacterium
LIEHSAAVFRRWIDLIADKLVAVGVVRTR

SEQ ID NO: 947269 - protein, 18 aa, Mycobacterium
LIFGHALCMNTCRTMVVP

SEQ ID NO: 947270 - protein, 21 aa, Mycobacterium
LIGESCLFVPVLRSALNSEGF

SEQ ID NO: 947271 - protein, 19 aa, Mycobacterium
LIGFAAVVAILLSGCGAGQ

SEQ ID NO: 947272 - protein, 19 aa, Mycobacterium
LIGFLLAVVLAGAGGALGA

SEQ ID NO: 947273 - protein, 18 aa, Mycobacterium
LIGFNSMRVFLHDQLWAS

SEQ ID NO: 947274 - protein, 21 aa, Mycobacterium
LIGIFNSVWGQYPAAVSWQAA

SEQ ID NO: 947275 - protein, 19 aa, Mycobacterium
LIGSMVIVAALGVPGCHKK

SEQ ID NO: 947276 - protein, 24 aa, Mycobacterium
LIGWDTYRRLDRLPYLRPDTQALQ

SEQ ID NO: 947277 - protein, 19 aa, Mycobacterium
LIIAPNLVAARFIQLTPAY

SEQ ID NO: 947278 - protein, 22 aa, Mycobacterium
LIIDMTLSRIDAGFFTGTRWEG

SEQ ID NO: 947279 - protein, 20 aa, Mycobacterium
LILAAYHPAQFIYAGSLSAL

SEQ ID NO: 947280 - protein, 19 aa, Mycobacterium
LILTNNHVVAAAAGPPKAT

SEQ ID NO: 947281 - protein, 17 aa, Mycobacterium
LILTQPFDIDTVPKIFR

SEQ ID NO: 947282 - protein, 24 aa, Mycobacterium
LIPTFVMLRRVQLTAWIASHADAD

SEQ ID NO: 947283 - protein, 17 aa, Mycobacterium
LIPVAVAAIALAGCSKT

SEQ ID NO: 947284 - protein, 22 aa, Mycobacterium
LIQLAVFVIVALAGGAVMAFGY

SEQ ID NO: 947285 - protein, 18 aa, Mycobacterium
LIRARFGVPIPNLTAWRD

SEQ ID NO: 947286 - protein, 28 aa, Mycobacterium
LIRATTHWLRTTVLAVAVLLIAAACTSS

SEQ ID NO: 947287 - protein, 29 aa, Mycobacterium
LIRTGLLGLVLVVLIIVVGLQPQQLIQMA

SEQ ID NO: 947288 - protein, 22 aa, Mycobacterium
LISETWIQPTFVLSDKGRDAAK

SEQ ID NO: 947289 - protein, 19 aa, Mycobacterium
LITAFMAAGLVGGLVMSPS

SEQ ID NO: 947290 - protein, 17 aa, Mycobacterium
LITVLRAGSVILPQPDD

SEQ ID NO: 947291 - protein, 18 aa, Mycobacterium
LIVAVLVVGGFAVARVKS

SEQ ID NO: 947292 - protein, 17 aa, Mycobacterium
LIVAVVLVGGFAVVRVK

SEQ ID NO: 947293 - protein, 17 aa, Mycobacterium
LIVLPAEGQLQAVRNSM

SEQ ID NO: 947294 - protein, 17 aa, Mycobacterium
LIYTVWESKGPIEPDPY

SEQ ID NO: 947295 - protein, 27 aa, Mycobacterium
LKDGRQWRIPMWQLNAGAQRGFLSGIA

SEQ ID NO: 947296 - protein, 19 aa, Mycobacterium
LKDIPASEIPPLPNTPSPL

SEQ ID NO: 947297 - protein, 26 aa, Mycobacterium
LKDNDLVPYRSLVTSGAAVMIGHMQV

SEQ ID NO: 947298 - protein, 17 aa, Mycobacterium
LKFALELGADMIAMSFV

SEQ ID NO: 947299 - protein, 18 aa, Mycobacterium
LKFNYDFEMAKIGRPTDR

SEQ ID NO: 947300 - protein, 17 aa, Mycobacterium
LKGGTLLVLRRITMNLD

SEQ ID NO: 947301 - protein, 21 aa, Mycobacterium
LKGNYLYRMAGAVLGIYGNTA

SEQ ID NO: 947302 - protein, 22 aa, Mycobacterium
LKIEQYYRGDRFPYETGVVSAG

SEQ ID NO: 947303 - protein, 28 aa, Mycobacterium
LKKTYGIGAKPYWRPPYAKHNAAVDAVA

SEQ ID NO: 947304 - protein, 28 aa, Mycobacterium
LKKTYGIGAKPYWRPPYAKRNAAVDAVA

SEQ ID NO: 947305 - protein, 26 aa, Mycobacterium
LKLAVILALWAAVVAAFVSVIYRRQS

SEQ ID NO: 947306 - protein, 26 aa, Mycobacterium
LKPDPVPGAPWTPPAPSLAAVDSTTM

SEQ ID NO: 947307 - protein, 24 aa, Mycobacterium
LKPLNHSYIPNIENVWPVFTNPWY

SEQ ID NO: 947308 - protein, 19 aa, Mycobacterium
LKQAWLRELAQWQPDLVIN

SEQ ID NO: 947309 - protein, 28 aa, Mycobacterium
LKRADVDAVLPRILIESPVPGEAVTSPL

SEQ ID NO: 947310 - protein, 18 aa, Mycobacterium
LKRTLAAAAALVTGAAVL

SEQ ID NO: 947311 - protein, 26 aa, Mycobacterium
LKSPPRWRTAAALAVTTTLLAACGGG

SEQ ID NO: 947312 - protein, 20 aa, Mycobacterium
LKTLMELMGKIFSPKNPPTL

SEQ ID NO: 947313 - protein, 24 aa, Mycobacterium
LKTPVGAMALLAEALLASADDSDT

SEQ ID NO: 947314 - protein, 23 aa, Mycobacterium
LLAAGHTFVGFAEGLPTVGSPVC

SEQ ID NO: 947315 - protein, 22 aa, Mycobacterium
LLACLLAACSAPKPPPPAAAPD

SEQ ID NO: 947316 - protein, 21 aa, Mycobacterium
LLAFLAPRFLPRGPRGALASG

SEQ ID NO: 947317 - protein, 21 aa, Mycobacterium
LLALAGLLTTGVGVAGADEVE

SEQ ID NO: 947318 - protein, 22 aa, Mycobacterium
LLALARVWARPLWLAVGRSDAA

SEQ ID NO: 947319 - protein, 37 aa, Mycobacterium
LLALICVLPIALAPWPARAFVILLAVLMTAVVVDIVA

SEQ ID NO: 947320 - protein, 17 aa, Mycobacterium
LLALSRLGSMRAVADAF

SEQ ID NO: 947321 - protein, 18 aa, Mycobacterium
LLARLQVQPSGGGRRRRR

SEQ ID NO: 947322 - protein, 23 aa, Mycobacterium
LLASIAASCTASYQVALLPGGPS

SEQ ID NO: 947323 - protein, 23 aa, Mycobacterium
LLASIAASCTASYTVALMPGGPS

SEQ ID NO: 947324 - protein, 28 aa, Mycobacterium
LLASIVAAALMFPFAGGIGLMSNRASEV

SEQ ID NO: 947325 - protein, 24 aa, Mycobacterium
LLATAVLLGWPAAAEPPSCASLGG

SEQ ID NO: 947326 - protein, 34 aa, Mycobacterium
LLATLISVPRRVRRLFMVLGGLVSLVGLVVSACT

SEQ ID NO: 947327 - protein, 18 aa, Mycobacterium
LLATLVATNFLGVNSAAI

SEQ ID NO: 947328 - protein, 17 aa, Mycobacterium
LLAVVTLTLSACGLGSG

SEQ ID NO: 947329 - protein, 18 aa, Mycobacterium
LLCSAMVSYMAGGRGLEH

SEQ ID NO: 947330 - protein, 17 aa, Mycobacterium
LLCWRDTGHPQGGGSEA

SEQ ID NO: 947331 - protein, 35 aa, Mycobacterium
LLDDPYSRYFIHSPLLRVCLIHPLAARAFIEVLKS

SEQ ID NO: 947332 - protein, 21 aa, Mycobacterium
LLDRMNPTLPVVLANLIGVGQ

SEQ ID NO: 947333 - protein, 24 aa, Mycobacterium
LLDWGQFQSTYRRYTVYFADPAGR

SEQ ID NO: 947334 - protein, 19 aa, Mycobacterium
LLEADALPYVLDTFSYQGQ

SEQ ID NO: 947335 - protein, 25 aa, Mycobacterium
LLEDDKHFFPLYNLTEVVDTSLIND

SEQ ID NO: 947336 - protein, 20 aa, Mycobacterium
LLEKRFGVPVPNLSAWRRSV

SEQ ID NO: 947337 - protein, 19 aa, Mycobacterium
LLEQRFGVPVPNLTTWRRG

SEQ ID NO: 947338 - protein, 17 aa, Mycobacterium
LLERLISGQVGNPALDI

SEQ ID NO: 947339 - protein, 17 aa, Mycobacterium
LLGAYILAGELAAAGTD

SEQ ID NO: 947340 - protein, 19 aa, Mycobacterium
LLGGLLGGLGLDLGLDLDA

SEQ ID NO: 947341 - protein, 17 aa, Mycobacterium
LLGGRPIREPVFHYGPF

SEQ ID NO: 947342 - protein, 18 aa, Mycobacterium
LLGIALLSPVNPANPPAP

SEQ ID NO: 947343 - protein, 18 aa, Mycobacterium
LLGMAVLALSYRLWKLRQ

SEQ ID NO: 947344 - protein, 18 aa, Mycobacterium
LLGVIVGGAIIYTQGSTR

SEQ ID NO: 947345 - protein, 20 aa, Mycobacterium
LLHSSPLPVAVAPRGTRESA

SEQ ID NO: 947346 - protein, 21 aa, Mycobacterium
LLIFSLLAVTALGIMVFGYMR

SEQ ID NO: 947347 - protein, 23 aa, Mycobacterium
LLISGAALGLMASAGACSCSIGS

SEQ ID NO: 947348 - protein, 20 aa, Mycobacterium
LLIVGLAACAGYLQWRSSSM

SEQ ID NO: 947349 - protein, 17 aa, Mycobacterium
LLKVMLREPDELGDLDE

SEQ ID NO: 947350 - protein, 17 aa, Mycobacterium
LLKVMLREPGALGDLDE

SEQ ID NO: 947351 - protein, 20 aa, Mycobacterium
LLLAAIALLLPACVSRQQAA

SEQ ID NO: 947352 - protein, 17 aa, Mycobacterium
LLLATALLAGCSPARRG

SEQ ID NO: 947353 - protein, 20 aa, Mycobacterium
LLLFPVFGGGGMLVMRLSDQ

SEQ ID NO: 947354 - protein, 17 aa, Mycobacterium
LLLIAALVAGCSSTRPA

SEQ ID NO: 947355 - protein, 17 aa, Mycobacterium
LLLSYARDKGLPGVAMC

SEQ ID NO: 947356 - protein, 20 aa, Mycobacterium
LLLVALVATLVVVGGSAVGV

SEQ ID NO: 947357 - protein, 30 aa, Mycobacterium
LLNEPNFLPLQPFSWRIMPENLEDAGISWK

SEQ ID NO: 947358 - protein, 19 aa, Mycobacterium
LLNSDALKQLLYGPLDGPP

SEQ ID NO: 947359 - protein, 27 aa, Mycobacterium
LLNSDGLKQLLFGPLDGPPRNTAQIGM

SEQ ID NO: 947360 - protein, 20 aa, Mycobacterium
LLPFGALLILAAPAHAEPAS

SEQ ID NO: 947361 - protein, 27 aa, Mycobacterium
LLPGNPRVLSIAQFWHRAAQHDRISAE

SEQ ID NO: 947362 - protein, 19 aa, Mycobacterium
LLPVLRPGEHVLLTDQLAQ

SEQ ID NO: 947363 - protein, 17 aa, Mycobacterium
LLRVMLREPDELGDLDE

SEQ ID NO: 947364 - protein, 29 aa, Mycobacterium
LLSDPMLPEELLPAKWPGAQLRSAYHDFA

SEQ ID NO: 947365 - protein, 17 aa, Mycobacterium
LLSFERWAPDMPWEIST

SEQ ID NO: 947366 - protein, 25 aa, Mycobacterium
LLSIPNPFAVGYYLALGSLQAPYAA

SEQ ID NO: 947367 - protein, 17 aa, Mycobacterium
LLSVLGATGVAACGTDH

SEQ ID NO: 947368 - protein, 17 aa, Mycobacterium
LLTAVPSAVLIGAPAAN

SEQ ID NO: 947369 - protein, 28 aa, Mycobacterium
LLTDPVLPDELLPADWPGARLRAAYHDF

SEQ ID NO: 947370 - protein, 21 aa, Mycobacterium
LLTRIVGITALALGLMGGSPM

SEQ ID NO: 947371 - protein, 24 aa, Mycobacterium
LLVAGIALTYLSYTSAFTPTDTVV

SEQ ID NO: 947372 - protein, 19 aa, Mycobacterium
LLVDAGRLALSDPLAQYVP

SEQ ID NO: 947373 - protein, 17 aa, Mycobacterium
LLVGALVLLARPLLARR

SEQ ID NO: 947374 - protein, 20 aa, Mycobacterium
LLVGLALAGGYAVSASKTVT

SEQ ID NO: 947375 - protein, 17 aa, Mycobacterium
LLVLTGCSRSIGGNAVK

SEQ ID NO: 947376 - protein, 24 aa, Mycobacterium
LLVRPDDFVGWRWEALPADPEAEL

SEQ ID NO: 947377 - protein, 19 aa, Mycobacterium
LLVRPDGFVGWRAETLPTD

SEQ ID NO: 947378 - protein, 21 aa, Mycobacterium
LLVSGAAAGLLAGVTACSCSV

SEQ ID NO: 947379 - protein, 20 aa, Mycobacterium
LLVWVVGCGSPSRPADGARS

SEQ ID NO: 947380 - protein, 20 aa, Mycobacterium
LLYKSGYGGYLLRLLDGWGG

SEQ ID NO: 947381 - protein, 17 aa, Mycobacterium
LLYRAPAGVVDVLIAHP

SEQ ID NO: 947382 - protein, 27 aa, Mycobacterium
LMAGALALVALLLAATAVLLDYSGRPP

SEQ ID NO: 947383 - protein, 17 aa, Mycobacterium
LMALDSSLLTPVDWDRI

SEQ ID NO: 947384 - protein, 18 aa, Mycobacterium
LMAVLPQLSARHQILLAA

SEQ ID NO: 947385 - protein, 18 aa, Mycobacterium
LMFSLAVVDKLTTGGLAG

SEQ ID NO: 947386 - protein, 27 aa, Mycobacterium
LMGADPPPASAPWFWTDRHGDHVEAVG

SEQ ID NO: 947387 - protein, 23 aa, Mycobacterium
LMGKIFSPKNPPTLSYRATGCRD

SEQ ID NO: 947388 - protein, 18 aa, Mycobacterium
LMLALVCAPNAFADPALP

SEQ ID NO: 947389 - protein, 21 aa, Mycobacterium
LMNLVICLLSTRTYVTAERIR

SEQ ID NO: 947390 - protein, 18 aa, Mycobacterium
LMQASTYIYCPQWARFTG

SEQ ID NO: 947391 - protein, 17 aa, Mycobacterium
LMQLGPVKLSGLSGWIG

SEQ ID NO: 947392 - protein, 23 aa, Mycobacterium
LMRKVILLAAAGLATATMSACDS

SEQ ID NO: 947393 - protein, 18 aa, Mycobacterium
LMRRQFWPISSVDIGVEI

SEQ ID NO: 947394 - protein, 18 aa, Mycobacterium
LMRYRTENFVPKRPIRVA

SEQ ID NO: 947395 - protein, 33 aa, Mycobacterium
LMTIPTTKSRARTVLCVTAIAALALSGCTSQQG

SEQ ID NO: 947396 - protein, 24 aa, Mycobacterium
LMVGAVGAALLLGLVGVVDVTGGS

SEQ ID NO: 947397 - protein, 24 aa, Mycobacterium
LMVVFSGPIPDDKWPQAVQIVKDR

SEQ ID NO: 947398 - protein, 26 aa, Mycobacterium
LNAWGSFLNKIMPPYKIADGAGTLDV

SEQ ID NO: 947399 - protein, 26 aa, Mycobacterium
LNDGPEWTCFFPHPQRVVCGGISIPG

SEQ ID NO: 947400 - protein, 25 aa, Mycobacterium
LNDGRADFFAVLRSMALFVNALYKD

SEQ ID NO: 947401 - protein, 23 aa, Mycobacterium
LNDITRAYFKAQAPLRPGEVGQA

SEQ ID NO: 947402 - protein, 21 aa, Mycobacterium
LNDLLVFLNDADGKPMVITIK

SEQ ID NO: 947403 - protein, 24 aa, Mycobacterium
LNDLVHPMASLTLLSELMNYDFAQ

SEQ ID NO: 947404 - protein, 19 aa, Mycobacterium
LNEIVLASAFGNNNSVAAT

SEQ ID NO: 947405 - protein, 35 aa, Mycobacterium
LNEPFPPVLTEFLAIPWVVPNWPPGVLRPDLASTF

SEQ ID NO: 947406 - protein, 18 aa, Mycobacterium
LNEYWAAVRQPDWSQFVL

SEQ ID NO: 947407 - protein, 19 aa, Mycobacterium
LNGAEFTVFAPTDEAFAKL

SEQ ID NO: 947408 - protein, 17 aa, Mycobacterium
LNGAPGMPGFSAGLLGP

SEQ ID NO: 947409 - protein, 18 aa, Mycobacterium
LNGDLLAKIFQGQITKWN

SEQ ID NO: 947410 - protein, 17 aa, Mycobacterium
LNGFEPLFTLLDPKQVD

SEQ ID NO: 947411 - protein, 28 aa, Mycobacterium
LNGFVHDVPIPFWEWQHITVTVRDHPDG

SEQ ID NO: 947412 - protein, 17 aa, Mycobacterium
LNGFVNAKWIAQATIPA

SEQ ID NO: 947413 - protein, 18 aa, Mycobacterium
LNGRTYSPPYIITAIGDP

SEQ ID NO: 947414 - protein, 26 aa, Mycobacterium
LNLATWYPQQFIFAGALSGFLNPSQG

SEQ ID NO: 947415 - protein, 20 aa, Mycobacterium
LNLGTYTAGGLPLQFPPEIT

SEQ ID NO: 947416 - protein, 19 aa, Mycobacterium
LNLLPDVVALRIPIVVGFQ

SEQ ID NO: 947417 - protein, 17 aa, Mycobacterium
LNLLVGFIQVIDGPPVL

SEQ ID NO: 947418 - protein, 27 aa, Mycobacterium
LNLTYPQYLVLLALWEEDRATVSRLGE

SEQ ID NO: 947419 - protein, 17 aa, Mycobacterium
LNMFFGGPRRSTRVFLD

SEQ ID NO: 947420 - protein, 19 aa, Mycobacterium
LNNQYLMPQNIKPAAPGQG

SEQ ID NO: 947421 - protein, 18 aa, Mycobacterium
LNPAVGALAKLGVRTALA

SEQ ID NO: 947422 - protein, 18 aa, Mycobacterium
LNPQVSASTKFISWVTGA

SEQ ID NO: 947423 - protein, 17 aa, Mycobacterium
LNPSEGWWPMLIGISMG

SEQ ID NO: 947424 - protein, 18 aa, Mycobacterium
LNRMVGSIPWMYVASVAG

SEQ ID NO: 947425 - protein, 26 aa, Mycobacterium
LNRPTPLAVPGFVLRAALGEFADEGV

SEQ ID NO: 947426 - protein, 20 aa, Mycobacterium
LNRRRVLLGAAAIGGFLAVD

SEQ ID NO: 947427 - protein, 29 aa, Mycobacterium
LNRSFVYALNIGSPLYSAFWSQAPSQRNP

SEQ ID NO: 947428 - protein, 31 aa, Mycobacterium
LNSRRRARLLALRLRRLRYRQRRKMRGDQGS

SEQ ID NO: 947429 - protein, 21 aa, Mycobacterium
LNTEFLVAPDVWRGFDHGGLA

SEQ ID NO: 947430 - protein, 42 aa, Mycobacterium
LNTLPDTYRVMLRQGLYGNYFTFYLCDLLLKVNGKGGQPVYI

SEQ ID NO: 947431 - protein, 26 aa, Mycobacterium
LNVINAPTLAVLGRPLIGNGANGAPG

SEQ ID NO: 947432 - protein, 20 aa, Mycobacterium
LNVNPANARWFYDNTRRGDI

SEQ ID NO: 947433 - protein, 22 aa, Mycobacterium
LNVNPANARWFYDNTRRGDIVE

SEQ ID NO: 947434 - protein, 18 aa, Mycobacterium
LNVVAFTPSNLDAEESWT

SEQ ID NO: 947435 - protein, 25 aa, Mycobacterium
LNYDTFHFSRKWLQRLTAKATDFRS

SEQ ID NO: 947436 - protein, 28 aa, Mycobacterium
LNYSAYLGRYMVVVTVSPIAVGKVPPAM

SEQ ID NO: 947437 - protein, 18 aa, Mycobacterium
LNYYGDGGVAGAGGDGGR

SEQ ID NO: 947438 - protein, 26 aa, Mycobacterium
LPAADLKYFQQATGYYLALASGRIDA

SEQ ID NO: 947439 - protein, 24 aa, Mycobacterium
LPAARNLLAMRALAHRIAPDIRRA

SEQ ID NO: 947440 - protein, 22 aa, Mycobacterium
LPAIPYRVPYPQIMPTQESSPT

SEQ ID NO: 947441 - protein, 17 aa, Mycobacterium
LPALAAQISAAVQASFG

SEQ ID NO: 947442 - protein, 21 aa, Mycobacterium
LPALDRGIELLTRARAALADT

SEQ ID NO: 947443 - protein, 17 aa, Mycobacterium
LPALFLGSGLTEAAYRG

SEQ ID NO: 947444 - protein, 18 aa, Mycobacterium
LPAPGLGAGGYRLTAVFA

SEQ ID NO: 947445 - protein, 17 aa, Mycobacterium
LPARHELLLSRGPYDYE

SEQ ID NO: 947446 - protein, 24 aa, Mycobacterium
LPASQLTLTIGFGPGFFSKDGKDR

SEQ ID NO: 947447 - protein, 18 aa, Mycobacterium
LPDGTRAFTVAHDALWVI

SEQ ID NO: 947448 - protein, 17 aa, Mycobacterium
LPDTPVVFTVPATIDAC

SEQ ID NO: 947449 - protein, 23 aa, Mycobacterium
LPDVARTILVFRRGEFALAHDTV

SEQ ID NO: 947450 - protein, 22 aa, Mycobacterium
LPEDVWLADLGSHPLRDLPRPE

SEQ ID NO: 947451 - protein, 18 aa, Mycobacterium
LPFLQQLAANPAAATQLM

SEQ ID NO: 947452 - protein, 21 aa, Mycobacterium
LPGAHSFFVGNPRIGKTFFDA

SEQ ID NO: 947453 - protein, 17 aa, Mycobacterium
LPGASAHGARFAADAVA

SEQ ID NO: 947454 - protein, 17 aa, Mycobacterium
LPGFTEQLNDPGPAAAR

SEQ ID NO: 947455 - protein, 26 aa, Mycobacterium
LPGGDHLMLMDLTQPLQPGDDVALTV

SEQ ID NO: 947456 - protein, 19 aa, Mycobacterium
LPGLPPRSRTVFYLPSALV

SEQ ID NO: 947457 - protein, 23 aa, Mycobacterium
LPGNPRMLSIAQFWDRAAGHDRI

SEQ ID NO: 947458 - protein, 24 aa, Mycobacterium
LPGNPRVLSIAQFWDRAANHDRIS

SEQ ID NO: 947459 - protein, 26 aa, Mycobacterium
LPGPAIQPFLDYALGFRRGVNAGQPP

SEQ ID NO: 947460 - protein, 27 aa, Mycobacterium
LPGVSDPWGVVYANGLLYVTSTATQSV

SEQ ID NO: 947461 - protein, 18 aa, Mycobacterium
LPGWQFVVIDVPSGAEDG

SEQ ID NO: 947462 - protein, 24 aa, Mycobacterium
LPHEIRPAALWRIETDHDANPVAW

SEQ ID NO: 947463 - protein, 17 aa, Mycobacterium
LPHIGFGQRSKYLVTDT

SEQ ID NO: 947464 - protein, 22 aa, Mycobacterium
LPIAKRYNVGAFNWGLVAGKTQ

SEQ ID NO: 947465 - protein, 17 aa, Mycobacterium
LPIGWQFVHIDVPSGAE

SEQ ID NO: 947466 - protein, 19 aa, Mycobacterium
LPITPAWPKVYALMERTFG

SEQ ID NO: 947467 - protein, 21 aa, Mycobacterium
LPIVLKGLSRFYSEGAFINVY

SEQ ID NO: 947468 - protein, 19 aa, Mycobacterium
LPKVPFQKHPPFVITDVNA

SEQ ID NO: 947469 - protein, 36 aa, Mycobacterium
LPLGEPARPVWPPLLDAALTAVFDFAGRHLFVYEPL

SEQ ID NO: 947470 - protein, 17 aa, Mycobacterium
LPLLLAAGTALARAPRA

SEQ ID NO: 947471 - protein, 22 aa, Mycobacterium
LPLPDNAALITVLRAGSVILPQ

SEQ ID NO: 947472 - protein, 32 aa, Mycobacterium
LPLRAMVMVLLFLGVVFLLVGFQALGSDDDSS

SEQ ID NO: 947473 - protein, 17 aa, Mycobacterium
LPMVLIDNPGRANGGLF

SEQ ID NO: 947474 - protein, 20 aa, Mycobacterium
LPNMPALRPTPQARAIGIRS

SEQ ID NO: 947475 - protein, 20 aa, Mycobacterium
LPPGCAIGWTMVGHVLIYVP

SEQ ID NO: 947476 - protein, 19 aa, Mycobacterium
LPPGLGYLPPPGHGGPMPQ

SEQ ID NO: 947477 - protein, 20 aa, Mycobacterium
LPPVVIDRLRHPGAPTYMVS

SEQ ID NO: 947478 - protein, 19 aa, Mycobacterium
LPQPSRYFWDGAKWVERFD

SEQ ID NO: 947479 - protein, 24 aa, Mycobacterium
LPRMHLARYAGTARPRLAPPVPSI

SEQ ID NO: 947480 - protein, 17 aa, Mycobacterium
LPSAFRPVPDSATTTGS

SEQ ID NO: 947481 - protein, 18 aa, Mycobacterium
LPSGYAPPAPPPRNSLGG

SEQ ID NO: 947482 - protein, 29 aa, Mycobacterium
LPSLSNWPNILPDDFSILDGIFAMYATVG

SEQ ID NO: 947483 - protein, 17 aa, Mycobacterium
LPSPPQTPAPPPPTAHI

SEQ ID NO: 947484 - protein, 26 aa, Mycobacterium
LPSSAQLPVWLSRAGADVLAAHPIVA

SEQ ID NO: 947485 - protein, 17 aa, Mycobacterium
LPSSFRPVPDPTSPTGS

SEQ ID NO: 947486 - protein, 19 aa, Mycobacterium
LPSSTQLPVWLSHAGADVL

SEQ ID NO: 947487 - protein, 24 aa, Mycobacterium
LPSSVQLPVWLSRGGADVLQTHPI

SEQ ID NO: 947488 - protein, 27 aa, Mycobacterium
LPTHPAPVLLFVPGGAWIHGSRTMQGY

SEQ ID NO: 947489 - protein, 22 aa, Mycobacterium
LPTLPQSYPWDTNPRSFDPSSN

SEQ ID NO: 947490 - protein, 21 aa, Mycobacterium
LPVHRGELQHALLGALPAGTV

SEQ ID NO: 947491 - protein, 19 aa, Mycobacterium
LPVLGDPLADLVQPNLKVI

SEQ ID NO: 947492 - protein, 18 aa, Mycobacterium
LPVLGWNMRVSNLRWSGD

SEQ ID NO: 947493 - protein, 19 aa, Mycobacterium
LPVRLSLFEWAFHYAYQTA

SEQ ID NO: 947494 - protein, 21 aa, Mycobacterium
LPVSALVIAAAVLVGCSSRPS

SEQ ID NO: 947495 - protein, 25 aa, Mycobacterium
LPYARSTPLFYYNKAVWQRAGLPDR

SEQ ID NO: 947496 - protein, 22 aa, Mycobacterium
LPYTQITGGNYWWSGDDHSATF

SEQ ID NO: 947497 - protein, 37 aa, Mycobacterium
LQAAAQDMLTAIRAPAQALLGRPLIGNGADGAPGQAG

SEQ ID NO: 947498 - protein, 22 aa, Mycobacterium
LQADLGLAYLFISHDLAVVRQI

SEQ ID NO: 947499 - protein, 18 aa, Mycobacterium
LQAFLHWAITEGNGPSFL

SEQ ID NO: 947500 - protein, 24 aa, Mycobacterium
LQDDRHFFPLYNLTEVIDADLLAA

SEQ ID NO: 947501 - protein, 22 aa, Mycobacterium
LQDFGPDFGLTFVLDGMAAMGQ

SEQ ID NO: 947502 - protein, 29 aa, Mycobacterium
LQDHLAFPVEWEFPPGWGPDARGQACIYW

SEQ ID NO: 947503 - protein, 28 aa, Mycobacterium
LQDSDLVPYRTLVTQTPVAVMLGHLQVP

SEQ ID NO: 947504 - protein, 18 aa, Mycobacterium
LQGPQFDTLWLETMLGHH

SEQ ID NO: 947505 - protein, 18 aa, Mycobacterium
LQIFPLVGWAERGGYDAN

SEQ ID NO: 947506 - protein, 25 aa, Mycobacterium
LQKIPPALDVLIRERPRITAALDKL

SEQ ID NO: 947507 - protein, 21 aa, Mycobacterium
LQKTLARNLLPDLQATHGYVQ

SEQ ID NO: 947508 - protein, 19 aa, Mycobacterium
LQLAIFAMVTVLAGGSMAF

SEQ ID NO: 947509 - protein, 27 aa, Mycobacterium
LQLGLESLRLWHSGFLDGLPEKVVTAR

SEQ ID NO: 947510 - protein, 26 aa, Mycobacterium
LQNLQRPLKQLGRAAPYLVGALKLIL

SEQ ID NO: 947511 - protein, 30 aa, Mycobacterium
LQPQQGFSGTYPYWGFQKATSEDLDRLMNY

SEQ ID NO: 947512 - protein, 22 aa, Mycobacterium
LQPTLEFMRRLGAPWTFGTDAP

SEQ ID NO: 947513 - protein, 26 aa, Mycobacterium
LQQDPSIDYLVALGAPFALTAVQSAK

SEQ ID NO: 947514 - protein, 26 aa, Mycobacterium
LQQKTHFWKNISILGGLIIAGIDTEG

SEQ ID NO: 947515 - protein, 18 aa, Mycobacterium
LQRIETLLDVDLHTTNSA

SEQ ID NO: 947516 - protein, 17 aa, Mycobacterium
LQRLRGMTPRAALTKHL

SEQ ID NO: 947517 - protein, 47 aa, Mycobacterium
LQSLADQEIFLISPLAALAILPVKLIGDLVYIAVNIPAQIIARLTGV

SEQ ID NO: 947518 - protein, 18 aa, Mycobacterium
LQSWVHRVAQFQYALQDE

SEQ ID NO: 947519 - protein, 23 aa, Mycobacterium
LQTKIAFLESNPVTRRLTAVQQR

SEQ ID NO: 947520 - protein, 25 aa, Mycobacterium
LQTSDLVPYRSLVAAAPVAVMVGHL

SEQ ID NO: 947521 - protein, 19 aa, Mycobacterium
LQVKTIWAARAIGVLFPQI

SEQ ID NO: 947522 - protein, 17 aa, Mycobacterium
LQWGRTIGQMPSPYTAG

SEQ ID NO: 947523 - protein, 21 aa, Mycobacterium
LRAAETLRKKGFRGKLTLIGE

SEQ ID NO: 947524 - protein, 28 aa, Mycobacterium
LRAAPPGLPWEMVWSFHLIPRGDDQCRL

SEQ ID NO: 947525 - protein, 32 aa, Mycobacterium
LRAEGITAPVLAWLHPPGIDFRPALLADVEIA

SEQ ID NO: 947526 - protein, 18 aa, Mycobacterium
LRAISNPFTGRILKLHKT

SEQ ID NO: 947527 - protein, 33 aa, Mycobacterium
LRASGARRLVIAPWFLAPGLITDRVWKYACDND

SEQ ID NO: 947528 - protein, 18 aa, Mycobacterium
LRCIGCGLCIEACPTRAL

SEQ ID NO: 947529 - protein, 27 aa, Mycobacterium
LRDDVRILKSWNIIDSYKAYFTEGDRY

SEQ ID NO: 947530 - protein, 18 aa, Mycobacterium
LRDLMRLDAKAAAPLAAV

SEQ ID NO: 947531 - protein, 25 aa, Mycobacterium
LRDWDAMVTVNVQGVLYVTRAALPH

SEQ ID NO: 947532 - protein, 18 aa, Mycobacterium
LREGSLIPLSRGGAYPST

SEQ ID NO: 947533 - protein, 18 aa, Mycobacterium
LRELAFRDFYAAVVAEWP

SEQ ID NO: 947534 - protein, 30 aa, Mycobacterium
LRENGMTPMITLMHWVYPGWVADSGGFMNN

SEQ ID NO: 947535 - protein, 17 aa, Mycobacterium
LRGATLGGSGAVNGGYF

SEQ ID NO: 947536 - protein, 26 aa, Mycobacterium
LRGDRTLFLFILRSDDATVPGSHDER

SEQ ID NO: 947537 - protein, 29 aa, Mycobacterium
LRGGSIVGPHFSFNWYRGSPIGRERATEE

SEQ ID NO: 947538 - protein, 21 aa, Mycobacterium
LRGHRLPDYAPHRAIRVLDSA

SEQ ID NO: 947539 - protein, 24 aa, Mycobacterium
LRGNNWVAFNGCCDPGWAHRDAIM

SEQ ID NO: 947540 - protein, 30 aa, Mycobacterium
LRGYFTSNPQEYYDLRGILSPIGDTQRTCN

SEQ ID NO: 947541 - protein, 17 aa, Mycobacterium
LRHQFGRPIASFQAAQH

SEQ ID NO: 947542 - protein, 19 aa, Mycobacterium
LRLANLRRMMLGRVRGLGL

SEQ ID NO: 947543 - protein, 17 aa, Mycobacterium
LRLFAAGSVAALVLAGC

SEQ ID NO: 947544 - protein, 18 aa, Mycobacterium
LRLLLALSRLGSMRAVAD

SEQ ID NO: 947545 - protein, 21 aa, Mycobacterium
LRLLLTTGLAAAVVATAAGCQ

SEQ ID NO: 947546 - protein, 28 aa, Mycobacterium
LRLRWRRGCMPVPRRVIRARVHGRQVYL

SEQ ID NO: 947547 - protein, 19 aa, Mycobacterium
LRLVPIAGDSWGAFRAYLA

SEQ ID NO: 947548 - protein, 17 aa, Mycobacterium
LRLVRELYRGGTNLYTP

SEQ ID NO: 947549 - protein, 17 aa, Mycobacterium
LRMLTPVEDYPLIDGEG

SEQ ID NO: 947550 - protein, 25 aa, Mycobacterium
LRNHARWAVLLRNLRFVIVDECHYY

SEQ ID NO: 947551 - protein, 17 aa, Mycobacterium
LRNVLRQAAERDVPVVI

SEQ ID NO: 947552 - protein, 18 aa, Mycobacterium
LRPALSLIAALTAVITAL

SEQ ID NO: 947553 - protein, 24 aa, Mycobacterium
LRPAQAVLLVPLAAGSLHASDLAE

SEQ ID NO: 947554 - protein, 27 aa, Mycobacterium
LRPEDIADAVLFMVTRDRRVAVNHMLV

SEQ ID NO: 947555 - protein, 27 aa, Mycobacterium
LRPEDIADAVLFMVTRDRRVAVNRMLV

SEQ ID NO: 947556 - protein, 22 aa, Mycobacterium
LRPGRLPGVIAYPGLDFQHTPA

SEQ ID NO: 947557 - protein, 18 aa, Mycobacterium
LRPVILLHGKDSSAATVM

SEQ ID NO: 947558 - protein, 19 aa, Mycobacterium
LRPVQPGGPPIWIGGASEA

SEQ ID NO: 947559 - protein, 24 aa, Mycobacterium
LRQDRTYKPPPDACPLCPGPTGLT

SEQ ID NO: 947560 - protein, 25 aa, Mycobacterium
LRQQTGGLNILPYGVNYAASKLQLH

SEQ ID NO: 947561 - protein, 23 aa, Mycobacterium
LRQQTGLNILPYGVNYAASKLQL

SEQ ID NO: 947562 - protein, 17 aa, Mycobacterium
LRQRRRFEFNGRHGRRD

SEQ ID NO: 947563 - protein, 39 aa, Mycobacterium
LRQSVAGLVVLLALTVVLGVAYPAAVWLFGRINSGSAEG

SEQ ID NO: 947564 - protein, 21 aa, Mycobacterium
LRRKFRAIWVGGRTPPAGAIR

SEQ ID NO: 947565 - protein, 18 aa, Mycobacterium
LRRLLRLCARYSSAPTVV

SEQ ID NO: 947566 - protein, 26 aa, Mycobacterium
LRRLRGMFAFALWDTVTRELFCARDP

SEQ ID NO: 947567 - protein, 18 aa, Mycobacterium
LRRRTWAVWPATSRRRDV

SEQ ID NO: 947568 - protein, 25 aa, Mycobacterium
LRRTEVYYILLAGTAADFCTGLNAR

SEQ ID NO: 947569 - protein, 17 aa, Mycobacterium
LRRWSVAAAAGVVAVAG

SEQ ID NO: 947570 - protein, 24 aa, Mycobacterium
LRSALVWAAAVLVVAGCTTFVDGR

SEQ ID NO: 947571 - protein, 20 aa, Mycobacterium
LRSAPGLRAQPGLPVCQFRR

SEQ ID NO: 947572 - protein, 24 aa, Mycobacterium
LRSMALFVNALYKDDRNFVALNKD

SEQ ID NO: 947573 - protein, 23 aa, Mycobacterium
LRSPYYSEISWPTKWSTAACRYH

SEQ ID NO: 947574 - protein, 18 aa, Mycobacterium
LRSYLPDVTPTQRRKRVL

SEQ ID NO: 947575 - protein, 22 aa, Mycobacterium
LRTACLTGYFTSRAAGKGIVTP

SEQ ID NO: 947576 - protein, 33 aa, Mycobacterium
LRTDPAALTTLVYYHAFLGLLGPDDVKGQRPTQ

SEQ ID NO: 947577 - protein, 25 aa, Mycobacterium
LRTYVQLFVLIAQANDVKCDVASNS

SEQ ID NO: 947578 - protein, 23 aa, Mycobacterium
LRTYVQLFVVIAMANDVRCDVAS

SEQ ID NO: 947579 - protein, 23 aa, Mycobacterium
LRVAPLSVAGLLRDRVFSRSTTV

SEQ ID NO: 947580 - protein, 19 aa, Mycobacterium
LRVARTFETSIPPGFMVEA

SEQ ID NO: 947581 - protein, 28 aa, Mycobacterium
LRVAVQAIGRLLFAAGAVEVLTGLPGAP

SEQ ID NO: 947582 - protein, 23 aa, Mycobacterium
LRVGQPVVAIGSPLGLSGTVTTG

SEQ ID NO: 947583 - protein, 27 aa, Mycobacterium
LRVILGANHSTPFWWSADSRIGDSTVI

SEQ ID NO: 947584 - protein, 17 aa, Mycobacterium
LRVNAVAPGPIDTPLWS

SEQ ID NO: 947585 - protein, 26 aa, Mycobacterium
LRWRPVVALALIVAVLAGCGGGASDV

SEQ ID NO: 947586 - protein, 32 aa, Mycobacterium
LRWVRADEIPSLPWVPADRAWLPDLVGLLAGN

SEQ ID NO: 947587 - protein, 30 aa, Mycobacterium
LRYRNNVPLTYPFVLAFPSVMALVTGFDFP

SEQ ID NO: 947588 - protein, 22 aa, Mycobacterium
LRYSTLDAALLSPLIPLTGVYV

SEQ ID NO: 947589 - protein, 17 aa, Mycobacterium
LSAGGAAALLVVAACSS

SEQ ID NO: 947590 - protein, 30 aa, Mycobacterium
LSAGVFAALIYQLVLGIPLAEALAEAKRVL

SEQ ID NO: 947591 - protein, 18 aa, Mycobacterium
LSALANPIDGYAAAFTAA

SEQ ID NO: 947592 - protein, 19 aa, Mycobacterium
LSAPKRIFLGNTAAKMLRV

SEQ ID NO: 947593 - protein, 18 aa, Mycobacterium
LSAVLPGAAAALVKNPDR

SEQ ID NO: 947594 - protein, 17 aa, Mycobacterium
LSAWRHSNPAAPRSLAP

SEQ ID NO: 947595 - protein, 24 aa, Mycobacterium
LSCQIVTWRCWAEELGIAVDDITA

SEQ ID NO: 947596 - protein, 18 aa, Mycobacterium
LSDPVRLRLLSLVASHPG

SEQ ID NO: 947597 - protein, 23 aa, Mycobacterium
LSDTLRDYFAGREPDRNFSATGL

SEQ ID NO: 947598 - protein, 19 aa, Mycobacterium
LSEEITRVLNVTGAPQVNL

SEQ ID NO: 947599 - protein, 19 aa, Mycobacterium
LSFGYRTSVLKQADGLALP

SEQ ID NO: 947600 - protein, 17 aa, Mycobacterium
LSFLKYPMAVTVQNVTD

SEQ ID NO: 947601 - protein, 21 aa, Mycobacterium
LSGAALHQYLVLRGGIRMEEG

SEQ ID NO: 947602 - protein, 30 aa, Mycobacterium; identical to SEQ ID NO: 129134

SEQ ID NO: 947603 - protein, 26 aa, Mycobacterium
LSGENAQWFYNFSRPGDIVEIRNTGG

SEQ ID NO: 947604 - protein, 17 aa, Mycobacterium
LSGFCLLASIVAAALMF

SEQ ID NO: 947605 - protein, 32 aa, Mycobacterium
LSGGSLEIFLTPQLPAPLVRIYGATPIAEALI

SEQ ID NO: 947606 - protein, 20 aa, Mycobacterium
LSGLGLTMTGPRPGGFGALD

SEQ ID NO: 947607 - protein, 22 aa, Mycobacterium
LSGMAIGPHRVYLTLAGVPDVV

SEQ ID NO: 947608 - protein, 20 aa, Mycobacterium
LSHMDLVMYLAGGSATSSPR

SEQ ID NO: 947609 - protein, 17 aa, Mycobacterium
LSHPMLRGLSGIDWVDA

SEQ ID NO: 947610 - protein, 27 aa, Mycobacterium
LSIAGDLRVDFAWLGTVVQAYLRRTLD

SEQ ID NO: 947611 - protein, 28 aa, Mycobacterium
LSIPSAISRAPWVLLRAYTDDDIVEIVP

SEQ ID NO: 947612 - protein, 19 aa, Mycobacterium
LSKSFVRWYSVAQAERFNG

SEQ ID NO: 947613 - protein, 20 aa, Mycobacterium
LSLAAVFLALAVGVVLGSGL

SEQ ID NO: 947614 - protein, 19 aa, Mycobacterium
LSLFGKPASNMSVAYVFPG

SEQ ID NO: 947615 - protein, 20 aa, Mycobacterium
LSLTTWTCGRPQTYPPVVWQ

SEQ ID NO: 947616 - protein, 31 aa, Mycobacterium
LSLVFLLVVSVTYLLVGVLHVRPLASSYPLT

SEQ ID NO: 947617 - protein, 18 aa, Mycobacterium
LSMLSPLTDYPLVDALGR

SEQ ID NO: 947618 - protein, 26 aa, Mycobacterium
LSNPKYPYWFNSMALNDDAALREAYT

SEQ ID NO: 947619 - protein, 40 aa, Mycobacterium
LSPALKVFNPLMYFNFNYFPIPINPILAPAFDLQNVVYTE

SEQ ID NO: 947620 - protein, 20 aa, Mycobacterium
LSPEDFWRSAGLPEYRFPDP

SEQ ID NO: 947621 - protein, 25 aa, Mycobacterium
LSPEHVVTLVQFLASPAAAAVNGQL

SEQ ID NO: 947622 - protein, 18 aa, Mycobacterium
LSPGFHGLQIHSVGKCEA

SEQ ID NO: 947623 - protein, 20 aa, Mycobacterium
LSQLWPSLLQAHYGRGFSVA

SEQ ID NO: 947624 - protein, 19 aa, Mycobacterium
LSQYYPAALAAFPDIDGRD

SEQ ID NO: 947625 - protein, 26 aa, Mycobacterium
LSRGAAPVDRPAFWSANLCFSLGESL

SEQ ID NO: 947626 - protein, 18 aa, Mycobacterium
LSRRTAEMLLALGKSPAA

SEQ ID NO: 947627 - protein, 33 aa, Mycobacterium
LSSARMYFAYGLGNSVWFPLATGSSAVVNPLPV

SEQ ID NO: 947628 - protein, 18 aa, Mycobacterium
LSSFRWWPDRTLSRRGVE

SEQ ID NO: 947629 - protein, 24 aa, Mycobacterium
LSSGWNIIDFVQQLQQLTGGNVAF

SEQ ID NO: 947630 - protein, 17 aa, Mycobacterium
LSSILSSLLTPTDTPNT

SEQ ID NO: 947631 - protein, 21 aa, Mycobacterium
LSSSVALAAGALALTACGSGV

SEQ ID NO: 947632 - protein, 19 aa, Mycobacterium
LSTALGGKVLLPDSPQFAS

SEQ ID NO: 947633 - protein, 20 aa, Mycobacterium
LSTALSSVAALAVASPFAIA

SEQ ID NO: 947634 - protein, 20 aa, Mycobacterium
LSTEFFTSGEFNSGVGSSGT

SEQ ID NO: 947635 - protein, 22 aa, Mycobacterium
LSTIPWMFVAPLTGVTEREYYQ

SEQ ID NO: 947636 - protein, 18 aa, Mycobacterium
LSTIRGVAAEYLPAGNDG

SEQ ID NO: 947637 - protein, 25 aa, Mycobacterium
LSTLADYHPFMVAGVPIGGLTSGAS

SEQ ID NO: 947638 - protein, 30 aa, Mycobacterium
LSTQADLFHAQFVQLLNSGASAYTGAEAAN

SEQ ID NO: 947639 - protein, 20 aa, Mycobacterium
LSTRSNLFGSKAIDLCNPSD

SEQ ID NO: 947640 - protein, 20 aa, Mycobacterium
LSTTDGWIKALWAYNMSDVY

SEQ ID NO: 947641 - protein, 17 aa, Mycobacterium
LSVAALLAVLVAYQSVR

SEQ ID NO: 947642 - protein, 17 aa, Mycobacterium
LSVPHSWAMAAPEIRLA

SEQ ID NO: 947643 - protein, 18 aa, Mycobacterium
LSVRALFDGAIAALKHGV

SEQ ID NO: 947644 - protein, 18 aa, Mycobacterium
LSVRGYCRLLAEEDRRFA

SEQ ID NO: 947645 - protein, 22 aa, Mycobacterium
LSVSAVLGWHLFAAHHANVAAE

SEQ ID NO: 947646 - protein, 24 aa, Mycobacterium
LSVSLFRGSFIKSVPITVLTQRAG

SEQ ID NO: 947647 - protein, 23 aa, Mycobacterium
LSVVPIMLARILDLPDQVRARNP

SEQ ID NO: 947648 - protein, 21 aa, Mycobacterium
LSVVQVPFVSLGPGPTFNTLG

SEQ ID NO: 947649 - protein, 28 aa, Mycobacterium
LSYYLASAFREIWLQPSGSVGLIGFASN

SEQ ID NO: 947650 - protein, 17 aa, Mycobacterium
LTAIWEVFTRQAESAGA

SEQ ID NO: 947651 - protein, 19 aa, Mycobacterium
LTALALVALPGVAGADPEV

SEQ ID NO: 947652 - protein, 17 aa, Mycobacterium
LTALDGSALSLADFGDN

SEQ ID NO: 947653 - protein, 18 aa, Mycobacterium
LTAQFYNELDPKTAVLTW

SEQ ID NO: 947654 - protein, 17 aa, Mycobacterium
LTATLFSGSFKSSIAVT

SEQ ID NO: 947655 - protein, 17 aa, Mycobacterium
LTAVALGTLLVASAGVI

SEQ ID NO: 947656 - protein, 18 aa, Mycobacterium
LTDAIALVRGDGGTVRAV

SEQ ID NO: 947657 - protein, 25 aa, Mycobacterium
LTDAPPTLYTLPIKEFGQNAYGEDI

SEQ ID NO: 947658 - protein, 25 aa, Mycobacterium
LTDKIKALHLPPSPPPPPPQTANPQ

SEQ ID NO: 947659 - protein, 27 aa, Mycobacterium
LTDPMLPAELLPAQWPGTRLREAYHDF

SEQ ID NO: 947660 - protein, 24 aa, Mycobacterium
LTDQTDLFFTMTDALGLDRGEEPA

SEQ ID NO: 947661 - protein, 24 aa, Mycobacterium
LTDRQIELTPPYRGDGPTLRDHDT

SEQ ID NO: 947662 - protein, 25 aa, Mycobacterium
LTDRQIELTPPYRGGPVLQSHDTIG

SEQ ID NO: 947663 - protein, 25 aa, Mycobacterium
LTDSSGRVLTFAFLSNDAGPNGRNA

SEQ ID NO: 947664 - protein, 25 aa, Mycobacterium
LTEWNFVWDELLARGLRVIAFDQRG

SEQ ID NO: 947665 - protein, 18 aa, Mycobacterium
LTFASGWLEFRSAGYSGV

SEQ ID NO: 947666 - protein, 29 aa, Mycobacterium
LTGANGYLGRFLCLEWLQRLSQTGGQLIC

SEQ ID NO: 947667 - protein, 18 aa, Mycobacterium
LTGDERWRDAVAAATRAL

SEQ ID NO: 947668 - protein, 24 aa, Mycobacterium
LTGRPTYGVLPYDDQLWLDAEDSV

SEQ ID NO: 947669 - protein, 26 aa, Mycobacterium
LTHDLNSLTLPEPLRQRIRARLTEHE

SEQ ID NO: 947670 - protein, 20 aa, Mycobacterium
LTHPHGQIYGYPYLTPRTVA

SEQ ID NO: 947671 - protein, 25 aa, Mycobacterium
LTIGAPLPAPPLPTPPNSTAAPLDH

SEQ ID NO: 947672 - protein, 17 aa, Mycobacterium
LTIVTALGNPRAIASFA

SEQ ID NO: 947673 - protein, 30 aa, Mycobacterium
LTLALVALLLFGVAAWLGIPTTPHGKTVVT

SEQ ID NO: 947674 - protein, 18 aa, Mycobacterium
LTLARPNERVLPATITGV

SEQ ID NO: 947675 - protein, 21 aa, Mycobacterium
LTLGPLLISGIAWAGPARADQ

SEQ ID NO: 947676 - protein, 18 aa, Mycobacterium
LTLLKLSGFCLLASIVAA

SEQ ID NO: 947677 - protein, 20 aa, Mycobacterium
LTLVLAVTYLCVGALRANPF

SEQ ID NO: 947678 - protein, 18 aa, Mycobacterium
LTPDFRPGCKRMLVSSDY

SEQ ID NO: 947679 - protein, 25 aa, Mycobacterium
LTPDGRYLFAAMEQPLYQDGPATDE

SEQ ID NO: 947680 - protein, 20 aa, Mycobacterium
LTPNLYAQLAAIAPTVFTAA

SEQ ID NO: 947681 - protein, 22 aa, Mycobacterium
LTQIGTPYAWGGAGPGGFDCSG

SEQ ID NO: 947682 - protein, 28 aa, Mycobacterium
LTQSPPAWWRPAGALFDQFLGAAETDPV

SEQ ID NO: 947683 - protein, 19 aa, Mycobacterium
LTQVLLAWQNNKPAELVLG

SEQ ID NO: 947684 - protein, 19 aa, Mycobacterium
LTRPSWALDDAVWTVIDGG

SEQ ID NO: 947685 - protein, 25 aa, Mycobacterium
LTRSLNLFTTIPFVKDNLTKWWRGD

SEQ ID NO: 947686 - protein, 27 aa, Mycobacterium
LTRTTAIAGAAALAVLLAGCGDDSTGG

SEQ ID NO: 947687 - protein, 18 aa, Mycobacterium
LTRYLNLVAFGNGAFGVQ

SEQ ID NO: 947688 - protein, 18 aa, Mycobacterium
LTRYLNLVSFGNGAFGVQ

SEQ ID NO: 947689 - protein, 27 aa, Mycobacterium
LTSGAPYEFDLYYLATQPADKAAYDAD

SEQ ID NO: 947690 - protein, 27 aa, Mycobacterium
LTSRAWKVLAATLLAGSLIVSGCGTRT

SEQ ID NO: 947691 - protein, 17 aa, Mycobacterium
LTTLPPPSTLSAPPAPS

SEQ ID NO: 947692 - protein, 24 aa, Mycobacterium
LTTPHDLAVIFRAALNYPVIAQIL

SEQ ID NO: 947693 - protein, 19 aa, Mycobacterium
LTVKGTCAKANIGGADNKI

SEQ ID NO: 947694 - protein, 20 aa, Mycobacterium
LTVMRTILRLMDRSPDDFDH

SEQ ID NO: 947695 - protein, 21 aa, Mycobacterium
LTVRLLAGAAGLLIASAALAA

SEQ ID NO: 947696 - protein, 31 aa, Mycobacterium
LTVVFAHGFCLRMSAFHFQRARLAEQWGDQV

SEQ ID NO: 947697 - protein, 25 aa, Mycobacterium
LTYGRTHLLRLVAIKRLQGKGLSLE

SEQ ID NO: 947698 - protein, 18 aa, Mycobacterium
LTYLFGQAYWSKRTVFGD

SEQ ID NO: 947699 - protein, 18 aa, Mycobacterium
LVAALGLLVGPGCSRAVT

SEQ ID NO: 947700 - protein, 24 aa, Mycobacterium
LVAARFIQLTPVYTGGAVLPDGAS

SEQ ID NO: 947701 - protein, 18 aa, Mycobacterium
LVAFAVPEPGWSKAAPAF

SEQ ID NO: 947702 - protein, 34 aa, Mycobacterium
LVALICVLPIAVSPWPATAFVALLVALAVAVAVD

SEQ ID NO: 947703 - protein, 30 aa, Mycobacterium
LVALIPIVVFGLLMSVITVPFVSLGPGPTF

SEQ ID NO: 947704 - protein, 41 aa, Mycobacterium
LVALVCVLPIAVSPWPATAFGALLVLLLAAVGADVALAGSP

SEQ ID NO: 947705 - protein, 19 aa, Mycobacterium
LVALVPVVAFGVLLSVVQV

SEQ ID NO: 947706 - protein, 20 aa, Mycobacterium
LVAMNFFGVNVAPIALNEAD

SEQ ID NO: 947707 - protein, 25 aa, Mycobacterium
LVASAALVAWPAAAAPPTCASLGGT

SEQ ID NO: 947708 - protein, 24 aa, Mycobacterium
LVATVSGYRAGLLASIAASCTASY

SEQ ID NO: 947709 - protein, 23 aa, Mycobacterium
LVDDQWTFLHARPQGMTCPDGSY

SEQ ID NO: 947710 - protein, 18 aa, Mycobacterium
LVDELGGFRTAVRRAKIL

SEQ ID NO: 947711 - protein, 18 aa, Mycobacterium
LVDELGGFRTAVRRAKVL

SEQ ID NO: 947712 - protein, 25 aa, Mycobacterium
LVDPPVRLQDPTLLLRVLRANLRQR

SEQ ID NO: 947713 - protein, 29 aa, Mycobacterium
LVELFTADAVWEMPPFDGWYSGPADIIAL

SEQ ID NO: 947714 - protein, 18 aa, Mycobacterium
LVELLYGASQWTTDYLFD

SEQ ID NO: 947715 - protein, 18 aa, Mycobacterium
LVERGLVKPVLGATLPLA

SEQ ID NO: 947716 - protein, 19 aa, Mycobacterium
LVFAAAIAAAAPAAADQWV

SEQ ID NO: 947717 - protein, 25 aa, Mycobacterium
LVGDDLIGPLFRHGSRNADIAVVEG

SEQ ID NO: 947718 - protein, 25 aa, Mycobacterium
LVGDQGPWRLPYTHGAPEVNIVYPS

SEQ ID NO: 947719 - protein, 19 aa, Mycobacterium
LVGIFNSVWGDFPAAVSWG

SEQ ID NO: 947720 - protein, 19 aa, Mycobacterium
LVGRPFYVNPNSKGTRAAQ

SEQ ID NO: 947721 - protein, 22 aa, Mycobacterium
LVGRPLYEAFLKNYTAKQWQTD

SEQ ID NO: 947722 - protein, 19 aa, Mycobacterium
LVGTGITLAATAVAGCTTY

SEQ ID NO: 947723 - protein, 21 aa, Mycobacterium
LVGVLAVAFIALSALGGAMYW

SEQ ID NO: 947724 - protein, 22 aa, Mycobacterium
LVIVVPPGHKWTRRAHPVSAGE

SEQ ID NO: 947725 - protein, 24 aa, Mycobacterium
LVKARWERWLAPRRRQHPDLDAHV

SEQ ID NO: 947726 - protein, 18 aa, Mycobacterium
LVLAVVLPVSGLVVWRLH

SEQ ID NO: 947727 - protein, 21 aa, Mycobacterium
LVLIGAVFVASTTLACPARAD

SEQ ID NO: 947728 - protein, 19 aa, Mycobacterium
LVLIGRFYERFADHAVDIA

SEQ ID NO: 947729 - protein, 17 aa, Mycobacterium
LVLPDKPVAKVDTERAR

SEQ ID NO: 947730 - protein, 20 aa, Mycobacterium
LVLSLLAKTEFAVARVVARV

SEQ ID NO: 947731 - protein, 29 aa, Mycobacterium
LVLVLVVALALLGGWAYRTANRLDRLHVR

SEQ ID NO: 947732 - protein, 17 aa, Mycobacterium
LVMEIIGAAVRFVSGPP

SEQ ID NO: 947733 - protein, 28 aa, Mycobacterium
LVNDAQRILFRDMPVVPLWDNIAVVGWS

SEQ ID NO: 947734 - protein, 32 aa, Mycobacterium
LVNTGVAEFNYFFGWLIPPVALTTPTETLAFD

SEQ ID NO: 947735 - protein, 19 aa, Mycobacterium
LVPAVDRVIELLSRARDSL

SEQ ID NO: 947736 - protein, 17 aa, Mycobacterium
LVPLGIGAHLRKWGIPE

SEQ ID NO: 947737 - protein, 17 aa, Mycobacterium
LVQRFFSEGPSRKVLRR

SEQ ID NO: 947738 - protein, 19 aa, Mycobacterium
LVRAALPHIADRGSFTLIS

SEQ ID NO: 947739 - protein, 17 aa, Mycobacterium
LVRPDGHIAWIGTGLAV

SEQ ID NO: 947740 - protein, 18 aa, Mycobacterium
LVRYYDMLLDGAGGLPPE

SEQ ID NO: 947741 - protein, 18 aa, Mycobacterium
LVSFTFGIPAGAVIAALR

SEQ ID NO: 947742 - protein, 34 aa, Mycobacterium
LVSHDDARFNISRAALLVVALTQRPDLLMAATED

SEQ ID NO: 947743 - protein, 20 aa, Mycobacterium
LVSLLTLIAGVAVGVTVVPR

SEQ ID NO: 947744 - protein, 22 aa, Mycobacterium
LVSQFFGKYFTPDEARKLIAEQ

SEQ ID NO: 947745 - protein, 20 aa, Mycobacterium
LVSVACSVTMVLAGCVPVLG

SEQ ID NO: 947746 - protein, 27 aa, Mycobacterium
LVTGIGGWLFGWLADRTGSLAAPMLAH

SEQ ID NO: 947747 - protein, 17 aa, Mycobacterium
LVVAWRIDERAQPCWSV

SEQ ID NO: 947748 - protein, 25 aa, Mycobacterium
LVVDTFSFYKPTKPGSYPIVLATYE

SEQ ID NO: 947749 - protein, 21 aa, Mycobacterium
LVVFLAPRFFPPGPRGALASG

SEQ ID NO: 947750 - protein, 18 aa, Mycobacterium
LVVGYTWPTDFGGVIYCQ

SEQ ID NO: 947751 - protein, 18 aa, Mycobacterium
LVVILAAAVGAELFLRHL

SEQ ID NO: 947752 - protein, 26 aa, Mycobacterium
LVVLDDPKFTFPAGNLVPLVNAQKKS

SEQ ID NO: 947753 - protein, 17 aa, Mycobacterium
LVVLSAPAGRGAPPSLF

SEQ ID NO: 947754 - protein, 26 aa, Mycobacterium
LVVMSALARLGAVQNPIIPLLRESEV

SEQ ID NO: 947755 - protein, 19 aa, Mycobacterium
LVVPPPRPPTVKPAVTAVA

SEQ ID NO: 947756 - protein, 20 aa, Mycobacterium
LVVPTVALAVPWLTELQRLF

SEQ ID NO: 947757 - protein, 18 aa, Mycobacterium
LVVRMWALQRAGMYRDMA

SEQ ID NO: 947758 - protein, 33 aa, Mycobacterium
LVVRVPATNTFLYTPTLPVLGDPVPVSFDVVIR

SEQ ID NO: 947759 - protein, 21 aa, Mycobacterium
LVVVFGDFRFGPESTYHATFT

SEQ ID NO: 947760 - protein, 17 aa, Mycobacterium
LVYHATFAPRIAEIRDE

SEQ ID NO: 947761 - protein, 20 aa, Mycobacterium
LWLILAIAIASVILGVTTTA

SEQ ID NO: 947762 - protein, 31 aa, Mycobacterium
LWPAGGCDVQWWFDLPWSYDFVRPQRPIDLI

SEQ ID NO: 947763 - protein, 26 aa, Mycobacterium
LWSVVEAFVGDLWPNGDVAGLHAAAG

SEQ ID NO: 947764 - protein, 17 aa, Mycobacterium
LWVIESKTGQATPVYVP

SEQ ID NO: 947765 - protein, 24 aa, Mycobacterium
LYAAMSIVSLLYGRATRPEPGPAP

SEQ ID NO: 947766 - protein, 29 aa, Mycobacterium
LYDSGMEYAVFQPALFFQNYAAGWDDILR

SEQ ID NO: 947767 - protein, 20 aa, Mycobacterium
LYEGGWYFKDGTRFSDPLTG

SEQ ID NO: 947768 - protein, 25 aa, Mycobacterium
LYGDWVNFYLCDLSIRWNGLQAGGP

SEQ ID NO: 947769 - protein, 21 aa, Mycobacterium
LYGGTEPALTWYRAMKPIAED

SEQ ID NO: 947770 - protein, 28 aa, Mycobacterium
LYHPRRLQFYVIALSGPDLNLVAGLPHV

SEQ ID NO: 947771 - protein, 20 aa, Mycobacterium
LYKHFGSKRELLEAAVAHRI

SEQ ID NO: 947772 - protein, 25 aa, Mycobacterium
LYKVPPALDVLIRERPRITAALDRL

SEQ ID NO: 947773 - protein, 23 aa, Mycobacterium
LYVTRAALPHLIAAAADSPRGVA

SEQ ID NO: 947774 - protein, 20 aa, Mycobacterium
MAAALKLFAAKGYAATSVAE

SEQ ID NO: 947775 - protein, 24 aa, Mycobacterium
MAAALLSLPPEPWAPAVATVATRV

SEQ ID NO: 947776 - protein, 20 aa, Mycobacterium
MAAALPYCDHFLPAHTLTGL

SEQ ID NO: 947777 - protein, 24 aa, Mycobacterium
MAAAPVFMAPTPEMFFGLLSARLS

SEQ ID NO: 947778 - protein, 20 aa, Mycobacterium
MAAFSAAPWLAAPSAMLMCP

SEQ ID NO: 947779 - protein, 24 aa, Mycobacterium
MAAVDPVVALLFMSDCYGHPIKVT

SEQ ID NO: 947780 - protein, 23 aa, Mycobacterium
MACRTRFYDRFFLEAAGSGIGQV

SEQ ID NO: 947781 - protein, 25 aa, Mycobacterium
MADAVRLLSIRRGYDPRDFVLVVCG

SEQ ID NO: 947782 - protein, 17 aa, Mycobacterium
MADLLAFCASRKAGYLT

SEQ ID NO: 947783 - protein, 18 aa, Mycobacterium
MAGQAERGAWAPIRESHP

SEQ ID NO: 947784 - protein, 26 aa, Mycobacterium
MAHSVRNLLAPPLRLRGPVTRADGGK

SEQ ID NO: 947785 - protein, 25 aa, Mycobacterium
MAKSTYLVAPVNWIKGDVSYSIPGS

SEQ ID NO: 947786 - protein, 17 aa, Mycobacterium
MALAVGLPTAGAKNGDT

SEQ ID NO: 947787 - protein, 17 aa, Mycobacterium
MALQYWRSRGRPAKHRL

SEQ ID NO: 947788 - protein, 21 aa, Mycobacterium
MALYSPNLWHHLTDGLSELVD

SEQ ID NO: 947789 - protein, 26 aa, Mycobacterium
MAMASAAAPYAGWLAAAAAQSAGAAG

SEQ ID NO: 947790 - protein, 25 aa, Mycobacterium
MAPPPAPDVPPPPPAPRAYSVNWDA

SEQ ID NO: 947791 - protein, 20 aa, Mycobacterium
MAPVVQLPGPVPRAPGPAPQ

SEQ ID NO: 947792 - protein, 23 aa, Mycobacterium
MAQDPPPRRLVLGNSGYDAVIDA

SEQ ID NO: 947793 - protein, 22 aa, Mycobacterium
MARPPLKRPGLVSRPLLHEQLI

SEQ ID NO: 947794 - protein, 17 aa, Mycobacterium
MASDFGEEHQCPFWVGL

SEQ ID NO: 947795 - protein, 26 aa, Mycobacterium
MASHAHHYLAIFDRGRALSLHHTKRL

SEQ ID NO: 947796 - protein, 23 aa, Mycobacterium
MATARIPAGINFNVGGAGGHGGA

SEQ ID NO: 947797 - protein, 28 aa, Mycobacterium
MATARYSGFLRASLPPYWATTDGAAVRA

SEQ ID NO: 947798 - protein, 21 aa, Mycobacterium
MAVFGIAFPTPDPSIPVKGAL

SEQ ID NO: 947799 - protein, 30 aa, Mycobacterium
MDESSLRAMFELNFFAVLSVTRAVLPGMRA

SEQ ID NO: 947800 - protein, 17 aa, Mycobacterium
MDGPVLTGSRVVGIHGR

SEQ ID NO: 947801 - protein, 25 aa, Mycobacterium
MDPFLPNEGAPGRGPYLAPGSVLAI

SEQ ID NO: 947802 - protein, 22 aa, Mycobacterium
MDPSQLHFIPGNVLVDIASSTV

SEQ ID NO: 947803 - protein, 24 aa, Mycobacterium
MDSRGRFTYTPAEAARHAAAAAEA

SEQ ID NO: 947804 - protein, 29 aa, Mycobacterium
MEKPNSGWLYTWALGIPKSSDKPDAAWKF

SEQ ID NO: 947805 - protein, 22 aa, Mycobacterium
MEPAYLDLIPANVGVDIAAPTV

SEQ ID NO: 947806 - protein, 21 aa, Mycobacterium
MEQVRRRCPPLTGVIHAAGVL

SEQ ID NO: 947807 - protein, 18 aa, Mycobacterium
MFAKFTQQWQRCVGARIQ

SEQ ID NO: 947808 - protein, 23 aa, Mycobacterium
MGADLCQQLSWGASPQQLENLAI

SEQ ID NO: 947809 - protein, 18 aa, Mycobacterium
MGGRLFPDKYWPVTNNER

SEQ ID NO: 947810 - protein, 21 aa, Mycobacterium
MGHARPLYGPGLRCLIPLVDK

SEQ ID NO: 947811 - protein, 24 aa, Mycobacterium
MGLALDIPVYPVCTLDAIGHGTAG

SEQ ID NO: 947812 - protein, 17 aa, Mycobacterium
MGLDVMWTAEFAEAGWA

SEQ ID NO: 947813 - protein, 20 aa, Mycobacterium
MGLLAAGTILVGCSDDKPQA

SEQ ID NO: 947814 - protein, 26 aa, Mycobacterium
MGLPVPVTSRHTLLLGPPGTGKTSVA

SEQ ID NO: 947815 - protein, 17 aa, Mycobacterium
MGREELRLILWEFVGNR

SEQ ID NO: 947816 - protein, 28 aa, Mycobacterium
MGSLELKVSQFWDPAWMAANREAVNNGT

SEQ ID NO: 947817 - protein, 26 aa, Mycobacterium
MGTGETLWPDRLWLAIARTTAAEVDL

SEQ ID NO: 947818 - protein, 19 aa, Mycobacterium
MGVIPLTRTGSPYSLTDAV

SEQ ID NO: 947819 - protein, 23 aa, Mycobacterium
MGVMAVAQLLTGVLAGCAPGPSA

SEQ ID NO: 947820 - protein, 19 aa, Mycobacterium
MGYLFALHVAPRVDKVLIP

SEQ ID NO: 947821 - protein, 26 aa, Mycobacterium
MHGTPIPTLVEFLHALEVHDETAALD

SEQ ID NO: 947822 - protein, 18 aa, Mycobacterium
MHLDNFHTEVWTFTGGPA

SEQ ID NO: 947823 - protein, 30 aa, Mycobacterium
MIAADLRYWEKTLAGMPPPLELSPAQPGAT

SEQ ID NO: 947824 - protein, 19 aa, Mycobacterium
MIAAGWAMPRVLRWMRDVL

SEQ ID NO: 947825 - protein, 17 aa, Mycobacterium
MIAALLVLAGGFAYLGA

SEQ ID NO: 947826 - protein, 28 aa, Mycobacterium
MIAGNVDLAFFGPFAYVVAGVNGAKMTP

SEQ ID NO: 947827 - protein, 50 aa, Mycobacterium
MIDIAAKALQMLFNPGPTVPGDPPLLLGVLAFVRREIQRTFFNSSPTAVA

SEQ ID NO: 947828 - protein, 27 aa, Mycobacterium
MIEDGWVRAQLLHYMRSAPDFYFDEMA

SEQ ID NO: 947829 - protein, 18 aa, Mycobacterium
MIHGAFSDNLPTCIVKYI

SEQ ID NO: 947830 - protein, 24 aa, Mycobacterium
MIKRGWMLLVAVVVVAAAGFGVYR

SEQ ID NO: 947831 - protein, 22 aa, Mycobacterium
MIPAFLFFPPEINSALIVGGPG

SEQ ID NO: 947832 - protein, 18 aa, Mycobacterium
MISAILRRTRRRSLVVLL

SEQ ID NO: 947833 - protein, 26 aa, Mycobacterium
MITKGVKLLVIAPIDGSSLTNTLQHA

SEQ ID NO: 947834 - protein, 17 aa, Mycobacterium
MIVASFLVKDLHLPWQW

SEQ ID NO: 947835 - protein, 19 aa, Mycobacterium
MKLWADGSPWQGNIFTSFP

SEQ ID NO: 947836 - protein, 27 aa, Mycobacterium
MKTLNGEVFDQLWLQSMIAHHQGAIAM

SEQ ID NO: 947837 - protein, 27 aa, Mycobacterium
MLAHVPAIVHRRFAVLPLSSVVVGVRV

SEQ ID NO: 947838 - protein, 18 aa, Mycobacterium
MLATFGLDRLEAGLAREQ

SEQ ID NO: 947839 - protein, 18 aa, Mycobacterium
MLAVLLAGCAGVPSSSAP

SEQ ID NO: 947840 - protein, 27 aa, Mycobacterium
MLDDLLAFLHQWWTTTPVSWESEFFSL

SEQ ID NO: 947841 - protein, 18 aa, Mycobacterium
MLDLLPGSSYQVLPGLRE

SEQ ID NO: 947842 - protein, 18 aa, Mycobacterium
MLGAVALALAGCHAGAQT

SEQ ID NO: 947843 - protein, 20 aa, Mycobacterium
MLIAVPGIDLARFGDALTAD

SEQ ID NO: 947844 - protein, 20 aa, Mycobacterium
MLLAAYSLVATLWQTPTRQS

SEQ ID NO: 947845 - protein, 21 aa, Mycobacterium
MLRRKAQALPPTLYPDLIRAM

SEQ ID NO: 947846 - protein, 23 aa, Mycobacterium
MLRTYQLHLPPGMDKPSGLVVNL

SEQ ID NO: 947847 - protein, 22 aa, Mycobacterium
MLVGMIHGAFSDSLPTCITKYI

SEQ ID NO: 947848 - protein, 18 aa, Mycobacterium
MLVLVVVGLVVLGPERLP

SEQ ID NO: 947849 - protein, 17 aa, Mycobacterium
MLWLPGCAADKPESEAH

SEQ ID NO: 947850 - protein, 17 aa, Mycobacterium
MMAFSGLGMLAAAASMP

SEQ ID NO: 947851 - protein, 26 aa, Mycobacterium
MMAGAQLLLPDRFLQAGPLVEMIEAA

SEQ ID NO: 947852 - protein, 26 aa, Mycobacterium
MMAGAQLLLPDRFLQAGPLVEMIEAV

SEQ ID NO: 947853 - protein, 18 aa, Mycobacterium
MMHKARVLRYVAASNFQA

SEQ ID NO: 947854 - protein, 30 aa, Mycobacterium
MNANSRNKLPAWLFIQWATGKESMNKAVEG

SEQ ID NO: 947855 - protein, 25 aa, Mycobacterium
MNCSDHPEWALPTTWTVAAGRPVLE

SEQ ID NO: 947856 - protein, 20 aa, Mycobacterium
MNLVTGWPKPANARAAELIS

SEQ ID NO: 947857 - protein, 29 aa, Mycobacterium
MNRGFHAFFRQYYNLRALLARVDPQLRML

SEQ ID NO: 947858 - protein, 27 aa, Mycobacterium
MNRGFHAFFRQYYNLRGILSRIDPSLS

SEQ ID NO: 947859 - protein, 26 aa, Mycobacterium
MNYGGLKVYSGEWWHFDGPGAGVDLP

SEQ ID NO: 947860 - protein, 25 aa, Mycobacterium
MNYGGLNVYSGEWWHFDGPGADVDR

SEQ ID NO: 947861 - protein, 25 aa, Mycobacterium
MPDIISKLPVLHLPIGRKPVQTAST

SEQ ID NO: 947862 - protein, 26 aa, Mycobacterium
MPEGPVPPVIRYGAMAYAPSGAWGRT

SEQ ID NO: 947863 - protein, 17 aa, Mycobacterium
MPGDLIFYGPEGTQSVA

SEQ ID NO: 947864 - protein, 20 aa, Mycobacterium
MPLLLAAVMVSAGCATNGLA

SEQ ID NO: 947865 - protein, 17 aa, Mycobacterium
MPPFIKSTTSNAIAVRA

SEQ ID NO: 947866 - protein, 24 aa, Mycobacterium
MPSRLRALFVGRSVTPQVVLVDHN

SEQ ID NO: 947867 - protein, 17 aa, Mycobacterium
MPTPPGWHPYNNPNLAP

SEQ ID NO: 947868 - protein, 24 aa, Mycobacterium
MQAGGLQVYSGEWWHFDGPGAGEG

SEQ ID NO: 947869 - protein, 25 aa, Mycobacterium
MQFDCHWYGRVFIPDKPSWNLEPWR

SEQ ID NO: 947870 - protein, 41 aa, Mycobacterium
MQLVIFLTLTLVALVVLALFYLRLPTWAGLGMYKLNADLPN

SEQ ID NO: 947871 - protein, 17 aa, Mycobacterium
MQPLIEQVGQRPYPIAR

SEQ ID NO: 947872 - protein, 19 aa, Mycobacterium
MQWEKLICNAAYSAPCALT

SEQ ID NO: 947873 - protein, 24 aa, Mycobacterium
MRALAERLLPARFNAALAQSEPIG

SEQ ID NO: 947874 - protein, 27 aa, Mycobacterium
MRASGSWWVYTPTNVLGWDPANPEMTR

SEQ ID NO: 947875 - protein, 24 aa, Mycobacterium
MRELYGQAIAYWRTYADSIETYRP

SEQ ID NO: 947876 - protein, 25 aa, Mycobacterium
MRFSPNVLVPLEPFPGILAVGRSDT

SEQ ID NO: 947877 - protein, 17 aa, Mycobacterium
MRLLHPVLAPVVAACLA

SEQ ID NO: 947878 - protein, 25 aa, Mycobacterium
MRRRATMYLTYWTAGDTRNRGREML

SEQ ID NO: 947879 - protein, 26 aa, Mycobacterium
MRRRATMYLTYWTAGDTRNRGREMLA

SEQ ID NO: 947880 - protein, 19 aa, Mycobacterium
MRSLRPYQVLRRLFDSHSQ

SEQ ID NO: 947881 - protein, 22 aa, Mycobacterium
MRVAVYAWVSIAAVLAAAVGPG

SEQ ID NO: 947882 - protein, 20 aa, Mycobacterium
MRYRLLETVRQYALEKLDES

SEQ ID NO: 947883 - protein, 23 aa, Mycobacterium
MSAEGRWSIPWAWNAAGTYRVFA

SEQ ID NO: 947884 - protein, 20 aa, Mycobacterium
MSATPIPRTLEMSLAGIREM

SEQ ID NO: 947885 - protein, 18 aa, Mycobacterium
MSELGFDIDFNDLVYHGQ

SEQ ID NO: 947886 - protein, 21 aa, Mycobacterium
MSELGFEIDFNDLVYHGQRSH

SEQ ID NO: 947887 - protein, 19 aa, Mycobacterium
MSIPLVAAPMSGGPTTPAM

SEQ ID NO: 947888 - protein, 19 aa, Mycobacterium
MSKTMIIAAAMETVNPIPA

SEQ ID NO: 947889 - protein, 29 aa, Mycobacterium
MSMAAAAQPYLAWLTYTAESAAHAGSQAT

SEQ ID NO: 947890 - protein, 29 aa, Mycobacterium
MSMTSMMSRVKWMLRARPADYLLAMSVAG

SEQ ID NO: 947891 - protein, 25 aa, Mycobacterium
MSQSLPALFRNAGGYRRQLTLTPTG

SEQ ID NO: 947892 - protein, 26 aa, Mycobacterium
MSRIDLRNRVLSAAQLRSALPRGGVD

SEQ ID NO: 947893 - protein, 20 aa, Mycobacterium
MSSMLSWQPSVYVAHAVVDD

SEQ ID NO: 947894 - protein, 17 aa, Mycobacterium
MSYTLACTTEIFAAIGP

SEQ ID NO: 947895 - protein, 24 aa, Mycobacterium
MTAGGFTVYDGEWWHFDGPGAGVD

SEQ ID NO: 947896 - protein, 27 aa, Mycobacterium
MTDAMLTQLTLVRSLFAQTIAASGAAY

SEQ ID NO: 947897 - protein, 30 aa, Mycobacterium
MTFHHIVVDGWSLPILLKEIFGAYFEHRLP

SEQ ID NO: 947898 - protein, 19 aa, Mycobacterium
MTGPPPSPIERYPLYCNGI

SEQ ID NO: 947899 - protein, 26 aa, Mycobacterium
MTHTVRNLLAPPLRLRGPVTRADGGK

SEQ ID NO: 947900 - protein, 18 aa, Mycobacterium
MTIRRRVFGIPNVKVLDA

SEQ ID NO: 947901 - protein, 18 aa, Mycobacterium
MTLIGRLIMRPAQTFAVP

SEQ ID NO: 947902 - protein, 33 aa, Mycobacterium
MTPTPDIPPGPPLPSPHHRLHWGKPGVLPATMG

SEQ ID NO: 947903 - protein, 29 aa, Mycobacterium
MTRALSLLATYPFPKETIGKWARGDYANL

SEQ ID NO: 947904 - protein, 31 aa, Mycobacterium
MTRVELRRTGYLQRMSTILSRRVWENAGSPE

SEQ ID NO: 947905 - protein, 24 aa, Mycobacterium
MTRYSWQAYLIATGQFAQWIDRGR

SEQ ID NO: 947906 - protein, 19 aa, Mycobacterium
MTTSDGYYSTYQAKALIGA

SEQ ID NO: 947907 - protein, 20 aa, Mycobacterium
MTVNLRGYAAALKYAIPVML

SEQ ID NO: 947908 - protein, 17 aa, Mycobacterium
MTYCQTLGKPDTKISEA

SEQ ID NO: 947909 - protein, 20 aa, Mycobacterium
MVAARDLQFELAARFRDEIA

SEQ ID NO: 947910 - protein, 31 aa, Mycobacterium; identical to SEQ ID NO: 147408

SEQ ID NO: 947911 - protein, 28 aa, Mycobacterium
MVCAPARRRPYLAVPTFWSAQFGVNIKS

SEQ ID NO: 947912 - protein, 18 aa, Mycobacterium
MVCFGSVFAPASSAAGSC

SEQ ID NO: 947913 - protein, 20 aa, Mycobacterium
MVDALRLLRPGVRQTDLTAL

SEQ ID NO: 947914 - protein, 27 aa, Mycobacterium
MVDAVWLQRGLSVRAPFLDILATQYDA

SEQ ID NO: 947915 - protein, 29 aa, Mycobacterium
MVDAVWLQRGLTVRAPFLDILATQYDAGA

SEQ ID NO: 947916 - protein, 25 aa, Mycobacterium
MVDPRTGRMLIIDKTSSGNPAIYSA

SEQ ID NO: 947917 - protein, 19 aa, Mycobacterium
MVGPPPSPIERYPLYCNDI

SEQ ID NO: 947918 - protein, 17 aa, Mycobacterium
MVKLRPEDIADAVLFMV

SEQ ID NO: 947919 - protein, 17 aa, Mycobacterium
MVLPPAPSDDRPSGPAR

SEQ ID NO: 947920 - protein, 22 aa, Mycobacterium
MVNLVIALLSTRGYITAEKVRS

SEQ ID NO: 947921 - protein, 26 aa, Mycobacterium
MVRAFRLGGRAPLPAYFEIAERPQAQ

SEQ ID NO: 947922 - protein, 20 aa, Mycobacterium
MVRAFRLGGRAPLPTYFEIA

SEQ ID NO: 947923 - protein, 30 aa, Mycobacterium
MVTARYGDYLRASLPPFWQTTSATQVRAAL

SEQ ID NO: 947924 - protein, 20 aa, Mycobacterium
MVTELIALSRLQGAEKLPDL

SEQ ID NO: 947925 - protein, 23 aa, Mycobacterium
MVVALLVILAVSIGLFAGKFTET

SEQ ID NO: 947926 - protein, 21 aa, Mycobacterium
MVVFSGPIPDDKWPQAVQIVK

SEQ ID NO: 947927 - protein, 17 aa, Mycobacterium
MVVIKPSTGEILAIAQN

SEQ ID NO: 947928 - protein, 18 aa, Mycobacterium
MVVQAGLTALLALLTGRS

SEQ ID NO: 947929 - protein, 18 aa, Mycobacterium
MVVTPMLEKAIAEGRFTA

SEQ ID NO: 947930 - protein, 20 aa, Mycobacterium
MWGPPWDGAWKRNDPIRQVD

SEQ ID NO: 947931 - protein, 30 aa, Mycobacterium
MYPAQRADAAPWWRWPRAPARWRPRRRRRR

SEQ ID NO: 947932 - protein, 18 aa, Mycobacterium
MYRTGDLVRWRADGQLDY

SEQ ID NO: 947933 - protein, 25 aa, Mycobacterium
MYSPSRVTFFCIGGATLAQVASLPH

SEQ ID NO: 947934 - protein, 27 aa, Mycobacterium
NAAAAIPTTAIATAAADDVSAAIAALF

SEQ ID NO: 947935 - protein, 23 aa, Mycobacterium
NAAELRPYVRRPVMPGDLAGRDL

SEQ ID NO: 947936 - protein, 19 aa, Mycobacterium
NAAIPWSLTIVTTLTSVVA

SEQ ID NO: 947937 - protein, 19 aa, Mycobacterium
NAAQPMYGMVENAPALAPH

SEQ ID NO: 947938 - protein, 25 aa, Mycobacterium
NAAVYAFGVGALRSALSRLKTDNAQ

SEQ ID NO: 947939 - protein, 22 aa, Mycobacterium
NADAYLWVKRPGESDGSCDRGD

SEQ ID NO: 947940 - protein, 27 aa, Mycobacterium
NADGAFPLGPGFVAPLWGFGQDGYDEG

SEQ ID NO: 947941 - protein, 31 aa, Mycobacterium
NADGKWMVNPVFINPLPVSPPYRCATQGFNE

SEQ ID NO: 947942 - protein, 19 aa, Mycobacterium
NADWNWIPSNIWVGVGRMD

SEQ ID NO: 947943 - protein, 19 aa, Mycobacterium
NADWNWIPSNIWVGVGRME

SEQ ID NO: 947944 - protein, 27 aa, Mycobacterium
NAELDERMMRWSWQSYLVATDQFVGWI

SEQ ID NO: 947945 - protein, 25 aa, Mycobacterium
NAEQYLWMVPQNIAGLVTALGGRAA

SEQ ID NO: 947946 - protein, 25 aa, Mycobacterium
NAERFGMQDAIWRGVYYTPSGATRS

SEQ ID NO: 947947 - protein, 29 aa, Mycobacterium
NAERMGVIHVIWRQGFYPGIGAPSWTADY

SEQ ID NO: 947948 - protein, 25 aa, Mycobacterium
NAFAEDMVFLRNCGIHPVVVHGGGP

SEQ ID NO: 947949 - protein, 29 aa, Mycobacterium
NAFFTSRCNMIAWDRGVFMPVAEKYFGEI

SEQ ID NO: 947950 - protein, 36 aa, Mycobacterium
NAFYQYLSADNGWWAQWFTLPADAGPIVLAFNAGDR

SEQ ID NO: 947951 - protein, 29 aa, Mycobacterium
NAFYTSRCNLIAWDRGVFMPVAQKYFGDM

SEQ ID NO: 947952 - protein, 18 aa, Mycobacterium
NAGLIAPMAGRFTRFADL

SEQ ID NO: 947953 - protein, 17 aa, Mycobacterium
NAGLRKSILLGTHWGRL

SEQ ID NO: 947954 - protein, 45 aa, Mycobacterium
NAGPALTRALSFLPTYPFPKETLTNWMRGDYANLTLIIDMTLSRI

SEQ ID NO: 947955 - protein, 33 aa, Mycobacterium
NAGPALTRSLSLLTTYPFPKDTISNWARGDYAN

SEQ ID NO: 947956 - protein, 38 aa, Mycobacterium
NAGPNRPFMWAGNEPDFGVPWLYNYIGQPWKTQETVNR

SEQ ID NO: 947957 - protein, 17 aa, Mycobacterium
NAGPRAEFPWPYNGIPG

SEQ ID NO: 947958 - protein, 32 aa, Mycobacterium
NAGPSLTRSLSLLATFPFPNETFQNFQRGDYA

SEQ ID NO: 947959 - protein, 35 aa, Mycobacterium
NAGQQLLDIVNAPTQALIGRPLIGNGTNGAPGTGQ

SEQ ID NO: 947960 - protein, 25 aa, Mycobacterium
NAGRFKLQDVIWRGTYYTPSGPQAS

SEQ ID NO: 947961 - protein, 20 aa, Mycobacterium
NAHSPILDAHGGDGGAGGDA

SEQ ID NO: 947962 - protein, 17 aa, Mycobacterium
NAHVPQLVQWDDHEVIN

SEQ ID NO: 947963 - protein, 23 aa, Mycobacterium
NAITALVPGLTWSMDMDSWNHCG

SEQ ID NO: 947964 - protein, 18 aa, Mycobacterium
NAKLRKSLLLGTHWGRLG

SEQ ID NO: 947965 - protein, 22 aa, Mycobacterium
NALAPSKPILTPGLAYYAREFA

SEQ ID NO: 947966 - protein, 18 aa, Mycobacterium
NALFGSLLCQNGNGAPIV

SEQ ID NO: 947967 - protein, 21 aa, Mycobacterium
NALNRQFASLIKITPSDTISV

SEQ ID NO: 947968 - protein, 26 aa, Mycobacterium
NANFDSPLSLLTPQLARLAAIGGFRR

SEQ ID NO: 947969 - protein, 25 aa, Mycobacterium
NANFTFPMEFAPFQGGWQLSRHTAE

SEQ ID NO: 947970 - protein, 17 aa, Mycobacterium
NAPAMFAPAIPAARAIG

SEQ ID NO: 947971 - protein, 29 aa, Mycobacterium
NAPDRSKGVVILLFTEGRALATLQFDGPT

SEQ ID NO: 947972 - protein, 18 aa, Mycobacterium
NAPGVYLLDGLRAQDDFN

SEQ ID NO: 947973 - protein, 26 aa, Mycobacterium
NAPLGVCAFWPVPPTSKPHPIHAAGL

SEQ ID NO: 947974 - protein, 23 aa, Mycobacterium
NAPLTVVFVHGFCLQMASFHFQR

SEQ ID NO: 947975 - protein, 26 aa, Mycobacterium
NAPPPCLTGFLPASQWRSPADTRTEP

SEQ ID NO: 947976 - protein, 34 aa, Mycobacterium
NAQPRDGQVDLALGTAGVLEDVPIGAASQVAAGV

SEQ ID NO: 947977 - protein, 35 aa, Mycobacterium
NAQRILLRDMPAVPLWYYIAVVGWSPQVSGVKLTW

SEQ ID NO: 947978 - protein, 23 aa, Mycobacterium
NARARLAALSILIGSIAATGPGV

SEQ ID NO: 947979 - protein, 23 aa, Mycobacterium
NARRYRLRLDPPPPEGPPFTQIG

SEQ ID NO: 947980 - protein, 17 aa, Mycobacterium
NASKYEYYKKASSGWFG

SEQ ID NO: 947981 - protein, 22 aa, Mycobacterium
NASNPDLFWALRGGGGGNFGVT

SEQ ID NO: 947982 - protein, 27 aa, Mycobacterium
NASRWIQSKLVTSAITRFFKGTINEID

SEQ ID NO: 947983 - protein, 25 aa, Mycobacterium
NATVRFTPREYWPAHSSITVSVNGV

SEQ ID NO: 947984 - protein, 22 aa, Mycobacterium
NATYLLAPADWLKGDVQNSIPG

SEQ ID NO: 947985 - protein, 23 aa, Mycobacterium
NAVAPGFVHTPLTAAAASVPGVV

SEQ ID NO: 947986 - protein, 25 aa, Mycobacterium
NAVKGGVPFLPLNRLPELAGSVDSV

SEQ ID NO: 947987 - protein, 22 aa, Mycobacterium
NAVPWTDRLLARTFSDDFALPE

SEQ ID NO: 947988 - protein, 18 aa, Mycobacterium
NAVRSHGINFASPQAAIM

SEQ ID NO: 947989 - protein, 23 aa, Mycobacterium
NAWSAVHRVDAARVFRLALEDAP

SEQ ID NO: 947990 - protein, 23 aa, Mycobacterium
NCKLVSWPIATLSPNGIRTADGI

SEQ ID NO: 947991 - protein, 33 aa, Mycobacterium
NDAGVAALFRFVDNKLAVLALLDTERRVDNKPL

SEQ ID NO: 947992 - protein, 24 aa, Mycobacterium
NDAPEWVCYFPHPQRVVCGGISIA

SEQ ID NO: 947993 - protein, 36 aa, Mycobacterium
NDAQRILFHDMPVVPLWNYISVLGWSAEVSNVTVTW

SEQ ID NO: 947994 - protein, 25 aa, Mycobacterium
NDAVPTLPAGVRYISVASGAGHAVL

SEQ ID NO: 947995 - protein, 30 aa, Mycobacterium
NDDLGALAAWYVWAALGVYPATPGTPILTV

SEQ ID NO: 947996 - protein, 24 aa, Mycobacterium
NDGLFDHVVPPTPPPGTPGEWVKG

SEQ ID NO: 947997 - protein, 22 aa, Mycobacterium
NDIAMYLNFTTLGSPNAGFFTE

SEQ ID NO: 947998 - protein, 22 aa, Mycobacterium
NDILDYAVIKFDPAKVTPVNEV

SEQ ID NO: 947999 - protein, 31 aa, Mycobacterium
NDLAFDTISFYRPNLPGSYPIVLATYEIVCS

SEQ ID NO: 948000 - protein, 18 aa, Mycobacterium
NDLQGIYLNYLGSAGAVF

SEQ ID NO: 948001 - protein, 19 aa, Mycobacterium
NDPDVHYPYLYGSPGGRTR

SEQ ID NO: 948002 - protein, 22 aa, Mycobacterium
NDPQAIYLNYIGSAGGVFMRDN

SEQ ID NO: 948003 - protein, 21 aa, Mycobacterium
NDPRNEWLFDDAWGVDVAVST

SEQ ID NO: 948004 - protein, 21 aa, Mycobacterium
NDPRNEWLFTDAWGVDVAVST

SEQ ID NO: 948005 - protein, 23 aa, Mycobacterium
NDPRNEWLFTDAWGVDVAVSTPR

SEQ ID NO: 948006 - protein, 24 aa, Mycobacterium
NDPRRSLFTALGFQTQDVVGDVSE

SEQ ID NO: 948007 - protein, 24 aa, Mycobacterium
NDSILIWHDSAGRDPLWAAPDAFA

SEQ ID NO: 948008 - protein, 24 aa, Mycobacterium
NDTLDYAVIKFDPAKVTPVADFNG

SEQ ID NO: 948009 - protein, 18 aa, Mycobacterium
NDVALQQAFLTFGKTSRL

SEQ ID NO: 948010 - protein, 22 aa, Mycobacterium
NDVALVIWTNLTLSPDNKTTAN

SEQ ID NO: 948011 - protein, 19 aa, Mycobacterium
NEDQLWLLSREVGSAHVDR

SEQ ID NO: 948012 - protein, 23 aa, Mycobacterium
NEDTKTIDYWRSSGLPVPGAVIA

SEQ ID NO: 948013 - protein, 28 aa, Mycobacterium
NEEDAANRLVWLPPAPMNNTYAFAIRES

SEQ ID NO: 948014 - protein, 18 aa, Mycobacterium
NEEPPFLNKLVINHALPM

SEQ ID NO: 948015 - protein, 18 aa, Mycobacterium
NEFDPPAAVLNWKGNQEI

SEQ ID NO: 948016 - protein, 28 aa, Mycobacterium
NEITFSEDWLRPDYIPPAQPVTQDLDPE

SEQ ID NO: 948017 - protein, 24 aa, Mycobacterium
NEKPWWRDRIHAGLGSYWVYQHIG

SEQ ID NO: 948018 - protein, 30 aa, Mycobacterium
NELDKLIWEEVFSLPLFQSPGNVAVRSNLA

SEQ ID NO: 948019 - protein, 25 aa, Mycobacterium
NEPARAWFEAMKPIADNYGPTVLPP

SEQ ID NO: 948020 - protein, 24 aa, Mycobacterium
NEPARTWFTALKPIATDFGEVQLP

SEQ ID NO: 948021 - protein, 19 aa, Mycobacterium
NEQMVVFNLGLRGKPGGLL

SEQ ID NO: 948022 - protein, 24 aa, Mycobacterium
NEQPPLFNKLAINTFLPVFVDGER

SEQ ID NO: 948023 - protein, 19 aa, Mycobacterium
NERYWGAAPDFTRAEYQWR

SEQ ID NO: 948024 - protein, 23 aa, Mycobacterium
NESRIPTWDDFVKPRDLYAKFPK

SEQ ID NO: 948025 - protein, 20 aa, Mycobacterium
NEVWTFKALTVGTTTIAIDE

SEQ ID NO: 948026 - protein, 18 aa, Mycobacterium
NFADLPEPFDPKVVRYEI

SEQ ID NO: 948027 - protein, 23 aa, Mycobacterium
NFDIAQFAWGGDAFPLGGLTQIY

SEQ ID NO: 948028 - protein, 24 aa, Mycobacterium
NFNLALPELIAGFNNGLTGLIQTG

SEQ ID NO: 948029 - protein, 22 aa, Mycobacterium
NFPEPKVTAALRDPAYRLETTT

SEQ ID NO: 948030 - protein, 28 aa, Mycobacterium
NFPPEAFAQVLVGWQNWLRTADRNSWAL

SEQ ID NO: 948031 - protein, 32 aa, Mycobacterium
NFQLAHRFAQPLQRWFPTRLLSAEDYLQQWVD

SEQ ID NO: 948032 - protein, 29 aa, Mycobacterium
NFSGRARMSSMLWTFKVEKSDGVSCPGGG

SEQ ID NO: 948033 - protein, 22 aa, Mycobacterium
NFSRWSGLRNVLRRGFGGNGHK

SEQ ID NO: 948034 - protein, 20 aa, Mycobacterium
NFTHTQLYPADARCLVHQSM

SEQ ID NO: 948035 - protein, 17 aa, Mycobacterium
NFVTPLPEEVTSKYFAD

SEQ ID NO: 948036 - protein, 20 aa, Mycobacterium
NFVVVDGTLYATLTPNKWSD

SEQ ID NO: 948037 - protein, 24 aa, Mycobacterium
NFYGYFPGLNDMVPIIVAAATPGG

SEQ ID NO: 948038 - protein, 20 aa, Mycobacterium
NGAIRVHGLLDKALTDSQSA

SEQ ID NO: 948039 - protein, 24 aa, Mycobacterium
NGAMLALRLGCQTDIFAAIAPVAG

SEQ ID NO: 948040 - protein, 24 aa, Mycobacterium
NGAPGAILADPALRLAICKGIDRR

SEQ ID NO: 948041 - protein, 22 aa, Mycobacterium
NGAQVALAYAGAHPTKVARLVL

SEQ ID NO: 948042 - protein, 23 aa, Mycobacterium
NGDLPLSFTVANIAPAAAGAATA

SEQ ID NO: 948043 - protein, 25 aa, Mycobacterium
NGDPESLLLPREDFPAGAGTYEVLK

SEQ ID NO: 948044 - protein, 19 aa, Mycobacterium
NGEAGLLDWQAVRRGHPGR

SEQ ID NO: 948045 - protein, 23 aa, Mycobacterium
NGESSYFVWLNRSKESIALDVKS

SEQ ID NO: 948046 - protein, 17 aa, Mycobacterium
NGFFPGLNDLVPEIVRR

SEQ ID NO: 948047 - protein, 17 aa, Mycobacterium
NGFFSGLRGLPPEERRA

SEQ ID NO: 948048 - protein, 21 aa, Mycobacterium
NGFGIYQPQDQLAWMGKITCD

SEQ ID NO: 948049 - protein, 21 aa, Mycobacterium
NGFYGGVQFDYGTWLAHGGGK

SEQ ID NO: 948050 - protein, 22 aa, Mycobacterium
NGGAGGILYGNGGAGGSGAPGH

SEQ ID NO: 948051 - protein, 23 aa, Mycobacterium
NGGAGGWLFGNGGAGGAGGATPG

SEQ ID NO: 948052 - protein, 28 aa, Mycobacterium
NGGFFTRFPGITIPWLDITFTEATPPDS

SEQ ID NO: 948053 - protein, 18 aa, Mycobacterium
NGGLPWSRATVVRAITTA

SEQ ID NO: 948054 - protein, 25 aa, Mycobacterium
NGGPEWTCFFPHPQRVVCGGISIPD

SEQ ID NO: 948055 - protein, 24 aa, Mycobacterium
NGGRAGLFFGVGGTGGNGGATSTN

SEQ ID NO: 948056 - protein, 20 aa, Mycobacterium
NGHHPGDIVSISWTSNSGGQ

SEQ ID NO: 948057 - protein, 27 aa, Mycobacterium
NGIAPAPPPPPAGAPPPGGPPPPAGET

SEQ ID NO: 948058 - protein, 26 aa, Mycobacterium
NGIDAPRLWPDLPVRPVKGEVLRLRW

SEQ ID NO: 948059 - protein, 26 aa, Mycobacterium
NGIVNIGGPEKLSFADMARAVLAKHG

SEQ ID NO: 948060 - protein, 17 aa, Mycobacterium
NGMLQNCDVVTITEGEV

SEQ ID NO: 948061 - protein, 29 aa, Mycobacterium
NGNTQYYMFMTKDLPLLDPLRAIPFVGEP

SEQ ID NO: 948062 - protein, 25 aa, Mycobacterium
NGPGSGVYALFSNGTNLASAFSSTI

SEQ ID NO: 948063 - protein, 18 aa, Mycobacterium
NGPSRALPLASSPQDILS

SEQ ID NO: 948064 - protein, 26 aa, Mycobacterium
NGQAYQFPMGLGLVAQFFGRYFTPDE

SEQ ID NO: 948065 - protein, 36 aa, Mycobacterium
NGQAYQFPMGLGLVSQFFGKYFSPAEARQLIAEQAA

SEQ ID NO: 948066 - protein, 25 aa, Mycobacterium
NGQAYQFPMGLGLVSQFFGKYFTPD

SEQ ID NO: 948067 - protein, 36 aa, Mycobacterium
NGQAYQFPMGLGLVSQFFGRYFSPAEARRLIAEQAS

SEQ ID NO: 948068 - protein, 26 aa, Mycobacterium
NGQTYKWETFLTSELPGYLASRGVRS

SEQ ID NO: 948069 - protein, 24 aa, Mycobacterium
NGRQYMPWISLDDHIRAVRFTMDN

SEQ ID NO: 948070 - protein, 27 aa, Mycobacterium
NGRSEFAYGSFMRSVTLPPGADEDAIK

SEQ ID NO: 948071 - protein, 24 aa, Mycobacterium
NGSDPRLFGRRLADFFTGRDPRGG

SEQ ID NO: 948072 - protein, 17 aa, Mycobacterium
NGTCYWKRLGNPEGALL

SEQ ID NO: 948073 - protein, 20 aa, Mycobacterium
NGTHDWPYWGAQLQAMKPDM

SEQ ID NO: 948074 - protein, 21 aa, Mycobacterium
NGTHDWPYWGAQLQAMKPELQ

SEQ ID NO: 948075 - protein, 21 aa, Mycobacterium
NGTHNWAYWGRELQAMVPDLQ

SEQ ID NO: 948076 - protein, 22 aa, Mycobacterium
NGTHSWPYWNQQLVAMKGDILK

SEQ ID NO: 948077 - protein, 21 aa, Mycobacterium
NGTHTWSYWGAQLQAMLPDLR

SEQ ID NO: 948078 - protein, 20 aa, Mycobacterium
NGTRIWVYCGTGRPGELGGG

SEQ ID NO: 948079 - protein, 20 aa, Mycobacterium
NGVFHTIQAVLPDMVAAGWG

SEQ ID NO: 948080 - protein, 20 aa, Mycobacterium
NGVHSWGYWGAQLAAMKPDM

SEQ ID NO: 948081 - protein, 19 aa, Mycobacterium
NGYHVGGIFIGSWTDLTIF

SEQ ID NO: 948082 - protein, 21 aa, Mycobacterium
NGYIPLPDAFGSKLSDAVGAI

SEQ ID NO: 948083 - protein, 21 aa, Mycobacterium
NHAALLLAQGAGRLLRRVTDR

SEQ ID NO: 948084 - protein, 20 aa, Mycobacterium
NHAQAYQAVSAQAAAFHDRF

SEQ ID NO: 948085 - protein, 22 aa, Mycobacterium
NHAWPYWGAQLSALKPDLIASL

SEQ ID NO: 948086 - protein, 24 aa, Mycobacterium
NHGNFGSGFLNAGSFSSGFRNTGP

SEQ ID NO: 948087 - protein, 27 aa, Mycobacterium
NHITGIVLPWTFDISTTLPSIVGNVVA

SEQ ID NO: 948088 - protein, 18 aa, Mycobacterium
NIAIPDWVRPYAASYPAP

SEQ ID NO: 948089 - protein, 34 aa, Mycobacterium
NIAKAWNTIWDLKPDIDLKRFPSSGPYRLDSVSE

SEQ ID NO: 948090 - protein, 22 aa, Mycobacterium
NICSLSGRRPSPGTGAYGAAKA

SEQ ID NO: 948091 - protein, 26 aa, Mycobacterium
NIEDLRAPLLAALGAADLALATVNDL

SEQ ID NO: 948092 - protein, 30 aa, Mycobacterium
NIMKPTDWNNQWWVSCMITFKTSYGVVQQS

SEQ ID NO: 948093 - protein, 18 aa, Mycobacterium
NINLPWSSEFTAFGGQVF

SEQ ID NO: 948094 - protein, 17 aa, Mycobacterium
NIPAIATTLSQYFRVPV

SEQ ID NO: 948095 - protein, 23 aa, Mycobacterium
NIQGRYDFHTWTWAVTYCTPAAT

SEQ ID NO: 948096 - protein, 22 aa, Mycobacterium
NIQTQEWISYLGVWARGMQDGV

SEQ ID NO: 948097 - protein, 28 aa, Mycobacterium
NISGQRFAGMLVAGVFLREFVADGVGWA

SEQ ID NO: 948098 - protein, 21 aa, Mycobacterium
NITFEDWQRVIDVNLNGVFHT

SEQ ID NO: 948099 - protein, 17 aa, Mycobacterium
NITPQTLIISKGGKFPT

SEQ ID NO: 948100 - protein, 25 aa, Mycobacterium
NIVGAPIRWESEFTAPFQAFSVDNP

SEQ ID NO: 948101 - protein, 24 aa, Mycobacterium
NIVGQRYLALAPGRTGRGIPIPPG

SEQ ID NO: 948102 - protein, 29 aa, Mycobacterium
NKAYLPLAGRSMLAWSLDTLTRLPDVART

SEQ ID NO: 948103 - protein, 22 aa, Mycobacterium
NKGIETWMWGTAENGVLKLADQ

SEQ ID NO: 948104 - protein, 24 aa, Mycobacterium
NKVNPGIFSLISRATCVTLDGNQH

SEQ ID NO: 948105 - protein, 20 aa, Mycobacterium
NLALHPATMLAGRFDDDVYA

SEQ ID NO: 948106 - protein, 17 aa, Mycobacterium
NLAPIAGALLQKDCRHA

SEQ ID NO: 948107 - protein, 20 aa, Mycobacterium
NLAQYPAVLVELGNMKNAGD

SEQ ID NO: 948108 - protein, 17 aa, Mycobacterium
NLDAFLISSIGLADMGN

SEQ ID NO: 948109 - protein, 23 aa, Mycobacterium
NLDQWDLAITTWTPDWQGNSARM

SEQ ID NO: 948110 - protein, 25 aa, Mycobacterium
NLDVTLSNWRGLYGPPGMPAGAVSY

SEQ ID NO: 948111 - protein, 17 aa, Mycobacterium
NLFGSKAIDLCNPSDPI

SEQ ID NO: 948112 - protein, 18 aa, Mycobacterium
NLGKLALRNIHLVGNSDP

SEQ ID NO: 948113 - protein, 23 aa, Mycobacterium
NLGLGNFGSLNWGSGNNGSTNFG

SEQ ID NO: 948114 - protein, 22 aa, Mycobacterium
NLGRPQPGLNLPVVLGGNMVQY

SEQ ID NO: 948115 - protein, 31 aa, Mycobacterium
NLGSDPFVAILGFPFIPQAMRDRYGELEIKA

SEQ ID NO: 948116 - protein, 25 aa, Mycobacterium
NLHPSNDPIPYQPHGKLWEATATVK

SEQ ID NO: 948117 - protein, 26 aa, Mycobacterium
NLKGVVGATLRCQLIDGSKTYGVNVT

SEQ ID NO: 948118 - protein, 23 aa, Mycobacterium
NLKVVACAGLCGAAIALSPDVAA

SEQ ID NO: 948119 - protein, 25 aa, Mycobacterium
NLLPGQFVQPFIGAAFSDLGLDPAT

SEQ ID NO: 948120 - protein, 19 aa, Mycobacterium
NLPAAERYHRTATYPVFLN

SEQ ID NO: 948121 - protein, 22 aa, Mycobacterium
NLPDLTVSIPTPAGWTVASNPH

SEQ ID NO: 948122 - protein, 17 aa, Mycobacterium
NLQDLYRGLGVDKAIAL

SEQ ID NO: 948123 - protein, 17 aa, Mycobacterium
NLRGVAGATLRCQLTDH

SEQ ID NO: 948124 - protein, 28 aa, Mycobacterium
NLRRQVSDTWLRRQLTPNFRAGCKRMLM

SEQ ID NO: 948125 - protein, 25 aa, Mycobacterium
NLSAAGYVPLPNAFKERLLTSIDAI

SEQ ID NO: 948126 - protein, 20 aa, Mycobacterium
NLSFRSLEILRGLGLRDEVH

SEQ ID NO: 948127 - protein, 27 aa, Mycobacterium
NLSTQLADFHQQFLQALTGSANSYTAA

SEQ ID NO: 948128 - protein, 23 aa, Mycobacterium
NLVAQACAFINYAMGRYGVAPDA

SEQ ID NO: 948129 - protein, 19 aa, Mycobacterium
NLVEITLPDDTPWGGKPVR

SEQ ID NO: 948130 - protein, 21 aa, Mycobacterium
NLVRRSIAVAAAGLTVAAASA

SEQ ID NO: 948131 - protein, 23 aa, Mycobacterium
NMGEAWWVPIVQIPGDTIEGKPR

SEQ ID NO: 948132 - protein, 17 aa, Mycobacterium
NMGSLIFTSPTTLLVQT

SEQ ID NO: 948133 - protein, 17 aa, Mycobacterium
NMLIVLPAEGQLQAVRN

SEQ ID NO: 948134 - protein, 17 aa, Mycobacterium
NNELRIVGAYYTLDTGV

SEQ ID NO: 948135 - protein, 21 aa, Mycobacterium
NNMVLAVQQIAIGEAFVLAEK

SEQ ID NO: 948136 - protein, 23 aa, Mycobacterium
NNMVLAVQQIAIGEAFVLAEKLG

SEQ ID NO: 948137 - protein, 24 aa, Mycobacterium
NNMVLAVQQIAIGEAFVLAEKLGL

SEQ ID NO: 948138 - protein, 21 aa, Mycobacterium
NNMVLAVQQIAIGEAFVLAEN

SEQ ID NO: 948139 - protein, 17 aa, Mycobacterium
NNPMIGRPVPTNDPRGL

SEQ ID NO: 948140 - protein, 18 aa, Mycobacterium
NNTLTVKGTCAKANIGGA

SEQ ID NO: 948141 - protein, 27 aa, Mycobacterium
NNTLWASWAFVGPTHRAYFGGDTGYTK

SEQ ID NO: 948142 - protein, 18 aa, Mycobacterium
NNTRVWVWSPTNPGASDP

SEQ ID NO: 948143 - protein, 24 aa, Mycobacterium
NNTYTVYFAMKFNQPFISYGAWDG

SEQ ID NO: 948144 - protein, 23 aa, Mycobacterium
NNTYTVYFAMKFSQPFTSYGAWD

SEQ ID NO: 948145 - protein, 23 aa, Mycobacterium
NNTYTVYFAMKFSRPFTSYGTWD

SEQ ID NO: 948146 - protein, 30 aa, Mycobacterium
NNYGQLDIPPLPTGITYTQVAAGAWHTVLL

SEQ ID NO: 948147 - protein, 21 aa, Mycobacterium
NPALDAGFAAALLVKTVSALR

SEQ ID NO: 948148 - protein, 18 aa, Mycobacterium
NPAPADRLPPGGTPPPVS

SEQ ID NO: 948149 - protein, 23 aa, Mycobacterium
NPDLMGWNFRRVALTPEDTAYTV

SEQ ID NO: 948150 - protein, 25 aa, Mycobacterium
NPEPFTGQPPFLPPSFNPVNGSMVG

SEQ ID NO: 948151 - protein, 18 aa, Mycobacterium
NPIVWVPCDFEHDTLREK

SEQ ID NO: 948152 - protein, 22 aa, Mycobacterium
NPKPRLFRLPADRGLLNRMGFN

SEQ ID NO: 948153 - protein, 20 aa, Mycobacterium
NPNHVFTFNDAVRSGARLAV

SEQ ID NO: 948154 - protein, 17 aa, Mycobacterium
NPNQWAIVTASGGLRVN

SEQ ID NO: 948155 - protein, 20 aa, Mycobacterium
NPNVPPPSPILTAGSDKPEC

SEQ ID NO: 948156 - protein, 18 aa, Mycobacterium
NPPLPRYAEAYRSIPQLS

SEQ ID NO: 948157 - protein, 21 aa, Mycobacterium
NPPVEGSWAWLPDEAKGARVH

SEQ ID NO: 948158 - protein, 20 aa, Mycobacterium
NPQITPAHLLMALLTQNDGI

SEQ ID NO: 948159 - protein, 23 aa, Mycobacterium
NPQLAAPFSLMRRALACQPNDAG

SEQ ID NO: 948160 - protein, 25 aa, Mycobacterium
NPSEGWWPMLIGLAMNDAGGFNAES

SEQ ID NO: 948161 - protein, 26 aa, Mycobacterium
NPVAAKRLSVLSLPTTFIFDTDGRQR

SEQ ID NO: 948162 - protein, 23 aa, Mycobacterium
NPVGPVRGFGWRVDMFGPEGPTR

SEQ ID NO: 948163 - protein, 18 aa, Mycobacterium
NPVTALGLKRPSGYLAGA

SEQ ID NO: 948164 - protein, 31 aa, Mycobacterium
NQEQQADCFAGSYLRWVTQGDSPRFTLNTAD

SEQ ID NO: 948165 - protein, 24 aa, Mycobacterium
NQGAVTFDFDFTTGSQYWTTPRRE

SEQ ID NO: 948166 - protein, 20 aa, Mycobacterium
NQIVPYLRAWESVIGHQRTG

SEQ ID NO: 948167 - protein, 23 aa, Mycobacterium
NQTFDLTHWDGDTFTFALSTENA

SEQ ID NO: 948168 - protein, 17 aa, Mycobacterium
NQTRLRENVLLQAKVCQ

SEQ ID NO: 948169 - protein, 26 aa, Mycobacterium
NQTRMYNLLCWAYGADPDANAAIVSD

SEQ ID NO: 948170 - protein, 22 aa, Mycobacterium
NQVTIDGFAFAPPNLTVPAGTT

SEQ ID NO: 948171 - protein, 22 aa, Mycobacterium
NRADLIWGKDKLLAPLQEGMQA

SEQ ID NO: 948172 - protein, 27 aa, Mycobacterium
NRAGSARAWWVLTAAGLPNVRILDGGL

SEQ ID NO: 948173 - protein, 27 aa, Mycobacterium
NRAKLGFPVPIRHWLRSGELMDWAYAL

SEQ ID NO: 948174 - protein, 18 aa, Mycobacterium
NRANIIEAFRSVGNLAKI

SEQ ID NO: 948175 - protein, 24 aa, Mycobacterium
NRAQYWQNLFNPATGYLSPRNADG

SEQ ID NO: 948176 - protein, 17 aa, Mycobacterium
NRAQYWQNLFNPSTRYI

SEQ ID NO: 948177 - protein, 28 aa, Mycobacterium
NRDKITLSVPFYRVNPDTFTAAELRYLE

SEQ ID NO: 948178 - protein, 24 aa, Mycobacterium
NRFGAAVSVLALGASILSGCSGDN

SEQ ID NO: 948179 - protein, 41 aa, Mycobacterium
NRGRWVRLALAALLLVTLGVGIYQVWPSRGGLKLTAYFTNA

SEQ ID NO: 948180 - protein, 20 aa, Mycobacterium
NRIVALIVAGGLAAGLTACS

SEQ ID NO: 948181 - protein, 27 aa, Mycobacterium
NRLAPVYAYRRLKLYLGYDLRQIRSSH

SEQ ID NO: 948182 - protein, 17 aa, Mycobacterium
NRLASYLHSQGLGVHTE

SEQ ID NO: 948183 - protein, 17 aa, Mycobacterium
NRLDDVIMFDALDPEQL

SEQ ID NO: 948184 - protein, 24 aa, Mycobacterium
NRLGEVLLMSRNLPTGGAIGPGDV

SEQ ID NO: 948185 - protein, 26 aa, Mycobacterium
NRLPKVSWVLPGFLLSEHPAFPVNVG

SEQ ID NO: 948186 - protein, 32 aa, Mycobacterium
NRLQVKTIWAERAISVLFPQIKTIYGYREDAL

SEQ ID NO: 948187 - protein, 26 aa, Mycobacterium
NRNQIELMCWAYANADGKWMVNPVFI

SEQ ID NO: 948188 - protein, 30 aa, Mycobacterium
NRNRIDLAAGIRHLLVLLAAGIDEVLLFDP

SEQ ID NO: 948189 - protein, 26 aa, Mycobacterium
NRWKRRLTVAALTTAALPWLVGVVGG

SEQ ID NO: 948190 - protein, 19 aa, Mycobacterium
NRYLVYTSADIRALYAFKR

SEQ ID NO: 948191 - protein, 25 aa, Mycobacterium
NRYQHPLMDFLTPGGRRLARLDMGE

SEQ ID NO: 948192 - protein, 22 aa, Mycobacterium
NRYVRDGFWLGDDQAHRATADL

SEQ ID NO: 948193 - protein, 30 aa, Mycobacterium
NSAAMKAFFVYDEPFWRADGLNGQLISDIG

SEQ ID NO: 948194 - protein, 18 aa, Mycobacterium
NSDAIVAFNPKYVRYEVF

SEQ ID NO: 948195 - protein, 25 aa, Mycobacterium
NSDGTVAMRNGPLQWQHTDYGSCSN

SEQ ID NO: 948196 - protein, 25 aa, Mycobacterium
NSEGLKNWLFGPLDGPPRNTAQIGQ

SEQ ID NO: 948197 - protein, 28 aa, Mycobacterium
NSFAWDRGQLFPFLRKQMGDMAMNTVMA

SEQ ID NO: 948198 - protein, 24 aa, Mycobacterium
NSFTRWLPVVLYRATPEAFTDRSR

SEQ ID NO: 948199 - protein, 25 aa, Mycobacterium
NSGKVGMLITGPWDLSQLSDIDYGV

SEQ ID NO: 948200 - protein, 20 aa, Mycobacterium
NSGLPRVPLPGGGTLTALPS

SEQ ID NO: 948201 - protein, 27 aa, Mycobacterium
NSGLWYVKRVLPQWRYCADGTPIEGLQ

SEQ ID NO: 948202 - protein, 25 aa, Mycobacterium
NSGMGTSMWDVPALLAHYGVDAKVT

SEQ ID NO: 948203 - protein, 17 aa, Mycobacterium
NSITIPAAILQAPFYDA

SEQ ID NO: 948204 - protein, 22 aa, Mycobacterium
NSMAGAFHYLDPRGGYVNDRGW

SEQ ID NO: 948205 - protein, 27 aa, Mycobacterium
NSQRLLVAHAVSLISIELEKPARVVDA

SEQ ID NO: 948206 - protein, 20 aa, Mycobacterium
NSRIIPRLRRIRNKIERMLD

SEQ ID NO: 948207 - protein, 17 aa, Mycobacterium
NSRVRVADVYVGRVRAI

SEQ ID NO: 948208 - protein, 21 aa, Mycobacterium
NSSMIINWTVAPAGPGSSVTM

SEQ ID NO: 948209 - protein, 28 aa, Mycobacterium
NSSPMAQSYIRSFLASPPPKRQEMAQQI

SEQ ID NO: 948210 - protein, 20 aa, Mycobacterium
NSSPPLRFYADDDKTMIGIE

SEQ ID NO: 948211 - protein, 24 aa, Mycobacterium
NSTAAWKIVANDLPISIVVPDKAT

SEQ ID NO: 948212 - protein, 24 aa, Mycobacterium
NSTVVVPFPVELLRFLDRVTPHES

SEQ ID NO: 948213 - protein, 33 aa, Mycobacterium
NSYERGAPVDFPLNGVVPGFQKAIAGQKVGSTV

SEQ ID NO: 948214 - protein, 17 aa, Mycobacterium
NTGFRTAGIANSATNGL

SEQ ID NO: 948215 - protein, 17 aa, Mycobacterium
NTGGPWGYSPKGATGVP

SEQ ID NO: 948216 - protein, 22 aa, Mycobacterium
NTITVFLDQPNSNFYRVVANGR

SEQ ID NO: 948217 - protein, 23 aa, Mycobacterium
NTKGTFLVYNFGGSNPAPFRNAA

SEQ ID NO: 948218 - protein, 24 aa, Mycobacterium
NTPPEILQYWFPADGKGLVDNDLM

SEQ ID NO: 948219 - protein, 22 aa, Mycobacterium
NTRGHVWALQLSPDGNVWGATV

SEQ ID NO: 948220 - protein, 23 aa, Mycobacterium
NTRGSYLVYNFGSGFAAPMLNAA

SEQ ID NO: 948221 - protein, 17 aa, Mycobacterium
NTRVWVWSPTNLGASDP

SEQ ID NO: 948222 - protein, 23 aa, Mycobacterium
NTSKVLALLATAMLLGACGGGSP

SEQ ID NO: 948223 - protein, 25 aa, Mycobacterium
NTTLWASWVFRGPTHRAYFGGDTGY

SEQ ID NO: 948224 - protein, 23 aa, Mycobacterium
NTVWKPTVPLGYGRTYTLTVTGR

SEQ ID NO: 948225 - protein, 20 aa, Mycobacterium
NTYGQLNIPQPPPGVTYTQA

SEQ ID NO: 948226 - protein, 17 aa, Mycobacterium
NVAFATIPVLDGAGWSD

SEQ ID NO: 948227 - protein, 17 aa, Mycobacterium
NVAGLLEAAGVPLEQND

SEQ ID NO: 948228 - protein, 18 aa, Mycobacterium
NVAGLLSAAGAPLLESDQ

SEQ ID NO: 948229 - protein, 22 aa, Mycobacterium
NVANCLVALAILDAVGVSPEQA

SEQ ID NO: 948230 - protein, 23 aa, Mycobacterium
NVDARLYGLPFGDSAYGAEDISL

SEQ ID NO: 948231 - protein, 24 aa, Mycobacterium
NVDRQIGLLLPCNVVVRADRADDT

SEQ ID NO: 948232 - protein, 20 aa, Mycobacterium
NVGIGFNRPLPPTVGDRIVA

SEQ ID NO: 948233 - protein, 24 aa, Mycobacterium
NVGRQAWFWGHELMAVGMVWDTPV

SEQ ID NO: 948234 - protein, 20 aa, Mycobacterium
NVHDMRTWTKVLGSGALLQP

SEQ ID NO: 948235 - protein, 37 aa, Mycobacterium
NVISDLFGEPLLALRIPWYVTVLDLGPAGAVYTEGWD

SEQ ID NO: 948236 - protein, 20 aa, Mycobacterium
NVLRTQGIKAWPKCGAKGMA

SEQ ID NO: 948237 - protein, 25 aa, Mycobacterium
NVLSIAEFWRRCAGPMRLTAERVAV

SEQ ID NO: 948238 - protein, 19 aa, Mycobacterium
NVMARIVLSSAWINAEIPT

SEQ ID NO: 948239 - protein, 17 aa, Mycobacterium
NVNLFLSGLEQALNGDP

SEQ ID NO: 948240 - protein, 19 aa, Mycobacterium
NVPPPCTTGFLPAQQQRAP

SEQ ID NO: 948241 - protein, 20 aa, Mycobacterium
NVQGVLYVTRAALPHLIAAA

SEQ ID NO: 948242 - protein, 25 aa, Mycobacterium
NVRGTRVFFLAEWATLNDPKLTGDD

SEQ ID NO: 948243 - protein, 30 aa, Mycobacterium
NVRLEQWLPAPTGLRFYVPVSHAAGDFVPI

SEQ ID NO: 948244 - protein, 17 aa, Mycobacterium
NVRVRQGNRWRTGTAQF

SEQ ID NO: 948245 - protein, 26 aa, Mycobacterium
NVTDAFTRMLLSLVLTGIAPRSFYQG

SEQ ID NO: 948246 - protein, 29 aa, Mycobacterium
NVTGAVALTLALLPALRAARGHVVFINSG

SEQ ID NO: 948247 - protein, 19 aa, Mycobacterium
NVTGLNSLSLDGPTAAKIF

SEQ ID NO: 948248 - protein, 20 aa, Mycobacterium
NVTLIFSVDRHRGVMDAYLT

SEQ ID NO: 948249 - protein, 20 aa, Mycobacterium
NVTLIFSVERYREVVDAYLA

SEQ ID NO: 948250 - protein, 31 aa, Mycobacterium
NVTLSSVFRATRAALRYFRQAGHGGVIVNNA

SEQ ID NO: 948251 - protein, 25 aa, Mycobacterium
NVTVPVLHFEGWYDAFLRGGLENFA

SEQ ID NO: 948252 - protein, 17 aa, Mycobacterium
NVYPVNYSAGLLSTGEG

SEQ ID NO: 948253 - protein, 24 aa, Mycobacterium
NWDMNVCHTWYWVDYGFQANRGGF

SEQ ID NO: 948254 - protein, 27 aa, Mycobacterium
NWDPSVAILGFPFITQARRHHFDEVEI

SEQ ID NO: 948255 - protein, 19 aa, Mycobacterium
NWRSTLVAVFAPRSLYAPG

SEQ ID NO: 948256 - protein, 28 aa, Mycobacterium
NWSRALAYGLIPGLALSLASAAGFLKWQ

SEQ ID NO: 948257 - protein, 18 aa, Mycobacterium
NYFPVTRAVPEPPSIRYP

SEQ ID NO: 948258 - protein, 26 aa, Mycobacterium
NYFTANSAEYYDLRGILAPIGNAQRD

SEQ ID NO: 948259 - protein, 17 aa, Mycobacterium
NYKVPRDITILPELPRG

SEQ ID NO: 948260 - protein, 25 aa, Mycobacterium
NYMDLVNYLAVGNLNPSPLGYVGGS

SEQ ID NO: 948261 - protein, 22 aa, Mycobacterium
NYNIAFLQGVVGDQFYITMQCG

SEQ ID NO: 948262 - protein, 26 aa, Mycobacterium
NYRHLPVVTELRRRLQHGDFGTICAV

SEQ ID NO: 948263 - protein, 18 aa, Mycobacterium
NYRLGTLGFLAHPALEAP

SEQ ID NO: 948264 - protein, 17 aa, Mycobacterium
NYRVVLKPGWTFTDGSP

SEQ ID NO: 948265 - protein, 24 aa, Mycobacterium
NYTYKWETFLTQELPAWLEANRGV

SEQ ID NO: 948266 - protein, 35 aa, Mycobacterium
PAAAAALPGAAAAVGFPVLHIGNIGFANLSVGNIG

SEQ ID NO: 948267 - protein, 27 aa, Mycobacterium
PAAAKQLSVLSLPTTFIFDAAGRQRYR

SEQ ID NO: 948268 - protein, 23 aa, Mycobacterium
PAAALVVLTMLLVSGCAGSAPQR

SEQ ID NO: 948269 - protein, 17 aa, Mycobacterium
PAADRIIELLNRARDSL

SEQ ID NO: 948270 - protein, 34 aa, Mycobacterium
PAAGRSLVLLLAVVLLLLGLACGLPVATSGAAPG

SEQ ID NO: 948271 - protein, 19 aa, Mycobacterium
PAAGYFSTYKPLESIQIGV

SEQ ID NO: 948272 - protein, 18 aa, Mycobacterium
PAAHWRLGDACEITMLES

SEQ ID NO: 948273 - protein, 17 aa, Mycobacterium
PAAHWRLGDACELSLLE

SEQ ID NO: 948274 - protein, 18 aa, Mycobacterium
PAAMIDIAAKALQMLFNP

SEQ ID NO: 948275 - protein, 29 aa, Mycobacterium
PAAMLSDRLHTWLLTTFLSRTSHRRMSTQ

SEQ ID NO: 948276 - protein, 24 aa, Mycobacterium
PAAPGIGYPFLVGGGPGIGFGDGM

SEQ ID NO: 948277 - protein, 17 aa, Mycobacterium
PAAPLLVPELMGAAAAE

SEQ ID NO: 948278 - protein, 27 aa, Mycobacterium
PAAPPAPPNPFAFPPPAAPAAVGPADP

SEQ ID NO: 948279 - protein, 25 aa, Mycobacterium
PAAPSGEIWQWALGKSMLTDPTLRD

SEQ ID NO: 948280 - protein, 24 aa, Mycobacterium
PAARLLVIGPPWPTADVPPSMFLI

SEQ ID NO: 948281 - protein, 19 aa, Mycobacterium
PAATLWIGPLGGSTVQAME

SEQ ID NO: 948282 - protein, 21 aa, Mycobacterium
PACRHVLPLALYRRQMHYVRR

SEQ ID NO: 948283 - protein, 27 aa, Mycobacterium
PADAPLTLVFVHGFCLRMGAFHFQRTR

SEQ ID NO: 948284 - protein, 17 aa, Mycobacterium
PADGALATVPAVAASGG

SEQ ID NO: 948285 - protein, 17 aa, Mycobacterium
PADIPEVPQAEQPPWVV

SEQ ID NO: 948286 - protein, 24 aa, Mycobacterium
PADLPLCALVAAWVRGQVRPEASA

SEQ ID NO: 948287 - protein, 27 aa, Mycobacterium
PADLQPYLGAYGHLVALRASDLHYLHV

SEQ ID NO: 948288 - protein, 30 aa, Mycobacterium
PADPIVFAAALKRIALPLGPASGPMFVYAG

SEQ ID NO: 948289 - protein, 17 aa, Mycobacterium
PADRLPPGGTPPPVSDP

SEQ ID NO: 948290 - protein, 17 aa, Mycobacterium
PAEGRVGLLRKVLDSAG

SEQ ID NO: 948291 - protein, 31 aa, Mycobacterium
PAEGVLVWSMGRSDWNCDYGLAVVPRAALVI

SEQ ID NO: 948292 - protein, 25 aa, Mycobacterium
PAEHRELSRHWPQGRLSKAYAAYET

SEQ ID NO: 948293 - protein, 27 aa, Mycobacterium
PAEQPQQPWNPFAPQQPAPETATANTP

SEQ ID NO: 948294 - protein, 38 aa, Mycobacterium
PAERVHVWVFALLRAVTWAAPLRAALARLLAPRDPILA

SEQ ID NO: 948295 - protein, 20 aa, Mycobacterium
PAFAAVAAVPAGRVAPRDPV

SEQ ID NO: 948296 - protein, 25 aa, Mycobacterium
PAFPALPLPVLSIPAGLPPFPYPAD

SEQ ID NO: 948297 - protein, 24 aa, Mycobacterium
PAFSLVTVLGLPVDAPPSLLAAGG

SEQ ID NO: 948298 - protein, 26 aa, Mycobacterium
PAGAPHPGPLVYRYGSTTLAGTAADT

SEQ ID NO: 948299 - protein, 23 aa, Mycobacterium
PAGASPRLVFGLGANATAQPAPC

SEQ ID NO: 948300 - protein, 18 aa, Mycobacterium
PAGGMLFIGTPDGQLVAP

SEQ ID NO: 948301 - protein, 20 aa, Mycobacterium
PAGHGAIGPAPPATAITAQG

SEQ ID NO: 948302 - protein, 23 aa, Mycobacterium
PAGIEPFGCLRPGPAPDGVGVAF

SEQ ID NO: 948303 - protein, 17 aa, Mycobacterium
PAGILAFLSGTDGSPLG

SEQ ID NO: 948304 - protein, 27 aa, Mycobacterium
PAGLAPGPALRLNWTDRATISNSGLQR

SEQ ID NO: 948305 - protein, 24 aa, Mycobacterium
PAGLPPGQGPLLLDAPPGAAEMPV

SEQ ID NO: 948306 - protein, 24 aa, Mycobacterium
PAGLVDITRFWFETGSLDNERSVA

SEQ ID NO: 948307 - protein, 24 aa, Mycobacterium
PAGPNRWRVPLRPGVVFSDGTTFD

SEQ ID NO: 948308 - protein, 22 aa, Mycobacterium
PAGQRLLLAVMTRSASDDPDAP

SEQ ID NO: 948309 - protein, 31 aa, Mycobacterium
PAGRGAPPSLFTPGYFKQLTVPVAVAGGSAA

SEQ ID NO: 948310 - protein, 27 aa, Mycobacterium
PAGSPPDPAWWYLVPARETIKNPVEWD

SEQ ID NO: 948311 - protein, 22 aa, Mycobacterium
PAGWAPPPPAWAPPPAPAVAGA

SEQ ID NO: 948312 - protein, 20 aa, Mycobacterium
PAHWRAMDVIPLGTGGQQFT

SEQ ID NO: 948313 - protein, 18 aa, Mycobacterium
PAIEIIPFDSQDAATNAV

SEQ ID NO: 948314 - protein, 21 aa, Mycobacterium
PAIGALSVPPSWAAGGVPSVN

SEQ ID NO: 948315 - protein, 23 aa, Mycobacterium
PAIKGMWTVPVFGNPTGVTYSWD

SEQ ID NO: 948316 - protein, 20 aa, Mycobacterium
PAIQPVVFGAPLPQQPAPEL

SEQ ID NO: 948317 - protein, 28 aa, Mycobacterium
PAITTDPAILTGGARAARGVRAHPPLPG

SEQ ID NO: 948318 - protein, 19 aa, Mycobacterium
PAIVILGYGLKPDGTMRQI

SEQ ID NO: 948319 - protein, 20 aa, Mycobacterium
PAKQRYLVQLTITGLANEAV

SEQ ID NO: 948320 - protein, 25 aa, Mycobacterium
PAKVSPPAVLTADTLKICAPNDGTP

SEQ ID NO: 948321 - protein, 24 aa, Mycobacterium
PALAAALLGLGVTASLVASPALAN

SEQ ID NO: 948322 - protein, 22 aa, Mycobacterium
PALADPIDPIPGNGFFLVGPDI

SEQ ID NO: 948323 - protein, 25 aa, Mycobacterium
PALDLDALIGGFKPVFRALDPDKVN

SEQ ID NO: 948324 - protein, 20 aa, Mycobacterium
PALDLDALLGGLKPVLKGLD

SEQ ID NO: 948325 - protein, 25 aa, Mycobacterium
PALDLDALVGGFRPLFRSLEPEKVN

SEQ ID NO: 948326 - protein, 18 aa, Mycobacterium
PALHHLTSPLRKAAAAAG

SEQ ID NO: 948327 - protein, 22 aa, Mycobacterium
PALLGLGFAGASLRPAPASASL

SEQ ID NO: 948328 - protein, 22 aa, Mycobacterium
PALTVLDRMGLLAAAQACKTGI

SEQ ID NO: 948329 - protein, 19 aa, Mycobacterium
PALVDIFARRLIGNPRVRF

SEQ ID NO: 948330 - protein, 17 aa, Mycobacterium
PAMFAPAIPAARAIGVR

SEQ ID NO: 948331 - protein, 20 aa, Mycobacterium
PAMHHRIFGPRIEFAQQLDE

SEQ ID NO: 948332 - protein, 20 aa, Mycobacterium
PAMLQAAGRILGWRLRLAGV

SEQ ID NO: 948333 - protein, 29 aa, Mycobacterium
PAMPASAEYLRLLRRHNVAATLSGAGPSV

SEQ ID NO: 948334 - protein, 23 aa, Mycobacterium
PAMRDRLVWQAASLLLAYPDDGL

SEQ ID NO: 948335 - protein, 24 aa, Mycobacterium
PANASFHFPMEFTPFQGGWELSRR

SEQ ID NO: 948336 - protein, 27 aa, Mycobacterium
PANGTHSWPYWNQQLMAMKPDMQQVLL

SEQ ID NO: 948337 - protein, 17 aa, Mycobacterium
PAPGLGSGGYRITAIFA

SEQ ID NO: 948338 - protein, 21 aa, Mycobacterium
PAPIEPDPFLKSYPWAAGLSG

SEQ ID NO: 948339 - protein, 18 aa, Mycobacterium
PAPPPKPISEDRLSALLL

SEQ ID NO: 948340 - protein, 20 aa, Mycobacterium
PAPPQTPPPAAPPQAPPRQA

SEQ ID NO: 948341 - protein, 17 aa, Mycobacterium
PAPPYIDHVTWAKWGDL

SEQ ID NO: 948342 - protein, 20 aa, Mycobacterium
PAPSWSHFTINGAPGAILAD

SEQ ID NO: 948343 - protein, 18 aa, Mycobacterium
PAPSWSHFTLNGAPGAVL

SEQ ID NO: 948344 - protein, 30 aa, Mycobacterium
PAPTGKFNLMLRLYWPKETPPSIIDGTWKP

SEQ ID NO: 948345 - protein, 26 aa, Mycobacterium
PAPTHDSWARYLRWVANAVGLKVVRG

SEQ ID NO: 948346 - protein, 28 aa, Mycobacterium
PAPVPPAPMPNLPVVNQLAGVPGAAPQL

SEQ ID NO: 948347 - protein, 17 aa, Mycobacterium
PAPYLTVVTTNDAQYRV

SEQ ID NO: 948348 - protein, 35 aa, Mycobacterium
PAQILVEYAQLRAQWGWRLVAAASTLPTPALRDAG

SEQ ID NO: 948349 - protein, 23 aa, Mycobacterium
PAQLLDVWRRKELPTHPAPVLLF

SEQ ID NO: 948350 - protein, 28 aa, Mycobacterium
PAQLSAAISALFLHVPYGANTLVGSASV

SEQ ID NO: 948351 - protein, 19 aa, Mycobacterium
PARHFSGRFLQRNTTLWAS

SEQ ID NO: 948352 - protein, 18 aa, Mycobacterium
PARHFSGRFLSRDNTLWA

SEQ ID NO: 948353 - protein, 24 aa, Mycobacterium
PARIDRVRYDLPPGYEVSGLDGRV

SEQ ID NO: 948354 - protein, 31 aa, Mycobacterium
PARIPGAAMPLPPPPSTPAPPPPAPSASEML

SEQ ID NO: 948355 - protein, 17 aa, Mycobacterium
PARSFLARVPRSVVEPS

SEQ ID NO: 948356 - protein, 19 aa, Mycobacterium
PARSWAYYAPQPDGSLRGT

SEQ ID NO: 948357 - protein, 22 aa, Mycobacterium
PARTWYTAMKPIAEHFGPIAMP

SEQ ID NO: 948358 - protein, 21 aa, Mycobacterium
PARYRLRLLNASNARRYRLQL

SEQ ID NO: 948359 - protein, 26 aa, Mycobacterium
PASAPDWLLVRIPVGTVWSEESAFRA

SEQ ID NO: 948360 - protein, 24 aa, Mycobacterium
PASMTPFPTMYELFSVGWGKPDLR

SEQ ID NO: 948361 - protein, 25 aa, Mycobacterium
PASMTPFPTMYELFSVGWGQPDLRE

SEQ ID NO: 948362 - protein, 25 aa, Mycobacterium
PASMTPFPTMYELFSVGWGRPDLRG

SEQ ID NO: 948363 - protein, 22 aa, Mycobacterium
PASTTLPFRLDTTRPPLLNGAC

SEQ ID NO: 948364 - protein, 27 aa, Mycobacterium
PATGRGFHVLYSSPPLNAAQAGPSVQF

SEQ ID NO: 948365 - protein, 25 aa, Mycobacterium
PATGTIVTTLWQPDKPVPVLLGITY

SEQ ID NO: 948366 - protein, 26 aa, Mycobacterium
PATIETLGFVGLLLANPDRARLSDFV

SEQ ID NO: 948367 - protein, 23 aa, Mycobacterium
PATSLFGTLSLWQGVDVPGPSLS

SEQ ID NO: 948368 - protein, 20 aa, Mycobacterium
PAVAGRLRQLGFRPASAVEV

SEQ ID NO: 948369 - protein, 21 aa, Mycobacterium
PAVANYLKKTLGYQKICVVDD

SEQ ID NO: 948370 - protein, 21 aa, Mycobacterium
PAVCAVLLLAAVSFWSATASA

SEQ ID NO: 948371 - protein, 18 aa, Mycobacterium
PAVLLRQTSFRALAEPRR

SEQ ID NO: 948372 - protein, 18 aa, Mycobacterium
PAVPFDPPPPPPAAAPAQ

SEQ ID NO: 948373 - protein, 21 aa, Mycobacterium
PAVPGIPMDPAVPVPGAPGAP

SEQ ID NO: 948374 - protein, 28 aa, Mycobacterium
PAVSAELPMLFHSLLPRPSRRVINKDAT

SEQ ID NO: 948375 - protein, 28 aa, Mycobacterium
PAVVKNAIDWLSRPFGDGALKGKPLAVI

SEQ ID NO: 948376 - protein, 31 aa, Mycobacterium
PDAARVLSVLSLPTTFIFDATGRQAYRVSGV

SEQ ID NO: 948377 - protein, 31 aa, Mycobacterium
PDADAGSRITKLWWPATGAPKLSLTTWTCGR

SEQ ID NO: 948378 - protein, 23 aa, Mycobacterium
PDANLAVLWLPSQGAGTCIDRSA

SEQ ID NO: 948379 - protein, 21 aa, Mycobacterium
PDAPGTPVPLPPDAPPGARTE

SEQ ID NO: 948380 - protein, 30 aa, Mycobacterium
PDDFDAVFALNVRAPYFLVGALAPTMAKRG

SEQ ID NO: 948381 - protein, 18 aa, Mycobacterium
PDDPLLGARQRSVAARGG

SEQ ID NO: 948382 - protein, 17 aa, Mycobacterium
PDDPLLSARQRAVAARG

SEQ ID NO: 948383 - protein, 28 aa, Mycobacterium
PDDWARDYWIPFDRFRRLDRVRTVHARL

SEQ ID NO: 948384 - protein, 25 aa, Mycobacterium
PDEKKLYVIEWRGTPNRSLWSFDVN

SEQ ID NO: 948385 - protein, 20 aa, Mycobacterium
PDFQAIVAAMLELTGERATG

SEQ ID NO: 948386 - protein, 25 aa, Mycobacterium
PDFRIGCKRILLTNDWLPTLARDDV

SEQ ID NO: 948387 - protein, 17 aa, Mycobacterium
PDFRITDERFTALYAST

SEQ ID NO: 948388 - protein, 26 aa, Mycobacterium
PDGEDLSWLWDVRFEDFSGVQVVAAG

SEQ ID NO: 948389 - protein, 25 aa, Mycobacterium
PDGEDLSWLWDVRFEHFENTAVVAA

SEQ ID NO: 948390 - protein, 25 aa, Mycobacterium
PDGEDLSWLWDVRFEHFEQTEVVAA

SEQ ID NO: 948391 - protein, 25 aa, Mycobacterium
PDGLAVPMRLALPGAVNRGNAAQAV

SEQ ID NO: 948392 - protein, 17 aa, Mycobacterium
PDGLIYTVWESPAPIEP

SEQ ID NO: 948393 - protein, 25 aa, Mycobacterium
PDGNYKTNLWTWTWAMNANSRNKLP

SEQ ID NO: 948394 - protein, 22 aa, Mycobacterium
PDGPRRLAVSLFYPAEQPSPDD

SEQ ID NO: 948395 - protein, 33 aa, Mycobacterium
PDGPTPTRLIYFQHGFMAAGPFYSFTAARLAEA

SEQ ID NO: 948396 - protein, 28 aa, Mycobacterium
PDGSKAVTLLMFTQGRALVRLEFDSAIE

SEQ ID NO: 948397 - protein, 22 aa, Mycobacterium
PDHSHFRSMDIWQTASPAEPAS

SEQ ID NO: 948398 - protein, 26 aa, Mycobacterium
PDHVTELFKFFTKCPDWVTYAEQCRL

SEQ ID NO: 948399 - protein, 20 aa, Mycobacterium
PDIPAIDEWPIQFPTTMTNP

SEQ ID NO: 948400 - protein, 18 aa, Mycobacterium
PDITSLGFPMYDPRYRDV

SEQ ID NO: 948401 - protein, 36 aa, Mycobacterium
PDIVRLLNPPPPPPPAPLPPGAPLPPPPAPPAPPAP

SEQ ID NO: 948402 - protein, 25 aa, Mycobacterium
PDKSKGVTILMFTEGRAFVTIQFDG

SEQ ID NO: 948403 - protein, 18 aa, Mycobacterium
PDLIRYYEMLLDGEGGLP

SEQ ID NO: 948404 - protein, 17 aa, Mycobacterium
PDMASSLWVGPLGGNAA

SEQ ID NO: 948405 - protein, 25 aa, Mycobacterium
PDNGLHTWQYWGAQLQAMLPDLRRV

SEQ ID NO: 948406 - protein, 17 aa, Mycobacterium
PDNKAPLATIPATKTRP

SEQ ID NO: 948407 - protein, 25 aa, Mycobacterium
PDPAGLPSVFVYDGYPGGAGFAERG

SEQ ID NO: 948408 - protein, 22 aa, Mycobacterium
PDPLALPPADPLAPPPPDPLAI

SEQ ID NO: 948409 - protein, 25 aa, Mycobacterium
PDPLRFSGITMFRGAGRMAAFLDGH

SEQ ID NO: 948410 - protein, 24 aa, Mycobacterium
PDQALMFHRGAFVGTATAVAYPFT

SEQ ID NO: 948411 - protein, 23 aa, Mycobacterium
PDQAQFDPMPLLDKLIVELDERN

SEQ ID NO: 948412 - protein, 25 aa, Mycobacterium
PDQLAAVIGPLFRSALRSAEVRRRV

SEQ ID NO: 948413 - protein, 25 aa, Mycobacterium
PDQLTWTFHLRDGVRWHDGTPLTAD

SEQ ID NO: 948414 - protein, 19 aa, Mycobacterium
PDQLTWTFRLRPGVTFHDG

SEQ ID NO: 948415 - protein, 22 aa, Mycobacterium
PDQPGRYFTVRAGSLVAWNSDG

SEQ ID NO: 948416 - protein, 22 aa, Mycobacterium
PDQPWPGRLPEPSPTVLLDDPV

SEQ ID NO: 948417 - protein, 27 aa, Mycobacterium
PDQSRPIIERPAWLPGSVTLIPTAGVS

SEQ ID NO: 948418 - protein, 20 aa, Mycobacterium
PDQYACFTGIPFGTPETAER

SEQ ID NO: 948419 - protein, 22 aa, Mycobacterium
PDRPWTMQVMLANPDQWATVTA

SEQ ID NO: 948420 - protein, 35 aa, Mycobacterium
PDRSLLYTGNFLHALLPFLARGLLSNLKVPVQNPA

SEQ ID NO: 948421 - protein, 25 aa, Mycobacterium
PDRVRELVVAWGKQYPLFGRTSALE

SEQ ID NO: 948422 - protein, 20 aa, Mycobacterium
PDSAQVRLKRMYPSASYRAT

SEQ ID NO: 948423 - protein, 17 aa, Mycobacterium
PDSHDICFIPSGDTQAF

SEQ ID NO: 948424 - protein, 17 aa, Mycobacterium
PDSHDICFIPSGDTRAF

SEQ ID NO: 948425 - protein, 23 aa, Mycobacterium
PDSIFAPFYQARIDRLNAQLARY

SEQ ID NO: 948426 - protein, 40 aa, Mycobacterium
PDSTGLPLRAMVMVLLFLGVIFLLLGWQALGSSGSSDDDS

SEQ ID NO: 948427 - protein, 23 aa, Mycobacterium
PDSWFDNWGWRYGGRDWRGEGGR

SEQ ID NO: 948428 - protein, 27 aa, Mycobacterium
PDTIDGLLAPEWKGKIGFAPSNASWQS

SEQ ID NO: 948429 - protein, 22 aa, Mycobacterium
PDTKVAPAYRQSVSASVSASSA

SEQ ID NO: 948430 - protein, 26 aa, Mycobacterium
PDTSWAFMTYLIEQDTLRDVSLVNVA

SEQ ID NO: 948431 - protein, 24 aa, Mycobacterium
PDVAALEEWLLGHEPHIVSQSDWL

SEQ ID NO: 948432 - protein, 19 aa, Mycobacterium
PDVAYMFGSWSPNIAKIPQ

SEQ ID NO: 948433 - protein, 25 aa, Mycobacterium
PDVMRALARHPRLARRYLAVEGHRA

SEQ ID NO: 948434 - protein, 24 aa, Mycobacterium
PDVPEPVLALIGKDLPPVSGPAPA

SEQ ID NO: 948435 - protein, 18 aa, Mycobacterium
PDVPLPWSQTVNTTLPAV

SEQ ID NO: 948436 - protein, 17 aa, Mycobacterium
PDWTRTVAARRAAAAGL

SEQ ID NO: 948437 - protein, 25 aa, Mycobacterium
PDYPIGCKRVLFSSDWYPALACDNV

SEQ ID NO: 948438 - protein, 22 aa, Mycobacterium
PEAAMYYHGGEMPGFNSFMGYD

SEQ ID NO: 948439 - protein, 30 aa, Mycobacterium
PEAFLGMMVPKFPNFFIMYGPNTNSIPLVS

SEQ ID NO: 948440 - protein, 23 aa, Mycobacterium
PEAKAAWLPPLACGSLRATTAVW

SEQ ID NO: 948441 - protein, 22 aa, Mycobacterium
PEDLRFGLYGALAHPIEATGIG

SEQ ID NO: 948442 - protein, 24 aa, Mycobacterium
PEDLRFGLYGALVHPLEADGLGSC

SEQ ID NO: 948443 - protein, 17 aa, Mycobacterium
PEDPRMLSIAQFWQRTA

SEQ ID NO: 948444 - protein, 23 aa, Mycobacterium
PEFEVMYLLCGCDELQIADLRAQ

SEQ ID NO: 948445 - protein, 22 aa, Mycobacterium
PEFINRLDDVIIFHGLEPGELV

SEQ ID NO: 948446 - protein, 26 aa, Mycobacterium
PEFINRLDDVIVFAGLEPGELVAIVD

SEQ ID NO: 948447 - protein, 17 aa, Mycobacterium
PEFSGKTALLLAGSVTG

SEQ ID NO: 948448 - protein, 22 aa, Mycobacterium
PEGAYDALVLAGPSPNKPTIVA

SEQ ID NO: 948449 - protein, 29 aa, Mycobacterium
PEGSAGIERLLVAYLKLAGKTAQDTAFDG

SEQ ID NO: 948450 - protein, 19 aa, Mycobacterium
PEHAFTWAVVGLIADQLNQ

SEQ ID NO: 948451 - protein, 24 aa, Mycobacterium
PEHAGLFDLPRCEPSYPTVAGLAA

SEQ ID NO: 948452 - protein, 25 aa, Mycobacterium
PEHLDWIAQWGIFDALRAKPDVVRV

SEQ ID NO: 948453 - protein, 25 aa, Mycobacterium
PEIDQMQSWLKQWGNPPMGDHEGMG

SEQ ID NO: 948454 - protein, 19 aa, Mycobacterium
PEIGIHRAVPAYAGRPAAG

SEQ ID NO: 948455 - protein, 19 aa, Mycobacterium
PEIVWYLDEPVADPALVPL

SEQ ID NO: 948456 - protein, 17 aa, Mycobacterium
PEKPGPVAPRYHGRHQL

SEQ ID NO: 948457 - protein, 17 aa, Mycobacterium
PEKQFIPMLSEMSRKDA

SEQ ID NO: 948458 - protein, 24 aa, Mycobacterium
PELAPLLHAVWSSLAFDFVAKQKI

SEQ ID NO: 948459 - protein, 17 aa, Mycobacterium
PELFPWTPERHRELLRA

SEQ ID NO: 948460 - protein, 19 aa, Mycobacterium
PELLRAAYVRLPDRAARSA

SEQ ID NO: 948461 - protein, 18 aa, Mycobacterium
PELRKLLPPIADIGAPFN

SEQ ID NO: 948462 - protein, 26 aa, Mycobacterium
PEMKKQPFSLAMTGPPPSPIERYPLY

SEQ ID NO: 948463 - protein, 17 aa, Mycobacterium
PEPGCDTLLLPGGIGVS

SEQ ID NO: 948464 - protein, 19 aa, Mycobacterium
PEPGWSKIIPAFTATDEGK

SEQ ID NO: 948465 - protein, 17 aa, Mycobacterium
PEPKPVMVWIHGGSFVA

SEQ ID NO: 948466 - protein, 17 aa, Mycobacterium
PEPLPPTDPPPPAPPAP

SEQ ID NO: 948467 - protein, 24 aa, Mycobacterium
PEPPAHLVLGSDALRLVGAARAAV

SEQ ID NO: 948468 - protein, 20 aa, Mycobacterium
PEPPPPPVRQLPPETFRTVA

SEQ ID NO: 948469 - protein, 21 aa, Mycobacterium
PEPPRGDQWLRVAAVRVPRIS

SEQ ID NO: 948470 - protein, 23 aa, Mycobacterium
PEPTLPVPAGWPFGEEFPRTCGA

SEQ ID NO: 948471 - protein, 27 aa, Mycobacterium
PEQASFTSLPWTYTMTTTIPAVIANVV

SEQ ID NO: 948472 - protein, 17 aa, Mycobacterium
PEQNGCTYVLSAPSVVN

SEQ ID NO: 948473 - protein, 25 aa, Mycobacterium
PEQWSGNFLFYNRGLFADGGVPPPP

SEQ ID NO: 948474 - protein, 24 aa, Mycobacterium
PERILLRRLGVFVGGFDLDAALAV

SEQ ID NO: 948475 - protein, 23 aa, Mycobacterium
PERLPGAIRWSSGALRQARDYLS

SEQ ID NO: 948476 - protein, 27 aa, Mycobacterium
PERSAELLRVFLLGELPPEQAREHLVM

SEQ ID NO: 948477 - protein, 20 aa, Mycobacterium
PESYQRLLGIAKIIGPRYDA

SEQ ID NO: 948478 - protein, 27 aa, Mycobacterium
PEVANAVRFAFWGAEEDGLRGSNNYVG

SEQ ID NO: 948479 - protein, 21 aa, Mycobacterium
PEVHIGPPTLLGVGVRTAQRS

SEQ ID NO: 948480 - protein, 25 aa, Mycobacterium
PEVLNVVVPFLALQPLVENAVRHGF

SEQ ID NO: 948481 - protein, 26 aa, Mycobacterium
PEVNATTFMAVPMRWLHGDRSARIPG

SEQ ID NO: 948482 - protein, 22 aa, Mycobacterium
PEVNIVYPSSPVFMDWSVAHGA

SEQ ID NO: 948483 - protein, 17 aa, Mycobacterium
PEVPGLPFLQQLAANPA

SEQ ID NO: 948484 - protein, 20 aa, Mycobacterium
PEVQAKAWQLLRDDPDNPMT

SEQ ID NO: 948485 - protein, 20 aa, Mycobacterium
PFADLLVPKLTASVTDGAVG

SEQ ID NO: 948486 - protein, 27 aa, Mycobacterium
PFARAMGPMQFIPETWRLYGVDANNDG

SEQ ID NO: 948487 - protein, 23 aa, Mycobacterium
PFCHGWEMRDRKLAALAAGNAGL

SEQ ID NO: 948488 - protein, 18 aa, Mycobacterium
PFGCLRPVPPPDGVGTAF

SEQ ID NO: 948489 - protein, 24 aa, Mycobacterium
PFLHIDQLIANNTRLWIYCGSGDA

SEQ ID NO: 948490 - protein, 20 aa, Mycobacterium
PFLHSNVVGTYTILEAVRRH

SEQ ID NO: 948491 - protein, 36 aa, Mycobacterium
PFMSYGKFTGHAPLGTCAFWPVPPTSKPHAVSVPGL

SEQ ID NO: 948492 - protein, 21 aa, Mycobacterium
PFNRRVALATLGLGVLAPNAL

SEQ ID NO: 948493 - protein, 18 aa, Mycobacterium
PFSLVALTGDLAGTSTRV

SEQ ID NO: 948494 - protein, 17 aa, Mycobacterium
PFTGRPPGTPPPGAAQL

SEQ ID NO: 948495 - protein, 27 aa, Mycobacterium
PGAFDCSGLVMWSFQQAGIALPHSSQA

SEQ ID NO: 948496 - protein, 17 aa, Mycobacterium
PGALTPLYLRRPDAKEP

SEQ ID NO: 948497 - protein, 24 aa, Mycobacterium
PGALTPTMPVLLYHGSRSKAVGDL

SEQ ID NO: 948498 - protein, 27 aa, Mycobacterium
PGAPLPPPIPQRPVPPLPPGPGAPPGP

SEQ ID NO: 948499 - protein, 27 aa, Mycobacterium
PGAPSSPPLHAMLSVSAYLYGSDEYSD

SEQ ID NO: 948500 - protein, 31 aa, Mycobacterium
PGARADRDFVLRFRLDRGALSSSALLVPDAD

SEQ ID NO: 948501 - protein, 18 aa, Mycobacterium
PGARIVPLHLADGALIDL

SEQ ID NO: 948502 - protein, 26 aa, Mycobacterium
PGASCDIPSLLYSFSFVRNPKWSRTY

SEQ ID NO: 948503 - protein, 18 aa, Mycobacterium
PGASWDMEMPWLASADDA

SEQ ID NO: 948504 - protein, 17 aa, Mycobacterium
PGAVLADPALRLAVCKG

SEQ ID NO: 948505 - protein, 20 aa, Mycobacterium
PGAVVRYIMSRLQTPSQTPT

SEQ ID NO: 948506 - protein, 20 aa, Mycobacterium
PGCPGDGPGTYWLPFTLTPT

SEQ ID NO: 948507 - protein, 24 aa, Mycobacterium
PGDGPRPLLVYAPLPNGMGEQCAA

SEQ ID NO: 948508 - protein, 22 aa, Mycobacterium
PGDLPIVRAVIALAGAFGLQLV

SEQ ID NO: 948509 - protein, 17 aa, Mycobacterium
PGDMTFSWYAVDRSGQP

SEQ ID NO: 948510 - protein, 31 aa, Mycobacterium
PGDPLNLPGFPFQFLLYKQIAAENAALVAQA

SEQ ID NO: 948511 - protein, 31 aa, Mycobacterium
PGDSLLIAWLLTFHYRLRTRIVLKGLLRCEP

SEQ ID NO: 948512 - protein, 22 aa, Mycobacterium
PGDTPDYPPPPGPPARIPGAAM

SEQ ID NO: 948513 - protein, 28 aa, Mycobacterium
PGEKWTGYHRLEKDLWVTGLQPDTNAIA

SEQ ID NO: 948514 - protein, 20 aa, Mycobacterium
PGELPFLAFHDIVSNAARCQ

SEQ ID NO: 948515 - protein, 17 aa, Mycobacterium
PGFDSIGLALSLCDEIT

SEQ ID NO: 948516 - protein, 18 aa, Mycobacterium
PGFDSLGLALSLYDEIVL

SEQ ID NO: 948517 - protein, 25 aa, Mycobacterium
PGGDHVMLMGLTTPLRPGQDVVITL

SEQ ID NO: 948518 - protein, 24 aa, Mycobacterium
PGGGYALTYPRRLGYGLGENALSL

SEQ ID NO: 948519 - protein, 24 aa, Mycobacterium
PGGVYIKVPMPYRQSMRISVAANL

SEQ ID NO: 948520 - protein, 17 aa, Mycobacterium
PGHFEWIKDDVVQWVPN

SEQ ID NO: 948521 - protein, 28 aa, Mycobacterium
PGHRLGQIVNPRWSPTGKQIAFLQNDSN

SEQ ID NO: 948522 - protein, 17 aa, Mycobacterium
PGHRRIVLRFLTSPIEI

SEQ ID NO: 948523 - protein, 27 aa, Mycobacterium
PGHVRHNAMRAMRFGAYTSLPHETVES

SEQ ID NO: 948524 - protein, 27 aa, Mycobacterium
PGIDTYLQFGYAPLSFEFRTDGWIADA

SEQ ID NO: 948525 - protein, 32 aa, Mycobacterium
PGIEFGHLPLSLGRTYWFAGERSLEAQRAPDG

SEQ ID NO: 948526 - protein, 25 aa, Mycobacterium
PGITNGRIPRLYGRQASEFVIRRAM

SEQ ID NO: 948527 - protein, 21 aa, Mycobacterium
PGIVVTPQPEMLPTDPHFASA

SEQ ID NO: 948528 - protein, 20 aa, Mycobacterium
PGKNIAVYAVNYPASLDFND

SEQ ID NO: 948529 - protein, 17 aa, Mycobacterium
PGLASAIPGLAQAALPG

SEQ ID NO: 948530 - protein, 36 aa, Mycobacterium
PGLDTVNFNYLPFPVNPLLTPIPSDSKLIYSEPDLR

SEQ ID NO: 948531 - protein, 26 aa, Mycobacterium
PGLERRLIVQLSQPGTYQTACKPGMI

SEQ ID NO: 948532 - protein, 18 aa, Mycobacterium
PGLIAWLKAQGVEFRGGP

SEQ ID NO: 948533 - protein, 22 aa, Mycobacterium
PGLLPLLALASVVAVVSGCVRS

SEQ ID NO: 948534 - protein, 18 aa, Mycobacterium
PGLQVFRFKAMNAEGAMA

SEQ ID NO: 948535 - protein, 19 aa, Mycobacterium
PGLSHYFCPIPDTDLSFEP

SEQ ID NO: 948536 - protein, 23 aa, Mycobacterium
PGMMGPWRYPAAPPPSCSAPALP

SEQ ID NO: 948537 - protein, 25 aa, Mycobacterium
PGNVWATRLPVPRSPATVAYVAPLS

SEQ ID NO: 948538 - protein, 24 aa, Mycobacterium
PGPAIQPFLDYALGFRRGVNAGQP

SEQ ID NO: 948539 - protein, 17 aa, Mycobacterium
PGPDPLRFSGITMFRGA

SEQ ID NO: 948540 - protein, 18 aa, Mycobacterium
PGPMPYPGAPPYGAPQYG

SEQ ID NO: 948541 - protein, 30 aa, Mycobacterium
PGPQGSLALSAWWPMPFAHAARVTLINTTE

SEQ ID NO: 948542 - protein, 19 aa, Mycobacterium
PGPRAISPIDWNLPAAERY

SEQ ID NO: 948543 - protein, 23 aa, Mycobacterium
PGPTMPKFLAFPSAQHGPPDGGA

SEQ ID NO: 948544 - protein, 26 aa, Mycobacterium
PGQALLVGIYSLRWGGKPAAMSWSAI

SEQ ID NO: 948545 - protein, 25 aa, Mycobacterium
PGQDPAILAAPPAPPVPGAIPPGDI

SEQ ID NO: 948546 - protein, 24 aa, Mycobacterium
PGQDWKELLPIRTLGEKVGDKTQR

SEQ ID NO: 948547 - protein, 20 aa, Mycobacterium
PGQFVQPFIDAAFSDLGLDP

SEQ ID NO: 948548 - protein, 25 aa, Mycobacterium
PGQIKKVCPWQSPPGHWVGGPHGIP

SEQ ID NO: 948549 - protein, 19 aa, Mycobacterium
PGQKITYGLKATDKVITCA

SEQ ID NO: 948550 - protein, 24 aa, Mycobacterium
PGQRAQLAAPAPVPPPPAAEPGEA

SEQ ID NO: 948551 - protein, 18 aa, Mycobacterium
PGQTYTVVVACRADFNGQ

SEQ ID NO: 948552 - protein, 25 aa, Mycobacterium
PGQVKQLCPWQAPPGHWVGGPHGVP

SEQ ID NO: 948553 - protein, 30 aa, Mycobacterium
PGRAAVPWWPWAPLVQLMRVLPPPLAKKFA

SEQ ID NO: 948554 - protein, 24 aa, Mycobacterium
PGRCRVLLVALVAAAAALTSAAPA

SEQ ID NO: 948555 - protein, 20 aa, Mycobacterium
PGRIYRAPWSLVSDANPQGG

SEQ ID NO: 948556 - protein, 26 aa, Mycobacterium
PGRRIHGEPLPWQDLRAAFTERGWLD

SEQ ID NO: 948557 - protein, 25 aa, Mycobacterium
PGRSAAWLIVDVRDLAALHAALLEP

SEQ ID NO: 948558 - protein, 25 aa, Mycobacterium
PGRSGAWLIVDVRDLAALHAALLEP

SEQ ID NO: 948559 - protein, 23 aa, Mycobacterium
PGSMLPPLPPRFAADLLVKTVST

SEQ ID NO: 948560 - protein, 20 aa, Mycobacterium
PGSRLGVWALTRGAQLVSAL

SEQ ID NO: 948561 - protein, 19 aa, Mycobacterium
PGSRQYLPKPVIGATTRAF

SEQ ID NO: 948562 - protein, 24 aa, Mycobacterium
PGSYTYIYNNFPAVAPATVDARGV

SEQ ID NO: 948563 - protein, 24 aa, Mycobacterium
PGSYTYSYYNFPAVAPAAVDARGI

SEQ ID NO: 948564 - protein, 20 aa, Mycobacterium
PGTAPPAFGYTPELVAAKGA

SEQ ID NO: 948565 - protein, 26 aa, Mycobacterium
PGTLGSGVLAPALWSVVEAFVGDLWP

SEQ ID NO: 948566 - protein, 23 aa, Mycobacterium
PGTQVPLRFRIVDASGAAVTEYD

SEQ ID NO: 948567 - protein, 20 aa, Mycobacterium
PGTTPSVWTGSPAPAGTNEH

SEQ ID NO: 948568 - protein, 19 aa, Mycobacterium
PGTYQTACKPGMIGDGIRG

SEQ ID NO: 948569 - protein, 33 aa, Mycobacterium
PGVDETAWRRAALSQLMLLKAYQQRVTYEATYG

SEQ ID NO: 948570 - protein, 18 aa, Mycobacterium
PGWVLPRPDFSHPQWVRT

SEQ ID NO: 948571 - protein, 19 aa, Mycobacterium
PGYVRVYPQIKDLIATLQA

SEQ ID NO: 948572 - protein, 18 aa, Mycobacterium
PHAGTYWFHPHVGTQIDR

SEQ ID NO: 948573 - protein, 22 aa, Mycobacterium
PHELKVEGLPPILVVSTTNDPA

SEQ ID NO: 948574 - protein, 25 aa, Mycobacterium
PHEQAPVRVFLYDSGDAEPFTSGRT

SEQ ID NO: 948575 - protein, 18 aa, Mycobacterium
PHFDYLELELGYVYGGHN

SEQ ID NO: 948576 - protein, 23 aa, Mycobacterium
PHGLPDIHVILPAPGDPRGLPAG

SEQ ID NO: 948577 - protein, 18 aa, Mycobacterium
PHGWGANLLMYNVNVVRD

SEQ ID NO: 948578 - protein, 17 aa, Mycobacterium
PHHWVNLGDRRISTLDL

SEQ ID NO: 948579 - protein, 18 aa, Mycobacterium
PHIAMTVVMLRQAGVDVD

SEQ ID NO: 948580 - protein, 18 aa, Mycobacterium
PHPWAEPVRRLLAAADPA

SEQ ID NO: 948581 - protein, 17 aa, Mycobacterium
PHQVEITSLPWSHTETT

SEQ ID NO: 948582 - protein, 30 aa, Mycobacterium
PHSRALLAAQIIWTLARADIRGPYVINADG

SEQ ID NO: 948583 - protein, 30 aa, Mycobacterium; identical to SEQ ID NO: 147444

SEQ ID NO: 948584 - protein, 25 aa, Mycobacterium
PHVVAGIQVYLWYAGGAAHPNVSVS

SEQ ID NO: 948585 - protein, 24 aa, Mycobacterium
PHYDVYPAFAFRFDVKDPAVSITF

SEQ ID NO: 948586 - protein, 25 aa, Mycobacterium
PIAADDYWYLWRQMVSQPGVVDPAG

SEQ ID NO: 948587 - protein, 18 aa, Mycobacterium
PIADLFQPQLRVLVDLGY

SEQ ID NO: 948588 - protein, 28 aa, Mycobacterium
PIAFNEMDYFIRMWTQAALAMDVYQAET

SEQ ID NO: 948589 - protein, 18 aa, Mycobacterium
PIALGSSADLRVGQPVLA

SEQ ID NO: 948590 - protein, 26 aa, Mycobacterium
PIATTWSVRPFARISGWTLVCRGENA

SEQ ID NO: 948591 - protein, 27 aa, Mycobacterium
PIAVTGTYFEPYNAWPGGGPRPLISYA

SEQ ID NO: 948592 - protein, 18 aa, Mycobacterium
PIDTFMQAWQASDYQMVV

SEQ ID NO: 948593 - protein, 19 aa, Mycobacterium
PIEPDPYLKSYPWAAGLSS

SEQ ID NO: 948594 - protein, 25 aa, Mycobacterium
PIGADDFWYLWRQMVSQPGAVDPAG

SEQ ID NO: 948595 - protein, 32 aa, Mycobacterium
PIGEVPLDDWQWVLGINLWGPIHGCHVFTPIL

SEQ ID NO: 948596 - protein, 27 aa, Mycobacterium
PIGGMFGDITYPVNSPLAITLSFAVSE

SEQ ID NO: 948597 - protein, 22 aa, Mycobacterium
PIGLGFRVPCLVISPFSRGGLM

SEQ ID NO: 948598 - protein, 23 aa, Mycobacterium
PIGLGFRVPCLVISPFSRGGLMV

SEQ ID NO: 948599 - protein, 20 aa, Mycobacterium
PIGQEWLRVAAVRLPRISNS

SEQ ID NO: 948600 - protein, 17 aa, Mycobacterium
PIGVIHWASTDTAVEWS

SEQ ID NO: 948601 - protein, 19 aa, Mycobacterium
PIHDLPLDDLGIPGVSVDI

SEQ ID NO: 948602 - protein, 19 aa, Mycobacterium
PIHLHGHTFQLIKADGSPG

SEQ ID NO: 948603 - protein, 26 aa, Mycobacterium
PIIKNRQYNFLPFGQNLFVGASARPN

SEQ ID NO: 948604 - protein, 21 aa, Mycobacterium
PIIKNRQYNFPPLGENLIVGA

SEQ ID NO: 948605 - protein, 21 aa, Mycobacterium
PIKITFSVEGLSHPFLVKQKQ

SEQ ID NO: 948606 - protein, 18 aa, Mycobacterium
PILAARAAIYAESFRRRA

SEQ ID NO: 948607 - protein, 20 aa, Mycobacterium
PILALYGIPNRDCGSLAAGG

SEQ ID NO: 948608 - protein, 20 aa, Mycobacterium
PILKNRQYNFPPLGENLFVG

SEQ ID NO: 948609 - protein, 23 aa, Mycobacterium
PILLDQVSLISETWIQPTFVLSD

SEQ ID NO: 948610 - protein, 23 aa, Mycobacterium
PILQPLAPGQVLRIGPTAGTGTP

SEQ ID NO: 948611 - protein, 26 aa, Mycobacterium
PILTVGAPLFDRIEIALPAGKSLRIS

SEQ ID NO: 948612 - protein, 21 aa, Mycobacterium
PILVAVAFSVTTVLAACVPVL

SEQ ID NO: 948613 - protein, 23 aa, Mycobacterium
PILVPVWILVLVAALAGCATRTD

SEQ ID NO: 948614 - protein, 27 aa, Mycobacterium
PIPIMNAYVLLDRPLGTVAPWESLLDS

SEQ ID NO: 948615 - protein, 17 aa, Mycobacterium
PIPYAVQGTLWEATATD

SEQ ID NO: 948616 - protein, 17 aa, Mycobacterium
PIQTACMVLMDNKIMQG

SEQ ID NO: 948617 - protein, 20 aa, Mycobacterium
PIRPPVPDDLAYLTYTSGTT

SEQ ID NO: 948618 - protein, 17 aa, Mycobacterium
PISEISPWYGHKAIDLC

SEQ ID NO: 948619 - protein, 19 aa, Mycobacterium
PITASPVWGTRSIDLCNGA

SEQ ID NO: 948620 - protein, 26 aa, Mycobacterium
PITDPDMTPILLARALGLFDQLGRST

SEQ ID NO: 948621 - protein, 29 aa, Mycobacterium
PITTNTQLLWYRADLMPAPPTTWDGMLDE

SEQ ID NO: 948622 - protein, 18 aa, Mycobacterium
PIVGSFLADVLDAPLRVL

SEQ ID NO: 948623 - protein, 21 aa, Mycobacterium
PIVHVSSFSALFHAGLEQLSA

SEQ ID NO: 948624 - protein, 27 aa, Mycobacterium
PIVHVSSFTALFHPGLQTLSADLPVVG

SEQ ID NO: 948625 - protein, 26 aa, Mycobacterium
PIVHVSSITALFRPGLETFAADLPAA

SEQ ID NO: 948626 - protein, 19 aa, Mycobacterium
PIYAINANPTLGLGGLACG

SEQ ID NO: 948627 - protein, 19 aa, Mycobacterium
PKDLVIDPTNLWLTIHESI

SEQ ID NO: 948628 - protein, 25 aa, Mycobacterium
PKENVQMITKLLISAAIAVGAAIGV

SEQ ID NO: 948629 - protein, 26 aa, Mycobacterium
PKFRTGGYMIDFWGVGYQAAKRMGIE

SEQ ID NO: 948630 - protein, 17 aa, Mycobacterium
PKGGIHNWTYWGNQLRA

SEQ ID NO: 948631 - protein, 19 aa, Mycobacterium
PKGGSFPLYTAIDVNMTAQ

SEQ ID NO: 948632 - protein, 28 aa, Mycobacterium
PKIREMRIPLQVYLVGRDLEPIGGAIPG

SEQ ID NO: 948633 - protein, 22 aa, Mycobacterium
PKLNLLNNHPLPNIGRVVVTGN

SEQ ID NO: 948634 - protein, 19 aa, Mycobacterium
PKMGGFAVPMSFSPEGEGW

SEQ ID NO: 948635 - protein, 31 aa, Mycobacterium
PKNPNSWINGPFTYIGPLLSGSRESQLIALG

SEQ ID NO: 948636 - protein, 26 aa, Mycobacterium
PKPPAGLPGAPVPPVAPGGPGGPTPK

SEQ ID NO: 948637 - protein, 24 aa, Mycobacterium
PKRIDGAPLPWTLVLSTTAPSVFP

SEQ ID NO: 948638 - protein, 26 aa, Mycobacterium
PKRIDGAPLPWTLVLSTTAPSVFPNL

SEQ ID NO: 948639 - protein, 23 aa, Mycobacterium
PKSDWRFGVPRLLPTRTAIAPDE

SEQ ID NO: 948640 - protein, 23 aa, Mycobacterium
PKVNQWHMRLAVSKVGDQLSITG

SEQ ID NO: 948641 - protein, 18 aa, Mycobacterium
PKVYALMERTFGPVLRGS

SEQ ID NO: 948642 - protein, 25 aa, Mycobacterium
PLAAAGLLRFDLDLLAAIAKPFESE

SEQ ID NO: 948643 - protein, 23 aa, Mycobacterium
PLACDNGWWWDPGANECRPPVGP

SEQ ID NO: 948644 - protein, 18 aa, Mycobacterium
PLADALEPVLKLLVNTSY

SEQ ID NO: 948645 - protein, 19 aa, Mycobacterium
PLAEPFIQEALDRAAWQHT

SEQ ID NO: 948646 - protein, 20 aa, Mycobacterium
PLAGAMAAALPYCDHFLPAH

SEQ ID NO: 948647 - protein, 32 aa, Mycobacterium
PLAHPDWLPQRLGFRPFPYPSFTRRLVEAMCD

SEQ ID NO: 948648 - protein, 18 aa, Mycobacterium
PLAILKQVLPQQSAKKKP

SEQ ID NO: 948649 - protein, 22 aa, Mycobacterium
PLAPGALAGLLLDTGGIGAVMD

SEQ ID NO: 948650 - protein, 27 aa, Mycobacterium
PLAPLTTLRVGPVARRLITCASTEQVV

SEQ ID NO: 948651 - protein, 20 aa, Mycobacterium
PLATDLLAPPPDQPPPPAPP

SEQ ID NO: 948652 - protein, 26 aa, Mycobacterium
PLATMAGYHLGWWDIDRSALAGSSGT

SEQ ID NO: 948653 - protein, 17 aa, Mycobacterium
PLCAEPVRWRLVGEEAE

SEQ ID NO: 948654 - protein, 21 aa, Mycobacterium
PLCALICGWLRGQARPDARVE

SEQ ID NO: 948655 - protein, 28 aa, Mycobacterium
PLCHGIGATLIRLFGADRVRVLPHVSSV

SEQ ID NO: 948656 - protein, 26 aa, Mycobacterium
PLDDARLLFLFRTQEELQYHYRDVLR

SEQ ID NO: 948657 - protein, 24 aa, Mycobacterium
PLEQRFPKLPKPVTGEWVQGFFSD

SEQ ID NO: 948658 - protein, 20 aa, Mycobacterium
PLEYLGQWQLPPQEAGAPNR

SEQ ID NO: 948659 - protein, 23 aa, Mycobacterium
PLFHGDSIYRLWYQFTQISDKIK

SEQ ID NO: 948660 - protein, 18 aa, Mycobacterium
PLGDVFVALRPPAGAGTE

SEQ ID NO: 948661 - protein, 22 aa, Mycobacterium
PLGDVFVSIRPPAGAPSDGPIL

SEQ ID NO: 948662 - protein, 18 aa, Mycobacterium
PLGYPALHHLTSPLRKAA

SEQ ID NO: 948663 - protein, 24 aa, Mycobacterium
PLHTPAVVQSFNAILGDINAKHRP

SEQ ID NO: 948664 - protein, 18 aa, Mycobacterium
PLHTPAVVQSFNAVLADV

SEQ ID NO: 948665 - protein, 18 aa, Mycobacterium
PLIGVRKAGLFTSSSFVL

SEQ ID NO: 948666 - protein, 20 aa, Mycobacterium
PLKTAADFLVAIPTGWDNAI

SEQ ID NO: 948667 - protein, 21 aa, Mycobacterium
PLLDRAGILGGFHTPSDGLAS

SEQ ID NO: 948668 - protein, 20 aa, Mycobacterium
PLLNFAATPGLGPAGHSYSV

SEQ ID NO: 948669 - protein, 25 aa, Mycobacterium
PLNCALAQVLFALRDVRLGDTVVIQ

SEQ ID NO: 948670 - protein, 18 aa, Mycobacterium
PLNTFQDGLYTRGLPGVL

SEQ ID NO: 948671 - protein, 33 aa, Mycobacterium
PLPTARAVVLPQWLFSVLLTPAIRLTNGAANWI

SEQ ID NO: 948672 - protein, 28 aa, Mycobacterium
PLQEIVTSLYRMALLDDALEIRTSSSSD

SEQ ID NO: 948673 - protein, 18 aa, Mycobacterium
PLQELPKFRNEKLDPARC

SEQ ID NO: 948674 - protein, 19 aa, Mycobacterium
PLRGTARALLELGRDWRSW

SEQ ID NO: 948675 - protein, 24 aa, Mycobacterium
PLRPGQDVVITLAFQDGSTTPMTA

SEQ ID NO: 948676 - protein, 22 aa, Mycobacterium
PLRRILGNPKSRRLLVAVSAIV

SEQ ID NO: 948677 - protein, 17 aa, Mycobacterium
PLRRPILCTEYLARPLG

SEQ ID NO: 948678 - protein, 21 aa, Mycobacterium
PLRTRYVGYTAWRGIAAHPLD

SEQ ID NO: 948679 - protein, 23 aa, Mycobacterium
PLSAEGPLLSPTGPLSANGPLTA

SEQ ID NO: 948680 - protein, 26 aa, Mycobacterium
PLSDVPPPLVPAMPLPENAVANAVAK

SEQ ID NO: 948681 - protein, 19 aa, Mycobacterium
PLSDWIIPDCYIPDRIDCN

SEQ ID NO: 948682 - protein, 20 aa, Mycobacterium
PLSGMAIGPKRVYLTLRGQP

SEQ ID NO: 948683 - protein, 26 aa, Mycobacterium
PLSPEHVVSLVQFLASPAAAEVNGQL

SEQ ID NO: 948684 - protein, 24 aa, Mycobacterium
PLTATPEHIPAAGAGLDAHLPAGI

SEQ ID NO: 948685 - protein, 19 aa, Mycobacterium
PLTAVLTISALVAACGSGP

SEQ ID NO: 948686 - protein, 19 aa, Mycobacterium
PLTFIAGPSPTGWQLSKQS

SEQ ID NO: 948687 - protein, 17 aa, Mycobacterium
PLTVRIGYQTPNARLAA

SEQ ID NO: 948688 - protein, 17 aa, Mycobacterium
PLVPSLLVEVSPADDWL

SEQ ID NO: 948689 - protein, 27 aa, Mycobacterium
PLYNGDSFYHLWFQFTQISDKIKQQLP

SEQ ID NO: 948690 - protein, 18 aa, Mycobacterium
PLYSNGSFTYRPAAGYSG

SEQ ID NO: 948691 - protein, 19 aa, Mycobacterium
PMEFKPPSGFQLPTGMGPP

SEQ ID NO: 948692 - protein, 17 aa, Mycobacterium
PMFHAFPASKWRRYDKL

SEQ ID NO: 948693 - protein, 28 aa, Mycobacterium
PMFHGLGFGMLVLTISLGGTVLTRRHFD

SEQ ID NO: 948694 - protein, 32 aa, Mycobacterium
PMHGYELRKRLTGLLGAFRAFSYGSLYPALRR

SEQ ID NO: 948695 - protein, 19 aa, Mycobacterium
PMLGSIFIVAGADGLTRPS

SEQ ID NO: 948696 - protein, 20 aa, Mycobacterium
PMLVEVLSTPRWFTGTDGRT

SEQ ID NO: 948697 - protein, 17 aa, Mycobacterium
PMMIDRSYFLEPDSKSS

SEQ ID NO: 948698 - protein, 19 aa, Mycobacterium
PMPDVVWDMNVCHHYYGGS

SEQ ID NO: 948699 - protein, 25 aa, Mycobacterium
PMPGTTRWLDGRSVQWEPAEFYPAH

SEQ ID NO: 948700 - protein, 20 aa, Mycobacterium
PMQFLPSTFAMYGAGTDIAS

SEQ ID NO: 948701 - protein, 20 aa, Mycobacterium
PMSADRWNFVRKNYLSDVTG

SEQ ID NO: 948702 - protein, 22 aa, Mycobacterium
PMTLWADRIVLCAGAIGSAHLL

SEQ ID NO: 948703 - protein, 20 aa, Mycobacterium
PMVSFTFGIPPRGVIAALQR

SEQ ID NO: 948704 - protein, 20 aa, Mycobacterium
PNADWNWIPSNIWVGVGRME

SEQ ID NO: 948705 - protein, 31 aa, Mycobacterium
PNAGFPILKRPAMRMVLVGAAVIIGCLVGAT

SEQ ID NO: 948706 - protein, 27 aa, Mycobacterium
PNEGPPQRWFVVWLGTSNDPVDKGAAK

SEQ ID NO: 948707 - protein, 23 aa, Mycobacterium
PNGSILLGRLDLKLFAGAEPDNQ

SEQ ID NO: 948708 - protein, 24 aa, Mycobacterium
PNHHGGALAFGPDGKLYWGVGDNA

SEQ ID NO: 948709 - protein, 21 aa, Mycobacterium
PNKGIAFGSIVTFAVRPGNPK

SEQ ID NO: 948710 - protein, 21 aa, Mycobacterium
PNLELLAQVAGVANAPVIASG

SEQ ID NO: 948711 - protein, 23 aa, Mycobacterium
PNLEQLLVLLPQGTAVTQAVGVA

SEQ ID NO: 948712 - protein, 20 aa, Mycobacterium
PNLLLPLVRLTHLAESAIER

SEQ ID NO: 948713 - protein, 17 aa, Mycobacterium
PNLSHPLLAAVPKLPQC

SEQ ID NO: 948714 - protein, 17 aa, Mycobacterium
PNMFTISGPGSPSVLAN

SEQ ID NO: 948715 - protein, 22 aa, Mycobacterium
PNNDWTHFFAEQWELQDYFAKA

SEQ ID NO: 948716 - protein, 25 aa, Mycobacterium
PNPNTRAVLFHQGKFIPTGVPDTYG

SEQ ID NO: 948717 - protein, 29 aa, Mycobacterium
PNSNLKVIAPWFQINDFSWISPPGRQLEG

SEQ ID NO: 948718 - protein, 24 aa, Mycobacterium
PNTTYRVRLIQLPRPSVAPCNPGD

SEQ ID NO: 948719 - protein, 20 aa, Mycobacterium
PNTWKQNWPQHLASAYIQDG

SEQ ID NO: 948720 - protein, 26 aa, Mycobacterium
PNVATPFGLWPEVSPLTIADALAAGT

SEQ ID NO: 948721 - protein, 24 aa, Mycobacterium
PNVRLRVFTAFAGQLRSWLYDGEL

SEQ ID NO: 948722 - protein, 25 aa, Mycobacterium
PPADARVFDFPLPKGITPEGGLQVH

SEQ ID NO: 948723 - protein, 25 aa, Mycobacterium
PPADSLPFSAFPMGNYAGLPTVSFV

SEQ ID NO: 948724 - protein, 17 aa, Mycobacterium
PPAPLPLAAAEYDPATG

SEQ ID NO: 948725 - protein, 36 aa, Mycobacterium
PPAQWMPPNAAFACQYAIQFIAVLRGYSLPVDEASA

SEQ ID NO: 948726 - protein, 29 aa, Mycobacterium
PPARSTSLWTVLTAAWRQPGRSGTDATAG

SEQ ID NO: 948727 - protein, 17 aa, Mycobacterium
PPASTIKVLLALVALDE

SEQ ID NO: 948728 - protein, 23 aa, Mycobacterium
PPASTIKVLLALVALDELDLNST

SEQ ID NO: 948729 - protein, 20 aa, Mycobacterium
PPAVAEPLDPIPGNGVFVVG

SEQ ID NO: 948730 - protein, 41 aa, Mycobacterium
PPDKLNFATFGDPIGRHAFGQSFLTAMFPVGSVVPALDYTM

SEQ ID NO: 948731 - protein, 21 aa, Mycobacterium
PPDPARWFIVPARETIRNPVE

SEQ ID NO: 948732 - protein, 23 aa, Mycobacterium
PPEGGWPVINWAHGTTGYADTCA

SEQ ID NO: 948733 - protein, 17 aa, Mycobacterium
PPELAGLWELPGGKVTP

SEQ ID NO: 948734 - protein, 25 aa, Mycobacterium
PPERAHTFVFALLRAVTAVAPARRM

SEQ ID NO: 948735 - protein, 33 aa, Mycobacterium
PPETPPVLSAYNPGPPPPPPFTGRPPGTPPPGA

SEQ ID NO: 948736 - protein, 17 aa, Mycobacterium
PPFVDHTQWAYSGRLSS

SEQ ID NO: 948737 - protein, 25 aa, Mycobacterium
PPGGIHNWTYWGQQLRAMKPDMVAY

SEQ ID NO: 948738 - protein, 25 aa, Mycobacterium
PPGGKIVVTVRLWAAPIAAAYQQSF

SEQ ID NO: 948739 - protein, 21 aa, Mycobacterium
PPGQDTWYRGAARISDLVEQI

SEQ ID NO: 948740 - protein, 20 aa, Mycobacterium
PPGVDTWYRGAARISDLVEQ

SEQ ID NO: 948741 - protein, 24 aa, Mycobacterium
PPGVTGPIRPIIALHGKGQTAAGV

SEQ ID NO: 948742 - protein, 19 aa, Mycobacterium
PPGWHPYNNPNLAPFTRMI

SEQ ID NO: 948743 - protein, 18 aa, Mycobacterium
PPHFRLRHDRIDAAGVIT

SEQ ID NO: 948744 - protein, 23 aa, Mycobacterium
PPLGQPGTPPLPVPYPRTGQGGD

SEQ ID NO: 948745 - protein, 17 aa, Mycobacterium
PPLPNTPSPLPATNIPI

SEQ ID NO: 948746 - protein, 17 aa, Mycobacterium
PPLPPPPPLVWAPQTPE

SEQ ID NO: 948747 - protein, 19 aa, Mycobacterium
PPLPVPYPRTGQGGDPKLT

SEQ ID NO: 948748 - protein, 29 aa, Mycobacterium
PPMKEPPPFLRGVFTAVIMALGLGQESKY

SEQ ID NO: 948749 - protein, 32 aa, Mycobacterium
PPMSEPLLPVTPPPPAAPWLPQSQPITSGNIF

SEQ ID NO: 948750 - protein, 27 aa, Mycobacterium
PPNQARALFVLRAAGLIALKGGRVTPS

SEQ ID NO: 948751 - protein, 19 aa, Mycobacterium
PPNQQFLQQYLASSPDQRV

SEQ ID NO: 948752 - protein, 19 aa, Mycobacterium
PPNTPITSTPTITTGLTRT

SEQ ID NO: 948753 - protein, 26 aa, Mycobacterium
PPNVPTPFGVLPPLSATTSLPGYLAI

SEQ ID NO: 948754 - protein, 32 aa, Mycobacterium
PPPAAAPAPPILALPGIPPGDVAPPPAAPILD

SEQ ID NO: 948755 - protein, 20 aa, Mycobacterium
PPPDGCALAAIWTTGPMMNR

SEQ ID NO: 948756 - protein, 24 aa, Mycobacterium
PPPELADLTALLDRARADSALASE

SEQ ID NO: 948757 - protein, 17 aa, Mycobacterium
PPPPPGNTFLPAPPPAD

SEQ ID NO: 948758 - protein, 18 aa, Mycobacterium
PPPPPPPPAPDINAYPPA

SEQ ID NO: 948759 - protein, 24 aa, Mycobacterium
PPPPPPRPWWSPNEPMWNAGFHQW

SEQ ID NO: 948760 - protein, 32 aa, Mycobacterium
PPPVGTQAHFLWVLQRAVNRLAGWPGPAGQNF

SEQ ID NO: 948761 - protein, 24 aa, Mycobacterium
PPQAIPPQAIPPQQAPPAAAPPAQ

SEQ ID NO: 948762 - protein, 26 aa, Mycobacterium
PPQAKRWLLGRIGAKRPRRAPTIAAS

SEQ ID NO: 948763 - protein, 27 aa, Mycobacterium
PPQEVLLHQWQQTIPLLSTPATANQPP

SEQ ID NO: 948764 - protein, 17 aa, Mycobacterium
PPQFMDFRYTVHDKWHG

SEQ ID NO: 948765 - protein, 21 aa, Mycobacterium
PPQFSGIFVSAGLTLGVERYR

SEQ ID NO: 948766 - protein, 28 aa, Mycobacterium
PPQLPGLAELWGTAVFHCPFCHGWEMRD

SEQ ID NO: 948767 - protein, 19 aa, Mycobacterium
PPQLPQLPALPAPAPPKIS

SEQ ID NO: 948768 - protein, 28 aa, Mycobacterium
PPQLSGRVLTLIDLIAAPSVRLPAKKID

SEQ ID NO: 948769 - protein, 26 aa, Mycobacterium
PPQSFAQVLVGWQNWLRTADRNSWAL

SEQ ID NO: 948770 - protein, 26 aa, Mycobacterium
PPRAIDPQFFAARKLPDGLSFDPANC

SEQ ID NO: 948771 - protein, 22 aa, Mycobacterium
PPRSRTVFYLPSALVSNGVIAN

SEQ ID NO: 948772 - protein, 20 aa, Mycobacterium
PPSPALASKPSLPAPSAAPA

SEQ ID NO: 948773 - protein, 19 aa, Mycobacterium
PPTARRVMMWPSADGSCVR

SEQ ID NO: 948774 - protein, 27 aa, Mycobacterium
PPTGRGFHVLYSSPPLNAAQSGPSVQF

SEQ ID NO: 948775 - protein, 18 aa, Mycobacterium
PPVAGVRPGDPRLLIARG

SEQ ID NO: 948776 - protein, 19 aa, Mycobacterium
PPVEGSWAWLPDEAKGARV

SEQ ID NO: 948777 - protein, 21 aa, Mycobacterium
PPVIMSVVTWADCLVALQQRQ

SEQ ID NO: 948778 - protein, 24 aa, Mycobacterium
PPVPDLNAFWRHVDRCDAPVATVS

SEQ ID NO: 948779 - protein, 20 aa, Mycobacterium
PPVRQLPPETFRTVAPPPPP

SEQ ID NO: 948780 - protein, 24 aa, Mycobacterium
PPVTKRVTVWPSGIDVQKRLSDGD

SEQ ID NO: 948781 - protein, 23 aa, Mycobacterium
PPWPFVGYHWCPGQPFDPAWGPQ

SEQ ID NO: 948782 - protein, 30 aa, Mycobacterium
PPYKLAGIAALILALMAGALVYGQFRGDLT

SEQ ID NO: 948783 - protein, 22 aa, Mycobacterium
PQCVGLPKLPFNTAPPQLIADI

SEQ ID NO: 948784 - protein, 23 aa, Mycobacterium
PQCWDLPVVPFDVAPPFVVADVG

SEQ ID NO: 948785 - protein, 24 aa, Mycobacterium
PQGAIAFSGLYPPGSTFKTITTAA

SEQ ID NO: 948786 - protein, 24 aa, Mycobacterium
PQGSLLILAPVSRPADALNALGWA

SEQ ID NO: 948787 - protein, 20 aa, Mycobacterium
PQHLIVAAAAVLLTACTQDV

SEQ ID NO: 948788 - protein, 18 aa, Mycobacterium
PQIAGINPGLQLPATPVV

SEQ ID NO: 948789 - protein, 20 aa, Mycobacterium
PQLAAIAPTVFTAAPGAAWE

SEQ ID NO: 948790 - protein, 20 aa, Mycobacterium
PQLAGPFSLLRRALACQTDN

SEQ ID NO: 948791 - protein, 30 aa, Mycobacterium
PQNLGPELVPPSRYLAAPQAATPLAPPATA

SEQ ID NO: 948792 - protein, 27 aa, Mycobacterium
PQNLIEAWGRNAAYHFVFTRQNRGKLD

SEQ ID NO: 948793 - protein, 18 aa, Mycobacterium
PQPADQLRRWLDSILDAV

SEQ ID NO: 948794 - protein, 26 aa, Mycobacterium
PQPRTPAPPAPPPAPLPLAAAEYDPA

SEQ ID NO: 948795 - protein, 25 aa, Mycobacterium
PQRAAWAIDALSLYVAAYTLEISLV

SEQ ID NO: 948796 - protein, 17 aa, Mycobacterium
PQRDEILLARNDRYWAT

SEQ ID NO: 948797 - protein, 30 aa, Mycobacterium
PQRTFTPQQLLGYALDKPLQFPPGTQYDYC

SEQ ID NO: 948798 - protein, 17 aa, Mycobacterium
PQSPLLNRAISETYPPG

SEQ ID NO: 948799 - protein, 38 aa, Mycobacterium
PQTIAYFLSGDLGFLAPLLNWTLYAQNINLIAYGDGAI

SEQ ID NO: 948800 - protein, 21 aa, Mycobacterium
PQTIWVTGCNSWYLGKDGLPE

SEQ ID NO: 948801 - protein, 19 aa, Mycobacterium
PQTSLFGTLSLWQGVDVPG

SEQ ID NO: 948802 - protein, 19 aa, Mycobacterium
PQVDLWLEELDRTPAFYFD

SEQ ID NO: 948803 - protein, 21 aa, Mycobacterium
PRAASRSKVLPPWATGQGADE

SEQ ID NO: 948804 - protein, 19 aa, Mycobacterium
PRADQLRRALEDSGVHNVA

SEQ ID NO: 948805 - protein, 20 aa, Mycobacterium
PRAHILARDLLLQDGDNTPL

SEQ ID NO: 948806 - protein, 18 aa, Mycobacterium
PRALWHLGAGATATPARC

SEQ ID NO: 948807 - protein, 18 aa, Mycobacterium
PRCRVYGIDNLWVIDGSV

SEQ ID NO: 948808 - protein, 26 aa, Mycobacterium
PRDAVEQILFLIAPAPELAAAAVLFA

SEQ ID NO: 948809 - protein, 19 aa, Mycobacterium
PRDDWVPFAGVPGYNHIKI

SEQ ID NO: 948810 - protein, 19 aa, Mycobacterium
PRDITILPELPRGSTGKIL

SEQ ID NO: 948811 - protein, 25 aa, Mycobacterium
PRDLCALWPVPATSTPHVASPAAPG

SEQ ID NO: 948812 - protein, 22 aa, Mycobacterium
PRDMCAFWPVPPTSTPHTPSTP

SEQ ID NO: 948813 - protein, 19 aa, Mycobacterium
PRDSILAAGRYLAANGFAN

SEQ ID NO: 948814 - protein, 18 aa, Mycobacterium
PRFGLCQIYANESWHFEL

SEQ ID NO: 948815 - protein, 30 aa, Mycobacterium
PRGANERAPLPKLGPLSRLLNPGARRSAPV

SEQ ID NO: 948816 - protein, 36 aa, Mycobacterium
PRGERLREIWSDSPLTFLGLMVPGLPNLFTISGPGS

SEQ ID NO: 948817 - protein, 24 aa, Mycobacterium
PRGLGMLYYEDGTWGLTTFGVGKV

SEQ ID NO: 948818 - protein, 23 aa, Mycobacterium
PRHTARVLLAKNPAGWQEALSMV

SEQ ID NO: 948819 - protein, 26 aa, Mycobacterium
PRHWRRSTHALLAVAVVLAIAALVLL

SEQ ID NO: 948820 - protein, 18 aa, Mycobacterium
PRILGQLDTLMRSLRAAK

SEQ ID NO: 948821 - protein, 35 aa, Mycobacterium
PRIPHAIRRLAVPIVLLWLALAAITNASVPQLEDV

SEQ ID NO: 948822 - protein, 22 aa, Mycobacterium
PRISPDQLLMMISNEYQTGASG

SEQ ID NO: 948823 - protein, 24 aa, Mycobacterium
PRLTRILLVALVALTAAGGGVVLY

SEQ ID NO: 948824 - protein, 26 aa, Mycobacterium
PRLWEMSTVLPILQDTTIVAAGPSVE

SEQ ID NO: 948825 - protein, 18 aa, Mycobacterium
PRNEWLFDENWGVDVAVS

SEQ ID NO: 948826 - protein, 18 aa, Mycobacterium
PRNEWLFDESWGVDVAVS

SEQ ID NO: 948827 - protein, 27 aa, Mycobacterium
PRNTPPHAWYIAFAPAQDPKVAVAVLV

SEQ ID NO: 948828 - protein, 17 aa, Mycobacterium
PRQITNILTGRRPKLYG

SEQ ID NO: 948829 - protein, 17 aa, Mycobacterium
PRQITNILTGRRPRLYG

SEQ ID NO: 948830 - protein, 22 aa, Mycobacterium
PRRMAAFIASLDAAAMAGGLLA

SEQ ID NO: 948831 - protein, 22 aa, Mycobacterium
PRRSLAYDRAWWFARFVAQTYG

SEQ ID NO: 948832 - protein, 24 aa, Mycobacterium
PRRVRRFFVTVGVVGSLAGLALAA

SEQ ID NO: 948833 - protein, 17 aa, Mycobacterium
PRRYMVGGHRIPVPELA

SEQ ID NO: 948834 - protein, 25 aa, Mycobacterium
PRVAGLIARVQLPPAPIGAVQELRE

SEQ ID NO: 948835 - protein, 21 aa, Mycobacterium
PRVGAIFLDDGPVHICTGAVL

SEQ ID NO: 948836 - protein, 21 aa, Mycobacterium
PRWRLGILATVLATTACSTNG

SEQ ID NO: 948837 - protein, 24 aa, Mycobacterium
PRYASVFDAYRAYIASTFGLIGAD

SEQ ID NO: 948838 - protein, 23 aa, Mycobacterium
PSAAMGRDIPVAFLAGGPHAVYL

SEQ ID NO: 948839 - protein, 18 aa, Mycobacterium
PSAGLMFSLAVIDKLTTG

SEQ ID NO: 948840 - protein, 17 aa, Mycobacterium
PSAGYVPLPDKVKERLV

SEQ ID NO: 948841 - protein, 25 aa, Mycobacterium
PSAKPQHAPPLAAAPVRPAVPQVPQ

SEQ ID NO: 948842 - protein, 29 aa, Mycobacterium
PSALTTPEAPALQALLALMVERGVDTVVM

SEQ ID NO: 948843 - protein, 23 aa, Mycobacterium
PSDGIEQLIFAPQGPLAQPKARR

SEQ ID NO: 948844 - protein, 23 aa, Mycobacterium
PSDGRWWNTFSSAPDLIRYYEML

SEQ ID NO: 948845 - protein, 19 aa, Mycobacterium
PSEDLAIIALTNAAPYGVP

SEQ ID NO: 948846 - protein, 23 aa, Mycobacterium
PSEGWWPMLIGLAMNDAGGYNAE

SEQ ID NO: 948847 - protein, 25 aa, Mycobacterium
PSFDIAKLFNGFRPIFETLDPAQFN

SEQ ID NO: 948848 - protein, 21 aa, Mycobacterium
PSFDIGMLLHGFEPLFSVLDP

SEQ ID NO: 948849 - protein, 26 aa, Mycobacterium
PSGDTRAFLGERIAVRRGAVVGADGA

SEQ ID NO: 948850 - protein, 25 aa, Mycobacterium
PSGPIQAKYILFDNGDNLARSFSAS

SEQ ID NO: 948851 - protein, 28 aa, Mycobacterium
PSIAESYWNWPEPLLTDEGWLDTRDRVC

SEQ ID NO: 948852 - protein, 17 aa, Mycobacterium
PSLAWRGRRAASRLSEA

SEQ ID NO: 948853 - protein, 29 aa, Mycobacterium
PSLFAVEVALFALLRDWGVSPDVVMGHSV

SEQ ID NO: 948854 - protein, 18 aa, Mycobacterium
PSLGPAADRFAAVFLDAL

SEQ ID NO: 948855 - protein, 21 aa, Mycobacterium
PSLLLLAVGVVPAAGLLGVLG

SEQ ID NO: 948856 - protein, 18 aa, Mycobacterium
PSLLYSYSFEQNPQWSRA

SEQ ID NO: 948857 - protein, 18 aa, Mycobacterium
PSNATIPGYTPKGTLYQA

SEQ ID NO: 948858 - protein, 30 aa, Mycobacterium
PSNLALDRFADFPTLPLDPSAMVAQVGPQV

SEQ ID NO: 948859 - protein, 18 aa, Mycobacterium
PSNLPKPIPGMDPDVLLR

SEQ ID NO: 948860 - protein, 21 aa, Mycobacterium
PSNLYSYSFARKTDWGRRYAE

SEQ ID NO: 948861 - protein, 23 aa, Mycobacterium
PSPADLDAFLNLLSERGVDVLVY

SEQ ID NO: 948862 - protein, 25 aa, Mycobacterium
PSPAMISVFLEWFHQHLDRHGPHLP

SEQ ID NO: 948863 - protein, 22 aa, Mycobacterium
PSPKTLKVDVLLLGVQNDPIVG

SEQ ID NO: 948864 - protein, 22 aa, Mycobacterium
PSPLAERLAGIPAPSTALDATD

SEQ ID NO: 948865 - protein, 24 aa, Mycobacterium
PSPRATGRRALRAVAAAAVVLAGP

SEQ ID NO: 948866 - protein, 19 aa, Mycobacterium
PSQLTGCHALALVGDPLYP

SEQ ID NO: 948867 - protein, 27 aa, Mycobacterium
PSQPARGLARKLGWAPPLAWDEDSIDD

SEQ ID NO: 948868 - protein, 17 aa, Mycobacterium
PSRAAEVLGFRAAVDPA

SEQ ID NO: 948869 - protein, 39 aa, Mycobacterium
PSRKVLRRRLVALSVLPALLLLGFAVKLIVMVSTGYAAQ

SEQ ID NO: 948870 - protein, 20 aa, Mycobacterium
PSRPGGGLFALATPFTNQFG

SEQ ID NO: 948871 - protein, 23 aa, Mycobacterium
PSRREFADYLRWVARQLDHLVRY

SEQ ID NO: 948872 - protein, 17 aa, Mycobacterium
PSSDPIPYAVQGTLWEA

SEQ ID NO: 948873 - protein, 19 aa, Mycobacterium
PSSLWLDATGKRLPVPLYP

SEQ ID NO: 948874 - protein, 17 aa, Mycobacterium
PSSMSMALSAAPYVVWM

SEQ ID NO: 948875 - protein, 34 aa, Mycobacterium
PSSPVFRQILPTTPGPEGILPIPSRNLLAISSET

SEQ ID NO: 948876 - protein, 18 aa, Mycobacterium
PSSTQLPVWLSHAGADIL

SEQ ID NO: 948877 - protein, 25 aa, Mycobacterium
PSTFALDRFADYPSLPLDPSALVGQ

SEQ ID NO: 948878 - protein, 23 aa, Mycobacterium
PSTLKAWLDYVHVIGQTSPAAQG

SEQ ID NO: 948879 - protein, 17 aa, Mycobacterium
PSTLQFLFHGTFAERDD

SEQ ID NO: 948880 - protein, 19 aa, Mycobacterium
PSWASIRPVFGDHIIRIED

SEQ ID NO: 948881 - protein, 30 aa, Mycobacterium
PTAARIRADRPFRWVTPQLVPDDGKIPARG

SEQ ID NO: 948882 - protein, 19 aa, Mycobacterium
PTAPPAMTTPAALALLEGA

SEQ ID NO: 948883 - protein, 23 aa, Mycobacterium
PTARMLVIGPPWPTADVPVSVLR

SEQ ID NO: 948884 - protein, 19 aa, Mycobacterium
PTCHSLRMLGVGDKPLRLL

SEQ ID NO: 948885 - protein, 24 aa, Mycobacterium
PTDNGAYIIGDRYSFLVMDSSTYG

SEQ ID NO: 948886 - protein, 38 aa, Mycobacterium
PTDTPLLALDSPWRAPEYLQTLPLRRLTRPAEVARSVE

SEQ ID NO: 948887 - protein, 21 aa, Mycobacterium
PTEFMAARLMGLNWLNEINES

SEQ ID NO: 948888 - protein, 24 aa, Mycobacterium
PTELCSFPLRQCGSGNLFGGNEPA

SEQ ID NO: 948889 - protein, 27 aa, Mycobacterium
PTELLRRARLYVGRPGEAFAEFCKVSL

SEQ ID NO: 948890 - protein, 26 aa, Mycobacterium
PTEPAPVLIFVPGGAWIHGSRAIQGY

SEQ ID NO: 948891 - protein, 25 aa, Mycobacterium
PTGDDPAYVSWFAELMRLVEQFQLP

SEQ ID NO: 948892 - protein, 38 aa, Mycobacterium
PTGDPLLPNPPMPAPPPPPAQILIPPAPIAATPPPKQS

SEQ ID NO: 948893 - protein, 17 aa, Mycobacterium
PTGKVCRPLGVGPQPLA

SEQ ID NO: 948894 - protein, 29 aa, Mycobacterium
PTGRGAPPTLFSPGYFKQLTVPVAVVNQY

SEQ ID NO: 948895 - protein, 24 aa, Mycobacterium
PTGTPIPAAAINQPALPTTTTSTT

SEQ ID NO: 948896 - protein, 20 aa, Mycobacterium
PTGWFQVAWSADLAVAEVIP

SEQ ID NO: 948897 - protein, 23 aa, Mycobacterium
PTHGRWGQYLRWVAERIDMTVVY

SEQ ID NO: 948898 - protein, 19 aa, Mycobacterium
PTIAALYRTRLKAVDSDRA

SEQ ID NO: 948899 - protein, 24 aa, Mycobacterium
PTIDFRMRLGHSAFYPLPRAAFRD

SEQ ID NO: 948900 - protein, 24 aa, Mycobacterium
PTKMPMPGAYLPKNTYRLKIEFSS

SEQ ID NO: 948901 - protein, 25 aa, Mycobacterium
PTLAAAAAWDGLAADLASAAQSFSA

SEQ ID NO: 948902 - protein, 30 aa, Mycobacterium
PTLAVTGRLLPYLVGADPVNLLSLAKIVDL

SEQ ID NO: 948903 - protein, 21 aa, Mycobacterium
PTLLNVVGSLVLNLLVGFIQV

SEQ ID NO: 948904 - protein, 24 aa, Mycobacterium
PTNGAPLSYPSVYLGCHYSNCSPG

SEQ ID NO: 948905 - protein, 24 aa, Mycobacterium
PTPFVGDPPFRPPTFNPVNGAMVG

SEQ ID NO: 948906 - protein, 23 aa, Mycobacterium
PTPTFPEPWPPFGLGGTRFSPCP

SEQ ID NO: 948907 - protein, 29 aa, Mycobacterium
PTPTITARLNFQLAFGARVGQRLAEAREQ

SEQ ID NO: 948908 - protein, 24 aa, Mycobacterium
PTQDSMCMWFTYSTPDANKDNVVA

SEQ ID NO: 948909 - protein, 27 aa, Mycobacterium
PTRGSIVSRLWRRPLPAVPAAVAAPAG

SEQ ID NO: 948910 - protein, 18 aa, Mycobacterium
PTRRRQCSHWATLSGLFW

SEQ ID NO: 948911 - protein, 23 aa, Mycobacterium
PTSDALYWCNPSGRALGTPPTTA

SEQ ID NO: 948912 - protein, 26 aa, Mycobacterium
PTSNRGWCRYVFNLGLDERPVQPAGR

SEQ ID NO: 948913 - protein, 27 aa, Mycobacterium
PTSPNRLYWLSAWIDPAGTNGGPLVET

SEQ ID NO: 948914 - protein, 23 aa, Mycobacterium
PTTKYKAFNWDQGYRKPITYDTL

SEQ ID NO: 948915 - protein, 27 aa, Mycobacterium
PTTNLLMKYNPMLTCLFVGAKTTLDTG

SEQ ID NO: 948916 - protein, 22 aa, Mycobacterium
PTTVDGLLLPPGAPAAPPVAPN

SEQ ID NO: 948917 - protein, 20 aa, Mycobacterium
PTVMQLITGFDFPFAAMGSV

SEQ ID NO: 948918 - protein, 19 aa, Mycobacterium
PTVTLPPMASSGGGPIIGG

SEQ ID NO: 948919 - protein, 33 aa, Mycobacterium
PTWGTMLRQQGYRTWWWGKWHLGDWSDTNPEGL

SEQ ID NO: 948920 - protein, 17 aa, Mycobacterium
PTYTARLGDHPDRTAWD

SEQ ID NO: 948921 - protein, 31 aa, Mycobacterium
PVADAVLAWVRRLITHTFFNKTPVVRSVETE

SEQ ID NO: 948922 - protein, 21 aa, Mycobacterium
PVAGSPFSITYLIDSNQDRTG

SEQ ID NO: 948923 - protein, 18 aa, Mycobacterium
PVALPQAGPRIITRAQWG

SEQ ID NO: 948924 - protein, 23 aa, Mycobacterium
PVANFNGFLISGIGPDPAFGEIA

SEQ ID NO: 948925 - protein, 26 aa, Mycobacterium
PVAQSYIRNFLAAPPPKREQMAQQIQ

SEQ ID NO: 948926 - protein, 22 aa, Mycobacterium
PVARTLLEICTVGILAVPTVEV

SEQ ID NO: 948927 - protein, 25 aa, Mycobacterium
PVAVRAVWAARVAPPATAAPAAMLG

SEQ ID NO: 948928 - protein, 17 aa, Mycobacterium
PVAWIHATALRTEPLAY

SEQ ID NO: 948929 - protein, 33 aa, Mycobacterium
PVDAYDAYLRLHLLSHRLIQPHGASVDGLFGVL

SEQ ID NO: 948930 - protein, 19 aa, Mycobacterium
PVDPNFVQSLFTPEGFYID

SEQ ID NO: 948931 - protein, 23 aa, Mycobacterium
PVDQFPLALQDAGGFMDAMMTTC

SEQ ID NO: 948932 - protein, 23 aa, Mycobacterium
PVDREIRLIGRNSLFPKVTETVE

SEQ ID NO: 948933 - protein, 26 aa, Mycobacterium
PVDVPVDMALPRMAKDLPPQCGWVFA

SEQ ID NO: 948934 - protein, 18 aa, Mycobacterium
PVEGSWAWLPDEAQGARV

SEQ ID NO: 948935 - protein, 26 aa, Mycobacterium
PVELPLSALVAGWLRGRVAPQAVVDA

SEQ ID NO: 948936 - protein, 23 aa, Mycobacterium
PVERWHRGVPFDLHLMIFGDSTA

SEQ ID NO: 948937 - protein, 18 aa, Mycobacterium
PVFHCEVYVDGALATQAD

SEQ ID NO: 948938 - protein, 26 aa, Mycobacterium
PVGASGLRMLYEAWLQFRGEAGQRQL

SEQ ID NO: 948939 - protein, 23 aa, Mycobacterium
PVIFLMLTAAVPAIPAAAAPLPA

SEQ ID NO: 948940 - protein, 18 aa, Mycobacterium
PVIVVPAPTRRSAARRRG

SEQ ID NO: 948941 - protein, 18 aa, Mycobacterium
PVLAAADEPMWLSDNELD

SEQ ID NO: 948942 - protein, 17 aa, Mycobacterium
PVLPQLSAKHHVVVAAV

SEQ ID NO: 948943 - protein, 18 aa, Mycobacterium
PVLWAQSTAALAARAHQA

SEQ ID NO: 948944 - protein, 22 aa, Mycobacterium
PVLWDEMPTLPLYRQERTLLMS

SEQ ID NO: 948945 - protein, 17 aa, Mycobacterium
PVNLRDALTLAADATAR

SEQ ID NO: 948946 - protein, 30 aa, Mycobacterium
PVNRRVALATLGLGVFAPGLLAACGGTTAK

SEQ ID NO: 948947 - protein, 26 aa, Mycobacterium
PVPERPTAPPPPRLAAPPPPEPAARH

SEQ ID NO: 948948 - protein, 27 aa, Mycobacterium
PVPGAALFVLDGWLRPVPVGVVGELYV

SEQ ID NO: 948949 - protein, 18 aa, Mycobacterium
PVPLYPGYDTLGTLEHIC

SEQ ID NO: 948950 - protein, 19 aa, Mycobacterium
PVPPPPPLPPPPPLVWAPQ

SEQ ID NO: 948951 - protein, 23 aa, Mycobacterium
PVPQMAVLPTADPGIAAAAAPGS

SEQ ID NO: 948952 - protein, 24 aa, Mycobacterium
PVQARYFNELLISTFTIAGATPRY

SEQ ID NO: 948953 - protein, 23 aa, Mycobacterium
PVQRWRRGTPFDLHLMMFGDSTA

SEQ ID NO: 948954 - protein, 24 aa, Mycobacterium
PVQRWRRGTPFDLHLMMFGDSTAC

SEQ ID NO: 948955 - protein, 19 aa, Mycobacterium
PVRLRLLSLVASHPGGQAC

SEQ ID NO: 948956 - protein, 20 aa, Mycobacterium
PVRMKYIIRPDLTGFVNMGF

SEQ ID NO: 948957 - protein, 19 aa, Mycobacterium
PVRSLMFAADPQPDGSLVL

SEQ ID NO: 948958 - protein, 17 aa, Mycobacterium
PVRVTVLCPTFVKTNIL

SEQ ID NO: 948959 - protein, 20 aa, Mycobacterium
PVTALDGLLLDDRKIDDIVG

SEQ ID NO: 948960 - protein, 20 aa, Mycobacterium
PVTCDDLVLAWAAQSGRYPE

SEQ ID NO: 948961 - protein, 18 aa, Mycobacterium
PVTDRVTVWPRSPDIQDR

SEQ ID NO: 948962 - protein, 21 aa, Mycobacterium
PVTDTVLLNLNCSAAVASAKT

SEQ ID NO: 948963 - protein, 20 aa, Mycobacterium
PVTITYPGMVLGPPVGDQFG

SEQ ID NO: 948964 - protein, 17 aa, Mycobacterium
PVTLIAGNRFTAPSEPA

SEQ ID NO: 948965 - protein, 24 aa, Mycobacterium
PVTQPGMTPAPRPAAASPLGGGAP

SEQ ID NO: 948966 - protein, 18 aa, Mycobacterium
PVVAANRSLLAALVATNF

SEQ ID NO: 948967 - protein, 23 aa, Mycobacterium
PVVEFNLPNGLAIDSWMCAISGR

SEQ ID NO: 948968 - protein, 18 aa, Mycobacterium
PVVEQFTRNGTLWGVPQL

SEQ ID NO: 948969 - protein, 18 aa, Mycobacterium
PVWASLIALLDDGVPTVG

SEQ ID NO: 948970 - protein, 17 aa, Mycobacterium
PVWASLIALLEDGVPSI

SEQ ID NO: 948971 - protein, 18 aa, Mycobacterium
PVWASLIALLEDGVPSVG

SEQ ID NO: 948972 - protein, 23 aa, Mycobacterium
PWDQRLHRVTYGGPLPRVHPIAT

SEQ ID NO: 948973 - protein, 18 aa, Mycobacterium
PWDSWDHPYRTPPKVWFS

SEQ ID NO: 948974 - protein, 19 aa, Mycobacterium
PWELTSEGIVIPLPDHIGV

SEQ ID NO: 948975 - protein, 23 aa, Mycobacterium
PWGPPPAWAPPAPPPPSWAPGAQ

SEQ ID NO: 948976 - protein, 22 aa, Mycobacterium
PWGVVTEKGRWYLVGHDRDRGA

SEQ ID NO: 948977 - protein, 32 aa, Mycobacterium
PWILSLPEADGRYYLFPMLDGFTNVFEVPGKR

SEQ ID NO: 948978 - protein, 19 aa, Mycobacterium
PWNYGGWTGIGFWPLVGAY

SEQ ID NO: 948979 - protein, 19 aa, Mycobacterium
PWQLTPDATPPPQAPPAGV

SEQ ID NO: 948980 - protein, 20 aa, Mycobacterium
PWRVEALVLLAFSAYARGDG

SEQ ID NO: 948981 - protein, 23 aa, Mycobacterium
PWTCEQIVLPRLQAASGLRAGED

SEQ ID NO: 948982 - protein, 19 aa, Mycobacterium
PWYSSYTLDPLKAPVTPKP

SEQ ID NO: 948983 - protein, 25 aa, Mycobacterium
PYAHVTAPLRRLGDRFVTEICLALS

SEQ ID NO: 948984 - protein, 18 aa, Mycobacterium
PYAIERWEYGQKLVLHRN

SEQ ID NO: 948985 - protein, 25 aa, Mycobacterium
PYCYGAAFDPWTGRYLLVLEDLPAE

SEQ ID NO: 948986 - protein, 28 aa, Mycobacterium
PYDGDIHILFYNAELFDRYKVEPPTTWD

SEQ ID NO: 948987 - protein, 25 aa, Mycobacterium
PYDPSPVGIAFPKGSDLLPAVKTAM

SEQ ID NO: 948988 - protein, 18 aa, Mycobacterium
PYFAEMFLGRLDVREALQ

SEQ ID NO: 948989 - protein, 18 aa, Mycobacterium
PYFDALDPPLFTRAQMHP

SEQ ID NO: 948990 - protein, 19 aa, Mycobacterium
PYGIPEALTAQFMDLVQYG

SEQ ID NO: 948991 - protein, 26 aa, Mycobacterium
PYGNAIINTLLLYMENHRDELVVFGA

SEQ ID NO: 948992 - protein, 29 aa, Mycobacterium
PYGNNGGWPFFHMEMMLAGIPIPVPPGGP

SEQ ID NO: 948993 - protein, 19 aa, Mycobacterium
PYIDHVTWAKWGDLSSLRV

SEQ ID NO: 948994 - protein, 25 aa, Mycobacterium
PYLGAYGHLVALREGDLAYLHVHPE

SEQ ID NO: 948995 - protein, 30 aa, Mycobacterium
PYQLMAAIDEHFGHPAHLPRAGLPSEIGPV

SEQ ID NO: 948996 - protein, 19 aa, Mycobacterium
PYSGAVCQYVLALESAPDA

SEQ ID NO: 948997 - protein, 19 aa, Mycobacterium
PYVPYPCDWNYYNCNEWWD

SEQ ID NO: 948998 - protein, 24 aa, Mycobacterium
PYVSKLPGYWDTVVQHKLQTGRDA

SEQ ID NO: 948999 - protein, 26 aa, Mycobacterium
QAAADPALMTWFREAAEHARRIVSVC

SEQ ID NO: 949000 - protein, 31 aa, Mycobacterium
QAAASNHTVLLFSTSSSFNSLPLATNDAATV

SEQ ID NO: 949001 - protein, 24 aa, Mycobacterium
QAAETWLIPIVLSGEVAGWLWVIT

SEQ ID NO: 949002 - protein, 25 aa, Mycobacterium
QAAKAAPLGILPQPNELPRGCIAAG

SEQ ID NO: 949003 - protein, 17 aa, Mycobacterium
QAAKLCVQYLAPIVKNR

SEQ ID NO: 949004 - protein, 23 aa, Mycobacterium
QAARRLSVLSLPTTFIFDARGHQ

SEQ ID NO: 949005 - protein, 26 aa, Mycobacterium
QACAPVIAWYLAMARRSQGNEESAQV

SEQ ID NO: 949006 - protein, 23 aa, Mycobacterium
QACNRVIAWYSAMAYRGLGNEEA

SEQ ID NO: 949007 - protein, 18 aa, Mycobacterium
QADCLGGVYMRWVAEGKS

SEQ ID NO: 949008 - protein, 26 aa, Mycobacterium
QADFSTLPWTFTITTTVPAVIASVVA

SEQ ID NO: 949009 - protein, 29 aa, Mycobacterium
QADGVMGISVWLPNAAFSDDLFGSAADYA

SEQ ID NO: 949010 - protein, 25 aa, Mycobacterium
QADLLVTLPPFVQKAAGSGLLVGAD

SEQ ID NO: 949011 - protein, 21 aa, Mycobacterium
QADTLRYVGGYWQGAPEQLRV

SEQ ID NO: 949012 - protein, 26 aa, Mycobacterium
QAEAAQIPYFFSQKGMLGVEPASQVL

SEQ ID NO: 949013 - protein, 25 aa, Mycobacterium
QAEESAFVLLALQAPVAGDLRTVVS

SEQ ID NO: 949014 - protein, 20 aa, Mycobacterium
QAEFADKFPAPEKLWTIDDL

SEQ ID NO: 949015 - protein, 17 aa, Mycobacterium
QAFALSCNTAFVQLGML

SEQ ID NO: 949016 - protein, 17 aa, Mycobacterium
QAFARVLTGFSYHGPEG

SEQ ID NO: 949017 - protein, 24 aa, Mycobacterium
QAFGLDTPPPAIPLQVAESTTGPI

SEQ ID NO: 949018 - protein, 19 aa, Mycobacterium
QAFLARRDTTGAACSATAA

SEQ ID NO: 949019 - protein, 17 aa, Mycobacterium
QAGADVALWLSTGEVPA

SEQ ID NO: 949020 - protein, 23 aa, Mycobacterium
QAGDAPMFPILMGHPKVNTSGPG

SEQ ID NO: 949021 - protein, 25 aa, Mycobacterium
QAGDLLGIALLIDKSPGAAPVDDSQ

SEQ ID NO: 949022 - protein, 26 aa, Mycobacterium
QAGDLVGIVLQIPRDPAPPVTDEQRN

SEQ ID NO: 949023 - protein, 26 aa, Mycobacterium
QAGQFALTYPRRLGFGLGTSVVSLSW

SEQ ID NO: 949024 - protein, 24 aa, Mycobacterium
QAGQYALTYPRRLGFGLGNSVVSL

SEQ ID NO: 949025 - protein, 25 aa, Mycobacterium
QAGQYALTYPRRLGFGLGNSVVSLS

SEQ ID NO: 949026 - protein, 24 aa, Mycobacterium
QAIDGLVVGMQRYVRGQLTQFLGQ

SEQ ID NO: 949027 - protein, 21 aa, Mycobacterium
QAIDLLKGVLMPSIMQAVQNG

SEQ ID NO: 949028 - protein, 20 aa, Mycobacterium
QAISQVMPFLVDLPVGEPNA

SEQ ID NO: 949029 - protein, 29 aa, Mycobacterium
QAIVMSDIILAKQGIDPRVTELATQIKAA

SEQ ID NO: 949030 - protein, 28 aa, Mycobacterium
QAKQCDVIMAQLYIKPEREKVVDFVPYV

SEQ ID NO: 949031 - protein, 24 aa, Mycobacterium
QALHYLAVYDEHTGVPLYLGRARR

SEQ ID NO: 949032 - protein, 18 aa, Mycobacterium
QALMSAAMELQRIGSVLV

SEQ ID NO: 949033 - protein, 24 aa, Mycobacterium
QALQSITFSATALGLPRTVTITVT

SEQ ID NO: 949034 - protein, 22 aa, Mycobacterium
QANLVEITLPDDTPWGGKPVRK

SEQ ID NO: 949035 - protein, 25 aa, Mycobacterium
QANVVKIIGNFLIASAIQSLSEAVS

SEQ ID NO: 949036 - protein, 24 aa, Mycobacterium
QAPTHDAVTYWKLLDSPPTGRDPL

SEQ ID NO: 949037 - protein, 22 aa, Mycobacterium
QAQFAAPIWTPRARRDEIRLVQ

SEQ ID NO: 949038 - protein, 17 aa, Mycobacterium
QAQKFVDLVTSAAGQQI

SEQ ID NO: 949039 - protein, 20 aa, Mycobacterium
QASQKVFGFAPYPGVAPGHP

SEQ ID NO: 949040 - protein, 17 aa, Mycobacterium
QASTEILLSLGLADRMV

SEQ ID NO: 949041 - protein, 17 aa, Mycobacterium
QATGRLYFDVRGGTAPD

SEQ ID NO: 949042 - protein, 19 aa, Mycobacterium
QAVAMPYRTLFMTLQQLLV

SEQ ID NO: 949043 - protein, 20 aa, Mycobacterium
QAVELPYLGGDLKMLIVLPA

SEQ ID NO: 949044 - protein, 18 aa, Mycobacterium
QAVKKVLLDDGELAKLLG

SEQ ID NO: 949045 - protein, 20 aa, Mycobacterium
QAVLSPNYPIPSGALVKGTP

SEQ ID NO: 949046 - protein, 26 aa, Mycobacterium
QAVRNSMDDAWFRDLAFVQGPVDLSL

SEQ ID NO: 949047 - protein, 31 aa, Mycobacterium
QAVSAQAAAFHDRFVQALTASAESYAGAEAA

SEQ ID NO: 949048 - protein, 25 aa, Mycobacterium
QAWQGPASKAMLAAAAPYAGWLNTA

SEQ ID NO: 949049 - protein, 30 aa, Mycobacterium
QAYQRLGAQVAMFHQQFVQSLNVGAELYAA

SEQ ID NO: 949050 - protein, 18 aa, Mycobacterium
QCEWIPPQLLDRGQHRTN

SEQ ID NO: 949051 - protein, 21 aa, Mycobacterium
QCRLLIRSRLALRHPGEVVAA

SEQ ID NO: 949052 - protein, 20 aa, Mycobacterium
QCSPRCWPPWEPPPAPGEPT

SEQ ID NO: 949053 - protein, 22 aa, Mycobacterium
QCTDLPKIPYGKAPPFVVTDTG

SEQ ID NO: 949054 - protein, 22 aa, Mycobacterium
QDALDLLELGLGGPLRSERLQE

SEQ ID NO: 949055 - protein, 26 aa, Mycobacterium
QDATLRHLPLTLVHMVNAAVPMWPEM

SEQ ID NO: 949056 - protein, 23 aa, Mycobacterium
QDEPAYQAAMRNLLKSLIVVKAE

SEQ ID NO: 949057 - protein, 20 aa, Mycobacterium
QDFGPDFGLSYVLDGLTAMG

SEQ ID NO: 949058 - protein, 26 aa, Mycobacterium
QDGLCSYFWQHNWGSPKGFVHPEAHL

SEQ ID NO: 949059 - protein, 25 aa, Mycobacterium
QDIAVLQLRGAAGLPTAAIGGEARV

SEQ ID NO: 949060 - protein, 20 aa, Mycobacterium
QDRRYAIVNLLASTTAVAQE

SEQ ID NO: 949061 - protein, 17 aa, Mycobacterium
QDRVALVALPARSAHEV

SEQ ID NO: 949062 - protein, 18 aa, Mycobacterium
QDRWIWEQTLENWNATIA

SEQ ID NO: 949063 - protein, 26 aa, Mycobacterium
QDTLSTLMELLGKIFAPANPPVVSYQ

SEQ ID NO: 949064 - protein, 23 aa, Mycobacterium
QDWPILAHAPAPLPPTVGSRTIS

SEQ ID NO: 949065 - protein, 23 aa, Mycobacterium
QDYDQRISVNWPAEARPYTGEDD

SEQ ID NO: 949066 - protein, 24 aa, Mycobacterium
QDYKGLFLSFNLNLNVPPPCRTGY

SEQ ID NO: 949067 - protein, 17 aa, Mycobacterium
QDYMGDYLVFNLNLNVP

SEQ ID NO: 949068 - protein, 18 aa, Mycobacterium
QEALLADDRIRHLRGRVA

SEQ ID NO: 949069 - protein, 21 aa, Mycobacterium
QEGILVPGDSPFRTIDDLVAA

SEQ ID NO: 949070 - protein, 19 aa, Mycobacterium
QEIIKRRGELPRGLGVGPN

SEQ ID NO: 949071 - protein, 23 aa, Mycobacterium
QEKAEKFTAIAASAYCPDAISST

SEQ ID NO: 949072 - protein, 18 aa, Mycobacterium
QEPCEFPDTLHPLDKDRA

SEQ ID NO: 949073 - protein, 41 aa, Mycobacterium
QESELLFWVLNTGCPGVFIRLGGNRWTFHTGFDPAREAVSD

SEQ ID NO: 949074 - protein, 24 aa, Mycobacterium
QETSFKFMFRHLRGYFTKDLDQLV

SEQ ID NO: 949075 - protein, 24 aa, Mycobacterium
QFAAPVWMPRAKRMPIRDVQEAIE

SEQ ID NO: 949076 - protein, 19 aa, Mycobacterium
QFAGYADRGDAFAAAVRAA

SEQ ID NO: 949077 - protein, 17 aa, Mycobacterium
QFDTLWLETMLGHHQGG

SEQ ID NO: 949078 - protein, 25 aa, Mycobacterium
QFGGRPHPTILAAAALLGVDEVWAV

SEQ ID NO: 949079 - protein, 17 aa, Mycobacterium
QFLPSTFAGYGQGGDIH

SEQ ID NO: 949080 - protein, 18 aa, Mycobacterium
QFMDFRYTVHDKWHGEFH

SEQ ID NO: 949081 - protein, 18 aa, Mycobacterium
QFNASPIAQGWLHSFLAS

SEQ ID NO: 949082 - protein, 25 aa, Mycobacterium
QFNTSPMAQGMLRNFLAAAPAERQQ

SEQ ID NO: 949083 - protein, 20 aa, Mycobacterium
QFPGPILRIRQGDNLRILLK

SEQ ID NO: 949084 - protein, 25 aa, Mycobacterium
QFQAKYPMYMIIRRQLTDAAVRPAT

SEQ ID NO: 949085 - protein, 24 aa, Mycobacterium
QFQAKYPMYRIIRQQLTEAAVRPA

SEQ ID NO: 949086 - protein, 17 aa, Mycobacterium
QFRPEVSDGLFLRLAVT

SEQ ID NO: 949087 - protein, 25 aa, Mycobacterium
QFVFHNMSEPLHFICGAIGAVENVT

SEQ ID NO: 949088 - protein, 23 aa, Mycobacterium
QFVVKTVVGMLDWGLDPQQAVSM

SEQ ID NO: 949089 - protein, 33 aa, Mycobacterium
QFWIMKPTDWNNRWWITCMVAFQTSYGVIQQSL

SEQ ID NO: 949090 - protein, 24 aa, Mycobacterium
QGAKGWPTLAWQTLARRGVQINAD

SEQ ID NO: 949091 - protein, 26 aa, Mycobacterium
QGASAAKFTFLSAAHYCPKYITGEDR

SEQ ID NO: 949092 - protein, 25 aa, Mycobacterium
QGDMYSVPFYGESSFLMYRKDLFEQ

SEQ ID NO: 949093 - protein, 33 aa, Mycobacterium
QGEGMTGMPAAGDLPPLLVRSDGNGKLVATTDT

SEQ ID NO: 949094 - protein, 18 aa, Mycobacterium
QGFLERDLLGRPASTPPN

SEQ ID NO: 949095 - protein, 25 aa, Mycobacterium
QGGSIGLGFAIPVDQAKRIADEIIQ

SEQ ID NO: 949096 - protein, 27 aa, Mycobacterium
QGHVLERLFPGIGKLDEQFPGLGADGP

SEQ ID NO: 949097 - protein, 25 aa, Mycobacterium
QGIAQLFDVPPLAPKELKIATAEGG

SEQ ID NO: 949098 - protein, 18 aa, Mycobacterium
QGIYLNYIGSAGGVFQRG

SEQ ID NO: 949099 - protein, 25 aa, Mycobacterium
QGKAALELNWPYVFASMLENAVKGG

SEQ ID NO: 949100 - protein, 24 aa, Mycobacterium
QGKPIGFIRLPERCANLTFGGPEN

SEQ ID NO: 949101 - protein, 25 aa, Mycobacterium
QGKQYEGMVVWFNTLLQSAGGQVLS

SEQ ID NO: 949102 - protein, 19 aa, Mycobacterium
QGLGWEQYSYPVTLDQLLA

SEQ ID NO: 949103 - protein, 25 aa, Mycobacterium
QGLSQFGINLPPMPSLTGGAATPSL

SEQ ID NO: 949104 - protein, 25 aa, Mycobacterium
QGNDLVLDTLSFYKPKQAGSYPIVL

SEQ ID NO: 949105 - protein, 29 aa, Mycobacterium
QGNDLVLDTLSFYKPTQPGSYPIVLATYE

SEQ ID NO: 949106 - protein, 30 aa, Mycobacterium
QGNDLVLDTVSFYKPTKPGSYPIVLATYEI

SEQ ID NO: 949107 - protein, 31 aa, Mycobacterium
QGPQKFDPTLQKPILDSIVASKPDALLVAPT

SEQ ID NO: 949108 - protein, 18 aa, Mycobacterium
QGQTTFRQILALASTTYT

SEQ ID NO: 949109 - protein, 18 aa, Mycobacterium
QGRGLARLARRVWPDARW

SEQ ID NO: 949110 - protein, 26 aa, Mycobacterium
QGSPPTLFSPGYYNQLTVPVAVVDAN

SEQ ID NO: 949111 - protein, 26 aa, Mycobacterium
QGSRALLLDFTFDKLAQFPKAVMLRL

SEQ ID NO: 949112 - protein, 24 aa, Mycobacterium
QGTDALMMMPATTQGLDAVLKQAE

SEQ ID NO: 949113 - protein, 17 aa, Mycobacterium
QGVGFGGWYSPIALRVD

SEQ ID NO: 949114 - protein, 23 aa, Mycobacterium
QGVGPLRCRILLDGNVVADAQSA

SEQ ID NO: 949115 - protein, 19 aa, Mycobacterium
QGYALLSRMAEQGWVCLSI

SEQ ID NO: 949116 - protein, 26 aa, Mycobacterium
QGYTYKWETFLTREMPAWLQANKGVS

SEQ ID NO: 949117 - protein, 19 aa, Mycobacterium
QHHFPFIDPELRLTTTNDL

SEQ ID NO: 949118 - protein, 24 aa, Mycobacterium
QHRPEVIFHLAAQIDVRHSVADPQ

SEQ ID NO: 949119 - protein, 20 aa, Mycobacterium
QHYRRFNATVPQLIQWDDHE

SEQ ID NO: 949120 - protein, 29 aa, Mycobacterium
QIAFGDKVLPLYLPTSDGLIGLLSQTQYA

SEQ ID NO: 949121 - protein, 17 aa, Mycobacterium
QIAQWPVGNIRILNSED

SEQ ID NO: 949122 - protein, 21 aa, Mycobacterium
QIAYEIVRTPAPLASPEQRRE

SEQ ID NO: 949123 - protein, 24 aa, Mycobacterium
QIDVNLFQHLRFLGEYNVADNATL

SEQ ID NO: 949124 - protein, 17 aa, Mycobacterium
QIELTPPYHGGPTLEDH

SEQ ID NO: 949125 - protein, 27 aa, Mycobacterium
QIGLDEYGYIPLPSSFQSKLIPVVNAI

SEQ ID NO: 949126 - protein, 18 aa, Mycobacterium
QIGRPIDLAGPAAGVAVA

SEQ ID NO: 949127 - protein, 23 aa, Mycobacterium
QIPLDTFVKAWATSHDFMTVTQE

SEQ ID NO: 949128 - protein, 32 aa, Mycobacterium
QIPSWEPLPIQYIDFALWQRAYLGDPQDPDSM

SEQ ID NO: 949129 - protein, 24 aa, Mycobacterium
QIREDWGPLYQKAIGWLNNPVGSL

SEQ ID NO: 949130 - protein, 19 aa, Mycobacterium
QISAIRSFIQQGVDVIAFS

SEQ ID NO: 949131 - protein, 22 aa, Mycobacterium
QISRYLGIIAVAAALVGAPLAA

SEQ ID NO: 949132 - protein, 17 aa, Mycobacterium
QIWANISAVARQLKGFI

SEQ ID NO: 949133 - protein, 18 aa, Mycobacterium
QKFLTFITSKAGQEVLEK

SEQ ID NO: 949134 - protein, 25 aa, Mycobacterium
QKKAFLTAHPMLAHVPAIVHRRFAV

SEQ ID NO: 949135 - protein, 18 aa, Mycobacterium
QKLHTLGAHAAWGGSGSR

SEQ ID NO: 949136 - protein, 18 aa, Mycobacterium
QKLLAVLVADNPGVWMLH

SEQ ID NO: 949137 - protein, 18 aa, Mycobacterium
QKQPKLPPPAAVLRITPA

SEQ ID NO: 949138 - protein, 17 aa, Mycobacterium
QKVVAFAAANNLKVAPR

SEQ ID NO: 949139 - protein, 19 aa, Mycobacterium
QLAAIAPTVFTAAPGAAWE

SEQ ID NO: 949140 - protein, 17 aa, Mycobacterium
QLAAPFVLLHRALACQG

SEQ ID NO: 949141 - protein, 21 aa, Mycobacterium
QLAAQRPVLDKALRTIPDALA

SEQ ID NO: 949142 - protein, 17 aa, Mycobacterium
QLAFGARVGQRLAEARE

SEQ ID NO: 949143 - protein, 24 aa, Mycobacterium
QLAGAITVALGFPAGGRVNATNGL

SEQ ID NO: 949144 - protein, 20 aa, Mycobacterium
QLAGFATPYLDLFQVGFIDV

SEQ ID NO: 949145 - protein, 21 aa, Mycobacterium
QLAPGSVLAIEPMLTLGTGKT

SEQ ID NO: 949146 - protein, 21 aa, Mycobacterium
QLDLHPDIHLFSAIPEVRSST

SEQ ID NO: 949147 - protein, 19 aa, Mycobacterium
QLDSLLTALAHRGDPLPGV

SEQ ID NO: 949148 - protein, 24 aa, Mycobacterium
QLFERVQPTLPILLANLVSLGQVA

SEQ ID NO: 949149 - protein, 29 aa, Mycobacterium
QLGKGGGTLPITLYIVDVKAAGTSTTPGG

SEQ ID NO: 949150 - protein, 18 aa, Mycobacterium
QLGLIHVEPPRSLAAGFY

SEQ ID NO: 949151 - protein, 17 aa, Mycobacterium
QLHARSVTEFVIRHADA

SEQ ID NO: 949152 - protein, 18 aa, Mycobacterium
QLIFAPEGALAAVPARRA

SEQ ID NO: 949153 - protein, 39 aa, Mycobacterium
QLIVFAVLTVVSLLVLGVYYLRIPSLAGIGRYTLKAELP

SEQ ID NO: 949154 - protein, 18 aa, Mycobacterium
QLKNWVATLTLGIDQGVK

SEQ ID NO: 949155 - protein, 19 aa, Mycobacterium
QLLEAAAAQLAGIGSSIST

SEQ ID NO: 949156 - protein, 23 aa, Mycobacterium
QLLGTTLTMGAAGAAGWFVTLEI

SEQ ID NO: 949157 - protein, 22 aa, Mycobacterium
QLLIAAAFAAATLAPVAVPFQA

SEQ ID NO: 949158 - protein, 32 aa, Mycobacterium
QLLPVYDKPMVYYPLSTLILAGIRDVLVITAP

SEQ ID NO: 949159 - protein, 17 aa, Mycobacterium
QLLQLGLESLRLWHSGF

SEQ ID NO: 949160 - protein, 25 aa, Mycobacterium
QLLQREVIVTRYLTVPAEDAAPRIR

SEQ ID NO: 949161 - protein, 18 aa, Mycobacterium
QLLVLERDKLNGPDAHVK

SEQ ID NO: 949162 - protein, 17 aa, Mycobacterium
QLMRHTAWFGAAVGLSV

SEQ ID NO: 949163 - protein, 26 aa, Mycobacterium
QLNDIALYLNFTMLGSPNAGFFTDDG

SEQ ID NO: 949164 - protein, 18 aa, Mycobacterium
QLNGWKLEFDLPAGESIT

SEQ ID NO: 949165 - protein, 26 aa, Mycobacterium
QLNSIALYLNFDMLGSPNAGYFTDDG

SEQ ID NO: 949166 - protein, 19 aa, Mycobacterium
QLPALVGLAALTAAALVAS

SEQ ID NO: 949167 - protein, 25 aa, Mycobacterium
QLQASDLVPYRTLAAQAPVGVMVGH

SEQ ID NO: 949168 - protein, 29 aa, Mycobacterium
QLQSNLKVPYLLKSLPWSQFLPLQDGKGM

SEQ ID NO: 949169 - protein, 20 aa, Mycobacterium
QLRHALFPIGDTPKPQIRAE

SEQ ID NO: 949170 - protein, 21 aa, Mycobacterium
QLRHALFPIGDTPKPQIRAEA

SEQ ID NO: 949171 - protein, 24 aa, Mycobacterium
QLRSWLYDGELDVALLFGVTDQTA

SEQ ID NO: 949172 - protein, 26 aa, Mycobacterium
QLSDARAFFLFRTPEPLDYHHRDVGR

SEQ ID NO: 949173 - protein, 20 aa, Mycobacterium
QLSDVPLPWSQTVSTSLPAV

SEQ ID NO: 949174 - protein, 24 aa, Mycobacterium
QLSDVTIAGYLPQGQLYSADVTAR

SEQ ID NO: 949175 - protein, 27 aa, Mycobacterium
QLSIHRGRLQMLLLAAVRERLGADAVR

SEQ ID NO: 949176 - protein, 28 aa, Mycobacterium
QLSKDGHRFWMLPATPQTTQWGVYDNKI

SEQ ID NO: 949177 - protein, 19 aa, Mycobacterium
QLTAQPMLDLLPGSSYQVL

SEQ ID NO: 949178 - protein, 18 aa, Mycobacterium
QLTAWDYYQTIDTPVNNE

SEQ ID NO: 949179 - protein, 26 aa, Mycobacterium
QLVEPGFLPLHQYSWRIMPENLEDAG

SEQ ID NO: 949180 - protein, 17 aa, Mycobacterium
QLVEQPLIGLGAGVTVR

SEQ ID NO: 949181 - protein, 45 aa, Mycobacterium
QLVPTDYYSWARLVIDPRLPRLDYDPTLWRAFVERARYRADGGSL

SEQ ID NO: 949182 - protein, 17 aa, Mycobacterium
QLVRSDFRAGCPVVAVA

SEQ ID NO: 949183 - protein, 18 aa, Mycobacterium
QLVSLVVSNLFGQNAPAI

SEQ ID NO: 949184 - protein, 25 aa, Mycobacterium
QMFKVQLWDFFAPGGFTFTDPITPE

SEQ ID NO: 949185 - protein, 28 aa, Mycobacterium
QMLDGPSALFRPHLLRRMAKAGMTRGRN

SEQ ID NO: 949186 - protein, 23 aa, Mycobacterium
QMMQPLMGMFANPGAMGMGGATP

SEQ ID NO: 949187 - protein, 28 aa, Mycobacterium
QMNLPPNYLMFFRVLGGLIGIAAQLDAP

SEQ ID NO: 949188 - protein, 30 aa, Mycobacterium
QMPALNTPQFSWVLSRLPRQPQPVPPIYQP

SEQ ID NO: 949189 - protein, 27 aa, Mycobacterium
QMPAPPPPMFPWMQPTPQPLAPQPGCT

SEQ ID NO: 949190 - protein, 24 aa, Mycobacterium
QMPLPVMIGLALLSAALSTAPAAH

SEQ ID NO: 949191 - protein, 27 aa, Mycobacterium
QMRAPQWFPDVQKLTNILPNLSRLHRD

SEQ ID NO: 949192 - protein, 19 aa, Mycobacterium
QMRSIGLFGLMIPEQYGGL

SEQ ID NO: 949193 - protein, 19 aa, Mycobacterium
QMRTAAPDFRLFWDNAYAV

SEQ ID NO: 949194 - protein, 21 aa, Mycobacterium
QMTRELIPAFTQRGSGHFVFV

SEQ ID NO: 949195 - protein, 24 aa, Mycobacterium
QMTRYLDPVLLWTVAATATSRVRL

SEQ ID NO: 949196 - protein, 24 aa, Mycobacterium
QMTRYLDPVLLWTVAATATTRIRL

SEQ ID NO: 949197 - protein, 19 aa, Mycobacterium
QMYGLPKTGYAASAAPITD

SEQ ID NO: 949198 - protein, 30 aa, Mycobacterium
QNFSGRARMSSMLWTFKVQKDNGVACPGGG

SEQ ID NO: 949199 - protein, 21 aa, Mycobacterium
QNGADGGLLWGNGGTGGTGDA

SEQ ID NO: 949200 - protein, 17 aa, Mycobacterium
QNLALPVRSTRVDGVYW

SEQ ID NO: 949201 - protein, 21 aa, Mycobacterium
QNLPYRIEFSTFTSGPPMVEA

SEQ ID NO: 949202 - protein, 25 aa, Mycobacterium
QNLQRPLRELGKSGPYLLGALKIFL

SEQ ID NO: 949203 - protein, 23 aa, Mycobacterium
QNLVDHHLDLENILHAAPNAFGN

SEQ ID NO: 949204 - protein, 17 aa, Mycobacterium
QNMQDAFTAIRCVDDVY

SEQ ID NO: 949205 - protein, 20 aa, Mycobacterium
QNPDGYLLPFHLDTAVNSVQ

SEQ ID NO: 949206 - protein, 21 aa, Mycobacterium
QNRFAAASWLGSLRSRGGTEM

SEQ ID NO: 949207 - protein, 28 aa, Mycobacterium
QNRLQIPLLERGILQRLLRSRTIAVLFG

SEQ ID NO: 949208 - protein, 19 aa, Mycobacterium
QNTWERNGGLRYAPRADLA

SEQ ID NO: 949209 - protein, 19 aa, Mycobacterium
QNVRPKILSPQYSEYQVLE

SEQ ID NO: 949210 - protein, 26 aa, Mycobacterium
QNYTYKWETFLTQEMPLWLQANKQVS

SEQ ID NO: 949211 - protein, 25 aa, Mycobacterium
QNYTYKWETFLTQEMPLWMQANKQI

SEQ ID NO: 949212 - protein, 23 aa, Mycobacterium
QPALIANLVAYGIPIYRADEDTP

SEQ ID NO: 949213 - protein, 33 aa, Mycobacterium
QPAPEPVSAWAPPPPPPSMPPLQPSPTIEGGGW

SEQ ID NO: 949214 - protein, 27 aa, Mycobacterium
QPEIDTFTGWLKQWNQPLMPEGHDPAG

SEQ ID NO: 949215 - protein, 22 aa, Mycobacterium
QPEINILNVFLVQWDENPDIRT

SEQ ID NO: 949216 - protein, 18 aa, Mycobacterium
QPESVKVSFWYDSKYKVP

SEQ ID NO: 949217 - protein, 20 aa, Mycobacterium
QPGDKWIVTSGTLFRDNGTA

SEQ ID NO: 949218 - protein, 25 aa, Mycobacterium
QPGDPRVAPWYFDWIRHSTRDDYWK

SEQ ID NO: 949219 - protein, 23 aa, Mycobacterium
QPGTPAMPVPFPRTGQGGEPRMT

SEQ ID NO: 949220 - protein, 17 aa, Mycobacterium
QPMTPQLGLVEPVTFSV

SEQ ID NO: 949221 - protein, 27 aa, Mycobacterium
QPNLEQILALYPIEIAGLQGAALANRN

SEQ ID NO: 949222 - protein, 25 aa, Mycobacterium
QPNPNPQLPGLPALAQLSPIIQQAA

SEQ ID NO: 949223 - protein, 26 aa, Mycobacterium
QPNSVGQLLFFDRQTPLGTATPEPRP

SEQ ID NO: 949224 - protein, 20 aa, Mycobacterium
QPPPGVTYTQAAVGLTHTVL

SEQ ID NO: 949225 - protein, 17 aa, Mycobacterium
QPPTGFVQLIDLTGAPD

SEQ ID NO: 949226 - protein, 27 aa, Mycobacterium
QPQPRRVKITFWYESRYQVPADAKAVI

SEQ ID NO: 949227 - protein, 29 aa, Mycobacterium
QPQQQLVELLLRAIAPPGAPDALLPGAGL

SEQ ID NO: 949228 - protein, 26 aa, Mycobacterium
QPQQQQLIELLLRAITPPEDPAALLP

SEQ ID NO: 949229 - protein, 33 aa, Mycobacterium
QPQTWALHVGGPLPLDPVLPAPAPAPAPAPAPG

SEQ ID NO: 949230 - protein, 28 aa, Mycobacterium
QPRFARGALLAFAGLTAFSVAACGTHGD

SEQ ID NO: 949231 - protein, 19 aa, Mycobacterium
QPRNKGLRFEFYANLDTAY

SEQ ID NO: 949232 - protein, 28 aa, Mycobacterium
QPRRVDGAHLPWSLEIKSTSASLTGNIV

SEQ ID NO: 949233 - protein, 25 aa, Mycobacterium
QPRSNTFHRWLDDTYLVPQSVTAGK

SEQ ID NO: 949234 - protein, 20 aa, Mycobacterium
QPRVLAFKQQVLDRQGAVPS

SEQ ID NO: 949235 - protein, 29 aa, Mycobacterium
QPSPTQELPGLPALSQLSPIIQQAATDPA

SEQ ID NO: 949236 - protein, 20 aa, Mycobacterium
QPSRFRTPDWFASHCYLVVV

SEQ ID NO: 949237 - protein, 32 aa, Mycobacterium; identical to SEQ ID NO: 116884

SEQ ID NO: 949238 - protein, 30 aa, Mycobacterium
QPSSTPPPPPPLPPTPFPKECPAPGVMQGC

SEQ ID NO: 949239 - protein, 17 aa, Mycobacterium
QPTFVLSDKGRDAAKDQ

SEQ ID NO: 949240 - protein, 26 aa, Mycobacterium
QPVELPSGWVASAVGFLPAPAAAAAR

SEQ ID NO: 949241 - protein, 18 aa, Mycobacterium
QPVTAASVKISPSVNGAC

SEQ ID NO: 949242 - protein, 27 aa, Mycobacterium
QQAAFDRIHWFFSLDPVGRRQYSENTA

SEQ ID NO: 949243 - protein, 25 aa, Mycobacterium
QQAGMRIVLHFPYSANVHCEIDVDD

SEQ ID NO: 949244 - protein, 17 aa, Mycobacterium
QQGIHDFGYHISHLDLP

SEQ ID NO: 949245 - protein, 27 aa, Mycobacterium
QQIAKLWNTIWDLKPGLDLKNFPSSGP

SEQ ID NO: 949246 - protein, 19 aa, Mycobacterium
QQLERLTALLQPTEPGEVS

SEQ ID NO: 949247 - protein, 17 aa, Mycobacterium
QQLIDQLALERTVAAEI

SEQ ID NO: 949248 - protein, 23 aa, Mycobacterium
QQMLDQMKGIFDKATFTPQECAD

SEQ ID NO: 949249 - protein, 27 aa, Mycobacterium
QQNAIEQFVYAYIRACPGYTLDYNANG

SEQ ID NO: 949250 - protein, 25 aa, Mycobacterium
QQNAIEQFVYAYVRACPGYTLDYDA

SEQ ID NO: 949251 - protein, 17 aa, Mycobacterium
QQPPLPPPPQQPPPPQE

SEQ ID NO: 949252 - protein, 26 aa, Mycobacterium
QQRTALAEPGPVPAGLPVPGAPAPEA

SEQ ID NO: 949253 - protein, 17 aa, Mycobacterium
QQRVSVKWPAQAGPMTG

SEQ ID NO: 949254 - protein, 22 aa, Mycobacterium
QQVPMILGCSYINRLTGYGGNL

SEQ ID NO: 949255 - protein, 22 aa, Mycobacterium
QQVVMASLAHRVISGKTLSSPT

SEQ ID NO: 949256 - protein, 23 aa, Mycobacterium
QQWDTFLNGVFPLDRNRLTREWF

SEQ ID NO: 949257 - protein, 36 aa, Mycobacterium
QRAARLGVHPSLFIEHVYFWGDPLIDELFGQDHGAH

SEQ ID NO: 949258 - protein, 18 aa, Mycobacterium
QRAPFFVPLGVGAHLRAW

SEQ ID NO: 949259 - protein, 33 aa, Mycobacterium
QRCGSPAWNLPVVFGPIAITYNVKGLSSLSLDG

SEQ ID NO: 949260 - protein, 32 aa, Mycobacterium
QRCGSPAWNLPVVFGPIAITYNVTGLNSLSLD

SEQ ID NO: 949261 - protein, 22 aa, Mycobacterium
QRDPQVIIVCDYGVGPNNTAQA

SEQ ID NO: 949262 - protein, 26 aa, Mycobacterium
QREVTEFFDVLPLMADNLYNAVDQRN

SEQ ID NO: 949263 - protein, 21 aa, Mycobacterium
QRFDTFAAATYMNGPSSSYLT

SEQ ID NO: 949264 - protein, 21 aa, Mycobacterium
QRGVVSVPITVTIPPANAAPT

SEQ ID NO: 949265 - protein, 32 aa, Mycobacterium
QRIRWVIGLFLGLQLVLASTLAWTPATAGVPP

SEQ ID NO: 949266 - protein, 26 aa, Mycobacterium
QRISAQAMAFHDQFARSLSAASGSYA

SEQ ID NO: 949267 - protein, 18 aa, Mycobacterium
QRIVLTRNPKWWGQRPRL

SEQ ID NO: 949268 - protein, 18 aa, Mycobacterium
QRLEPVDGKLVCLVRAAS

SEQ ID NO: 949269 - protein, 18 aa, Mycobacterium
QRLPLVGSWVRQGIDELS

SEQ ID NO: 949270 - protein, 25 aa, Mycobacterium
QRLTRMRDFYAFMLDEIPALLERWQ

SEQ ID NO: 949271 - protein, 18 aa, Mycobacterium
QRLTSALVISQWCRLPSG

SEQ ID NO: 949272 - protein, 23 aa, Mycobacterium
QRNPDVIVIYDYFGTPSVEDKWA

SEQ ID NO: 949273 - protein, 22 aa, Mycobacterium
QRNQWLVVDNIPGGAPIPQEVF

SEQ ID NO: 949274 - protein, 25 aa, Mycobacterium
QRRASVLPLLDAYRIPGNPRRAAAT

SEQ ID NO: 949275 - protein, 29 aa, Mycobacterium
QRRLTRTTWMSGCRSWYLTKDGFNGSMYP

SEQ ID NO: 949276 - protein, 30 aa, Mycobacterium
QRRLTRTTWMSGCRSWYLTKDGYNGSMYPG

SEQ ID NO: 949277 - protein, 17 aa, Mycobacterium
QRRWWAADGHGAFVAFN

SEQ ID NO: 949278 - protein, 18 aa, Mycobacterium
QRRWWAGRGQGAFTAVQG

SEQ ID NO: 949279 - protein, 25 aa, Mycobacterium
QRSCLDIGLAERVLGWRPRVELAEG

SEQ ID NO: 949280 - protein, 27 aa, Mycobacterium
QRTEDQSMLFFPFVGGAGPNPLIITRG

SEQ ID NO: 949281 - protein, 21 aa, Mycobacterium
QRTKGITIRRAPAPAWSHITF

SEQ ID NO: 949282 - protein, 23 aa, Mycobacterium
QRTPGWVLPRLDFQHPDWAQRVF

SEQ ID NO: 949283 - protein, 18 aa, Mycobacterium
QRTRLPQHLGPGVRMVFY

SEQ ID NO: 949284 - protein, 25 aa, Mycobacterium
QRTSPQFFEILNFALRYAPVLPQEQ

SEQ ID NO: 949285 - protein, 19 aa, Mycobacterium
QRVRVLPRCDAVTVDPAAG

SEQ ID NO: 949286 - protein, 29 aa, Mycobacterium
QRVSARVYPALVPLTHPLASVNGAFNAVF

SEQ ID NO: 949287 - protein, 29 aa, Mycobacterium
QRVSYGPLLDVFLLDMRSYKDPNSPNRQQ

SEQ ID NO: 949288 - protein, 19 aa, Mycobacterium
QRVVAEMLDVLPLTLENLY

SEQ ID NO: 949289 - protein, 25 aa, Mycobacterium
QSAAAGFASLTSGLTGQFWQGAAAQ

SEQ ID NO: 949290 - protein, 27 aa, Mycobacterium
QSALIAASLTGLLWLAPTAHADPDPIS

SEQ ID NO: 949291 - protein, 17 aa, Mycobacterium
QSDARRLTYGSALLTNP

SEQ ID NO: 949292 - protein, 21 aa, Mycobacterium
QSDRPLGIPGEQLPGSVAAVD

SEQ ID NO: 949293 - protein, 34 aa, Mycobacterium; identical to SEQ ID NO: 850417

SEQ ID NO: 949294 - protein, 34 aa, Mycobacterium
QSFPTTQWVRWRKPVIGLPLTARLVAPGRVLAVT

SEQ ID NO: 949295 - protein, 24 aa, Mycobacterium
QSGGANSPALYLLDGMRAQDDFNG

SEQ ID NO: 949296 - protein, 24 aa, Mycobacterium
QSGGANSPALYLLDGMRAQDDFSG

SEQ ID NO: 949297 - protein, 24 aa, Mycobacterium
QSGGANSPALYLLDGMRAQEDFNG

SEQ ID NO: 949298 - protein, 20 aa, Mycobacterium
QSGLFNYSMSLAFSRDLEAD

SEQ ID NO: 949299 - protein, 24 aa, Mycobacterium
QSGSIGLGFAIPVDQAKRIADELI

SEQ ID NO: 949300 - protein, 20 aa, Mycobacterium
QSGVLFGTPGAGGAGGAGGA

SEQ ID NO: 949301 - protein, 17 aa, Mycobacterium
QSLPIGWQFVHIDVPSG

SEQ ID NO: 949302 - protein, 26 aa, Mycobacterium
QSLYPGGPYHLLGWSFGGIVVHELAV

SEQ ID NO: 949303 - protein, 20 aa, Mycobacterium
QSPLRTGGVRGLRIGLSVHL

SEQ ID NO: 949304 - protein, 17 aa, Mycobacterium
QSPPQFSGIFVSAGLTL

SEQ ID NO: 949305 - protein, 37 aa, Mycobacterium
QSVQQDLLGLVNAPTQALLGRPLIGNGANGAPGTGAN

SEQ ID NO: 949306 - protein, 36 aa, Mycobacterium
QSVQQDLLGLVNAPTQALLGRPLIGNGANGTAADPN

SEQ ID NO: 949307 - protein, 24 aa, Mycobacterium
QSVVFRPAFEFIESGWRELGVALQ

SEQ ID NO: 949308 - protein, 19 aa, Mycobacterium
QSWPAVMRQVYLDSRSVDS

SEQ ID NO: 949309 - protein, 27 aa, Mycobacterium
QSYPPKPPVGAALWKLMERARQIGLHV

SEQ ID NO: 949310 - protein, 20 aa, Mycobacterium
QTACMVLMDNKIMQGNITGI

SEQ ID NO: 949311 - protein, 30 aa, Mycobacterium
QTADLEHWPAFLKSFLRLSALIESAADHSS

SEQ ID NO: 949312 - protein, 19 aa, Mycobacterium
QTAGAAVPGGRPFDLETGS

SEQ ID NO: 949313 - protein, 18 aa, Mycobacterium
QTAQLHARSVTEFVIRHA

SEQ ID NO: 949314 - protein, 20 aa, Mycobacterium
QTDLAILNGLLGPTGQRVPQ

SEQ ID NO: 949315 - protein, 39 aa, Mycobacterium
QTEPDVWWDTFRLPPFGRYTLRMYFRPDVTGMTVYHCHI

SEQ ID NO: 949316 - protein, 33 aa, Mycobacterium
QTESPMLRLVVGALLLGLAFAGGYAVSAAKTVT

SEQ ID NO: 949317 - protein, 35 aa, Mycobacterium
QTFAVPLVGLALTCPVTLPVAFPVAFPVAQADPLS

SEQ ID NO: 949318 - protein, 17 aa, Mycobacterium
QTFTLTHWDADTFTFPL

SEQ ID NO: 949319 - protein, 19 aa, Mycobacterium
QTIAIERGLPVGVPSWMRA

SEQ ID NO: 949320 - protein, 26 aa, Mycobacterium
QTIGLQAHLPTPDPALTKALQAEIDD

SEQ ID NO: 949321 - protein, 17 aa, Mycobacterium
QTIPSFDIAKLFNGFRP

SEQ ID NO: 949322 - protein, 24 aa, Mycobacterium
QTLASISLILRGGGIPNLEVLQNE

SEQ ID NO: 949323 - protein, 24 aa, Mycobacterium
QTLASLSLILRGGGIPNLEVLQNE

SEQ ID NO: 949324 - protein, 20 aa, Mycobacterium
QTLIPPALVNGIPAAAAAPA

SEQ ID NO: 949325 - protein, 17 aa, Mycobacterium
QTLVLYRPDPDGDEVLG

SEQ ID NO: 949326 - protein, 26 aa, Mycobacterium
QTNALKLYDLPATPPPIFVAASGPKS

SEQ ID NO: 949327 - protein, 17 aa, Mycobacterium
QTPIAVSALDDLLLDVN

SEQ ID NO: 949328 - protein, 18 aa, Mycobacterium
QTPILQVGIIYQATADGT

SEQ ID NO: 949329 - protein, 33 aa, Mycobacterium
QTPSPMLRFVVGGLLVVLAFAGGFAVSACKTVT

SEQ ID NO: 949330 - protein, 25 aa, Mycobacterium
QTPTFDSWLSVLKQPGLRIGNPLED

SEQ ID NO: 949331 - protein, 22 aa, Mycobacterium
QTPTGRGLRLGGTGFGPFDDAG

SEQ ID NO: 949332 - protein, 37 aa, Mycobacterium
QTRVAVLLPAHWQTAAVLFGIWWIGAEIVLEGPADIA

SEQ ID NO: 949333 - protein, 26 aa, Mycobacterium
QTSRTLLLDFTLDTLAQFPKAVMLRL

SEQ ID NO: 949334 - protein, 30 aa, Mycobacterium
QTTELRTSDRLNYLWVQWADNPNTVEHNGG

SEQ ID NO: 949335 - protein, 21 aa, Mycobacterium
QTTLIPLSSLHRVFPGSVVDA

SEQ ID NO: 949336 - protein, 23 aa, Mycobacterium
QTTLRQFIDAPRDLRQRMAKAIV

SEQ ID NO: 949337 - protein, 26 aa, Mycobacterium
QTTTTPPPPLPGKPFPKQCPAEGVMQ

SEQ ID NO: 949338 - protein, 29 aa, Mycobacterium
QTVALPGFPNFFMMLGPHSPVGNLALTTV

SEQ ID NO: 949339 - protein, 25 aa, Mycobacterium
QTVARHLVMYLRRPGGQTQFAAPVW

SEQ ID NO: 949340 - protein, 37 aa, Mycobacterium
QTVGQDLVNVVNRPTQALLGRPLIGNGSDAASGSGAN

SEQ ID NO: 949341 - protein, 30 aa, Mycobacterium
QTWEARIKLDCLFPGLWPSFWGVNEDPLPD

SEQ ID NO: 949342 - protein, 18 aa, Mycobacterium
QTWQDDVFPPVAGIYRDD

SEQ ID NO: 949343 - protein, 24 aa, Mycobacterium
QTYLPWDSWDHPYTKPPKVWFSDL

SEQ ID NO: 949344 - protein, 25 aa, Mycobacterium
QTYTYKWETFLTRELPAWLAANRNV

SEQ ID NO: 949345 - protein, 20 aa, Mycobacterium
QVAQVLALAARFQSALDGTL

SEQ ID NO: 949346 - protein, 19 aa, Mycobacterium
QVCLPFYGALVTNCGLDRS

SEQ ID NO: 949347 - protein, 25 aa, Mycobacterium
QVDARVKDGKWAIWHAVGSNPKLSR

SEQ ID NO: 949348 - protein, 20 aa, Mycobacterium
QVDIDPTWARAHPGAQLPVT

SEQ ID NO: 949349 - protein, 26 aa, Mycobacterium
QVDLDSMDWLNFLLGIHKRMHVDIPE

SEQ ID NO: 949350 - protein, 17 aa, Mycobacterium
QVDLLTSLASLAAVAVA

SEQ ID NO: 949351 - protein, 24 aa, Mycobacterium
QVEILPGIQEINAGWYNGKPESMA

SEQ ID NO: 949352 - protein, 17 aa, Mycobacterium
QVFRFKPMTPNGAMNDP

SEQ ID NO: 949353 - protein, 26 aa, Mycobacterium
QVGLPTYAFARRRFWLDGSASAADVG

SEQ ID NO: 949354 - protein, 17 aa, Mycobacterium
QVGLVLPLVPMAHQYAR

SEQ ID NO: 949355 - protein, 30 aa, Mycobacterium
QVGWDTPVVSRLPWFALSDPTTTQMVTVGD

SEQ ID NO: 949356 - protein, 19 aa, Mycobacterium
QVIEPARNGVLRVGAKPGT

SEQ ID NO: 949357 - protein, 24 aa, Mycobacterium
QVKDSWMRRQLTPDFRPGCKRMLM

SEQ ID NO: 949358 - protein, 19 aa, Mycobacterium
QVLGSWSWAIPANSATPDA

SEQ ID NO: 949359 - protein, 26 aa, Mycobacterium
QVLLFAAEEKLPYERPPLSKDYLAGK

SEQ ID NO: 949360 - protein, 32 aa, Mycobacterium
QVMGVNFFAPMRMTLALLPRMLARGSGTIVNV

SEQ ID NO: 949361 - protein, 26 aa, Mycobacterium
QVNANPIAGAWLQQFVASPKPKRQQM

SEQ ID NO: 949362 - protein, 23 aa, Mycobacterium
QVNGLTWLPPAPMNNTYTLAIRE

SEQ ID NO: 949363 - protein, 17 aa, Mycobacterium
QVNIGMGAGMQAIAVVL

SEQ ID NO: 949364 - protein, 25 aa, Mycobacterium
QVPEPSWWKEGYLGFSLSSIFGSWA

SEQ ID NO: 949365 - protein, 23 aa, Mycobacterium
QVPIETFIKAWATSHDFLVVTTG

SEQ ID NO: 949366 - protein, 22 aa, Mycobacterium
QVPMALFMQAWATSQDFMAVTT

SEQ ID NO: 949367 - protein, 17 aa, Mycobacterium
QVQPVVFGAPLPQDPAP

SEQ ID NO: 949368 - protein, 25 aa, Mycobacterium
QVRKAILGLLDIDLLAAVGAGSDNT

SEQ ID NO: 949369 - protein, 31 aa, Mycobacterium
QVRTQTQLFQRLQLIYLFTTGHRKSSTLEGL

SEQ ID NO: 949370 - protein, 34 aa, Mycobacterium
QVSHVDARFNLSRAALLVVALSERPDLLMAATED

SEQ ID NO: 949371 - protein, 30 aa, Mycobacterium
QVSNNLAERLIWQDPITGEYKPWLAESYQT

SEQ ID NO: 949372 - protein, 19 aa, Mycobacterium
QVTCDDLVLAWAAESGRYA

SEQ ID NO: 949373 - protein, 22 aa, Mycobacterium
QVVAEWRRIDGRWKLASKSLCN

SEQ ID NO: 949374 - protein, 24 aa, Mycobacterium
QVVDAPLPWSFTITTTEPAVLGNV

SEQ ID NO: 949375 - protein, 21 aa, Mycobacterium
QVVLLASGLDCRAYRLQWPAE

SEQ ID NO: 949376 - protein, 17 aa, Mycobacterium
QVWSFDGGPPTATDSAW

SEQ ID NO: 949377 - protein, 19 aa, Mycobacterium
QWAENGWLVDLSDYARNTP

SEQ ID NO: 949378 - protein, 25 aa, Mycobacterium
QYASAGELFAALRRGEVAVAWTSTA

SEQ ID NO: 949379 - protein, 26 aa, Mycobacterium
QYASSVPGTTPAIWTGSPSPSGAKAA

SEQ ID NO: 949380 - protein, 20 aa, Mycobacterium
QYDPTLPFAGPSQGADPAKI

SEQ ID NO: 949381 - protein, 18 aa, Mycobacterium
QYGWLIPADGSEDTVWHY

SEQ ID NO: 949382 - protein, 27 aa, Mycobacterium
QYKEPDAMWVMPDLKGKVLFAAKQEVE

SEQ ID NO: 949383 - protein, 18 aa, Mycobacterium
QYLALTPDQRTALADPGQ

SEQ ID NO: 949384 - protein, 26 aa, Mycobacterium
QYLGPALRLLNFNNVPFPVSPYLMPS

SEQ ID NO: 949385 - protein, 19 aa, Mycobacterium
QYPSILVELGNMKSPVDSA

SEQ ID NO: 949386 - protein, 18 aa, Mycobacterium
QYRPVAEAQLRLAGERLA

SEQ ID NO: 949387 - protein, 31 aa, Mycobacterium
QYRVADILPLTPLQQGLFFHSLIGPGEASTD

SEQ ID NO: 949388 - protein, 19 aa, Mycobacterium
QYVWSVPHNVAGLVTALGG

SEQ ID NO: 949389 - protein, 21 aa, Mycobacterium
RAAEAALAPLATPAAIVAIQP

SEQ ID NO: 949390 - protein, 18 aa, Mycobacterium
RAAFWRYRRSRPLQASLP

SEQ ID NO: 949391 - protein, 23 aa, Mycobacterium
RAAGQTGFVWKFLDSVQTVDDHT

SEQ ID NO: 949392 - protein, 20 aa, Mycobacterium
RAAGVFIHKDAEPYVIQAGH

SEQ ID NO: 949393 - protein, 30 aa, Mycobacterium
RAALADPGPVPPTPPAPPAANPAIMAMPEA

SEQ ID NO: 949394 - protein, 26 aa, Mycobacterium
RAAQYWVMKPTYHNSFWFSSCMVTFK

SEQ ID NO: 949395 - protein, 24 aa, Mycobacterium
RAARGVRAHPPLPGDARTAGTTGT

SEQ ID NO: 949396 - protein, 24 aa, Mycobacterium
RAARGVRAHPPLPGDPGTAGTAGT

SEQ ID NO: 949397 - protein, 18 aa, Mycobacterium
RAARRLIDRGVQLTAEVL

SEQ ID NO: 949398 - protein, 20 aa, Mycobacterium
RAAYVRLPDRAARSALVGVT

SEQ ID NO: 949399 - protein, 26 aa, Mycobacterium
RADDVRLEWPLRPPPAIARGFDAPSP

SEQ ID NO: 949400 - protein, 24 aa, Mycobacterium
RADELARWLASRQPQLVSAAHWQA

SEQ ID NO: 949401 - protein, 23 aa, Mycobacterium
RADLLPPLANALRSGLERLLTWG

SEQ ID NO: 949402 - protein, 30 aa, Mycobacterium
RAEKYRSLMAKRIPLYRRVATIRVDTNRRN

SEQ ID NO: 949403 - protein, 23 aa, Mycobacterium
RAELGIELYAVIAAPVAGLAGAA

SEQ ID NO: 949404 - protein, 27 aa, Mycobacterium
RAENVVPLYRRNALSDRQLLAINEVAG

SEQ ID NO: 949405 - protein, 18 aa, Mycobacterium
RAEQYAQLSGLRLGRVLS

SEQ ID NO: 949406 - protein, 25 aa, Mycobacterium
RAETLVLCLALLHARTPDVPAIAAA

SEQ ID NO: 949407 - protein, 26 aa, Mycobacterium
RAEVLRPGLLALSVRGAARYFGSEVA

SEQ ID NO: 949408 - protein, 20 aa, Mycobacterium
RAEWTLPTFSPDGTQIAYTD

SEQ ID NO: 949409 - protein, 17 aa, Mycobacterium
RAFAAYELQMREPVHRS

SEQ ID NO: 949410 - protein, 20 aa, Mycobacterium
RAFTVAHDALWVIESKTGQA

SEQ ID NO: 949411 - protein, 17 aa, Mycobacterium
RAGFKGLCYFDPGARSF

SEQ ID NO: 949412 - protein, 17 aa, Mycobacterium
RAGLSQYYPAALAAFPD

SEQ ID NO: 949413 - protein, 25 aa, Mycobacterium
RAGNRAFFDWMNAQKLSYCLDFDDD

SEQ ID NO: 949414 - protein, 17 aa, Mycobacterium
RAGRLGGSVLPLEQVLP

SEQ ID NO: 949415 - protein, 29 aa, Mycobacterium
RAGWIGDYPSMIEFLAPLYATGAGSNDVG

SEQ ID NO: 949416 - protein, 30 aa, Mycobacterium
RAHIRLEKLGFLFQEYNLLNALTSAENVAL

SEQ ID NO: 949417 - protein, 31 aa, Mycobacterium
RAHVRAARLLVPHWQSVGSGYFVSVASAAGL

SEQ ID NO: 949418 - protein, 20 aa, Mycobacterium
RAIALLIGPLVLGKLSTLPD

SEQ ID NO: 949419 - protein, 18 aa, Mycobacterium
RAIRELEKELRAPLFDRG

SEQ ID NO: 949420 - protein, 18 aa, Mycobacterium
RAITGAGEHLTIIPSMDG

SEQ ID NO: 949421 - protein, 20 aa, Mycobacterium
RAIVVYIGTTKRPLAELKDR

SEQ ID NO: 949422 - protein, 28 aa, Mycobacterium
RAKGYEPMNFFAPLSRLKELDALPTADA

SEQ ID NO: 949423 - protein, 18 aa, Mycobacterium
RALAGIAASAALVLTACG

SEQ ID NO: 949424 - protein, 23 aa, Mycobacterium
RALANDLDRLIWAEGFSLPLTQS

SEQ ID NO: 949425 - protein, 28 aa, Mycobacterium
RALARSAFPVFVVSPYYGGTLGRGDDQV

SEQ ID NO: 949426 - protein, 17 aa, Mycobacterium
RALFDGTALAKLLDQPF

SEQ ID NO: 949427 - protein, 18 aa, Mycobacterium
RALLFAISHHELAGPVNV

SEQ ID NO: 949428 - protein, 22 aa, Mycobacterium
RALPALLIFVVTACTSPPAPVE

SEQ ID NO: 949429 - protein, 17 aa, Mycobacterium
RALQRLRRTFDDALLVA

SEQ ID NO: 949430 - protein, 37 aa, Mycobacterium
RALRMLSEPAPWQWLVELWRGISPHLGTFRDIVSIGQ

SEQ ID NO: 949431 - protein, 22 aa, Mycobacterium
RALRTPWNTYMAEGLPATAICS

SEQ ID NO: 949432 - protein, 17 aa, Mycobacterium
RALVNHVMGLSLAFRYA

SEQ ID NO: 949433 - protein, 20 aa, Mycobacterium
RAMGPMQFLPGTWARYASDG

SEQ ID NO: 949434 - protein, 29 aa, Mycobacterium
RANGGLFARAYPLFRLMGIDTVTPDTQVQ

SEQ ID NO: 949435 - protein, 25 aa, Mycobacterium
RANGMAPYLVRVLGVPSAPVQALPQ

SEQ ID NO: 949436 - protein, 25 aa, Mycobacterium
RANGMTPYMVRILGASAPTPQAPAQ

SEQ ID NO: 949437 - protein, 22 aa, Mycobacterium
RANGVSIRRAPAPNWYHLTFNG

SEQ ID NO: 949438 - protein, 22 aa, Mycobacterium
RANRLPQVSWLVPNILVSEHPA

SEQ ID NO: 949439 - protein, 28 aa, Mycobacterium
RAPDLRGYIWLVRNLSKRGWVVAITDYE

SEQ ID NO: 949440 - protein, 19 aa, Mycobacterium
RAPFLVPLGIGAHLRKWGI

SEQ ID NO: 949441 - protein, 21 aa, Mycobacterium
RAQQYAQLSGLRLGTVLSISE

SEQ ID NO: 949442 - protein, 20 aa, Mycobacterium
RARAYGDFLSYCLVAEGAVD

SEQ ID NO: 949443 - protein, 23 aa, Mycobacterium
RARELILEFADFTRYSFRAAGQF

SEQ ID NO: 949444 - protein, 26 aa, Mycobacterium
RARLSSRSRRRLAIALSAVAVAAGLA

SEQ ID NO: 949445 - protein, 24 aa, Mycobacterium
RARLTFGALLAVPTLLLGGCTVSP

SEQ ID NO: 949446 - protein, 17 aa, Mycobacterium
RARPILDPMAGKIIHCG

SEQ ID NO: 949447 - protein, 28 aa, Mycobacterium
RARSPFWKSLAVFWLALSVAACSSSTTS

SEQ ID NO: 949448 - protein, 26 aa, Mycobacterium
RARTLLIWTSVAAVALLVAGCARVVV

SEQ ID NO: 949449 - protein, 17 aa, Mycobacterium
RARWERLYQLVNHVLEH

SEQ ID NO: 949450 - protein, 21 aa, Mycobacterium
RASLYAATKFGIRGFALCLRD

SEQ ID NO: 949451 - protein, 32 aa, Mycobacterium
RASLYAATKFGIRGFALCLRDDLRPAGVGVSV

SEQ ID NO: 949452 - protein, 25 aa, Mycobacterium
RASPYLIGALKLILTQPFDIDTVPK

SEQ ID NO: 949453 - protein, 25 aa, Mycobacterium
RASPYLVGALKLILTQPFDIDTVPK

SEQ ID NO: 949454 - protein, 22 aa, Mycobacterium
RASSLEWIVLRLGGVLSVDPKA

SEQ ID NO: 949455 - protein, 25 aa, Mycobacterium
RASVMSRLWRRPAPGPAPSSCPEVG

SEQ ID NO: 949456 - protein, 20 aa, Mycobacterium
RATGQWLAGMKAGAEIYSDN

SEQ ID NO: 949457 - protein, 19 aa, Mycobacterium
RATPPRFVLASSVAVYGTR

SEQ ID NO: 949458 - protein, 19 aa, Mycobacterium
RAVALASAPLVAASLLSGC

SEQ ID NO: 949459 - protein, 28 aa, Mycobacterium
RAVCLIFTVLFMMSLSMTASVASADSMN

SEQ ID NO: 949460 - protein, 24 aa, Mycobacterium
RAVDSVSFRLRRASTLAIVGESGS

SEQ ID NO: 949461 - protein, 31 aa, Mycobacterium
RAVENPGTRLMILPPLIHGAAQWAAMTAVTT

SEQ ID NO: 949462 - protein, 23 aa, Mycobacterium
RAVGYFQQSVELMLALGLGESVV

SEQ ID NO: 949463 - protein, 23 aa, Mycobacterium
RAVIRAAVWLTAICALAACSSAD

SEQ ID NO: 949464 - protein, 26 aa, Mycobacterium
RAVLAALPDAVVVRSAWVYTGGTGSD

SEQ ID NO: 949465 - protein, 25 aa, Mycobacterium
RAVPMNAVYRWPALGAVATALTRTT

SEQ ID NO: 949466 - protein, 21 aa, Mycobacterium
RAVSPLVVQMYMPNGAAAAIG

SEQ ID NO: 949467 - protein, 32 aa, Mycobacterium
RAVSRRAWQGLALLMVALVLSSCGWRGISNVA

SEQ ID NO: 949468 - protein, 28 aa, Mycobacterium
RAVVPGWPWWPLVEVMKLLPPRFTKYFA

SEQ ID NO: 949469 - protein, 20 aa, Mycobacterium
RAWGRRLLVGTAAAVTLPGL

SEQ ID NO: 949470 - protein, 19 aa, Mycobacterium
RAWQAIVFGEADVAICGGV

SEQ ID NO: 949471 - protein, 22 aa, Mycobacterium
RAWVLAAMTALMLPMTACVETV

SEQ ID NO: 949472 - protein, 17 aa, Mycobacterium
RAYRLDWPAGHTVYEVD

SEQ ID NO: 949473 - protein, 26 aa, Mycobacterium
RCAPALLGAAAFLGAPRATAGVAGSA

SEQ ID NO: 949474 - protein, 36 aa, Mycobacterium
RCDGNPAWDLPLVFGPIALVYHLADVPALVVSSDAL

SEQ ID NO: 949475 - protein, 29 aa, Mycobacterium
RCGGNPAWNLPLVFGPVAMAYNLEGVDKL

SEQ ID NO: 949476 - protein, 32 aa, Mycobacterium
RCGGSDAWNLPAVFGPIAITYNVAGVDGLVLD

SEQ ID NO: 949477 - protein, 18 aa, Mycobacterium
RCGRNIVILAYSEFGRRV

SEQ ID NO: 949478 - protein, 27 aa, Mycobacterium
RCGSEAWDLPVVFGPIAVTYNINGVST

SEQ ID NO: 949479 - protein, 26 aa, Mycobacterium
RCGSPAWDLPTVFGPIAVTYNVNGVS

SEQ ID NO: 949480 - protein, 29 aa, Mycobacterium
RCGSPAWNLPVVFGPIAITYHVAGVTSLS

SEQ ID NO: 949481 - protein, 29 aa, Mycobacterium
RCGSPAWNLPVVFGPLAVTYNLAGVDALV

SEQ ID NO: 949482 - protein, 29 aa, Mycobacterium
RCGSQAWDLPTVFGPIAVTYHLTGVSGLK

SEQ ID NO: 949483 - protein, 17 aa, Mycobacterium
RCLAALQAMLFPDRASD

SEQ ID NO: 949484 - protein, 19 aa, Mycobacterium
RCNCIVPGAIDTELWRRWV

SEQ ID NO: 949485 - protein, 22 aa, Mycobacterium
RCPYHSWTYGLDGTLIAAPNIA

SEQ ID NO: 949486 - protein, 19 aa, Mycobacterium
RCTQIEWYRTIQIGDQASG

SEQ ID NO: 949487 - protein, 21 aa, Mycobacterium
RDAAPFMAYGEFTGLAPMPTC

SEQ ID NO: 949488 - protein, 21 aa, Mycobacterium
RDADWFVWYEHGGVGYFWQAV

SEQ ID NO: 949489 - protein, 19 aa, Mycobacterium
RDALTQYVEQSRKLAGAFD

SEQ ID NO: 949490 - protein, 23 aa, Mycobacterium
RDATFRWGVAMLPIGPVGRVSVT

SEQ ID NO: 949491 - protein, 19 aa, Mycobacterium
RDEFTARLAPLFDNAPRVP

SEQ ID NO: 949492 - protein, 26 aa, Mycobacterium
RDEGRWRVRWTSTGLHPKLGEHQTFA

SEQ ID NO: 949493 - protein, 25 aa, Mycobacterium
RDELADPGFFQWLAERRYASAAEEE

SEQ ID NO: 949494 - protein, 28 aa, Mycobacterium
RDETTGLFWTVYSLPAKIPPQPAQDLGE

SEQ ID NO: 949495 - protein, 31 aa, Mycobacterium
RDFDRQGVQLLFPLPLGISMVGLEEPALTPN

SEQ ID NO: 949496 - protein, 17 aa, Mycobacterium
RDFILNGWSTPDVVSRI

SEQ ID NO: 949497 - protein, 23 aa, Mycobacterium
RDFRYEFVLPEPGTYWYHSHANL

SEQ ID NO: 949498 - protein, 25 aa, Mycobacterium
RDGGYLPMNFAANDLAWSATNPSDV

SEQ ID NO: 949499 - protein, 23 aa, Mycobacterium
RDGHTTDCRLHWVQVGLTDPQPN

SEQ ID NO: 949500 - protein, 18 aa, Mycobacterium
RDGLTFTASDTAKGGVIV

SEQ ID NO: 949501 - protein, 27 aa, Mycobacterium
RDGVARYQCRIQLVLAANLCPCAPPDP

SEQ ID NO: 949502 - protein, 26 aa, Mycobacterium
RDIHRRLLTRLSAFKVPHRFAVVERL

SEQ ID NO: 949503 - protein, 17 aa, Mycobacterium
RDIWADGPVTFLGLMVP

SEQ ID NO: 949504 - protein, 31 aa, Mycobacterium
RDLQRALLRIAYRLIVLFVVEDRDLLHGAAA

SEQ ID NO: 949505 - protein, 17 aa, Mycobacterium
RDMARITGVPLALGMAQ

SEQ ID NO: 949506 - protein, 24 aa, Mycobacterium
RDNEYVVGWIKRGPVGVIGTNKSD

SEQ ID NO: 949507 - protein, 23 aa, Mycobacterium
RDNGYLPMTFAANDIAWSDKNPS

SEQ ID NO: 949508 - protein, 25 aa, Mycobacterium
RDNLSWWNRTWTPQLVPKGAMLEVQ

SEQ ID NO: 949509 - protein, 36 aa, Mycobacterium
RDQGHWYSTGADFKRPSPQWWFDDETLYGPDGLAVP

SEQ ID NO: 949510 - protein, 30 aa, Mycobacterium
RDQLALLVPELLLIGQLIDRSGMAYCIQHF

SEQ ID NO: 949511 - protein, 23 aa, Mycobacterium
RDRFAGMGWLVPEVLERCPPSAD

SEQ ID NO: 949512 - protein, 25 aa, Mycobacterium
RDRLLSAALRLFAAKGYAATSVADI

SEQ ID NO: 949513 - protein, 32 aa, Mycobacterium
RDRPPTWSRGAPPQWWLATPISLNTAGINAPG

SEQ ID NO: 949514 - protein, 20 aa, Mycobacterium
RDRRYVIVNLLANTSAVARQ

SEQ ID NO: 949515 - protein, 24 aa, Mycobacterium
RDSSGGLLIRCAIRFDITVSTAQA

SEQ ID NO: 949516 - protein, 23 aa, Mycobacterium
RDTDLMIGALRTLGLRVDGAGSE

SEQ ID NO: 949517 - protein, 23 aa, Mycobacterium
RDTDLMIGALRTLGLRVDGDGTE

SEQ ID NO: 949518 - protein, 22 aa, Mycobacterium
RDTFRGLPRTPPFNAMAFALRS

SEQ ID NO: 949519 - protein, 17 aa, Mycobacterium
RDTGGLDESLWGSAPTA

SEQ ID NO: 949520 - protein, 23 aa, Mycobacterium
RDTWNRVALQWFRGINSVLGVQR

SEQ ID NO: 949521 - protein, 20 aa, Mycobacterium
RDVDTARRAFGALVAAVGDC

SEQ ID NO: 949522 - protein, 34 aa, Mycobacterium
RDWYSTGTDFKRPSPQWWFDETHIHGPDGLSVPM

SEQ ID NO: 949523 - protein, 41 aa, Mycobacterium; identical to SEQ ID NO: 117055

SEQ ID NO: 949524 - protein, 29 aa, Mycobacterium
REDPKVHSLALFQPLSGRYLDIITNRVRA

SEQ ID NO: 949525 - protein, 17 aa, Mycobacterium
REDRSNFSIFIPAARDG

SEQ ID NO: 949526 - protein, 22 aa, Mycobacterium
REELPVQLVVRSVGYRGVPTPG

SEQ ID NO: 949527 - protein, 23 aa, Mycobacterium
REELPVQLVVRSVGYRGVPTPGL

SEQ ID NO: 949528 - protein, 25 aa, Mycobacterium
REGPLATMGLYPPGSTFKIVTAGAA

SEQ ID NO: 949529 - protein, 17 aa, Mycobacterium
REIAGELVALYAKRQAS

SEQ ID NO: 949530 - protein, 25 aa, Mycobacterium
REIAPFMSYGQFTGNAPLGTCAFWP

SEQ ID NO: 949531 - protein, 23 aa, Mycobacterium
REITMPVLSPGSTPLRVLHISDL

SEQ ID NO: 949532 - protein, 30 aa, Mycobacterium
REKDGHQLVVRLLFYEAQSSRQFAQVAQYS

SEQ ID NO: 949533 - protein, 17 aa, Mycobacterium
REKLRPDYRAGCKRLII

SEQ ID NO: 949534 - protein, 29 aa, Mycobacterium
REKNGRQLVVRLLFYDAQSTRQFGQVAQH

SEQ ID NO: 949535 - protein, 25 aa, Mycobacterium
RELFEVVMQPRWPHGCAAAADLVLI

SEQ ID NO: 949536 - protein, 23 aa, Mycobacterium
RELTELVDVLPLALDNLYNIIDQ

SEQ ID NO: 949537 - protein, 39 aa, Mycobacterium
RELVVAWAKLYPDFGTVAALNLVKCVHWPTGSPPAPPKS

SEQ ID NO: 949538 - protein, 30 aa, Mycobacterium
RELVVAWGKLYPQFGTVAALNLVKCVHWPS

SEQ ID NO: 949539 - protein, 22 aa, Mycobacterium
REMLADHLPPYMVPAAVLRLDT

SEQ ID NO: 949540 - protein, 30 aa, Mycobacterium
REMMIKVSIFAVAMLLVSAGLVVVFGDFRF

SEQ ID NO: 949541 - protein, 25 aa, Mycobacterium
RENLRSILRLWTTDAARLTQGIPAL

SEQ ID NO: 949542 - protein, 32 aa, Mycobacterium
REPGRAAVPWWPWAPLVQVMRVLPPPLTKWFA

SEQ ID NO: 949543 - protein, 24 aa, Mycobacterium
REPNISGWRRKTFGNLLSAFGFDS

SEQ ID NO: 949544 - protein, 29 aa, Mycobacterium
REQAANPGQYLVPPISTFGTREQAASMDP

SEQ ID NO: 949545 - protein, 24 aa, Mycobacterium
REQSVDFVTYFSAGSLWAQRVGGG

SEQ ID NO: 949546 - protein, 36 aa, Mycobacterium
RERLGPVLRRLTANYPPFLFHPLNTITAYKGQIIYD

SEQ ID NO: 949547 - protein, 26 aa, Mycobacterium
RERVQIHPYLTGRILARVGGLKAVRE

SEQ ID NO: 949548 - protein, 23 aa, Mycobacterium
RESERQATLTKRAIHTVCEDLST

SEQ ID NO: 949549 - protein, 35 aa, Mycobacterium
RESFRRLPHTPPWNALWFALRSPTFRLRDLMRLDA

SEQ ID NO: 949550 - protein, 19 aa, Mycobacterium
RESSSPSPLLKGLGPGANS

SEQ ID NO: 949551 - protein, 24 aa, Mycobacterium
REVAEFFDVLPLMADNLYNAIDQR

SEQ ID NO: 949552 - protein, 24 aa, Mycobacterium
REWTSGHVTTLRDLAHLASARIFN

SEQ ID NO: 949553 - protein, 17 aa, Mycobacterium
RFAARMWPVVRKAIDFV

SEQ ID NO: 949554 - protein, 25 aa, Mycobacterium
RFAELEHRYAARLGVYMPATGTTAA

SEQ ID NO: 949555 - protein, 18 aa, Mycobacterium
RFAGQLLSVRAFAPRITA

SEQ ID NO: 949556 - protein, 29 aa, Mycobacterium
RFAPLRWSVLRLALAFRTLLRTGQVGDGR

SEQ ID NO: 949557 - protein, 25 aa, Mycobacterium
RFDEKIALLLDDPVPLVSFTFGIPA

SEQ ID NO: 949558 - protein, 18 aa, Mycobacterium
RFFFDQGAILPDSYGALQ

SEQ ID NO: 949559 - protein, 23 aa, Mycobacterium
RFGELREGVWLRPDNLDQALPGE

SEQ ID NO: 949560 - protein, 25 aa, Mycobacterium
RFGLLWFGFWSTLFDMPGLPADHEL

SEQ ID NO: 949561 - protein, 20 aa, Mycobacterium
RFGQALPVLGWNMRVSNLRW

SEQ ID NO: 949562 - protein, 25 aa, Mycobacterium
RFGQESVLTFEYLPAGDARVNAVAV

SEQ ID NO: 949563 - protein, 17 aa, Mycobacterium
RFGTALKVTLRVAPEVL

SEQ ID NO: 949564 - protein, 21 aa, Mycobacterium
RFIGAALTLGPLLISGIAWAG

SEQ ID NO: 949565 - protein, 36 aa, Mycobacterium
RFLSDERLLRVFTFQALYVGVPPRRALAAYAVIAYM

SEQ ID NO: 949566 - protein, 23 aa, Mycobacterium
RFLVAGLILAGWAGSAGVAAADP

SEQ ID NO: 949567 - protein, 28 aa, Mycobacterium
RFLVLPHAELLEMYRRKGGDYDRWISGM

SEQ ID NO: 949568 - protein, 18 aa, Mycobacterium
RFMRTPMVGAAALAPLIL

SEQ ID NO: 949569 - protein, 17 aa, Mycobacterium
RFMTVPKGTPQEVRDRI

SEQ ID NO: 949570 - protein, 23 aa, Mycobacterium
RFTDSLTLGYREAVALTGSVLFE

SEQ ID NO: 949571 - protein, 18 aa, Mycobacterium
RFVDFLERVVVKRSIKRH

SEQ ID NO: 949572 - protein, 24 aa, Mycobacterium
RGAAIPAVLAAQPVYHEYWASRGV

SEQ ID NO: 949573 - protein, 19 aa, Mycobacterium
RGAARSLIAPILQAGSFGD

SEQ ID NO: 949574 - protein, 24 aa, Mycobacterium
RGAHRLSMMFGGHPLHFPMSFTRP

SEQ ID NO: 949575 - protein, 28 aa, Mycobacterium
RGAQRITLTRNPKWWGEPPVLDSITYTV

SEQ ID NO: 949576 - protein, 17 aa, Mycobacterium
RGDLLFWGPGGSQHVAI

SEQ ID NO: 949577 - protein, 17 aa, Mycobacterium
RGDLLFWGPGGSQHVAL

SEQ ID NO: 949578 - protein, 17 aa, Mycobacterium
RGDLLFYGPGGSQHVVI

SEQ ID NO: 949579 - protein, 18 aa, Mycobacterium
RGDLPIALTYDRSGRLET

SEQ ID NO: 949580 - protein, 21 aa, Mycobacterium
RGDLPVLLPEDQTGELPITEE

SEQ ID NO: 949581 - protein, 20 aa, Mycobacterium
RGDLYCRVPQDSAFNVRGAR

SEQ ID NO: 949582 - protein, 25 aa, Mycobacterium
RGDNRTFNLYRPQELPDAVPLVVMM

SEQ ID NO: 949583 - protein, 17 aa, Mycobacterium
RGDPALASELWLDGADA

SEQ ID NO: 949584 - protein, 25 aa, Mycobacterium
RGDPGTPVLDIPIPPGWADAGADTP

SEQ ID NO: 949585 - protein, 23 aa, Mycobacterium
RGDPWAGVPVFAAWVCEPADVAA

SEQ ID NO: 949586 - protein, 25 aa, Mycobacterium
RGDRFGLFFMNEGNRLFLSTAGSGA

SEQ ID NO: 949587 - protein, 30 aa, Mycobacterium
RGDYLNVFTTFDLTLRRIGETFFTTAYFDP

SEQ ID NO: 949588 - protein, 17 aa, Mycobacterium
RGELYCMPQFDAKVGWN

SEQ ID NO: 949589 - protein, 28 aa, Mycobacterium
RGEMTHVSNMPPFPVYYGAIAYGHDGSN

SEQ ID NO: 949590 - protein, 28 aa, Mycobacterium
RGEPLPWQDLRAAFTERGWLDLTHTRRE

SEQ ID NO: 949591 - protein, 20 aa, Mycobacterium
RGETYYILLAGTAADFCSDL

SEQ ID NO: 949592 - protein, 17 aa, Mycobacterium
RGFDPVPAALSAAVETG

SEQ ID NO: 949593 - protein, 32 aa, Mycobacterium
RGFSVARRLALLLTFQRFLPATGPIAMRSPRL

SEQ ID NO: 949594 - protein, 31 aa, Mycobacterium
RGFSVARRLALLLTFQRFLPTTGPVAMRSTR

SEQ ID NO: 949595 - protein, 29 aa, Mycobacterium
RGFSVARRLALLLTYQRFLPTTGPVAMRS

SEQ ID NO: 949596 - protein, 35 aa, Mycobacterium
RGGDPQWAAPPPFAWDYRLFAHPAPVPPPEQTIEM

SEQ ID NO: 949597 - protein, 20 aa, Mycobacterium
RGGLLAHLFGTVAVLEPGDQ

SEQ ID NO: 949598 - protein, 25 aa, Mycobacterium
RGGPLMLLASPTLPGAGLNPACAAY

SEQ ID NO: 949599 - protein, 22 aa, Mycobacterium
RGGPLMVVAAPTLPPPGLSHAC

SEQ ID NO: 949600 - protein, 22 aa, Mycobacterium
RGGPMMLLTSPTLPGRGLSPSC

SEQ ID NO: 949601 - protein, 25 aa, Mycobacterium
RGGRRLVIAMMYGLVKAGGPSYWDQ

SEQ ID NO: 949602 - protein, 25 aa, Mycobacterium
RGGTNLYTPLAIAAARWPERTAIVD

SEQ ID NO: 949603 - protein, 23 aa, Mycobacterium
RGGYVYACPRYAESFAAGAAIGA

SEQ ID NO: 949604 - protein, 24 aa, Mycobacterium
RGIDPKLLAGRKLPDGLTFDPANC

SEQ ID NO: 949605 - protein, 29 aa, Mycobacterium
RGKMLDDLLAFLREWWTTTPVSWESEFFS

SEQ ID NO: 949606 - protein, 28 aa, Mycobacterium
RGLADLWTSLSRREIFPARPLAGAMGVL

SEQ ID NO: 949607 - protein, 24 aa, Mycobacterium
RGLSAPLNIPYKVAFVLDVAGDNE

SEQ ID NO: 949608 - protein, 25 aa, Mycobacterium
RGLSEPLNIPYQVAFILDVAGDNEA

SEQ ID NO: 949609 - protein, 21 aa, Mycobacterium
RGLSILFALGVVAAPGVAHAI

SEQ ID NO: 949610 - protein, 21 aa, Mycobacterium
RGLVVLAAVFGAFGLAGCTVD

SEQ ID NO: 949611 - protein, 18 aa, Mycobacterium
RGMAQIGVPYSWGGGNAA

SEQ ID NO: 949612 - protein, 18 aa, Mycobacterium
RGNNWVAFNGCCEPGWAH

SEQ ID NO: 949613 - protein, 25 aa, Mycobacterium
RGNRFWITLSSLVFAVMLTACDGHG

SEQ ID NO: 949614 - protein, 27 aa, Mycobacterium
RGPAAQAMAFAAIRYAEWLQVTAEQTR

SEQ ID NO: 949615 - protein, 18 aa, Mycobacterium
RGPYLAPGSVLAIEPMLT

SEQ ID NO: 949616 - protein, 17 aa, Mycobacterium
RGQQWRYNVLFRSQDGA

SEQ ID NO: 949617 - protein, 27 aa, Mycobacterium
RGQRTPERWFVVWLGTANNPIDKDAAV

SEQ ID NO: 949618 - protein, 28 aa, Mycobacterium
RGQRTPERWFVVWLGTATNPVPQGEAVT

SEQ ID NO: 949619 - protein, 26 aa, Mycobacterium
RGRARDTYLLSVKFGAQIGPGVTWLG

SEQ ID NO: 949620 - protein, 19 aa, Mycobacterium
RGRLLNVVAFTPSNLDAEE

SEQ ID NO: 949621 - protein, 24 aa, Mycobacterium
RGRLPFRVVASYTVKAPPFGDVVA

SEQ ID NO: 949622 - protein, 29 aa, Mycobacterium
RGRSTWPPLRLVLDRLRPPDGRPVPLMSW

SEQ ID NO: 949623 - protein, 20 aa, Mycobacterium
RGSAYHYFPGGRTQLLCEAV

SEQ ID NO: 949624 - protein, 19 aa, Mycobacterium
RGSFAEHLAQFPGLAARLD

SEQ ID NO: 949625 - protein, 24 aa, Mycobacterium
RGSGWLRRLAGATSLVRVGWSLGA

SEQ ID NO: 949626 - protein, 31 aa, Mycobacterium
RGSQYLIGALKLILTQPFDIDAVPKIFRGDY

SEQ ID NO: 949627 - protein, 25 aa, Mycobacterium
RGSQYLIGALKLILTQPYDIDTVPK

SEQ ID NO: 949628 - protein, 21 aa, Mycobacterium
RGSRTPLFLEELGYPRPRDDE

SEQ ID NO: 949629 - protein, 25 aa, Mycobacterium
RGSRVPLAGMALPVVSPKTVQIDDG

SEQ ID NO: 949630 - protein, 17 aa, Mycobacterium
RGSTVEGILPIAKRHNV

SEQ ID NO: 949631 - protein, 17 aa, Mycobacterium
RGSWRIDWRLPLAAVCT

SEQ ID NO: 949632 - protein, 24 aa, Mycobacterium
RGTAVRPIYGPTLDGTLPGNEVIV

SEQ ID NO: 949633 - protein, 22 aa, Mycobacterium
RGTIALLALGAAAGVPAAGADP

SEQ ID NO: 949634 - protein, 18 aa, Mycobacterium
RGTRLPVWLSKWGYQRPA

SEQ ID NO: 949635 - protein, 20 aa, Mycobacterium
RGVFLGIKHGAAAMKHTGGG

SEQ ID NO: 949636 - protein, 18 aa, Mycobacterium
RGVPVWASLIALLEDGVP

SEQ ID NO: 949637 - protein, 22 aa, Mycobacterium
RGYDPRDFVLVVCGGAGALHGA

SEQ ID NO: 949638 - protein, 21 aa, Mycobacterium
RGYIDKAKRKVLPGPDVAVNE

SEQ ID NO: 949639 - protein, 17 aa, Mycobacterium
RGYRFAPSFSIWTTIEE

SEQ ID NO: 949640 - protein, 20 aa, Mycobacterium
RHAGLLCDALTSAAVVLPSG

SEQ ID NO: 949641 - protein, 25 aa, Mycobacterium
RHDRLIEAITLIRRLWTGARTSFAG

SEQ ID NO: 949642 - protein, 26 aa, Mycobacterium
RHGIKPLFVLFDSCWDPFPKLGQQRA

SEQ ID NO: 949643 - protein, 25 aa, Mycobacterium
RHGIKPLFVLFDSCWDPFPRPGRQR

SEQ ID NO: 949644 - protein, 29 aa, Mycobacterium
RHGTFDGILSDGSFTYRPHAGYFGTDSFT

SEQ ID NO: 949645 - protein, 22 aa, Mycobacterium
RHGWHVPPVAAPPLERVRDAIA

SEQ ID NO: 949646 - protein, 27 aa, Mycobacterium
RHHIKPLFVFFDSCWDPLPHPGPQPEP

SEQ ID NO: 949647 - protein, 20 aa, Mycobacterium
RHHPLVAVEARRVGSMGLGA

SEQ ID NO: 949648 - protein, 23 aa, Mycobacterium
RHIYNQVPQRKGPPTRTLAAHVM

SEQ ID NO: 949649 - protein, 23 aa, Mycobacterium
RHLDDIGFLVALVGKVQKDFGVP

SEQ ID NO: 949650 - protein, 25 aa, Mycobacterium
RHRAWQTLVLLVAAMVLSSCGWKGI

SEQ ID NO: 949651 - protein, 26 aa, Mycobacterium
RHRFTVYPFEDHIAWILQDKFNDPIA

SEQ ID NO: 949652 - protein, 25 aa, Mycobacterium
RHRIKPLFVFFDSCWDPAPRAGRQR

SEQ ID NO: 949653 - protein, 33 aa, Mycobacterium
RHRSGRATQWGFVNMWFSYYSAGLFAMNNGVPW

SEQ ID NO: 949654 - protein, 27 aa, Mycobacterium
RHTWGDPEIRWILSTLPTAMIFDDHDI

SEQ ID NO: 949655 - protein, 31 aa, Mycobacterium
RHVTFPSIYDPAMRTLIAFGGKYPTTVIPST

SEQ ID NO: 949656 - protein, 17 aa, Mycobacterium
RHYALPYARSTPLFYYN

SEQ ID NO: 949657 - protein, 26 aa, Mycobacterium
RIADEVSYIYLYNPSVIQAWSNDLSG

SEQ ID NO: 949658 - protein, 22 aa, Mycobacterium
RIAGALALAAALPFAMTACGGG

SEQ ID NO: 949659 - protein, 21 aa, Mycobacterium
RIAGVLPAILGAAAVLPAPRA

SEQ ID NO: 949660 - protein, 17 aa, Mycobacterium
RIALRRPGEVFALELAR

SEQ ID NO: 949661 - protein, 17 aa, Mycobacterium
RIARPPGVTGPIRPIIA

SEQ ID NO: 949662 - protein, 17 aa, Mycobacterium
RIATDFPGLREAAWTAT

SEQ ID NO: 949663 - protein, 18 aa, Mycobacterium
RIDAFRVGILGDEARCLK

SEQ ID NO: 949664 - protein, 24 aa, Mycobacterium
RIDGVLWRMRVLEMPPPEYTRYDD

SEQ ID NO: 949665 - protein, 17 aa, Mycobacterium
RIDLYFPGESALQEYHP

SEQ ID NO: 949666 - protein, 18 aa, Mycobacterium
RIDRLPNGVFLDWQQFQA

SEQ ID NO: 949667 - protein, 24 aa, Mycobacterium
RIERVTERLPLLPDALRIEDPEMN

SEQ ID NO: 949668 - protein, 33 aa, Mycobacterium
RIFDEEHLQWLAFPNPLLTPPAQFTASYDWLPA

SEQ ID NO: 949669 - protein, 36 aa, Mycobacterium
RIGRSRPLISNMIRLLRLPIAVQRRVAAGVLSAGHA

SEQ ID NO: 949670 - protein, 17 aa, Mycobacterium
RIGTRSAWRRKLGSIAT

SEQ ID NO: 949671 - protein, 21 aa, Mycobacterium
RIIDRLFAGLVSYDAKGKPSL

SEQ ID NO: 949672 - protein, 17 aa, Mycobacterium
RILAATAAAMVPMAALA

SEQ ID NO: 949673 - protein, 19 aa, Mycobacterium
RILGGFHTPADGLAKALRA

SEQ ID NO: 949674 - protein, 18 aa, Mycobacterium
RILHGAALEGRWPSVVWH

SEQ ID NO: 949675 - protein, 18 aa, Mycobacterium
RILLSNPAVWEKTALIVS

SEQ ID NO: 949676 - protein, 19 aa, Mycobacterium
RILPGPSSLWLDATGKRLP

SEQ ID NO: 949677 - protein, 37 aa, Mycobacterium
RINDARNEWLFTEAWGIDVAVSTPLALVAAVEGAIDV

SEQ ID NO: 949678 - protein, 26 aa, Mycobacterium
RINVKYIQHLFPGAIPKALFTPEQFW

SEQ ID NO: 949679 - protein, 21 aa, Mycobacterium
RIPASVFWRQLSSIAGYEAGN

SEQ ID NO: 949680 - protein, 25 aa, Mycobacterium
RIPGVLTLTAYLRDAGRYETPSYAP

SEQ ID NO: 949681 - protein, 27 aa, Mycobacterium
RIQQISPPPLIVGVVTWADCLVALQQR

SEQ ID NO: 949682 - protein, 26 aa, Mycobacterium
RIRALAVLSVLFLSTLPVGVARADMA

SEQ ID NO: 949683 - protein, 19 aa, Mycobacterium
RIRIAAGIAALAVAVSGCS

SEQ ID NO: 949684 - protein, 18 aa, Mycobacterium
RIRPRRRPRRVVLLCDVS

SEQ ID NO: 949685 - protein, 23 aa, Mycobacterium
RIRRIGLEALLRMPPDQIPGFFD

SEQ ID NO: 949686 - protein, 21 aa, Mycobacterium
RIRRYRQTLIGVMTGLAVFGA

SEQ ID NO: 949687 - protein, 27 aa, Mycobacterium
RITHASALVALHDGFFAKQLGPQVNFT

SEQ ID NO: 949688 - protein, 26 aa, Mycobacterium
RITMNYPPVLFHPINSITAYKGQIIY

SEQ ID NO: 949689 - protein, 19 aa, Mycobacterium
RIVAPRTLQLTLRAGQPTL

SEQ ID NO: 949690 - protein, 33 aa, Mycobacterium
RIVDGSMQPAADLPPRPLRGADIARVLPGVDEL

SEQ ID NO: 949691 - protein, 17 aa, Mycobacterium
RIVLSSAWINAEIPTGR

SEQ ID NO: 949692 - protein, 20 aa, Mycobacterium
RIVPLHLADGALIDLVRAGD

SEQ ID NO: 949693 - protein, 19 aa, Mycobacterium
RIVTPRVMALTLRARQPAL

SEQ ID NO: 949694 - protein, 30 aa, Mycobacterium
RIVVTVRLWAEPIAFAYQRSFDAFTRAHPD

SEQ ID NO: 949695 - protein, 18 aa, Mycobacterium
RIWLRISGYGEHSRRPAF

SEQ ID NO: 949696 - protein, 21 aa, Mycobacterium
RKAILGLLDVDLLAAVGAGSD

SEQ ID NO: 949697 - protein, 20 aa, Mycobacterium
RKDLVLSGGWDEDLIRRMGE

SEQ ID NO: 949698 - protein, 25 aa, Mycobacterium
RKDVVLSAGWDQDLFRRMGELAGGN

SEQ ID NO: 949699 - protein, 26 aa, Mycobacterium
RKEKVAFAGPYLITGQSLLVRNDNND

SEQ ID NO: 949700 - protein, 28 aa, Mycobacterium
RKEKVDFAGPYLITGQSLLVRADNNDIT

SEQ ID NO: 949701 - protein, 18 aa, Mycobacterium
RKELFAGIGPYNLRYRLW

SEQ ID NO: 949702 - protein, 18 aa, Mycobacterium
RKIPPALEVLIKERPRLT

SEQ ID NO: 949703 - protein, 23 aa, Mycobacterium
RKLELPRDAVLVAILRGSRVIAA

SEQ ID NO: 949704 - protein, 24 aa, Mycobacterium
RKLQLPRDAVLVTILRGPRVIVPQ

SEQ ID NO: 949705 - protein, 26 aa, Mycobacterium
RKQASIDFVKWLTAPEQVKAFSLQTG

SEQ ID NO: 949706 - protein, 26 aa, Mycobacterium
RKTEVDFMLAPYLAAAQELGMDTPTL

SEQ ID NO: 949707 - protein, 26 aa, Mycobacterium
RKYGPDAVLPQSFTLVGHSLGAGVAA

SEQ ID NO: 949708 - protein, 17 aa, Mycobacterium
RKYWPERMGRVPEQLLS

SEQ ID NO: 949709 - protein, 24 aa, Mycobacterium
RLAERRRLSSLGPLSLALREQPTV

SEQ ID NO: 949710 - protein, 19 aa, Mycobacterium
RLAFFMVKPDPTLLTAIES

SEQ ID NO: 949711 - protein, 17 aa, Mycobacterium
RLAIIKYPAKGNKIGSL

SEQ ID NO: 949712 - protein, 26 aa, Mycobacterium
RLALGMLSVFGLPPIEFVELAAELGC

SEQ ID NO: 949713 - protein, 17 aa, Mycobacterium
RLALIAALQHLSPRQRA

SEQ ID NO: 949714 - protein, 17 aa, Mycobacterium
RLALSDFPPNFNTLHID

SEQ ID NO: 949715 - protein, 18 aa, Mycobacterium
RLALSYDGGVLVLDAGTL

SEQ ID NO: 949716 - protein, 21 aa, Mycobacterium
RLALTTRIKPVTYLSTMAVAM

SEQ ID NO: 949717 - protein, 25 aa, Mycobacterium
RLAQDLIRLGLFVGYDPVAIANSNQ

SEQ ID NO: 949718 - protein, 19 aa, Mycobacterium
RLATVLSRCSYLCDGVAVR

SEQ ID NO: 949719 - protein, 19 aa, Mycobacterium
RLAVGLPPDGLTKAAAQLG

SEQ ID NO: 949720 - protein, 26 aa, Mycobacterium
RLAVVYRPMTFLDLDGPGYSAHVSNA

SEQ ID NO: 949721 - protein, 23 aa, Mycobacterium
RLCAVLGVVLLAGCSVSAPPAVQ

SEQ ID NO: 949722 - protein, 18 aa, Mycobacterium
RLCGPLDVEALRVAVTDV

SEQ ID NO: 949723 - protein, 26 aa, Mycobacterium
RLDDFWFIEHVVPNWMPCPNGTFATG

SEQ ID NO: 949724 - protein, 18 aa, Mycobacterium
RLDIGHRTVPNYGGFDLG

SEQ ID NO: 949725 - protein, 19 aa, Mycobacterium
RLDMLVLATGFRVDRFLRP

SEQ ID NO: 949726 - protein, 17 aa, Mycobacterium
RLDTMTVIAQFDSAAGL

SEQ ID NO: 949727 - protein, 19 aa, Mycobacterium
RLFASFTQQWRQCEGRTVT

SEQ ID NO: 949728 - protein, 19 aa, Mycobacterium
RLFAVVVALSLATTVVVGC

SEQ ID NO: 949729 - protein, 19 aa, Mycobacterium
RLFGARELALAVALLAAPS

SEQ ID NO: 949730 - protein, 24 aa, Mycobacterium
RLGAGWFPGLKREIVNYPAGQVQG

SEQ ID NO: 949731 - protein, 17 aa, Mycobacterium
RLGDLQRSCLDIGLAER

SEQ ID NO: 949732 - protein, 36 aa, Mycobacterium
RLGDLRRSCLDIGLAERVLGWRPRVALDEGVRRTVE

SEQ ID NO: 949733 - protein, 21 aa, Mycobacterium
RLGIRLVIIAARWWVKWRARG

SEQ ID NO: 949734 - protein, 24 aa, Mycobacterium
RLGLPAGTHWVRHGTTLLIESDGA

SEQ ID NO: 949735 - protein, 20 aa, Mycobacterium
RLGTLGFLAAPGLSGGIGNY

SEQ ID NO: 949736 - protein, 18 aa, Mycobacterium
RLGYPDHYTLLNQRGMTA

SEQ ID NO: 949737 - protein, 19 aa, Mycobacterium
RLHMLRHQQILAPKFALAA

SEQ ID NO: 949738 - protein, 19 aa, Mycobacterium
RLHRFAAAQGYRSVLTAPL

SEQ ID NO: 949739 - protein, 21 aa, Mycobacterium
RLHSFNRIVIATGAPPAKQRY

SEQ ID NO: 949740 - protein, 19 aa, Mycobacterium
RLHVRYDLSWQALDGALAR

SEQ ID NO: 949741 - protein, 18 aa, Mycobacterium
RLIDLPEVLIFSAVSERH

SEQ ID NO: 949742 - protein, 17 aa, Mycobacterium
RLIGNRPLSARSVLASA

SEQ ID NO: 949743 - protein, 18 aa, Mycobacterium
RLLAAAAGLLTVASAFAA

SEQ ID NO: 949744 - protein, 18 aa, Mycobacterium
RLLCVAVLSIGLGGVTAA

SEQ ID NO: 949745 - protein, 19 aa, Mycobacterium
RLLDVLRAQGAKATFFVIG

SEQ ID NO: 949746 - protein, 26 aa, Mycobacterium
RLLGDGGILDPLPMAPIASVNADLTI

SEQ ID NO: 949747 - protein, 21 aa, Mycobacterium
RLLIFAFLGVTAAVGVDLMDG

SEQ ID NO: 949748 - protein, 22 aa, Mycobacterium
RLLMLTDIEGLYTDWPDRESLV

SEQ ID NO: 949749 - protein, 31 aa, Mycobacterium
RLLMPGFVEGHIHPFFGAFLSGGVNLQVSTK

SEQ ID NO: 949750 - protein, 19 aa, Mycobacterium
RLLTTTDLDTWKSYLTFHA

SEQ ID NO: 949751 - protein, 31 aa, Mycobacterium
RLNKRDILGRLPLWPFLRFQRRFDAPTEEPV

SEQ ID NO: 949752 - protein, 24 aa, Mycobacterium
RLNPPYRVPYPQAMPSQETTPTRG

SEQ ID NO: 949753 - protein, 19 aa, Mycobacterium
RLPAVSWLIMTSTASEHPD

SEQ ID NO: 949754 - protein, 17 aa, Mycobacterium
RLPDLLNTTDRAADAVL

SEQ ID NO: 949755 - protein, 20 aa, Mycobacterium
RLPGQILGRVAFQVLAGLGE

SEQ ID NO: 949756 - protein, 21 aa, Mycobacterium
RLPLPLLAAAAVFGSPVASAP

SEQ ID NO: 949757 - protein, 20 aa, Mycobacterium
RLPQVSWLVPPFIQSEHPAL

SEQ ID NO: 949758 - protein, 20 aa, Mycobacterium
RLPRTANGKLLRSALRGQTP

SEQ ID NO: 949759 - protein, 19 aa, Mycobacterium
RLQEPISDRLYLAGEAAAV

SEQ ID NO: 949760 - protein, 22 aa, Mycobacterium
RLRAVDVTGLDLRRALRAVWLG

SEQ ID NO: 949761 - protein, 20 aa, Mycobacterium
RLRIDLSALRAIGDGLAWAP

SEQ ID NO: 949762 - protein, 17 aa, Mycobacterium
RLRLLRDASSLTRQSYV

SEQ ID NO: 949763 - protein, 17 aa, Mycobacterium
RLRPCVEAARRLLAGVQ

SEQ ID NO: 949764 - protein, 25 aa, Mycobacterium
RLRRRLLLFSAVPAVLVTLLAVKLI

SEQ ID NO: 949765 - protein, 17 aa, Mycobacterium
RLRTGVLAIRKGGKLPP

SEQ ID NO: 949766 - protein, 30 aa, Mycobacterium
RLRTVLLTALLIVALGLLLTRCPSNRDGMP

SEQ ID NO: 949767 - protein, 18 aa, Mycobacterium
RLSQPFSEFLRMLAQGGN

SEQ ID NO: 949768 - protein, 20 aa, Mycobacterium
RLSYVRVPALNALFPNYRGS

SEQ ID NO: 949769 - protein, 18 aa, Mycobacterium
RLTRTFTRFVAAAVQAYC

SEQ ID NO: 949770 - protein, 20 aa, Mycobacterium
RLVEQFQLPPIAYAEYFDAS

SEQ ID NO: 949771 - protein, 18 aa, Mycobacterium
RLVFTAHSIPLRAASRCG

SEQ ID NO: 949772 - protein, 25 aa, Mycobacterium
RLVGILGFPLLRMAVRSPLPTSPCA

SEQ ID NO: 949773 - protein, 29 aa, Mycobacterium
RLVGYPGSSLLDLLWPRGSSRPVAASVPE

SEQ ID NO: 949774 - protein, 17 aa, Mycobacterium
RLVLVPRETPLSEIHLD

SEQ ID NO: 949775 - protein, 28 aa, Mycobacterium
RLVQGALTAPLGLIPLVEALGAQDSEAL

SEQ ID NO: 949776 - protein, 23 aa, Mycobacterium
RLVQTLCRWNLRLSVRDPQLRAK

SEQ ID NO: 949777 - protein, 22 aa, Mycobacterium
RLVRALPTFEGPGLGDWDLRAL

SEQ ID NO: 949778 - protein, 41 aa, Mycobacterium
RLVRGMVYIYREGYLALLAHLTWLLPLLEIIAKTQLRRQVP

SEQ ID NO: 949779 - protein, 17 aa, Mycobacterium
RLVVGFVAAVAALVVGA

SEQ ID NO: 949780 - protein, 52 aa, Mycobacterium
RLYKNVFDKLVPWIRDILNAYTPHILTFFNTLPPVINWLADDIYLPNTKTHG

SEQ ID NO: 949781 - protein, 17 aa, Mycobacterium
RLYRRVGDKLVLISVGG

SEQ ID NO: 949782 - protein, 20 aa, Mycobacterium
RLYRRVGDRLVLISVGGIED

SEQ ID NO: 949783 - protein, 25 aa, Mycobacterium
RMAKAIVEYPPNQPYIGLLQTVFDT

SEQ ID NO: 949784 - protein, 18 aa, Mycobacterium
RMCLRDPAPLFRTNVEGL

SEQ ID NO: 949785 - protein, 18 aa, Mycobacterium
RMDIGHRTVPNYGGFDLG

SEQ ID NO: 949786 - protein, 26 aa, Mycobacterium
RMDPAKVLIPLRPIYRRKGIVFRQAL

SEQ ID NO: 949787 - protein, 18 aa, Mycobacterium
RMDTWSKGRITLVGDAGY

SEQ ID NO: 949788 - protein, 18 aa, Mycobacterium
RMFALCSVVMLAVTGCAF

SEQ ID NO: 949789 - protein, 18 aa, Mycobacterium
RMGALALHVAKIARRRHP

SEQ ID NO: 949790 - protein, 17 aa, Mycobacterium
RMGLAAHGDSRQVRTDP

SEQ ID NO: 949791 - protein, 18 aa, Mycobacterium
RMLSIAQFWQRTAGDNRI

SEQ ID NO: 949792 - protein, 17 aa, Mycobacterium
RMLVLGAAVMLSVTGCA

SEQ ID NO: 949793 - protein, 25 aa, Mycobacterium
RMMQPFSVDAFQRLGARLSKTVGAA

SEQ ID NO: 949794 - protein, 26 aa, Mycobacterium
RMMRLSWQSYLVATGQFAEWVDRDKP

SEQ ID NO: 949795 - protein, 22 aa, Mycobacterium
RMTAPQSIVLRAAPPGLPWEMV

SEQ ID NO: 949796 - protein, 17 aa, Mycobacterium
RMTARVLATLLFTEQPS

SEQ ID NO: 949797 - protein, 24 aa, Mycobacterium
RNAGGSFWHPTWLKLVCTVGADLD

SEQ ID NO: 949798 - protein, 35 aa, Mycobacterium
RNAGPSKYVLPLLSPLIRAALKRRGAYWKQPGQYA

SEQ ID NO: 949799 - protein, 20 aa, Mycobacterium
RNCRLSWVQIIPTIANESTP

SEQ ID NO: 949800 - protein, 17 aa, Mycobacterium
RNFTGELKVLVSKLAIL

SEQ ID NO: 949801 - protein, 27 aa, Mycobacterium
RNGAVVLLMWAGILAYLDHAGYDHVTG

SEQ ID NO: 949802 - protein, 18 aa, Mycobacterium
RNGQVDAWAVWDPYTAQA

SEQ ID NO: 949803 - protein, 21 aa, Mycobacterium
RNGRRLVIAMMYGLVKEGGPT

SEQ ID NO: 949804 - protein, 23 aa, Mycobacterium
RNIDRYLTLERARFGQSLKVRLQ

SEQ ID NO: 949805 - protein, 21 aa, Mycobacterium
RNIVILAYSEFGRRVAANASQ

SEQ ID NO: 949806 - protein, 18 aa, Mycobacterium
RNLLAIPGDIPEALPVGV

SEQ ID NO: 949807 - protein, 19 aa, Mycobacterium
RNLLDPPLKLRGPVTRADG

SEQ ID NO: 949808 - protein, 20 aa, Mycobacterium
RNMAWLADRFNGVPTSSNCS

SEQ ID NO: 949809 - protein, 37 aa, Mycobacterium
RNNADKGYHLALCDGMKPWTLQSFPSAIAYASKTDSP

SEQ ID NO: 949810 - protein, 23 aa, Mycobacterium
RNPATALYIDGGHSRWVSADVMA

SEQ ID NO: 949811 - protein, 26 aa, Mycobacterium
RNPKWWGQRPRLDSITYLVLDDAARL

SEQ ID NO: 949812 - protein, 17 aa, Mycobacterium
RNRFPWLDRGAYRGYSM

SEQ ID NO: 949813 - protein, 21 aa, Mycobacterium
RNRGREMLAFATAYREAGVEP

SEQ ID NO: 949814 - protein, 25 aa, Mycobacterium
RNSRQAAPRRALALGAAAALVVTLA

SEQ ID NO: 949815 - protein, 19 aa, Mycobacterium
RNSSGTALIIHQTADNLTG

SEQ ID NO: 949816 - protein, 25 aa, Mycobacterium
RNSVMWPTFTFRFRARTRSFDVINY

SEQ ID NO: 949817 - protein, 18 aa, Mycobacterium
RNSYAYTNFGLTAAAEAV

SEQ ID NO: 949818 - protein, 32 aa, Mycobacterium
RNTKRVNWALTYGPSKYRCFVSYNGVANVVVQ

SEQ ID NO: 949819 - protein, 22 aa, Mycobacterium
RNTTLWASWAFAGPKHKVFFGG

SEQ ID NO: 949820 - protein, 24 aa, Mycobacterium
RNTTLWASWAFTGPNRRAYFGGDT

SEQ ID NO: 949821 - protein, 22 aa, Mycobacterium
RNTWGIVDLMVGSAPNCHVLAT

SEQ ID NO: 949822 - protein, 19 aa, Mycobacterium
RNVLRRGFGGNGHKIAAVG

SEQ ID NO: 949823 - protein, 19 aa, Mycobacterium
RNVRPKILSPQYSEYEVLE

SEQ ID NO: 949824 - protein, 26 aa, Mycobacterium
RPADAALRPLMSYYADLRREEWGLVG

SEQ ID NO: 949825 - protein, 17 aa, Mycobacterium
RPALRRLAGLPTAQTDE

SEQ ID NO: 949826 - protein, 21 aa, Mycobacterium
RPAPMGLFRTAGRGNRLLRDL

SEQ ID NO: 949827 - protein, 17 aa, Mycobacterium
RPAPWSMLQVWPAGPEL

SEQ ID NO: 949828 - protein, 19 aa, Mycobacterium
RPDDPLLTARQRAIAARGG

SEQ ID NO: 949829 - protein, 24 aa, Mycobacterium
RPDIETHLVISRWGRATIDYETDR

SEQ ID NO: 949830 - protein, 21 aa, Mycobacterium
RPDSKPWHPSGLAIDIMIPNH

SEQ ID NO: 949831 - protein, 23 aa, Mycobacterium
RPDSKPWHPSGLAIDVMIPNPSS

SEQ ID NO: 949832 - protein, 25 aa, Mycobacterium
RPDTESMLLADIYVAALRSYGFAAR

SEQ ID NO: 949833 - protein, 25 aa, Mycobacterium
RPDWTRTVLARRVAAGGLVVLAGIA

SEQ ID NO: 949834 - protein, 18 aa, Mycobacterium
RPEEMAELLAFCASDKAG

SEQ ID NO: 949835 - protein, 18 aa, Mycobacterium
RPEPFLHSNVIGTFTVLE

SEQ ID NO: 949836 - protein, 23 aa, Mycobacterium
RPEPVPLYGAYDTYLDHARQTFE

SEQ ID NO: 949837 - protein, 19 aa, Mycobacterium
RPETYHILLAGTAADFCAK

SEQ ID NO: 949838 - protein, 17 aa, Mycobacterium
RPGDPRLLIARGGTAVV

SEQ ID NO: 949839 - protein, 27 aa, Mycobacterium
RPGFIVNRFLIPWENSCIEALEAGVAT

SEQ ID NO: 949840 - protein, 30 aa, Mycobacterium
RPGLGFGGNLFDVATLFVPGAGGAGAGAKG

SEQ ID NO: 949841 - protein, 22 aa, Mycobacterium
RPGMTASRFVACPFAADGSRMY

SEQ ID NO: 949842 - protein, 37 aa, Mycobacterium
RPGRVLHAISRSGLLPRAHRAFPAAPPPTFAMDRGKV

SEQ ID NO: 949843 - protein, 27 aa, Mycobacterium
RPGSSTARLVFAPKTSTSGTALTVTPI

SEQ ID NO: 949844 - protein, 19 aa, Mycobacterium
RPGVYLFRGPSGEVLYVGT

SEQ ID NO: 949845 - protein, 40 aa, Mycobacterium
RPGYSALGGRQWAAAGLTPLRPWRSALVAALAAASDRALA

SEQ ID NO: 949846 - protein, 22 aa, Mycobacterium
RPHPRGPIKYLGLLPGVGAVAA

SEQ ID NO: 949847 - protein, 27 aa, Mycobacterium
RPKRLLIGTLLALALIGALTAAIVYGV

SEQ ID NO: 949848 - protein, 20 aa, Mycobacterium
RPLIGLATVLALAAVIAVAV

SEQ ID NO: 949849 - protein, 20 aa, Mycobacterium
RPLLLCGAVVLAAACTRVVD

SEQ ID NO: 949850 - protein, 25 aa, Mycobacterium
RPLTGRRLALPLASALLYWSGMVLN

SEQ ID NO: 949851 - protein, 20 aa, Mycobacterium
RPLTLLSPDFGSRTADLCNT

SEQ ID NO: 949852 - protein, 17 aa, Mycobacterium
RPMMRLVVTNGSAKDLA

SEQ ID NO: 949853 - protein, 18 aa, Mycobacterium
RPMPSTPAFPPPAGPPPA

SEQ ID NO: 949854 - protein, 24 aa, Mycobacterium
RPNCKLIDWPIATLSPVGIRTSDG

SEQ ID NO: 949855 - protein, 25 aa, Mycobacterium
RPNGGFFERLAFLGTVPVLDATFGN

SEQ ID NO: 949856 - protein, 21 aa, Mycobacterium
RPNQFALIDTAGNRLQLVTLP

SEQ ID NO: 949857 - protein, 28 aa, Mycobacterium
RPPTVDGFAISLKLPNGQYQLPYQGTNS

SEQ ID NO: 949858 - protein, 21 aa, Mycobacterium
RPQTRLLATDRALTSPTLSGL

SEQ ID NO: 949859 - protein, 21 aa, Mycobacterium
RPRTEKWIALQVGECVADLPP

SEQ ID NO: 949860 - protein, 18 aa, Mycobacterium
RPRVRDWNGSWRLVVITS

SEQ ID NO: 949861 - protein, 20 aa, Mycobacterium
RPRYAAAAHPALWLTERGGR

SEQ ID NO: 949862 - protein, 34 aa, Mycobacterium
RPSHTRPTRPPGWPGWPGWPPHHGHWPTKPTKPT

SEQ ID NO: 949863 - protein, 19 aa, Mycobacterium
RPSRAVYLLDGLRAQDDYS

SEQ ID NO: 949864 - protein, 29 aa, Mycobacterium
RPTPTITARLNFQLAFGARVGQRLAEARD

SEQ ID NO: 949865 - protein, 30 aa, Mycobacterium
RPTPTITARLNFQLAFGARVGQRLSEARDE

SEQ ID NO: 949866 - protein, 18 aa, Mycobacterium
RPVQAGGPPIWIGGASEA

SEQ ID NO: 949867 - protein, 19 aa, Mycobacterium
RPVQSPNPIVWVPCDFEHD

SEQ ID NO: 949868 - protein, 25 aa, Mycobacterium
RQAPLQQAPLPRATLPQLPTQQAPA

SEQ ID NO: 949869 - protein, 17 aa, Mycobacterium
RQDLLDHGYRVFTSPAM

SEQ ID NO: 949870 - protein, 24 aa, Mycobacterium
RQFIPELGIYINTPHDWVSFADGV

SEQ ID NO: 949871 - protein, 18 aa, Mycobacterium
RQFMAALLHRAASPAVWL

SEQ ID NO: 949872 - protein, 24 aa, Mycobacterium
RQFRAHGLPEPSYFAYPFSAHEGE

SEQ ID NO: 949873 - protein, 17 aa, Mycobacterium
RQFRAIWVGGRTPPAGA

SEQ ID NO: 949874 - protein, 24 aa, Mycobacterium
RQGIAQLFDVPPLPYQEVKIATAE

SEQ ID NO: 949875 - protein, 26 aa, Mycobacterium
RQGIKPLFVLFDSCWDPLPKPGAQRA

SEQ ID NO: 949876 - protein, 22 aa, Mycobacterium
RQGIPITCLPGPSAVTTALAVS

SEQ ID NO: 949877 - protein, 21 aa, Mycobacterium
RQGYGVTPLPRTGPLPEGLRH

SEQ ID NO: 949878 - protein, 28 aa, Mycobacterium
RQHWKLLGAFVVFVAVVALVFGDVRIRP

SEQ ID NO: 949879 - protein, 31 aa, Mycobacterium
RQIGQILDYPNLMQILSYLTPFVHSASTADT

SEQ ID NO: 949880 - protein, 22 aa, Mycobacterium
RQLQSIPGFGVQPALPVCHAGI

SEQ ID NO: 949881 - protein, 20 aa, Mycobacterium
RQLRRWLTQLIVTGRVVAAE

SEQ ID NO: 949882 - protein, 25 aa, Mycobacterium
RQNNCKLITWPIATISPIGIRTADG

SEQ ID NO: 949883 - protein, 28 aa, Mycobacterium
RQPMELDPRYPPVSGRPPLPLGDSDWFQ

SEQ ID NO: 949884 - protein, 26 aa, Mycobacterium
RQPRPATVWIASDGSHRLVRATIDIG

SEQ ID NO: 949885 - protein, 23 aa, Mycobacterium
RQPYVVSFQLNWPRDHGPTVTGW

SEQ ID NO: 949886 - protein, 17 aa, Mycobacterium
RQQAVIDGLVGLGIDRA

SEQ ID NO: 949887 - protein, 23 aa, Mycobacterium
RQQQIDFVDYFSSGITIMIQKGN

SEQ ID NO: 949888 - protein, 19 aa, Mycobacterium
RQQTGGIYAPMLHPWSPST

SEQ ID NO: 949889 - protein, 21 aa, Mycobacterium
RQVELTPPYRSGPVLKNHDTI

SEQ ID NO: 949890 - protein, 18 aa, Mycobacterium
RRAACGFVATFLVLTFTI

SEQ ID NO: 949891 - protein, 20 aa, Mycobacterium
RRAFHRLVDRTVGCSGQTTA

SEQ ID NO: 949892 - protein, 22 aa, Mycobacterium
RRALQLLGLAGGAAMLAPALAA

SEQ ID NO: 949893 - protein, 34 aa, Mycobacterium
RRCGSPAWNLPVVFGPIAIAYRVNGRPSLALDGS

SEQ ID NO: 949894 - protein, 35 aa, Mycobacterium
RRDVSTLLTAWALTLGLAIALLSGASVAAADTGAA

SEQ ID NO: 949895 - protein, 17 aa, Mycobacterium
RRELDTLFAARTSNSPR

SEQ ID NO: 949896 - protein, 26 aa, Mycobacterium
RRFARERSRWLFSNPDMIHLSILRNH

SEQ ID NO: 949897 - protein, 21 aa, Mycobacterium
RRFAVTVTRLAVVIATIAAIA

SEQ ID NO: 949898 - protein, 21 aa, Mycobacterium
RRFDELDRYPRGILPFGDAVA

SEQ ID NO: 949899 - protein, 25 aa, Mycobacterium
RRFDPFRPVELLTSLWSTAAMVPVN

SEQ ID NO: 949900 - protein, 24 aa, Mycobacterium
RRFDRMYSTPLPYISALHQYSGAG

SEQ ID NO: 949901 - protein, 23 aa, Mycobacterium
RRGDLPVLLPEDQTGELPVTEDS

SEQ ID NO: 949902 - protein, 22 aa, Mycobacterium
RRGLFAALVAVGLPGLALVTVA

SEQ ID NO: 949903 - protein, 22 aa, Mycobacterium
RRGPLGWLYTPSGDATSLLTGS

SEQ ID NO: 949904 - protein, 24 aa, Mycobacterium
RRHDAMLTAMRLLLAHKDLGQING

SEQ ID NO: 949905 - protein, 21 aa, Mycobacterium
RRIAILAGTLTVTALFAVGCQ

SEQ ID NO: 949906 - protein, 22 aa, Mycobacterium
RRIRMRIENWDRTTLLEQERVI

SEQ ID NO: 949907 - protein, 27 aa, Mycobacterium
RRIVDQLRIAPLLTGWRGGPVADIDAL

SEQ ID NO: 949908 - protein, 19 aa, Mycobacterium
RRIVLRFLTSPIEIKGNDK

SEQ ID NO: 949909 - protein, 26 aa, Mycobacterium
RRKRFRLINFAWITTVVTGLMLSVAG

SEQ ID NO: 949910 - protein, 19 aa, Mycobacterium
RRLILAGGFVVAAAAAPAI

SEQ ID NO: 949911 - protein, 18 aa, Mycobacterium
RRLLVGAIGAGAVAGTLV

SEQ ID NO: 949912 - protein, 20 aa, Mycobacterium
RRLPLAVGMACAAAAVAVAP

SEQ ID NO: 949913 - protein, 17 aa, Mycobacterium
RRLQHGDFGTICAVELG

SEQ ID NO: 949914 - protein, 27 aa, Mycobacterium
RRLRALIAIGYTPHLLSRELGLASRHI

SEQ ID NO: 949915 - protein, 17 aa, Mycobacterium
RRLRRATAVTAAAVCTA

SEQ ID NO: 949916 - protein, 29 aa, Mycobacterium
RRLTWMSAAALLVLLVALSSTSATSSAWS

SEQ ID NO: 949917 - protein, 18 aa, Mycobacterium
RRLVLVAREAPLSEIHLE

SEQ ID NO: 949918 - protein, 17 aa, Mycobacterium
RRMVPLRPAPSAVVAHF

SEQ ID NO: 949919 - protein, 23 aa, Mycobacterium
RRNPSVYFVSALAPAAVFLAVKG

SEQ ID NO: 949920 - protein, 19 aa, Mycobacterium
RRPALCHLALRARAGWLRW

SEQ ID NO: 949921 - protein, 23 aa, Mycobacterium
RRPALCRLALTARTGWQRWESEF

SEQ ID NO: 949922 - protein, 21 aa, Mycobacterium
RRPHNKGLRFEFYANLDTAYA

SEQ ID NO: 949923 - protein, 34 aa, Mycobacterium
RRPRRRRCVPKRPAMPLPWPAVAPPPYCVRRAQA

SEQ ID NO: 949924 - protein, 26 aa, Mycobacterium
RRRACQGLVLLMATLVLSSCGWRGIS

SEQ ID NO: 949925 - protein, 25 aa, Mycobacterium
RRRAFRAWLDARRAALVRLAPGYEH

SEQ ID NO: 949926 - protein, 33 aa, Mycobacterium
RRRDVDLSVLTSKLPRRAAIPVLLCNDATLAGL

SEQ ID NO: 949927 - protein, 23 aa, Mycobacterium
RRRESLIANIRFARPRVGARGHP

SEQ ID NO: 949928 - protein, 17 aa, Mycobacterium
RRRGDLPTGLRVDSSGN

SEQ ID NO: 949929 - protein, 21 aa, Mycobacterium
RRRHGLWTTLALAAVSSASVV

SEQ ID NO: 949930 - protein, 29 aa, Mycobacterium
RRRHPRIPVRILSADPALPYSKPPLSKEF

SEQ ID NO: 949931 - protein, 19 aa, Mycobacterium
RRRRPRRRSHPRLSDRTRR

SEQ ID NO: 949932 - protein, 19 aa, Mycobacterium
RRRRRYCSAPPTWPPRPPA

SEQ ID NO: 949933 - protein, 23 aa, Mycobacterium
RRRTIVGVVIAAVVTLLLCSCGV

SEQ ID NO: 949934 - protein, 30 aa, Mycobacterium
RRRVEAFLARRRLFDPALLAGARTIAADGG

SEQ ID NO: 949935 - protein, 20 aa, Mycobacterium
RRRVFGIPNVKVLDAHDAVD

SEQ ID NO: 949936 - protein, 19 aa, Mycobacterium
RRRVTLVGDAGYCPGPAVG

SEQ ID NO: 949937 - protein, 24 aa, Mycobacterium
RRRYDRIRRFPLGLLVTGDAICSF

SEQ ID NO: 949938 - protein, 19 aa, Mycobacterium
RRSIRYALAALCAVTLVSS

SEQ ID NO: 949939 - protein, 24 aa, Mycobacterium
RRSPWLRANLRLRMPIRGTRPTMK

SEQ ID NO: 949940 - protein, 29 aa, Mycobacterium
RRSRAAVPFLAYGQFTGFAPRDVCAMWPV

SEQ ID NO: 949941 - protein, 17 aa, Mycobacterium
RRTAEALGVPWTNDTPI

SEQ ID NO: 949942 - protein, 17 aa, Mycobacterium
RRTGPLTGSAAVALLAL

SEQ ID NO: 949943 - protein, 34 aa, Mycobacterium
RRTPGISIRRAPSPSWYHFTFNGAPGSILADKAL

SEQ ID NO: 949944 - protein, 21 aa, Mycobacterium
RRTPSLWKAVADSGVFGLAVA

SEQ ID NO: 949945 - protein, 20 aa, Mycobacterium
RRVFLARAGLLAGGVVAAPS

SEQ ID NO: 949946 - protein, 21 aa, Mycobacterium
RRVLVALLAAAALLAGAVAPA

SEQ ID NO: 949947 - protein, 28 aa, Mycobacterium
RRVYGRKWRKRFPPGTLPQAVSRNPIGY

SEQ ID NO: 949948 - protein, 26 aa, Mycobacterium
RRWGIRRHIQIAPWSDCVEVYWAPDA

SEQ ID NO: 949949 - protein, 30 aa, Mycobacterium
RRWPLPIRVPAYQVPLPKLPHGLLLTDVDL

SEQ ID NO: 949950 - protein, 23 aa, Mycobacterium
RRYEPRWFRSPPMAGIRDENSSC

SEQ ID NO: 949951 - protein, 24 aa, Mycobacterium
RSADWRGIALPADNPFTADVTARL

SEQ ID NO: 949952 - protein, 20 aa, Mycobacterium
RSAFIVCIAVLAISACSHQS

SEQ ID NO: 949953 - protein, 17 aa, Mycobacterium
RSAFKPEFINRLDDVII

SEQ ID NO: 949954 - protein, 28 aa, Mycobacterium
RSAIAAFKRPREVLFVDELPLTGNGKIA

SEQ ID NO: 949955 - protein, 24 aa, Mycobacterium
RSALVVLVAPVFAVLLAAGAGVLA

SEQ ID NO: 949956 - protein, 27 aa, Mycobacterium
RSAQPSYFAFWEAKGVNVEPFFAVLSG

SEQ ID NO: 949957 - protein, 31 aa, Mycobacterium
RSAWRRKLGSIATILLLVAPTALVSCRARTT

SEQ ID NO: 949958 - protein, 30 aa, Mycobacterium
RSDLVKGLVYPVPDPRYPFLGVHFTRGIDG

SEQ ID NO: 949959 - protein, 24 aa, Mycobacterium
RSDWDRRLRPMLARQFELAAGRRK

SEQ ID NO: 949960 - protein, 27 aa, Mycobacterium
RSDYDGFTLAGIPSGGLFAGAEVKKTD

SEQ ID NO: 949961 - protein, 21 aa, Mycobacterium
RSELGPVLILVNNAGIEQFGK

SEQ ID NO: 949962 - protein, 20 aa, Mycobacterium
RSFIDLFEATGGRFVGYRRN

SEQ ID NO: 949963 - protein, 35 aa, Mycobacterium
RSFSIARRLAALLTLPRFLPVMGPVGMHSAVLMRI

SEQ ID NO: 949964 - protein, 17 aa, Mycobacterium
RSGEVIVRERGHWFSTG

SEQ ID NO: 949965 - protein, 21 aa, Mycobacterium
RSGFLLAPWTVEKIAAELEGA

SEQ ID NO: 949966 - protein, 20 aa, Mycobacterium
RSGTFEGLIPRLAELTDSLD

SEQ ID NO: 949967 - protein, 25 aa, Mycobacterium
RSGTRTFDFLIGADGLHSNVRRKVF

SEQ ID NO: 949968 - protein, 20 aa, Mycobacterium
RSHVTPAAWVRGVAYHGVLC

SEQ ID NO: 949969 - protein, 17 aa, Mycobacterium
RSIQLTPAYTGGPALAD

SEQ ID NO: 949970 - protein, 23 aa, Mycobacterium
RSISMRYAGQWRSLTVAADDRDG

SEQ ID NO: 949971 - protein, 19 aa, Mycobacterium
RSIVDAMEILFEPQNPPAL

SEQ ID NO: 949972 - protein, 28 aa, Mycobacterium
RSLAGGSLLLVALFAGSGLVSGCSSVIG

SEQ ID NO: 949973 - protein, 25 aa, Mycobacterium
RSLDDGLRALLDWIAERPEAAGSNE

SEQ ID NO: 949974 - protein, 17 aa, Mycobacterium
RSLLYQLDRLRTDLGDL

SEQ ID NO: 949975 - protein, 27 aa, Mycobacterium
RSLPDDSGWWQYTKLVITGRDGTSETI

SEQ ID NO: 949976 - protein, 18 aa, Mycobacterium
RSLSRLVAARRINIHDTF

SEQ ID NO: 949977 - protein, 26 aa, Mycobacterium
RSLVERLVPDFLWISTEHTAQVSLDA

SEQ ID NO: 949978 - protein, 20 aa, Mycobacterium
RSMFTVWLRAVDPDPVMPEP

SEQ ID NO: 949979 - protein, 24 aa, Mycobacterium
RSMMSAVAPYVTWLSAAAAQTETA

SEQ ID NO: 949980 - protein, 19 aa, Mycobacterium
RSPHSERLFCVPATIDLAG

SEQ ID NO: 949981 - protein, 21 aa, Mycobacterium
RSQFGPVTLGLVPVTVTHRVV

SEQ ID NO: 949982 - protein, 17 aa, Mycobacterium
RSQGRGLARLARRVWPD

SEQ ID NO: 949983 - protein, 18 aa, Mycobacterium
RSQYWQNLFNPTTGYISP

SEQ ID NO: 949984 - protein, 28 aa, Mycobacterium
RSRERGYAYFLYPPHAPLTETAYDRLAT

SEQ ID NO: 949985 - protein, 17 aa, Mycobacterium
RSRLFGHSTAVLTSATL

SEQ ID NO: 949986 - protein, 20 aa, Mycobacterium
RSRPIAPEELAATPLVTREQ

SEQ ID NO: 949987 - protein, 20 aa, Mycobacterium
RSRRIWDEWGRRLGVELLCS

SEQ ID NO: 949988 - protein, 27 aa, Mycobacterium
RSRRPGTFGVIFALIAVLASACQGGPS

SEQ ID NO: 949989 - protein, 26 aa, Mycobacterium
RSTMAPTLIFDTSGPDRRLYAVAGSP

SEQ ID NO: 949990 - protein, 33 aa, Mycobacterium
RSTMDLLVRFLGERKALLLLDNCEHLLDGCGTM

SEQ ID NO: 949991 - protein, 21 aa, Mycobacterium
RSVFALVFAAVLLGGCASVPS

SEQ ID NO: 949992 - protein, 28 aa, Mycobacterium
RSVISTLSGMYWWGPASAAMLAATGPFI

SEQ ID NO: 949993 - protein, 26 aa, Mycobacterium
RSVLATTLILVLVAGVIAAMRTAGDA

SEQ ID NO: 949994 - protein, 26 aa, Mycobacterium
RSVNPPAPSLPDSGPAGLTGWPGQDK

SEQ ID NO: 949995 - protein, 20 aa, Mycobacterium
RSWLRDRGLQIFPLVGWAER

SEQ ID NO: 949996 - protein, 19 aa, Mycobacterium
RSWQGLLVAARKGLLRVVP

SEQ ID NO: 949997 - protein, 28 aa, Mycobacterium
RSYFTAHPQEYYDLRGILAPIGDTERQC

SEQ ID NO: 949998 - protein, 20 aa, Mycobacterium
RTAGRLIWNNLKHSEDLLKV

SEQ ID NO: 949999 - protein, 25 aa, Mycobacterium
RTAPPFAVHRLWLDRPVTADRPAFM

SEQ ID NO: 950000 - protein, 21 aa, Mycobacterium
RTAQWVFPMPNPHYSPLIQAA

SEQ ID NO: 950001 - protein, 17 aa, Mycobacterium
RTARIVAPRTLQLTLRA

SEQ ID NO: 950002 - protein, 19 aa, Mycobacterium
RTCVFFESPRRLAACLHDA

SEQ ID NO: 950003 - protein, 18 aa, Mycobacterium
RTDAPSAGIEQLIFAPEG

SEQ ID NO: 950004 - protein, 24 aa, Mycobacterium
RTDGMVVCPCSMKTLSAIRIGFSD

SEQ ID NO: 950005 - protein, 17 aa, Mycobacterium
RTDGPAVLLRQTSFRAL

SEQ ID NO: 950006 - protein, 25 aa, Mycobacterium
RTDPMLAPRYPAISGQTLFGFGWDI

SEQ ID NO: 950007 - protein, 25 aa, Mycobacterium
RTDTILLVHIPALGSSTPATMVSIP

SEQ ID NO: 950008 - protein, 23 aa, Mycobacterium
RTDYTFPPECKYTIHAGLASEYA

SEQ ID NO: 950009 - protein, 28 aa, Mycobacterium
RTEYQRTWMPNGKWLVLPVRVLDHKLVY

SEQ ID NO: 950010 - protein, 17 aa, Mycobacterium
RTFAAITAGTAVAAVGR

SEQ ID NO: 950011 - protein, 20 aa, Mycobacterium
RTFHLYRPQGLTGAAPLVVM

SEQ ID NO: 950012 - protein, 26 aa, Mycobacterium
RTGAATYPCDVLIFATGFDALTGALT

SEQ ID NO: 950013 - protein, 23 aa, Mycobacterium
RTGALRVVPLDASYSFRSLDRGP

SEQ ID NO: 950014 - protein, 31 aa, Mycobacterium
RTGELYNYVATFGNFIVIVTANPLVVADKPV

SEQ ID NO: 950015 - protein, 22 aa, Mycobacterium
RTGTWTIFPTCVPIVGDLREPL

SEQ ID NO: 950016 - protein, 21 aa, Mycobacterium
RTHLAYELMLTNPMSGNVTLN

SEQ ID NO: 950017 - protein, 30 aa, Mycobacterium
RTIDINYLGPVRLLLGLVPAMRDNGSGHIV

SEQ ID NO: 950018 - protein, 25 aa, Mycobacterium
RTIDRAMDGVLFIDEAYTLVQERDG

SEQ ID NO: 950019 - protein, 34 aa, Mycobacterium
RTIGDKAFLEILRSWPSVHKWGNATWPQFEAYVQ

SEQ ID NO: 950020 - protein, 17 aa, Mycobacterium
RTKLAIAAAGFAAALPL

SEQ ID NO: 950021 - protein, 18 aa, Mycobacterium
RTLDLRWGRPYARSPWRT

SEQ ID NO: 950022 - protein, 24 aa, Mycobacterium
RTLEPPWVLPAEFASVLLAGPADH

SEQ ID NO: 950023 - protein, 19 aa, Mycobacterium
RTPDWFASHCYLVVVQDVR

SEQ ID NO: 950024 - protein, 27 aa, Mycobacterium
RTPPFNAMAFALRSPTFRVRDLIRLDA

SEQ ID NO: 950025 - protein, 21 aa, Mycobacterium
RTQLLADFPNIKVAVAALDVN

SEQ ID NO: 950026 - protein, 17 aa, Mycobacterium
RTRFTAAALIGAAALAI

SEQ ID NO: 950027 - protein, 36 aa, Mycobacterium
RTRGQLLRRNIVVAMTPWLHRVGLDRLLRTERREAT

SEQ ID NO: 950028 - protein, 25 aa, Mycobacterium
RTRIVLKGLLRCEPVLDLAGDLGCL

SEQ ID NO: 950029 - protein, 17 aa, Mycobacterium
RTRRRESLIANIRFARP

SEQ ID NO: 950030 - protein, 25 aa, Mycobacterium
RTSALELVNCLQWPSGSKPNPPQDL

SEQ ID NO: 950031 - protein, 27 aa, Mycobacterium
RTSTLLRLGIPFGLPAGMPATALAALT

SEQ ID NO: 950032 - protein, 25 aa, Mycobacterium
RTSVMSRLWRRPVARPAPSSCPQVG

SEQ ID NO: 950033 - protein, 18 aa, Mycobacterium
RTSYAYTNFGLTAGAEAV

SEQ ID NO: 950034 - protein, 18 aa, Mycobacterium
RTSYRKLAPSPLGRSGIV

SEQ ID NO: 950035 - protein, 17 aa, Mycobacterium
RTTIPYATRISVDGIYL

SEQ ID NO: 950036 - protein, 27 aa, Mycobacterium
RTTTSALRVLLGLSLILTGCTARQDTP

SEQ ID NO: 950037 - protein, 22 aa, Mycobacterium
RTVRADWYYPDGDEPPQRLIYL

SEQ ID NO: 950038 - protein, 18 aa, Mycobacterium
RTVRPAVAALANGALLAS

SEQ ID NO: 950039 - protein, 27 aa, Mycobacterium
RTVRRFVEFTGGWPWSWTAGQLESWIA

SEQ ID NO: 950040 - protein, 27 aa, Mycobacterium
RTVSGQLTLLVPFIDRIRARVDLRERV

SEQ ID NO: 950041 - protein, 20 aa, Mycobacterium
RTVSRSLIGPVLRAASYSDL

SEQ ID NO: 950042 - protein, 26 aa, Mycobacterium
RVAAGPAFRIRLADCGGMMGAGHADM

SEQ ID NO: 950043 - protein, 23 aa, Mycobacterium
RVAATSRLLPAIAIAAESISAME

SEQ ID NO: 950044 - protein, 24 aa, Mycobacterium
RVAAVFLRELLAPDLQPVVQKLAR

SEQ ID NO: 950045 - protein, 21 aa, Mycobacterium
RVAAVFLRELLAQDLQPVVER

SEQ ID NO: 950046 - protein, 24 aa, Mycobacterium
RVAAVFLRELLAQDLRPVVERLAQ

SEQ ID NO: 950047 - protein, 20 aa, Mycobacterium
RVAFLGWSMGGYGALLLGGR

SEQ ID NO: 950048 - protein, 17 aa, Mycobacterium
RVAFLGWSMGGYGAMLL

SEQ ID NO: 950049 - protein, 17 aa, Mycobacterium
RVASAAAFTGGLVLAGC

SEQ ID NO: 950050 - protein, 17 aa, Mycobacterium
RVAYQVLAGLAGTGPRT

SEQ ID NO: 950051 - protein, 29 aa, Mycobacterium
RVCAVPLVVGMLLATALYGGGPAAADPAA

SEQ ID NO: 950052 - protein, 20 aa, Mycobacterium
RVDDIAPWRSATKSVIDKYG

SEQ ID NO: 950053 - protein, 17 aa, Mycobacterium
RVDMLAPVQLAPQEMRL

SEQ ID NO: 950054 - protein, 24 aa, Mycobacterium
RVEPYQLVTTGRRWYLMCFDRDRD

SEQ ID NO: 950055 - protein, 25 aa, Mycobacterium
RVETELSVVGLNNTVTYRDGDPQVN

SEQ ID NO: 950056 - protein, 20 aa, Mycobacterium
RVFDAIPRIIGPRYEDLMAP

SEQ ID NO: 950057 - protein, 18 aa, Mycobacterium
RVFNQGIHWSPWLDLMVN

SEQ ID NO: 950058 - protein, 18 aa, Mycobacterium
RVGLLTAFIPGGTCYFVP

SEQ ID NO: 950059 - protein, 19 aa, Mycobacterium
RVGPDGALYFGAGLPDLLS

SEQ ID NO: 950060 - protein, 18 aa, Mycobacterium
RVGSFADLARPGLGVVIC

SEQ ID NO: 950061 - protein, 24 aa, Mycobacterium
RVHGRVFISVLAYELGRRNSNEVL

SEQ ID NO: 950062 - protein, 19 aa, Mycobacterium
RVHLDSVKDWVLSAAASVP

SEQ ID NO: 950063 - protein, 17 aa, Mycobacterium
RVHNNAPPFLVIHGSRD

SEQ ID NO: 950064 - protein, 17 aa, Mycobacterium
RVHTNAPPFLVIHGSRD

SEQ ID NO: 950065 - protein, 20 aa, Mycobacterium
RVLARVAGGWELTDLGREAL

SEQ ID NO: 950066 - protein, 30 aa, Mycobacterium
RVLDDDRKFFPLYNLSVVVNSDLLRAHPEL

SEQ ID NO: 950067 - protein, 18 aa, Mycobacterium
RVLHISDIHMRPGQRLKQ

SEQ ID NO: 950068 - protein, 26 aa, Mycobacterium
RVLPGQVSLTLTYWLVTRAETLRRPE

SEQ ID NO: 950069 - protein, 17 aa, Mycobacterium
RVLPPYGVGLHCEIQVD

SEQ ID NO: 950070 - protein, 21 aa, Mycobacterium
RVLQPLGLRKAVTDDLSGFAG

SEQ ID NO: 950071 - protein, 20 aa, Mycobacterium
RVLRLVRRAPSNPDELFWNP

SEQ ID NO: 950072 - protein, 17 aa, Mycobacterium
RVLTDIPPLIKHFADTR

SEQ ID NO: 950073 - protein, 17 aa, Mycobacterium
RVLVALTPRGRTLRNRL

SEQ ID NO: 950074 - protein, 28 aa, Mycobacterium
RVLVAVALAIPLLLGAAFLMVERLHSSP

SEQ ID NO: 950075 - protein, 25 aa, Mycobacterium
RVMLFQRTAQWVLKLPNPRYTRLTG

SEQ ID NO: 950076 - protein, 17 aa, Mycobacterium
RVPAWMMPATDAPAAEV

SEQ ID NO: 950077 - protein, 17 aa, Mycobacterium
RVPCFIISPYSRGPLMV

SEQ ID NO: 950078 - protein, 29 aa, Mycobacterium
RVPYLVVALLFGAASLILPPAASAQACPQ

SEQ ID NO: 950079 - protein, 23 aa, Mycobacterium
RVQAGWPMVALEPYGGAWVQTWL

SEQ ID NO: 950080 - protein, 32 aa, Mycobacterium
RVRELVVAWAKLYPQFGTVAALNLVKCVHWPS

SEQ ID NO: 950081 - protein, 27 aa, Mycobacterium
RVRELVVAWGKMYPQFGTTGALDMVKC

SEQ ID NO: 950082 - protein, 20 aa, Mycobacterium
RVRLLARARIALRYPGEVFV

SEQ ID NO: 950083 - protein, 20 aa, Mycobacterium
RVRLRFINNSMMFHPMHLHG

SEQ ID NO: 950084 - protein, 24 aa, Mycobacterium
RVRPVSTAQFPRPAVRPGYSALGG

SEQ ID NO: 950085 - protein, 19 aa, Mycobacterium
RVRRRAQLLVWLNPRAAQS

SEQ ID NO: 950086 - protein, 24 aa, Mycobacterium
RVSNYTAITTLRILDGVRLPKGST

SEQ ID NO: 950087 - protein, 17 aa, Mycobacterium
RVSTVIKVDWRQGAVDA

SEQ ID NO: 950088 - protein, 23 aa, Mycobacterium
RVTQWGFVDTFVPPLSAGLFALN

SEQ ID NO: 950089 - protein, 19 aa, Mycobacterium
RVVAPHRLTDPKAGPLIAV

SEQ ID NO: 950090 - protein, 17 aa, Mycobacterium
RVVDRFGSLSTLVNCAG

SEQ ID NO: 950091 - protein, 19 aa, Mycobacterium
RVVGIPALIPVLVLSPGRV

SEQ ID NO: 950092 - protein, 27 aa, Mycobacterium
RVVGRYVRWEVLPGVRDVGLVDLAGSS

SEQ ID NO: 950093 - protein, 17 aa, Mycobacterium
RVVKVVGFVASAPGFHG

SEQ ID NO: 950094 - protein, 21 aa, Mycobacterium
RVVRKAVALAVAGLVAASLSG

SEQ ID NO: 950095 - protein, 23 aa, Mycobacterium
RVWGRRPYAYLGITVPGFPNLFL

SEQ ID NO: 950096 - protein, 23 aa, Mycobacterium
RVWLLTVLAVIGLAGCGWRGLNS

SEQ ID NO: 950097 - protein, 19 aa, Mycobacterium
RVWVWSPTNLGASDPAAMI

SEQ ID NO: 950098 - protein, 19 aa, Mycobacterium
RVWVWSPTNPGASDPAAMI

SEQ ID NO: 950099 - protein, 17 aa, Mycobacterium
RVYFVRAGKVATAGRNA

SEQ ID NO: 950100 - protein, 17 aa, Mycobacterium
RVYGARNFPASVLSAVG

SEQ ID NO: 950101 - protein, 22 aa, Mycobacterium
RWAVGVVLASLLIAGTVALARP

SEQ ID NO: 950102 - protein, 17 aa, Mycobacterium
RWDGWDPSLPQIPSANI

SEQ ID NO: 950103 - protein, 21 aa, Mycobacterium
RWEVRWSATGLHPRLGENQTF

SEQ ID NO: 950104 - protein, 18 aa, Mycobacterium
RWGLPRRVQDIDAAVLSR

SEQ ID NO: 950105 - protein, 30 aa, Mycobacterium
RWIWMFRNQPLTVRLLAAAAGLLTAASALA

SEQ ID NO: 950106 - protein, 21 aa, Mycobacterium
RWLSITLAFVFVAELVAAAAL

SEQ ID NO: 950107 - protein, 21 aa, Mycobacterium
RWLVCLAALTAAIFASGVCSS

SEQ ID NO: 950108 - protein, 35 aa, Mycobacterium
RWRDVNVRQLWRSVSYPGMLRLARHHWRMGASEIV

SEQ ID NO: 950109 - protein, 18 aa, Mycobacterium
RWVLLPAGAACAAVVTGL

SEQ ID NO: 950110 - protein, 25 aa, Mycobacterium
RWVNARRVTFKYGLGAEFINVLRTL

SEQ ID NO: 950111 - protein, 20 aa, Mycobacterium
RWVVCGGTYNPPSSSLAPEN

SEQ ID NO: 950112 - protein, 29 aa, Mycobacterium
RWWRRKSARISFVVIGTALIILAKVGLAE

SEQ ID NO: 950113 - protein, 26 aa, Mycobacterium
RYADGIGHPFWLSRTIFGELAQLHGD

SEQ ID NO: 950114 - protein, 19 aa, Mycobacterium
RYAEYAAQRLARSCADKLV

SEQ ID NO: 950115 - protein, 18 aa, Mycobacterium
RYAEYAAQRLARSCVDKL

SEQ ID NO: 950116 - protein, 22 aa, Mycobacterium
RYDWAKFVGTIKYSLWRLQERV

SEQ ID NO: 950117 - protein, 17 aa, Mycobacterium
RYGGAGGKAGLYFGDGG

SEQ ID NO: 950118 - protein, 18 aa, Mycobacterium
RYGLVAVALREWLGYAWV

SEQ ID NO: 950119 - protein, 26 aa, Mycobacterium
RYHRTATYPVFLNRPADDPVDAETVA

SEQ ID NO: 950120 - protein, 30 aa, Mycobacterium
RYIRGDYVNGYFIIDLTNAGLRKSILLGTH

SEQ ID NO: 950121 - protein, 23 aa, Mycobacterium
RYITARFLPDKAIDLVDESASRL

SEQ ID NO: 950122 - protein, 23 aa, Mycobacterium
RYITSRFLPDKAIDLVDEAASRL

SEQ ID NO: 950123 - protein, 20 aa, Mycobacterium
RYNFQFTGQRFFKITDGRLD

SEQ ID NO: 950124 - protein, 18 aa, Mycobacterium
RYNSMLLRSDGTAIGFGQ

SEQ ID NO: 950125 - protein, 25 aa, Mycobacterium
RYPYREPPPAPPPGGPPPGPPAVAP

SEQ ID NO: 950126 - protein, 18 aa, Mycobacterium
RYRLQLDPQPPGGSALVQ

SEQ ID NO: 950127 - protein, 30 aa, Mycobacterium
RYTPEGDRWEWYGYPLEATSVDGDWIGLSE

SEQ ID NO: 950128 - protein, 23 aa, Mycobacterium
RYWKGRITIAVPLPWNGYRGAEG

SEQ ID NO: 950129 - protein, 23 aa, Mycobacterium
SAAAAISGLLLIAAPAVSAEPDG

SEQ ID NO: 950130 - protein, 26 aa, Mycobacterium
SAAAPALLGTLPMGSDPDSAMFAAAL

SEQ ID NO: 950131 - protein, 28 aa, Mycobacterium
SAAASALAPWKQVLRNLGIDIGKNGQIN

SEQ ID NO: 950132 - protein, 27 aa, Mycobacterium
SAADVLPHVAGWRLDWLDVDSLIGSTP

SEQ ID NO: 950133 - protein, 26 aa, Mycobacterium
SAAERLLTGEFLSYYRQFTGQTVVPT

SEQ ID NO: 950134 - protein, 23 aa, Mycobacterium
SAAIQGMPLVPLGYPAFSLKDDA

SEQ ID NO: 950135 - protein, 22 aa, Mycobacterium
SAALANLQLAIQAALNASFGVQ

SEQ ID NO: 950136 - protein, 20 aa, Mycobacterium
SAALLALPSATALVFAAPAA

SEQ ID NO: 950137 - protein, 26 aa, Mycobacterium
SAALLTAAGLIAWAPPVSAGCQYGGG

SEQ ID NO: 950138 - protein, 21 aa, Mycobacterium
SAAMGRDIPVAFLAGGPHAVY

SEQ ID NO: 950139 - protein, 28 aa, Mycobacterium
SAAMLAATGPFIDWLEITGALASETANQ

SEQ ID NO: 950140 - protein, 25 aa, Mycobacterium
SAAPDEGFWRLLDARLQLATTLVRR

SEQ ID NO: 950141 - protein, 24 aa, Mycobacterium
SAAPPGVETWYRGAARISDLVDQI

SEQ ID NO: 950142 - protein, 21 aa, Mycobacterium
SAAPYVVWMIETAAQCQEAAA

SEQ ID NO: 950143 - protein, 18 aa, Mycobacterium
SAARALGRYGVCANAICP

SEQ ID NO: 950144 - protein, 21 aa, Mycobacterium
SAARMVLLVTLGALAVAGAAV

SEQ ID NO: 950145 - protein, 25 aa, Mycobacterium
SACALFASLALAPAAGAAGAPWFAN

SEQ ID NO: 950146 - protein, 22 aa, Mycobacterium
SACSFSIGGLDYDKLESGITEQ

SEQ ID NO: 950147 - protein, 17 aa, Mycobacterium
SADALVAAVRSKAPGDK

SEQ ID NO: 950148 - protein, 25 aa, Mycobacterium
SADDHPDLFWALRGGGGGNFGVTTS

SEQ ID NO: 950149 - protein, 19 aa, Mycobacterium
SADDIFWISNGYFAGYADN

SEQ ID NO: 950150 - protein, 26 aa, Mycobacterium
SADGRARPWWRLPVHRRLVVHVSLIP

SEQ ID NO: 950151 - protein, 29 aa, Mycobacterium
SADLRVGQPVLAIGSPLGLAGTVTTGIVS

SEQ ID NO: 950152 - protein, 27 aa, Mycobacterium
SADRHRGWIWIYPIQPHVYVPHVSTEV

SEQ ID NO: 950153 - protein, 24 aa, Mycobacterium
SADYHPFLVAGVPIGGLTTGASQT

SEQ ID NO: 950154 - protein, 24 aa, Mycobacterium
SAEFAALGYLKYPAAVTVLTISDD

SEQ ID NO: 950155 - protein, 23 aa, Mycobacterium
SAEGLLVYLPDDAQDALFDNITA

SEQ ID NO: 950156 - protein, 25 aa, Mycobacterium
SAEIAEPLWIVQNFQHGTLNFDREK

SEQ ID NO: 950157 - protein, 31 aa, Mycobacterium
SAEPTVKLPIGPATALLLTREDFPAGNGTFT

SEQ ID NO: 950158 - protein, 31 aa, Mycobacterium
SAERYVAAHVPYLMWLMQAGTVSAAAAARHE

SEQ ID NO: 950159 - protein, 19 aa, Mycobacterium
SAEVTVFGLENIATVATSG

SEQ ID NO: 950160 - protein, 25 aa, Mycobacterium
SAFERVSAFQFGFTDGAAACKAIDV

SEQ ID NO: 950161 - protein, 24 aa, Mycobacterium
SAFERVSAFQFGFTDGPSACSGID

SEQ ID NO: 950162 - protein, 25 aa, Mycobacterium
SAFNLINQNAIRFVFNYTGDDWTED

SEQ ID NO: 950163 - protein, 28 aa, Mycobacterium
SAFSTLLRARRGFGFRLAVSSGQELVTD

SEQ ID NO: 950164 - protein, 19 aa, Mycobacterium
SAFVLYNDWIQAALAKTVW

SEQ ID NO: 950165 - protein, 17 aa, Mycobacterium
SAGCLLGGITMGVVGAP

SEQ ID NO: 950166 - protein, 26 aa, Mycobacterium
SAGFVNGILPYREFFGPNVAGTAEVI

SEQ ID NO: 950167 - protein, 25 aa, Mycobacterium
SAGGLPPVPVVLPKPVRQLEQTVTQ

SEQ ID NO: 950168 - protein, 20 aa, Mycobacterium
SAGIEQLIFAPRGPLGAPDA

SEQ ID NO: 950169 - protein, 20 aa, Mycobacterium
SAGMGIANAQPRDGQVDLAL

SEQ ID NO: 950170 - protein, 27 aa, Mycobacterium
SAGRLLDVVGPYLPFETPINSAAMQYY

SEQ ID NO: 950171 - protein, 23 aa, Mycobacterium
SAHSVLSDLQPLAGGGLGALGVA

SEQ ID NO: 950172 - protein, 28 aa, Mycobacterium
SAIAVTIAIALVLFMGVPRAAADDNPLG

SEQ ID NO: 950173 - protein, 25 aa, Mycobacterium
SAIFDPDPCLFVETIRLQAKKGPVP

SEQ ID NO: 950174 - protein, 18 aa, Mycobacterium
SAIGWLYAGAACATHQPP

SEQ ID NO: 950175 - protein, 23 aa, Mycobacterium
SAKLCVQYLAPIIKNRQYNFPPI

SEQ ID NO: 950176 - protein, 24 aa, Mycobacterium
SAKLCVQYLAPIIKNRQYNFPPLG

SEQ ID NO: 950177 - protein, 20 aa, Mycobacterium
SAKLVTTTNLLTASDLRNSS

SEQ ID NO: 950178 - protein, 23 aa, Mycobacterium
SAKQVWERTYPYSWLSVLADVAP

SEQ ID NO: 950179 - protein, 25 aa, Mycobacterium
SAKSKGIPLLAVNAALETPDLAGNV

SEQ ID NO: 950180 - protein, 17 aa, Mycobacterium
SAKVVGLWRGGIGTTWE

SEQ ID NO: 950181 - protein, 30 aa, Mycobacterium
SALADALAPTHTLFLAGRPSPRLDAVAERL

SEQ ID NO: 950182 - protein, 39 aa, Mycobacterium
SALAQASATPALRPIIGPGGWLIGDGLDAAADCTGEACN

SEQ ID NO: 950183 - protein, 25 aa, Mycobacterium
SALARLGPLLVVTATGREADDLTAE

SEQ ID NO: 950184 - protein, 25 aa, Mycobacterium
SALDELMLLKGRRVVTAILRQAAAR

SEQ ID NO: 950185 - protein, 24 aa, Mycobacterium
SALLAGIYVAALRSYGFGARFQPT

SEQ ID NO: 950186 - protein, 23 aa, Mycobacterium
SALPVLPPRFAADLLAKTVSTLR

SEQ ID NO: 950187 - protein, 25 aa, Mycobacterium
SALSNLYAPFVKLTAGTSISGSAGI

SEQ ID NO: 950188 - protein, 18 aa, Mycobacterium
SALTTMILPSGGAPYVVW

SEQ ID NO: 950189 - protein, 20 aa, Mycobacterium
SALVCLVSLTNPPPAPATAY

SEQ ID NO: 950190 - protein, 25 aa, Mycobacterium
SALVISQWCRLPSGADPRSYYEKGL

SEQ ID NO: 950191 - protein, 25 aa, Mycobacterium
SAMDPKLFLLWGKANTSAGYRYSVE

SEQ ID NO: 950192 - protein, 25 aa, Mycobacterium
SANATVPLTITRLPGGAIQVDIDPT

SEQ ID NO: 950193 - protein, 25 aa, Mycobacterium
SANFQNLFQAFASDPFPILSQVAAN

SEQ ID NO: 950194 - protein, 22 aa, Mycobacterium
SANGTLVLDLRGLPGGANFDGN

SEQ ID NO: 950195 - protein, 26 aa, Mycobacterium
SANHSIWFHRQVNFNDWVLYSTSSPV

SEQ ID NO: 950196 - protein, 24 aa, Mycobacterium
SANRNAFVQLVMSNLFGQNAPAIA

SEQ ID NO: 950197 - protein, 24 aa, Mycobacterium
SAPALQRRWWAARGRGAFVSVNGA

SEQ ID NO: 950198 - protein, 21 aa, Mycobacterium
SAPAVWLVEGLLQYLDASDVD

SEQ ID NO: 950199 - protein, 28 aa, Mycobacterium
SAPDVMVWSVAAPLREPVWSYRTHALVA

SEQ ID NO: 950200 - protein, 18 aa, Mycobacterium
SAPITDSLFIAGYQLGCQ

SEQ ID NO: 950201 - protein, 28 aa, Mycobacterium
SAPLAPLTTLRIGPIARRLVTCTNSDQV

SEQ ID NO: 950202 - protein, 17 aa, Mycobacterium
SAPLVAASLLSGCGAQS

SEQ ID NO: 950203 - protein, 20 aa, Mycobacterium
SAPRGVVFPIGSFGGTGFTG

SEQ ID NO: 950204 - protein, 23 aa, Mycobacterium
SAPTPTRRGLATALAAALANPDL

SEQ ID NO: 950205 - protein, 20 aa, Mycobacterium
SAPYALVCDFYGGPAPAPQP

SEQ ID NO: 950206 - protein, 27 aa, Mycobacterium
SAQDYTPVDELPYVGPLLPGNEKVFVA

SEQ ID NO: 950207 - protein, 26 aa, Mycobacterium
SAQKQVQLIADLIPRRPTAITVVPNS

SEQ ID NO: 950208 - protein, 18 aa, Mycobacterium
SARALGCTIKLLAICERL

SEQ ID NO: 950209 - protein, 25 aa, Mycobacterium
SARFLVIGPPWPTADVPLPILFIRD

SEQ ID NO: 950210 - protein, 18 aa, Mycobacterium
SARIFAGAGVGPTLAAAA

SEQ ID NO: 950211 - protein, 24 aa, Mycobacterium
SARPVLLNGILVQGAPVFPGIEMR

SEQ ID NO: 950212 - protein, 25 aa, Mycobacterium
SARTTKSVAARRAAVGSGASSTRVS

SEQ ID NO: 950213 - protein, 26 aa, Mycobacterium
SARVTAPAMTWRRPGRSWCPGCARPR

SEQ ID NO: 950214 - protein, 24 aa, Mycobacterium
SASDLSMFTVIELPFETNNPQVQL

SEQ ID NO: 950215 - protein, 25 aa, Mycobacterium
SASFGVAPLVLWQLATKHFTNITAE

SEQ ID NO: 950216 - protein, 23 aa, Mycobacterium
SASGKMRWIVGNLGAIPAVTLDY

SEQ ID NO: 950217 - protein, 23 aa, Mycobacterium
SASGLEMIPLQNVIRQCDFVVEQ

SEQ ID NO: 950218 - protein, 19 aa, Mycobacterium
SASLPPFWQTTNAAQVRAA

SEQ ID NO: 950219 - protein, 25 aa, Mycobacterium
SASMINYNWQLPALNEPGSGPAAGK

SEQ ID NO: 950220 - protein, 24 aa, Mycobacterium
SASRKAMLPVFEDNNALLYYGQQY

SEQ ID NO: 950221 - protein, 28 aa, Mycobacterium
SATAASPTAMPVGALGADEISSAVAVMF

SEQ ID NO: 950222 - protein, 27 aa, Mycobacterium
SATAAVTAFWGPQWPRDIPIVVAGTTG

SEQ ID NO: 950223 - protein, 33 aa, Mycobacterium
SATGLDDHLWAHRPLLMFAPGETDPRLVETLRR

SEQ ID NO: 950224 - protein, 28 aa, Mycobacterium
SATGVDSLPFMAILQVGIDKGWFKEEGL

SEQ ID NO: 950225 - protein, 21 aa, Mycobacterium
SATPIVGIAPLPVRPVHKSQP

SEQ ID NO: 950226 - protein, 17 aa, Mycobacterium
SATPRLALSYDGGVLVL

SEQ ID NO: 950227 - protein, 25 aa, Mycobacterium
SATQVLVGWQSWLSAADRNTWGIVD

SEQ ID NO: 950228 - protein, 33 aa, Mycobacterium
SAVAAQLAPWQQAIQALPGRVAAMATTGPAASA

SEQ ID NO: 950229 - protein, 26 aa, Mycobacterium
SAVAAQLPQINLGLGNIGSLNMGSGN

SEQ ID NO: 950230 - protein, 31 aa, Mycobacterium
SAVAAQVVPWQSVLKGLPGLASGLAGGAGAG

SEQ ID NO: 950231 - protein, 26 aa, Mycobacterium
SAVCGVIGIFCPKAAPAAAASGEGGE

SEQ ID NO: 950232 - protein, 25 aa, Mycobacterium
SAVFAYTTAFLQKGPLVIRISVGQR

SEQ ID NO: 950233 - protein, 24 aa, Mycobacterium
SAVGFLNIPLIPPFAREQNDFEGA

SEQ ID NO: 950234 - protein, 21 aa, Mycobacterium
SAVLLAWPAAAEPPSCASLGG

SEQ ID NO: 950235 - protein, 18 aa, Mycobacterium
SAVQQVWIRCGRFREGLA

SEQ ID NO: 950236 - protein, 25 aa, Mycobacterium
SAVWKILTHGAVGRTYLIGADGECD

SEQ ID NO: 950237 - protein, 21 aa, Mycobacterium
SAYVALRLRGPGTLPPFFAAV

SEQ ID NO: 950238 - protein, 17 aa, Mycobacterium
SCAVALMLLVSGCTVSP

SEQ ID NO: 950239 - protein, 20 aa, Mycobacterium
SCVDKLLFGHLQRGNPASGG

SEQ ID NO: 950240 - protein, 18 aa, Mycobacterium
SCWDPLPHPGPQPEPRPG

SEQ ID NO: 950241 - protein, 18 aa, Mycobacterium
SDAAGVVGWWVNPQAPGI

SEQ ID NO: 950242 - protein, 19 aa, Mycobacterium
SDAAGVVGWWVNPQAPGID

SEQ ID NO: 950243 - protein, 19 aa, Mycobacterium
SDAWFLIRAVTEPDSASLP

SEQ ID NO: 950244 - protein, 38 aa, Mycobacterium
SDEKPPMVDGFAISLTLPAGQYQLPYQATKSATQVLAT

SEQ ID NO: 950245 - protein, 25 aa, Mycobacterium
SDFPRYPLNLLADLNALMSTGRHEL

SEQ ID NO: 950246 - protein, 34 aa, Mycobacterium
SDGASRWWQLANLRMMFLTRALRRRLGRDVHVRR

SEQ ID NO: 950247 - protein, 34 aa, Mycobacterium
SDGDIWDWAVDWDTWLSMSALPAPSARTPATQIP

SEQ ID NO: 950248 - protein, 23 aa, Mycobacterium
SDGGFLPIIPILGGSGPQTQSPT

SEQ ID NO: 950249 - protein, 27 aa, Mycobacterium
SDGPPVILLHGWPYDIHSYLDVVPLLT

SEQ ID NO: 950250 - protein, 25 aa, Mycobacterium
SDGRAAHLYVYAACRLQAAVDSRGH

SEQ ID NO: 950251 - protein, 24 aa, Mycobacterium
SDHAEWVLPTDWTVAPGRPVLEVV

SEQ ID NO: 950252 - protein, 30 aa, Mycobacterium
SDHSRRLWTLLIFMLWHAIFIERSITPQIS

SEQ ID NO: 950253 - protein, 28 aa, Mycobacterium
SDHSRRLWTVLIFMLWHAIFVEHSVTPQ

SEQ ID NO: 950254 - protein, 18 aa, Mycobacterium
SDILIPFGGPPDPSKGRC

SEQ ID NO: 950255 - protein, 27 aa, Mycobacterium
SDKDIRLDYAYYNPLSLVVRDQKLLEN

SEQ ID NO: 950256 - protein, 28 aa, Mycobacterium
SDKDQLVGNLLPQVFRWARAVDPSQPLT

SEQ ID NO: 950257 - protein, 31 aa, Mycobacterium
SDKSEPLVLKPWTMPEPLLPMAIEAHAKTDE

SEQ ID NO: 950258 - protein, 18 aa, Mycobacterium
SDLGLDPSVLLPSQRTEP

SEQ ID NO: 950259 - protein, 17 aa, Mycobacterium
SDLKRLPRSALTFCIES

SEQ ID NO: 950260 - protein, 21 aa, Mycobacterium
SDLLKQIMFGPIDGPPRNSAQ

SEQ ID NO: 950261 - protein, 23 aa, Mycobacterium
SDMGEFFMPFPGTRVNQQVVPLD

SEQ ID NO: 950262 - protein, 26 aa, Mycobacterium
SDNLPTCIVKYIPLHTPAVVQSFNAI

SEQ ID NO: 950263 - protein, 29 aa, Mycobacterium
SDPSVAILVFPFIPQALRHRYKEIEIKAH

SEQ ID NO: 950264 - protein, 33 aa, Mycobacterium
SDPVLAEWFLRRFSLLDSLYMVPSARLIGRTVR

SEQ ID NO: 950265 - protein, 19 aa, Mycobacterium
SDTAPPPSPILTAGSDQPE

SEQ ID NO: 950266 - protein, 20 aa, Mycobacterium
SDTFGYFRYHVSDEGLGFSP

SEQ ID NO: 950267 - protein, 17 aa, Mycobacterium
SDVAGLVAFLLSEEGEW

SEQ ID NO: 950268 - protein, 21 aa, Mycobacterium
SDVDAVFYVPPAFIDGEAELG

SEQ ID NO: 950269 - protein, 18 aa, Mycobacterium
SDVIAWIEAAHPADPGRY

SEQ ID NO: 950270 - protein, 24 aa, Mycobacterium
SDVVVLLAQFGIKGAITNASTEEQ

SEQ ID NO: 950271 - protein, 24 aa, Mycobacterium
SDWDTYRCLAALQALLFPDRASDM

SEQ ID NO: 950272 - protein, 18 aa, Mycobacterium
SDWDTYRSLAPLQGLLFP

SEQ ID NO: 950273 - protein, 23 aa, Mycobacterium
SDYDAFTKAGVPAGGLFSGAEAK

SEQ ID NO: 950274 - protein, 25 aa, Mycobacterium
SDYDGFTLAGIPAGGLFSGAEGKMS

SEQ ID NO: 950275 - protein, 25 aa, Mycobacterium
SDYDGFTLAGIPSGGLFSGAEVKMT

SEQ ID NO: 950276 - protein, 19 aa, Mycobacterium
SEDWLRPDYIPPQAIPPQA

SEQ ID NO: 950277 - protein, 24 aa, Mycobacterium
SEDWMRPDYVPPQPTLPAATGADP

SEQ ID NO: 950278 - protein, 25 aa, Mycobacterium
SEFVIRRAMSQLGVPYSWGGGNANG

SEQ ID NO: 950279 - protein, 24 aa, Mycobacterium
SEGIQQLIFSPKGPLADVRNRRAV

SEQ ID NO: 950280 - protein, 24 aa, Mycobacterium
SEHLVSWLKAVIYGAAERWTDVID

SEQ ID NO: 950281 - protein, 19 aa, Mycobacterium
SEHQQQFLDSLLPEDPDNP

SEQ ID NO: 950282 - protein, 25 aa, Mycobacterium
SEHVPGWRRPLSPQPGRDLVVPVPY

SEQ ID NO: 950283 - protein, 24 aa, Mycobacterium
SEILAYIKAMVDKHALARFICFHV

SEQ ID NO: 950284 - protein, 36 aa, Mycobacterium
SEIPPRAIDPQFFAARKLPDGLTFDPAICATAAVGP

SEQ ID NO: 950285 - protein, 37 aa, Mycobacterium
SELARAANVLIITPLRIAFLILLVGTTLEVVTETSRQ

SEQ ID NO: 950286 - protein, 17 aa, Mycobacterium
SEPEVFDFPDGIGPVEC

SEQ ID NO: 950287 - protein, 17 aa, Mycobacterium
SEPEVFDFPGGIGPVEC

SEQ ID NO: 950288 - protein, 26 aa, Mycobacterium
SEPIGLLTYLLLKRIDDLAYGLGLWY

SEQ ID NO: 950289 - protein, 25 aa, Mycobacterium
SEPVDVVLTSLPWSVSETTTSSAVS

SEQ ID NO: 950290 - protein, 22 aa, Mycobacterium
SESQAVASLMRAAGRPGAALVM

SEQ ID NO: 950291 - protein, 28 aa, Mycobacterium
SEVIAHPHLVARDRWRTVATPKGDIQAL

SEQ ID NO: 950292 - protein, 19 aa, Mycobacterium
SEVPRALRMLSEPAPWQWL

SEQ ID NO: 950293 - protein, 25 aa, Mycobacterium
SFADDDVLHFFTTSTKNLLAAEQTA

SEQ ID NO: 950294 - protein, 18 aa, Mycobacterium
SFALLGLLGIKPWTAYEI

SEQ ID NO: 950295 - protein, 26 aa, Mycobacterium
SFAMCSTFKAYLAARILRGAERGELS

SEQ ID NO: 950296 - protein, 18 aa, Mycobacterium
SFDLLVFVPPHEPSVTID

SEQ ID NO: 950297 - protein, 24 aa, Mycobacterium
SFDPYRLALMFFGEVKAPITVRTT

SEQ ID NO: 950298 - protein, 21 aa, Mycobacterium
SFDTQPLWQHVIVGNGITAGT

SEQ ID NO: 950299 - protein, 23 aa, Mycobacterium
SFELLHVFALLQDDVMDGSAERR

SEQ ID NO: 950300 - protein, 26 aa, Mycobacterium
SFGFDLFAAGLTKPGLRRKMMGALCR

SEQ ID NO: 950301 - protein, 17 aa, Mycobacterium
SFGFGVWNLRSQQWDFL

SEQ ID NO: 950302 - protein, 17 aa, Mycobacterium
SFGFGVWNLRSQQWDLL

SEQ ID NO: 950303 - protein, 25 aa, Mycobacterium
SFLVPQWFWVAHADPPAPVPEPILP

SEQ ID NO: 950304 - protein, 29 aa, Mycobacterium
SFPEVDRVGWFPVALARTKLLKGQRTFLD

SEQ ID NO: 950305 - protein, 25 aa, Mycobacterium
SFPQLPFYAVWHPRLDHDASHLWLR

SEQ ID NO: 950306 - protein, 27 aa, Mycobacterium
SFSAITVGLVGEAWQGAAATAMAAAAR

SEQ ID NO: 950307 - protein, 21 aa, Mycobacterium
SFSIGWYDTFTMHLDANVRPG

SEQ ID NO: 950308 - protein, 23 aa, Mycobacterium
SFVKRWRTALHVTLLALMVAIPG

SEQ ID NO: 950309 - protein, 17 aa, Mycobacterium
SFVLVACLAGCGEQRVS

SEQ ID NO: 950310 - protein, 32 aa, Mycobacterium
SFYATLTSQGLPLLAPARLVAGLLSAATGEDV

SEQ ID NO: 950311 - protein, 26 aa, Mycobacterium
SFYHELGHMLIDIYDLPITGREEDVA

SEQ ID NO: 950312 - protein, 23 aa, Mycobacterium
SFYKPIWESFAKAGYASLSWNKP

SEQ ID NO: 950313 - protein, 18 aa, Mycobacterium
SGAALLYHPRRLQFYVIA

SEQ ID NO: 950314 - protein, 18 aa, Mycobacterium
SGAATVTMLLLLNSGRPE

SEQ ID NO: 950315 - protein, 26 aa, Mycobacterium
SGAGGRGGLLAGLQGSTGSGGAGGTG

SEQ ID NO: 950316 - protein, 20 aa, Mycobacterium
SGAKAAVRFLADRPATDPER

SEQ ID NO: 950317 - protein, 17 aa, Mycobacterium
SGALFFGNGGAGGNGAP

SEQ ID NO: 950318 - protein, 20 aa, Mycobacterium
SGALPRRPVFALLKGRGNYL

SEQ ID NO: 950319 - protein, 23 aa, Mycobacterium
SGANFERNLALVDALRGVADELG

SEQ ID NO: 950320 - protein, 20 aa, Mycobacterium
SGANNLLFRRNSQTGAVEVV

SEQ ID NO: 950321 - protein, 17 aa, Mycobacterium
SGAPGHAGGRGGNAGLI

SEQ ID NO: 950322 - protein, 23 aa, Mycobacterium
SGAVSLLTQPRPWPAVDGRPRRA

SEQ ID NO: 950323 - protein, 23 aa, Mycobacterium
SGCSGWRGLNSLPLPGVQGGGPG

SEQ ID NO: 950324 - protein, 25 aa, Mycobacterium
SGDDPLNLPWLSVGAVGFVSVISHF

SEQ ID NO: 950325 - protein, 21 aa, Mycobacterium
SGDELILYMPDYPVGRDTPTN

SEQ ID NO: 950326 - protein, 17 aa, Mycobacterium
SGDIDNVPIGWGALGAL

SEQ ID NO: 950327 - protein, 28 aa, Mycobacterium
SGDLQTFYTSLYRTLLHPNTFNDADGRY

SEQ ID NO: 950328 - protein, 17 aa, Mycobacterium
SGDLVVKQNRWLETALP

SEQ ID NO: 950329 - protein, 23 aa, Mycobacterium
SGDTQAFLGARIGVRRGNVVDAD

SEQ ID NO: 950330 - protein, 25 aa, Mycobacterium
SGFAVVAALPMLLPAGVCAAASNTA

SEQ ID NO: 950331 - protein, 24 aa, Mycobacterium
SGFDKFMALVSRCPRFSSAAAGSY

SEQ ID NO: 950332 - protein, 23 aa, Mycobacterium
SGFFSNYINVGAFDIALFGWVGD

SEQ ID NO: 950333 - protein, 21 aa, Mycobacterium
SGFFTAWFHSVTRPEDRYLFP

SEQ ID NO: 950334 - protein, 31 aa, Mycobacterium
SGFHIHGAAGLLNLFTFGLLGSSGHRSTQDV

SEQ ID NO: 950335 - protein, 18 aa, Mycobacterium
SGFLYPTAGLIEEGVVKS

SEQ ID NO: 950336 - protein, 18 aa, Mycobacterium
SGFQLPTGMGPPPGKELG

SEQ ID NO: 950337 - protein, 18 aa, Mycobacterium
SGGFERQVLPWPTGFFAA

SEQ ID NO: 950338 - protein, 20 aa, Mycobacterium
SGGILVFPHAGGAAAAYRGL

SEQ ID NO: 950339 - protein, 19 aa, Mycobacterium
SGGLQFTASTWRANGGAGS

SEQ ID NO: 950340 - protein, 23 aa, Mycobacterium
SGGPNSPALYLLDGLRAQDDFNG

SEQ ID NO: 950341 - protein, 31 aa, Mycobacterium
SGGSALILAAYYPQQFPYAAALSGFLNPSEG

SEQ ID NO: 950342 - protein, 28 aa, Mycobacterium
SGGSALILAAYYPQQFPYAASLSGFLNP

SEQ ID NO: 950343 - protein, 26 aa, Mycobacterium
SGGSCVAFDFVGFAAAHGGAGGTGGA

SEQ ID NO: 950344 - protein, 17 aa, Mycobacterium
SGGWRIDRLPNGVFLDW

SEQ ID NO: 950345 - protein, 18 aa, Mycobacterium
SGGYKAWALTPSELILYL

SEQ ID NO: 950346 - protein, 26 aa, Mycobacterium
SGGYSPTLIASIPAAAGIALDSKGRI

SEQ ID NO: 950347 - protein, 24 aa, Mycobacterium
SGHPLPEFLSTEVFQPLGLAMAVD

SEQ ID NO: 950348 - protein, 17 aa, Mycobacterium
SGIAGVFGSRAIDLCNQ

SEQ ID NO: 950349 - protein, 23 aa, Mycobacterium
SGIHYGRFISLTDILGNIAAKTH

SEQ ID NO: 950350 - protein, 25 aa, Mycobacterium
SGITGALVPFVPPAPNSDPIGLAAQ

SEQ ID NO: 950351 - protein, 25 aa, Mycobacterium
SGKNPVLAHLFLNHMLDPVSAQQNF

SEQ ID NO: 950352 - protein, 17 aa, Mycobacterium
SGKTTTTYLAEAGLRAA

SEQ ID NO: 950353 - protein, 30 aa, Mycobacterium
SGKVMVFAAASLKPVFTRLGQQFTAENPGS

SEQ ID NO: 950354 - protein, 20 aa, Mycobacterium
SGLCSYPLRKCGDGDLYGGT

SEQ ID NO: 950355 - protein, 18 aa, Mycobacterium
SGLCSYPLRKCGSGDLYG

SEQ ID NO: 950356 - protein, 24 aa, Mycobacterium
SGLDAPGMPFWSTPHDLAVIFRAA

SEQ ID NO: 950357 - protein, 26 aa, Mycobacterium
SGLERLLTWGVVVAPVIVVPAPTRRS

SEQ ID NO: 950358 - protein, 24 aa, Mycobacterium
SGLGGGGFLLYYDAAAQSVQAFDG

SEQ ID NO: 950359 - protein, 19 aa, Mycobacterium
SGLIQYAYAGAGIKLPRSS

SEQ ID NO: 950360 - protein, 17 aa, Mycobacterium
SGLIYFDVTGQPPNGVV

SEQ ID NO: 950361 - protein, 27 aa, Mycobacterium
SGLNSPVDFRFLPDGRILVAEKAGAIR

SEQ ID NO: 950362 - protein, 18 aa, Mycobacterium
SGLPAVGLPLTPGNLPVA

SEQ ID NO: 950363 - protein, 28 aa, Mycobacterium
SGLRRLLKEHLLFRRLEDAPIPLHVVAT

SEQ ID NO: 950364 - protein, 28 aa, Mycobacterium
SGLSLSPTLIFDYPTPATLARHLAQQLI

SEQ ID NO: 950365 - protein, 22 aa, Mycobacterium
SGLTGQFWQGAAAQAMTGVAQA

SEQ ID NO: 950366 - protein, 21 aa, Mycobacterium
SGLTLESWMGPASASMAAAAA

SEQ ID NO: 950367 - protein, 17 aa, Mycobacterium
SGLTPIALGSSADLRVG

SEQ ID NO: 950368 - protein, 21 aa, Mycobacterium
SGLTRLWRRSTGVPAPIVVAA

SEQ ID NO: 950369 - protein, 20 aa, Mycobacterium
SGMQIIPVANGFDAGIHRQE

SEQ ID NO: 950370 - protein, 17 aa, Mycobacterium
SGPAAAAALPGAAAAVG

SEQ ID NO: 950371 - protein, 18 aa, Mycobacterium
SGPDMARQWARCLDMYLW

SEQ ID NO: 950372 - protein, 26 aa, Mycobacterium
SGPNPLIVTRGLIATLLGLPSAAAAY

SEQ ID NO: 950373 - protein, 27 aa, Mycobacterium
SGPTPGFGMWVKILAADGTVTLYGHID

SEQ ID NO: 950374 - protein, 25 aa, Mycobacterium
SGPYLLGALKIFLTAPYSIENLPKA

SEQ ID NO: 950375 - protein, 26 aa, Mycobacterium
SGRARLSSVLWTFTVTKQDGVVCPGG

SEQ ID NO: 950376 - protein, 34 aa, Mycobacterium
SGRFLSRDNTLWASWAFIGPRHRAYFGGDSGYTK

SEQ ID NO: 950377 - protein, 29 aa, Mycobacterium
SGRGDARWPWRLPLRLAWVHAELAMVSGD

SEQ ID NO: 950378 - protein, 25 aa, Mycobacterium
SGRITAWNDPILAALNPGVPLPDTK

SEQ ID NO: 950379 - protein, 29 aa, Mycobacterium
SGRLLPGHVPMWALGPLRRGNLWETTAFA

SEQ ID NO: 950380 - protein, 24 aa, Mycobacterium
SGRQYMSWISLEDEVRALLFAISN

SEQ ID NO: 950381 - protein, 23 aa, Mycobacterium
SGRSAWRRALALSAATTLIVTSA

SEQ ID NO: 950382 - protein, 26 aa, Mycobacterium
SGRVHGRVFVSLLAYELGRHNSDVEL

SEQ ID NO: 950383 - protein, 22 aa, Mycobacterium
SGSAFPWRRQSAVAQWYVETPG

SEQ ID NO: 950384 - protein, 20 aa, Mycobacterium
SGSHIFYPPPRSHAQLVAGR

SEQ ID NO: 950385 - protein, 22 aa, Mycobacterium
SGSIIDIPLARVRESFDINVFG

SEQ ID NO: 950386 - protein, 26 aa, Mycobacterium
SGSSGAALAAGLRDLRRVGAVGAGAA

SEQ ID NO: 950387 - protein, 23 aa, Mycobacterium
SGTELIRLFLGMFTDHRGYDNVD

SEQ ID NO: 950388 - protein, 24 aa, Mycobacterium
SGTLSPSRPLTPVPIVDLVSQVVA

SEQ ID NO: 950389 - protein, 31 aa, Mycobacterium
SGTRTDVDMAFWFSDVRAPYFAGCCGASGVI

SEQ ID NO: 950390 - protein, 20 aa, Mycobacterium
SGTTPLFGAYSGGAGGDGGA

SEQ ID NO: 950391 - protein, 25 aa, Mycobacterium
SGTYDAAYDIWLDPTPKKDGVNQME

SEQ ID NO: 950392 - protein, 25 aa, Mycobacterium
SGVDSALLVELLTSTLFQGPAYSSY

SEQ ID NO: 950393 - protein, 17 aa, Mycobacterium
SGVVLVLAGCFPGVANA

SEQ ID NO: 950394 - protein, 25 aa, Mycobacterium
SGWAAGHPGLFTRAPWVVSVDDHVD

SEQ ID NO: 950395 - protein, 26 aa, Mycobacterium
SGYLKSIYDPYTLLDGKRYGLPYDGD

SEQ ID NO: 950396 - protein, 19 aa, Mycobacterium
SGYVGIAFGQGGAGGIGGA

SEQ ID NO: 950397 - protein, 26 aa, Mycobacterium
SHARQFPQRYPARIVGAALISSAAEG

SEQ ID NO: 950398 - protein, 17 aa, Mycobacterium
SHAVSAQWWLRENAKPL

SEQ ID NO: 950399 - protein, 33 aa, Mycobacterium
SHDEARFNISRVALLVVALTQRPDLLMPATEDV

SEQ ID NO: 950400 - protein, 23 aa, Mycobacterium
SHGAFVFLGPGFTPGSPSGGSGG

SEQ ID NO: 950401 - protein, 24 aa, Mycobacterium
SHGSFVFLGPGFTPGSPSGGSGGS

SEQ ID NO: 950402 - protein, 18 aa, Mycobacterium
SHLHLEIVPGLAPAGAVP

SEQ ID NO: 950403 - protein, 28 aa, Mycobacterium
SHLVPNTGLRRLLADRLEFARLEEAPIP

SEQ ID NO: 950404 - protein, 20 aa, Mycobacterium
SHPRAEAYAAFRSAGRLLMD

SEQ ID NO: 950405 - protein, 23 aa, Mycobacterium
SHTQLLSGLGLLANPVSAVATLA

SEQ ID NO: 950406 - protein, 40 aa, Mycobacterium
SHVDEWRATFNVNLFGAVALTLALLPALRSARGQVVFINS

SEQ ID NO: 950407 - protein, 18 aa, Mycobacterium
SIITIQISNGIPPAPPPP

SEQ ID NO: 950408 - protein, 23 aa, Mycobacterium
SIKAGVDWALWVSTEKVGSVLDR

SEQ ID NO: 950409 - protein, 28 aa, Mycobacterium
SILFTAIAATLIVVPWALSGTGDEHHNP

SEQ ID NO: 950410 - protein, 18 aa, Mycobacterium
SIPTPPGWSPYSGPKISP

SEQ ID NO: 950411 - protein, 17 aa, Mycobacterium
SIRIVGTNAVFRYHTAD

SEQ ID NO: 950412 - protein, 17 aa, Mycobacterium
SISMILRGGGIPNLEVL

SEQ ID NO: 950413 - protein, 17 aa, Mycobacterium
SISYLRSVFGSNGAVVT

SEQ ID NO: 950414 - protein, 23 aa, Mycobacterium
SITGLVPGLTWRTDMDSWNHCEG

SEQ ID NO: 950415 - protein, 17 aa, Mycobacterium
SITIKDAAVGKLCLAKN

SEQ ID NO: 950416 - protein, 24 aa, Mycobacterium
SITREYVLGGPVTRRYAGYVNYNG

SEQ ID NO: 950417 - protein, 28 aa, Mycobacterium
SITRRRALAAFAVGIVAPATLAACMSDG

SEQ ID NO: 950418 - protein, 28 aa, Mycobacterium
SITVGRAAILTFAITGSGFAICPIAAAA

SEQ ID NO: 950419 - protein, 27 aa, Mycobacterium
SITVMALIVLLLLNATMTQVFAADSLR

SEQ ID NO: 950420 - protein, 22 aa, Mycobacterium
SIVAFLRAGYASGAPAVGYAPL

SEQ ID NO: 950421 - protein, 22 aa, Mycobacterium
SIVAILVLTLGTAVFVGAEFSL

SEQ ID NO: 950422 - protein, 17 aa, Mycobacterium
SIYAARLAAAGNDVVVI

SEQ ID NO: 950423 - protein, 25 aa, Mycobacterium
SIYDPPMRTMIAFGGKYPTTVIPST

SEQ ID NO: 950424 - protein, 21 aa, Mycobacterium
SIYGVPPRYPTPETVPTDPAS

SEQ ID NO: 950425 - protein, 28 aa, Mycobacterium
SIYSSCAVPPLIGYLNDGKLPGTDTYCP

SEQ ID NO: 950426 - protein, 23 aa, Mycobacterium
SKDPKVVLLALDSINSDVWLVGA

SEQ ID NO: 950427 - protein, 24 aa, Mycobacterium
SKGAWQFIAPTFAAYHQPGTSRDI

SEQ ID NO: 950428 - protein, 21 aa, Mycobacterium
SKISTVWTWPDRPGVAGCAAL

SEQ ID NO: 950429 - protein, 18 aa, Mycobacterium
SKLPLLGRKLADVLDDVS

SEQ ID NO: 950430 - protein, 25 aa, Mycobacterium
SKNTPAMLSVPPWAVEPVIELGDDH

SEQ ID NO: 950431 - protein, 33 aa, Mycobacterium
SKNVPLGRLAKPDDIGWAAAFLASDAASYISGA

SEQ ID NO: 950432 - protein, 23 aa, Mycobacterium
SKRYDGLLKKTGPKWSILESAIG

SEQ ID NO: 950433 - protein, 33 aa, Mycobacterium
SKTIDWALHDGLGSYFWQHNWGSPKGYAHPAAH

SEQ ID NO: 950434 - protein, 27 aa, Mycobacterium
SKTVSGQLTLLLPFVDKIRARVDLRER

SEQ ID NO: 950435 - protein, 20 aa, Mycobacterium
SKVTEFYVYDKGDRALGEVE

SEQ ID NO: 950436 - protein, 28 aa, Mycobacterium
SKYAKLPIAPIGFIPTRYYVNMNVADRP

SEQ ID NO: 950437 - protein, 25 aa, Mycobacterium
SLAAGGWLMRALHGAPAALGADPAA

SEQ ID NO: 950438 - protein, 20 aa, Mycobacterium
SLAGGGWLLRALHGAPDALG

SEQ ID NO: 950439 - protein, 28 aa, Mycobacterium
SLAGKKAVLWFWAPWCPTCQKEAPDLQK

SEQ ID NO: 950440 - protein, 21 aa, Mycobacterium
SLAIANLPTFGLATNTPYLVD

SEQ ID NO: 950441 - protein, 32 aa, Mycobacterium; identical to SEQ ID NO: 369495

SEQ ID NO: 950442 - protein, 25 aa, Mycobacterium
SLAVMGLVVLLLANATITQVFTAPG

SEQ ID NO: 950443 - protein, 31 aa, Mycobacterium
SLDVAALKNIALYLNYDMLGSPNAAYLTYDG

SEQ ID NO: 950444 - protein, 25 aa, Mycobacterium
SLDVPGALVLLQTPQGRFAAGVGTT

SEQ ID NO: 950445 - protein, 18 aa, Mycobacterium
SLEAFLKRRIRSHGLVTA

SEQ ID NO: 950446 - protein, 26 aa, Mycobacterium
SLEAWFMHIPGMKVIVPSTPRDGKGL

SEQ ID NO: 950447 - protein, 21 aa, Mycobacterium
SLFDRRFGLADRKPAKLKPMT

SEQ ID NO: 950448 - protein, 18 aa, Mycobacterium
SLFEPYLAMVQAAPAGTA

SEQ ID NO: 950449 - protein, 30 aa, Mycobacterium
SLFSQLGGFAIPGLGPLVTRSPLLTSLVSS

SEQ ID NO: 950450 - protein, 33 aa, Mycobacterium
SLFSRLMMLRPDWTRTVLARRVAAGGLVVLAGL

SEQ ID NO: 950451 - protein, 23 aa, Mycobacterium
SLGASFPVINREGANGALAAAEV

SEQ ID NO: 950452 - protein, 20 aa, Mycobacterium
SLGCRITVNGVVRAEREVES

SEQ ID NO: 950453 - protein, 17 aa, Mycobacterium
SLGIKLLGVGYTHYTAE

SEQ ID NO: 950454 - protein, 25 aa, Mycobacterium
SLGLLDEFPPYDSIFDPVNRVLLPR

SEQ ID NO: 950455 - protein, 20 aa, Mycobacterium
SLGTLIDYAGGVPTPESIKA

SEQ ID NO: 950456 - protein, 22 aa, Mycobacterium
SLIFQSELQMRYINLCLERLVA

SEQ ID NO: 950457 - protein, 17 aa, Mycobacterium
SLITAINALAVPANDAD

SEQ ID NO: 950458 - protein, 26 aa, Mycobacterium
SLKGKPVVLWFWAAYCPFCNGEGPHV

SEQ ID NO: 950459 - protein, 20 aa, Mycobacterium
SLKYWTRALGNPAAPANVLG

SEQ ID NO: 950460 - protein, 25 aa, Mycobacterium
SLLAAVIAFRDPLLTESDMYLGVDE

SEQ ID NO: 950461 - protein, 18 aa, Mycobacterium
SLLAPRAAAPADTRRTCS

SEQ ID NO: 950462 - protein, 17 aa, Mycobacterium
SLLIAGTVALARPSSPR

SEQ ID NO: 950463 - protein, 23 aa, Mycobacterium
SLLQGYTGFIYRGGFYAKRIHDG

SEQ ID NO: 950464 - protein, 23 aa, Mycobacterium
SLLTAFVVFTTLTTKLSKRDSVY

SEQ ID NO: 950465 - protein, 25 aa, Mycobacterium
SLLTGTLPNRLYWMSAWNDPAGTNG

SEQ ID NO: 950466 - protein, 19 aa, Mycobacterium
SLLTKIPTSTPDTIRIQKS

SEQ ID NO: 950467 - protein, 19 aa, Mycobacterium
SLMAVARKDLVLSGGWDED

SEQ ID NO: 950468 - protein, 26 aa, Mycobacterium
SLMSEGPPWKVRRQWWVDHPPRELIS

SEQ ID NO: 950469 - protein, 33 aa, Mycobacterium
SLNIDALKNIALYLNFDMLASPNPGYFTYDGDQ

SEQ ID NO: 950470 - protein, 18 aa, Mycobacterium
SLPALAAQISAAVQASFG

SEQ ID NO: 950471 - protein, 23 aa, Mycobacterium
SLPDSVWINPRDIPLDRASHWAP

SEQ ID NO: 950472 - protein, 27 aa, Mycobacterium
SLQAGSPFQIAQLAEAFLKAGRCTAEA

SEQ ID NO: 950473 - protein, 27 aa, Mycobacterium
SLQGKPAVLWFWTPWCPFCNAEAPGVS

SEQ ID NO: 950474 - protein, 27 aa, Mycobacterium
SLQGKPAVLWFWTPWCPFCNAEGPAAS

SEQ ID NO: 950475 - protein, 27 aa, Mycobacterium
SLQGKPAVLWFWTPWCPYCNAEAPGVS

SEQ ID NO: 950476 - protein, 25 aa, Mycobacterium
SLQLVGPPPSPIERYPLRCNQIAIC

SEQ ID NO: 950477 - protein, 17 aa, Mycobacterium
SLRIRRALSALARRVAI

SEQ ID NO: 950478 - protein, 30 aa, Mycobacterium
SLRMLGVGDKPLRLLRNVRGLTLVELPAAE

SEQ ID NO: 950479 - protein, 19 aa, Mycobacterium
SLRQRGIAWIRADGRRRAE

SEQ ID NO: 950480 - protein, 26 aa, Mycobacterium
SLSAQAALFHEQFVQALNAGAGSYAL

SEQ ID NO: 950481 - protein, 26 aa, Mycobacterium
SLSASYTTPWPLLGAYSVTKSALDKL

SEQ ID NO: 950482 - protein, 19 aa, Mycobacterium
SLSGFLYPSSTTTNGAILA

SEQ ID NO: 950483 - protein, 25 aa, Mycobacterium
SLSPQAYGLLRSGGYGGPPFGGVVF

SEQ ID NO: 950484 - protein, 18 aa, Mycobacterium
SLSRKDVFPTNLSVGFLG

SEQ ID NO: 950485 - protein, 18 aa, Mycobacterium
SLSRLATGALLGAALAFG

SEQ ID NO: 950486 - protein, 21 aa, Mycobacterium
SLSVMRIRRSIRYALAALCAV

SEQ ID NO: 950487 - protein, 27 aa, Mycobacterium
SLTHHPLIQVMLAWQSPAPADELMLPG

SEQ ID NO: 950488 - protein, 28 aa, Mycobacterium
SLTIAEQLMPRWLVSLHADARRRGVPTP

SEQ ID NO: 950489 - protein, 20 aa, Mycobacterium
SLTKTFTITALLTLIDQGKA

SEQ ID NO: 950490 - protein, 25 aa, Mycobacterium
SLTNAYTGIVALFARLAREGQSLEV

SEQ ID NO: 950491 - protein, 25 aa, Mycobacterium
SLTNSYTGIVALFARLARQGLALEV

SEQ ID NO: 950492 - protein, 20 aa, Mycobacterium
SLTTIGTPWQGTYLSDYAHG

SEQ ID NO: 950493 - protein, 27 aa, Mycobacterium
SLTVAEQLLPRWLVSWREAVTRQGGPA

SEQ ID NO: 950494 - protein, 25 aa, Mycobacterium
SLVAAYLAAPSYWQWHRAEERQQRL

SEQ ID NO: 950495 - protein, 18 aa, Mycobacterium
SLVEITLPDDTPWGGKPV

SEQ ID NO: 950496 - protein, 20 aa, Mycobacterium
SLVFRWLVSLCSRCGDCVLV

SEQ ID NO: 950497 - protein, 19 aa, Mycobacterium
SLVIALAGPAALPGIIATA

SEQ ID NO: 950498 - protein, 26 aa, Mycobacterium
SLVNPHDICWWPKNPLPEDVPHWFDG

SEQ ID NO: 950499 - protein, 30 aa, Mycobacterium
SMAAHILPAELIPTAVFPAALQDPDTFMAE

SEQ ID NO: 950500 - protein, 18 aa, Mycobacterium
SMADALMSPLLGGKFKDQ

SEQ ID NO: 950501 - protein, 23 aa, Mycobacterium
SMALDVCRLLTLVSGLDPRLMGL

SEQ ID NO: 950502 - protein, 19 aa, Mycobacterium
SMCSWFTYSTPDANKDHVL

SEQ ID NO: 950503 - protein, 19 aa, Mycobacterium
SMDDAWFRTVAFADTAVSL

SEQ ID NO: 950504 - protein, 30 aa, Mycobacterium
SMDETPMMLLPSIPTMVWGGNVRLVGRGLG

SEQ ID NO: 950505 - protein, 25 aa, Mycobacterium
SMLDPPTRLFRPSVLWRVAEHSQRR

SEQ ID NO: 950506 - protein, 24 aa, Mycobacterium
SMQPYAAIYLHLMRALVARQPGIR

SEQ ID NO: 950507 - protein, 20 aa, Mycobacterium
SMRPVLRVAPLSVAGLLRDR

SEQ ID NO: 950508 - protein, 17 aa, Mycobacterium
SMSMALSAAPYVVWMIE

SEQ ID NO: 950509 - protein, 20 aa, Mycobacterium
SMTAGWFLGQLTGQIQIPSS

SEQ ID NO: 950510 - protein, 21 aa, Mycobacterium
SMTEVLVPHHPGDTIAVHYRS

SEQ ID NO: 950511 - protein, 22 aa, Mycobacterium
SMVFDLFAVGLTKPGVRRKIMG

SEQ ID NO: 950512 - protein, 29 aa, Mycobacterium
SNAIEAYDGYLIPLFTPGEFEGGSSFSHL

SEQ ID NO: 950513 - protein, 22 aa, Mycobacterium
SNAPHLHFQLMSGPSLLEADAV

SEQ ID NO: 950514 - protein, 25 aa, Mycobacterium
SNAVFFGHNIYGQRNIPALPEGVTY

SEQ ID NO: 950515 - protein, 25 aa, Mycobacterium
SNDTGVTELLFALGLQDRMAGYFLD

SEQ ID NO: 950516 - protein, 23 aa, Mycobacterium
SNDTWMVLAAVERALALDSEPPD

SEQ ID NO: 950517 - protein, 22 aa, Mycobacterium
SNDYWYLALNEARAPWNDVRVR

SEQ ID NO: 950518 - protein, 24 aa, Mycobacterium
SNERTFVPAVLPMTAVGNSFYVVI

SEQ ID NO: 950519 - protein, 24 aa, Mycobacterium
SNFDVALWNPLASYLERLGAHVHT

SEQ ID NO: 950520 - protein, 25 aa, Mycobacterium
SNGAMMALRLGCQSDLFAAIAPVAG

SEQ ID NO: 950521 - protein, 20 aa, Mycobacterium
SNGKAWRHLSKAQAKHRALE

SEQ ID NO: 950522 - protein, 24 aa, Mycobacterium
SNGMVVLTLWEPGADKPVLVGLRY

SEQ ID NO: 950523 - protein, 17 aa, Mycobacterium
SNGQIYPGAVLYQRIID

SEQ ID NO: 950524 - protein, 23 aa, Mycobacterium
SNITFEDWQRVIDVNLNGVFHTI

SEQ ID NO: 950525 - protein, 24 aa, Mycobacterium
SNNFVGIPLYPPTARCLVHESLAG

SEQ ID NO: 950526 - protein, 25 aa, Mycobacterium
SNNGLTLNYLIKQAPTMGTLTIDQE

SEQ ID NO: 950527 - protein, 31 aa, Mycobacterium
SNNPFNTGNYPFLLGPIYISNSPTGGGQTIF

SEQ ID NO: 950528 - protein, 26 aa, Mycobacterium
SNNSGLPLPGLGLLGLANHGTFNQGF

SEQ ID NO: 950529 - protein, 23 aa, Mycobacterium
SNPYATIYDAYAVCRELDRGTSP

SEQ ID NO: 950530 - protein, 25 aa, Mycobacterium
SNSGYPEHTFTWDTALRLRAALNAL

SEQ ID NO: 950531 - protein, 22 aa, Mycobacterium
SNSTFLYAYGFPEDIDATHALY

SEQ ID NO: 950532 - protein, 30 aa, Mycobacterium
SNSVTWWTGPGCHLVTYPIAGGSLLNLAAS

SEQ ID NO: 950533 - protein, 30 aa, Mycobacterium
SNTDLSLPLASIFKLYVLLAVADAVKAGTL

SEQ ID NO: 950534 - protein, 24 aa, Mycobacterium
SNVGLGNAGLLNTGSFNSGNFNTG

SEQ ID NO: 950535 - protein, 19 aa, Mycobacterium
SNWATITINVTPVNDVPVA

SEQ ID NO: 950536 - protein, 20 aa, Mycobacterium
SNYLLLGEIVRRVSGHPLPE

SEQ ID NO: 950537 - protein, 23 aa, Mycobacterium
SPAEPAGPPPPPPPVSDVINALR

SEQ ID NO: 950538 - protein, 28 aa, Mycobacterium
SPAGGALGRLRPLFRTGLGARLGSGRQY

SEQ ID NO: 950539 - protein, 19 aa, Mycobacterium
SPALWTSPGAAAPGAFDGA

SEQ ID NO: 950540 - protein, 17 aa, Mycobacterium
SPAWARLMRDVIRFDDS

SEQ ID NO: 950541 - protein, 24 aa, Mycobacterium
SPDPPANLPPQQGLLSPLEQSTGR

SEQ ID NO: 950542 - protein, 32 aa, Mycobacterium
SPDTSLVALNRLLPILIKANAGSALAVDVNMA

SEQ ID NO: 950543 - protein, 28 aa, Mycobacterium
SPDVKNAVRFAFWGAEEEGLIGSTDYVK

SEQ ID NO: 950544 - protein, 21 aa, Mycobacterium
SPFSESFLTQNFAPGSVVPFM

SEQ ID NO: 950545 - protein, 27 aa, Mycobacterium
SPGEPKPWTLVPAKDPLKTAADFLVAI

SEQ ID NO: 950546 - protein, 25 aa, Mycobacterium
SPGFHGLHIHAFGRCEPNSPAPDGG

SEQ ID NO: 950547 - protein, 27 aa, Mycobacterium
SPGLKRQLIVQLTQPGTYQTSCRPGMV

SEQ ID NO: 950548 - protein, 22 aa, Mycobacterium
SPGPINRRMALMALGAGVLAPN

SEQ ID NO: 950549 - protein, 27 aa, Mycobacterium
SPIAQGWLHSFLASPPPRRAQMAAQVQ

SEQ ID NO: 950550 - protein, 28 aa, Mycobacterium
SPKTPLAKAALPDLMLSPDDIDSALGTR

SEQ ID NO: 950551 - protein, 24 aa, Mycobacterium
SPKVESLGLVYDGSALAVSENMGV

SEQ ID NO: 950552 - protein, 43 aa, Mycobacterium
SPLTGLTDQLGMPGGLASLLPAGNPLAGLLPGAATTAPATTVA

SEQ ID NO: 950553 - protein, 24 aa, Mycobacterium
SPLTTLLGLLGLGNALPSGGSVLN

SEQ ID NO: 950554 - protein, 24 aa, Mycobacterium
SPLYAIAAGAAVGALLTACAGSDS

SEQ ID NO: 950555 - protein, 18 aa, Mycobacterium
SPPGREFRYSDINYILLG

SEQ ID NO: 950556 - protein, 26 aa, Mycobacterium
SPQAEWGWWYQYYFATERGLHGYRHN

SEQ ID NO: 950557 - protein, 23 aa, Mycobacterium
SPQGARTIALWEPALRADLLGEN

SEQ ID NO: 950558 - protein, 18 aa, Mycobacterium
SPQNLTMPYVLPNNGEVV

SEQ ID NO: 950559 - protein, 22 aa, Mycobacterium
SPQVHNAVRFGFWGAEELGLIG

SEQ ID NO: 950560 - protein, 23 aa, Mycobacterium
SPTYIQDRLMYAYISTPTDNRVV

SEQ ID NO: 950561 - protein, 28 aa, Mycobacterium
SPVAQGWLHSFLASPPPRRAQMAAQLQA

SEQ ID NO: 950562 - protein, 33 aa, Mycobacterium
SPVHNYVPAPLKPFFRLVWSPRLARVTRRWARR

SEQ ID NO: 950563 - protein, 24 aa, Mycobacterium
SPVNAAISALVLPSAFRPVPDASS

SEQ ID NO: 950564 - protein, 29 aa, Mycobacterium
SPVNAAISALVLPSAFRPVPDPATPTGSR

SEQ ID NO: 950565 - protein, 29 aa, Mycobacterium
SPVNAAISALVLPSAFRPVPDPNSPTGSR

SEQ ID NO: 950566 - protein, 30 aa, Mycobacterium
SPVNAAISALVLPSAFRPVPDTAAPTGSRW

SEQ ID NO: 950567 - protein, 25 aa, Mycobacterium
SPVNSAISALVLPSAFRPVPDSATT

SEQ ID NO: 950568 - protein, 25 aa, Mycobacterium
SQAGDLLGIALLTSAKPDPAAGPGV

SEQ ID NO: 950569 - protein, 23 aa, Mycobacterium
SQAPINRRMALMALGAGVLAPNV

SEQ ID NO: 950570 - protein, 24 aa, Mycobacterium
SQAPLQQTPLPQTPLRQAPLQQVP

SEQ ID NO: 950571 - protein, 28 aa, Mycobacterium
SQARLPARYHVPLPIPAQLAPVATDAHT

SEQ ID NO: 950572 - protein, 20 aa, Mycobacterium
SQDDCIVTNAWNAPTFEHTG

SEQ ID NO: 950573 - protein, 18 aa, Mycobacterium
SQEPFTVTYTIRPEAQWT

SEQ ID NO: 950574 - protein, 22 aa, Mycobacterium
SQGAMVIDLITIARAPVAGFIP

SEQ ID NO: 950575 - protein, 28 aa, Mycobacterium
SQGFKALDVTLPMPPRWTPVPDPNVPDA

SEQ ID NO: 950576 - protein, 27 aa, Mycobacterium
SQGQADAWAIWDPYTALAQKQLKVRTL

SEQ ID NO: 950577 - protein, 18 aa, Mycobacterium
SQMDPALLAAVQNAARAA

SEQ ID NO: 950578 - protein, 21 aa, Mycobacterium
SQNAVFVVPLGVGAHLRGWGV

SEQ ID NO: 950579 - protein, 26 aa, Mycobacterium
SQPSYVLLRVLIDEGPLPLSRLARLA

SEQ ID NO: 950580 - protein, 22 aa, Mycobacterium
SQRSLAYDRAWWFARFVADTYG

SEQ ID NO: 950581 - protein, 17 aa, Mycobacterium
SQWPATCDSLGLPATSG

SEQ ID NO: 950582 - protein, 24 aa, Mycobacterium
SRAASPLALLAAAVLLAGCGHSES

SEQ ID NO: 950583 - protein, 23 aa, Mycobacterium
SRADYHPFMVAGVPIGGLTTGSS

SEQ ID NO: 950584 - protein, 23 aa, Mycobacterium
SRAQLALWAEWGSPLIAGNDLTH

SEQ ID NO: 950585 - protein, 24 aa, Mycobacterium
SRCTFKTWANLLAGGAPTGFPGDT

SEQ ID NO: 950586 - protein, 26 aa, Mycobacterium
SRDFRALNIVLPMPRGWELIPDPNVP

SEQ ID NO: 950587 - protein, 34 aa, Mycobacterium
SREIEVLEFVPAADLDPLMYDRSYFLEPEGKSTK

SEQ ID NO: 950588 - protein, 25 aa, Mycobacterium
SRFSFISYLHAMGRLTNFINHGVLT

SEQ ID NO: 950589 - protein, 22 aa, Mycobacterium
SRFWSKFAGHLMVRSSIPDPAS

SEQ ID NO: 950590 - protein, 20 aa, Mycobacterium
SRFYSEGAFINVYMCDLNLT

SEQ ID NO: 950591 - protein, 21 aa, Mycobacterium
SRIYVVLPHTATARAVTSWVH

SEQ ID NO: 950592 - protein, 25 aa, Mycobacterium
SRLATFVIGLTFLVGIGIAYPAQVR

SEQ ID NO: 950593 - protein, 27 aa, Mycobacterium
SRLRRRAHLVVWLNPRAAAPGYEPLAG

SEQ ID NO: 950594 - protein, 24 aa, Mycobacterium
SRNEYVVGWIKRGPSGVIGTNKKD

SEQ ID NO: 950595 - protein, 26 aa, Mycobacterium
SRPKLDPPLLNALPRLPQCVPNAVLG

SEQ ID NO: 950596 - protein, 29 aa, Mycobacterium
SRPSAWLVEGLLFFLKSSAQDLLLETIDS

SEQ ID NO: 950597 - protein, 25 aa, Mycobacterium
SRQAITLDTLLIDPATALPKISALV

SEQ ID NO: 950598 - protein, 24 aa, Mycobacterium
SRRRFLYSAAGLTLLGVTATACGS

SEQ ID NO: 950599 - protein, 18 aa, Mycobacterium
SRRRVLVGAAALAALSVT

SEQ ID NO: 950600 - protein, 21 aa, Mycobacterium
SRRRVTLVGDAGYCPGPAVGG

SEQ ID NO: 950601 - protein, 19 aa, Mycobacterium
SRRVVPPGGVYWNPVTQQP

SEQ ID NO: 950602 - protein, 18 aa, Mycobacterium
SRRYGISVLRVIPTAGLG

SEQ ID NO: 950603 - protein, 23 aa, Mycobacterium
SRTLLITLVVVIGTVALAFASTI

SEQ ID NO: 950604 - protein, 21 aa, Mycobacterium
SRTWEIPAMGAMPSPLLGSDS

SEQ ID NO: 950605 - protein, 21 aa, Mycobacterium
SRVGFLGWSMGGYGALLLGSR

SEQ ID NO: 950606 - protein, 22 aa, Mycobacterium
SRVGFLGWSMGGYGALLLGSRL

SEQ ID NO: 950607 - protein, 26 aa, Mycobacterium
SRVRLLGNWITTVAFPARAGSSTTAT

SEQ ID NO: 950608 - protein, 18 aa, Mycobacterium
SRWRRFDELDRYPRGILP

SEQ ID NO: 950609 - protein, 18 aa, Mycobacterium
SRYFGPNLARLSAIRQKY

SEQ ID NO: 950610 - protein, 19 aa, Mycobacterium
SRYHALVDPLVAKPGRTSD

SEQ ID NO: 950611 - protein, 26 aa, Mycobacterium
SSAIVTVLLALVFGPANAAAADDKVP

SEQ ID NO: 950612 - protein, 25 aa, Mycobacterium
SSANLFGPGYYNQLKVPVAVVGASG

SEQ ID NO: 950613 - protein, 27 aa, Mycobacterium
SSAVSLRLGYLPRITHASALVALHDGF

SEQ ID NO: 950614 - protein, 28 aa, Mycobacterium
SSAVTVLPGFTGQLLVALDPGASARADE

SEQ ID NO: 950615 - protein, 24 aa, Mycobacterium
SSCTWQLSLFIPDGVPPPAGDPVP

SEQ ID NO: 950616 - protein, 24 aa, Mycobacterium
SSCTWQLSLFIPEGVPPPAGAPVP

SEQ ID NO: 950617 - protein, 28 aa, Mycobacterium
SSDARVNSFLLPLLRSCNFNVVANQPGN

SEQ ID NO: 950618 - protein, 18 aa, Mycobacterium
SSDCVAAVFGGWTSSSRK

SEQ ID NO: 950619 - protein, 29 aa, Mycobacterium
SSDGFTQSYTLPDPARPGAAPPFGIDDTV

SEQ ID NO: 950620 - protein, 19 aa, Mycobacterium
SSEFTAFGGQVFVLSAQGQ

SEQ ID NO: 950621 - protein, 27 aa, Mycobacterium
SSEPGTTPAIWTGSPSPAAPSGEDHGG

SEQ ID NO: 950622 - protein, 26 aa, Mycobacterium
SSFPVPSKLWTIKDLGGWKSVDKELF

SEQ ID NO: 950623 - protein, 24 aa, Mycobacterium
SSGSAKWNLLAPYAAKSNGGQDPE

SEQ ID NO: 950624 - protein, 20 aa, Mycobacterium
SSGWDIMDFVKQMQSLSGGN

SEQ ID NO: 950625 - protein, 21 aa, Mycobacterium
SSGWFGGSPARWVGSPSSASA

SEQ ID NO: 950626 - protein, 26 aa, Mycobacterium
SSIAERIPLPGRRPARRSSSRPVRSQ

SEQ ID NO: 950627 - protein, 29 aa, Mycobacterium
SSLAGKPAVLWFWTPWCPFCNAEAPSVGQ

SEQ ID NO: 950628 - protein, 21 aa, Mycobacterium
SSLFSLDEWAADALALIQAMD

SEQ ID NO: 950629 - protein, 25 aa, Mycobacterium
SSLGLLDDFPPYDSIFDPVNRVLLP

SEQ ID NO: 950630 - protein, 20 aa, Mycobacterium
SSLPRRAAASTVLIVPVVST

SEQ ID NO: 950631 - protein, 18 aa, Mycobacterium
SSLRDRGVVTRRSSTVLV

SEQ ID NO: 950632 - protein, 22 aa, Mycobacterium
SSNMPQIQCQIAVDGQVVVTQS

SEQ ID NO: 950633 - protein, 24 aa, Mycobacterium
SSNRKPSLQRWLRGRLVGAMLNAA

SEQ ID NO: 950634 - protein, 27 aa, Mycobacterium
SSPAVWANPFRWYPVATSTADAITLAE

SEQ ID NO: 950635 - protein, 22 aa, Mycobacterium
SSPDLVLLFHNGTSAGIATTKA

SEQ ID NO: 950636 - protein, 20 aa, Mycobacterium
SSPKGLIAGALVVAAALTAA

SEQ ID NO: 950637 - protein, 31 aa, Mycobacterium
SSPQDDPLNPLTFPKALLLKVTGPISTDFPE

SEQ ID NO: 950638 - protein, 27 aa, Mycobacterium
SSPVAMPPIPPIPPIAPRYGAIAVADN

SEQ ID NO: 950639 - protein, 32 aa, Mycobacterium
SSQLSIRRAGLRFTWRPLINRFVETTLAGEPT

SEQ ID NO: 950640 - protein, 33 aa, Mycobacterium
SSRKAMLPVFESANSLLYYPVQYEGLESSPNIF

SEQ ID NO: 950641 - protein, 23 aa, Mycobacterium
SSRTRVYVLFPNTGKPGAVTSWL

SEQ ID NO: 950642 - protein, 34 aa, Mycobacterium
SSSPAYDLIVVDNPWMVDFANAKFLQPLDARIDS

SEQ ID NO: 950643 - protein, 34 aa, Mycobacterium
SSSRKAMLPVFESANALLYYPVQYEGLESSPNIF

SEQ ID NO: 950644 - protein, 24 aa, Mycobacterium
SSSRYFPLAVRSTSSVTSYWSSSV

SEQ ID NO: 950645 - protein, 23 aa, Mycobacterium
SSTFWGVTALVLVAVLALTAAEI

SEQ ID NO: 950646 - protein, 26 aa, Mycobacterium
SSTTPAPPPGSPAPAPKPAAIRGSVA

SEQ ID NO: 950647 - protein, 24 aa, Mycobacterium
SSTTPLAGAGWTAAAPTAAPGTFM

SEQ ID NO: 950648 - protein, 21 aa, Mycobacterium
SSVAFQAAHARFVEVAAKVNA

SEQ ID NO: 950649 - protein, 21 aa, Mycobacterium
SSVTSYWSSSVLSARVSVFSE

SEQ ID NO: 950650 - protein, 27 aa, Mycobacterium
SSYQRGAPVDFPLDGVIPGFQKAIAGQ

SEQ ID NO: 950651 - protein, 25 aa, Mycobacterium
STAAAAILGLLAPGGRITAGRIIFD

SEQ ID NO: 950652 - protein, 25 aa, Mycobacterium
STAGAALAAGLRDLRRVGAVGAGAA

SEQ ID NO: 950653 - protein, 22 aa, Mycobacterium
STAISPAAWGAPSNIAGMVVFI

SEQ ID NO: 950654 - protein, 21 aa, Mycobacterium
STAPATHLVTPAAAGTAPQHF

SEQ ID NO: 950655 - protein, 22 aa, Mycobacterium
STAVWKVVANDLPLALVVPDGT

SEQ ID NO: 950656 - protein, 35 aa, Mycobacterium
STDPRVQLVSNEEELLWLTLDAGSDRAKTDSSSAL

SEQ ID NO: 950657 - protein, 26 aa, Mycobacterium
STDSMEQLLRAWLPKASEAGITSVFD

SEQ ID NO: 950658 - protein, 23 aa, Mycobacterium
STFDLARRLAPSARFLVIGPPWP

SEQ ID NO: 950659 - protein, 17 aa, Mycobacterium
STFLVAAAGLLASAAPR

SEQ ID NO: 950660 - protein, 18 aa, Mycobacterium
STGKIYFDVTGPAPTIVA

SEQ ID NO: 950661 - protein, 29 aa, Mycobacterium
STGLGYALTFPLNQNIIDRGVRGDYMNLF

SEQ ID NO: 950662 - protein, 30 aa, Mycobacterium; identical to SEQ ID NO: 935768

SEQ ID NO: 950663 - protein, 24 aa, Mycobacterium
STHELLDYAFAQPSNFVPGQGYEY

SEQ ID NO: 950664 - protein, 20 aa, Mycobacterium
STIKVLLALVALDELDLNST

SEQ ID NO: 950665 - protein, 23 aa, Mycobacterium
STKAYFDLLATLLKDNPPAEADK

SEQ ID NO: 950666 - protein, 17 aa, Mycobacterium
STLCLDVDWVLGSCMSV

SEQ ID NO: 950667 - protein, 29 aa, Mycobacterium
STLNAAVDLYRKLGRAPIVIRKEIPGFVA

SEQ ID NO: 950668 - protein, 27 aa, Mycobacterium
STLPMIDMPHYLDYLTKRLAAAGCEIE

SEQ ID NO: 950669 - protein, 24 aa, Mycobacterium
STLSRFIPAVSAALLTAGLVPGTA

SEQ ID NO: 950670 - protein, 20 aa, Mycobacterium
STLSTFYYEPPHLARLLTTL

SEQ ID NO: 950671 - protein, 25 aa, Mycobacterium
STNPALLRLLRDVLPPREWTTDELV

SEQ ID NO: 950672 - protein, 25 aa, Mycobacterium
STNTQLLWYRKDLVPEPPATWDQTV

SEQ ID NO: 950673 - protein, 25 aa, Mycobacterium
STPAALAVPPWAVEPFTELGRDHRR

SEQ ID NO: 950674 - protein, 19 aa, Mycobacterium
STPAFPPPAGPPPANGAPP

SEQ ID NO: 950675 - protein, 17 aa, Mycobacterium
STPFGLDCGIWEDSSFG

SEQ ID NO: 950676 - protein, 23 aa, Mycobacterium
STPGFARRLIALAVAGAAAGCLS

SEQ ID NO: 950677 - protein, 29 aa, Mycobacterium
STPPPVAQAALPGLLLTSADLDSALGATG

SEQ ID NO: 950678 - protein, 20 aa, Mycobacterium
STPRDLAVLFRAAMAYPVFA

SEQ ID NO: 950679 - protein, 23 aa, Mycobacterium
STRLHRAWPRYDTMRTELAVGQF

SEQ ID NO: 950680 - protein, 19 aa, Mycobacterium
STRLVKPDPFRAGWATVPG

SEQ ID NO: 950681 - protein, 18 aa, Mycobacterium
STRPTVGSVLRVEPRRFK

SEQ ID NO: 950682 - protein, 24 aa, Mycobacterium
STRSTAYDRAWWFTRYVADAYGPA

SEQ ID NO: 950683 - protein, 25 aa, Mycobacterium
STTDQAYQFLAAALRTYCPDRLPIL

SEQ ID NO: 950684 - protein, 17 aa, Mycobacterium
STTIWARRVLAGAPFDD

SEQ ID NO: 950685 - protein, 27 aa, Mycobacterium
STTPMEPALYLLWAQANVAAGYRYSVE

SEQ ID NO: 950686 - protein, 22 aa, Mycobacterium
STTRVTTLLGAAVLATALTGCG

SEQ ID NO: 950687 - protein, 23 aa, Mycobacterium
STVFGVHFPGPLGLAAGFDKNGR

SEQ ID NO: 950688 - protein, 20 aa, Mycobacterium
STVLFSSNNTSSASALGIEN

SEQ ID NO: 950689 - protein, 21 aa, Mycobacterium
STWGTFPAAISWEVASRQAQA

SEQ ID NO: 950690 - protein, 26 aa, Mycobacterium
STYATALLRWWDQAEAIPARFVLAAA

SEQ ID NO: 950691 - protein, 21 aa, Mycobacterium
STYLLAPMGWINGDATHSIPG

SEQ ID NO: 950692 - protein, 31 aa, Mycobacterium
SVAAADPAPPIPFIPAVPAPLPAVPGSYTYS

SEQ ID NO: 950693 - protein, 20 aa, Mycobacterium
SVANVWRVRPGPVAARHWQV

SEQ ID NO: 950694 - protein, 28 aa, Mycobacterium
SVAPTAIRFYSADGTLLFTEPRGLAAGD

SEQ ID NO: 950695 - protein, 19 aa, Mycobacterium
SVAVPGFPNLFMLMGPHSP

SEQ ID NO: 950696 - protein, 25 aa, Mycobacterium
SVAWAETYPGTLSYYLASAFREIWL

SEQ ID NO: 950697 - protein, 37 aa, Mycobacterium
SVAWAETYPGTLSYYLATAFREIWMQPSGEAGLIGFA

SEQ ID NO: 950698 - protein, 24 aa, Mycobacterium
SVAYVFPGWLDIGSANKNLTAVSA

SEQ ID NO: 950699 - protein, 31 aa, Mycobacterium
SVDRVAFHWWLVLATLRWGVICRYQAERHLS

SEQ ID NO: 950700 - protein, 41 aa, Mycobacterium
SVDTRRAQISVPGWLAFGWGLVDLFVPEPVERLARRLIDDR

SEQ ID NO: 950701 - protein, 18 aa, Mycobacterium
SVDVYPVDYPASGDFGDR

SEQ ID NO: 950702 - protein, 23 aa, Mycobacterium
SVEAKLYGLPFGDSAYGAEDISL

SEQ ID NO: 950703 - protein, 27 aa, Mycobacterium
SVEATMEGLWWDRPFALDSVDISASVA

SEQ ID NO: 950704 - protein, 24 aa, Mycobacterium
SVEREVFPALLADGLRIYGHVDAS

SEQ ID NO: 950705 - protein, 25 aa, Mycobacterium
SVERVVMPWIVRWGMYRGVRENDPL

SEQ ID NO: 950706 - protein, 23 aa, Mycobacterium
SVGALSVPVGWTTAAPAATGGAA

SEQ ID NO: 950707 - protein, 17 aa, Mycobacterium
SVGVQMPFGCRMGICQS

SEQ ID NO: 950708 - protein, 17 aa, Mycobacterium
SVGVSIFAVSAAAAVLA

SEQ ID NO: 950709 - protein, 26 aa, Mycobacterium
SVIGDPRLRIFHASRLHLVSFNDDSV

SEQ ID NO: 950710 - protein, 29 aa, Mycobacterium
SVIRDAGAVPSFLGYHGYPASICASVNER

SEQ ID NO: 950711 - protein, 28 aa, Mycobacterium
SVIREAGAIPSFLGYHGYPASICASVNE

SEQ ID NO: 950712 - protein, 21 aa, Mycobacterium
SVKVSFWYDSKYKVPADAKAA

SEQ ID NO: 950713 - protein, 28 aa, Mycobacterium
SVLFTALAATVMLLPWAISGIPDGDEKP

SEQ ID NO: 950714 - protein, 29 aa, Mycobacterium
SVLMALLEQIPIIGDFVQPLVIGLQQVPV

SEQ ID NO: 950715 - protein, 21 aa, Mycobacterium
SVLPPLPPQFAADLLVKTVAM

SEQ ID NO: 950716 - protein, 26 aa, Mycobacterium
SVLSADRYVIAAGAWTGQLAALAGID

SEQ ID NO: 950717 - protein, 18 aa, Mycobacterium
SVLSGWHLALALTSRARV

SEQ ID NO: 950718 - protein, 25 aa, Mycobacterium
SVMIMALIVVLLANATLTQVFTADG

SEQ ID NO: 950719 - protein, 26 aa, Mycobacterium
SVMSPLGGFLPRRRPARPSGSPRPAR

SEQ ID NO: 950720 - protein, 19 aa, Mycobacterium
SVNRDLAFSELGFDSQMTV

SEQ ID NO: 950721 - protein, 24 aa, Mycobacterium
SVNVSGYPNLFFTFGPNSGPGHNS

SEQ ID NO: 950722 - protein, 23 aa, Mycobacterium
SVNYQVGLLYRAATDDAKLDAAG

SEQ ID NO: 950723 - protein, 26 aa, Mycobacterium
SVPGPAPVMPLPGAPALPLPAAAPQA

SEQ ID NO: 950724 - protein, 20 aa, Mycobacterium
SVPNRWRVRPGPVAARHWVV

SEQ ID NO: 950725 - protein, 27 aa, Mycobacterium
SVPPDQATAHFGWLGGFFAVDANLGSA

SEQ ID NO: 950726 - protein, 24 aa, Mycobacterium
SVPSGLVITFFTPATDSASFSAVA

SEQ ID NO: 950727 - protein, 23 aa, Mycobacterium
SVQIDHIVPLAYAWDMGAYGWPA

SEQ ID NO: 950728 - protein, 23 aa, Mycobacterium
SVQIDHIVPLSYAWDMGAYGWPA

SEQ ID NO: 950729 - protein, 25 aa, Mycobacterium
SVQWEPAEFYPAHTPITVSVGGFST

SEQ ID NO: 950730 - protein, 24 aa, Mycobacterium
SVRDGDTIVLKRSRPLDISVDGQD

SEQ ID NO: 950731 - protein, 30 aa, Mycobacterium
SVRVAELHESFTRALTAGSTAYATAEAANA

SEQ ID NO: 950732 - protein, 41 aa, Mycobacterium
SVSAGPFFKTYVANLLPGQFLQPFIDVAFSDLGLDPNVLLP

SEQ ID NO: 950733 - protein, 26 aa, Mycobacterium
SVSTEGRFRFLRVYPNPMAYAPVTGF

SEQ ID NO: 950734 - protein, 24 aa, Mycobacterium
SVSVLLLAVGCSFFGAPRSGDWRA

SEQ ID NO: 950735 - protein, 18 aa, Mycobacterium
SVSVPGFPNLFMLNGPNG

SEQ ID NO: 950736 - protein, 23 aa, Mycobacterium
SVTEQLLTTRPDLTLGGGAETFS

SEQ ID NO: 950737 - protein, 20 aa, Mycobacterium
SVTGPPGELYLLASDGTTLA

SEQ ID NO: 950738 - protein, 26 aa, Mycobacterium
SVTPAGVYLLPFPMCHIAGYNMLVQH

SEQ ID NO: 950739 - protein, 20 aa, Mycobacterium
SVTPAPGWTLGNRGPNWVAL

SEQ ID NO: 950740 - protein, 23 aa, Mycobacterium
SVTVAALASLLPAAPAKADVLVY

SEQ ID NO: 950741 - protein, 26 aa, Mycobacterium
SVTVMALIVLLLINATMTQVFAADSL

SEQ ID NO: 950742 - protein, 32 aa, Mycobacterium
SVVATEPVAFYLLKATGLLNRTPPSFAAAIEN

SEQ ID NO: 950743 - protein, 22 aa, Mycobacterium
SVVKVFIADDLLLQVAQRRTGL

SEQ ID NO: 950744 - protein, 25 aa, Mycobacterium
SVVPRSWSGFFRPGPAVVVSPENFG

SEQ ID NO: 950745 - protein, 24 aa, Mycobacterium
SVVSALTLESWLGPASASMAAAAA

SEQ ID NO: 950746 - protein, 19 aa, Mycobacterium
SVVYMSGLSEVPVVATRDG

SEQ ID NO: 950747 - protein, 24 aa, Mycobacterium
SWAKVHWPGAIQTHYWSAQDYTPV

SEQ ID NO: 950748 - protein, 19 aa, Mycobacterium
SWDLVRDGLFVGYQLDRVF

SEQ ID NO: 950749 - protein, 24 aa, Mycobacterium
SWFAGYRGDLAFASLIVGGGSSEY

SEQ ID NO: 950750 - protein, 20 aa, Mycobacterium
SWFWFVSLCIPEKTPDCVNV

SEQ ID NO: 950751 - protein, 21 aa, Mycobacterium
SWGIWAICALAAVVVAGCGRS

SEQ ID NO: 950752 - protein, 22 aa, Mycobacterium
SWGQSWLQICHNAFAGIDVDPD

SEQ ID NO: 950753 - protein, 19 aa, Mycobacterium
SWGRLVFCGSPRRYEPRYF

SEQ ID NO: 950754 - protein, 27 aa, Mycobacterium
SWKPEGMYFWKDYAPGMEPFFSVPANS

SEQ ID NO: 950755 - protein, 17 aa, Mycobacterium
SWKSCSNRRFDDVAPGE

SEQ ID NO: 950756 - protein, 19 aa, Mycobacterium
SWLAAAIAAVAVFAVACGG

SEQ ID NO: 950757 - protein, 22 aa, Mycobacterium
SWLAAILIPVAVLAVACGGSSA

SEQ ID NO: 950758 - protein, 18 aa, Mycobacterium
SWLGPASMLMAAAAAPYV

SEQ ID NO: 950759 - protein, 17 aa, Mycobacterium
SWNARWADLTPARQAAV

SEQ ID NO: 950760 - protein, 26 aa, Mycobacterium
SWNNSPLPLNPFISKSIDPARVLYTE

SEQ ID NO: 950761 - protein, 17 aa, Mycobacterium
SWNVRWAELTPARQAAV

SEQ ID NO: 950762 - protein, 18 aa, Mycobacterium
SWRIDWRLPLAAVCTHHG

SEQ ID NO: 950763 - protein, 24 aa, Mycobacterium
SWSALTTMILPSGGAPYVVWPRTK

SEQ ID NO: 950764 - protein, 27 aa, Mycobacterium
SWSVERVVMPWIVRWGMYRGVRQNNPL

SEQ ID NO: 950765 - protein, 32 aa, Mycobacterium
SWWRSLHAASTRRALLLTALGGLLIAGVITAL

SEQ ID NO: 950766 - protein, 32 aa, Mycobacterium
SWYLDDRGVPVAWPWTFTRFRDVMARPALEDY

SEQ ID NO: 950767 - protein, 20 aa, Mycobacterium
SYACQLNINGFFPGLNDLVP

SEQ ID NO: 950768 - protein, 27 aa, Mycobacterium
SYADGDLWDWVVDWPTWQSMSALPPNP

SEQ ID NO: 950769 - protein, 24 aa, Mycobacterium
SYAPINFLEAIANIPYYSVAGTNR

SEQ ID NO: 950770 - protein, 23 aa, Mycobacterium
SYAWDMGAYGWPAPERLRFANDP

SEQ ID NO: 950771 - protein, 26 aa, Mycobacterium
SYFTGHPQEYYDLRGILAPIGETERQ

SEQ ID NO: 950772 - protein, 28 aa, Mycobacterium
SYGPPASHHLRWLASANALLDIPEDVVE

SEQ ID NO: 950773 - protein, 20 aa, Mycobacterium
SYHPPVLSTMFYDLNAKAVI

SEQ ID NO: 950774 - protein, 20 aa, Mycobacterium
SYLPTYPYTQDFIDRGIRGD

SEQ ID NO: 950775 - protein, 26 aa, Mycobacterium
SYPGSSLLDLLLPRMSSRPAAASVPD

SEQ ID NO: 950776 - protein, 31 aa, Mycobacterium
SYQEDLLHFLNQTFKLLRPHGVRSALRSLMA

SEQ ID NO: 950777 - protein, 19 aa, Mycobacterium
SYQLLDQLGLLVDKSLVVA

SEQ ID NO: 950778 - protein, 18 aa, Mycobacterium
SYSGVFVHSAPWSVGAQG

SEQ ID NO: 950779 - protein, 18 aa, Mycobacterium
SYVLLAKTLAETERMAIV

SEQ ID NO: 950780 - protein, 18 aa, Mycobacterium
TAAAVVALTLAGCGGSEQ

SEQ ID NO: 950781 - protein, 25 aa, Mycobacterium
TAADGVIRFTFAPDPIWDYMHDTGI

SEQ ID NO: 950782 - protein, 25 aa, Mycobacterium
TAADTVWVLDARRGTWKSVDVADVV

SEQ ID NO: 950783 - protein, 21 aa, Mycobacterium
TAAEVPLAFALAAGSFRDATR

SEQ ID NO: 950784 - protein, 25 aa, Mycobacterium
TAALAAGFFALAAPAAAAPAGGDAT

SEQ ID NO: 950785 - protein, 23 aa, Mycobacterium
TAALAATIAPLAACANQQGGQGA

SEQ ID NO: 950786 - protein, 21 aa, Mycobacterium
TAALLTVLYGARRYYRNWGAT

SEQ ID NO: 950787 - protein, 24 aa, Mycobacterium
TAAPLPGLGFTQPLPAQAAQHVAA

SEQ ID NO: 950788 - protein, 25 aa, Mycobacterium
TAARALLGSGLLSPSSPAAALRLVR

SEQ ID NO: 950789 - protein, 17 aa, Mycobacterium
TAARLLRAGGERLVFWD

SEQ ID NO: 950790 - protein, 23 aa, Mycobacterium
TAASLGLAALGFAATATASAGST

SEQ ID NO: 950791 - protein, 17 aa, Mycobacterium
TAASVKISPSVNGACPA

SEQ ID NO: 950792 - protein, 23 aa, Mycobacterium
TAATSWPDKFLVGAALVAHGVAA

SEQ ID NO: 950793 - protein, 27 aa, Mycobacterium
TAATVAVVLAVGFLPAGTAAADDKVPL

SEQ ID NO: 950794 - protein, 21 aa, Mycobacterium
TAATVRPFVFTFPGVPDQDQL

SEQ ID NO: 950795 - protein, 20 aa, Mycobacterium
TAAVELFGGRLPEDQPAPVI

SEQ ID NO: 950796 - protein, 29 aa, Mycobacterium
TAAWYTTATIPTAIFLANALDTGAPVVAA

SEQ ID NO: 950797 - protein, 27 aa, Mycobacterium
TACGQLRIPHLILARPAWDPGEALVVG

SEQ ID NO: 950798 - protein, 24 aa, Mycobacterium
TADGVNYRVLWQASGPNTISGATI

SEQ ID NO: 950799 - protein, 24 aa, Mycobacterium
TADGYLLHYAIADVAAQIEPGSTL

SEQ ID NO: 950800 - protein, 23 aa, Mycobacterium
TADRLANLLTLHGAGPGTYVAIM

SEQ ID NO: 950801 - protein, 18 aa, Mycobacterium
TAEKWNLRSIGDLAAHSA

SEQ ID NO: 950802 - protein, 21 aa, Mycobacterium
TAEPLGYNKRYTLTAQALGLG

SEQ ID NO: 950803 - protein, 27 aa, Mycobacterium
TAERDTTLALLPVGYADGVFRSLGGRL

SEQ ID NO: 950804 - protein, 20 aa, Mycobacterium
TAFARFATLRRRRVTRMVRT

SEQ ID NO: 950805 - protein, 30 aa, Mycobacterium
TAFKNFQYTAAAQKLWAQAGFRPVDPAVAT

SEQ ID NO: 950806 - protein, 29 aa, Mycobacterium
TAFKNFQYTAAAQKLWAQSGFRPVDPAVA

SEQ ID NO: 950807 - protein, 21 aa, Mycobacterium
TAFSRRTALKAGAAAAASLAA

SEQ ID NO: 950808 - protein, 25 aa, Mycobacterium
TAGAAALFRDFARQWRDCDGTTVII

SEQ ID NO: 950809 - protein, 28 aa, Mycobacterium
TAGGTKLSIPDLIRLASQALHYLAVYDE

SEQ ID NO: 950810 - protein, 23 aa, Mycobacterium
TAGKWNLKTIADLAPHSANLRFA

SEQ ID NO: 950811 - protein, 24 aa, Mycobacterium
TAGLLSVTLLLTGCLKPNTLDPYA

SEQ ID NO: 950812 - protein, 17 aa, Mycobacterium
TAGLMIAALPFMPGVGA

SEQ ID NO: 950813 - protein, 21 aa, Mycobacterium
TAGPGNLHVSIRPFMDILPGA

SEQ ID NO: 950814 - protein, 26 aa, Mycobacterium
TAGRFTIVAIATYCPALIAPLLGNRL

SEQ ID NO: 950815 - protein, 22 aa, Mycobacterium
TAGRLDILVANHAYMTMAPLLE

SEQ ID NO: 950816 - protein, 28 aa, Mycobacterium
TAGTRLVNPPLLVPVLRAGLGMVEAAQA

SEQ ID NO: 950817 - protein, 22 aa, Mycobacterium
TAGYRWAWQTRAWSGGVREPAA

SEQ ID NO: 950818 - protein, 31 aa, Mycobacterium
TAHLTVFQRTPIWIAPRFDFPFTPEQQELFE

SEQ ID NO: 950819 - protein, 30 aa, Mycobacterium
TAHLTVFQRTPIWISPRFDIPFTAEQQDLF

SEQ ID NO: 950820 - protein, 24 aa, Mycobacterium
TAHPDARLRFMLHDAKPVAAVTTS

SEQ ID NO: 950821 - protein, 17 aa, Mycobacterium
TAIARAAAVDRTFLYRH

SEQ ID NO: 950822 - protein, 27 aa, Mycobacterium
TAIATAPLTFAQPAPPPCFNADGTPCT

SEQ ID NO: 950823 - protein, 17 aa, Mycobacterium
TAIFSNALNLPANAKVK

SEQ ID NO: 950824 - protein, 18 aa, Mycobacterium
TAIGPSLSYTPAADFDGT

SEQ ID NO: 950825 - protein, 23 aa, Mycobacterium
TAIPPLAQPFIVQALDQAPPPHQ

SEQ ID NO: 950826 - protein, 25 aa, Mycobacterium
TAIVNILRILLSNPAVWEKTALIVS

SEQ ID NO: 950827 - protein, 18 aa, Mycobacterium
TAKFDFADGFATVTIVTT

SEQ ID NO: 950828 - protein, 17 aa, Mycobacterium
TAKILEYAPNETIALPG

SEQ ID NO: 950829 - protein, 17 aa, Mycobacterium
TALAAAVLSAGCSASRP

SEQ ID NO: 950830 - protein, 26 aa, Mycobacterium
TALDEGLLPVLPQLSAKHHLLLAAVS

SEQ ID NO: 950831 - protein, 24 aa, Mycobacterium
TALGIMVFGYMRLPEMIGIGQYKV

SEQ ID NO: 950832 - protein, 17 aa, Mycobacterium
TALHVFPHFAANALAIY

SEQ ID NO: 950833 - protein, 20 aa, Mycobacterium
TALRAITFSAESLGLLARTV

SEQ ID NO: 950834 - protein, 19 aa, Mycobacterium
TALRGLRTSPFYPRQCELG

SEQ ID NO: 950835 - protein, 24 aa, Mycobacterium
TALTWMVYVTLRRDVKGPTARYGA

SEQ ID NO: 950836 - protein, 25 aa, Mycobacterium
TAMENLLQRAPGVNALYTINEPAAA

SEQ ID NO: 950837 - protein, 18 aa, Mycobacterium
TAMWETMRQHPNAIPLVL

SEQ ID NO: 950838 - protein, 25 aa, Mycobacterium
TANAGVTDIALAFGSGSTAEATGGV

SEQ ID NO: 950839 - protein, 17 aa, Mycobacterium
TANPPVLAAADEPMWLS

SEQ ID NO: 950840 - protein, 23 aa, Mycobacterium
TANRGLQVLPADKIPVLLDETAQ

SEQ ID NO: 950841 - protein, 23 aa, Mycobacterium
TANSWKLRTIADLAAHSADVRFG

SEQ ID NO: 950842 - protein, 26 aa, Mycobacterium
TANTGTSMPALFYAKAGSLYVSDPAG

SEQ ID NO: 950843 - protein, 28 aa, Mycobacterium
TAPALDLDALIGGFKPLFRALDPEKVNT

SEQ ID NO: 950844 - protein, 22 aa, Mycobacterium
TAPGQQLPPQTPLPQAPVQQTP

SEQ ID NO: 950845 - protein, 23 aa, Mycobacterium
TAPGRITAVLGLHDLVNGGHAGQ

SEQ ID NO: 950846 - protein, 17 aa, Mycobacterium
TAPLPPPEALTDVLARL

SEQ ID NO: 950847 - protein, 21 aa, Mycobacterium
TAPTLQVLANAGFPLGPATRV

SEQ ID NO: 950848 - protein, 24 aa, Mycobacterium
TAQFQYALADPLPISQAQWLGTHN

SEQ ID NO: 950849 - protein, 18 aa, Mycobacterium
TAQPYVTTCLTWLARRSG

SEQ ID NO: 950850 - protein, 19 aa, Mycobacterium
TAQRWNLTSIADLAARSPE

SEQ ID NO: 950851 - protein, 18 aa, Mycobacterium
TARAIRWTQVTPRDEVIA

SEQ ID NO: 950852 - protein, 25 aa, Mycobacterium
TARPDLVFAGWNYGFSETSGLTPDW

SEQ ID NO: 950853 - protein, 24 aa, Mycobacterium
TARPRLAPPVPSIPGRRGKPTIAV

SEQ ID NO: 950854 - protein, 26 aa, Mycobacterium
TARRDRIVLFARPCAIRDPATASLTG

SEQ ID NO: 950855 - protein, 21 aa, Mycobacterium
TARRFAQRWLVVDLNTDADLG

SEQ ID NO: 950856 - protein, 22 aa, Mycobacterium
TARRLQAVISHDVIAGLYTEDP

SEQ ID NO: 950857 - protein, 21 aa, Mycobacterium
TASEVPLAFALAAGSFRDATR

SEQ ID NO: 950858 - protein, 24 aa, Mycobacterium
TASLAGLMPWHPDPVYSLGKHGVV

SEQ ID NO: 950859 - protein, 23 aa, Mycobacterium
TASRFVACPFGTPGQRMYRTGDL

SEQ ID NO: 950860 - protein, 24 aa, Mycobacterium
TATAAMALGAAPLAMAETEAGFGE

SEQ ID NO: 950861 - protein, 27 aa, Mycobacterium
TATAVEILWRGQRLRTLATLPELIAAA

SEQ ID NO: 950862 - protein, 32 aa, Mycobacterium
TATDAFFEQLAWMWPNWAKLFFNNKGVAANTT

SEQ ID NO: 950863 - protein, 26 aa, Mycobacterium
TATGVIWLQHGFLGNKSFVSALARNL

SEQ ID NO: 950864 - protein, 19 aa, Mycobacterium
TATLKTHTGGARTARAAGP

SEQ ID NO: 950865 - protein, 18 aa, Mycobacterium
TATLPDGSTFTFARPYNT

SEQ ID NO: 950866 - protein, 26 aa, Mycobacterium
TATPLGDVFVALKPPRPAVPDAPLLR

SEQ ID NO: 950867 - protein, 21 aa, Mycobacterium
TAVAIAFDLADPSSVAGLFAS

SEQ ID NO: 950868 - protein, 24 aa, Mycobacterium
TAVEPLPPMPTPSSTLKPPTTRTM

SEQ ID NO: 950869 - protein, 30 aa, Mycobacterium
TAVEPRLWNMWTVLPILQDTTIVAVGPSVR

SEQ ID NO: 950870 - protein, 28 aa, Mycobacterium
TAVESPAPPAFLLLGPDALMAYRHIAQR

SEQ ID NO: 950871 - protein, 18 aa, Mycobacterium
TAVLASALATRISWRRPY

SEQ ID NO: 950872 - protein, 21 aa, Mycobacterium
TAVPPPLIAANRSQLATLVTT

SEQ ID NO: 950873 - protein, 22 aa, Mycobacterium
TAVPYRVPFPQVMPTQETQPAR

SEQ ID NO: 950874 - protein, 22 aa, Mycobacterium
TAYDSPIYIADAALYLSKSKPE

SEQ ID NO: 950875 - protein, 17 aa, Mycobacterium
TAYLVSRRYGISVLRVI

SEQ ID NO: 950876 - protein, 27 aa, Mycobacterium
TCGASPLPVPQWWAKLCDAWWCTDTSL

SEQ ID NO: 950877 - protein, 25 aa, Mycobacterium
TCGRPQTYPPVVWQVSGDQIAQTNP

SEQ ID NO: 950878 - protein, 25 aa, Mycobacterium
TCMSSSLPTLFRRAADYQRQITLTP

SEQ ID NO: 950879 - protein, 18 aa, Mycobacterium
TCVFFESPRRLAACLRDA

SEQ ID NO: 950880 - protein, 22 aa, Mycobacterium
TDAASRLLALIVTTGGDATRIS

SEQ ID NO: 950881 - protein, 25 aa, Mycobacterium
TDALKLYDTPPTPPPIFVAASGPKS

SEQ ID NO: 950882 - protein, 24 aa, Mycobacterium
TDARIHWWVWRVGAVNTVAVAFPG

SEQ ID NO: 950883 - protein, 23 aa, Mycobacterium
TDDAVIFYFGQGEIMAGAGGALQ

SEQ ID NO: 950884 - protein, 29 aa, Mycobacterium
TDDGLLVPIHWGTFRLAPHPWAEPVERLL

SEQ ID NO: 950885 - protein, 25 aa, Mycobacterium
TDEKPPRMYLARYAGTARSRLAPPV

SEQ ID NO: 950886 - protein, 23 aa, Mycobacterium
TDELHVHSTPDHKFQVAAAPHQT

SEQ ID NO: 950887 - protein, 24 aa, Mycobacterium
TDGAGAAYLARRGGYLRLDIASGE

SEQ ID NO: 950888 - protein, 29 aa, Mycobacterium
TDGAIWARYNVPWQPAYVFYRADGSSTFV

SEQ ID NO: 950889 - protein, 26 aa, Mycobacterium
TDGKPGWPGFLSIPLAAYRRHFEISV

SEQ ID NO: 950890 - protein, 24 aa, Mycobacterium
TDGRFRRRNCCLFYQVPGGGYCGD

SEQ ID NO: 950891 - protein, 17 aa, Mycobacterium
TDHIDICRPARLDPAVP

SEQ ID NO: 950892 - protein, 20 aa, Mycobacterium
TDHPEWVLPTTWGVAPERPV

SEQ ID NO: 950893 - protein, 18 aa, Mycobacterium
TDIFSTIKNLAILVSALQ

SEQ ID NO: 950894 - protein, 32 aa, Mycobacterium
TDKMGNVAAWRFLAPLSAFLEGLTVGADGRRI

SEQ ID NO: 950895 - protein, 26 aa, Mycobacterium
TDLDVPWGIAFLPDGSALIAERDSAA

SEQ ID NO: 950896 - protein, 17 aa, Mycobacterium
TDLLAAAGQIKSAPRFG

SEQ ID NO: 950897 - protein, 18 aa, Mycobacterium
TDLLLQLVTGRSPAGNTA

SEQ ID NO: 950898 - protein, 23 aa, Mycobacterium
TDLQSLFVPQAPGPAPGSPPGYG

SEQ ID NO: 950899 - protein, 22 aa, Mycobacterium
TDNGAYIIGDRYSFLVMDSSTY

SEQ ID NO: 950900 - protein, 21 aa, Mycobacterium
TDNVNYRILLEPGWKFTDGSP

SEQ ID NO: 950901 - protein, 24 aa, Mycobacterium
TDNVNYRIVLKPGWKFTDGSPVTA

SEQ ID NO: 950902 - protein, 31 aa, Mycobacterium
TDPLVDNDFRQLWFGWADPAQILVEYAQLRA

SEQ ID NO: 950903 - protein, 29 aa, Mycobacterium
TDPRHTPPHAWYIAFAPAQAPRVAIAVFV

SEQ ID NO: 950904 - protein, 26 aa, Mycobacterium
TDPVLPDELLPADWPGARLRAAYHDF

SEQ ID NO: 950905 - protein, 29 aa, Mycobacterium
TDQATGTVPPLPAFAPPADLGANCQYPSA

SEQ ID NO: 950906 - protein, 33 aa, Mycobacterium
TDRPIYGMGGEPFKPLPPGSRLSYREVSCGLDS

SEQ ID NO: 950907 - protein, 18 aa, Mycobacterium
TDRQIELTPPYHGGPTLE

SEQ ID NO: 950908 - protein, 24 aa, Mycobacterium
TDRSGRVLTFAFISNAAGPNGRNV

SEQ ID NO: 950909 - protein, 23 aa, Mycobacterium
TDRSGRVLTFAFISNDAGPNGRN

SEQ ID NO: 950910 - protein, 23 aa, Mycobacterium
TDRSGRVLTFALISNNAGPTGRT

SEQ ID NO: 950911 - protein, 18 aa, Mycobacterium
TDRSLFEPYLAMVQAAPA

SEQ ID NO: 950912 - protein, 25 aa, Mycobacterium
TDSKGNIIAWLYSQRRFEVPSDQIA

SEQ ID NO: 950913 - protein, 23 aa, Mycobacterium
TDSVGQVVLAWTVSNLQPSNDVT

SEQ ID NO: 950914 - protein, 21 aa, Mycobacterium
TDTILLVHVPGVGSSVPTALV

SEQ ID NO: 950915 - protein, 20 aa, Mycobacterium
TDTLELFACEARAGRLQRRG

SEQ ID NO: 950916 - protein, 21 aa, Mycobacterium
TDVLFHYAPPSPSTAAIIAVL

SEQ ID NO: 950917 - protein, 26 aa, Mycobacterium
TDVMNQVWTKLLLNSTFSGLAGVTGM

SEQ ID NO: 950918 - protein, 22 aa, Mycobacterium
TDVRGRDRLARTVFGALPGGRR

SEQ ID NO: 950919 - protein, 29 aa, Mycobacterium
TDWFGAEPFGVWPWARPQLGAAQPVVLSL

SEQ ID NO: 950920 - protein, 22 aa, Mycobacterium
TEAITRYGLRITGRRGDLVITD

SEQ ID NO: 950921 - protein, 25 aa, Mycobacterium
TEDDSEPLLRIPVPDGWERNTMMDN

SEQ ID NO: 950922 - protein, 25 aa, Mycobacterium
TEDVDGYIRVYPQIKDLIATLQAHG

SEQ ID NO: 950923 - protein, 26 aa, Mycobacterium
TEFPEGLWYVDLAPITIPEVAPVTVA

SEQ ID NO: 950924 - protein, 18 aa, Mycobacterium
TEFPPLKQVDAGLLNVGY

SEQ ID NO: 950925 - protein, 21 aa, Mycobacterium
TEGYRAGLLASIAASCTASYQ

SEQ ID NO: 950926 - protein, 20 aa, Mycobacterium
TEIPALNVWTARTDVLADPA

SEQ ID NO: 950927 - protein, 22 aa, Mycobacterium
TEIRAVYGGIPLAFALALVRAG

SEQ ID NO: 950928 - protein, 28 aa, Mycobacterium
TEKDRYSMDWYYPILGSALRGPEAAARI

SEQ ID NO: 950929 - protein, 20 aa, Mycobacterium
TELAPVFKAAGFRPNNAAPG

SEQ ID NO: 950930 - protein, 23 aa, Mycobacterium
TELGYTVPVLWSGSLSDSTLITE

SEQ ID NO: 950931 - protein, 29 aa, Mycobacterium
TENALGGTTVRYLVPAETLPLVQSNPSLA

SEQ ID NO: 950932 - protein, 22 aa, Mycobacterium
TENRSLALPGHTFNVIALDGNP

SEQ ID NO: 950933 - protein, 18 aa, Mycobacterium
TEPGGVLDRLFAKDGPVD

SEQ ID NO: 950934 - protein, 17 aa, Mycobacterium
TEPLTFDTLFDEINQLA

SEQ ID NO: 950935 - protein, 17 aa, Mycobacterium
TEPPLGQPGTPPLPVPY

SEQ ID NO: 950936 - protein, 24 aa, Mycobacterium
TEPPTPGRYLLYLDFQVNGRVHTA

SEQ ID NO: 950937 - protein, 28 aa, Mycobacterium
TEPVRRLALILCWTLASASPAVADDFRL

SEQ ID NO: 950938 - protein, 17 aa, Mycobacterium
TEQWLGPASMSMAAAAQ

SEQ ID NO: 950939 - protein, 25 aa, Mycobacterium
TEQYNPTYDYTYRKAPETVYDTVEV

SEQ ID NO: 950940 - protein, 24 aa, Mycobacterium
TERTLAAVSLLLNGGGLGQVQDIT

SEQ ID NO: 950941 - protein, 19 aa, Mycobacterium
TERWVPVERVGLYVPGGNA

SEQ ID NO: 950942 - protein, 24 aa, Mycobacterium
TETPTLLRRSGLGSHPRLGRNLAL

SEQ ID NO: 950943 - protein, 20 aa, Mycobacterium
TEVTLRVHRLPEETWYQGWS

SEQ ID NO: 950944 - protein, 18 aa, Mycobacterium
TFAAMSARDRAGPAGAAS

SEQ ID NO: 950945 - protein, 27 aa, Mycobacterium
TFAQPYPAWKELFSNILPAHIVKDVPG

SEQ ID NO: 950946 - protein, 26 aa, Mycobacterium
TFAQPYPSWKELFSNILPAHIVKDVP

SEQ ID NO: 950947 - protein, 17 aa, Mycobacterium
TFATAIGDNNGVAASAP

SEQ ID NO: 950948 - protein, 24 aa, Mycobacterium
TFDEHFGGPIPSFPPREVLYDYIT

SEQ ID NO: 950949 - protein, 25 aa, Mycobacterium
TFESRKHFFTDWSASSPAVATDITS

SEQ ID NO: 950950 - protein, 18 aa, Mycobacterium
TFGIPPRGVIAALQRAKS

SEQ ID NO: 950951 - protein, 32 aa, Mycobacterium
TFGPEQRFLRHLGFYVALADLPGYTPSGRDNP

SEQ ID NO: 950952 - protein, 28 aa, Mycobacterium
TFPSIYDPPMRTMIALGARYPTTVIPST

SEQ ID NO: 950953 - protein, 18 aa, Mycobacterium
TFRLYKVRSFLRLDITDK

SEQ ID NO: 950954 - protein, 20 aa, Mycobacterium
TFRVRDLIRLDARAAAPLAA

SEQ ID NO: 950955 - protein, 34 aa, Mycobacterium
TFTYTVSDAGARRTFFGIPLSRSATTATGIVTVT

SEQ ID NO: 950956 - protein, 34 aa, Mycobacterium
TFVDSDNLGIQRLLRYYPPANYTGQITIPYTVWD

SEQ ID NO: 950957 - protein, 23 aa, Mycobacterium
TFVGAICRWQAANPAGLIDITRF

SEQ ID NO: 950958 - protein, 23 aa, Mycobacterium
TFVGAICRWQAANPAGLIDITRY

SEQ ID NO: 950959 - protein, 20 aa, Mycobacterium
TFVGAICRWQAANPAGLVDI

SEQ ID NO: 950960 - protein, 23 aa, Mycobacterium
TGADQWLITNGPRFGLCQIYANE

SEQ ID NO: 950961 - protein, 34 aa, Mycobacterium
TGAGAGYLLPALRRPNLTLLEQTRVLRLRFAGTR

SEQ ID NO: 950962 - protein, 25 aa, Mycobacterium
TGAQLAAALLFKSADVPSQAVPFDG

SEQ ID NO: 950963 - protein, 35 aa, Mycobacterium
TGAYSPIGAIIVPGGWWLLSLQALGLSQNAPGVAE

SEQ ID NO: 950964 - protein, 29 aa, Mycobacterium
TGDAPLGTCAFWPVPPTSKPHTISAPGLA

SEQ ID NO: 950965 - protein, 26 aa, Mycobacterium
TGDNVVPLIVNLYMFGGKDFDVGTAL

SEQ ID NO: 950966 - protein, 27 aa, Mycobacterium
TGEFDVFDYFYFGLGDLVDADALVELT

SEQ ID NO: 950967 - protein, 32 aa, Mycobacterium
TGESLPLASIFKLYVLHALAGAIRDGTASWDD

SEQ ID NO: 950968 - protein, 34 aa, Mycobacterium
TGFDCSGLVLYSFAGVGIKLPHYSGSQYNLGRKI

SEQ ID NO: 950969 - protein, 23 aa, Mycobacterium
TGFDTFTGLVSRCLRFSSAAVGS

SEQ ID NO: 950970 - protein, 18 aa, Mycobacterium
TGFLALGMLSFVLALPIL

SEQ ID NO: 950971 - protein, 19 aa, Mycobacterium
TGFQVLGDQTLLVAAVANL

SEQ ID NO: 950972 - protein, 25 aa, Mycobacterium
TGGAGGVGGWLYGNGGAGGAGGHGG

SEQ ID NO: 950973 - protein, 20 aa, Mycobacterium
TGGKVQWVLGNLGAIPTVKI

SEQ ID NO: 950974 - protein, 25 aa, Mycobacterium
TGGLELPFVVVDGELFAQLGSAYSS

SEQ ID NO: 950975 - protein, 24 aa, Mycobacterium
TGGNLFTPGVHAPAAPTVPPGQHP

SEQ ID NO: 950976 - protein, 24 aa, Mycobacterium
TGGQPLVYTATLQNPSQWAIVTAS

SEQ ID NO: 950977 - protein, 26 aa, Mycobacterium
TGHDQLFDTLFVYESYPFDAGAFAGT

SEQ ID NO: 950978 - protein, 21 aa, Mycobacterium
TGHDYLLALGIVPVAVTEWYG

SEQ ID NO: 950979 - protein, 19 aa, Mycobacterium
TGIYVGNGMMVHASTYGVP

SEQ ID NO: 950980 - protein, 23 aa, Mycobacterium
TGKSLAYLVPAIVRAIDDDSPVV

SEQ ID NO: 950981 - protein, 25 aa, Mycobacterium
TGLAVVLSLLLIGGLMTVQRASDQI

SEQ ID NO: 950982 - protein, 17 aa, Mycobacterium
TGLGLMACPLPDPEQVD

SEQ ID NO: 950983 - protein, 19 aa, Mycobacterium
TGLIFATYQRDIDTQFLPV

SEQ ID NO: 950984 - protein, 18 aa, Mycobacterium
TGLSLITAINALAVPAND

SEQ ID NO: 950985 - protein, 18 aa, Mycobacterium
TGLYNRRALMAHLEARLA

SEQ ID NO: 950986 - protein, 26 aa, Mycobacterium
TGNLQPLINFLKWLDSADDEEFARSL

SEQ ID NO: 950987 - protein, 26 aa, Mycobacterium
TGPAGAAIAILAAVTAGPATPAGGGT

SEQ ID NO: 950988 - protein, 23 aa, Mycobacterium
TGQDYTWFVLNSRIIDKEFGLSG

SEQ ID NO: 950989 - protein, 24 aa, Mycobacterium
TGQELWRQLDDMPLIPASTNKVLT

SEQ ID NO: 950990 - protein, 30 aa, Mycobacterium
TGQIYTPPGYIGYYPGVYGLQSIWSLTPPP

SEQ ID NO: 950991 - protein, 24 aa, Mycobacterium
TGQPGTPPLPMPYPRTGQGGEPRL

SEQ ID NO: 950992 - protein, 24 aa, Mycobacterium
TGQPWVVSFQLNWPRDHGPNVTGW

SEQ ID NO: 950993 - protein, 25 aa, Mycobacterium
TGQPWVVSFQLNWPRDHGPTVTGWM

SEQ ID NO: 950994 - protein, 20 aa, Mycobacterium
TGQVSLPWTLTLETTIPSVR

SEQ ID NO: 950995 - protein, 24 aa, Mycobacterium
TGRRWYLMCFDRDRDDWRSLRLDR

SEQ ID NO: 950996 - protein, 17 aa, Mycobacterium
TGSALVCLVSLTNPPPA

SEQ ID NO: 950997 - protein, 25 aa, Mycobacterium
TGSDWYRWVHDPLNRLLGLVKGVPE

SEQ ID NO: 950998 - protein, 29 aa, Mycobacterium
TGSGLLVPIHWGTFRLAPHPWAEPVERLL

SEQ ID NO: 950999 - protein, 17 aa, Mycobacterium
TGSLMHTSIKRLAERTT

SEQ ID NO: 951000 - protein, 22 aa, Mycobacterium
TGSTFTLSIPAAKPSPRDEGES

SEQ ID NO: 951001 - protein, 20 aa, Mycobacterium
TGSVITVAGLLLAGCGSKAS

SEQ ID NO: 951002 - protein, 17 aa, Mycobacterium
TGTGYLAPGFHGVHIHK

SEQ ID NO: 951003 - protein, 19 aa, Mycobacterium
TGTRFGGVLFVDSLSEADG

SEQ ID NO: 951004 - protein, 24 aa, Mycobacterium
TGTRLSITAFCQTVGKQDSTIKEA

SEQ ID NO: 951005 - protein, 28 aa, Mycobacterium
TGTVGYRFAWHLPKNRVWSYDGQLRMAR

SEQ ID NO: 951006 - protein, 28 aa, Mycobacterium
TGVDGLMMTFDLIPILTKAEVEESLLDE

SEQ ID NO: 951007 - protein, 35 aa, Mycobacterium
TGVERDGPTLFLPLTSLRGLRRHSKKRSGLRAQSG

SEQ ID NO: 951008 - protein, 29 aa, Mycobacterium
TGVINNVFTPWTYDTWPSVFTQLEAQNPD

SEQ ID NO: 951009 - protein, 26 aa, Mycobacterium
TGVRARVMLDVDPRYVPLLPANVEAS

SEQ ID NO: 951010 - protein, 24 aa, Mycobacterium
TGVTFAVLALHTSGLATAGHGSEP

SEQ ID NO: 951011 - protein, 30 aa, Mycobacterium
TGVWALTRGARLVSLLPARLTRSVAARNTK

SEQ ID NO: 951012 - protein, 20 aa, Mycobacterium
TGWIGRWLDATGDDPLRAVN

SEQ ID NO: 951013 - protein, 20 aa, Mycobacterium
TGYRGDMAFSALIVGGGSSE

SEQ ID NO: 951014 - protein, 18 aa, Mycobacterium
TGYYFSSPSGRWACAILP

SEQ ID NO: 951015 - protein, 18 aa, Mycobacterium
TGYYFTTPSGRWACAILP

SEQ ID NO: 951016 - protein, 19 aa, Mycobacterium
THAFFRPMRVVGRDGLRAD

SEQ ID NO: 951017 - protein, 20 aa, Mycobacterium
THAHAWALRMSPDGNVWGAT

SEQ ID NO: 951018 - protein, 19 aa, Mycobacterium
THAQIYQRISAQAMAFHDQ

SEQ ID NO: 951019 - protein, 17 aa, Mycobacterium
THDPSRPPRLHLSGTEA

SEQ ID NO: 951020 - protein, 19 aa, Mycobacterium
THEVPGDSFWDLVRKGAEA

SEQ ID NO: 951021 - protein, 31 aa, Mycobacterium
THFWSAQDYTPIDQLPYVGPILPGTETIFVA

SEQ ID NO: 951022 - protein, 23 aa, Mycobacterium
THGGQLCLPLYGAIVTNCELDRS

SEQ ID NO: 951023 - protein, 24 aa, Mycobacterium
THGTLFFDGTNRAFSYRPNTGFTG

SEQ ID NO: 951024 - protein, 20 aa, Mycobacterium
THLPVPYLEALPDKLARRPV

SEQ ID NO: 951025 - protein, 17 aa, Mycobacterium
THNIAVDSAWHTWRCQW

SEQ ID NO: 951026 - protein, 25 aa, Mycobacterium
THNYQWETFLTSELPAYLAANKGIS

SEQ ID NO: 951027 - protein, 27 aa, Mycobacterium
THPVAGLLGFLGRRQHLVPSAGLRRIL

SEQ ID NO: 951028 - protein, 18 aa, Mycobacterium
THTQLYPSDARCLVHQSM

SEQ ID NO: 951029 - protein, 23 aa, Mycobacterium
THWDGDVFTFRFVSENAPPGTIS

SEQ ID NO: 951030 - protein, 28 aa, Mycobacterium
TIAEQLMPHWLLSLQDAARRRGDSAPQV

SEQ ID NO: 951031 - protein, 22 aa, Mycobacterium
TIAQVPPQFRPATSKWTGVAAR

SEQ ID NO: 951032 - protein, 26 aa, Mycobacterium
TIAYPHDVPPWITPGAEWAPGTDFTT

SEQ ID NO: 951033 - protein, 24 aa, Mycobacterium
TIDGLLAPEWKGKIGFAPSNASWQ

SEQ ID NO: 951034 - protein, 26 aa, Mycobacterium
TIDHPEWVLPVSWAPTHGVPPLEAVL

SEQ ID NO: 951035 - protein, 17 aa, Mycobacterium
TIDQALGGVLFIDEAYA

SEQ ID NO: 951036 - protein, 32 aa, Mycobacterium
TIDSLKTDAPLLKKILTYHVVPGQLSPSQVVG

SEQ ID NO: 951037 - protein, 18 aa, Mycobacterium
TIDYDRLTLGGSADVYVS

SEQ ID NO: 951038 - protein, 29 aa, Mycobacterium
TIENGARLNLPWRRDFNALVYALSGSGCV

SEQ ID NO: 951039 - protein, 20 aa, Mycobacterium
TIGFGPSFFRKDGVDRFGIA

SEQ ID NO: 951040 - protein, 19 aa, Mycobacterium
TIGPLSVPPAWTATSSLGA

SEQ ID NO: 951041 - protein, 17 aa, Mycobacterium
TIGQLPSPYTARNPLIV

SEQ ID NO: 951042 - protein, 18 aa, Mycobacterium
TIHLARFGPAPGAPWEVV

SEQ ID NO: 951043 - protein, 18 aa, Mycobacterium
TIKDIQPVFLQPADAFTA

SEQ ID NO: 951044 - protein, 17 aa, Mycobacterium
TIKFPQAAPAVNVYPIA

SEQ ID NO: 951045 - protein, 21 aa, Mycobacterium
TIKILLAMVVLDELPLDATVV

SEQ ID NO: 951046 - protein, 23 aa, Mycobacterium
TILGLLTAVLIWGPNVGLARAAE

SEQ ID NO: 951047 - protein, 24 aa, Mycobacterium
TILLAILALVVPPPVTAQPLELAA

SEQ ID NO: 951048 - protein, 21 aa, Mycobacterium
TILTRRTFLAATLAASTAAMA

SEQ ID NO: 951049 - protein, 39 aa, Mycobacterium
TIPGSVITILMSNGIPPAPPPLVIPGIPGAPPGEMTTTI

SEQ ID NO: 951050 - protein, 25 aa, Mycobacterium
TIPQQIPETQPVFGWLPGGWTTNTF

SEQ ID NO: 951051 - protein, 19 aa, Mycobacterium
TIPVIGTFTELLNTSNGRS

SEQ ID NO: 951052 - protein, 37 aa, Mycobacterium
TIQQAVELWKIVDRPNLFIKIPATKAGLPAITAVLAE

SEQ ID NO: 951053 - protein, 24 aa, Mycobacterium
TISAVAGMRAATAAVPAGTTAAAG

SEQ ID NO: 951054 - protein, 27 aa, Mycobacterium
TISEQLMPHWLLSLQTEAARRGGAAPH

SEQ ID NO: 951055 - protein, 19 aa, Mycobacterium
TISFIDWTGLVRSEGTVIK

SEQ ID NO: 951056 - protein, 24 aa, Mycobacterium
TISRDPGYWRTVVQNKLLGGEDSN

SEQ ID NO: 951057 - protein, 22 aa, Mycobacterium
TISVRVSIDRLILGSIPDAGFK

SEQ ID NO: 951058 - protein, 21 aa, Mycobacterium
TITEPLGYDTTYSWSGAAVGH

SEQ ID NO: 951059 - protein, 24 aa, Mycobacterium
TITQVIPPPPPPPRRPRAAVPPPS

SEQ ID NO: 951060 - protein, 19 aa, Mycobacterium
TITTITAITAQHQPIRAAT

SEQ ID NO: 951061 - protein, 40 aa, Mycobacterium
TITTNPPVEGAFYWLNNREVRWRPEHFWKSGTAIDVAVNT

SEQ ID NO: 951062 - protein, 34 aa, Mycobacterium
TIVRHLLTDPVLPDELLPADWPGADLRAAYNDFA

SEQ ID NO: 951063 - protein, 23 aa, Mycobacterium
TIVVPNMLLVRDDLDANLACVLT

SEQ ID NO: 951064 - protein, 25 aa, Mycobacterium
TIWAARAIGVLFPQIKTIYGYREDP

SEQ ID NO: 951065 - protein, 28 aa, Mycobacterium
TIYREPLSLRPFDYLPRPLRKSLGKASK

SEQ ID NO: 951066 - protein, 25 aa, Mycobacterium
TKAFNIVLAEGLWYELKPHGVDVMA

SEQ ID NO: 951067 - protein, 17 aa, Mycobacterium
TKALPPQAAGHVAAIAV

SEQ ID NO: 951068 - protein, 29 aa, Mycobacterium
TKDLADGLTYRFTFTFEKAGEVTVAVPID

SEQ ID NO: 951069 - protein, 23 aa, Mycobacterium
TKFISWVTGAFYDGDYALLANTL

SEQ ID NO: 951070 - protein, 27 aa, Mycobacterium
TKGLRTYVQLFVLIAAANDVRCDVASN

SEQ ID NO: 951071 - protein, 26 aa, Mycobacterium
TKGPKLNIYYTLDAKSLPLLEPTYLA

SEQ ID NO: 951072 - protein, 23 aa, Mycobacterium
TKGSYLVYNFGPGHPAPMLNAGG

SEQ ID NO: 951073 - protein, 23 aa, Mycobacterium
TKIERRGWHALLTLALNGDVDLP

SEQ ID NO: 951074 - protein, 23 aa, Mycobacterium
TKLLETYAVPPLLHNQALAISVT

SEQ ID NO: 951075 - protein, 24 aa, Mycobacterium
TKNLPLTQFLRDIGVPDQWVDAID

SEQ ID NO: 951076 - protein, 23 aa, Mycobacterium
TKQPITFDALFAPGTTPLDAIFP

SEQ ID NO: 951077 - protein, 25 aa, Mycobacterium
TKSPAGLEVLHRLLDRADAFVSNLA

SEQ ID NO: 951078 - protein, 19 aa, Mycobacterium
TKTVAPPPPPGPKTSIEAN

SEQ ID NO: 951079 - protein, 26 aa, Mycobacterium
TKVPNVWFHDLLRPDGRPYKDSEYAT

SEQ ID NO: 951080 - protein, 19 aa, Mycobacterium
TKYHGALTCMLVGAKIALD

SEQ ID NO: 951081 - protein, 28 aa, Mycobacterium
TLAAAPPPPPVPAALPVPPAPGQDPAIL

SEQ ID NO: 951082 - protein, 18 aa, Mycobacterium
TLAAVALSLSGCSPDQQA

SEQ ID NO: 951083 - protein, 30 aa, Mycobacterium
TLAELGTSIGWVPFVGTGLYGASFVGNLGA

SEQ ID NO: 951084 - protein, 21 aa, Mycobacterium
TLAFVVLLTAGLAIKFAHGIF

SEQ ID NO: 951085 - protein, 18 aa, Mycobacterium
TLAIYQLAFTGREEDVAD

SEQ ID NO: 951086 - protein, 24 aa, Mycobacterium
TLAKPISNGLTYNFTFNFEKAGQA

SEQ ID NO: 951087 - protein, 18 aa, Mycobacterium
TLALPLGDSLHGAHLLSR

SEQ ID NO: 951088 - protein, 22 aa, Mycobacterium
TLAMLRQLVADGSLWPVSGTAF

SEQ ID NO: 951089 - protein, 18 aa, Mycobacterium
TLATILIAATTVVAGCVP

SEQ ID NO: 951090 - protein, 23 aa, Mycobacterium
TLDDRWTLSQILSWQSNAAVVSG

SEQ ID NO: 951091 - protein, 20 aa, Mycobacterium
TLDLVGVGFVLIAGPEGAEW

SEQ ID NO: 951092 - protein, 22 aa, Mycobacterium
TLDPNIPARYWAPEQRKLGDDT

SEQ ID NO: 951093 - protein, 21 aa, Mycobacterium
TLDRSVLRQLGQGRRTAIVTG

SEQ ID NO: 951094 - protein, 32 aa, Mycobacterium
TLDVNLLGYVRTIRAVLPHLLARGGGSIVNTS

SEQ ID NO: 951095 - protein, 33 aa, Mycobacterium
TLDVNVLAPVALTQALLPALRAAQGDVVFINSG

SEQ ID NO: 951096 - protein, 20 aa, Mycobacterium
TLDYRTYSALGWTIEATESG

SEQ ID NO: 951097 - protein, 22 aa, Mycobacterium
TLGEALTLWLSDTEQLVPRDII

SEQ ID NO: 951098 - protein, 18 aa, Mycobacterium
TLGFLAHPALEAPGEVGN

SEQ ID NO: 951099 - protein, 19 aa, Mycobacterium
TLGGGQFLLSRLDGEVPDD

SEQ ID NO: 951100 - protein, 21 aa, Mycobacterium
TLGGWLNSDFAPGGTWNGVTY

SEQ ID NO: 951101 - protein, 17 aa, Mycobacterium
TLGLLNGLLGGGQGGQQ

SEQ ID NO: 951102 - protein, 18 aa, Mycobacterium
TLGRLRAVPVAGLDLRRD

SEQ ID NO: 951103 - protein, 24 aa, Mycobacterium
TLGRPTPLFVPAVALRTLLGEFAD

SEQ ID NO: 951104 - protein, 18 aa, Mycobacterium
TLGVHRVLQALVAGGPRT

SEQ ID NO: 951105 - protein, 20 aa, Mycobacterium
TLGVLAIFGRLACAGPRTSE

SEQ ID NO: 951106 - protein, 23 aa, Mycobacterium
TLGYRPLTMDFRLTHLAVIGDSY

SEQ ID NO: 951107 - protein, 21 aa, Mycobacterium
TLHHLDLIAHLPDTAPPPAEG

SEQ ID NO: 951108 - protein, 19 aa, Mycobacterium
TLKLDGPTLARIFNGAISK

SEQ ID NO: 951109 - protein, 19 aa, Mycobacterium
TLLADIYVAALRSYGFPAR

SEQ ID NO: 951110 - protein, 22 aa, Mycobacterium
TLLEDWRPYVRGHIVEYPVDAT

SEQ ID NO: 951111 - protein, 17 aa, Mycobacterium
TLLGWNMSVANLRFEAE

SEQ ID NO: 951112 - protein, 20 aa, Mycobacterium
TLLKQKVLAPLGLTATANSE

SEQ ID NO: 951113 - protein, 17 aa, Mycobacterium
TLLPLAICALSGCSARG

SEQ ID NO: 951114 - protein, 31 aa, Mycobacterium
TLLRDMLNGIYDPVQWEINIIKTTTGATVTA

SEQ ID NO: 951115 - protein, 21 aa, Mycobacterium
TLLVLRRITMNLDGWDQLDRK

SEQ ID NO: 951116 - protein, 20 aa, Mycobacterium
TLNKLDAILIPRVNAGYSRN

SEQ ID NO: 951117 - protein, 22 aa, Mycobacterium
TLNQPLPGTAPPPGTRIPGLGD

SEQ ID NO: 951118 - protein, 24 aa, Mycobacterium
TLPADLRDALTEWVDAVRAVASAI

SEQ ID NO: 951119 - protein, 17 aa, Mycobacterium
TLPAEPITVIFRSDESG

SEQ ID NO: 951120 - protein, 27 aa, Mycobacterium
TLPDKYRVLGRQAMYGDYFSFYLCDLI

SEQ ID NO: 951121 - protein, 23 aa, Mycobacterium
TLPGPIRTATWKHRLYAAPVTTN

SEQ ID NO: 951122 - protein, 17 aa, Mycobacterium
TLPLYATMKGALRGFAK

SEQ ID NO: 951123 - protein, 17 aa, Mycobacterium
TLPSALTWRRIAGDPLR

SEQ ID NO: 951124 - protein, 17 aa, Mycobacterium
TLPVPIDSNWHTWRCTW

SEQ ID NO: 951125 - protein, 19 aa, Mycobacterium
TLQDVGTLALPSGSGYLVT

SEQ ID NO: 951126 - protein, 17 aa, Mycobacterium
TLQPYLGAYGHLVVLRE

SEQ ID NO: 951127 - protein, 17 aa, Mycobacterium
TLRLGHSAFYPLPDMAF

SEQ ID NO: 951128 - protein, 19 aa, Mycobacterium
TLRRWRCGIDGPLGGYEIH

SEQ ID NO: 951129 - protein, 28 aa, Mycobacterium
TLRTNGERLVFWDCYRPHEVQVRMFQVV

SEQ ID NO: 951130 - protein, 28 aa, Mycobacterium
TLSENGWKTFFRGLANDGVQGPSVANYL

SEQ ID NO: 951131 - protein, 17 aa, Mycobacterium
TLSIYHPQLFVYAGALS

SEQ ID NO: 951132 - protein, 32 aa, Mycobacterium
TLSSDIRATLWRKFMLISSYGGVGVLCRQPVG

SEQ ID NO: 951133 - protein, 18 aa, Mycobacterium
TLSTFYYEPVHLARLLTT

SEQ ID NO: 951134 - protein, 17 aa, Mycobacterium
TLTLALAPAAEAAPHQV

SEQ ID NO: 951135 - protein, 19 aa, Mycobacterium
TLTNAPMPPQPSPASLLGE

SEQ ID NO: 951136 - protein, 21 aa, Mycobacterium
TLTNPIIGELLKAKAPVVVMD

SEQ ID NO: 951137 - protein, 17 aa, Mycobacterium
TLTVAQCHPSWTGPGSG

SEQ ID NO: 951138 - protein, 17 aa, Mycobacterium
TLVGLVALIAALVSACG

SEQ ID NO: 951139 - protein, 19 aa, Mycobacterium
TLVRDVRYTFFNKAPTLSP

SEQ ID NO: 951140 - protein, 24 aa, Mycobacterium
TLVTGYPNFYMLYGPNTNGVNSII

SEQ ID NO: 951141 - protein, 17 aa, Mycobacterium
TLVVVLVLCLAGVTAVS

SEQ ID NO: 951142 - protein, 17 aa, Mycobacterium
TLVWPRGSGTVREFPEI

SEQ ID NO: 951143 - protein, 20 aa, Mycobacterium
TLWFPFATSAWPTLAGATSA

SEQ ID NO: 951144 - protein, 19 aa, Mycobacterium
TLWYHDHRMGYTGSAVWRG

SEQ ID NO: 951145 - protein, 19 aa, Mycobacterium
TLYLTYFTAMKSEAITLVR

SEQ ID NO: 951146 - protein, 22 aa, Mycobacterium
TMAELWWDRPFTVEGVAIGASV

SEQ ID NO: 951147 - protein, 18 aa, Mycobacterium
TMAGWRTDFLNEMGLVIS

SEQ ID NO: 951148 - protein, 19 aa, Mycobacterium
TMATFHPDRYRFAGSLSGF

SEQ ID NO: 951149 - protein, 27 aa, Mycobacterium
TMEESALWLDLTYGGDAPIVLTGAMRS

SEQ ID NO: 951150 - protein, 26 aa, Mycobacterium
TMEETALWLELTYDGAPPVVLTGAQR

SEQ ID NO: 951151 - protein, 30 aa, Mycobacterium
TMKPAGMDPKLLSPAPLPPGVTVDPPDCAK

SEQ ID NO: 951152 - protein, 20 aa, Mycobacterium
TMKTVKLLATSVAAFAVIGG

SEQ ID NO: 951153 - protein, 24 aa, Mycobacterium
TMLAQRLPGLLPPLSHKDALEVTA

SEQ ID NO: 951154 - protein, 17 aa, Mycobacterium
TMLDSELIRFAMSNPAL

SEQ ID NO: 951155 - protein, 17 aa, Mycobacterium
TMLVLAAATACQGPGTG

SEQ ID NO: 951156 - protein, 17 aa, Mycobacterium
TMRPYLVDNLRGPDLAN

SEQ ID NO: 951157 - protein, 17 aa, Mycobacterium
TMRVFLHDQLWAQDRQG

SEQ ID NO: 951158 - protein, 18 aa, Mycobacterium
TMTNNVAAALFPTYILRN

SEQ ID NO: 951159 - protein, 17 aa, Mycobacterium
TMTREALRALPNRTLDA

SEQ ID NO: 951160 - protein, 18 aa, Mycobacterium
TMVCTPFMVPNSPGAFSG

SEQ ID NO: 951161 - protein, 25 aa, Mycobacterium
TMVDEIARQWPVLHSPVCRPDLDRA

SEQ ID NO: 951162 - protein, 32 aa, Mycobacterium
TMYGDPVAAAKWWRYQKYDDCVIMSSADVIGQ

SEQ ID NO: 951163 - protein, 20 aa, Mycobacterium
TNAAIPWSLTVVTTLSAVIA

SEQ ID NO: 951164 - protein, 25 aa, Mycobacterium
TNARLRKGLLLGTHWGRLGAELVPA

SEQ ID NO: 951165 - protein, 18 aa, Mycobacterium
TNDAKNILSYIRGSNTDA

SEQ ID NO: 951166 - protein, 26 aa, Mycobacterium
TNEPPLTAVLPQIKNWLNIPGHTDEV

SEQ ID NO: 951167 - protein, 20 aa, Mycobacterium
TNEYAPALNCAFAGLVQITH

SEQ ID NO: 951168 - protein, 19 aa, Mycobacterium
TNFYNIYDPAQGTLNGLLS

SEQ ID NO: 951169 - protein, 23 aa, Mycobacterium
TNGRPLIYTLLDGPDQGGKITLN

SEQ ID NO: 951170 - protein, 26 aa, Mycobacterium
TNGTHSWPYWNQQLVAMKPDMLQVLN

SEQ ID NO: 951171 - protein, 20 aa, Mycobacterium
TNKVLTAAAALLTLERDAKL

SEQ ID NO: 951172 - protein, 30 aa, Mycobacterium
TNLSKVLANPLLTQNFFKLIQGGTTAASTI

SEQ ID NO: 951173 - protein, 18 aa, Mycobacterium
TNLYRQQMSPINTPEGSL

SEQ ID NO: 951174 - protein, 24 aa, Mycobacterium
TNNRLTVRFFGPPSAAPPGNYWIV

SEQ ID NO: 951175 - protein, 22 aa, Mycobacterium
TNPLQALEQQLLAAINAPTQTL

SEQ ID NO: 951176 - protein, 25 aa, Mycobacterium
TNSGYPEHTFAWDTALRVRQELNAL

SEQ ID NO: 951177 - protein, 24 aa, Mycobacterium
TNSGYPEHTFTWDTALRLRAALNA

SEQ ID NO: 951178 - protein, 25 aa, Mycobacterium
TNSLKLYDVPATPPPIFVAAGGPKS

SEQ ID NO: 951179 - protein, 30 aa, Mycobacterium
TNTDLSLPLASIFKLYVLLAVSDAIKEGTL

SEQ ID NO: 951180 - protein, 22 aa, Mycobacterium
TNTDTIILVRIPNNGRSATAIS

SEQ ID NO: 951181 - protein, 17 aa, Mycobacterium
TNTLILVHVGADGKVVA

SEQ ID NO: 951182 - protein, 29 aa, Mycobacterium
TNTNQPLPLASIFKLYVLHALADAIKSGT

SEQ ID NO: 951183 - protein, 22 aa, Mycobacterium
TNVLVPGYRYHVALDAKAAGAD

SEQ ID NO: 951184 - protein, 28 aa, Mycobacterium
TNVVALLNSIIAYAYRYKSQAFTGLPVD

SEQ ID NO: 951185 - protein, 22 aa, Mycobacterium
TNYSILFSTKIPRGPLVPSGAT

SEQ ID NO: 951186 - protein, 26 aa, Mycobacterium
TPAAALTVLVLPATTFAIGTAGAEGA

SEQ ID NO: 951187 - protein, 24 aa, Mycobacterium
TPAAIGAKSWPLVLATRLGISSKE

SEQ ID NO: 951188 - protein, 22 aa, Mycobacterium
TPAATYPCDVLVFATGFDAMTG

SEQ ID NO: 951189 - protein, 28 aa, Mycobacterium
TPAEELRMLPMLLLAFGRHLSRGRQVVD

SEQ ID NO: 951190 - protein, 17 aa, Mycobacterium
TPAFEWFYNSGISVVMP

SEQ ID NO: 951191 - protein, 17 aa, Mycobacterium
TPAFITTGRIREAWNVP

SEQ ID NO: 951192 - protein, 25 aa, Mycobacterium
TPAGPAPNAAPPPAPPPAAKDHVEG

SEQ ID NO: 951193 - protein, 25 aa, Mycobacterium
TPANARYFIVPVTDLWTVTGDYWHQ

SEQ ID NO: 951194 - protein, 24 aa, Mycobacterium
TPDAAWAFVSWITAKPNDVVRTEK

SEQ ID NO: 951195 - protein, 24 aa, Mycobacterium
TPDDVKLVFLQPADALSAFKQGRV

SEQ ID NO: 951196 - protein, 20 aa, Mycobacterium
TPDELIIYMPDYPVARDRPT

SEQ ID NO: 951197 - protein, 23 aa, Mycobacterium
TPDGPVAFWGWFSGGSAALAAAE

SEQ ID NO: 951198 - protein, 35 aa, Mycobacterium
TPEDTLVHGLPLFHVHGLVLGLIGSLRIGNRFVHT

SEQ ID NO: 951199 - protein, 17 aa, Mycobacterium
TPEFAALGADTWHWHPM

SEQ ID NO: 951200 - protein, 26 aa, Mycobacterium
TPEFEGHPLPLLLPGVDYAFDNSHCA

SEQ ID NO: 951201 - protein, 20 aa, Mycobacterium
TPELLFSPDMFHPSAAGYEL

SEQ ID NO: 951202 - protein, 20 aa, Mycobacterium
TPFAVIPHGSAAPPGLLVMS

SEQ ID NO: 951203 - protein, 27 aa, Mycobacterium
TPFGTIQYVSFMSVTRWGQSGRWSTNY

SEQ ID NO: 951204 - protein, 25 aa, Mycobacterium
TPGDLCSFPLRKCGDGNLYGGNEPA

SEQ ID NO: 951205 - protein, 26 aa, Mycobacterium
TPGEYAELPYFFTDQYDLGMEYAGHA

SEQ ID NO: 951206 - protein, 26 aa, Mycobacterium
TPGEYAELPYFFTDQYDLGMEYVGHA

SEQ ID NO: 951207 - protein, 23 aa, Mycobacterium
TPGLRLAAPKEWGLAPTASGVAW

SEQ ID NO: 951208 - protein, 20 aa, Mycobacterium
TPGNLPVAAGPLPGPAPANR

SEQ ID NO: 951209 - protein, 19 aa, Mycobacterium
TPHDLAVIFRAAMADPVFA

SEQ ID NO: 951210 - protein, 20 aa, Mycobacterium
TPIAVPLVTVPLNGVVTVGL

SEQ ID NO: 951211 - protein, 28 aa, Mycobacterium
TPIINVNFLPLNHLAGRVGLLTAFIPGG

SEQ ID NO: 951212 - protein, 31 aa, Mycobacterium
TPIIVFSHIPLFAMYPNWGWGTDDAAHALSY

SEQ ID NO: 951213 - protein, 25 aa, Mycobacterium
TPISPKMIDALRPMMRLVVTNGTAK

SEQ ID NO: 951214 - protein, 25 aa, Mycobacterium
TPISPKMVDALRPMMRLVVTNGTAK

SEQ ID NO: 951215 - protein, 17 aa, Mycobacterium
TPKTKLTMLASRAGLVM

SEQ ID NO: 951216 - protein, 20 aa, Mycobacterium
TPLFDRAVIALPAGKSIRIS

SEQ ID NO: 951217 - protein, 19 aa, Mycobacterium
TPLMSELLDKPVGPAVQPA

SEQ ID NO: 951218 - protein, 21 aa, Mycobacterium
TPMGQTPWTPSGPPLPPAPGG

SEQ ID NO: 951219 - protein, 25 aa, Mycobacterium
TPNGYWSVLPNVTLSWYRGSPIGRE

SEQ ID NO: 951220 - protein, 24 aa, Mycobacterium
TPPDGVTGPLLLAPSDDSPGCTPS

SEQ ID NO: 951221 - protein, 25 aa, Mycobacterium
TPPDTSIPLLAYRAADEIGLVEGTT

SEQ ID NO: 951222 - protein, 22 aa, Mycobacterium
TPPLEEVLPYYDTLEPIPVSTA

SEQ ID NO: 951223 - protein, 20 aa, Mycobacterium
TPPPPPPGPGGNGPVLGPGG

SEQ ID NO: 951224 - protein, 20 aa, Mycobacterium
TPPPSTFAPGFPPGPAAPPG

SEQ ID NO: 951225 - protein, 19 aa, Mycobacterium
TPQSPVADLLPGGAKTAVA

SEQ ID NO: 951226 - protein, 28 aa, Mycobacterium
TPQTPNFWGYWLYFKTPGGWSCGLAPNG

SEQ ID NO: 951227 - protein, 20 aa, Mycobacterium
TPRGIIWKAYVTIRPTKVPN

SEQ ID NO: 951228 - protein, 25 aa, Mycobacterium
TPSDSIDIGIPTLAATAVQSRGAAP

SEQ ID NO: 951229 - protein, 22 aa, Mycobacterium
TPSTVICLLQAPNGQLLTGSAR

SEQ ID NO: 951230 - protein, 29 aa, Mycobacterium
TPSYRLTHLWYRDNPPMFPFLSAQNYAVL

SEQ ID NO: 951231 - protein, 28 aa, Mycobacterium
TPTSTSTPRWLTVTSTPEGAPATPNALY

SEQ ID NO: 951232 - protein, 26 aa, Mycobacterium
TPVGSAVPGAFPTVAAVTTGATVATV

SEQ ID NO: 951233 - protein, 23 aa, Mycobacterium
TPVVVGGRTVWLIGLGGADSERL

SEQ ID NO: 951234 - protein, 27 aa, Mycobacterium
TQAGQFALTYPRRLGFGLGTSVVSLSW

SEQ ID NO: 951235 - protein, 21 aa, Mycobacterium
TQAVDLIKGAIPAAASAAAPP

SEQ ID NO: 951236 - protein, 17 aa, Mycobacterium
TQDSMCLWFTYSTPDTN

SEQ ID NO: 951237 - protein, 25 aa, Mycobacterium
TQEGYTAWLLEPYADKPDSIGGSPF

SEQ ID NO: 951238 - protein, 24 aa, Mycobacterium
TQFAAPVWMPRARRSPIRDVQEVI

SEQ ID NO: 951239 - protein, 26 aa, Mycobacterium
TQGAFWLKVIGWSDGRQRIVIDHITR

SEQ ID NO: 951240 - protein, 24 aa, Mycobacterium
TQGGYTAWLIDPYADKPDSIGTSP

SEQ ID NO: 951241 - protein, 23 aa, Mycobacterium
TQHRRYITVTAQFDSAAGLYPGS

SEQ ID NO: 951242 - protein, 19 aa, Mycobacterium
TQIAEVEALYRALTPDQRA

SEQ ID NO: 951243 - protein, 24 aa, Mycobacterium
TQIRRTLWHTWQGESVPVPPAWPA

SEQ ID NO: 951244 - protein, 22 aa, Mycobacterium
TQKRLTYQVFGTGSGAMLSYVD

SEQ ID NO: 951245 - protein, 31 aa, Mycobacterium
TQLAVRTYGHVYLWNRDPSQDIWTALAQPAV

SEQ ID NO: 951246 - protein, 21 aa, Mycobacterium
TQLPVWLSHAGADILRSHPIV

SEQ ID NO: 951247 - protein, 27 aa, Mycobacterium
TQMTLFTAEGLLRYLVRGRIKGLSTYT

SEQ ID NO: 951248 - protein, 26 aa, Mycobacterium
TQNLGRKFLQSIGLLPTPTGITNGAI

SEQ ID NO: 951249 - protein, 19 aa, Mycobacterium
TQNLIDRAIRGDFVNGFFV

SEQ ID NO: 951250 - protein, 24 aa, Mycobacterium
TQPALDLDALLGGLRPVLKGLDAD

SEQ ID NO: 951251 - protein, 25 aa, Mycobacterium
TQPALDLDALLGGLRPVLKGLDGAK

SEQ ID NO: 951252 - protein, 22 aa, Mycobacterium
TQPTKFFNIEFGISTNKIDPQT

SEQ ID NO: 951253 - protein, 22 aa, Mycobacterium
TQQSVHLLLTVQGKVDGLPVEK

SEQ ID NO: 951254 - protein, 20 aa, Mycobacterium
TQQTYLLAFGRVKEDLRRSQ

SEQ ID NO: 951255 - protein, 33 aa, Mycobacterium
TQRIVLSRNPKWWGPRPRLDNITYLVLDDAARL

SEQ ID NO: 951256 - protein, 24 aa, Mycobacterium
TQRPSTMWAQYGLAGVLEYEHFVR

SEQ ID NO: 951257 - protein, 24 aa, Mycobacterium
TQTLRQRFPVIAISTDPRLETDCA

SEQ ID NO: 951258 - protein, 25 aa, Mycobacterium
TQVFPKLGLSHSFIRVPQAQMDDYA

SEQ ID NO: 951259 - protein, 21 aa, Mycobacterium
TQVGTPYAWGGAAPGGFDCSG

SEQ ID NO: 951260 - protein, 25 aa, Mycobacterium
TQVHTMLVLVRSGIGIALVPASAAT

SEQ ID NO: 951261 - protein, 28 aa, Mycobacterium
TQVLLYGIDVLLQPDLQLPTRTILDALA

SEQ ID NO: 951262 - protein, 19 aa, Mycobacterium
TQWLINGLKNSTAAWKIVA

SEQ ID NO: 951263 - protein, 19 aa, Mycobacterium
TQWTAAPLLHQCCGALLAS

SEQ ID NO: 951264 - protein, 26 aa, Mycobacterium
TRAADVHARFVQALAAGADRYASAEA

SEQ ID NO: 951265 - protein, 23 aa, Mycobacterium
TRAALSLLLVSTLVLAACGGRSG

SEQ ID NO: 951266 - protein, 18 aa, Mycobacterium
TRALLLATKRRAERFAPV

SEQ ID NO: 951267 - protein, 27 aa, Mycobacterium
TRAPVEFDRVLGMLDRLASSLQGDGRG

SEQ ID NO: 951268 - protein, 25 aa, Mycobacterium
TRAQDFSPVFRRIATDFPGLREAAW

SEQ ID NO: 951269 - protein, 24 aa, Mycobacterium
TRDFNKLIWHNASPTWKFDDDTYA

SEQ ID NO: 951270 - protein, 18 aa, Mycobacterium
TRELGRCPGVTGAVAMGR

SEQ ID NO: 951271 - protein, 28 aa, Mycobacterium
TRESLPLASIFKLYVLHALADAVKDGTV

SEQ ID NO: 951272 - protein, 20 aa, Mycobacterium
TRETVGVAAGLWAGAEVGAA

SEQ ID NO: 951273 - protein, 28 aa, Mycobacterium
TRFHTTEPLGFDVKYTWKGSAVGLDGKA

SEQ ID NO: 951274 - protein, 25 aa, Mycobacterium
TRGLGYGPPVLWYGSLSDSGVVTPE

SEQ ID NO: 951275 - protein, 18 aa, Mycobacterium
TRGVDVTPFFTVLNGPRI

SEQ ID NO: 951276 - protein, 22 aa, Mycobacterium
TRGVSGDGRFAYLRGENALTVV

SEQ ID NO: 951277 - protein, 20 aa, Mycobacterium
TRHQWYVDLGINPENLRLFE

SEQ ID NO: 951278 - protein, 24 aa, Mycobacterium
TRLSALTYCQTLGKPDTKISEAPH

SEQ ID NO: 951279 - protein, 18 aa, Mycobacterium
TRLVLAAAAAAGLVLSGC

SEQ ID NO: 951280 - protein, 20 aa, Mycobacterium
TRLVLASCALVPLGAGVPVA

SEQ ID NO: 951281 - protein, 20 aa, Mycobacterium
TRLWIYCAPGGATPLDDGAD

SEQ ID NO: 951282 - protein, 18 aa, Mycobacterium
TRMYNWECWIYGSDTTAN

SEQ ID NO: 951283 - protein, 23 aa, Mycobacterium
TRNRGREMLAFATAYREAGAQPP

SEQ ID NO: 951284 - protein, 25 aa, Mycobacterium
TRQDQPIHYLLADTFTICDGYHCSL

SEQ ID NO: 951285 - protein, 25 aa, Mycobacterium
TRQDQPIHYLLADTFTICDGYYCSL

SEQ ID NO: 951286 - protein, 32 aa, Mycobacterium
TRQELDSVLPDRPGFFFAVDAHSMWANSKSLE

SEQ ID NO: 951287 - protein, 18 aa, Mycobacterium
TRQRQGWGAWPVCSGRAG

SEQ ID NO: 951288 - protein, 24 aa, Mycobacterium
TRSAGLLAGGWLLGALRGTYASVG

SEQ ID NO: 951289 - protein, 25 aa, Mycobacterium
TRTAPPAPPRAATPVPIEPGQQTVS

SEQ ID NO: 951290 - protein, 33 aa, Mycobacterium
TRTELDSVLPDRPGFFFAIDGHSMWANSKALEM

SEQ ID NO: 951291 - protein, 32 aa, Mycobacterium
TRTGDTALRLARQRSPLPLLAFAHDDEVRGRL

SEQ ID NO: 951292 - protein, 24 aa, Mycobacterium
TRTPVEFDRVLGMLDKLSGSLRGD

SEQ ID NO: 951293 - protein, 23 aa, Mycobacterium
TRTVGAALMAGSLVLGMTACGGS

SEQ ID NO: 951294 - protein, 23 aa, Mycobacterium
TRVCNAFALVRNAVSLQTNANLG

SEQ ID NO: 951295 - protein, 20 aa, Mycobacterium
TRVVAPHRLTDPKAGPLIAV

SEQ ID NO: 951296 - protein, 24 aa, Mycobacterium
TRVVLLRTGLVLARSGGLIGRLKP

SEQ ID NO: 951297 - protein, 20 aa, Mycobacterium
TRWAAALVCAVLVAVAATWS

SEQ ID NO: 951298 - protein, 26 aa, Mycobacterium
TRYNPDYLPGTLLPPGIRATPEAEEA

SEQ ID NO: 951299 - protein, 32 aa, Mycobacterium
TSADIRALYAFKRLAWWPYSVAMRQVNVIFTR

SEQ ID NO: 951300 - protein, 23 aa, Mycobacterium
TSAGSFLTGAYRSGIQAGGGAAK

SEQ ID NO: 951301 - protein, 28 aa, Mycobacterium
TSAGYAITLWPNALAACDALGIGEDVRA

SEQ ID NO: 951302 - protein, 18 aa, Mycobacterium
TSAPFLRELTGTDGLALF

SEQ ID NO: 951303 - protein, 20 aa, Mycobacterium
TSATVLVSVACSVTMVLAGC

SEQ ID NO: 951304 - protein, 20 aa, Mycobacterium
TSCINTFNQSGFVISPTGSY

SEQ ID NO: 951305 - protein, 29 aa, Mycobacterium
TSDGTFPAIPYRVPYPQSMPGQESTPVRG

SEQ ID NO: 951306 - protein, 27 aa, Mycobacterium
TSDPLTAIPPLAQPFVQTALDQAPPPH

SEQ ID NO: 951307 - protein, 21 aa, Mycobacterium
TSEPLGYDMTYTWSGSAVGHD

SEQ ID NO: 951308 - protein, 28 aa, Mycobacterium
TSEQLDIPVLPVGVTYTGGAAGGYSTWL

SEQ ID NO: 951309 - protein, 23 aa, Mycobacterium
TSFTGHDVIYFYPANPDTGETQL

SEQ ID NO: 951310 - protein, 26 aa, Mycobacterium
TSGGWRIDRLPNGVFLDWQQFQATYK

SEQ ID NO: 951311 - protein, 21 aa, Mycobacterium
TSGLFMAGLGGALAFANPDAG

SEQ ID NO: 951312 - protein, 24 aa, Mycobacterium
TSGPLPQPPVAVAALDGLLLDQGQ

SEQ ID NO: 951313 - protein, 49 aa, Mycobacterium
TSKLFCDIVFDIIGPDVRLYWDQAVYKKPFSPLPFPWHQDNGYTFVEPQ

SEQ ID NO: 951314 - protein, 27 aa, Mycobacterium
TSKPAPGYFYWYTDQQLRWKPTQFWPA

SEQ ID NO: 951315 - protein, 24 aa, Mycobacterium
TSKPHEISVTGLPPILVVSTTNDP

SEQ ID NO: 951316 - protein, 29 aa, Mycobacterium
TSLAALNRLMPPIIKIMAGSAFAARVSID

SEQ ID NO: 951317 - protein, 29 aa, Mycobacterium
TSLARRPGLPLSTLRRRLHARLAHHGIRA

SEQ ID NO: 951318 - protein, 21 aa, Mycobacterium
TSLGFPMYDPRYRDVRVRQAI

SEQ ID NO: 951319 - protein, 20 aa, Mycobacterium
TSLLGSQHIELAPPADGSGT

SEQ ID NO: 951320 - protein, 28 aa, Mycobacterium
TSNPLTAIPPLAQPFIQTALDQAPPPHD

SEQ ID NO: 951321 - protein, 25 aa, Mycobacterium
TSNPLTAIPPLGQPYIQAALDAAAP

SEQ ID NO: 951322 - protein, 26 aa, Mycobacterium
TSPFAPMRFFCRPEATLLTLVPARTS

SEQ ID NO: 951323 - protein, 26 aa, Mycobacterium
TSPNRLYWISAWIDPDGVAGGPLLID

SEQ ID NO: 951324 - protein, 23 aa, Mycobacterium
TSPNRLYWMSAWIDPNGEQGGPL

SEQ ID NO: 951325 - protein, 23 aa, Mycobacterium
TSPTDFYHVFFKTPDGRHCGIGP

SEQ ID NO: 951326 - protein, 19 aa, Mycobacterium
TSRLLARFPSIGGTDTSGR

SEQ ID NO: 951327 - protein, 20 aa, Mycobacterium
TSRLTLYRQGAQRPTRVDLT

SEQ ID NO: 951328 - protein, 28 aa, Mycobacterium
TSTTPPPPPPPLPFSPATLYDPANYQNF

SEQ ID NO: 951329 - protein, 21 aa, Mycobacterium
TSVHLAIRTSGKVDSLLGITS

SEQ ID NO: 951330 - protein, 17 aa, Mycobacterium
TSVLPNMPALRPTPQAR

SEQ ID NO: 951331 - protein, 24 aa, Mycobacterium
TSVPSYNINLFLDGIQQVANGDPM

SEQ ID NO: 951332 - protein, 19 aa, Mycobacterium
TSVQSWKSCSNRRFDDVAP

SEQ ID NO: 951333 - protein, 21 aa, Mycobacterium
TSWGRLVFCGSPRRYEPRYFR

SEQ ID NO: 951334 - protein, 20 aa, Mycobacterium
TTAMDVLLLGGRPIREPVFH

SEQ ID NO: 951335 - protein, 24 aa, Mycobacterium
TTAQIRYLDLIGNRYLELKRGDGE

SEQ ID NO: 951336 - protein, 29 aa, Mycobacterium
TTAQSWQFLGTAINYYCPDQRFVMEQAAA

SEQ ID NO: 951337 - protein, 24 aa, Mycobacterium
TTATPYESTFLKAGPGSAVFNVEE

SEQ ID NO: 951338 - protein, 25 aa, Mycobacterium
TTAVLLIVLAFFSLAVVREYERGVV

SEQ ID NO: 951339 - protein, 20 aa, Mycobacterium
TTAYPLPRPGDGPAPKPVTL

SEQ ID NO: 951340 - protein, 25 aa, Mycobacterium
TTEQTLAAISLLLNGGGIGQIQDIT

SEQ ID NO: 951341 - protein, 19 aa, Mycobacterium
TTFYTCLYRSLLHPNIFND

SEQ ID NO: 951342 - protein, 25 aa, Mycobacterium
TTGAKRIRAGFPADWRVIDKTGSGE

SEQ ID NO: 951343 - protein, 21 aa, Mycobacterium
TTGKVYFDVKGEAPDSVVYSD

SEQ ID NO: 951344 - protein, 25 aa, Mycobacterium
TTGLDAILISPKLAPPDAARFEERW

SEQ ID NO: 951345 - protein, 19 aa, Mycobacterium
TTGVLPPAADEVSALVAVQ

SEQ ID NO: 951346 - protein, 17 aa, Mycobacterium
TTIVDFLRALEQHDETA

SEQ ID NO: 951347 - protein, 23 aa, Mycobacterium
TTKTLPDFPRLWADMLTAQEDRG

SEQ ID NO: 951348 - protein, 21 aa, Mycobacterium
TTKVTPLLQALSRRVNAADGD

SEQ ID NO: 951349 - protein, 25 aa, Mycobacterium
TTLAMPYLRNVAEPNAFQNLHWAFG

SEQ ID NO: 951350 - protein, 22 aa, Mycobacterium
TTLFPLDGPNQLETRVILNCFK

SEQ ID NO: 951351 - protein, 19 aa, Mycobacterium
TTLGLLGGALVAAAPAAAD

SEQ ID NO: 951352 - protein, 19 aa, Mycobacterium
TTLQPYLGAYGHLVALREG

SEQ ID NO: 951353 - protein, 22 aa, Mycobacterium
TTLRIDPRNRLPVAITGGLVRL

SEQ ID NO: 951354 - protein, 17 aa, Mycobacterium
TTLTADRIVLCAGAIES

SEQ ID NO: 951355 - protein, 20 aa, Mycobacterium
TTLTLVAYAVPEPGFREIIP

SEQ ID NO: 951356 - protein, 21 aa, Mycobacterium
TTMFPGFATQFARQLRTVELD

SEQ ID NO: 951357 - protein, 17 aa, Mycobacterium
TTMILPSGGAPYVVWPK

SEQ ID NO: 951358 - protein, 37 aa, Mycobacterium
TTMLWRNQYLARAMSVLLYFLFDHRGRFLDAAGGYGV

SEQ ID NO: 951359 - protein, 25 aa, Mycobacterium
TTNTQLLWYRPDLVAQPPETWNAVV

SEQ ID NO: 951360 - protein, 24 aa, Mycobacterium
TTNTQLLWYRSDLVPQPPGDWNGM

SEQ ID NO: 951361 - protein, 19 aa, Mycobacterium
TTPAPRRKPIQMPGLQDVA

SEQ ID NO: 951362 - protein, 29 aa, Mycobacterium
TTPDEVLLALFNALPGDLSILYPSPAEDK

SEQ ID NO: 951363 - protein, 23 aa, Mycobacterium
TTQKRPHEDADFWKLSITSADTA

SEQ ID NO: 951364 - protein, 17 aa, Mycobacterium
TTQSALLGSKAIDLCNP

SEQ ID NO: 951365 - protein, 19 aa, Mycobacterium
TTQVWSFDGPAPTATDAAW

SEQ ID NO: 951366 - protein, 25 aa, Mycobacterium
TTRAVLWAMAPALVAAPMALAGTAS

SEQ ID NO: 951367 - protein, 27 aa, Mycobacterium
TTRDEFTLFVALRYLRQDQRFTPEEYP

SEQ ID NO: 951368 - protein, 23 aa, Mycobacterium
TTRDEWTLFVALQHLRDGKDYAP

SEQ ID NO: 951369 - protein, 27 aa, Mycobacterium
TTSGFYHELGHATLAIYQLAFTGREED

SEQ ID NO: 951370 - protein, 25 aa, Mycobacterium
TTSGFYHELGHATLSIYELAFTGRE

SEQ ID NO: 951371 - protein, 25 aa, Mycobacterium
TTSLKLLAIIFPDNDFRIMQGWYDS

SEQ ID NO: 951372 - protein, 26 aa, Mycobacterium
TTSNRPFIGPFGITDLAIVATPGASA

SEQ ID NO: 951373 - protein, 25 aa, Mycobacterium
TTTAQIRYLNLFADRYLELKRGEGE

SEQ ID NO: 951374 - protein, 21 aa, Mycobacterium
TTTRMIAAALAPLGPVASNTE

SEQ ID NO: 951375 - protein, 21 aa, Mycobacterium
TTTTPIWIVTAGQPTTLTVQS

SEQ ID NO: 951376 - protein, 30 aa, Mycobacterium
TTTTYLIPEKHLPLVIPLGYLGVPEDELNQ

SEQ ID NO: 951377 - protein, 18 aa, Mycobacterium
TTTYLAEAGLRAAGRVAG

SEQ ID NO: 951378 - protein, 17 aa, Mycobacterium
TTTYLVEAGLRAAGRTA

SEQ ID NO: 951379 - protein, 28 aa, Mycobacterium
TTVGVRGAALIPGATSRAGPAETTITAG

SEQ ID NO: 951380 - protein, 18 aa, Mycobacterium
TTVIYTPTADFTGTDTFT

SEQ ID NO: 951381 - protein, 22 aa, Mycobacterium
TTVLAACVPVLGADPRFATNTG

SEQ ID NO: 951382 - protein, 19 aa, Mycobacterium
TTVYRQLLDVIGERQLRTV

SEQ ID NO: 951383 - protein, 25 aa, Mycobacterium
TVAAGRYVGWLRTSALHAAGAAAAA

SEQ ID NO: 951384 - protein, 23 aa, Mycobacterium
TVAAILRLWTVDAARLTAGRPAV

SEQ ID NO: 951385 - protein, 23 aa, Mycobacterium
TVAAMGLYVATLGIPMASRCDGV

SEQ ID NO: 951386 - protein, 19 aa, Mycobacterium
TVAAPVTPLAWSAEADDPG

SEQ ID NO: 951387 - protein, 18 aa, Mycobacterium
TVADLAWMRRHGVADAVV

SEQ ID NO: 951388 - protein, 25 aa, Mycobacterium
TVAENGLLVIDAPGLLGNDLDSEHP

SEQ ID NO: 951389 - protein, 19 aa, Mycobacterium
TVAGLLPPPPPSARIRLPG

SEQ ID NO: 951390 - protein, 23 aa, Mycobacterium
TVAKNGVLVISAPGLLANDSDPE

SEQ ID NO: 951391 - protein, 23 aa, Mycobacterium
TVALVWLLIGAFAAWQRDYFKND

SEQ ID NO: 951392 - protein, 19 aa, Mycobacterium
TVAPLRQRALARFAANAPE

SEQ ID NO: 951393 - protein, 25 aa, Mycobacterium
TVAQMLQRIVTLMPLGVAVVDSHRD

SEQ ID NO: 951394 - protein, 18 aa, Mycobacterium
TVASSLPRRAAASTVLIV

SEQ ID NO: 951395 - protein, 17 aa, Mycobacterium
TVATGLMGALRHAGHRV

SEQ ID NO: 951396 - protein, 20 aa, Mycobacterium
TVCALTAFLLVAVFGQVRFG

SEQ ID NO: 951397 - protein, 37 aa, Mycobacterium
TVDCLNRLNLPPLQAMWLPPLQPVPADELVRRLRGQP

SEQ ID NO: 951398 - protein, 28 aa, Mycobacterium
TVDPPRVPSWRPWPTAFDLRGAVTYVVD

SEQ ID NO: 951399 - protein, 17 aa, Mycobacterium
TVDRFCVLAFDDRIDTP

SEQ ID NO: 951400 - protein, 30 aa, Mycobacterium
TVELLARVHAAFWGRLPERSGRGPLGWLYS

SEQ ID NO: 951401 - protein, 22 aa, Mycobacterium
TVFHIHLHVLPRRNGDKLSVAK

SEQ ID NO: 951402 - protein, 17 aa, Mycobacterium
TVFQLASLSKPIAATVV

SEQ ID NO: 951403 - protein, 26 aa, Mycobacterium
TVGARQALPMLGPATPVLTIQNGLGS

SEQ ID NO: 951404 - protein, 24 aa, Mycobacterium
TVGFDCSGLMLYAFAGVGIKLDHY

SEQ ID NO: 951405 - protein, 24 aa, Mycobacterium
TVGLNGWYLMYQAPGGLNASMRPS

SEQ ID NO: 951406 - protein, 26 aa, Mycobacterium
TVGQALDILGWHITLSDLRFEADRVL

SEQ ID NO: 951407 - protein, 17 aa, Mycobacterium
TVGTRLTVLRRLAHPED

SEQ ID NO: 951408 - protein, 32 aa, Mycobacterium
TVGYDCSGLMMYGFAAVGIRLRHYTGYQYNSG

SEQ ID NO: 951409 - protein, 20 aa, Mycobacterium
TVGYRLAKIQSLLGLDLRKA

SEQ ID NO: 951410 - protein, 17 aa, Mycobacterium
TVHALRILKSVATAPGA

SEQ ID NO: 951411 - protein, 21 aa, Mycobacterium
TVHLAAPNVAGLLSAAGAPLL

SEQ ID NO: 951412 - protein, 20 aa, Mycobacterium
TVHLPAPNVAGLLSAAGAPL

SEQ ID NO: 951413 - protein, 25 aa, Mycobacterium
TVHVDADLYGVPFGDGAYGAADSTL

SEQ ID NO: 951414 - protein, 19 aa, Mycobacterium
TVIAGGAAVIGMISFTAAC

SEQ ID NO: 951415 - protein, 26 aa, Mycobacterium
TVIHDSFVRMLHFGAGSYAATEAINA

SEQ ID NO: 951416 - protein, 25 aa, Mycobacterium
TVKPAAPFRANVASVPPLTPQIVDP

SEQ ID NO: 951417 - protein, 22 aa, Mycobacterium
TVLAALRDTGFLTYGTERIGAA

SEQ ID NO: 951418 - protein, 23 aa, Mycobacterium
TVLAALRETGFITYPPADHFGVA

SEQ ID NO: 951419 - protein, 18 aa, Mycobacterium
TVLDSNPWRKLSANHDNR

SEQ ID NO: 951420 - protein, 18 aa, Mycobacterium
TVLDVPPTFAAKGLGSSD

SEQ ID NO: 951421 - protein, 19 aa, Mycobacterium
TVLPILQDTTIVAAGPSVQ

SEQ ID NO: 951422 - protein, 17 aa, Mycobacterium
TVLRLVQMRTAAPDFRL

SEQ ID NO: 951423 - protein, 24 aa, Mycobacterium
TVNAIPPGFIDTPMLRKAAEQGFL

SEQ ID NO: 951424 - protein, 26 aa, Mycobacterium
TVNHLAHYLLARLLVPSIADGGRLVI

SEQ ID NO: 951425 - protein, 30 aa, Mycobacterium
TVNQGMWLDFFERLIAESAPFPPAAPGFDR

SEQ ID NO: 951426 - protein, 29 aa, Mycobacterium
TVNTPLFDRAVISLPADKFIRLSAPGASA

SEQ ID NO: 951427 - protein, 17 aa, Mycobacterium
TVPAERQLVSLSPVPVS

SEQ ID NO: 951428 - protein, 23 aa, Mycobacterium
TVPKIFRGDYLNLSLTLDVTYSA

SEQ ID NO: 951429 - protein, 25 aa, Mycobacterium
TVPLKIIAGWRNNFDPRYPPLVTAV

SEQ ID NO: 951430 - protein, 18 aa, Mycobacterium
TVPLTPPAPAAPVAAASG

SEQ ID NO: 951431 - protein, 19 aa, Mycobacterium
TVPLTYPFALTFPTVMQLI

SEQ ID NO: 951432 - protein, 26 aa, Mycobacterium
TVPLVTVLMLGVLLYSVPAMALAVVA

SEQ ID NO: 951433 - protein, 23 aa, Mycobacterium
TVPPYRVPFPQVMPSQETSPTRG

SEQ ID NO: 951434 - protein, 17 aa, Mycobacterium
TVQSLLLQPGAGSGWHA

SEQ ID NO: 951435 - protein, 24 aa, Mycobacterium
TVRDIAKRWDGWANWENWPNITRE

SEQ ID NO: 951436 - protein, 18 aa, Mycobacterium
TVRIGYQTPNARLAATVG

SEQ ID NO: 951437 - protein, 36 aa, Mycobacterium
TVRLNTPFAIYPMTLGYTAFLPLPKAFFRDPVKFGV

SEQ ID NO: 951438 - protein, 26 aa, Mycobacterium
TVRNPEQLLLLFDPLPNTGIVEIQGN

SEQ ID NO: 951439 - protein, 19 aa, Mycobacterium
TVRNSFIAAAVAALTVAGS

SEQ ID NO: 951440 - protein, 18 aa, Mycobacterium
TVRPKILSPQYSEYQVVQ

SEQ ID NO: 951441 - protein, 23 aa, Mycobacterium
TVRVDAVIYFKVIDPVRAVVDVQ

SEQ ID NO: 951442 - protein, 24 aa, Mycobacterium
TVSGQLTILVPFVDRIRAKVDLRE

SEQ ID NO: 951443 - protein, 19 aa, Mycobacterium
TVSPVRMSGLQPYAARIIE

SEQ ID NO: 951444 - protein, 25 aa, Mycobacterium
TVSQMLERIVAISPTGIVVVDKHQD

SEQ ID NO: 951445 - protein, 24 aa, Mycobacterium
TVSQMLERIVSFSPIGIAVVDNFR

SEQ ID NO: 951446 - protein, 41 aa, Mycobacterium
TVSSGFYYNPFIPNLFTIQFFQWFIDYAFGFRAHGAPGQPP

SEQ ID NO: 951447 - protein, 27 aa, Mycobacterium
TVSVTVSVGPPPPPPWCRGGSVVVVVT

SEQ ID NO: 951448 - protein, 25 aa, Mycobacterium
TVTADAPFWAHIYYRDTQPAIFSDY

SEQ ID NO: 951449 - protein, 19 aa, Mycobacterium
TVTMLLLLNSGRPEDRELV

SEQ ID NO: 951450 - protein, 22 aa, Mycobacterium
TVTPTPLVPIAGAPGAGVAPPQ

SEQ ID NO: 951451 - protein, 23 aa, Mycobacterium
TVTTGIISALNRPVAASGDARNQ

SEQ ID NO: 951452 - protein, 25 aa, Mycobacterium
TVTVKTVAGGILTPGFHGMHVHEFG

SEQ ID NO: 951453 - protein, 19 aa, Mycobacterium
TVVAAPDGSLWFTTSNRDG

SEQ ID NO: 951454 - protein, 19 aa, Mycobacterium
TVVGGRWGLPRRVQDIDAA

SEQ ID NO: 951455 - protein, 18 aa, Mycobacterium
TVVGINRGAPIRGTVQDY

SEQ ID NO: 951456 - protein, 20 aa, Mycobacterium
TVVLVALWGPPGVAPAEPAG

SEQ ID NO: 951457 - protein, 17 aa, Mycobacterium
TVVPRIVARRQRRAAYA

SEQ ID NO: 951458 - protein, 20 aa, Mycobacterium
TVVTQPTAGVFKGFSSKCTH

SEQ ID NO: 951459 - protein, 17 aa, Mycobacterium
TVVTTNDAQYRVLAHIY

SEQ ID NO: 951460 - protein, 29 aa, Mycobacterium
TVVYNAGGKDLLVWDKPAASATAPSGTGQ

SEQ ID NO: 951461 - protein, 19 aa, Mycobacterium
TVYVFPGWIDVGTTNPYIT

SEQ ID NO: 951462 - protein, 17 aa, Mycobacterium
TWACYMAARQRANFVAS

SEQ ID NO: 951463 - protein, 20 aa, Mycobacterium
TWELGAIRHLGKWPRSFASA

SEQ ID NO: 951464 - protein, 19 aa, Mycobacterium
TWGGVYVHSAPWSVGSQGY

SEQ ID NO: 951465 - protein, 26 aa, Mycobacterium
TWRGDQYVLFVQLSGSGARYGRQGVE

SEQ ID NO: 951466 - protein, 24 aa, Mycobacterium
TWTTYDSWHYTNALGMYAAGTFHA

SEQ ID NO: 951467 - protein, 27 aa, Mycobacterium
TYAPGRAMPLTLLLHSLALGQNQFASI

SEQ ID NO: 951468 - protein, 22 aa, Mycobacterium
TYDGALALRDHLRRLADGSPTP

SEQ ID NO: 951469 - protein, 25 aa, Mycobacterium
TYDKPFCEVFVYLGKEYQPMYFPPE

SEQ ID NO: 951470 - protein, 32 aa, Mycobacterium
TYDSGNLPLLEPFRVMPHLLNLIPGTNIPTPL

SEQ ID NO: 951471 - protein, 20 aa, Mycobacterium
TYEYFPTEPTRVLTLSLLPG

SEQ ID NO: 951472 - protein, 20 aa, Mycobacterium
TYFFQGAMSVLQPYIDSGKL

SEQ ID NO: 951473 - protein, 26 aa, Mycobacterium
TYFIPEQHLPLVMGFKYLGVPEETLN

SEQ ID NO: 951474 - protein, 18 aa, Mycobacterium
TYGGLLVDEQFTPPGFAA

SEQ ID NO: 951475 - protein, 17 aa, Mycobacterium
TYGLKATDKVITCAVGE

SEQ ID NO: 951476 - protein, 23 aa, Mycobacterium
TYGSSVLILPDASLDAVHVNASL

SEQ ID NO: 951477 - protein, 33 aa, Mycobacterium
TYIHPEDRFMLTDPIYGLGPRVAQLVAGAFFRE

SEQ ID NO: 951478 - protein, 44 aa, Mycobacterium
TYKLINAFFSPRCNLIAWDRGVLIPTGKVYFGAMPVTGIFAHEY

SEQ ID NO: 951479 - protein, 25 aa, Mycobacterium
TYKPMAAWVAMGKPTFIINANFFDV

SEQ ID NO: 951480 - protein, 27 aa, Mycobacterium
TYLAELRHLATLLLHLASRAGAPSVVA

SEQ ID NO: 951481 - protein, 20 aa, Mycobacterium
TYLLKVGIADQPWSYIQRFG

SEQ ID NO: 951482 - protein, 17 aa, Mycobacterium
TYMILIRAALAGVAAAG

SEQ ID NO: 951483 - protein, 30 aa, Mycobacterium
TYMIPEEHLPLVLPFKYLGVPKDTLMELDK

SEQ ID NO: 951484 - protein, 19 aa, Mycobacterium
TYNEWSFAQAQKLSMAKVI

SEQ ID NO: 951485 - protein, 23 aa, Mycobacterium
TYQYLDMHMAIASALSMYDNVLA

SEQ ID NO: 951486 - protein, 23 aa, Mycobacterium
TYQYLDMHMAIASALSMYENVLA

SEQ ID NO: 951487 - protein, 17 aa, Mycobacterium
TYRAFLHVAGEQALAAA

SEQ ID NO: 951488 - protein, 25 aa, Mycobacterium
TYSEDWLRPDYIPPGGPAPAPAAGV

SEQ ID NO: 951489 - protein, 17 aa, Mycobacterium
VAAAIGLAAALLGLTGC

SEQ ID NO: 951490 - protein, 18 aa, Mycobacterium
VAAALAAGLSLGLASQAD

SEQ ID NO: 951491 - protein, 24 aa, Mycobacterium
VAAALTRIGAPYSWGGSGPNAFDC

SEQ ID NO: 951492 - protein, 30 aa, Mycobacterium
VAADFRGQFPVPAKLWTIADLGGWDVVDPQ

SEQ ID NO: 951493 - protein, 23 aa, Mycobacterium
VAADWRDALLDEWSVILGPTFST

SEQ ID NO: 951494 - protein, 32 aa, Mycobacterium
VAAEALVRWRHPIWGLLLPDSFIGVAESTNLA

SEQ ID NO: 951495 - protein, 23 aa, Mycobacterium
VAAFFAGIAISMYCPQMISGIGD

SEQ ID NO: 951496 - protein, 21 aa, Mycobacterium
VAAGMAFAAPPIAHADNNWIA

SEQ ID NO: 951497 - protein, 19 aa, Mycobacterium
VAALCRLLARRGTRVAPFK

SEQ ID NO: 951498 - protein, 19 aa, Mycobacterium
VAALDGLLLDQGQINSVLT

SEQ ID NO: 951499 - protein, 22 aa, Mycobacterium
VAALRCAALPPATMLCDFNNEA

SEQ ID NO: 951500 - protein, 23 aa, Mycobacterium
VAALTATLAPLAACANQQGSQPN

SEQ ID NO: 951501 - protein, 30 aa, Mycobacterium
VAANRNDLVALVISNLFGQNTPAIAATEGL

SEQ ID NO: 951502 - protein, 28 aa, Mycobacterium
VAAQRMSVLSLPTTFIFDADGRQLYRTA

SEQ ID NO: 951503 - protein, 26 aa, Mycobacterium
VAARGPRIYVLLPQTQTRAATSWVRG

SEQ ID NO: 951504 - protein, 22 aa, Mycobacterium
VAARRWPLIAALGHAVTLTIRG

SEQ ID NO: 951505 - protein, 26 aa, Mycobacterium
VAASAFLWHNLPVPTQVWAPFDVDGA

SEQ ID NO: 951506 - protein, 20 aa, Mycobacterium
VAATFAGALALGLAVPADAA

SEQ ID NO: 951507 - protein, 22 aa, Mycobacterium
VAATIAERLAIIDPAHAAEYRT

SEQ ID NO: 951508 - protein, 24 aa, Mycobacterium
VAATLLLVTAPLAAAWGPQGHNIV

SEQ ID NO: 951509 - protein, 17 aa, Mycobacterium
VAAVRSKAPGDKVSLTF

SEQ ID NO: 951510 - protein, 17 aa, Mycobacterium
VAAVRSKAPGDKVTLTY

SEQ ID NO: 951511 - protein, 17 aa, Mycobacterium
VAAVVAAATFFTSAGHG

SEQ ID NO: 951512 - protein, 18 aa, Mycobacterium
VAAYKWNTHGAIEDPVRV

SEQ ID NO: 951513 - protein, 25 aa, Mycobacterium
VACALQLQRAQLPPIRLRVGIHTGD

SEQ ID NO: 951514 - protein, 19 aa, Mycobacterium
VACCCAAAIALSPIAAADP

SEQ ID NO: 951515 - protein, 21 aa, Mycobacterium
VADAAVPRWGTPEEMAELFAF

SEQ ID NO: 951516 - protein, 29 aa, Mycobacterium
VADEEHWAAAMPVVRARLGPVTVLHSNAA

SEQ ID NO: 951517 - protein, 23 aa, Mycobacterium
VADFPRYPLNLVSTLNALAGAYY

SEQ ID NO: 951518 - protein, 17 aa, Mycobacterium
VADIPMEGFLRVNPAGD

SEQ ID NO: 951519 - protein, 25 aa, Mycobacterium
VADVLGIPFYVWDFAERFQADVIDD

SEQ ID NO: 951520 - protein, 23 aa, Mycobacterium
VAEEVRRYFGSKVLRTVIPRSVK

SEQ ID NO: 951521 - protein, 23 aa, Mycobacterium
VAEGMTVHWLNRITTALAAQPDH

SEQ ID NO: 951522 - protein, 30 aa, Mycobacterium
VAEIYDAFTYMLLLTIEDLGFCPKGEGGAF

SEQ ID NO: 951523 - protein, 22 aa, Mycobacterium
VAELLPQVFGWARSVDPVQPLT

SEQ ID NO: 951524 - protein, 25 aa, Mycobacterium
VAENIRYKAWLAEAALVCAEAAAAL

SEQ ID NO: 951525 - protein, 17 aa, Mycobacterium
VAEVTRERQGWGAWPVC

SEQ ID NO: 951526 - protein, 28 aa, Mycobacterium
VAEYFKEGTFIPILNYRVKRVALSPYPT

SEQ ID NO: 951527 - protein, 19 aa, Mycobacterium
VAFGCALISAPSAAADDDF

SEQ ID NO: 951528 - protein, 17 aa, Mycobacterium
VAFNGCCEPGWAHRDSI

SEQ ID NO: 951529 - protein, 23 aa, Mycobacterium
VAFNGTPPRRISVSSVAQLNSAS

SEQ ID NO: 951530 - protein, 18 aa, Mycobacterium
VAFSIPRDDWVPFAGVPG

SEQ ID NO: 951531 - protein, 25 aa, Mycobacterium
VAGAITLWLGLVAQVGGVSGAETQM

SEQ ID NO: 951532 - protein, 21 aa, Mycobacterium
VAGAMFLGAAGFASAVAGADP

SEQ ID NO: 951533 - protein, 21 aa, Mycobacterium
VAGDVPLAFALAAGSFRDGTR

SEQ ID NO: 951534 - protein, 28 aa, Mycobacterium
VAGEIYLNTFRHLYGMDCSHIAPANVYG

SEQ ID NO: 951535 - protein, 23 aa, Mycobacterium
VAGGWWWRYDLVPRGEHTDVTLT

SEQ ID NO: 951536 - protein, 22 aa, Mycobacterium
VAGHGGLFTRAPWVIAVDDHVD

SEQ ID NO: 951537 - protein, 26 aa, Mycobacterium
VAGKTQTYFPWDSWDKPYTKVPNVWF

SEQ ID NO: 951538 - protein, 24 aa, Mycobacterium
VAGLVAAPGFGYYSATKFAIEAVT

SEQ ID NO: 951539 - protein, 25 aa, Mycobacterium
VAGPGRMQFWRYRRSRPLQASLPMG

SEQ ID NO: 951540 - protein, 24 aa, Mycobacterium
VAGPVLAYWLSRYGFDVTVVERAP

SEQ ID NO: 951541 - protein, 19 aa, Mycobacterium
VAGREFVAFWLDGDNRVLA

SEQ ID NO: 951542 - protein, 35 aa, Mycobacterium
VAGRPVPAGWYSEPWWKPALVAGAWGLGSALLFST

SEQ ID NO: 951543 - protein, 45 aa, Mycobacterium
VAGRPVPAGWYSEPWWKPALVAGAWGLGSVLLFDALFSGMHGVDY

SEQ ID NO: 951544 - protein, 34 aa, Mycobacterium
VAGRPVPAGWYSEPWWKPALVAGAWGVGSALLFN

SEQ ID NO: 951545 - protein, 27 aa, Mycobacterium
VAGRRVLLNLWAYWCAECTAELPALAE

SEQ ID NO: 951546 - protein, 23 aa, Mycobacterium
VAGTALIAGLLKGLLDAGITPHT

SEQ ID NO: 951547 - protein, 17 aa, Mycobacterium
VAHQACIGGIPGYIGLE

SEQ ID NO: 951548 - protein, 24 aa, Mycobacterium
VAIHEMMHAFGWGSTLQGPGENQG

SEQ ID NO: 951549 - protein, 24 aa, Mycobacterium
VAISYVATLLLKLVDEHKLSLDDK

SEQ ID NO: 951550 - protein, 22 aa, Mycobacterium
VAIVDVLRILLSNPAVWEKTAL

SEQ ID NO: 951551 - protein, 26 aa, Mycobacterium
VAKQFTATAILLLVDAGRLALSDPLA

SEQ ID NO: 951552 - protein, 23 aa, Mycobacterium
VALAGFGIYRLHGIFGSHDNTTA

SEQ ID NO: 951553 - protein, 18 aa, Mycobacterium
VALALAWAAAVVAAQCWL

SEQ ID NO: 951554 - protein, 29 aa, Mycobacterium
VALANSIRPWAPPPPPPPAPADPADPNAA

SEQ ID NO: 951555 - protein, 17 aa, Mycobacterium
VALAVAVTAVGLAGCGI

SEQ ID NO: 951556 - protein, 17 aa, Mycobacterium
VALCPNYGHPDGHPETK

SEQ ID NO: 951557 - protein, 17 aa, Mycobacterium
VALGADRVWVLPTGYSC

SEQ ID NO: 951558 - protein, 18 aa, Mycobacterium
VALLAVATLLGGVSGCST

SEQ ID NO: 951559 - protein, 17 aa, Mycobacterium
VALLLARSVPATVAIIA

SEQ ID NO: 951560 - protein, 24 aa, Mycobacterium
VALLTVALTARPDLLMTATEDRLH

SEQ ID NO: 951561 - protein, 24 aa, Mycobacterium
VALQRALATGYFRPYTNADVIGAE

SEQ ID NO: 951562 - protein, 29 aa, Mycobacterium
VALRPQGHVLVFWDCYRPHEAQVKMFNAV

SEQ ID NO: 951563 - protein, 17 aa, Mycobacterium
VALVAGLGIYRLHRVFG

SEQ ID NO: 951564 - protein, 17 aa, Mycobacterium
VALVLVTGLVGCGSKPA

SEQ ID NO: 951565 - protein, 19 aa, Mycobacterium
VALYAYYSQGRRAVSMVPV

SEQ ID NO: 951566 - protein, 18 aa, Mycobacterium
VAMPVTIRFAAPVADRIA

SEQ ID NO: 951567 - protein, 18 aa, Mycobacterium
VAMPVVLIPVAGAEQPCA

SEQ ID NO: 951568 - protein, 20 aa, Mycobacterium
VAMTVLLCVPAPAAAAEIGQ

SEQ ID NO: 951569 - protein, 24 aa, Mycobacterium
VAMVTALRILLSNPAVWEKTALII

SEQ ID NO: 951570 - protein, 22 aa, Mycobacterium
VAMYLVPFAVDHFSVFRSTLPS

SEQ ID NO: 951571 - protein, 18 aa, Mycobacterium
VANDKWWGNPPVTKRVTV

SEQ ID NO: 951572 - protein, 21 aa, Mycobacterium
VAPELMRVAASDLANIGSTLS

SEQ ID NO: 951573 - protein, 20 aa, Mycobacterium
VAPFMSYGEFTGDAPLGTCA

SEQ ID NO: 951574 - protein, 29 aa, Mycobacterium
VAPGATAFPWRRQYALVQWYVETGDVAAA

SEQ ID NO: 951575 - protein, 25 aa, Mycobacterium
VAPGRAAWCSRRWARGTPVPRWSTR

SEQ ID NO: 951576 - protein, 19 aa, Mycobacterium
VAPTPINSWSFDVLDFVSD

SEQ ID NO: 951577 - protein, 30 aa, Mycobacterium
VAPTPLQLRAVGRLLGWRLGMDDVDPKGTV

SEQ ID NO: 951578 - protein, 25 aa, Mycobacterium
VAPVRRSQLYWAARLTLVSRAEDLP

SEQ ID NO: 951579 - protein, 36 aa, Mycobacterium
VAQAVELWKIVDRPNLFIKIPATKAGIPAITAVLAE

SEQ ID NO: 951580 - protein, 30 aa, Mycobacterium
VAQRILFHDMPTIPLWDYIAVVGWSTEVSN

SEQ ID NO: 951581 - protein, 30 aa, Mycobacterium
VARDLGDPALIARALIACGMLALYDPELSQ

SEQ ID NO: 951582 - protein, 22 aa, Mycobacterium
VARLAMIRFPATGDRIGSLVIN

SEQ ID NO: 951583 - protein, 32 aa, Mycobacterium
VARLGRYLPDSDTWEWFGYPLESTDVDGDWIG

SEQ ID NO: 951584 - protein, 17 aa, Mycobacterium
VARLVGAPPGYVGYDQG

SEQ ID NO: 951585 - protein, 24 aa, Mycobacterium
VARRIRMLIESWDRTVLTEQERVI

SEQ ID NO: 951586 - protein, 18 aa, Mycobacterium
VASEKLWAVAPKEAALQP

SEQ ID NO: 951587 - protein, 28 aa, Mycobacterium
VASFDNYMVIVTANPLVLPDKPVAKVDT

SEQ ID NO: 951588 - protein, 17 aa, Mycobacterium
VASLDFPFPAIGTVHLE

SEQ ID NO: 951589 - protein, 25 aa, Mycobacterium
VASVCTGALLLAKAGFLKNRRATTH

SEQ ID NO: 951590 - protein, 17 aa, Mycobacterium
VATAALAALAVGAALGV

SEQ ID NO: 951591 - protein, 19 aa, Mycobacterium
VATADFQFADGFATVTIET

SEQ ID NO: 951592 - protein, 28 aa, Mycobacterium
VATAIQNFYLWAEPWVQWGFSVASWAAG

SEQ ID NO: 951593 - protein, 24 aa, Mycobacterium
VATASLSHTVLLRSDGTAVAVGDN

SEQ ID NO: 951594 - protein, 18 aa, Mycobacterium
VATAVTLAVVLAIGGCSS

SEQ ID NO: 951595 - protein, 18 aa, Mycobacterium
VATAYLRAISNPFTGRIL

SEQ ID NO: 951596 - protein, 25 aa, Mycobacterium
VATDSRFRFLRQYADPEVYAPVTGF

SEQ ID NO: 951597 - protein, 30 aa, Mycobacterium
VATEFRAQYPVPAKLWTVADLGGWEAVDPQ

SEQ ID NO: 951598 - protein, 17 aa, Mycobacterium
VATVLFGGNNTVSASGL

SEQ ID NO: 951599 - protein, 19 aa, Mycobacterium
VATVLFSSHSTAHASALGV

SEQ ID NO: 951600 - protein, 25 aa, Mycobacterium
VATVSIWMGILLTEKLRGAFGQHPD

SEQ ID NO: 951601 - protein, 20 aa, Mycobacterium
VATYLAPIAAAQPPVPPVCG

SEQ ID NO: 951602 - protein, 26 aa, Mycobacterium
VAVAAIGWSFLSDRLDAITVTAQFDS

SEQ ID NO: 951603 - protein, 33 aa, Mycobacterium
VAVAATWSILYSFEPTTPPPSPALASKPSLPAP

SEQ ID NO: 951604 - protein, 21 aa, Mycobacterium
VAVATRFPGPITDLQLSRDST

SEQ ID NO: 951605 - protein, 25 aa, Mycobacterium
VAVDMLEMLPTPWGLVRSGVAPDHP

SEQ ID NO: 951606 - protein, 35 aa, Mycobacterium
VAVDSSGRPMIGPGGWLIGNGIEPGQNGGLLIGNG

SEQ ID NO: 951607 - protein, 17 aa, Mycobacterium
VAVEARRVGSMGLGARC

SEQ ID NO: 951608 - protein, 19 aa, Mycobacterium
VAVFGNPLRDLPGGGPLSQ

SEQ ID NO: 951609 - protein, 19 aa, Mycobacterium
VAVFLEYVCDNRYGWVVEC

SEQ ID NO: 951610 - protein, 18 aa, Mycobacterium
VAVGLFRGSFTSTVPVTV

SEQ ID NO: 951611 - protein, 20 aa, Mycobacterium
VAVLFVVLVAFGAWGYQRAN

SEQ ID NO: 951612 - protein, 19 aa, Mycobacterium
VAVLLVAVSGACQDPGVGA

SEQ ID NO: 951613 - protein, 21 aa, Mycobacterium
VAVLQLRGAAGLPTAAIGGGV

SEQ ID NO: 951614 - protein, 29 aa, Mycobacterium
VAVLVVLLALGTAFWLELRDDGAAPGAEA

SEQ ID NO: 951615 - protein, 20 aa, Mycobacterium
VAVMAAIFFSGCGSANPLGG

SEQ ID NO: 951616 - protein, 27 aa, Mycobacterium
VAVMRRMRATLAVVAVLLAVSPVAACG

SEQ ID NO: 951617 - protein, 30 aa, Mycobacterium
VAVTEWYGGFPFATWPWATERLGGATPEVL

SEQ ID NO: 951618 - protein, 28 aa, Mycobacterium
VCAAGFWGAQLARQVGLVLPLVPMAHQY

SEQ ID NO: 951619 - protein, 27 aa, Mycobacterium
VCAELGLPHLVLARPAWSPGDAIVVAS

SEQ ID NO: 951620 - protein, 17 aa, Mycobacterium
VCDHYFCSVLGPTSPNR

SEQ ID NO: 951621 - protein, 22 aa, Mycobacterium
VCMVGLVEPRLRVAITSGQCGS

SEQ ID NO: 951622 - protein, 17 aa, Mycobacterium
VCPAGTYWNPAVVQCLP

SEQ ID NO: 951623 - protein, 18 aa, Mycobacterium
VCRSRYGRFMTMGYRRPH

SEQ ID NO: 951624 - protein, 25 aa, Mycobacterium
VCSGAPLAALAALAALTAAVTTESG

SEQ ID NO: 951625 - protein, 18 aa, Mycobacterium
VCTAGKYARKHVPWANFT

SEQ ID NO: 951626 - protein, 17 aa, Mycobacterium
VCWCVCHRLGCVGPSFR

SEQ ID NO: 951627 - protein, 24 aa, Mycobacterium
VDAALPPQVALIPDLRPADPAEIP

SEQ ID NO: 951628 - protein, 23 aa, Mycobacterium
VDAGSWTFDHGDHSHFYVEPAAV

SEQ ID NO: 951629 - protein, 24 aa, Mycobacterium
VDAKFVRRVIDTLILPAVCAANTK

SEQ ID NO: 951630 - protein, 23 aa, Mycobacterium
VDALWFTTLLNQDALDLLELGLG

SEQ ID NO: 951631 - protein, 19 aa, Mycobacterium
VDCQTAVVFIPAGQSAPSP

SEQ ID NO: 951632 - protein, 24 aa, Mycobacterium
VDDDPLVYTVPGRGAVGGPTHGTV

SEQ ID NO: 951633 - protein, 21 aa, Mycobacterium
VDDMLPALRKLLADNRDGLTH

SEQ ID NO: 951634 - protein, 31 aa, Mycobacterium
VDDPLAMYQFDLCTLPLNLAGHCGMSVPSGL

SEQ ID NO: 951635 - protein, 26 aa, Mycobacterium
VDEALLRGAPLRIVAAWPSRYPDMYD

SEQ ID NO: 951636 - protein, 25 aa, Mycobacterium
VDEDAHVWNLARLAWSLRGDPVTMT

SEQ ID NO: 951637 - protein, 23 aa, Mycobacterium
VDELPYLTLRLTGVASLTVDVKR

SEQ ID NO: 951638 - protein, 20 aa, Mycobacterium
VDEWRLGTLGKVLSPYEIRV

SEQ ID NO: 951639 - protein, 18 aa, Mycobacterium
VDGAIVLVDRGSCPFGGK

SEQ ID NO: 951640 - protein, 24 aa, Mycobacterium
VDGEILYADRIVLSAGAIGSAHLL

SEQ ID NO: 951641 - protein, 25 aa, Mycobacterium
VDGRALSMLNDPFLVGGLPATNGPS

SEQ ID NO: 951642 - protein, 27 aa, Mycobacterium
VDGSGADPLWFLPLLDQDAVDMLELEL

SEQ ID NO: 951643 - protein, 29 aa, Mycobacterium
VDGTTYGVPFYNYALGYIYNKDDLAAAGA

SEQ ID NO: 951644 - protein, 18 aa, Mycobacterium
VDGVFWSATLQQIAYERA

SEQ ID NO: 951645 - protein, 28 aa, Mycobacterium
VDHPEWVLPVAWTPTHDLPPLEAVLTTA

SEQ ID NO: 951646 - protein, 29 aa, Mycobacterium
VDHYAEIGLLGFALIADALGGVDVCLKEP

SEQ ID NO: 951647 - protein, 29 aa, Mycobacterium
VDHYAEIGLLGFALITDALGGVDVCLNGP

SEQ ID NO: 951648 - protein, 29 aa, Mycobacterium
VDHYAEIGLLGFSLITDALGGVDVCLKEP

SEQ ID NO: 951649 - protein, 20 aa, Mycobacterium
VDIEYKFGFAGNPWGELEGV

SEQ ID NO: 951650 - protein, 18 aa, Mycobacterium
VDIQLAQLQKRLAQRRLT

SEQ ID NO: 951651 - protein, 26 aa, Mycobacterium
VDLEYVQYRQGFPPTFGLDGTGYVTS

SEQ ID NO: 951652 - protein, 25 aa, Mycobacterium
VDLVYQFIPVLKANGYRMVTVSELL

SEQ ID NO: 951653 - protein, 17 aa, Mycobacterium
VDMAIKLGLRSYANPGT

SEQ ID NO: 951654 - protein, 19 aa, Mycobacterium
VDMEFDCVIGNPTPADILL

SEQ ID NO: 951655 - protein, 18 aa, Mycobacterium
VDMLFQHYQTRVDALMAG

SEQ ID NO: 951656 - protein, 23 aa, Mycobacterium
VDPAQLSTLRWGPDERDTLRPVL

SEQ ID NO: 951657 - protein, 17 aa, Mycobacterium
VDPVKLNLTLSAAAQAL

SEQ ID NO: 951658 - protein, 34 aa, Mycobacterium
VDQQPYLQGYLAVDSLWLYLSNGNVIGGGQPTLT

SEQ ID NO: 951659 - protein, 23 aa, Mycobacterium
VDRRTALKLPLLLAAGTAVATAG

SEQ ID NO: 951660 - protein, 20 aa, Mycobacterium
VDRSIPLYQSTTAQIRYLDL

SEQ ID NO: 951661 - protein, 32 aa, Mycobacterium; identical to SEQ ID NO: 118180

SEQ ID NO: 951662 - protein, 18 aa, Mycobacterium
VDRYLSQLPTTSRLAVRA

SEQ ID NO: 951663 - protein, 24 aa, Mycobacterium
VDSAFRPLLVQYDIPGMAVAVTVN

SEQ ID NO: 951664 - protein, 21 aa, Mycobacterium
VDSLRAQAFPRTVGVHGVNYP

SEQ ID NO: 951665 - protein, 23 aa, Mycobacterium
VDTRARWERLYRLVNHVFEHHND

SEQ ID NO: 951666 - protein, 19 aa, Mycobacterium
VDTSSFYRPTQDGAYPIVL

SEQ ID NO: 951667 - protein, 24 aa, Mycobacterium
VDVIPDVLRHRLVLTYDALADEIS

SEQ ID NO: 951668 - protein, 18 aa, Mycobacterium
VDVKAVLGLLAGPPPQLP

SEQ ID NO: 951669 - protein, 18 aa, Mycobacterium
VDVSPFFEVLRGQQIAAP

SEQ ID NO: 951670 - protein, 20 aa, Mycobacterium
VDVSPFFRVLQGPRIAAPGG

SEQ ID NO: 951671 - protein, 19 aa, Mycobacterium
VDYAQLFTATSLMPSHVLA

SEQ ID NO: 951672 - protein, 19 aa, Mycobacterium
VDYYSFFLSGGFQAPPGRA

SEQ ID NO: 951673 - protein, 25 aa, Mycobacterium
VEAAKILEFAPGELKNLPGYEGSNN

SEQ ID NO: 951674 - protein, 21 aa, Mycobacterium
VEAARLPLLGALGAEVAEVFA

SEQ ID NO: 951675 - protein, 17 aa, Mycobacterium
VEALYRALTPDQRAALA

SEQ ID NO: 951676 - protein, 24 aa, Mycobacterium
VEAQRLWAQAGFRPVDPAVVAEFR

SEQ ID NO: 951677 - protein, 23 aa, Mycobacterium
VEATYVFPLPARAGVTDFAASLA

SEQ ID NO: 951678 - protein, 17 aa, Mycobacterium
VEAVMLLSGYRVMPQWV

SEQ ID NO: 951679 - protein, 24 aa, Mycobacterium
VEAYGGYLVPLRTSTIWGGASSIS

SEQ ID NO: 951680 - protein, 27 aa, Mycobacterium
VEDVANLAMFLLSDAAAWITGQCINVD

SEQ ID NO: 951681 - protein, 19 aa, Mycobacterium
VEEAVAVGDLVRLMEFRKG

SEQ ID NO: 951682 - protein, 19 aa, Mycobacterium
VEEAVSVGDLVRLMEFRKG

SEQ ID NO: 951683 - protein, 25 aa, Mycobacterium
VEERWTQILGRRRLAELRKSLQMLL

SEQ ID NO: 951684 - protein, 18 aa, Mycobacterium
VEESLLDELARHIGSRPD

SEQ ID NO: 951685 - protein, 34 aa, Mycobacterium
VEEVMRVNFFAPMRLTLALLPRMRERGSGMIVNV

SEQ ID NO: 951686 - protein, 35 aa, Mycobacterium
VEEVMRVNFFAPMRMTLALLPRMLARRSGIVVNVS

SEQ ID NO: 951687 - protein, 17 aa, Mycobacterium
VEFEKYAAYLAWKYGDQ

SEQ ID NO: 951688 - protein, 25 aa, Mycobacterium
VEGEEVTIYPTRFGDWLASQAPSNA

SEQ ID NO: 951689 - protein, 29 aa, Mycobacterium
VEHLRYITTACFLVIAYLSGVRTGEALNL

SEQ ID NO: 951690 - protein, 24 aa, Mycobacterium
VEKAVAFAAANKLKIAPRGGGHSY

SEQ ID NO: 951691 - protein, 25 aa, Mycobacterium
VEKLAPWQQVLQNLGFHFSSSGQLT

SEQ ID NO: 951692 - protein, 19 aa, Mycobacterium
VEKRITVLGMNNTITYKDG

SEQ ID NO: 951693 - protein, 18 aa, Mycobacterium
VEKVSLPWSLHFDIGKTT

SEQ ID NO: 951694 - protein, 18 aa, Mycobacterium
VELMGPVEPARRGILGAL

SEQ ID NO: 951695 - protein, 17 aa, Mycobacterium
VELNMFFGGPRRSTRVF

SEQ ID NO: 951696 - protein, 29 aa, Mycobacterium
VELPAAAPTAILFFSYGCGECVGGGKSLA

SEQ ID NO: 951697 - protein, 27 aa, Mycobacterium
VELRRLSYLQKMATVLGRRVWANAGSP

SEQ ID NO: 951698 - protein, 31 aa, Mycobacterium
VELSKPITNGLTYDFTFSFEKAGEVTVAVPI

SEQ ID NO: 951699 - protein, 24 aa, Mycobacterium
VEPGRLLIVTHLGQILIFDAQRGE

SEQ ID NO: 951700 - protein, 17 aa, Mycobacterium
VEPIIWRTYEATLPPDA

SEQ ID NO: 951701 - protein, 18 aa, Mycobacterium
VEPRARWERLYQLVNHVL

SEQ ID NO: 951702 - protein, 23 aa, Mycobacterium
VEPRARWERLYRLVNHVLEHHGD

SEQ ID NO: 951703 - protein, 28 aa, Mycobacterium
VEPRLWNMATVLPILQDTTIVAAGPSVQ

SEQ ID NO: 951704 - protein, 25 aa, Mycobacterium
VEQIARLWNTTWDLKRGVDLKHFPS

SEQ ID NO: 951705 - protein, 24 aa, Mycobacterium
VEQLELLGLRPWLDEHIRYRGLRL

SEQ ID NO: 951706 - protein, 32 aa, Mycobacterium
VEQTLLNAINAPTEALFGRPLIGDGADGQTVN

SEQ ID NO: 951707 - protein, 22 aa, Mycobacterium
VERALAFYERLWRPVVEDKQQS

SEQ ID NO: 951708 - protein, 18 aa, Mycobacterium
VERPAPSNLPKPIPGMDP

SEQ ID NO: 951709 - protein, 25 aa, Mycobacterium
VERSLMETYPLLTPGFRQQFESDAQ

SEQ ID NO: 951710 - protein, 24 aa, Mycobacterium
VERVRDTMYPGLTRKLVTADDAEM

SEQ ID NO: 951711 - protein, 17 aa, Mycobacterium
VERWERGVPFDLHLMIF

SEQ ID NO: 951712 - protein, 23 aa, Mycobacterium
VESAIFVYAPEMIPAIKGQAAQA

SEQ ID NO: 951713 - protein, 36 aa, Mycobacterium
VESPEPPGFLLLGPDALALYRYIAEQRANEIATWEQ

SEQ ID NO: 951714 - protein, 27 aa, Mycobacterium
VETGKLCSLFIGPGLRQTSWNNSPLPL

SEQ ID NO: 951715 - protein, 19 aa, Mycobacterium
VETIVWRTYAQTLPPDAVE

SEQ ID NO: 951716 - protein, 25 aa, Mycobacterium
VETQDFVVKIPWADEPSLTVAGNKV

SEQ ID NO: 951717 - protein, 23 aa, Mycobacterium
VEVAQRFVPLLVLGAAVVDPSVD

SEQ ID NO: 951718 - protein, 24 aa, Mycobacterium
VEVKANLYGIPFGDGAFGNEDMSL

SEQ ID NO: 951719 - protein, 29 aa, Mycobacterium
VEVRIRPGSAPIVVAIPGVPVVAPAGVPE

SEQ ID NO: 951720 - protein, 21 aa, Mycobacterium
VEVTQYRFMTVPKGTPQEVRD

SEQ ID NO: 951721 - protein, 22 aa, Mycobacterium
VEYPSIFDPAMRSLITLGRTYP

SEQ ID NO: 951722 - protein, 19 aa, Mycobacterium
VEYVIRRGMSQIGVPYSWG

SEQ ID NO: 951723 - protein, 21 aa, Mycobacterium
VFAALRAIAAFTPTRWLLNRL

SEQ ID NO: 951724 - protein, 29 aa, Mycobacterium
VFADHVSFPFRIGFTRVYGLFAQAGLTDR

SEQ ID NO: 951725 - protein, 19 aa, Mycobacterium
VFALLFGAKKLPDLARSLG

SEQ ID NO: 951726 - protein, 25 aa, Mycobacterium
VFARRLLTTALAAALTIGLGGCGNT

SEQ ID NO: 951727 - protein, 17 aa, Mycobacterium
VFDFPDGIGPVECVNVE

SEQ ID NO: 951728 - protein, 20 aa, Mycobacterium
VFEHRCPLCAEPVRWRLVGE

SEQ ID NO: 951729 - protein, 22 aa, Mycobacterium
VFGTHWHGLLDNDDFRRAWLTQ

SEQ ID NO: 951730 - protein, 18 aa, Mycobacterium
VFGTITQAGLAVLDKIAQ

SEQ ID NO: 951731 - protein, 18 aa, Mycobacterium
VFGVIWYRMLATEQLLSS

SEQ ID NO: 951732 - protein, 24 aa, Mycobacterium
VFGVLLAVVTVPFVSLGPGPTFDT

SEQ ID NO: 951733 - protein, 17 aa, Mycobacterium
VFHTIQAVLPDMVEAGW

SEQ ID NO: 951734 - protein, 18 aa, Mycobacterium
VFITITPVDDAPVAVNDA

SEQ ID NO: 951735 - protein, 17 aa, Mycobacterium
VFKQLRQKGPWSDDLIL

SEQ ID NO: 951736 - protein, 31 aa, Mycobacterium
VFLDWQQFQATYKRYTLYFVDPTGTTVVPDP

SEQ ID NO: 951737 - protein, 17 aa, Mycobacterium
VFLLVGFQALSGSDDDQ

SEQ ID NO: 951738 - protein, 26 aa, Mycobacterium
VFPAEGWVDIALLLTTLTAAIAEAGG

SEQ ID NO: 951739 - protein, 24 aa, Mycobacterium
VFQRTPCWVLPRLDAATPPAVQNL

SEQ ID NO: 951740 - protein, 18 aa, Mycobacterium
VFRFMTSPIEIRGDGRVE

SEQ ID NO: 951741 - protein, 19 aa, Mycobacterium
VFRWTMVAAAVGSLIAAAI

SEQ ID NO: 951742 - protein, 25 aa, Mycobacterium
VFSHANAIMVWTLMNTRNGKESLMN

SEQ ID NO: 951743 - protein, 27 aa, Mycobacterium
VFSQGTAIMVWTLMNVKNPKLNLLNNH

SEQ ID NO: 951744 - protein, 20 aa, Mycobacterium
VFVGRVRKIELINWVPTLTV

SEQ ID NO: 951745 - protein, 19 aa, Mycobacterium
VFWAAEMLIKLVRQVKATA

SEQ ID NO: 951746 - protein, 18 aa, Mycobacterium
VGAAALWDGPGRWKQTPA

SEQ ID NO: 951747 - protein, 21 aa, Mycobacterium
VGAALLALALIGCTEPSPARA

SEQ ID NO: 951748 - protein, 32 aa, Mycobacterium
VGAEALVRWRHPVWGLLLPDSFIGVAESTNLA

SEQ ID NO: 951749 - protein, 27 aa, Mycobacterium
VGAFDIALFGWVGDAFPLSSLTQIYMS

SEQ ID NO: 951750 - protein, 26 aa, Mycobacterium
VGAFDIALFGWVGDAFPLSSLTQIYT

SEQ ID NO: 951751 - protein, 23 aa, Mycobacterium
VGAGMGITTWWYRGSDMDTERDL

SEQ ID NO: 951752 - protein, 21 aa, Mycobacterium
VGALALALGIGTAVATPAWAE

SEQ ID NO: 951753 - protein, 17 aa, Mycobacterium
VGAMAVFGIAFPTPDPS

SEQ ID NO: 951754 - protein, 23 aa, Mycobacterium
VGAVALVLGLFGSMAVATASPDT

SEQ ID NO: 951755 - protein, 25 aa, Mycobacterium
VGAYALDMALLPRTSRAAPAPPIGT

SEQ ID NO: 951756 - protein, 24 aa, Mycobacterium
VGDAKTIGLLLFDGVEELDFAGPW

SEQ ID NO: 951757 - protein, 39 aa, Mycobacterium; identical to SEQ ID NO: 871972

SEQ ID NO: 951758 - protein, 18 aa, Mycobacterium
VGDLVRLMEFRKGQANLV

SEQ ID NO: 951759 - protein, 24 aa, Mycobacterium
VGDPIIKVFGGYGIRLGDYLDTRV

SEQ ID NO: 951760 - protein, 18 aa, Mycobacterium
VGDYLWELGAVEAADLML

SEQ ID NO: 951761 - protein, 23 aa, Mycobacterium
VGEAIYRFYCGEMYRTGFFCADP

SEQ ID NO: 951762 - protein, 24 aa, Mycobacterium
VGEHEVRMLLAKNPAGWQEALSMV

SEQ ID NO: 951763 - protein, 23 aa, Mycobacterium
VGEQYVALLPRADSPPLRDGDVI

SEQ ID NO: 951764 - protein, 23 aa, Mycobacterium
VGEYLGLRPRWIDSTAVGGASWE

SEQ ID NO: 951765 - protein, 30 aa, Mycobacterium; identical to SEQ ID NO: 937172

SEQ ID NO: 951766 - protein, 29 aa, Mycobacterium
VGFAAIVFLVWRYVVPPVRRMMAARQDTV

SEQ ID NO: 951767 - protein, 19 aa, Mycobacterium
VGFPYRSALVPGRNAELDE

SEQ ID NO: 951768 - protein, 18 aa, Mycobacterium
VGGTDLPGLNPASVTCVK

SEQ ID NO: 951769 - protein, 22 aa, Mycobacterium
VGHAFQLLEYPQPVSQPVAEPA

SEQ ID NO: 951770 - protein, 20 aa, Mycobacterium
VGHIGIWNTGKLYDQNNYGP

SEQ ID NO: 951771 - protein, 26 aa, Mycobacterium
VGIKPGRTYTARQLLDALLLVSGNDA

SEQ ID NO: 951772 - protein, 25 aa, Mycobacterium
VGIKPGRTYTARQLLDGLLLVSGND

SEQ ID NO: 951773 - protein, 24 aa, Mycobacterium
VGKAAIYRRWASKAALMTDALVYW

SEQ ID NO: 951774 - protein, 27 aa, Mycobacterium
VGKGKDRWFIVWLGTAASPVDKGVAKA

SEQ ID NO: 951775 - protein, 23 aa, Mycobacterium
VGLAAAAMLLSAAIAGCGEDKNS

SEQ ID NO: 951776 - protein, 17 aa, Mycobacterium
VGLAAAGGWFYWDRVET

SEQ ID NO: 951777 - protein, 22 aa, Mycobacterium
VGLCQFIDASPSPFHAVDTVAQ

SEQ ID NO: 951778 - protein, 23 aa, Mycobacterium
VGLGNIDGVTLGFADGAPGGKAT

SEQ ID NO: 951779 - protein, 17 aa, Mycobacterium
VGLPLTPGNLPVAAGPL

SEQ ID NO: 951780 - protein, 22 aa, Mycobacterium
VGLQIMAPALADDRLYRVGAAY

SEQ ID NO: 951781 - protein, 17 aa, Mycobacterium
VGLQPFTLTVPPRKGTP

SEQ ID NO: 951782 - protein, 31 aa, Mycobacterium; identical to SEQ ID NO: 118246

SEQ ID NO: 951783 - protein, 18 aa, Mycobacterium
VGLYFSAVLAQAGHHVTI

SEQ ID NO: 951784 - protein, 32 aa, Mycobacterium
VGMAQMSWGMTSPYWLYIVTSSELQAPNGPNV

SEQ ID NO: 951785 - protein, 22 aa, Mycobacterium
VGMNTPLLLKGLARVFGQGTYM

SEQ ID NO: 951786 - protein, 25 aa, Mycobacterium
VGNSFYVVILAKPELAPLLHAVWSS

SEQ ID NO: 951787 - protein, 29 aa, Mycobacterium
VGPAALDPRFLTAQKLPPGLTFDPQDCAK

SEQ ID NO: 951788 - protein, 24 aa, Mycobacterium
VGPNPAFNAWQKSGGKAIKIISGA

SEQ ID NO: 951789 - protein, 19 aa, Mycobacterium
VGQFVNGDWWVVGPVKVVS

SEQ ID NO: 951790 - protein, 20 aa, Mycobacterium
VGQMLECIVALMPVGAAVVD

SEQ ID NO: 951791 - protein, 23 aa, Mycobacterium
VGRDAQVPLRWFREIYSDFDCDQ

SEQ ID NO: 951792 - protein, 24 aa, Mycobacterium
VGRDAQVPLRWFREIYSDFDCDQG

SEQ ID NO: 951793 - protein, 29 aa, Mycobacterium
VGRHAFGQSFLTSFFPVGAVVPAMDYRIP

SEQ ID NO: 951794 - protein, 22 aa, Mycobacterium
VGRRTAVLAAVALVLTSCGQWR

SEQ ID NO: 951795 - protein, 23 aa, Mycobacterium
VGSMSKSVFLRRARAYIPELTAS

SEQ ID NO: 951796 - protein, 17 aa, Mycobacterium
VGSPVCTAGKYARKHVP

SEQ ID NO: 951797 - protein, 25 aa, Mycobacterium
VGTDYLTWQRGTVNQLLAALQSGRS

SEQ ID NO: 951798 - protein, 18 aa, Mycobacterium
VGTFLSDMLARRSTTPLA

SEQ ID NO: 951799 - protein, 17 aa, Mycobacterium
VGTLWEATATDTAVEGS

SEQ ID NO: 951800 - protein, 23 aa, Mycobacterium
VGTPVPLFVGQYGRLRTVVAAPD

SEQ ID NO: 951801 - protein, 17 aa, Mycobacterium
VGTRLCWSDEPRADQLR

SEQ ID NO: 951802 - protein, 20 aa, Mycobacterium
VGTWPVRLMKQVLSAGWRAT

SEQ ID NO: 951803 - protein, 25 aa, Mycobacterium
VGVAAGVYFFLYRPDQQVGDAAARR

SEQ ID NO: 951804 - protein, 24 aa, Mycobacterium
VGVAAPIILQFDAAIADADRAEVE

SEQ ID NO: 951805 - protein, 24 aa, Mycobacterium
VGVAGRLCLSAGPAVTAVAAGPTG

SEQ ID NO: 951806 - protein, 22 aa, Mycobacterium
VGVAGRLCLTTGPTVTTTTAGP

SEQ ID NO: 951807 - protein, 18 aa, Mycobacterium
VGVFLLAGCTPAPANDDH

SEQ ID NO: 951808 - protein, 22 aa, Mycobacterium
VGVFVGAKLWHTMFGAGDDYTG

SEQ ID NO: 951809 - protein, 24 aa, Mycobacterium
VGVKMDTIWWDRPFKVTSVEIGAG

SEQ ID NO: 951810 - protein, 26 aa, Mycobacterium
VGVKPGRLYTARQLLDGLLLVSGNDA

SEQ ID NO: 951811 - protein, 17 aa, Mycobacterium
VGVQLQIADAALGLQTA

SEQ ID NO: 951812 - protein, 39 aa, Mycobacterium
VGVVPIAVTNWFGDQPFAVWPWAQPKLGAAQPVVLNLDN

SEQ ID NO: 951813 - protein, 37 aa, Mycobacterium
VGVVPIAVTNWFGDQPFAVWPWAQPKLGRAQPVVLNL

SEQ ID NO: 951814 - protein, 21 aa, Mycobacterium
VGYAPLLALLPRRVSDEEVTT

SEQ ID NO: 951815 - protein, 17 aa, Mycobacterium
VGYAWVSAAPRAALRTV

SEQ ID NO: 951816 - protein, 23 aa, Mycobacterium
VHDATNIVLRRSRPLQISLDGHD

SEQ ID NO: 951817 - protein, 25 aa, Mycobacterium
VHDKQLHLILVRSDGQHFAHVHPVL

SEQ ID NO: 951818 - protein, 23 aa, Mycobacterium
VHQSDTIVLRRSRPLEVSLDGEG

SEQ ID NO: 951819 - protein, 36 aa, Mycobacterium
VHRVRVSGFAGWLAWGFIHIAFLTGMRNRVSTVITW

SEQ ID NO: 951820 - protein, 25 aa, Mycobacterium
VHVSSFTALFRPDLDRLHADLPVVG

SEQ ID NO: 951821 - protein, 38 aa, Mycobacterium
VHWDRVLFCAKEATYKAWYPLTHRWLGFEDAHITFDVD

SEQ ID NO: 951822 - protein, 24 aa, Mycobacterium
VIAANRVLLMTLVATNFFGQNTPA

SEQ ID NO: 951823 - protein, 24 aa, Mycobacterium
VIAARLPCHDWPDRALRVTAIDVS

SEQ ID NO: 951824 - protein, 25 aa, Mycobacterium
VIAAVPFPAIGFNAPLPANVPEHVA

SEQ ID NO: 951825 - protein, 19 aa, Mycobacterium
VIADGNLYAALTPGDPLSN

SEQ ID NO: 951826 - protein, 21 aa, Mycobacterium
VIALAPIAPPAPAFGGATVAK

SEQ ID NO: 951827 - protein, 17 aa, Mycobacterium
VIASPPQGQFGGRPHPT

SEQ ID NO: 951828 - protein, 26 aa, Mycobacterium
VIATEPVVHYLLAASGLVNRTPAAFA

SEQ ID NO: 951829 - protein, 25 aa, Mycobacterium
VIATVVGAGWWYLGAGEDTITVTAQ

SEQ ID NO: 951830 - protein, 28 aa, Mycobacterium
VIAVLAAPVLLIVLLIPGQTAQDFYQAC

SEQ ID NO: 951831 - protein, 37 aa, Mycobacterium
VIAWNSLTRALYPTKAFKTGWATLLGLDLLEAGARIN

SEQ ID NO: 951832 - protein, 21 aa, Mycobacterium
VIDLKSRFRDTLAADFNGTDL

SEQ ID NO: 951833 - protein, 34 aa, Mycobacterium
VIDLNSMQMWLGPGRSFLIYPVSRGRLLNVVAFT

SEQ ID NO: 951834 - protein, 26 aa, Mycobacterium
VIDPTHPEFILNNPLDYMTPELRALS

SEQ ID NO: 951835 - protein, 19 aa, Mycobacterium
VIDTVPVPNGLNPAPINQG

SEQ ID NO: 951836 - protein, 25 aa, Mycobacterium
VIDVTLMTLALLRNPGRPNGGLYAR

SEQ ID NO: 951837 - protein, 19 aa, Mycobacterium
VIDYRRKNAPPGEATITLG

SEQ ID NO: 951838 - protein, 22 aa, Mycobacterium
VIERSIIGFGARIGPRALIRDG

SEQ ID NO: 951839 - protein, 17 aa, Mycobacterium
VIGAGAIIALGLAGCSG

SEQ ID NO: 951840 - protein, 17 aa, Mycobacterium
VIGLFADGNMPVRWSGP

SEQ ID NO: 951841 - protein, 26 aa, Mycobacterium
VIGPDRRFVMVIGALQPTDATTARET

SEQ ID NO: 951842 - protein, 28 aa, Mycobacterium
VIGYRTRLRPWIYRWGATYEESVAGLPG

SEQ ID NO: 951843 - protein, 19 aa, Mycobacterium
VIHRLAGMTFVRNAPSPAA

SEQ ID NO: 951844 - protein, 19 aa, Mycobacterium
VIILAGWAVIAGCASGRPA

SEQ ID NO: 951845 - protein, 30 aa, Mycobacterium
VIKVMTILGSRYLELVPDGPGSIPGKTITL

SEQ ID NO: 951846 - protein, 18 aa, Mycobacterium
VILGFIGEMFRRQPVEGV

SEQ ID NO: 951847 - protein, 17 aa, Mycobacterium
VILLYLEDELKDARAYA

SEQ ID NO: 951848 - protein, 18 aa, Mycobacterium
VILTVCAVGLAAPAQAQG

SEQ ID NO: 951849 - protein, 23 aa, Mycobacterium
VINLGPNFTYALLNGAPGMPGFS

SEQ ID NO: 951850 - protein, 18 aa, Mycobacterium
VIPELVPALAAQEPQPAG

SEQ ID NO: 951851 - protein, 18 aa, Mycobacterium
VIPLASLDIAKGGLLGGV

SEQ ID NO: 951852 - protein, 18 aa, Mycobacterium
VIPVRVHVWVDGDGPAHI

SEQ ID NO: 951853 - protein, 26 aa, Mycobacterium
VIQTEFNVALPWSKEVSLPKSSLHPA

SEQ ID NO: 951854 - protein, 28 aa, Mycobacterium
VIRAALAVWGFDDWPGGLPADVDVGPVP

SEQ ID NO: 951855 - protein, 36 aa, Mycobacterium
VISDLFGEPLLAFRIPWYVTVLDLGPAGAVYTEGWD

SEQ ID NO: 951856 - protein, 17 aa, Mycobacterium
VISYDRLIKGTPNVDYY

SEQ ID NO: 951857 - protein, 18 aa, Mycobacterium
VISYPLYGVQQAGAPCPG

SEQ ID NO: 951858 - protein, 17 aa, Mycobacterium
VITDLDKRTRQQIDTGV

SEQ ID NO: 951859 - protein, 20 aa, Mycobacterium
VITEPLNYSFSDPAALDFVA

SEQ ID NO: 951860 - protein, 22 aa, Mycobacterium
VIVLVAAVVWWTSDARATRSTP

SEQ ID NO: 951861 - protein, 18 aa, Mycobacterium
VIVVGLQPQQLWAMATSV

SEQ ID NO: 951862 - protein, 22 aa, Mycobacterium
VIYERWQALGGMNSVLGAPTSP

SEQ ID NO: 951863 - protein, 24 aa, Mycobacterium
VKDAPLPWSFTITTTEPAVIGNVV

SEQ ID NO: 951864 - protein, 27 aa, Mycobacterium
VKDCARLDLPGWIREAQFEAGNDDALV

SEQ ID NO: 951865 - protein, 18 aa, Mycobacterium
VKEFDLPVRIGGHLLEEF

SEQ ID NO: 951866 - protein, 25 aa, Mycobacterium
VKGDDGYVYMYGTPNGRQGAAYLAR

SEQ ID NO: 951867 - protein, 18 aa, Mycobacterium
VKIPGGALCGKLAVPVDY

SEQ ID NO: 951868 - protein, 28 aa, Mycobacterium
VKKSRTMPAMVAVAVVAFLVVGCVRWST

SEQ ID NO: 951869 - protein, 20 aa, Mycobacterium
VKMFSLVPNPAWVARPGQYA

SEQ ID NO: 951870 - protein, 24 aa, Mycobacterium
VKNNKWLEEALPDHNIKWVKFDSG

SEQ ID NO: 951871 - protein, 18 aa, Mycobacterium
VKQGWFCCWNGGNHLHVS

SEQ ID NO: 951872 - protein, 17 aa, Mycobacterium
VKSLDVAALKNIALYLN

SEQ ID NO: 951873 - protein, 21 aa, Mycobacterium
VKSLYDGRAFLYQVVKLYANG

SEQ ID NO: 951874 - protein, 17 aa, Mycobacterium
VKSLYRVAIPDGEGVTS

SEQ ID NO: 951875 - protein, 22 aa, Mycobacterium
VKTQLMRLATDLGPKSGVSGTS

SEQ ID NO: 951876 - protein, 37 aa, Mycobacterium
VKTTPPVEGAFYWLNNREVRWRPAEYWKPGTTVDVQV

SEQ ID NO: 951877 - protein, 22 aa, Mycobacterium
VKVWSFTREGSVTQQLTYLLPD

SEQ ID NO: 951878 - protein, 19 aa, Mycobacterium
VLAAALAAFALTSCQAKEE

SEQ ID NO: 951879 - protein, 25 aa, Mycobacterium
VLAAAVIERPWPPRGDPVEKEYLDY

SEQ ID NO: 951880 - protein, 19 aa, Mycobacterium
VLAADVRATGWRLALAALD

SEQ ID NO: 951881 - protein, 18 aa, Mycobacterium
VLAAVVLTTAGCARVVEG

SEQ ID NO: 951882 - protein, 19 aa, Mycobacterium
VLADPARPLPPPEERIAAL

SEQ ID NO: 951883 - protein, 28 aa, Mycobacterium
VLAESPHFQPYFPGYPPVSAEDVATAYL

SEQ ID NO: 951884 - protein, 26 aa, Mycobacterium
VLAFVGSNLMKFGPLLGELLARAVLD

SEQ ID NO: 951885 - protein, 18 aa, Mycobacterium
VLAGCAALLGACSTPQYA

SEQ ID NO: 951886 - protein, 27 aa, Mycobacterium
VLAGPIWFLLLFLIPAGVSYAVARYRT

SEQ ID NO: 951887 - protein, 17 aa, Mycobacterium
VLAHLFGSVAVLEPADQ

SEQ ID NO: 951888 - protein, 19 aa, Mycobacterium
VLALSYRLWKLRQGGTAGI

SEQ ID NO: 951889 - protein, 34 aa, Mycobacterium
VLARVVQAPEFPLPSAWRLLTSRGPYELAGELAL

SEQ ID NO: 951890 - protein, 17 aa, Mycobacterium
VLASGTLAAVALSLSGC

SEQ ID NO: 951891 - protein, 25 aa, Mycobacterium
VLAVPMPALPSMLTHIRELAPSCPL

SEQ ID NO: 951892 - protein, 25 aa, Mycobacterium
VLAVPMPAMAGMLTHIAELAPDCPL

SEQ ID NO: 951893 - protein, 24 aa, Mycobacterium
VLCVVVVLAGGYWLSNSRTFQVAG

SEQ ID NO: 951894 - protein, 18 aa, Mycobacterium
VLDAIKKARDAGVVVIAL

SEQ ID NO: 951895 - protein, 18 aa, Mycobacterium
VLDIARMVLFGQVGRELV

SEQ ID NO: 951896 - protein, 29 aa, Mycobacterium
VLDQATGIWSMPWMWKAAGTYRVFADFQP

SEQ ID NO: 951897 - protein, 24 aa, Mycobacterium
VLDRANRFLPFETPFTSAGMQYYT

SEQ ID NO: 951898 - protein, 19 aa, Mycobacterium
VLDRLFPGLLAELSASGAI

SEQ ID NO: 951899 - protein, 26 aa, Mycobacterium
VLDRVLTEFPPLLKHFADKQNLLINA

SEQ ID NO: 951900 - protein, 21 aa, Mycobacterium
VLDTTLPWSYTITTTQPAVFA

SEQ ID NO: 951901 - protein, 21 aa, Mycobacterium
VLELLIVHPGGPFWARKDDGA

SEQ ID NO: 951902 - protein, 31 aa, Mycobacterium
VLEQITGGDLLFPGFQWCSQEQFLYGSHRTR

SEQ ID NO: 951903 - protein, 21 aa, Mycobacterium
VLERLGMHAAVFLITGFVGTH

SEQ ID NO: 951904 - protein, 39 aa, Mycobacterium
VLETALQLGPLPPVNNAVRFAFWGAGLTGAMDYVFGLNG

SEQ ID NO: 951905 - protein, 36 aa, Mycobacterium
VLETALQLGPLPPVTNAVRFAFWGDGINGAMDYVFG

SEQ ID NO: 951906 - protein, 20 aa, Mycobacterium
VLFATPVLALSACSPPGETA

SEQ ID NO: 951907 - protein, 18 aa, Mycobacterium
VLFHARAKLERKGCDLLV

SEQ ID NO: 951908 - protein, 19 aa, Mycobacterium
VLGFVKFGDREWLPAELNA

SEQ ID NO: 951909 - protein, 18 aa, Mycobacterium
VLGIPYDEYIRQEGAQWF

SEQ ID NO: 951910 - protein, 20 aa, Mycobacterium
VLGIRRTGIYGHARACGWAI

SEQ ID NO: 951911 - protein, 24 aa, Mycobacterium
VLGVAATCFAPPASAMYLGNYNLH

SEQ ID NO: 951912 - protein, 34 aa, Mycobacterium
VLHRPKLGFPVPIRHWLRAGELLEWAYAMVTTSQ

SEQ ID NO: 951913 - protein, 19 aa, Mycobacterium
VLHSPVCRPDLDRALDAVA

SEQ ID NO: 951914 - protein, 18 aa, Mycobacterium
VLIALVIVVGLQPQQLWA

SEQ ID NO: 951915 - protein, 22 aa, Mycobacterium
VLIVLIILGVTIVLKSVALVPQ

SEQ ID NO: 951916 - protein, 22 aa, Mycobacterium
VLKFAAPVLLGLGATAAPGNEA

SEQ ID NO: 951917 - protein, 19 aa, Mycobacterium
VLLAAFMIAGCGGAAEQNP

SEQ ID NO: 951918 - protein, 22 aa, Mycobacterium
VLLAVLVIFAIVVVAKSVALIP

SEQ ID NO: 951919 - protein, 18 aa, Mycobacterium
VLLAVLVVFAAVIVAKSV

SEQ ID NO: 951920 - protein, 17 aa, Mycobacterium
VLLGCPGTDAANSAADF

SEQ ID NO: 951921 - protein, 17 aa, Mycobacterium
VLLSAVAVLIGFVSGYN

SEQ ID NO: 951922 - protein, 23 aa, Mycobacterium
VLLVSLALTPFFAPGAARADESR

SEQ ID NO: 951923 - protein, 22 aa, Mycobacterium
VLLVVLVIFAIVVVAKSVALIP

SEQ ID NO: 951924 - protein, 21 aa, Mycobacterium
VLLVVLVVFAIIVVAKSVALI

SEQ ID NO: 951925 - protein, 17 aa, Mycobacterium
VLMAWDLTYAELAARGV

SEQ ID NO: 951926 - protein, 30 aa, Mycobacterium
VLMFAGAGSEPMLLAARGWSELSAELQSAA

SEQ ID NO: 951927 - protein, 17 aa, Mycobacterium
VLMRLSEARRRGLAVLG

SEQ ID NO: 951928 - protein, 27 aa, Mycobacterium
VLNTVGPYFRFGLTVLRMAIETRTHYL

SEQ ID NO: 951929 - protein, 31 aa, Mycobacterium
VLNVINTPTQSLLGRPLIGNGSNATAPGGSG

SEQ ID NO: 951930 - protein, 23 aa, Mycobacterium
VLPGLTIPGKIDKLGYKGIDTTE

SEQ ID NO: 951931 - protein, 31 aa, Mycobacterium
VLPGPAEKLTFIDRLFTAGSMILFGIDFATC

SEQ ID NO: 951932 - protein, 17 aa, Mycobacterium
VLPRCDAVTVDPAAGSF

SEQ ID NO: 951933 - protein, 20 aa, Mycobacterium
VLPVDLPPITGPPPPIGDAH

SEQ ID NO: 951934 - protein, 25 aa, Mycobacterium
VLQAAWVHVLPSRKEGWGLAVIEAA

SEQ ID NO: 951935 - protein, 25 aa, Mycobacterium
VLQLLGLLQSRRVWSGDELAARLRV

SEQ ID NO: 951936 - protein, 19 aa, Mycobacterium
VLQVVQLHPLLNPAGYVNA

SEQ ID NO: 951937 - protein, 17 aa, Mycobacterium
VLRRLYRRVGDKLVLIS

SEQ ID NO: 951938 - protein, 19 aa, Mycobacterium
VLRTQGLAAWPKCGARGGV

SEQ ID NO: 951939 - protein, 17 aa, Mycobacterium
VLRTRDDNPRDLAARLW

SEQ ID NO: 951940 - protein, 24 aa, Mycobacterium
VLSALLAAFVMPVSMAAAMTINPA

SEQ ID NO: 951941 - protein, 17 aa, Mycobacterium
VLSGLGYCYLDTGQHRA

SEQ ID NO: 951942 - protein, 23 aa, Mycobacterium
VLSLAVVLPLSACSPGLAANPRY

SEQ ID NO: 951943 - protein, 18 aa, Mycobacterium
VLSLLLASTLALSACGGH

SEQ ID NO: 951944 - protein, 18 aa, Mycobacterium
VLSRGLLSGHWTPGGGRE

SEQ ID NO: 951945 - protein, 19 aa, Mycobacterium
VLSTAKRLGYPGPDPVARS

SEQ ID NO: 951946 - protein, 17 aa, Mycobacterium
VLSVTAATVRPFVFTFP

SEQ ID NO: 951947 - protein, 17 aa, Mycobacterium
VLTAIPGYSYTDSLNAW

SEQ ID NO: 951948 - protein, 20 aa, Mycobacterium
VLTDTRVLRLTFAAGRVTGV

SEQ ID NO: 951949 - protein, 18 aa, Mycobacterium
VLTKPITNGLTYSFTFNF

SEQ ID NO: 951950 - protein, 25 aa, Mycobacterium
VLTKRPDYAWPPVNSPNQGAAYLDK

SEQ ID NO: 951951 - protein, 20 aa, Mycobacterium
VLTPANWNRVIAPGGSATGG

SEQ ID NO: 951952 - protein, 17 aa, Mycobacterium
VLVALPARVANTVAGSA

SEQ ID NO: 951953 - protein, 29 aa, Mycobacterium
VLVANDKWWGTPAITPKVTVWPRGADIQE

SEQ ID NO: 951954 - protein, 26 aa, Mycobacterium
VLVANDRWWGAKAITKRVIVRPQGAD

SEQ ID NO: 951955 - protein, 21 aa, Mycobacterium
VLVANDRWWGPKAVTKRVTVW

SEQ ID NO: 951956 - protein, 20 aa, Mycobacterium
VLVAREAPLSEIHLENMHYL

SEQ ID NO: 951957 - protein, 22 aa, Mycobacterium
VLVDKMRPLITNCAYKDFGVGM

SEQ ID NO: 951958 - protein, 18 aa, Mycobacterium
VLVGGIALVIGLSQPDLL

SEQ ID NO: 951959 - protein, 17 aa, Mycobacterium
VLVNNAGILRDAAFKNM

SEQ ID NO: 951960 - protein, 21 aa, Mycobacterium
VLVPGYLYHYTLDATQAGSGT

SEQ ID NO: 951961 - protein, 19 aa, Mycobacterium
VLVPRETPLSEIHLDNMLA

SEQ ID NO: 951962 - protein, 37 aa, Mycobacterium
VLVRPEAYLVYLLRRLSPTLLYAFSNLIFGSRTITFA

SEQ ID NO: 951963 - protein, 28 aa, Mycobacterium
VLVVGGVGIWLVTRPKPAPPPKPISEDR

SEQ ID NO: 951964 - protein, 18 aa, Mycobacterium
VLVVLALIATGCGGQSGT

SEQ ID NO: 951965 - protein, 25 aa, Mycobacterium
VLVVVAIVLVITLAGRGGPGGGGSA

SEQ ID NO: 951966 - protein, 25 aa, Mycobacterium
VMAAVDVTLLSRFYERFADHAVEVA

SEQ ID NO: 951967 - protein, 25 aa, Mycobacterium
VMAAVGALPFIPRPSTLPTRVVRTQ

SEQ ID NO: 951968 - protein, 17 aa, Mycobacterium
VMAGCRFLDVMLGAGPN

SEQ ID NO: 951969 - protein, 17 aa, Mycobacterium
VMDFVQQMQKLAGGNVA

SEQ ID NO: 951970 - protein, 32 aa, Mycobacterium
VMGMVRCVRAALPLLRKAEWARIVNFSAHSTQ

SEQ ID NO: 951971 - protein, 18 aa, Mycobacterium
VMHFSANWCGPCAAVRRV

SEQ ID NO: 951972 - protein, 17 aa, Mycobacterium
VMKTGFPVVDRFNALSA

SEQ ID NO: 951973 - protein, 20 aa, Mycobacterium
VMLSGVVLFSALDAGGRDAG

SEQ ID NO: 951974 - protein, 18 aa, Mycobacterium
VMPYLGNAHIPLLDHTRS

SEQ ID NO: 951975 - protein, 17 aa, Mycobacterium
VMVWIHGGSFVAGSSGV

SEQ ID NO: 951976 - protein, 19 aa, Mycobacterium
VMWLGLTAAPPATADPGPT

SEQ ID NO: 951977 - protein, 18 aa, Mycobacterium
VMWTAEFAEAGWALPLSE

SEQ ID NO: 951978 - protein, 19 aa, Mycobacterium
VNAPLPWSTEFTGFGGEVF

SEQ ID NO: 951979 - protein, 27 aa, Mycobacterium
VNDAAAWLLGRDLPFAYAGIRMAELMS

SEQ ID NO: 951980 - protein, 18 aa, Mycobacterium
VNDIQDFWQHNYGQFFPG

SEQ ID NO: 951981 - protein, 35 aa, Mycobacterium
VNDITVYGWDQKVFYKNGAPFVWDRGRELGMTNQI

SEQ ID NO: 951982 - protein, 25 aa, Mycobacterium
VNDMARWLMMLLGNGTHDGRRIAAP

SEQ ID NO: 951983 - protein, 22 aa, Mycobacterium
VNFRGFGGFTGSFWADNIGDAE

SEQ ID NO: 951984 - protein, 24 aa, Mycobacterium
VNGAPWPVLHTDPARYRLRLLNAS

SEQ ID NO: 951985 - protein, 24 aa, Mycobacterium
VNGDGTFVYTPSAAALAGAANPFA

SEQ ID NO: 951986 - protein, 27 aa, Mycobacterium
VNGDPLFIQKVPLPWSVKFEIGKTTAV

SEQ ID NO: 951987 - protein, 27 aa, Mycobacterium
VNGPALSLLGHPLLGTGADSAARAATA

SEQ ID NO: 951988 - protein, 37 aa, Mycobacterium
VNHFTLPVWVHDPVLARPLIQLGLPVAAAGWLSTETA

SEQ ID NO: 951989 - protein, 23 aa, Mycobacterium
VNKKKVHRLWKEEGLQVRIYHPR

SEQ ID NO: 951990 - protein, 23 aa, Mycobacterium
VNLDSMFLTTLLARGYSIVIPDG

SEQ ID NO: 951991 - protein, 30 aa, Mycobacterium
VNLGEVNGLKFMYYELLKKDGESATLTKDG

SEQ ID NO: 951992 - protein, 28 aa, Mycobacterium
VNLNGPFFLSRAALPHLLQAGGNIVNVA

SEQ ID NO: 951993 - protein, 30 aa, Mycobacterium
VNLRGPFICTQALLPDMLDAGWGRIVNISS

SEQ ID NO: 951994 - protein, 19 aa, Mycobacterium
VNLVSLGRKPLGANPIPVE

SEQ ID NO: 951995 - protein, 19 aa, Mycobacterium
VNMAKLALGNWPDAGYKGD

SEQ ID NO: 951996 - protein, 24 aa, Mycobacterium
VNRTGIVKALYRGLGEPAAQLIPE

SEQ ID NO: 951997 - protein, 18 aa, Mycobacterium
VNSPLAITLSFAVSEAAV

SEQ ID NO: 951998 - protein, 27 aa, Mycobacterium
VNSSGTFISGFFNAGTFTPGLLETFNS

SEQ ID NO: 951999 - protein, 24 aa, Mycobacterium
VNTGSFAYLGDYGGTGYPAGKGGV

SEQ ID NO: 952000 - protein, 22 aa, Mycobacterium
VNTLNLRKLGHLGTDQLDFVRK

SEQ ID NO: 952001 - protein, 24 aa, Mycobacterium
VNVDAKLYGLPFGDGAYGAQDFSL

SEQ ID NO: 952002 - protein, 31 aa, Mycobacterium
VNVTLIFSVERHRLVMDAYLEGLEKAKEAGH

SEQ ID NO: 952003 - protein, 30 aa, Mycobacterium
VNVVGAVALTLELLPALRAARGHVVFINSG

SEQ ID NO: 952004 - protein, 18 aa, Mycobacterium
VPAGFTRITAFRSGVVST

SEQ ID NO: 952005 - protein, 18 aa, Mycobacterium
VPAIKRALFDGTALAKLL

SEQ ID NO: 952006 - protein, 18 aa, Mycobacterium
VPAKTAGPALAADATISA

SEQ ID NO: 952007 - protein, 20 aa, Mycobacterium
VPALLMLTTLGLGRLEQTLS

SEQ ID NO: 952008 - protein, 22 aa, Mycobacterium
VPARERILAMFTVPTRGDGPVR

SEQ ID NO: 952009 - protein, 24 aa, Mycobacterium
VPASALPDWPFNGAGYTAYPVFNL

SEQ ID NO: 952010 - protein, 33 aa, Mycobacterium
VPASSLPDWPFNGPGYTVYPVFNLAVAGSGGGD

SEQ ID NO: 952011 - protein, 18 aa, Mycobacterium
VPDKYLVLNATRPDLRWN

SEQ ID NO: 952012 - protein, 19 aa, Mycobacterium
VPDYLGNVWFATGSGVVGV

SEQ ID NO: 952013 - protein, 23 aa, Mycobacterium
VPETAFYLMVKPTAAGDTVTCKV

SEQ ID NO: 952014 - protein, 19 aa, Mycobacterium
VPFLPLDRLPELAGSINDV

SEQ ID NO: 952015 - protein, 20 aa, Mycobacterium
VPFLPLNRDPALAGSINGAG

SEQ ID NO: 952016 - protein, 24 aa, Mycobacterium
VPFPVSPYLMPSANPENLIYSEPN

SEQ ID NO: 952017 - protein, 26 aa, Mycobacterium
VPGAAVFVLDSWLRPVPPGVAGEVYV

SEQ ID NO: 952018 - protein, 20 aa, Mycobacterium
VPGELSWWVPSLSVTGEAVE

SEQ ID NO: 952019 - protein, 18 aa, Mycobacterium
VPGFAAAMRALIWEISEF

SEQ ID NO: 952020 - protein, 23 aa, Mycobacterium
VPGLKRDVDSLLGCRWSTGPGTG

SEQ ID NO: 952021 - protein, 18 aa, Mycobacterium
VPGREFVSFWLDGDNRVL

SEQ ID NO: 952022 - protein, 22 aa, Mycobacterium
VPGTAWVAEEGDHKLMQVRLEP

SEQ ID NO: 952023 - protein, 28 aa, Mycobacterium
VPHQVRILPPFLSRKHLPSRLARLRELD

SEQ ID NO: 952024 - protein, 30 aa, Mycobacterium
VPIDSNWHTWRCTWTEAGLYFWMDYHDGME

SEQ ID NO: 952025 - protein, 27 aa, Mycobacterium
VPIGGLYGDITYPVASPLAITMGFAAS

SEQ ID NO: 952026 - protein, 20 aa, Mycobacterium
VPISAGEQPRRPVPPAGPGS

SEQ ID NO: 952027 - protein, 26 aa, Mycobacterium
VPKVLLLAAIVLLVLTGCARTVEGTA

SEQ ID NO: 952028 - protein, 17 aa, Mycobacterium
VPLIAAASLVLASGTVV

SEQ ID NO: 952029 - protein, 17 aa, Mycobacterium
VPLLVAGCSHDIDGRPG

SEQ ID NO: 952030 - protein, 17 aa, Mycobacterium
VPLYRRNALSERQVLAI

SEQ ID NO: 952031 - protein, 19 aa, Mycobacterium
VPMFHANAWGLPYAAMMAG

SEQ ID NO: 952032 - protein, 29 aa, Mycobacterium
VPMFHANAWGLPYAAMMAGAQLLLPDRFL

SEQ ID NO: 952033 - protein, 20 aa, Mycobacterium
VPNPIFQQRLPFLQDLDQDK

SEQ ID NO: 952034 - protein, 28 aa, Mycobacterium
VPPPAPMPFGLMPPPPAPAAPPPPDPLA

SEQ ID NO: 952035 - protein, 25 aa, Mycobacterium
VPPQGVVAGYYYQAINKDAPHPAAA

SEQ ID NO: 952036 - protein, 23 aa, Mycobacterium
VPPTLPVFTPYPSAWMPDYSLFP

SEQ ID NO: 952037 - protein, 30 aa, Mycobacterium
VPPTPIQLRTVGRLLGWRLGIDGVDPKGTV

SEQ ID NO: 952038 - protein, 25 aa, Mycobacterium
VPSQAVPFDGGAPALTALLGNQIDV

SEQ ID NO: 952039 - protein, 24 aa, Mycobacterium
VPSSVQLPAWLSRAGADVLKTNPI

SEQ ID NO: 952040 - protein, 18 aa, Mycobacterium
VPSSVRDMLAPAGPPPGP

SEQ ID NO: 952041 - protein, 27 aa, Mycobacterium
VPTDPGFVLHELPLLRLRGLVAPAHGD

SEQ ID NO: 952042 - protein, 30 aa, Mycobacterium
VPTSFNLIDRWWQAPASGLAAIIGACNDQP

SEQ ID NO: 952043 - protein, 19 aa, Mycobacterium
VPVLLMLAALGLGRLESEL

SEQ ID NO: 952044 - protein, 25 aa, Mycobacterium
VPYPSIYDPSMRTLIAFGKKFPTGA

SEQ ID NO: 952045 - protein, 17 aa, Mycobacterium
VQAAIDKLGFVRNDAAR

SEQ ID NO: 952046 - protein, 19 aa, Mycobacterium
VQCLLLERWATVYPQPRAV

SEQ ID NO: 952047 - protein, 17 aa, Mycobacterium
VQEVLVVGYTWPTDFGG

SEQ ID NO: 952048 - protein, 18 aa, Mycobacterium
VQGGGFAGPLFDGFDNLY

SEQ ID NO: 952049 - protein, 22 aa, Mycobacterium
VQGHTLERLFPGIGAFGDRIAP

SEQ ID NO: 952050 - protein, 24 aa, Mycobacterium
VQGHTLERLFPGIGALGERFMPGL

SEQ ID NO: 952051 - protein, 32 aa, Mycobacterium
VQILNSGGIFRIYRVYRPRGLTGAAPLVVMLH

SEQ ID NO: 952052 - protein, 22 aa, Mycobacterium
VQLDAQLGLNPGLRGLTQLWQQ

SEQ ID NO: 952053 - protein, 18 aa, Mycobacterium
VQLVPAQQSPFLPAAPGT

SEQ ID NO: 952054 - protein, 25 aa, Mycobacterium
VQNDTIPFPKDGFIGFSLANRSSDV

SEQ ID NO: 952055 - protein, 18 aa, Mycobacterium
VQNFLTYGLPTPDNNYAG

SEQ ID NO: 952056 - protein, 21 aa, Mycobacterium
VQNPIIPLLRESEVGFITGQL

SEQ ID NO: 952057 - protein, 32 aa, Mycobacterium
VQPLVIGLQQVPVLGALLQPIIGYRVITTIGV

SEQ ID NO: 952058 - protein, 18 aa, Mycobacterium
VQQRRYIVVNGADLNPSI

SEQ ID NO: 952059 - protein, 17 aa, Mycobacterium
VQRLFDDGLAVPHRDEW

SEQ ID NO: 952060 - protein, 18 aa, Mycobacterium
VRAAFKPEFINRLDDVLI

SEQ ID NO: 952061 - protein, 31 aa, Mycobacterium
VRAIDLGLHVNLLQLLRPLGSGRATSLVNQG

SEQ ID NO: 952062 - protein, 23 aa, Mycobacterium
VRAIGYRGVPVPGLPFDSRRGVI

SEQ ID NO: 952063 - protein, 17 aa, Mycobacterium
VRALTGVPIDYFAEVNL

SEQ ID NO: 952064 - protein, 27 aa, Mycobacterium
VRCHQSGWSWFIETPDEENGFVAVVST

SEQ ID NO: 952065 - protein, 25 aa, Mycobacterium
VREGAMYFVALAKDLLGVYRAKGYE

SEQ ID NO: 952066 - protein, 25 aa, Mycobacterium
VREIERFFKAFLRPPAEEETGDEQE

SEQ ID NO: 952067 - protein, 21 aa, Mycobacterium
VRERFAVRISNNGEFIHANPA

SEQ ID NO: 952068 - protein, 20 aa, Mycobacterium
VRGDPTLLITAISNLVANAI

SEQ ID NO: 952069 - protein, 30 aa, Mycobacterium
VRGDYLNVFTTFDLTLRRIGETFFTTSYAL

SEQ ID NO: 952070 - protein, 31 aa, Mycobacterium; identical to SEQ ID NO: 118411

SEQ ID NO: 952071 - protein, 27 aa, Mycobacterium
VRGDYLNVYTTFDLTLRRVGESVFTTS

SEQ ID NO: 952072 - protein, 19 aa, Mycobacterium
VRGGAVIPGPAVRAGPAET

SEQ ID NO: 952073 - protein, 18 aa, Mycobacterium
VRGLVAEGHRLFAGIPYA

SEQ ID NO: 952074 - protein, 20 aa, Mycobacterium
VRGQRIVLARVRSLVFEVAG

SEQ ID NO: 952075 - protein, 19 aa, Mycobacterium
VRGVMFYEPVTLAIGLNFL

SEQ ID NO: 952076 - protein, 19 aa, Mycobacterium
VRGVPVWASLIALLDDGVP

SEQ ID NO: 952077 - protein, 19 aa, Mycobacterium
VRGVPVWASLIALLEDGVP

SEQ ID NO: 952078 - protein, 23 aa, Mycobacterium
VRGVPVWASLIALLHDGVPVVGV

SEQ ID NO: 952079 - protein, 18 aa, Mycobacterium
VRHFFYDWDTEVASSLRI

SEQ ID NO: 952080 - protein, 17 aa, Mycobacterium
VRIGRYTPEGDRWEWYG

SEQ ID NO: 952081 - protein, 22 aa, Mycobacterium
VRKAILGLLDVDLLAAVGAGDD

SEQ ID NO: 952082 - protein, 18 aa, Mycobacterium
VRKIELINWVPTLTVDVE

SEQ ID NO: 952083 - protein, 31 aa, Mycobacterium
VRLSRPHDWARDYWIPFDRFRRLDRVRTVQA

SEQ ID NO: 952084 - protein, 17 aa, Mycobacterium
VRLVPNVDIPADFNLDS

SEQ ID NO: 952085 - protein, 22 aa, Mycobacterium
VRMSVAYHPDGDLYFLAGEDVS

SEQ ID NO: 952086 - protein, 23 aa, Mycobacterium
VRNLLGIPIDHFVEVTLGAFFEI

SEQ ID NO: 952087 - protein, 25 aa, Mycobacterium
VRNPQQVRQWLPYVGPGLNTDSVLI

SEQ ID NO: 952088 - protein, 29 aa, Mycobacterium
VRNRGAITSSWYLTSIQAGFEPWNGGIGL

SEQ ID NO: 952089 - protein, 25 aa, Mycobacterium
VRPDSLPWHPRGLALDVMIPNPGSA

SEQ ID NO: 952090 - protein, 21 aa, Mycobacterium
VRPEPFGALLYHFGTRKLSFL

SEQ ID NO: 952091 - protein, 27 aa, Mycobacterium
VRPGAVLGILDLRRLCSTLLDPLGAFG

SEQ ID NO: 952092 - protein, 22 aa, Mycobacterium
VRPWIEHFYLAHGVGTDSAEMP

SEQ ID NO: 952093 - protein, 17 aa, Mycobacterium
VRQIFVYGNSERAYLLA

SEQ ID NO: 952094 - protein, 25 aa, Mycobacterium
VRQTDLTALFLRRVFELGASAGGID

SEQ ID NO: 952095 - protein, 26 aa, Mycobacterium
VRRARALRLSDYCLGLYGSRDYLATH

SEQ ID NO: 952096 - protein, 19 aa, Mycobacterium
VRRCLYGMCAGGVLSAGFT

SEQ ID NO: 952097 - protein, 22 aa, Mycobacterium
VRRRHAAPYTVHPYRPVVLDGR

SEQ ID NO: 952098 - protein, 34 aa, Mycobacterium
VRSAASLNWDPWVAILGFPFIPQARDHRYNEIEI

SEQ ID NO: 952099 - protein, 25 aa, Mycobacterium
VRTIRDRIIPFFKDGGPKYTVTDIQ

SEQ ID NO: 952100 - protein, 18 aa, Mycobacterium
VRVAFWGAEELGLIGSRN

SEQ ID NO: 952101 - protein, 24 aa, Mycobacterium
VRVGDTWHPVLNLASARLIAASDA

SEQ ID NO: 952102 - protein, 18 aa, Mycobacterium
VRVPNPFVPAAQRARGLS

SEQ ID NO: 952103 - protein, 18 aa, Mycobacterium
VRWETKDRPALEAAFKKA

SEQ ID NO: 952104 - protein, 25 aa, Mycobacterium
VRWSWLVAIVAVLGLGLATPPAPAS

SEQ ID NO: 952105 - protein, 42 aa, Mycobacterium
VSAGFMKILGPQFLSRFYGRIINTHPALLPAFPGAHGVADAL

SEQ ID NO: 952106 - protein, 24 aa, Mycobacterium
VSAGPHLTVVAPLGRLAPLPEAPP

SEQ ID NO: 952107 - protein, 36 aa, Mycobacterium
VSALVSFEVFIRPALRNAMGLPDPFRPRRTAMLTES

SEQ ID NO: 952108 - protein, 24 aa, Mycobacterium
VSAMLKATLPRAFVIGPDGSTTVD

SEQ ID NO: 952109 - protein, 18 aa, Mycobacterium
VSAMLVAGLVGCGSTPPP

SEQ ID NO: 952110 - protein, 17 aa, Mycobacterium
VSELATAIAFDEASRRG

SEQ ID NO: 952111 - protein, 18 aa, Mycobacterium
VSELTKIYRESRGAPWRR

SEQ ID NO: 952112 - protein, 25 aa, Mycobacterium
VSEVPLPWSLTLSTTLPSVMPTLFA

SEQ ID NO: 952113 - protein, 29 aa, Mycobacterium
VSFASTPPMLWQYFSGRYPDISVQTAGNQ

SEQ ID NO: 952114 - protein, 18 aa, Mycobacterium
VSGERVIPQWVKIRNVDG

SEQ ID NO: 952115 - protein, 27 aa, Mycobacterium
VSGLDPRLMGLFLVTPDIFDSLPESAR

SEQ ID NO: 952116 - protein, 18 aa, Mycobacterium
VSGRARVLVYNPDIAPNP

SEQ ID NO: 952117 - protein, 23 aa, Mycobacterium
VSGTLVWSALIKQMHDLDVVGGD

SEQ ID NO: 952118 - protein, 25 aa, Mycobacterium
VSGTPAIIEFGPLATTRKACPQDTD

SEQ ID NO: 952119 - protein, 18 aa, Mycobacterium
VSIATLCIAGAYIAHLRL

SEQ ID NO: 952120 - protein, 20 aa, Mycobacterium
VSIAWDPPGFTPGVGGSGLI

SEQ ID NO: 952121 - protein, 24 aa, Mycobacterium
VSISEGIFAIDVNLGGAGGDGGTA

SEQ ID NO: 952122 - protein, 38 aa, Mycobacterium
VSLPAKKWLAERGFDPLYGARPLRRLVQQAIGDQLARM

SEQ ID NO: 952123 - protein, 41 aa, Mycobacterium
VSLPAKQWLAHRGFDPVYGARPLRRLVQQAIGDQLAKLLLA

SEQ ID NO: 952124 - protein, 39 aa, Mycobacterium
VSLQAKQWLAHRGFDPVYGARPLRRLVQQAIGDQLAKML

SEQ ID NO: 952125 - protein, 24 aa, Mycobacterium
VSMPTPKGWEPYRNSNLSPGTRMI

SEQ ID NO: 952126 - protein, 17 aa, Mycobacterium
VSNMNVYPVNYSAGLLS

SEQ ID NO: 952127 - protein, 31 aa, Mycobacterium
VSNRAKLNWWESRALYGWTVLVPRTKDQAGE

SEQ ID NO: 952128 - protein, 27 aa, Mycobacterium
VSPDTSWLALNRMIPPMVKSTAGGALS

SEQ ID NO: 952129 - protein, 25 aa, Mycobacterium
VSPDTSWLSVNRLIPPLIKSTAGNS

SEQ ID NO: 952130 - protein, 34 aa, Mycobacterium
VSPLQDALNLINAPTQALFGRPLIGNGADGAPGT

SEQ ID NO: 952131 - protein, 22 aa, Mycobacterium
VSPSGMYWRVAINTAGHLTDEG

SEQ ID NO: 952132 - protein, 27 aa, Mycobacterium
VSSAAGLVALPWHAAYSASKYGLRGLS

SEQ ID NO: 952133 - protein, 17 aa, Mycobacterium
VSSRFPGPITDLQLSRD

SEQ ID NO: 952134 - protein, 24 aa, Mycobacterium
VSSVLTIGLGKPRPEWPADTVRRA

SEQ ID NO: 952135 - protein, 20 aa, Mycobacterium
VSTAIAMLFSRHAQAYQQLS

SEQ ID NO: 952136 - protein, 21 aa, Mycobacterium
VSVALSLALVGCGHDHKSGGQ

SEQ ID NO: 952137 - protein, 24 aa, Mycobacterium
VSVDAKLYGLPFGDGAYGAQDMTL

SEQ ID NO: 952138 - protein, 24 aa, Mycobacterium
VSVDKILLGSLPDIGYPGDIGLHG

SEQ ID NO: 952139 - protein, 18 aa, Mycobacterium
VSVFADPFSVAGMPATDG

SEQ ID NO: 952140 - protein, 19 aa, Mycobacterium
VSVLLLVSTPGLAPASPGT

SEQ ID NO: 952141 - protein, 22 aa, Mycobacterium
VSVSGYPNLFFTFGPNSGPGHN

SEQ ID NO: 952142 - protein, 21 aa, Mycobacterium
VSYPAQLWPLTIFQGNLTLNE

SEQ ID NO: 952143 - protein, 24 aa, Mycobacterium
VTADLYPRYACDYGTPRVPPSSAD

SEQ ID NO: 952144 - protein, 19 aa, Mycobacterium
VTAISKLPLLGRKLADVLD

SEQ ID NO: 952145 - protein, 32 aa, Mycobacterium
VTAIVGFIHVLPLVGDIIHPVIGFPIDHRAPA

SEQ ID NO: 952146 - protein, 32 aa, Mycobacterium
VTANRGLMQVLAATNWLGFNTPAIMDIEAAYE

SEQ ID NO: 952147 - protein, 20 aa, Mycobacterium
VTATPMMRWLQTVDGQVDQF

SEQ ID NO: 952148 - protein, 20 aa, Mycobacterium
VTAVVGLGLTLTACGSDSGS

SEQ ID NO: 952149 - protein, 24 aa, Mycobacterium
VTCEDMVLSWFAQSGRMPDFDTAS

SEQ ID NO: 952150 - protein, 22 aa, Mycobacterium
VTEALMYLRADNPAYSGLDRQV

SEQ ID NO: 952151 - protein, 25 aa, Mycobacterium
VTEDGWLILIADVKDIGIARRLVDA

SEQ ID NO: 952152 - protein, 21 aa, Mycobacterium
VTELATAFIEQGWQLACHVHG

SEQ ID NO: 952153 - protein, 28 aa, Mycobacterium
VTFAQPYPAWRELFDNLLPAHIVKDVPG

SEQ ID NO: 952154 - protein, 28 aa, Mycobacterium
VTFAQPYPAWRELFNDILPAHIVKDVPG

SEQ ID NO: 952155 - protein, 29 aa, Mycobacterium
VTFAQPYPAWRELFNNLLPAHIVKDVPGG

SEQ ID NO: 952156 - protein, 30 aa, Mycobacterium
VTFPSIYDPPMRTMIALGARYPTTVIPSTI

SEQ ID NO: 952157 - protein, 28 aa, Mycobacterium
VTFSQPYPAWRELFNDILPAHIVKDIPG

SEQ ID NO: 952158 - protein, 25 aa, Mycobacterium
VTGALRPVLRLLSAARPAFYPGRVE

SEQ ID NO: 952159 - protein, 22 aa, Mycobacterium
VTGGPAQRSVPANAARAMTAGD

SEQ ID NO: 952160 - protein, 22 aa, Mycobacterium
VTGPAWRREFLTAMGLTVLDTD

SEQ ID NO: 952161 - protein, 23 aa, Mycobacterium
VTGPVARLALLGSGAQGADVIDQ

SEQ ID NO: 952162 - protein, 23 aa, Mycobacterium
VTGQAILAALTPLGARATLTDDS

SEQ ID NO: 952163 - protein, 20 aa, Mycobacterium
VTGRIFIAAGGFVGEFARPT

SEQ ID NO: 952164 - protein, 17 aa, Mycobacterium
VTGTTVIYTPTADFTGT

SEQ ID NO: 952165 - protein, 20 aa, Mycobacterium
VTGVRALGYLEPDPLPAGGV

SEQ ID NO: 952166 - protein, 25 aa, Mycobacterium
VTGVSQPWGIAFANGMILAVSADTQ

SEQ ID NO: 952167 - protein, 26 aa, Mycobacterium
VTHDTEPFSVPWLVGIDQGFFEKRGV

SEQ ID NO: 952168 - protein, 19 aa, Mycobacterium
VTHLSVDKFFANEPEPKIQ

SEQ ID NO: 952169 - protein, 22 aa, Mycobacterium
VTIDGFKVVPLVLSWSADPAKV

SEQ ID NO: 952170 - protein, 17 aa, Mycobacterium
VTINLSAWGAPVTIPNP

SEQ ID NO: 952171 - protein, 27 aa, Mycobacterium
VTIPQVPGMPIPLPQTVNIPGDLASLA

SEQ ID NO: 952172 - protein, 29 aa, Mycobacterium
VTIRAIRVPNPYIMATIFSFNGVTPNADA

SEQ ID NO: 952173 - protein, 28 aa, Mycobacterium
VTLAKPITNGLLYNFTFNFEKAGQATVL

SEQ ID NO: 952174 - protein, 26 aa, Mycobacterium
VTLANSIRPWAPPPPPPADPNAPVPP

SEQ ID NO: 952175 - protein, 21 aa, Mycobacterium
VTLIFSVERHRQVMDAYLAGL

SEQ ID NO: 952176 - protein, 17 aa, Mycobacterium
VTLPGLIGLAGGAPTAG

SEQ ID NO: 952177 - protein, 29 aa, Mycobacterium
VTLTQQGWKTFFRGLANDGVQGPAVANYL

SEQ ID NO: 952178 - protein, 19 aa, Mycobacterium
VTMQPYLIDSLKGPDLANI

SEQ ID NO: 952179 - protein, 18 aa, Mycobacterium
VTMQPYLIDSLKGPDLTT

SEQ ID NO: 952180 - protein, 21 aa, Mycobacterium
VTPPYRVPFPQVMPTQETTPA

SEQ ID NO: 952181 - protein, 26 aa, Mycobacterium
VTPSNDYWYLALNQARAPWNDVRVRQ

SEQ ID NO: 952182 - protein, 20 aa, Mycobacterium
VTPVVVYLCHRSCDRTAHIY

SEQ ID NO: 952183 - protein, 25 aa, Mycobacterium
VTQLGQYFTFFAMDNHLGLDHQTVG

SEQ ID NO: 952184 - protein, 21 aa, Mycobacterium
VTQLPYSGRTFFERTRALVPG

SEQ ID NO: 952185 - protein, 25 aa, Mycobacterium
VTRIERQGWHALLTIRLNGDVDLPA

SEQ ID NO: 952186 - protein, 33 aa, Mycobacterium
VTRTVEPWGVITDRGRWYLVGHDRDRDATRTFR

SEQ ID NO: 952187 - protein, 32 aa, Mycobacterium
VTSLGAFIEDIIFLDIPRFVESAFHGLGATAD

SEQ ID NO: 952188 - protein, 22 aa, Mycobacterium
VTSSFAFLNFYSGGAITIDELS

SEQ ID NO: 952189 - protein, 26 aa, Mycobacterium
VTTDPKVEGSWYWVDDQTAHWRPEHY

SEQ ID NO: 952190 - protein, 36 aa, Mycobacterium
VTTGSPFTFLKLFGVDLGWVPPFPNPVAEDINNTEY

SEQ ID NO: 952191 - protein, 34 aa, Mycobacterium
VTTKPPVEGAFYWLSNREVRWRPAEYWEPGTSVE

SEQ ID NO: 952192 - protein, 23 aa, Mycobacterium
VTTLTYNGQFPGPLLRFTEGQRT

SEQ ID NO: 952193 - protein, 36 aa, Mycobacterium
VTTNPPVEGAFYWLSNREVRWRPAEYWEPGTHVEVS

SEQ ID NO: 952194 - protein, 26 aa, Mycobacterium
VTTNTQLLWYRPDLVRQLPRTWDGMV

SEQ ID NO: 952195 - protein, 17 aa, Mycobacterium
VTTRLRENVLLQAKVCQ

SEQ ID NO: 952196 - protein, 29 aa, Mycobacterium
VTTTPPVEGSWAWLPDEAGGSRMHWRTRE

SEQ ID NO: 952197 - protein, 17 aa, Mycobacterium
VTTYCQTLGKPDTKISE

SEQ ID NO: 952198 - protein, 24 aa, Mycobacterium
VTVAPLRQRALARFAANAPEIASR

SEQ ID NO: 952199 - protein, 26 aa, Mycobacterium
VTVAVPAHWSGAAIGAFRSAAPHVTV

SEQ ID NO: 952200 - protein, 25 aa, Mycobacterium
VTVEAGPNQVLSPGFHGLQIHSVGK

SEQ ID NO: 952201 - protein, 37 aa, Mycobacterium
VTVEEWTPPLEWLQRIPVLGPLLVTAIVGFIHVLPLV

SEQ ID NO: 952202 - protein, 29 aa, Mycobacterium
VTVGGARYRYWHLVLAPGSAAVPLSVPGG

SEQ ID NO: 952203 - protein, 24 aa, Mycobacterium
VTVGPRTPAIYDPEWNRPAGSVTD

SEQ ID NO: 952204 - protein, 20 aa, Mycobacterium
VTVPALMRGYLRLGAQVCGE

SEQ ID NO: 952205 - protein, 22 aa, Mycobacterium
VTVVRIGLPISPAASSPPPAAP

SEQ ID NO: 952206 - protein, 25 aa, Mycobacterium
VTYNLAGVDALVLDGPTAAKIFNGA

SEQ ID NO: 952207 - protein, 20 aa, Mycobacterium
VTYRADGLPMLQPLRDFGGQ

SEQ ID NO: 952208 - protein, 18 aa, Mycobacterium
VVAASLVLVVGCTRIVDG

SEQ ID NO: 952209 - protein, 19 aa, Mycobacterium
VVACIVLAGMLGMCSFQGS

SEQ ID NO: 952210 - protein, 20 aa, Mycobacterium
VVACLVGCGVRHVSAASARD

SEQ ID NO: 952211 - protein, 18 aa, Mycobacterium
VVADPTWASAHPAAQIAV

SEQ ID NO: 952212 - protein, 20 aa, Mycobacterium
VVAEWPRSTWWNWNSTFDAI

SEQ ID NO: 952213 - protein, 23 aa, Mycobacterium
VVAGEVPLAFALAAGSFRDGTRV

SEQ ID NO: 952214 - protein, 17 aa, Mycobacterium
VVAIGSPLGLSGTVTTG

SEQ ID NO: 952215 - protein, 17 aa, Mycobacterium
VVATSMLGGALLSAPQA

SEQ ID NO: 952216 - protein, 20 aa, Mycobacterium
VVAVVVLVGVFVGAKLWHTM

SEQ ID NO: 952217 - protein, 30 aa, Mycobacterium
VVAWDTPVAAKLPWFTLGDPYVSSHVTVAD

SEQ ID NO: 952218 - protein, 28 aa, Mycobacterium
VVCAAGFWGAQLAKQVGLVLPLVPMAHQ

SEQ ID NO: 952219 - protein, 28 aa, Mycobacterium
VVDADALAWDRVYCSAGRRGWDVGVSPQ

SEQ ID NO: 952220 - protein, 18 aa, Mycobacterium
VVDDYWPRDELTYVLYNI

SEQ ID NO: 952221 - protein, 32 aa, Mycobacterium
VVDEDFSHFLGFTLPWVMRGWREVESVPIRPN

SEQ ID NO: 952222 - protein, 27 aa, Mycobacterium
VVDIQSLWLRLAGRFDRTGLWPLASRG

SEQ ID NO: 952223 - protein, 18 aa, Mycobacterium
VVDLLTAPGGLLDRLTAE

SEQ ID NO: 952224 - protein, 19 aa, Mycobacterium
VVDLLTAPGGLLDRVTAEG

SEQ ID NO: 952225 - protein, 27 aa, Mycobacterium
VVDSGAHQIMVLPNGLMAAEELVAVCA

SEQ ID NO: 952226 - protein, 24 aa, Mycobacterium
VVDVFARLLEMRYPIEKMRTVENY

SEQ ID NO: 952227 - protein, 18 aa, Mycobacterium
VVDVLDRLPFREEPDPIV

SEQ ID NO: 952228 - protein, 26 aa, Mycobacterium
VVEEFLGRKLPPIRQRWAGVYSQCLD

SEQ ID NO: 952229 - protein, 25 aa, Mycobacterium
VVEGMPAMMSGMMGGGMMGPGMGHG

SEQ ID NO: 952230 - protein, 21 aa, Mycobacterium
VVELELRRRLPGDLSILTPAP

SEQ ID NO: 952231 - protein, 27 aa, Mycobacterium
VVEQLDRYLRLPLRDALWGGDEHLLES

SEQ ID NO: 952232 - protein, 23 aa, Mycobacterium
VVEVRVDFIPIYGPGDQGNGNIN

SEQ ID NO: 952233 - protein, 31 aa, Mycobacterium
VVEVSCPHFEYALPAYYLILPSEVSSNLARF

SEQ ID NO: 952234 - protein, 17 aa, Mycobacterium
VVFGAPLPQQPAPELEA

SEQ ID NO: 952235 - protein, 18 aa, Mycobacterium
VVFRFRTSPIELHSDSAG

SEQ ID NO: 952236 - protein, 25 aa, Mycobacterium
VVGADRRYVVALSSLDPSGEAAARQ

SEQ ID NO: 952237 - protein, 23 aa, Mycobacterium
VVGAGIFLAPGALAAPSPPVPPG

SEQ ID NO: 952238 - protein, 28 aa, Mycobacterium
VVGAGVIGLSWARLARSHGWRVGITDPR

SEQ ID NO: 952239 - protein, 19 aa, Mycobacterium
VVGARRFFYDVWGDAVNVA

SEQ ID NO: 952240 - protein, 20 aa, Mycobacterium
VVGCILLAGLVGMCSFQPGA

SEQ ID NO: 952241 - protein, 26 aa, Mycobacterium
VVGEPYMKALQILKSQGLKATFGGSR

SEQ ID NO: 952242 - protein, 26 aa, Mycobacterium
VVGIEPQYAFLGDNLPIVLKGLSRFY

SEQ ID NO: 952243 - protein, 25 aa, Mycobacterium
VVGLTQPLLRHMPNLSALAASGAMR

SEQ ID NO: 952244 - protein, 18 aa, Mycobacterium
VVGLWRGGIGTTWEARVK

SEQ ID NO: 952245 - protein, 18 aa, Mycobacterium
VVGPRRLHAPPVPLEALP

SEQ ID NO: 952246 - protein, 17 aa, Mycobacterium
VVHFSAAWCGPCAVVRR

SEQ ID NO: 952247 - protein, 18 aa, Mycobacterium
VVHFTAAWCGPCASVRRV

SEQ ID NO: 952248 - protein, 17 aa, Mycobacterium
VVHLEVLNLGQATRSFL

SEQ ID NO: 952249 - protein, 24 aa, Mycobacterium
VVHSGVYYPPGSLKATLCRRGVGL

SEQ ID NO: 952250 - protein, 23 aa, Mycobacterium
VVIAGFAIYRLHGIFGSHNNASG

SEQ ID NO: 952251 - protein, 25 aa, Mycobacterium
VVIDPANPYLLGPQLLCAATEMPLD

SEQ ID NO: 952252 - protein, 26 aa, Mycobacterium
VVKQNRWLETALPDYNIKWTRFDSGA

SEQ ID NO: 952253 - protein, 18 aa, Mycobacterium
VVKSQYLALTPDQRTALA

SEQ ID NO: 952254 - protein, 21 aa, Mycobacterium
VVLASWILAVSLPASAHAETL

SEQ ID NO: 952255 - protein, 17 aa, Mycobacterium
VVLLSNAIHLRGSTPIS

SEQ ID NO: 952256 - protein, 20 aa, Mycobacterium
VVLVANDKWWGAKPVTDRVT

SEQ ID NO: 952257 - protein, 29 aa, Mycobacterium
VVLVDGLGWHLLPQLAGGAPLLASVLGGA

SEQ ID NO: 952258 - protein, 18 aa, Mycobacterium
VVLVLVATVLFALGSVIF

SEQ ID NO: 952259 - protein, 19 aa, Mycobacterium
VVMPGQAPPIISRAEWGAD

SEQ ID NO: 952260 - protein, 18 aa, Mycobacterium
VVMRPYLVDSLKGPDLAN

SEQ ID NO: 952261 - protein, 25 aa, Mycobacterium
VVNDITVYGFNQKVLYKSGEPAIID

SEQ ID NO: 952262 - protein, 17 aa, Mycobacterium
VVNGTKAFLPHLIASGD

SEQ ID NO: 952263 - protein, 32 aa, Mycobacterium
VVNGVVDTLLFNPDVWAGLQNAIRQPVANTLS

SEQ ID NO: 952264 - protein, 18 aa, Mycobacterium
VVNHYYLYELVDAKGEQA

SEQ ID NO: 952265 - protein, 19 aa, Mycobacterium
VVNLNFPPEAFAQVLVGWQ

SEQ ID NO: 952266 - protein, 19 aa, Mycobacterium
VVPAALPSFGMPSAAAAGC

SEQ ID NO: 952267 - protein, 18 aa, Mycobacterium
VVPFIVSLNTFGAKDFDV

SEQ ID NO: 952268 - protein, 22 aa, Mycobacterium
VVPGPVASPLAWPAATAAQVVP

SEQ ID NO: 952269 - protein, 26 aa, Mycobacterium
VVPNWNDPAYLNAFGQLLAALGRRYD

SEQ ID NO: 952270 - protein, 17 aa, Mycobacterium
VVPTEFMAARLMGLNWL

SEQ ID NO: 952271 - protein, 29 aa, Mycobacterium
VVPVRTEAWLGYFMLRIAPAVNRRMTQPF

SEQ ID NO: 952272 - protein, 31 aa, Mycobacterium
VVPVRTEAWLGYFMLRIAPGVNRRMMQPFSV

SEQ ID NO: 952273 - protein, 22 aa, Mycobacterium
VVQWVPDQYWAPHTHVSVGVQA

SEQ ID NO: 952274 - protein, 19 aa, Mycobacterium
VVQWVPDRYWPTHTRVSVG

SEQ ID NO: 952275 - protein, 19 aa, Mycobacterium
VVQWVPNRYWPAHTHVSVG

SEQ ID NO: 952276 - protein, 24 aa, Mycobacterium
VVRHQRFPVQTLGGPLRGVALNFF

SEQ ID NO: 952277 - protein, 23 aa, Mycobacterium
VVSDAGMPLINDPGFRLVTACVE

SEQ ID NO: 952278 - protein, 18 aa, Mycobacterium
VVSQWPFGATPYILATKL

SEQ ID NO: 952279 - protein, 18 aa, Mycobacterium
VVTASAAAFGFCPSAAAD

SEQ ID NO: 952280 - protein, 27 aa, Mycobacterium
VVTGCLLALVFIGLSAAGGWFYWARVQ

SEQ ID NO: 952281 - protein, 18 aa, Mycobacterium
VVTPGILTLISRATCVDL

SEQ ID NO: 952282 - protein, 18 aa, Mycobacterium
VVTQKGRWYLVGHDRDRD

SEQ ID NO: 952283 - protein, 22 aa, Mycobacterium
VVTRYFVPRFAATPITSATERA

SEQ ID NO: 952284 - protein, 20 aa, Mycobacterium
VVTTLITVPIKPANARPTGK

SEQ ID NO: 952285 - protein, 28 aa, Mycobacterium
VVTWDTPVVAKLPWFELGDAYVTSHVTI

SEQ ID NO: 952286 - protein, 19 aa, Mycobacterium
VVVAACPPVYVPWTPDFAG

SEQ ID NO: 952287 - protein, 17 aa, Mycobacterium
VVVAALCRLLARRGTRV

SEQ ID NO: 952288 - protein, 17 aa, Mycobacterium
VVVALPMGSPGATVSGS

SEQ ID NO: 952289 - protein, 18 aa, Mycobacterium
VVVATALTLVTAACGSGG

SEQ ID NO: 952290 - protein, 17 aa, Mycobacterium
VVVFGDFRFGPENTYHA

SEQ ID NO: 952291 - protein, 17 aa, Mycobacterium
VVVLLLSVGAGLGAWLL

SEQ ID NO: 952292 - protein, 19 aa, Mycobacterium
VVVLVLCLAGVTAVSMQIR

SEQ ID NO: 952293 - protein, 25 aa, Mycobacterium
VVVPKMIYRVGFFRPPKGASVVTGP

SEQ ID NO: 952294 - protein, 25 aa, Mycobacterium
VVVRRAAILALCVVLPAVTAPRAAA

SEQ ID NO: 952295 - protein, 27 aa, Mycobacterium
VVVVPPGHTWARRSRPIAPEELAATPL

SEQ ID NO: 952296 - protein, 28 aa, Mycobacterium
VVVYQQFFSPYTVVAYFRSATAIYAGDE

SEQ ID NO: 952297 - protein, 18 aa, Mycobacterium
VWDRVMTVNLRGYAAALK

SEQ ID NO: 952298 - protein, 17 aa, Mycobacterium
VWLACSNYFRHPSGKVV

SEQ ID NO: 952299 - protein, 20 aa, Mycobacterium
VWLAVLLAALTVIGAGVAIR

SEQ ID NO: 952300 - protein, 21 aa, Mycobacterium
VWQHDGIFFIAGHNLFKHAPA

SEQ ID NO: 952301 - protein, 30 aa, Mycobacterium
VWSRVVSVVAVVALGLGLDAGIGLGMATAS

SEQ ID NO: 952302 - protein, 28 aa, Mycobacterium
VWTSLTTMIIPVGGAPYVLRPKGRQDYD

SEQ ID NO: 952303 - protein, 17 aa, Mycobacterium
VWTTRLPGPAQIAITGA

SEQ ID NO: 952304 - protein, 24 aa, Mycobacterium
VWWSWVVSVLAVVGVGLGLGIAPA

SEQ ID NO: 952305 - protein, 31 aa, Mycobacterium
VYDGDAEQWLSFPSPLLTPPSNFTASYDWLP

SEQ ID NO: 952306 - protein, 19 aa, Mycobacterium
VYFGGYYAEAAPLVQQLRN

SEQ ID NO: 952307 - protein, 18 aa, Mycobacterium
VYFHYWATRGVDVTPFFT

SEQ ID NO: 952308 - protein, 24 aa, Mycobacterium
VYFNALSSGFYTPGNFLGTLADAV

SEQ ID NO: 952309 - protein, 30 aa, Mycobacterium
VYGYDQTVFYHNGSPFLWDRGRELGMTNRL

SEQ ID NO: 952310 - protein, 18 aa, Mycobacterium
VYLDPRWTASKDPTADYA

SEQ ID NO: 952311 - protein, 18 aa, Mycobacterium
VYLDPRWVASKDPHADYA

SEQ ID NO: 952312 - protein, 26 aa, Mycobacterium
VYLGKEYQPMYFPPERARPGDSRRPG

SEQ ID NO: 952313 - protein, 17 aa, Mycobacterium
VYPPWWVCMANGGEMRA

SEQ ID NO: 952314 - protein, 18 aa, Mycobacterium
VYQINYLRCIGCGLCIEA

SEQ ID NO: 952315 - protein, 40 aa, Mycobacterium
WAAGWVPYIGILAPQINFFYYLFEPMVQSGLFNTLDWLDG

SEQ ID NO: 952316 - protein, 17 aa, Mycobacterium
WAAKANLRRQVKDSWMR

SEQ ID NO: 952317 - protein, 37 aa, Mycobacterium
WAALRALLVLTAITGLAYPLFVWCVAQLPGLREHAEG

SEQ ID NO: 952318 - protein, 17 aa, Mycobacterium
WADDDVLNFFTTSTRNL

SEQ ID NO: 952319 - protein, 26 aa, Mycobacterium
WADPPDRPWNLLATANALLGIVYVHG

SEQ ID NO: 952320 - protein, 30 aa, Mycobacterium
WAGNEPGFGVPWIYNYLGAPWKTQRTVNRV

SEQ ID NO: 952321 - protein, 30 aa, Mycobacterium; identical to SEQ ID NO: 237084

SEQ ID NO: 952322 - protein, 31 aa, Mycobacterium
WAGNEPGFGVPWLYNYLGQPWKTQRTVDRVR

SEQ ID NO: 952323 - protein, 30 aa, Mycobacterium
WAGNEPSFGVPWLYNYIGQPWKTQRTVDRV

SEQ ID NO: 952324 - protein, 17 aa, Mycobacterium
WALQDGLCSYFWQHNWG

SEQ ID NO: 952325 - protein, 23 aa, Mycobacterium
WAPAPPPGPVPPGPAPAVAPPAP

SEQ ID NO: 952326 - protein, 24 aa, Mycobacterium
WAQDALAMYGYAASSAAAGTLNPL

SEQ ID NO: 952327 - protein, 17 aa, Mycobacterium
WARAHPGAQLPVTVTVT

SEQ ID NO: 952328 - protein, 18 aa, Mycobacterium
WARRGVLAVGALLMTLVA

SEQ ID NO: 952329 - protein, 17 aa, Mycobacterium
WARYPRVSPDMPSAPPL

SEQ ID NO: 952330 - protein, 19 aa, Mycobacterium
WASWVVIGPGHRAFFGGDT

SEQ ID NO: 952331 - protein, 18 aa, Mycobacterium
WAVANNSLLILTFDEDDN

SEQ ID NO: 952332 - protein, 17 aa, Mycobacterium
WCVRLVQGGGFAGPLFD

SEQ ID NO: 952333 - protein, 19 aa, Mycobacterium
WDDVLPHFRAIETDLDFAT

SEQ ID NO: 952334 - protein, 18 aa, Mycobacterium
WDEWGRRLGVELLCSDGV

SEQ ID NO: 952335 - protein, 24 aa, Mycobacterium
WDINTPAFEWYYQSGISVAMPVGG

SEQ ID NO: 952336 - protein, 26 aa, Mycobacterium
WDINTPAFEWYYQSGLSIIMPVGGQS

SEQ ID NO: 952337 - protein, 25 aa, Mycobacterium
WDINTPAFEWYYQSGLSVIMPVGGQ

SEQ ID NO: 952338 - protein, 19 aa, Mycobacterium
WDINTPVFDWFDQSGLSVV

SEQ ID NO: 952339 - protein, 17 aa, Mycobacterium
WDMGASDWPAARRLRFA

SEQ ID NO: 952340 - protein, 20 aa, Mycobacterium
WDNKLHGHSRAARGVLAVAD

SEQ ID NO: 952341 - protein, 18 aa, Mycobacterium
WDRVLNVTLSSVFRATRA

SEQ ID NO: 952342 - protein, 22 aa, Mycobacterium
WDTPVTTLIQWIAKANLRRQIS

SEQ ID NO: 952343 - protein, 17 aa, Mycobacterium
WDTYRCLAALQAMLFPD

SEQ ID NO: 952344 - protein, 17 aa, Mycobacterium
WDYVRRFTDFTDYRHRV

SEQ ID NO: 952345 - protein, 27 aa, Mycobacterium
WEARIKFNCLTPGAWPAFWLGSDQDGE

SEQ ID NO: 952346 - protein, 27 aa, Mycobacterium
WEARIKLDCLFPGLWPSFWGVNEDPLP

SEQ ID NO: 952347 - protein, 26 aa, Mycobacterium
WEDRVRLLTRTRIALRRPGEVFALEL

SEQ ID NO: 952348 - protein, 29 aa, Mycobacterium
WEEGVTGQWLIFFNNPSRPGGGLFALATP

SEQ ID NO: 952349 - protein, 17 aa, Mycobacterium
WEELSRSTDFADGAQLA

SEQ ID NO: 952350 - protein, 21 aa, Mycobacterium
WEKLAQIALAAAWSVTALGAI

SEQ ID NO: 952351 - protein, 24 aa, Mycobacterium
WEPLRRYLHEHGVRFHLGASVTRI

SEQ ID NO: 952352 - protein, 18 aa, Mycobacterium
WEQMLAVWQTADGIDVYE

SEQ ID NO: 952353 - protein, 18 aa, Mycobacterium
WEQYSYPVTLDQLLAGNS

SEQ ID NO: 952354 - protein, 20 aa, Mycobacterium
WERGVPFDLHLMIFGDSTAT

SEQ ID NO: 952355 - protein, 17 aa, Mycobacterium
WEVPSERIANTMKLAIV

SEQ ID NO: 952356 - protein, 20 aa, Mycobacterium
WFTSLFGQDVLDLLELGLGG

SEQ ID NO: 952357 - protein, 30 aa, Mycobacterium
WFTTKYPVAITVAPLRWDLVRDGAPALGAM

SEQ ID NO: 952358 - protein, 21 aa, Mycobacterium
WGINHVIWRQKIYPGVGGGSW

SEQ ID NO: 952359 - protein, 27 aa, Mycobacterium
WGKVPYIDGVVFRPLPDPSARTAALRS

SEQ ID NO: 952360 - protein, 19 aa, Mycobacterium
WGPWYQTEYETAAPDPAGA

SEQ ID NO: 952361 - protein, 19 aa, Mycobacterium
WGRTIGQMPSPYTAGNPLV

SEQ ID NO: 952362 - protein, 21 aa, Mycobacterium
WGTHWHGVLDNDDFRRAWLTQ

SEQ ID NO: 952363 - protein, 17 aa, Mycobacterium
WGTYGFSSLRMGRDRYA

SEQ ID NO: 952364 - protein, 31 aa, Mycobacterium
WHNWRVTWNVTGMYFWLDYADGMQPYFSVPA

SEQ ID NO: 952365 - protein, 18 aa, Mycobacterium
WHTWRMSWKPEGMYFWKD

SEQ ID NO: 952366 - protein, 21 aa, Mycobacterium
WIPLLILVVVAIAGFTVQRIR

SEQ ID NO: 952367 - protein, 22 aa, Mycobacterium
WIPLLLVVVVALGAYAITRIRE

SEQ ID NO: 952368 - protein, 22 aa, Mycobacterium
WIPLLLVVVVALGAYAVVRIRD

SEQ ID NO: 952369 - protein, 21 aa, Mycobacterium
WIPLLLVVVVGIGGYAIAQIR

SEQ ID NO: 952370 - protein, 25 aa, Mycobacterium
WIPLVLVVVLALSALIVSRLHKIFG

SEQ ID NO: 952371 - protein, 21 aa, Mycobacterium
WIPLVVVIALVAGGIAVDRLR

SEQ ID NO: 952372 - protein, 18 aa, Mycobacterium
WKIDQVYFDPRWIANQDP

SEQ ID NO: 952373 - protein, 25 aa, Mycobacterium
WKRLLDGLRLPWSSPGLVVAGSYVD

SEQ ID NO: 952374 - protein, 18 aa, Mycobacterium
WLAAFRDAALFKVCYGFG

SEQ ID NO: 952375 - protein, 18 aa, Mycobacterium
WLAAWSLLGAAAAHADDT

SEQ ID NO: 952376 - protein, 17 aa, Mycobacterium
WLATSPMSTGQAALLEP

SEQ ID NO: 952377 - protein, 18 aa, Mycobacterium
WLDPRRWYSVPRAAADAL

SEQ ID NO: 952378 - protein, 18 aa, Mycobacterium
WLGAFGAGACIALGAGHG

SEQ ID NO: 952379 - protein, 20 aa, Mycobacterium
WLLIGVLAAWQRDYFQNGTT

SEQ ID NO: 952380 - protein, 17 aa, Mycobacterium
WLLVAVTKNLVPQSTRL

SEQ ID NO: 952381 - protein, 21 aa, Mycobacterium
WLLVVGLFISVVGCSSSPDPA

SEQ ID NO: 952382 - protein, 17 aa, Mycobacterium
WLNRQLSGYANWAVANN

SEQ ID NO: 952383 - protein, 21 aa, Mycobacterium
WLPLLIVVVVVIAGATVSRIR

SEQ ID NO: 952384 - protein, 17 aa, Mycobacterium
WLPMLVVAAVAIGSITV

SEQ ID NO: 952385 - protein, 33 aa, Mycobacterium
WLQPRGNIFHRWLDDTYLLPPPATAGKAQLTIT

SEQ ID NO: 952386 - protein, 18 aa, Mycobacterium
WLQYWNEFAGVVTSLPEV

SEQ ID NO: 952387 - protein, 17 aa, Mycobacterium
WLRAKTGSLTAINSLVG

SEQ ID NO: 952388 - protein, 18 aa, Mycobacterium
WLVLPVRVLDHKLVYISL

SEQ ID NO: 952389 - protein, 18 aa, Mycobacterium
WLVRALHGAPAALGAHPS

SEQ ID NO: 952390 - protein, 18 aa, Mycobacterium
WLVRALHGAPAALGANPA

SEQ ID NO: 952391 - protein, 17 aa, Mycobacterium
WMDAIIEMPPQQLAAYV

SEQ ID NO: 952392 - protein, 19 aa, Mycobacterium
WMDDFADAGFLQPLDERIA

SEQ ID NO: 952393 - protein, 31 aa, Mycobacterium
WMPPNGAFACQYAMQFIAVLRGYALPVDAAS

SEQ ID NO: 952394 - protein, 21 aa, Mycobacterium
WMPPNKEFWCQYSMQFAEVVR

SEQ ID NO: 952395 - protein, 25 aa, Mycobacterium
WMVFDSIHLQRYGFLGIEPGQPVPD

SEQ ID NO: 952396 - protein, 28 aa, Mycobacterium
WNADQLVRSFLYAYEVEFLTGLTGIQTC

SEQ ID NO: 952397 - protein, 36 aa, Mycobacterium
WNDVALAPDATLYALNRLLPPFIKSMSSGAISLDAS

SEQ ID NO: 952398 - protein, 25 aa, Mycobacterium
WNPDMTPFAYLARPLAKILCPTCNA

SEQ ID NO: 952399 - protein, 17 aa, Mycobacterium
WNQPLMPEGHDPAGHMP

SEQ ID NO: 952400 - protein, 17 aa, Mycobacterium
WNRIVIPTGPPPDNQRY

SEQ ID NO: 952401 - protein, 17 aa, Mycobacterium
WNTMSSVTDLIRYYEML

SEQ ID NO: 952402 - protein, 24 aa, Mycobacterium
WNYAHTNYVLLGLALEKATGQDMA

SEQ ID NO: 952403 - protein, 20 aa, Mycobacterium
WPAAGYFSTYKPLDSIQIGV

SEQ ID NO: 952404 - protein, 17 aa, Mycobacterium
WPAGGSEVQWWFDLPWS

SEQ ID NO: 952405 - protein, 20 aa, Mycobacterium
WPARILRVTAIDIATGELVV

SEQ ID NO: 952406 - protein, 26 aa, Mycobacterium
WPGGRQYLPKAIIGPTTRALDGSEAI

SEQ ID NO: 952407 - protein, 22 aa, Mycobacterium
WPHIGVALMRPRARGRITLISA

SEQ ID NO: 952408 - protein, 18 aa, Mycobacterium
WPRDELTYVLYNIPGKQV

SEQ ID NO: 952409 - protein, 17 aa, Mycobacterium
WPRQWAHAYVDFAAGEK

SEQ ID NO: 952410 - protein, 27 aa, Mycobacterium
WPTADVPLPILFIRDQLAAAAAGAGAT

SEQ ID NO: 952411 - protein, 20 aa, Mycobacterium
WPVCGRGLSGSTPRTAPAAN

SEQ ID NO: 952412 - protein, 24 aa, Mycobacterium
WQALALLMVALMLSSCGWRGISNV

SEQ ID NO: 952413 - protein, 29 aa, Mycobacterium
WQDNEGHSMFPWLTLALVGNATGRISFGT

SEQ ID NO: 952414 - protein, 28 aa, Mycobacterium
WQDNQGHSMFPWLTLALVGSATSRISFG

SEQ ID NO: 952415 - protein, 17 aa, Mycobacterium
WQEALSMVDRTGAGVVI

SEQ ID NO: 952416 - protein, 18 aa, Mycobacterium
WQGFARDSSPPWYDEVTA

SEQ ID NO: 952417 - protein, 20 aa, Mycobacterium
WQGHPMVWAQLPAGGHWGVW

SEQ ID NO: 952418 - protein, 17 aa, Mycobacterium
WQIRRRVLALDNVRLID

SEQ ID NO: 952419 - protein, 28 aa, Mycobacterium
WQKITRELWPAPYLVMDTGLSVAPYNHV

SEQ ID NO: 952420 - protein, 19 aa, Mycobacterium
WQMVFRAASSRRNRSAFIV

SEQ ID NO: 952421 - protein, 18 aa, Mycobacterium
WQRCVTFANWVPHGASSY

SEQ ID NO: 952422 - protein, 19 aa, Mycobacterium
WQRNTVERLLAALQSSRPV

SEQ ID NO: 952423 - protein, 31 aa, Mycobacterium
WRFALAAAAALAVFIVLVNVLRQPVAAPTRS

SEQ ID NO: 952424 - protein, 22 aa, Mycobacterium
WRFGVPLVCLLAGLLLAATHGV

SEQ ID NO: 952425 - protein, 23 aa, Mycobacterium
WRFGVPLVCLLAGLLLAATHGVS

SEQ ID NO: 952426 - protein, 21 aa, Mycobacterium
WRFGVPVVCALAGLLLAATHG

SEQ ID NO: 952427 - protein, 22 aa, Mycobacterium
WRFGVPVVCLLAGLLLAATHGV

SEQ ID NO: 952428 - protein, 27 aa, Mycobacterium
WRHAVARPVVLALVVGVVAACHGGPSD

SEQ ID NO: 952429 - protein, 17 aa, Mycobacterium
WRILTDGTIGRTYLIGA

SEQ ID NO: 952430 - protein, 24 aa, Mycobacterium
WRLGVPVICLLAGLLLAATHGVSG

SEQ ID NO: 952431 - protein, 17 aa, Mycobacterium
WRLPGRTPAYPVSLPEM

SEQ ID NO: 952432 - protein, 28 aa, Mycobacterium
WRLTAALAITIVSLWQLMPTARADDRHY

SEQ ID NO: 952433 - protein, 19 aa, Mycobacterium
WRTAMLSLPVFPDKTPEGF

SEQ ID NO: 952434 - protein, 19 aa, Mycobacterium
WRTWWAMVQLVRFEQDPAR

SEQ ID NO: 952435 - protein, 19 aa, Mycobacterium
WRVSGLLRIDEVAIAIGYQ

SEQ ID NO: 952436 - protein, 27 aa, Mycobacterium
WSAQDYTPIDHLPYVGPILPNNENIFV

SEQ ID NO: 952437 - protein, 17 aa, Mycobacterium
WSDTWMLSSKAAHPNCM

SEQ ID NO: 952438 - protein, 25 aa, Mycobacterium
WSEGKDLYFTLSRWSDYSVMLMRTS

SEQ ID NO: 952439 - protein, 21 aa, Mycobacterium
WSGNFLFYNKRLFAEAGLPAP

SEQ ID NO: 952440 - protein, 20 aa, Mycobacterium
WSGNYLFYNKRLFADAGVPA

SEQ ID NO: 952441 - protein, 25 aa, Mycobacterium
WSHRARPLVLVPDAAATLLAVRTNP

SEQ ID NO: 952442 - protein, 17 aa, Mycobacterium
WSMGGYGALLLGSRLGA

SEQ ID NO: 952443 - protein, 17 aa, Mycobacterium
WSMGGYGALLLGSRLGP

SEQ ID NO: 952444 - protein, 18 aa, Mycobacterium
WSQLLDDGLVRPGPLNLG

SEQ ID NO: 952445 - protein, 17 aa, Mycobacterium
WSQYLSWVADHVGMNVV

SEQ ID NO: 952446 - protein, 23 aa, Mycobacterium
WSQYQAQVLFTMQVTPATGGPPK

SEQ ID NO: 952447 - protein, 22 aa, Mycobacterium
WSVPLGYLAQTPPSVTPDGLVI

SEQ ID NO: 952448 - protein, 18 aa, Mycobacterium
WTADAVYLDPRWTASKDP

SEQ ID NO: 952449 - protein, 19 aa, Mycobacterium
WTAHGRWLRAPVDGIFWAG

SEQ ID NO: 952450 - protein, 24 aa, Mycobacterium
WTANPKLIYLGMQDQFYTFTMFDA

SEQ ID NO: 952451 - protein, 25 aa, Mycobacterium
WTGRGPRPLLAYATLPYGMGEQCAP

SEQ ID NO: 952452 - protein, 24 aa, Mycobacterium
WTNELPPLFNKLGTNLFLAPLVDG

SEQ ID NO: 952453 - protein, 17 aa, Mycobacterium
WTRAKAAYFMVVFSGPI

SEQ ID NO: 952454 - protein, 26 aa, Mycobacterium
WTSLTTMIIPAGGAPYVLRPKGREDY

SEQ ID NO: 952455 - protein, 24 aa, Mycobacterium
WTSTSPYLTPPAASALAAACGGLA

SEQ ID NO: 952456 - protein, 18 aa, Mycobacterium
WTTAIGSSVFVILPGVRS

SEQ ID NO: 952457 - protein, 18 aa, Mycobacterium
WVIAAALCVLAAAAIVIT

SEQ ID NO: 952458 - protein, 17 aa, Mycobacterium
WVLGNLGAIPTVKIDYQ

SEQ ID NO: 952459 - protein, 22 aa, Mycobacterium
WVLLQVAGQPMFKRWCRLVGRE

SEQ ID NO: 952460 - protein, 31 aa, Mycobacterium
WVMKPTDWNDRWWTTCMIAFDTSYGVIQQSL

SEQ ID NO: 952461 - protein, 17 aa, Mycobacterium
WVPIVVVIAVAIGGTAV

SEQ ID NO: 952462 - protein, 17 aa, Mycobacterium
WVPLVVVAAVALGGIAI

SEQ ID NO: 952463 - protein, 17 aa, Mycobacterium
WVQSDARRLTYGSALLT

SEQ ID NO: 952464 - protein, 21 aa, Mycobacterium
WVTGCRSWYLDDRGVPVAWPW

SEQ ID NO: 952465 - protein, 17 aa, Mycobacterium
WVVGNLGAIPAVTLDYR

SEQ ID NO: 952466 - protein, 17 aa, Mycobacterium
WVYCGTGRPGELGGGGD

SEQ ID NO: 952467 - protein, 25 aa, Mycobacterium
YAAGLFGGLAIFDPATELLETISST

SEQ ID NO: 952468 - protein, 45 aa, Mycobacterium
YAAGLPTAAILLGLLIDGEPVLGLTWLPFMDLRYTAILGEQVRCN

SEQ ID NO: 952469 - protein, 20 aa, Mycobacterium
YAALEYLKYPDAVTVATVSE

SEQ ID NO: 952470 - protein, 17 aa, Mycobacterium
YADAIVRGIAGFLGSQS

SEQ ID NO: 952471 - protein, 21 aa, Mycobacterium
YADLLVPKLEASVTDGAIGVA

SEQ ID NO: 952472 - protein, 18 aa, Mycobacterium
YADYFSTARLRRLAGTPI

SEQ ID NO: 952473 - protein, 20 aa, Mycobacterium
YAFDFSVWEIWSALLHGGRL

SEQ ID NO: 952474 - protein, 26 aa, Mycobacterium
YAGLYPGMYNALRQTLQAYFGVGIGN

SEQ ID NO: 952475 - protein, 26 aa, Mycobacterium
YAGNTQYYMLLTQDLPLVQPIRDIPY

SEQ ID NO: 952476 - protein, 17 aa, Mycobacterium
YAGSKLCNLLTARSFAA

SEQ ID NO: 952477 - protein, 17 aa, Mycobacterium
YAIYHPEQFIYASTLSG

SEQ ID NO: 952478 - protein, 18 aa, Mycobacterium
YALLAVSGLVIAAVTLAG

SEQ ID NO: 952479 - protein, 17 aa, Mycobacterium
YALLYRSMNGALGSGLF

SEQ ID NO: 952480 - protein, 25 aa, Mycobacterium
YALSKSFVRWYSSSQAERFTGRGLR

SEQ ID NO: 952481 - protein, 25 aa, Mycobacterium
YAPTFPFTQGFIDRYIRGDYVNGYF

SEQ ID NO: 952482 - protein, 19 aa, Mycobacterium
YAPVTGFYSLNYSSTGLER

SEQ ID NO: 952483 - protein, 20 aa, Mycobacterium
YAPVTGFYSLRYSSTGLERA

SEQ ID NO: 952484 - protein, 26 aa, Mycobacterium
YAPVTGFYSLRYSSTGLERAEDPLLN

SEQ ID NO: 952485 - protein, 27 aa, Mycobacterium
YAQLPVAPIGLIPTRYYVRMRVADKPG

SEQ ID NO: 952486 - protein, 25 aa, Mycobacterium
YARATELLVKYPNLKGFQGAASTDV

SEQ ID NO: 952487 - protein, 26 aa, Mycobacterium
YASKRSFLGIDIYNETYGDKVKAVIT

SEQ ID NO: 952488 - protein, 26 aa, Mycobacterium
YATFERGAIYWSPVTGAQPLTGAIYE

SEQ ID NO: 952489 - protein, 19 aa, Mycobacterium
YATLFPYTQNFVDRAIRGD

SEQ ID NO: 952490 - protein, 21 aa, Mycobacterium
YATLTPNKWSDFGKASDIYDV

SEQ ID NO: 952491 - protein, 26 aa, Mycobacterium
YAVSKSFVKWYSQSQAERFNAHGLRI

SEQ ID NO: 952492 - protein, 24 aa, Mycobacterium
YAYGAAFDPWTGRYLLVLEDLPAE

SEQ ID NO: 952493 - protein, 28 aa, Mycobacterium
YAYRSVTVAGYPNLFFTFGPNSGPGHNS

SEQ ID NO: 952494 - protein, 22 aa, Mycobacterium
YDAEWIVVLDDWTDGIGKSPQQ

SEQ ID NO: 952495 - protein, 30 aa, Mycobacterium
YDEGNAEQYLWLVPQNVAGLVAALGGRQAA

SEQ ID NO: 952496 - protein, 29 aa, Mycobacterium
YDEYTNAAQPIWWLVRALEFSQDFQTFAK

SEQ ID NO: 952497 - protein, 26 aa, Mycobacterium
YDGMADFPDRFNLTAISNAMAGSVLR

SEQ ID NO: 952498 - protein, 34 aa, Mycobacterium
YDGQQVLQRLKYLPLAPFRISYAYTNFGVTAAAE

SEQ ID NO: 952499 - protein, 18 aa, Mycobacterium
YDLPVESFEPVGMRLDPA

SEQ ID NO: 952500 - protein, 20 aa, Mycobacterium
YDPIWPRHGIRILPGPSSLW

SEQ ID NO: 952501 - protein, 17 aa, Mycobacterium
YDPLIKMLEKQTGSKVE

SEQ ID NO: 952502 - protein, 18 aa, Mycobacterium
YDPNEQAIVLCYEDADFA

SEQ ID NO: 952503 - protein, 20 aa, Mycobacterium
YDPVWPNHGIRILPGPSSLW

SEQ ID NO: 952504 - protein, 19 aa, Mycobacterium
YDREPARCWARGPVVLAGD

SEQ ID NO: 952505 - protein, 25 aa, Mycobacterium
YDRLAKADFGQRLVFATIADVVQGD

SEQ ID NO: 952506 - protein, 34 aa, Mycobacterium
YDTTQVLERLKYLPLDPFRISYAYTNFGVTAAAD

SEQ ID NO: 952507 - protein, 23 aa, Mycobacterium
YEAAPPIDVLLVPGGKGWRTLVD

SEQ ID NO: 952508 - protein, 22 aa, Mycobacterium
YEALAKAPWRKVTVGATAVGLQ

SEQ ID NO: 952509 - protein, 28 aa, Mycobacterium
YEDRSFTFTLKTPPAAKLLLKAAGVGKG

SEQ ID NO: 952510 - protein, 17 aa, Mycobacterium
YEHGGVGYFWQAVVARV

SEQ ID NO: 952511 - protein, 17 aa, Mycobacterium
YEHYLGCKVAACVVDDY

SEQ ID NO: 952512 - protein, 24 aa, Mycobacterium
YEQVATRWGNWAKLFFNNKGVVAH

SEQ ID NO: 952513 - protein, 23 aa, Mycobacterium
YERADIPFHFALAEAFTVCDNFH

SEQ ID NO: 952514 - protein, 28 aa, Mycobacterium
YESGWTFDHFYPIFSDPTGPCLEGWTTL

SEQ ID NO: 952515 - protein, 23 aa, Mycobacterium
YETAFVMTVPPPVIAANRVLLMT

SEQ ID NO: 952516 - protein, 17 aa, Mycobacterium
YETFAFNGSQFALPEQW

SEQ ID NO: 952517 - protein, 25 aa, Mycobacterium
YEVPLGLERLPGAPSSPPLHAMLSV

SEQ ID NO: 952518 - protein, 36 aa, Mycobacterium
YEYLRIHKKEKLRPMPHLLLIVDEFTQMFAEHDGAK

SEQ ID NO: 952519 - protein, 18 aa, Mycobacterium
YFGFENVGGWSVFGIAFP

SEQ ID NO: 952520 - protein, 26 aa, Mycobacterium
YFTAHPNEYYDLRGILAPIGDTERQC

SEQ ID NO: 952521 - protein, 21 aa, Mycobacterium
YGALLLGSRLGPARTAAICAV

SEQ ID NO: 952522 - protein, 32 aa, Mycobacterium
YGALPIFVVFVYFKAPWRRFVPDLLDGDGVQV

SEQ ID NO: 952523 - protein, 31 aa, Mycobacterium
YGALPIYVVFIYFRAPWRHFVSHLNDGDAVQ

SEQ ID NO: 952524 - protein, 17 aa, Mycobacterium
YGAPRKDNFYRIQDILR

SEQ ID NO: 952525 - protein, 31 aa, Mycobacterium
YGASAVPSRWRLMLQGWPGLTTRGLIQLADK

SEQ ID NO: 952526 - protein, 20 aa, Mycobacterium
YGGELWVLDLAEDAPAGAPH

SEQ ID NO: 952527 - protein, 19 aa, Mycobacterium
YGIAQQMLSFMASAAGGAG

SEQ ID NO: 952528 - protein, 24 aa, Mycobacterium
YGLPVGSRLGYRTTIPYATRISVD

SEQ ID NO: 952529 - protein, 19 aa, Mycobacterium
YGLQSIWSLTPPPRVRDAG

SEQ ID NO: 952530 - protein, 17 aa, Mycobacterium
YGMCAGGVLSAGFTIPM

SEQ ID NO: 952531 - protein, 25 aa, Mycobacterium
YGMRDLHRFISGPAYARRLTTLATD

SEQ ID NO: 952532 - protein, 31 aa, Mycobacterium
YGNPQLLLNFDGLKQLLYGPIAGPPRNPAQI

SEQ ID NO: 952533 - protein, 17 aa, Mycobacterium
YGNVFPPDYLPKSHTSA

SEQ ID NO: 952534 - protein, 17 aa, Mycobacterium
YGPGLRCLIPLVDKMIR

SEQ ID NO: 952535 - protein, 31 aa, Mycobacterium
YGRADLAGLNLAAYPAILVELGNMKNADDAA

SEQ ID NO: 952536 - protein, 21 aa, Mycobacterium
YGRPDLMRHLPQQLLFESQST

SEQ ID NO: 952537 - protein, 31 aa, Mycobacterium
YGSNYFGLTHPSLPNYYPILGGSDFGANYNC

SEQ ID NO: 952538 - protein, 21 aa, Mycobacterium
YHLATMVLDCRIGRWTGGDKT

SEQ ID NO: 952539 - protein, 24 aa, Mycobacterium
YHNSYWYYSCMVAFKTGYGVLQQA

SEQ ID NO: 952540 - protein, 18 aa, Mycobacterium
YHPMHLHGHTFAVARPDW

SEQ ID NO: 952541 - protein, 21 aa, Mycobacterium
YHRLATYPVHLNKPATDPVDA

SEQ ID NO: 952542 - protein, 27 aa, Mycobacterium
YHTRDDLPIHFLLADTFTVCDHYFCSV

SEQ ID NO: 952543 - protein, 23 aa, Mycobacterium
YIHPEDRFMLTDPVKAFGRGLIG

SEQ ID NO: 952544 - protein, 20 aa, Mycobacterium
YIHYMLTEEGFALQLADGKP

SEQ ID NO: 952545 - protein, 17 aa, Mycobacterium
YIMVVQSLQTSDDATAR

SEQ ID NO: 952546 - protein, 17 aa, Mycobacterium
YIPLHTPTTTYSINTVL

SEQ ID NO: 952547 - protein, 19 aa, Mycobacterium
YIRAGNSDVPALYQWWRTN

SEQ ID NO: 952548 - protein, 26 aa, Mycobacterium
YISPRSWTTFFRAGPAFVVSPKDFGQ

SEQ ID NO: 952549 - protein, 18 aa, Mycobacterium
YKAWGALGFERGALGLPT

SEQ ID NO: 952550 - protein, 19 aa, Mycobacterium
YKHFGSKRELLEAAVAHRI

SEQ ID NO: 952551 - protein, 19 aa, Mycobacterium
YKKASSGWFGGSPARWVGS

SEQ ID NO: 952552 - protein, 17 aa, Mycobacterium
YKRRLFGQIVAAAVRAT

SEQ ID NO: 952553 - protein, 20 aa, Mycobacterium
YKSATFLQRNLPRGTTQGQA

SEQ ID NO: 952554 - protein, 24 aa, Mycobacterium
YKSNAQLLWYRKSAAAAAGVDPAS

SEQ ID NO: 952555 - protein, 19 aa, Mycobacterium
YKSQAFTGLPVDPALGIDP

SEQ ID NO: 952556 - protein, 18 aa, Mycobacterium
YLAAINFIETRFGSIVGA

SEQ ID NO: 952557 - protein, 19 aa, Mycobacterium
YLAPGSVLAIEPMLTLGTR

SEQ ID NO: 952558 - protein, 23 aa, Mycobacterium
YLAQLRAVGLSWPPRTEEALIGE

SEQ ID NO: 952559 - protein, 18 aa, Mycobacterium
YLEPYIEPLNYDTFHFSR

SEQ ID NO: 952560 - protein, 18 aa, Mycobacterium
YLESDYWGVGFNSEAIAN

SEQ ID NO: 952561 - protein, 20 aa, Mycobacterium
YLFTHPDVNDFFTGLKGLPK

SEQ ID NO: 952562 - protein, 26 aa, Mycobacterium
YLGAYGHLVVLREGDLAYLHAHPENG

SEQ ID NO: 952563 - protein, 29 aa, Mycobacterium
YLGFQPDDEVVVLLLTGFTPLLTAQDDLG

SEQ ID NO: 952564 - protein, 18 aa, Mycobacterium
YLGIAVLDAPWAPFDIEF

SEQ ID NO: 952565 - protein, 29 aa, Mycobacterium
YLGITVPGFPNLFLIYGPGTHLAHGGSLI

SEQ ID NO: 952566 - protein, 24 aa, Mycobacterium
YLGKQLYIGFNFGESIIASAVFNG

SEQ ID NO: 952567 - protein, 35 aa, Mycobacterium
YLGPALRLVNFGNLPFPINPYLRPAISPDRLIYTD

SEQ ID NO: 952568 - protein, 17 aa, Mycobacterium
YLLPFHLDTAVNSVQKI

SEQ ID NO: 952569 - protein, 25 aa, Mycobacterium
YLNGPLAFRYSGYTAWRGIADISIP

SEQ ID NO: 952570 - protein, 17 aa, Mycobacterium
YLPDVTPTQRRKRVLAE

SEQ ID NO: 952571 - protein, 18 aa, Mycobacterium
YLPVQVKGGLIWTGDSHA

SEQ ID NO: 952572 - protein, 31 aa, Mycobacterium
YLQGYPKSPGNTWIPLVYPAAARQSSITQGA

SEQ ID NO: 952573 - protein, 19 aa, Mycobacterium
YLQYQYTPDPLHPGAPGPV

SEQ ID NO: 952574 - protein, 25 aa, Mycobacterium
YLRHLGPYVAIWDIPTEMIAPGTGY

SEQ ID NO: 952575 - protein, 24 aa, Mycobacterium
YLSDTVFWLQRAKADGIPIVGYNY

SEQ ID NO: 952576 - protein, 24 aa, Mycobacterium
YLSGRYRSLIDSPNWTRLVDQSMV

SEQ ID NO: 952577 - protein, 22 aa, Mycobacterium
YLTLERARFGTALKVTLRVAPE

SEQ ID NO: 952578 - protein, 19 aa, Mycobacterium
YLTLVRPRYAAAAHPALWL

SEQ ID NO: 952579 - protein, 28 aa, Mycobacterium
YLVSYAVNLLCPELIWQLRNSAAGYQPP

SEQ ID NO: 952580 - protein, 21 aa, Mycobacterium
YMGDYLVFNLNLNVPPPCTTG

SEQ ID NO: 952581 - protein, 31 aa, Mycobacterium
YNDAVVGTILPLYSPALWRHLTQALGEVKEG

SEQ ID NO: 952582 - protein, 17 aa, Mycobacterium
YNDGMQDVLIWTSNMEG

SEQ ID NO: 952583 - protein, 17 aa, Mycobacterium
YNEWSFAQAQKLNMAKI

SEQ ID NO: 952584 - protein, 25 aa, Mycobacterium
YNGWDMHLPVFEWFDQSGLSLVMPV

SEQ ID NO: 952585 - protein, 26 aa, Mycobacterium
YNHGSYIFLGPGFYPGSPSGGSGGSP

SEQ ID NO: 952586 - protein, 18 aa, Mycobacterium
YNYAARTELGHGPLLVPV

SEQ ID NO: 952587 - protein, 18 aa, Mycobacterium
YPEPFLYTYCRDDDPAIL

SEQ ID NO: 952588 - protein, 19 aa, Mycobacterium
YPFTVDRWTPDKVYSGAYK

SEQ ID NO: 952589 - protein, 17 aa, Mycobacterium
YPFTVDRWTPDNVFSGG

SEQ ID NO: 952590 - protein, 20 aa, Mycobacterium
YPGAACDIPSLLYSYGFEQN

SEQ ID NO: 952591 - protein, 18 aa, Mycobacterium
YPLKHPDWYPQRLGYQPF

SEQ ID NO: 952592 - protein, 17 aa, Mycobacterium
YPQQFPYAASLSGFLNP

SEQ ID NO: 952593 - protein, 18 aa, Mycobacterium
YPQRFGIPDGLYAEPVAV

SEQ ID NO: 952594 - protein, 24 aa, Mycobacterium
YPTDDFYLYYSGNEKAYPYAQHAA

SEQ ID NO: 952595 - protein, 17 aa, Mycobacterium
YPVPDAPYGLAGSTDPK

SEQ ID NO: 952596 - protein, 17 aa, Mycobacterium
YQAWLDGLQQRADRVTA

SEQ ID NO: 952597 - protein, 26 aa, Mycobacterium
YQEIGPFTCYSGTAASAPLLFQCVSD

SEQ ID NO: 952598 - protein, 29 aa, Mycobacterium
YQIRRGDYTDLVPLPAIIGHDISGVIEEV

SEQ ID NO: 952599 - protein, 20 aa, Mycobacterium
YQQDRLMYAYISTPTDNRVV

SEQ ID NO: 952600 - protein, 30 aa, Mycobacterium
YQTVAMPGFPNFFMMLGPHSPVGNLALTTV

SEQ ID NO: 952601 - protein, 20 aa, Mycobacterium
YQTVRPKILSSHYSGYQVLE

SEQ ID NO: 952602 - protein, 24 aa, Mycobacterium
YQVAPLSVYLKQPSPPPAPPIDFT

SEQ ID NO: 952603 - protein, 19 aa, Mycobacterium
YRAIGRMIVLSKAGEIRSR

SEQ ID NO: 952604 - protein, 23 aa, Mycobacterium
YREDPLPWHPKGLAIDVMIPNFH

SEQ ID NO: 952605 - protein, 31 aa, Mycobacterium
YRIARGMYVDVPPLAPLLLARNYAVLIPDHE

SEQ ID NO: 952606 - protein, 20 aa, Mycobacterium
YRIDGWSLTLFGFQLTPQQQ

SEQ ID NO: 952607 - protein, 29 aa, Mycobacterium
YRKPITYDTLWQPKTDPLPTVFPIVQTAL

SEQ ID NO: 952608 - protein, 22 aa, Mycobacterium
YRKSLWCGIGGLVPFAQSPPQF

SEQ ID NO: 952609 - protein, 29 aa, Mycobacterium
YRLQSAPWPLRMLLRKLYPPEPTLTLDVG

SEQ ID NO: 952610 - protein, 19 aa, Mycobacterium
YRRQLLDSDFRAGCPVVAV

SEQ ID NO: 952611 - protein, 32 aa, Mycobacterium
YRTAGLAALAIMALLLVLVGQSFRGAFDPKVR

SEQ ID NO: 952612 - protein, 18 aa, Mycobacterium
YRTMRPLATIDVAKGWQE

SEQ ID NO: 952613 - protein, 17 aa, Mycobacterium
YRVLARHPQWDPVVRPR

SEQ ID NO: 952614 - protein, 18 aa, Mycobacterium
YRVPCIVISPYSRGPLVV

SEQ ID NO: 952615 - protein, 31 aa, Mycobacterium
YSAAALRRVWRYTHFSWWMTTMLHTTGDPFD

SEQ ID NO: 952616 - protein, 21 aa, Mycobacterium
YSDPVVWAFNCALNVVSATPN

SEQ ID NO: 952617 - protein, 28 aa, Mycobacterium
YSKEYEIERLMRDAPFLLIGEGTSEIQK

SEQ ID NO: 952618 - protein, 17 aa, Mycobacterium
YSLFPYNLWQNRVTPEQ

SEQ ID NO: 952619 - protein, 31 aa, Mycobacterium
YSPAAVRRVVPYPGSFWPVTGLNSPTVNSSV

SEQ ID NO: 952620 - protein, 39 aa, Mycobacterium
YSPLIQAALTRWPRLNGLGYWFWGLVVRRIFGRAPIRPG

SEQ ID NO: 952621 - protein, 24 aa, Mycobacterium
YSPLVFDSVLRPPAQQWAEVAGPG

SEQ ID NO: 952622 - protein, 21 aa, Mycobacterium
YSPPYIITAIGDPAAMQAALE

SEQ ID NO: 952623 - protein, 23 aa, Mycobacterium
YSSNAQVIVYKLIGQFDPREAIS

SEQ ID NO: 952624 - protein, 29 aa, Mycobacterium
YSVATDSRFRFLRVYPNPAVYAPVTGFYS

SEQ ID NO: 952625 - protein, 20 aa, Mycobacterium
YTGPQRYWWTPGVAHVVPNW

SEQ ID NO: 952626 - protein, 26 aa, Mycobacterium
YTGQITIPYTVWDGQVFSNWATITIN

SEQ ID NO: 952627 - protein, 27 aa, Mycobacterium
YTITTYVALVAIYKRFQEMATLTTFTT

SEQ ID NO: 952628 - protein, 19 aa, Mycobacterium
YTPERCRELIRLAVGAPEL

SEQ ID NO: 952629 - protein, 20 aa, Mycobacterium
YTPNAQVVVYKLIGDFDPRA

SEQ ID NO: 952630 - protein, 25 aa, Mycobacterium
YTRADLPIHYMLADTFTICDDYYCS

SEQ ID NO: 952631 - protein, 17 aa, Mycobacterium
YTRAVMQRWLAGEDVVA

SEQ ID NO: 952632 - protein, 17 aa, Mycobacterium
YTRQFIADAAAAAQHCP

SEQ ID NO: 952633 - protein, 24 aa, Mycobacterium
YTTANLLFQVVDRLVYLDPKTGEV

SEQ ID NO: 952634 - protein, 18 aa, Mycobacterium
YTTPYRWAPDMKVGEPAV

SEQ ID NO: 952635 - protein, 23 aa, Mycobacterium
YTYKWETFLTQELPAWLEANRGV

SEQ ID NO: 952636 - protein, 22 aa, Mycobacterium
YTYKWETFLTQELPAYLATNKQ

SEQ ID NO: 952637 - protein, 17 aa, Mycobacterium
YTYSGFPEARKPVRHPH

SEQ ID NO: 952638 - protein, 17 aa, Mycobacterium
YVAIMLPRCAQAIVAIL

SEQ ID NO: 952639 - protein, 26 aa, Mycobacterium
YVAVRQYIDAPLWVADPAIDSVAKVL

SEQ ID NO: 952640 - protein, 17 aa, Mycobacterium
YVDLGINPENLRLFEHP

SEQ ID NO: 952641 - protein, 20 aa, Mycobacterium
YVGTIMGDLSGRRGRVLGTD

SEQ ID NO: 952642 - protein, 17 aa, Mycobacterium
YVKNELHYLLTDAGATA

SEQ ID NO: 952643 - protein, 20 aa, Mycobacterium
YVLTPANWNRSIAPGGSATG

SEQ ID NO: 952644 - protein, 17 aa, Mycobacterium
YVMQNATRFGIQDAIWR

SEQ ID NO: 952645 - protein, 18 aa, Mycobacterium
YVPIFTPDPWDEGSSGAH

SEQ ID NO: 952646 - protein, 18 aa, Mycobacterium
YVPLPDKVKERLVAAINA

SEQ ID NO: 952647 - protein, 25 aa, Mycobacterium
YVQLVRPMLDRWVARGFAVVQTDYQ

SEQ ID NO: 952648 - protein, 42 aa, Mycobacterium
YVWTEGHITYVFVPTRNLPLLQPLRWFGLGFVADALNAPLKE

SEQ ID NO: 952649 - protein, 18 aa, Mycobacterium
YWSLVDNYEWGSYRPRFG

SEQ ID NO: 952650 - protein, 19 aa, Mycobacterium
YYAFGVTDWGRLVFCGSPR

SEQ ID NO: 952651 - protein, 18 aa, Mycobacterium
YYAFTTLTTDPGSMLPPL

SEQ ID NO: 952652 - protein, 30 aa, Mycobacterium
YYGQGWYGQHPLWQMVWHHGPRQPYQEKPP

SEQ ID NO: 952653 - protein, 28 aa, Mycobacterium
YYQREDIPIHYLLADTFTICDGYFCSLI

SEQ ID NO: 952654 - protein, 23 aa, Mycobacterium
TVSGQLTLLVPFIDRVRARVDLR

SEQ ID NO: 952655 - protein, 31 aa, Mycobacterium
DVMGALNAPTMAWLGRPLIGDGANGVDGTGG

SEQ ID NO: 952656 - protein, 25 aa, Mycobacterium
EDQLFRFSRILDAQPRLSILLGDYV

SEQ ID NO: 952657 - protein, 25 aa, Mycobacterium
GAGGRGGWLFSAGGNGGAGGAGGAG

SEQ ID NO: 952658 - protein, 21 aa, Mycobacterium
GAWAAGPTTALAGALGADEVS

SEQ ID NO: 952659 - protein, 23 aa, Mycobacterium
GGNGGAGGLLWGNGGRGGSGAAG

SEQ ID NO: 952660 - protein, 23 aa, Mycobacterium
HSRQLLAAQIIWTLARADIRGPY

SEQ ID NO: 952661 - protein, 25 aa, Mycobacterium
HWIKVLLHYLFIYKAKARPFWWLIP

SEQ ID NO: 952662 - protein, 18 aa, Mycobacterium
MEAAYVSVYLWKNTVEKA

SEQ ID NO: 952663 - protein, 24 aa, Mycobacterium
MQDYLDAPPISTPFRLFDCSLETD

SEQ ID NO: 952664 - protein, 21 aa, Mycobacterium
NIVVLSLWQPGAEAPVLVGLN

SEQ ID NO: 952665 - protein, 19 aa, Mycobacterium
PYPAWRELFNDILPAHIVK

SEQ ID NO: 952666 - protein, 18 aa, Mycobacterium
RHTPPHAWYIAFAPAQTP

SEQ ID NO: 952667 - protein, 24 aa, Mycobacterium
SFPPTQWIRWRKPVIGMPTTPRLL

SEQ ID NO: 952668 - protein, 26 aa, Mycobacterium
SLSHPYLDTVLFILGITRGEIEAADA

SEQ ID NO: 952669 - protein, 18 aa, Mycobacterium
TFDTLFKPGSRPLDVIFP

SEQ ID NO: 952670 - protein, 18 aa, Mycobacterium
TYVQLFVLIAAANDVRCD

SEQ ID NO: 952671 - protein, 24 aa, Mycobacterium
VTVMALIVLLLLNATMTQVFTADG

SEQ ID NO: 952672 - protein, 22 aa, Mycobacterium
YGSFFNIYFCSVTIKINGPAGG

SEQ ID NO: 952673 - protein, 22 aa, Mycobacterium
AAAAAPYAGWLSAAATRALGAA

SEQ ID NO: 952674 - protein, 23 aa, Mycobacterium
AAAAFGFPGFGGNGGLLFGKAGA

SEQ ID NO: 952675 - protein, 19 aa, Mycobacterium
AAAALLAGFSLAGCQAKES

SEQ ID NO: 952676 - protein, 21 aa, Mycobacterium
AAAAQPLLAWLSYTAESSALA

SEQ ID NO: 952677 - protein, 23 aa, Mycobacterium
AAAAQPYLAWLTYTAESAAHAGS

SEQ ID NO: 952678 - protein, 22 aa, Mycobacterium
AAAATPYTAWLTTAATAAAEAA

SEQ ID NO: 952679 - protein, 21 aa, Mycobacterium
AAAFHDRFVQALTASAESYAG

SEQ ID NO: 952680 - protein, 18 aa, Mycobacterium
AAAILVLAGCSSTANPPA

SEQ ID NO: 952681 - protein, 24 aa, Mycobacterium
AAAPAPPILALPGIPPGDVAPPPA

SEQ ID NO: 952682 - protein, 32 aa, Mycobacterium
AAAQDMLTAIRAPAQALLGRPLIGNGADGAPG

SEQ ID NO: 952683 - protein, 20 aa, Mycobacterium
AAAYRVLWYVASPTNISGAT

SEQ ID NO: 952684 - protein, 17 aa, Mycobacterium
AADLKYFQQATGYYLAL

SEQ ID NO: 952685 - protein, 22 aa, Mycobacterium
AADRWSLSPLLRDLATAYTARC

SEQ ID NO: 952686 - protein, 22 aa, Mycobacterium
AAFLEYLDMFYNLGIAGRAMRR

SEQ ID NO: 952687 - protein, 26 aa, Mycobacterium
AAGLTPLRPWRSALVAALAAASDRAL

SEQ ID NO: 952688 - protein, 17 aa, Mycobacterium
AAKRLSVLSLPTTFIFD

SEQ ID NO: 952689 - protein, 18 aa, Mycobacterium
AAKWWRYQKYDDCVIMSS

SEQ ID NO: 952690 - protein, 21 aa, Mycobacterium
AAKYWRYQKYDDCLIMAVADV

SEQ ID NO: 952691 - protein, 20 aa, Mycobacterium
AALAAGLRDLRRVGAVGAGA

SEQ ID NO: 952692 - protein, 17 aa, Mycobacterium
AALAATIAPLAACANQQ

SEQ ID NO: 952693 - protein, 20 aa, Mycobacterium
AALAFLIRILGKLVADGYIA

SEQ ID NO: 952694 - protein, 17 aa, Mycobacterium
AALFRFVDNKLAVLALL

SEQ ID NO: 952695 - protein, 19 aa, Mycobacterium
AALMFPFAGGIGLMSNRAS

SEQ ID NO: 952696 - protein, 21 aa, Mycobacterium
AALSAAFLGLAAPALAAPTGG

SEQ ID NO: 952697 - protein, 23 aa, Mycobacterium
AAPTAILFFSYGCGECVGGGKSL

SEQ ID NO: 952698 - protein, 39 aa, Mycobacterium
AAQLAPLQQALALPAAVDFSISIFGLQLVQGGTANANST

SEQ ID NO: 952699 - protein, 23 aa, Mycobacterium
AAQLAPWQQAIQALPGRVAAMAT

SEQ ID NO: 952700 - protein, 20 aa, Mycobacterium
AAQLAPWQQALRTLQNRVAG

SEQ ID NO: 952701 - protein, 23 aa, Mycobacterium
AAQYWVLKPTYHNSFWYSSCMVT

SEQ ID NO: 952702 - protein, 24 aa, Mycobacterium
AASPTAMPVGALGADEISSAVAVM

SEQ ID NO: 952703 - protein, 18 aa, Mycobacterium
AASWAFLGWRHLRTGQAR

SEQ ID NO: 952704 - protein, 17 aa, Mycobacterium
AATATHLSSLRTTLVAA

SEQ ID NO: 952705 - protein, 17 aa, Mycobacterium
AAVAVLLSPGFLAVGCG

SEQ ID NO: 952706 - protein, 17 aa, Mycobacterium
AAVIGPLFRSALRSAEV

SEQ ID NO: 952707 - protein, 21 aa, Mycobacterium
AAWWVVVLALTAATMMAAALG

SEQ ID NO: 952708 - protein, 23 aa, Mycobacterium
AAYIPVVLALIAVLLAACGSSNP

SEQ ID NO: 952709 - protein, 25 aa, Mycobacterium
AAYYVHYWQYQFLPQFGALLNENPS

SEQ ID NO: 952710 - protein, 22 aa, Mycobacterium
ACCTALLACFTLAATNGLPLAR

SEQ ID NO: 952711 - protein, 19 aa, Mycobacterium
ACQYAIQFIAVLRGYSLPV

SEQ ID NO: 952712 - protein, 17 aa, Mycobacterium
ACQYAMQFIAVLRGYAL

SEQ ID NO: 952713 - protein, 18 aa, Mycobacterium
ADAAPWWRWPRAPARWRP

SEQ ID NO: 952714 - protein, 25 aa, Mycobacterium
ADAGSRITKLWWPATGAPKLSLTTW

SEQ ID NO: 952715 - protein, 21 aa, Mycobacterium
ADCFAGVYLFWVADGKSPRFT

SEQ ID NO: 952716 - protein, 17 aa, Mycobacterium
ADEIPSLPWVPADRAWL

SEQ ID NO: 952717 - protein, 22 aa, Mycobacterium
ADGIGHPFWLSRTIFGELAQLH

SEQ ID NO: 952718 - protein, 24 aa, Mycobacterium
ADGKFNYIVECNPLLGPELMDLAK

SEQ ID NO: 952719 - protein, 23 aa, Mycobacterium
ADHVSFPFRIGFTRVYGLFAQAG

SEQ ID NO: 952720 - protein, 17 aa, Mycobacterium
ADNGYIPIPDAFKARLS

SEQ ID NO: 952721 - protein, 17 aa, Mycobacterium
ADNPLNPQFLPKDQRPI

SEQ ID NO: 952722 - protein, 24 aa, Mycobacterium
ADPAPPIPFIPAVPAPLPAVPGSY

SEQ ID NO: 952723 - protein, 25 aa, Mycobacterium
ADTDPWHVTAIYLDPRWLADQDEQA

SEQ ID NO: 952724 - protein, 23 aa, Mycobacterium
AEESAFVLLALQAPVAGDLRTVV

SEQ ID NO: 952725 - protein, 20 aa, Mycobacterium
AEGLLPFLPAAAQHALFTAI

SEQ ID NO: 952726 - protein, 23 aa, Mycobacterium
AEIYVPFSWFEPMWLENLGFVAE

SEQ ID NO: 952727 - protein, 21 aa, Mycobacterium
AELPMLFHSLLPRPSRRVINK

SEQ ID NO: 952728 - protein, 24 aa, Mycobacterium
AEPAAWFTYYYWLDDTRAPEFAPC

SEQ ID NO: 952729 - protein, 24 aa, Mycobacterium
AEPGIPLVALWDETTWYPGSPWLG

SEQ ID NO: 952730 - protein, 21 aa, Mycobacterium
AESIRPWMPPPAPAPAPGEPA

SEQ ID NO: 952731 - protein, 24 aa, Mycobacterium
AFATIPAVLLRWGVSQFDADARPA

SEQ ID NO: 952732 - protein, 18 aa, Mycobacterium
AFDFVGFAAAHGGAGGTG

SEQ ID NO: 952733 - protein, 19 aa, Mycobacterium
AFNGILNLAVAFADNVQAT

SEQ ID NO: 952734 - protein, 20 aa, Mycobacterium
AFPVEWEFPPGWGPDARGQA

SEQ ID NO: 952735 - protein, 18 aa, Mycobacterium
AFWGPQWPRDIPIVVAGT

SEQ ID NO: 952736 - protein, 23 aa, Mycobacterium
AGAGYLLPALRRPNLTLLEQTRV

SEQ ID NO: 952737 - protein, 19 aa, Mycobacterium
AGAIFVGAWSPVSLGDYCA

SEQ ID NO: 952738 - protein, 22 aa, Mycobacterium
AGGSGGWLWGAGGTGGDGGAGS

SEQ ID NO: 952739 - protein, 19 aa, Mycobacterium
AGHPGLFTRAPWVVSVDDH

SEQ ID NO: 952740 - protein, 24 aa, Mycobacterium
AGIERLLVAYLKLAGKTAQDTAFD

SEQ ID NO: 952741 - protein, 24 aa, Mycobacterium
AGKKAVLWFWAPWCPTCQKEAPDL

SEQ ID NO: 952742 - protein, 19 aa, Mycobacterium
AGLPLTPMSLADSALVLID

SEQ ID NO: 952743 - protein, 19 aa, Mycobacterium
AGMRIVLHFPYSANVHCEI

SEQ ID NO: 952744 - protein, 23 aa, Mycobacterium
AGNTQYYMLLTQDLPLVQPIRDI

SEQ ID NO: 952745 - protein, 24 aa, Mycobacterium
AGPSKYVLPLLSPLIRAALKRRGA

SEQ ID NO: 952746 - protein, 26 aa, Mycobacterium
AGRRVVLNLWAYWCAPCAAELPAMAE

SEQ ID NO: 952747 - protein, 18 aa, Mycobacterium
AHVPYLAWLTRAGANSAA

SEQ ID NO: 952748 - protein, 20 aa, Mycobacterium
AIADGTYRKVLQRWGLEDEA

SEQ ID NO: 952749 - protein, 18 aa, Mycobacterium
AIATAPLTFAQPAPPPCF

SEQ ID NO: 952750 - protein, 17 aa, Mycobacterium
AIDEHFGHPAHLPRAGL

SEQ ID NO: 952751 - protein, 19 aa, Mycobacterium
AILVFPFIPQALRHRYKEI

SEQ ID NO: 952752 - protein, 24 aa, Mycobacterium
AINAPTQTLLGRPLIGNGANGAPG

SEQ ID NO: 952753 - protein, 22 aa, Mycobacterium
AIPALMLTFLPSPTSAAASNTA

SEQ ID NO: 952754 - protein, 26 aa, Mycobacterium
AIRRLAVPIVLLWLALAAITNASVPQ

SEQ ID NO: 952755 - protein, 18 aa, Mycobacterium
AISALFLHVPYGANTLVG

SEQ ID NO: 952756 - protein, 24 aa, Mycobacterium
AISAQAAVFHGRFVAALNAAADSY

SEQ ID NO: 952757 - protein, 23 aa, Mycobacterium
AKTLPLVEPLRWVGLGQLADELT

SEQ ID NO: 952758 - protein, 20 aa, Mycobacterium
AKVFAGCAIALGAALAGCGT

SEQ ID NO: 952759 - protein, 18 aa, Mycobacterium
AKYWRHQNYDDCAIMSSA

SEQ ID NO: 952760 - protein, 18 aa, Mycobacterium
ALAGWAAGWVAAATAPIA

SEQ ID NO: 952761 - protein, 25 aa, Mycobacterium
ALALTSWLQPLWLSRGRIREGRTWF

SEQ ID NO: 952762 - protein, 17 aa, Mycobacterium
ALASWYVWAALGLYPST

SEQ ID NO: 952763 - protein, 20 aa, Mycobacterium
ALDMALLPRTSRAAPAPPIG

SEQ ID NO: 952764 - protein, 17 aa, Mycobacterium
ALELVNCLQWPSGSKPN

SEQ ID NO: 952765 - protein, 25 aa, Mycobacterium
ALERLPLDFPIYNLAARSYFWNMSG

SEQ ID NO: 952766 - protein, 20 aa, Mycobacterium
ALFIAMMTFAPAFAGADPAD

SEQ ID NO: 952767 - protein, 19 aa, Mycobacterium
ALGRLRPLFRAGLGARLGS

SEQ ID NO: 952768 - protein, 24 aa, Mycobacterium
ALHPNPVYLFAYDPMAFGGKGRAA

SEQ ID NO: 952769 - protein, 17 aa, Mycobacterium
ALLAHLTWLLPLLEIIA

SEQ ID NO: 952770 - protein, 17 aa, Mycobacterium
ALLRAFCLAALAVGLAF

SEQ ID NO: 952771 - protein, 17 aa, Mycobacterium
ALLRVFLLSAVPSEEAG

SEQ ID NO: 952772 - protein, 19 aa, Mycobacterium
ALMFPFAGGLGLMSNRASE

SEQ ID NO: 952773 - protein, 18 aa, Mycobacterium
ALMPLWLGAIALSLAIPA

SEQ ID NO: 952774 - protein, 25 aa, Mycobacterium
ALPIFVVFVYFKAPWRRFVPDLLDG

SEQ ID NO: 952775 - protein, 24 aa, Mycobacterium
ALPIYVVFIYFRAPWRHFVSHLND

SEQ ID NO: 952776 - protein, 21 aa, Mycobacterium
ALQLILSLRPLWLRGGRVQEA

SEQ ID NO: 952777 - protein, 21 aa, Mycobacterium
ALRFWEVMYPSPPPGLAEPGD

SEQ ID NO: 952778 - protein, 19 aa, Mycobacterium
ALRLARQRSPLPLLAFAHD

SEQ ID NO: 952779 - protein, 22 aa, Mycobacterium
ALRLMNFNYLPMPFNAYLGPAP

SEQ ID NO: 952780 - protein, 19 aa, Mycobacterium
ALSAAFLGLAAPALAAPTG

SEQ ID NO: 952781 - protein, 17 aa, Mycobacterium
ALSSWYVWAALGLYPIT

SEQ ID NO: 952782 - protein, 17 aa, Mycobacterium
ALTLALLPALRAARGHV

SEQ ID NO: 952783 - protein, 26 aa, Mycobacterium
ALVRWRHPIWGLLLPDSFIGVAESTN

SEQ ID NO: 952784 - protein, 20 aa, Mycobacterium
ALYQLIYQPGSLVRIELADA

SEQ ID NO: 952785 - protein, 24 aa, Mycobacterium
ALYTPAHWKYLTSGLLGLQRGTDA

SEQ ID NO: 952786 - protein, 17 aa, Mycobacterium
AMMALRLGCQSDLFAAI

SEQ ID NO: 952787 - protein, 18 aa, Mycobacterium
AMQTIACLLLLAGSAYLY

SEQ ID NO: 952788 - protein, 20 aa, Mycobacterium
AMRNLLLMLGFPANRIIVED

SEQ ID NO: 952789 - protein, 24 aa, Mycobacterium
ANLNVVHYSLFPPNADLAPVAQVV

SEQ ID NO: 952790 - protein, 27 aa, Mycobacterium
ANVLIITPLRIAFLILLVGTTLEVVTE

SEQ ID NO: 952791 - protein, 24 aa, Mycobacterium
APDDFRWPFNIPGYWMTPMFTLAV

SEQ ID NO: 952792 - protein, 23 aa, Mycobacterium
APDDFRWPFNNPGYWMTPMFTLA

SEQ ID NO: 952793 - protein, 18 aa, Mycobacterium
APGDWLYFVTIDSQGTTL

SEQ ID NO: 952794 - protein, 23 aa, Mycobacterium
APLVVLYKQYVVRFGLGYREEVK

SEQ ID NO: 952795 - protein, 18 aa, Mycobacterium
APPLAIGPLYQPKTLELC

SEQ ID NO: 952796 - protein, 18 aa, Mycobacterium
APPLLPKALARDLLPDLQ

SEQ ID NO: 952797 - protein, 17 aa, Mycobacterium
APPNPFAFPPPAAPAAV

SEQ ID NO: 952798 - protein, 20 aa, Mycobacterium
APTEALFGRPLIGDGADGQT

SEQ ID NO: 952799 - protein, 17 aa, Mycobacterium
APVIRRWHRRHPDVAIS

SEQ ID NO: 952800 - protein, 33 aa, Mycobacterium
AQASATPALRPIIGPGGWLIGDGLDAAADCTGE

SEQ ID NO: 952801 - protein, 23 aa, Mycobacterium
AQEKATLIYARALRRVDPCGFAS

SEQ ID NO: 952802 - protein, 26 aa, Mycobacterium
AQISVPGWLAFGWGLVDLFVPEPVER

SEQ ID NO: 952803 - protein, 26 aa, Mycobacterium
AQPQRAVFTTLPWKLTITTTMTSVFA

SEQ ID NO: 952804 - protein, 17 aa, Mycobacterium
AQSSWYVWAALGLFPST

SEQ ID NO: 952805 - protein, 21 aa, Mycobacterium
AQYVWWVPHNVAGLVTALGGR

SEQ ID NO: 952806 - protein, 20 aa, Mycobacterium
ARAFFLFRTPEPLDYHHRDV

SEQ ID NO: 952807 - protein, 20 aa, Mycobacterium
AREFVAFWLDPESRVLAGMN

SEQ ID NO: 952808 - protein, 17 aa, Mycobacterium
ARLNFQLAFGARVGQRL

SEQ ID NO: 952809 - protein, 18 aa, Mycobacterium
ARQFPQRYPARIVGAALI

SEQ ID NO: 952810 - protein, 24 aa, Mycobacterium
ARRLALLLTFQRFLPATGPIAMRS

SEQ ID NO: 952811 - protein, 21 aa, Mycobacterium
ARRLALLLTFQRFLPTTGPVA

SEQ ID NO: 952812 - protein, 28 aa, Mycobacterium
ARVVQAPEFPLPSAWRLLTSRGPYELAG

SEQ ID NO: 952813 - protein, 18 aa, Mycobacterium
ARYQCRIQLVLAANLCPC

SEQ ID NO: 952814 - protein, 24 aa, Mycobacterium
ASADLAWFPLIERVKTIPTSDRVT

SEQ ID NO: 952815 - protein, 23 aa, Mycobacterium
ASAFLWHNLPVPTQVWAPFDVDG

SEQ ID NO: 952816 - protein, 25 aa, Mycobacterium
ASESAFFMLAFTKIGLMPDGGASAL

SEQ ID NO: 952817 - protein, 20 aa, Mycobacterium
ASIFKLYVLHALAGAIRDGT

SEQ ID NO: 952818 - protein, 24 aa, Mycobacterium
ASNPILTEIWFLLTGQTVLPNNLG

SEQ ID NO: 952819 - protein, 17 aa, Mycobacterium
ASSSLLWFLGAAGRRQT

SEQ ID NO: 952820 - protein, 17 aa, Mycobacterium
ATAFPWRRQYALVQWYV

SEQ ID NO: 952821 - protein, 25 aa, Mycobacterium
ATDDAFLAQMHKLGFTWPAGDDSDI

SEQ ID NO: 952822 - protein, 21 aa, Mycobacterium
ATEPVVHYLLAASGLVNRTPA

SEQ ID NO: 952823 - protein, 28 aa, Mycobacterium
ATRAIPTTWYFPTTPPLGLVWLQHGFVE

SEQ ID NO: 952824 - protein, 25 aa, Mycobacterium
ATRSPLLRALVAALLVVIGAGGGYA

SEQ ID NO: 952825 - protein, 18 aa, Mycobacterium
ATVHPMLVAANRSRLVSL

SEQ ID NO: 952826 - protein, 23 aa, Mycobacterium
ATVPALATIWRVLSRRGFITAQP

SEQ ID NO: 952827 - protein, 18 aa, Mycobacterium
ATVWIASDGSHRLVRATI

SEQ ID NO: 952828 - protein, 18 aa, Mycobacterium
AVAFLLSDDARFITGEAL

SEQ ID NO: 952829 - protein, 18 aa, Mycobacterium
AVATLWLAALGPGAATAR

SEQ ID NO: 952830 - protein, 26 aa, Mycobacterium
AVENPGTRLMILPPLIHGAAQWAAMT

SEQ ID NO: 952831 - protein, 20 aa, Mycobacterium
AVFALNVRAPYFLVGALAPT

SEQ ID NO: 952832 - protein, 19 aa, Mycobacterium
AVFRRWIDLIADKLVAVGV

SEQ ID NO: 952833 - protein, 20 aa, Mycobacterium
AVGFPVLHIGNIGFANLSVG

SEQ ID NO: 952834 - protein, 17 aa, Mycobacterium
AVLLSPGFLAVGCGSDS

SEQ ID NO: 952835 - protein, 18 aa, Mycobacterium
AVMGLVVLLLANATITQV

SEQ ID NO: 952836 - protein, 20 aa, Mycobacterium
AVNGKRWAIKGTATGVDMSN

SEQ ID NO: 952837 - protein, 20 aa, Mycobacterium
AVPYIAQFWPIPLPGWGGLE

SEQ ID NO: 952838 - protein, 17 aa, Mycobacterium
AVRFAFWGDGINGAMDY

SEQ ID NO: 952839 - protein, 17 aa, Mycobacterium
AVRPIYGPALDGTLPGN

SEQ ID NO: 952840 - protein, 19 aa, Mycobacterium
AVVGPFTYLRPGTALGADG

SEQ ID NO: 952841 - protein, 25 aa, Mycobacterium
AVVPGWYRMMALLARAFIAMAQDEP

SEQ ID NO: 952842 - protein, 19 aa, Mycobacterium
AVWVQPPPVPQRPATRSGS

SEQ ID NO: 952843 - protein, 20 aa, Mycobacterium
AWNLPAVFGPIAITYNVAGV

SEQ ID NO: 952844 - protein, 18 aa, Mycobacterium
AWQLRALFAAGLSAMYAA

SEQ ID NO: 952845 - protein, 17 aa, Mycobacterium
AWWVMNAIPTAVSLGHT

SEQ ID NO: 952846 - protein, 18 aa, Mycobacterium
AYLGVRVNAIAPGLIRSA

SEQ ID NO: 952847 - protein, 22 aa, Mycobacterium
CAVPPLIGYLNDGKLPGTDTYC

SEQ ID NO: 952848 - protein, 22 aa, Mycobacterium
CAVPPLLGYLNDGKLPGTDTYC

SEQ ID NO: 952849 - protein, 23 aa, Mycobacterium
CGQLRIPHLILARPAWDPGEALV

SEQ ID NO: 952850 - protein, 24 aa, Mycobacterium
CIPCDPHYLLWQLRARRFDSPLMR

SEQ ID NO: 952851 - protein, 17 aa, Mycobacterium
CLAILLLAACGAPDGSD

SEQ ID NO: 952852 - protein, 24 aa, Mycobacterium
CLDLPGLFVWRRYHPMPATTRGVL

SEQ ID NO: 952853 - protein, 19 aa, Mycobacterium
CVLALILATFWIVVIANSF

SEQ ID NO: 952854 - protein, 25 aa, Mycobacterium
CVRAALPLLRKAEWARIVNFSAHST

SEQ ID NO: 952855 - protein, 20 aa, Mycobacterium
DAALDFWMGSPGHRAIILNC

SEQ ID NO: 952856 - protein, 24 aa, Mycobacterium
DAFFEQLAWMWPNWAKLFFNNKGV

SEQ ID NO: 952857 - protein, 22 aa, Mycobacterium
DAFTYMLLLTIEDLGFCPKGEG

SEQ ID NO: 952858 - protein, 25 aa, Mycobacterium
DAGARRTFFGIPLSRSATTATGIVT

SEQ ID NO: 952859 - protein, 25 aa, Mycobacterium
DARVNSFLLPLLRSCNFNVVANQPG

SEQ ID NO: 952860 - protein, 18 aa, Mycobacterium
DAWAIWDPYTALAQKQLK

SEQ ID NO: 952861 - protein, 27 aa, Mycobacterium
DAYEPFPCVVVTRGWWILQTNAGAGVL

SEQ ID NO: 952862 - protein, 20 aa, Mycobacterium
DCARLDLPGWIREAQFEAGN

SEQ ID NO: 952863 - protein, 23 aa, Mycobacterium
DDPLNPLTFPKALLLKVTGPIST

SEQ ID NO: 952864 - protein, 17 aa, Mycobacterium
DDWLITWSPTVLHRDLT

SEQ ID NO: 952865 - protein, 17 aa, Mycobacterium
DEGRWRVRWTSTGLHPK

SEQ ID NO: 952866 - protein, 23 aa, Mycobacterium
DERWALLPLVPLIPERVMRRLIG

SEQ ID NO: 952867 - protein, 25 aa, Mycobacterium
DETTGLFWTVYSLPAKIPPQPAQDL

SEQ ID NO: 952868 - protein, 23 aa, Mycobacterium
DFDFAMLLPPFRGAALTAYDKRG

SEQ ID NO: 952869 - protein, 20 aa, Mycobacterium
DFIEWSISFSQKPFPPPCDI

SEQ ID NO: 952870 - protein, 17 aa, Mycobacterium
DFRFLPDGRILVAEKAG

SEQ ID NO: 952871 - protein, 23 aa, Mycobacterium
DFSTLPWTFTITTTVPAVIASVV

SEQ ID NO: 952872 - protein, 20 aa, Mycobacterium
DGGYLPMNFAANDLAWSATN

SEQ ID NO: 952873 - protein, 30 aa, Mycobacterium
DGQQVLQRLKYLPLAPFRISYAYTNFGVTA

SEQ ID NO: 952874 - protein, 24 aa, Mycobacterium
DGRDMFWSMAPLVLVCIVLAGVLG

SEQ ID NO: 952875 - protein, 20 aa, Mycobacterium
DGRPLLRHRVELGHGSYADD

SEQ ID NO: 952876 - protein, 21 aa, Mycobacterium
DGRWDRNWLLGWRDITNASNE

SEQ ID NO: 952877 - protein, 24 aa, Mycobacterium
DGRWLVNPMFIDPLPAHPPYPCAT

SEQ ID NO: 952878 - protein, 21 aa, Mycobacterium
DGRYYLFPMLDGFTNVFEVPG

SEQ ID NO: 952879 - protein, 17 aa, Mycobacterium
DGSIDKIFFWDPAMAAE

SEQ ID NO: 952880 - protein, 24 aa, Mycobacterium
DGSLWRQFGVPWQPAYLFINSNGT

SEQ ID NO: 952881 - protein, 18 aa, Mycobacterium
DIGPYFYEPTILSGVREG

SEQ ID NO: 952882 - protein, 24 aa, Mycobacterium
DILGRLPLWPFLRFQRRFDAPTEE

SEQ ID NO: 952883 - protein, 17 aa, Mycobacterium
DILGWHITLSDLRFEAD

SEQ ID NO: 952884 - protein, 21 aa, Mycobacterium
DIQSLWLRLAGRFDRTGLWPL

SEQ ID NO: 952885 - protein, 21 aa, Mycobacterium
DIRALFETHFFGSVAMIKAVL

SEQ ID NO: 952886 - protein, 25 aa, Mycobacterium
DIRALYAFKRLAWWPYSVAMRQVNV

SEQ ID NO: 952887 - protein, 24 aa, Mycobacterium
DIVNAPTQALIGRPLIGNGTNGAP

SEQ ID NO: 952888 - protein, 22 aa, Mycobacterium
DIWDWAVDWDTWLSMSALPAPS

SEQ ID NO: 952889 - protein, 23 aa, Mycobacterium
DKPKLRPLLDVLPIAGGSGTLSE

SEQ ID NO: 952890 - protein, 18 aa, Mycobacterium
DLCSFPLRKCGDGNLYGG

SEQ ID NO: 952891 - protein, 21 aa, Mycobacterium
DLDALIGGFRPLFRALDPHQV

SEQ ID NO: 952892 - protein, 25 aa, Mycobacterium
DLGLHVNLLQLLRPLGSGRATSLVN

SEQ ID NO: 952893 - protein, 19 aa, Mycobacterium
DLKYFQQATGYYLALASGR

SEQ ID NO: 952894 - protein, 24 aa, Mycobacterium
DLVPEYIGNLLLYFAPESTATLLD

SEQ ID NO: 952895 - protein, 19 aa, Mycobacterium
DLWDWVVDWPTWQSMSALP

SEQ ID NO: 952896 - protein, 19 aa, Mycobacterium
DMLGIPFYVWDFADRFKED

SEQ ID NO: 952897 - protein, 25 aa, Mycobacterium
DNDFRQLWFGWADPAQILVEYAQLR

SEQ ID NO: 952898 - protein, 21 aa, Mycobacterium
DPFVAIVAFPFIPQAMRGRYN

SEQ ID NO: 952899 - protein, 20 aa, Mycobacterium
DPMLAPRYPAISGQTLFGFG

SEQ ID NO: 952900 - protein, 22 aa, Mycobacterium
DPRTDFAVGPFFTILGGFMAMD

SEQ ID NO: 952901 - protein, 17 aa, Mycobacterium
DPWLRRQLTPDFRPGCK

SEQ ID NO: 952902 - protein, 20 aa, Mycobacterium
DPWLRRQLTPDFRPGCKRML

SEQ ID NO: 952903 - protein, 25 aa, Mycobacterium
DPYDDLAWFCIRAWRFGAPAGLGAG

SEQ ID NO: 952904 - protein, 18 aa, Mycobacterium
DQASALLDWGFALGPNAG

SEQ ID NO: 952905 - protein, 22 aa, Mycobacterium
DQEIFLISPLAALAILPVKLIG

SEQ ID NO: 952906 - protein, 22 aa, Mycobacterium
DQKVFYKNGAPFVWDRGRELGM

SEQ ID NO: 952907 - protein, 25 aa, Mycobacterium
DQLPPPGPLLLPPPPPPPAPVAGPP

SEQ ID NO: 952908 - protein, 25 aa, Mycobacterium
DQPALRPLLDLLPIAGGSGTLGERF

SEQ ID NO: 952909 - protein, 21 aa, Mycobacterium
DQSMLFFPFVGGAGPNPLIIT

SEQ ID NO: 952910 - protein, 20 aa, Mycobacterium
DQTVFFKNGDPFIWDRGREL

SEQ ID NO: 952911 - protein, 18 aa, Mycobacterium
DRFPLLALLRRTLTEEQV

SEQ ID NO: 952912 - protein, 23 aa, Mycobacterium
DRHRGWIWIYPIQPHVYVPHVST

SEQ ID NO: 952913 - protein, 21 aa, Mycobacterium
DRPNLFIKIPATKAGIPAITA

SEQ ID NO: 952914 - protein, 23 aa, Mycobacterium
DRPNLFIKIPATKAGLPAITAVL

SEQ ID NO: 952915 - protein, 23 aa, Mycobacterium
DRPNLLIKIPATKAGLPAIAAVL

SEQ ID NO: 952916 - protein, 24 aa, Mycobacterium
DRYSMDWYYPILGSALRGPEAAAR

SEQ ID NO: 952917 - protein, 24 aa, Mycobacterium
DSEGLLLHYLPEVDLWTGAIVGAE

SEQ ID NO: 952918 - protein, 23 aa, Mycobacterium
DSEHPFIYITTITNPRHGTFDGI

SEQ ID NO: 952919 - protein, 26 aa, Mycobacterium
DSLKTDAPLLKKILTYHVVPGQLSPS

SEQ ID NO: 952920 - protein, 21 aa, Mycobacterium
DSVLPDRPGFFFAIDGHSMWA

SEQ ID NO: 952921 - protein, 19 aa, Mycobacterium
DSVLPDRPGFFFAVDAHSM

SEQ ID NO: 952922 - protein, 23 aa, Mycobacterium
DTEDVVFPLFPKGGGFPRANDDL

SEQ ID NO: 952923 - protein, 19 aa, Mycobacterium
DTISFYRPNLPGSYPIVLA

SEQ ID NO: 952924 - protein, 17 aa, Mycobacterium
DTIVLRRSRPLEISLDG

SEQ ID NO: 952925 - protein, 18 aa, Mycobacterium
DTPPQWIPVESPRGLNYA

SEQ ID NO: 952926 - protein, 20 aa, Mycobacterium
DTRAFLGERIAVRRGAVVGA

SEQ ID NO: 952927 - protein, 20 aa, Mycobacterium
DVAEMRLPFSWRGVSLHAAG

SEQ ID NO: 952928 - protein, 23 aa, Mycobacterium
DVANLAMFLLSDAAAWITGQCIN

SEQ ID NO: 952929 - protein, 25 aa, Mycobacterium
DVDWVYLSPAPLIEPGKRTGSYRVA

SEQ ID NO: 952930 - protein, 24 aa, Mycobacterium
DVEPLGWYRRPGVLFAAAACLAAV

SEQ ID NO: 952931 - protein, 17 aa, Mycobacterium
DWAVDWDTWVAMSALPP

SEQ ID NO: 952932 - protein, 18 aa, Mycobacterium
DWAVDWDTWVAMSALPPP

SEQ ID NO: 952933 - protein, 19 aa, Mycobacterium
DWDTWVAMSALPPPTAHPP

SEQ ID NO: 952934 - protein, 22 aa, Mycobacterium
DYQAQYPFFGGYALLFHHGGGH

SEQ ID NO: 952935 - protein, 17 aa, Mycobacterium
DYVQPFGGGYFFALPGI

SEQ ID NO: 952936 - protein, 24 aa, Mycobacterium
EAELRRLLGLHKVIWLPGIAGMDI

SEQ ID NO: 952937 - protein, 18 aa, Mycobacterium
EALFLLTQRPLDPGTPPP

SEQ ID NO: 952938 - protein, 17 aa, Mycobacterium
EAPALQALLALMVERGV

SEQ ID NO: 952939 - protein, 21 aa, Mycobacterium
EAWNLPVVFGPIALAYNLPGV

SEQ ID NO: 952940 - protein, 18 aa, Mycobacterium
EAYDGYLIPLFTPGEFEG

SEQ ID NO: 952941 - protein, 23 aa, Mycobacterium
EDAANRLVWLPPAPMNNTYAFAI

SEQ ID NO: 952942 - protein, 22 aa, Mycobacterium
EDFSHFLGFTLPWVMRGWREVE

SEQ ID NO: 952943 - protein, 23 aa, Mycobacterium
EDVHRWWTSLTPQQRQRFIAQSP

SEQ ID NO: 952944 - protein, 23 aa, Mycobacterium
EEHLPLVLPFKYLGVDKDTLNKL

SEQ ID NO: 952945 - protein, 32 aa, Mycobacterium
EEVMRVNFFAPMRLTLALLPRMRERGSGMIVN

SEQ ID NO: 952946 - protein, 27 aa, Mycobacterium
EEWTPPLEWLQRIPVLGPLLVTAIVGF

SEQ ID NO: 952947 - protein, 17 aa, Mycobacterium
EFILNNPLDYMTPELRA

SEQ ID NO: 952948 - protein, 26 aa, Mycobacterium
EFLPTFPFHYKYLRNAVRGDYLNVYT

SEQ ID NO: 952949 - protein, 23 aa, Mycobacterium
EGPPQRWFVVWLGTSNDPVDKGA

SEQ ID NO: 952950 - protein, 18 aa, Mycobacterium
EHPAPGDWLYFVTIDSQG

SEQ ID NO: 952951 - protein, 20 aa, Mycobacterium
EIGLLGFSLITEALGGVDVC

SEQ ID NO: 952952 - protein, 27 aa, Mycobacterium
EIPGLPPIVLPWPAPPPPPPAPPPPPP

SEQ ID NO: 952953 - protein, 17 aa, Mycobacterium
EIPTLPPGVRYTQAAIG

SEQ ID NO: 952954 - protein, 20 aa, Mycobacterium
EKLYPVLPPRQAELADRLLS

SEQ ID NO: 952955 - protein, 22 aa, Mycobacterium
ELDERMMRWSWQSYLVATDQFV

SEQ ID NO: 952956 - protein, 25 aa, Mycobacterium
ELDKLIWEEVFSLPLFQSPGNVAVR

SEQ ID NO: 952957 - protein, 23 aa, Mycobacterium
ELFVAWGKLYPQFGTVAALNMVK

SEQ ID NO: 952958 - protein, 19 aa, Mycobacterium
ELKVSQFWDPAWMAANREA

SEQ ID NO: 952959 - protein, 21 aa, Mycobacterium
ELLVLLIVGLVVLGPERLPGA

SEQ ID NO: 952960 - protein, 18 aa, Mycobacterium
ELNKPYLVLARPPWDPGD

SEQ ID NO: 952961 - protein, 20 aa, Mycobacterium
ELQTWIDWLVRNGGLEEGKL

SEQ ID NO: 952962 - protein, 24 aa, Mycobacterium
ELSKPITNGLTYDFTFSFEKAGEV

SEQ ID NO: 952963 - protein, 20 aa, Mycobacterium
ELSSFQLHWAPSLRPEAGAV

SEQ ID NO: 952964 - protein, 24 aa, Mycobacterium
ELVSYVRGVLYFRTGRWPDVLNQF

SEQ ID NO: 952965 - protein, 23 aa, Mycobacterium
EPGFGVPWLYNYLGQPWKTQRTV

SEQ ID NO: 952966 - protein, 18 aa, Mycobacterium
EPLGFDVKYTWKGSAVGL

SEQ ID NO: 952967 - protein, 21 aa, Mycobacterium
EPLYPQPPLPAPVPMQPAAPP

SEQ ID NO: 952968 - protein, 23 aa, Mycobacterium
EPSFGVPWLYNYIGQPWKTQRTV

SEQ ID NO: 952969 - protein, 23 aa, Mycobacterium
EPVAFYLLKATGLLNRTPPSFAA

SEQ ID NO: 952970 - protein, 17 aa, Mycobacterium
EQFVYAYVRACPGYTLD

SEQ ID NO: 952971 - protein, 21 aa, Mycobacterium
EQLMPHWLLSLQDAARRRGDS

SEQ ID NO: 952972 - protein, 25 aa, Mycobacterium
EQQADCFAGVYLYWVAAGKSPRFTL

SEQ ID NO: 952973 - protein, 24 aa, Mycobacterium
EQRKDWLDLFPFNTTRRPDTYARL

SEQ ID NO: 952974 - protein, 22 aa, Mycobacterium
EQYLWLVPQNVAGLVAALGGRQ

SEQ ID NO: 952975 - protein, 21 aa, Mycobacterium
ESALWLDLTYGGDAPIVLTGA

SEQ ID NO: 952976 - protein, 23 aa, Mycobacterium
ESPLVTLYKRYAVRFGLGYTEET

SEQ ID NO: 952977 - protein, 18 aa, Mycobacterium
ESPLWLVAAAALRRQIDP

SEQ ID NO: 952978 - protein, 30 aa, Mycobacterium
ESPMLRLVVGALLLGLAFAGGYAVSAAKTV

SEQ ID NO: 952979 - protein, 18 aa, Mycobacterium
ETFLTSELPQWLSANRSV

SEQ ID NO: 952980 - protein, 17 aa, Mycobacterium
EVAAFLDLWDRGLAEWR

SEQ ID NO: 952981 - protein, 32 aa, Mycobacterium
EVMRVNFFAPMRMTLALLPRMLARRSGIVVNV

SEQ ID NO: 952982 - protein, 24 aa, Mycobacterium
EVNGQLFIVYGPQVTLVAAPTAER

SEQ ID NO: 952983 - protein, 20 aa, Mycobacterium
EVRGRLTFSWGVESAVLAPT

SEQ ID NO: 952984 - protein, 25 aa, Mycobacterium
EVSCPHFEYALPAYYLILPSEVSSN

SEQ ID NO: 952985 - protein, 25 aa, Mycobacterium
EVSTAIAALFGWHAQTYQSLSAQAT

SEQ ID NO: 952986 - protein, 20 aa, Mycobacterium
EVTIYPTRFGDWLASQAPSN

SEQ ID NO: 952987 - protein, 20 aa, Mycobacterium
EYAELPYFFTDQYDLGMEYA

SEQ ID NO: 952988 - protein, 23 aa, Mycobacterium
EYAQLRAQWGWRLVAAASTLPTP

SEQ ID NO: 952989 - protein, 25 aa, Mycobacterium
EYTNAAQPIWWLVRALEFSQDFQTF

SEQ ID NO: 952990 - protein, 17 aa, Mycobacterium
EYYDLRGILSPIGDTQR

SEQ ID NO: 952991 - protein, 18 aa, Mycobacterium
FAALFAAVALLAGCSSSS

SEQ ID NO: 952992 - protein, 18 aa, Mycobacterium
FAFFEIQLRLPVDGRWVL

SEQ ID NO: 952993 - protein, 26 aa, Mycobacterium
FARTLLVWTAFAAVALLLAGCVRVVA

SEQ ID NO: 952994 - protein, 18 aa, Mycobacterium
FATLLLPAAPAAAEPADP

SEQ ID NO: 952995 - protein, 18 aa, Mycobacterium
FAVELSSFQLHWAPSLRP

SEQ ID NO: 952996 - protein, 20 aa, Mycobacterium
FDCSGLVMWAFQQAGIALPH

SEQ ID NO: 952997 - protein, 23 aa, Mycobacterium
FDCSGLVMWAFQQAGIALPHSSQ

SEQ ID NO: 952998 - protein, 19 aa, Mycobacterium
FDCSGLVMWAYGQQGVSLP

SEQ ID NO: 952999 - protein, 19 aa, Mycobacterium
FDCSGLVMWSFQQAGIALP

SEQ ID NO: 953000 - protein, 25 aa, Mycobacterium
FDEEHLQWLAFPNPLLTPPAQFTAS

SEQ ID NO: 953001 - protein, 21 aa, Mycobacterium
FDFAMLLPPFRGASLAAYDNA

SEQ ID NO: 953002 - protein, 21 aa, Mycobacterium
FDFAMLLPPFRGASLAAYDRD

SEQ ID NO: 953003 - protein, 24 aa, Mycobacterium
FDGPYFVMQWLLRQPRRAILPVAG

SEQ ID NO: 953004 - protein, 20 aa, Mycobacterium
FDGVLGLSLLWVLRGWRRPD

SEQ ID NO: 953005 - protein, 22 aa, Mycobacterium
FDLAQFGWLGDAFPLSSLTQIY

SEQ ID NO: 953006 - protein, 17 aa, Mycobacterium
FDLFAAGLTKPGLRRKM

SEQ ID NO: 953007 - protein, 19 aa, Mycobacterium
FFAPMRMTLALLPRMLARG

SEQ ID NO: 953008 - protein, 19 aa, Mycobacterium
FFNIYFCTVTIKINGPAGS

SEQ ID NO: 953009 - protein, 17 aa, Mycobacterium
FFPLYNLSVVVNSDLLR

SEQ ID NO: 953010 - protein, 18 aa, Mycobacterium
FFQPYRPGATYTATGRGC

SEQ ID NO: 953011 - protein, 23 aa, Mycobacterium
FGDKVLPLYLPTSDGLIGLLSQT

SEQ ID NO: 953012 - protein, 23 aa, Mycobacterium
FGDQPFAVWPWAQPKLGAAQPVV

SEQ ID NO: 953013 - protein, 26 aa, Mycobacterium
FGEPLLAFRIPWYVTVLDLGPAGAVY

SEQ ID NO: 953014 - protein, 17 aa, Mycobacterium
FHDMPTIPLWDYIAVVG

SEQ ID NO: 953015 - protein, 19 aa, Mycobacterium
FHDMPVVPLWNYISVLGWS

SEQ ID NO: 953016 - protein, 17 aa, Mycobacterium
FHRWLDDTYLLPPPATA

SEQ ID NO: 953017 - protein, 17 aa, Mycobacterium
FHVLYSSPPLNAAQAGP

SEQ ID NO: 953018 - protein, 18 aa, Mycobacterium
FIEWSISFSQKPFPPPCD

SEQ ID NO: 953019 - protein, 19 aa, Mycobacterium
FIHVLPLVGDIIHPVIGFP

SEQ ID NO: 953020 - protein, 22 aa, Mycobacterium
FIVNRFLIPWENSCIEALEAGV

SEQ ID NO: 953021 - protein, 20 aa, Mycobacterium
FKALDVTLPMPPRWTPVPDP

SEQ ID NO: 953022 - protein, 17 aa, Mycobacterium
FLAVVLLSAGCSTGGLA

SEQ ID NO: 953023 - protein, 18 aa, Mycobacterium
FLLAAGCSWQLGGRNPLP

SEQ ID NO: 953024 - protein, 23 aa, Mycobacterium
FLLLLWLFIWSVLRILRTDIYAP

SEQ ID NO: 953025 - protein, 17 aa, Mycobacterium
FMLIGAAFYRDEYRRTA

SEQ ID NO: 953026 - protein, 25 aa, Mycobacterium
FNCLAPGMWPAWWLSNDDPGRSGEI

SEQ ID NO: 953027 - protein, 21 aa, Mycobacterium
FNLIDRWWQAPASGLAAIIGA

SEQ ID NO: 953028 - protein, 20 aa, Mycobacterium
FPAIPYRVPYPQSMPGQEST

SEQ ID NO: 953029 - protein, 17 aa, Mycobacterium
FPMGLGLVSQFFGRYFT

SEQ ID NO: 953030 - protein, 17 aa, Mycobacterium
FPNFFMMLGPHSPVGNL

SEQ ID NO: 953031 - protein, 21 aa, Mycobacterium
FQNLHWAFGQLAAVGIATASE

SEQ ID NO: 953032 - protein, 18 aa, Mycobacterium
FSFRWDLGRSRLIMVDSR

SEQ ID NO: 953033 - protein, 20 aa, Mycobacterium
FSHKFAIEYWTLMNAKNAKD

SEQ ID NO: 953034 - protein, 17 aa, Mycobacterium
FSPYTVVAYFRSATAIY

SEQ ID NO: 953035 - protein, 26 aa, Mycobacterium
FSVARRLALLLTLPRFLQVTGPVAMR

SEQ ID NO: 953036 - protein, 21 aa, Mycobacterium
FTAIAATLIVVPWALSGTGDE

SEQ ID NO: 953037 - protein, 18 aa, Mycobacterium
FTDWIIPGNFDIAQFSWV

SEQ ID NO: 953038 - protein, 17 aa, Mycobacterium
FTRFPGITIPWLDITFT

SEQ ID NO: 953039 - protein, 17 aa, Mycobacterium
FTRMLLSLVLTGIAPRS

SEQ ID NO: 953040 - protein, 17 aa, Mycobacterium
FVDNKLAVLALLDTERR

SEQ ID NO: 953041 - protein, 17 aa, Mycobacterium
FVMVAITVLAVVAAGSP

SEQ ID NO: 953042 - protein, 29 aa, Mycobacterium
FVPTRNLPLLQPLRWFGLGFVADALNAPL

SEQ ID NO: 953043 - protein, 26 aa, Mycobacterium
FVSYYRRPIYTAAMAGVLVAPEILTA

SEQ ID NO: 953044 - protein, 17 aa, Mycobacterium
FVVTPDGWELTVSAKDE

SEQ ID NO: 953045 - protein, 25 aa, Mycobacterium
FWGPEWFPQAYPWIPSINPGLHFYI

SEQ ID NO: 953046 - protein, 17 aa, Mycobacterium
FYYYGFASNLLPGPAIQ

SEQ ID NO: 953047 - protein, 18 aa, Mycobacterium
GAAFYRDEYRRTADGWRI

SEQ ID NO: 953048 - protein, 17 aa, Mycobacterium
GAAGLLLAGWAGSMGVA

SEQ ID NO: 953049 - protein, 19 aa, Mycobacterium
GAALAPFGLIPVAQGLATS

SEQ ID NO: 953050 - protein, 23 aa, Mycobacterium
GADALWFLPLFDQSALDLMELKL

SEQ ID NO: 953051 - protein, 19 aa, Mycobacterium
GADRRYVVALSSLDPSGEA

SEQ ID NO: 953052 - protein, 17 aa, Mycobacterium
GAEPFGVWPWARPQLGA

SEQ ID NO: 953053 - protein, 18 aa, Mycobacterium
GAFWLKVIGWSDGRQRIV

SEQ ID NO: 953054 - protein, 20 aa, Mycobacterium
GAGGLLFGKGGAGGAGGVGG

SEQ ID NO: 953055 - protein, 23 aa, Mycobacterium
GAIATLFCGYARDYQNLSTQLAD

SEQ ID NO: 953056 - protein, 19 aa, Mycobacterium
GAITSSWYLTSIQAGFEPW

SEQ ID NO: 953057 - protein, 23 aa, Mycobacterium
GALAAWYVWAALGVYPATPGTPI

SEQ ID NO: 953058 - protein, 17 aa, Mycobacterium
GALFLSAGMGIANAQPR

SEQ ID NO: 953059 - protein, 24 aa, Mycobacterium
GALPIFVVFIYFRAPWTKYVSNLA

SEQ ID NO: 953060 - protein, 19 aa, Mycobacterium
GALTAPLGLIPLVEALGAQ

SEQ ID NO: 953061 - protein, 22 aa, Mycobacterium
GAPALWLPDSSLWLARQMRATG

SEQ ID NO: 953062 - protein, 22 aa, Mycobacterium
GARYRYWHLVLAPGSAAVPLSV

SEQ ID NO: 953063 - protein, 17 aa, Mycobacterium
GATSMKVWFNAKAMWDW

SEQ ID NO: 953064 - protein, 24 aa, Mycobacterium
GCDVQWWFDLPWSYDFVRPQRPID

SEQ ID NO: 953065 - protein, 25 aa, Mycobacterium
GDAPQPPFLWALMAFARRELDTLFA

SEQ ID NO: 953066 - protein, 21 aa, Mycobacterium
GDFFNFYACDLTLKLNGLQPG

SEQ ID NO: 953067 - protein, 24 aa, Mycobacterium
GDPQWAAPPPFAWDYRLFAHPAPV

SEQ ID NO: 953068 - protein, 23 aa, Mycobacterium
GDPRYPYRPPLPQPPPGGPPPGP

SEQ ID NO: 953069 - protein, 22 aa, Mycobacterium
GDQGPWRLPYTHGAPEVNIVYP

SEQ ID NO: 953070 - protein, 23 aa, Mycobacterium
GELGIPHLVLARPAWDPGSAIVV

SEQ ID NO: 953071 - protein, 23 aa, Mycobacterium
GENAQWFYNFSRPGDIVEIRNTG

SEQ ID NO: 953072 - protein, 25 aa, Mycobacterium
GEPARPVWPPLLDAALTAVFDFAGR

SEQ ID NO: 953073 - protein, 23 aa, Mycobacterium
GEPVLGLTWLPFMDLRYTAILGE

SEQ ID NO: 953074 - protein, 21 aa, Mycobacterium
GFDCSGLMLYMFAGVGIKLDH

SEQ ID NO: 953075 - protein, 17 aa, Mycobacterium
GFFTDWIIPGNFDIAQF

SEQ ID NO: 953076 - protein, 19 aa, Mycobacterium
GFGVPWIYNYLGAPWKTQR

SEQ ID NO: 953077 - protein, 19 aa, Mycobacterium
GFHVLYSSPPLNAAQSGPS

SEQ ID NO: 953078 - protein, 24 aa, Mycobacterium
GFLAPLLNWTLYAQNINLIAYGDG

SEQ ID NO: 953079 - protein, 18 aa, Mycobacterium
GFLLAPWTAKTIGAVLDG

SEQ ID NO: 953080 - protein, 24 aa, Mycobacterium
GFNALEITLPMPPRWTPVPDPNVP

SEQ ID NO: 953081 - protein, 18 aa, Mycobacterium
GFPNFFMMLGPHSPVGNL

SEQ ID NO: 953082 - protein, 18 aa, Mycobacterium
GFPVPIRHWLRAGELLEW

SEQ ID NO: 953083 - protein, 20 aa, Mycobacterium
GGAGGWLWGGGGAGGLGGAA

SEQ ID NO: 953084 - protein, 24 aa, Mycobacterium
GGNPAWNLPLVFGPVAMAYNLEGV

SEQ ID NO: 953085 - protein, 23 aa, Mycobacterium
GGSLLLVALFAGSGLVSGCSSVI

SEQ ID NO: 953086 - protein, 18 aa, Mycobacterium
GGTKLSIPDLIRLASQAL

SEQ ID NO: 953087 - protein, 23 aa, Mycobacterium
GGWPFFHMEMMLAGIPIPVPPGG

SEQ ID NO: 953088 - protein, 20 aa, Mycobacterium
GHGQAYQAISAQAAVFHGRF

SEQ ID NO: 953089 - protein, 21 aa, Mycobacterium
GHGQAYQAISAQAAVFHGRFV

SEQ ID NO: 953090 - protein, 17 aa, Mycobacterium
GHQQLFDALFDSTLRRI

SEQ ID NO: 953091 - protein, 20 aa, Mycobacterium
GHSMFPWLTLALVGNATGRI

SEQ ID NO: 953092 - protein, 18 aa, Mycobacterium
GHWFSTGADFKRPSPQWW

SEQ ID NO: 953093 - protein, 25 aa, Mycobacterium
GIDRTYLLHVPPGSPVGLVLSLHGG

SEQ ID NO: 953094 - protein, 23 aa, Mycobacterium
GIETYLRFGYAPFTLVFGRNGWI

SEQ ID NO: 953095 - protein, 18 aa, Mycobacterium
GIRPLFTDKALFGAFSYG

SEQ ID NO: 953096 - protein, 20 aa, Mycobacterium
GIWSMPWMWKAAGTYRVFAD

SEQ ID NO: 953097 - protein, 23 aa, Mycobacterium
GKELYFNLSLWSAYNVMLMRTTL

SEQ ID NO: 953098 - protein, 23 aa, Mycobacterium
GKELYFNLSLWSAYNVMLMRTVL

SEQ ID NO: 953099 - protein, 25 aa, Mycobacterium
GKGKDRWFIVWLGTAASPVDKGVAK

SEQ ID NO: 953100 - protein, 23 aa, Mycobacterium
GLDARAYRLPWPKGTVVYEVDMP

SEQ ID NO: 953101 - protein, 24 aa, Mycobacterium
GLDEYGYIPLPSSFQSKLIPVVNA

SEQ ID NO: 953102 - protein, 23 aa, Mycobacterium
GLDSRAYRLPWPAGTTLFEVDQP

SEQ ID NO: 953103 - protein, 23 aa, Mycobacterium
GLDTRPYRLWWPPGTTVFEIDRP

SEQ ID NO: 953104 - protein, 17 aa, Mycobacterium
GLFYAWLAQALASKGYL

SEQ ID NO: 953105 - protein, 21 aa, Mycobacterium
GLGWHLLPQLAGGAPLLASVL

SEQ ID NO: 953106 - protein, 22 aa, Mycobacterium
GLLAACAPWRPPSARPPPPDTL

SEQ ID NO: 953107 - protein, 19 aa, Mycobacterium
GLLNLFTFGLLGSSGHRST

SEQ ID NO: 953108 - protein, 20 aa, Mycobacterium
GLLVPIHWGTFRLAPHPWAE

SEQ ID NO: 953109 - protein, 34 aa, Mycobacterium
GLPLRAMVMVLLFLGVIFLLLGWQALGSSGSSDD

SEQ ID NO: 953110 - protein, 18 aa, Mycobacterium
GLTYRFTFTFEKAGEVTV

SEQ ID NO: 953111 - protein, 19 aa, Mycobacterium
GMRIVLHFPYSANVHCEID

SEQ ID NO: 953112 - protein, 25 aa, Mycobacterium
GNAEQYLWWVPHNVAGLVTALGGRK

SEQ ID NO: 953113 - protein, 20 aa, Mycobacterium
GNAGLIFGFGGAGGTGGSGI

SEQ ID NO: 953114 - protein, 26 aa, Mycobacterium
GNALYSPRYWPFLTSGLLGLERGTDA

SEQ ID NO: 953115 - protein, 22 aa, Mycobacterium
GNVAAWRFLAPLSAFLEGLTVG

SEQ ID NO: 953116 - protein, 24 aa, Mycobacterium
GNVDLAFFGPFAYVVAGVNGAKMT

SEQ ID NO: 953117 - protein, 21 aa, Mycobacterium
GPAHISYFDPAPLFSVVDPAR

SEQ ID NO: 953118 - protein, 18 aa, Mycobacterium
GPALAKYILFATPDDMNG

SEQ ID NO: 953119 - protein, 21 aa, Mycobacterium
GPAPWWYRPVGALFDQFLGAA

SEQ ID NO: 953120 - protein, 27 aa, Mycobacterium
GPDAFDCSGLIKWAFLQNGKSLPRSSQ

SEQ ID NO: 953121 - protein, 27 aa, Mycobacterium
GPDQPPLRALLDLLPIAAGSGTLGDRF

SEQ ID NO: 953122 - protein, 23 aa, Mycobacterium
GPDRRFVMVIGALQPTDATTARE

SEQ ID NO: 953123 - protein, 22 aa, Mycobacterium
GPIWFLLLFLIPAGVSYAVARY

SEQ ID NO: 953124 - protein, 17 aa, Mycobacterium
GPKLNIYYTLDAKSLPL

SEQ ID NO: 953125 - protein, 30 aa, Mycobacterium
GPLQILRVAVPSFLLLFLVACGGSGRVSHP

SEQ ID NO: 953126 - protein, 17 aa, Mycobacterium
GPPGFVVTPDGWELTVS

SEQ ID NO: 953127 - protein, 25 aa, Mycobacterium
GPPPPPNVVLIPGLPPITIPGAPPP

SEQ ID NO: 953128 - protein, 26 aa, Mycobacterium
GPTPTRLIYFQHGFMAAGPFYSFTAA

SEQ ID NO: 953129 - protein, 17 aa, Mycobacterium
GPWARRLGIATLAALLL

SEQ ID NO: 953130 - protein, 19 aa, Mycobacterium
GQFPVPAKLWTIADLGGWD

SEQ ID NO: 953131 - protein, 23 aa, Mycobacterium
GQKWTGFHRLEKDLWVTGLQPDT

SEQ ID NO: 953132 - protein, 22 aa, Mycobacterium
GQNYYLWYDLGTKKFTVVSWDL

SEQ ID NO: 953133 - protein, 19 aa, Mycobacterium
GRALSMLNDPFLVGGLPAT

SEQ ID NO: 953134 - protein, 24 aa, Mycobacterium
GRPVVLNLWAYWCGPCADELPAMA

SEQ ID NO: 953135 - protein, 20 aa, Mycobacterium
GRQLVVRLLFYDAQSTRQFG

SEQ ID NO: 953136 - protein, 23 aa, Mycobacterium
GRSLVLLLAVVLLLLGLACGLPV

SEQ ID NO: 953137 - protein, 21 aa, Mycobacterium
GRWVRLALAALLLVTLGVGIY

SEQ ID NO: 953138 - protein, 19 aa, Mycobacterium
GRYSVYVWALLAMAAARLG

SEQ ID NO: 953139 - protein, 25 aa, Mycobacterium
GSEVQWWFDLPWSHGFVRPQRPIEM

SEQ ID NO: 953140 - protein, 22 aa, Mycobacterium
GSPPDPAWWYLVPARETIKNPV

SEQ ID NO: 953141 - protein, 22 aa, Mycobacterium
GSRIEVLLRQQEDPRWTCSHAM

SEQ ID NO: 953142 - protein, 19 aa, Mycobacterium
GSYIFLGPGFYPGSPSGGS

SEQ ID NO: 953143 - protein, 19 aa, Mycobacterium
GTSMWDVPALLAHYGVDAK

SEQ ID NO: 953144 - protein, 27 aa, Mycobacterium
GVAEFNYFFGWLIPPVALTTPTETLAF

SEQ ID NO: 953145 - protein, 28 aa, Mycobacterium
GVERDGPTLFLPLTSLRGLRRHSKKRSG

SEQ ID NO: 953146 - protein, 21 aa, Mycobacterium
GVGPIFWAADLLGLTPTGVIQ

SEQ ID NO: 953147 - protein, 22 aa, Mycobacterium
GVHLLDLLTYISGGRILVDECQ

SEQ ID NO: 953148 - protein, 21 aa, Mycobacterium
GVIFLLLGWQALDSSGKAVDD

SEQ ID NO: 953149 - protein, 21 aa, Mycobacterium
GVIFLLLGWQALGSSGKSDDD

SEQ ID NO: 953150 - protein, 21 aa, Mycobacterium
GVIFLLLGWQALGTSGSSDDD

SEQ ID NO: 953151 - protein, 18 aa, Mycobacterium
GVITDRGRWYLVGHDRDR

SEQ ID NO: 953152 - protein, 17 aa, Mycobacterium
GVIWLQHGFLGNKSFVS

SEQ ID NO: 953153 - protein, 20 aa, Mycobacterium
GVKPGRLYTARQLLDGLLLV

SEQ ID NO: 953154 - protein, 17 aa, Mycobacterium
GVWPWARPQLGAAQPVV

SEQ ID NO: 953155 - protein, 19 aa, Mycobacterium
GWKTFFRGLANDGVQGPSV

SEQ ID NO: 953156 - protein, 18 aa, Mycobacterium
GWLVYATLLREVSGSTTA

SEQ ID NO: 953157 - protein, 21 aa, Mycobacterium
GWWAQWFTLPADAGPIVLAFN

SEQ ID NO: 953158 - protein, 17 aa, Mycobacterium
GYHLALCDGMKPWTLQS

SEQ ID NO: 953159 - protein, 17 aa, Mycobacterium
HDICWWPKNPLPEDVPH

SEQ ID NO: 953160 - protein, 18 aa, Mycobacterium
HGAAGLLNLFTFGLLGSS

SEQ ID NO: 953161 - protein, 22 aa, Mycobacterium
HGLLGWLQFVPILGSFLNPGGG

SEQ ID NO: 953162 - protein, 17 aa, Mycobacterium
HGRSGFLLAPWTAKTIG

SEQ ID NO: 953163 - protein, 18 aa, Mycobacterium
HGVQLWVNLPKRDKLAPP

SEQ ID NO: 953164 - protein, 18 aa, Mycobacterium
HHPLIQVMLAWQSPAPAD

SEQ ID NO: 953165 - protein, 17 aa, Mycobacterium
HIPFGDPALTCLCGARG

SEQ ID NO: 953166 - protein, 19 aa, Mycobacterium
HLRGHFLLTRNAAAYWRAK

SEQ ID NO: 953167 - protein, 17 aa, Mycobacterium
HPHLVARDRWRTVATPK

SEQ ID NO: 953168 - protein, 19 aa, Mycobacterium
HSMFPWLTLALVGSATSRI

SEQ ID NO: 953169 - protein, 20 aa, Mycobacterium
HSRQLLAAQLIWTLSRAGVA

SEQ ID NO: 953170 - protein, 23 aa, Mycobacterium
HSRQLLAAQLIWTLSRSGINGPY

SEQ ID NO: 953171 - protein, 18 aa, Mycobacterium
HTVLLFSTSSSFNSLPLA

SEQ ID NO: 953172 - protein, 25 aa, Mycobacterium
HYAEIGLLGFALIADALGGVDVCLK

SEQ ID NO: 953173 - protein, 25 aa, Mycobacterium
HYLVPAEKLPLVRLFPSLANREAEL

SEQ ID NO: 953174 - protein, 25 aa, Mycobacterium
HYPTARLVVFLLRGNFDPADVARRG

SEQ ID NO: 953175 - protein, 21 aa, Mycobacterium
IAAALPMVTWLQTASTQAKTR

SEQ ID NO: 953176 - protein, 17 aa, Mycobacterium
IAAAQPYLAWLTYTSEA

SEQ ID NO: 953177 - protein, 18 aa, Mycobacterium
IAALVLLASLTTGASTAH

SEQ ID NO: 953178 - protein, 17 aa, Mycobacterium
IAAPMFHAWGFSQLLFA

SEQ ID NO: 953179 - protein, 18 aa, Mycobacterium
IAGRWQLIAFAAPLLGVL

SEQ ID NO: 953180 - protein, 20 aa, Mycobacterium
IAIALVLFMGVPRAAADDNP

SEQ ID NO: 953181 - protein, 22 aa, Mycobacterium
IAKLWNTIWDLKPGLDLKNFPS

SEQ ID NO: 953182 - protein, 20 aa, Mycobacterium
IALFGLFAAAIPAAAAPAAG

SEQ ID NO: 953183 - protein, 18 aa, Mycobacterium
IALLATPAAILSGCSNQS

SEQ ID NO: 953184 - protein, 17 aa, Mycobacterium
IAPMRPDRYLRMGLAMR

SEQ ID NO: 953185 - protein, 18 aa, Mycobacterium
IATVVGAGWWYLGAGEDT

SEQ ID NO: 953186 - protein, 22 aa, Mycobacterium
IDAYPRVVWIAGGMLKGASVED

SEQ ID NO: 953187 - protein, 17 aa, Mycobacterium
IDTFTGWLKQWNQPLMP

SEQ ID NO: 953188 - protein, 20 aa, Mycobacterium
IFMGWLFTLLGRPKVEGLEH

SEQ ID NO: 953189 - protein, 21 aa, Mycobacterium
IGDILHPVFGFPIDHNAPPGT

SEQ ID NO: 953190 - protein, 22 aa, Mycobacterium
IGDPRLRIFHASRLHLVSFNDD

SEQ ID NO: 953191 - protein, 20 aa, Mycobacterium
IGGWLFGWLADRTGSLAAPM

SEQ ID NO: 953192 - protein, 22 aa, Mycobacterium
IGLSLFVVFAIGVTTLVYGTLR

SEQ ID NO: 953193 - protein, 18 aa, Mycobacterium
IGRVFPRRLLLGDHVIHE

SEQ ID NO: 953194 - protein, 23 aa, Mycobacterium
IHDSFVRMLHFGAGSYAATEAIN

SEQ ID NO: 953195 - protein, 19 aa, Mycobacterium
IHHNPLLTPLALPLIPLIL

SEQ ID NO: 953196 - protein, 18 aa, Mycobacterium
IHWCIYASQLPAEIAARK

SEQ ID NO: 953197 - protein, 19 aa, Mycobacterium
IITLWLGLVAHFGEMANGG

SEQ ID NO: 953198 - protein, 18 aa, Mycobacterium
IITRGLIATLLGLPSGAP

SEQ ID NO: 953199 - protein, 26 aa, Mycobacterium
IKLTREKWLLPLLYELGWGRPEVVGG

SEQ ID NO: 953200 - protein, 18 aa, Mycobacterium
ILALWAAVAGAFVSVLYR

SEQ ID NO: 953201 - protein, 19 aa, Mycobacterium
ILGSRYLELVPDGPGSIPG

SEQ ID NO: 953202 - protein, 19 aa, Mycobacterium
ILNNLLFSANLGAAMSALE

SEQ ID NO: 953203 - protein, 17 aa, Mycobacterium
ILRQAYPVPQAPYGLAG

SEQ ID NO: 953204 - protein, 24 aa, Mycobacterium
ILTVLALRDGIIPPTRNLNNLDPE

SEQ ID NO: 953205 - protein, 18 aa, Mycobacterium
ILVRPFDIDAVPKAFRGD

SEQ ID NO: 953206 - protein, 18 aa, Mycobacterium
ILWADMPTLPLYRQQRTL

SEQ ID NO: 953207 - protein, 24 aa, Mycobacterium
ILWNDLPTLPLYRQPRVLIAPKSM

SEQ ID NO: 953208 - protein, 17 aa, Mycobacterium
IMALIVVLLANATLTQV

SEQ ID NO: 953209 - protein, 17 aa, Mycobacterium
INFAWITAVVAGLTLAV

SEQ ID NO: 953210 - protein, 17 aa, Mycobacterium
INLAWITAMVTGLLVAV

SEQ ID NO: 953211 - protein, 19 aa, Mycobacterium
IPFSILGVYPWPTPTDEGV

SEQ ID NO: 953212 - protein, 21 aa, Mycobacterium
IPLPDHIGVLNFTPGNIGSLN

SEQ ID NO: 953213 - protein, 17 aa, Mycobacterium
IPLQVYLVGRDLEPIGG

SEQ ID NO: 953214 - protein, 26 aa, Mycobacterium
IPNLFTIQFFQWFIDYAFGFRAHGAP

SEQ ID NO: 953215 - protein, 18 aa, Mycobacterium
IPSLPWVPADRAWLPDLV

SEQ ID NO: 953216 - protein, 17 aa, Mycobacterium
IPVRLHARSWHRYAEPP

SEQ ID NO: 953217 - protein, 29 aa, Mycobacterium
IQAFTYDYGRIPWLPINLVEPYDAGGEVP

SEQ ID NO: 953218 - protein, 22 aa, Mycobacterium
IQAMYTPRYWKYLTSGLSGLAD

SEQ ID NO: 953219 - protein, 17 aa, Mycobacterium
IQLPIPPGWEPAGPQTP

SEQ ID NO: 953220 - protein, 18 aa, Mycobacterium
IQNLLHAVARFFRLAQPD

SEQ ID NO: 953221 - protein, 25 aa, Mycobacterium
IRASQNLIPRLFWTTYQGGREEILP

SEQ ID NO: 953222 - protein, 26 aa, Mycobacterium
IRATLWRKFMLISSYGGVGVLCRQPV

SEQ ID NO: 953223 - protein, 19 aa, Mycobacterium
IRRAMLRLSWRPLVNRFIE

SEQ ID NO: 953224 - protein, 17 aa, Mycobacterium
ISALVLPSAFRPVPDPA

SEQ ID NO: 953225 - protein, 21 aa, Mycobacterium
ISSAVAVMFGNHAQAYQAVSA

SEQ ID NO: 953226 - protein, 17 aa, Mycobacterium
ISTFPQLQVLPLALPIA

SEQ ID NO: 953227 - protein, 23 aa, Mycobacterium
ISTLSGMYWWGPASAAMLAATGP

SEQ ID NO: 953228 - protein, 20 aa, Mycobacterium
ITLSVPFYRVNPDTFTAAEL

SEQ ID NO: 953229 - protein, 17 aa, Mycobacterium
ITTACFLVIAYLSGVRT

SEQ ID NO: 953230 - protein, 19 aa, Mycobacterium
IVFSLVLAPVAWNAGAPAV

SEQ ID NO: 953231 - protein, 17 aa, Mycobacterium
IVILPLAGATVAAVRAF

SEQ ID NO: 953232 - protein, 17 aa, Mycobacterium
IVIPLPDHIGVLNFTPG

SEQ ID NO: 953233 - protein, 17 aa, Mycobacterium
IVLVIGAIAFAVYSSSR

SEQ ID NO: 953234 - protein, 20 aa, Mycobacterium
IWARYNVPWQPAYVFYRADG

SEQ ID NO: 953235 - protein, 22 aa, Mycobacterium
KADPGLLRWLEDPEIGGVELKG

SEQ ID NO: 953236 - protein, 24 aa, Mycobacterium
KAPYGRIPGLPPLAADWYRGDGPM

SEQ ID NO: 953237 - protein, 23 aa, Mycobacterium
KGGGTLPITLYIVDVKAAGTSTT

SEQ ID NO: 953238 - protein, 18 aa, Mycobacterium
KGPFGLVLRLYWPKPDAL

SEQ ID NO: 953239 - protein, 28 aa, Mycobacterium
KHDAFMLGAYFIWQYGPPGWIEDLNPWL

SEQ ID NO: 953240 - protein, 19 aa, Mycobacterium
KHIAWYLHGFPAGSELRRA

SEQ ID NO: 953241 - protein, 25 aa, Mycobacterium
KKAAVLAGALPWLKKLHGTIVVIKY

SEQ ID NO: 953242 - protein, 21 aa, Mycobacterium
KLAVILALWAAVVAAFVSVIY

SEQ ID NO: 953243 - protein, 24 aa, Mycobacterium
KLGIFSLVLLTFTALIFVVFGQIR

SEQ ID NO: 953244 - protein, 21 aa, Mycobacterium
KNAIDWLSRPFGDGALKGKPL

SEQ ID NO: 953245 - protein, 23 aa, Mycobacterium
KNIALYLNFDMLASPNPGYFTYD

SEQ ID NO: 953246 - protein, 24 aa, Mycobacterium
KNIALYLNFDMLASPNPGYFTYDG

SEQ ID NO: 953247 - protein, 23 aa, Mycobacterium
KPINPFYPLIALNYPKIGIHFHE

SEQ ID NO: 953248 - protein, 21 aa, Mycobacterium
KPMVYYPLSTLILAGIRDVLV

SEQ ID NO: 953249 - protein, 19 aa, Mycobacterium
KQCDVIMAQLYIKPEREKV

SEQ ID NO: 953250 - protein, 24 aa, Mycobacterium
KSIALYLNFDMLASPNPGYFTYDG

SEQ ID NO: 953251 - protein, 24 aa, Mycobacterium
KSPGNTWIPLVYPAAARQSSITQG

SEQ ID NO: 953252 - protein, 24 aa, Mycobacterium
KSVDLLNRFLGLGLRFISAGTDVG

SEQ ID NO: 953253 - protein, 18 aa, Mycobacterium
KTIPVIRVIGYRAGLPPA

SEQ ID NO: 953254 - protein, 24 aa, Mycobacterium
KTTPPVEGAFYWLNNREVRWRPAE

SEQ ID NO: 953255 - protein, 18 aa, Mycobacterium
KVFTPFFDAWRQHGWRPP

SEQ ID NO: 953256 - protein, 22 aa, Mycobacterium
KVGIFTMVMLLVAAGLVVVFGE

SEQ ID NO: 953257 - protein, 17 aa, Mycobacterium
KVIGWSDGRQRIVIDHI

SEQ ID NO: 953258 - protein, 20 aa, Mycobacterium
KVLANPLLTQNFFKLIQGGT

SEQ ID NO: 953259 - protein, 21 aa, Mycobacterium
KWMVNPVFINPLPVSPPYRCA

SEQ ID NO: 953260 - protein, 17 aa, Mycobacterium
LAAFAVGIVAPATLAAC

SEQ ID NO: 953261 - protein, 17 aa, Mycobacterium
LAAGAITLWLGLVGNVG

SEQ ID NO: 953262 - protein, 17 aa, Mycobacterium
LAAIVALLALAIGVAIG

SEQ ID NO: 953263 - protein, 18 aa, Mycobacterium
LAAQIIWTLARADIRGPY

SEQ ID NO: 953264 - protein, 18 aa, Mycobacterium
LAAQLIWTLSRAGVAGPY

SEQ ID NO: 953265 - protein, 24 aa, Mycobacterium
LADEGLVQIFPKLGSFVARIDPER

SEQ ID NO: 953266 - protein, 28 aa, Mycobacterium
LAGHWIKLLLHYLFIYKAKARPFWWLIP

SEQ ID NO: 953267 - protein, 25 aa, Mycobacterium
LAGKPAVLWFWTPWCPFCNAEAPSV

SEQ ID NO: 953268 - protein, 21 aa, Mycobacterium
LAHLTWLLPLLEIIAKTQLRR

SEQ ID NO: 953269 - protein, 22 aa, Mycobacterium
LAIMALLLVLVGQSFRGAFDPK

SEQ ID NO: 953270 - protein, 18 aa, Mycobacterium
LAKGWLTPLLRTGRRSPG

SEQ ID NO: 953271 - protein, 18 aa, Mycobacterium
LALARVWARPLWLAVGRS

SEQ ID NO: 953272 - protein, 17 aa, Mycobacterium
LALLVALAVFVAYQTIS

SEQ ID NO: 953273 - protein, 20 aa, Mycobacterium
LALSAWWPMPFAHAARVTLI

SEQ ID NO: 953274 - protein, 20 aa, Mycobacterium
LAPTHTLFLAGRPSPRLDAV

SEQ ID NO: 953275 - protein, 20 aa, Mycobacterium
LAQRFFLMAARGIRPTWAMN

SEQ ID NO: 953276 - protein, 23 aa, Mycobacterium
LARMLLIWTAIASVALVLTGCIR

SEQ ID NO: 953277 - protein, 17 aa, Mycobacterium
LATVASVLLLAAGVTAC

SEQ ID NO: 953278 - protein, 17 aa, Mycobacterium
LAVLLVGLLAAGVVVLL

SEQ ID NO: 953279 - protein, 18 aa, Mycobacterium
LAVPVTVSILPWAASIAG

SEQ ID NO: 953280 - protein, 19 aa, Mycobacterium
LDDWAWTLGINLWGPIHGC

SEQ ID NO: 953281 - protein, 20 aa, Mycobacterium
LDIPVLPVGVTYTGGAAGGY

SEQ ID NO: 953282 - protein, 17 aa, Mycobacterium
LDPRYPPVSGRPPLPLG

SEQ ID NO: 953283 - protein, 24 aa, Mycobacterium
LDRVTLFRAWYSRRNFGRLAGSAQ

SEQ ID NO: 953284 - protein, 18 aa, Mycobacterium
LEILRSWPSVHKWGNATW

SEQ ID NO: 953285 - protein, 18 aa, Mycobacterium
LFDLIQKYPFWTDDGGLS

SEQ ID NO: 953286 - protein, 17 aa, Mycobacterium
LFETHFFGTVALIKAVL

SEQ ID NO: 953287 - protein, 20 aa, Mycobacterium
LFGAVALTLALLPALRSARG

SEQ ID NO: 953288 - protein, 27 aa, Mycobacterium
LFGEPLLALRIPWYVTVLDLGPAGAVY

SEQ ID NO: 953289 - protein, 18 aa, Mycobacterium
LFHAQFVQLLNSGASAYT

SEQ ID NO: 953290 - protein, 21 aa, Mycobacterium
LFIEHVYFWGDPLIDELFGQD

SEQ ID NO: 953291 - protein, 21 aa, Mycobacterium
LFSRLMMLRPDWTRTVLARRV

SEQ ID NO: 953292 - protein, 17 aa, Mycobacterium
LGAFVVFVAVVALVFGD

SEQ ID NO: 953293 - protein, 20 aa, Mycobacterium
LGATIDWYRANESWWRPLKD

SEQ ID NO: 953294 - protein, 25 aa, Mycobacterium
LGEPLLALRIPWYVTVLDLGPAGAV

SEQ ID NO: 953295 - protein, 22 aa, Mycobacterium
LGGTTVRYLVPAETLPLVQSNP

SEQ ID NO: 953296 - protein, 22 aa, Mycobacterium
LGKEYQPMYFPPERARPGDSRR

SEQ ID NO: 953297 - protein, 18 aa, Mycobacterium
LGLAWITLAVAALLVVVS

SEQ ID NO: 953298 - protein, 18 aa, Mycobacterium
LGLTWPADHDLPLTTMGR

SEQ ID NO: 953299 - protein, 26 aa, Mycobacterium
LGLVNAPTQALLGRPLIGNGANGAPG

SEQ ID NO: 953300 - protein, 19 aa, Mycobacterium
LGRAGPLQVLQSPVALVGS

SEQ ID NO: 953301 - protein, 17 aa, Mycobacterium
LGRFLVLEWLQRLEPVD

SEQ ID NO: 953302 - protein, 17 aa, Mycobacterium
LGRLRPLFRTGLGARLG

SEQ ID NO: 953303 - protein, 17 aa, Mycobacterium
LGRYMVVVTVSPIAVGK

SEQ ID NO: 953304 - protein, 17 aa, Mycobacterium
LGTCAFWPVPPTSKPHT

SEQ ID NO: 953305 - protein, 17 aa, Mycobacterium
LGVLPRPDPLPQGCIGA

SEQ ID NO: 953306 - protein, 19 aa, Mycobacterium
LGYVRTIRAVLPHLLARGG

SEQ ID NO: 953307 - protein, 18 aa, Mycobacterium
LHLILVRSDGQHFAHVHP

SEQ ID NO: 953308 - protein, 22 aa, Mycobacterium
LHVGGPLPLDPVLPAPAPAPAP

SEQ ID NO: 953309 - protein, 20 aa, Mycobacterium
LIFSVERYRAVMDAYLAGME

SEQ ID NO: 953310 - protein, 18 aa, Mycobacterium
LIGRLKPLFSFGLGARLG

SEQ ID NO: 953311 - protein, 25 aa, Mycobacterium
LKDIALYLNFDMLGSPNPGYFTYDG

SEQ ID NO: 953312 - protein, 24 aa, Mycobacterium
LKGKPVVLWFWAAYCPFCNGEGPH

SEQ ID NO: 953313 - protein, 25 aa, Mycobacterium
LKNIALYLNFDMLASPNPGYFTYDG

SEQ ID NO: 953314 - protein, 23 aa, Mycobacterium
LKNIALYLNYDMLGSPNAAYLTY

SEQ ID NO: 953315 - protein, 18 aa, Mycobacterium
LKPDIDLKRFPSSGPYRL

SEQ ID NO: 953316 - protein, 32 aa, Mycobacterium
LKVFNPLMYFNFNYFPIPINPILAPAFDLQNV

SEQ ID NO: 953317 - protein, 17 aa, Mycobacterium
LKYTWTWGEGRDFGYDT

SEQ ID NO: 953318 - protein, 22 aa, Mycobacterium
LLALICVLPIALAPWPARAFVI

SEQ ID NO: 953319 - protein, 18 aa, Mycobacterium
LLATYPFPKETIGKWARG

SEQ ID NO: 953320 - protein, 18 aa, Mycobacterium
LLGLVLVVLIIVVGLQPQ

SEQ ID NO: 953321 - protein, 27 aa, Mycobacterium
LLGLVNAPTQALLGRPLIGNGANGTAA

SEQ ID NO: 953322 - protein, 17 aa, Mycobacterium
LLIFSLLAVTALGIMVF

SEQ ID NO: 953323 - protein, 18 aa, Mycobacterium
LLISGAALGLMASAGACS

SEQ ID NO: 953324 - protein, 17 aa, Mycobacterium
LLIVGLAACAGYLQWRS

SEQ ID NO: 953325 - protein, 18 aa, Mycobacterium
LLLFPVFGGGGMLVMRLS

SEQ ID NO: 953326 - protein, 17 aa, Mycobacterium
LLLVALVATLVVVGGSA

SEQ ID NO: 953327 - protein, 17 aa, Mycobacterium
LLMLGFPANRIIVEDRA

SEQ ID NO: 953328 - protein, 28 aa, Mycobacterium
LLQAINAPTQTLLGRPLIGDGAAGTATN

SEQ ID NO: 953329 - protein, 20 aa, Mycobacterium
LLRIAYRLIVLFVVEDRDLL

SEQ ID NO: 953330 - protein, 17 aa, Mycobacterium
LLRVFLLGELPPEQARE

SEQ ID NO: 953331 - protein, 25 aa, Mycobacterium
LLTAWALTLGLAIALLSGASVAAAD

SEQ ID NO: 953332 - protein, 20 aa, Mycobacterium
LLTIHLPEDVPLAPAQWGPD

SEQ ID NO: 953333 - protein, 17 aa, Mycobacterium
LLVAHAVSLISIELEKP

SEQ ID NO: 953334 - protein, 19 aa, Mycobacterium
LLVGLALAGGYAVSASKTV

SEQ ID NO: 953335 - protein, 20 aa, Mycobacterium
LLVPIHWATFRLAPHPWAEP

SEQ ID NO: 953336 - protein, 20 aa, Mycobacterium
LLVPIHWGTFRLAPHPWAEP

SEQ ID NO: 953337 - protein, 18 aa, Mycobacterium
LLVVLVIFAIVVVAKSVA

SEQ ID NO: 953338 - protein, 20 aa, Mycobacterium
LMRKVILLAAAGLATATMSA

SEQ ID NO: 953339 - protein, 29 aa, Mycobacterium
LNAYTPHILTFFNTLPPVINWLADDIYLP

SEQ ID NO: 953340 - protein, 24 aa, Mycobacterium
LNGPFFLSRAALPHLLQAGGNIVN

SEQ ID NO: 953341 - protein, 25 aa, Mycobacterium
LNLPGFPFQFLLYKQIAAENAALVA

SEQ ID NO: 953342 - protein, 20 aa, Mycobacterium
LNSPVDFRFLPDGRILVAEK

SEQ ID NO: 953343 - protein, 20 aa, Mycobacterium
LPADAWLIDLGIQPLRDLPR

SEQ ID NO: 953344 - protein, 17 aa, Mycobacterium
LPFSWRGVSLHAAGAAG

SEQ ID NO: 953345 - protein, 17 aa, Mycobacterium
LPGWIREAQFEAGNDDA

SEQ ID NO: 953346 - protein, 18 aa, Mycobacterium
LPLNPFISKSIDPARVLY

SEQ ID NO: 953347 - protein, 30 aa, Mycobacterium
LPLRAMVMVLLFLGVVFLLVGFQALGSDDD

SEQ ID NO: 953348 - protein, 21 aa, Mycobacterium
LPLVFGPIALVYHLADVPALV

SEQ ID NO: 953349 - protein, 22 aa, Mycobacterium
LPPLYRTRLPIPIRLAPVASDA

SEQ ID NO: 953350 - protein, 17 aa, Mycobacterium
LPVILVHGTWGSTAREF

SEQ ID NO: 953351 - protein, 17 aa, Mycobacterium
LPVPLWWAKICDAWWCT

SEQ ID NO: 953352 - protein, 18 aa, Mycobacterium
LPVTPPPPAAPWLPQSQP

SEQ ID NO: 953353 - protein, 20 aa, Mycobacterium
LQARILPILKHHYANFIAEV

SEQ ID NO: 953354 - protein, 24 aa, Mycobacterium
LQDFFGRLSGFWDWYKANPDEVTQ

SEQ ID NO: 953355 - protein, 17 aa, Mycobacterium
LQFKFGAPIPPGPPPAD

SEQ ID NO: 953356 - protein, 24 aa, Mycobacterium
LQGKPAVLWFWTPWCPFCNAEAPG

SEQ ID NO: 953357 - protein, 25 aa, Mycobacterium
LQGKPAVLWFWTPWCPFCNAEGPAA

SEQ ID NO: 953358 - protein, 25 aa, Mycobacterium
LQGKPAVLWFWTPWCPYCNAEAPGV

SEQ ID NO: 953359 - protein, 18 aa, Mycobacterium
LQGYLAVDSLWLYLSNGN

SEQ ID NO: 953360 - protein, 20 aa, Mycobacterium
LQIPLLERGILQRLLRSRTI

SEQ ID NO: 953361 - protein, 18 aa, Mycobacterium
LQLLGLLQSRRVWSGDEL

SEQ ID NO: 953362 - protein, 20 aa, Mycobacterium
LRAMFELNFFAVLSVTRAVL

SEQ ID NO: 953363 - protein, 31 aa, Mycobacterium
LRDDAIIVVPAWWKAFWYLERLSPALSMRAA

SEQ ID NO: 953364 - protein, 17 aa, Mycobacterium
LRFSFRWDLGRSRLIMV

SEQ ID NO: 953365 - protein, 17 aa, Mycobacterium
LRLLLTTGLAAAVVATA

SEQ ID NO: 953366 - protein, 21 aa, Mycobacterium
LRPFRNLVYAMPPYICPPAEI

SEQ ID NO: 953367 - protein, 18 aa, Mycobacterium
LRRNIVVAMTPWLHRVGL

SEQ ID NO: 953368 - protein, 26 aa, Mycobacterium
LRVANPLLLFNFNYLPIPLNPIMAAS

SEQ ID NO: 953369 - protein, 23 aa, Mycobacterium
LRWRPVVALALIVAVLAGCGGGA

SEQ ID NO: 953370 - protein, 23 aa, Mycobacterium
LSAAGYVPLPNAFKERLLTSIDA

SEQ ID NO: 953371 - protein, 19 aa, Mycobacterium
LSARWMPMPFLADREALTL

SEQ ID NO: 953372 - protein, 24 aa, Mycobacterium
LSEPAPWQWLVELWRGISPHLGTF

SEQ ID NO: 953373 - protein, 26 aa, Mycobacterium
LSGLSGWIGWGFIHIAFLTGVRNRFS

SEQ ID NO: 953374 - protein, 22 aa, Mycobacterium
LSGRVLTLIDLIAAPSVRLPAK

SEQ ID NO: 953375 - protein, 20 aa, Mycobacterium
LSLVFLLVVSVTYLLVGVLH

SEQ ID NO: 953376 - protein, 24 aa, Mycobacterium
LSVFMVIALAMTWLVYATLRREVA

SEQ ID NO: 953377 - protein, 23 aa, Mycobacterium
LTGRFDFALVALKAPYLQAALGP

SEQ ID NO: 953378 - protein, 18 aa, Mycobacterium
LTGWQTWLAAADRNTWGL

SEQ ID NO: 953379 - protein, 24 aa, Mycobacterium
LTLALVALLLFGVAAWLGIPTTPH

SEQ ID NO: 953380 - protein, 19 aa, Mycobacterium
LTLPRFLPVMGPVGMHSAV

SEQ ID NO: 953381 - protein, 27 aa, Mycobacterium
LTLVALVVLALFYLRLPTWAGLGMYKL

SEQ ID NO: 953382 - protein, 28 aa, Mycobacterium
LTRSLGFLGTFPFPAETLSKWIRGDYAN

SEQ ID NO: 953383 - protein, 25 aa, Mycobacterium
LTRSLSLLATFPFPNETFQNFQRGD

SEQ ID NO: 953384 - protein, 19 aa, Mycobacterium
LTSILTYHVVPGQLGPDMV

SEQ ID NO: 953385 - protein, 21 aa, Mycobacterium
LTSLDYYHAFLGLLGNDDVKG

SEQ ID NO: 953386 - protein, 26 aa, Mycobacterium
LTSRAWKVLAATLLAGSLIVSGCGTR

SEQ ID NO: 953387 - protein, 23 aa, Mycobacterium
LTTLVYYHAFLGLLGPDDVKGQR

SEQ ID NO: 953388 - protein, 17 aa, Mycobacterium
LVAIYKRFQEMATLTTF

SEQ ID NO: 953389 - protein, 18 aa, Mycobacterium
LVIGPPWPTAEVPDWVLQ

SEQ ID NO: 953390 - protein, 18 aa, Mycobacterium
LVISQWCRLPSGADPRSY

SEQ ID NO: 953391 - protein, 22 aa, Mycobacterium
LVIVVPPGHKWARRGRVVTARE

SEQ ID NO: 953392 - protein, 24 aa, Mycobacterium
LVKDLHLPWQWGARWFLDQLTDGD

SEQ ID NO: 953393 - protein, 18 aa, Mycobacterium
LVLEWLQRLEPVDGKLVC

SEQ ID NO: 953394 - protein, 20 aa, Mycobacterium
LVLGVYYLRIPSLAGIGRYT

SEQ ID NO: 953395 - protein, 18 aa, Mycobacterium
LVLRLYWPKPDALNGTWT

SEQ ID NO: 953396 - protein, 17 aa, Mycobacterium
LVMGLLLTPVSGLVRIG

SEQ ID NO: 953397 - protein, 28 aa, Mycobacterium
LVNVVNRPTQALLGRPLIGNGSDAASGS

SEQ ID NO: 953398 - protein, 21 aa, Mycobacterium
LVPEYIGNLLLYFAPDSEATT

SEQ ID NO: 953399 - protein, 24 aa, Mycobacterium
LVPEYIGNLLLYFDPHATVTLLDA

SEQ ID NO: 953400 - protein, 25 aa, Mycobacterium
LVRASRLDWLILRLGGVMSSTFSVD

SEQ ID NO: 953401 - protein, 24 aa, Mycobacterium
LVRWRHPVWGLLLPDSFIGVAEST

SEQ ID NO: 953402 - protein, 27 aa, Mycobacterium
LVSNEEELLWLTLDAGSDRAKTDSSSA

SEQ ID NO: 953403 - protein, 18 aa, Mycobacterium
LVSQFFGKYFSPAEARQL

SEQ ID NO: 953404 - protein, 17 aa, Mycobacterium
LVVPRWVLLSGVGWHTF

SEQ ID NO: 953405 - protein, 18 aa, Mycobacterium
LVVSHILHLLLTGKLRSG

SEQ ID NO: 953406 - protein, 17 aa, Mycobacterium
LWNDVPTLPLYRQQRTV

SEQ ID NO: 953407 - protein, 17 aa, Mycobacterium
LWYVDLAPITIPEVAPV

SEQ ID NO: 953408 - protein, 24 aa, Mycobacterium
LYADFRLLFLILHASRFAPRLDEH

SEQ ID NO: 953409 - protein, 26 aa, Mycobacterium
MAFAYLRLPSLLFGVGRYQVTMKLQD

SEQ ID NO: 953410 - protein, 20 aa, Mycobacterium
MAPTLIFDTSGPDRRLYAVA

SEQ ID NO: 953411 - protein, 22 aa, Mycobacterium
MAVPGFPNMFLIYGPNTNLGSS

SEQ ID NO: 953412 - protein, 17 aa, Mycobacterium
MCWAYANADGKWMVNPV

SEQ ID NO: 953413 - protein, 17 aa, Mycobacterium
MDPKLLSPAPLPPGVTV

SEQ ID NO: 953414 - protein, 18 aa, Mycobacterium
MEGLWWDRPFALDSVDIS

SEQ ID NO: 953415 - protein, 24 aa, Mycobacterium
MESAYAAVLLWKATVEKANSFAVP

SEQ ID NO: 953416 - protein, 19 aa, Mycobacterium
MGLLAAGTILVGCSDDKPQ

SEQ ID NO: 953417 - protein, 17 aa, Mycobacterium
MGRNFLVKLGILSPATA

SEQ ID NO: 953418 - protein, 17 aa, Mycobacterium
MGVAVLDAPWAPFVVDF

SEQ ID NO: 953419 - protein, 21 aa, Mycobacterium
MGVIHVIWRQGFYPGIGAPSW

SEQ ID NO: 953420 - protein, 28 aa, Mycobacterium
MHAHRLALLWPEMYPRLLRIMDADPIYQ

SEQ ID NO: 953421 - protein, 24 aa, Mycobacterium
MKEPPPFLRGVFTAVIMALGLGQE

SEQ ID NO: 953422 - protein, 26 aa, Mycobacterium
MKYMQRWPFRFFAERKWFTIAESIEL

SEQ ID NO: 953423 - protein, 17 aa, Mycobacterium
MMFLTRALRRRLGRDVH

SEQ ID NO: 953424 - protein, 23 aa, Mycobacterium
MQLVIFLTLTLVALVVLALFYLR

SEQ ID NO: 953425 - protein, 20 aa, Mycobacterium
MQVLAATNWLGFNTPAIMDI

SEQ ID NO: 953426 - protein, 18 aa, Mycobacterium
MTSPYWLYIVTSSELQAP

SEQ ID NO: 953427 - protein, 21 aa, Mycobacterium
MVITVLSWRLDLDRLAATAQR

SEQ ID NO: 953428 - protein, 17 aa, Mycobacterium
MVVLTLWEPGADKPVLV

SEQ ID NO: 953429 - protein, 17 aa, Mycobacterium
MYVDVPPLAPLLLARNY

SEQ ID NO: 953430 - protein, 20 aa, Mycobacterium
NAAPLPWSFTISTTLPSVSA

SEQ ID NO: 953431 - protein, 22 aa, Mycobacterium
NAIEQFVYAYIRACPGYTLDYN

SEQ ID NO: 953432 - protein, 20 aa, Mycobacterium
NALYRKWLSVLGPAPAPPSA

SEQ ID NO: 953433 - protein, 26 aa, Mycobacterium
NAMWALSIPIPFIKPVGAGAGGYFAP

SEQ ID NO: 953434 - protein, 20 aa, Mycobacterium
NAVPLIVNLYTFGAKDFDVH

SEQ ID NO: 953435 - protein, 19 aa, Mycobacterium
NDLVALVISNLFGQNTPAI

SEQ ID NO: 953436 - protein, 20 aa, Mycobacterium
NFKALDITLPVPARWTQVPD

SEQ ID NO: 953437 - protein, 17 aa, Mycobacterium
NGILPYREFFGPNVAGT

SEQ ID NO: 953438 - protein, 19 aa, Mycobacterium
NGLKFMYYELLKKDGESAT

SEQ ID NO: 953439 - protein, 18 aa, Mycobacterium
NIYYTLDAKSLPLLEPTY

SEQ ID NO: 953440 - protein, 24 aa, Mycobacterium
NLINAPTQALFGRPLIGNGADGAP

SEQ ID NO: 953441 - protein, 24 aa, Mycobacterium
NLKVIAPWFQINDFSWISPPGRQL

SEQ ID NO: 953442 - protein, 24 aa, Mycobacterium
NLPPNYLMFFRVLGGLIGIAAQLD

SEQ ID NO: 953443 - protein, 17 aa, Mycobacterium
NNRWWITCMVAFQTSYG

SEQ ID NO: 953444 - protein, 21 aa, Mycobacterium
NPGQYLVPPISTFGTREQAAS

SEQ ID NO: 953445 - protein, 22 aa, Mycobacterium
NPKWWGPRPRLDNITYLVLDDA

SEQ ID NO: 953446 - protein, 21 aa, Mycobacterium
NPLNPQFLPKDQRPIPTGTAL

SEQ ID NO: 953447 - protein, 25 aa, Mycobacterium
NPNSWINGPFTYIGPLLSGSRESQL

SEQ ID NO: 953448 - protein, 24 aa, Mycobacterium
NQVSLLWTYLGYPVANSVVLDLVA

SEQ ID NO: 953449 - protein, 18 aa, Mycobacterium
NREVRWRPEHFWKPGTAV

SEQ ID NO: 953450 - protein, 19 aa, Mycobacterium
NREVRWRPEHFWKSGTAID

SEQ ID NO: 953451 - protein, 25 aa, Mycobacterium
NRRSRFPHRWWWVALTDEAFPRLAV

SEQ ID NO: 953452 - protein, 19 aa, Mycobacterium
NSGWLYTWALGIPKSSDKP

SEQ ID NO: 953453 - protein, 25 aa, Mycobacterium
NSRNKLPAWLFIQWATGKESMNKAV

SEQ ID NO: 953454 - protein, 24 aa, Mycobacterium
NSSGTFISGFFNAGTFTPGLLETF

SEQ ID NO: 953455 - protein, 23 aa, Mycobacterium
NTLYRKWLTVLGPAPAPPVARYT

SEQ ID NO: 953456 - protein, 19 aa, Mycobacterium
NVFLPWEKRYPVYEKLESE

SEQ ID NO: 953457 - protein, 20 aa, Mycobacterium
NVVPLIVNLYMFGGKDFDVG

SEQ ID NO: 953458 - protein, 18 aa, Mycobacterium
NVVPLIVNLYTFGARDFD

SEQ ID NO: 953459 - protein, 17 aa, Mycobacterium
NYLPFPVNPLLTPIPSD

SEQ ID NO: 953460 - protein, 22 aa, Mycobacterium
PADARVFDFPLPKGITPEGGLQ

SEQ ID NO: 953461 - protein, 24 aa, Mycobacterium
PAEELRMLPMLLLAFGRHLSRGRQ

SEQ ID NO: 953462 - protein, 21 aa, Mycobacterium
PAHSWWLGPSTVLAAFSAFNT

SEQ ID NO: 953463 - protein, 20 aa, Mycobacterium
PAIHRFPFTLTFKEPLPIPV

SEQ ID NO: 953464 - protein, 17 aa, Mycobacterium
PAKPGLILFRRAGAPAA

SEQ ID NO: 953465 - protein, 23 aa, Mycobacterium
PALRLMNFNYLPMPFNAYLGPAP

SEQ ID NO: 953466 - protein, 30 aa, Mycobacterium
PALRVFNPLLLFNWNYLPIPINPILASSAD

SEQ ID NO: 953467 - protein, 18 aa, Mycobacterium
PAPLVPLYLRRPDAKPLA

SEQ ID NO: 953468 - protein, 17 aa, Mycobacterium
PAPVDMLAAPMPAPEGL

SEQ ID NO: 953469 - protein, 20 aa, Mycobacterium
PASHHLRWLASANALLDIPE

SEQ ID NO: 953470 - protein, 25 aa, Mycobacterium
PATPNALYGAILPSTSPGSVTSTGS

SEQ ID NO: 953471 - protein, 23 aa, Mycobacterium
PAVWANPFRWYPVATSTADAITL

SEQ ID NO: 953472 - protein, 23 aa, Mycobacterium
PAVWLNPWRWYAVPHAAAGALTV

SEQ ID NO: 953473 - protein, 19 aa, Mycobacterium
PAVYDWLMPIPAPSPDARA

SEQ ID NO: 953474 - protein, 21 aa, Mycobacterium
PDFGVPWLYNYIGQPWKTQET

SEQ ID NO: 953475 - protein, 23 aa, Mycobacterium
PDLNLALLWTSAFPYGPTFADRV

SEQ ID NO: 953476 - protein, 24 aa, Mycobacterium
PDLRGYIWLVRNLSKRGWVVAITD

SEQ ID NO: 953477 - protein, 25 aa, Mycobacterium
PDRSKGVVILLFTEGRALATLQFDG

SEQ ID NO: 953478 - protein, 17 aa, Mycobacterium
PDSSLWLARQMRATGAA

SEQ ID NO: 953479 - protein, 17 aa, Mycobacterium
PDTYRVMLRQGLYGNYF

SEQ ID NO: 953480 - protein, 19 aa, Mycobacterium
PDVRLYWDQAVYKKPFSPL

SEQ ID NO: 953481 - protein, 24 aa, Mycobacterium
PEEHLPLVLPFKYLGVPKDTLMEL

SEQ ID NO: 953482 - protein, 20 aa, Mycobacterium
PEPALRLVAVARLRLLCRAA

SEQ ID NO: 953483 - protein, 24 aa, Mycobacterium
PESFAQVLLGWQQWLRTADRNNWA

SEQ ID NO: 953484 - protein, 20 aa, Mycobacterium
PEVYQFVVLFPAPDQANAFF

SEQ ID NO: 953485 - protein, 27 aa, Mycobacterium
PFNTGNYPFLLGPIYISNSPTGGGQTI

SEQ ID NO: 953486 - protein, 20 aa, Mycobacterium
PFPVNPLLTPIPSDSKLIYS

SEQ ID NO: 953487 - protein, 18 aa, Mycobacterium
PFRSPWLNPQVSASTKFI

SEQ ID NO: 953488 - protein, 17 aa, Mycobacterium
PFSLQFVKPLDVPVERF

SEQ ID NO: 953489 - protein, 18 aa, Mycobacterium
PFTYLRPGTALGADGKLG

SEQ ID NO: 953490 - protein, 19 aa, Mycobacterium
PFVAILGFPFIPQAMRDRY

SEQ ID NO: 953491 - protein, 17 aa, Mycobacterium
PFYVWDFADRFKEDVID

SEQ ID NO: 953492 - protein, 23 aa, Mycobacterium
PGAYTYILGFWMRPRRVLDAAGT

SEQ ID NO: 953493 - protein, 19 aa, Mycobacterium
PGDWLYFVTIDAQGTTLFT

SEQ ID NO: 953494 - protein, 23 aa, Mycobacterium
PGEYAELPYFFTDQYDLGMEYAG

SEQ ID NO: 953495 - protein, 23 aa, Mycobacterium
PGEYAELPYFFTDQYDLGMEYVG

SEQ ID NO: 953496 - protein, 21 aa, Mycobacterium
PGFGVPWLYNYIGQPWKTQRT

SEQ ID NO: 953497 - protein, 17 aa, Mycobacterium
PGSGVYALFSNGTNLAS

SEQ ID NO: 953498 - protein, 23 aa, Mycobacterium
PGTALFVLDPWLRQVPIGVVGEI

SEQ ID NO: 953499 - protein, 18 aa, Mycobacterium
PGVEVLAGFFWGQDRYRY

SEQ ID NO: 953500 - protein, 19 aa, Mycobacterium
PILVPVWILVLVAALAGCA

SEQ ID NO: 953501 - protein, 24 aa, Mycobacterium
PIRNAALLRVFLLGHLPPGQARKY

SEQ ID NO: 953502 - protein, 24 aa, Mycobacterium
PKGPFTLVLRLYWPKPDALNGTWQ

SEQ ID NO: 953503 - protein, 24 aa, Mycobacterium
PKVHSLALFQPLSGRYLDIITNRV

SEQ ID NO: 953504 - protein, 25 aa, Mycobacterium
PKVHSLGLFQPLPGRYLDIITNRVT

SEQ ID NO: 953505 - protein, 17 aa, Mycobacterium
PKYPYWFNSMALNDDAA

SEQ ID NO: 953506 - protein, 23 aa, Mycobacterium
PLAPLTTLRIGPIARRLVTCTNS

SEQ ID NO: 953507 - protein, 17 aa, Mycobacterium
PLIVNLYTFGARDFDVK

SEQ ID NO: 953508 - protein, 17 aa, Mycobacterium
PLMLPGFAVRAALGEFA

SEQ ID NO: 953509 - protein, 20 aa, Mycobacterium
PLPAPLPIDGLQAPGLPAVQ

SEQ ID NO: 953510 - protein, 24 aa, Mycobacterium
PLPIQYIDFALWQRAYLGDPQDPD

SEQ ID NO: 953511 - protein, 17 aa, Mycobacterium
PLVTLYRQYVVRFGLGY

SEQ ID NO: 953512 - protein, 17 aa, Mycobacterium
PLWFLPLLDQDAVDMLE

SEQ ID NO: 953513 - protein, 18 aa, Mycobacterium
PLYAIAAGAAVGALLTAC

SEQ ID NO: 953514 - protein, 20 aa, Mycobacterium
PMFHAWGFSQLLFAALLACP

SEQ ID NO: 953515 - protein, 19 aa, Mycobacterium
PMMLLPSIPTMVWGGNVRL

SEQ ID NO: 953516 - protein, 17 aa, Mycobacterium
PMNFAANDLAWSATNPS

SEQ ID NO: 953517 - protein, 19 aa, Mycobacterium
PMVDGFAISLTLPAGQYQL

SEQ ID NO: 953518 - protein, 25 aa, Mycobacterium
PNQARALFVLRAAGLIALKGGRVTP

SEQ ID NO: 953519 - protein, 21 aa, Mycobacterium
PNRLYWLSAWIDPAGTNGGPL

SEQ ID NO: 953520 - protein, 23 aa, Mycobacterium
PPAKPALILFRRAGAPAALADSV

SEQ ID NO: 953521 - protein, 20 aa, Mycobacterium
PPPPPPLPAVPFPKECPAPG

SEQ ID NO: 953522 - protein, 25 aa, Mycobacterium
PPPPPPLPWELPPPPPPPAPDAPPP

SEQ ID NO: 953523 - protein, 24 aa, Mycobacterium
PPVNNAVRFAFWGAGLTGAMDYVF

SEQ ID NO: 953524 - protein, 29 aa, Mycobacterium
PPYKLAGIAALILALMAGALVYGQFRGDL

SEQ ID NO: 953525 - protein, 17 aa, Mycobacterium
PQDDPLNPLTFPKALLL

SEQ ID NO: 953526 - protein, 23 aa, Mycobacterium
PQGHLLVFWDCYRPHDVQVKMFE

SEQ ID NO: 953527 - protein, 24 aa, Mycobacterium
PQGHLLVFWDCYRPHDVQVKMFSL

SEQ ID NO: 953528 - protein, 21 aa, Mycobacterium
PQRLIYLQHGYLGIGPMYSYT

SEQ ID NO: 953529 - protein, 23 aa, Mycobacterium
PRIDAVLPMFLEFAGDAVLVAHN

SEQ ID NO: 953530 - protein, 25 aa, Mycobacterium
PRLNGLGYWFWGLVVRRIFGRAPIR

SEQ ID NO: 953531 - protein, 18 aa, Mycobacterium
PRLWPDLPVRPVKGEVLR

SEQ ID NO: 953532 - protein, 24 aa, Mycobacterium
PRRVRRLFMVLGGLVSLVGLVVSA

SEQ ID NO: 953533 - protein, 18 aa, Mycobacterium
PRWRLGILATVLATTACS

SEQ ID NO: 953534 - protein, 21 aa, Mycobacterium
PSALFRPHLLRRMAKAGMTRG

SEQ ID NO: 953535 - protein, 30 aa, Mycobacterium
PSPMLRFVVGGLLVVLAFAGGFAVSACKTV

SEQ ID NO: 953536 - protein, 26 aa, Mycobacterium
PSQPPLLWVVLAWVRRELQRTFANST

SEQ ID NO: 953537 - protein, 18 aa, Mycobacterium
PSVRFNPILLKPGSDRTS

SEQ ID NO: 953538 - protein, 18 aa, Mycobacterium
PSVRFNPVLLKPGSDRTS

SEQ ID NO: 953539 - protein, 19 aa, Mycobacterium
PSVRFNPVLLKPGSDRTSQ

SEQ ID NO: 953540 - protein, 30 aa, Mycobacterium
PTARAVVLPQWLFSVLLTPAIRLTNGAANW

SEQ ID NO: 953541 - protein, 26 aa, Mycobacterium
PTGKFNLMLRLYWPKETPPSIIDGTW

SEQ ID NO: 953542 - protein, 17 aa, Mycobacterium
PTPLMLPGFAVRAALGE

SEQ ID NO: 953543 - protein, 19 aa, Mycobacterium
PTQSLLGRPLIGNGSNATA

SEQ ID NO: 953544 - protein, 18 aa, Mycobacterium
PTQTLLGRPLIGTGADGA

SEQ ID NO: 953545 - protein, 25 aa, Mycobacterium
PTWSRGAPPQWWLATPISLNTAGIN

SEQ ID NO: 953546 - protein, 20 aa, Mycobacterium
PVAITVAPLRWDLVRDGAPA

SEQ ID NO: 953547 - protein, 17 aa, Mycobacterium
PVDMLAAPMPAPEGLPP

SEQ ID NO: 953548 - protein, 21 aa, Mycobacterium
PVEFDRVLGMLDRLASSLQGD

SEQ ID NO: 953549 - protein, 21 aa, Mycobacterium
PVIFLMLTAAVPAIPAAAAPL

SEQ ID NO: 953550 - protein, 20 aa, Mycobacterium
PVLARPLIQLGLPVAAAGWL

SEQ ID NO: 953551 - protein, 28 aa, Mycobacterium
PVPAGWYSEPWWKPALVAGAWGLGSALL

SEQ ID NO: 953552 - protein, 20 aa, Mycobacterium
PVPRPAAVPVLWLGAGERVS

SEQ ID NO: 953553 - protein, 19 aa, Mycobacterium
PVRNAALLRVFLLGQLDPS

SEQ ID NO: 953554 - protein, 25 aa, Mycobacterium
PVRTEAWLGYFMLRIAPGVNRRMMQ

SEQ ID NO: 953555 - protein, 19 aa, Mycobacterium
PVTNAVRFAFWGDGINGAM

SEQ ID NO: 953556 - protein, 21 aa, Mycobacterium
PVVLNLWAYWCGPCADELPAM

SEQ ID NO: 953557 - protein, 17 aa, Mycobacterium
PVYDKPMVYYPLSTLIL

SEQ ID NO: 953558 - protein, 17 aa, Mycobacterium
PWNPLPCAGGGIGPFGG

SEQ ID NO: 953559 - protein, 21 aa, Mycobacterium
PYPAWRELFNNLLPAHIVKDV

SEQ ID NO: 953560 - protein, 18 aa, Mycobacterium
QAASLFDWGFALSPQASI

SEQ ID NO: 953561 - protein, 18 aa, Mycobacterium
QADCFAGVYLYWVAEGKS

SEQ ID NO: 953562 - protein, 24 aa, Mycobacterium
QAGSPFQIAQLAEAFLKAGRCTAE

SEQ ID NO: 953563 - protein, 25 aa, Mycobacterium
QAISAQAAVFHGRFVAALNAAADSY

SEQ ID NO: 953564 - protein, 17 aa, Mycobacterium
QALQRTPWRCFFDFRNK

SEQ ID NO: 953565 - protein, 22 aa, Mycobacterium
QAPLLPIHWATFNLALHPWAEP

SEQ ID NO: 953566 - protein, 20 aa, Mycobacterium
QATAHFGWLGGFFAVDANLG

SEQ ID NO: 953567 - protein, 20 aa, Mycobacterium
QAWDLPTVFGPIAVTYHLTG

SEQ ID NO: 953568 - protein, 22 aa, Mycobacterium
QAWNDLALPWFRGINSVIGVQR

SEQ ID NO: 953569 - protein, 23 aa, Mycobacterium
QDAAWLVTTWRLVRPYAIATDPH

SEQ ID NO: 953570 - protein, 17 aa, Mycobacterium
QDYTPIDQLPYVGPILP

SEQ ID NO: 953571 - protein, 19 aa, Mycobacterium
QFAFLGSNLPLLLKGLART

SEQ ID NO: 953572 - protein, 17 aa, Mycobacterium
QFFGKYFSPAEARQLIA

SEQ ID NO: 953573 - protein, 20 aa, Mycobacterium
QGLALLMVALVLSSCGWRGI

SEQ ID NO: 953574 - protein, 24 aa, Mycobacterium
QGLYWSLSIGNPWWETIHYGRHQS

SEQ ID NO: 953575 - protein, 17 aa, Mycobacterium
QGRVDVWAVWDPYTAQA

SEQ ID NO: 953576 - protein, 20 aa, Mycobacterium
QGTAIMVWTLMNVKNPKLNL

SEQ ID NO: 953577 - protein, 19 aa, Mycobacterium
QIELMCWAYANADGKWMVN

SEQ ID NO: 953578 - protein, 23 aa, Mycobacterium
QINFFYYLFEPMVQSGLFNTLDW

SEQ ID NO: 953579 - protein, 17 aa, Mycobacterium
QIRRGMYFFWPRSDAHL

SEQ ID NO: 953580 - protein, 17 aa, Mycobacterium
QLAAVIGPLFRSALRSA

SEQ ID NO: 953581 - protein, 19 aa, Mycobacterium
QLFQRLQLIYLFTTGHRKS

SEQ ID NO: 953582 - protein, 17 aa, Mycobacterium
QLIADLIPRRPTAITVV

SEQ ID NO: 953583 - protein, 18 aa, Mycobacterium
QLRAVGRLLGWRLGMDDV

SEQ ID NO: 953584 - protein, 18 aa, Mycobacterium
QLRTVGRLLGWRLGIDGV

SEQ ID NO: 953585 - protein, 17 aa, Mycobacterium
QMQSWLKQWGNPPMGDH

SEQ ID NO: 953586 - protein, 22 aa, Mycobacterium
QPALRPLLDLLPIAGGSGTLGE

SEQ ID NO: 953587 - protein, 22 aa, Mycobacterium
QPALRPLVDLLPIAGGSGTLSN

SEQ ID NO: 953588 - protein, 28 aa, Mycobacterium
QPDGSLVLWDWWPMPFANSTRVTLVNTT

SEQ ID NO: 953589 - protein, 19 aa, Mycobacterium
QPRFARGALLAFAGLTAFS

SEQ ID NO: 953590 - protein, 24 aa, Mycobacterium
QPSLRALLDLLPIAAGSGTLGDRF

SEQ ID NO: 953591 - protein, 26 aa, Mycobacterium
QPTQVRITFWFDAKYPVPADAKAVIL

SEQ ID NO: 953592 - protein, 24 aa, Mycobacterium
QPWTWPLYQLLMPTVTNPAVPNPT

SEQ ID NO: 953593 - protein, 21 aa, Mycobacterium
QPWVVSFQLNWPQFRSSTAAG

SEQ ID NO: 953594 - protein, 22 aa, Mycobacterium
QQGWKTFFRGLANDGVQGPAVA

SEQ ID NO: 953595 - protein, 24 aa, Mycobacterium
QQGYRTWWWGKWHLGDWSDTNPEG

SEQ ID NO: 953596 - protein, 17 aa, Mycobacterium
QQIKDAFNAYIDAAHSV

SEQ ID NO: 953597 - protein, 23 aa, Mycobacterium
QQLLLTFPFPNFGIKQAVRGDYL

SEQ ID NO: 953598 - protein, 23 aa, Mycobacterium
QREDIPIHYLLADTFTICDGYFC

SEQ ID NO: 953599 - protein, 32 aa, Mycobacterium
QRILLRDMPAVPLWYYIAVVGWSPQVSGVKLT

SEQ ID NO: 953600 - protein, 22 aa, Mycobacterium
QRIRWVIGLFLGLQLVLASTLA

SEQ ID NO: 953601 - protein, 25 aa, Mycobacterium
QRIVLTRNPKWWGTPPLLDSMTYTV

SEQ ID NO: 953602 - protein, 19 aa, Mycobacterium
QRSSALLRVFLLSAVPSEE

SEQ ID NO: 953603 - protein, 23 aa, Mycobacterium
QRTPERWFVVWLGTANNPIDKDA

SEQ ID NO: 953604 - protein, 24 aa, Mycobacterium
QRTPERWFVVWLGTATNPVPQGEA

SEQ ID NO: 953605 - protein, 24 aa, Mycobacterium
QSDQGMFMVNWPYVLAAARSAAEE

SEQ ID NO: 953606 - protein, 22 aa, Mycobacterium
QSPPAWWRPAGALFDQFLGAAE

SEQ ID NO: 953607 - protein, 21 aa, Mycobacterium
QSVDLVPYRTLVTAAPVAVML

SEQ ID NO: 953608 - protein, 17 aa, Mycobacterium
QSWLKQWGNPPMGDHEG

SEQ ID NO: 953609 - protein, 20 aa, Mycobacterium
QTAAALFGVWWIGAEAVLEP

SEQ ID NO: 953610 - protein, 19 aa, Mycobacterium
QTAAVLLGVWWIGAEVVLD

SEQ ID NO: 953611 - protein, 24 aa, Mycobacterium
QTPNFWGYWLYFKTPGGWSCGLAP

SEQ ID NO: 953612 - protein, 21 aa, Mycobacterium
QTTMEALWWDRPFTLDGVDIG

SEQ ID NO: 953613 - protein, 24 aa, Mycobacterium
QTVDLWATNLPKLLPAGVQQTLIP

SEQ ID NO: 953614 - protein, 19 aa, Mycobacterium
QTVFYHNGSPFLWDRGREL

SEQ ID NO: 953615 - protein, 19 aa, Mycobacterium
QVEYGFPICFPSIEVLTIG

SEQ ID NO: 953616 - protein, 17 aa, Mycobacterium
QVVPWQSVLKGLPGLAS

SEQ ID NO: 953617 - protein, 18 aa, Mycobacterium
QWLSFPSPLLTPPSNFTA

SEQ ID NO: 953618 - protein, 26 aa, Mycobacterium
QWVRWRKPVIGLPLTARLVAPGRVLA

SEQ ID NO: 953619 - protein, 21 aa, Mycobacterium
QWYGYFMRRLAERPANLGFFL

SEQ ID NO: 953620 - protein, 20 aa, Mycobacterium
QWYGYFMRRLAERPANLTFF

SEQ ID NO: 953621 - protein, 18 aa, Mycobacterium
QYPVPAKLWTVADLGGWE

SEQ ID NO: 953622 - protein, 18 aa, Mycobacterium
QYRRAFAMAIPTFALPDI

SEQ ID NO: 953623 - protein, 19 aa, Mycobacterium
QYWVLKPTYHNSYWFYSCM

SEQ ID NO: 953624 - protein, 19 aa, Mycobacterium
QYYMFMTKDLPLLDPLRAI

SEQ ID NO: 953625 - protein, 19 aa, Mycobacterium
RAEFPWLGVALQAYLRRTP

SEQ ID NO: 953626 - protein, 17 aa, Mycobacterium
RAGLFFGVGGTGGNGGA

SEQ ID NO: 953627 - protein, 17 aa, Mycobacterium
RALAILKSQGIKAFFGG

SEQ ID NO: 953628 - protein, 17 aa, Mycobacterium
RALPALLIFVVTACTSP

SEQ ID NO: 953629 - protein, 19 aa, Mycobacterium
RAPLRPDFYHRIGSVTKTF

SEQ ID NO: 953630 - protein, 17 aa, Mycobacterium
RARLTFGALLAVPTLLL

SEQ ID NO: 953631 - protein, 18 aa, Mycobacterium
RARMSSMLWTFKVEKSDG

SEQ ID NO: 953632 - protein, 17 aa, Mycobacterium
RARMSSMLWTFKVQKDN

SEQ ID NO: 953633 - protein, 23 aa, Mycobacterium
RARSPFWKSLAVFWLALSVAACS

SEQ ID NO: 953634 - protein, 23 aa, Mycobacterium
RARTLLIWTSVAAVALLVAGCAR

SEQ ID NO: 953635 - protein, 19 aa, Mycobacterium
RAVGRLLGWRLGIAEVDPK

SEQ ID NO: 953636 - protein, 26 aa, Mycobacterium
RCGSPVWNLPLVFGPIAIAYRVNGLT

SEQ ID NO: 953637 - protein, 17 aa, Mycobacterium
RCRVLLVALVAAAAALT

SEQ ID NO: 953638 - protein, 24 aa, Mycobacterium
RDKFPRAVLPRTFDYGFATGLMTK

SEQ ID NO: 953639 - protein, 18 aa, Mycobacterium
RDVLKLIPVMWDNVPPPG

SEQ ID NO: 953640 - protein, 25 aa, Mycobacterium
REAHPTMWIRLWFSDGEKLHQRAYT

SEQ ID NO: 953641 - protein, 24 aa, Mycobacterium
RERGYAYFLYPPHAPLTETAYDRL

SEQ ID NO: 953642 - protein, 17 aa, Mycobacterium
REVRWRPEHFWKSGTSV

SEQ ID NO: 953643 - protein, 25 aa, Mycobacterium
RFAPLRWSVLRLALAFRTLLRTGQV

SEQ ID NO: 953644 - protein, 23 aa, Mycobacterium
RFGLLWFGFWSTLFDMPGLPADH

SEQ ID NO: 953645 - protein, 20 aa, Mycobacterium
RFGLWFRNIAMRTMNIGPLA

SEQ ID NO: 953646 - protein, 21 aa, Mycobacterium
RFLVAGLILAGWAGSAGVAAA

SEQ ID NO: 953647 - protein, 20 aa, Mycobacterium
RFMLTDPIYGLGPRVAQLVA

SEQ ID NO: 953648 - protein, 21 aa, Mycobacterium
RGAPPTLFSPGYFKQLTVPVA

SEQ ID NO: 953649 - protein, 18 aa, Mycobacterium
RGAPVDFPLNGVVPGFQK

SEQ ID NO: 953650 - protein, 25 aa, Mycobacterium
RGDARWPWRLPLRLAWVHAELAMVS

SEQ ID NO: 953651 - protein, 21 aa, Mycobacterium
RGINLTGWLNSGSGNIGLFNS

SEQ ID NO: 953652 - protein, 18 aa, Mycobacterium
RGLLAQKFPTVPPDVISA

SEQ ID NO: 953653 - protein, 18 aa, Mycobacterium
RGPSTWYFGAGELDVWEV

SEQ ID NO: 953654 - protein, 19 aa, Mycobacterium
RGTVFYTGLVMWIGCHADS

SEQ ID NO: 953655 - protein, 29 aa, Mycobacterium
RHLPFYGRWYRFLLLWPGADKGLDAARTD

SEQ ID NO: 953656 - protein, 17 aa, Mycobacterium
RHTPPHAWYIAFAPAQA

SEQ ID NO: 953657 - protein, 18 aa, Mycobacterium
RHTPPHAWYIAFAPAQAP

SEQ ID NO: 953658 - protein, 23 aa, Mycobacterium
RIERGLWLTALLRATLTVVRGAA

SEQ ID NO: 953659 - protein, 17 aa, Mycobacterium
RILFCAKEATYKAWYPL

SEQ ID NO: 953660 - protein, 18 aa, Mycobacterium
RIRALAVLSVLFLSTLPV

SEQ ID NO: 953661 - protein, 22 aa, Mycobacterium
RKDTVIVLPMQKLTVALAADNP

SEQ ID NO: 953662 - protein, 17 aa, Mycobacterium
RKRFRLINFAWITTVVT

SEQ ID NO: 953663 - protein, 17 aa, Mycobacterium
RLCAVLGVVLLAGCSVS

SEQ ID NO: 953664 - protein, 18 aa, Mycobacterium
RLHVLAAASLRKAFTEIG

SEQ ID NO: 953665 - protein, 17 aa, Mycobacterium
RLLELFELFDPADPAVI

SEQ ID NO: 953666 - protein, 19 aa, Mycobacterium
RLLIFAFLGVTAAVGVDLM

SEQ ID NO: 953667 - protein, 18 aa, Mycobacterium
RLLTRTRIALRRPGEVFA

SEQ ID NO: 953668 - protein, 23 aa, Mycobacterium
RLRRPQFTFPARGILTSGFGARW

SEQ ID NO: 953669 - protein, 27 aa, Mycobacterium
RLRTVLLTALLIVALGLLLTRCPSNRD

SEQ ID NO: 953670 - protein, 17 aa, Mycobacterium
RLTHLWYRDNPPMFPFL

SEQ ID NO: 953671 - protein, 18 aa, Mycobacterium
RLVNFGNLPFPINPYLRP

SEQ ID NO: 953672 - protein, 18 aa, Mycobacterium
RLWADWDFNIRCFSNPAL

SEQ ID NO: 953673 - protein, 17 aa, Mycobacterium
RLYTARQLLDGLLLVSG

SEQ ID NO: 953674 - protein, 23 aa, Mycobacterium
RNPEQLLLLFDPLPNTGIVEIQG

SEQ ID NO: 953675 - protein, 17 aa, Mycobacterium
RNRVLSAAQLRSALPRG

SEQ ID NO: 953676 - protein, 17 aa, Mycobacterium
RNSMDDAWFRDLAFVQG

SEQ ID NO: 953677 - protein, 19 aa, Mycobacterium
RPDWTRTVLARRVAAGGLV

SEQ ID NO: 953678 - protein, 24 aa, Mycobacterium
RPEAYLVYLLRRLSPTLLYAFSNL

SEQ ID NO: 953679 - protein, 18 aa, Mycobacterium
RPIAPLLDALRGLGVRID

SEQ ID NO: 953680 - protein, 21 aa, Mycobacterium
RPKRLLIGTLLALALIGALTA

SEQ ID NO: 953681 - protein, 27 aa, Mycobacterium
RPLISNMIRLLRLPIAVQRRVAAGVLS

SEQ ID NO: 953682 - protein, 17 aa, Mycobacterium
RPLLLCGAVVLAAACTR

SEQ ID NO: 953683 - protein, 23 aa, Mycobacterium
RPNLLIKIPATMAGLPAISAVIA

SEQ ID NO: 953684 - protein, 24 aa, Mycobacterium
RPQGHVLVFWDCYRPHEAQVKMFN

SEQ ID NO: 953685 - protein, 17 aa, Mycobacterium
RPWLPIAHVFDRMAFIV

SEQ ID NO: 953686 - protein, 23 aa, Mycobacterium
RQGVQLLFPLPLGISMVGLEEPA

SEQ ID NO: 953687 - protein, 19 aa, Mycobacterium
RQHWKLLGAFVVFVAVVAL

SEQ ID NO: 953688 - protein, 24 aa, Mycobacterium
RQTWNNLALPWFRGINSVIGVQRT

SEQ ID NO: 953689 - protein, 18 aa, Mycobacterium
RQWRIPMWQLNAGAQRGF

SEQ ID NO: 953690 - protein, 17 aa, Mycobacterium
RRGLFVHPAPWAENSIG

SEQ ID NO: 953691 - protein, 20 aa, Mycobacterium
RRLVALSVLPALLLLGFAVK

SEQ ID NO: 953692 - protein, 28 aa, Mycobacterium
RRQTLERLRYLPLAPFRISYAYTNYGIT

SEQ ID NO: 953693 - protein, 21 aa, Mycobacterium
RRRFRVVAAWLACAGLLAPLA

SEQ ID NO: 953694 - protein, 18 aa, Mycobacterium
RRVFLARAGLLAGGVVAA

SEQ ID NO: 953695 - protein, 23 aa, Mycobacterium
RRVVLNLWAYWCAPCAAELPAMA

SEQ ID NO: 953696 - protein, 19 aa, Mycobacterium
RRVVPYPGSFWPVTGLNSP

SEQ ID NO: 953697 - protein, 20 aa, Mycobacterium
RSVFALVFAAVLLGGCASVP

SEQ ID NO: 953698 - protein, 20 aa, Mycobacterium
RSVFGVLAVLLCLLLGVAIA

SEQ ID NO: 953699 - protein, 18 aa, Mycobacterium
RSVLATTLILVLVAGVIA

SEQ ID NO: 953700 - protein, 19 aa, Mycobacterium
RTANYSPFVPPGSLGYWRA

SEQ ID NO: 953701 - protein, 18 aa, Mycobacterium
RTLFMTVRRLVLGRRLTV

SEQ ID NO: 953702 - protein, 17 aa, Mycobacterium
RTMPAMVAVAVVAFLVV

SEQ ID NO: 953703 - protein, 17 aa, Mycobacterium
RTTIYKWWPSAPAIVLE

SEQ ID NO: 953704 - protein, 17 aa, Mycobacterium
RTTWDVPALALFGVGNG

SEQ ID NO: 953705 - protein, 17 aa, Mycobacterium
RTVLCVTAIAALALSGC

SEQ ID NO: 953706 - protein, 24 aa, Mycobacterium
RVAKWWLPERWAFVADVPLTSTGK

SEQ ID NO: 953707 - protein, 25 aa, Mycobacterium
RVAKWWLPERWAFVTDIPLTSTGKF

SEQ ID NO: 953708 - protein, 24 aa, Mycobacterium
RVEAFLARRRLFDPALLAGARTIA

SEQ ID NO: 953709 - protein, 20 aa, Mycobacterium
RVFTVGYLPILPPDAKGCLV

SEQ ID NO: 953710 - protein, 20 aa, Mycobacterium
RVPYLVVALLFGAASLILPP

SEQ ID NO: 953711 - protein, 18 aa, Mycobacterium
RVRALLVGVAGLAVLAVG

SEQ ID NO: 953712 - protein, 28 aa, Mycobacterium
RVRVSGFAGWLAWGFIHIAFLTGMRNRV

SEQ ID NO: 953713 - protein, 17 aa, Mycobacterium
RVRWTSTGLHPKLGEHQ

SEQ ID NO: 953714 - protein, 25 aa, Mycobacterium
RVSARVYPALVPLTHPLAAVNGAFN

SEQ ID NO: 953715 - protein, 24 aa, Mycobacterium
RVSARVYPALVPLTHPLASVNGAF

SEQ ID NO: 953716 - protein, 20 aa, Mycobacterium
RVWLLTVLAVIGLAGCGWRG

SEQ ID NO: 953717 - protein, 18 aa, Mycobacterium
RVWRYTHFSWWMTTMLHT

SEQ ID NO: 953718 - protein, 19 aa, Mycobacterium
RWAEGPVYFPDGGYLLCSD

SEQ ID NO: 953719 - protein, 25 aa, Mycobacterium
RWALLPLVPLIPKPVFRRLLSVVTG

SEQ ID NO: 953720 - protein, 22 aa, Mycobacterium
RWIWMFRNQPLTVRLLAAAAGL

SEQ ID NO: 953721 - protein, 18 aa, Mycobacterium
RWKRRLTVAALTTAALPW

SEQ ID NO: 953722 - protein, 18 aa, Mycobacterium
RYDWRKFIGSLKFTLWRL

SEQ ID NO: 953723 - protein, 18 aa, Mycobacterium
RYEDLMAPFYGMGRYGIG

SEQ ID NO: 953724 - protein, 21 aa, Mycobacterium
RYLMIPTDTLPLLYELSQTPI

SEQ ID NO: 953725 - protein, 24 aa, Mycobacterium
RYNPDYLPGTLLPPGIRATPEAEE

SEQ ID NO: 953726 - protein, 18 aa, Mycobacterium
RYPALWQVASPYGIPAAT

SEQ ID NO: 953727 - protein, 19 aa, Mycobacterium
SADNGWWAQWFTLPADAGP

SEQ ID NO: 953728 - protein, 18 aa, Mycobacterium
SAELLRVFLLGELPPEQA

SEQ ID NO: 953729 - protein, 20 aa, Mycobacterium
SAEYLAILRRCGIAAVLSGA

SEQ ID NO: 953730 - protein, 18 aa, Mycobacterium
SAQAALFHEQFVQALNAG

SEQ ID NO: 953731 - protein, 19 aa, Mycobacterium
SAVSFLVALAALAAMAVAS

SEQ ID NO: 953732 - protein, 24 aa, Mycobacterium
SAVSLRLGYLPRITHASALVALHD

SEQ ID NO: 953733 - protein, 19 aa, Mycobacterium
SDIILAKQGIDPRVTELAT

SEQ ID NO: 953734 - protein, 26 aa, Mycobacterium
SDNLGIQRLLRYYPPANYTGQITIPY

SEQ ID NO: 953735 - protein, 20 aa, Mycobacterium
SDWYLTYERDAWRYCNPVIT

SEQ ID NO: 953736 - protein, 24 aa, Mycobacterium
SEPLVLKPWTMPEPLLPMAIEAHA

SEQ ID NO: 953737 - protein, 26 aa, Mycobacterium
SFASTPPMLWQYFSGRYPDISVQTAG

SEQ ID NO: 953738 - protein, 17 aa, Mycobacterium
SFFDVIGARTWRLGDAP

SEQ ID NO: 953739 - protein, 17 aa, Mycobacterium
SFLVPQWFWVAHADPPA

SEQ ID NO: 953740 - protein, 27 aa, Mycobacterium
SFRRLPHTPPWNALWFALRSPTFRLRD

SEQ ID NO: 953741 - protein, 25 aa, Mycobacterium
SGARRLVIAPWFLAPGLITDRVWKY

SEQ ID NO: 953742 - protein, 23 aa, Mycobacterium
SGDAYKLVVLMGLRIGQDSVNGK

SEQ ID NO: 953743 - protein, 18 aa, Mycobacterium
SGFALIKMAAGERVRWSP

SEQ ID NO: 953744 - protein, 23 aa, Mycobacterium
SGGMLSRLRLLFSLGLGARLGNG

SEQ ID NO: 953745 - protein, 19 aa, Mycobacterium
SGIAPLQLFGHCLGAVVAF

SEQ ID NO: 953746 - protein, 21 aa, Mycobacterium
SGSWWVYTPTNVLGWDPANPE

SEQ ID NO: 953747 - protein, 26 aa, Mycobacterium
SHTAPGHWLPWGLLPDAIRSGERQIK

SEQ ID NO: 953748 - protein, 20 aa, Mycobacterium
SIDKIFFWDPAMAAEAQLQI

SEQ ID NO: 953749 - protein, 25 aa, Mycobacterium
SITVMALIVLLLLNATMTQVFAADS

SEQ ID NO: 953750 - protein, 18 aa, Mycobacterium
SITYRYTWHLPKDRTWTY

SEQ ID NO: 953751 - protein, 19 aa, Mycobacterium
SIVSRLWRRPLPAVPAAVA

SEQ ID NO: 953752 - protein, 21 aa, Mycobacterium
SKAVTLLMFTQGRALVRLEFD

SEQ ID NO: 953753 - protein, 24 aa, Mycobacterium
SKDGHRFWMLPATPQTTQWGVYDN

SEQ ID NO: 953754 - protein, 21 aa, Mycobacterium
SLEIFLTPQLPAPLVRIYGAT

SEQ ID NO: 953755 - protein, 25 aa, Mycobacterium
SLGAFIEDIIFLDIPRFVESAFHGL

SEQ ID NO: 953756 - protein, 25 aa, Mycobacterium
SLNWDPWVAILGFPFIPQARDHRYN

SEQ ID NO: 953757 - protein, 17 aa, Mycobacterium
SLRELFDLIQKYPFWTD

SEQ ID NO: 953758 - protein, 20 aa, Mycobacterium
SLRLWHEQFLGSLPAQVVTA

SEQ ID NO: 953759 - protein, 18 aa, Mycobacterium
SMDDAWFRDLAFVQGPVD

SEQ ID NO: 953760 - protein, 17 aa, Mycobacterium
SPAPPAFLLLGPDALMA

SEQ ID NO: 953761 - protein, 17 aa, Mycobacterium
SPAVWLNPLRWSPMMRA

SEQ ID NO: 953762 - protein, 25 aa, Mycobacterium
SPDPVLEAFPLWSTPWGLGVPSSEV

SEQ ID NO: 953763 - protein, 30 aa, Mycobacterium
SPIGAIIVPGGWWLLSLQALGLSQNAPGVA

SEQ ID NO: 953764 - protein, 20 aa, Mycobacterium
SPTLIFDYPTPATLARHLAQ

SEQ ID NO: 953765 - protein, 20 aa, Mycobacterium
SPWQGNIFTSFPYLDTAATR

SEQ ID NO: 953766 - protein, 23 aa, Mycobacterium
SQAFQSLLYLPLYVAKEKGYFEE

SEQ ID NO: 953767 - protein, 23 aa, Mycobacterium
SQGLPLLAPARLVAGLLSAATGE

SEQ ID NO: 953768 - protein, 23 aa, Mycobacterium
SRFPGFYIPFLDVPFNGATPPNS

SEQ ID NO: 953769 - protein, 24 aa, Mycobacterium
SRRLWTLLIFMLWHAIFIERSITP

SEQ ID NO: 953770 - protein, 22 aa, Mycobacterium
SRRLWTVLIFMLWHAIFVEHSV

SEQ ID NO: 953771 - protein, 20 aa, Mycobacterium
SRRRFLYSAAGLTLLGVTAT

SEQ ID NO: 953772 - protein, 24 aa, Mycobacterium
SRVVSVVAVVALGLGLDAGIGLGM

SEQ ID NO: 953773 - protein, 23 aa, Mycobacterium
SSDTYFIGFPDWLPIGASNSVDA

SEQ ID NO: 953774 - protein, 18 aa, Mycobacterium
SSGAALAAGLRDLRRVGA

SEQ ID NO: 953775 - protein, 24 aa, Mycobacterium
SSLQLLLTFPFPNFGIKQAVRGDY

SEQ ID NO: 953776 - protein, 23 aa, Mycobacterium
SSTARLVFAPKTSTSGTALTVTP

SEQ ID NO: 953777 - protein, 28 aa, Mycobacterium
SSTPPPPPPLPPTPFPKACPAPGVMQGC

SEQ ID NO: 953778 - protein, 20 aa, Mycobacterium
SSWYVWAALGLFPSTPGTPI

SEQ ID NO: 953779 - protein, 18 aa, Mycobacterium
SSWYVWAALGLYPITAGT

SEQ ID NO: 953780 - protein, 22 aa, Mycobacterium
STMDLLVRFFGDKKILLLLDNC

SEQ ID NO: 953781 - protein, 18 aa, Mycobacterium
STMLWGGQPLPTINPAYG

SEQ ID NO: 953782 - protein, 21 aa, Mycobacterium
STSLWTVLTAAWRQPGRSGTD

SEQ ID NO: 953783 - protein, 18 aa, Mycobacterium
SVALSLALVGCGHDHKSG

SEQ ID NO: 953784 - protein, 19 aa, Mycobacterium
SVGPPPPPPWCRGGSVVVV

SEQ ID NO: 953785 - protein, 19 aa, Mycobacterium
SVLLLAVGCSFFGAPRSGD

SEQ ID NO: 953786 - protein, 17 aa, Mycobacterium
SVQTTMEALWWDRPFTL

SEQ ID NO: 953787 - protein, 27 aa, Mycobacterium
SVQTTMEALWWDRPFTLDGVDLRASVA

SEQ ID NO: 953788 - protein, 18 aa, Mycobacterium
SVVPIDFHIIRELAAHPN

SEQ ID NO: 953789 - protein, 21 aa, Mycobacterium
SWLAAILIPVAVLAVACGGSS

SEQ ID NO: 953790 - protein, 18 aa, Mycobacterium
SYYMIPTQNLPLLDPVRA

SEQ ID NO: 953791 - protein, 26 aa, Mycobacterium
TADTRAQLWLAIRAWQLLVSRERPGL

SEQ ID NO: 953792 - protein, 41 aa, Mycobacterium
TAEAANAGPLQPLLDLINAPTQALLARPLIGDGSNGAPGTG

SEQ ID NO: 953793 - protein, 23 aa, Mycobacterium
TAFAMFGPFGACLRTASATPSPT

SEQ ID NO: 953794 - protein, 19 aa, Mycobacterium
TAFFDRLIAVNARGVFLGI

SEQ ID NO: 953795 - protein, 19 aa, Mycobacterium
TAGLLSVTLLLTGCLKPNT

SEQ ID NO: 953796 - protein, 20 aa, Mycobacterium
TAIPKVWFHDLLRPDGRPFQ

SEQ ID NO: 953797 - protein, 21 aa, Mycobacterium
TAIPQPLRWYARSRGLRLARA

SEQ ID NO: 953798 - protein, 26 aa, Mycobacterium
TAMAAAARPYASWLGTAAARAAVTAA

SEQ ID NO: 953799 - protein, 22 aa, Mycobacterium
TANYPPFLFHPLNTITAYKGQI

SEQ ID NO: 953800 - protein, 22 aa, Mycobacterium
TAPALDLDLLLGGLKPVIKGLD

SEQ ID NO: 953801 - protein, 21 aa, Mycobacterium
TAVAIPFWWSIHNIVLQELLR

SEQ ID NO: 953802 - protein, 17 aa, Mycobacterium
TCFFPHPQRVVCGGISI

SEQ ID NO: 953803 - protein, 24 aa, Mycobacterium
TDAMPALHLLPLAGVLGALPVLAT

SEQ ID NO: 953804 - protein, 23 aa, Mycobacterium
TDRVTLFRAWYSRSNFGQLAGAA

SEQ ID NO: 953805 - protein, 24 aa, Mycobacterium
TEPAPVLIFVPGGAWIHGSRAIQG

SEQ ID NO: 953806 - protein, 19 aa, Mycobacterium
TEPFSVPWLVGIDQGFFEK

SEQ ID NO: 953807 - protein, 22 aa, Mycobacterium
TERTYLFDLLSRRDARIPRAPK

SEQ ID NO: 953808 - protein, 20 aa, Mycobacterium
TFPQLQVLPLALPIAAPGLL

SEQ ID NO: 953809 - protein, 18 aa, Mycobacterium
TFRWGLYDRKPLNRWTTD

SEQ ID NO: 953810 - protein, 17 aa, Mycobacterium
TFSWGVESAVLAPTELA

SEQ ID NO: 953811 - protein, 20 aa, Mycobacterium
TFTGWLKQWNQPLMPEGHDP

SEQ ID NO: 953812 - protein, 22 aa, Mycobacterium
TGETLWPDRLWLAIARTTAAEV

SEQ ID NO: 953813 - protein, 20 aa, Mycobacterium
TGLAVVLSLLLIGGLMTVQR

SEQ ID NO: 953814 - protein, 28 aa, Mycobacterium
TGLDDHLWAHRPLLMFAPGETDPRLVET

SEQ ID NO: 953815 - protein, 17 aa, Mycobacterium
TGLRRLLADRLEFARLE

SEQ ID NO: 953816 - protein, 27 aa, Mycobacterium
TGPNGILRWIPFRIPIIGLTPVRPPDT

SEQ ID NO: 953817 - protein, 23 aa, Mycobacterium
TGTVPPLPAFAPPADLGANCQYP

SEQ ID NO: 953818 - protein, 24 aa, Mycobacterium
TGVDSLPFMAILQVGIDKGWFKEE

SEQ ID NO: 953819 - protein, 18 aa, Mycobacterium
THLRRLFGSWAEPIPQLL

SEQ ID NO: 953820 - protein, 23 aa, Mycobacterium
THPAPVLLFVPGGAWIHGSRTMQ

SEQ ID NO: 953821 - protein, 22 aa, Mycobacterium
TILLAILALVVPPPVTAQPLEL

SEQ ID NO: 953822 - protein, 17 aa, Mycobacterium
TILPLYSPALWRHLTQA

SEQ ID NO: 953823 - protein, 17 aa, Mycobacterium
TIMFWVMMNVDNPDLLL

SEQ ID NO: 953824 - protein, 24 aa, Mycobacterium
TIPQVPGMPIPLPQTVNIPGDLAS

SEQ ID NO: 953825 - protein, 18 aa, Mycobacterium
TIYKWWPSAPAIVLEGLL

SEQ ID NO: 953826 - protein, 25 aa, Mycobacterium
TKGTDPYFFLLQALDANGLSASDVE

SEQ ID NO: 953827 - protein, 24 aa, Mycobacterium
TKRVNWALTYGPSKYRCFVSYNGV

SEQ ID NO: 953828 - protein, 17 aa, Mycobacterium
TLAFVVLLTAGLAIKFA

SEQ ID NO: 953829 - protein, 24 aa, Mycobacterium
TLAILLAAVPIPLWDPVRLAEEMS

SEQ ID NO: 953830 - protein, 18 aa, Mycobacterium
TLEQRLLQAINAPTQTLL

SEQ ID NO: 953831 - protein, 18 aa, Mycobacterium
TLMLNWYPYGEHAPFYYG

SEQ ID NO: 953832 - protein, 18 aa, Mycobacterium
TLMVLPGQKLLAVLVADN

SEQ ID NO: 953833 - protein, 17 aa, Mycobacterium
TLPLLYELSQTPIVGSF

SEQ ID NO: 953834 - protein, 21 aa, Mycobacterium
TLYALNRLLPPFIKSMSSGAI

SEQ ID NO: 953835 - protein, 23 aa, Mycobacterium
TNDIAVIWPPGRAPIVMAVLTVP

SEQ ID NO: 953836 - protein, 20 aa, Mycobacterium
TNYRALFQVATPQGVNPSTI

SEQ ID NO: 953837 - protein, 23 aa, Mycobacterium
TPAKPALILFRRAGAPAALADSV

SEQ ID NO: 953838 - protein, 18 aa, Mycobacterium
TPELLAYQYLQTLPKMAE

SEQ ID NO: 953839 - protein, 25 aa, Mycobacterium
TPFGWIKGFPFLALQVVWAPGSEMS

SEQ ID NO: 953840 - protein, 24 aa, Mycobacterium
TPMEPALYLLWAQANVAAGYRYSV

SEQ ID NO: 953841 - protein, 18 aa, Mycobacterium
TPPLEWLQTIPLFGRFVM

SEQ ID NO: 953842 - protein, 21 aa, Mycobacterium
TPQPVVDAIVRFLISADTNPH

SEQ ID NO: 953843 - protein, 22 aa, Mycobacterium
TPSEAFMRRFGAPEITIGPLYA

SEQ ID NO: 953844 - protein, 23 aa, Mycobacterium
TQAHFLWVLQRAVNRLAGWPGPA

SEQ ID NO: 953845 - protein, 20 aa, Mycobacterium
TQLLWYRADLMPAPPTTWDG

SEQ ID NO: 953846 - protein, 18 aa, Mycobacterium
TQSYTLPDPARPGAAPPF

SEQ ID NO: 953847 - protein, 24 aa, Mycobacterium
TQWGFVNMWFSYYSAGLFAMNNGV

SEQ ID NO: 953848 - protein, 21 aa, Mycobacterium
TRAALSLLLVSTLVLAACGGR

SEQ ID NO: 953849 - protein, 23 aa, Mycobacterium
TRALSFLPTYPFPKETLTNWMRG

SEQ ID NO: 953850 - protein, 22 aa, Mycobacterium
TRDDLPIHFLLADTFTVCDHYF

SEQ ID NO: 953851 - protein, 18 aa, Mycobacterium
TRGPLLERLGLPEPSTAL

SEQ ID NO: 953852 - protein, 25 aa, Mycobacterium
TRPPGWPGWPGWPPHHGHWPTKPTK

SEQ ID NO: 953853 - protein, 18 aa, Mycobacterium
TRRWLLMPRFKINQADLL

SEQ ID NO: 953854 - protein, 23 aa, Mycobacterium
TSLLSLNRLYAPFIKITAGSAIS

SEQ ID NO: 953855 - protein, 24 aa, Mycobacterium
TSLQLLLTFPFPNFGIKQAVRGDY

SEQ ID NO: 953856 - protein, 21 aa, Mycobacterium
TSTPRWLTVTSTPEGAPATPN

SEQ ID NO: 953857 - protein, 18 aa, Mycobacterium
TSWAFMTYLIEQDTLRDV

SEQ ID NO: 953858 - protein, 24 aa, Mycobacterium
TTDNVNYRILLKPGWRFTDGSPVT

SEQ ID NO: 953859 - protein, 19 aa, Mycobacterium
TTNPPVEGAFYWLNNREVR

SEQ ID NO: 953860 - protein, 20 aa, Mycobacterium
TTNPPVEGAFYWLNNREVRW

SEQ ID NO: 953861 - protein, 25 aa, Mycobacterium
TTNPPVEGAFYWLSNREVRWRPAEY

SEQ ID NO: 953862 - protein, 25 aa, Mycobacterium
TTQVLERLKYLPLDPFRISYAYTNF

SEQ ID NO: 953863 - protein, 17 aa, Mycobacterium
TTSDWYLTYERDAWRYC

SEQ ID NO: 953864 - protein, 24 aa, Mycobacterium
TTTSALRVLLGLSLILTGCTARQD

SEQ ID NO: 953865 - protein, 28 aa, Mycobacterium
TTTYLIPTEKLPLLQPLRDLGFPESFVA

SEQ ID NO: 953866 - protein, 23 aa, Mycobacterium
TVAVPAHWSGAAIGAFRSAAPHV

SEQ ID NO: 953867 - protein, 20 aa, Mycobacterium
TVAVVLAVGFLPAGTAAADD

SEQ ID NO: 953868 - protein, 18 aa, Mycobacterium
TVDGFAISLKLPNGQYQL

SEQ ID NO: 953869 - protein, 22 aa, Mycobacterium
TVFMAVALALTWLVYATLRRDV

SEQ ID NO: 953870 - protein, 25 aa, Mycobacterium
TVFQRTPIWIAPRFDFPFTPEQQEL

SEQ ID NO: 953871 - protein, 25 aa, Mycobacterium
TVFQRTPIWISPRFDIPFTAEQQDL

SEQ ID NO: 953872 - protein, 27 aa, Mycobacterium
TVPGDPPLLLGVLAFVRREIQRTFFNS

SEQ ID NO: 953873 - protein, 18 aa, Mycobacterium
TVPKVWFHDLLYPDGRPY

SEQ ID NO: 953874 - protein, 18 aa, Mycobacterium
TVPLLAPVIRRWHRRHPD

SEQ ID NO: 953875 - protein, 17 aa, Mycobacterium
TVRNLLAPPLRLRGPVT

SEQ ID NO: 953876 - protein, 23 aa, Mycobacterium
TVSGQLTLLLPFVDKIRARVDLR

SEQ ID NO: 953877 - protein, 23 aa, Mycobacterium
TVSGQLTLLVPFIDRIRARVDLR

SEQ ID NO: 953878 - protein, 18 aa, Mycobacterium
TYDTLWQPKTDPLPTVFP

SEQ ID NO: 953879 - protein, 23 aa, Mycobacterium
TYGHVYLWNRDPSQDIWTALAQP

SEQ ID NO: 953880 - protein, 21 aa, Mycobacterium
TYPFVFDRWLPDKVYSGAYKA

SEQ ID NO: 953881 - protein, 18 aa, Mycobacterium
TYPTAMLLAFKLYGDFDV

SEQ ID NO: 953882 - protein, 23 aa, Mycobacterium
VAATLLLVTAPLAAAWGPQGHNI

SEQ ID NO: 953883 - protein, 24 aa, Mycobacterium
VADDRFYFFFDVVEPEGLPFEKGT

SEQ ID NO: 953884 - protein, 22 aa, Mycobacterium
VAELHESFTRALTAGSTAYATA

SEQ ID NO: 953885 - protein, 22 aa, Mycobacterium
VAGAITLWLGLVAQVGGVSGAE

SEQ ID NO: 953886 - protein, 19 aa, Mycobacterium
VALFALLRDWGVSPDVVMG

SEQ ID NO: 953887 - protein, 17 aa, Mycobacterium
VALLAVATLLGGVSGCS

SEQ ID NO: 953888 - protein, 24 aa, Mycobacterium
VALNRLLPILIKANAGSALAVDVN

SEQ ID NO: 953889 - protein, 22 aa, Mycobacterium
VAMPPIPPIPPIAPRYGAIAVA

SEQ ID NO: 953890 - protein, 18 aa, Mycobacterium
VAMTPWLHRVGLDRLLRT

SEQ ID NO: 953891 - protein, 19 aa, Mycobacterium
VANDRWWGAKAITKRVIVR

SEQ ID NO: 953892 - protein, 17 aa, Mycobacterium
VAPPVLLPVVVAPVIVP

SEQ ID NO: 953893 - protein, 18 aa, Mycobacterium
VAQAALPGLLLTSADLDS

SEQ ID NO: 953894 - protein, 25 aa, Mycobacterium
VARRLALLLTFPRFLPVAGPVAMRS

SEQ ID NO: 953895 - protein, 20 aa, Mycobacterium
VARWLVLSLRRPGGQAQFAA

SEQ ID NO: 953896 - protein, 23 aa, Mycobacterium
VAVALAIPLLLGAAFLMVERLHS

SEQ ID NO: 953897 - protein, 22 aa, Mycobacterium
VDGVSWRILLEDLNIAWAQRRA

SEQ ID NO: 953898 - protein, 25 aa, Mycobacterium
VDRVAFHWWLVLATLRWGVICRYQA

SEQ ID NO: 953899 - protein, 27 aa, Mycobacterium
VDSSGRPMIGPGGWLIGNGIEPGQNGG

SEQ ID NO: 953900 - protein, 18 aa, Mycobacterium
VEGAFYWLSNREVRWRPA

SEQ ID NO: 953901 - protein, 24 aa, Mycobacterium
VEGGIIYHYYWFRDQSQTKEISGN

SEQ ID NO: 953902 - protein, 25 aa, Mycobacterium
VELTKPITNGLLYDFTFTFEDGETT

SEQ ID NO: 953903 - protein, 17 aa, Mycobacterium
VENFDFFGFGVAHGGDG

SEQ ID NO: 953904 - protein, 17 aa, Mycobacterium
VGAALMAGSLVLGMTAC

SEQ ID NO: 953905 - protein, 18 aa, Mycobacterium
VGATYIVPLGLYSQKHKT

SEQ ID NO: 953906 - protein, 27 aa, Mycobacterium
VGFAAIVFLVWRYVVPPVRRLMSARQQ

SEQ ID NO: 953907 - protein, 25 aa, Mycobacterium
VGFAAIVFLVWRYVVPPVRRMMAAR

SEQ ID NO: 953908 - protein, 24 aa, Mycobacterium
VIDPRLRTLAIRPALRRLAGLPTA

SEQ ID NO: 953909 - protein, 17 aa, Mycobacterium
VIGLSWARLARSHGWRV

SEQ ID NO: 953910 - protein, 17 aa, Mycobacterium
VIGPLFRSALRSAEVRR

SEQ ID NO: 953911 - protein, 22 aa, Mycobacterium
VKGFFEKTFAPLGLRRIQDEVL

SEQ ID NO: 953912 - protein, 19 aa, Mycobacterium
VKTLRRWGPPGLTGYEIHH

SEQ ID NO: 953913 - protein, 18 aa, Mycobacterium
VLAAPVLLIVLLIPGQTA

SEQ ID NO: 953914 - protein, 25 aa, Mycobacterium
VLAEWFLRRFSLLDSLYIVPPPRLI

SEQ ID NO: 953915 - protein, 26 aa, Mycobacterium
VLAEWFLRRFSLLDSLYMVPSARLIG

SEQ ID NO: 953916 - protein, 17 aa, Mycobacterium
VLHYLPEVDLWTGAVVA

SEQ ID NO: 953917 - protein, 20 aa, Mycobacterium
VLIVLIILGVTIVLKSVALV

SEQ ID NO: 953918 - protein, 18 aa, Mycobacterium
VLKFAAPVLLGLGATAAP

SEQ ID NO: 953919 - protein, 19 aa, Mycobacterium
VLSGFLFTASGITPLLGGL

SEQ ID NO: 953920 - protein, 17 aa, Mycobacterium
VLTLWEPGADKPVLVGL

SEQ ID NO: 953921 - protein, 17 aa, Mycobacterium
VLTSKLPRRAAIPVLLC

SEQ ID NO: 953922 - protein, 17 aa, Mycobacterium
VLYKGGQPFLWDRGREL

SEQ ID NO: 953923 - protein, 24 aa, Mycobacterium
VMDQAGRFLPFDTPFTWAGMQYYT

SEQ ID NO: 953924 - protein, 17 aa, Mycobacterium
VMWAFQQAGIALPHSSQ

SEQ ID NO: 953925 - protein, 18 aa, Mycobacterium
VMWLGLTAAPPATADPGP

SEQ ID NO: 953926 - protein, 23 aa, Mycobacterium
VNGQLFIVYGPQVTLVAAPTAEH

SEQ ID NO: 953927 - protein, 17 aa, Mycobacterium
VNIGGPEKLSFADMARA

SEQ ID NO: 953928 - protein, 24 aa, Mycobacterium
VNVRQLWRSVSYPGMLRLARHHWR

SEQ ID NO: 953929 - protein, 17 aa, Mycobacterium
VPAEWRFIDGRWKLASK

SEQ ID NO: 953930 - protein, 26 aa, Mycobacterium
VPAGWYSEPWWKPALVAGAWGLGSVL

SEQ ID NO: 953931 - protein, 26 aa, Mycobacterium
VPAGWYSEPWWKPALVAGAWGVGSAL

SEQ ID NO: 953932 - protein, 17 aa, Mycobacterium
VPGFPNLFLIYGPGTHL

SEQ ID NO: 953933 - protein, 18 aa, Mycobacterium
VPGKFYWMSPTQVRWRPL

SEQ ID NO: 953934 - protein, 17 aa, Mycobacterium
VPIHWGTFRLAPHPWAE

SEQ ID NO: 953935 - protein, 17 aa, Mycobacterium
VPILPPLAPGQVLRMGP

SEQ ID NO: 953936 - protein, 24 aa, Mycobacterium
VPKVLLLAAIVLLVLTGCARTVEG

SEQ ID NO: 953937 - protein, 22 aa, Mycobacterium
VPLDDWQWVLGINLWGPIHGCH

SEQ ID NO: 953938 - protein, 17 aa, Mycobacterium
VPLYRRNALSDRQLLAI

SEQ ID NO: 953939 - protein, 17 aa, Mycobacterium
VPRRVLLERLLDGFDAE

SEQ ID NO: 953940 - protein, 21 aa, Mycobacterium
VPSRWRLMLQGWPGLTTRGLI

SEQ ID NO: 953941 - protein, 20 aa, Mycobacterium
VRALFETHFFGTVAMIKAVL

SEQ ID NO: 953942 - protein, 20 aa, Mycobacterium
VRGAALIPGATSRAGPAETT

SEQ ID NO: 953943 - protein, 18 aa, Mycobacterium
VRQYIDAPLWVADPAIDS

SEQ ID NO: 953944 - protein, 23 aa, Mycobacterium
VRRLALILCWTLASASPAVADDF

SEQ ID NO: 953945 - protein, 23 aa, Mycobacterium
VRTEAWLGYFMLRIAPAVNRRMT

SEQ ID NO: 953946 - protein, 23 aa, Mycobacterium
VRWSWLVAIVAVLGLGLATPPAP

SEQ ID NO: 953947 - protein, 29 aa, Mycobacterium
VSALYSQRFWPYLTSGLLGLQRGTDPGDL

SEQ ID NO: 953948 - protein, 22 aa, Mycobacterium
VSGQLTLLVPFIDRIRARVDLR

SEQ ID NO: 953949 - protein, 21 aa, Mycobacterium
VSIFALAMLLVAAALVVVFGD

SEQ ID NO: 953950 - protein, 23 aa, Mycobacterium
VSSPLGAWLLLALAAPVARGRVR

SEQ ID NO: 953951 - protein, 18 aa, Mycobacterium
VTAVVGLGLTLTACGSDS

SEQ ID NO: 953952 - protein, 24 aa, Mycobacterium
VTGLPRLLKVWDPVDSMFGSTDPS

SEQ ID NO: 953953 - protein, 17 aa, Mycobacterium
VTLYRQYVVRFGLGYRE

SEQ ID NO: 953954 - protein, 17 aa, Mycobacterium
VTSLYRMALLDDALEIR

SEQ ID NO: 953955 - protein, 24 aa, Mycobacterium
VTVMALIVLLLINATMTQVFAADS

SEQ ID NO: 953956 - protein, 24 aa, Mycobacterium
VVAALVFGLVRYRSRRISLTRSDK

SEQ ID NO: 953957 - protein, 26 aa, Mycobacterium
VVAEFRDQFPLPEKLWTIADLGGWDT

SEQ ID NO: 953958 - protein, 25 aa, Mycobacterium
VVLDDIWWFHFALSGVISPLDKLFR

SEQ ID NO: 953959 - protein, 17 aa, Mycobacterium
VVLDNYLRRCDFSRVSV

SEQ ID NO: 953960 - protein, 18 aa, Mycobacterium
VVLLMWAGILAYLDHAGY

SEQ ID NO: 953961 - protein, 24 aa, Mycobacterium
VVNTARPWYFGYNGFRPAPSPGGI

SEQ ID NO: 953962 - protein, 17 aa, Mycobacterium
VVQWIPDHYWPAHSHIS

SEQ ID NO: 953963 - protein, 18 aa, Mycobacterium
VVSRLPWFALSDPTTTQM

SEQ ID NO: 953964 - protein, 18 aa, Mycobacterium
VVTELRRRLQHGDFGTIC

SEQ ID NO: 953965 - protein, 18 aa, Mycobacterium
VVVFGDFRFGPKATYHAT

SEQ ID NO: 953966 - protein, 21 aa, Mycobacterium
VWWDTFRLPPFGRYTLRMYFR

SEQ ID NO: 953967 - protein, 23 aa, Mycobacterium
VWWSWVVSVLAVVGVGLGLGIAP

SEQ ID NO: 953968 - protein, 18 aa, Mycobacterium
VYALFSNGTNLASAFSST

SEQ ID NO: 953969 - protein, 17 aa, Mycobacterium
WAAGHPGLFTRAPWVVS

SEQ ID NO: 953970 - protein, 17 aa, Mycobacterium
WAALRALLVLTAITGLA

SEQ ID NO: 953971 - protein, 18 aa, Mycobacterium
WAQLVGSFKYTLWRLQER

SEQ ID NO: 953972 - protein, 18 aa, Mycobacterium
WARYNVPWQPAWVFYRAD

SEQ ID NO: 953973 - protein, 18 aa, Mycobacterium
WARYNVPWQPAYVFYRAD

SEQ ID NO: 953974 - protein, 18 aa, Mycobacterium
WASWAFVGPTHRAYFGGD

SEQ ID NO: 953975 - protein, 19 aa, Mycobacterium
WATGLRRLGLWSLRLPGIR

SEQ ID NO: 953976 - protein, 17 aa, Mycobacterium
WDTPVVEHLPWFALSDP

SEQ ID NO: 953977 - protein, 18 aa, Mycobacterium
WDTPVVSRLPWFALSDPT

SEQ ID NO: 953978 - protein, 18 aa, Mycobacterium
WDTWLSMSALPAPSARTP

SEQ ID NO: 953979 - protein, 17 aa, Mycobacterium
WEFPPGWGPDARGQACI

SEQ ID NO: 953980 - protein, 24 aa, Mycobacterium
WFGDQPFAVWPWAQPKLGAAQPVV

SEQ ID NO: 953981 - protein, 25 aa, Mycobacterium
WFGDQPFAVWPWAQPKLGRAQPVVL

SEQ ID NO: 953982 - protein, 18 aa, Mycobacterium
WIPLLILVVVAIAGFTVQ

SEQ ID NO: 953983 - protein, 19 aa, Mycobacterium
WIPLLLVVVVALGAYAITR

SEQ ID NO: 953984 - protein, 20 aa, Mycobacterium
WIPLLLVVVVALGAYAVVRI

SEQ ID NO: 953985 - protein, 18 aa, Mycobacterium
WIPLLLVVVVGIGGYAIA

SEQ ID NO: 953986 - protein, 19 aa, Mycobacterium
WIPLVLVVVLALSALIVSR

SEQ ID NO: 953987 - protein, 17 aa, Mycobacterium
WIPLVVVIALVAGGIAV

SEQ ID NO: 953988 - protein, 21 aa, Mycobacterium
WKRYPLGLAAPLIRAFLRSKS

SEQ ID NO: 953989 - protein, 26 aa, Mycobacterium
WLAMTRRYRWLTAALLRGSGIRPVRA

SEQ ID NO: 953990 - protein, 18 aa, Mycobacterium
WLIFFNNPSRPGGGLFAL

SEQ ID NO: 953991 - protein, 18 aa, Mycobacterium
WLLVVGLFISVVGCSSSP

SEQ ID NO: 953992 - protein, 17 aa, Mycobacterium
WLNNREVRWRPAEYWKP

SEQ ID NO: 953993 - protein, 21 aa, Mycobacterium
WLPDLGRVLGLFVLTAIPGYS

SEQ ID NO: 953994 - protein, 19 aa, Mycobacterium
WLPLLIVVVVVIAGATVSR

SEQ ID NO: 953995 - protein, 18 aa, Mycobacterium
WLRRQLTPDFRPGCKRML

SEQ ID NO: 953996 - protein, 18 aa, Mycobacterium
WQLANLRMMFLTRALRRR

SEQ ID NO: 953997 - protein, 17 aa, Mycobacterium
WQQVLQNLGFHFSSSGQ

SEQ ID NO: 953998 - protein, 22 aa, Mycobacterium
WQTAAVLFGIWWIGAEIVLEGP

SEQ ID NO: 953999 - protein, 17 aa, Mycobacterium
WRFALAAAAALAVFIVL

SEQ ID NO: 954000 - protein, 18 aa, Mycobacterium
WRFGVPLVCLLAGLLLAA

SEQ ID NO: 954001 - protein, 19 aa, Mycobacterium
WRFGVPLVCLLAGLLLAAT

SEQ ID NO: 954002 - protein, 17 aa, Mycobacterium
WRLTAALAITIVSLWQL

SEQ ID NO: 954003 - protein, 20 aa, Mycobacterium
WRRAALSQLMLLKAYQQRVT

SEQ ID NO: 954004 - protein, 17 aa, Mycobacterium
WRRGCMPVPRRVIRARV

SEQ ID NO: 954005 - protein, 20 aa, Mycobacterium
WSFGPGLWKAWRQPTAEVLR

SEQ ID NO: 954006 - protein, 18 aa, Mycobacterium
WTCFFPHPQRVVCGGISI

SEQ ID NO: 954007 - protein, 18 aa, Mycobacterium
WVCYFPHPQRVVCGGISI

SEQ ID NO: 954008 - protein, 17 aa, Mycobacterium
WVNLPKRDKLAPPRYQA

SEQ ID NO: 954009 - protein, 20 aa, Mycobacterium
WYGGFPFATWPWATERLGGA

SEQ ID NO: 954010 - protein, 24 aa, Mycobacterium
YAEIGLLGFALITDALGGVDVCLN

SEQ ID NO: 954011 - protein, 23 aa, Mycobacterium
YAEIGLLGFSLITDALGGVDVCL

SEQ ID NO: 954012 - protein, 18 aa, Mycobacterium
YAHRLMGWINPDGKLKDG

SEQ ID NO: 954013 - protein, 19 aa, Mycobacterium
YAITLWPNALAACDALGIG

SEQ ID NO: 954014 - protein, 25 aa, Mycobacterium
YDAYLRLHLLSHRLIQPHGASVDGL

SEQ ID NO: 954015 - protein, 23 aa, Mycobacterium
YDCSGLMMYGFAAVGIRLRHYTG

SEQ ID NO: 954016 - protein, 22 aa, Mycobacterium
YDGFTLAGIPSGGLFAGAEVKK

SEQ ID NO: 954017 - protein, 17 aa, Mycobacterium
YEYFTPFGWIKGFPFLA

SEQ ID NO: 954018 - protein, 17 aa, Mycobacterium
YFRDLGEVLLWRQSNKL

SEQ ID NO: 954019 - protein, 20 aa, Mycobacterium
YFSFYLCDLILKLNGKGGQP

SEQ ID NO: 954020 - protein, 18 aa, Mycobacterium
YGFMPFYPGPGVGGHCIP

SEQ ID NO: 954021 - protein, 23 aa, Mycobacterium
YGNYFTFYLCDLLLKVNGKGGQP

SEQ ID NO: 954022 - protein, 21 aa, Mycobacterium
YGPLLDVFLLDMRSYKDPNSP

SEQ ID NO: 954023 - protein, 22 aa, Mycobacterium
YGQHPLWQMVWHHGPRQPYQEK

SEQ ID NO: 954024 - protein, 21 aa, Mycobacterium
YGRKWRKRFPPGTLPQAVSRN

SEQ ID NO: 954025 - protein, 21 aa, Mycobacterium
YGVDPLILRQAYPVPQAPYGL

SEQ ID NO: 954026 - protein, 18 aa, Mycobacterium
YHRLEKDLWVTGLQPDTN

SEQ ID NO: 954027 - protein, 19 aa, Mycobacterium
YILHVPPGPPTGLVLNLHG

SEQ ID NO: 954028 - protein, 17 aa, Mycobacterium
YIPIPDAFKARLSSSIN

SEQ ID NO: 954029 - protein, 17 aa, Mycobacterium
YIPVPASFKSRLLAAVD

SEQ ID NO: 954030 - protein, 17 aa, Mycobacterium
YLDLVRYLAVGNLNPAP

SEQ ID NO: 954031 - protein, 18 aa, Mycobacterium
YLGPVRLLLGLVPAMRDN

SEQ ID NO: 954032 - protein, 18 aa, Mycobacterium
YLGRFLCLEWLQRLSQTG

SEQ ID NO: 954033 - protein, 24 aa, Mycobacterium
YLIPEKHLPLVIPLGYLGVPEDEL

SEQ ID NO: 954034 - protein, 17 aa, Mycobacterium
YLRASLPPFWQTTSATQ

SEQ ID NO: 954035 - protein, 20 aa, Mycobacterium
YNLRYRLWADWDFNIRCFSN

SEQ ID NO: 954036 - protein, 18 aa, Mycobacterium
YNPFIPNLFTIQFFQWFI

SEQ ID NO: 954037 - protein, 21 aa, Mycobacterium
YPGSSLLDLLWPRGSSRPVAA

SEQ ID NO: 954038 - protein, 17 aa, Mycobacterium
YPSMIEFLAPLFATGAG

SEQ ID NO: 954039 - protein, 19 aa, Mycobacterium
YPTIPPFDYLEEVTFAHVG

SEQ ID NO: 954040 - protein, 19 aa, Mycobacterium
YQIGCGISLAWVKLNGGAN

SEQ ID NO: 954041 - protein, 17 aa, Mycobacterium
YQKYDDCLIMAVADVVG

SEQ ID NO: 954042 - protein, 17 aa, Mycobacterium
YRLYKPAGLPRAAPLVV

SEQ ID NO: 954043 - protein, 21 aa, Mycobacterium
YSPCALPPVLDYLTSGELPST

SEQ ID NO: 954044 - protein, 18 aa, Mycobacterium
YTFIAYLGDYYAFTTLTT

SEQ ID NO: 954045 - protein, 26 aa, Mycobacterium
YTGNFLHALLPFLARGLLSNLKVPVQ

SEQ ID NO: 954046 - protein, 22 aa, Mycobacterium
YTLYRKWLTVLGPAPAPPVARY

SEQ ID NO: 954047 - protein, 25 aa, Mycobacterium
YVAAHVPYLMWLMQAGTVSAAAAAR

SEQ ID NO: 954048 - protein, 18 aa, Mycobacterium
YVIRTYPIPLLMPLDPFL

SEQ ID NO: 954049 - protein, 19 aa, Mycobacterium
YVNGYFIIDLTNAGLRKSI

SEQ ID NO: 954050 - protein, 17 aa, Mycobacterium
YVWAALGLYPSTPGTPI

SEQ ID NO: 954051 - protein, 17 aa, Mycobacterium
YWMSPTQVRWRPLQFWP

SEQ ID NO: 954052 - protein, 18 aa, Mycobacterium
YWVLKPTYHNSYWYYSCM

SEQ ID NO: 954053 - protein, 20 aa, Mycobacterium
YWVMKPTYHNSFWFSSCMVT

SEQ ID NO: 954054 - protein, 11 aa, Mycobacterium
VPDPRDPRGRR

SEQ ID NO: 954055 - protein, 5 aa, Mycobacterium
AKATA

SEQ ID NO: 954056 - protein, 6 aa, Mycobacterium
ATASDD

SEQ ID NO: 954057 - protein, 6 aa, Mycobacterium
EKSNEI

SEQ ID NO: 954058 - protein, 6 aa, Mycobacterium
RPSEKT

SEQ ID NO: 954059 - protein, 8 aa, Mycobacterium
ASSDPSGL

SEQ ID NO: 954060 - protein, 4 aa, Mycobacterium
DPAD

SEQ ID NO: 954061 - protein, 4 aa, Mycobacterium
ADNI

SEQ ID NO: 954062 - protein, 6 aa, Mycobacterium
ATDQRS

SEQ ID NO: 954063 - protein, 7 aa, Mycobacterium
AGERSEL

SEQ ID NO: 954064 - protein, 15 aa, Mycobacterium
PAAATDDSRGHGRVE

SEQ ID NO: 954065 - protein, 15 aa, Mycobacterium
PAAATDDSRGHGRVK

SEQ ID NO: 954066 - protein, 8 aa, Mycobacterium
SPGERSEL

SEQ ID NO: 954067 - protein, 9 aa, Mycobacterium
HRAHTGNGA

SEQ ID NO: 954068 - protein, 13 aa, Mycobacterium
DEDRQRPHTGNGA

SEQ ID NO: 954069 - protein, 8 aa, Mycobacterium
ASSDPGGL

SEQ ID NO: 954070 - protein, 8 aa, Mycobacterium
HRAHTGHG

SEQ ID NO: 954071 - protein, 6 aa, Mycobacterium
GDRGRL

SEQ ID NO: 954072 - protein, 13 aa, Mycobacterium
DEDRQRAHTGNGA

SEQ ID NO: 954073 - protein, 12 aa, Mycobacterium
DEDRQRPHTGHG

SEQ ID NO: 954074 - protein, 5 aa, Mycobacterium
GISGT

SEQ ID NO: 954075 - protein, 20 aa, Mycobacterium
AINQDGASNGLTAPHGPSQQ

SEQ ID NO: 954076 - protein, 7 aa, Mycobacterium
AQNEHPG

SEQ ID NO: 954077 - protein, 6 aa, Mycobacterium
AQTTDH

SEQ ID NO: 954078 - protein, 6 aa, Mycobacterium
ATGQPV

SEQ ID NO: 954079 - protein, 12 aa, Mycobacterium
DPDPDAVGKTYT

SEQ ID NO: 954080 - protein, 8 aa, Mycobacterium
DTDDMGRQ

SEQ ID NO: 954081 - protein, 14 aa, Mycobacterium
DTVEQAGGGGAAVP

SEQ ID NO: 954082 - protein, 14 aa, Mycobacterium
EAHGTGTTLGDPIE

SEQ ID NO: 954083 - protein, 7 aa, Mycobacterium
EARRNNH

SEQ ID NO: 954084 - protein, 6 aa, Mycobacterium
EPTQQL

SEQ ID NO: 954085 - protein, 8 aa, Mycobacterium
GDFSGANT

SEQ ID NO: 954086 - protein, 6 aa, Mycobacterium
GGTGTL

SEQ ID NO: 954087 - protein, 10 aa, Mycobacterium
GLSPQQQQQT

SEQ ID NO: 954088 - protein, 5 aa, Mycobacterium
GVASA

SEQ ID NO: 954089 - protein, 11 aa, Mycobacterium
HDNTTTGDEQP

SEQ ID NO: 954090 - protein, 6 aa, Mycobacterium
HHTPDQ

SEQ ID NO: 954091 - protein, 7 aa, Mycobacterium
HPDTTGT

SEQ ID NO: 954092 - protein, 14 aa, Mycobacterium
LTTATGSAPATTAA

SEQ ID NO: 954093 - protein, 12 aa, Mycobacterium
NIGHTQAAAGAA

SEQ ID NO: 954094 - protein, 9 aa, Mycobacterium
NTDHPRTAA

SEQ ID NO: 954095 - protein, 5 aa, Mycobacterium
PADRG

SEQ ID NO: 954096 - protein, 8 aa, Mycobacterium
PEDTDIDG

SEQ ID NO: 954097 - protein, 10 aa, Mycobacterium
PREARAMDPQ

SEQ ID NO: 954098 - protein, 17 aa, Mycobacterium
PSNEELQAHQASDTAVS

SEQ ID NO: 954099 - protein, 4 aa, Mycobacterium
PTRE

SEQ ID NO: 954100 - protein, 9 aa, Mycobacterium
PWPPPGTAA

SEQ ID NO: 954101 - protein, 8 aa, Mycobacterium
QGYNYGPT

SEQ ID NO: 954102 - protein, 19 aa, Mycobacterium
QPPTNDTDDTNTADTGDQV

SEQ ID NO: 954103 - protein, 6 aa, Mycobacterium
QPSPHI

SEQ ID NO: 954104 - protein, 6 aa, Mycobacterium
RAGYSS

SEQ ID NO: 954105 - protein, 8 aa, Mycobacterium
RGLAPDGR

SEQ ID NO: 954106 - protein, 7 aa, Mycobacterium
RKDRPDA

SEQ ID NO: 954107 - protein, 6 aa, Mycobacterium
RNNESQ

SEQ ID NO: 954108 - protein, 12 aa, Mycobacterium
RRGPQAHGATDL

SEQ ID NO: 954109 - protein, 5 aa, Mycobacterium
RTGAD

SEQ ID NO: 954110 - protein, 5 aa, Mycobacterium
SDPEA

SEQ ID NO: 954111 - protein, 5 aa, Mycobacterium
SPRTQ

SEQ ID NO: 954112 - protein, 11 aa, Mycobacterium
TDDNTNSDTLT

SEQ ID NO: 954113 - protein, 5 aa, Mycobacterium
TELAE

SEQ ID NO: 954114 - protein, 10 aa, Mycobacterium
TPESISPATA

SEQ ID NO: 954115 - protein, 13 aa, Mycobacterium
TPRRRAASAATDL

SEQ ID NO: 954116 - protein, 8 aa, Mycobacterium
TSDTTGAP

SEQ ID NO: 954117 - protein, 11 aa, Mycobacterium
VSTSAHDPVPD

SEQ ID NO: 954118 - protein, 9 aa, Mycobacterium
ATTRSHHPH

SEQ ID NO: 954119 - protein, 9 aa, Mycobacterium
DLHTSTTEA

SEQ ID NO: 954120 - protein, 5 aa, Mycobacterium
DPADL

SEQ ID NO: 954121 - protein, 6 aa, Mycobacterium
GRTEEP

SEQ ID NO: 954122 - protein, 14 aa, Mycobacterium
GSPGQGNYAAANTA

SEQ ID NO: 954123 - protein, 11 aa, Mycobacterium
HSENNHDTTDA

SEQ ID NO: 954124 - protein, 6 aa, Mycobacterium
NNGTHP

SEQ ID NO: 954125 - protein, 4 aa, Mycobacterium
PDLD

SEQ ID NO: 954126 - protein, 15 aa, Mycobacterium
PHPDTTTDTDTDTDA

SEQ ID NO: 954127 - protein, 8 aa, Mycobacterium
QGSQYPGM

SEQ ID NO: 954128 - protein, 9 aa, Mycobacterium
RSAPGLSAQ

SEQ ID NO: 954129 - protein, 4 aa, Mycobacterium
TGGV

SEQ ID NO: 954130 - protein, 7 aa, Mycobacterium
TPQGPGK

SEQ ID NO: 954131 - protein, 9 aa, Mycobacterium
TPVTELTGD

SEQ ID NO: 954132 - protein, 5 aa, Mycobacterium
AGTST

SEQ ID NO: 954133 - protein, 6 aa, Mycobacterium
AKATAT

SEQ ID NO: 954134 - protein, 5 aa, Mycobacterium
ARDNT

SEQ ID NO: 954135 - protein, 6 aa, Mycobacterium
ATAPDD

SEQ ID NO: 954136 - protein, 11 aa, Mycobacterium
ATADGTGFGEG

SEQ ID NO: 954137 - protein, 6 aa, Mycobacterium
LTDTYD

SEQ ID NO: 954138 - protein, 5 aa, Mycobacterium
PPSTY

SEQ ID NO: 954139 - protein, 19 aa, Mycobacterium
TRRSQLRSRQGDTADVYRR

SEQ ID NO: 954140 - protein, 13 aa, Mycobacterium
DEDRQRPHTRNGA

SEQ ID NO: 954141 - protein, 8 aa, Mycobacterium
ELTPRPST

SEQ ID NO: 954142 - protein, 7 aa, Mycobacterium
EPEAPSL

SEQ ID NO: 954143 - protein, 18 aa, Mycobacterium
LGSGSGGPVRRPSALFCL

SEQ ID NO: 954144 - protein, 4 aa, Mycobacterium
PGTG

SEQ ID NO: 954145 - protein, 5 aa, Mycobacterium
PSHSP

SEQ ID NO: 954146 - protein, 9 aa, Mycobacterium
RHSSDGALT

SEQ ID NO: 954147 - protein, 6 aa, Mycobacterium
SPEEPL

SEQ ID NO: 954148 - protein, 7 aa, Mycobacterium
SPGERSE

SEQ ID NO: 954149 - protein, 4 aa, Mycobacterium
SQGE

SEQ ID NO: 954150 - protein, 15 aa, Mycobacterium
VDGEPHDTAYDTTTM

SEQ ID NO: 954151 - protein, 15 aa, Mycobacterium
VNGPASAVVSGDTTA

SEQ ID NO: 954152 - protein, 9 aa, Mycobacterium
AAGETVEPK

SEQ ID NO: 954153 - protein, 5 aa, Mycobacterium
AAKWS

SEQ ID NO: 954154 - protein, 6 aa, Mycobacterium
ATNGAG

SEQ ID NO: 954155 - protein, 5 aa, Mycobacterium
CTPGG

SEQ ID NO: 954156 - protein, 5 aa, Mycobacterium
DEGAN

SEQ ID NO: 954157 - protein, 8 aa, Mycobacterium
DGFGGEAA

SEQ ID NO: 954158 - protein, 6 aa, Mycobacterium
DRRTTR

SEQ ID NO: 954159 - protein, 8 aa, Mycobacterium
DTTGKGDL

SEQ ID NO: 954160 - protein, 12 aa, Mycobacterium
EDRHRPHTGNGA

SEQ ID NO: 954161 - protein, 6 aa, Mycobacterium
FAPSTV

SEQ ID NO: 954162 - protein, 10 aa, Mycobacterium
FDTAKNDDSF

SEQ ID NO: 954163 - protein, 5 aa, Mycobacterium
FNPGQ

SEQ ID NO: 954164 - protein, 7 aa, Mycobacterium
GDPASVA

SEQ ID NO: 954165 - protein, 6 aa, Mycobacterium
GERSEL

SEQ ID NO: 954166 - protein, 5 aa, Mycobacterium
GLSRG

SEQ ID NO: 954167 - protein, 5 aa, Mycobacterium
GSEAA

SEQ ID NO: 954168 - protein, 5 aa, Mycobacterium
GYTGP

SEQ ID NO: 954169 - protein, 5 aa, Mycobacterium
HDSLE

SEQ ID NO: 954170 - protein, 4 aa, Mycobacterium
IPGT

SEQ ID NO: 954171 - protein, 4 aa, Mycobacterium
KAAT

SEQ ID NO: 954172 - protein, 6 aa, Mycobacterium
KASESP

SEQ ID NO: 954173 - protein, 7 aa, Mycobacterium
KPLPTTN

SEQ ID NO: 954174 - protein, 5 aa, Mycobacterium
LASPD

SEQ ID NO: 954175 - protein, 5 aa, Mycobacterium
LRPEP

SEQ ID NO: 954176 - protein, 10 aa, Mycobacterium
LSDNANTMGK

SEQ ID NO: 954177 - protein, 4 aa, Mycobacterium
LTGT

SEQ ID NO: 954178 - protein, 9 aa, Mycobacterium
LTPPDSGPW

SEQ ID NO: 954179 - protein, 8 aa, Mycobacterium
MGGTGKVV

SEQ ID NO: 954180 - protein, 4 aa, Mycobacterium
PEDP

SEQ ID NO: 954181 - protein, 7 aa, Mycobacterium
PVDGHNT

SEQ ID NO: 954182 - protein, 5 aa, Mycobacterium
QARHT

SEQ ID NO: 954183 - protein, 6 aa, Mycobacterium
QGRTRP

SEQ ID NO: 954184 - protein, 4 aa, Mycobacterium
QRYR

SEQ ID NO: 954185 - protein, 10 aa, Mycobacterium
RHRAHTGNGA

SEQ ID NO: 954186 - protein, 8 aa, Mycobacterium
RLAKAGPG

SEQ ID NO: 954187 - protein, 7 aa, Mycobacterium
RPSSGSF

SEQ ID NO: 954188 - protein, 7 aa, Mycobacterium
SCPPPRH

SEQ ID NO: 954189 - protein, 5 aa, Mycobacterium
SEAEV

SEQ ID NO: 954190 - protein, 22 aa, Mycobacterium
SGASRAGVLGEEAGYHKGLKPR

SEQ ID NO: 954191 - protein, 6 aa, Mycobacterium
SSDGHA

SEQ ID NO: 954192 - protein, 4 aa, Mycobacterium
STTR

SEQ ID NO: 954193 - protein, 14 aa, Mycobacterium
TAAEEALKGTPLED

SEQ ID NO: 954194 - protein, 6 aa, Mycobacterium
TDIRDT

SEQ ID NO: 954195 - protein, 5 aa, Mycobacterium
TDQRS

SEQ ID NO: 954196 - protein, 12 aa, Mycobacterium
VGLPPDRSLVYS

SEQ ID NO: 954197 - protein, 4 aa, Mycobacterium
AAAG

SEQ ID NO: 954198 - protein, 7 aa, Mycobacterium
AAGSATD

SEQ ID NO: 954199 - protein, 4 aa, Mycobacterium
AALT

SEQ ID NO: 954200 - protein, 6 aa, Mycobacterium
AAPSVS

SEQ ID NO: 954201 - protein, 5 aa, Mycobacterium
AARAG

SEQ ID NO: 954202 - protein, 8 aa, Mycobacterium
ADQAPEAV

SEQ ID NO: 954203 - protein, 5 aa, Mycobacterium
ADRST

SEQ ID NO: 954204 - protein, 8 aa, Mycobacterium
AGAPEKAA

SEQ ID NO: 954205 - protein, 4 aa, Mycobacterium
AGEA

SEQ ID NO: 954206 - protein, 5 aa, Mycobacterium
AGITS

SEQ ID NO: 954207 - protein, 9 aa, Mycobacterium
AGNTVDGTS

SEQ ID NO: 954208 - protein, 7 aa, Mycobacterium
AGPTGVE

SEQ ID NO: 954209 - protein, 4 aa, Mycobacterium
AGRI

SEQ ID NO: 954210 - protein, 5 aa, Mycobacterium
APAGA

SEQ ID NO: 954211 - protein, 5 aa, Mycobacterium
APGEN

SEQ ID NO: 954212 - protein, 5 aa, Mycobacterium
APGTD

SEQ ID NO: 954213 - protein, 4 aa, Mycobacterium
APYG

SEQ ID NO: 954214 - protein, 9 aa, Mycobacterium
AQQARADET

SEQ ID NO: 954215 - protein, 7 aa, Mycobacterium
ARHEPEA

SEQ ID NO: 954216 - protein, 8 aa, Mycobacterium
ASGESKSK

SEQ ID NO: 954217 - protein, 5 aa, Mycobacterium
ASRPE

SEQ ID NO: 954218 - protein, 6 aa, Mycobacterium
ASSTPY

SEQ ID NO: 954219 - protein, 5 aa, Mycobacterium
ASTDT

SEQ ID NO: 954220 - protein, 10 aa, Mycobacterium
ATADGTGWGE

SEQ ID NO: 954221 - protein, 4 aa, Mycobacterium
ATEA

SEQ ID NO: 954222 - protein, 13 aa, Mycobacterium
AYDDKAKKTTKAV

SEQ ID NO: 954223 - protein, 4 aa, Mycobacterium
CTPA

SEQ ID NO: 954224 - protein, 9 aa, Mycobacterium
DADGHAPGL

SEQ ID NO: 954225 - protein, 5 aa, Mycobacterium
DAPAD

SEQ ID NO: 954226 - protein, 7 aa, Mycobacterium
DAPPGMT

SEQ ID NO: 954227 - protein, 5 aa, Mycobacterium
DGSHG

SEQ ID NO: 954228 - protein, 8 aa, Mycobacterium
DKPLGDDA

SEQ ID NO: 954229 - protein, 5 aa, Mycobacterium
DMTGA

SEQ ID NO: 954230 - protein, 6 aa, Mycobacterium
DPAGRP

SEQ ID NO: 954231 - protein, 6 aa, Mycobacterium
DPDEGF

SEQ ID NO: 954232 - protein, 5 aa, Mycobacterium
DPHNG

SEQ ID NO: 954233 - protein, 12 aa, Mycobacterium
DPNPTASSYQPP

SEQ ID NO: 954234 - protein, 9 aa, Mycobacterium
DPRDPRGRR

SEQ ID NO: 954235 - protein, 7 aa, Mycobacterium
DRTATGE

SEQ ID NO: 954236 - protein, 7 aa, Mycobacterium
DSDPQAG

SEQ ID NO: 954237 - protein, 8 aa, Mycobacterium
DTSGPGSN

SEQ ID NO: 954238 - protein, 9 aa, Mycobacterium
EGDDCPDST

SEQ ID NO: 954239 - protein, 10 aa, Mycobacterium
EIPRSPNDQD

SEQ ID NO: 954240 - protein, 6 aa, Mycobacterium
EKNNEI

SEQ ID NO: 954241 - protein, 6 aa, Mycobacterium
ERGTGG

SEQ ID NO: 954242 - protein, 7 aa, Mycobacterium
ESPEFNR

SEQ ID NO: 954243 - protein, 4 aa, Mycobacterium
EVVP

SEQ ID NO: 954244 - protein, 4 aa, Mycobacterium
EWRR

SEQ ID NO: 954245 - protein, 5 aa, Mycobacterium
FPSSN

SEQ ID NO: 954246 - protein, 6 aa, Mycobacterium
FSGPQI

SEQ ID NO: 954247 - protein, 17 aa, Mycobacterium
GALGGKTGYTDDAGQTF

SEQ ID NO: 954248 - protein, 4 aa, Mycobacterium
GAVS

SEQ ID NO: 954249 - protein, 6 aa, Mycobacterium
GGAPYY

SEQ ID NO: 954250 - protein, 6 aa, Mycobacterium
GGPGFC

SEQ ID NO: 954251 - protein, 4 aa, Mycobacterium
GGST

SEQ ID NO: 954252 - protein, 4 aa, Mycobacterium
GGTR

SEQ ID NO: 954253 - protein, 5 aa, Mycobacterium
GGTST

SEQ ID NO: 954254 - protein, 6 aa, Mycobacterium
GITPEA

SEQ ID NO: 954255 - protein, 9 aa, Mycobacterium
GKRPFTGDG

SEQ ID NO: 954256 - protein, 9 aa, Mycobacterium
GLTDPEARV

SEQ ID NO: 954257 - protein, 10 aa, Mycobacterium
GNNPAAQTTE

SEQ ID NO: 954258 - protein, 7 aa, Mycobacterium
GNRETPA

SEQ ID NO: 954259 - protein, 8 aa, Mycobacterium
GPPGTGKT

SEQ ID NO: 954260 - protein, 9 aa, Mycobacterium
GPTGAGKTT

SEQ ID NO: 954261 - protein, 8 aa, Mycobacterium
GQASPTHM

SEQ ID NO: 954262 - protein, 5 aa, Mycobacterium
GQTIA

SEQ ID NO: 954263 - protein, 7 aa, Mycobacterium
GRDPKTD

SEQ ID NO: 954264 - protein, 5 aa, Mycobacterium
GRGAQ

SEQ ID NO: 954265 - protein, 15 aa, Mycobacterium
GRIPSDKPPIKTPGE

SEQ ID NO: 954266 - protein, 10 aa, Mycobacterium
GSTGSGKSSF

SEQ ID NO: 954267 - protein, 4 aa, Mycobacterium
GTLT

SEQ ID NO: 954268 - protein, 9 aa, Mycobacterium
HGTNDAQKT

SEQ ID NO: 954269 - protein, 6 aa, Mycobacterium
HPDYPS

SEQ ID NO: 954270 - protein, 6 aa, Mycobacterium
HSPGVG

SEQ ID NO: 954271 - protein, 9 aa, Mycobacterium
IDNPDQRIQ

SEQ ID NO: 954272 - protein, 6 aa, Mycobacterium
IPGKSA

SEQ ID NO: 954273 - protein, 5 aa, Mycobacterium
KAPVI

SEQ ID NO: 954274 - protein, 5 aa, Mycobacterium
KARAA

SEQ ID NO: 954275 - protein, 6 aa, Mycobacterium
KGGGLS

SEQ ID NO: 954276 - protein, 8 aa, Mycobacterium
KGGPLPRG

SEQ ID NO: 954277 - protein, 8 aa, Mycobacterium
KGGSAVKP

SEQ ID NO: 954278 - protein, 6 aa, Mycobacterium
KNGVPY

SEQ ID NO: 954279 - protein, 9 aa, Mycobacterium
KNKPIRPVA

SEQ ID NO: 954280 - protein, 4 aa, Mycobacterium
KRPR

SEQ ID NO: 954281 - protein, 5 aa, Mycobacterium
KYPTG

SEQ ID NO: 954282 - protein, 8 aa, Mycobacterium
LAGDDGPL

SEQ ID NO: 954283 - protein, 11 aa, Mycobacterium
LAKDAAGDKWS

SEQ ID NO: 954284 - protein, 4 aa, Mycobacterium
LARQ

SEQ ID NO: 954285 - protein, 11 aa, Mycobacterium
LDEGGDGPHGV

SEQ ID NO: 954286 - protein, 7 aa, Mycobacterium
LEQRPEC

SEQ ID NO: 954287 - protein, 6 aa, Mycobacterium
LESYTS

SEQ ID NO: 954288 - protein, 14 aa, Mycobacterium
LGGSPLQVSGPAAG

SEQ ID NO: 954289 - protein, 4 aa, Mycobacterium
LGQG

SEQ ID NO: 954290 - protein, 6 aa, Mycobacterium
LRPGEE

SEQ ID NO: 954291 - protein, 4 aa, Mycobacterium
LRRP

SEQ ID NO: 954292 - protein, 13 aa, Mycobacterium
LSEDGKGGPPNNG

SEQ ID NO: 954293 - protein, 10 aa, Mycobacterium
LSTTLPGGPV

SEQ ID NO: 954294 - protein, 4 aa, Mycobacterium
LTPA

SEQ ID NO: 954295 - protein, 7 aa, Mycobacterium
MPPTGGL

SEQ ID NO: 954296 - protein, 10 aa, Mycobacterium
NGEETRSLDS

SEQ ID NO: 954297 - protein, 10 aa, Mycobacterium
NGSGPKFTAR

SEQ ID NO: 954298 - protein, 9 aa, Mycobacterium
NNDPDTATG

SEQ ID NO: 954299 - protein, 6 aa, Mycobacterium
NNTPDG

SEQ ID NO: 954300 - protein, 9 aa, Mycobacterium
NPDERADEM

SEQ ID NO: 954301 - protein, 5 aa, Mycobacterium
NQLQS

SEQ ID NO: 954302 - protein, 6 aa, Mycobacterium
NQPGGL

SEQ ID NO: 954303 - protein, 5 aa, Mycobacterium
NRPDI

SEQ ID NO: 954304 - protein, 7 aa, Mycobacterium
NTADPAA

SEQ ID NO: 954305 - protein, 7 aa, Mycobacterium
PAIGPGT

SEQ ID NO: 954306 - protein, 8 aa, Mycobacterium
PDPTPQPL

SEQ ID NO: 954307 - protein, 6 aa, Mycobacterium
PGAPER

SEQ ID NO: 954308 - protein, 4 aa, Mycobacterium
PKET

SEQ ID NO: 954309 - protein, 5 aa, Mycobacterium
PKPVT

SEQ ID NO: 954310 - protein, 10 aa, Mycobacterium
PLPNGTGNGL

SEQ ID NO: 954311 - protein, 5 aa, Mycobacterium
PPEAN

SEQ ID NO: 954312 - protein, 5 aa, Mycobacterium
PPRVP

SEQ ID NO: 954313 - protein, 7 aa, Mycobacterium
PRNPTGK

SEQ ID NO: 954314 - protein, 6 aa, Mycobacterium
PSSSSH

SEQ ID NO: 954315 - protein, 6 aa, Mycobacterium
PTEQLD

SEQ ID NO: 954316 - protein, 6 aa, Mycobacterium
PTPTAL

SEQ ID NO: 954317 - protein, 5 aa, Mycobacterium
PTYSN

SEQ ID NO: 954318 - protein, 9 aa, Mycobacterium
QGAQLGAGP

SEQ ID NO: 954319 - protein, 7 aa, Mycobacterium
QGPTLSR

SEQ ID NO: 954320 - protein, 7 aa, Mycobacterium
QISGPQQ

SEQ ID NO: 954321 - protein, 5 aa, Mycobacterium
QLGAE

SEQ ID NO: 954322 - protein, 32 aa, Mycobacterium
QPPTPDTTQTPNPTTGSDPAVGSDSAVGSDPA

SEQ ID NO: 954323 - protein, 26 aa, Mycobacterium
QPPTPDTTQTPNTTTGSDPAVGSDPA

SEQ ID NO: 954324 - protein, 4 aa, Mycobacterium
QPSE

SEQ ID NO: 954325 - protein, 6 aa, Mycobacterium
QRARKR

SEQ ID NO: 954326 - protein, 5 aa, Mycobacterium
QRPSV

SEQ ID NO: 954327 - protein, 6 aa, Mycobacterium
QTLNTQ

SEQ ID NO: 954328 - protein, 6 aa, Mycobacterium
QVRSTR

SEQ ID NO: 954329 - protein, 7 aa, Mycobacterium
RARERDS

SEQ ID NO: 954330 - protein, 8 aa, Mycobacterium
RGGGPDNV

SEQ ID NO: 954331 - protein, 12 aa, Mycobacterium
RGSTASHSGSGL

SEQ ID NO: 954332 - protein, 13 aa, Mycobacterium
RGYSRDGKKGLPQ

SEQ ID NO: 954333 - protein, 4 aa, Mycobacterium
RPRD

SEQ ID NO: 954334 - protein, 4 aa, Mycobacterium
RPRE

SEQ ID NO: 954335 - protein, 9 aa, Mycobacterium
RSPQSPNGT

SEQ ID NO: 954336 - protein, 5 aa, Mycobacterium
RTQSR

SEQ ID NO: 954337 - protein, 4 aa, Mycobacterium
SEGA

SEQ ID NO: 954338 - protein, 6 aa, Mycobacterium
SEGSVR

SEQ ID NO: 954339 - protein, 4 aa, Mycobacterium
SERP

SEQ ID NO: 954340 - protein, 4 aa, Mycobacterium
SGLA

SEQ ID NO: 954341 - protein, 6 aa, Mycobacterium
SGVTTQ

SEQ ID NO: 954342 - protein, 7 aa, Mycobacterium
SHLEQAG

SEQ ID NO: 954343 - protein, 8 aa, Mycobacterium
SIPPPEGK

SEQ ID NO: 954344 - protein, 16 aa, Mycobacterium
SLAADPGKAIEGTAYS

SEQ ID NO: 954345 - protein, 5 aa, Mycobacterium
SPEQK

SEQ ID NO: 954346 - protein, 6 aa, Mycobacterium
SSPEPY

SEQ ID NO: 954347 - protein, 7 aa, Mycobacterium
STAGWRD

SEQ ID NO: 954348 - protein, 5 aa, Mycobacterium
SVNPS

SEQ ID NO: 954349 - protein, 9 aa, Mycobacterium
SVSGPSQDQ

SEQ ID NO: 954350 - protein, 6 aa, Mycobacterium
TANELD

SEQ ID NO: 954351 - protein, 10 aa, Mycobacterium
TAPKQGKDAN

SEQ ID NO: 954352 - protein, 4 aa, Mycobacterium
TDGA

SEQ ID NO: 954353 - protein, 10 aa, Mycobacterium
TGCTRGPTVT

SEQ ID NO: 954354 - protein, 7 aa, Mycobacterium
TGKPLSP

SEQ ID NO: 954355 - protein, 7 aa, Mycobacterium
TGTLTEN

SEQ ID NO: 954356 - protein, 6 aa, Mycobacterium
TIESRA

SEQ ID NO: 954357 - protein, 5 aa, Mycobacterium
TPGAV

SEQ ID NO: 954358 - protein, 7 aa, Mycobacterium
TPGGAAD

SEQ ID NO: 954359 - protein, 10 aa, Mycobacterium
TPGTERRTAT

SEQ ID NO: 954360 - protein, 4 aa, Mycobacterium
TRRT

SEQ ID NO: 954361 - protein, 8 aa, Mycobacterium
TSTSPNQQ

SEQ ID NO: 954362 - protein, 10 aa, Mycobacterium
VAGPTDPYGV

SEQ ID NO: 954363 - protein, 5 aa, Mycobacterium
VGADT

SEQ ID NO: 954364 - protein, 5 aa, Mycobacterium
VGDPP

SEQ ID NO: 954365 - protein, 4 aa, Mycobacterium
VGTQ

SEQ ID NO: 954366 - protein, 12 aa, Mycobacterium
VPEEDKGLRTRS

SEQ ID NO: 954367 - protein, 13 aa, Mycobacterium
VSGRGSSAARGAA

SEQ ID NO: 954368 - protein, 9 aa, Mycobacterium
VSRSGSTIS

SEQ ID NO: 954369 - protein, 12 aa, Mycobacterium
VTRDQTKIDAEA

SEQ ID NO: 954370 - protein, 7 aa, Mycobacterium
WGEPGQG

SEQ ID NO: 954371 - protein, 6 aa, Mycobacterium
YGQTQP

SEQ ID NO: 954372 - protein, 13 aa, Mycobacterium
YLPPNNAVRQSQE

SEQ ID NO: 954373 - protein, 4 aa, Mycobacterium
YPRE

SEQ ID NO: 954374 - protein, 4 aa, Mycobacterium
AAAA

SEQ ID NO: 954375 - protein, 8 aa, Mycobacterium
AAAAAGST

SEQ ID NO: 954376 - protein, 9 aa, Mycobacterium
AAADAAHRA

SEQ ID NO: 954377 - protein, 8 aa, Mycobacterium
AAAGTDPI

SEQ ID NO: 954378 - protein, 4 aa, Mycobacterium
AAAP

SEQ ID NO: 954379 - protein, 10 aa, Mycobacterium
AAARTDGADA

SEQ ID NO: 954380 - protein, 4 aa, Mycobacterium
AAAS

SEQ ID NO: 954381 - protein, 8 aa, Mycobacterium
AAASNEAS

SEQ ID NO: 954382 - protein, 4 aa, Mycobacterium
AAAT

SEQ ID NO: 954383 - protein, 5 aa, Mycobacterium
AAATD

SEQ ID NO: 954384 - protein, 17 aa, Mycobacterium
AAATPSGPMHHPHAPSS

SEQ ID NO: 954385 - protein, 4 aa, Mycobacterium
AADG

SEQ ID NO: 954386 - protein, 13 aa, Mycobacterium
AAEEMNTPDRTLP

SEQ ID NO: 954387 - protein, 5 aa, Mycobacterium
AAEIE

SEQ ID NO: 954388 - protein, 12 aa, Mycobacterium
AAEISDAQRTRL

SEQ ID NO: 954389 - protein, 15 aa, Mycobacterium
AAEREADRTLGNKRG

SEQ ID NO: 954390 - protein, 8 aa, Mycobacterium
AAERPDDV

SEQ ID NO: 954391 - protein, 7 aa, Mycobacterium
AAGATTA

SEQ ID NO: 954392 - protein, 5 aa, Mycobacterium
AAGDL

SEQ ID NO: 954393 - protein, 4 aa, Mycobacterium
AAGG

SEQ ID NO: 954394 - protein, 21 aa, Mycobacterium
AAGKQAPGVVGQQDGTPGSGT

SEQ ID NO: 954395 - protein, 5 aa, Mycobacterium
AAGLS

SEQ ID NO: 954396 - protein, 16 aa, Mycobacterium
AAGPHAGDRSPSRTVP

SEQ ID NO: 954397 - protein, 7 aa, Mycobacterium
AAGQPRV

SEQ ID NO: 954398 - protein, 9 aa, Mycobacterium
AAGRAGGQL

SEQ ID NO: 954399 - protein, 7 aa, Mycobacterium
AAGSWQS

SEQ ID NO: 954400 - protein, 16 aa, Mycobacterium
AAIDTAKGSMKGPVES

SEQ ID NO: 954401 - protein, 13 aa, Mycobacterium
AAIPDGEVAESAE

SEQ ID NO: 954402 - protein, 9 aa, Mycobacterium
AAKASRAAA

SEQ ID NO: 954403 - protein, 33 aa, Mycobacterium
AAKNEARRLNSAQRATNKALKAQLKAKRNSDRV

SEQ ID NO: 954404 - protein, 15 aa, Mycobacterium
AAKPKNKNDAGPQLN

SEQ ID NO: 954405 - protein, 7 aa, Mycobacterium
AAMPPTA

SEQ ID NO: 954406 - protein, 10 aa, Mycobacterium
AANESADSMD

SEQ ID NO: 954407 - protein, 12 aa, Mycobacterium
AANGNTPAETFG

SEQ ID NO: 954408 - protein, 12 aa, Mycobacterium
AANKAESAVTSH

SEQ ID NO: 954409 - protein, 8 aa, Mycobacterium
AANLGSDP

SEQ ID NO: 954410 - protein, 16 aa, Mycobacterium
AANNEDKEDTDQDDGA

SEQ ID NO: 954411 - protein, 31 aa, Mycobacterium
AAPATGAPVPAAPRKPVPIPTTEKSPPPQTV

SEQ ID NO: 954412 - protein, 12 aa, Mycobacterium
AAPSYEEERRTR

SEQ ID NO: 954413 - protein, 16 aa, Mycobacterium
AAPTNNATFNKTMSEQ

SEQ ID NO: 954414 - protein, 7 aa, Mycobacterium
AAPVASA

SEQ ID NO: 954415 - protein, 4 aa, Mycobacterium
AAQA

SEQ ID NO: 954416 - protein, 11 aa, Mycobacterium
AAQALGPGALG

SEQ ID NO: 954417 - protein, 8 aa, Mycobacterium
AAQDISLA

SEQ ID NO: 954418 - protein, 16 aa, Mycobacterium
AAQEAAKQFAGELTPG

SEQ ID NO: 954419 - protein, 5 aa, Mycobacterium
AAQEL

SEQ ID NO: 954420 - protein, 19 aa, Mycobacterium
AARASTQPHDGQGHTHATD

SEQ ID NO: 954421 - protein, 7 aa, Mycobacterium
AARGAKN

SEQ ID NO: 954422 - protein, 8 aa, Mycobacterium
AARRGRIQ

SEQ ID NO: 954423 - protein, 6 aa, Mycobacterium
AARSGN

SEQ ID NO: 954424 - protein, 26 aa, Mycobacterium
AARTNSPSARAHRKRGNKTRGGARGY

SEQ ID NO: 954425 - protein, 8 aa, Mycobacterium
AASAGAQA

SEQ ID NO: 954426 - protein, 12 aa, Mycobacterium
AASDNDSPLAAN

SEQ ID NO: 954427 - protein, 4 aa, Mycobacterium
AASE

SEQ ID NO: 954428 - protein, 4 aa, Mycobacterium
AASQ

SEQ ID NO: 954429 - protein, 11 aa, Mycobacterium
AATDDGSSGVQ

SEQ ID NO: 954430 - protein, 7 aa, Mycobacterium
AATGLDD

SEQ ID NO: 954431 - protein, 8 aa, Mycobacterium
AATPAGKQ

SEQ ID NO: 954432 - protein, 8 aa, Mycobacterium
AATRRTSL

SEQ ID NO: 954433 - protein, 4 aa, Mycobacterium
AATT

SEQ ID NO: 954434 - protein, 7 aa, Mycobacterium
AATTRRR

SEQ ID NO: 954435 - protein, 14 aa, Mycobacterium
AAVAANSKHDIAEA

SEQ ID NO: 954436 - protein, 6 aa, Mycobacterium
AAVAAS

SEQ ID NO: 954437 - protein, 11 aa, Mycobacterium
AAVRAAGRTPL

SEQ ID NO: 954438 - protein, 5 aa, Mycobacterium
ACTAA

SEQ ID NO: 954439 - protein, 11 aa, Mycobacterium
ADAPDQPNYQR

SEQ ID NO: 954440 - protein, 8 aa, Mycobacterium
ADDQRKEV

SEQ ID NO: 954441 - protein, 5 aa, Mycobacterium
ADDST

SEQ ID NO: 954442 - protein, 15 aa, Mycobacterium
ADEMGDAITARGGIG

SEQ ID NO: 954443 - protein, 8 aa, Mycobacterium
ADFSRQTG

SEQ ID NO: 954444 - protein, 6 aa, Mycobacterium
ADGSGV

SEQ ID NO: 954445 - protein, 7 aa, Mycobacterium
ADGTQHR

SEQ ID NO: 954446 - protein, 12 aa, Mycobacterium
ADGYTDYAGAGK

SEQ ID NO: 954447 - protein, 6 aa, Mycobacterium
ADIPQG

SEQ ID NO: 954448 - protein, 10 aa, Mycobacterium
ADLDPAEAQR

SEQ ID NO: 954449 - protein, 10 aa, Mycobacterium
ADLSGAGAAI

SEQ ID NO: 954450 - protein, 5 aa, Mycobacterium
ADNVT

SEQ ID NO: 954451 - protein, 8 aa, Mycobacterium
ADPAPAHR

SEQ ID NO: 954452 - protein, 7 aa, Mycobacterium
ADPERTA

SEQ ID NO: 954453 - protein, 6 aa, Mycobacterium
ADPRPV

SEQ ID NO: 954454 - protein, 16 aa, Mycobacterium
ADPSPRKVPAGYSGVR

SEQ ID NO: 954455 - protein, 5 aa, Mycobacterium
ADQFS

SEQ ID NO: 954456 - protein, 6 aa, Mycobacterium
ADRNPT

SEQ ID NO: 954457 - protein, 9 aa, Mycobacterium
ADSTSVTQT

SEQ ID NO: 954458 - protein, 9 aa, Mycobacterium
ADTTGREAD

SEQ ID NO: 954459 - protein, 7 aa, Mycobacterium
ADVPGMP

SEQ ID NO: 954460 - protein, 9 aa, Mycobacterium
AEAANGTQT

SEQ ID NO: 954461 - protein, 7 aa, Mycobacterium
AEAGKEA

SEQ ID NO: 954462 - protein, 5 aa, Mycobacterium
AEATT

SEQ ID NO: 954463 - protein, 5 aa, Mycobacterium
AEDQI

SEQ ID NO: 954464 - protein, 10 aa, Mycobacterium
AEEAGTAKPK

SEQ ID NO: 954465 - protein, 9 aa, Mycobacterium
AEGYDTEAA

SEQ ID NO: 954466 - protein, 4 aa, Mycobacterium
AEKG

SEQ ID NO: 954467 - protein, 9 aa, Mycobacterium
AELDTDRPF

SEQ ID NO: 954468 - protein, 13 aa, Mycobacterium
AELGEANPAEREP

SEQ ID NO: 954469 - protein, 7 aa, Mycobacterium
AEPNTAA

SEQ ID NO: 954470 - protein, 6 aa, Mycobacterium
AEPRTV

SEQ ID NO: 954471 - protein, 16 aa, Mycobacterium
AEQQGCCRQGTLAHRR

SEQ ID NO: 954472 - protein, 13 aa, Mycobacterium
AERDTGSLSGGEL

SEQ ID NO: 954473 - protein, 6 aa, Mycobacterium
AERIAE

SEQ ID NO: 954474 - protein, 6 aa, Mycobacterium
AERSKL

SEQ ID NO: 954475 - protein, 18 aa, Mycobacterium
AERVSNEVNAYTYCLVKS

SEQ ID NO: 954476 - protein, 4 aa, Mycobacterium
AESQ

SEQ ID NO: 954477 - protein, 15 aa, Mycobacterium
AETATGRDVDPDGAV

SEQ ID NO: 954478 - protein, 11 aa, Mycobacterium
AFDGDQQVAGK

SEQ ID NO: 954479 - protein, 8 aa, Mycobacterium
AFPGTGTN

SEQ ID NO: 954480 - protein, 4 aa, Mycobacterium
AFTG

SEQ ID NO: 954481 - protein, 10 aa, Mycobacterium
AGAGSGGEPV

SEQ ID NO: 954482 - protein, 29 aa, Mycobacterium
AGAKQPDAKKPVSQTTSAKATEAPAATVP

SEQ ID NO: 954483 - protein, 9 aa, Mycobacterium
AGAKSRASS

SEQ ID NO: 954484 - protein, 15 aa, Mycobacterium
AGDETWRGMQQGSDY

SEQ ID NO: 954485 - protein, 7 aa, Mycobacterium
AGDHASV

SEQ ID NO: 954486 - protein, 13 aa, Mycobacterium
AGDSSKKNCKQNP

SEQ ID NO: 954487 - protein, 7 aa, Mycobacterium
AGDVGTY

SEQ ID NO: 954488 - protein, 15 aa, Mycobacterium
AGEDISKTGNPVQSA

SEQ ID NO: 954489 - protein, 7 aa, Mycobacterium
AGESLQD

SEQ ID NO: 954490 - protein, 7 aa, Mycobacterium
AGESRSR

SEQ ID NO: 954491 - protein, 10 aa, Mycobacterium
AGETTAPVGP

SEQ ID NO: 954492 - protein, 7 aa, Mycobacterium
AGETTKT

SEQ ID NO: 954493 - protein, 11 aa, Mycobacterium
AGFSPRDEDRV

SEQ ID NO: 954494 - protein, 6 aa, Mycobacterium
AGGEAV

SEQ ID NO: 954495 - protein, 9 aa, Mycobacterium
AGGLSNEAV

SEQ ID NO: 954496 - protein, 10 aa, Mycobacterium
AGGQSTAQAA

SEQ ID NO: 954497 - protein, 4 aa, Mycobacterium
AGGR

SEQ ID NO: 954498 - protein, 10 aa, Mycobacterium
AGGSGKTTAL

SEQ ID NO: 954499 - protein, 7 aa, Mycobacterium
AGGTSAA

SEQ ID NO: 954500 - protein, 20 aa, Mycobacterium
AGGVSGPLGPKQGGQHPIGA

SEQ ID NO: 954501 - protein, 30 aa, Mycobacterium
AGHRPPRPNQTPSSGRASPTTIPSSTQARA

SEQ ID NO: 954502 - protein, 6 aa, Mycobacterium
AGIGQA

SEQ ID NO: 954503 - protein, 7 aa, Mycobacterium
AGKDSFP

SEQ ID NO: 954504 - protein, 11 aa, Mycobacterium
AGLASTGMPAR

SEQ ID NO: 954505 - protein, 4 aa, Mycobacterium
AGLG

SEQ ID NO: 954506 - protein, 4 aa, Mycobacterium
AGLP

SEQ ID NO: 954507 - protein, 19 aa, Mycobacterium
AGLPPNPAGSHPDNNAGPR

SEQ ID NO: 954508 - protein, 5 aa, Mycobacterium
AGLSG

SEQ ID NO: 954509 - protein, 12 aa, Mycobacterium
AGLSRQGRRGPM

SEQ ID NO: 954510 - protein, 12 aa, Mycobacterium
AGLTGPQSAGQT

SEQ ID NO: 954511 - protein, 9 aa, Mycobacterium
AGLTPASAD

SEQ ID NO: 954512 - protein, 75 aa, Mycobacterium
AGMPATGGFSAQHSAQQGPSTPPTGFPSFSPPPSVGAAAGSQAGSAPVSYSNPTDSKQGFGQGRESTSSSSGSAP

SEQ ID NO: 954513 - protein, 28 aa, Mycobacterium
AGNEQHQPPTPTVTDTGTPPATKTLSGF

SEQ ID NO: 954514 - protein, 7 aa, Mycobacterium
AGNPGTI

SEQ ID NO: 954515 - protein, 6 aa, Mycobacterium
AGNQGE

SEQ ID NO: 954516 - protein, 6 aa, Mycobacterium
AGNTDL

SEQ ID NO: 954517 - protein, 6 aa, Mycobacterium
AGNTWP

SEQ ID NO: 954518 - protein, 5 aa, Mycobacterium
AGNTY

SEQ ID NO: 954519 - protein, 7 aa, Mycobacterium
AGPKDLQ

SEQ ID NO: 954520 - protein, 23 aa, Mycobacterium
AGPKQALENADTVRDRVQQRAAV

SEQ ID NO: 954521 - protein, 4 aa, Mycobacterium
AGPL

SEQ ID NO: 954522 - protein, 7 aa, Mycobacterium
AGPNPGH

SEQ ID NO: 954523 - protein, 9 aa, Mycobacterium
AGPPDSHGM

SEQ ID NO: 954524 - protein, 16 aa, Mycobacterium
AGPSGQISPQVNGNTW

SEQ ID NO: 954525 - protein, 7 aa, Mycobacterium
AGPTEQI

SEQ ID NO: 954526 - protein, 5 aa, Mycobacterium
AGPTV

SEQ ID NO: 954527 - protein, 6 aa, Mycobacterium
AGQDAL

SEQ ID NO: 954528 - protein, 7 aa, Mycobacterium
AGQGAES

SEQ ID NO: 954529 - protein, 6 aa, Mycobacterium
AGQVQT

SEQ ID NO: 954530 - protein, 4 aa, Mycobacterium
AGRA

SEQ ID NO: 954531 - protein, 9 aa, Mycobacterium
AGRQLAEGR

SEQ ID NO: 954532 - protein, 9 aa, Mycobacterium
AGRSSERLR

SEQ ID NO: 954533 - protein, 8 aa, Mycobacterium
AGRTRTGV

SEQ ID NO: 954534 - protein, 6 aa, Mycobacterium
AGRYGQ

SEQ ID NO: 954535 - protein, 4 aa, Mycobacterium
AGSA

SEQ ID NO: 954536 - protein, 6 aa, Mycobacterium
AGSDGV

SEQ ID NO: 954537 - protein, 8 aa, Mycobacterium
AGSGRLGN

SEQ ID NO: 954538 - protein, 7 aa, Mycobacterium
AGSPQLE

SEQ ID NO: 954539 - protein, 9 aa, Mycobacterium
AGSSARRAT

SEQ ID NO: 954540 - protein, 6 aa, Mycobacterium
AGSTSI

SEQ ID NO: 954541 - protein, 14 aa, Mycobacterium
AGTADSGNFTDAGA

SEQ ID NO: 954542 - protein, 5 aa, Mycobacterium
AGTDH

SEQ ID NO: 954543 - protein, 6 aa, Mycobacterium
AGTGTA

SEQ ID NO: 954544 - protein, 6 aa, Mycobacterium
AGTSTG

SEQ ID NO: 954545 - protein, 8 aa, Mycobacterium
AGTTARFD

SEQ ID NO: 954546 - protein, 11 aa, Mycobacterium
AGVDGSNVGRG

SEQ ID NO: 954547 - protein, 11 aa, Mycobacterium
AGYDDEPYYPI

SEQ ID NO: 954548 - protein, 4 aa, Mycobacterium
AGYR

SEQ ID NO: 954549 - protein, 32 aa, Mycobacterium
AGYSRGHNLAGGRPSAAKTGTVQLGDTTANKD

SEQ ID NO: 954550 - protein, 6 aa, Mycobacterium
AHASSS

SEQ ID NO: 954551 - protein, 13 aa, Mycobacterium
AHAYPDAARASAE

SEQ ID NO: 954552 - protein, 10 aa, Mycobacterium
AHDATRSYPE

SEQ ID NO: 954553 - protein, 9 aa, Mycobacterium
AHDRGDELE

SEQ ID NO: 954554 - protein, 26 aa, Mycobacterium
AHSPQQSPAGYGAQYGAYTSSPTQIQ

SEQ ID NO: 954555 - protein, 4 aa, Mycobacterium
AHTR

SEQ ID NO: 954556 - protein, 7 aa, Mycobacterium
AIASPTG

SEQ ID NO: 954557 - protein, 4 aa, Mycobacterium
AIDE

SEQ ID NO: 954558 - protein, 9 aa, Mycobacterium
AIDQTRSEI

SEQ ID NO: 954559 - protein, 5 aa, Mycobacterium
AIGGP

SEQ ID NO: 954560 - protein, 8 aa, Mycobacterium
AIGNGARR

SEQ ID NO: 954561 - protein, 5 aa, Mycobacterium
AIGRQ

SEQ ID NO: 954562 - protein, 8 aa, Mycobacterium
AIGSSAAS

SEQ ID NO: 954563 - protein, 9 aa, Mycobacterium
AIQSATRDR

SEQ ID NO: 954564 - protein, 10 aa, Mycobacterium
AKAAPHNPAL

SEQ ID NO: 954565 - protein, 10 aa, Mycobacterium
AKAKSETASS

SEQ ID NO: 954566 - protein, 10 aa, Mycobacterium
AKDGSETGRR

SEQ ID NO: 954567 - protein, 9 aa, Mycobacterium
AKDKPSEIN

SEQ ID NO: 954568 - protein, 4 aa, Mycobacterium
AKGA

SEQ ID NO: 954569 - protein, 8 aa, Mycobacterium
AKGGNAVS

SEQ ID NO: 954570 - protein, 7 aa, Mycobacterium
AKGLTRR

SEQ ID NO: 954571 - protein, 4 aa, Mycobacterium
AKIP

SEQ ID NO: 954572 - protein, 8 aa, Mycobacterium
AKKLKRAN

SEQ ID NO: 954573 - protein, 11 aa, Mycobacterium
AKKTQQSTSRT

SEQ ID NO: 954574 - protein, 38 aa, Mycobacterium
AKLDGRSAATVGGGRRRRLPSDPPSPKQPGRATGPGWR

SEQ ID NO: 954575 - protein, 6 aa, Mycobacterium
AKLPVD

SEQ ID NO: 954576 - protein, 11 aa, Mycobacterium
AKMDGATSGQA

SEQ ID NO: 954577 - protein, 13 aa, Mycobacterium
AKNPENRYQTAAE

SEQ ID NO: 954578 - protein, 12 aa, Mycobacterium
AKQDAENHNRTT

SEQ ID NO: 954579 - protein, 5 aa, Mycobacterium
AKQQQ

SEQ ID NO: 954580 - protein, 12 aa, Mycobacterium
AKQWQTDPAELP

SEQ ID NO: 954581 - protein, 4 aa, Mycobacterium
AKSG

SEQ ID NO: 954582 - protein, 6 aa, Mycobacterium
AKSGLA

SEQ ID NO: 954583 - protein, 9 aa, Mycobacterium
AKSKAGSAL

SEQ ID NO: 954584 - protein, 21 aa, Mycobacterium
AKSTGRALGTGHSPNFANRVD

SEQ ID NO: 954585 - protein, 12 aa, Mycobacterium
AKTDADSKMSAA

SEQ ID NO: 954586 - protein, 16 aa, Mycobacterium
AKTTSVPTEVTVPNRY

SEQ ID NO: 954587 - protein, 9 aa, Mycobacterium
AKWSPSGGR

SEQ ID NO: 954588 - protein, 21 aa, Mycobacterium
AKYPEVGSERQDLRQYPGGSL

SEQ ID NO: 954589 - protein, 10 aa, Mycobacterium
ALANTPANVF

SEQ ID NO: 954590 - protein, 5 aa, Mycobacterium
ALASA

SEQ ID NO: 954591 - protein, 10 aa, Mycobacterium
ALDGPPPAMP

SEQ ID NO: 954592 - protein, 6 aa, Mycobacterium
ALEPER

SEQ ID NO: 954593 - protein, 8 aa, Mycobacterium
ALESSTIR

SEQ ID NO: 954594 - protein, 6 aa, Mycobacterium
ALGKPH

SEQ ID NO: 954595 - protein, 4 aa, Mycobacterium
ALGP

SEQ ID NO: 954596 - protein, 30 aa, Mycobacterium
ALGQGDNSRQHRRATGGGISAQDLLRREGR

SEQ ID NO: 954597 - protein, 14 aa, Mycobacterium
ALGSGEDDSTPAFD

SEQ ID NO: 954598 - protein, 8 aa, Mycobacterium
ALNTDQNI

SEQ ID NO: 954599 - protein, 8 aa, Mycobacterium
ALPGTTTA

SEQ ID NO: 954600 - protein, 8 aa, Mycobacterium
ALRSRRNR

SEQ ID NO: 954601 - protein, 10 aa, Mycobacterium
ALSNPDQDHA

SEQ ID NO: 954602 - protein, 6 aa, Mycobacterium
ALSPTG

SEQ ID NO: 954603 - protein, 18 aa, Mycobacterium
ALSPTGRCNSFDANADGF

SEQ ID NO: 954604 - protein, 5 aa, Mycobacterium
ALTGD

SEQ ID NO: 954605 - protein, 13 aa, Mycobacterium
ALTTDDPRSTDNN

SEQ ID NO: 954606 - protein, 10 aa, Mycobacterium
AMTPKGADVE

SEQ ID NO: 954607 - protein, 4 aa, Mycobacterium
ANDL

SEQ ID NO: 954608 - protein, 7 aa, Mycobacterium
ANDSEGA

SEQ ID NO: 954609 - protein, 13 aa, Mycobacterium
ANDSGVTPAELRT

SEQ ID NO: 954610 - protein, 15 aa, Mycobacterium
ANEFDTRATAPQRPV

SEQ ID NO: 954611 - protein, 17 aa, Mycobacterium
ANGGGPTVARNPDGSVA

SEQ ID NO: 954612 - protein, 5 aa, Mycobacterium
ANGQL

SEQ ID NO: 954613 - protein, 13 aa, Mycobacterium
ANGRDDLGGRLCS

SEQ ID NO: 954614 - protein, 8 aa, Mycobacterium
ANHAEPQQ

SEQ ID NO: 954615 - protein, 5 aa, Mycobacterium
ANIDQ

SEQ ID NO: 954616 - protein, 10 aa, Mycobacterium
ANKPLDESTL

SEQ ID NO: 954617 - protein, 6 aa, Mycobacterium
ANPDPA

SEQ ID NO: 954618 - protein, 15 aa, Mycobacterium
ANPPVQPSERSHSQN

SEQ ID NO: 954619 - protein, 5 aa, Mycobacterium
ANQDD

SEQ ID NO: 954620 - protein, 5 aa, Mycobacterium
ANQER

SEQ ID NO: 954621 - protein, 6 aa, Mycobacterium
ANRATR

SEQ ID NO: 954622 - protein, 6 aa, Mycobacterium
ANRNGR

SEQ ID NO: 954623 - protein, 16 aa, Mycobacterium
ANRQSRPGTSASMPLP

SEQ ID NO: 954624 - protein, 10 aa, Mycobacterium
ANSDPQRIDG

SEQ ID NO: 954625 - protein, 6 aa, Mycobacterium
ANSEAV

SEQ ID NO: 954626 - protein, 9 aa, Mycobacterium
ANSSDDGYQ

SEQ ID NO: 954627 - protein, 7 aa, Mycobacterium
ANTSDDG

SEQ ID NO: 954628 - protein, 18 aa, Mycobacterium
APAAGVSSCTATRSPAVS

SEQ ID NO: 954629 - protein, 13 aa, Mycobacterium
APADIPEDTVRDT

SEQ ID NO: 954630 - protein, 7 aa, Mycobacterium
APAPDLA

SEQ ID NO: 954631 - protein, 7 aa, Mycobacterium
APAPRLS

SEQ ID NO: 954632 - protein, 6 aa, Mycobacterium
APDGLG

SEQ ID NO: 954633 - protein, 4 aa, Mycobacterium
APDK

SEQ ID NO: 954634 - protein, 4 aa, Mycobacterium
APDL

SEQ ID NO: 954635 - protein, 24 aa, Mycobacterium
APDPETSQNSASPATRLPTAYANL

SEQ ID NO: 954636 - protein, 7 aa, Mycobacterium
APDTTVP

SEQ ID NO: 954637 - protein, 5 aa, Mycobacterium
APEDQ

SEQ ID NO: 954638 - protein, 13 aa, Mycobacterium
APEPRWPKSPPLT

SEQ ID NO: 954639 - protein, 4 aa, Mycobacterium
APEQ

SEQ ID NO: 954640 - protein, 20 aa, Mycobacterium
APERKTRALKEAGTDSPRLK

SEQ ID NO: 954641 - protein, 31 aa, Mycobacterium
APGASPSSAAPPASAASAAAAAPAPPGTGFG

SEQ ID NO: 954642 - protein, 6 aa, Mycobacterium
APGFDA

SEQ ID NO: 954643 - protein, 14 aa, Mycobacterium
APGGTSAPPTSERS

SEQ ID NO: 954644 - protein, 4 aa, Mycobacterium
APGV

SEQ ID NO: 954645 - protein, 24 aa, Mycobacterium
APGVRPVRPTGTRRPTGKRNNVGR

SEQ ID NO: 954646 - protein, 5 aa, Mycobacterium
APNRP

SEQ ID NO: 954647 - protein, 36 aa, Mycobacterium
APPASATSSGNSYTSNSAPSTSASATTDNPLSSPSI

SEQ ID NO: 954648 - protein, 4 aa, Mycobacterium
APPQ

SEQ ID NO: 954649 - protein, 8 aa, Mycobacterium
APPQFADN

SEQ ID NO: 954650 - protein, 5 aa, Mycobacterium
APPSL

SEQ ID NO: 954651 - protein, 8 aa, Mycobacterium
APQAKPYR

SEQ ID NO: 954652 - protein, 8 aa, Mycobacterium
APQLDPQL

SEQ ID NO: 954653 - protein, 11 aa, Mycobacterium
APRSDASYQDM

SEQ ID NO: 954654 - protein, 7 aa, Mycobacterium
APRSGYD

SEQ ID NO: 954655 - protein, 8 aa, Mycobacterium
APSERGGS

SEQ ID NO: 954656 - protein, 5 aa, Mycobacterium
APSLD

SEQ ID NO: 954657 - protein, 6 aa, Mycobacterium
APSNET

SEQ ID NO: 954658 - protein, 13 aa, Mycobacterium
APSNSYSGSPAWN

SEQ ID NO: 954659 - protein, 5 aa, Mycobacterium
APSRC

SEQ ID NO: 954660 - protein, 11 aa, Mycobacterium
APSRSALPARP

SEQ ID NO: 954661 - protein, 10 aa, Mycobacterium
APSTEGDYPD

SEQ ID NO: 954662 - protein, 7 aa, Mycobacterium
APTENIT

SEQ ID NO: 954663 - protein, 7 aa, Mycobacterium
APTPPLA

SEQ ID NO: 954664 - protein, 11 aa, Mycobacterium
APTSEGARGSD

SEQ ID NO: 954665 - protein, 14 aa, Mycobacterium
APTTLPDSSFHDPP

SEQ ID NO: 954666 - protein, 8 aa, Mycobacterium
AQADYEAA

SEQ ID NO: 954667 - protein, 23 aa, Mycobacterium
AQATHSRPATIPAPNPTPAREVP

SEQ ID NO: 954668 - protein, 17 aa, Mycobacterium
AQDATGLAQDARLGPAF

SEQ ID NO: 954669 - protein, 7 aa, Mycobacterium
AQDTRRQ

SEQ ID NO: 954670 - protein, 9 aa, Mycobacterium
AQDYPGARA

SEQ ID NO: 954671 - protein, 7 aa, Mycobacterium
AQEDYNG

SEQ ID NO: 954672 - protein, 7 aa, Mycobacterium
AQGGTTL

SEQ ID NO: 954673 - protein, 8 aa, Mycobacterium
AQGNTDSI

SEQ ID NO: 954674 - protein, 13 aa, Mycobacterium
AQHAAPAIGREGG

SEQ ID NO: 954675 - protein, 9 aa, Mycobacterium
AQHATRTVT

SEQ ID NO: 954676 - protein, 7 aa, Mycobacterium
AQNGMPS

SEQ ID NO: 954677 - protein, 4 aa, Mycobacterium
AQPG

SEQ ID NO: 954678 - protein, 8 aa, Mycobacterium
AQPGSAGA

SEQ ID NO: 954679 - protein, 11 aa, Mycobacterium
AQPTAANDPMY

SEQ ID NO: 954680 - protein, 6 aa, Mycobacterium
AQQPAL

SEQ ID NO: 954681 - protein, 7 aa, Mycobacterium
AQQQSKT

SEQ ID NO: 954682 - protein, 16 aa, Mycobacterium
AQQTRSVDAGGEAPRV

SEQ ID NO: 954683 - protein, 5 aa, Mycobacterium
AQRPR

SEQ ID NO: 954684 - protein, 6 aa, Mycobacterium
ARAATR

SEQ ID NO: 954685 - protein, 4 aa, Mycobacterium
ARAS

SEQ ID NO: 954686 - protein, 52 aa, Mycobacterium
ARASQAAEASHQAAQSDTDGPPGQGANGSHAGDRQRQHGPTQPDYGAPPGWH

SEQ ID NO: 954687 - protein, 13 aa, Mycobacterium
ARDAAHSVKTYPA

SEQ ID NO: 954688 - protein, 7 aa, Mycobacterium
ARDKAGP

SEQ ID NO: 954689 - protein, 6 aa, Mycobacterium
ARDNTL

SEQ ID NO: 954690 - protein, 4 aa, Mycobacterium
ARDP

SEQ ID NO: 954691 - protein, 11 aa, Mycobacterium
ARDPHGRHRPA

SEQ ID NO: 954692 - protein, 9 aa, Mycobacterium
AREAQKKGD

SEQ ID NO: 954693 - protein, 4 aa, Mycobacterium
AREP

SEQ ID NO: 954694 - protein, 10 aa, Mycobacterium
ARERGGGTRY

SEQ ID NO: 954695 - protein, 12 aa, Mycobacterium
ARERRASAKTGR

SEQ ID NO: 954696 - protein, 8 aa, Mycobacterium
ARGGERDV

SEQ ID NO: 954697 - protein, 9 aa, Mycobacterium
ARHPGGGVD

SEQ ID NO: 954698 - protein, 14 aa, Mycobacterium
ARHPLRSRPHNTSP

SEQ ID NO: 954699 - protein, 5 aa, Mycobacterium
ARHSA

SEQ ID NO: 954700 - protein, 9 aa, Mycobacterium
ARLPEGDPW

SEQ ID NO: 954701 - protein, 25 aa, Mycobacterium
ARLRPNKSGKRPNVIPTQPKCHLPV

SEQ ID NO: 954702 - protein, 8 aa, Mycobacterium
ARNEGQVK

SEQ ID NO: 954703 - protein, 15 aa, Mycobacterium
ARNPEKTLESALTAG

SEQ ID NO: 954704 - protein, 19 aa, Mycobacterium
ARNTNIPNSTGGQDPCFAN

SEQ ID NO: 954705 - protein, 7 aa, Mycobacterium
ARPRDPR

SEQ ID NO: 954706 - protein, 8 aa, Mycobacterium
ARQPEAQS

SEQ ID NO: 954707 - protein, 11 aa, Mycobacterium
ARQRAGTQDVP

SEQ ID NO: 954708 - protein, 10 aa, Mycobacterium
ARREGESRGE

SEQ ID NO: 954709 - protein, 18 aa, Mycobacterium
ARRGARGAQGGLETYLDP

SEQ ID NO: 954710 - protein, 6 aa, Mycobacterium
ARRRTE

SEQ ID NO: 954711 - protein, 7 aa, Mycobacterium
ARRSPHR

SEQ ID NO: 954712 - protein, 9 aa, Mycobacterium
ARSASESSV

SEQ ID NO: 954713 - protein, 28 aa, Mycobacterium
ARSDRPAPSRLTQQVEPASERTSKYPTL

SEQ ID NO: 954714 - protein, 10 aa, Mycobacterium
ARSGLSGAQI

SEQ ID NO: 954715 - protein, 9 aa, Mycobacterium
ARSGQLGSG

SEQ ID NO: 954716 - protein, 11 aa, Mycobacterium
ARSPARGVDNQ

SEQ ID NO: 954717 - protein, 7 aa, Mycobacterium
ARSRELP

SEQ ID NO: 954718 - protein, 10 aa, Mycobacterium
ARTGTDYADL

SEQ ID NO: 954719 - protein, 13 aa, Mycobacterium
ARVDGRKSIEEAR

SEQ ID NO: 954720 - protein, 14 aa, Mycobacterium
ARVSAEAKTAATVS

SEQ ID NO: 954721 - protein, 10 aa, Mycobacterium
ARYPGASRRE

SEQ ID NO: 954722 - protein, 14 aa, Mycobacterium
ASAASEFSQPLPTG

SEQ ID NO: 954723 - protein, 5 aa, Mycobacterium
ASASH

SEQ ID NO: 954724 - protein, 9 aa, Mycobacterium
ASATRQEFA

SEQ ID NO: 954725 - protein, 9 aa, Mycobacterium
ASDPEGAKA

SEQ ID NO: 954726 - protein, 5 aa, Mycobacterium
ASDRF

SEQ ID NO: 954727 - protein, 8 aa, Mycobacterium
ASDTTNTV

SEQ ID NO: 954728 - protein, 14 aa, Mycobacterium
ASEALGVPAGTSGA

SEQ ID NO: 954729 - protein, 8 aa, Mycobacterium
ASEDGTLD

SEQ ID NO: 954730 - protein, 8 aa, Mycobacterium
ASESRAHS

SEQ ID NO: 954731 - protein, 5 aa, Mycobacterium
ASGAG

SEQ ID NO: 954732 - protein, 5 aa, Mycobacterium
ASGAV

SEQ ID NO: 954733 - protein, 6 aa, Mycobacterium
ASGGLT

SEQ ID NO: 954734 - protein, 12 aa, Mycobacterium
ASGRDGQAADIA

SEQ ID NO: 954735 - protein, 8 aa, Mycobacterium
ASGRRRTQ

SEQ ID NO: 954736 - protein, 19 aa, Mycobacterium
ASHTGSKAINTGSTLEAQA

SEQ ID NO: 954737 - protein, 50 aa, Mycobacterium
ASLAAPASRVPRGPTHPATLEPSQRARSGLASRPQIKRPQELPSGASTAR

SEQ ID NO: 954738 - protein, 11 aa, Mycobacterium
ASLSSAAGRLA

SEQ ID NO: 954739 - protein, 6 aa, Mycobacterium
ASPAAF

SEQ ID NO: 954740 - protein, 21 aa, Mycobacterium
ASPANTVRGIANDPNQNGGYP

SEQ ID NO: 954741 - protein, 8 aa, Mycobacterium
ASPATTAP

SEQ ID NO: 954742 - protein, 8 aa, Mycobacterium
ASPDPALV

SEQ ID NO: 954743 - protein, 10 aa, Mycobacterium
ASPESGPAKL

SEQ ID NO: 954744 - protein, 13 aa, Mycobacterium
ASPGVSDAASSYP

SEQ ID NO: 954745 - protein, 4 aa, Mycobacterium
ASPL

SEQ ID NO: 954746 - protein, 6 aa, Mycobacterium
ASPRQS

SEQ ID NO: 954747 - protein, 13 aa, Mycobacterium
ASPSVSGRYPNLG

SEQ ID NO: 954748 - protein, 12 aa, Mycobacterium
ASPTGDADDAIT

SEQ ID NO: 954749 - protein, 5 aa, Mycobacterium
ASPVG

SEQ ID NO: 954750 - protein, 17 aa, Mycobacterium
ASQAHTKATEDAKVEAQ

SEQ ID NO: 954751 - protein, 8 aa, Mycobacterium
ASQPSTLE

SEQ ID NO: 954752 - protein, 4 aa, Mycobacterium
ASQS

SEQ ID NO: 954753 - protein, 6 aa, Mycobacterium
ASRSRW

SEQ ID NO: 954754 - protein, 5 aa, Mycobacterium
ASSAL

SEQ ID NO: 954755 - protein, 9 aa, Mycobacterium
ASSDPETYG

SEQ ID NO: 954756 - protein, 7 aa, Mycobacterium
ASSFPEN

SEQ ID NO: 954757 - protein, 11 aa, Mycobacterium
ASSPATETPQH

SEQ ID NO: 954758 - protein, 4 aa, Mycobacterium
ASSV

SEQ ID NO: 954759 - protein, 7 aa, Mycobacterium
ASTDLSQ

SEQ ID NO: 954760 - protein, 4 aa, Mycobacterium
ASTG

SEQ ID NO: 954761 - protein, 22 aa, Mycobacterium
ASTIGTASPATATPSKPNPSTV

SEQ ID NO: 954762 - protein, 17 aa, Mycobacterium
ASTTAAGPISQNAYGTR

SEQ ID NO: 954763 - protein, 5 aa, Mycobacterium
ASVAA

SEQ ID NO: 954764 - protein, 24 aa, Mycobacterium
ASVIEPPSSIPERSYTATRSHDDV

SEQ ID NO: 954765 - protein, 4 aa, Mycobacterium
ASVS

SEQ ID NO: 954766 - protein, 6 aa, Mycobacterium
ASWERS

SEQ ID NO: 954767 - protein, 5 aa, Mycobacterium
ASWGG

SEQ ID NO: 954768 - protein, 5 aa, Mycobacterium
ATAAF

SEQ ID NO: 954769 - protein, 7 aa, Mycobacterium
ATAGATA

SEQ ID NO: 954770 - protein, 5 aa, Mycobacterium
ATAGI

SEQ ID NO: 954771 - protein, 12 aa, Mycobacterium
ATANGVNRLSSA

SEQ ID NO: 954772 - protein, 9 aa, Mycobacterium
ATAPPPPAL

SEQ ID NO: 954773 - protein, 16 aa, Mycobacterium
ATARQPVPKDEQPHTS

SEQ ID NO: 954774 - protein, 14 aa, Mycobacterium
ATDEVNRPNLRKAG

SEQ ID NO: 954775 - protein, 7 aa, Mycobacterium
ATDGVNV

SEQ ID NO: 954776 - protein, 6 aa, Mycobacterium
ATDSAR

SEQ ID NO: 954777 - protein, 14 aa, Mycobacterium
ATDSGAASGQPGGA

SEQ ID NO: 954778 - protein, 8 aa, Mycobacterium
ATGANAVE

SEQ ID NO: 954779 - protein, 7 aa, Mycobacterium
ATGRTPT

SEQ ID NO: 954780 - protein, 8 aa, Mycobacterium
ATGSHSGA

SEQ ID NO: 954781 - protein, 4 aa, Mycobacterium
ATGT

SEQ ID NO: 954782 - protein, 13 aa, Mycobacterium
ATGTVERILTTPL

SEQ ID NO: 954783 - protein, 5 aa, Mycobacterium
ATKVP

SEQ ID NO: 954784 - protein, 18 aa, Mycobacterium
ATLPRYRSSHHTVGVRNA

SEQ ID NO: 954785 - protein, 29 aa, Mycobacterium
ATMADTVDAPDHSEPTSHTISNHSAGPIG

SEQ ID NO: 954786 - protein, 11 aa, Mycobacterium
ATMPDANHHTD

SEQ ID NO: 954787 - protein, 9 aa, Mycobacterium
ATPEKMRSV

SEQ ID NO: 954788 - protein, 15 aa, Mycobacterium
ATPRVTPDTSGSSVL

SEQ ID NO: 954789 - protein, 6 aa, Mycobacterium
ATPTAI

SEQ ID NO: 954790 - protein, 7 aa, Mycobacterium
ATPTVTV

SEQ ID NO: 954791 - protein, 7 aa, Mycobacterium
ATQAGYR

SEQ ID NO: 954792 - protein, 15 aa, Mycobacterium
ATQAPDTNTMAASEQ

SEQ ID NO: 954793 - protein, 6 aa, Mycobacterium
ATQDQI

SEQ ID NO: 954794 - protein, 6 aa, Mycobacterium
ATQDTN

SEQ ID NO: 954795 - protein, 8 aa, Mycobacterium
ATQEPTRR

SEQ ID NO: 954796 - protein, 6 aa, Mycobacterium
ATQPTG

SEQ ID NO: 954797 - protein, 7 aa, Mycobacterium
ATRAGCS

SEQ ID NO: 954798 - protein, 6 aa, Mycobacterium
ATRDSF

SEQ ID NO: 954799 - protein, 6 aa, Mycobacterium
ATRITD

SEQ ID NO: 954800 - protein, 9 aa, Mycobacterium
ATSSIDTRT

SEQ ID NO: 954801 - protein, 13 aa, Mycobacterium
ATSTGIGSSSGVT

SEQ ID NO: 954802 - protein, 6 aa, Mycobacterium
ATSTTI

SEQ ID NO: 954803 - protein, 13 aa, Mycobacterium
ATSVQRDRGSRSR

SEQ ID NO: 954804 - protein, 6 aa, Mycobacterium
ATTEIS

SEQ ID NO: 954805 - protein, 8 aa, Mycobacterium
ATTTLTGG

SEQ ID NO: 954806 - protein, 6 aa, Mycobacterium
ATVDAY

SEQ ID NO: 954807 - protein, 8 aa, Mycobacterium
ATVGESAR

SEQ ID NO: 954808 - protein, 12 aa, Mycobacterium
ATVPDQSSRPIT

SEQ ID NO: 954809 - protein, 11 aa, Mycobacterium
ATYGRGESSCA

SEQ ID NO: 954810 - protein, 6 aa, Mycobacterium
AVDRYG

SEQ ID NO: 954811 - protein, 6 aa, Mycobacterium
AVEDAK

SEQ ID NO: 954812 - protein, 9 aa, Mycobacterium
AVGAAPPVV

SEQ ID NO: 954813 - protein, 5 aa, Mycobacterium
AVGAS

SEQ ID NO: 954814 - protein, 7 aa, Mycobacterium
AVGGDTQ

SEQ ID NO: 954815 - protein, 16 aa, Mycobacterium
AVGGELTASGAAPQPF

SEQ ID NO: 954816 - protein, 5 aa, Mycobacterium
AVGSS

SEQ ID NO: 954817 - protein, 6 aa, Mycobacterium
AVGTTQ

SEQ ID NO: 954818 - protein, 12 aa, Mycobacterium
AVGYTDSGLVDT

SEQ ID NO: 954819 - protein, 8 aa, Mycobacterium
AVLQPDGS

SEQ ID NO: 954820 - protein, 18 aa, Mycobacterium
AVNQDGRSNGLMAPNPAA

SEQ ID NO: 954821 - protein, 11 aa, Mycobacterium
AVNRAEHTTPA

SEQ ID NO: 954822 - protein, 6 aa, Mycobacterium
AVPDVS

SEQ ID NO: 954823 - protein, 6 aa, Mycobacterium
AVPGKA

SEQ ID NO: 954824 - protein, 6 aa, Mycobacterium
AVPPRN

SEQ ID NO: 954825 - protein, 6 aa, Mycobacterium
AVQSPP

SEQ ID NO: 954826 - protein, 8 aa, Mycobacterium
AVRGSRAL

SEQ ID NO: 954827 - protein, 6 aa, Mycobacterium
AVRPDD

SEQ ID NO: 954828 - protein, 5 aa, Mycobacterium
AVTGN

SEQ ID NO: 954829 - protein, 6 aa, Mycobacterium
AVTNGF

SEQ ID NO: 954830 - protein, 10 aa, Mycobacterium
AVYSDGKQVT

SEQ ID NO: 954831 - protein, 8 aa, Mycobacterium
AWRQSGER

SEQ ID NO: 954832 - protein, 5 aa, Mycobacterium
AWSKD

SEQ ID NO: 954833 - protein, 12 aa, Mycobacterium
AYARGGEKTPEG

SEQ ID NO: 954834 - protein, 14 aa, Mycobacterium
AYGHRSGPYEWPTN

SEQ ID NO: 954835 - protein, 8 aa, Mycobacterium
AYKSTAGL

SEQ ID NO: 954836 - protein, 7 aa, Mycobacterium
AYPARPK

SEQ ID NO: 954837 - protein, 7 aa, Mycobacterium
AYPDERY

SEQ ID NO: 954838 - protein, 16 aa, Mycobacterium
AYQRSVASSANRKADS

SEQ ID NO: 954839 - protein, 4 aa, Mycobacterium
AYQS

SEQ ID NO: 954840 - protein, 8 aa, Mycobacterium
AYTTGKYT

SEQ ID NO: 954841 - protein, 8 aa, Mycobacterium
CDTETDPD

SEQ ID NO: 954842 - protein, 18 aa, Mycobacterium
CESNPLTDLGRPDDPRNW

SEQ ID NO: 954843 - protein, 6 aa, Mycobacterium
CGSASG

SEQ ID NO: 954844 - protein, 9 aa, Mycobacterium
CGTTRDGYV

SEQ ID NO: 954845 - protein, 5 aa, Mycobacterium
CPESL

SEQ ID NO: 954846 - protein, 23 aa, Mycobacterium
CPPPTRLRSTACSPVDASPLRPV

SEQ ID NO: 954847 - protein, 18 aa, Mycobacterium
CPPTPSRRGRQNAALGGD

SEQ ID NO: 954848 - protein, 8 aa, Mycobacterium
CPRSRSAT

SEQ ID NO: 954849 - protein, 24 aa, Mycobacterium
CSAPRRPARPDIDSPEEYEYEPVP

SEQ ID NO: 954850 - protein, 7 aa, Mycobacterium
CSGSAAG

SEQ ID NO: 954851 - protein, 6 aa, Mycobacterium
CSGTQA

SEQ ID NO: 954852 - protein, 11 aa, Mycobacterium
CSNTPVASSGS

SEQ ID NO: 954853 - protein, 4 aa, Mycobacterium
CSPV

SEQ ID NO: 954854 - protein, 11 aa, Mycobacterium
CTGDPNSGTVP

SEQ ID NO: 954855 - protein, 5 aa, Mycobacterium
CTPDE

SEQ ID NO: 954856 - protein, 5 aa, Mycobacterium
DAAAA

SEQ ID NO: 954857 - protein, 4 aa, Mycobacterium
DAAE

SEQ ID NO: 954858 - protein, 12 aa, Mycobacterium
DAAGGASAGITG

SEQ ID NO: 954859 - protein, 7 aa, Mycobacterium
DAAGQAA

SEQ ID NO: 954860 - protein, 8 aa, Mycobacterium
DAAPVTQT

SEQ ID NO: 954861 - protein, 8 aa, Mycobacterium
DAAQVATG

SEQ ID NO: 954862 - protein, 9 aa, Mycobacterium
DAATQGQPG

SEQ ID NO: 954863 - protein, 4 aa, Mycobacterium
DADR

SEQ ID NO: 954864 - protein, 20 aa, Mycobacterium
DAEADADVSNVPSGDDGQDV

SEQ ID NO: 954865 - protein, 8 aa, Mycobacterium
DAESGRSD

SEQ ID NO: 954866 - protein, 7 aa, Mycobacterium
DAGASFT

SEQ ID NO: 954867 - protein, 7 aa, Mycobacterium
DAGRPRN

SEQ ID NO: 954868 - protein, 4 aa, Mycobacterium
DAGV

SEQ ID NO: 954869 - protein, 6 aa, Mycobacterium
DAHGTL

SEQ ID NO: 954870 - protein, 7 aa, Mycobacterium
DALPADA

SEQ ID NO: 954871 - protein, 11 aa, Mycobacterium
DAPADVGQKEL

SEQ ID NO: 954872 - protein, 5 aa, Mycobacterium
DAPAI

SEQ ID NO: 954873 - protein, 9 aa, Mycobacterium
DAPAWRPSE

SEQ ID NO: 954874 - protein, 12 aa, Mycobacterium
DAPNQADPKLAS

SEQ ID NO: 954875 - protein, 14 aa, Mycobacterium
DAPSACNEDAPVGP

SEQ ID NO: 954876 - protein, 7 aa, Mycobacterium
DATTQVS

SEQ ID NO: 954877 - protein, 16 aa, Mycobacterium
DAVRQQLTEAAEAADR

SEQ ID NO: 954878 - protein, 5 aa, Mycobacterium
DAYDD

SEQ ID NO: 954879 - protein, 10 aa, Mycobacterium
DDAPSTAPDC

SEQ ID NO: 954880 - protein, 9 aa, Mycobacterium
DDDEPGGDL

SEQ ID NO: 954881 - protein, 7 aa, Mycobacterium
DDDPVNG

SEQ ID NO: 954882 - protein, 4 aa, Mycobacterium
DDDR

SEQ ID NO: 954883 - protein, 37 aa, Mycobacterium
DDDTPTGELSAAQTKEQTAAVATAESEAPTEIIYHQR

SEQ ID NO: 954884 - protein, 5 aa, Mycobacterium
DDECR

SEQ ID NO: 954885 - protein, 11 aa, Mycobacterium
DDGEDDPVGRH

SEQ ID NO: 954886 - protein, 6 aa, Mycobacterium
DDKEWG

SEQ ID NO: 954887 - protein, 12 aa, Mycobacterium
DDLTGEDEQPPV

SEQ ID NO: 954888 - protein, 12 aa, Mycobacterium
DDNGSGVPEDER

SEQ ID NO: 954889 - protein, 7 aa, Mycobacterium
DDNTDKT

SEQ ID NO: 954890 - protein, 9 aa, Mycobacterium
DDPHAATPW

SEQ ID NO: 954891 - protein, 5 aa, Mycobacterium
DDPME

SEQ ID NO: 954892 - protein, 8 aa, Mycobacterium
DDPQAKVD

SEQ ID NO: 954893 - protein, 28 aa, Mycobacterium
DDRGCGQVSTIDGSTGRREAARSSYADP

SEQ ID NO: 954894 - protein, 7 aa, Mycobacterium
DDRSALT

SEQ ID NO: 954895 - protein, 11 aa, Mycobacterium
DDSGKEVPRGQ

SEQ ID NO: 954896 - protein, 5 aa, Mycobacterium
DDTRL

SEQ ID NO: 954897 - protein, 16 aa, Mycobacterium
DDVPTTPEPAVQAGTA

SEQ ID NO: 954898 - protein, 11 aa, Mycobacterium
DEAAAKNTAAQ

SEQ ID NO: 954899 - protein, 6 aa, Mycobacterium
DEAGNR

SEQ ID NO: 954900 - protein, 6 aa, Mycobacterium
DEDLAP

SEQ ID NO: 954901 - protein, 12 aa, Mycobacterium
DEDRQRAHTGHG

SEQ ID NO: 954902 - protein, 5 aa, Mycobacterium
DEDTV

SEQ ID NO: 954903 - protein, 5 aa, Mycobacterium
DEERD

SEQ ID NO: 954904 - protein, 4 aa, Mycobacterium
DEFA

SEQ ID NO: 954905 - protein, 4 aa, Mycobacterium
DEGA

SEQ ID NO: 954906 - protein, 4 aa, Mycobacterium
DEGI

SEQ ID NO: 954907 - protein, 6 aa, Mycobacterium
DELPGT

SEQ ID NO: 954908 - protein, 9 aa, Mycobacterium
DELVTKPAN

SEQ ID NO: 954909 - protein, 9 aa, Mycobacterium
DEPSAADDL

SEQ ID NO: 954910 - protein, 18 aa, Mycobacterium
DERRRPTVSGRPVRPPVT

SEQ ID NO: 954911 - protein, 7 aa, Mycobacterium
DESFDGE

SEQ ID NO: 954912 - protein, 6 aa, Mycobacterium
DETGPE

SEQ ID NO: 954913 - protein, 6 aa, Mycobacterium
DEVGSI

SEQ ID NO: 954914 - protein, 7 aa, Mycobacterium
DEVPRHP

SEQ ID NO: 954915 - protein, 22 aa, Mycobacterium
DEVRNGGYGQVSNDAPGNAARG

SEQ ID NO: 954916 - protein, 9 aa, Mycobacterium
DFADTGEGG

SEQ ID NO: 954917 - protein, 5 aa, Mycobacterium
DFGGN

SEQ ID NO: 954918 - protein, 6 aa, Mycobacterium
DFSPSS

SEQ ID NO: 954919 - protein, 13 aa, Mycobacterium
DGALPDDSLQETL

SEQ ID NO: 954920 - protein, 5 aa, Mycobacterium
DGDAT

SEQ ID NO: 954921 - protein, 4 aa, Mycobacterium
DGDV

SEQ ID NO: 954922 - protein, 6 aa, Mycobacterium
DGEEQP

SEQ ID NO: 954923 - protein, 8 aa, Mycobacterium
DGEGVSAS

SEQ ID NO: 954924 - protein, 4 aa, Mycobacterium
DGEP

SEQ ID NO: 954925 - protein, 7 aa, Mycobacterium
DGIRQSV

SEQ ID NO: 954926 - protein, 8 aa, Mycobacterium
DGKQPSRA

SEQ ID NO: 954927 - protein, 4 aa, Mycobacterium
DGMD

SEQ ID NO: 954928 - protein, 8 aa, Mycobacterium
DGPGPYTD

SEQ ID NO: 954929 - protein, 8 aa, Mycobacterium
DGPMPPQQ

SEQ ID NO: 954930 - protein, 9 aa, Mycobacterium
DGPQAGTEI

SEQ ID NO: 954931 - protein, 16 aa, Mycobacterium
DGQCTYDAESGTEHPV

SEQ ID NO: 954932 - protein, 6 aa, Mycobacterium
DGSPEV

SEQ ID NO: 954933 - protein, 8 aa, Mycobacterium
DGSPLMEE

SEQ ID NO: 954934 - protein, 12 aa, Mycobacterium
DGSTPDVSGLQT

SEQ ID NO: 954935 - protein, 6 aa, Mycobacterium
DGTLTY

SEQ ID NO: 954936 - protein, 8 aa, Mycobacterium
DGTQPAYT

SEQ ID NO: 954937 - protein, 15 aa, Mycobacterium
DGVKGRDLAAGGQSV

SEQ ID NO: 954938 - protein, 8 aa, Mycobacterium
DGVSKGNT

SEQ ID NO: 954939 - protein, 6 aa, Mycobacterium
DGVSTG

SEQ ID NO: 954940 - protein, 4 aa, Mycobacterium
DGVV

SEQ ID NO: 954941 - protein, 9 aa, Mycobacterium
DGWSNTGGA

SEQ ID NO: 954942 - protein, 8 aa, Mycobacterium
DGYSGHSA

SEQ ID NO: 954943 - protein, 7 aa, Mycobacterium
DGYTPLG

SEQ ID NO: 954944 - protein, 7 aa, Mycobacterium
DHGDQLA

SEQ ID NO: 954945 - protein, 6 aa, Mycobacterium
DHPDIA

SEQ ID NO: 954946 - protein, 12 aa, Mycobacterium
DHQTEAADQIAS

SEQ ID NO: 954947 - protein, 10 aa, Mycobacterium
DHTAQSGTQI

SEQ ID NO: 954948 - protein, 5 aa, Mycobacterium
DIDDE

SEQ ID NO: 954949 - protein, 9 aa, Mycobacterium
DIDKNTSYR

SEQ ID NO: 954950 - protein, 12 aa, Mycobacterium
DIPGAPPEDFSG

SEQ ID NO: 954951 - protein, 7 aa, Mycobacterium
DISANEM

SEQ ID NO: 954952 - protein, 8 aa, Mycobacterium
DKDTSGTV

SEQ ID NO: 954953 - protein, 9 aa, Mycobacterium
DKEPFSRDG

SEQ ID NO: 954954 - protein, 7 aa, Mycobacterium
DKERAVE

SEQ ID NO: 954955 - protein, 10 aa, Mycobacterium
DKGLGPADET

SEQ ID NO: 954956 - protein, 15 aa, Mycobacterium
DKGPDVDAGGSQHNR

SEQ ID NO: 954957 - protein, 13 aa, Mycobacterium
DKHGRPFRRRNAR

SEQ ID NO: 954958 - protein, 4 aa, Mycobacterium
DKHV

SEQ ID NO: 954959 - protein, 18 aa, Mycobacterium
DKIGPAVQVSGKSANFRD

SEQ ID NO: 954960 - protein, 6 aa, Mycobacterium
DKSGLT

SEQ ID NO: 954961 - protein, 8 aa, Mycobacterium
DKTLAGTI

SEQ ID NO: 954962 - protein, 9 aa, Mycobacterium
DLPASTRDG

SEQ ID NO: 954963 - protein, 7 aa, Mycobacterium
DLRTPRA

SEQ ID NO: 954964 - protein, 12 aa, Mycobacterium
DLSDVGTALGTI

SEQ ID NO: 954965 - protein, 12 aa, Mycobacterium
DLTSVTDPDADV

SEQ ID NO: 954966 - protein, 11 aa, Mycobacterium
DNAANLTAAQT

SEQ ID NO: 954967 - protein, 14 aa, Mycobacterium
DNAGVDDAKEYNSV

SEQ ID NO: 954968 - protein, 8 aa, Mycobacterium
DNAQQDYS

SEQ ID NO: 954969 - protein, 17 aa, Mycobacterium
DNDAGGVATYAQAGQKY

SEQ ID NO: 954970 - protein, 5 aa, Mycobacterium
DNDAK

SEQ ID NO: 954971 - protein, 6 aa, Mycobacterium
DNDRDR

SEQ ID NO: 954972 - protein, 6 aa, Mycobacterium
DNNSTV

SEQ ID NO: 954973 - protein, 6 aa, Mycobacterium
DNPDFQ

SEQ ID NO: 954974 - protein, 5 aa, Mycobacterium
DNPTQ

SEQ ID NO: 954975 - protein, 8 aa, Mycobacterium
DNQAAARA

SEQ ID NO: 954976 - protein, 16 aa, Mycobacterium
DNRLAEADPAATELAR

SEQ ID NO: 954977 - protein, 7 aa, Mycobacterium
DNSAERA

SEQ ID NO: 954978 - protein, 19 aa, Mycobacterium
DNTFDPSQDIGRQGGKQLG

SEQ ID NO: 954979 - protein, 4 aa, Mycobacterium
DNTS

SEQ ID NO: 954980 - protein, 4 aa, Mycobacterium
DPAN

SEQ ID NO: 954981 - protein, 6 aa, Mycobacterium
DPAQRV

SEQ ID NO: 954982 - protein, 7 aa, Mycobacterium
DPARTPV

SEQ ID NO: 954983 - protein, 5 aa, Mycobacterium
DPAVA

SEQ ID NO: 954984 - protein, 8 aa, Mycobacterium
DPDRTPVM

SEQ ID NO: 954985 - protein, 8 aa, Mycobacterium
DPEADVAH

SEQ ID NO: 954986 - protein, 9 aa, Mycobacterium
DPEDLGARE

SEQ ID NO: 954987 - protein, 15 aa, Mycobacterium
DPEDQAAWEAGNKTI

SEQ ID NO: 954988 - protein, 8 aa, Mycobacterium
DPEQISTE

SEQ ID NO: 954989 - protein, 4 aa, Mycobacterium
DPER

SEQ ID NO: 954990 - protein, 14 aa, Mycobacterium
DPGNVAANVSSGAQ

SEQ ID NO: 954991 - protein, 6 aa, Mycobacterium
DPGPRR

SEQ ID NO: 954992 - protein, 5 aa, Mycobacterium
DPHGN

SEQ ID NO: 954993 - protein, 18 aa, Mycobacterium
DPMGYQQGTGPAAGVSGY

SEQ ID NO: 954994 - protein, 4 aa, Mycobacterium
DPNF

SEQ ID NO: 954995 - protein, 15 aa, Mycobacterium
DPPAGSYPNMSERRQ

SEQ ID NO: 954996 - protein, 24 aa, Mycobacterium
DPPLRTRQTARDNRSARTHSGQAR

SEQ ID NO: 954997 - protein, 6 aa, Mycobacterium
DPQAQR

SEQ ID NO: 954998 - protein, 6 aa, Mycobacterium
DPRGWS

SEQ ID NO: 954999 - protein, 4 aa, Mycobacterium
DPTF

SEQ ID NO: 955000 - protein, 8 aa, Mycobacterium
DPVNEAAR

SEQ ID NO: 955001 - protein, 4 aa, Mycobacterium
DPVR

SEQ ID NO: 955002 - protein, 6 aa, Mycobacterium
DPWGYG

SEQ ID NO: 955003 - protein, 7 aa, Mycobacterium
DPYPGSE

SEQ ID NO: 955004 - protein, 15 aa, Mycobacterium
DPYQVPDGYPIKASP

SEQ ID NO: 955005 - protein, 10 aa, Mycobacterium
DQAGNGLSDC

SEQ ID NO: 955006 - protein, 5 aa, Mycobacterium
DQARD

SEQ ID NO: 955007 - protein, 7 aa, Mycobacterium
DQATAKF

SEQ ID NO: 955008 - protein, 4 aa, Mycobacterium
DQGH

SEQ ID NO: 955009 - protein, 4 aa, Mycobacterium
DQHI

SEQ ID NO: 955010 - protein, 10 aa, Mycobacterium
DQLPRIDGGP

SEQ ID NO: 955011 - protein, 7 aa, Mycobacterium
DQLSGGQ

SEQ ID NO: 955012 - protein, 9 aa, Mycobacterium
DQMSQQAGS

SEQ ID NO: 955013 - protein, 14 aa, Mycobacterium
DQNHRANQDTADTE

SEQ ID NO: 955014 - protein, 7 aa, Mycobacterium
DQSRTRL

SEQ ID NO: 955015 - protein, 7 aa, Mycobacterium
DQSVDGN

SEQ ID NO: 955016 - protein, 6 aa, Mycobacterium
DQTQAA

SEQ ID NO: 955017 - protein, 13 aa, Mycobacterium
DQWSDPDNKAEWQ

SEQ ID NO: 955018 - protein, 4 aa, Mycobacterium
DRAT

SEQ ID NO: 955019 - protein, 12 aa, Mycobacterium
DRDTSLPDHQAG

SEQ ID NO: 955020 - protein, 16 aa, Mycobacterium
DRESELRPQVRSGFGS

SEQ ID NO: 955021 - protein, 4 aa, Mycobacterium
DRGL

SEQ ID NO: 955022 - protein, 5 aa, Mycobacterium
DRHSG

SEQ ID NO: 955023 - protein, 14 aa, Mycobacterium
DRHTESSAVPSQPT

SEQ ID NO: 955024 - protein, 4 aa, Mycobacterium
DRIS

SEQ ID NO: 955025 - protein, 10 aa, Mycobacterium
DRNSVTSDVA

SEQ ID NO: 955026 - protein, 11 aa, Mycobacterium
DRPTKSGGGVV

SEQ ID NO: 955027 - protein, 6 aa, Mycobacterium
DRQGRD

SEQ ID NO: 955028 - protein, 10 aa, Mycobacterium
DRRGARRRSH

SEQ ID NO: 955029 - protein, 8 aa, Mycobacterium
DRSTVNPA

SEQ ID NO: 955030 - protein, 6 aa, Mycobacterium
DRSVGD

SEQ ID NO: 955031 - protein, 6 aa, Mycobacterium
DRTGEL

SEQ ID NO: 955032 - protein, 10 aa, Mycobacterium
DRVSGDGDDI

SEQ ID NO: 955033 - protein, 7 aa, Mycobacterium
DSAKVSE

SEQ ID NO: 955034 - protein, 4 aa, Mycobacterium
DSFD

SEQ ID NO: 955035 - protein, 8 aa, Mycobacterium
DSGASQGI

SEQ ID NO: 955036 - protein, 12 aa, Mycobacterium
DSHGQPLTQTSI

SEQ ID NO: 955037 - protein, 13 aa, Mycobacterium
DSKTLGEIDTAGK

SEQ ID NO: 955038 - protein, 8 aa, Mycobacterium
DSPLPDEP

SEQ ID NO: 955039 - protein, 6 aa, Mycobacterium
DSPLTN

SEQ ID NO: 955040 - protein, 14 aa, Mycobacterium
DSQAMARNDNAALK

SEQ ID NO: 955041 - protein, 7 aa, Mycobacterium
DSSGAAL

SEQ ID NO: 955042 - protein, 15 aa, Mycobacterium
DSSPRSPSTHSTERR

SEQ ID NO: 955043 - protein, 5 aa, Mycobacterium
DSTVP

SEQ ID NO: 955044 - protein, 18 aa, Mycobacterium
DSYSGADFPAGRQRLDAS

SEQ ID NO: 955045 - protein, 10 aa, Mycobacterium
DTAAETRGIS

SEQ ID NO: 955046 - protein, 12 aa, Mycobacterium
DTAGDMGASART

SEQ ID NO: 955047 - protein, 10 aa, Mycobacterium
DTAGDVDADA

SEQ ID NO: 955048 - protein, 12 aa, Mycobacterium
DTAPGVQPPGTS

SEQ ID NO: 955049 - protein, 22 aa, Mycobacterium
DTAPQGAAPLAGLTPQHGNHRP

SEQ ID NO: 955050 - protein, 9 aa, Mycobacterium
DTARPSSRP

SEQ ID NO: 955051 - protein, 17 aa, Mycobacterium
DTATRSGWWSPGKIRIK

SEQ ID NO: 955052 - protein, 7 aa, Mycobacterium
DTDAGTL

SEQ ID NO: 955053 - protein, 17 aa, Mycobacterium
DTEADARSEATAGPGKI

SEQ ID NO: 955054 - protein, 13 aa, Mycobacterium
DTELSTTATTSVG

SEQ ID NO: 955055 - protein, 8 aa, Mycobacterium
DTEPRRLS

SEQ ID NO: 955056 - protein, 14 aa, Mycobacterium
DTETPPKQLQHDTG

SEQ ID NO: 955057 - protein, 18 aa, Mycobacterium
DTGEQSAVAADDHDNDRA

SEQ ID NO: 955058 - protein, 9 aa, Mycobacterium
DTKAKPGTN

SEQ ID NO: 955059 - protein, 6 aa, Mycobacterium
DTLGNG

SEQ ID NO: 955060 - protein, 7 aa, Mycobacterium
DTLPDGA

SEQ ID NO: 955061 - protein, 17 aa, Mycobacterium
DTNAPNAFATGRNPRNA

SEQ ID NO: 955062 - protein, 5 aa, Mycobacterium
DTPEI

SEQ ID NO: 955063 - protein, 7 aa, Mycobacterium
DTPPEEF

SEQ ID NO: 955064 - protein, 5 aa, Mycobacterium
DTRGY

SEQ ID NO: 955065 - protein, 7 aa, Mycobacterium
DTRQRGE

SEQ ID NO: 955066 - protein, 10 aa, Mycobacterium
DTRYSSSPTL

SEQ ID NO: 955067 - protein, 6 aa, Mycobacterium
DTSTEL

SEQ ID NO: 955068 - protein, 13 aa, Mycobacterium
DTSVSPSTSRHGL

SEQ ID NO: 955069 - protein, 6 aa, Mycobacterium
DTTVST

SEQ ID NO: 955070 - protein, 10 aa, Mycobacterium
DTVGGSGGHV

SEQ ID NO: 955071 - protein, 30 aa, Mycobacterium
DVAEQAQSAVEGASNPVPNGAEALEASNSP

SEQ ID NO: 955072 - protein, 8 aa, Mycobacterium
DVAPRTPT

SEQ ID NO: 955073 - protein, 7 aa, Mycobacterium
DVDAGGM

SEQ ID NO: 955074 - protein, 5 aa, Mycobacterium
DVDKP

SEQ ID NO: 955075 - protein, 5 aa, Mycobacterium
DVEDK

SEQ ID NO: 955076 - protein, 5 aa, Mycobacterium
DVGGY

SEQ ID NO: 955077 - protein, 18 aa, Mycobacterium
DVGQERSVSLSPKDAPSY

SEQ ID NO: 955078 - protein, 7 aa, Mycobacterium
DVKDGEV

SEQ ID NO: 955079 - protein, 9 aa, Mycobacterium
DVKGAAADA

SEQ ID NO: 955080 - protein, 12 aa, Mycobacterium
DVKTRFGLRHSR

SEQ ID NO: 955081 - protein, 9 aa, Mycobacterium
DVNNGARGE

SEQ ID NO: 955082 - protein, 15 aa, Mycobacterium
DVTNPAARNETASPI

SEQ ID NO: 955083 - protein, 5 aa, Mycobacterium
DWADG

SEQ ID NO: 955084 - protein, 22 aa, Mycobacterium
DYAGDRRRAREAMKTALELHGR

SEQ ID NO: 955085 - protein, 4 aa, Mycobacterium
DYPD

SEQ ID NO: 955086 - protein, 6 aa, Mycobacterium
DYPVPG

SEQ ID NO: 955087 - protein, 7 aa, Mycobacterium
DYQDGHD

SEQ ID NO: 955088 - protein, 11 aa, Mycobacterium
DYSDPGLSDGS

SEQ ID NO: 955089 - protein, 10 aa, Mycobacterium
EAANKPSQFK

SEQ ID NO: 955090 - protein, 6 aa, Mycobacterium
EAASEH

SEQ ID NO: 955091 - protein, 16 aa, Mycobacterium
EADGGVLKGSEGEEQQ

SEQ ID NO: 955092 - protein, 7 aa, Mycobacterium
EAGSAQL

SEQ ID NO: 955093 - protein, 11 aa, Mycobacterium
EAGTTRARASL

SEQ ID NO: 955094 - protein, 14 aa, Mycobacterium
EAHRREATKVEESL

SEQ ID NO: 955095 - protein, 13 aa, Mycobacterium
EAQHDRAPIQTVG

SEQ ID NO: 955096 - protein, 9 aa, Mycobacterium
EAQNAAALN

SEQ ID NO: 955097 - protein, 6 aa, Mycobacterium
EAQPVG

SEQ ID NO: 955098 - protein, 10 aa, Mycobacterium
EAQVARKDPI

SEQ ID NO: 955099 - protein, 6 aa, Mycobacterium
EARAGD

SEQ ID NO: 955100 - protein, 7 aa, Mycobacterium
EARREAK

SEQ ID NO: 955101 - protein, 7 aa, Mycobacterium
EARSSAL

SEQ ID NO: 955102 - protein, 5 aa, Mycobacterium
EARTT

SEQ ID NO: 955103 - protein, 4 aa, Mycobacterium
EARV

SEQ ID NO: 955104 - protein, 9 aa, Mycobacterium
EASAGNTVP

SEQ ID NO: 955105 - protein, 7 aa, Mycobacterium
EATGQPI

SEQ ID NO: 955106 - protein, 8 aa, Mycobacterium
EAVPTSRT

SEQ ID NO: 955107 - protein, 8 aa, Mycobacterium
ECSSNTAV

SEQ ID NO: 955108 - protein, 9 aa, Mycobacterium
EDAGPAGAQ

SEQ ID NO: 955109 - protein, 6 aa, Mycobacterium
EDAGPL

SEQ ID NO: 955110 - protein, 6 aa, Mycobacterium
EDEAPR

SEQ ID NO: 955111 - protein, 5 aa, Mycobacterium
EDERT

SEQ ID NO: 955112 - protein, 13 aa, Mycobacterium
EDPIPPSQRHEGI

SEQ ID NO: 955113 - protein, 4 aa, Mycobacterium
EDPK

SEQ ID NO: 955114 - protein, 23 aa, Mycobacterium
EDPPSQSDSRFEPRHRPPRSAPL

SEQ ID NO: 955115 - protein, 16 aa, Mycobacterium
EDRDPTDRLREPDTEG

SEQ ID NO: 955116 - protein, 12 aa, Mycobacterium
EDRDVADRHPDT

SEQ ID NO: 955117 - protein, 15 aa, Mycobacterium
EDRHADSTYADDDLN

SEQ ID NO: 955118 - protein, 6 aa, Mycobacterium
EEGTLT

SEQ ID NO: 955119 - protein, 7 aa, Mycobacterium
EENTHGF

SEQ ID NO: 955120 - protein, 4 aa, Mycobacterium
EEPI

SEQ ID NO: 955121 - protein, 17 aa, Mycobacterium
EEPTLDQRDTVMKIPGR

SEQ ID NO: 955122 - protein, 8 aa, Mycobacterium
EEQSVQGQ

SEQ ID NO: 955123 - protein, 6 aa, Mycobacterium
EESAYA

SEQ ID NO: 955124 - protein, 6 aa, Mycobacterium
EESKSW

SEQ ID NO: 955125 - protein, 8 aa, Mycobacterium
EESPPQPR

SEQ ID NO: 955126 - protein, 20 aa, Mycobacterium
EFDEEIAEEEAEGGVRTPKI

SEQ ID NO: 955127 - protein, 5 aa, Mycobacterium
EFDQT

SEQ ID NO: 955128 - protein, 13 aa, Mycobacterium
EFDTRATAPQRPV

SEQ ID NO: 955129 - protein, 4 aa, Mycobacterium
EFPG

SEQ ID NO: 955130 - protein, 10 aa, Mycobacterium
EFRPGDDLSA

SEQ ID NO: 955131 - protein, 14 aa, Mycobacterium
EGAGKQHHATRPQG

SEQ ID NO: 955132 - protein, 10 aa, Mycobacterium
EGASGTANHL

SEQ ID NO: 955133 - protein, 6 aa, Mycobacterium
EGAVKA

SEQ ID NO: 955134 - protein, 7 aa, Mycobacterium
EGDVGSY

SEQ ID NO: 955135 - protein, 4 aa, Mycobacterium
EGGD

SEQ ID NO: 955136 - protein, 6 aa, Mycobacterium
EGPGAE

SEQ ID NO: 955137 - protein, 5 aa, Mycobacterium
EGPRH

SEQ ID NO: 955138 - protein, 13 aa, Mycobacterium
EGQYKISKLDQVT

SEQ ID NO: 955139 - protein, 5 aa, Mycobacterium
EGRRK

SEQ ID NO: 955140 - protein, 11 aa, Mycobacterium
EGTRSRTGKML

SEQ ID NO: 955141 - protein, 14 aa, Mycobacterium
EHNPGLDTAARAQQ

SEQ ID NO: 955142 - protein, 13 aa, Mycobacterium
EHPDSAGAALSAA

SEQ ID NO: 955143 - protein, 6 aa, Mycobacterium
EHPEPG

SEQ ID NO: 955144 - protein, 19 aa, Mycobacterium
EHRSGQYRAGQLRAGQRYT

SEQ ID NO: 955145 - protein, 15 aa, Mycobacterium
EHSTNIDRQKHREGE

SEQ ID NO: 955146 - protein, 5 aa, Mycobacterium
EIPAG

SEQ ID NO: 955147 - protein, 35 aa, Mycobacterium
EIPEPESATERATVASTYATTTAVPVSADEEFAET

SEQ ID NO: 955148 - protein, 20 aa, Mycobacterium
EIREDGPPSHHNKRGTPSMG

SEQ ID NO: 955149 - protein, 9 aa, Mycobacterium
EIREGRSFR

SEQ ID NO: 955150 - protein, 10 aa, Mycobacterium
EKFPAPKTHT

SEQ ID NO: 955151 - protein, 9 aa, Mycobacterium
EKLGQRAAA

SEQ ID NO: 955152 - protein, 5 aa, Mycobacterium
EKLPR

SEQ ID NO: 955153 - protein, 8 aa, Mycobacterium
EKPDDPNW

SEQ ID NO: 955154 - protein, 5 aa, Mycobacterium
EKSNE

SEQ ID NO: 955155 - protein, 7 aa, Mycobacterium
EKSPSFH

SEQ ID NO: 955156 - protein, 11 aa, Mycobacterium
EKSTVTSRGGC

SEQ ID NO: 955157 - protein, 12 aa, Mycobacterium
EKYRERGANLAP

SEQ ID NO: 955158 - protein, 19 aa, Mycobacterium
ELDQGKLGNCTGPGPAALA

SEQ ID NO: 955159 - protein, 4 aa, Mycobacterium
ELDR

SEQ ID NO: 955160 - protein, 11 aa, Mycobacterium
ELGTSASYQAY

SEQ ID NO: 955161 - protein, 5 aa, Mycobacterium
ELNEQ

SEQ ID NO: 955162 - protein, 6 aa, Mycobacterium
ELNPDR

SEQ ID NO: 955163 - protein, 8 aa, Mycobacterium
ELRSQAAD

SEQ ID NO: 955164 - protein, 6 aa, Mycobacterium
ENAHDR

SEQ ID NO: 955165 - protein, 7 aa, Mycobacterium
ENGPGEL

SEQ ID NO: 955166 - protein, 10 aa, Mycobacterium
ENPDSAPPTA

SEQ ID NO: 955167 - protein, 5 aa, Mycobacterium
ENRMT

SEQ ID NO: 955168 - protein, 4 aa, Mycobacterium
ENSR

SEQ ID NO: 955169 - protein, 4 aa, Mycobacterium
EPAF

SEQ ID NO: 955170 - protein, 8 aa, Mycobacterium
EPDPREMH

SEQ ID NO: 955171 - protein, 16 aa, Mycobacterium
EPDPTVAGNADRHGHG

SEQ ID NO: 955172 - protein, 8 aa, Mycobacterium
EPDSNAGY

SEQ ID NO: 955173 - protein, 6 aa, Mycobacterium
EPGRRQ

SEQ ID NO: 955174 - protein, 4 aa, Mycobacterium
EPGS

SEQ ID NO: 955175 - protein, 13 aa, Mycobacterium
EPKTTRAYGEADT

SEQ ID NO: 955176 - protein, 8 aa, Mycobacterium
EPPFIGDS

SEQ ID NO: 955177 - protein, 8 aa, Mycobacterium
EPPPPGMV

SEQ ID NO: 955178 - protein, 12 aa, Mycobacterium
EPPVDDHGHVPP

SEQ ID NO: 955179 - protein, 17 aa, Mycobacterium
EPTTGAVSDIEKATKIA

SEQ ID NO: 955180 - protein, 5 aa, Mycobacterium
EPVTG

SEQ ID NO: 955181 - protein, 4 aa, Mycobacterium
EQAT

SEQ ID NO: 955182 - protein, 9 aa, Mycobacterium
EQIKRERDA

SEQ ID NO: 955183 - protein, 13 aa, Mycobacterium
EQNRTKEALASAR

SEQ ID NO: 955184 - protein, 5 aa, Mycobacterium
EQPAF

SEQ ID NO: 955185 - protein, 5 aa, Mycobacterium
EQPYP

SEQ ID NO: 955186 - protein, 5 aa, Mycobacterium
EQQSI

SEQ ID NO: 955187 - protein, 5 aa, Mycobacterium
EQRGT

SEQ ID NO: 955188 - protein, 16 aa, Mycobacterium
ERAPEPDPDESPATGA

SEQ ID NO: 955189 - protein, 6 aa, Mycobacterium
ERARSY

SEQ ID NO: 955190 - protein, 9 aa, Mycobacterium
EREDQIDEV

SEQ ID NO: 955191 - protein, 13 aa, Mycobacterium
ERGGFGRSVVTRG

SEQ ID NO: 955192 - protein, 9 aa, Mycobacterium
ERHNNDGSI

SEQ ID NO: 955193 - protein, 16 aa, Mycobacterium
ERKSSARLQIPRDSSS

SEQ ID NO: 955194 - protein, 9 aa, Mycobacterium
ERQPGGYSL

SEQ ID NO: 955195 - protein, 7 aa, Mycobacterium
ERQTPTT

SEQ ID NO: 955196 - protein, 14 aa, Mycobacterium
ERRPQRGPSPAMPP

SEQ ID NO: 955197 - protein, 10 aa, Mycobacterium
ERRRSEREQL

SEQ ID NO: 955198 - protein, 10 aa, Mycobacterium
ERSDPDGGTA

SEQ ID NO: 955199 - protein, 7 aa, Mycobacterium
ERWSANT

SEQ ID NO: 955200 - protein, 7 aa, Mycobacterium
ERYPEQQ

SEQ ID NO: 955201 - protein, 5 aa, Mycobacterium
ESAAW

SEQ ID NO: 955202 - protein, 6 aa, Mycobacterium
ESAPIA

SEQ ID NO: 955203 - protein, 16 aa, Mycobacterium
ESAPWPAIPGPRRGAV

SEQ ID NO: 955204 - protein, 9 aa, Mycobacterium
ESDEAAPAR

SEQ ID NO: 955205 - protein, 11 aa, Mycobacterium
ESDGDGTTMES

SEQ ID NO: 955206 - protein, 17 aa, Mycobacterium
ESDGEPINFEDPSEDAV

SEQ ID NO: 955207 - protein, 7 aa, Mycobacterium
ESFEATR

SEQ ID NO: 955208 - protein, 9 aa, Mycobacterium
ESLGGPVNS

SEQ ID NO: 955209 - protein, 6 aa, Mycobacterium
ESMEPT

SEQ ID NO: 955210 - protein, 4 aa, Mycobacterium
ESNL

SEQ ID NO: 955211 - protein, 8 aa, Mycobacterium
ESRERQAR

SEQ ID NO: 955212 - protein, 8 aa, Mycobacterium
ESRMGEEI

SEQ ID NO: 955213 - protein, 14 aa, Mycobacterium
ESSPVAVRGSWLTT

SEQ ID NO: 955214 - protein, 5 aa, Mycobacterium
ESVRQ

SEQ ID NO: 955215 - protein, 10 aa, Mycobacterium
ETAGDPEHPP

SEQ ID NO: 955216 - protein, 11 aa, Mycobacterium
ETAGNQIRDAK

SEQ ID NO: 955217 - protein, 14 aa, Mycobacterium
ETDSSGTPRTRYDG

SEQ ID NO: 955218 - protein, 16 aa, Mycobacterium
ETELKAAKEGKLLSPT

SEQ ID NO: 955219 - protein, 7 aa, Mycobacterium
ETGTTVA

SEQ ID NO: 955220 - protein, 8 aa, Mycobacterium
ETHGTGTV

SEQ ID NO: 955221 - protein, 5 aa, Mycobacterium
ETHKE

SEQ ID NO: 955222 - protein, 16 aa, Mycobacterium
ETKGNPWGQNAGDRTN

SEQ ID NO: 955223 - protein, 5 aa, Mycobacterium
ETKQV

SEQ ID NO: 955224 - protein, 7 aa, Mycobacterium
ETPAPYG

SEQ ID NO: 955225 - protein, 9 aa, Mycobacterium
ETPDSGRVA

SEQ ID NO: 955226 - protein, 10 aa, Mycobacterium
EVATSDADRG

SEQ ID NO: 955227 - protein, 9 aa, Mycobacterium
EVPNTDREA

SEQ ID NO: 955228 - protein, 7 aa, Mycobacterium
EVRPEAA

SEQ ID NO: 955229 - protein, 8 aa, Mycobacterium
EVSEREGA

SEQ ID NO: 955230 - protein, 9 aa, Mycobacterium
EVSETAAEA

SEQ ID NO: 955231 - protein, 5 aa, Mycobacterium
EVTPS

SEQ ID NO: 955232 - protein, 9 aa, Mycobacterium
EVTSTGVTS

SEQ ID NO: 955233 - protein, 32 aa, Mycobacterium
EVVATDNSSVATDNSSLLETAADTEVSTGRHA

SEQ ID NO: 955234 - protein, 9 aa, Mycobacterium
EYGSGTPWA

SEQ ID NO: 955235 - protein, 12 aa, Mycobacterium
FAASVGASRTHR

SEQ ID NO: 955236 - protein, 8 aa, Mycobacterium
FAGESQAS

SEQ ID NO: 955237 - protein, 23 aa, Mycobacterium
FAPGGTTKSTVSSYDAAAALRAD

SEQ ID NO: 955238 - protein, 4 aa, Mycobacterium
FATE

SEQ ID NO: 955239 - protein, 5 aa, Mycobacterium
FDKDG

SEQ ID NO: 955240 - protein, 8 aa, Mycobacterium
FDTTGDKN

SEQ ID NO: 955241 - protein, 11 aa, Mycobacterium
FEGAGAQNDLV

SEQ ID NO: 955242 - protein, 18 aa, Mycobacterium
FEGPRRRARRERAERRAA

SEQ ID NO: 955243 - protein, 11 aa, Mycobacterium
FEPSEAQTVSA

SEQ ID NO: 955244 - protein, 8 aa, Mycobacterium
FESSRGYA

SEQ ID NO: 955245 - protein, 12 aa, Mycobacterium
FGAGRGGTRFLV

SEQ ID NO: 955246 - protein, 4 aa, Mycobacterium
FGDR

SEQ ID NO: 955247 - protein, 9 aa, Mycobacterium
FGGNTRDVQ

SEQ ID NO: 955248 - protein, 8 aa, Mycobacterium
FGGQQEDG

SEQ ID NO: 955249 - protein, 6 aa, Mycobacterium
FGLSGT

SEQ ID NO: 955250 - protein, 4 aa, Mycobacterium
FGPT

SEQ ID NO: 955251 - protein, 7 aa, Mycobacterium
FGPTDDV

SEQ ID NO: 955252 - protein, 15 aa, Mycobacterium
FGTTITGQPVGSTLG

SEQ ID NO: 955253 - protein, 10 aa, Mycobacterium
FGTTRDEENP

SEQ ID NO: 955254 - protein, 12 aa, Mycobacterium
FGTVTTTDGSCR

SEQ ID NO: 955255 - protein, 11 aa, Mycobacterium
FGVEDTKDVRD

SEQ ID NO: 955256 - protein, 12 aa, Mycobacterium
FKQANSPSTPEL

SEQ ID NO: 955257 - protein, 13 aa, Mycobacterium
FPAANEGDGGIVT

SEQ ID NO: 955258 - protein, 5 aa, Mycobacterium
FPDGP

SEQ ID NO: 955259 - protein, 9 aa, Mycobacterium
FPDGSPSYQ

SEQ ID NO: 955260 - protein, 14 aa, Mycobacterium
FPGPGDHPGYQLEN

SEQ ID NO: 955261 - protein, 5 aa, Mycobacterium
FPPGS

SEQ ID NO: 955262 - protein, 4 aa, Mycobacterium
FPSE

SEQ ID NO: 955263 - protein, 7 aa, Mycobacterium
FPSNTES

SEQ ID NO: 955264 - protein, 8 aa, Mycobacterium
FPSSGPYK

SEQ ID NO: 955265 - protein, 4 aa, Mycobacterium
FQAR

SEQ ID NO: 955266 - protein, 15 aa, Mycobacterium
FQQAPGSSNGVTVSP

SEQ ID NO: 955267 - protein, 11 aa, Mycobacterium
FQRNNSNKVTG

SEQ ID NO: 955268 - protein, 11 aa, Mycobacterium
FSAQDSTSGSL

SEQ ID NO: 955269 - protein, 5 aa, Mycobacterium
FSDEP

SEQ ID NO: 955270 - protein, 5 aa, Mycobacterium
FSGLP

SEQ ID NO: 955271 - protein, 11 aa, Mycobacterium
FSKGSARNTAT

SEQ ID NO: 955272 - protein, 8 aa, Mycobacterium
FSKNGTRS

SEQ ID NO: 955273 - protein, 14 aa, Mycobacterium
FSTSNNDGAKFDPE

SEQ ID NO: 955274 - protein, 5 aa, Mycobacterium
FTGER

SEQ ID NO: 955275 - protein, 24 aa, Mycobacterium
FTGKGGALSSGKYAPDLGPANEQQ

SEQ ID NO: 955276 - protein, 15 aa, Mycobacterium
FTGSSQFEEPTGSIA

SEQ ID NO: 955277 - protein, 8 aa, Mycobacterium
FTPAQATA

SEQ ID NO: 955278 - protein, 8 aa, Mycobacterium
FTPGEQVT

SEQ ID NO: 955279 - protein, 12 aa, Mycobacterium
FTPSAPTSSIDR

SEQ ID NO: 955280 - protein, 11 aa, Mycobacterium
FTQGTPPSPLQ

SEQ ID NO: 955281 - protein, 8 aa, Mycobacterium
GAAATTQV

SEQ ID NO: 955282 - protein, 12 aa, Mycobacterium
GAAGHQPTSTSS

SEQ ID NO: 955283 - protein, 9 aa, Mycobacterium
GAAPTTGYT

SEQ ID NO: 955284 - protein, 4 aa, Mycobacterium
GAAV

SEQ ID NO: 955285 - protein, 6 aa, Mycobacterium
GADGTT

SEQ ID NO: 955286 - protein, 7 aa, Mycobacterium
GADQFQT

SEQ ID NO: 955287 - protein, 18 aa, Mycobacterium
GAEANSPVMDNNGGGPLG

SEQ ID NO: 955288 - protein, 14 aa, Mycobacterium
GAEAPLAAAPTSSS

SEQ ID NO: 955289 - protein, 9 aa, Mycobacterium
GAEFGGGPH

SEQ ID NO: 955290 - protein, 17 aa, Mycobacterium
GAESTDGGRRRRREGHY

SEQ ID NO: 955291 - protein, 8 aa, Mycobacterium
GAGARPVI

SEQ ID NO: 955292 - protein, 5 aa, Mycobacterium
GAGCS

SEQ ID NO: 955293 - protein, 12 aa, Mycobacterium
GAGGISGPPVAR

SEQ ID NO: 955294 - protein, 16 aa, Mycobacterium
GAGGTPNGPSNGTGST

SEQ ID NO: 955295 - protein, 9 aa, Mycobacterium
GAGIGDGMA

SEQ ID NO: 955296 - protein, 8 aa, Mycobacterium
GAGQSYFG

SEQ ID NO: 955297 - protein, 5 aa, Mycobacterium
GAGTD

SEQ ID NO: 955298 - protein, 21 aa, Mycobacterium
GALEGTPNEGFPKPTEVGGYA

SEQ ID NO: 955299 - protein, 7 aa, Mycobacterium
GALSGVA

SEQ ID NO: 955300 - protein, 15 aa, Mycobacterium
GAPGRSVRTRAAQAG

SEQ ID NO: 955301 - protein, 6 aa, Mycobacterium
GAPLGL

SEQ ID NO: 955302 - protein, 12 aa, Mycobacterium
GAPNELGGDNIP

SEQ ID NO: 955303 - protein, 4 aa, Mycobacterium
GAPS

SEQ ID NO: 955304 - protein, 5 aa, Mycobacterium
GAPVG

SEQ ID NO: 955305 - protein, 25 aa, Mycobacterium
GAQSYGATNSDDAEGYAMTGGATSV

SEQ ID NO: 955306 - protein, 5 aa, Mycobacterium
GARPN

SEQ ID NO: 955307 - protein, 5 aa, Mycobacterium
GARRY

SEQ ID NO: 955308 - protein, 6 aa, Mycobacterium
GASPAW

SEQ ID NO: 955309 - protein, 7 aa, Mycobacterium
GASPDRA

SEQ ID NO: 955310 - protein, 8 aa, Mycobacterium
GASSQGAQ

SEQ ID NO: 955311 - protein, 5 aa, Mycobacterium
GATGE

SEQ ID NO: 955312 - protein, 7 aa, Mycobacterium
GATGSYP

SEQ ID NO: 955313 - protein, 7 aa, Mycobacterium
GCTDTAD

SEQ ID NO: 955314 - protein, 6 aa, Mycobacterium
GCTGSV

SEQ ID NO: 955315 - protein, 12 aa, Mycobacterium
GDAISEVPPDRW

SEQ ID NO: 955316 - protein, 8 aa, Mycobacterium
GDDESRRR

SEQ ID NO: 955317 - protein, 10 aa, Mycobacterium
GDDFGGGPTM

SEQ ID NO: 955318 - protein, 9 aa, Mycobacterium
GDGANDAAA

SEQ ID NO: 955319 - protein, 19 aa, Mycobacterium
GDGPRTATTAGPVDQVPNS

SEQ ID NO: 955320 - protein, 7 aa, Mycobacterium
GDIRGSA

SEQ ID NO: 955321 - protein, 7 aa, Mycobacterium
GDLSGNS

SEQ ID NO: 955322 - protein, 4 aa, Mycobacterium
GDNP

SEQ ID NO: 955323 - protein, 10 aa, Mycobacterium
GDNPASAAAV

SEQ ID NO: 955324 - protein, 10 aa, Mycobacterium
GDPGPNGGLV

SEQ ID NO: 955325 - protein, 13 aa, Mycobacterium
GDPPKKCSAANNH

SEQ ID NO: 955326 - protein, 12 aa, Mycobacterium
GDPRRQDAAGNA

SEQ ID NO: 955327 - protein, 5 aa, Mycobacterium
GDPSA

SEQ ID NO: 955328 - protein, 15 aa, Mycobacterium
GDQIQNSTSGMNQRG

SEQ ID NO: 955329 - protein, 5 aa, Mycobacterium
GDRKP

SEQ ID NO: 955330 - protein, 4 aa, Mycobacterium
GDSG

SEQ ID NO: 955331 - protein, 7 aa, Mycobacterium
GDSTTVI

SEQ ID NO: 955332 - protein, 12 aa, Mycobacterium
GDTGLDSGRPQS

SEQ ID NO: 955333 - protein, 7 aa, Mycobacterium
GDTGTFT

SEQ ID NO: 955334 - protein, 6 aa, Mycobacterium
GDTIGR

SEQ ID NO: 955335 - protein, 9 aa, Mycobacterium
GDVGQTATA

SEQ ID NO: 955336 - protein, 9 aa, Mycobacterium
GEAGTQPRV

SEQ ID NO: 955337 - protein, 7 aa, Mycobacterium
GEAGVTL

SEQ ID NO: 955338 - protein, 12 aa, Mycobacterium
GEAIYGSGLPSD

SEQ ID NO: 955339 - protein, 8 aa, Mycobacterium
GEAQTDDL

SEQ ID NO: 955340 - protein, 9 aa, Mycobacterium
GEEAERKQL

SEQ ID NO: 955341 - protein, 8 aa, Mycobacterium
GEFSSDPE

SEQ ID NO: 955342 - protein, 22 aa, Mycobacterium
GEGGSPGEEAEAEQRQSDRYGY

SEQ ID NO: 955343 - protein, 9 aa, Mycobacterium
GEGNHARAA

SEQ ID NO: 955344 - protein, 8 aa, Mycobacterium
GEHGELSE

SEQ ID NO: 955345 - protein, 7 aa, Mycobacterium
GEIAPPT

SEQ ID NO: 955346 - protein, 5 aa, Mycobacterium
GEIPA

SEQ ID NO: 955347 - protein, 14 aa, Mycobacterium
GENSDGIMVEWGGG

SEQ ID NO: 955348 - protein, 7 aa, Mycobacterium
GEPDGGI

SEQ ID NO: 955349 - protein, 5 aa, Mycobacterium
GEPLN

SEQ ID NO: 955350 - protein, 5 aa, Mycobacterium
GEPVK

SEQ ID NO: 955351 - protein, 7 aa, Mycobacterium
GERTGWS

SEQ ID NO: 955352 - protein, 8 aa, Mycobacterium
GESLPVDK

SEQ ID NO: 955353 - protein, 10 aa, Mycobacterium
GESTGDLNRL

SEQ ID NO: 955354 - protein, 14 aa, Mycobacterium
GETCNGDSAHRSGN

SEQ ID NO: 955355 - protein, 6 aa, Mycobacterium
GETITA

SEQ ID NO: 955356 - protein, 5 aa, Mycobacterium
GEVEQ

SEQ ID NO: 955357 - protein, 5 aa, Mycobacterium
GFGGT

SEQ ID NO: 955358 - protein, 8 aa, Mycobacterium
GFGPAPEG

SEQ ID NO: 955359 - protein, 25 aa, Mycobacterium
GFGSGGVAPSRDGDKQVKSTSAADA

SEQ ID NO: 955360 - protein, 6 aa, Mycobacterium
GFHGTA

SEQ ID NO: 955361 - protein, 8 aa, Mycobacterium
GFVRGEGA

SEQ ID NO: 955362 - protein, 5 aa, Mycobacterium
GGADV

SEQ ID NO: 955363 - protein, 9 aa, Mycobacterium
GGARRHSGY

SEQ ID NO: 955364 - protein, 7 aa, Mycobacterium
GGASVGA

SEQ ID NO: 955365 - protein, 9 aa, Mycobacterium
GGATARPFA

SEQ ID NO: 955366 - protein, 10 aa, Mycobacterium
GGDGLSDCDA

SEQ ID NO: 955367 - protein, 4 aa, Mycobacterium
GGDT

SEQ ID NO: 955368 - protein, 9 aa, Mycobacterium
GGDTAGAGG

SEQ ID NO: 955369 - protein, 12 aa, Mycobacterium
GGELGPVPNDGF

SEQ ID NO: 955370 - protein, 8 aa, Mycobacterium
GGEMPPPA

SEQ ID NO: 955371 - protein, 11 aa, Mycobacterium
GGGQRDPQTPM

SEQ ID NO: 955372 - protein, 4 aa, Mycobacterium
GGGT

SEQ ID NO: 955373 - protein, 7 aa, Mycobacterium
GGIPGLS

SEQ ID NO: 955374 - protein, 7 aa, Mycobacterium
GGISGPE

SEQ ID NO: 955375 - protein, 13 aa, Mycobacterium
GGKAGFPPDGRAG

SEQ ID NO: 955376 - protein, 8 aa, Mycobacterium
GGKQNSPA

SEQ ID NO: 955377 - protein, 16 aa, Mycobacterium
GGKTIVGPVKDNSSSL

SEQ ID NO: 955378 - protein, 6 aa, Mycobacterium
GGKVTD

SEQ ID NO: 955379 - protein, 10 aa, Mycobacterium
GGLAGEPEGI

SEQ ID NO: 955380 - protein, 11 aa, Mycobacterium
GGLGAGSIRQH

SEQ ID NO: 955381 - protein, 5 aa, Mycobacterium
GGLNA

SEQ ID NO: 955382 - protein, 13 aa, Mycobacterium
GGLNAHTDQRSED

SEQ ID NO: 955383 - protein, 5 aa, Mycobacterium
GGLRS

SEQ ID NO: 955384 - protein, 6 aa, Mycobacterium
GGNERV

SEQ ID NO: 955385 - protein, 5 aa, Mycobacterium
GGNGL

SEQ ID NO: 955386 - protein, 7 aa, Mycobacterium
GGNPEAM

SEQ ID NO: 955387 - protein, 4 aa, Mycobacterium
GGPN

SEQ ID NO: 955388 - protein, 16 aa, Mycobacterium
GGQPGDSGVVAGTSRA

SEQ ID NO: 955389 - protein, 37 aa, Mycobacterium
GGRITASSSSSDATSMPDVAPATSPAAAIDGDPATSW

SEQ ID NO: 955390 - protein, 9 aa, Mycobacterium
GGRPAPTDG

SEQ ID NO: 955391 - protein, 9 aa, Mycobacterium
GGRSGLYSG

SEQ ID NO: 955392 - protein, 5 aa, Mycobacterium
GGSAM

SEQ ID NO: 955393 - protein, 5 aa, Mycobacterium
GGSHA

SEQ ID NO: 955394 - protein, 4 aa, Mycobacterium
GGSM

SEQ ID NO: 955395 - protein, 9 aa, Mycobacterium
GGSNGLGAA

SEQ ID NO: 955396 - protein, 12 aa, Mycobacterium
GGTGLGLRSGGP

SEQ ID NO: 955397 - protein, 7 aa, Mycobacterium
GGTTGPV

SEQ ID NO: 955398 - protein, 6 aa, Mycobacterium
GGTTVS

SEQ ID NO: 955399 - protein, 4 aa, Mycobacterium
GGVT

SEQ ID NO: 955400 - protein, 6 aa, Mycobacterium
GHAHPL

SEQ ID NO: 955401 - protein, 10 aa, Mycobacterium
GHGVSGTVAE

SEQ ID NO: 955402 - protein, 15 aa, Mycobacterium
GHNVKSAQIDDREQQ

SEQ ID NO: 955403 - protein, 11 aa, Mycobacterium
GHRAKNDYGSS

SEQ ID NO: 955404 - protein, 5 aa, Mycobacterium
GHRAR

SEQ ID NO: 955405 - protein, 9 aa, Mycobacterium
GHSAPNRPY

SEQ ID NO: 955406 - protein, 7 aa, Mycobacterium
GHSLNTT

SEQ ID NO: 955407 - protein, 5 aa, Mycobacterium
GHTRD

SEQ ID NO: 955408 - protein, 6 aa, Mycobacterium
GHVEGS

SEQ ID NO: 955409 - protein, 12 aa, Mycobacterium
GIAPDSLSGTRT

SEQ ID NO: 955410 - protein, 21 aa, Mycobacterium
GIATGPDTANQPVPDDKRNPV

SEQ ID NO: 955411 - protein, 14 aa, Mycobacterium
GIKGDQAGRTANGK

SEQ ID NO: 955412 - protein, 7 aa, Mycobacterium
GINDGPA

SEQ ID NO: 955413 - protein, 10 aa, Mycobacterium
GINDGPALAR

SEQ ID NO: 955414 - protein, 8 aa, Mycobacterium
GIPSGTAK

SEQ ID NO: 955415 - protein, 13 aa, Mycobacterium
GISSNSLRRSQTG

SEQ ID NO: 955416 - protein, 10 aa, Mycobacterium
GITSPARGWQ

SEQ ID NO: 955417 - protein, 7 aa, Mycobacterium
GKDVPAN

SEQ ID NO: 955418 - protein, 6 aa, Mycobacterium
GKELSA

SEQ ID NO: 955419 - protein, 29 aa, Mycobacterium
GKETMPTNPDNPKGAYTAARTAKDQGVPI

SEQ ID NO: 955420 - protein, 5 aa, Mycobacterium
GKFPY

SEQ ID NO: 955421 - protein, 6 aa, Mycobacterium
GKITGN

SEQ ID NO: 955422 - protein, 30 aa, Mycobacterium
GKNGDDREYDYETNTDTKRYTYAGSGGVPI

SEQ ID NO: 955423 - protein, 7 aa, Mycobacterium
GKNPYDS

SEQ ID NO: 955424 - protein, 7 aa, Mycobacterium
GKPKTPC

SEQ ID NO: 955425 - protein, 7 aa, Mycobacterium
GKPRDQT

SEQ ID NO: 955426 - protein, 4 aa, Mycobacterium
GKPS

SEQ ID NO: 955427 - protein, 7 aa, Mycobacterium
GKRVDTA

SEQ ID NO: 955428 - protein, 8 aa, Mycobacterium
GKSKSTAW

SEQ ID NO: 955429 - protein, 7 aa, Mycobacterium
GKSSNVG

SEQ ID NO: 955430 - protein, 7 aa, Mycobacterium
GKTASRV

SEQ ID NO: 955431 - protein, 4 aa, Mycobacterium
GLAA

SEQ ID NO: 955432 - protein, 8 aa, Mycobacterium
GLAGPDSR

SEQ ID NO: 955433 - protein, 18 aa, Mycobacterium
GLAPDTRAGRTTTAYGEH

SEQ ID NO: 955434 - protein, 13 aa, Mycobacterium
GLDNGDLDRTHRQ

SEQ ID NO: 955435 - protein, 6 aa, Mycobacterium
GLGGGN

SEQ ID NO: 955436 - protein, 14 aa, Mycobacterium
GLGNGQPDAIPAAS

SEQ ID NO: 955437 - protein, 9 aa, Mycobacterium
GLGPPKEVA

SEQ ID NO: 955438 - protein, 7 aa, Mycobacterium
GLGVSGS

SEQ ID NO: 955439 - protein, 7 aa, Mycobacterium
GLNTEDR

SEQ ID NO: 955440 - protein, 56 aa, Mycobacterium
GLNTPTSSTSSSPTSSVPEGSIVKPTKATVFSPDGEADNPDDAGLAIDGNPATSWQ

SEQ ID NO: 955441 - protein, 7 aa, Mycobacterium
GLNTRQA

SEQ ID NO: 955442 - protein, 10 aa, Mycobacterium
GLPGESEGLV

SEQ ID NO: 955443 - protein, 8 aa, Mycobacterium
GLQPGGPV

SEQ ID NO: 955444 - protein, 7 aa, Mycobacterium
GLQTGSS

SEQ ID NO: 955445 - protein, 25 aa, Mycobacterium
GLSPPEVSSGPKAGTKSPDTATNTI

SEQ ID NO: 955446 - protein, 14 aa, Mycobacterium
GLSSGLSAGPSAAI

SEQ ID NO: 955447 - protein, 5 aa, Mycobacterium
GLTAA

SEQ ID NO: 955448 - protein, 5 aa, Mycobacterium
GLTGF

SEQ ID NO: 955449 - protein, 21 aa, Mycobacterium
GLTRGAGGAQRADALNRSPPA

SEQ ID NO: 955450 - protein, 12 aa, Mycobacterium
GLTSAPRSTPQD

SEQ ID NO: 955451 - protein, 11 aa, Mycobacterium
GMGGHAAGEVA

SEQ ID NO: 955452 - protein, 7 aa, Mycobacterium
GMSATGA

SEQ ID NO: 955453 - protein, 4 aa, Mycobacterium
GNEH

SEQ ID NO: 955454 - protein, 7 aa, Mycobacterium
GNGPQVR

SEQ ID NO: 955455 - protein, 4 aa, Mycobacterium
GNGS

SEQ ID NO: 955456 - protein, 9 aa, Mycobacterium
GNLHDEAAN

SEQ ID NO: 955457 - protein, 6 aa, Mycobacterium
GNPGLT

SEQ ID NO: 955458 - protein, 7 aa, Mycobacterium
GNRSDNG

SEQ ID NO: 955459 - protein, 9 aa, Mycobacterium
GNSNTDGSS

SEQ ID NO: 955460 - protein, 14 aa, Mycobacterium
GNTGGDCTQNPMPD

SEQ ID NO: 955461 - protein, 8 aa, Mycobacterium
GNTPGWDD

SEQ ID NO: 955462 - protein, 5 aa, Mycobacterium
GNTTL

SEQ ID NO: 955463 - protein, 7 aa, Mycobacterium
GNTTVSP

SEQ ID NO: 955464 - protein, 21 aa, Mycobacterium
GNVNGPKLANNAITTDPAVSQ

SEQ ID NO: 955465 - protein, 4 aa, Mycobacterium
GNVP

SEQ ID NO: 955466 - protein, 8 aa, Mycobacterium
GNVTGPDS

SEQ ID NO: 955467 - protein, 4 aa, Mycobacterium
GPAA

SEQ ID NO: 955468 - protein, 8 aa, Mycobacterium
GPELTPVT

SEQ ID NO: 955469 - protein, 30 aa, Mycobacterium
GPGAASAATGIEPTEAVPPKSPAGSSTPPI

SEQ ID NO: 955470 - protein, 7 aa, Mycobacterium
GPGRTNG

SEQ ID NO: 955471 - protein, 10 aa, Mycobacterium
GPGTGGLSTN

SEQ ID NO: 955472 - protein, 6 aa, Mycobacterium
GPHQTI

SEQ ID NO: 955473 - protein, 27 aa, Mycobacterium
GPKGADAKPSKQAISDAAVSETWGGQI

SEQ ID NO: 955474 - protein, 6 aa, Mycobacterium
GPLSDG

SEQ ID NO: 955475 - protein, 9 aa, Mycobacterium
GPLSGDSYR

SEQ ID NO: 955476 - protein, 20 aa, Mycobacterium
GPNAEHPGVPLRGERSGYDF

SEQ ID NO: 955477 - protein, 5 aa, Mycobacterium
GPNAQ

SEQ ID NO: 955478 - protein, 8 aa, Mycobacterium
GPNGGPEL

SEQ ID NO: 955479 - protein, 6 aa, Mycobacterium
GPPGTV

SEQ ID NO: 955480 - protein, 6 aa, Mycobacterium
GPPSWN

SEQ ID NO: 955481 - protein, 23 aa, Mycobacterium
GPPTTVTVPPTQALPDLTTSTTP

SEQ ID NO: 955482 - protein, 7 aa, Mycobacterium
GPQNMPK

SEQ ID NO: 955483 - protein, 5 aa, Mycobacterium
GPQPA

SEQ ID NO: 955484 - protein, 9 aa, Mycobacterium
GPQYKSPRL

SEQ ID NO: 955485 - protein, 19 aa, Mycobacterium
GPRAPGSSYGRRENGPPVN

SEQ ID NO: 955486 - protein, 7 aa, Mycobacterium
GPTANGD

SEQ ID NO: 955487 - protein, 6 aa, Mycobacterium
GPTGIA

SEQ ID NO: 955488 - protein, 8 aa, Mycobacterium
GPTGPLGG

SEQ ID NO: 955489 - protein, 10 aa, Mycobacterium
GPTNDVRIPR

SEQ ID NO: 955490 - protein, 10 aa, Mycobacterium
GPVPQAPEYT

SEQ ID NO: 955491 - protein, 6 aa, Mycobacterium
GQADGP

SEQ ID NO: 955492 - protein, 6 aa, Mycobacterium
GQGANQ

SEQ ID NO: 955493 - protein, 8 aa, Mycobacterium
GQGNRERV

SEQ ID NO: 955494 - protein, 13 aa, Mycobacterium
GQGREGSASLFAG

SEQ ID NO: 955495 - protein, 8 aa, Mycobacterium
GQGSQWAG

SEQ ID NO: 955496 - protein, 6 aa, Mycobacterium
GQHVRS

SEQ ID NO: 955497 - protein, 11 aa, Mycobacterium
GQIPPNQRFES

SEQ ID NO: 955498 - protein, 4 aa, Mycobacterium
GQKK

SEQ ID NO: 955499 - protein, 6 aa, Mycobacterium
GQPAKE

SEQ ID NO: 955500 - protein, 17 aa, Mycobacterium
GQPAPSGEDGFSGVAPA

SEQ ID NO: 955501 - protein, 5 aa, Mycobacterium
GQPLW

SEQ ID NO: 955502 - protein, 20 aa, Mycobacterium
GQPSRYRGEPQRQHPATTSA

SEQ ID NO: 955503 - protein, 13 aa, Mycobacterium
GQRQPVPVDDETM

SEQ ID NO: 955504 - protein, 6 aa, Mycobacterium
GQSGGH

SEQ ID NO: 955505 - protein, 4 aa, Mycobacterium
GQSS

SEQ ID NO: 955506 - protein, 4 aa, Mycobacterium
GQTI

SEQ ID NO: 955507 - protein, 7 aa, Mycobacterium
GRAPVGT

SEQ ID NO: 955508 - protein, 6 aa, Mycobacterium
GRASQM

SEQ ID NO: 955509 - protein, 7 aa, Mycobacterium
GRATRLQ

SEQ ID NO: 955510 - protein, 8 aa, Mycobacterium
GRDNQNRI

SEQ ID NO: 955511 - protein, 5 aa, Mycobacterium
GRETT

SEQ ID NO: 955512 - protein, 7 aa, Mycobacterium
GRGGGQK

SEQ ID NO: 955513 - protein, 44 aa, Mycobacterium
GRGPGVGFGSGRQSAYANKVSESVSDSAVAEAAAQASAREQARA

SEQ ID NO: 955514 - protein, 8 aa, Mycobacterium
GRGSQWAG

SEQ ID NO: 955515 - protein, 6 aa, Mycobacterium
GRGTDV

SEQ ID NO: 955516 - protein, 13 aa, Mycobacterium
GRIPGLAAGPSRR

SEQ ID NO: 955517 - protein, 14 aa, Mycobacterium
GRITAEEAHSHPQR

SEQ ID NO: 955518 - protein, 4 aa, Mycobacterium
GRLG

SEQ ID NO: 955519 - protein, 8 aa, Mycobacterium
GRLTKEKR

SEQ ID NO: 955520 - protein, 38 aa, Mycobacterium
GRNNKRSDRVLPGAATQESEEDPAMGKASDSTAALTAA

SEQ ID NO: 955521 - protein, 7 aa, Mycobacterium
GRPTHEH

SEQ ID NO: 955522 - protein, 17 aa, Mycobacterium
GRQLDDATDMTTGKVNP

SEQ ID NO: 955523 - protein, 6 aa, Mycobacterium
GRRGTQ

SEQ ID NO: 955524 - protein, 8 aa, Mycobacterium
GRRRGKGV

SEQ ID NO: 955525 - protein, 7 aa, Mycobacterium
GRRSRID

SEQ ID NO: 955526 - protein, 6 aa, Mycobacterium
GRRTPG

SEQ ID NO: 955527 - protein, 8 aa, Mycobacterium
GRSAFSPD

SEQ ID NO: 955528 - protein, 8 aa, Mycobacterium
GRSGVGKT

SEQ ID NO: 955529 - protein, 9 aa, Mycobacterium
GRTAPTQLA

SEQ ID NO: 955530 - protein, 6 aa, Mycobacterium
GRTGTS

SEQ ID NO: 955531 - protein, 16 aa, Mycobacterium
GRTQISGGDPPFTAAT

SEQ ID NO: 955532 - protein, 6 aa, Mycobacterium
GRTSAI

SEQ ID NO: 955533 - protein, 4 aa, Mycobacterium
GRVG

SEQ ID NO: 955534 - protein, 25 aa, Mycobacterium
GRVPGHGPEQATRPLVGTAEQGGVI

SEQ ID NO: 955535 - protein, 9 aa, Mycobacterium
GRVRSGESV

SEQ ID NO: 955536 - protein, 9 aa, Mycobacterium
GRYAKEGWD

SEQ ID NO: 955537 - protein, 6 aa, Mycobacterium
GSAARV

SEQ ID NO: 955538 - protein, 9 aa, Mycobacterium
GSAETEITL

SEQ ID NO: 955539 - protein, 6 aa, Mycobacterium
GSAQAV

SEQ ID NO: 955540 - protein, 9 aa, Mycobacterium
GSARQGTSK

SEQ ID NO: 955541 - protein, 20 aa, Mycobacterium
GSATNQDGRSNGMTAPNALA

SEQ ID NO: 955542 - protein, 9 aa, Mycobacterium
GSDAKTGGH

SEQ ID NO: 955543 - protein, 16 aa, Mycobacterium
GSDQKKDHSGAAAEPV

SEQ ID NO: 955544 - protein, 17 aa, Mycobacterium
GSFTPRHASSSAQTPTP

SEQ ID NO: 955545 - protein, 19 aa, Mycobacterium
GSGGGGGGKKVPEINADRK

SEQ ID NO: 955546 - protein, 11 aa, Mycobacterium
GSGLGKPGGEV

SEQ ID NO: 955547 - protein, 7 aa, Mycobacterium
GSGPDRV

SEQ ID NO: 955548 - protein, 10 aa, Mycobacterium
GSGSAQDAGC

SEQ ID NO: 955549 - protein, 6 aa, Mycobacterium
GSGSGY

SEQ ID NO: 955550 - protein, 6 aa, Mycobacterium
GSGTLD

SEQ ID NO: 955551 - protein, 8 aa, Mycobacterium
GSHDGEDL

SEQ ID NO: 955552 - protein, 5 aa, Mycobacterium
GSHSC

SEQ ID NO: 955553 - protein, 4 aa, Mycobacterium
GSLS

SEQ ID NO: 955554 - protein, 6 aa, Mycobacterium
GSLTGA

SEQ ID NO: 955555 - protein, 12 aa, Mycobacterium
GSNAKTAPSPYR

SEQ ID NO: 955556 - protein, 9 aa, Mycobacterium
GSNGSGKST

SEQ ID NO: 955557 - protein, 8 aa, Mycobacterium
GSPDLSGH

SEQ ID NO: 955558 - protein, 12 aa, Mycobacterium
GSPETPEVRRGA

SEQ ID NO: 955559 - protein, 6 aa, Mycobacterium
GSPSAL

SEQ ID NO: 955560 - protein, 10 aa, Mycobacterium
GSRDITPSEA

SEQ ID NO: 955561 - protein, 8 aa, Mycobacterium
GSTNGTYL

SEQ ID NO: 955562 - protein, 5 aa, Mycobacterium
GSTPQ

SEQ ID NO: 955563 - protein, 4 aa, Mycobacterium
GSTQ

SEQ ID NO: 955564 - protein, 13 aa, Mycobacterium
GSTQSSQTIGATV

SEQ ID NO: 955565 - protein, 12 aa, Mycobacterium
GSVAADSGTPGI

SEQ ID NO: 955566 - protein, 6 aa, Mycobacterium
GSVAAY

SEQ ID NO: 955567 - protein, 4 aa, Mycobacterium
GTAF

SEQ ID NO: 955568 - protein, 9 aa, Mycobacterium
GTAFPTDIS

SEQ ID NO: 955569 - protein, 7 aa, Mycobacterium
GTAGQAT

SEQ ID NO: 955570 - protein, 5 aa, Mycobacterium
GTAIT

SEQ ID NO: 955571 - protein, 4 aa, Mycobacterium
GTAL

SEQ ID NO: 955572 - protein, 5 aa, Mycobacterium
GTAPV

SEQ ID NO: 955573 - protein, 7 aa, Mycobacterium
GTAVPKR

SEQ ID NO: 955574 - protein, 17 aa, Mycobacterium
GTDGNPIAPANASRNRI

SEQ ID NO: 955575 - protein, 8 aa, Mycobacterium
GTDLGRGG

SEQ ID NO: 955576 - protein, 18 aa, Mycobacterium
GTEDLSASVGATHPPGTP

SEQ ID NO: 955577 - protein, 5 aa, Mycobacterium
GTFSG

SEQ ID NO: 955578 - protein, 5 aa, Mycobacterium
GTGEL

SEQ ID NO: 955579 - protein, 5 aa, Mycobacterium
GTGFP

SEQ ID NO: 955580 - protein, 6 aa, Mycobacterium
GTGMAG

SEQ ID NO: 955581 - protein, 11 aa, Mycobacterium
GTGNARTAEDW

SEQ ID NO: 955582 - protein, 4 aa, Mycobacterium
GTGP

SEQ ID NO: 955583 - protein, 6 aa, Mycobacterium
GTGRLG

SEQ ID NO: 955584 - protein, 30 aa, Mycobacterium
GTKTPAPRRSRPSTSGNRPPPARNTFSSGQ

SEQ ID NO: 955585 - protein, 9 aa, Mycobacterium
GTLEPTGRG

SEQ ID NO: 955586 - protein, 11 aa, Mycobacterium
GTLGGPRRHPY

SEQ ID NO: 955587 - protein, 4 aa, Mycobacterium
GTLN

SEQ ID NO: 955588 - protein, 12 aa, Mycobacterium
GTLSRPDGKNET

SEQ ID NO: 955589 - protein, 5 aa, Mycobacterium
GTLTV

SEQ ID NO: 955590 - protein, 12 aa, Mycobacterium
GTNPSANQTSAI

SEQ ID NO: 955591 - protein, 6 aa, Mycobacterium
GTPALS

SEQ ID NO: 955592 - protein, 9 aa, Mycobacterium
GTPLTGGLG

SEQ ID NO: 955593 - protein, 4 aa, Mycobacterium
GTPR

SEQ ID NO: 955594 - protein, 6 aa, Mycobacterium
GTPTLR

SEQ ID NO: 955595 - protein, 9 aa, Mycobacterium
GTPTSSQVT

SEQ ID NO: 955596 - protein, 9 aa, Mycobacterium
GTQADYSHE

SEQ ID NO: 955597 - protein, 6 aa, Mycobacterium
GTQAPT

SEQ ID NO: 955598 - protein, 16 aa, Mycobacterium
GTSNRSNRAVASPGLT

SEQ ID NO: 955599 - protein, 4 aa, Mycobacterium
GTTG

SEQ ID NO: 955600 - protein, 5 aa, Mycobacterium
GTTGI

SEQ ID NO: 955601 - protein, 5 aa, Mycobacterium
GTTSI

SEQ ID NO: 955602 - protein, 4 aa, Mycobacterium
GTTY

SEQ ID NO: 955603 - protein, 13 aa, Mycobacterium
GTVVSEGPARLDQ

SEQ ID NO: 955604 - protein, 10 aa, Mycobacterium
GVARRGQLRA

SEQ ID NO: 955605 - protein, 4 aa, Mycobacterium
GVAV

SEQ ID NO: 955606 - protein, 9 aa, Mycobacterium
GVDPARKKA

SEQ ID NO: 955607 - protein, 10 aa, Mycobacterium
GVDRRGRPPV

SEQ ID NO: 955608 - protein, 17 aa, Mycobacterium
GVDTDRVDGARPGRAGC

SEQ ID NO: 955609 - protein, 16 aa, Mycobacterium
GVEASPRVPAEPGGDF

SEQ ID NO: 955610 - protein, 5 aa, Mycobacterium
GVKPK

SEQ ID NO: 955611 - protein, 9 aa, Mycobacterium
GVNDAPALA

SEQ ID NO: 955612 - protein, 14 aa, Mycobacterium
GVNDRQEEAGRSGV

SEQ ID NO: 955613 - protein, 4 aa, Mycobacterium
GVNN

SEQ ID NO: 955614 - protein, 11 aa, Mycobacterium
GVNNPEDPQLD

SEQ ID NO: 955615 - protein, 17 aa, Mycobacterium
GVNPDEEEPPGSTDETL

SEQ ID NO: 955616 - protein, 6 aa, Mycobacterium
GVPEHT

SEQ ID NO: 955617 - protein, 12 aa, Mycobacterium
GVPGVAQGAIQG

SEQ ID NO: 955618 - protein, 7 aa, Mycobacterium
GVPRLDG

SEQ ID NO: 955619 - protein, 6 aa, Mycobacterium
GVPTRG

SEQ ID NO: 955620 - protein, 7 aa, Mycobacterium
GVRGGDG

SEQ ID NO: 955621 - protein, 31 aa, Mycobacterium
GVRPGPRLPNVEAGGDYVESSDGLTDCDGHG

SEQ ID NO: 955622 - protein, 9 aa, Mycobacterium
GVRSAETLA

SEQ ID NO: 955623 - protein, 9 aa, Mycobacterium
GVRSYGDDG

SEQ ID NO: 955624 - protein, 10 aa, Mycobacterium
GVSTSARTIT

SEQ ID NO: 955625 - protein, 11 aa, Mycobacterium
GVTESDSAKGR

SEQ ID NO: 955626 - protein, 7 aa, Mycobacterium
GVTGADV

SEQ ID NO: 955627 - protein, 6 aa, Mycobacterium
GVYSGD

SEQ ID NO: 955628 - protein, 10 aa, Mycobacterium
GWPPQQPPDY

SEQ ID NO: 955629 - protein, 5 aa, Mycobacterium
GWQRP

SEQ ID NO: 955630 - protein, 7 aa, Mycobacterium
GWSDEGQ

SEQ ID NO: 955631 - protein, 4 aa, Mycobacterium
GWSR

SEQ ID NO: 955632 - protein, 10 aa, Mycobacterium
GWSSAGSDPM

SEQ ID NO: 955633 - protein, 6 aa, Mycobacterium
GYDADG

SEQ ID NO: 955634 - protein, 8 aa, Mycobacterium
GYGPTVGD

SEQ ID NO: 955635 - protein, 18 aa, Mycobacterium
GYNGEPVNALPGEEGPVA

SEQ ID NO: 955636 - protein, 18 aa, Mycobacterium
GYQTRVSGDGDNISAGEK

SEQ ID NO: 955637 - protein, 22 aa, Mycobacterium
GYRATAHAESAVEEIDPDADYA

SEQ ID NO: 955638 - protein, 6 aa, Mycobacterium
GYRSER

SEQ ID NO: 955639 - protein, 9 aa, Mycobacterium
GYRTNYKDR

SEQ ID NO: 955640 - protein, 11 aa, Mycobacterium
GYSGGLGSPLA

SEQ ID NO: 955641 - protein, 6 aa, Mycobacterium
GYSRYQ

SEQ ID NO: 955642 - protein, 10 aa, Mycobacterium
GYTGGGGKQI

SEQ ID NO: 955643 - protein, 15 aa, Mycobacterium
GYVPSQRLRRANAPS

SEQ ID NO: 955644 - protein, 6 aa, Mycobacterium
HAAGPG

SEQ ID NO: 955645 - protein, 4 aa, Mycobacterium
HAAT

SEQ ID NO: 955646 - protein, 6 aa, Mycobacterium
HADEQH

SEQ ID NO: 955647 - protein, 7 aa, Mycobacterium
HADSGMS

SEQ ID NO: 955648 - protein, 8 aa, Mycobacterium
HAEPGGIY

SEQ ID NO: 955649 - protein, 10 aa, Mycobacterium
HAEPTEPSIG

SEQ ID NO: 955650 - protein, 12 aa, Mycobacterium
HAGDSNDGGYNT

SEQ ID NO: 955651 - protein, 4 aa, Mycobacterium
HARP

SEQ ID NO: 955652 - protein, 11 aa, Mycobacterium
HASLPPSRRRA

SEQ ID NO: 955653 - protein, 4 aa, Mycobacterium
HDHD

SEQ ID NO: 955654 - protein, 6 aa, Mycobacterium
HDMRNP

SEQ ID NO: 955655 - protein, 7 aa, Mycobacterium
HDNDPVA

SEQ ID NO: 955656 - protein, 12 aa, Mycobacterium
HDPVSDTGSAQH

SEQ ID NO: 955657 - protein, 6 aa, Mycobacterium
HDQPAW

SEQ ID NO: 955658 - protein, 4 aa, Mycobacterium
HDTA

SEQ ID NO: 955659 - protein, 17 aa, Mycobacterium
HDTGNAMATSIASGALA

SEQ ID NO: 955660 - protein, 17 aa, Mycobacterium
HDTTDDNDTDADAVDAA

SEQ ID NO: 955661 - protein, 10 aa, Mycobacterium
HEATHEETPT

SEQ ID NO: 955662 - protein, 5 aa, Mycobacterium
HEHTQ

SEQ ID NO: 955663 - protein, 4 aa, Mycobacterium
HELR

SEQ ID NO: 955664 - protein, 6 aa, Mycobacterium
HELRTP

SEQ ID NO: 955665 - protein, 18 aa, Mycobacterium
HEPTDLREPVRVADLLLR

SEQ ID NO: 955666 - protein, 4 aa, Mycobacterium
HESP

SEQ ID NO: 955667 - protein, 6 aa, Mycobacterium
HGAGAA

SEQ ID NO: 955668 - protein, 6 aa, Mycobacterium
HGAPPV

SEQ ID NO: 955669 - protein, 11 aa, Mycobacterium
HGEGQGSEKIM

SEQ ID NO: 955670 - protein, 7 aa, Mycobacterium
HGGGAGS

SEQ ID NO: 955671 - protein, 11 aa, Mycobacterium
HGHPHAGRSRR

SEQ ID NO: 955672 - protein, 4 aa, Mycobacterium
HGNS

SEQ ID NO: 955673 - protein, 6 aa, Mycobacterium
HGPDGQ

SEQ ID NO: 955674 - protein, 5 aa, Mycobacterium
HGREG

SEQ ID NO: 955675 - protein, 7 aa, Mycobacterium
HGSGAAL

SEQ ID NO: 955676 - protein, 10 aa, Mycobacterium
HGTELGGQER

SEQ ID NO: 955677 - protein, 22 aa, Mycobacterium
HGYTAGQVRDRSSGEPTTTSIQ

SEQ ID NO: 955678 - protein, 7 aa, Mycobacterium
HHATGGT

SEQ ID NO: 955679 - protein, 6 aa, Mycobacterium
HIGDSR

SEQ ID NO: 955680 - protein, 11 aa, Mycobacterium
HKQTAASSNLW

SEQ ID NO: 955681 - protein, 6 aa, Mycobacterium
HKTPPT

SEQ ID NO: 955682 - protein, 8 aa, Mycobacterium
HNGPRTDL

SEQ ID NO: 955683 - protein, 7 aa, Mycobacterium
HNNGSRS

SEQ ID NO: 955684 - protein, 23 aa, Mycobacterium
HNRRPTGKVSHQRRRARSGIAVE

SEQ ID NO: 955685 - protein, 5 aa, Mycobacterium
HNVPT

SEQ ID NO: 955686 - protein, 4 aa, Mycobacterium
HPAQ

SEQ ID NO: 955687 - protein, 5 aa, Mycobacterium
HPDSE

SEQ ID NO: 955688 - protein, 9 aa, Mycobacterium
HPERDKRVA

SEQ ID NO: 955689 - protein, 4 aa, Mycobacterium
HPGD

SEQ ID NO: 955690 - protein, 10 aa, Mycobacterium
HPGPIDPATK

SEQ ID NO: 955691 - protein, 6 aa, Mycobacterium
HPGVGS

SEQ ID NO: 955692 - protein, 4 aa, Mycobacterium
HPGY

SEQ ID NO: 955693 - protein, 4 aa, Mycobacterium
HPIT

SEQ ID NO: 955694 - protein, 7 aa, Mycobacterium
HPPEQQK

SEQ ID NO: 955695 - protein, 6 aa, Mycobacterium
HPPIED

SEQ ID NO: 955696 - protein, 14 aa, Mycobacterium
HPPLSSSDPPGHLG

SEQ ID NO: 955697 - protein, 6 aa, Mycobacterium
HPPPNH

SEQ ID NO: 955698 - protein, 10 aa, Mycobacterium
HPQGGGSETY

SEQ ID NO: 955699 - protein, 10 aa, Mycobacterium
HPTETDAAGA

SEQ ID NO: 955700 - protein, 4 aa, Mycobacterium
HQAN

SEQ ID NO: 955701 - protein, 15 aa, Mycobacterium
HQDSIASSPNGERGK

SEQ ID NO: 955702 - protein, 9 aa, Mycobacterium
HQRPKLERY

SEQ ID NO: 955703 - protein, 10 aa, Mycobacterium
HQTAAREQFR

SEQ ID NO: 955704 - protein, 5 aa, Mycobacterium
HQTET

SEQ ID NO: 955705 - protein, 12 aa, Mycobacterium
HQTGSESDARTM

SEQ ID NO: 955706 - protein, 4 aa, Mycobacterium
HRGP

SEQ ID NO: 955707 - protein, 21 aa, Mycobacterium
HRPALAGAEAPQAKAAPPTCA

SEQ ID NO: 955708 - protein, 23 aa, Mycobacterium
HRRRSSESSPPNSGPADPGHPER

SEQ ID NO: 955709 - protein, 6 aa, Mycobacterium
HRSSTY

SEQ ID NO: 955710 - protein, 5 aa, Mycobacterium
HRTGA

SEQ ID NO: 955711 - protein, 8 aa, Mycobacterium
HSDSETEA

SEQ ID NO: 955712 - protein, 6 aa, Mycobacterium
HSEHKP

SEQ ID NO: 955713 - protein, 5 aa, Mycobacterium
HSGDK

SEQ ID NO: 955714 - protein, 12 aa, Mycobacterium
HSNGPGRAGLAR

SEQ ID NO: 955715 - protein, 7 aa, Mycobacterium
HSRPPIE

SEQ ID NO: 955716 - protein, 5 aa, Mycobacterium
HSSDI

SEQ ID NO: 955717 - protein, 43 aa, Mycobacterium
HSSQRSSEQARDFDAGESPRRSRRQPTPQSDPELRSQPPREIR

SEQ ID NO: 955718 - protein, 10 aa, Mycobacterium
HSTHKSLSAL

SEQ ID NO: 955719 - protein, 11 aa, Mycobacterium
HSTSQATSAYS

SEQ ID NO: 955720 - protein, 17 aa, Mycobacterium
HSYSPASRHSVLWPVIR

SEQ ID NO: 955721 - protein, 7 aa, Mycobacterium
HTANSKV

SEQ ID NO: 955722 - protein, 27 aa, Mycobacterium
HTDPGRNTVTTQTTQHRSGRAAELINP

SEQ ID NO: 955723 - protein, 7 aa, Mycobacterium
HTDTQSH

SEQ ID NO: 955724 - protein, 10 aa, Mycobacterium
HTEVKDTRRN

SEQ ID NO: 955725 - protein, 19 aa, Mycobacterium
HTGNGNNLSGYANAQVDNN

SEQ ID NO: 955726 - protein, 5 aa, Mycobacterium
HTKPP

SEQ ID NO: 955727 - protein, 8 aa, Mycobacterium
HTPFTGDS

SEQ ID NO: 955728 - protein, 5 aa, Mycobacterium
HTPLT

SEQ ID NO: 955729 - protein, 6 aa, Mycobacterium
HTRQQS

SEQ ID NO: 955730 - protein, 39 aa, Mycobacterium
HTSPGATDRIARPGYPSASDRTNATNGGQPGPGNLGTGE

SEQ ID NO: 955731 - protein, 5 aa, Mycobacterium
HVPTP

SEQ ID NO: 955732 - protein, 10 aa, Mycobacterium
HYATGGAGDF

SEQ ID NO: 955733 - protein, 11 aa, Mycobacterium
HYNPTTRRAEL

SEQ ID NO: 955734 - protein, 15 aa, Mycobacterium
IADTGAQVESGAHGI

SEQ ID NO: 955735 - protein, 14 aa, Mycobacterium
IAGAPTTSPASLGE

SEQ ID NO: 955736 - protein, 5 aa, Mycobacterium
IAGGA

SEQ ID NO: 955737 - protein, 12 aa, Mycobacterium
IAGKTGTAQQVN

SEQ ID NO: 955738 - protein, 41 aa, Mycobacterium
IAKGPEVSDRPVESASSRSASDTGLPSELPRPVAGNSQPYI

SEQ ID NO: 955739 - protein, 8 aa, Mycobacterium
IAPDGSEL

SEQ ID NO: 955740 - protein, 12 aa, Mycobacterium
IAPPPPSSTPPQ

SEQ ID NO: 955741 - protein, 5 aa, Mycobacterium
IAQRS

SEQ ID NO: 955742 - protein, 6 aa, Mycobacterium
IARSEQ

SEQ ID NO: 955743 - protein, 12 aa, Mycobacterium
IASTTAASGPAI

SEQ ID NO: 955744 - protein, 10 aa, Mycobacterium
IDARSERWRE

SEQ ID NO: 955745 - protein, 5 aa, Mycobacterium
IDAST

SEQ ID NO: 955746 - protein, 10 aa, Mycobacterium
IDDRSPTPTA

SEQ ID NO: 955747 - protein, 9 aa, Mycobacterium
IDGKTNAEA

SEQ ID NO: 955748 - protein, 7 aa, Mycobacterium
IDGPDNT

SEQ ID NO: 955749 - protein, 4 aa, Mycobacterium
IDNL

SEQ ID NO: 955750 - protein, 12 aa, Mycobacterium
IDRRSDLPTGRG

SEQ ID NO: 955751 - protein, 5 aa, Mycobacterium
IDSTK

SEQ ID NO: 955752 - protein, 11 aa, Mycobacterium
IEADQEHPTKR

SEQ ID NO: 955753 - protein, 9 aa, Mycobacterium
IEDSADVTE

SEQ ID NO: 955754 - protein, 15 aa, Mycobacterium
IEEDEGLRAISSTDD

SEQ ID NO: 955755 - protein, 5 aa, Mycobacterium
IEPET

SEQ ID NO: 955756 - protein, 12 aa, Mycobacterium
IESKSDQEEMQG

SEQ ID NO: 955757 - protein, 7 aa, Mycobacterium
IETADDA

SEQ ID NO: 955758 - protein, 7 aa, Mycobacterium
IETNGQL

SEQ ID NO: 955759 - protein, 8 aa, Mycobacterium
IGAGATAQ

SEQ ID NO: 955760 - protein, 6 aa, Mycobacterium
IGDRPV

SEQ ID NO: 955761 - protein, 14 aa, Mycobacterium
IGETQEAVATGACV

SEQ ID NO: 955762 - protein, 5 aa, Mycobacterium
IGGAP

SEQ ID NO: 955763 - protein, 26 aa, Mycobacterium
IGGPRRKGRIISEQEKKITAYHEGGH

SEQ ID NO: 955764 - protein, 7 aa, Mycobacterium
IGGTHGN

SEQ ID NO: 955765 - protein, 9 aa, Mycobacterium
IGKSTAASM

SEQ ID NO: 955766 - protein, 6 aa, Mycobacterium
IGPGPH

SEQ ID NO: 955767 - protein, 5 aa, Mycobacterium
IGQDA

SEQ ID NO: 955768 - protein, 6 aa, Mycobacterium
IGRQGR

SEQ ID NO: 955769 - protein, 9 aa, Mycobacterium
IGTASTGRL

SEQ ID NO: 955770 - protein, 4 aa, Mycobacterium
IGTG

SEQ ID NO: 955771 - protein, 12 aa, Mycobacterium
IGTNPPKDATVP

SEQ ID NO: 955772 - protein, 10 aa, Mycobacterium
IGVSEPKKRS

SEQ ID NO: 955773 - protein, 5 aa, Mycobacterium
IHSAD

SEQ ID NO: 955774 - protein, 8 aa, Mycobacterium
IKGDASAG

SEQ ID NO: 955775 - protein, 52 aa, Mycobacterium
IKTQTAVPPLPAITESSSATPTPTTKTSPTPTAGPAPSTTGSGTLTQTIGPS

SEQ ID NO: 955776 - protein, 4 aa, Mycobacterium
IKVR

SEQ ID NO: 955777 - protein, 9 aa, Mycobacterium
INDRGEGPG

SEQ ID NO: 955778 - protein, 10 aa, Mycobacterium
INFSGGQRQR

SEQ ID NO: 955779 - protein, 5 aa, Mycobacterium
INPDG

SEQ ID NO: 955780 - protein, 11 aa, Mycobacterium
INPNDASKKIN

SEQ ID NO: 955781 - protein, 24 aa, Mycobacterium
INPPSIDPGAVPPDVTGPDQPTEQ

SEQ ID NO: 955782 - protein, 17 aa, Mycobacterium
IPAAAAAARLADPENRV

SEQ ID NO: 955783 - protein, 8 aa, Mycobacterium
IPAEGKQI

SEQ ID NO: 955784 - protein, 8 aa, Mycobacterium
IPAGELKK

SEQ ID NO: 955785 - protein, 9 aa, Mycobacterium
IPAPEPTSI

SEQ ID NO: 955786 - protein, 12 aa, Mycobacterium
IPDTGAPNSLGL

SEQ ID NO: 955787 - protein, 18 aa, Mycobacterium
IPGAPYATPVSGDSSSTW

SEQ ID NO: 955788 - protein, 21 aa, Mycobacterium
IPKGPLPNAGKMRGVQRTVRR

SEQ ID NO: 955789 - protein, 6 aa, Mycobacterium
IPPSGI

SEQ ID NO: 955790 - protein, 19 aa, Mycobacterium
IPSPVDQTGSRVSDCGAGS

SEQ ID NO: 955791 - protein, 4 aa, Mycobacterium
IPTQ

SEQ ID NO: 955792 - protein, 12 aa, Mycobacterium
IPVPGETVDNEE

SEQ ID NO: 955793 - protein, 4 aa, Mycobacterium
IQGV

SEQ ID NO: 955794 - protein, 4 aa, Mycobacterium
IRGT

SEQ ID NO: 955795 - protein, 4 aa, Mycobacterium
IRNP

SEQ ID NO: 955796 - protein, 21 aa, Mycobacterium
IRRSSSQDSMSGDSPSRTHSM

SEQ ID NO: 955797 - protein, 6 aa, Mycobacterium
ISARRE

SEQ ID NO: 955798 - protein, 8 aa, Mycobacterium
ISATPTIK

SEQ ID NO: 955799 - protein, 11 aa, Mycobacterium
ISDGEIGDGPG

SEQ ID NO: 955800 - protein, 10 aa, Mycobacterium
ISGATVEEAG

SEQ ID NO: 955801 - protein, 12 aa, Mycobacterium
ISGQNSGGSNDG

SEQ ID NO: 955802 - protein, 4 aa, Mycobacterium
ISLP

SEQ ID NO: 955803 - protein, 6 aa, Mycobacterium
ISPDNL

SEQ ID NO: 955804 - protein, 10 aa, Mycobacterium
ISPNKSWEGF

SEQ ID NO: 955805 - protein, 7 aa, Mycobacterium
ISPPEEG

SEQ ID NO: 955806 - protein, 24 aa, Mycobacterium
ISPPKIDPGAVPPDGPPGPATPMK

SEQ ID NO: 955807 - protein, 17 aa, Mycobacterium
ISQSALAATPQATPPPL

SEQ ID NO: 955808 - protein, 17 aa, Mycobacterium
ISSGVQAAPLPPEPQLA

SEQ ID NO: 955809 - protein, 6 aa, Mycobacterium
ISTQLP

SEQ ID NO: 955810 - protein, 14 aa, Mycobacterium
ISTSSVRDAPLDGP

SEQ ID NO: 955811 - protein, 5 aa, Mycobacterium
ITAGS

SEQ ID NO: 955812 - protein, 40 aa, Mycobacterium
ITAKGSTPISQPTPPAGPAFAEQPPRLVPASPSDPVPRHR

SEQ ID NO: 955813 - protein, 8 aa, Mycobacterium
ITAQGHPL

SEQ ID NO: 955814 - protein, 9 aa, Mycobacterium
ITDHGGGVS

SEQ ID NO: 955815 - protein, 7 aa, Mycobacterium
ITGNGKA

SEQ ID NO: 955816 - protein, 4 aa, Mycobacterium
ITGS

SEQ ID NO: 955817 - protein, 11 aa, Mycobacterium
ITNNGDESCGN

SEQ ID NO: 955818 - protein, 7 aa, Mycobacterium
ITPAEGI

SEQ ID NO: 955819 - protein, 6 aa, Mycobacterium
ITPDSV

SEQ ID NO: 955820 - protein, 6 aa, Mycobacterium
ITPPDD

SEQ ID NO: 955821 - protein, 10 aa, Mycobacterium
ITRPDGTAMD

SEQ ID NO: 955822 - protein, 11 aa, Mycobacterium
ITSRNNESDGA

SEQ ID NO: 955823 - protein, 7 aa, Mycobacterium
IVEQGSH

SEQ ID NO: 955824 - protein, 10 aa, Mycobacterium
KAEGQTGGAA

SEQ ID NO: 955825 - protein, 7 aa, Mycobacterium
KAENRLD

SEQ ID NO: 955826 - protein, 6 aa, Mycobacterium
KAGFSD

SEQ ID NO: 955827 - protein, 18 aa, Mycobacterium
KAGGDNSVLGAKKGEVYP

SEQ ID NO: 955828 - protein, 16 aa, Mycobacterium
KAGPSERNKTTLEDSE

SEQ ID NO: 955829 - protein, 7 aa, Mycobacterium
KAGRRRY

SEQ ID NO: 955830 - protein, 7 aa, Mycobacterium
KAIGSSV

SEQ ID NO: 955831 - protein, 4 aa, Mycobacterium
KAKH

SEQ ID NO: 955832 - protein, 49 aa, Mycobacterium
KAKLPAKGTAAAEITKTAGLSPAKPTESEAPAPEKSTQAAASAAPAKGI

SEQ ID NO: 955833 - protein, 12 aa, Mycobacterium
KAQQQARRWSRD

SEQ ID NO: 955834 - protein, 9 aa, Mycobacterium
KASDQAPKR

SEQ ID NO: 955835 - protein, 7 aa, Mycobacterium
KASSAGV

SEQ ID NO: 955836 - protein, 10 aa, Mycobacterium
KAVGGDVSGA

SEQ ID NO: 955837 - protein, 13 aa, Mycobacterium
KAVRGSITDRNNE

SEQ ID NO: 955838 - protein, 9 aa, Mycobacterium
KDAQGIANN

SEQ ID NO: 955839 - protein, 9 aa, Mycobacterium
KDDLADASD

SEQ ID NO: 955840 - protein, 5 aa, Mycobacterium
KDGAG

SEQ ID NO: 955841 - protein, 20 aa, Mycobacterium
KDGAGASRELDETTQGTMSR

SEQ ID NO: 955842 - protein, 5 aa, Mycobacterium
KDGAK

SEQ ID NO: 955843 - protein, 6 aa, Mycobacterium
KDNDPR

SEQ ID NO: 955844 - protein, 10 aa, Mycobacterium
KDPSRPKITE

SEQ ID NO: 955845 - protein, 30 aa, Mycobacterium
KDQAEPEYTEGVTTAKTTGERTDVDPDIGD

SEQ ID NO: 955846 - protein, 7 aa, Mycobacterium
KDYGSAR

SEQ ID NO: 955847 - protein, 38 aa, Mycobacterium
KEDEAKKQKAIERRTANAPAPGSKPKYVSTTAPVSVNG

SEQ ID NO: 955848 - protein, 6 aa, Mycobacterium
KEHELA

SEQ ID NO: 955849 - protein, 15 aa, Mycobacterium
KEPPPPLPADLPPNV

SEQ ID NO: 955850 - protein, 7 aa, Mycobacterium
KEPRQTH

SEQ ID NO: 955851 - protein, 7 aa, Mycobacterium
KFATGAG

SEQ ID NO: 955852 - protein, 8 aa, Mycobacterium
KFDPNSKY

SEQ ID NO: 955853 - protein, 4 aa, Mycobacterium
KFYA

SEQ ID NO: 955854 - protein, 23 aa, Mycobacterium
KGAGGAARSIGRARDIEPGHRRD

SEQ ID NO: 955855 - protein, 9 aa, Mycobacterium
KGEAGADSF

SEQ ID NO: 955856 - protein, 4 aa, Mycobacterium
KGET

SEQ ID NO: 955857 - protein, 15 aa, Mycobacterium
KGGQKPRYFGRHKGA

SEQ ID NO: 955858 - protein, 15 aa, Mycobacterium
KGKPIADDADLDGLA

SEQ ID NO: 955859 - protein, 5 aa, Mycobacterium
KGLTG

SEQ ID NO: 955860 - protein, 12 aa, Mycobacterium
KGNNDTDGSDKV

SEQ ID NO: 955861 - protein, 8 aa, Mycobacterium
KGREEPEN

SEQ ID NO: 955862 - protein, 6 aa, Mycobacterium
KGRHSI

SEQ ID NO: 955863 - protein, 4 aa, Mycobacterium
KGSV

SEQ ID NO: 955864 - protein, 4 aa, Mycobacterium
KGVP

SEQ ID NO: 955865 - protein, 4 aa, Mycobacterium
KHQA

SEQ ID NO: 955866 - protein, 7 aa, Mycobacterium
KIDGAGE

SEQ ID NO: 955867 - protein, 8 aa, Mycobacterium
KIEARDDV

SEQ ID NO: 955868 - protein, 11 aa, Mycobacterium
KIESESPAVQT

SEQ ID NO: 955869 - protein, 5 aa, Mycobacterium
KIPGV

SEQ ID NO: 955870 - protein, 61 aa, Mycobacterium
KKANQRRIRRRKGRKDNEAEDEEADAGEHNEAETPAQAEEVTSENPQPAPESGAQKEPDEL

SEQ ID NO: 955871 - protein, 6 aa, Mycobacterium
KKGNLR

SEQ ID NO: 955872 - protein, 17 aa, Mycobacterium
KKKASAVKTEKAAESVA

SEQ ID NO: 955873 - protein, 10 aa, Mycobacterium
KKPKDAETKQ

SEQ ID NO: 955874 - protein, 9 aa, Mycobacterium
KKTTDTELP

SEQ ID NO: 955875 - protein, 10 aa, Mycobacterium
KKVSGRLRQP

SEQ ID NO: 955876 - protein, 10 aa, Mycobacterium
KKWRQSTKQS

SEQ ID NO: 955877 - protein, 10 aa, Mycobacterium
KLAGSGTHES

SEQ ID NO: 955878 - protein, 7 aa, Mycobacterium
KLDGGTV

SEQ ID NO: 955879 - protein, 11 aa, Mycobacterium
KLEPDESDRAM

SEQ ID NO: 955880 - protein, 4 aa, Mycobacterium
KLGG

SEQ ID NO: 955881 - protein, 12 aa, Mycobacterium
KLGSAGSPSSGS

SEQ ID NO: 955882 - protein, 7 aa, Mycobacterium
KLGSSAG

SEQ ID NO: 955883 - protein, 7 aa, Mycobacterium
KLNDTEV

SEQ ID NO: 955884 - protein, 6 aa, Mycobacterium
KLRDKN

SEQ ID NO: 955885 - protein, 8 aa, Mycobacterium
KLTSSGFK

SEQ ID NO: 955886 - protein, 7 aa, Mycobacterium
KNADSDV

SEQ ID NO: 955887 - protein, 6 aa, Mycobacterium
KNDPNL

SEQ ID NO: 955888 - protein, 10 aa, Mycobacterium
KNDRSASYQL

SEQ ID NO: 955889 - protein, 5 aa, Mycobacterium
KNDSL

SEQ ID NO: 955890 - protein, 4 aa, Mycobacterium
KNLA

SEQ ID NO: 955891 - protein, 10 aa, Mycobacterium
KPASTVKDGK

SEQ ID NO: 955892 - protein, 11 aa, Mycobacterium
KPDAVRKESEY

SEQ ID NO: 955893 - protein, 16 aa, Mycobacterium
KPDGKTCRFNPWPYPI

SEQ ID NO: 955894 - protein, 4 aa, Mycobacterium
KPDS

SEQ ID NO: 955895 - protein, 51 aa, Mycobacterium
KPEGVNDDLKSDPVVSKPGLVNSDASPNKPNVTFSDSAGTAGGKGPVGVNG

SEQ ID NO: 955896 - protein, 6 aa, Mycobacterium
KPGAIN

SEQ ID NO: 955897 - protein, 5 aa, Mycobacterium
KPGLP

SEQ ID NO: 955898 - protein, 4 aa, Mycobacterium
KPGT

SEQ ID NO: 955899 - protein, 8 aa, Mycobacterium
KPKEASGS

SEQ ID NO: 955900 - protein, 9 aa, Mycobacterium
KPLPNGNSG

SEQ ID NO: 955901 - protein, 5 aa, Mycobacterium
KPLTL

SEQ ID NO: 955902 - protein, 6 aa, Mycobacterium
KPPDVS

SEQ ID NO: 955903 - protein, 6 aa, Mycobacterium
KPPGLA

SEQ ID NO: 955904 - protein, 21 aa, Mycobacterium
KPPPALSSEEHADASSKDHEA

SEQ ID NO: 955905 - protein, 13 aa, Mycobacterium
KPPQGMAAESSSA

SEQ ID NO: 955906 - protein, 6 aa, Mycobacterium
KPSWVT

SEQ ID NO: 955907 - protein, 7 aa, Mycobacterium
KPTPLSE

SEQ ID NO: 955908 - protein, 7 aa, Mycobacterium
KPVPLEG

SEQ ID NO: 955909 - protein, 16 aa, Mycobacterium
KQQHDARRAARRACPN

SEQ ID NO: 955910 - protein, 13 aa, Mycobacterium
KQSVTEVTEELKV

SEQ ID NO: 955911 - protein, 9 aa, Mycobacterium
KQTRNSHQK

SEQ ID NO: 955912 - protein, 30 aa, Mycobacterium
KQVRPQPGKASVGRKPARKAPREPDRPLRP

SEQ ID NO: 955913 - protein, 10 aa, Mycobacterium
KRDPDLDTGN

SEQ ID NO: 955914 - protein, 10 aa, Mycobacterium
KRDRDGAAPI

SEQ ID NO: 955915 - protein, 7 aa, Mycobacterium
KREPGKP

SEQ ID NO: 955916 - protein, 8 aa, Mycobacterium
KRKGQGTL

SEQ ID NO: 955917 - protein, 9 aa, Mycobacterium
KRMDTDPEH

SEQ ID NO: 955918 - protein, 16 aa, Mycobacterium
KRQTLADKIMTTVCLP

SEQ ID NO: 955919 - protein, 7 aa, Mycobacterium
KRSELDQ

SEQ ID NO: 955920 - protein, 6 aa, Mycobacterium
KRSGGI

SEQ ID NO: 955921 - protein, 7 aa, Mycobacterium
KRSHGSP

SEQ ID NO: 955922 - protein, 6 aa, Mycobacterium
KRSIER

SEQ ID NO: 955923 - protein, 7 aa, Mycobacterium
KSAGTPI

SEQ ID NO: 955924 - protein, 7 aa, Mycobacterium
KSARPPV

SEQ ID NO: 955925 - protein, 10 aa, Mycobacterium
KSLQHDERSR

SEQ ID NO: 955926 - protein, 6 aa, Mycobacterium
KSLRAG

SEQ ID NO: 955927 - protein, 7 aa, Mycobacterium
KSMAPQV

SEQ ID NO: 955928 - protein, 4 aa, Mycobacterium
KSPQ

SEQ ID NO: 955929 - protein, 14 aa, Mycobacterium
KSPSKRQPASDLTA

SEQ ID NO: 955930 - protein, 15 aa, Mycobacterium
KSRAKQLSKDMPKTT

SEQ ID NO: 955931 - protein, 8 aa, Mycobacterium
KSSVATAS

SEQ ID NO: 955932 - protein, 4 aa, Mycobacterium
KSTG

SEQ ID NO: 955933 - protein, 7 aa, Mycobacterium
KTAEKLE

SEQ ID NO: 955934 - protein, 11 aa, Mycobacterium
KTEFPTPTGKY

SEQ ID NO: 955935 - protein, 17 aa, Mycobacterium
KTEPDQDPGADRQHHER

SEQ ID NO: 955936 - protein, 4 aa, Mycobacterium
KTGE

SEQ ID NO: 955937 - protein, 7 aa, Mycobacterium
KTGTQGL

SEQ ID NO: 955938 - protein, 16 aa, Mycobacterium
KTKATPASHTVDDYRA

SEQ ID NO: 955939 - protein, 8 aa, Mycobacterium
KTSRVQKK

SEQ ID NO: 955940 - protein, 6 aa, Mycobacterium
KTVTRV

SEQ ID NO: 955941 - protein, 5 aa, Mycobacterium
KTYPY

SEQ ID NO: 955942 - protein, 5 aa, Mycobacterium
KVGPS

SEQ ID NO: 955943 - protein, 5 aa, Mycobacterium
KVRGE

SEQ ID NO: 955944 - protein, 9 aa, Mycobacterium
KVSKTASEW

SEQ ID NO: 955945 - protein, 6 aa, Mycobacterium
KYPELT

SEQ ID NO: 955946 - protein, 9 aa, Mycobacterium
LAAPADGVS

SEQ ID NO: 955947 - protein, 8 aa, Mycobacterium
LAAPPESI

SEQ ID NO: 955948 - protein, 11 aa, Mycobacterium
LAERANPRRLA

SEQ ID NO: 955949 - protein, 12 aa, Mycobacterium
LAERRGDEHAAG

SEQ ID NO: 955950 - protein, 6 aa, Mycobacterium
LAGDPD

SEQ ID NO: 955951 - protein, 8 aa, Mycobacterium
LAGGAGNL

SEQ ID NO: 955952 - protein, 11 aa, Mycobacterium
LAGGGTEDAAG

SEQ ID NO: 955953 - protein, 8 aa, Mycobacterium
LAGGSPVV

SEQ ID NO: 955954 - protein, 10 aa, Mycobacterium
LAGNDDPNLP

SEQ ID NO: 955955 - protein, 5 aa, Mycobacterium
LANGS

SEQ ID NO: 955956 - protein, 10 aa, Mycobacterium
LANPKGWTHN

SEQ ID NO: 955957 - protein, 15 aa, Mycobacterium
LAPAQQDTTGQPVEP

SEQ ID NO: 955958 - protein, 7 aa, Mycobacterium
LAPEEPV

SEQ ID NO: 955959 - protein, 10 aa, Mycobacterium
LAPGSATQNV

SEQ ID NO: 955960 - protein, 6 aa, Mycobacterium
LAQHTE

SEQ ID NO: 955961 - protein, 6 aa, Mycobacterium
LAQSRQ

SEQ ID NO: 955962 - protein, 6 aa, Mycobacterium
LARQDR

SEQ ID NO: 955963 - protein, 12 aa, Mycobacterium
LARTDNSGWGDE

SEQ ID NO: 955964 - protein, 7 aa, Mycobacterium
LASPQTA

SEQ ID NO: 955965 - protein, 21 aa, Mycobacterium
LASSASAAAAPVAAPTLLSAL

SEQ ID NO: 955966 - protein, 10 aa, Mycobacterium
LASSLAPGGR

SEQ ID NO: 955967 - protein, 8 aa, Mycobacterium
LATNATTI

SEQ ID NO: 955968 - protein, 6 aa, Mycobacterium
LATPNE

SEQ ID NO: 955969 - protein, 5 aa, Mycobacterium
LATSL

SEQ ID NO: 955970 - protein, 13 aa, Mycobacterium
LATTNNTEEPAGR

SEQ ID NO: 955971 - protein, 11 aa, Mycobacterium
LDADDEGTVSI

SEQ ID NO: 955972 - protein, 12 aa, Mycobacterium
LDAGKDNPVVRP

SEQ ID NO: 955973 - protein, 5 aa, Mycobacterium
LDEAA

SEQ ID NO: 955974 - protein, 17 aa, Mycobacterium
LDEAPAQSLSGTRGAAP

SEQ ID NO: 955975 - protein, 6 aa, Mycobacterium
LDEPRH

SEQ ID NO: 955976 - protein, 6 aa, Mycobacterium
LDGANT

SEQ ID NO: 955977 - protein, 10 aa, Mycobacterium
LDGHTDTDAD

SEQ ID NO: 955978 - protein, 5 aa, Mycobacterium
LDGRS

SEQ ID NO: 955979 - protein, 14 aa, Mycobacterium
LDNPRSPRRRAGIP

SEQ ID NO: 955980 - protein, 10 aa, Mycobacterium
LDPDTSRSAR

SEQ ID NO: 955981 - protein, 4 aa, Mycobacterium
LDSR

SEQ ID NO: 955982 - protein, 8 aa, Mycobacterium
LDTQPGVA

SEQ ID NO: 955983 - protein, 9 aa, Mycobacterium
LDVTNPDYC

SEQ ID NO: 955984 - protein, 4 aa, Mycobacterium
LEGK

SEQ ID NO: 955985 - protein, 11 aa, Mycobacterium
LEPPATRNGLA

SEQ ID NO: 955986 - protein, 9 aa, Mycobacterium
LESDEDRSV

SEQ ID NO: 955987 - protein, 10 aa, Mycobacterium
LESTAASSSA

SEQ ID NO: 955988 - protein, 16 aa, Mycobacterium
LETTKDKSRHVPESGF

SEQ ID NO: 955989 - protein, 6 aa, Mycobacterium
LGAGTA

SEQ ID NO: 955990 - protein, 11 aa, Mycobacterium
LGAGTPTAATG

SEQ ID NO: 955991 - protein, 9 aa, Mycobacterium
LGAKAQARS

SEQ ID NO: 955992 - protein, 5 aa, Mycobacterium
LGATA

SEQ ID NO: 955993 - protein, 7 aa, Mycobacterium
LGDPADS

SEQ ID NO: 955994 - protein, 9 aa, Mycobacterium
LGDSGKVRV

SEQ ID NO: 955995 - protein, 19 aa, Mycobacterium
LGDTSTGQWQTPDRDAELT

SEQ ID NO: 955996 - protein, 15 aa, Mycobacterium
LGEDLNATNASTGEI

SEQ ID NO: 955997 - protein, 8 aa, Mycobacterium
LGERPGAQ

SEQ ID NO: 955998 - protein, 6 aa, Mycobacterium
LGGPGV

SEQ ID NO: 955999 - protein, 23 aa, Mycobacterium
LGGQDTRVATPSGLDGPGMSTSA

SEQ ID NO: 956000 - protein, 4 aa, Mycobacterium
LGGR

SEQ ID NO: 956001 - protein, 11 aa, Mycobacterium
LGHDATPASDV

SEQ ID NO: 956002 - protein, 5 aa, Mycobacterium
LGHDV

SEQ ID NO: 956003 - protein, 16 aa, Mycobacterium
LGKPANPAAVKSSELT

SEQ ID NO: 956004 - protein, 12 aa, Mycobacterium
LGLNKTAKTVGQ

SEQ ID NO: 956005 - protein, 10 aa, Mycobacterium
LGPVDDHGHP

SEQ ID NO: 956006 - protein, 12 aa, Mycobacterium
LGPVKEREPVPP

SEQ ID NO: 956007 - protein, 10 aa, Mycobacterium
LGRDSGPEHR

SEQ ID NO: 956008 - protein, 4 aa, Mycobacterium
LGRQ

SEQ ID NO: 956009 - protein, 15 aa, Mycobacterium
LGRRRRHRSARPARV

SEQ ID NO: 956010 - protein, 5 aa, Mycobacterium
LGSAL

SEQ ID NO: 956011 - protein, 8 aa, Mycobacterium
LGSPGQAA

SEQ ID NO: 956012 - protein, 9 aa, Mycobacterium
LGSRAGASL

SEQ ID NO: 956013 - protein, 8 aa, Mycobacterium
LGSTGGKS

SEQ ID NO: 956014 - protein, 10 aa, Mycobacterium
LGTSDVAGSL

SEQ ID NO: 956015 - protein, 7 aa, Mycobacterium
LGTYNTN

SEQ ID NO: 956016 - protein, 4 aa, Mycobacterium
LHRP

SEQ ID NO: 956017 - protein, 10 aa, Mycobacterium
LKGDDDDTIL

SEQ ID NO: 956018 - protein, 9 aa, Mycobacterium
LKGPNGKLG

SEQ ID NO: 956019 - protein, 5 aa, Mycobacterium
LKPEV

SEQ ID NO: 956020 - protein, 5 aa, Mycobacterium
LKPGH

SEQ ID NO: 956021 - protein, 11 aa, Mycobacterium
LKPGPSSAKVR

SEQ ID NO: 956022 - protein, 12 aa, Mycobacterium
LKPGRHGVAPGQ

SEQ ID NO: 956023 - protein, 7 aa, Mycobacterium
LKSDAGR

SEQ ID NO: 956024 - protein, 13 aa, Mycobacterium
LLPPRGQAPQQGG

SEQ ID NO: 956025 - protein, 4 aa, Mycobacterium
LNAG

SEQ ID NO: 956026 - protein, 7 aa, Mycobacterium
LNGTPNL

SEQ ID NO: 956027 - protein, 14 aa, Mycobacterium
LNRYGGAAARGIDD

SEQ ID NO: 956028 - protein, 18 aa, Mycobacterium
LPAGTLPDGGAFTEAGDK

SEQ ID NO: 956029 - protein, 6 aa, Mycobacterium
LPAQAG

SEQ ID NO: 956030 - protein, 8 aa, Mycobacterium
LPDGDRGR

SEQ ID NO: 956031 - protein, 5 aa, Mycobacterium
LPDGH

SEQ ID NO: 956032 - protein, 4 aa, Mycobacterium
LPES

SEQ ID NO: 956033 - protein, 7 aa, Mycobacterium
LPGAGDA

SEQ ID NO: 956034 - protein, 4 aa, Mycobacterium
LPGI

SEQ ID NO: 956035 - protein, 4 aa, Mycobacterium
LPGT

SEQ ID NO: 956036 - protein, 94 aa, Mycobacterium
LPKAAESSASRGPTAGATPGGTTGGNPPGGTTGGNPPGGTTGRNPPGGTTGGNPPGGTTGGNPPDGTTGTDGTAPATGPGRTAGTAAGTAPRPA

SEQ ID NO: 956037 - protein, 21 aa, Mycobacterium
LPKGISKTQAVAAARTRGDNA

SEQ ID NO: 956038 - protein, 8 aa, Mycobacterium
LPNDTPLR

SEQ ID NO: 956039 - protein, 12 aa, Mycobacterium
LPNTSSPKPMPN

SEQ ID NO: 956040 - protein, 8 aa, Mycobacterium
LPPASPFA

SEQ ID NO: 956041 - protein, 5 aa, Mycobacterium
LPPGQ

SEQ ID NO: 956042 - protein, 9 aa, Mycobacterium
LPPPHEPKS

SEQ ID NO: 956043 - protein, 11 aa, Mycobacterium
LPPPSPKPVKL

SEQ ID NO: 956044 - protein, 6 aa, Mycobacterium
LPPQDR

SEQ ID NO: 956045 - protein, 7 aa, Mycobacterium
LPPSEEL

SEQ ID NO: 956046 - protein, 6 aa, Mycobacterium
LPPSGG

SEQ ID NO: 956047 - protein, 9 aa, Mycobacterium
LPQGKSCTR

SEQ ID NO: 956048 - protein, 5 aa, Mycobacterium
LPRDR

SEQ ID NO: 956049 - protein, 8 aa, Mycobacterium
LPRPPTLA

SEQ ID NO: 956050 - protein, 6 aa, Mycobacterium
LPSRAE

SEQ ID NO: 956051 - protein, 4 aa, Mycobacterium
LPTG

SEQ ID NO: 956052 - protein, 7 aa, Mycobacterium
LPVPDAA

SEQ ID NO: 956053 - protein, 9 aa, Mycobacterium
LQAGEPQAL

SEQ ID NO: 956054 - protein, 10 aa, Mycobacterium
LQPNDPRGWN

SEQ ID NO: 956055 - protein, 11 aa, Mycobacterium
LQQPPRLGADE

SEQ ID NO: 956056 - protein, 8 aa, Mycobacterium
LQRGQEAG

SEQ ID NO: 956057 - protein, 9 aa, Mycobacterium
LQTQSRGQI

SEQ ID NO: 956058 - protein, 9 aa, Mycobacterium
LRDESSHGL

SEQ ID NO: 956059 - protein, 7 aa, Mycobacterium
LRETSSV

SEQ ID NO: 956060 - protein, 4 aa, Mycobacterium
LRGD

SEQ ID NO: 956061 - protein, 4 aa, Mycobacterium
LRKP

SEQ ID NO: 956062 - protein, 8 aa, Mycobacterium
LRNPSDDV

SEQ ID NO: 956063 - protein, 9 aa, Mycobacterium
LRNRSQSRR

SEQ ID NO: 956064 - protein, 6 aa, Mycobacterium
LRPEGQ

SEQ ID NO: 956065 - protein, 24 aa, Mycobacterium
LRPSGGAQVQAGLPGGNLDQAESQ

SEQ ID NO: 956066 - protein, 6 aa, Mycobacterium
LRPTEA

SEQ ID NO: 956067 - protein, 9 aa, Mycobacterium
LRQQGEGRW

SEQ ID NO: 956068 - protein, 16 aa, Mycobacterium
LRRPPPKPTSLATDSR

SEQ ID NO: 956069 - protein, 11 aa, Mycobacterium
LRSGRQPQEAV

SEQ ID NO: 956070 - protein, 8 aa, Mycobacterium
LSDAGRSW

SEQ ID NO: 956071 - protein, 8 aa, Mycobacterium
LSDPVSDE

SEQ ID NO: 956072 - protein, 12 aa, Mycobacterium
LSDSPDNAGMAE

SEQ ID NO: 956073 - protein, 16 aa, Mycobacterium
LSGNSPGLTFWLFLVF

SEQ ID NO: 956074 - protein, 6 aa, Mycobacterium
LSGQGG

SEQ ID NO: 956075 - protein, 5 aa, Mycobacterium
LSGSP

SEQ ID NO: 956076 - protein, 7 aa, Mycobacterium
LSMSGSS

SEQ ID NO: 956077 - protein, 18 aa, Mycobacterium
LSPASQLGDSSEPRVSKT

SEQ ID NO: 956078 - protein, 6 aa, Mycobacterium
LSPDRP

SEQ ID NO: 956079 - protein, 17 aa, Mycobacterium
LSPEQARGDSVDARSDV

SEQ ID NO: 956080 - protein, 7 aa, Mycobacterium
LSPNDRS

SEQ ID NO: 956081 - protein, 11 aa, Mycobacterium
LSPTDDGSTAQ

SEQ ID NO: 956082 - protein, 8 aa, Mycobacterium
LSRSQQNI

SEQ ID NO: 956083 - protein, 14 aa, Mycobacterium
LSSDGTAVLSAGDT

SEQ ID NO: 956084 - protein, 8 aa, Mycobacterium
LSSGAGPG

SEQ ID NO: 956085 - protein, 8 aa, Mycobacterium
LSSGHPIT

SEQ ID NO: 956086 - protein, 6 aa, Mycobacterium
LSSSSG

SEQ ID NO: 956087 - protein, 11 aa, Mycobacterium
LSTNARPEDTR

SEQ ID NO: 956088 - protein, 16 aa, Mycobacterium
LSVQDDELGAPATAAL

SEQ ID NO: 956089 - protein, 11 aa, Mycobacterium
LTADGRTGLTG

SEQ ID NO: 956090 - protein, 10 aa, Mycobacterium
LTAPAPHHTR

SEQ ID NO: 956091 - protein, 14 aa, Mycobacterium
LTAPGAQSNDGKAA

SEQ ID NO: 956092 - protein, 10 aa, Mycobacterium
LTEPDPNAGM

SEQ ID NO: 956093 - protein, 19 aa, Mycobacterium
LTGARSAPKVAPFADPGNP

SEQ ID NO: 956094 - protein, 5 aa, Mycobacterium
LTGTD

SEQ ID NO: 956095 - protein, 6 aa, Mycobacterium
LTGTPA

SEQ ID NO: 956096 - protein, 4 aa, Mycobacterium
LTPE

SEQ ID NO: 956097 - protein, 6 aa, Mycobacterium
LTPEQG

SEQ ID NO: 956098 - protein, 9 aa, Mycobacterium
LTPSGALTE

SEQ ID NO: 956099 - protein, 10 aa, Mycobacterium
LTPSGRPSKF

SEQ ID NO: 956100 - protein, 7 aa, Mycobacterium
LTQITKD

SEQ ID NO: 956101 - protein, 12 aa, Mycobacterium
LTQSKEQPELAS

SEQ ID NO: 956102 - protein, 10 aa, Mycobacterium
LTRDEPAQYD

SEQ ID NO: 956103 - protein, 5 aa, Mycobacterium
LTRPG

SEQ ID NO: 956104 - protein, 4 aa, Mycobacterium
LTSP

SEQ ID NO: 956105 - protein, 12 aa, Mycobacterium
LTSQPFNTKHLV

SEQ ID NO: 956106 - protein, 17 aa, Mycobacterium
LVPDEYRASAVSSYRQV

SEQ ID NO: 956107 - protein, 7 aa, Mycobacterium
MATPDKK

SEQ ID NO: 956108 - protein, 4 aa, Mycobacterium
MATS

SEQ ID NO: 956109 - protein, 13 aa, Mycobacterium
MDLSTGKRLPAVT

SEQ ID NO: 956110 - protein, 22 aa, Mycobacterium
MGDAHDTVTPSDSRCPGGPNPP

SEQ ID NO: 956111 - protein, 12 aa, Mycobacterium
MGGQQQMSRPKL

SEQ ID NO: 956112 - protein, 8 aa, Mycobacterium
MGSSPHCP

SEQ ID NO: 956113 - protein, 11 aa, Mycobacterium
MNPANGRRRRV

SEQ ID NO: 956114 - protein, 8 aa, Mycobacterium
MNSSTTDV

SEQ ID NO: 956115 - protein, 6 aa, Mycobacterium
MPDQSH

SEQ ID NO: 956116 - protein, 12 aa, Mycobacterium
MPGSGDHGWQAD

SEQ ID NO: 956117 - protein, 11 aa, Mycobacterium
MQKTTSKLRDE

SEQ ID NO: 956118 - protein, 22 aa, Mycobacterium
MQPPGAPADQLAARPDPRDPTL

SEQ ID NO: 956119 - protein, 7 aa, Mycobacterium
MQQNNDM

SEQ ID NO: 956120 - protein, 13 aa, Mycobacterium
MSKGKGSQLEPAT

SEQ ID NO: 956121 - protein, 4 aa, Mycobacterium
MSLP

SEQ ID NO: 956122 - protein, 16 aa, Mycobacterium
MSPITGEAKPVRVNPG

SEQ ID NO: 956123 - protein, 8 aa, Mycobacterium
MSSNDTLP

SEQ ID NO: 956124 - protein, 4 aa, Mycobacterium
MSSR

SEQ ID NO: 956125 - protein, 6 aa, Mycobacterium
MSTPQA

SEQ ID NO: 956126 - protein, 5 aa, Mycobacterium
MTDDP

SEQ ID NO: 956127 - protein, 12 aa, Mycobacterium
NAAGLRAQAAGQ

SEQ ID NO: 956128 - protein, 6 aa, Mycobacterium
NAAGTV

SEQ ID NO: 956129 - protein, 9 aa, Mycobacterium
NAASAAVGS

SEQ ID NO: 956130 - protein, 9 aa, Mycobacterium
NAGKPGNTK

SEQ ID NO: 956131 - protein, 8 aa, Mycobacterium
NASDIDPL

SEQ ID NO: 956132 - protein, 16 aa, Mycobacterium
NDAGDASTNNATPHRK

SEQ ID NO: 956133 - protein, 11 aa, Mycobacterium
NDLASAGRRIA

SEQ ID NO: 956134 - protein, 6 aa, Mycobacterium
NDPGTF

SEQ ID NO: 956135 - protein, 11 aa, Mycobacterium
NDRAHNQETGY

SEQ ID NO: 956136 - protein, 10 aa, Mycobacterium
NDRKERLDRK

SEQ ID NO: 956137 - protein, 5 aa, Mycobacterium
NDRMN

SEQ ID NO: 956138 - protein, 7 aa, Mycobacterium
NDSDTVA

SEQ ID NO: 956139 - protein, 9 aa, Mycobacterium
NDSGGYNAN

SEQ ID NO: 956140 - protein, 9 aa, Mycobacterium
NDVGENRTQ

SEQ ID NO: 956141 - protein, 17 aa, Mycobacterium
NDYSDGIRGTDDHRAGP

SEQ ID NO: 956142 - protein, 6 aa, Mycobacterium
NEGNSD

SEQ ID NO: 956143 - protein, 10 aa, Mycobacterium
NEPKEYGRKS

SEQ ID NO: 956144 - protein, 6 aa, Mycobacterium
NERPVP

SEQ ID NO: 956145 - protein, 62 aa, Mycobacterium
NGAAAQPANVDKPGSSQNHPGSATPKVLPPNGHEGNLAPAPPQGRNPESSTSTAAVQPPPVL

SEQ ID NO: 956146 - protein, 10 aa, Mycobacterium
NGARADFGVE

SEQ ID NO: 956147 - protein, 8 aa, Mycobacterium
NGASATVR

SEQ ID NO: 956148 - protein, 8 aa, Mycobacterium
NGDAGQEI

SEQ ID NO: 956149 - protein, 10 aa, Mycobacterium
NGDEYDPLTP

SEQ ID NO: 956150 - protein, 5 aa, Mycobacterium
NGDGE

SEQ ID NO: 956151 - protein, 6 aa, Mycobacterium
NGGEVQ

SEQ ID NO: 956152 - protein, 20 aa, Mycobacterium
NGIPADVSADPVMEPPGDRS

SEQ ID NO: 956153 - protein, 29 aa, Mycobacterium
NGMTTGGEAGNEGGTNATPGINGSRAQLP

SEQ ID NO: 956154 - protein, 13 aa, Mycobacterium
NGPQAVADAAHQA

SEQ ID NO: 956155 - protein, 17 aa, Mycobacterium
NGPVFNQGERVEANTST

SEQ ID NO: 956156 - protein, 10 aa, Mycobacterium
NGQPSNPADC

SEQ ID NO: 956157 - protein, 6 aa, Mycobacterium
NGSPEY

SEQ ID NO: 956158 - protein, 22 aa, Mycobacterium
NGTIGAPAVSRRRRRRTDSDAV

SEQ ID NO: 956159 - protein, 13 aa, Mycobacterium
NGTPDYGTPARLD

SEQ ID NO: 956160 - protein, 8 aa, Mycobacterium
NGTQSATT

SEQ ID NO: 956161 - protein, 8 aa, Mycobacterium
NGTSTANK

SEQ ID NO: 956162 - protein, 9 aa, Mycobacterium
NGTSYAAGY

SEQ ID NO: 956163 - protein, 12 aa, Mycobacterium
NGVSQPSLATRE

SEQ ID NO: 956164 - protein, 6 aa, Mycobacterium
NHGAVL

SEQ ID NO: 956165 - protein, 6 aa, Mycobacterium
NHRERR

SEQ ID NO: 956166 - protein, 5 aa, Mycobacterium
NIGGA

SEQ ID NO: 956167 - protein, 7 aa, Mycobacterium
NKAQASV

SEQ ID NO: 956168 - protein, 6 aa, Mycobacterium
NKDHPN

SEQ ID NO: 956169 - protein, 14 aa, Mycobacterium
NKNGTADDRLPGQS

SEQ ID NO: 956170 - protein, 13 aa, Mycobacterium
NKTEETDEPRRGL

SEQ ID NO: 956171 - protein, 9 aa, Mycobacterium
NLDGGTGKL

SEQ ID NO: 956172 - protein, 7 aa, Mycobacterium
NLQAGEQ

SEQ ID NO: 956173 - protein, 9 aa, Mycobacterium
NLQALTGQT

SEQ ID NO: 956174 - protein, 7 aa, Mycobacterium
NMPATRR

SEQ ID NO: 956175 - protein, 4 aa, Mycobacterium
NNAI

SEQ ID NO: 956176 - protein, 4 aa, Mycobacterium
NNCE

SEQ ID NO: 956177 - protein, 11 aa, Mycobacterium
NNEADTADRTI

SEQ ID NO: 956178 - protein, 7 aa, Mycobacterium
NNNGAGA

SEQ ID NO: 956179 - protein, 7 aa, Mycobacterium
NNTAQAA

SEQ ID NO: 956180 - protein, 11 aa, Mycobacterium
NNTFTADPANL

SEQ ID NO: 956181 - protein, 11 aa, Mycobacterium
NNTGGNSGELV

SEQ ID NO: 956182 - protein, 30 aa, Mycobacterium
NPANSSPRAPVPNQPSSPLAPTSRPDAYAG

SEQ ID NO: 956183 - protein, 6 aa, Mycobacterium
NPDASA

SEQ ID NO: 956184 - protein, 5 aa, Mycobacterium
NPDRP

SEQ ID NO: 956185 - protein, 14 aa, Mycobacterium
NPERNADGTPGHSA

SEQ ID NO: 956186 - protein, 6 aa, Mycobacterium
NPFSSA

SEQ ID NO: 956187 - protein, 8 aa, Mycobacterium
NPGGSYTL

SEQ ID NO: 956188 - protein, 6 aa, Mycobacterium
NPITVK

SEQ ID NO: 956189 - protein, 8 aa, Mycobacterium
NPKSLRDD

SEQ ID NO: 956190 - protein, 7 aa, Mycobacterium
NPLQPNE

SEQ ID NO: 956191 - protein, 4 aa, Mycobacterium
NPNV

SEQ ID NO: 956192 - protein, 4 aa, Mycobacterium
NPPT

SEQ ID NO: 956193 - protein, 11 aa, Mycobacterium
NPQPDSKQVLP

SEQ ID NO: 956194 - protein, 8 aa, Mycobacterium
NPQVNEPL

SEQ ID NO: 956195 - protein, 9 aa, Mycobacterium
NPSFGPDRQ

SEQ ID NO: 956196 - protein, 7 aa, Mycobacterium
NPSRSLP

SEQ ID NO: 956197 - protein, 5 aa, Mycobacterium
NPTTN

SEQ ID NO: 956198 - protein, 5 aa, Mycobacterium
NQGPS

SEQ ID NO: 956199 - protein, 13 aa, Mycobacterium
NQPPTPPPDIPEE

SEQ ID NO: 956200 - protein, 4 aa, Mycobacterium
NQTT

SEQ ID NO: 956201 - protein, 5 aa, Mycobacterium
NQVAD

SEQ ID NO: 956202 - protein, 14 aa, Mycobacterium
NQVAGDAGAPGCSS

SEQ ID NO: 956203 - protein, 5 aa, Mycobacterium
NRAAL

SEQ ID NO: 956204 - protein, 5 aa, Mycobacterium
NRATN

SEQ ID NO: 956205 - protein, 19 aa, Mycobacterium
NRGFKTRTLQKPDSTIPPD

SEQ ID NO: 956206 - protein, 15 aa, Mycobacterium
NRGLMGNDTNHPATT

SEQ ID NO: 956207 - protein, 14 aa, Mycobacterium
NRGVGQSSVPKPVS

SEQ ID NO: 956208 - protein, 25 aa, Mycobacterium
NRIQPAGKPPPPRGRELGKARPIRA

SEQ ID NO: 956209 - protein, 8 aa, Mycobacterium
NRTASRNV

SEQ ID NO: 956210 - protein, 7 aa, Mycobacterium
NRTDDSV

SEQ ID NO: 956211 - protein, 7 aa, Mycobacterium
NRTDQPT

SEQ ID NO: 956212 - protein, 13 aa, Mycobacterium
NRTLEPEDQPYYD

SEQ ID NO: 956213 - protein, 10 aa, Mycobacterium
NRTTGGFGQP

SEQ ID NO: 956214 - protein, 9 aa, Mycobacterium
NSASEFGGD

SEQ ID NO: 956215 - protein, 12 aa, Mycobacterium
NSGEGLAKLPQD

SEQ ID NO: 956216 - protein, 5 aa, Mycobacterium
NSGFA

SEQ ID NO: 956217 - protein, 7 aa, Mycobacterium
NSGSPMS

SEQ ID NO: 956218 - protein, 17 aa, Mycobacterium
NSKQHESREALAGPPVS

SEQ ID NO: 956219 - protein, 14 aa, Mycobacterium
NSPGMGDDATNVSY

SEQ ID NO: 956220 - protein, 19 aa, Mycobacterium
NSPPSGPFGEEYAQPPGPT

SEQ ID NO: 956221 - protein, 8 aa, Mycobacterium
NSRGGCGS

SEQ ID NO: 956222 - protein, 11 aa, Mycobacterium
NSRKARRQRQA

SEQ ID NO: 956223 - protein, 4 aa, Mycobacterium
NSRS

SEQ ID NO: 956224 - protein, 4 aa, Mycobacterium
NSTT

SEQ ID NO: 956225 - protein, 8 aa, Mycobacterium
NSTTPPTD

SEQ ID NO: 956226 - protein, 5 aa, Mycobacterium
NTEAD

SEQ ID NO: 956227 - protein, 5 aa, Mycobacterium
NTERI

SEQ ID NO: 956228 - protein, 5 aa, Mycobacterium
NTESR

SEQ ID NO: 956229 - protein, 11 aa, Mycobacterium
NTEYPSPARAA

SEQ ID NO: 956230 - protein, 5 aa, Mycobacterium
NTGGV

SEQ ID NO: 956231 - protein, 8 aa, Mycobacterium
NTGIPTPG

SEQ ID NO: 956232 - protein, 7 aa, Mycobacterium
NTGNEED

SEQ ID NO: 956233 - protein, 14 aa, Mycobacterium
NTLTSKTDPTSGAG

SEQ ID NO: 956234 - protein, 6 aa, Mycobacterium
NTPPVP

SEQ ID NO: 956235 - protein, 6 aa, Mycobacterium
NTPYPQ

SEQ ID NO: 956236 - protein, 11 aa, Mycobacterium
NTRMSRENNQI

SEQ ID NO: 956237 - protein, 6 aa, Mycobacterium
NTSAAY

SEQ ID NO: 956238 - protein, 6 aa, Mycobacterium
NTSFTG

SEQ ID NO: 956239 - protein, 4 aa, Mycobacterium
NTSI

SEQ ID NO: 956240 - protein, 6 aa, Mycobacterium
NTTHDA

SEQ ID NO: 956241 - protein, 6 aa, Mycobacterium
NTTSTP

SEQ ID NO: 956242 - protein, 13 aa, Mycobacterium
NVKAGSPAQKGGI

SEQ ID NO: 956243 - protein, 8 aa, Mycobacterium
NVLPTGNA

SEQ ID NO: 956244 - protein, 16 aa, Mycobacterium
NVTDPDDLGCNPDQPL

SEQ ID NO: 956245 - protein, 20 aa, Mycobacterium
NYPYSERTSLSSATADSTEV

SEQ ID NO: 956246 - protein, 6 aa, Mycobacterium
PAAGTV

SEQ ID NO: 956247 - protein, 8 aa, Mycobacterium
PAAQSPLE

SEQ ID NO: 956248 - protein, 4 aa, Mycobacterium
PADA

SEQ ID NO: 956249 - protein, 5 aa, Mycobacterium
PADGA

SEQ ID NO: 956250 - protein, 4 aa, Mycobacterium
PAEQ

SEQ ID NO: 956251 - protein, 14 aa, Mycobacterium
PAGNAGSTGTVGGN

SEQ ID NO: 956252 - protein, 7 aa, Mycobacterium
PAGQLSR

SEQ ID NO: 956253 - protein, 5 aa, Mycobacterium
PAGSV

SEQ ID NO: 956254 - protein, 12 aa, Mycobacterium
PAGSYPGATPSF

SEQ ID NO: 956255 - protein, 5 aa, Mycobacterium
PAGYM

SEQ ID NO: 956256 - protein, 8 aa, Mycobacterium
PAKVREPE

SEQ ID NO: 956257 - protein, 4 aa, Mycobacterium
PALA

SEQ ID NO: 956258 - protein, 5 aa, Mycobacterium
PALGT

SEQ ID NO: 956259 - protein, 5 aa, Mycobacterium
PALVP

SEQ ID NO: 956260 - protein, 4 aa, Mycobacterium
PAPD

SEQ ID NO: 956261 - protein, 20 aa, Mycobacterium
PAPDPESESAPRRSVQGALE

SEQ ID NO: 956262 - protein, 12 aa, Mycobacterium
PAPGDPTPSAPS

SEQ ID NO: 956263 - protein, 11 aa, Mycobacterium
PAPRNTAQYRS

SEQ ID NO: 956264 - protein, 7 aa, Mycobacterium
PAPRPIG

SEQ ID NO: 956265 - protein, 5 aa, Mycobacterium
PAPVN

SEQ ID NO: 956266 - protein, 11 aa, Mycobacterium
PARDFATSGLE

SEQ ID NO: 956267 - protein, 17 aa, Mycobacterium
PARPKPEQQPPDDPALR

SEQ ID NO: 956268 - protein, 6 aa, Mycobacterium
PARTPV

SEQ ID NO: 956269 - protein, 10 aa, Mycobacterium
PASPWAAPPP

SEQ ID NO: 956270 - protein, 4 aa, Mycobacterium
PATG

SEQ ID NO: 956271 - protein, 10 aa, Mycobacterium
PATNDSPPVP

SEQ ID NO: 956272 - protein, 6 aa, Mycobacterium
PAYPAR

SEQ ID NO: 956273 - protein, 8 aa, Mycobacterium
PCDKQGGL

SEQ ID NO: 956274 - protein, 28 aa, Mycobacterium
PDDARDRSLARANSTMHPARAAASMRHV

SEQ ID NO: 956275 - protein, 17 aa, Mycobacterium
PDDPNTQASSPKHRQTI

SEQ ID NO: 956276 - protein, 8 aa, Mycobacterium
PDDRRRAA

SEQ ID NO: 956277 - protein, 4 aa, Mycobacterium
PDEA

SEQ ID NO: 956278 - protein, 6 aa, Mycobacterium
PDGGYT

SEQ ID NO: 956279 - protein, 4 aa, Mycobacterium
PDGH

SEQ ID NO: 956280 - protein, 11 aa, Mycobacterium
PDGKTVNDPAW

SEQ ID NO: 956281 - protein, 4 aa, Mycobacterium
PDGL

SEQ ID NO: 956282 - protein, 10 aa, Mycobacterium
PDGQTRTSTV

SEQ ID NO: 956283 - protein, 4 aa, Mycobacterium
PDGR

SEQ ID NO: 956284 - protein, 42 aa, Mycobacterium
PDGTSTLPAKKVPAKAAKAPAKKAPPKSPSFASPQAANQSLG

SEQ ID NO: 956285 - protein, 10 aa, Mycobacterium
PDISDSEIDD

SEQ ID NO: 956286 - protein, 6 aa, Mycobacterium
PDKINT

SEQ ID NO: 956287 - protein, 8 aa, Mycobacterium
PDKYTTYT

SEQ ID NO: 956288 - protein, 6 aa, Mycobacterium
PDLGQT

SEQ ID NO: 956289 - protein, 6 aa, Mycobacterium
PDLPNT

SEQ ID NO: 956290 - protein, 6 aa, Mycobacterium
PDPNRA

SEQ ID NO: 956291 - protein, 5 aa, Mycobacterium
PDRPT

SEQ ID NO: 956292 - protein, 8 aa, Mycobacterium
PDSNPLQA

SEQ ID NO: 956293 - protein, 10 aa, Mycobacterium
PDSSSNRNTI

SEQ ID NO: 956294 - protein, 4 aa, Mycobacterium
PDTP

SEQ ID NO: 956295 - protein, 7 aa, Mycobacterium
PDTTRAW

SEQ ID NO: 956296 - protein, 6 aa, Mycobacterium
PDVTDN

SEQ ID NO: 956297 - protein, 14 aa, Mycobacterium
PEADPQDTGYQARQ

SEQ ID NO: 956298 - protein, 7 aa, Mycobacterium
PEAPPLK

SEQ ID NO: 956299 - protein, 10 aa, Mycobacterium
PEAPRLPDQE

SEQ ID NO: 956300 - protein, 4 aa, Mycobacterium
PEAS

SEQ ID NO: 956301 - protein, 4 aa, Mycobacterium
PEAV

SEQ ID NO: 956302 - protein, 20 aa, Mycobacterium
PEDGNPAFSQVRSPVNLCGP

SEQ ID NO: 956303 - protein, 6 aa, Mycobacterium
PEELPD

SEQ ID NO: 956304 - protein, 6 aa, Mycobacterium
PEFASA

SEQ ID NO: 956305 - protein, 14 aa, Mycobacterium
PEGPAKPPPQLSSP

SEQ ID NO: 956306 - protein, 4 aa, Mycobacterium
PEHF

SEQ ID NO: 956307 - protein, 4 aa, Mycobacterium
PEKI

SEQ ID NO: 956308 - protein, 4 aa, Mycobacterium
PENT

SEQ ID NO: 956309 - protein, 10 aa, Mycobacterium
PEPDSPRRMP

SEQ ID NO: 956310 - protein, 4 aa, Mycobacterium
PEPL

SEQ ID NO: 956311 - protein, 5 aa, Mycobacterium
PEQRK

SEQ ID NO: 956312 - protein, 15 aa, Mycobacterium
PEQVRDGDASPRSDV

SEQ ID NO: 956313 - protein, 9 aa, Mycobacterium
PERRNGIPA

SEQ ID NO: 956314 - protein, 5 aa, Mycobacterium
PESLS

SEQ ID NO: 956315 - protein, 5 aa, Mycobacterium
PFPPV

SEQ ID NO: 956316 - protein, 6 aa, Mycobacterium
PFRGPI

SEQ ID NO: 956317 - protein, 11 aa, Mycobacterium
PGAAPPNRRRQ

SEQ ID NO: 956318 - protein, 15 aa, Mycobacterium
PGAPSELSPETPQTS

SEQ ID NO: 956319 - protein, 13 aa, Mycobacterium
PGGGNFTATSARI

SEQ ID NO: 956320 - protein, 10 aa, Mycobacterium
PGKEDDEPQQ

SEQ ID NO: 956321 - protein, 16 aa, Mycobacterium
PGKVSSPGPVGSPGRV

SEQ ID NO: 956322 - protein, 7 aa, Mycobacterium
PGLGGNR

SEQ ID NO: 956323 - protein, 7 aa, Mycobacterium
PGLPGQA

SEQ ID NO: 956324 - protein, 4 aa, Mycobacterium
PGLV

SEQ ID NO: 956325 - protein, 8 aa, Mycobacterium
PGMRYPSG

SEQ ID NO: 956326 - protein, 14 aa, Mycobacterium
PGNDGNEARNLGQT

SEQ ID NO: 956327 - protein, 5 aa, Mycobacterium
PGNEH

SEQ ID NO: 956328 - protein, 7 aa, Mycobacterium
PGPDGRL

SEQ ID NO: 956329 - protein, 11 aa, Mycobacterium
PGQGSYAAANS

SEQ ID NO: 956330 - protein, 6 aa, Mycobacterium
PGQVAA

SEQ ID NO: 956331 - protein, 13 aa, Mycobacterium
PGRDPYHPNRRQQ

SEQ ID NO: 956332 - protein, 7 aa, Mycobacterium
PGRGTVA

SEQ ID NO: 956333 - protein, 4 aa, Mycobacterium
PGRK

SEQ ID NO: 956334 - protein, 17 aa, Mycobacterium
PGSEYGPNAAPPSPARI

SEQ ID NO: 956335 - protein, 7 aa, Mycobacterium
PGSPGYP

SEQ ID NO: 956336 - protein, 6 aa, Mycobacterium
PGSRSM

SEQ ID NO: 956337 - protein, 11 aa, Mycobacterium
PGTGPADRHDK

SEQ ID NO: 956338 - protein, 5 aa, Mycobacterium
PGTST

SEQ ID NO: 956339 - protein, 4 aa, Mycobacterium
PGWP

SEQ ID NO: 956340 - protein, 7 aa, Mycobacterium
PGYPAQA

SEQ ID NO: 956341 - protein, 17 aa, Mycobacterium
PHIGGNAYSEAEPQTGI

SEQ ID NO: 956342 - protein, 5 aa, Mycobacterium
PHNPA

SEQ ID NO: 956343 - protein, 10 aa, Mycobacterium
PHPATTAETD

SEQ ID NO: 956344 - protein, 4 aa, Mycobacterium
PHPQ

SEQ ID NO: 956345 - protein, 21 aa, Mycobacterium
PHRETNNATGGTTESGISSGH

SEQ ID NO: 956346 - protein, 8 aa, Mycobacterium
PHSDHRTR

SEQ ID NO: 956347 - protein, 14 aa, Mycobacterium
PHTRRQSGRATSTC

SEQ ID NO: 956348 - protein, 6 aa, Mycobacterium
PIPASR

SEQ ID NO: 956349 - protein, 4 aa, Mycobacterium
PIPD

SEQ ID NO: 956350 - protein, 10 aa, Mycobacterium
PKAAVPQSIP

SEQ ID NO: 956351 - protein, 9 aa, Mycobacterium
PKAKSSAGV

SEQ ID NO: 956352 - protein, 6 aa, Mycobacterium
PKATGA

SEQ ID NO: 956353 - protein, 7 aa, Mycobacterium
PKPDDRH

SEQ ID NO: 956354 - protein, 21 aa, Mycobacterium
PKQRGGYARFGTDAAPMQQGY

SEQ ID NO: 956355 - protein, 6 aa, Mycobacterium
PKVPGA

SEQ ID NO: 956356 - protein, 14 aa, Mycobacterium
PLAGPEGLVPGTAT

SEQ ID NO: 956357 - protein, 7 aa, Mycobacterium
PLNSSGV

SEQ ID NO: 956358 - protein, 7 aa, Mycobacterium
PLPEQNG

SEQ ID NO: 956359 - protein, 6 aa, Mycobacterium
PLPGSA

SEQ ID NO: 956360 - protein, 16 aa, Mycobacterium
PLPNGVDSLGPPQVAA

SEQ ID NO: 956361 - protein, 4 aa, Mycobacterium
PLPQ

SEQ ID NO: 956362 - protein, 16 aa, Mycobacterium
PLPTWRPNGVRRLLPP

SEQ ID NO: 956363 - protein, 12 aa, Mycobacterium
PLSGEGSDTDTV

SEQ ID NO: 956364 - protein, 14 aa, Mycobacterium
PLSPDPGPPLTLQA

SEQ ID NO: 956365 - protein, 7 aa, Mycobacterium
PLTPPQA

SEQ ID NO: 956366 - protein, 6 aa, Mycobacterium
PLTPPR

SEQ ID NO: 956367 - protein, 8 aa, Mycobacterium
PMPHSTRQ

SEQ ID NO: 956368 - protein, 56 aa, Mycobacterium
PMPPDHPGAQPRPYLQDPTSSPSSDPMPSPVPTGAALPGEVPSVEQPAPPDPRKDL

SEQ ID NO: 956369 - protein, 10 aa, Mycobacterium
PNAGATPSFG

SEQ ID NO: 956370 - protein, 12 aa, Mycobacterium
PNALPAASEQDT

SEQ ID NO: 956371 - protein, 5 aa, Mycobacterium
PNDTT

SEQ ID NO: 956372 - protein, 4 aa, Mycobacterium
PNGA

SEQ ID NO: 956373 - protein, 9 aa, Mycobacterium
PNGAAGNNA

SEQ ID NO: 956374 - protein, 4 aa, Mycobacterium
PNHP

SEQ ID NO: 956375 - protein, 7 aa, Mycobacterium
PNKGRKE

SEQ ID NO: 956376 - protein, 20 aa, Mycobacterium
PNKVPIAGTYTTGAQQQSRL

SEQ ID NO: 956377 - protein, 6 aa, Mycobacterium
PNLDTR

SEQ ID NO: 956378 - protein, 6 aa, Mycobacterium
PNLSPD

SEQ ID NO: 956379 - protein, 7 aa, Mycobacterium
PNPVANN

SEQ ID NO: 956380 - protein, 15 aa, Mycobacterium
PNSEVANKPGSVSWS

SEQ ID NO: 956381 - protein, 24 aa, Mycobacterium
PNSQSNVPVNPIPPGNQQHRKQQP

SEQ ID NO: 956382 - protein, 11 aa, Mycobacterium
PNTAASRASAI

SEQ ID NO: 956383 - protein, 4 aa, Mycobacterium
PNTL

SEQ ID NO: 956384 - protein, 7 aa, Mycobacterium
PPAARTD

SEQ ID NO: 956385 - protein, 6 aa, Mycobacterium
PPDEND

SEQ ID NO: 956386 - protein, 65 aa, Mycobacterium
PPEQQPSQSPYWPQPAPSYPGQAPPPYPSYPPCPSYPPPGQSAPDAGKPPAQLDEGVSPSNPPAH

SEQ ID NO: 956387 - protein, 5 aa, Mycobacterium
PPEVS

SEQ ID NO: 956388 - protein, 4 aa, Mycobacterium
PPGG

SEQ ID NO: 956389 - protein, 6 aa, Mycobacterium
PPGTDV

SEQ ID NO: 956390 - protein, 10 aa, Mycobacterium
PPHTPHPAEP

SEQ ID NO: 956391 - protein, 7 aa, Mycobacterium
PPLAGSG

SEQ ID NO: 956392 - protein, 7 aa, Mycobacterium
PPNGTHS

SEQ ID NO: 956393 - protein, 9 aa, Mycobacterium
PPPHGQVPR

SEQ ID NO: 956394 - protein, 14 aa, Mycobacterium
PPPPPQPGIDCRAV

SEQ ID NO: 956395 - protein, 12 aa, Mycobacterium
PPPVITPGPDRN

SEQ ID NO: 956396 - protein, 4 aa, Mycobacterium
PPRG

SEQ ID NO: 956397 - protein, 5 aa, Mycobacterium
PPRIP

SEQ ID NO: 956398 - protein, 6 aa, Mycobacterium
PPRRRR

SEQ ID NO: 956399 - protein, 5 aa, Mycobacterium
PPSFS

SEQ ID NO: 956400 - protein, 5 aa, Mycobacterium
PPTPW

SEQ ID NO: 956401 - protein, 7 aa, Mycobacterium
PPVGGSD

SEQ ID NO: 956402 - protein, 12 aa, Mycobacterium
PQDNDSEVATEK

SEQ ID NO: 956403 - protein, 9 aa, Mycobacterium
PQGKLGAST

SEQ ID NO: 956404 - protein, 10 aa, Mycobacterium
PQHDSQGDEM

SEQ ID NO: 956405 - protein, 14 aa, Mycobacterium
PQHQYDDWVDEENR

SEQ ID NO: 956406 - protein, 9 aa, Mycobacterium
PQISQSATK

SEQ ID NO: 956407 - protein, 4 aa, Mycobacterium
PQMR

SEQ ID NO: 956408 - protein, 5 aa, Mycobacterium
PQPPN

SEQ ID NO: 956409 - protein, 7 aa, Mycobacterium
PQQTGPG

SEQ ID NO: 956410 - protein, 13 aa, Mycobacterium
PQSARADISPDGQ

SEQ ID NO: 956411 - protein, 39 aa, Mycobacterium
PQSPASTAPAASVSPAKHLPKARHTRQMSKRRGRPISPH

SEQ ID NO: 956412 - protein, 8 aa, Mycobacterium
PQTKSSDN

SEQ ID NO: 956413 - protein, 8 aa, Mycobacterium
PRAEPGLG

SEQ ID NO: 956414 - protein, 5 aa, Mycobacterium
PRDVE

SEQ ID NO: 956415 - protein, 5 aa, Mycobacterium
PRDVP

SEQ ID NO: 956416 - protein, 5 aa, Mycobacterium
PRITD

SEQ ID NO: 956417 - protein, 10 aa, Mycobacterium
PRKPNGKIDR

SEQ ID NO: 956418 - protein, 6 aa, Mycobacterium
PRPAPL

SEQ ID NO: 956419 - protein, 10 aa, Mycobacterium
PRPGDIRTNQ

SEQ ID NO: 956420 - protein, 9 aa, Mycobacterium
PRQSQSSGV

SEQ ID NO: 956421 - protein, 6 aa, Mycobacterium
PRRDRA

SEQ ID NO: 956422 - protein, 5 aa, Mycobacterium
PRRRS

SEQ ID NO: 956423 - protein, 6 aa, Mycobacterium
PRSASV

SEQ ID NO: 956424 - protein, 4 aa, Mycobacterium
PRTD

SEQ ID NO: 956425 - protein, 15 aa, Mycobacterium
PRTGKSRSGQVTTSL

SEQ ID NO: 956426 - protein, 10 aa, Mycobacterium
PRVRSGSGAR

SEQ ID NO: 956427 - protein, 6 aa, Mycobacterium
PSAGVA

SEQ ID NO: 956428 - protein, 10 aa, Mycobacterium
PSAPDGSVAL

SEQ ID NO: 956429 - protein, 4 aa, Mycobacterium
PSAR

SEQ ID NO: 956430 - protein, 16 aa, Mycobacterium
PSATVTEEVTTGRAAA

SEQ ID NO: 956431 - protein, 22 aa, Mycobacterium
PSDSAAMGGDVNGDRVEAVAED

SEQ ID NO: 956432 - protein, 5 aa, Mycobacterium
PSGFG

SEQ ID NO: 956433 - protein, 7 aa, Mycobacterium
PSGQLNE

SEQ ID NO: 956434 - protein, 9 aa, Mycobacterium
PSGRIQRDA

SEQ ID NO: 956435 - protein, 5 aa, Mycobacterium
PSGWD

SEQ ID NO: 956436 - protein, 4 aa, Mycobacterium
PSIA

SEQ ID NO: 956437 - protein, 5 aa, Mycobacterium
PSIKS

SEQ ID NO: 956438 - protein, 5 aa, Mycobacterium
PSLQG

SEQ ID NO: 956439 - protein, 4 aa, Mycobacterium
PSLR

SEQ ID NO: 956440 - protein, 7 aa, Mycobacterium
PSMKPGV

SEQ ID NO: 956441 - protein, 11 aa, Mycobacterium
PSNYGPLGPLG

SEQ ID NO: 956442 - protein, 6 aa, Mycobacterium
PSPSMG

SEQ ID NO: 956443 - protein, 7 aa, Mycobacterium
PSQSSSR

SEQ ID NO: 956444 - protein, 7 aa, Mycobacterium
PSRPLSP

SEQ ID NO: 956445 - protein, 5 aa, Mycobacterium
PSRSY

SEQ ID NO: 956446 - protein, 6 aa, Mycobacterium
PSSGSF

SEQ ID NO: 956447 - protein, 11 aa, Mycobacterium
PSSHPTGTVDV

SEQ ID NO: 956448 - protein, 5 aa, Mycobacterium
PSTPW

SEQ ID NO: 956449 - protein, 4 aa, Mycobacterium
PSVA

SEQ ID NO: 956450 - protein, 22 aa, Mycobacterium
PSYPQYPGAGGYLDPAAPWGRY

SEQ ID NO: 956451 - protein, 9 aa, Mycobacterium
PTARRRTQG

SEQ ID NO: 956452 - protein, 4 aa, Mycobacterium
PTDG

SEQ ID NO: 956453 - protein, 5 aa, Mycobacterium
PTDGF

SEQ ID NO: 956454 - protein, 9 aa, Mycobacterium
PTDIPPEGL

SEQ ID NO: 956455 - protein, 22 aa, Mycobacterium
PTFTSSSDIGPGSGGFAGDAGT

SEQ ID NO: 956456 - protein, 49 aa, Mycobacterium
PTGKRSRQRAANASNTGANVEVEESSTQAAIAKEGKVKKPKKSADRSAN

SEQ ID NO: 956457 - protein, 18 aa, Mycobacterium
PTGWRSNSGSRGSIEDGR

SEQ ID NO: 956458 - protein, 4 aa, Mycobacterium
PTHA

SEQ ID NO: 956459 - protein, 12 aa, Mycobacterium
PTLPTSLNGSGI

SEQ ID NO: 956460 - protein, 5 aa, Mycobacterium
PTLSR

SEQ ID NO: 956461 - protein, 4 aa, Mycobacterium
PTPG

SEQ ID NO: 956462 - protein, 4 aa, Mycobacterium
PTPT

SEQ ID NO: 956463 - protein, 21 aa, Mycobacterium
PTPVGPTPSSPTVSKYPVPPR

SEQ ID NO: 956464 - protein, 4 aa, Mycobacterium
PTQR

SEQ ID NO: 956465 - protein, 13 aa, Mycobacterium
PTSMSSRRNPIKE

SEQ ID NO: 956466 - protein, 5 aa, Mycobacterium
PTTAR

SEQ ID NO: 956467 - protein, 11 aa, Mycobacterium
PTTNRYATKNA

SEQ ID NO: 956468 - protein, 8 aa, Mycobacterium
PTTTPVGG

SEQ ID NO: 956469 - protein, 7 aa, Mycobacterium
PTVGTGS

SEQ ID NO: 956470 - protein, 10 aa, Mycobacterium
PVADALGSSL

SEQ ID NO: 956471 - protein, 24 aa, Mycobacterium
PVAPDSIAQKQSDAEGMSPDPVEP

SEQ ID NO: 956472 - protein, 10 aa, Mycobacterium
PVGHPPSHTV

SEQ ID NO: 956473 - protein, 13 aa, Mycobacterium
PVGIDSGAAAALG

SEQ ID NO: 956474 - protein, 9 aa, Mycobacterium
PVGPAAPGI

SEQ ID NO: 956475 - protein, 6 aa, Mycobacterium
PVGYSD

SEQ ID NO: 956476 - protein, 6 aa, Mycobacterium
PVPSLS

SEQ ID NO: 956477 - protein, 7 aa, Mycobacterium
PVRGEDD

SEQ ID NO: 956478 - protein, 15 aa, Mycobacterium
PVRTRKSAQRRDAGV

SEQ ID NO: 956479 - protein, 4 aa, Mycobacterium
PVSE

SEQ ID NO: 956480 - protein, 17 aa, Mycobacterium
PVTAAAAAAPPGPLGSP

SEQ ID NO: 956481 - protein, 10 aa, Mycobacterium
PVTNRKATEL

SEQ ID NO: 956482 - protein, 4 aa, Mycobacterium
PVTV

SEQ ID NO: 956483 - protein, 17 aa, Mycobacterium
PVVDPGVPPPNGAPGPV

SEQ ID NO: 956484 - protein, 4 aa, Mycobacterium
PWPP

SEQ ID NO: 956485 - protein, 6 aa, Mycobacterium
PWRPGP

SEQ ID NO: 956486 - protein, 13 aa, Mycobacterium
PYKPSQVSAGSQP

SEQ ID NO: 956487 - protein, 23 aa, Mycobacterium
PYSRGGEKPDGQLYPEDQPDRVN

SEQ ID NO: 956488 - protein, 7 aa, Mycobacterium
QAAATGA

SEQ ID NO: 956489 - protein, 10 aa, Mycobacterium
QAAEEGKSSN

SEQ ID NO: 956490 - protein, 4 aa, Mycobacterium
QAAY

SEQ ID NO: 956491 - protein, 23 aa, Mycobacterium
QADEMTWSGGRSAAISGCGANLA

SEQ ID NO: 956492 - protein, 7 aa, Mycobacterium
QADVEAE

SEQ ID NO: 956493 - protein, 12 aa, Mycobacterium
QAEDIDTRYHPS

SEQ ID NO: 956494 - protein, 4 aa, Mycobacterium
QAEG

SEQ ID NO: 956495 - protein, 7 aa, Mycobacterium
QAEMPTA

SEQ ID NO: 956496 - protein, 12 aa, Mycobacterium
QAERSNDPERRE

SEQ ID NO: 956497 - protein, 6 aa, Mycobacterium
QAKQNS

SEQ ID NO: 956498 - protein, 5 aa, Mycobacterium
QALGA

SEQ ID NO: 956499 - protein, 8 aa, Mycobacterium
QANQTTAY

SEQ ID NO: 956500 - protein, 12 aa, Mycobacterium
QAQQQNANAQRL

SEQ ID NO: 956501 - protein, 7 aa, Mycobacterium
QARATRR

SEQ ID NO: 956502 - protein, 12 aa, Mycobacterium
QARSSRIPLQET

SEQ ID NO: 956503 - protein, 16 aa, Mycobacterium
QASEIDTADAKTLEEK

SEQ ID NO: 956504 - protein, 13 aa, Mycobacterium
QASVDSPRPTGEV

SEQ ID NO: 956505 - protein, 6 aa, Mycobacterium
QCKSDG

SEQ ID NO: 956506 - protein, 9 aa, Mycobacterium
QDASQPSMA

SEQ ID NO: 956507 - protein, 8 aa, Mycobacterium
QDATIDED

SEQ ID NO: 956508 - protein, 12 aa, Mycobacterium
QDDKGTYEVGRP

SEQ ID NO: 956509 - protein, 5 aa, Mycobacterium
QDEYD

SEQ ID NO: 956510 - protein, 14 aa, Mycobacterium
QDLDGQNCAARPLA

SEQ ID NO: 956511 - protein, 13 aa, Mycobacterium
QDLSTSKSQWRQV

SEQ ID NO: 956512 - protein, 5 aa, Mycobacterium
QDPNA

SEQ ID NO: 956513 - protein, 7 aa, Mycobacterium
QDQDAKR

SEQ ID NO: 956514 - protein, 9 aa, Mycobacterium
QDVPGCGAQ

SEQ ID NO: 956515 - protein, 12 aa, Mycobacterium
QEARQANENKEA

SEQ ID NO: 956516 - protein, 8 aa, Mycobacterium
QEKKRTAR

SEQ ID NO: 956517 - protein, 5 aa, Mycobacterium
QEPLP

SEQ ID NO: 956518 - protein, 9 aa, Mycobacterium
QEQYPDQGA

SEQ ID NO: 956519 - protein, 13 aa, Mycobacterium
QERHDGASPEIDR

SEQ ID NO: 956520 - protein, 6 aa, Mycobacterium
QFGSTS

SEQ ID NO: 956521 - protein, 10 aa, Mycobacterium
QFPGPGRTEY

SEQ ID NO: 956522 - protein, 10 aa, Mycobacterium
QFSGPSARLS

SEQ ID NO: 956523 - protein, 7 aa, Mycobacterium
QFTTGTP

SEQ ID NO: 956524 - protein, 11 aa, Mycobacterium
QGELSTSDDHV

SEQ ID NO: 956525 - protein, 6 aa, Mycobacterium
QGERNY

SEQ ID NO: 956526 - protein, 5 aa, Mycobacterium
QGGGQ

SEQ ID NO: 956527 - protein, 6 aa, Mycobacterium
QGGTRV

SEQ ID NO: 956528 - protein, 12 aa, Mycobacterium
QGPSATPVQGRE

SEQ ID NO: 956529 - protein, 7 aa, Mycobacterium
QGQGGTI

SEQ ID NO: 956530 - protein, 6 aa, Mycobacterium
QGSVPL

SEQ ID NO: 956531 - protein, 9 aa, Mycobacterium
QGVPDHGPS

SEQ ID NO: 956532 - protein, 20 aa, Mycobacterium
QGVTDQKELETQGREAGRAA

SEQ ID NO: 956533 - protein, 6 aa, Mycobacterium
QHAEAN

SEQ ID NO: 956534 - protein, 21 aa, Mycobacterium
QHAKQDGAAPLTGSGDTVRVT

SEQ ID NO: 956535 - protein, 4 aa, Mycobacterium
QHGI

SEQ ID NO: 956536 - protein, 5 aa, Mycobacterium
QHQET

SEQ ID NO: 956537 - protein, 8 aa, Mycobacterium
QIPGVARG

SEQ ID NO: 956538 - protein, 7 aa, Mycobacterium
QITETAR

SEQ ID NO: 956539 - protein, 23 aa, Mycobacterium
QKGQKGLFEEDESHADPPSARSA

SEQ ID NO: 956540 - protein, 10 aa, Mycobacterium
QKTKTREEVE

SEQ ID NO: 956541 - protein, 5 aa, Mycobacterium
QLGSA

SEQ ID NO: 956542 - protein, 15 aa, Mycobacterium
QLHGGTASLETSPLG

SEQ ID NO: 956543 - protein, 9 aa, Mycobacterium
QLPPSFDSP

SEQ ID NO: 956544 - protein, 10 aa, Mycobacterium
QLPPSPTPGG

SEQ ID NO: 956545 - protein, 5 aa, Mycobacterium
QLRNS

SEQ ID NO: 956546 - protein, 12 aa, Mycobacterium
QLSGGNSYNAAT

SEQ ID NO: 956547 - protein, 19 aa, Mycobacterium
QLSSASARSAVPSDHPDQI

SEQ ID NO: 956548 - protein, 38 aa, Mycobacterium
QLSTQDGTELPSARTISADTGKWGPSRREVRAPGSATS

SEQ ID NO: 956549 - protein, 7 aa, Mycobacterium
QMDGAGA

SEQ ID NO: 956550 - protein, 7 aa, Mycobacterium
QMSRGEL

SEQ ID NO: 956551 - protein, 6 aa, Mycobacterium
QNAERY

SEQ ID NO: 956552 - protein, 7 aa, Mycobacterium
QNGAGLG

SEQ ID NO: 956553 - protein, 7 aa, Mycobacterium
QNTAQLN

SEQ ID NO: 956554 - protein, 14 aa, Mycobacterium
QNTPGQPPSQAAPA

SEQ ID NO: 956555 - protein, 12 aa, Mycobacterium
QNYAGSGEGAAG

SEQ ID NO: 956556 - protein, 5 aa, Mycobacterium
QPALG

SEQ ID NO: 956557 - protein, 12 aa, Mycobacterium
QPDRGEHRSRSG

SEQ ID NO: 956558 - protein, 6 aa, Mycobacterium
QPKKAA

SEQ ID NO: 956559 - protein, 5 aa, Mycobacterium
QPPNT

SEQ ID NO: 956560 - protein, 28 aa, Mycobacterium
QPPPPPGSSGPALAPSPEAPPANVPVSG

SEQ ID NO: 956561 - protein, 32 aa, Mycobacterium
QPPTPDTTQTPNTTTGSDPAVGSDSAVGSDPA

SEQ ID NO: 956562 - protein, 8 aa, Mycobacterium
QPSAMSTG

SEQ ID NO: 956563 - protein, 27 aa, Mycobacterium
QPSPQASTAGQQHGTQRQRLREHAERS

SEQ ID NO: 956564 - protein, 10 aa, Mycobacterium
QPSQGNGQHY

SEQ ID NO: 956565 - protein, 6 aa, Mycobacterium
QPTYRD

SEQ ID NO: 956566 - protein, 9 aa, Mycobacterium
QPYEQPGTK

SEQ ID NO: 956567 - protein, 4 aa, Mycobacterium
QQDV

SEQ ID NO: 956568 - protein, 10 aa, Mycobacterium
QQEASPQDFP

SEQ ID NO: 956569 - protein, 6 aa, Mycobacterium
QQGWDT

SEQ ID NO: 956570 - protein, 5 aa, Mycobacterium
QQTTS

SEQ ID NO: 956571 - protein, 15 aa, Mycobacterium
QRADNALTGEDESAI

SEQ ID NO: 956572 - protein, 8 aa, Mycobacterium
QRDADDTV

SEQ ID NO: 956573 - protein, 15 aa, Mycobacterium
QRLGPNDYRPKLFVT

SEQ ID NO: 956574 - protein, 5 aa, Mycobacterium
QRLTA

SEQ ID NO: 956575 - protein, 12 aa, Mycobacterium
QRMSPIDQGDEY

SEQ ID NO: 956576 - protein, 4 aa, Mycobacterium
QRNR

SEQ ID NO: 956577 - protein, 13 aa, Mycobacterium
QRPDAYTAAEKLT

SEQ ID NO: 956578 - protein, 6 aa, Mycobacterium
QRRADQ

SEQ ID NO: 956579 - protein, 4 aa, Mycobacterium
QRRI

SEQ ID NO: 956580 - protein, 12 aa, Mycobacterium
QRRPTAQPTRAK

SEQ ID NO: 956581 - protein, 5 aa, Mycobacterium
QRRSA

SEQ ID NO: 956582 - protein, 4 aa, Mycobacterium
QRSG

SEQ ID NO: 956583 - protein, 6 aa, Mycobacterium
QRTPPG

SEQ ID NO: 956584 - protein, 6 aa, Mycobacterium
QRVDVT

SEQ ID NO: 956585 - protein, 9 aa, Mycobacterium
QRWSQRQTG

SEQ ID NO: 956586 - protein, 12 aa, Mycobacterium
QRYHSGKAEVKG

SEQ ID NO: 956587 - protein, 21 aa, Mycobacterium
QSAATLPRSAATWRPSTIGWP

SEQ ID NO: 956588 - protein, 8 aa, Mycobacterium
QSAITGEN

SEQ ID NO: 956589 - protein, 9 aa, Mycobacterium
QSDADQSRV

SEQ ID NO: 956590 - protein, 12 aa, Mycobacterium
QSLASDKYRRQL

SEQ ID NO: 956591 - protein, 9 aa, Mycobacterium
QSLDDAGVV

SEQ ID NO: 956592 - protein, 7 aa, Mycobacterium
QSLPQAI

SEQ ID NO: 956593 - protein, 10 aa, Mycobacterium
QSLTEQDVYD

SEQ ID NO: 956594 - protein, 8 aa, Mycobacterium
QSNADEDR

SEQ ID NO: 956595 - protein, 4 aa, Mycobacterium
QSND

SEQ ID NO: 956596 - protein, 12 aa, Mycobacterium
QSNGAPSGRHVD

SEQ ID NO: 956597 - protein, 7 aa, Mycobacterium
QSNGTYE

SEQ ID NO: 956598 - protein, 9 aa, Mycobacterium
QSPDPRYSE

SEQ ID NO: 956599 - protein, 16 aa, Mycobacterium
QSPGQISPDTKLDLTT

SEQ ID NO: 956600 - protein, 4 aa, Mycobacterium
QSRI

SEQ ID NO: 956601 - protein, 4 aa, Mycobacterium
QSSE

SEQ ID NO: 956602 - protein, 8 aa, Mycobacterium
QSSEAGGP

SEQ ID NO: 956603 - protein, 6 aa, Mycobacterium
QSSSAT

SEQ ID NO: 956604 - protein, 6 aa, Mycobacterium
QSTEHR

SEQ ID NO: 956605 - protein, 6 aa, Mycobacterium
QSTTAQ

SEQ ID NO: 956606 - protein, 8 aa, Mycobacterium
QSVAQPGE

SEQ ID NO: 956607 - protein, 4 aa, Mycobacterium
QTGR

SEQ ID NO: 956608 - protein, 5 aa, Mycobacterium
QTGRQ

SEQ ID NO: 956609 - protein, 10 aa, Mycobacterium
QTKRTRQEGY

SEQ ID NO: 956610 - protein, 6 aa, Mycobacterium
QTNTAK

SEQ ID NO: 956611 - protein, 7 aa, Mycobacterium
QTPEGIQ

SEQ ID NO: 956612 - protein, 6 aa, Mycobacterium
QTPKAL

SEQ ID NO: 956613 - protein, 5 aa, Mycobacterium
QTPTR

SEQ ID NO: 956614 - protein, 6 aa, Mycobacterium
QTSELG

SEQ ID NO: 956615 - protein, 16 aa, Mycobacterium
QTTGTGPGGQRVPNWD

SEQ ID NO: 956616 - protein, 12 aa, Mycobacterium
QVGPVTRTNGHW

SEQ ID NO: 956617 - protein, 16 aa, Mycobacterium
QVNATTADALRATQSH

SEQ ID NO: 956618 - protein, 4 aa, Mycobacterium
QVQK

SEQ ID NO: 956619 - protein, 44 aa, Mycobacterium
QWQSPGEGVENHSSDQPTQAASPWQQQPSTQDSTWHPPAYASPE

SEQ ID NO: 956620 - protein, 14 aa, Mycobacterium
QYPSATPGYGQPGY

SEQ ID NO: 956621 - protein, 17 aa, Mycobacterium
QYRKSSADLARRNVTAQ

SEQ ID NO: 956622 - protein, 21 aa, Mycobacterium
RAAGTDLSSSSPRTGGRLHPT

SEQ ID NO: 956623 - protein, 5 aa, Mycobacterium
RAART

SEQ ID NO: 956624 - protein, 6 aa, Mycobacterium
RADSLG

SEQ ID NO: 956625 - protein, 7 aa, Mycobacterium
RADTHDV

SEQ ID NO: 956626 - protein, 16 aa, Mycobacterium
RAEASGLRGDDGLIER

SEQ ID NO: 956627 - protein, 9 aa, Mycobacterium
RAESMSTQE

SEQ ID NO: 956628 - protein, 7 aa, Mycobacterium
RAGLDTA

SEQ ID NO: 956629 - protein, 8 aa, Mycobacterium
RAGRDDKV

SEQ ID NO: 956630 - protein, 18 aa, Mycobacterium
RAGRRVERRTRHHSFHSQ

SEQ ID NO: 956631 - protein, 10 aa, Mycobacterium
RANNEDSVYA

SEQ ID NO: 956632 - protein, 5 aa, Mycobacterium
RANPA

SEQ ID NO: 956633 - protein, 7 aa, Mycobacterium
RAPAGDL

SEQ ID NO: 956634 - protein, 13 aa, Mycobacterium
RAQAGGKWPPSTE

SEQ ID NO: 956635 - protein, 27 aa, Mycobacterium
RAQREPLARGEGRVRVNRGRSRRWRKQ

SEQ ID NO: 956636 - protein, 7 aa, Mycobacterium
RARGQDM

SEQ ID NO: 956637 - protein, 6 aa, Mycobacterium
RARTTV

SEQ ID NO: 956638 - protein, 13 aa, Mycobacterium
RARYTDPDTRSFT

SEQ ID NO: 956639 - protein, 18 aa, Mycobacterium
RATATSCGKNCAGCILSC

SEQ ID NO: 956640 - protein, 7 aa, Mycobacterium
RATVPAK

SEQ ID NO: 956641 - protein, 11 aa, Mycobacterium
RAVRDTRQGVG

SEQ ID NO: 956642 - protein, 7 aa, Mycobacterium
RDAAPRS

SEQ ID NO: 956643 - protein, 4 aa, Mycobacterium
RDDN

SEQ ID NO: 956644 - protein, 5 aa, Mycobacterium
RDGAS

SEQ ID NO: 956645 - protein, 9 aa, Mycobacterium
RDGQSKPVD

SEQ ID NO: 956646 - protein, 17 aa, Mycobacterium
RDGRADAIANPDPDRRR

SEQ ID NO: 956647 - protein, 6 aa, Mycobacterium
RDLRDP

SEQ ID NO: 956648 - protein, 6 aa, Mycobacterium
RDPQFG

SEQ ID NO: 956649 - protein, 5 aa, Mycobacterium
RDQPR

SEQ ID NO: 956650 - protein, 10 aa, Mycobacterium
RDRGGRERHN

SEQ ID NO: 956651 - protein, 7 aa, Mycobacterium
RDSEPVM

SEQ ID NO: 956652 - protein, 5 aa, Mycobacterium
RDSLA

SEQ ID NO: 956653 - protein, 4 aa, Mycobacterium
RDTE

SEQ ID NO: 956654 - protein, 10 aa, Mycobacterium
RDTPTSRGTI

SEQ ID NO: 956655 - protein, 4 aa, Mycobacterium
REAI

SEQ ID NO: 956656 - protein, 6 aa, Mycobacterium
RECGRT

SEQ ID NO: 956657 - protein, 21 aa, Mycobacterium
REEANRRSVPERTRRRSVSVE

SEQ ID NO: 956658 - protein, 6 aa, Mycobacterium
RELSDH

SEQ ID NO: 956659 - protein, 5 aa, Mycobacterium
RENPS

SEQ ID NO: 956660 - protein, 14 aa, Mycobacterium
REPQLASPKRPQAP

SEQ ID NO: 956661 - protein, 14 aa, Mycobacterium
REPTSGTVDRPGAV

SEQ ID NO: 956662 - protein, 4 aa, Mycobacterium
REQT

SEQ ID NO: 956663 - protein, 13 aa, Mycobacterium
RERGGEQSSPTGD

SEQ ID NO: 956664 - protein, 5 aa, Mycobacterium
RFGDP

SEQ ID NO: 956665 - protein, 9 aa, Mycobacterium
RGAAPGERY

SEQ ID NO: 956666 - protein, 7 aa, Mycobacterium
RGAASTE

SEQ ID NO: 956667 - protein, 16 aa, Mycobacterium
RGAQFDQHPASLARCL

SEQ ID NO: 956668 - protein, 4 aa, Mycobacterium
RGEF

SEQ ID NO: 956669 - protein, 13 aa, Mycobacterium
RGEPWPQPVPEPA

SEQ ID NO: 956670 - protein, 7 aa, Mycobacterium
RGGGLRV

SEQ ID NO: 956671 - protein, 12 aa, Mycobacterium
RGGPATGHRSDH

SEQ ID NO: 956672 - protein, 5 aa, Mycobacterium
RGIGN

SEQ ID NO: 956673 - protein, 15 aa, Mycobacterium
RGKHTDTGDLEEPGI

SEQ ID NO: 956674 - protein, 10 aa, Mycobacterium
RGKSADTGLD

SEQ ID NO: 956675 - protein, 5 aa, Mycobacterium
RGKWD

SEQ ID NO: 956676 - protein, 5 aa, Mycobacterium
RGLAN

SEQ ID NO: 956677 - protein, 5 aa, Mycobacterium
RGMKT

SEQ ID NO: 956678 - protein, 13 aa, Mycobacterium
RGPHAPDSLPGGP

SEQ ID NO: 956679 - protein, 6 aa, Mycobacterium
RGPMPP

SEQ ID NO: 956680 - protein, 8 aa, Mycobacterium
RGPRLTPG

SEQ ID NO: 956681 - protein, 8 aa, Mycobacterium
RGQGGRAI

SEQ ID NO: 956682 - protein, 8 aa, Mycobacterium
RGRAEDSP

SEQ ID NO: 956683 - protein, 10 aa, Mycobacterium
RGRKTHRTRA

SEQ ID NO: 956684 - protein, 7 aa, Mycobacterium
RGRTGGH

SEQ ID NO: 956685 - protein, 5 aa, Mycobacterium
RGRTV

SEQ ID NO: 956686 - protein, 6 aa, Mycobacterium
RGSANP

SEQ ID NO: 956687 - protein, 8 aa, Mycobacterium
RGSDTIAS

SEQ ID NO: 956688 - protein, 5 aa, Mycobacterium
RGTDV

SEQ ID NO: 956689 - protein, 6 aa, Mycobacterium
RHPDKT

SEQ ID NO: 956690 - protein, 37 aa, Mycobacterium
RHPLPTPSPASGQTRAMPVPANRSSDNASETAEPTTA

SEQ ID NO: 956691 - protein, 12 aa, Mycobacterium
RHPPTELPGWAR

SEQ ID NO: 956692 - protein, 10 aa, Mycobacterium
RHRTTPAGLP

SEQ ID NO: 956693 - protein, 44 aa, Mycobacterium
RHSTSHRGLPPNSPTCTPGPKCPSPVRAKSGWTRSRGCSPTRSA

SEQ ID NO: 956694 - protein, 10 aa, Mycobacterium
RIASSDSYSL

SEQ ID NO: 956695 - protein, 17 aa, Mycobacterium
RIDTPTAKQERVRDRRG

SEQ ID NO: 956696 - protein, 23 aa, Mycobacterium
RIPSGAPVQLSDDRGPTTPDSAV

SEQ ID NO: 956697 - protein, 10 aa, Mycobacterium
RKATESPPYL

SEQ ID NO: 956698 - protein, 13 aa, Mycobacterium
RKEGQAGQAKMTQ

SEQ ID NO: 956699 - protein, 5 aa, Mycobacterium
RKEGW

SEQ ID NO: 956700 - protein, 7 aa, Mycobacterium
RKELESG

SEQ ID NO: 956701 - protein, 7 aa, Mycobacterium
RKPDGKD

SEQ ID NO: 956702 - protein, 14 aa, Mycobacterium
RKQIPASDESSVGY

SEQ ID NO: 956703 - protein, 9 aa, Mycobacterium
RKQTPVSKS

SEQ ID NO: 956704 - protein, 6 aa, Mycobacterium
RKVADA

SEQ ID NO: 956705 - protein, 9 aa, Mycobacterium
RKYGKDRQR

SEQ ID NO: 956706 - protein, 7 aa, Mycobacterium
RLASAGP

SEQ ID NO: 956707 - protein, 10 aa, Mycobacterium
RLDNRTRVVP

SEQ ID NO: 956708 - protein, 5 aa, Mycobacterium
RLGGS

SEQ ID NO: 956709 - protein, 4 aa, Mycobacterium
RLGR

SEQ ID NO: 956710 - protein, 4 aa, Mycobacterium
RLLQ

SEQ ID NO: 956711 - protein, 24 aa, Mycobacterium
RLPDADHGRPKISRRGIDATYPQQ

SEQ ID NO: 956712 - protein, 16 aa, Mycobacterium
RLPPDRVDLVTVSGPV

SEQ ID NO: 956713 - protein, 12 aa, Mycobacterium
RLPPLPRGTTAT

SEQ ID NO: 956714 - protein, 8 aa, Mycobacterium
RLTSGQEY

SEQ ID NO: 956715 - protein, 9 aa, Mycobacterium
RMQTDNKDL

SEQ ID NO: 956716 - protein, 10 aa, Mycobacterium
RNAAANDTPA

SEQ ID NO: 956717 - protein, 8 aa, Mycobacterium
RNAELRGE

SEQ ID NO: 956718 - protein, 19 aa, Mycobacterium
RNASRGRRRGHLWPTDGSA

SEQ ID NO: 956719 - protein, 7 aa, Mycobacterium
RNATEFS

SEQ ID NO: 956720 - protein, 8 aa, Mycobacterium
RNDRRIPP

SEQ ID NO: 956721 - protein, 5 aa, Mycobacterium
RNDTK

SEQ ID NO: 956722 - protein, 17 aa, Mycobacterium
RNERAADAAAQPWTPGA

SEQ ID NO: 956723 - protein, 7 aa, Mycobacterium
RNFYSNP

SEQ ID NO: 956724 - protein, 15 aa, Mycobacterium
RNGITVQDSDGTVRR

SEQ ID NO: 956725 - protein, 4 aa, Mycobacterium
RNGP

SEQ ID NO: 956726 - protein, 12 aa, Mycobacterium
RNHNYPSRAGAA

SEQ ID NO: 956727 - protein, 11 aa, Mycobacterium
RNIKSKTAEFS

SEQ ID NO: 956728 - protein, 6 aa, Mycobacterium
RNPTRW

SEQ ID NO: 956729 - protein, 4 aa, Mycobacterium
RNRA

SEQ ID NO: 956730 - protein, 7 aa, Mycobacterium
RNRNPDI

SEQ ID NO: 956731 - protein, 4 aa, Mycobacterium
RNTG

SEQ ID NO: 956732 - protein, 5 aa, Mycobacterium
RNVRS

SEQ ID NO: 956733 - protein, 8 aa, Mycobacterium
RNVTQRSE

SEQ ID NO: 956734 - protein, 7 aa, Mycobacterium
RPAYNGL

SEQ ID NO: 956735 - protein, 9 aa, Mycobacterium
RPDEDPVRL

SEQ ID NO: 956736 - protein, 4 aa, Mycobacterium
RPDG

SEQ ID NO: 956737 - protein, 5 aa, Mycobacterium
RPDRL

SEQ ID NO: 956738 - protein, 16 aa, Mycobacterium
RPEDYEGAEISDGAGE

SEQ ID NO: 956739 - protein, 10 aa, Mycobacterium
RPENASSFGD

SEQ ID NO: 956740 - protein, 10 aa, Mycobacterium
RPFGERVGQA

SEQ ID NO: 956741 - protein, 20 aa, Mycobacterium
RPGATEPSDPALLQKIHANS

SEQ ID NO: 956742 - protein, 11 aa, Mycobacterium
RPGCAPAPDNV

SEQ ID NO: 956743 - protein, 36 aa, Mycobacterium
RPGECPEPIPGRPASASLVDPEDDLTPVGYPGDFGT

SEQ ID NO: 956744 - protein, 8 aa, Mycobacterium
RPGRPTAD

SEQ ID NO: 956745 - protein, 8 aa, Mycobacterium
RPGSPPMK

SEQ ID NO: 956746 - protein, 19 aa, Mycobacterium
RPLRRTEEPRRFDSRRRRT

SEQ ID NO: 956747 - protein, 4 aa, Mycobacterium
RPMP

SEQ ID NO: 956748 - protein, 16 aa, Mycobacterium
RPPDIDTASGRRMAGR

SEQ ID NO: 956749 - protein, 12 aa, Mycobacterium
RPRLPVAMKTLA

SEQ ID NO: 956750 - protein, 13 aa, Mycobacterium
RPRLSPGAPGGTI

SEQ ID NO: 956751 - protein, 7 aa, Mycobacterium
RPRTLPN

SEQ ID NO: 956752 - protein, 32 aa, Mycobacterium
RPSQSVEATTTRLSVPGNAPTTAAVSSSQGVQ

SEQ ID NO: 956753 - protein, 13 aa, Mycobacterium
RPSSDQPGQRRQV

SEQ ID NO: 956754 - protein, 6 aa, Mycobacterium
RPSSHV

SEQ ID NO: 956755 - protein, 5 aa, Mycobacterium
RPTEV

SEQ ID NO: 956756 - protein, 12 aa, Mycobacterium
RPVSASGSATRT

SEQ ID NO: 956757 - protein, 11 aa, Mycobacterium
RQGATGSSIGK

SEQ ID NO: 956758 - protein, 6 aa, Mycobacterium
RQGPKL

SEQ ID NO: 956759 - protein, 6 aa, Mycobacterium
RQPIAP

SEQ ID NO: 956760 - protein, 21 aa, Mycobacterium
RQQLEEAKQKTPSAPDPQQRL

SEQ ID NO: 956761 - protein, 18 aa, Mycobacterium
RQRRNAQSATALTTVGGQ

SEQ ID NO: 956762 - protein, 8 aa, Mycobacterium
RQSWPEEV

SEQ ID NO: 956763 - protein, 7 aa, Mycobacterium
RQTGGTV

SEQ ID NO: 956764 - protein, 9 aa, Mycobacterium
RQTSGKGQV

SEQ ID NO: 956765 - protein, 10 aa, Mycobacterium
RQWSRPANAD

SEQ ID NO: 956766 - protein, 8 aa, Mycobacterium
RRAQPRDR

SEQ ID NO: 956767 - protein, 4 aa, Mycobacterium
RRAT

SEQ ID NO: 956768 - protein, 21 aa, Mycobacterium
RRGAGGIAQQPSCSGSEQAQF

SEQ ID NO: 956769 - protein, 7 aa, Mycobacterium
RRGDDMD

SEQ ID NO: 956770 - protein, 9 aa, Mycobacterium
RRGGNAAKF

SEQ ID NO: 956771 - protein, 5 aa, Mycobacterium
RRGND

SEQ ID NO: 956772 - protein, 6 aa, Mycobacterium
RRGQEN

SEQ ID NO: 956773 - protein, 6 aa, Mycobacterium
RRGYRP

SEQ ID NO: 956774 - protein, 8 aa, Mycobacterium
RRITRESP

SEQ ID NO: 956775 - protein, 11 aa, Mycobacterium
RRKRMSKKKHR

SEQ ID NO: 956776 - protein, 8 aa, Mycobacterium
RRPPSSSA

SEQ ID NO: 956777 - protein, 6 aa, Mycobacterium
RRRDDE

SEQ ID NO: 956778 - protein, 4 aa, Mycobacterium
RRRR

SEQ ID NO: 956779 - protein, 13 aa, Mycobacterium
RRRSAAKERGYRE

SEQ ID NO: 956780 - protein, 7 aa, Mycobacterium
RRRTTDG

SEQ ID NO: 956781 - protein, 20 aa, Mycobacterium
RRSPPVPEHSRSGQNRADSN

SEQ ID NO: 956782 - protein, 10 aa, Mycobacterium
RRTDKQKDTG

SEQ ID NO: 956783 - protein, 5 aa, Mycobacterium
RRTPW

SEQ ID NO: 956784 - protein, 4 aa, Mycobacterium
RRTR

SEQ ID NO: 956785 - protein, 4 aa, Mycobacterium
RRVT

SEQ ID NO: 956786 - protein, 9 aa, Mycobacterium
RSACSRPLP

SEQ ID NO: 956787 - protein, 4 aa, Mycobacterium
RSAD

SEQ ID NO: 956788 - protein, 4 aa, Mycobacterium
RSAN

SEQ ID NO: 956789 - protein, 8 aa, Mycobacterium
RSANRSRT

SEQ ID NO: 956790 - protein, 6 aa, Mycobacterium
RSASRR

SEQ ID NO: 956791 - protein, 12 aa, Mycobacterium
RSASTPTPAKLA

SEQ ID NO: 956792 - protein, 5 aa, Mycobacterium
RSCQT

SEQ ID NO: 956793 - protein, 12 aa, Mycobacterium
RSDAIDKEDLQS

SEQ ID NO: 956794 - protein, 10 aa, Mycobacterium
RSDEPPSTRA

SEQ ID NO: 956795 - protein, 12 aa, Mycobacterium
RSDEQPQTDSRD

SEQ ID NO: 956796 - protein, 15 aa, Mycobacterium
RSDGGPPVLEGPASV

SEQ ID NO: 956797 - protein, 12 aa, Mycobacterium
RSDLPGPYTKKP

SEQ ID NO: 956798 - protein, 4 aa, Mycobacterium
RSDY

SEQ ID NO: 956799 - protein, 5 aa, Mycobacterium
RSECT

SEQ ID NO: 956800 - protein, 5 aa, Mycobacterium
RSEID

SEQ ID NO: 956801 - protein, 5 aa, Mycobacterium
RSERP

SEQ ID NO: 956802 - protein, 4 aa, Mycobacterium
RSGA

SEQ ID NO: 956803 - protein, 9 aa, Mycobacterium
RSGASDRVA

SEQ ID NO: 956804 - protein, 22 aa, Mycobacterium
RSGASPRRSVGGPGLNEPSPSA

SEQ ID NO: 956805 - protein, 8 aa, Mycobacterium
RSGRMGPD

SEQ ID NO: 956806 - protein, 9 aa, Mycobacterium
RSGSGGVGK

SEQ ID NO: 956807 - protein, 14 aa, Mycobacterium
RSIARRDGAATAIS

SEQ ID NO: 956808 - protein, 9 aa, Mycobacterium
RSIDQSGLG

SEQ ID NO: 956809 - protein, 6 aa, Mycobacterium
RSPGAS

SEQ ID NO: 956810 - protein, 8 aa, Mycobacterium
RSPHPPQA

SEQ ID NO: 956811 - protein, 26 aa, Mycobacterium
RSPSKLAAVSADPVGGWRREDPGTIR

SEQ ID NO: 956812 - protein, 14 aa, Mycobacterium
RSQSRTAKSELALP

SEQ ID NO: 956813 - protein, 7 aa, Mycobacterium
RSREGVR

SEQ ID NO: 956814 - protein, 14 aa, Mycobacterium
RSREYQADESGAML

SEQ ID NO: 956815 - protein, 9 aa, Mycobacterium
RSRRRPRHH

SEQ ID NO: 956816 - protein, 8 aa, Mycobacterium
RSRTTNSV

SEQ ID NO: 956817 - protein, 12 aa, Mycobacterium
RSSSAPAPKVRK

SEQ ID NO: 956818 - protein, 6 aa, Mycobacterium
RSTEER

SEQ ID NO: 956819 - protein, 6 aa, Mycobacterium
RSTGGV

SEQ ID NO: 956820 - protein, 6 aa, Mycobacterium
RSTPEE

SEQ ID NO: 956821 - protein, 9 aa, Mycobacterium
RSTTKPSMA

SEQ ID NO: 956822 - protein, 7 aa, Mycobacterium
RSVPGPI

SEQ ID NO: 956823 - protein, 5 aa, Mycobacterium
RSVSS

SEQ ID NO: 956824 - protein, 14 aa, Mycobacterium
RSYGSAGSTAGDSY

SEQ ID NO: 956825 - protein, 7 aa, Mycobacterium
RTAASDT

SEQ ID NO: 956826 - protein, 5 aa, Mycobacterium
RTADA

SEQ ID NO: 956827 - protein, 14 aa, Mycobacterium
RTAGAAQAAGVPNA

SEQ ID NO: 956828 - protein, 70 aa, Mycobacterium
RTANPTEPLTPTNQNYLTGGAASPQHKRGVAAATTGAAAGGASTLAGGPGRTTKPDKAACGEAVGTPLPA

SEQ ID NO: 956829 - protein, 6 aa, Mycobacterium
RTASDQ

SEQ ID NO: 956830 - protein, 11 aa, Mycobacterium
RTATGQKGRQM

SEQ ID NO: 956831 - protein, 8 aa, Mycobacterium
RTDAMGKS

SEQ ID NO: 956832 - protein, 5 aa, Mycobacterium
RTDRG

SEQ ID NO: 956833 - protein, 5 aa, Mycobacterium
RTIGS

SEQ ID NO: 956834 - protein, 4 aa, Mycobacterium
RTIR

SEQ ID NO: 956835 - protein, 18 aa, Mycobacterium
RTKLSDTVGSYTSARGRF

SEQ ID NO: 956836 - protein, 8 aa, Mycobacterium
RTNGYTAE

SEQ ID NO: 956837 - protein, 20 aa, Mycobacterium
RTNNREGNPVGSSYLSEASG

SEQ ID NO: 956838 - protein, 8 aa, Mycobacterium
RTPTQPYA

SEQ ID NO: 956839 - protein, 7 aa, Mycobacterium
RTRRQQG

SEQ ID NO: 956840 - protein, 13 aa, Mycobacterium
RTRSSKPFTGAGY

SEQ ID NO: 956841 - protein, 7 aa, Mycobacterium
RTSAGEQ

SEQ ID NO: 956842 - protein, 5 aa, Mycobacterium
RTSQN

SEQ ID NO: 956843 - protein, 8 aa, Mycobacterium
RTSRRPLA

SEQ ID NO: 956844 - protein, 6 aa, Mycobacterium
RTTNDV

SEQ ID NO: 956845 - protein, 6 aa, Mycobacterium
RVAKTE

SEQ ID NO: 956846 - protein, 10 aa, Mycobacterium
RVAPDAPVRQ

SEQ ID NO: 956847 - protein, 19 aa, Mycobacterium
RVDDPAGGPFDRAPYAPPS

SEQ ID NO: 956848 - protein, 7 aa, Mycobacterium
RVDQDST

SEQ ID NO: 956849 - protein, 4 aa, Mycobacterium
RVFG

SEQ ID NO: 956850 - protein, 9 aa, Mycobacterium
RVKPPARGL

SEQ ID NO: 956851 - protein, 5 aa, Mycobacterium
RVNEG

SEQ ID NO: 956852 - protein, 6 aa, Mycobacterium
RVSTEG

SEQ ID NO: 956853 - protein, 9 aa, Mycobacterium
RVTSSAASQ

SEQ ID NO: 956854 - protein, 19 aa, Mycobacterium
RVTSVRQDRVTNSADDTSI

SEQ ID NO: 956855 - protein, 10 aa, Mycobacterium
RYGATPGQVI

SEQ ID NO: 956856 - protein, 13 aa, Mycobacterium
RYGRSRLPGRSRH

SEQ ID NO: 956857 - protein, 8 aa, Mycobacterium
SAAAGANT

SEQ ID NO: 956858 - protein, 7 aa, Mycobacterium
SAAATGL

SEQ ID NO: 956859 - protein, 12 aa, Mycobacterium
SAAGDGQQPGPR

SEQ ID NO: 956860 - protein, 8 aa, Mycobacterium
SAAKAAAL

SEQ ID NO: 956861 - protein, 4 aa, Mycobacterium
SAAT

SEQ ID NO: 956862 - protein, 12 aa, Mycobacterium
SAATGSPPPSVS

SEQ ID NO: 956863 - protein, 7 aa, Mycobacterium
SADPAER

SEQ ID NO: 956864 - protein, 5 aa, Mycobacterium
SAGAM

SEQ ID NO: 956865 - protein, 7 aa, Mycobacterium
SAGATVP

SEQ ID NO: 956866 - protein, 12 aa, Mycobacterium
SAGEKSHAAGHN

SEQ ID NO: 956867 - protein, 16 aa, Mycobacterium
SAGNRDTRTRSDPQVG

SEQ ID NO: 956868 - protein, 8 aa, Mycobacterium
SAGPRRST

SEQ ID NO: 956869 - protein, 4 aa, Mycobacterium
SAGR

SEQ ID NO: 956870 - protein, 9 aa, Mycobacterium
SAGRSTARI

SEQ ID NO: 956871 - protein, 4 aa, Mycobacterium
SAGS

SEQ ID NO: 956872 - protein, 10 aa, Mycobacterium
SAGSKSASPI

SEQ ID NO: 956873 - protein, 9 aa, Mycobacterium
SAHATSTAA

SEQ ID NO: 956874 - protein, 6 aa, Mycobacterium
SAHQSG

SEQ ID NO: 956875 - protein, 5 aa, Mycobacterium
SAIVG

SEQ ID NO: 956876 - protein, 5 aa, Mycobacterium
SAKDA

SEQ ID NO: 956877 - protein, 5 aa, Mycobacterium
SAKGP

SEQ ID NO: 956878 - protein, 6 aa, Mycobacterium
SAKHGV

SEQ ID NO: 956879 - protein, 15 aa, Mycobacterium
SAKNTKVTTAVNEGS

SEQ ID NO: 956880 - protein, 8 aa, Mycobacterium
SALGADRD

SEQ ID NO: 956881 - protein, 16 aa, Mycobacterium
SAMYAAKNKKQCAVTP

SEQ ID NO: 956882 - protein, 4 aa, Mycobacterium
SANL

SEQ ID NO: 956883 - protein, 6 aa, Mycobacterium
SAPAMN

SEQ ID NO: 956884 - protein, 7 aa, Mycobacterium
SAPLADQ

SEQ ID NO: 956885 - protein, 4 aa, Mycobacterium
SAPR

SEQ ID NO: 956886 - protein, 13 aa, Mycobacterium
SAPSRGDSSTASR

SEQ ID NO: 956887 - protein, 5 aa, Mycobacterium
SAQHG

SEQ ID NO: 956888 - protein, 16 aa, Mycobacterium
SAQSEATVRTLDEGRE

SEQ ID NO: 956889 - protein, 10 aa, Mycobacterium
SARAQRQYPS

SEQ ID NO: 956890 - protein, 7 aa, Mycobacterium
SASAGGV

SEQ ID NO: 956891 - protein, 7 aa, Mycobacterium
SASGTFQ

SEQ ID NO: 956892 - protein, 7 aa, Mycobacterium
SASQDPV

SEQ ID NO: 956893 - protein, 10 aa, Mycobacterium
SASRLGRDLA

SEQ ID NO: 956894 - protein, 7 aa, Mycobacterium
SASVRSY

SEQ ID NO: 956895 - protein, 7 aa, Mycobacterium
SATANDP

SEQ ID NO: 956896 - protein, 14 aa, Mycobacterium
SATDERSAGRVDPL

SEQ ID NO: 956897 - protein, 6 aa, Mycobacterium
SATVGP

SEQ ID NO: 956898 - protein, 18 aa, Mycobacterium
SCATGYPAEAGGAERSSR

SEQ ID NO: 956899 - protein, 12 aa, Mycobacterium
SCSPRHSKISTT

SEQ ID NO: 956900 - protein, 13 aa, Mycobacterium
SDGTNPGKPYFAD

SEQ ID NO: 956901 - protein, 7 aa, Mycobacterium
SDIDSET

SEQ ID NO: 956902 - protein, 10 aa, Mycobacterium
SDLDPTLRRS

SEQ ID NO: 956903 - protein, 4 aa, Mycobacterium
SDLE

SEQ ID NO: 956904 - protein, 8 aa, Mycobacterium
SDMNANDV

SEQ ID NO: 956905 - protein, 8 aa, Mycobacterium
SDNASRPG

SEQ ID NO: 956906 - protein, 6 aa, Mycobacterium
SDPADP

SEQ ID NO: 956907 - protein, 7 aa, Mycobacterium
SDPHPVD

SEQ ID NO: 956908 - protein, 5 aa, Mycobacterium
SDPHT

SEQ ID NO: 956909 - protein, 7 aa, Mycobacterium
SDPSRPV

SEQ ID NO: 956910 - protein, 14 aa, Mycobacterium
SDPSRVRRSGGTGL

SEQ ID NO: 956911 - protein, 8 aa, Mycobacterium
SDQTISSF

SEQ ID NO: 956912 - protein, 4 aa, Mycobacterium
SDRF

SEQ ID NO: 956913 - protein, 9 aa, Mycobacterium
SDTARRQDA

SEQ ID NO: 956914 - protein, 5 aa, Mycobacterium
SDTPV

SEQ ID NO: 956915 - protein, 6 aa, Mycobacterium
SDVGES

SEQ ID NO: 956916 - protein, 5 aa, Mycobacterium
SDVRE

SEQ ID NO: 956917 - protein, 10 aa, Mycobacterium
SDWAKRNPRR

SEQ ID NO: 956918 - protein, 21 aa, Mycobacterium
SEKRESYADSNLGSSKPFNPK

SEQ ID NO: 956919 - protein, 7 aa, Mycobacterium
SELDRFP

SEQ ID NO: 956920 - protein, 30 aa, Mycobacterium
SELPSESEEPLGLEEDDPDAVDTDSMPALS

SEQ ID NO: 956921 - protein, 7 aa, Mycobacterium
SEPKTVS

SEQ ID NO: 956922 - protein, 5 aa, Mycobacterium
SEPVR

SEQ ID NO: 956923 - protein, 9 aa, Mycobacterium
SERETARFG

SEQ ID NO: 956924 - protein, 5 aa, Mycobacterium
SERQR

SEQ ID NO: 956925 - protein, 5 aa, Mycobacterium
SERTD

SEQ ID NO: 956926 - protein, 6 aa, Mycobacterium
SESTAR

SEQ ID NO: 956927 - protein, 11 aa, Mycobacterium
SETRLSKEACR

SEQ ID NO: 956928 - protein, 18 aa, Mycobacterium
SEVPNPTQLPPRPDRPYG

SEQ ID NO: 956929 - protein, 7 aa, Mycobacterium
SFQPSEL

SEQ ID NO: 956930 - protein, 4 aa, Mycobacterium
SGAA

SEQ ID NO: 956931 - protein, 13 aa, Mycobacterium
SGAADEARGTAED

SEQ ID NO: 956932 - protein, 29 aa, Mycobacterium
SGAGNFGVPRTDALSRQSLDETESDGSIG

SEQ ID NO: 956933 - protein, 4 aa, Mycobacterium
SGAL

SEQ ID NO: 956934 - protein, 4 aa, Mycobacterium
SGAS

SEQ ID NO: 956935 - protein, 13 aa, Mycobacterium
SGDLQGGSTITQQ

SEQ ID NO: 956936 - protein, 8 aa, Mycobacterium
SGDPSEQI

SEQ ID NO: 956937 - protein, 13 aa, Mycobacterium
SGDPVGDPGAWPQ

SEQ ID NO: 956938 - protein, 4 aa, Mycobacterium
SGDV

SEQ ID NO: 956939 - protein, 15 aa, Mycobacterium
SGEDEIPKAEPGEAA

SEQ ID NO: 956940 - protein, 9 aa, Mycobacterium
SGEGGHAAH

SEQ ID NO: 956941 - protein, 12 aa, Mycobacterium
SGEHGSTFAGNP

SEQ ID NO: 956942 - protein, 7 aa, Mycobacterium
SGENESW

SEQ ID NO: 956943 - protein, 4 aa, Mycobacterium
SGGA

SEQ ID NO: 956944 - protein, 9 aa, Mycobacterium
SGGETAAAN

SEQ ID NO: 956945 - protein, 12 aa, Mycobacterium
SGGGRAKALANE

SEQ ID NO: 956946 - protein, 7 aa, Mycobacterium
SGHLRAE

SEQ ID NO: 956947 - protein, 9 aa, Mycobacterium
SGKLTGGGF

SEQ ID NO: 956948 - protein, 6 aa, Mycobacterium
SGLASA

SEQ ID NO: 956949 - protein, 4 aa, Mycobacterium
SGLE

SEQ ID NO: 956950 - protein, 5 aa, Mycobacterium
SGLPS

SEQ ID NO: 956951 - protein, 5 aa, Mycobacterium
SGMPR

SEQ ID NO: 956952 - protein, 8 aa, Mycobacterium
SGNDAAHS

SEQ ID NO: 956953 - protein, 6 aa, Mycobacterium
SGNPFD

SEQ ID NO: 956954 - protein, 6 aa, Mycobacterium
SGPDMR

SEQ ID NO: 956955 - protein, 12 aa, Mycobacterium
SGPETKQIPDVT

SEQ ID NO: 956956 - protein, 10 aa, Mycobacterium
SGPGAAAPLA

SEQ ID NO: 956957 - protein, 7 aa, Mycobacterium
SGPIPTG

SEQ ID NO: 956958 - protein, 10 aa, Mycobacterium
SGPNPSALTA

SEQ ID NO: 956959 - protein, 7 aa, Mycobacterium
SGQAAAV

SEQ ID NO: 956960 - protein, 16 aa, Mycobacterium
SGQAPSGALAAGGNTT

SEQ ID NO: 956961 - protein, 4 aa, Mycobacterium
SGQG

SEQ ID NO: 956962 - protein, 4 aa, Mycobacterium
SGQM

SEQ ID NO: 956963 - protein, 13 aa, Mycobacterium
SGQPANGRTDELG

SEQ ID NO: 956964 - protein, 14 aa, Mycobacterium
SGQPPEAPKVLTDA

SEQ ID NO: 956965 - protein, 6 aa, Mycobacterium
SGRFPG

SEQ ID NO: 956966 - protein, 7 aa, Mycobacterium
SGRFPSG

SEQ ID NO: 956967 - protein, 6 aa, Mycobacterium
SGRGAQ

SEQ ID NO: 956968 - protein, 8 aa, Mycobacterium
SGRPSVGL

SEQ ID NO: 956969 - protein, 8 aa, Mycobacterium
SGRSNSAV

SEQ ID NO: 956970 - protein, 7 aa, Mycobacterium
SGRTGAL

SEQ ID NO: 956971 - protein, 10 aa, Mycobacterium
SGSLQPGELA

SEQ ID NO: 956972 - protein, 9 aa, Mycobacterium
SGTEPMAQS

SEQ ID NO: 956973 - protein, 10 aa, Mycobacterium
SGTPKSANFD

SEQ ID NO: 956974 - protein, 6 aa, Mycobacterium
SGTQDT

SEQ ID NO: 956975 - protein, 11 aa, Mycobacterium
SGTTGSGKSTL

SEQ ID NO: 956976 - protein, 21 aa, Mycobacterium
SGTTGTPKGANRNTPASLAPL

SEQ ID NO: 956977 - protein, 6 aa, Mycobacterium
SGVGGF

SEQ ID NO: 956978 - protein, 12 aa, Mycobacterium
SGVPENVKTPGV

SEQ ID NO: 956979 - protein, 7 aa, Mycobacterium
SGVSQLS

SEQ ID NO: 956980 - protein, 7 aa, Mycobacterium
SHDNTHG

SEQ ID NO: 956981 - protein, 6 aa, Mycobacterium
SHDPGQ

SEQ ID NO: 956982 - protein, 10 aa, Mycobacterium
SHGNAAISSI

SEQ ID NO: 956983 - protein, 6 aa, Mycobacterium
SHSSRS

SEQ ID NO: 956984 - protein, 5 aa, Mycobacterium
SHTGH

SEQ ID NO: 956985 - protein, 13 aa, Mycobacterium
SIAAGNDDEPDVY

SEQ ID NO: 956986 - protein, 16 aa, Mycobacterium
SIARQSAEAAENPQTA

SEQ ID NO: 956987 - protein, 10 aa, Mycobacterium
SIGSPTSRAI

SEQ ID NO: 956988 - protein, 9 aa, Mycobacterium
SIPANQGFA

SEQ ID NO: 956989 - protein, 10 aa, Mycobacterium
SIRSRPPERI

SEQ ID NO: 956990 - protein, 6 aa, Mycobacterium
SISSET

SEQ ID NO: 956991 - protein, 8 aa, Mycobacterium
SITPPKGL

SEQ ID NO: 956992 - protein, 8 aa, Mycobacterium
SKAEATRI

SEQ ID NO: 956993 - protein, 8 aa, Mycobacterium
SKAEPALG

SEQ ID NO: 956994 - protein, 8 aa, Mycobacterium
SKAGQRLT

SEQ ID NO: 956995 - protein, 7 aa, Mycobacterium
SKDATGI

SEQ ID NO: 956996 - protein, 6 aa, Mycobacterium
SKLSSK

SEQ ID NO: 956997 - protein, 8 aa, Mycobacterium
SKPAGAAT

SEQ ID NO: 956998 - protein, 11 aa, Mycobacterium
SKPLDTPSEPV

SEQ ID NO: 956999 - protein, 5 aa, Mycobacterium
SKPVR

SEQ ID NO: 957000 - protein, 4 aa, Mycobacterium
SKQF

SEQ ID NO: 957001 - protein, 7 aa, Mycobacterium
SKSGKTT

SEQ ID NO: 957002 - protein, 21 aa, Mycobacterium
SKSVSPPTSTRLASSTSDASA

SEQ ID NO: 957003 - protein, 5 aa, Mycobacterium
SKTFN

SEQ ID NO: 957004 - protein, 13 aa, Mycobacterium
SKTLSNDQTSKLR

SEQ ID NO: 957005 - protein, 5 aa, Mycobacterium
SKTVA

SEQ ID NO: 957006 - protein, 9 aa, Mycobacterium
SLAGSFQPT

SEQ ID NO: 957007 - protein, 5 aa, Mycobacterium
SLAKH

SEQ ID NO: 957008 - protein, 10 aa, Mycobacterium
SLASASVGAY

SEQ ID NO: 957009 - protein, 5 aa, Mycobacterium
SLDNN

SEQ ID NO: 957010 - protein, 5 aa, Mycobacterium
SLDNQ

SEQ ID NO: 957011 - protein, 11 aa, Mycobacterium
SLGGDPQLKQA

SEQ ID NO: 957012 - protein, 9 aa, Mycobacterium
SLGGPVGSD

SEQ ID NO: 957013 - protein, 17 aa, Mycobacterium
SLGTTTRSGLWNPAPLR

SEQ ID NO: 957014 - protein, 22 aa, Mycobacterium
SLHGDEQAVGSPLNDADRGALQ

SEQ ID NO: 957015 - protein, 11 aa, Mycobacterium
SLKKEGEIREP

SEQ ID NO: 957016 - protein, 49 aa, Mycobacterium
SLPADEDSTMDETITSQKVGTYPPYSYNTSPYPTPDQGKPIDGGGIPCV

SEQ ID NO: 957017 - protein, 8 aa, Mycobacterium
SLPAPATR

SEQ ID NO: 957018 - protein, 11 aa, Mycobacterium
SLPGKPDSPTS

SEQ ID NO: 957019 - protein, 7 aa, Mycobacterium
SLQTGGV

SEQ ID NO: 957020 - protein, 7 aa, Mycobacterium
SLRQSTE

SEQ ID NO: 957021 - protein, 7 aa, Mycobacterium
SLSTTGT

SEQ ID NO: 957022 - protein, 4 aa, Mycobacterium
SLTP

SEQ ID NO: 957023 - protein, 13 aa, Mycobacterium
SLYGPGRRSKTVP

SEQ ID NO: 957024 - protein, 4 aa, Mycobacterium
SMAT

SEQ ID NO: 957025 - protein, 9 aa, Mycobacterium
SMDQLSNGV

SEQ ID NO: 957026 - protein, 12 aa, Mycobacterium
SMRATDVEPNRM

SEQ ID NO: 957027 - protein, 8 aa, Mycobacterium
SNADGSMT

SEQ ID NO: 957028 - protein, 9 aa, Mycobacterium
SNHQPVTDQ

SEQ ID NO: 957029 - protein, 8 aa, Mycobacterium
SNISAQSD

SEQ ID NO: 957030 - protein, 5 aa, Mycobacterium
SNPHV

SEQ ID NO: 957031 - protein, 14 aa, Mycobacterium
SNPVPSTGAKSNVA

SEQ ID NO: 957032 - protein, 12 aa, Mycobacterium
SNQGKNLANESV

SEQ ID NO: 957033 - protein, 19 aa, Mycobacterium
SNRDSGDLANALPNDRDQQ

SEQ ID NO: 957034 - protein, 22 aa, Mycobacterium
SNSPDGPAQQPGTPTHPGTGQD

SEQ ID NO: 957035 - protein, 14 aa, Mycobacterium
SNTRNAFGTAPSRW

SEQ ID NO: 957036 - protein, 6 aa, Mycobacterium
SNTSAD

SEQ ID NO: 957037 - protein, 6 aa, Mycobacterium
SNVDAS

SEQ ID NO: 957038 - protein, 11 aa, Mycobacterium
SNYNSDGYVGS

SEQ ID NO: 957039 - protein, 7 aa, Mycobacterium
SPDGSVA

SEQ ID NO: 957040 - protein, 8 aa, Mycobacterium
SPDRDFSL

SEQ ID NO: 957041 - protein, 9 aa, Mycobacterium
SPEHGTAST

SEQ ID NO: 957042 - protein, 6 aa, Mycobacterium
SPESRK

SEQ ID NO: 957043 - protein, 8 aa, Mycobacterium
SPFEPGSV

SEQ ID NO: 957044 - protein, 18 aa, Mycobacterium
SPFIPSPEAGHDASGVNQ

SEQ ID NO: 957045 - protein, 7 aa, Mycobacterium
SPGEQQR

SEQ ID NO: 957046 - protein, 6 aa, Mycobacterium
SPGLPA

SEQ ID NO: 957047 - protein, 8 aa, Mycobacterium
SPGVAANG

SEQ ID NO: 957048 - protein, 7 aa, Mycobacterium
SPIAGTG

SEQ ID NO: 957049 - protein, 4 aa, Mycobacterium
SPLL

SEQ ID NO: 957050 - protein, 7 aa, Mycobacterium
SPNARAA

SEQ ID NO: 957051 - protein, 13 aa, Mycobacterium
SPQDPTEHGEGAE

SEQ ID NO: 957052 - protein, 8 aa, Mycobacterium
SPQTAQTV

SEQ ID NO: 957053 - protein, 6 aa, Mycobacterium
SPRDDS

SEQ ID NO: 957054 - protein, 22 aa, Mycobacterium
SPRPLAADRQSADNRDCPSRTD

SEQ ID NO: 957055 - protein, 5 aa, Mycobacterium
SPRQT

SEQ ID NO: 957056 - protein, 12 aa, Mycobacterium
SPSEADKMDPQQ

SEQ ID NO: 957057 - protein, 18 aa, Mycobacterium
SPSSPGSPPDSLVSQKPQ

SEQ ID NO: 957058 - protein, 6 aa, Mycobacterium
SPSTTR

SEQ ID NO: 957059 - protein, 5 aa, Mycobacterium
SPTEI

SEQ ID NO: 957060 - protein, 5 aa, Mycobacterium
SPTKR

SEQ ID NO: 957061 - protein, 5 aa, Mycobacterium
SPTLR

SEQ ID NO: 957062 - protein, 4 aa, Mycobacterium
SPVR

SEQ ID NO: 957063 - protein, 8 aa, Mycobacterium
SPVTSTMS

SEQ ID NO: 957064 - protein, 5 aa, Mycobacterium
SPWGV

SEQ ID NO: 957065 - protein, 7 aa, Mycobacterium
SQAPQVD

SEQ ID NO: 957066 - protein, 6 aa, Mycobacterium
SQQTAL

SEQ ID NO: 957067 - protein, 25 aa, Mycobacterium
SQYEEPGEDEYQTDEEADEARRTHQ

SEQ ID NO: 957068 - protein, 8 aa, Mycobacterium
SRAADART

SEQ ID NO: 957069 - protein, 6 aa, Mycobacterium
SRASSI

SEQ ID NO: 957070 - protein, 10 aa, Mycobacterium
SREPPPDLSA

SEQ ID NO: 957071 - protein, 5 aa, Mycobacterium
SRGEG

SEQ ID NO: 957072 - protein, 6 aa, Mycobacterium
SRIPEQ

SEQ ID NO: 957073 - protein, 10 aa, Mycobacterium
SRKDQQGNDL

SEQ ID NO: 957074 - protein, 12 aa, Mycobacterium
SRKEHASEPKVP

SEQ ID NO: 957075 - protein, 6 aa, Mycobacterium
SRLPKG

SEQ ID NO: 957076 - protein, 31 aa, Mycobacterium
SRLSGREDHPGLAPGTSRQRRSKGAAGSFTS

SEQ ID NO: 957077 - protein, 40 aa, Mycobacterium
SRLSPATEDAIAAADGAREAGQFSKADPAAAHDALSGETL

SEQ ID NO: 957078 - protein, 7 aa, Mycobacterium
SRNLAPA

SEQ ID NO: 957079 - protein, 8 aa, Mycobacterium
SRNRSGSF

SEQ ID NO: 957080 - protein, 7 aa, Mycobacterium
SRPAITP

SEQ ID NO: 957081 - protein, 4 aa, Mycobacterium
SRPS

SEQ ID NO: 957082 - protein, 5 aa, Mycobacterium
SRQPW

SEQ ID NO: 957083 - protein, 4 aa, Mycobacterium
SRRQ

SEQ ID NO: 957084 - protein, 11 aa, Mycobacterium
SRSDPTEEQRK

SEQ ID NO: 957085 - protein, 14 aa, Mycobacterium
SRSPRGDFSRHATA

SEQ ID NO: 957086 - protein, 13 aa, Mycobacterium
SRSYTGDSAAPTC

SEQ ID NO: 957087 - protein, 5 aa, Mycobacterium
SRTPV

SEQ ID NO: 957088 - protein, 7 aa, Mycobacterium
SRTSPAL

SEQ ID NO: 957089 - protein, 7 aa, Mycobacterium
SSAKPMP

SEQ ID NO: 957090 - protein, 4 aa, Mycobacterium
SSAP

SEQ ID NO: 957091 - protein, 7 aa, Mycobacterium
SSAPLLD

SEQ ID NO: 957092 - protein, 13 aa, Mycobacterium
SSASLKTRVRQAN

SEQ ID NO: 957093 - protein, 15 aa, Mycobacterium
SSASQVMSGNMRPLE

SEQ ID NO: 957094 - protein, 9 aa, Mycobacterium
SSATSYNCP

SEQ ID NO: 957095 - protein, 5 aa, Mycobacterium
SSAVQ

SEQ ID NO: 957096 - protein, 14 aa, Mycobacterium
SSAWTGRLTPPGTF

SEQ ID NO: 957097 - protein, 4 aa, Mycobacterium
SSCR

SEQ ID NO: 957098 - protein, 7 aa, Mycobacterium
SSDGTAT

SEQ ID NO: 957099 - protein, 12 aa, Mycobacterium
SSEANSPKPVAR

SEQ ID NO: 957100 - protein, 11 aa, Mycobacterium
SSEFTTEPTAL

SEQ ID NO: 957101 - protein, 7 aa, Mycobacterium
SSEIHSR

SEQ ID NO: 957102 - protein, 7 aa, Mycobacterium
SSELSLT

SEQ ID NO: 957103 - protein, 8 aa, Mycobacterium
SSFGPTDH

SEQ ID NO: 957104 - protein, 7 aa, Mycobacterium
SSGDQAL

SEQ ID NO: 957105 - protein, 5 aa, Mycobacterium
SSGGV

SEQ ID NO: 957106 - protein, 37 aa, Mycobacterium
SSGLGLEQKDDKSPVPVAPTVSRQRRYDTKTATAVSA

SEQ ID NO: 957107 - protein, 14 aa, Mycobacterium
SSGQSNRSDPPPAV

SEQ ID NO: 957108 - protein, 8 aa, Mycobacterium
SSGVRTYG

SEQ ID NO: 957109 - protein, 6 aa, Mycobacterium
SSHLEP

SEQ ID NO: 957110 - protein, 6 aa, Mycobacterium
SSIEGN

SEQ ID NO: 957111 - protein, 8 aa, Mycobacterium
SSIGQVPN

SEQ ID NO: 957112 - protein, 6 aa, Mycobacterium
SSKNRF

SEQ ID NO: 957113 - protein, 10 aa, Mycobacterium
SSLNSHTDST

SEQ ID NO: 957114 - protein, 5 aa, Mycobacterium
SSPAR

SEQ ID NO: 957115 - protein, 6 aa, Mycobacterium
SSPLTV

SEQ ID NO: 957116 - protein, 9 aa, Mycobacterium
SSPNTPGLR

SEQ ID NO: 957117 - protein, 7 aa, Mycobacterium
SSPQPGD

SEQ ID NO: 957118 - protein, 10 aa, Mycobacterium
SSPTDAGTPI

SEQ ID NO: 957119 - protein, 4 aa, Mycobacterium
SSQA

SEQ ID NO: 957120 - protein, 8 aa, Mycobacterium
SSQAAPGD

SEQ ID NO: 957121 - protein, 13 aa, Mycobacterium
SSRSMRCRTSSTA

SEQ ID NO: 957122 - protein, 21 aa, Mycobacterium
SSSIGDKSMSNPAAGCPGQRL

SEQ ID NO: 957123 - protein, 9 aa, Mycobacterium
SSSNPPMKQ

SEQ ID NO: 957124 - protein, 6 aa, Mycobacterium
SSSVRA

SEQ ID NO: 957125 - protein, 7 aa, Mycobacterium
SSTPFPD

SEQ ID NO: 957126 - protein, 10 aa, Mycobacterium
SSTPRPTFDD

SEQ ID NO: 957127 - protein, 7 aa, Mycobacterium
SSVTETE

SEQ ID NO: 957128 - protein, 7 aa, Mycobacterium
STAAQAD

SEQ ID NO: 957129 - protein, 11 aa, Mycobacterium
STADNSGDQRI

SEQ ID NO: 957130 - protein, 9 aa, Mycobacterium
STAGDITGP

SEQ ID NO: 957131 - protein, 10 aa, Mycobacterium
STAMKTGDLA

SEQ ID NO: 957132 - protein, 5 aa, Mycobacterium
STASR

SEQ ID NO: 957133 - protein, 7 aa, Mycobacterium
STDPNVS

SEQ ID NO: 957134 - protein, 11 aa, Mycobacterium
STDRAEEKAEK

SEQ ID NO: 957135 - protein, 19 aa, Mycobacterium
STESFDDSGAHGRTGGNNH

SEQ ID NO: 957136 - protein, 17 aa, Mycobacterium
STGGATGSGSSGSSSMD

SEQ ID NO: 957137 - protein, 10 aa, Mycobacterium
STGRQYNTRE

SEQ ID NO: 957138 - protein, 6 aa, Mycobacterium
STGTPH

SEQ ID NO: 957139 - protein, 9 aa, Mycobacterium
STHAATGAV

SEQ ID NO: 957140 - protein, 8 aa, Mycobacterium
STIATDQR

SEQ ID NO: 957141 - protein, 9 aa, Mycobacterium
STPATAGRI

SEQ ID NO: 957142 - protein, 5 aa, Mycobacterium
STPDE

SEQ ID NO: 957143 - protein, 5 aa, Mycobacterium
STPHT

SEQ ID NO: 957144 - protein, 13 aa, Mycobacterium
STRPWNTKPGDVM

SEQ ID NO: 957145 - protein, 15 aa, Mycobacterium
STRSVSNAIASGAQV

SEQ ID NO: 957146 - protein, 7 aa, Mycobacterium
STSALDE

SEQ ID NO: 957147 - protein, 17 aa, Mycobacterium
STTASRSAKDTAAESLR

SEQ ID NO: 957148 - protein, 7 aa, Mycobacterium
STTHREP

SEQ ID NO: 957149 - protein, 8 aa, Mycobacterium
STVDELES

SEQ ID NO: 957150 - protein, 9 aa, Mycobacterium
STVTSTGGW

SEQ ID NO: 957151 - protein, 25 aa, Mycobacterium
SVAGTAEDAAAEGTKVGVHDGGTYT

SEQ ID NO: 957152 - protein, 4 aa, Mycobacterium
SVNS

SEQ ID NO: 957153 - protein, 5 aa, Mycobacterium
SVPSD

SEQ ID NO: 957154 - protein, 7 aa, Mycobacterium
SVQGRRK

SEQ ID NO: 957155 - protein, 6 aa, Mycobacterium
SVQPEQ

SEQ ID NO: 957156 - protein, 17 aa, Mycobacterium
SVSPLTRPHRSKPGVAE

SEQ ID NO: 957157 - protein, 11 aa, Mycobacterium
SVTTHPTNGTI

SEQ ID NO: 957158 - protein, 6 aa, Mycobacterium
SWGETL

SEQ ID NO: 957159 - protein, 4 aa, Mycobacterium
SWGP

SEQ ID NO: 957160 - protein, 23 aa, Mycobacterium
SYGATNSDDAEGYAMTGGSTSVM

SEQ ID NO: 957161 - protein, 14 aa, Mycobacterium
SYGENTLAASATSA

SEQ ID NO: 957162 - protein, 17 aa, Mycobacterium
SYQQDPHKYRQATDPSY

SEQ ID NO: 957163 - protein, 11 aa, Mycobacterium
SYRDGKKVRHQ

SEQ ID NO: 957164 - protein, 10 aa, Mycobacterium
TAAASGLTQA

SEQ ID NO: 957165 - protein, 5 aa, Mycobacterium
TAAEG

SEQ ID NO: 957166 - protein, 10 aa, Mycobacterium
TAAETTNPRC

SEQ ID NO: 957167 - protein, 7 aa, Mycobacterium
TAAPGWQ

SEQ ID NO: 957168 - protein, 8 aa, Mycobacterium
TACDDDGI

SEQ ID NO: 957169 - protein, 4 aa, Mycobacterium
TACS

SEQ ID NO: 957170 - protein, 6 aa, Mycobacterium
TADHSG

SEQ ID NO: 957171 - protein, 15 aa, Mycobacterium
TADLTPTPNHEPRAD

SEQ ID NO: 957172 - protein, 8 aa, Mycobacterium
TADRSAAA

SEQ ID NO: 957173 - protein, 6 aa, Mycobacterium
TAENPV

SEQ ID NO: 957174 - protein, 17 aa, Mycobacterium
TAESQSTAAANRATMRA

SEQ ID NO: 957175 - protein, 13 aa, Mycobacterium
TAGKSLSDSASGL

SEQ ID NO: 957176 - protein, 21 aa, Mycobacterium
TAGLDGSDEHKPHSDVGPKLS

SEQ ID NO: 957177 - protein, 8 aa, Mycobacterium
TAHTGART

SEQ ID NO: 957178 - protein, 10 aa, Mycobacterium
TAIGERDQAI

SEQ ID NO: 957179 - protein, 6 aa, Mycobacterium
TAIGPA

SEQ ID NO: 957180 - protein, 9 aa, Mycobacterium
TAKSTNDGT

SEQ ID NO: 957181 - protein, 13 aa, Mycobacterium
TANGGPVGVGEAV

SEQ ID NO: 957182 - protein, 15 aa, Mycobacterium
TANQPGQTLPVGTAE

SEQ ID NO: 957183 - protein, 8 aa, Mycobacterium
TAPAGPDA

SEQ ID NO: 957184 - protein, 9 aa, Mycobacterium
TAPDPATEA

SEQ ID NO: 957185 - protein, 13 aa, Mycobacterium
TAPLGTSPDSRSA

SEQ ID NO: 957186 - protein, 9 aa, Mycobacterium
TAPSTRRDH

SEQ ID NO: 957187 - protein, 6 aa, Mycobacterium
TAQRRR

SEQ ID NO: 957188 - protein, 17 aa, Mycobacterium
TARTPDGSRPSREALSQ

SEQ ID NO: 957189 - protein, 15 aa, Mycobacterium
TASRPEIPAPTITTS

SEQ ID NO: 957190 - protein, 17 aa, Mycobacterium
TASSNSEDDTVSKPNSL

SEQ ID NO: 957191 - protein, 9 aa, Mycobacterium
TATAGTPLV

SEQ ID NO: 957192 - protein, 7 aa, Mycobacterium
TATGPCG

SEQ ID NO: 957193 - protein, 14 aa, Mycobacterium
TATPHAAADEPRAT

SEQ ID NO: 957194 - protein, 7 aa, Mycobacterium
TAVADRT

SEQ ID NO: 957195 - protein, 8 aa, Mycobacterium
TAVPPDAT

SEQ ID NO: 957196 - protein, 11 aa, Mycobacterium
TAYPQPGNPAP

SEQ ID NO: 957197 - protein, 11 aa, Mycobacterium
TAYSPFAADPN

SEQ ID NO: 957198 - protein, 70 aa, Mycobacterium
TCPPPRATSPPGPFTMPTDSGTPQPTNTASPTSTTPPTITSSSGTAPTNISPTSSPASTAPTTPVGTSQT

SEQ ID NO: 957199 - protein, 6 aa, Mycobacterium
TCTRPT

SEQ ID NO: 957200 - protein, 8 aa, Mycobacterium
TDAQRDGD

SEQ ID NO: 957201 - protein, 14 aa, Mycobacterium
TDASINHGNSGGPL

SEQ ID NO: 957202 - protein, 36 aa, Mycobacterium
TDENPPARENPVTPAQRSAAAKTKAARHQDANGATL

SEQ ID NO: 957203 - protein, 32 aa, Mycobacterium
TDETNGYGAKNVKDVKCNNGADPTVKKGDTFD

SEQ ID NO: 957204 - protein, 17 aa, Mycobacterium
TDGGEALQRRQADADNA

SEQ ID NO: 957205 - protein, 10 aa, Mycobacterium
TDGGPKSRTD

SEQ ID NO: 957206 - protein, 8 aa, Mycobacterium
TDHATTSN

SEQ ID NO: 957207 - protein, 5 aa, Mycobacterium
TDKNG

SEQ ID NO: 957208 - protein, 4 aa, Mycobacterium
TDLG

SEQ ID NO: 957209 - protein, 4 aa, Mycobacterium
TDNF

SEQ ID NO: 957210 - protein, 6 aa, Mycobacterium
TDPLGR

SEQ ID NO: 957211 - protein, 13 aa, Mycobacterium
TDPTSAATAKVGI

SEQ ID NO: 957212 - protein, 6 aa, Mycobacterium
TDPTTA

SEQ ID NO: 957213 - protein, 4 aa, Mycobacterium
TDPV

SEQ ID NO: 957214 - protein, 13 aa, Mycobacterium
TDRIPRKIRLDRA

SEQ ID NO: 957215 - protein, 18 aa, Mycobacterium
TDSAGNPLRGGFPDPNLR

SEQ ID NO: 957216 - protein, 8 aa, Mycobacterium
TDSRVSKS

SEQ ID NO: 957217 - protein, 19 aa, Mycobacterium
TDTDGHGQRGDRRPPGSEK

SEQ ID NO: 957218 - protein, 5 aa, Mycobacterium
TDTRA

SEQ ID NO: 957219 - protein, 13 aa, Mycobacterium
TEAAERVARTDDL

SEQ ID NO: 957220 - protein, 4 aa, Mycobacterium
TEDI

SEQ ID NO: 957221 - protein, 25 aa, Mycobacterium
TEEPVPGAEAETEKLPTQRPELRDS

SEQ ID NO: 957222 - protein, 6 aa, Mycobacterium
TEEQRR

SEQ ID NO: 957223 - protein, 11 aa, Mycobacterium
TEGADSNRPDP

SEQ ID NO: 957224 - protein, 4 aa, Mycobacterium
TEGF

SEQ ID NO: 957225 - protein, 6 aa, Mycobacterium
TEGFSG

SEQ ID NO: 957226 - protein, 9 aa, Mycobacterium
TEGRSTETV

SEQ ID NO: 957227 - protein, 28 aa, Mycobacterium
TEGSQEHDAEPAATTAPGNDEVAPLSFA

SEQ ID NO: 957228 - protein, 5 aa, Mycobacterium
TEHSP

SEQ ID NO: 957229 - protein, 6 aa, Mycobacterium
TERRSQ

SEQ ID NO: 957230 - protein, 6 aa, Mycobacterium
TERSSL

SEQ ID NO: 957231 - protein, 7 aa, Mycobacterium
TERTDHD

SEQ ID NO: 957232 - protein, 8 aa, Mycobacterium
TERTGAAI

SEQ ID NO: 957233 - protein, 14 aa, Mycobacterium
TERYGAVGNPDPGS

SEQ ID NO: 957234 - protein, 17 aa, Mycobacterium
TESALTESGLDRANRDA

SEQ ID NO: 957235 - protein, 13 aa, Mycobacterium
TESSYLKAGEAVS

SEQ ID NO: 957236 - protein, 5 aa, Mycobacterium
TETGL

SEQ ID NO: 957237 - protein, 16 aa, Mycobacterium
TETNGDSSPSSPWASR

SEQ ID NO: 957238 - protein, 5 aa, Mycobacterium
TGADQ

SEQ ID NO: 957239 - protein, 11 aa, Mycobacterium
TGAGSGIGRET

SEQ ID NO: 957240 - protein, 6 aa, Mycobacterium
TGAHQP

SEQ ID NO: 957241 - protein, 6 aa, Mycobacterium
TGALSS

SEQ ID NO: 957242 - protein, 9 aa, Mycobacterium
TGANGSGKT

SEQ ID NO: 957243 - protein, 11 aa, Mycobacterium
TGAQPNTTLSD

SEQ ID NO: 957244 - protein, 11 aa, Mycobacterium
TGDADPQTSQT

SEQ ID NO: 957245 - protein, 18 aa, Mycobacterium
TGDGHQIDGRNPVTGESR

SEQ ID NO: 957246 - protein, 17 aa, Mycobacterium
TGDGLRDAFDPVSKHLR

SEQ ID NO: 957247 - protein, 17 aa, Mycobacterium
TGDQEAHQRAVLNTIGP

SEQ ID NO: 957248 - protein, 9 aa, Mycobacterium
TGDTAERAR

SEQ ID NO: 957249 - protein, 11 aa, Mycobacterium
TGEAETSAGPL

SEQ ID NO: 957250 - protein, 18 aa, Mycobacterium
TGEARPVHASPASTVVGG

SEQ ID NO: 957251 - protein, 6 aa, Mycobacterium
TGEPLP

SEQ ID NO: 957252 - protein, 10 aa, Mycobacterium
TGETSPGVYG

SEQ ID NO: 957253 - protein, 4 aa, Mycobacterium
TGFG

SEQ ID NO: 957254 - protein, 9 aa, Mycobacterium
TGGAPSGLR

SEQ ID NO: 957255 - protein, 6 aa, Mycobacterium
TGHGEG

SEQ ID NO: 957256 - protein, 6 aa, Mycobacterium
TGHSSG

SEQ ID NO: 957257 - protein, 6 aa, Mycobacterium
TGMNGY

SEQ ID NO: 957258 - protein, 4 aa, Mycobacterium
TGNP

SEQ ID NO: 957259 - protein, 5 aa, Mycobacterium
TGNTT

SEQ ID NO: 957260 - protein, 4 aa, Mycobacterium
TGPD

SEQ ID NO: 957261 - protein, 8 aa, Mycobacterium
TGPRTAVS

SEQ ID NO: 957262 - protein, 8 aa, Mycobacterium
TGPTPSLD

SEQ ID NO: 957263 - protein, 6 aa, Mycobacterium
TGQGRA

SEQ ID NO: 957264 - protein, 6 aa, Mycobacterium
TGQHHG

SEQ ID NO: 957265 - protein, 14 aa, Mycobacterium
TGRPDNPHAVRSSQ

SEQ ID NO: 957266 - protein, 4 aa, Mycobacterium
TGRY

SEQ ID NO: 957267 - protein, 5 aa, Mycobacterium
TGSGG

SEQ ID NO: 957268 - protein, 7 aa, Mycobacterium
TGSGVNP

SEQ ID NO: 957269 - protein, 5 aa, Mycobacterium
TGSPM

SEQ ID NO: 957270 - protein, 7 aa, Mycobacterium
TGSRGWV

SEQ ID NO: 957271 - protein, 8 aa, Mycobacterium
TGTLTTGQ

SEQ ID NO: 957272 - protein, 18 aa, Mycobacterium
TGTNAPEPAASEPITEPP

SEQ ID NO: 957273 - protein, 5 aa, Mycobacterium
TGTPV

SEQ ID NO: 957274 - protein, 5 aa, Mycobacterium
TGTSF

SEQ ID NO: 957275 - protein, 4 aa, Mycobacterium
TGYT

SEQ ID NO: 957276 - protein, 5 aa, Mycobacterium
THCDK

SEQ ID NO: 957277 - protein, 6 aa, Mycobacterium
THGTGT

SEQ ID NO: 957278 - protein, 16 aa, Mycobacterium
THRQEKLAKPSQAPMA

SEQ ID NO: 957279 - protein, 8 aa, Mycobacterium
THSGDERA

SEQ ID NO: 957280 - protein, 5 aa, Mycobacterium
THTPE

SEQ ID NO: 957281 - protein, 6 aa, Mycobacterium
TIDHPG

SEQ ID NO: 957282 - protein, 7 aa, Mycobacterium
TIPINSA

SEQ ID NO: 957283 - protein, 8 aa, Mycobacterium
TISSQLDG

SEQ ID NO: 957284 - protein, 22 aa, Mycobacterium
TITDTPVARETDYGRVDQHSSA

SEQ ID NO: 957285 - protein, 32 aa, Mycobacterium
TKGIDEPDRNDNTDDNGAGAVEVTEAAEDAVE

SEQ ID NO: 957286 - protein, 4 aa, Mycobacterium
TKGT

SEQ ID NO: 957287 - protein, 7 aa, Mycobacterium
TKNHPRS

SEQ ID NO: 957288 - protein, 13 aa, Mycobacterium
TKPPSSSAVVSQA

SEQ ID NO: 957289 - protein, 4 aa, Mycobacterium
TKQL

SEQ ID NO: 957290 - protein, 7 aa, Mycobacterium
TKRKGSS

SEQ ID NO: 957291 - protein, 10 aa, Mycobacterium
TKRRSASPEH

SEQ ID NO: 957292 - protein, 15 aa, Mycobacterium
TKTATTPADKPDCVG

SEQ ID NO: 957293 - protein, 13 aa, Mycobacterium
TLAAARRSSQMDV

SEQ ID NO: 957294 - protein, 12 aa, Mycobacterium
TLADQDMGEANF

SEQ ID NO: 957295 - protein, 8 aa, Mycobacterium
TLAPPPPL

SEQ ID NO: 957296 - protein, 6 aa, Mycobacterium
TLARAR

SEQ ID NO: 957297 - protein, 17 aa, Mycobacterium
TLDSSTDPSGPQALRDG

SEQ ID NO: 957298 - protein, 34 aa, Mycobacterium
TLESTAGSSLKANLTGPASTVADLTDAGARDRTS

SEQ ID NO: 957299 - protein, 8 aa, Mycobacterium
TLGSDPES

SEQ ID NO: 957300 - protein, 46 aa, Mycobacterium
TLGSQVGKKNADSHVAAGTRKPQNQAESCADASSQEGTEVATASVP

SEQ ID NO: 957301 - protein, 7 aa, Mycobacterium
TLGTTTE

SEQ ID NO: 957302 - protein, 5 aa, Mycobacterium
TLPTI

SEQ ID NO: 957303 - protein, 11 aa, Mycobacterium
TLSDDDVYEAG

SEQ ID NO: 957304 - protein, 6 aa, Mycobacterium
TLTRSG

SEQ ID NO: 957305 - protein, 6 aa, Mycobacterium
TMGNGG

SEQ ID NO: 957306 - protein, 17 aa, Mycobacterium
TMISDDGAKLGSQEADS

SEQ ID NO: 957307 - protein, 16 aa, Mycobacterium
TNAADGTRTQEPRPDG

SEQ ID NO: 957308 - protein, 10 aa, Mycobacterium
TNADGHTTEV

SEQ ID NO: 957309 - protein, 5 aa, Mycobacterium
TNDYA

SEQ ID NO: 957310 - protein, 8 aa, Mycobacterium
TNFKTGPA

SEQ ID NO: 957311 - protein, 4 aa, Mycobacterium
TNGP

SEQ ID NO: 957312 - protein, 9 aa, Mycobacterium
TNGSAKTRF

SEQ ID NO: 957313 - protein, 7 aa, Mycobacterium
TNNNTYP

SEQ ID NO: 957314 - protein, 5 aa, Mycobacterium
TNPEY

SEQ ID NO: 957315 - protein, 17 aa, Mycobacterium
TNPRAGALGSSIAGQTL

SEQ ID NO: 957316 - protein, 5 aa, Mycobacterium
TNQPI

SEQ ID NO: 957317 - protein, 10 aa, Mycobacterium
TNSAGNYHPW

SEQ ID NO: 957318 - protein, 6 aa, Mycobacterium
TNTTVS

SEQ ID NO: 957319 - protein, 11 aa, Mycobacterium
TPAALATGPGI

SEQ ID NO: 957320 - protein, 7 aa, Mycobacterium
TPAPPGI

SEQ ID NO: 957321 - protein, 4 aa, Mycobacterium
TPDF

SEQ ID NO: 957322 - protein, 13 aa, Mycobacterium
TPDVVTTSSEPVV

SEQ ID NO: 957323 - protein, 22 aa, Mycobacterium
TPDYSAKKIDTDTWEDGANGGL

SEQ ID NO: 957324 - protein, 6 aa, Mycobacterium
TPEAFE

SEQ ID NO: 957325 - protein, 11 aa, Mycobacterium
TPEQVSQARPM

SEQ ID NO: 957326 - protein, 7 aa, Mycobacterium
TPGSASE

SEQ ID NO: 957327 - protein, 8 aa, Mycobacterium
TPGSDPFS

SEQ ID NO: 957328 - protein, 5 aa, Mycobacterium
TPGSP

SEQ ID NO: 957329 - protein, 10 aa, Mycobacterium
TPHQEPRSGE

SEQ ID NO: 957330 - protein, 7 aa, Mycobacterium
TPLPPRR

SEQ ID NO: 957331 - protein, 24 aa, Mycobacterium
TPNQPGTDYDWEAPTKLKAPGING

SEQ ID NO: 957332 - protein, 12 aa, Mycobacterium
TPRSAEEHRTQA

SEQ ID NO: 957333 - protein, 14 aa, Mycobacterium
TPSAHVDKAGNARR

SEQ ID NO: 957334 - protein, 9 aa, Mycobacterium
TPSATAVGA

SEQ ID NO: 957335 - protein, 7 aa, Mycobacterium
TPSPEDM

SEQ ID NO: 957336 - protein, 9 aa, Mycobacterium
TPVNDNPDK

SEQ ID NO: 957337 - protein, 6 aa, Mycobacterium
TQGPSV

SEQ ID NO: 957338 - protein, 5 aa, Mycobacterium
TQGTT

SEQ ID NO: 957339 - protein, 11 aa, Mycobacterium
TQLAETKPPTK

SEQ ID NO: 957340 - protein, 17 aa, Mycobacterium
TQPGRTYDVSSPDLPTV

SEQ ID NO: 957341 - protein, 5 aa, Mycobacterium
TQQSV

SEQ ID NO: 957342 - protein, 7 aa, Mycobacterium
TQVQEDP

SEQ ID NO: 957343 - protein, 4 aa, Mycobacterium
TRAE

SEQ ID NO: 957344 - protein, 8 aa, Mycobacterium
TRDDAGQV

SEQ ID NO: 957345 - protein, 6 aa, Mycobacterium
TRDYYD

SEQ ID NO: 957346 - protein, 14 aa, Mycobacterium
TREGVDDAAAATRS

SEQ ID NO: 957347 - protein, 10 aa, Mycobacterium
TRFSSTPTTL

SEQ ID NO: 957348 - protein, 8 aa, Mycobacterium
TRIEEKVR

SEQ ID NO: 957349 - protein, 16 aa, Mycobacterium
TRMPHDPLPDITDPHS

SEQ ID NO: 957350 - protein, 12 aa, Mycobacterium
TRPAVGNPPCPH

SEQ ID NO: 957351 - protein, 14 aa, Mycobacterium
TRPHPGQLGGPAAN

SEQ ID NO: 957352 - protein, 6 aa, Mycobacterium
TRREAA

SEQ ID NO: 957353 - protein, 9 aa, Mycobacterium
TRRGETQYG

SEQ ID NO: 957354 - protein, 14 aa, Mycobacterium
TRTGERGHDYLGNE

SEQ ID NO: 957355 - protein, 8 aa, Mycobacterium
TRTMGTSL

SEQ ID NO: 957356 - protein, 9 aa, Mycobacterium
TRTQSNPST

SEQ ID NO: 957357 - protein, 4 aa, Mycobacterium
TRTT

SEQ ID NO: 957358 - protein, 20 aa, Mycobacterium
TRVTSQDSATQTLLTPVSTA

SEQ ID NO: 957359 - protein, 14 aa, Mycobacterium
TSADVDNNTVNTDR

SEQ ID NO: 957360 - protein, 9 aa, Mycobacterium
TSAQAPPVR

SEQ ID NO: 957361 - protein, 9 aa, Mycobacterium
TSDERSRGM

SEQ ID NO: 957362 - protein, 6 aa, Mycobacterium
TSEAFQ

SEQ ID NO: 957363 - protein, 15 aa, Mycobacterium
TSERGFGSKLLSCLQ

SEQ ID NO: 957364 - protein, 4 aa, Mycobacterium
TSGL

SEQ ID NO: 957365 - protein, 35 aa, Mycobacterium
TSGSSAIAKASLDASLQNDLPEESRASGFGRSEST

SEQ ID NO: 957366 - protein, 9 aa, Mycobacterium
TSGSTGQPK

SEQ ID NO: 957367 - protein, 6 aa, Mycobacterium
TSHDEP

SEQ ID NO: 957368 - protein, 11 aa, Mycobacterium
TSHRGNEFSPG

SEQ ID NO: 957369 - protein, 17 aa, Mycobacterium
TSMADNRSVADSTRKAA

SEQ ID NO: 957370 - protein, 10 aa, Mycobacterium
TSPTRTGVTT

SEQ ID NO: 957371 - protein, 6 aa, Mycobacterium
TSPTVQ

SEQ ID NO: 957372 - protein, 6 aa, Mycobacterium
TSRHRT

SEQ ID NO: 957373 - protein, 4 aa, Mycobacterium
TSRI

SEQ ID NO: 957374 - protein, 6 aa, Mycobacterium
TSRSAS

SEQ ID NO: 957375 - protein, 10 aa, Mycobacterium
TSRSAYQPTT

SEQ ID NO: 957376 - protein, 4 aa, Mycobacterium
TSRT

SEQ ID NO: 957377 - protein, 8 aa, Mycobacterium
TSRTERYR

SEQ ID NO: 957378 - protein, 7 aa, Mycobacterium
TSSLTDS

SEQ ID NO: 957379 - protein, 4 aa, Mycobacterium
TSSR

SEQ ID NO: 957380 - protein, 7 aa, Mycobacterium
TSSTKFT

SEQ ID NO: 957381 - protein, 6 aa, Mycobacterium
TSTHAG

SEQ ID NO: 957382 - protein, 9 aa, Mycobacterium
TSTKAAITA

SEQ ID NO: 957383 - protein, 9 aa, Mycobacterium
TSTNGDRIE

SEQ ID NO: 957384 - protein, 6 aa, Mycobacterium
TSTPAV

SEQ ID NO: 957385 - protein, 9 aa, Mycobacterium
TSTTSGGLD

SEQ ID NO: 957386 - protein, 9 aa, Mycobacterium
TSWRGTSAT

SEQ ID NO: 957387 - protein, 7 aa, Mycobacterium
TTAGAFA

SEQ ID NO: 957388 - protein, 10 aa, Mycobacterium
TTARSLPGSG

SEQ ID NO: 957389 - protein, 10 aa, Mycobacterium
TTDTFDDNSR

SEQ ID NO: 957390 - protein, 5 aa, Mycobacterium
TTESA

SEQ ID NO: 957391 - protein, 8 aa, Mycobacterium
TTGSGKSE

SEQ ID NO: 957392 - protein, 5 aa, Mycobacterium
TTHTL

SEQ ID NO: 957393 - protein, 8 aa, Mycobacterium
TTIPSSAY

SEQ ID NO: 957394 - protein, 5 aa, Mycobacterium
TTKRI

SEQ ID NO: 957395 - protein, 9 aa, Mycobacterium
TTNGNITDD

SEQ ID NO: 957396 - protein, 5 aa, Mycobacterium
TTNNM

SEQ ID NO: 957397 - protein, 11 aa, Mycobacterium
TTQHEKTASAV

SEQ ID NO: 957398 - protein, 16 aa, Mycobacterium
TTQKRAAGASATAAAL

SEQ ID NO: 957399 - protein, 8 aa, Mycobacterium
TTQRANAS

SEQ ID NO: 957400 - protein, 9 aa, Mycobacterium
TTREDRRAG

SEQ ID NO: 957401 - protein, 6 aa, Mycobacterium
TTRRRL

SEQ ID NO: 957402 - protein, 7 aa, Mycobacterium
TTSETSR

SEQ ID NO: 957403 - protein, 8 aa, Mycobacterium
TTSNDPEA

SEQ ID NO: 957404 - protein, 26 aa, Mycobacterium
TTSSAESKAVIGTPEAQYITNKESGV

SEQ ID NO: 957405 - protein, 5 aa, Mycobacterium
TTSST

SEQ ID NO: 957406 - protein, 7 aa, Mycobacterium
TTVGENE

SEQ ID NO: 957407 - protein, 13 aa, Mycobacterium
TVAPGASKDPSVR

SEQ ID NO: 957408 - protein, 7 aa, Mycobacterium
TVAPPVS

SEQ ID NO: 957409 - protein, 6 aa, Mycobacterium
TVASAA

SEQ ID NO: 957410 - protein, 6 aa, Mycobacterium
TVDPTQ

SEQ ID NO: 957411 - protein, 7 aa, Mycobacterium
TVESPAN

SEQ ID NO: 957412 - protein, 7 aa, Mycobacterium
TVGELNT

SEQ ID NO: 957413 - protein, 5 aa, Mycobacterium
TVGMT

SEQ ID NO: 957414 - protein, 9 aa, Mycobacterium
TVKDSAADA

SEQ ID NO: 957415 - protein, 19 aa, Mycobacterium
TVPPDQARAQNQTTGPNGL

SEQ ID NO: 957416 - protein, 21 aa, Mycobacterium
TVPTTASTPTGMAASTSSSVP

SEQ ID NO: 957417 - protein, 20 aa, Mycobacterium
TVQCRSDTGLTVNGKPLKEP

SEQ ID NO: 957418 - protein, 10 aa, Mycobacterium
TVRDPSGRYA

SEQ ID NO: 957419 - protein, 11 aa, Mycobacterium
TVRPKGDITPE

SEQ ID NO: 957420 - protein, 17 aa, Mycobacterium
TVRPQEADIQDRVNNRS

SEQ ID NO: 957421 - protein, 5 aa, Mycobacterium
TVSKE

SEQ ID NO: 957422 - protein, 10 aa, Mycobacterium
TVSKTASTPP

SEQ ID NO: 957423 - protein, 7 aa, Mycobacterium
TVTTTNQ

SEQ ID NO: 957424 - protein, 11 aa, Mycobacterium
TYDATVAETNN

SEQ ID NO: 957425 - protein, 14 aa, Mycobacterium
VAAAGVSASPAAMP

SEQ ID NO: 957426 - protein, 11 aa, Mycobacterium
VAAQTGGAHLT

SEQ ID NO: 957427 - protein, 13 aa, Mycobacterium
VAATRASSGLTDT

SEQ ID NO: 957428 - protein, 8 aa, Mycobacterium
VADQAKRA

SEQ ID NO: 957429 - protein, 10 aa, Mycobacterium
VADTSPSPVG

SEQ ID NO: 957430 - protein, 16 aa, Mycobacterium
VAEPTEIDSDQDNERL

SEQ ID NO: 957431 - protein, 8 aa, Mycobacterium
VAGDPAQK

SEQ ID NO: 957432 - protein, 14 aa, Mycobacterium
VAGRLSNKPDGPSL

SEQ ID NO: 957433 - protein, 4 aa, Mycobacterium
VAGS

SEQ ID NO: 957434 - protein, 10 aa, Mycobacterium
VANRISPDEG

SEQ ID NO: 957435 - protein, 4 aa, Mycobacterium
VAPS

SEQ ID NO: 957436 - protein, 6 aa, Mycobacterium
VASGAD

SEQ ID NO: 957437 - protein, 10 aa, Mycobacterium
VATNPAGAKR

SEQ ID NO: 957438 - protein, 36 aa, Mycobacterium
VCNPPTQSTGSVPTQLGKQVPRTEMTDVTPAKLSDT

SEQ ID NO: 957439 - protein, 7 aa, Mycobacterium
VDDSETG

SEQ ID NO: 957440 - protein, 5 aa, Mycobacterium
VDDSL

SEQ ID NO: 957441 - protein, 8 aa, Mycobacterium
VDEAGKPL

SEQ ID NO: 957442 - protein, 5 aa, Mycobacterium
VDETP

SEQ ID NO: 957443 - protein, 7 aa, Mycobacterium
VDGRSGR

SEQ ID NO: 957444 - protein, 13 aa, Mycobacterium
VDHKNVNENWEGS

SEQ ID NO: 957445 - protein, 4 aa, Mycobacterium
VDNP

SEQ ID NO: 957446 - protein, 6 aa, Mycobacterium
VDNRSS

SEQ ID NO: 957447 - protein, 7 aa, Mycobacterium
VDPAEVP

SEQ ID NO: 957448 - protein, 9 aa, Mycobacterium
VDPSASADS

SEQ ID NO: 957449 - protein, 9 aa, Mycobacterium
VDSAANGSL

SEQ ID NO: 957450 - protein, 6 aa, Mycobacterium
VDSGRE

SEQ ID NO: 957451 - protein, 9 aa, Mycobacterium
VEAASEHSV

SEQ ID NO: 957452 - protein, 13 aa, Mycobacterium
VEAETPPPLPSPH

SEQ ID NO: 957453 - protein, 6 aa, Mycobacterium
VEDNPG

SEQ ID NO: 957454 - protein, 9 aa, Mycobacterium
VEGPGEPRP

SEQ ID NO: 957455 - protein, 18 aa, Mycobacterium
VEKDSRHDGHSHGGHASA

SEQ ID NO: 957456 - protein, 9 aa, Mycobacterium
VEPGTPDWR

SEQ ID NO: 957457 - protein, 5 aa, Mycobacterium
VEPGV

SEQ ID NO: 957458 - protein, 16 aa, Mycobacterium
VEPPIRPAGVPERGGV

SEQ ID NO: 957459 - protein, 10 aa, Mycobacterium
VEQGNSGGPL

SEQ ID NO: 957460 - protein, 6 aa, Mycobacterium
VERGPT

SEQ ID NO: 957461 - protein, 7 aa, Mycobacterium
VESASEH

SEQ ID NO: 957462 - protein, 8 aa, Mycobacterium
VETSNSEC

SEQ ID NO: 957463 - protein, 5 aa, Mycobacterium
VEVGK

SEQ ID NO: 957464 - protein, 9 aa, Mycobacterium
VGAGATAEL

SEQ ID NO: 957465 - protein, 6 aa, Mycobacterium
VGAQTA

SEQ ID NO: 957466 - protein, 7 aa, Mycobacterium
VGDETQL

SEQ ID NO: 957467 - protein, 5 aa, Mycobacterium
VGDPT

SEQ ID NO: 957468 - protein, 8 aa, Mycobacterium
VGGAGNRV

SEQ ID NO: 957469 - protein, 11 aa, Mycobacterium
VGGGDAEQKVR

SEQ ID NO: 957470 - protein, 6 aa, Mycobacterium
VGGKPT

SEQ ID NO: 957471 - protein, 7 aa, Mycobacterium
VGGPEVD

SEQ ID NO: 957472 - protein, 6 aa, Mycobacterium
VGGPTA

SEQ ID NO: 957473 - protein, 10 aa, Mycobacterium
VGGTPALEQD

SEQ ID NO: 957474 - protein, 12 aa, Mycobacterium
VGIPVDDPEGYR

SEQ ID NO: 957475 - protein, 6 aa, Mycobacterium
VGKHTT

SEQ ID NO: 957476 - protein, 4 aa, Mycobacterium
VGMP

SEQ ID NO: 957477 - protein, 5 aa, Mycobacterium
VGNNT

SEQ ID NO: 957478 - protein, 6 aa, Mycobacterium
VGNPNA

SEQ ID NO: 957479 - protein, 11 aa, Mycobacterium
VGPSEGSKARE

SEQ ID NO: 957480 - protein, 8 aa, Mycobacterium
VGQPGPGV

SEQ ID NO: 957481 - protein, 19 aa, Mycobacterium
VGRQRGTGLGGGHDEREQT

SEQ ID NO: 957482 - protein, 5 aa, Mycobacterium
VGRRK

SEQ ID NO: 957483 - protein, 12 aa, Mycobacterium
VGRSKAQSARDS

SEQ ID NO: 957484 - protein, 9 aa, Mycobacterium
VGRSRDTFG

SEQ ID NO: 957485 - protein, 9 aa, Mycobacterium
VGSAAPATA

SEQ ID NO: 957486 - protein, 23 aa, Mycobacterium
VGSSGSLATPDNYARIDSPSAGI

SEQ ID NO: 957487 - protein, 6 aa, Mycobacterium
VGTAAH

SEQ ID NO: 957488 - protein, 10 aa, Mycobacterium
VGTPSPLSFP

SEQ ID NO: 957489 - protein, 5 aa, Mycobacterium
VGTSL

SEQ ID NO: 957490 - protein, 16 aa, Mycobacterium
VHPSPGSVELEGQEPA

SEQ ID NO: 957491 - protein, 8 aa, Mycobacterium
VKASAADA

SEQ ID NO: 957492 - protein, 9 aa, Mycobacterium
VKASPAEQV

SEQ ID NO: 957493 - protein, 8 aa, Mycobacterium
VKHGGATR

SEQ ID NO: 957494 - protein, 5 aa, Mycobacterium
VKPAD

SEQ ID NO: 957495 - protein, 5 aa, Mycobacterium
VLPPM

SEQ ID NO: 957496 - protein, 5 aa, Mycobacterium
VLPTA

SEQ ID NO: 957497 - protein, 18 aa, Mycobacterium
VLSGTDGSVTYDRGSDGV

SEQ ID NO: 957498 - protein, 7 aa, Mycobacterium
VNDEGWA

SEQ ID NO: 957499 - protein, 7 aa, Mycobacterium
VNGTTNL

SEQ ID NO: 957500 - protein, 6 aa, Mycobacterium
VNNTDS

SEQ ID NO: 957501 - protein, 11 aa, Mycobacterium
VNPSASITDSS

SEQ ID NO: 957502 - protein, 7 aa, Mycobacterium
VNSTGVP

SEQ ID NO: 957503 - protein, 5 aa, Mycobacterium
VNTPE

SEQ ID NO: 957504 - protein, 5 aa, Mycobacterium
VPADS

SEQ ID NO: 957505 - protein, 14 aa, Mycobacterium
VPAGADQSTAGEHR

SEQ ID NO: 957506 - protein, 26 aa, Mycobacterium
VPAGTSTEAPDAGSQEGDTNSGELSG

SEQ ID NO: 957507 - protein, 18 aa, Mycobacterium
VPAMSTDTRFRRGQIGSA

SEQ ID NO: 957508 - protein, 13 aa, Mycobacterium
VPAPEDTRGRNEL

SEQ ID NO: 957509 - protein, 9 aa, Mycobacterium
VPATDGSAL

SEQ ID NO: 957510 - protein, 5 aa, Mycobacterium
VPATG

SEQ ID NO: 957511 - protein, 10 aa, Mycobacterium
VPDPRDPRGR

SEQ ID NO: 957512 - protein, 5 aa, Mycobacterium
VPDSA

SEQ ID NO: 957513 - protein, 8 aa, Mycobacterium
VPEQRSSW

SEQ ID NO: 957514 - protein, 9 aa, Mycobacterium
VPGLASGPT

SEQ ID NO: 957515 - protein, 4 aa, Mycobacterium
VPGP

SEQ ID NO: 957516 - protein, 11 aa, Mycobacterium
VPGPRDPRGRR

SEQ ID NO: 957517 - protein, 8 aa, Mycobacterium
VPGSPPGW

SEQ ID NO: 957518 - protein, 10 aa, Mycobacterium
VPKQAPKAVD

SEQ ID NO: 957519 - protein, 18 aa, Mycobacterium
VPNEGNPASFPGAPGPVG

SEQ ID NO: 957520 - protein, 18 aa, Mycobacterium
VPPAKSDAMDSAVAPDIT

SEQ ID NO: 957521 - protein, 8 aa, Mycobacterium
VPPEGNRV

SEQ ID NO: 957522 - protein, 15 aa, Mycobacterium
VPPPPAPKDNTPRNV

SEQ ID NO: 957523 - protein, 33 aa, Mycobacterium
VPPPPEEGLSPPGVPPPLQSGQHASSGRWDGST

SEQ ID NO: 957524 - protein, 7 aa, Mycobacterium
VPPTTGD

SEQ ID NO: 957525 - protein, 20 aa, Mycobacterium
VPQVTDPRETPYPYAASKSL

SEQ ID NO: 957526 - protein, 5 aa, Mycobacterium
VPTAN

SEQ ID NO: 957527 - protein, 7 aa, Mycobacterium
VPVQSGR

SEQ ID NO: 957528 - protein, 7 aa, Mycobacterium
VQEDGGI

SEQ ID NO: 957529 - protein, 6 aa, Mycobacterium
VQGGGS

SEQ ID NO: 957530 - protein, 18 aa, Mycobacterium
VQPNANDPNAIPAAGSIR

SEQ ID NO: 957531 - protein, 12 aa, Mycobacterium
VQQAKNLSGAHN

SEQ ID NO: 957532 - protein, 6 aa, Mycobacterium
VQQSAT

SEQ ID NO: 957533 - protein, 6 aa, Mycobacterium
VQRGNY

SEQ ID NO: 957534 - protein, 17 aa, Mycobacterium
VQRGQDPKPGSPAGTLP

SEQ ID NO: 957535 - protein, 11 aa, Mycobacterium
VQSSLSGSTVV

SEQ ID NO: 957536 - protein, 6 aa, Mycobacterium
VRDDTD

SEQ ID NO: 957537 - protein, 9 aa, Mycobacterium
VRGQVSADA

SEQ ID NO: 957538 - protein, 11 aa, Mycobacterium
VRLGQGPGAGT

SEQ ID NO: 957539 - protein, 20 aa, Mycobacterium
VRPEPGSHVPPIPRPPNEAV

SEQ ID NO: 957540 - protein, 12 aa, Mycobacterium
VRRSGPRVSGLT

SEQ ID NO: 957541 - protein, 13 aa, Mycobacterium
VRSGEITAPLGSQ

SEQ ID NO: 957542 - protein, 7 aa, Mycobacterium
VRSPRTI

SEQ ID NO: 957543 - protein, 7 aa, Mycobacterium
VSANAGE

SEQ ID NO: 957544 - protein, 26 aa, Mycobacterium
VSDDTHTGGSIQKPRGFTDENPPTAI

SEQ ID NO: 957545 - protein, 10 aa, Mycobacterium
VSEASNDSDD

SEQ ID NO: 957546 - protein, 7 aa, Mycobacterium
VSEDAAL

SEQ ID NO: 957547 - protein, 16 aa, Mycobacterium
VSEGNGTALDSSSLSS

SEQ ID NO: 957548 - protein, 12 aa, Mycobacterium
VSENVGGKPTTV

SEQ ID NO: 957549 - protein, 9 aa, Mycobacterium
VSEQSQPSE

SEQ ID NO: 957550 - protein, 9 aa, Mycobacterium
VSGEESQQM

SEQ ID NO: 957551 - protein, 5 aa, Mycobacterium
VSGSP

SEQ ID NO: 957552 - protein, 6 aa, Mycobacterium
VSHPTS

SEQ ID NO: 957553 - protein, 14 aa, Mycobacterium
VSKPEGKDSHGEEL

SEQ ID NO: 957554 - protein, 14 aa, Mycobacterium
VSKQQARSTVESTY

SEQ ID NO: 957555 - protein, 8 aa, Mycobacterium
VSLAGGGT

SEQ ID NO: 957556 - protein, 7 aa, Mycobacterium
VSLGGAS

SEQ ID NO: 957557 - protein, 11 aa, Mycobacterium
VSLSKSAVHPA

SEQ ID NO: 957558 - protein, 10 aa, Mycobacterium
VSMPNDPRGW

SEQ ID NO: 957559 - protein, 9 aa, Mycobacterium
VSNPDLAGR

SEQ ID NO: 957560 - protein, 10 aa, Mycobacterium
VSPGVGGTGA

SEQ ID NO: 957561 - protein, 20 aa, Mycobacterium
VSPSPPRGKLSSTRDPNQPF

SEQ ID NO: 957562 - protein, 5 aa, Mycobacterium
VSQHS

SEQ ID NO: 957563 - protein, 7 aa, Mycobacterium
VSSQLGQ

SEQ ID NO: 957564 - protein, 7 aa, Mycobacterium
VSSRAGV

SEQ ID NO: 957565 - protein, 12 aa, Mycobacterium
VSTGPEQREVPD

SEQ ID NO: 957566 - protein, 10 aa, Mycobacterium
VSTGRGVGAP

SEQ ID NO: 957567 - protein, 8 aa, Mycobacterium
VSTPRSYL

SEQ ID NO: 957568 - protein, 10 aa, Mycobacterium
VTGHHHTSAA

SEQ ID NO: 957569 - protein, 15 aa, Mycobacterium
VTGNAGQGPDHDYAT

SEQ ID NO: 957570 - protein, 12 aa, Mycobacterium
VTIGTDDDAPGL

SEQ ID NO: 957571 - protein, 4 aa, Mycobacterium
VTND

SEQ ID NO: 957572 - protein, 4 aa, Mycobacterium
VTPD

SEQ ID NO: 957573 - protein, 11 aa, Mycobacterium
VTPDNEQSKLA

SEQ ID NO: 957574 - protein, 6 aa, Mycobacterium
VTPHPR

SEQ ID NO: 957575 - protein, 18 aa, Mycobacterium
VTPKSGTGPSRKTQARGH

SEQ ID NO: 957576 - protein, 7 aa, Mycobacterium
VTPTPRM

SEQ ID NO: 957577 - protein, 9 aa, Mycobacterium
VTQPGTHDP

SEQ ID NO: 957578 - protein, 16 aa, Mycobacterium
VTQSGFYDDSSQSVKA

SEQ ID NO: 957579 - protein, 5 aa, Mycobacterium
VTQTA

SEQ ID NO: 957580 - protein, 8 aa, Mycobacterium
VTQTTRPL

SEQ ID NO: 957581 - protein, 4 aa, Mycobacterium
VTRA

SEQ ID NO: 957582 - protein, 7 aa, Mycobacterium
VTRARRA

SEQ ID NO: 957583 - protein, 18 aa, Mycobacterium
VTRPTGKPLEETSATYQA

SEQ ID NO: 957584 - protein, 15 aa, Mycobacterium
VTSGKGNDTHVSGNC

SEQ ID NO: 957585 - protein, 7 aa, Mycobacterium
VTSPGVA

SEQ ID NO: 957586 - protein, 21 aa, Mycobacterium
VTSTEETIESQVNSARDERDR

SEQ ID NO: 957587 - protein, 7 aa, Mycobacterium
VTTSPLP

SEQ ID NO: 957588 - protein, 11 aa, Mycobacterium
VVGSTGSGKST

SEQ ID NO: 957589 - protein, 6 aa, Mycobacterium
VVSNGG

SEQ ID NO: 957590 - protein, 8 aa, Mycobacterium
VYPNQPNV

SEQ ID NO: 957591 - protein, 7 aa, Mycobacterium
WAAGSRK

SEQ ID NO: 957592 - protein, 11 aa, Mycobacterium
WADSDSHQSGL

SEQ ID NO: 957593 - protein, 16 aa, Mycobacterium
WAGSDEHQHNAPSDLR

SEQ ID NO: 957594 - protein, 4 aa, Mycobacterium
WEGR

SEQ ID NO: 957595 - protein, 10 aa, Mycobacterium
WGATKAGDRT

SEQ ID NO: 957596 - protein, 9 aa, Mycobacterium
WGEPQNMPT

SEQ ID NO: 957597 - protein, 12 aa, Mycobacterium
WGPSTDPAWKRN

SEQ ID NO: 957598 - protein, 13 aa, Mycobacterium
WGQTGPRSQQAGH

SEQ ID NO: 957599 - protein, 4 aa, Mycobacterium
WGSE

SEQ ID NO: 957600 - protein, 68 aa, Mycobacterium
WLPPGTQDSAWTDVESASASVAAPSGRRRRSRHSSLDEAAASSPGEAETAQQHSGSGRRARSRHSAEY

SEQ ID NO: 957601 - protein, 12 aa, Mycobacterium
WPATARSGPTFT

SEQ ID NO: 957602 - protein, 14 aa, Mycobacterium
WPIEGTKAEKRTER

SEQ ID NO: 957603 - protein, 4 aa, Mycobacterium
WPNA

SEQ ID NO: 957604 - protein, 9 aa, Mycobacterium
WPQNGQLNS

SEQ ID NO: 957605 - protein, 9 aa, Mycobacterium
WPQNSTFES

SEQ ID NO: 957606 - protein, 9 aa, Mycobacterium
WQPDAADEQ

SEQ ID NO: 957607 - protein, 16 aa, Mycobacterium
WRGGGTGRQHSGTLTS

SEQ ID NO: 957608 - protein, 8 aa, Mycobacterium
WRNGQTDV

SEQ ID NO: 957609 - protein, 9 aa, Mycobacterium
WRPENQQTL

SEQ ID NO: 957610 - protein, 4 aa, Mycobacterium
WRPN

SEQ ID NO: 957611 - protein, 32 aa, Mycobacterium
WRQNPVDGEFADADQDIGEEQDQNVDDTQRTR

SEQ ID NO: 957612 - protein, 10 aa, Mycobacterium
WSDTGGTNML

SEQ ID NO: 957613 - protein, 5 aa, Mycobacterium
WSGST

SEQ ID NO: 957614 - protein, 4 aa, Mycobacterium
WSPE

SEQ ID NO: 957615 - protein, 5 aa, Mycobacterium
WSTAT

SEQ ID NO: 957616 - protein, 9 aa, Mycobacterium
YAASGGRNG

SEQ ID NO: 957617 - protein, 15 aa, Mycobacterium
YAATDGNPATSWTAP

SEQ ID NO: 957618 - protein, 14 aa, Mycobacterium
YAEPGYGFAIVSGS

SEQ ID NO: 957619 - protein, 4 aa, Mycobacterium
YAPQ

SEQ ID NO: 957620 - protein, 4 aa, Mycobacterium
YAPT

SEQ ID NO: 957621 - protein, 12 aa, Mycobacterium
YASDEDGKITTT

SEQ ID NO: 957622 - protein, 15 aa, Mycobacterium
YASNRHARLSQRGSE

SEQ ID NO: 957623 - protein, 9 aa, Mycobacterium
YDDQYDAEY

SEQ ID NO: 957624 - protein, 6 aa, Mycobacterium
YDDRRR

SEQ ID NO: 957625 - protein, 9 aa, Mycobacterium
YDESSWDET

SEQ ID NO: 957626 - protein, 12 aa, Mycobacterium
YDPDPSASGRMT

SEQ ID NO: 957627 - protein, 4 aa, Mycobacterium
YDPS

SEQ ID NO: 957628 - protein, 4 aa, Mycobacterium
YEAP

SEQ ID NO: 957629 - protein, 4 aa, Mycobacterium
YEEI

SEQ ID NO: 957630 - protein, 7 aa, Mycobacterium
YEESDRE

SEQ ID NO: 957631 - protein, 12 aa, Mycobacterium
YGAGADTDAQNV

SEQ ID NO: 957632 - protein, 13 aa, Mycobacterium
YGAQSYYGQPNRQ

SEQ ID NO: 957633 - protein, 9 aa, Mycobacterium
YGDASANRT

SEQ ID NO: 957634 - protein, 4 aa, Mycobacterium
YGDR

SEQ ID NO: 957635 - protein, 7 aa, Mycobacterium
YGEQPKA

SEQ ID NO: 957636 - protein, 12 aa, Mycobacterium
YGESHMDGEGRT

SEQ ID NO: 957637 - protein, 9 aa, Mycobacterium
YGGADANGF

SEQ ID NO: 957638 - protein, 8 aa, Mycobacterium
YGGAPRAV

SEQ ID NO: 957639 - protein, 4 aa, Mycobacterium
YGIS

SEQ ID NO: 957640 - protein, 4 aa, Mycobacterium
YGLD

SEQ ID NO: 957641 - protein, 7 aa, Mycobacterium
YGPDKVA

SEQ ID NO: 957642 - protein, 9 aa, Mycobacterium
YGPGIPPQE

SEQ ID NO: 957643 - protein, 7 aa, Mycobacterium
YGRDRSG

SEQ ID NO: 957644 - protein, 12 aa, Mycobacterium
YGRPQASEDEVM

SEQ ID NO: 957645 - protein, 9 aa, Mycobacterium
YGSEHGDPF

SEQ ID NO: 957646 - protein, 6 aa, Mycobacterium
YGSHTG

SEQ ID NO: 957647 - protein, 5 aa, Mycobacterium
YKPSE

SEQ ID NO: 957648 - protein, 10 aa, Mycobacterium
YKQPGPPEHF

SEQ ID NO: 957649 - protein, 19 aa, Mycobacterium
YKQPRRRATPPRASSVNPI

SEQ ID NO: 957650 - protein, 9 aa, Mycobacterium
YLDGQDPDM

SEQ ID NO: 957651 - protein, 20 aa, Mycobacterium
YNNNPTSHTRRSGQRTKRRK

SEQ ID NO: 957652 - protein, 13 aa, Mycobacterium
YPGQNNSSPPRVN

SEQ ID NO: 957653 - protein, 8 aa, Mycobacterium
YPGTNHPA

SEQ ID NO: 957654 - protein, 12 aa, Mycobacterium
YPRAPDRDVAGR

SEQ ID NO: 957655 - protein, 18 aa, Mycobacterium
YQETSNRVDTETTASTQI

SEQ ID NO: 957656 - protein, 8 aa, Mycobacterium
YQGPNARL

SEQ ID NO: 957657 - protein, 21 aa, Mycobacterium
YQNPPAGAGVNRDGIITLKFG

SEQ ID NO: 957658 - protein, 9 aa, Mycobacterium
YQNQEDING

SEQ ID NO: 957659 - protein, 31 aa, Mycobacterium
YRGSTARDDPRVDRQRSQTPRRPVTESWEFD

SEQ ID NO: 957660 - protein, 12 aa, Mycobacterium
YRNRHRAVNGST

SEQ ID NO: 957661 - protein, 4 aa, Mycobacterium
YRPG

SEQ ID NO: 957662 - protein, 7 aa, Mycobacterium
YRPGVTE

SEQ ID NO: 957663 - protein, 6 aa, Mycobacterium
YRQLGG

SEQ ID NO: 957664 - protein, 11 aa, Mycobacterium
YRRSRTNPDAT

SEQ ID NO: 957665 - protein, 9 aa, Mycobacterium
YRSSGGLTD

SEQ ID NO: 957666 - protein, 9 aa, Mycobacterium
YRVGPASAL

SEQ ID NO: 957667 - protein, 15 aa, Mycobacterium
YSDPDHLKGPGGTGY

SEQ ID NO: 957668 - protein, 11 aa, Mycobacterium
YSELTDPVEQR

SEQ ID NO: 957669 - protein, 6 aa, Mycobacterium
YSRKDH

SEQ ID NO: 957670 - protein, 6 aa, Mycobacterium
YTALSE

SEQ ID NO: 957671 - protein, 10 aa, Mycobacterium
YTARAKSHAS

SEQ ID NO: 957672 - protein, 30 aa, Mycobacterium
YTLTTDRDAEPDLGPQPDFPRHRGSDLAPE

SEQ ID NO: 957673 - protein, 13 aa, Mycobacterium
YTPGSLPTSSGSA

SEQ ID NO: 957674 - protein, 9 aa, Mycobacterium
YTTTTTGAR

SEQ ID NO: 957675 - protein, 6 aa, Mycobacterium
YVGSSQ

SEQ ID NO: 957676 - protein, 12 aa, Mycobacterium
YVKTNGSSYAYT

SEQ ID NO: 957677 - protein, 10 aa, Mycobacterium
YYPNAQPARL

SEQ ID NO: 957678 - protein, 14 aa, Mycobacterium
AAAAAGGRRGLSAA

SEQ ID NO: 957679 - protein, 7 aa, Mycobacterium
AAAAAST

SEQ ID NO: 957680 - protein, 7 aa, Mycobacterium
AAAAATA

SEQ ID NO: 957681 - protein, 6 aa, Mycobacterium
AAAAEA

SEQ ID NO: 957682 - protein, 7 aa, Mycobacterium
AAAAEGA

SEQ ID NO: 957683 - protein, 5 aa, Mycobacterium
AAAAG

SEQ ID NO: 957684 - protein, 9 aa, Mycobacterium
AAAAGARAR

SEQ ID NO: 957685 - protein, 100 aa, Mycobacterium
AAAAPAAGSPPSGPSAVAGPPRGVAPSGPAGPSGPIPRPPAAGQPGWQQASGPIPASQPTPSPPYYQGSGWGGAPPPGQPAGPSTWNQGPQGPGPRGRNP

SEQ ID NO: 957686 - protein, 14 aa, Mycobacterium
AAAARRARRGRTFS

SEQ ID NO: 957687 - protein, 6 aa, Mycobacterium
AAAASM

SEQ ID NO: 957688 - protein, 10 aa, Mycobacterium
AAAATGATSV

SEQ ID NO: 957689 - protein, 17 aa, Mycobacterium
AAADTPPAQQPIFAQQV

SEQ ID NO: 957690 - protein, 16 aa, Mycobacterium
AAAEAQETPVQSRTDH

SEQ ID NO: 957691 - protein, 14 aa, Mycobacterium
AAAERKPPQLGGEE

SEQ ID NO: 957692 - protein, 47 aa, Mycobacterium
AAAGAAIPAGPAITARKAGRAELGRSTLSAGPAGAAVTGGAAGAVRA

SEQ ID NO: 957693 - protein, 9 aa, Mycobacterium
AAAGAGSTM

SEQ ID NO: 957694 - protein, 26 aa, Mycobacterium
AAAGATAQTLRRRRSASALGTSSPSG

SEQ ID NO: 957695 - protein, 7 aa, Mycobacterium
AAAGEAS

SEQ ID NO: 957696 - protein, 19 aa, Mycobacterium
AAAGPGTARLPDPEAPVRT

SEQ ID NO: 957697 - protein, 8 aa, Mycobacterium
AAAGRGVR

SEQ ID NO: 957698 - protein, 16 aa, Mycobacterium
AAAGSGSIASPPRTSD

SEQ ID NO: 957699 - protein, 11 aa, Mycobacterium
AAAGSNPTVPT

SEQ ID NO: 957700 - protein, 14 aa, Mycobacterium
AAAKDRAESQGKTA

SEQ ID NO: 957701 - protein, 5 aa, Mycobacterium
AAAKR

SEQ ID NO: 957702 - protein, 6 aa, Mycobacterium
AAALEA

SEQ ID NO: 957703 - protein, 4 aa, Mycobacterium
AAAN

SEQ ID NO: 957704 - protein, 20 aa, Mycobacterium
AAAPAQPQTPTDLGAPAHTS

SEQ ID NO: 957705 - protein, 7 aa, Mycobacterium
AAAPESE

SEQ ID NO: 957706 - protein, 12 aa, Mycobacterium
AAAQALGPGALG

SEQ ID NO: 957707 - protein, 14 aa, Mycobacterium
AAARGGSPRPRTGH

SEQ ID NO: 957708 - protein, 12 aa, Mycobacterium
AAARTEGTDAHV

SEQ ID NO: 957709 - protein, 7 aa, Mycobacterium
AAASALL

SEQ ID NO: 957710 - protein, 15 aa, Mycobacterium
AAASAPADAPPTAGI

SEQ ID NO: 957711 - protein, 13 aa, Mycobacterium
AAASGSGHESTHR

SEQ ID NO: 957712 - protein, 7 aa, Mycobacterium
AAASSFK

SEQ ID NO: 957713 - protein, 10 aa, Mycobacterium
AAASVGDDRI

SEQ ID NO: 957714 - protein, 6 aa, Mycobacterium
AAATAV

SEQ ID NO: 957715 - protein, 7 aa, Mycobacterium
AAATGAV

SEQ ID NO: 957716 - protein, 32 aa, Mycobacterium
AAATSDRVARNGGFAGTGHRQTTTAASGLTTL

SEQ ID NO: 957717 - protein, 16 aa, Mycobacterium
AAAVGRAGDGTAAATA

SEQ ID NO: 957718 - protein, 8 aa, Mycobacterium
AADAAHRA

SEQ ID NO: 957719 - protein, 5 aa, Mycobacterium
AADAD

SEQ ID NO: 957720 - protein, 8 aa, Mycobacterium
AADDAPDK

SEQ ID NO: 957721 - protein, 25 aa, Mycobacterium
AADDHPDFPPRPAGSSTSSQAPTSL

SEQ ID NO: 957722 - protein, 30 aa, Mycobacterium; identical to SEQ ID NO: 242714

SEQ ID NO: 957723 - protein, 14 aa, Mycobacterium
AADGLNKSPRPSGG

SEQ ID NO: 957724 - protein, 10 aa, Mycobacterium
AADGTGWGEG

SEQ ID NO: 957725 - protein, 4 aa, Mycobacterium
AADI

SEQ ID NO: 957726 - protein, 17 aa, Mycobacterium
AADNSVSMNPAGAPSLQ

SEQ ID NO: 957727 - protein, 8 aa, Mycobacterium
AADPISSL

SEQ ID NO: 957728 - protein, 10 aa, Mycobacterium
AADPSATELA

SEQ ID NO: 957729 - protein, 7 aa, Mycobacterium
AADPVLT

SEQ ID NO: 957730 - protein, 6 aa, Mycobacterium
AADRRE

SEQ ID NO: 957731 - protein, 47 aa, Mycobacterium
AADSAGPGGMTDGGGGTAIAAGTAVSAGARTARAATRAGAGAGATPL

SEQ ID NO: 957732 - protein, 5 aa, Mycobacterium
AADTG

SEQ ID NO: 957733 - protein, 11 aa, Mycobacterium
AAEAADPSHTL

SEQ ID NO: 957734 - protein, 10 aa, Mycobacterium
AAEDGTGELA

SEQ ID NO: 957735 - protein, 7 aa, Mycobacterium
AAEDTVS

SEQ ID NO: 957736 - protein, 10 aa, Mycobacterium
AAEEPDTALA

SEQ ID NO: 957737 - protein, 11 aa, Mycobacterium
AAEERQPGGYG

SEQ ID NO: 957738 - protein, 7 aa, Mycobacterium
AAEGGAA

SEQ ID NO: 957739 - protein, 14 aa, Mycobacterium
AAEGRAGYGMPGDH

SEQ ID NO: 957740 - protein, 7 aa, Mycobacterium
AAEGSAV

SEQ ID NO: 957741 - protein, 5 aa, Mycobacterium
AAELG

SEQ ID NO: 957742 - protein, 10 aa, Mycobacterium
AAEQSSEHPL

SEQ ID NO: 957743 - protein, 14 aa, Mycobacterium
AAERERPKLGGEDR

SEQ ID NO: 957744 - protein, 4 aa, Mycobacterium
AAGA

SEQ ID NO: 957745 - protein, 23 aa, Mycobacterium
AAGAAAASRASARSRRRRRTEMR

SEQ ID NO: 957746 - protein, 6 aa, Mycobacterium
AAGAAG

SEQ ID NO: 957747 - protein, 6 aa, Mycobacterium
AAGAAS

SEQ ID NO: 957748 - protein, 31 aa, Mycobacterium
AAGAETQDRSSGRRRRARHYDSDEDQGDIGE

SEQ ID NO: 957749 - protein, 7 aa, Mycobacterium
AAGAGPA

SEQ ID NO: 957750 - protein, 13 aa, Mycobacterium
AAGAGRHGAQASH

SEQ ID NO: 957751 - protein, 7 aa, Mycobacterium
AAGAPAG

SEQ ID NO: 957752 - protein, 50 aa, Mycobacterium
AAGAPGPARGQRGDRRAQWAGAGVGDGPPAQRIGGTTRCRRGGGNPRTGR

SEQ ID NO: 957753 - protein, 12 aa, Mycobacterium
AAGAQSADGKSA

SEQ ID NO: 957754 - protein, 66 aa, Mycobacterium
AAGARSLPADPPRGPGHPAPRPARAEPAPPQPVPPSKPTESVTQQLPTASATQRIATPPPAPSTFE

SEQ ID NO: 957755 - protein, 6 aa, Mycobacterium
AAGATA

SEQ ID NO: 957756 - protein, 8 aa, Mycobacterium
AAGATGVG

SEQ ID NO: 957757 - protein, 10 aa, Mycobacterium
AAGATTSTEL

SEQ ID NO: 957758 - protein, 6 aa, Mycobacterium
AAGDEV

SEQ ID NO: 957759 - protein, 27 aa, Mycobacterium
AAGDGPDPALEPGHDVTPQRRARSRTK

SEQ ID NO: 957760 - protein, 10 aa, Mycobacterium
AAGEAAEPEK

SEQ ID NO: 957761 - protein, 11 aa, Mycobacterium
AAGETAEPEKV

SEQ ID NO: 957762 - protein, 8 aa, Mycobacterium
AAGETQAH

SEQ ID NO: 957763 - protein, 9 aa, Mycobacterium
AAGGDPEAM

SEQ ID NO: 957764 - protein, 5 aa, Mycobacterium
AAGGG

SEQ ID NO: 957765 - protein, 12 aa, Mycobacterium
AAGGNTAAQNFG

SEQ ID NO: 957766 - protein, 6 aa, Mycobacterium
AAGGNV

SEQ ID NO: 957767 - protein, 7 aa, Mycobacterium
AAGGPST

SEQ ID NO: 957768 - protein, 10 aa, Mycobacterium
AAGGRNLSAG

SEQ ID NO: 957769 - protein, 12 aa, Mycobacterium
AAGGVPQDEGAK

SEQ ID NO: 957770 - protein, 6 aa, Mycobacterium
AAGLSR

SEQ ID NO: 957771 - protein, 9 aa, Mycobacterium
AAGPAGAAV

SEQ ID NO: 957772 - protein, 22 aa, Mycobacterium
AAGPGSIAEHQARRGATSTEPF

SEQ ID NO: 957773 - protein, 9 aa, Mycobacterium
AAGQPGPGV

SEQ ID NO: 957774 - protein, 9 aa, Mycobacterium
AAGRGPRKR

SEQ ID NO: 957775 - protein, 27 aa, Mycobacterium
AAGSPRPPRAGRHAAAETAEDDSEDEV

SEQ ID NO: 957776 - protein, 14 aa, Mycobacterium
AAGTAGRSMASDTS

SEQ ID NO: 957777 - protein, 37 aa, Mycobacterium
AAGTAVPEAELDGEEEPVDESQLGDEPELADDSELDT

SEQ ID NO: 957778 - protein, 5 aa, Mycobacterium
AAGTK

SEQ ID NO: 957779 - protein, 8 aa, Mycobacterium
AAGTSPEV

SEQ ID NO: 957780 - protein, 6 aa, Mycobacterium
AAGVGT

SEQ ID NO: 957781 - protein, 7 aa, Mycobacterium
AAGYSRY

SEQ ID NO: 957782 - protein, 12 aa, Mycobacterium
AAHEAVKGTPLA

SEQ ID NO: 957783 - protein, 13 aa, Mycobacterium
AAHSNGVTHRDVK

SEQ ID NO: 957784 - protein, 21 aa, Mycobacterium
AAHTEPPEPPGPYPSARGRFD

SEQ ID NO: 957785 - protein, 10 aa, Mycobacterium
AAHYGKQAPE

SEQ ID NO: 957786 - protein, 11 aa, Mycobacterium
AAINPGNSGGA

SEQ ID NO: 957787 - protein, 19 aa, Mycobacterium
AAKAEAKAARKAAARERRT

SEQ ID NO: 957788 - protein, 19 aa, Mycobacterium
AAKAGETGDIEDAPDVVPT

SEQ ID NO: 957789 - protein, 41 aa, Mycobacterium
AAKAGGIVAGGGGAALATGTSGSAVARHPHGAAGAGRTRHP

SEQ ID NO: 957790 - protein, 7 aa, Mycobacterium
AAKQRSA

SEQ ID NO: 957791 - protein, 14 aa, Mycobacterium
AAKSSANFCLASLW

SEQ ID NO: 957792 - protein, 6 aa, Mycobacterium
AALGSV

SEQ ID NO: 957793 - protein, 6 aa, Mycobacterium
AALPQR

SEQ ID NO: 957794 - protein, 4 aa, Mycobacterium
AALQ

SEQ ID NO: 957795 - protein, 10 aa, Mycobacterium
AALSGGERQR

SEQ ID NO: 957796 - protein, 6 aa, Mycobacterium
AALTGA

SEQ ID NO: 957797 - protein, 15 aa, Mycobacterium
AALTGDATLTRAPDT

SEQ ID NO: 957798 - protein, 7 aa, Mycobacterium
AALTGSP

SEQ ID NO: 957799 - protein, 9 aa, Mycobacterium
AANANGNVE

SEQ ID NO: 957800 - protein, 7 aa, Mycobacterium
AANGATA

SEQ ID NO: 957801 - protein, 10 aa, Mycobacterium
AANPAAAKRI

SEQ ID NO: 957802 - protein, 9 aa, Mycobacterium
AANPSTGSF

SEQ ID NO: 957803 - protein, 11 aa, Mycobacterium
AANRGRRRSSA

SEQ ID NO: 957804 - protein, 7 aa, Mycobacterium
AANRPSD

SEQ ID NO: 957805 - protein, 9 aa, Mycobacterium
AANTATVAR

SEQ ID NO: 957806 - protein, 16 aa, Mycobacterium
AAPANGALPPPAVPRR

SEQ ID NO: 957807 - protein, 7 aa, Mycobacterium
AAPAPVA

SEQ ID NO: 957808 - protein, 6 aa, Mycobacterium
AAPDAI

SEQ ID NO: 957809 - protein, 17 aa, Mycobacterium
AAPDPPANARPKPKHMS

SEQ ID NO: 957810 - protein, 4 aa, Mycobacterium
AAPG

SEQ ID NO: 957811 - protein, 17 aa, Mycobacterium
AAPGGGSPSAAPKLSDL

SEQ ID NO: 957812 - protein, 5 aa, Mycobacterium
AAPIQ

SEQ ID NO: 957813 - protein, 15 aa, Mycobacterium
AAPLPQGALGRTGKL

SEQ ID NO: 957814 - protein, 7 aa, Mycobacterium
AAPNPRT

SEQ ID NO: 957815 - protein, 7 aa, Mycobacterium
AAPPALS

SEQ ID NO: 957816 - protein, 5 aa, Mycobacterium
AAPPL

SEQ ID NO: 957817 - protein, 41 aa, Mycobacterium
AAPPPQAPPAPLTPPTPPVPPTPPQPPKQTSDTSPSGPGPH

SEQ ID NO: 957818 - protein, 8 aa, Mycobacterium
AAPQTTRA

SEQ ID NO: 957819 - protein, 5 aa, Mycobacterium
AAPRT

SEQ ID NO: 957820 - protein, 5 aa, Mycobacterium
AAPSM

SEQ ID NO: 957821 - protein, 19 aa, Mycobacterium
AAPSSFGGNVGPVGSVQER

SEQ ID NO: 957822 - protein, 6 aa, Mycobacterium
AAPSYE

SEQ ID NO: 957823 - protein, 4 aa, Mycobacterium
AAPT

SEQ ID NO: 957824 - protein, 8 aa, Mycobacterium
AAPTTGYT

SEQ ID NO: 957825 - protein, 16 aa, Mycobacterium
AAQARAESVQAATAGT

SEQ ID NO: 957826 - protein, 16 aa, Mycobacterium
AAQHRATAQGYAADGN

SEQ ID NO: 957827 - protein, 6 aa, Mycobacterium
AAQSLG

SEQ ID NO: 957828 - protein, 14 aa, Mycobacterium
AAQTGGAPLSGASA

SEQ ID NO: 957829 - protein, 40 aa, Mycobacterium
AAQTKTAVAAGSGGLDSFTPQASAVPGSDAEREAQRAGVA

SEQ ID NO: 957830 - protein, 9 aa, Mycobacterium
AARAQAAER

SEQ ID NO: 957831 - protein, 16 aa, Mycobacterium
AARAQSGAAAAGGSDP

SEQ ID NO: 957832 - protein, 11 aa, Mycobacterium
AARARARAAQL

SEQ ID NO: 957833 - protein, 6 aa, Mycobacterium
AAREGT

SEQ ID NO: 957834 - protein, 8 aa, Mycobacterium
AARGGERG

SEQ ID NO: 957835 - protein, 7 aa, Mycobacterium
AARHGAK

SEQ ID NO: 957836 - protein, 10 aa, Mycobacterium
AARHPSPNAG

SEQ ID NO: 957837 - protein, 4 aa, Mycobacterium
AARL

SEQ ID NO: 957838 - protein, 4 aa, Mycobacterium
AARP

SEQ ID NO: 957839 - protein, 6 aa, Mycobacterium
AARPAA

SEQ ID NO: 957840 - protein, 6 aa, Mycobacterium
AARPGL

SEQ ID NO: 957841 - protein, 5 aa, Mycobacterium
AARPL

SEQ ID NO: 957842 - protein, 4 aa, Mycobacterium
AARR

SEQ ID NO: 957843 - protein, 7 aa, Mycobacterium
AARRDPA

SEQ ID NO: 957844 - protein, 6 aa, Mycobacterium
AARRSA

SEQ ID NO: 957845 - protein, 8 aa, Mycobacterium
AARTAGAD

SEQ ID NO: 957846 - protein, 9 aa, Mycobacterium
AARTATDSA

SEQ ID NO: 957847 - protein, 8 aa, Mycobacterium
AARTDGAN

SEQ ID NO: 957848 - protein, 4 aa, Mycobacterium
AARV

SEQ ID NO: 957849 - protein, 5 aa, Mycobacterium
AARVS

SEQ ID NO: 957850 - protein, 10 aa, Mycobacterium
AASAGDSTNI

SEQ ID NO: 957851 - protein, 25 aa, Mycobacterium
AASAGLGAVPSTLNPPLAAAPGDKA

SEQ ID NO: 957852 - protein, 6 aa, Mycobacterium
AASDHL

SEQ ID NO: 957853 - protein, 10 aa, Mycobacterium
AASDSGTGAR

SEQ ID NO: 957854 - protein, 4 aa, Mycobacterium
AASG

SEQ ID NO: 957855 - protein, 26 aa, Mycobacterium
AASGTAFTAEAAGSLGRASGAADESA

SEQ ID NO: 957856 - protein, 9 aa, Mycobacterium
AASLATAGE

SEQ ID NO: 957857 - protein, 4 aa, Mycobacterium
AASP

SEQ ID NO: 957858 - protein, 31 aa, Mycobacterium; identical to SEQ ID NO: 243632

SEQ ID NO: 957859 - protein, 5 aa, Mycobacterium
AASQR

SEQ ID NO: 957860 - protein, 6 aa, Mycobacterium
AASRAQ

SEQ ID NO: 957861 - protein, 10 aa, Mycobacterium
AASSANSGVF

SEQ ID NO: 957862 - protein, 7 aa, Mycobacterium
AASSGAD

SEQ ID NO: 957863 - protein, 6 aa, Mycobacterium
AASSIA

SEQ ID NO: 957864 - protein, 4 aa, Mycobacterium
AATA

SEQ ID NO: 957865 - protein, 5 aa, Mycobacterium
AATAA

SEQ ID NO: 957866 - protein, 9 aa, Mycobacterium
AATAGTVGG

SEQ ID NO: 957867 - protein, 104 aa, Mycobacterium; identical to SEQ ID NO: 243683

SEQ ID NO: 957868 - protein, 5 aa, Mycobacterium
AATAS

SEQ ID NO: 957869 - protein, 9 aa, Mycobacterium
AATASSALA

SEQ ID NO: 957870 - protein, 5 aa, Mycobacterium
AATAT

SEQ ID NO: 957871 - protein, 11 aa, Mycobacterium
AATDQGGGAQH

SEQ ID NO: 957872 - protein, 8 aa, Mycobacterium
AATDSLQG

SEQ ID NO: 957873 - protein, 14 aa, Mycobacterium
AATGGAPNRERGHR

SEQ ID NO: 957874 - protein, 7 aa, Mycobacterium
AATGRIG

SEQ ID NO: 957875 - protein, 7 aa, Mycobacterium
AATKEGV

SEQ ID NO: 957876 - protein, 9 aa, Mycobacterium
AATNNRNGA

SEQ ID NO: 957877 - protein, 6 aa, Mycobacterium
AATPTT

SEQ ID NO: 957878 - protein, 10 aa, Mycobacterium
AATQAAPAPM

SEQ ID NO: 957879 - protein, 16 aa, Mycobacterium
AATSGAAVVIETMLHA

SEQ ID NO: 957880 - protein, 16 aa, Mycobacterium
AATSQTTTSTTEPGAT

SEQ ID NO: 957881 - protein, 5 aa, Mycobacterium
AATSR

SEQ ID NO: 957882 - protein, 9 aa, Mycobacterium
AATTASARE

SEQ ID NO: 957883 - protein, 10 aa, Mycobacterium
AATTTPAGVG

SEQ ID NO: 957884 - protein, 12 aa, Mycobacterium
AATYKDISEGST

SEQ ID NO: 957885 - protein, 7 aa, Mycobacterium
AAVATSA

SEQ ID NO: 957886 - protein, 30 aa, Mycobacterium
AAVPAPVPALPAPASGIQPGPAAAAAPGVS

SEQ ID NO: 957887 - protein, 17 aa, Mycobacterium
AAVPGSRRQWERDPHDP

SEQ ID NO: 957888 - protein, 7 aa, Mycobacterium
AAVPPDA

SEQ ID NO: 957889 - protein, 11 aa, Mycobacterium
AAVTGAHSPLS

SEQ ID NO: 957890 - protein, 9 aa, Mycobacterium
ACGKAGCQT

SEQ ID NO: 957891 - protein, 7 aa, Mycobacterium
ACGKSSA

SEQ ID NO: 957892 - protein, 5 aa, Mycobacterium
ACPTN

SEQ ID NO: 957893 - protein, 14 aa, Mycobacterium
ACTPPARRAVTARG

SEQ ID NO: 957894 - protein, 4 aa, Mycobacterium
ADAA

SEQ ID NO: 957895 - protein, 8 aa, Mycobacterium
ADAAPPSG

SEQ ID NO: 957896 - protein, 10 aa, Mycobacterium
ADAARSGVPV

SEQ ID NO: 957897 - protein, 6 aa, Mycobacterium
ADAATT

SEQ ID NO: 957898 - protein, 6 aa, Mycobacterium
ADAGQP

SEQ ID NO: 957899 - protein, 18 aa, Mycobacterium
ADAPSQAPDDARAMIDSM

SEQ ID NO: 957900 - protein, 7 aa, Mycobacterium
ADAPVQS

SEQ ID NO: 957901 - protein, 7 aa, Mycobacterium
ADASPDG

SEQ ID NO: 957902 - protein, 6 aa, Mycobacterium
ADATGE

SEQ ID NO: 957903 - protein, 7 aa, Mycobacterium
ADATGES

SEQ ID NO: 957904 - protein, 14 aa, Mycobacterium
ADATGPSDHSPKPD

SEQ ID NO: 957905 - protein, 7 aa, Mycobacterium
ADCPQTR

SEQ ID NO: 957906 - protein, 10 aa, Mycobacterium
ADDDFSTTER

SEQ ID NO: 957907 - protein, 15 aa, Mycobacterium
ADDDVQTDRLRRAPA

SEQ ID NO: 957908 - protein, 5 aa, Mycobacterium
ADDGR

SEQ ID NO: 957909 - protein, 7 aa, Mycobacterium
ADDIGRR

SEQ ID NO: 957910 - protein, 9 aa, Mycobacterium
ADDPEGAQA

SEQ ID NO: 957911 - protein, 4 aa, Mycobacterium
ADDS

SEQ ID NO: 957912 - protein, 10 aa, Mycobacterium
ADDSPTGEMP

SEQ ID NO: 957913 - protein, 6 aa, Mycobacterium
ADEDTV

SEQ ID NO: 957914 - protein, 19 aa, Mycobacterium
ADEPVQEPPKKASRAGRDL

SEQ ID NO: 957915 - protein, 9 aa, Mycobacterium
ADEQPSHST

SEQ ID NO: 957916 - protein, 4 aa, Mycobacterium
ADES

SEQ ID NO: 957917 - protein, 7 aa, Mycobacterium
ADESSAA

SEQ ID NO: 957918 - protein, 8 aa, Mycobacterium
ADETDGPV

SEQ ID NO: 957919 - protein, 6 aa, Mycobacterium
ADEVSA

SEQ ID NO: 957920 - protein, 7 aa, Mycobacterium
ADEYPGV

SEQ ID NO: 957921 - protein, 4 aa, Mycobacterium
ADFA

SEQ ID NO: 957922 - protein, 6 aa, Mycobacterium
ADFSGT

SEQ ID NO: 957923 - protein, 19 aa, Mycobacterium
ADGAPGAGVVTGQAGSVGK

SEQ ID NO: 957924 - protein, 6 aa, Mycobacterium
ADGDED

SEQ ID NO: 957925 - protein, 4 aa, Mycobacterium
ADGE

SEQ ID NO: 957926 - protein, 5 aa, Mycobacterium
ADGEK

SEQ ID NO: 957927 - protein, 15 aa, Mycobacterium
ADGKPVDFENPPDDA

SEQ ID NO: 957928 - protein, 14 aa, Mycobacterium
ADGKTDASDEAPEV

SEQ ID NO: 957929 - protein, 5 aa, Mycobacterium
ADGPA

SEQ ID NO: 957930 - protein, 15 aa, Mycobacterium
ADGQATVQEREAGAP

SEQ ID NO: 957931 - protein, 6 aa, Mycobacterium
ADGRGI

SEQ ID NO: 957932 - protein, 8 aa, Mycobacterium
ADGSGGMG

SEQ ID NO: 957933 - protein, 5 aa, Mycobacterium
ADGTA

SEQ ID NO: 957934 - protein, 6 aa, Mycobacterium
ADGTRH

SEQ ID NO: 957935 - protein, 7 aa, Mycobacterium
ADGVEDA

SEQ ID NO: 957936 - protein, 12 aa, Mycobacterium
ADGWRDTESERG

SEQ ID NO: 957937 - protein, 6 aa, Mycobacterium
ADHPEW

SEQ ID NO: 957938 - protein, 5 aa, Mycobacterium
ADHPG

SEQ ID NO: 957939 - protein, 6 aa, Mycobacterium
ADIGKG

SEQ ID NO: 957940 - protein, 4 aa, Mycobacterium
ADIN

SEQ ID NO: 957941 - protein, 7 aa, Mycobacterium
ADIYSQP

SEQ ID NO: 957942 - protein, 7 aa, Mycobacterium
ADKVNTV

SEQ ID NO: 957943 - protein, 6 aa, Mycobacterium
ADLAKA

SEQ ID NO: 957944 - protein, 8 aa, Mycobacterium
ADLEERGR

SEQ ID NO: 957945 - protein, 8 aa, Mycobacterium
ADLNGQPA

SEQ ID NO: 957946 - protein, 5 aa, Mycobacterium
ADLRV

SEQ ID NO: 957947 - protein, 10 aa, Mycobacterium
ADLSGAGTAF

SEQ ID NO: 957948 - protein, 8 aa, Mycobacterium
ADMSGREA

SEQ ID NO: 957949 - protein, 6 aa, Mycobacterium
ADNADT

SEQ ID NO: 957950 - protein, 6 aa, Mycobacterium
ADNIAE

SEQ ID NO: 957951 - protein, 8 aa, Mycobacterium
ADNRDEYD

SEQ ID NO: 957952 - protein, 4 aa, Mycobacterium
ADPA

SEQ ID NO: 957953 - protein, 8 aa, Mycobacterium
ADPANRGA

SEQ ID NO: 957954 - protein, 10 aa, Mycobacterium
ADPASEDAAL

SEQ ID NO: 957955 - protein, 4 aa, Mycobacterium
ADPD

SEQ ID NO: 957956 - protein, 7 aa, Mycobacterium
ADPDGPW

SEQ ID NO: 957957 - protein, 8 aa, Mycobacterium
ADPDGTGY

SEQ ID NO: 957958 - protein, 8 aa, Mycobacterium
ADPDRKTW

SEQ ID NO: 957959 - protein, 10 aa, Mycobacterium
ADPDTKNESI

SEQ ID NO: 957960 - protein, 7 aa, Mycobacterium
ADPEALA

SEQ ID NO: 957961 - protein, 11 aa, Mycobacterium
ADPGGSGGRRY

SEQ ID NO: 957962 - protein, 7 aa, Mycobacterium
ADPGTAL

SEQ ID NO: 957963 - protein, 7 aa, Mycobacterium
ADPKNRV

SEQ ID NO: 957964 - protein, 8 aa, Mycobacterium
ADPPPAGS

SEQ ID NO: 957965 - protein, 9 aa, Mycobacterium
ADPQAAHQS

SEQ ID NO: 957966 - protein, 105 aa, Mycobacterium
ADPQDGDQSTPGYPPPPNYGTPPPPPPPGYGAPPAGPPGYGAPPPPPGYGTPPPPPPPGYGQAPGGYAPPGYNPPPPPPPGYGPPPAGYSTQPGFGGPAKPPFSV

SEQ ID NO: 957967 - protein, 8 aa, Mycobacterium
ADPQSNPV

SEQ ID NO: 957968 - protein, 8 aa, Mycobacterium
ADPQSSVP

SEQ ID NO: 957969 - protein, 5 aa, Mycobacterium
ADPRG

SEQ ID NO: 957970 - protein, 4 aa, Mycobacterium
ADPS

SEQ ID NO: 957971 - protein, 4 aa, Mycobacterium
ADPT

SEQ ID NO: 957972 - protein, 6 aa, Mycobacterium
ADPTRV

SEQ ID NO: 957973 - protein, 7 aa, Mycobacterium
ADPTSDI

SEQ ID NO: 957974 - protein, 5 aa, Mycobacterium
ADPVA

SEQ ID NO: 957975 - protein, 12 aa, Mycobacterium
ADPVRSPRGDRG

SEQ ID NO: 957976 - protein, 19 aa, Mycobacterium
ADPVTDPEPSGADAQPERR

SEQ ID NO: 957977 - protein, 10 aa, Mycobacterium
ADQKTISESH

SEQ ID NO: 957978 - protein, 6 aa, Mycobacterium
ADQRAT

SEQ ID NO: 957979 - protein, 8 aa, Mycobacterium
ADRAGSET

SEQ ID NO: 957980 - protein, 19 aa, Mycobacterium
ADRAGTVRFGPSDAYRGKG

SEQ ID NO: 957981 - protein, 4 aa, Mycobacterium
ADRD

SEQ ID NO: 957982 - protein, 6 aa, Mycobacterium
ADRDSG

SEQ ID NO: 957983 - protein, 9 aa, Mycobacterium
ADRITASGL

SEQ ID NO: 957984 - protein, 10 aa, Mycobacterium
ADRPGPGRGT

SEQ ID NO: 957985 - protein, 7 aa, Mycobacterium
ADRPRPV

SEQ ID NO: 957986 - protein, 4 aa, Mycobacterium
ADRY

SEQ ID NO: 957987 - protein, 7 aa, Mycobacterium
ADSGAQR

SEQ ID NO: 957988 - protein, 8 aa, Mycobacterium
ADSGDRKL

SEQ ID NO: 957989 - protein, 8 aa, Mycobacterium
ADSGLAPA

SEQ ID NO: 957990 - protein, 10 aa, Mycobacterium
ADSGNSVTQT

SEQ ID NO: 957991 - protein, 10 aa, Mycobacterium
ADSGQITGTH

SEQ ID NO: 957992 - protein, 5 aa, Mycobacterium
ADSPT

SEQ ID NO: 957993 - protein, 6 aa, Mycobacterium
ADSSLA

SEQ ID NO: 957994 - protein, 23 aa, Mycobacterium
ADTAGSPATASARGWSTSTASGI

SEQ ID NO: 957995 - protein, 4 aa, Mycobacterium
ADTP

SEQ ID NO: 957996 - protein, 12 aa, Mycobacterium
ADTQTSSGSPTA

SEQ ID NO: 957997 - protein, 13 aa, Mycobacterium
ADTTETAKPFRPV

SEQ ID NO: 957998 - protein, 15 aa, Mycobacterium
ADTVRAGRLDERRRR

SEQ ID NO: 957999 - protein, 5 aa, Mycobacterium
ADVEE

SEQ ID NO: 958000 - protein, 9 aa, Mycobacterium
ADVPPRDAA

SEQ ID NO: 958001 - protein, 4 aa, Mycobacterium
ADVT

SEQ ID NO: 958002 - protein, 8 aa, Mycobacterium
AEAAASRA

SEQ ID NO: 958003 - protein, 10 aa, Mycobacterium
AEAADTGRTL

SEQ ID NO: 958004 - protein, 6 aa, Mycobacterium
AEAARG

SEQ ID NO: 958005 - protein, 10 aa, Mycobacterium
AEAATANAAT

SEQ ID NO: 958006 - protein, 5 aa, Mycobacterium
AEAEA

SEQ ID NO: 958007 - protein, 6 aa, Mycobacterium
AEAEAM

SEQ ID NO: 958008 - protein, 9 aa, Mycobacterium
AEAEGPSTA

SEQ ID NO: 958009 - protein, 4 aa, Mycobacterium
AEAG

SEQ ID NO: 958010 - protein, 10 aa, Mycobacterium
AEAGERTQVT

SEQ ID NO: 958011 - protein, 12 aa, Mycobacterium
AEAGGGAPDQGP

SEQ ID NO: 958012 - protein, 6 aa, Mycobacterium
AEAKTN

SEQ ID NO: 958013 - protein, 7 aa, Mycobacterium
AEAMRRR

SEQ ID NO: 958014 - protein, 15 aa, Mycobacterium
AEASLAGAQINSNAP

SEQ ID NO: 958015 - protein, 4 aa, Mycobacterium
AEAT

SEQ ID NO: 958016 - protein, 7 aa, Mycobacterium
AEATATA

SEQ ID NO: 958017 - protein, 7 aa, Mycobacterium
AEAVQAR

SEQ ID NO: 958018 - protein, 9 aa, Mycobacterium
AEDARNPRR

SEQ ID NO: 958019 - protein, 12 aa, Mycobacterium
AEDDAEKQNRTT

SEQ ID NO: 958020 - protein, 20 aa, Mycobacterium
AEDDDEPADGAGARGAQHPG

SEQ ID NO: 958021 - protein, 21 aa, Mycobacterium
AEDEDAESTEAEDEEPNKPLS

SEQ ID NO: 958022 - protein, 16 aa, Mycobacterium
AEDPNGSGDQSDAGRR

SEQ ID NO: 958023 - protein, 5 aa, Mycobacterium
AEDSL

SEQ ID NO: 958024 - protein, 8 aa, Mycobacterium
AEDTTALD

SEQ ID NO: 958025 - protein, 6 aa, Mycobacterium
AEDTVR

SEQ ID NO: 958026 - protein, 9 aa, Mycobacterium
AEDYSDAVD

SEQ ID NO: 958027 - protein, 6 aa, Mycobacterium
AEEASR

SEQ ID NO: 958028 - protein, 5 aa, Mycobacterium
AEEFG

SEQ ID NO: 958029 - protein, 6 aa, Mycobacterium
AEEKIE

SEQ ID NO: 958030 - protein, 5 aa, Mycobacterium
AEEPL

SEQ ID NO: 958031 - protein, 5 aa, Mycobacterium
AEEPS

SEQ ID NO: 958032 - protein, 5 aa, Mycobacterium
AEESV

SEQ ID NO: 958033 - protein, 13 aa, Mycobacterium
AEETADPARNVPR

SEQ ID NO: 958034 - protein, 15 aa, Mycobacterium
AEGDSSVTQSDPADL

SEQ ID NO: 958035 - protein, 15 aa, Mycobacterium
AEGGRATADTAPRRL

SEQ ID NO: 958036 - protein, 8 aa, Mycobacterium
AEGKQRPG

SEQ ID NO: 958037 - protein, 4 aa, Mycobacterium
AEGP

SEQ ID NO: 958038 - protein, 4 aa, Mycobacterium
AEGR

SEQ ID NO: 958039 - protein, 6 aa, Mycobacterium
AEGTKR

SEQ ID NO: 958040 - protein, 15 aa, Mycobacterium
AEHAGDASAPAPAAR

SEQ ID NO: 958041 - protein, 7 aa, Mycobacterium
AEIGQGV

SEQ ID NO: 958042 - protein, 13 aa, Mycobacterium
AEKHEQREATPLV

SEQ ID NO: 958043 - protein, 6 aa, Mycobacterium
AELRRD

SEQ ID NO: 958044 - protein, 10 aa, Mycobacterium
AENAGVKPQT

SEQ ID NO: 958045 - protein, 9 aa, Mycobacterium
AENASATRA

SEQ ID NO: 958046 - protein, 7 aa, Mycobacterium
AENEKTA

SEQ ID NO: 958047 - protein, 11 aa, Mycobacterium
AENSEAEPESI

SEQ ID NO: 958048 - protein, 11 aa, Mycobacterium
AEPAQSRRQPR

SEQ ID NO: 958049 - protein, 7 aa, Mycobacterium
AEPATGT

SEQ ID NO: 958050 - protein, 8 aa, Mycobacterium
AEPDPNAG

SEQ ID NO: 958051 - protein, 20 aa, Mycobacterium
AEPEAKTETIATTESEASTE

SEQ ID NO: 958052 - protein, 6 aa, Mycobacterium
AEPGHV

SEQ ID NO: 958053 - protein, 6 aa, Mycobacterium
AEPGST

SEQ ID NO: 958054 - protein, 15 aa, Mycobacterium
AEPNREHVGPPPRPP

SEQ ID NO: 958055 - protein, 4 aa, Mycobacterium
AEPR

SEQ ID NO: 958056 - protein, 5 aa, Mycobacterium
AEPTG

SEQ ID NO: 958057 - protein, 10 aa, Mycobacterium
AEQDDPDGGA

SEQ ID NO: 958058 - protein, 11 aa, Mycobacterium
AEQNPDSDETK

SEQ ID NO: 958059 - protein, 8 aa, Mycobacterium
AEQRDGGN

SEQ ID NO: 958060 - protein, 6 aa, Mycobacterium
AEQRQR

SEQ ID NO: 958061 - protein, 16 aa, Mycobacterium
AEQTQIKSDNPAFSGK

SEQ ID NO: 958062 - protein, 15 aa, Mycobacterium
AEQTRSIDAGDEAPR

SEQ ID NO: 958063 - protein, 6 aa, Mycobacterium
AERDQA

SEQ ID NO: 958064 - protein, 8 aa, Mycobacterium
AEREDPGG

SEQ ID NO: 958065 - protein, 13 aa, Mycobacterium
AERETGSLSGGEL

SEQ ID NO: 958066 - protein, 5 aa, Mycobacterium
AERGH

SEQ ID NO: 958067 - protein, 4 aa, Mycobacterium
AERS

SEQ ID NO: 958068 - protein, 9 aa, Mycobacterium
AERVARTDD

SEQ ID NO: 958069 - protein, 12 aa, Mycobacterium
AESAEPEGSVSR

SEQ ID NO: 958070 - protein, 7 aa, Mycobacterium
AESEGKF

SEQ ID NO: 958071 - protein, 6 aa, Mycobacterium
AESGAQ

SEQ ID NO: 958072 - protein, 6 aa, Mycobacterium
AESGGL

SEQ ID NO: 958073 - protein, 6 aa, Mycobacterium
AESLGE

SEQ ID NO: 958074 - protein, 7 aa, Mycobacterium
AESQRTT

SEQ ID NO: 958075 - protein, 4 aa, Mycobacterium
AESR

SEQ ID NO: 958076 - protein, 10 aa, Mycobacterium
AESTAGPGAR

SEQ ID NO: 958077 - protein, 8 aa, Mycobacterium
AETARPHY

SEQ ID NO: 958078 - protein, 7 aa, Mycobacterium
AETDDPV

SEQ ID NO: 958079 - protein, 5 aa, Mycobacterium
AETGP

SEQ ID NO: 958080 - protein, 12 aa, Mycobacterium
AETKRRTAEQLG

SEQ ID NO: 958081 - protein, 4 aa, Mycobacterium
AETL

SEQ ID NO: 958082 - protein, 9 aa, Mycobacterium
AETPDPEYA

SEQ ID NO: 958083 - protein, 7 aa, Mycobacterium
AETQDRW

SEQ ID NO: 958084 - protein, 21 aa, Mycobacterium
AETSNTHTDVAGESPEPPQRS

SEQ ID NO: 958085 - protein, 13 aa, Mycobacterium
AETVQASAPDESQ

SEQ ID NO: 958086 - protein, 19 aa, Mycobacterium
AEVAPPDTRTGTSSPGEHV

SEQ ID NO: 958087 - protein, 8 aa, Mycobacterium
AEVGDGPA

SEQ ID NO: 958088 - protein, 6 aa, Mycobacterium
AEVPQR

SEQ ID NO: 958089 - protein, 16 aa, Mycobacterium
AEVPRTAKSAALGRQL

SEQ ID NO: 958090 - protein, 6 aa, Mycobacterium
AEVPSQ

SEQ ID NO: 958091 - protein, 5 aa, Mycobacterium
AEWAT

SEQ ID NO: 958092 - protein, 12 aa, Mycobacterium
AEYGATDAQLQS

SEQ ID NO: 958093 - protein, 4 aa, Mycobacterium
AFEP

SEQ ID NO: 958094 - protein, 14 aa, Mycobacterium
AFPGATPRSSSGNR

SEQ ID NO: 958095 - protein, 10 aa, Mycobacterium
AGAAGAARTA

SEQ ID NO: 958096 - protein, 8 aa, Mycobacterium
AGAAGTVP

SEQ ID NO: 958097 - protein, 8 aa, Mycobacterium
AGAAPTAM

SEQ ID NO: 958098 - protein, 8 aa, Mycobacterium
AGADGANA

SEQ ID NO: 958099 - protein, 14 aa, Mycobacterium
AGADPTLQTADGVT

SEQ ID NO: 958100 - protein, 10 aa, Mycobacterium
AGADQRQVNG

SEQ ID NO: 958101 - protein, 6 aa, Mycobacterium
AGADRA

SEQ ID NO: 958102 - protein, 5 aa, Mycobacterium
AGADS

SEQ ID NO: 958103 - protein, 4 aa, Mycobacterium
AGAE

SEQ ID NO: 958104 - protein, 5 aa, Mycobacterium
AGAEA

SEQ ID NO: 958105 - protein, 5 aa, Mycobacterium
AGAEK

SEQ ID NO: 958106 - protein, 8 aa, Mycobacterium
AGAGAQGP

SEQ ID NO: 958107 - protein, 15 aa, Mycobacterium
AGAGGTPNQPSNGTA

SEQ ID NO: 958108 - protein, 11 aa, Mycobacterium
AGAGSGGEPTI

SEQ ID NO: 958109 - protein, 31 aa, Mycobacterium
AGAKKPGAKKAAAPTGETKPAEAAAPAAPVK

SEQ ID NO: 958110 - protein, 61 aa, Mycobacterium
AGAKPANADKPAGAQDHPGSSAPQAPQPAGQTEGNAPGAPPQGQNPETPTPTAAVQPPPVL

SEQ ID NO: 958111 - protein, 11 aa, Mycobacterium
AGAPPAPERHA

SEQ ID NO: 958112 - protein, 7 aa, Mycobacterium
AGAPPEV

SEQ ID NO: 958113 - protein, 10 aa, Mycobacterium
AGAPSNIGYR

SEQ ID NO: 958114 - protein, 12 aa, Mycobacterium
AGAPTTSPSALT

SEQ ID NO: 958115 - protein, 7 aa, Mycobacterium
AGARPVV

SEQ ID NO: 958116 - protein, 5 aa, Mycobacterium
AGASF

SEQ ID NO: 958117 - protein, 7 aa, Mycobacterium
AGASGSR

SEQ ID NO: 958118 - protein, 7 aa, Mycobacterium
AGATQPV

SEQ ID NO: 958119 - protein, 17 aa, Mycobacterium
AGATTKSALVRRACQFG

SEQ ID NO: 958120 - protein, 8 aa, Mycobacterium
AGAVGGAA

SEQ ID NO: 958121 - protein, 12 aa, Mycobacterium
AGAVKAGRAGAL

SEQ ID NO: 958122 - protein, 11 aa, Mycobacterium
AGDEDGKVTTT

SEQ ID NO: 958123 - protein, 12 aa, Mycobacterium
AGDGSKKDCKQN

SEQ ID NO: 958124 - protein, 6 aa, Mycobacterium
AGDHAS

SEQ ID NO: 958125 - protein, 7 aa, Mycobacterium
AGDPGTI

SEQ ID NO: 958126 - protein, 10 aa, Mycobacterium
AGDTAAPLGP

SEQ ID NO: 958127 - protein, 8 aa, Mycobacterium
AGDTTKAA

SEQ ID NO: 958128 - protein, 5 aa, Mycobacterium
AGEAV

SEQ ID NO: 958129 - protein, 15 aa, Mycobacterium
AGEDHSKTGNAVQSA

SEQ ID NO: 958130 - protein, 14 aa, Mycobacterium
AGEDQQRAANVDGT

SEQ ID NO: 958131 - protein, 6 aa, Mycobacterium
AGEDVD

SEQ ID NO: 958132 - protein, 12 aa, Mycobacterium
AGEEIPQTKEEI

SEQ ID NO: 958133 - protein, 7 aa, Mycobacterium
AGEGVTD

SEQ ID NO: 958134 - protein, 6 aa, Mycobacterium
AGELST

SEQ ID NO: 958135 - protein, 7 aa, Mycobacterium
AGENRSR

SEQ ID NO: 958136 - protein, 7 aa, Mycobacterium
AGEPALA

SEQ ID NO: 958137 - protein, 6 aa, Mycobacterium
AGEPGI

SEQ ID NO: 958138 - protein, 8 aa, Mycobacterium
AGEPHAQA

SEQ ID NO: 958139 - protein, 7 aa, Mycobacterium
AGESHAS

SEQ ID NO: 958140 - protein, 6 aa, Mycobacterium
AGESLQ

SEQ ID NO: 958141 - protein, 14 aa, Mycobacterium
AGESVPERVNDGGF

SEQ ID NO: 958142 - protein, 14 aa, Mycobacterium
AGETTTLTRPDELD

SEQ ID NO: 958143 - protein, 6 aa, Mycobacterium
AGEYTE

SEQ ID NO: 958144 - protein, 11 aa, Mycobacterium
AGFSARDEDRV

SEQ ID NO: 958145 - protein, 7 aa, Mycobacterium
AGGAGRV

SEQ ID NO: 958146 - protein, 47 aa, Mycobacterium
AGGAKRPGAKKSPDQAETPAPTESKSEAKPEPSDHADGNPAPPTAPV

SEQ ID NO: 958147 - protein, 22 aa, Mycobacterium
AGGATGPLGARRGAQYPIGGDG

SEQ ID NO: 958148 - protein, 4 aa, Mycobacterium
AGGE

SEQ ID NO: 958149 - protein, 12 aa, Mycobacterium
AGGERSGWPSTP

SEQ ID NO: 958150 - protein, 9 aa, Mycobacterium
AGGGGSQTD

SEQ ID NO: 958151 - protein, 7 aa, Mycobacterium
AGGGGTL

SEQ ID NO: 958152 - protein, 9 aa, Mycobacterium
AGGGIDPRR

SEQ ID NO: 958153 - protein, 13 aa, Mycobacterium
AGGGPVGEGEAVG

SEQ ID NO: 958154 - protein, 10 aa, Mycobacterium
AGGGTEDAAG

SEQ ID NO: 958155 - protein, 9 aa, Mycobacterium
AGGPDERVR

SEQ ID NO: 958156 - protein, 12 aa, Mycobacterium
AGGPPVLEGPAS

SEQ ID NO: 958157 - protein, 7 aa, Mycobacterium
AGGREVA

SEQ ID NO: 958158 - protein, 7 aa, Mycobacterium
AGGRTYA

SEQ ID NO: 958159 - protein, 17 aa, Mycobacterium
AGGSGGGSKKVPEINAD

SEQ ID NO: 958160 - protein, 9 aa, Mycobacterium
AGGSGKTTA

SEQ ID NO: 958161 - protein, 8 aa, Mycobacterium
AGGSPQHA

SEQ ID NO: 958162 - protein, 5 aa, Mycobacterium
AGGTP

SEQ ID NO: 958163 - protein, 9 aa, Mycobacterium
AGGTSTATT

SEQ ID NO: 958164 - protein, 6 aa, Mycobacterium
AGGTSV

SEQ ID NO: 958165 - protein, 6 aa, Mycobacterium
AGGVGG

SEQ ID NO: 958166 - protein, 15 aa, Mycobacterium
AGHARPCRADGSVGT

SEQ ID NO: 958167 - protein, 4 aa, Mycobacterium
AGHT

SEQ ID NO: 958168 - protein, 7 aa, Mycobacterium
AGKEHKG

SEQ ID NO: 958169 - protein, 6 aa, Mycobacterium
AGKPLT

SEQ ID NO: 958170 - protein, 4 aa, Mycobacterium
AGKS

SEQ ID NO: 958171 - protein, 8 aa, Mycobacterium
AGKTNAEA

SEQ ID NO: 958172 - protein, 16 aa, Mycobacterium
AGKTVTVTNKSKTYRR

SEQ ID NO: 958173 - protein, 11 aa, Mycobacterium
AGLADPQINGK

SEQ ID NO: 958174 - protein, 11 aa, Mycobacterium
AGLAGARASAG

SEQ ID NO: 958175 - protein, 9 aa, Mycobacterium
AGLAPASAE

SEQ ID NO: 958176 - protein, 4 aa, Mycobacterium
AGLD

SEQ ID NO: 958177 - protein, 48 aa, Mycobacterium
AGLDGAPGPTAPSPSDRQRPPPPPPPSPHSNGHTPRYGSDDALTAGNP

SEQ ID NO: 958178 - protein, 15 aa, Mycobacterium
AGLDRPPPGSGNPHE

SEQ ID NO: 958179 - protein, 9 aa, Mycobacterium
AGLPAGSLD

SEQ ID NO: 958180 - protein, 13 aa, Mycobacterium
AGLPGPAGRPVPG

SEQ ID NO: 958181 - protein, 5 aa, Mycobacterium
AGLPP

SEQ ID NO: 958182 - protein, 13 aa, Mycobacterium
AGLTKGGSYATAS

SEQ ID NO: 958183 - protein, 7 aa, Mycobacterium
AGLTKPD

SEQ ID NO: 958184 - protein, 4 aa, Mycobacterium
AGMG

SEQ ID NO: 958185 - protein, 12 aa, Mycobacterium
AGNPGADQDQLG

SEQ ID NO: 958186 - protein, 13 aa, Mycobacterium
AGNQGESLANESV

SEQ ID NO: 958187 - protein, 21 aa, Mycobacterium
AGNSGAGGSGSGGTCESNPLT

SEQ ID NO: 958188 - protein, 4 aa, Mycobacterium
AGPA

SEQ ID NO: 958189 - protein, 13 aa, Mycobacterium
AGPAEPARSPVAA

SEQ ID NO: 958190 - protein, 19 aa, Mycobacterium
AGPAGTPMAASPAVSADTT

SEQ ID NO: 958191 - protein, 6 aa, Mycobacterium
AGPARL

SEQ ID NO: 958192 - protein, 14 aa, Mycobacterium
AGPEGVNGEFDTPI

SEQ ID NO: 958193 - protein, 12 aa, Mycobacterium
AGPFPPKRAEEL

SEQ ID NO: 958194 - protein, 6 aa, Mycobacterium
AGPGAN

SEQ ID NO: 958195 - protein, 14 aa, Mycobacterium
AGPHAGDKSPSRTV

SEQ ID NO: 958196 - protein, 6 aa, Mycobacterium
AGPIRD

SEQ ID NO: 958197 - protein, 6 aa, Mycobacterium
AGPKRL

SEQ ID NO: 958198 - protein, 9 aa, Mycobacterium
AGPRAESRG

SEQ ID NO: 958199 - protein, 5 aa, Mycobacterium
AGPRR

SEQ ID NO: 958200 - protein, 5 aa, Mycobacterium
AGPSD

SEQ ID NO: 958201 - protein, 12 aa, Mycobacterium
AGPSTMPQSPHG

SEQ ID NO: 958202 - protein, 7 aa, Mycobacterium
AGPTGGP

SEQ ID NO: 958203 - protein, 6 aa, Mycobacterium
AGPVDA

SEQ ID NO: 958204 - protein, 10 aa, Mycobacterium
AGQAGQPGAA

SEQ ID NO: 958205 - protein, 5 aa, Mycobacterium
AGQGV

SEQ ID NO: 958206 - protein, 14 aa, Mycobacterium
AGQPGNDGFSGVAP

SEQ ID NO: 958207 - protein, 7 aa, Mycobacterium
AGQSHAQ

SEQ ID NO: 958208 - protein, 6 aa, Mycobacterium
AGQSYF

SEQ ID NO: 958209 - protein, 5 aa, Mycobacterium
AGQTL

SEQ ID NO: 958210 - protein, 9 aa, Mycobacterium
AGQTRKPQM

SEQ ID NO: 958211 - protein, 10 aa, Mycobacterium
AGRAADDPVL

SEQ ID NO: 958212 - protein, 9 aa, Mycobacterium
AGRAARQGR

SEQ ID NO: 958213 - protein, 8 aa, Mycobacterium
AGRAPVGT

SEQ ID NO: 958214 - protein, 7 aa, Mycobacterium
AGRGEPD

SEQ ID NO: 958215 - protein, 9 aa, Mycobacterium
AGRGREDNS

SEQ ID NO: 958216 - protein, 8 aa, Mycobacterium
AGRNRDDH

SEQ ID NO: 958217 - protein, 6 aa, Mycobacterium
AGRNRL

SEQ ID NO: 958218 - protein, 9 aa, Mycobacterium
AGRNTEDRT

SEQ ID NO: 958219 - protein, 64 aa, Mycobacterium
AGRRPPRPSQSPPAGRAAPAAIPSSAPARIAPAPTTRTTTPRRTRPATGGHRPPPSRRTFSSGQ

SEQ ID NO: 958220 - protein, 9 aa, Mycobacterium
AGRRVQGSA

SEQ ID NO: 958221 - protein, 6 aa, Mycobacterium
AGRSIR

SEQ ID NO: 958222 - protein, 13 aa, Mycobacterium
AGSAENSSNDQPV

SEQ ID NO: 958223 - protein, 5 aa, Mycobacterium
AGSAG

SEQ ID NO: 958224 - protein, 7 aa, Mycobacterium
AGSALDT

SEQ ID NO: 958225 - protein, 16 aa, Mycobacterium
AGSATPASLSDTTALT

SEQ ID NO: 958226 - protein, 21 aa, Mycobacterium
AGSATQGKATGAGLESISGTT

SEQ ID NO: 958227 - protein, 13 aa, Mycobacterium
AGSATSSNGTAAT

SEQ ID NO: 958228 - protein, 8 aa, Mycobacterium
AGSESSAR

SEQ ID NO: 958229 - protein, 6 aa, Mycobacterium
AGSGRE

SEQ ID NO: 958230 - protein, 12 aa, Mycobacterium
AGSGYDQGSATF

SEQ ID NO: 958231 - protein, 8 aa, Mycobacterium
AGSLAGAV

SEQ ID NO: 958232 - protein, 7 aa, Mycobacterium
AGSNNQV

SEQ ID NO: 958233 - protein, 9 aa, Mycobacterium
AGSPDRPTF

SEQ ID NO: 958234 - protein, 5 aa, Mycobacterium
AGSQS

SEQ ID NO: 958235 - protein, 10 aa, Mycobacterium
AGSRLGYQES

SEQ ID NO: 958236 - protein, 8 aa, Mycobacterium
AGSSATAA

SEQ ID NO: 958237 - protein, 6 aa, Mycobacterium
AGSSAV

SEQ ID NO: 958238 - protein, 4 aa, Mycobacterium
AGST

SEQ ID NO: 958239 - protein, 16 aa, Mycobacterium
AGSTAALAAAPRGVPA

SEQ ID NO: 958240 - protein, 8 aa, Mycobacterium
AGSTARTR

SEQ ID NO: 958241 - protein, 13 aa, Mycobacterium
AGSTPSNSALASL

SEQ ID NO: 958242 - protein, 13 aa, Mycobacterium
AGSTQARESLQAA

SEQ ID NO: 958243 - protein, 6 aa, Mycobacterium
AGSTVN

SEQ ID NO: 958244 - protein, 4 aa, Mycobacterium
AGSV

SEQ ID NO: 958245 - protein, 5 aa, Mycobacterium
AGSWQ

SEQ ID NO: 958246 - protein, 5 aa, Mycobacterium
AGSYR

SEQ ID NO: 958247 - protein, 6 aa, Mycobacterium
AGTAGE

SEQ ID NO: 958248 - protein, 14 aa, Mycobacterium
AGTAGTASGSRLAR

SEQ ID NO: 958249 - protein, 11 aa, Mycobacterium
AGTAPQQSIAQ

SEQ ID NO: 958250 - protein, 13 aa, Mycobacterium
AGTASDLDDQYQA

SEQ ID NO: 958251 - protein, 11 aa, Mycobacterium
AGTDDGSPGVQ

SEQ ID NO: 958252 - protein, 8 aa, Mycobacterium
AGTDPAIG

SEQ ID NO: 958253 - protein, 5 aa, Mycobacterium
AGTDR

SEQ ID NO: 958254 - protein, 11 aa, Mycobacterium
AGTEKIRSGDY

SEQ ID NO: 958255 - protein, 11 aa, Mycobacterium
AGTEKISGGDY

SEQ ID NO: 958256 - protein, 4 aa, Mycobacterium
AGTG

SEQ ID NO: 958257 - protein, 8 aa, Mycobacterium
AGTKRKPV

SEQ ID NO: 958258 - protein, 8 aa, Mycobacterium
AGTPLGGP

SEQ ID NO: 958259 - protein, 8 aa, Mycobacterium
AGTQAPGI

SEQ ID NO: 958260 - protein, 5 aa, Mycobacterium
AGTQD

SEQ ID NO: 958261 - protein, 6 aa, Mycobacterium
AGTSDV

SEQ ID NO: 958262 - protein, 7 aa, Mycobacterium
AGTSNQS

SEQ ID NO: 958263 - protein, 4 aa, Mycobacterium
AGTT

SEQ ID NO: 958264 - protein, 8 aa, Mycobacterium
AGVGGGNF

SEQ ID NO: 958265 - protein, 6 aa, Mycobacterium
AGVGQA

SEQ ID NO: 958266 - protein, 4 aa, Mycobacterium
AGVP

SEQ ID NO: 958267 - protein, 11 aa, Mycobacterium
AGVQSGDDKAA

SEQ ID NO: 958268 - protein, 14 aa, Mycobacterium
AGVTVTSDQGQAEA

SEQ ID NO: 958269 - protein, 4 aa, Mycobacterium
AGWP

SEQ ID NO: 958270 - protein, 5 aa, Mycobacterium
AGYGP

SEQ ID NO: 958271 - protein, 5 aa, Mycobacterium
AGYSS

SEQ ID NO: 958272 - protein, 18 aa, Mycobacterium
AHAPAAAAAGPSAGARPT

SEQ ID NO: 958273 - protein, 6 aa, Mycobacterium
AHAPRY

SEQ ID NO: 958274 - protein, 7 aa, Mycobacterium
AHDETNT

SEQ ID NO: 958275 - protein, 6 aa, Mycobacterium
AHDGGA

SEQ ID NO: 958276 - protein, 8 aa, Mycobacterium
AHEATGGE

SEQ ID NO: 958277 - protein, 11 aa, Mycobacterium
AHGGPAGVGEA

SEQ ID NO: 958278 - protein, 10 aa, Mycobacterium
AHGGPGGAPG

SEQ ID NO: 958279 - protein, 8 aa, Mycobacterium
AHGKTREA

SEQ ID NO: 958280 - protein, 8 aa, Mycobacterium
AHGSGTAL

SEQ ID NO: 958281 - protein, 11 aa, Mycobacterium
AHNGARDPSNV

SEQ ID NO: 958282 - protein, 9 aa, Mycobacterium
AHPAASPAE

SEQ ID NO: 958283 - protein, 10 aa, Mycobacterium
AHPESPSPVS

SEQ ID NO: 958284 - protein, 19 aa, Mycobacterium
AHPPQSRGVPALTDAAANQ

SEQ ID NO: 958285 - protein, 7 aa, Mycobacterium
AHPRPEE

SEQ ID NO: 958286 - protein, 5 aa, Mycobacterium
AHQAG

SEQ ID NO: 958287 - protein, 12 aa, Mycobacterium
AHQASPTTTGDS

SEQ ID NO: 958288 - protein, 5 aa, Mycobacterium
AHQSG

SEQ ID NO: 958289 - protein, 5 aa, Mycobacterium
AHSPE

SEQ ID NO: 958290 - protein, 5 aa, Mycobacterium
AHTGD

SEQ ID NO: 958291 - protein, 8 aa, Mycobacterium
AHTSPPKR

SEQ ID NO: 958292 - protein, 13 aa, Mycobacterium
AIADGDDPQRRLP

SEQ ID NO: 958293 - protein, 12 aa, Mycobacterium
AIAGARARGDNT

SEQ ID NO: 958294 - protein, 6 aa, Mycobacterium
AIDDGT

SEQ ID NO: 958295 - protein, 4 aa, Mycobacterium
AIEP

SEQ ID NO: 958296 - protein, 19 aa, Mycobacterium
AINQDGASNGLTAPNGLTQ

SEQ ID NO: 958297 - protein, 7 aa, Mycobacterium
AIPDSAT

SEQ ID NO: 958298 - protein, 6 aa, Mycobacterium
AITGEN

SEQ ID NO: 958299 - protein, 8 aa, Mycobacterium
AKAARRRG

SEQ ID NO: 958300 - protein, 9 aa, Mycobacterium
AKADLPSGA

SEQ ID NO: 958301 - protein, 8 aa, Mycobacterium
AKAQSTAG

SEQ ID NO: 958302 - protein, 6 aa, Mycobacterium
AKARVR

SEQ ID NO: 958303 - protein, 10 aa, Mycobacterium
AKDNPAMTHG

SEQ ID NO: 958304 - protein, 9 aa, Mycobacterium
AKDPADRYA

SEQ ID NO: 958305 - protein, 8 aa, Mycobacterium
AKDTAAGP

SEQ ID NO: 958306 - protein, 5 aa, Mycobacterium
AKEDV

SEQ ID NO: 958307 - protein, 11 aa, Mycobacterium
AKEEPEGPTKP

SEQ ID NO: 958308 - protein, 8 aa, Mycobacterium
AKEPQPVA

SEQ ID NO: 958309 - protein, 10 aa, Mycobacterium
AKGGDAQSCG

SEQ ID NO: 958310 - protein, 13 aa, Mycobacterium
AKGGPGGKPGCGS

SEQ ID NO: 958311 - protein, 17 aa, Mycobacterium
AKGKESRGTGNAAATVT

SEQ ID NO: 958312 - protein, 8 aa, Mycobacterium
AKGLSNKE

SEQ ID NO: 958313 - protein, 6 aa, Mycobacterium
AKGLTR

SEQ ID NO: 958314 - protein, 28 aa, Mycobacterium
AKGPSVTDRPSDSTASSSSASDIDLPRP

SEQ ID NO: 958315 - protein, 11 aa, Mycobacterium
AKHHQAPGQPH

SEQ ID NO: 958316 - protein, 9 aa, Mycobacterium
AKKAPLRQT

SEQ ID NO: 958317 - protein, 17 aa, Mycobacterium
AKKPEERYASAGDLARA

SEQ ID NO: 958318 - protein, 6 aa, Mycobacterium
AKNADL

SEQ ID NO: 958319 - protein, 8 aa, Mycobacterium
AKNAKVST

SEQ ID NO: 958320 - protein, 32 aa, Mycobacterium; identical to SEQ ID NO: 246618

SEQ ID NO: 958321 - protein, 9 aa, Mycobacterium
AKNDNSASY

SEQ ID NO: 958322 - protein, 11 aa, Mycobacterium
AKNPDNRYQTA

SEQ ID NO: 958323 - protein, 13 aa, Mycobacterium
AKPAAAESRDADN

SEQ ID NO: 958324 - protein, 16 aa, Mycobacterium
AKPGGGPGGGLSPKTT

SEQ ID NO: 958325 - protein, 6 aa, Mycobacterium
AKPGNW

SEQ ID NO: 958326 - protein, 8 aa, Mycobacterium
AKPGPGPL

SEQ ID NO: 958327 - protein, 15 aa, Mycobacterium
AKPKNNKDTGPQLDS

SEQ ID NO: 958328 - protein, 13 aa, Mycobacterium
AKPKPAIDAGRST

SEQ ID NO: 958329 - protein, 4 aa, Mycobacterium
AKPY

SEQ ID NO: 958330 - protein, 5 aa, Mycobacterium
AKQNS

SEQ ID NO: 958331 - protein, 9 aa, Mycobacterium
AKQPGDRYV

SEQ ID NO: 958332 - protein, 7 aa, Mycobacterium
AKQPNER

SEQ ID NO: 958333 - protein, 8 aa, Mycobacterium
AKRDRAAL

SEQ ID NO: 958334 - protein, 7 aa, Mycobacterium
AKREKQK

SEQ ID NO: 958335 - protein, 4 aa, Mycobacterium
AKRI

SEQ ID NO: 958336 - protein, 5 aa, Mycobacterium
AKRPD

SEQ ID NO: 958337 - protein, 13 aa, Mycobacterium
AKRPEDRFASAGE

SEQ ID NO: 958338 - protein, 6 aa, Mycobacterium
AKSANL

SEQ ID NO: 958339 - protein, 5 aa, Mycobacterium
AKSGL

SEQ ID NO: 958340 - protein, 6 aa, Mycobacterium
AKSNEQ

SEQ ID NO: 958341 - protein, 10 aa, Mycobacterium
AKSPGKLGQV

SEQ ID NO: 958342 - protein, 8 aa, Mycobacterium
AKSPGTHT

SEQ ID NO: 958343 - protein, 8 aa, Mycobacterium
AKSQNALG

SEQ ID NO: 958344 - protein, 5 aa, Mycobacterium
AKTDP

SEQ ID NO: 958345 - protein, 7 aa, Mycobacterium
AKVPQRA

SEQ ID NO: 958346 - protein, 4 aa, Mycobacterium
ALAA

SEQ ID NO: 958347 - protein, 41 aa, Mycobacterium
ALAAEKDATQLDEPDDPWRDPAAAATLASPAVASPVPHTEL

SEQ ID NO: 958348 - protein, 9 aa, Mycobacterium
ALADPSYQQ

SEQ ID NO: 958349 - protein, 7 aa, Mycobacterium
ALAPNGV

SEQ ID NO: 958350 - protein, 16 aa, Mycobacterium
ALAPPPTRARGRRSPP

SEQ ID NO: 958351 - protein, 11 aa, Mycobacterium
ALARSTPPGRV

SEQ ID NO: 958352 - protein, 15 aa, Mycobacterium
ALATAGARRRAEREK

SEQ ID NO: 958353 - protein, 12 aa, Mycobacterium
ALATPDQDRATD

SEQ ID NO: 958354 - protein, 32 aa, Mycobacterium
ALDAEKDGGQADEADDPWRDPGAAAALGTPAV

SEQ ID NO: 958355 - protein, 6 aa, Mycobacterium
ALEDPT

SEQ ID NO: 958356 - protein, 6 aa, Mycobacterium
ALEGAG

SEQ ID NO: 958357 - protein, 45 aa, Mycobacterium
ALEPARPSGTAPSAQAQPHPSEAGVSTASLGAADQPGAGKARHTK

SEQ ID NO: 958358 - protein, 4 aa, Mycobacterium
ALET

SEQ ID NO: 958359 - protein, 4 aa, Mycobacterium
ALGA

SEQ ID NO: 958360 - protein, 6 aa, Mycobacterium
ALGHPG

SEQ ID NO: 958361 - protein, 6 aa, Mycobacterium
ALGPPL

SEQ ID NO: 958362 - protein, 7 aa, Mycobacterium
ALGPSAA

SEQ ID NO: 958363 - protein, 18 aa, Mycobacterium
ALKGTEVESFPKPTEIGG

SEQ ID NO: 958364 - protein, 8 aa, Mycobacterium
ALNGSKNI

SEQ ID NO: 958365 - protein, 7 aa, Mycobacterium
ALPAAAT

SEQ ID NO: 958366 - protein, 10 aa, Mycobacterium
ALPAAGGGYT

SEQ ID NO: 958367 - protein, 17 aa, Mycobacterium
ALPAPEYGDGDRYRAPV

SEQ ID NO: 958368 - protein, 6 aa, Mycobacterium
ALPDGK

SEQ ID NO: 958369 - protein, 16 aa, Mycobacterium
ALPDRRRRIRGRLRGS

SEQ ID NO: 958370 - protein, 14 aa, Mycobacterium
ALPGPFSPSSASVT

SEQ ID NO: 958371 - protein, 5 aa, Mycobacterium
ALPQS

SEQ ID NO: 958372 - protein, 8 aa, Mycobacterium
ALPSPGVD

SEQ ID NO: 958373 - protein, 8 aa, Mycobacterium
ALPSPGVN

SEQ ID NO: 958374 - protein, 5 aa, Mycobacterium
ALRKE

SEQ ID NO: 958375 - protein, 8 aa, Mycobacterium
ALSPQEAA

SEQ ID NO: 958376 - protein, 8 aa, Mycobacterium
ALTGESAA

SEQ ID NO: 958377 - protein, 11 aa, Mycobacterium
ALTSGPSPNSC

SEQ ID NO: 958378 - protein, 6 aa, Mycobacterium
ALYPGD

SEQ ID NO: 958379 - protein, 8 aa, Mycobacterium
AMGSTPTN

SEQ ID NO: 958380 - protein, 5 aa, Mycobacterium
AMGTQ

SEQ ID NO: 958381 - protein, 17 aa, Mycobacterium
AMRERSELARKGIARGK

SEQ ID NO: 958382 - protein, 23 aa, Mycobacterium
AMTGPPSGAGEAQRAPAAVRQRV

SEQ ID NO: 958383 - protein, 8 aa, Mycobacterium
ANAAATAW

SEQ ID NO: 958384 - protein, 7 aa, Mycobacterium
ANAAYSE

SEQ ID NO: 958385 - protein, 13 aa, Mycobacterium
ANADRELESQTEA

SEQ ID NO: 958386 - protein, 8 aa, Mycobacterium
ANAGYAAA

SEQ ID NO: 958387 - protein, 6 aa, Mycobacterium
ANARGE

SEQ ID NO: 958388 - protein, 5 aa, Mycobacterium
ANDGT

SEQ ID NO: 958389 - protein, 8 aa, Mycobacterium
ANDNSASM

SEQ ID NO: 958390 - protein, 11 aa, Mycobacterium
ANDPNQNGGYP

SEQ ID NO: 958391 - protein, 9 aa, Mycobacterium
ANDYPGARA

SEQ ID NO: 958392 - protein, 8 aa, Mycobacterium
ANEKGRAL

SEQ ID NO: 958393 - protein, 5 aa, Mycobacterium
ANGEP

SEQ ID NO: 958394 - protein, 16 aa, Mycobacterium
ANGGGPTVVRNPDGSL

SEQ ID NO: 958395 - protein, 17 aa, Mycobacterium
ANGGSANVSPISSGVPD

SEQ ID NO: 958396 - protein, 9 aa, Mycobacterium
ANGQPVGYG

SEQ ID NO: 958397 - protein, 7 aa, Mycobacterium
ANKATTV

SEQ ID NO: 958398 - protein, 6 aa, Mycobacterium
ANKPFQ

SEQ ID NO: 958399 - protein, 7 aa, Mycobacterium
ANLTGGK

SEQ ID NO: 958400 - protein, 15 aa, Mycobacterium
ANPIASARLSRLNEL

SEQ ID NO: 958401 - protein, 8 aa, Mycobacterium
ANPKGWTH

SEQ ID NO: 958402 - protein, 17 aa, Mycobacterium
ANPVDGGRGEKAPIRSA

SEQ ID NO: 958403 - protein, 8 aa, Mycobacterium
ANQAGGAA

SEQ ID NO: 958404 - protein, 4 aa, Mycobacterium
ANQL

SEQ ID NO: 958405 - protein, 9 aa, Mycobacterium
ANRDPGSPE

SEQ ID NO: 958406 - protein, 4 aa, Mycobacterium
ANRG

SEQ ID NO: 958407 - protein, 14 aa, Mycobacterium
ANRRDFDPDELESD

SEQ ID NO: 958408 - protein, 9 aa, Mycobacterium
ANSKVGERV

SEQ ID NO: 958409 - protein, 8 aa, Mycobacterium
ANSPATRV

SEQ ID NO: 958410 - protein, 18 aa, Mycobacterium
ANSPDEELAGSQDFESEL

SEQ ID NO: 958411 - protein, 7 aa, Mycobacterium
ANSSDDG

SEQ ID NO: 958412 - protein, 6 aa, Mycobacterium
ANSSGL

SEQ ID NO: 958413 - protein, 6 aa, Mycobacterium
ANTAAL

SEQ ID NO: 958414 - protein, 8 aa, Mycobacterium
ANTAEDTV

SEQ ID NO: 958415 - protein, 7 aa, Mycobacterium
ANTGQGD

SEQ ID NO: 958416 - protein, 6 aa, Mycobacterium
ANTHQV

SEQ ID NO: 958417 - protein, 7 aa, Mycobacterium
ANTSSLR

SEQ ID NO: 958418 - protein, 6 aa, Mycobacterium
ANVTGG

SEQ ID NO: 958419 - protein, 7 aa, Mycobacterium
ANWTGSA

SEQ ID NO: 958420 - protein, 9 aa, Mycobacterium
APAANGRPN

SEQ ID NO: 958421 - protein, 8 aa, Mycobacterium
APAAPPVA

SEQ ID NO: 958422 - protein, 9 aa, Mycobacterium
APAASRGAL

SEQ ID NO: 958423 - protein, 17 aa, Mycobacterium
APAATAAQAAELPPDRQ

SEQ ID NO: 958424 - protein, 43 aa, Mycobacterium
APAHAAPAPQPQAPAPQAPAPQAQAPAPQAQVPAPKAPAPVPV

SEQ ID NO: 958425 - protein, 4 aa, Mycobacterium
APAK

SEQ ID NO: 958426 - protein, 10 aa, Mycobacterium
APAPARPRRQ

SEQ ID NO: 958427 - protein, 19 aa, Mycobacterium
APAPEAVPDSESNKGEPSL

SEQ ID NO: 958428 - protein, 11 aa, Mycobacterium
APAPRGRQPAI

SEQ ID NO: 958429 - protein, 15 aa, Mycobacterium
APAQADHNQCAPAGV

SEQ ID NO: 958430 - protein, 16 aa, Mycobacterium
APAQLEAKPAGKAQKV

SEQ ID NO: 958431 - protein, 14 aa, Mycobacterium
APASWGAPEETDTT

SEQ ID NO: 958432 - protein, 17 aa, Mycobacterium
APATADPEHLEPAEGIA

SEQ ID NO: 958433 - protein, 11 aa, Mycobacterium
APATNGGPQVH

SEQ ID NO: 958434 - protein, 8 aa, Mycobacterium
APAVPAGS

SEQ ID NO: 958435 - protein, 4 aa, Mycobacterium
APDG

SEQ ID NO: 958436 - protein, 12 aa, Mycobacterium
APDGKTVNDPAW

SEQ ID NO: 958437 - protein, 7 aa, Mycobacterium
APDGTPL

SEQ ID NO: 958438 - protein, 6 aa, Mycobacterium
APDIAR

SEQ ID NO: 958439 - protein, 8 aa, Mycobacterium
APDSTSPV

SEQ ID NO: 958440 - protein, 15 aa, Mycobacterium
APDYGPFADPSRRTS

SEQ ID NO: 958441 - protein, 8 aa, Mycobacterium
APEASQTG

SEQ ID NO: 958442 - protein, 6 aa, Mycobacterium
APEEPV

SEQ ID NO: 958443 - protein, 9 aa, Mycobacterium
APEKDAERL

SEQ ID NO: 958444 - protein, 10 aa, Mycobacterium
APEPGTTPRT

SEQ ID NO: 958445 - protein, 16 aa, Mycobacterium
APEQLTDEPIDGRADQ

SEQ ID NO: 958446 - protein, 16 aa, Mycobacterium
APEQLTGRPLDGRADQ

SEQ ID NO: 958447 - protein, 10 aa, Mycobacterium
APERRGSTTV

SEQ ID NO: 958448 - protein, 5 aa, Mycobacterium
APESL

SEQ ID NO: 958449 - protein, 9 aa, Mycobacterium
APETAQGKL

SEQ ID NO: 958450 - protein, 9 aa, Mycobacterium
APETKGRQL

SEQ ID NO: 958451 - protein, 5 aa, Mycobacterium
APEVG

SEQ ID NO: 958452 - protein, 8 aa, Mycobacterium
APFEGEQD

SEQ ID NO: 958453 - protein, 6 aa, Mycobacterium
APFQHT

SEQ ID NO: 958454 - protein, 9 aa, Mycobacterium
APGAHPHEA

SEQ ID NO: 958455 - protein, 21 aa, Mycobacterium
APGAPPAASAYPGRDGRRRLR

SEQ ID NO: 958456 - protein, 13 aa, Mycobacterium
APGARCDQSVKPG

SEQ ID NO: 958457 - protein, 17 aa, Mycobacterium
APGATSVPAPPPGQPSA

SEQ ID NO: 958458 - protein, 11 aa, Mycobacterium
APGDPTPSAPS

SEQ ID NO: 958459 - protein, 7 aa, Mycobacterium
APGEQVT

SEQ ID NO: 958460 - protein, 14 aa, Mycobacterium
APGEVSAPQTAGAG

SEQ ID NO: 958461 - protein, 8 aa, Mycobacterium
APGFDAKE

SEQ ID NO: 958462 - protein, 7 aa, Mycobacterium
APGGGKP

SEQ ID NO: 958463 - protein, 12 aa, Mycobacterium
APGHPSHPAASG

SEQ ID NO: 958464 - protein, 7 aa, Mycobacterium
APGHPTE

SEQ ID NO: 958465 - protein, 9 aa, Mycobacterium
APGKTPQAT

SEQ ID NO: 958466 - protein, 4 aa, Mycobacterium
APGL

SEQ ID NO: 958467 - protein, 5 aa, Mycobacterium
APGLP

SEQ ID NO: 958468 - protein, 43 aa, Mycobacterium
APGWPPPSERPQPSGYSPDQPSDTDESSEQQDRDVSRSNPPAH

SEQ ID NO: 958469 - protein, 7 aa, Mycobacterium
APHDQRV

SEQ ID NO: 958470 - protein, 11 aa, Mycobacterium
APHGAPGDATG

SEQ ID NO: 958471 - protein, 8 aa, Mycobacterium
APIKTESR

SEQ ID NO: 958472 - protein, 30 aa, Mycobacterium
APLDDVTSREPVAPGGDDADVPPAAPDEVD

SEQ ID NO: 958473 - protein, 6 aa, Mycobacterium
APLDGG

SEQ ID NO: 958474 - protein, 5 aa, Mycobacterium
APLDP

SEQ ID NO: 958475 - protein, 5 aa, Mycobacterium
APLEE

SEQ ID NO: 958476 - protein, 29 aa, Mycobacterium
APLTTLDGDSLDGDSPAEGTATPAPSVTV

SEQ ID NO: 958477 - protein, 8 aa, Mycobacterium
APNQDAQA

SEQ ID NO: 958478 - protein, 8 aa, Mycobacterium
APNSAVHS

SEQ ID NO: 958479 - protein, 14 aa, Mycobacterium
APPAPPHPPSPDQS

SEQ ID NO: 958480 - protein, 6 aa, Mycobacterium
APPAQL

SEQ ID NO: 958481 - protein, 9 aa, Mycobacterium
APPASGGRY

SEQ ID NO: 958482 - protein, 20 aa, Mycobacterium
APPDRKGLDHPRAAGPAAVA

SEQ ID NO: 958483 - protein, 5 aa, Mycobacterium
APPEL

SEQ ID NO: 958484 - protein, 6 aa, Mycobacterium
APPELA

SEQ ID NO: 958485 - protein, 6 aa, Mycobacterium
APPLAS

SEQ ID NO: 958486 - protein, 5 aa, Mycobacterium
APPPL

SEQ ID NO: 958487 - protein, 15 aa, Mycobacterium
APPPPPGAPPADNPP

SEQ ID NO: 958488 - protein, 11 aa, Mycobacterium
APPPPPGTPPQ

SEQ ID NO: 958489 - protein, 21 aa, Mycobacterium
APPQESNDATGGTTESGISDG

SEQ ID NO: 958490 - protein, 8 aa, Mycobacterium
APPQETSV

SEQ ID NO: 958491 - protein, 11 aa, Mycobacterium
APPQPPVHPGP

SEQ ID NO: 958492 - protein, 20 aa, Mycobacterium
APPQQATAPPQVAAPEPKIE

SEQ ID NO: 958493 - protein, 8 aa, Mycobacterium
APPSSERA

SEQ ID NO: 958494 - protein, 5 aa, Mycobacterium
APPSV

SEQ ID NO: 958495 - protein, 18 aa, Mycobacterium
APPTDAPAANQPSPPAAK

SEQ ID NO: 958496 - protein, 6 aa, Mycobacterium
APPYQH

SEQ ID NO: 958497 - protein, 9 aa, Mycobacterium
APQLGPPGV

SEQ ID NO: 958498 - protein, 5 aa, Mycobacterium
APQPA

SEQ ID NO: 958499 - protein, 17 aa, Mycobacterium
APQPGTDAAMPTKGDPW

SEQ ID NO: 958500 - protein, 11 aa, Mycobacterium
APQPLSDSVST

SEQ ID NO: 958501 - protein, 26 aa, Mycobacterium
APQPPGPLPAPGPALAPPPEAPPAQG

SEQ ID NO: 958502 - protein, 5 aa, Mycobacterium
APQQF

SEQ ID NO: 958503 - protein, 4 aa, Mycobacterium
APQR

SEQ ID NO: 958504 - protein, 7 aa, Mycobacterium
APQRPSR

SEQ ID NO: 958505 - protein, 11 aa, Mycobacterium
APRDGRTPRNL

SEQ ID NO: 958506 - protein, 19 aa, Mycobacterium
APRPGGTMDPESTSGSGAR

SEQ ID NO: 958507 - protein, 12 aa, Mycobacterium
APRPKVERGASV

SEQ ID NO: 958508 - protein, 6 aa, Mycobacterium
APRPTV

SEQ ID NO: 958509 - protein, 8 aa, Mycobacterium
APRPWQGP

SEQ ID NO: 958510 - protein, 11 aa, Mycobacterium
APSAAGPGGLA

SEQ ID NO: 958511 - protein, 5 aa, Mycobacterium
APSNE

SEQ ID NO: 958512 - protein, 5 aa, Mycobacterium
APSNL

SEQ ID NO: 958513 - protein, 6 aa, Mycobacterium
APSPLL

SEQ ID NO: 958514 - protein, 10 aa, Mycobacterium
APSRSALPAH

SEQ ID NO: 958515 - protein, 5 aa, Mycobacterium
APSSL

SEQ ID NO: 958516 - protein, 46 aa, Mycobacterium
APSVNNGMNPAPADKLPPGGTPPPISDPLERPGSGTVQCNGQQPNP

SEQ ID NO: 958517 - protein, 18 aa, Mycobacterium
APSYGQAEEAEPELPGVT

SEQ ID NO: 958518 - protein, 15 aa, Mycobacterium
APTGRAQDWLWRRRR

SEQ ID NO: 958519 - protein, 7 aa, Mycobacterium
APTPPLG

SEQ ID NO: 958520 - protein, 7 aa, Mycobacterium
APTPSLD

SEQ ID NO: 958521 - protein, 13 aa, Mycobacterium
APTTKTLQSEKFQ

SEQ ID NO: 958522 - protein, 8 aa, Mycobacterium
APTTRRDH

SEQ ID NO: 958523 - protein, 6 aa, Mycobacterium
APVADA

SEQ ID NO: 958524 - protein, 13 aa, Mycobacterium
APVATATAATTPV

SEQ ID NO: 958525 - protein, 4 aa, Mycobacterium
APVD

SEQ ID NO: 958526 - protein, 12 aa, Mycobacterium
APVDGEATSIEP

SEQ ID NO: 958527 - protein, 6 aa, Mycobacterium
APVPAH

SEQ ID NO: 958528 - protein, 7 aa, Mycobacterium
APVPAPA

SEQ ID NO: 958529 - protein, 5 aa, Mycobacterium
APVPG

SEQ ID NO: 958530 - protein, 7 aa, Mycobacterium
APVQTPT

SEQ ID NO: 958531 - protein, 21 aa, Mycobacterium
APVRDDDAQGHPRSGDPGKTQ

SEQ ID NO: 958532 - protein, 9 aa, Mycobacterium
APVTPETDK

SEQ ID NO: 958533 - protein, 5 aa, Mycobacterium
APYPQ

SEQ ID NO: 958534 - protein, 9 aa, Mycobacterium
AQAANGAPV

SEQ ID NO: 958535 - protein, 9 aa, Mycobacterium
AQAAQQRAA

SEQ ID NO: 958536 - protein, 8 aa, Mycobacterium
AQADTLSA

SEQ ID NO: 958537 - protein, 7 aa, Mycobacterium
AQAEHPG

SEQ ID NO: 958538 - protein, 7 aa, Mycobacterium
AQAENPG

SEQ ID NO: 958539 - protein, 6 aa, Mycobacterium
AQAEPA

SEQ ID NO: 958540 - protein, 18 aa, Mycobacterium
AQAGTDTSGLGDPPPHLP

SEQ ID NO: 958541 - protein, 8 aa, Mycobacterium
AQANESVD

SEQ ID NO: 958542 - protein, 11 aa, Mycobacterium
AQAQKADAQRL

SEQ ID NO: 958543 - protein, 11 aa, Mycobacterium
AQAQKARAQRL

SEQ ID NO: 958544 - protein, 10 aa, Mycobacterium
AQAQQAAEKA

SEQ ID NO: 958545 - protein, 6 aa, Mycobacterium
AQARER

SEQ ID NO: 958546 - protein, 8 aa, Mycobacterium
AQAVGGLG

SEQ ID NO: 958547 - protein, 6 aa, Mycobacterium
AQDDFS

SEQ ID NO: 958548 - protein, 5 aa, Mycobacterium
AQDFE

SEQ ID NO: 958549 - protein, 10 aa, Mycobacterium
AQDGKSAADQ

SEQ ID NO: 958550 - protein, 5 aa, Mycobacterium
AQDTD

SEQ ID NO: 958551 - protein, 16 aa, Mycobacterium
AQEWSRATRARPGRRG

SEQ ID NO: 958552 - protein, 7 aa, Mycobacterium
AQGALEG

SEQ ID NO: 958553 - protein, 10 aa, Mycobacterium
AQGDEPGWDD

SEQ ID NO: 958554 - protein, 7 aa, Mycobacterium
AQGDGSD

SEQ ID NO: 958555 - protein, 8 aa, Mycobacterium
AQGDGSQI

SEQ ID NO: 958556 - protein, 6 aa, Mycobacterium
AQGDTA

SEQ ID NO: 958557 - protein, 21 aa, Mycobacterium
AQGPNVTTVAPPKFAEDNDSA

SEQ ID NO: 958558 - protein, 6 aa, Mycobacterium
AQGRQL

SEQ ID NO: 958559 - protein, 9 aa, Mycobacterium
AQHDDPIGS

SEQ ID NO: 958560 - protein, 5 aa, Mycobacterium
AQHDG

SEQ ID NO: 958561 - protein, 4 aa, Mycobacterium
AQIE

SEQ ID NO: 958562 - protein, 4 aa, Mycobacterium
AQII

SEQ ID NO: 958563 - protein, 4 aa, Mycobacterium
AQIQ

SEQ ID NO: 958564 - protein, 8 aa, Mycobacterium
AQISDQSG

SEQ ID NO: 958565 - protein, 5 aa, Mycobacterium
AQKRQ

SEQ ID NO: 958566 - protein, 7 aa, Mycobacterium
AQLPTTG

SEQ ID NO: 958567 - protein, 10 aa, Mycobacterium
AQMDGATPYQ

SEQ ID NO: 958568 - protein, 6 aa, Mycobacterium
AQNAAA

SEQ ID NO: 958569 - protein, 11 aa, Mycobacterium
AQNATAAGLDP

SEQ ID NO: 958570 - protein, 17 aa, Mycobacterium
AQPAGRPEQAAPQQSDT

SEQ ID NO: 958571 - protein, 7 aa, Mycobacterium
AQPSREV

SEQ ID NO: 958572 - protein, 12 aa, Mycobacterium
AQPVGASKENAR

SEQ ID NO: 958573 - protein, 4 aa, Mycobacterium
AQQA

SEQ ID NO: 958574 - protein, 16 aa, Mycobacterium
AQQGAKGAGGNGVRTE

SEQ ID NO: 958575 - protein, 8 aa, Mycobacterium
AQQQDQDP

SEQ ID NO: 958576 - protein, 20 aa, Mycobacterium
AQQQMPAGAAQPSATPQASI

SEQ ID NO: 958577 - protein, 8 aa, Mycobacterium
AQQVTEDE

SEQ ID NO: 958578 - protein, 5 aa, Mycobacterium
AQRAT

SEQ ID NO: 958579 - protein, 7 aa, Mycobacterium
AQRDTNA

SEQ ID NO: 958580 - protein, 13 aa, Mycobacterium
AQRSGDEDESKRR

SEQ ID NO: 958581 - protein, 8 aa, Mycobacterium
AQRTTLGD

SEQ ID NO: 958582 - protein, 8 aa, Mycobacterium
AQSAADGE

SEQ ID NO: 958583 - protein, 7 aa, Mycobacterium
AQSEERK

SEQ ID NO: 958584 - protein, 7 aa, Mycobacterium
AQSELDG

SEQ ID NO: 958585 - protein, 6 aa, Mycobacterium
AQSSGS

SEQ ID NO: 958586 - protein, 5 aa, Mycobacterium
AQTDA

SEQ ID NO: 958587 - protein, 5 aa, Mycobacterium
AQTSL

SEQ ID NO: 958588 - protein, 23 aa, Mycobacterium
AQTTNRAIGRNGAADGAPDGVTP

SEQ ID NO: 958589 - protein, 7 aa, Mycobacterium
AQVNSAD

SEQ ID NO: 958590 - protein, 6 aa, Mycobacterium
AQVPSR

SEQ ID NO: 958591 - protein, 11 aa, Mycobacterium
AQYSESSRGQL

SEQ ID NO: 958592 - protein, 14 aa, Mycobacterium
ARAAGDEADDTHVD

SEQ ID NO: 958593 - protein, 6 aa, Mycobacterium
ARAAGE

SEQ ID NO: 958594 - protein, 6 aa, Mycobacterium
ARAAQL

SEQ ID NO: 958595 - protein, 22 aa, Mycobacterium
ARAELGTLPEPADFANTEGQGV

SEQ ID NO: 958596 - protein, 5 aa, Mycobacterium
ARAGD

SEQ ID NO: 958597 - protein, 10 aa, Mycobacterium
ARAGSGDIAG

SEQ ID NO: 958598 - protein, 8 aa, Mycobacterium
ARAPGGGI

SEQ ID NO: 958599 - protein, 7 aa, Mycobacterium
ARAPGTR

SEQ ID NO: 958600 - protein, 9 aa, Mycobacterium
ARARQASNL

SEQ ID NO: 958601 - protein, 18 aa, Mycobacterium
ARATTQPHDGQGHAHATD

SEQ ID NO: 958602 - protein, 10 aa, Mycobacterium
ARDFATSGLE

SEQ ID NO: 958603 - protein, 9 aa, Mycobacterium
ARDPSERYA

SEQ ID NO: 958604 - protein, 6 aa, Mycobacterium
ARDSNV

SEQ ID NO: 958605 - protein, 18 aa, Mycobacterium
ARDTPEPAQPESGHTGLP

SEQ ID NO: 958606 - protein, 9 aa, Mycobacterium
ARDTRQGVG

SEQ ID NO: 958607 - protein, 11 aa, Mycobacterium
AREAGRAAARA

SEQ ID NO: 958608 - protein, 5 aa, Mycobacterium
AREGY

SEQ ID NO: 958609 - protein, 36 aa, Mycobacterium
AREHRDADTPAALAGPRRRSNLPPCPAGGAGPGPAR

SEQ ID NO: 958610 - protein, 8 aa, Mycobacterium
ARENGTVI

SEQ ID NO: 958611 - protein, 13 aa, Mycobacterium
AREQAERGITGSM

SEQ ID NO: 958612 - protein, 4 aa, Mycobacterium
ARER

SEQ ID NO: 958613 - protein, 13 aa, Mycobacterium
ARERELEVPPATE

SEQ ID NO: 958614 - protein, 10 aa, Mycobacterium
ARERGGGTRF

SEQ ID NO: 958615 - protein, 20 aa, Mycobacterium
ARERIGEEAPTPAVGAHDHD

SEQ ID NO: 958616 - protein, 7 aa, Mycobacterium
ARGAASD

SEQ ID NO: 958617 - protein, 7 aa, Mycobacterium
ARGEAAA

SEQ ID NO: 958618 - protein, 7 aa, Mycobacterium
ARGGQDA

SEQ ID NO: 958619 - protein, 5 aa, Mycobacterium
ARGMQ

SEQ ID NO: 958620 - protein, 11 aa, Mycobacterium
ARGPHAPDTLP

SEQ ID NO: 958621 - protein, 10 aa, Mycobacterium
ARGSDAARTA

SEQ ID NO: 958622 - protein, 19 aa, Mycobacterium
ARHPGGKDPRRLGPGGTAD

SEQ ID NO: 958623 - protein, 7 aa, Mycobacterium
ARHPSSV

SEQ ID NO: 958624 - protein, 4 aa, Mycobacterium
ARIG

SEQ ID NO: 958625 - protein, 8 aa, Mycobacterium
ARKEDITK

SEQ ID NO: 958626 - protein, 12 aa, Mycobacterium
ARLDGEREAVPS

SEQ ID NO: 958627 - protein, 10 aa, Mycobacterium
ARLGVGASDR

SEQ ID NO: 958628 - protein, 4 aa, Mycobacterium
ARLT

SEQ ID NO: 958629 - protein, 7 aa, Mycobacterium
ARLTPGE

SEQ ID NO: 958630 - protein, 10 aa, Mycobacterium
ARNAGTSDLA

SEQ ID NO: 958631 - protein, 11 aa, Mycobacterium
ARNPDKALESA

SEQ ID NO: 958632 - protein, 7 aa, Mycobacterium
ARPDRRA

SEQ ID NO: 958633 - protein, 4 aa, Mycobacterium
ARPG

SEQ ID NO: 958634 - protein, 8 aa, Mycobacterium
ARPGEGTR

SEQ ID NO: 958635 - protein, 5 aa, Mycobacterium
ARPGL

SEQ ID NO: 958636 - protein, 5 aa, Mycobacterium
ARPKR

SEQ ID NO: 958637 - protein, 6 aa, Mycobacterium
ARPPAE

SEQ ID NO: 958638 - protein, 11 aa, Mycobacterium
ARPPARGVDNQ

SEQ ID NO: 958639 - protein, 8 aa, Mycobacterium
ARPPPPGV

SEQ ID NO: 958640 - protein, 6 aa, Mycobacterium
ARPPVD

SEQ ID NO: 958641 - protein, 9 aa, Mycobacterium
ARPRAGTES

SEQ ID NO: 958642 - protein, 13 aa, Mycobacterium
ARPVDPELRTTCW

SEQ ID NO: 958643 - protein, 13 aa, Mycobacterium
ARPYRTPGGIATS

SEQ ID NO: 958644 - protein, 14 aa, Mycobacterium
ARQENDELRQRADS

SEQ ID NO: 958645 - protein, 8 aa, Mycobacterium
ARQPEAQG

SEQ ID NO: 958646 - protein, 16 aa, Mycobacterium
ARQSPSAPADNSSDLA

SEQ ID NO: 958647 - protein, 6 aa, Mycobacterium
ARRAAS

SEQ ID NO: 958648 - protein, 11 aa, Mycobacterium
ARRADKVADEA

SEQ ID NO: 958649 - protein, 6 aa, Mycobacterium
ARRARP

SEQ ID NO: 958650 - protein, 4 aa, Mycobacterium
ARRE

SEQ ID NO: 958651 - protein, 5 aa, Mycobacterium
ARREG

SEQ ID NO: 958652 - protein, 9 aa, Mycobacterium
ARRHPRSRV

SEQ ID NO: 958653 - protein, 6 aa, Mycobacterium
ARRPAP

SEQ ID NO: 958654 - protein, 4 aa, Mycobacterium
ARRR

SEQ ID NO: 958655 - protein, 8 aa, Mycobacterium
ARRRAPEV

SEQ ID NO: 958656 - protein, 20 aa, Mycobacterium
ARRRETRAREDAPPADTPMT

SEQ ID NO: 958657 - protein, 8 aa, Mycobacterium
ARRRGEEY

SEQ ID NO: 958658 - protein, 4 aa, Mycobacterium
ARSA

SEQ ID NO: 958659 - protein, 8 aa, Mycobacterium
ARSEGRCG

SEQ ID NO: 958660 - protein, 8 aa, Mycobacterium
ARSGSREV

SEQ ID NO: 958661 - protein, 5 aa, Mycobacterium
ARSNE

SEQ ID NO: 958662 - protein, 6 aa, Mycobacterium
ARSSAL

SEQ ID NO: 958663 - protein, 7 aa, Mycobacterium
ARSSPDI

SEQ ID NO: 958664 - protein, 10 aa, Mycobacterium
ARTAPADAMR

SEQ ID NO: 958665 - protein, 8 aa, Mycobacterium
ARTDGDQT

SEQ ID NO: 958666 - protein, 10 aa, Mycobacterium
ARTDNSGWGD

SEQ ID NO: 958667 - protein, 17 aa, Mycobacterium
ARTEVKRQTGADQIESQ

SEQ ID NO: 958668 - protein, 8 aa, Mycobacterium
ARTGPKGN

SEQ ID NO: 958669 - protein, 6 aa, Mycobacterium
ARTIGG

SEQ ID NO: 958670 - protein, 14 aa, Mycobacterium
ARTPDGSAPSREAL

SEQ ID NO: 958671 - protein, 10 aa, Mycobacterium
ARTRDHGGAG

SEQ ID NO: 958672 - protein, 18 aa, Mycobacterium
ARTVRQPRTQFGGRQRSV

SEQ ID NO: 958673 - protein, 6 aa, Mycobacterium
ARVDHT

SEQ ID NO: 958674 - protein, 7 aa, Mycobacterium
ARYPDAA

SEQ ID NO: 958675 - protein, 11 aa, Mycobacterium
ARYTDPNTRSF

SEQ ID NO: 958676 - protein, 7 aa, Mycobacterium
ASAAPAV

SEQ ID NO: 958677 - protein, 11 aa, Mycobacterium
ASAAPTPGGVG

SEQ ID NO: 958678 - protein, 15 aa, Mycobacterium
ASAASEFSEPLPTGA

SEQ ID NO: 958679 - protein, 33 aa, Mycobacterium; identical to SEQ ID NO: 249154

SEQ ID NO: 958680 - protein, 14 aa, Mycobacterium
ASAGGYASAEAANA

SEQ ID NO: 958681 - protein, 5 aa, Mycobacterium
ASAGL

SEQ ID NO: 958682 - protein, 5 aa, Mycobacterium
ASAHG

SEQ ID NO: 958683 - protein, 14 aa, Mycobacterium
ASAHPGANPRPAAP

SEQ ID NO: 958684 - protein, 7 aa, Mycobacterium
ASAPALG

SEQ ID NO: 958685 - protein, 14 aa, Mycobacterium
ASAPPGSVGSPQAA

SEQ ID NO: 958686 - protein, 13 aa, Mycobacterium
ASAPSNLGEAAAD

SEQ ID NO: 958687 - protein, 12 aa, Mycobacterium
ASARGAEENRRG

SEQ ID NO: 958688 - protein, 6 aa, Mycobacterium
ASARPR

SEQ ID NO: 958689 - protein, 19 aa, Mycobacterium
ASASPYVETDRLSGRTAAP

SEQ ID NO: 958690 - protein, 6 aa, Mycobacterium
ASASSH

SEQ ID NO: 958691 - protein, 6 aa, Mycobacterium
ASATRR

SEQ ID NO: 958692 - protein, 5 aa, Mycobacterium
ASATS

SEQ ID NO: 958693 - protein, 9 aa, Mycobacterium
ASAVRQGRI

SEQ ID NO: 958694 - protein, 4 aa, Mycobacterium
ASCA

SEQ ID NO: 958695 - protein, 9 aa, Mycobacterium
ASDSSGNPQ

SEQ ID NO: 958696 - protein, 13 aa, Mycobacterium
ASEAAREAERIGA

SEQ ID NO: 958697 - protein, 12 aa, Mycobacterium
ASEAQSTEARQA

SEQ ID NO: 958698 - protein, 15 aa, Mycobacterium
ASEDSAEKARSSEER

SEQ ID NO: 958699 - protein, 18 aa, Mycobacterium
ASEEATERHRRSQQGAKA

SEQ ID NO: 958700 - protein, 7 aa, Mycobacterium
ASEGAPR

SEQ ID NO: 958701 - protein, 9 aa, Mycobacterium
ASEPGDNND

SEQ ID NO: 958702 - protein, 6 aa, Mycobacterium
ASFPSG

SEQ ID NO: 958703 - protein, 11 aa, Mycobacterium
ASGAAASGPAI

SEQ ID NO: 958704 - protein, 9 aa, Mycobacterium
ASGAGDSST

SEQ ID NO: 958705 - protein, 5 aa, Mycobacterium
ASGDH

SEQ ID NO: 958706 - protein, 8 aa, Mycobacterium
ASGGTSTV

SEQ ID NO: 958707 - protein, 4 aa, Mycobacterium
ASGI

SEQ ID NO: 958708 - protein, 8 aa, Mycobacterium
ASGKELRG

SEQ ID NO: 958709 - protein, 8 aa, Mycobacterium
ASGLGPPI

SEQ ID NO: 958710 - protein, 5 aa, Mycobacterium
ASGLP

SEQ ID NO: 958711 - protein, 12 aa, Mycobacterium
ASGLTPLSPTGI

SEQ ID NO: 958712 - protein, 6 aa, Mycobacterium
ASGNLG

SEQ ID NO: 958713 - protein, 6 aa, Mycobacterium
ASGNPM

SEQ ID NO: 958714 - protein, 12 aa, Mycobacterium
ASGNVRSEDDAR

SEQ ID NO: 958715 - protein, 13 aa, Mycobacterium
ASGRGGQAADVAG

SEQ ID NO: 958716 - protein, 6 aa, Mycobacterium
ASGSTY

SEQ ID NO: 958717 - protein, 16 aa, Mycobacterium
ASGYSISNDTTASAHR

SEQ ID NO: 958718 - protein, 4 aa, Mycobacterium
ASIG

SEQ ID NO: 958719 - protein, 12 aa, Mycobacterium
ASINHGNSGGPL

SEQ ID NO: 958720 - protein, 5 aa, Mycobacterium
ASIPG

SEQ ID NO: 958721 - protein, 5 aa, Mycobacterium
ASKFG

SEQ ID NO: 958722 - protein, 6 aa, Mycobacterium
ASKPGD

SEQ ID NO: 958723 - protein, 5 aa, Mycobacterium
ASLPQ

SEQ ID NO: 958724 - protein, 5 aa, Mycobacterium
ASMTN

SEQ ID NO: 958725 - protein, 8 aa, Mycobacterium
ASNGKPAV

SEQ ID NO: 958726 - protein, 13 aa, Mycobacterium
ASNQAQATAPTAV

SEQ ID NO: 958727 - protein, 8 aa, Mycobacterium
ASPAGPQV

SEQ ID NO: 958728 - protein, 6 aa, Mycobacterium
ASPAQT

SEQ ID NO: 958729 - protein, 11 aa, Mycobacterium
ASPDARPNPVY

SEQ ID NO: 958730 - protein, 9 aa, Mycobacterium
ASPDPALAR

SEQ ID NO: 958731 - protein, 7 aa, Mycobacterium
ASPESYS

SEQ ID NO: 958732 - protein, 13 aa, Mycobacterium
ASPGASDAASSYP

SEQ ID NO: 958733 - protein, 7 aa, Mycobacterium
ASPGKWD

SEQ ID NO: 958734 - protein, 13 aa, Mycobacterium
ASPNDCPTGPRDT

SEQ ID NO: 958735 - protein, 4 aa, Mycobacterium
ASPR

SEQ ID NO: 958736 - protein, 23 aa, Mycobacterium
ASPSTASPSAPTPVASTSQPDLR

SEQ ID NO: 958737 - protein, 15 aa, Mycobacterium
ASPTPNSTASVSTGP

SEQ ID NO: 958738 - protein, 24 aa, Mycobacterium
ASQAPPSPVSQNPGPQNPFMSPGT

SEQ ID NO: 958739 - protein, 6 aa, Mycobacterium
ASQDPL

SEQ ID NO: 958740 - protein, 7 aa, Mycobacterium
ASQPATL

SEQ ID NO: 958741 - protein, 6 aa, Mycobacterium
ASQPGR

SEQ ID NO: 958742 - protein, 7 aa, Mycobacterium
ASRDSLA

SEQ ID NO: 958743 - protein, 5 aa, Mycobacterium
ASRGY

SEQ ID NO: 958744 - protein, 5 aa, Mycobacterium
ASRLG

SEQ ID NO: 958745 - protein, 4 aa, Mycobacterium
ASRR

SEQ ID NO: 958746 - protein, 9 aa, Mycobacterium
ASRSENNDA

SEQ ID NO: 958747 - protein, 6 aa, Mycobacterium
ASRSLP

SEQ ID NO: 958748 - protein, 12 aa, Mycobacterium
ASRSRRTPVRVR

SEQ ID NO: 958749 - protein, 12 aa, Mycobacterium
ASRTYGTAADGE

SEQ ID NO: 958750 - protein, 7 aa, Mycobacterium
ASSAGVA

SEQ ID NO: 958751 - protein, 9 aa, Mycobacterium
ASSDPATYG

SEQ ID NO: 958752 - protein, 8 aa, Mycobacterium
ASSGIGRA

SEQ ID NO: 958753 - protein, 7 aa, Mycobacterium
ASSGVGA

SEQ ID NO: 958754 - protein, 32 aa, Mycobacterium; identical to SEQ ID NO: 249694

SEQ ID NO: 958755 - protein, 13 aa, Mycobacterium
ASSSVSGRYPNLG

SEQ ID NO: 958756 - protein, 5 aa, Mycobacterium
ASTAS

SEQ ID NO: 958757 - protein, 5 aa, Mycobacterium
ASTID

SEQ ID NO: 958758 - protein, 5 aa, Mycobacterium
ASTIG

SEQ ID NO: 958759 - protein, 17 aa, Mycobacterium
ASTLQQANEQLKRERDA

SEQ ID NO: 958760 - protein, 7 aa, Mycobacterium
ASTPVIG

SEQ ID NO: 958761 - protein, 9 aa, Mycobacterium
ASTSRQAKS

SEQ ID NO: 958762 - protein, 16 aa, Mycobacterium
ASTTAAGPISQNAYGA

SEQ ID NO: 958763 - protein, 6 aa, Mycobacterium
ASTVAH

SEQ ID NO: 958764 - protein, 15 aa, Mycobacterium
ASVGQRQERRGHHPG

SEQ ID NO: 958765 - protein, 8 aa, Mycobacterium
ASVGTSPE

SEQ ID NO: 958766 - protein, 4 aa, Mycobacterium
ASWG

SEQ ID NO: 958767 - protein, 18 aa, Mycobacterium
ASYAAPEAIQGGSVDQRA

SEQ ID NO: 958768 - protein, 7 aa, Mycobacterium
ASYSRTA

SEQ ID NO: 958769 - protein, 6 aa, Mycobacterium
ATAAGQ

SEQ ID NO: 958770 - protein, 12 aa, Mycobacterium
ATAAPPDPDNND

SEQ ID NO: 958771 - protein, 10 aa, Mycobacterium
ATAAQPPAEL

SEQ ID NO: 958772 - protein, 12 aa, Mycobacterium
ATADGADKSGLT

SEQ ID NO: 958773 - protein, 7 aa, Mycobacterium
ATADGSP

SEQ ID NO: 958774 - protein, 7 aa, Mycobacterium
ATADNDA

SEQ ID NO: 958775 - protein, 8 aa, Mycobacterium
ATAEDGSI

SEQ ID NO: 958776 - protein, 25 aa, Mycobacterium
ATAEPGATGATAAPAAGAKAAMPPM

SEQ ID NO: 958777 - protein, 4 aa, Mycobacterium
ATAG

SEQ ID NO: 958778 - protein, 7 aa, Mycobacterium
ATAGDPA

SEQ ID NO: 958779 - protein, 8 aa, Mycobacterium
ATAGSTAL

SEQ ID NO: 958780 - protein, 4 aa, Mycobacterium
ATAH

SEQ ID NO: 958781 - protein, 5 aa, Mycobacterium
ATAIG

SEQ ID NO: 958782 - protein, 9 aa, Mycobacterium
ATAKGLSRP

SEQ ID NO: 958783 - protein, 12 aa, Mycobacterium
ATALTGATPTRA

SEQ ID NO: 958784 - protein, 14 aa, Mycobacterium
ATAPDAIDEANTAF

SEQ ID NO: 958785 - protein, 7 aa, Mycobacterium
ATAPRGP

SEQ ID NO: 958786 - protein, 5 aa, Mycobacterium
ATAPS

SEQ ID NO: 958787 - protein, 11 aa, Mycobacterium
ATAQESIRTAN

SEQ ID NO: 958788 - protein, 6 aa, Mycobacterium
ATAQPD

SEQ ID NO: 958789 - protein, 6 aa, Mycobacterium
ATASGA

SEQ ID NO: 958790 - protein, 13 aa, Mycobacterium
ATASGQDEDEQLA

SEQ ID NO: 958791 - protein, 7 aa, Mycobacterium
ATATRNL

SEQ ID NO: 958792 - protein, 7 aa, Mycobacterium
ATATSEV

SEQ ID NO: 958793 - protein, 7 aa, Mycobacterium
ATDDDEF

SEQ ID NO: 958794 - protein, 9 aa, Mycobacterium
ATDEGPSTV

SEQ ID NO: 958795 - protein, 6 aa, Mycobacterium
ATDHRR

SEQ ID NO: 958796 - protein, 13 aa, Mycobacterium
ATDKAERVRPRGR

SEQ ID NO: 958797 - protein, 10 aa, Mycobacterium
ATDKGTPGAK

SEQ ID NO: 958798 - protein, 9 aa, Mycobacterium
ATDSEPSTV

SEQ ID NO: 958799 - protein, 7 aa, Mycobacterium
ATEPAGR

SEQ ID NO: 958800 - protein, 14 aa, Mycobacterium
ATERATVTAPAGYD

SEQ ID NO: 958801 - protein, 5 aa, Mycobacterium
ATGAI

SEQ ID NO: 958802 - protein, 5 aa, Mycobacterium
ATGAV

SEQ ID NO: 958803 - protein, 5 aa, Mycobacterium
ATGEF

SEQ ID NO: 958804 - protein, 6 aa, Mycobacterium
ATGEFE

SEQ ID NO: 958805 - protein, 5 aa, Mycobacterium
ATGGV

SEQ ID NO: 958806 - protein, 5 aa, Mycobacterium
ATGLT

SEQ ID NO: 958807 - protein, 5 aa, Mycobacterium
ATGPG

SEQ ID NO: 958808 - protein, 8 aa, Mycobacterium
ATGSETAP

SEQ ID NO: 958809 - protein, 9 aa, Mycobacterium
ATGSGKSEL

SEQ ID NO: 958810 - protein, 27 aa, Mycobacterium
ATGSPSYRSYPHGAEHPADSTPEALDE

SEQ ID NO: 958811 - protein, 7 aa, Mycobacterium
ATGSTVR

SEQ ID NO: 958812 - protein, 7 aa, Mycobacterium
ATGTGLA

SEQ ID NO: 958813 - protein, 16 aa, Mycobacterium
ATKDPYSEHIEPPDPA

SEQ ID NO: 958814 - protein, 6 aa, Mycobacterium
ATLPGI

SEQ ID NO: 958815 - protein, 40 aa, Mycobacterium; identical to SEQ ID NO: 250139

SEQ ID NO: 958816 - protein, 5 aa, Mycobacterium
ATNAA

SEQ ID NO: 958817 - protein, 7 aa, Mycobacterium
ATNAYSD

SEQ ID NO: 958818 - protein, 9 aa, Mycobacterium
ATPAPPGVK

SEQ ID NO: 958819 - protein, 4 aa, Mycobacterium
ATPE

SEQ ID NO: 958820 - protein, 8 aa, Mycobacterium
ATPFTGDT

SEQ ID NO: 958821 - protein, 4 aa, Mycobacterium
ATPG

SEQ ID NO: 958822 - protein, 29 aa, Mycobacterium
ATPISTEAPITSDAQPADTAALRNAGAPL

SEQ ID NO: 958823 - protein, 12 aa, Mycobacterium
ATPPKAKRGSSW

SEQ ID NO: 958824 - protein, 5 aa, Mycobacterium
ATPQP

SEQ ID NO: 958825 - protein, 5 aa, Mycobacterium
ATPSG

SEQ ID NO: 958826 - protein, 4 aa, Mycobacterium
ATPT

SEQ ID NO: 958827 - protein, 14 aa, Mycobacterium
ATQAPDTSAMAASE

SEQ ID NO: 958828 - protein, 5 aa, Mycobacterium
ATQDT

SEQ ID NO: 958829 - protein, 8 aa, Mycobacterium
ATQSEATV

SEQ ID NO: 958830 - protein, 6 aa, Mycobacterium
ATRAGR

SEQ ID NO: 958831 - protein, 7 aa, Mycobacterium
ATREVRS

SEQ ID NO: 958832 - protein, 7 aa, Mycobacterium
ATRGRSL

SEQ ID NO: 958833 - protein, 4 aa, Mycobacterium
ATSG

SEQ ID NO: 958834 - protein, 7 aa, Mycobacterium
ATSPEPL

SEQ ID NO: 958835 - protein, 9 aa, Mycobacterium
ATSRRNAGF

SEQ ID NO: 958836 - protein, 8 aa, Mycobacterium
ATSSVDTR

SEQ ID NO: 958837 - protein, 12 aa, Mycobacterium
ATSTSPIAVTAG

SEQ ID NO: 958838 - protein, 11 aa, Mycobacterium
ATTAAANGLTQ

SEQ ID NO: 958839 - protein, 4 aa, Mycobacterium
ATTD

SEQ ID NO: 958840 - protein, 9 aa, Mycobacterium
ATTHGEAEN

SEQ ID NO: 958841 - protein, 7 aa, Mycobacterium
ATTNGAL

SEQ ID NO: 958842 - protein, 7 aa, Mycobacterium
ATTQHDT

SEQ ID NO: 958843 - protein, 5 aa, Mycobacterium
ATTQM

SEQ ID NO: 958844 - protein, 7 aa, Mycobacterium
ATTRYRK

SEQ ID NO: 958845 - protein, 16 aa, Mycobacterium
ATTTGRPLARAADGRE

SEQ ID NO: 958846 - protein, 7 aa, Mycobacterium
ATTTSRP

SEQ ID NO: 958847 - protein, 5 aa, Mycobacterium
ATTVS

SEQ ID NO: 958848 - protein, 7 aa, Mycobacterium
ATVDAYD

SEQ ID NO: 958849 - protein, 7 aa, Mycobacterium
ATVEQAT

SEQ ID NO: 958850 - protein, 5 aa, Mycobacterium
ATVSR

SEQ ID NO: 958851 - protein, 12 aa, Mycobacterium
ATWEGPSAQSHV

SEQ ID NO: 958852 - protein, 20 aa, Mycobacterium
ATYAPDDRALADRPSADTEL

SEQ ID NO: 958853 - protein, 16 aa, Mycobacterium
AVAAGTATLDDGPAAA

SEQ ID NO: 958854 - protein, 6 aa, Mycobacterium
AVAAPT

SEQ ID NO: 958855 - protein, 10 aa, Mycobacterium
AVAASKPANW

SEQ ID NO: 958856 - protein, 6 aa, Mycobacterium
AVADRT

SEQ ID NO: 958857 - protein, 14 aa, Mycobacterium
AVAEPDERGESLSS

SEQ ID NO: 958858 - protein, 19 aa, Mycobacterium
AVAPSADATEESDAETLTD

SEQ ID NO: 958859 - protein, 4 aa, Mycobacterium
AVAT

SEQ ID NO: 958860 - protein, 29 aa, Mycobacterium
AVDTRGGAKPRQAHDDVERTPKVGSHIDG

SEQ ID NO: 958861 - protein, 8 aa, Mycobacterium
AVEPDPDT

SEQ ID NO: 958862 - protein, 7 aa, Mycobacterium
AVEPSTT

SEQ ID NO: 958863 - protein, 5 aa, Mycobacterium
AVEST

SEQ ID NO: 958864 - protein, 12 aa, Mycobacterium
AVGGEKPAAPAH

SEQ ID NO: 958865 - protein, 17 aa, Mycobacterium
AVGGELAASSAAPQPYL

SEQ ID NO: 958866 - protein, 7 aa, Mycobacterium
AVKGTPL

SEQ ID NO: 958867 - protein, 8 aa, Mycobacterium
AVKPSYGL

SEQ ID NO: 958868 - protein, 5 aa, Mycobacterium
AVLGS

SEQ ID NO: 958869 - protein, 10 aa, Mycobacterium
AVNNETLPYG

SEQ ID NO: 958870 - protein, 12 aa, Mycobacterium
AVPEPRAHYTGE

SEQ ID NO: 958871 - protein, 4 aa, Mycobacterium
AVPG

SEQ ID NO: 958872 - protein, 10 aa, Mycobacterium
AVPPTPPAPS

SEQ ID NO: 958873 - protein, 5 aa, Mycobacterium
AVPRD

SEQ ID NO: 958874 - protein, 4 aa, Mycobacterium
AVPS

SEQ ID NO: 958875 - protein, 5 aa, Mycobacterium
AVPTR

SEQ ID NO: 958876 - protein, 6 aa, Mycobacterium
AVRPSY

SEQ ID NO: 958877 - protein, 11 aa, Mycobacterium
AVRQTAAKYGQ

SEQ ID NO: 958878 - protein, 6 aa, Mycobacterium
AVRRTS

SEQ ID NO: 958879 - protein, 9 aa, Mycobacterium
AVRSGNSAI

SEQ ID NO: 958880 - protein, 8 aa, Mycobacterium
AVRTSSNE

SEQ ID NO: 958881 - protein, 8 aa, Mycobacterium
AVSAPTGT

SEQ ID NO: 958882 - protein, 22 aa, Mycobacterium
AVTSSSALRTSLDGSTDQYQPA

SEQ ID NO: 958883 - protein, 7 aa, Mycobacterium
AWQGPSG

SEQ ID NO: 958884 - protein, 12 aa, Mycobacterium
AWTTGNKRGQAH

SEQ ID NO: 958885 - protein, 19 aa, Mycobacterium
AYAAPEQLTGADVDGRADQ

SEQ ID NO: 958886 - protein, 17 aa, Mycobacterium
AYAGRATTRRLRPPSAA

SEQ ID NO: 958887 - protein, 49 aa, Mycobacterium
AYAPEADQTAEEEPQDDPESKDPKSKDEATEEEAPKEPEESEAEAEAEH

SEQ ID NO: 958888 - protein, 11 aa, Mycobacterium
AYLPPRDQGPV

SEQ ID NO: 958889 - protein, 6 aa, Mycobacterium
AYPAGP

SEQ ID NO: 958890 - protein, 6 aa, Mycobacterium
AYPDDP

SEQ ID NO: 958891 - protein, 7 aa, Mycobacterium
AYPGSGG

SEQ ID NO: 958892 - protein, 5 aa, Mycobacterium
AYPRT

SEQ ID NO: 958893 - protein, 10 aa, Mycobacterium
AYPSGGGDYE

SEQ ID NO: 958894 - protein, 11 aa, Mycobacterium
AYPVTERDGSI

SEQ ID NO: 958895 - protein, 7 aa, Mycobacterium
AYSDSYN

SEQ ID NO: 958896 - protein, 7 aa, Mycobacterium
AYTTGKY

SEQ ID NO: 958897 - protein, 11 aa, Mycobacterium
AYTTGPAHRTR

SEQ ID NO: 958898 - protein, 7 aa, Mycobacterium
CAETEPD

SEQ ID NO: 958899 - protein, 5 aa, Mycobacterium
CDPEQ

SEQ ID NO: 958900 - protein, 8 aa, Mycobacterium
CDTQTDPN

SEQ ID NO: 958901 - protein, 7 aa, Mycobacterium
CEKPGGL

SEQ ID NO: 958902 - protein, 41 aa, Mycobacterium
CGDPDPGHRGDDRGLRREVGADRGDHPSTDPGLHGLDRVGY

SEQ ID NO: 958903 - protein, 15 aa, Mycobacterium
CGDTDTAGSGEPPAV

SEQ ID NO: 958904 - protein, 13 aa, Mycobacterium
CGPPSQIGPAMGT

SEQ ID NO: 958905 - protein, 4 aa, Mycobacterium
CGQM

SEQ ID NO: 958906 - protein, 40 aa, Mycobacterium
CGRHPKSSASTMPAPLASRPAKATPAPRTLADRETPQRRG

SEQ ID NO: 958907 - protein, 8 aa, Mycobacterium
CGTTRDGY

SEQ ID NO: 958908 - protein, 9 aa, Mycobacterium
CKTGADANK

SEQ ID NO: 958909 - protein, 10 aa, Mycobacterium
CNKEGEASKV

SEQ ID NO: 958910 - protein, 11 aa, Mycobacterium
CPGEGPSPDGW

SEQ ID NO: 958911 - protein, 4 aa, Mycobacterium
CPPE

SEQ ID NO: 958912 - protein, 4 aa, Mycobacterium
CSGV

SEQ ID NO: 958913 - protein, 4 aa, Mycobacterium
CTAA

SEQ ID NO: 958914 - protein, 4 aa, Mycobacterium
CTDD

SEQ ID NO: 958915 - protein, 10 aa, Mycobacterium
CTGSGSCCSP

SEQ ID NO: 958916 - protein, 6 aa, Mycobacterium
CTSASN

SEQ ID NO: 958917 - protein, 10 aa, Mycobacterium
CTSATNAPCN

SEQ ID NO: 958918 - protein, 4 aa, Mycobacterium
DAAA

SEQ ID NO: 958919 - protein, 21 aa, Mycobacterium
DAAAAGPTEATCSAAAGRAAQ

SEQ ID NO: 958920 - protein, 6 aa, Mycobacterium
DAAAEA

SEQ ID NO: 958921 - protein, 6 aa, Mycobacterium
DAAEHD

SEQ ID NO: 958922 - protein, 7 aa, Mycobacterium
DAAERSY

SEQ ID NO: 958923 - protein, 8 aa, Mycobacterium
DAANHSAA

SEQ ID NO: 958924 - protein, 5 aa, Mycobacterium
DAAPG

SEQ ID NO: 958925 - protein, 7 aa, Mycobacterium
DAAPVTQ

SEQ ID NO: 958926 - protein, 7 aa, Mycobacterium
DAAQQIS

SEQ ID NO: 958927 - protein, 7 aa, Mycobacterium
DAARNDD

SEQ ID NO: 958928 - protein, 10 aa, Mycobacterium
DAARRGRTVT

SEQ ID NO: 958929 - protein, 6 aa, Mycobacterium
DAATLD

SEQ ID NO: 958930 - protein, 5 aa, Mycobacterium
DAATS

SEQ ID NO: 958931 - protein, 11 aa, Mycobacterium
DAATSSSPGFI

SEQ ID NO: 958932 - protein, 10 aa, Mycobacterium
DADAGDNIAA

SEQ ID NO: 958933 - protein, 9 aa, Mycobacterium
DADDPDERA

SEQ ID NO: 958934 - protein, 6 aa, Mycobacterium
DADLTP

SEQ ID NO: 958935 - protein, 7 aa, Mycobacterium
DADRAGL

SEQ ID NO: 958936 - protein, 9 aa, Mycobacterium
DAEGDEGTY

SEQ ID NO: 958937 - protein, 18 aa, Mycobacterium
DAERTAAQEGLKQSSLSD

SEQ ID NO: 958938 - protein, 7 aa, Mycobacterium
DAEVNQR

SEQ ID NO: 958939 - protein, 6 aa, Mycobacterium
DAGAEA

SEQ ID NO: 958940 - protein, 6 aa, Mycobacterium
DAGAQR

SEQ ID NO: 958941 - protein, 7 aa, Mycobacterium
DAGGYKA

SEQ ID NO: 958942 - protein, 8 aa, Mycobacterium
DAGIDPRN

SEQ ID NO: 958943 - protein, 9 aa, Mycobacterium
DAGKAYSRH

SEQ ID NO: 958944 - protein, 22 aa, Mycobacterium
DAGLASTPARADHGGGAPARND

SEQ ID NO: 958945 - protein, 7 aa, Mycobacterium
DAGPAAG

SEQ ID NO: 958946 - protein, 4 aa, Mycobacterium
DAGR

SEQ ID NO: 958947 - protein, 4 aa, Mycobacterium
DAGS

SEQ ID NO: 958948 - protein, 14 aa, Mycobacterium
DAGSAVDAGGPPRT

SEQ ID NO: 958949 - protein, 4 aa, Mycobacterium
DAGT

SEQ ID NO: 958950 - protein, 6 aa, Mycobacterium
DAGTRA

SEQ ID NO: 958951 - protein, 18 aa, Mycobacterium
DAHDDAPTTVLSGPGRAP

SEQ ID NO: 958952 - protein, 12 aa, Mycobacterium
DAHTSAAAATEG

SEQ ID NO: 958953 - protein, 14 aa, Mycobacterium
DAITGNPDDPRYPY

SEQ ID NO: 958954 - protein, 6 aa, Mycobacterium
DAKQGI

SEQ ID NO: 958955 - protein, 14 aa, Mycobacterium
DAKSAAKSAELEQS

SEQ ID NO: 958956 - protein, 14 aa, Mycobacterium
DALDPASKTLRSGD

SEQ ID NO: 958957 - protein, 12 aa, Mycobacterium
DALPPEPEQDGY

SEQ ID NO: 958958 - protein, 22 aa, Mycobacterium
DANPGAKLPAPVDAADTTPALS

SEQ ID NO: 958959 - protein, 16 aa, Mycobacterium
DAPGSSQKNLENAEYT

SEQ ID NO: 958960 - protein, 7 aa, Mycobacterium
DAPNAVA

SEQ ID NO: 958961 - protein, 8 aa, Mycobacterium
DAPNDDAY

SEQ ID NO: 958962 - protein, 33 aa, Mycobacterium; identical to SEQ ID NO: 251249

SEQ ID NO: 958963 - protein, 5 aa, Mycobacterium
DAPPR

SEQ ID NO: 958964 - protein, 11 aa, Mycobacterium
DAPPSMKSTTR

SEQ ID NO: 958965 - protein, 15 aa, Mycobacterium
DAPRNTGPDFGKASP

SEQ ID NO: 958966 - protein, 6 aa, Mycobacterium
DAPRSR

SEQ ID NO: 958967 - protein, 8 aa, Mycobacterium
DAQAAGLV

SEQ ID NO: 958968 - protein, 10 aa, Mycobacterium
DAQGSRPAGL

SEQ ID NO: 958969 - protein, 7 aa, Mycobacterium
DAQRNGH

SEQ ID NO: 958970 - protein, 11 aa, Mycobacterium
DARATGAPPVP

SEQ ID NO: 958971 - protein, 6 aa, Mycobacterium
DARPGD

SEQ ID NO: 958972 - protein, 8 aa, Mycobacterium
DARPNASM

SEQ ID NO: 958973 - protein, 8 aa, Mycobacterium
DARTEAAH

SEQ ID NO: 958974 - protein, 5 aa, Mycobacterium
DASDS

SEQ ID NO: 958975 - protein, 6 aa, Mycobacterium
DASKAD

SEQ ID NO: 958976 - protein, 13 aa, Mycobacterium
DASPALTSSDRAA

SEQ ID NO: 958977 - protein, 4 aa, Mycobacterium
DASQ

SEQ ID NO: 958978 - protein, 4 aa, Mycobacterium
DASR

SEQ ID NO: 958979 - protein, 37 aa, Mycobacterium; identical to SEQ ID NO: 251357

SEQ ID NO: 958980 - protein, 9 aa, Mycobacterium
DASSSRRAD

SEQ ID NO: 958981 - protein, 9 aa, Mycobacterium
DATESVTKA

SEQ ID NO: 958982 - protein, 8 aa, Mycobacterium
DATGAHSA

SEQ ID NO: 958983 - protein, 7 aa, Mycobacterium
DATPQLR

SEQ ID NO: 958984 - protein, 8 aa, Mycobacterium
DATRQRER

SEQ ID NO: 958985 - protein, 11 aa, Mycobacterium
DATSQTPDEAA

SEQ ID NO: 958986 - protein, 7 aa, Mycobacterium
DAVGGPA

SEQ ID NO: 958987 - protein, 8 aa, Mycobacterium
DAVPGSRT

SEQ ID NO: 958988 - protein, 5 aa, Mycobacterium
DAVPP

SEQ ID NO: 958989 - protein, 11 aa, Mycobacterium
DDAADGHAAPI

SEQ ID NO: 958990 - protein, 14 aa, Mycobacterium
DDAGDGSAWSAANA

SEQ ID NO: 958991 - protein, 17 aa, Mycobacterium
DDAGRNRPIGNRDSATS

SEQ ID NO: 958992 - protein, 8 aa, Mycobacterium
DDARRDGD

SEQ ID NO: 958993 - protein, 8 aa, Mycobacterium
DDDEPGGD

SEQ ID NO: 958994 - protein, 8 aa, Mycobacterium
DDDPAVSI

SEQ ID NO: 958995 - protein, 5 aa, Mycobacterium
DDEIS

SEQ ID NO: 958996 - protein, 18 aa, Mycobacterium
DDGEGDAAGRHRHRTTQS

SEQ ID NO: 958997 - protein, 10 aa, Mycobacterium
DDGGPGPGAV

SEQ ID NO: 958998 - protein, 6 aa, Mycobacterium
DDGRDV

SEQ ID NO: 958999 - protein, 5 aa, Mycobacterium
DDGTA

SEQ ID NO: 959000 - protein, 7 aa, Mycobacterium
DDLRPST

SEQ ID NO: 959001 - protein, 11 aa, Mycobacterium
DDNGSGVPEAE

SEQ ID NO: 959002 - protein, 11 aa, Mycobacterium
DDPAESSSAAA

SEQ ID NO: 959003 - protein, 18 aa, Mycobacterium
DDPAVRGDGSQPQPRPSR

SEQ ID NO: 959004 - protein, 5 aa, Mycobacterium
DDPGN

SEQ ID NO: 959005 - protein, 9 aa, Mycobacterium
DDPGPGVAP

SEQ ID NO: 959006 - protein, 10 aa, Mycobacterium
DDPGPTDPAT

SEQ ID NO: 959007 - protein, 9 aa, Mycobacterium
DDPRAATPW

SEQ ID NO: 959008 - protein, 6 aa, Mycobacterium
DDPTRV

SEQ ID NO: 959009 - protein, 6 aa, Mycobacterium
DDPVGA

SEQ ID NO: 959010 - protein, 8 aa, Mycobacterium
DDPYAGED

SEQ ID NO: 959011 - protein, 32 aa, Mycobacterium
DDQPGRSATDEDDRVDAAPDADAFELEGQEPA

SEQ ID NO: 959012 - protein, 7 aa, Mycobacterium
DDQSPNL

SEQ ID NO: 959013 - protein, 8 aa, Mycobacterium
DDQVKVGG

SEQ ID NO: 959014 - protein, 8 aa, Mycobacterium
DDRDAAKE

SEQ ID NO: 959015 - protein, 8 aa, Mycobacterium
DDRGCGQV

SEQ ID NO: 959016 - protein, 4 aa, Mycobacterium
DDSK

SEQ ID NO: 959017 - protein, 5 aa, Mycobacterium
DDSVD

SEQ ID NO: 959018 - protein, 7 aa, Mycobacterium
DDTETET

SEQ ID NO: 959019 - protein, 17 aa, Mycobacterium
DDTGRMTGYDLKYPDGG

SEQ ID NO: 959020 - protein, 24 aa, Mycobacterium
DDTHTGGTVQKPRGFGDESPPTAI

SEQ ID NO: 959021 - protein, 6 aa, Mycobacterium
DDVDGS

SEQ ID NO: 959022 - protein, 7 aa, Mycobacterium
DDYKEAG

SEQ ID NO: 959023 - protein, 13 aa, Mycobacterium
DEAEAEAAEAEAV

SEQ ID NO: 959024 - protein, 10 aa, Mycobacterium
DEAEERGDPV

SEQ ID NO: 959025 - protein, 9 aa, Mycobacterium
DEAEGGMGP

SEQ ID NO: 959026 - protein, 13 aa, Mycobacterium
DEAGATSSDRRDR

SEQ ID NO: 959027 - protein, 27 aa, Mycobacterium
DEARPESVPAADAPAATPATSRPKQQW

SEQ ID NO: 959028 - protein, 27 aa, Mycobacterium
DEAVGDAHGHGGHGSSEFSVGGGASGT

SEQ ID NO: 959029 - protein, 15 aa, Mycobacterium
DEAVPLEDAPSATSA

SEQ ID NO: 959030 - protein, 15 aa, Mycobacterium
DEDETKTDEVPKKKK

SEQ ID NO: 959031 - protein, 13 aa, Mycobacterium
DEDRQRPHTGNDA

SEQ ID NO: 959032 - protein, 11 aa, Mycobacterium
DEDRQRPHTRH

SEQ ID NO: 959033 - protein, 13 aa, Mycobacterium
DEDRQRTHTGNGA

SEQ ID NO: 959034 - protein, 8 aa, Mycobacterium
DEDVTDLA

SEQ ID NO: 959035 - protein, 5 aa, Mycobacterium
DEEAR

SEQ ID NO: 959036 - protein, 4 aa, Mycobacterium
DEER

SEQ ID NO: 959037 - protein, 14 aa, Mycobacterium
DEETPSDPATGDRT

SEQ ID NO: 959038 - protein, 24 aa, Mycobacterium
DEFDDGDDYEGYSDFAGDDADTVE

SEQ ID NO: 959039 - protein, 8 aa, Mycobacterium
DEGGAPGE

SEQ ID NO: 959040 - protein, 21 aa, Mycobacterium
DEGLSEAAGAAMARSSPSSHG

SEQ ID NO: 959041 - protein, 5 aa, Mycobacterium
DEGPL

SEQ ID NO: 959042 - protein, 9 aa, Mycobacterium
DEGQLPSSL

SEQ ID NO: 959043 - protein, 8 aa, Mycobacterium
DEGSAPGI

SEQ ID NO: 959044 - protein, 5 aa, Mycobacterium
DEGSR

SEQ ID NO: 959045 - protein, 9 aa, Mycobacterium
DEHGKQLPA

SEQ ID NO: 959046 - protein, 8 aa, Mycobacterium
DEHGQTTE

SEQ ID NO: 959047 - protein, 4 aa, Mycobacterium
DELA

SEQ ID NO: 959048 - protein, 21 aa, Mycobacterium
DELDPNSAPPNTALRSGGPQS

SEQ ID NO: 959049 - protein, 5 aa, Mycobacterium
DELEP

SEQ ID NO: 959050 - protein, 4 aa, Mycobacterium
DEMG

SEQ ID NO: 959051 - protein, 7 aa, Mycobacterium
DENLNRA

SEQ ID NO: 959052 - protein, 64 aa, Mycobacterium
DEPDPAGDSSAELEPFGDTGDEPDDALAGGELEPVSESGQIEPVDPAQESEAYSRAYSAPESEQ

SEQ ID NO: 959053 - protein, 9 aa, Mycobacterium
DEPSKRVDW

SEQ ID NO: 959054 - protein, 7 aa, Mycobacterium
DEPTAST

SEQ ID NO: 959055 - protein, 7 aa, Mycobacterium
DESFSDE

SEQ ID NO: 959056 - protein, 7 aa, Mycobacterium
DETAAQV

SEQ ID NO: 959057 - protein, 11 aa, Mycobacterium
DETNGYGAKNV

SEQ ID NO: 959058 - protein, 36 aa, Mycobacterium
DEVAPSAPASDPGVPAPTGDGAPRPQQPQQPSDDNI

SEQ ID NO: 959059 - protein, 15 aa, Mycobacterium
DEVGGSSGAAGRDDM

SEQ ID NO: 959060 - protein, 13 aa, Mycobacterium
DEVPGSTRWQGNP

SEQ ID NO: 959061 - protein, 13 aa, Mycobacterium
DEYDEAETAPVEA

SEQ ID NO: 959062 - protein, 6 aa, Mycobacterium
DEYRGQ

SEQ ID NO: 959063 - protein, 5 aa, Mycobacterium
DEYRY

SEQ ID NO: 959064 - protein, 6 aa, Mycobacterium
DFDPTE

SEQ ID NO: 959065 - protein, 5 aa, Mycobacterium
DFKPG

SEQ ID NO: 959066 - protein, 6 aa, Mycobacterium
DFPDGP

SEQ ID NO: 959067 - protein, 6 aa, Mycobacterium
DFSDGY

SEQ ID NO: 959068 - protein, 9 aa, Mycobacterium
DFSGTGAAL

SEQ ID NO: 959069 - protein, 10 aa, Mycobacterium
DGAADRSDAS

SEQ ID NO: 959070 - protein, 6 aa, Mycobacterium
DGAAEH

SEQ ID NO: 959071 - protein, 10 aa, Mycobacterium
DGAAPGLPGG

SEQ ID NO: 959072 - protein, 9 aa, Mycobacterium
DGADPQLGT

SEQ ID NO: 959073 - protein, 8 aa, Mycobacterium
DGADSDTV

SEQ ID NO: 959074 - protein, 13 aa, Mycobacterium
DGAGDSYSTPQRV

SEQ ID NO: 959075 - protein, 4 aa, Mycobacterium
DGAN

SEQ ID NO: 959076 - protein, 15 aa, Mycobacterium
DGANRLPAAKRPSVG

SEQ ID NO: 959077 - protein, 9 aa, Mycobacterium
DGANTPNWK

SEQ ID NO: 959078 - protein, 10 aa, Mycobacterium
DGAPNLPSGY

SEQ ID NO: 959079 - protein, 10 aa, Mycobacterium
DGARKRVGEM

SEQ ID NO: 959080 - protein, 5 aa, Mycobacterium
DGASK

SEQ ID NO: 959081 - protein, 7 aa, Mycobacterium
DGATEPV

SEQ ID NO: 959082 - protein, 63 aa, Mycobacterium; identical to SEQ ID NO: 252191

SEQ ID NO: 959083 - protein, 18 aa, Mycobacterium
DGDSTTSWETDTYNDPVP

SEQ ID NO: 959084 - protein, 13 aa, Mycobacterium
DGGASTPAHSQTV

SEQ ID NO: 959085 - protein, 4 aa, Mycobacterium
DGGL

SEQ ID NO: 959086 - protein, 5 aa, Mycobacterium
DGGPT

SEQ ID NO: 959087 - protein, 5 aa, Mycobacterium
DGGWQ

SEQ ID NO: 959088 - protein, 13 aa, Mycobacterium
DGHPARASAASVG

SEQ ID NO: 959089 - protein, 8 aa, Mycobacterium
DGHTTKVR

SEQ ID NO: 959090 - protein, 7 aa, Mycobacterium
DGIKESV

SEQ ID NO: 959091 - protein, 10 aa, Mycobacterium
DGITSSQVES

SEQ ID NO: 959092 - protein, 8 aa, Mycobacterium
DGKPPSRA

SEQ ID NO: 959093 - protein, 13 aa, Mycobacterium
DGLDRADPGSNPR

SEQ ID NO: 959094 - protein, 4 aa, Mycobacterium
DGLG

SEQ ID NO: 959095 - protein, 10 aa, Mycobacterium
DGLPAGSDVK

SEQ ID NO: 959096 - protein, 15 aa, Mycobacterium
DGLPRRASGRIERDA

SEQ ID NO: 959097 - protein, 15 aa, Mycobacterium
DGLSTATRDQSTGIV

SEQ ID NO: 959098 - protein, 6 aa, Mycobacterium
DGPDNS

SEQ ID NO: 959099 - protein, 9 aa, Mycobacterium
DGPEAGTEV

SEQ ID NO: 959100 - protein, 7 aa, Mycobacterium
DGPMAPT

SEQ ID NO: 959101 - protein, 7 aa, Mycobacterium
DGPSPFT

SEQ ID NO: 959102 - protein, 13 aa, Mycobacterium
DGPVNPAAGGTKR

SEQ ID NO: 959103 - protein, 7 aa, Mycobacterium
DGQDPEM

SEQ ID NO: 959104 - protein, 8 aa, Mycobacterium
DGQTRTST

SEQ ID NO: 959105 - protein, 16 aa, Mycobacterium
DGRADAKANPDPDRRA

SEQ ID NO: 959106 - protein, 7 aa, Mycobacterium
DGRADDS

SEQ ID NO: 959107 - protein, 7 aa, Mycobacterium
DGRDVEA

SEQ ID NO: 959108 - protein, 4 aa, Mycobacterium
DGRG

SEQ ID NO: 959109 - protein, 7 aa, Mycobacterium
DGRGPAL

SEQ ID NO: 959110 - protein, 11 aa, Mycobacterium
DGRRTEEAAAQ

SEQ ID NO: 959111 - protein, 10 aa, Mycobacterium
DGSAPDVSGL

SEQ ID NO: 959112 - protein, 9 aa, Mycobacterium
DGSGPMPEL

SEQ ID NO: 959113 - protein, 9 aa, Mycobacterium
DGSNDAAAI

SEQ ID NO: 959114 - protein, 8 aa, Mycobacterium
DGSTGPFG

SEQ ID NO: 959115 - protein, 7 aa, Mycobacterium
DGSTSGI

SEQ ID NO: 959116 - protein, 5 aa, Mycobacterium
DGSVE

SEQ ID NO: 959117 - protein, 6 aa, Mycobacterium
DGTAKG

SEQ ID NO: 959118 - protein, 6 aa, Mycobacterium
DGTDTR

SEQ ID NO: 959119 - protein, 9 aa, Mycobacterium
DGTGGYRSE

SEQ ID NO: 959120 - protein, 9 aa, Mycobacterium
DGTGPIPER

SEQ ID NO: 959121 - protein, 5 aa, Mycobacterium
DGTQD

SEQ ID NO: 959122 - protein, 6 aa, Mycobacterium
DGTQEF

SEQ ID NO: 959123 - protein, 7 aa, Mycobacterium
DGTQPAY

SEQ ID NO: 959124 - protein, 8 aa, Mycobacterium
DGTQSATT

SEQ ID NO: 959125 - protein, 9 aa, Mycobacterium
DGTRSPELP

SEQ ID NO: 959126 - protein, 8 aa, Mycobacterium
DGTSGPLR

SEQ ID NO: 959127 - protein, 6 aa, Mycobacterium
DGTTGE

SEQ ID NO: 959128 - protein, 6 aa, Mycobacterium
DGTTVT

SEQ ID NO: 959129 - protein, 10 aa, Mycobacterium
DGVARRGQLR

SEQ ID NO: 959130 - protein, 9 aa, Mycobacterium
DGVGVSGET

SEQ ID NO: 959131 - protein, 6 aa, Mycobacterium
DGVTVE

SEQ ID NO: 959132 - protein, 14 aa, Mycobacterium
DGYAAAPADTRDDV

SEQ ID NO: 959133 - protein, 17 aa, Mycobacterium
DGYADDTDAVPDASRIT

SEQ ID NO: 959134 - protein, 9 aa, Mycobacterium
DGYNAGGGH

SEQ ID NO: 959135 - protein, 8 aa, Mycobacterium
DHAGTATA

SEQ ID NO: 959136 - protein, 13 aa, Mycobacterium
DHAPGEPQAQPSG

SEQ ID NO: 959137 - protein, 46 aa, Mycobacterium
DHDARVPSGDGSGQQNKLEGDLDTGQSVGAPGKEPDFGVDPAMGPV

SEQ ID NO: 959138 - protein, 5 aa, Mycobacterium
DHDQM

SEQ ID NO: 959139 - protein, 21 aa, Mycobacterium
DHGPHGEDEDGHDDVRAGGQV

SEQ ID NO: 959140 - protein, 6 aa, Mycobacterium
DHHANP

SEQ ID NO: 959141 - protein, 12 aa, Mycobacterium
DHPATATATAQE

SEQ ID NO: 959142 - protein, 13 aa, Mycobacterium
DHQTEAAEQVSSY

SEQ ID NO: 959143 - protein, 5 aa, Mycobacterium
DHRAG

SEQ ID NO: 959144 - protein, 24 aa, Mycobacterium
DHSRPASGTSRQRRGKGSGGSFTS

SEQ ID NO: 959145 - protein, 6 aa, Mycobacterium
DIAPPT

SEQ ID NO: 959146 - protein, 9 aa, Mycobacterium
DIDTRTVRE

SEQ ID NO: 959147 - protein, 5 aa, Mycobacterium
DIGSL

SEQ ID NO: 959148 - protein, 8 aa, Mycobacterium
DIPTDAQA

SEQ ID NO: 959149 - protein, 8 aa, Mycobacterium
DISGAGAA

SEQ ID NO: 959150 - protein, 13 aa, Mycobacterium
DITSPTSPPPVQT

SEQ ID NO: 959151 - protein, 23 aa, Mycobacterium
DITTGDRGRRLRPSRGDTELGRA

SEQ ID NO: 959152 - protein, 7 aa, Mycobacterium
DKATASF

SEQ ID NO: 959153 - protein, 6 aa, Mycobacterium
DKATDW

SEQ ID NO: 959154 - protein, 7 aa, Mycobacterium
DKDIQDA

SEQ ID NO: 959155 - protein, 15 aa, Mycobacterium
DKEAEARGVSRGPAL

SEQ ID NO: 959156 - protein, 7 aa, Mycobacterium
DKELGDA

SEQ ID NO: 959157 - protein, 5 aa, Mycobacterium
DKEWG

SEQ ID NO: 959158 - protein, 17 aa, Mycobacterium
DKFSARSSGGDPSVERA

SEQ ID NO: 959159 - protein, 10 aa, Mycobacterium
DKGPGMPAED

SEQ ID NO: 959160 - protein, 8 aa, Mycobacterium
DKKAAPKL

SEQ ID NO: 959161 - protein, 14 aa, Mycobacterium
DKKMRTEEVDAERA

SEQ ID NO: 959162 - protein, 10 aa, Mycobacterium
DKKNPGGTEY

SEQ ID NO: 959163 - protein, 5 aa, Mycobacterium
DKPGV

SEQ ID NO: 959164 - protein, 10 aa, Mycobacterium
DKPKQRRAAR

SEQ ID NO: 959165 - protein, 11 aa, Mycobacterium
DKQYSSNGGAV

SEQ ID NO: 959166 - protein, 12 aa, Mycobacterium
DKRASGSAPDDC

SEQ ID NO: 959167 - protein, 6 aa, Mycobacterium
DKRETL

SEQ ID NO: 959168 - protein, 13 aa, Mycobacterium
DKRPDQRADTMST

SEQ ID NO: 959169 - protein, 7 aa, Mycobacterium
DKRPLRT

SEQ ID NO: 959170 - protein, 7 aa, Mycobacterium
DKSAQFK

SEQ ID NO: 959171 - protein, 7 aa, Mycobacterium
DKSPSQA

SEQ ID NO: 959172 - protein, 24 aa, Mycobacterium
DKTAALDGDKTAAVPSPAATDTVE

SEQ ID NO: 959173 - protein, 5 aa, Mycobacterium
DKTTL

SEQ ID NO: 959174 - protein, 5 aa, Mycobacterium
DKVNT

SEQ ID NO: 959175 - protein, 12 aa, Mycobacterium
DLADATSAPALA

SEQ ID NO: 959176 - protein, 11 aa, Mycobacterium
DLAEPDRGAPT

SEQ ID NO: 959177 - protein, 8 aa, Mycobacterium
DLAEQSEV

SEQ ID NO: 959178 - protein, 5 aa, Mycobacterium
DLAPQ

SEQ ID NO: 959179 - protein, 5 aa, Mycobacterium
DLARQ

SEQ ID NO: 959180 - protein, 8 aa, Mycobacterium
DLDPTLRR

SEQ ID NO: 959181 - protein, 14 aa, Mycobacterium
DLERRKREANDALQ

SEQ ID NO: 959182 - protein, 8 aa, Mycobacterium
DLGGQGVR

SEQ ID NO: 959183 - protein, 5 aa, Mycobacterium
DLGQT

SEQ ID NO: 959184 - protein, 53 aa, Mycobacterium
DLGSANYPHDESDPESPGEQPAAPARARRPRLRRRSTAKTPRPGKDEPKPRRR

SEQ ID NO: 959185 - protein, 12 aa, Mycobacterium
DLGSRTMREETD

SEQ ID NO: 959186 - protein, 7 aa, Mycobacterium
DLKTAGR

SEQ ID NO: 959187 - protein, 9 aa, Mycobacterium
DLNANAGAG

SEQ ID NO: 959188 - protein, 12 aa, Mycobacterium
DLPDSDPGRPNV

SEQ ID NO: 959189 - protein, 17 aa, Mycobacterium
DLPEESRASGFGRSEST

SEQ ID NO: 959190 - protein, 7 aa, Mycobacterium
DLPPGWT

SEQ ID NO: 959191 - protein, 7 aa, Mycobacterium
DLPPSPF

SEQ ID NO: 959192 - protein, 8 aa, Mycobacterium
DLPYPEGV

SEQ ID NO: 959193 - protein, 11 aa, Mycobacterium
DLQRPDAPWGK

SEQ ID NO: 959194 - protein, 8 aa, Mycobacterium
DLRDPQAV

SEQ ID NO: 959195 - protein, 8 aa, Mycobacterium
DLRDPQTM

SEQ ID NO: 959196 - protein, 4 aa, Mycobacterium
DLRN

SEQ ID NO: 959197 - protein, 5 aa, Mycobacterium
DLRNP

SEQ ID NO: 959198 - protein, 13 aa, Mycobacterium
DLRPNYKKSIKND

SEQ ID NO: 959199 - protein, 6 aa, Mycobacterium
DLSDPA

SEQ ID NO: 959200 - protein, 8 aa, Mycobacterium
DLSPGTPL

SEQ ID NO: 959201 - protein, 7 aa, Mycobacterium
DLSSLGD

SEQ ID NO: 959202 - protein, 5 aa, Mycobacterium
DLTGE

SEQ ID NO: 959203 - protein, 15 aa, Mycobacterium
DLTPDPYQGADPSMP

SEQ ID NO: 959204 - protein, 7 aa, Mycobacterium
DLTPGDS

SEQ ID NO: 959205 - protein, 4 aa, Mycobacterium
DMKP

SEQ ID NO: 959206 - protein, 14 aa, Mycobacterium
DMPDTGGARPSGGV

SEQ ID NO: 959207 - protein, 4 aa, Mycobacterium
DMRN

SEQ ID NO: 959208 - protein, 5 aa, Mycobacterium
DMRNP

SEQ ID NO: 959209 - protein, 5 aa, Mycobacterium
DMRNS

SEQ ID NO: 959210 - protein, 13 aa, Mycobacterium
DNEHVQRARRQGA

SEQ ID NO: 959211 - protein, 4 aa, Mycobacterium
DNGG

SEQ ID NO: 959212 - protein, 10 aa, Mycobacterium
DNGNEVSQGQ

SEQ ID NO: 959213 - protein, 10 aa, Mycobacterium
DNGPGISPQE

SEQ ID NO: 959214 - protein, 6 aa, Mycobacterium
DNIEPA

SEQ ID NO: 959215 - protein, 9 aa, Mycobacterium
DNKKSAEQF

SEQ ID NO: 959216 - protein, 15 aa, Mycobacterium
DNLASDAANSVKTYP

SEQ ID NO: 959217 - protein, 7 aa, Mycobacterium
DNNSQSR

SEQ ID NO: 959218 - protein, 5 aa, Mycobacterium
DNPDF

SEQ ID NO: 959219 - protein, 4 aa, Mycobacterium
DNPS

SEQ ID NO: 959220 - protein, 9 aa, Mycobacterium
DNPTKSYLQ

SEQ ID NO: 959221 - protein, 8 aa, Mycobacterium
DNQAVADS

SEQ ID NO: 959222 - protein, 7 aa, Mycobacterium
DNSAGLS

SEQ ID NO: 959223 - protein, 8 aa, Mycobacterium
DNSENPMT

SEQ ID NO: 959224 - protein, 7 aa, Mycobacterium
DNSKNAV

SEQ ID NO: 959225 - protein, 8 aa, Mycobacterium
DNSPATER

SEQ ID NO: 959226 - protein, 4 aa, Mycobacterium
DNST

SEQ ID NO: 959227 - protein, 16 aa, Mycobacterium
DNTATARQAIAASGPE

SEQ ID NO: 959228 - protein, 5 aa, Mycobacterium
DNYSG

SEQ ID NO: 959229 - protein, 9 aa, Mycobacterium
DPAARFPTA

SEQ ID NO: 959230 - protein, 9 aa, Mycobacterium
DPADPNARM

SEQ ID NO: 959231 - protein, 6 aa, Mycobacterium
DPAGGA

SEQ ID NO: 959232 - protein, 5 aa, Mycobacterium
DPAGL

SEQ ID NO: 959233 - protein, 7 aa, Mycobacterium
DPAGLPA

SEQ ID NO: 959234 - protein, 8 aa, Mycobacterium
DPAGSADK

SEQ ID NO: 959235 - protein, 83 aa, Mycobacterium; identical to SEQ ID NO: 253231

SEQ ID NO: 959236 - protein, 7 aa, Mycobacterium
DPAQRGR

SEQ ID NO: 959237 - protein, 6 aa, Mycobacterium
DPASID

SEQ ID NO: 959238 - protein, 8 aa, Mycobacterium
DPATAEGI

SEQ ID NO: 959239 - protein, 12 aa, Mycobacterium
DPAVRAAGRTPL

SEQ ID NO: 959240 - protein, 9 aa, Mycobacterium
DPCAPGQVT

SEQ ID NO: 959241 - protein, 7 aa, Mycobacterium
DPDADLE

SEQ ID NO: 959242 - protein, 7 aa, Mycobacterium
DPDDPTP

SEQ ID NO: 959243 - protein, 7 aa, Mycobacterium
DPDGPPR

SEQ ID NO: 959244 - protein, 12 aa, Mycobacterium
DPDPDAEGKTYT

SEQ ID NO: 959245 - protein, 6 aa, Mycobacterium
DPDQVN

SEQ ID NO: 959246 - protein, 14 aa, Mycobacterium
DPDRALRDDPRGPL

SEQ ID NO: 959247 - protein, 5 aa, Mycobacterium
DPEAE

SEQ ID NO: 959248 - protein, 22 aa, Mycobacterium
DPEDDLTPAKYSSDFGSAGTTT

SEQ ID NO: 959249 - protein, 7 aa, Mycobacterium
DPEDMGA

SEQ ID NO: 959250 - protein, 16 aa, Mycobacterium
DPEHSRPDTPQPPLNE

SEQ ID NO: 959251 - protein, 8 aa, Mycobacterium
DPEPTVPG

SEQ ID NO: 959252 - protein, 6 aa, Mycobacterium
DPFPTG

SEQ ID NO: 959253 - protein, 7 aa, Mycobacterium
DPGEDGQ

SEQ ID NO: 959254 - protein, 10 aa, Mycobacterium
DPGPRRLPYP

SEQ ID NO: 959255 - protein, 12 aa, Mycobacterium
DPGTGEVNPRAL

SEQ ID NO: 959256 - protein, 5 aa, Mycobacterium
DPGVV

SEQ ID NO: 959257 - protein, 20 aa, Mycobacterium
DPGYAAAAAKRESSGAQRTV

SEQ ID NO: 959258 - protein, 8 aa, Mycobacterium
DPHGRHRP

SEQ ID NO: 959259 - protein, 6 aa, Mycobacterium
DPHHGT

SEQ ID NO: 959260 - protein, 6 aa, Mycobacterium
DPHMPP

SEQ ID NO: 959261 - protein, 6 aa, Mycobacterium
DPHPSD

SEQ ID NO: 959262 - protein, 14 aa, Mycobacterium
DPHRGLSDGEAAER

SEQ ID NO: 959263 - protein, 8 aa, Mycobacterium
DPIGAESQ

SEQ ID NO: 959264 - protein, 9 aa, Mycobacterium
DPIPPSERH

SEQ ID NO: 959265 - protein, 6 aa, Mycobacterium
DPITTD

SEQ ID NO: 959266 - protein, 6 aa, Mycobacterium
DPLAGI

SEQ ID NO: 959267 - protein, 8 aa, Mycobacterium
DPLDDSEA

SEQ ID NO: 959268 - protein, 4 aa, Mycobacterium
DPLG

SEQ ID NO: 959269 - protein, 5 aa, Mycobacterium
DPLST

SEQ ID NO: 959270 - protein, 12 aa, Mycobacterium
DPPRADSAETIA

SEQ ID NO: 959271 - protein, 7 aa, Mycobacterium
DPPRGAA

SEQ ID NO: 959272 - protein, 21 aa, Mycobacterium
DPPRKSRKVASKEELASPYRG

SEQ ID NO: 959273 - protein, 5 aa, Mycobacterium
DPPTL

SEQ ID NO: 959274 - protein, 6 aa, Mycobacterium
DPQRGH

SEQ ID NO: 959275 - protein, 8 aa, Mycobacterium
DPQVNEPL

SEQ ID NO: 959276 - protein, 12 aa, Mycobacterium
DPRASKKRPDRT

SEQ ID NO: 959277 - protein, 6 aa, Mycobacterium
DPRIDR

SEQ ID NO: 959278 - protein, 4 aa, Mycobacterium
DPRK

SEQ ID NO: 959279 - protein, 14 aa, Mycobacterium
DPRLENARDTPLAE

SEQ ID NO: 959280 - protein, 5 aa, Mycobacterium
DPRLP

SEQ ID NO: 959281 - protein, 6 aa, Mycobacterium
DPRPLR

SEQ ID NO: 959282 - protein, 9 aa, Mycobacterium
DPRTEGLSD

SEQ ID NO: 959283 - protein, 5 aa, Mycobacterium
DPRVT

SEQ ID NO: 959284 - protein, 4 aa, Mycobacterium
DPSH

SEQ ID NO: 959285 - protein, 4 aa, Mycobacterium
DPSI

SEQ ID NO: 959286 - protein, 8 aa, Mycobacterium
DPSNAMGP

SEQ ID NO: 959287 - protein, 23 aa, Mycobacterium
DPSSGDHDVTYPEQRKSSLPGEN

SEQ ID NO: 959288 - protein, 4 aa, Mycobacterium
DPTA

SEQ ID NO: 959289 - protein, 7 aa, Mycobacterium
DPTERSV

SEQ ID NO: 959290 - protein, 7 aa, Mycobacterium
DPTMYGG

SEQ ID NO: 959291 - protein, 8 aa, Mycobacterium
DPTSRSTH

SEQ ID NO: 959292 - protein, 12 aa, Mycobacterium
DPTTPHGPLPAC

SEQ ID NO: 959293 - protein, 10 aa, Mycobacterium
DPYRRTPAAG

SEQ ID NO: 959294 - protein, 15 aa, Mycobacterium
DPYTGDEDPQTQQKI

SEQ ID NO: 959295 - protein, 4 aa, Mycobacterium
DPYV

SEQ ID NO: 959296 - protein, 24 aa, Mycobacterium
DQAQTRSPSDPGYEPTAPPALTTP

SEQ ID NO: 959297 - protein, 7 aa, Mycobacterium
DQATGHE

SEQ ID NO: 959298 - protein, 7 aa, Mycobacterium
DQGGALA

SEQ ID NO: 959299 - protein, 9 aa, Mycobacterium
DQGPGAADE

SEQ ID NO: 959300 - protein, 5 aa, Mycobacterium
DQGPV

SEQ ID NO: 959301 - protein, 13 aa, Mycobacterium
DQIQNATSGMDQR

SEQ ID NO: 959302 - protein, 9 aa, Mycobacterium
DQITNRPQN

SEQ ID NO: 959303 - protein, 8 aa, Mycobacterium
DQLGTGQQ

SEQ ID NO: 959304 - protein, 7 aa, Mycobacterium
DQLPSGS

SEQ ID NO: 959305 - protein, 27 aa, Mycobacterium
DQNAQLSNCTNGAAQPQDCGSAPDITG

SEQ ID NO: 959306 - protein, 7 aa, Mycobacterium
DQPAARE

SEQ ID NO: 959307 - protein, 8 aa, Mycobacterium
DQPLGTEA

SEQ ID NO: 959308 - protein, 6 aa, Mycobacterium
DQPPWT

SEQ ID NO: 959309 - protein, 5 aa, Mycobacterium
DQPWQ

SEQ ID NO: 959310 - protein, 15 aa, Mycobacterium
DQSEYEPHDQPADPV

SEQ ID NO: 959311 - protein, 6 aa, Mycobacterium
DQSRNH

SEQ ID NO: 959312 - protein, 16 aa, Mycobacterium
DQTEAAGTATAGSRST

SEQ ID NO: 959313 - protein, 6 aa, Mycobacterium
DQTPLR

SEQ ID NO: 959314 - protein, 5 aa, Mycobacterium
DQTTA

SEQ ID NO: 959315 - protein, 13 aa, Mycobacterium
DQVPDSPAMSGPY

SEQ ID NO: 959316 - protein, 6 aa, Mycobacterium
DRAADP

SEQ ID NO: 959317 - protein, 5 aa, Mycobacterium
DRAAL

SEQ ID NO: 959318 - protein, 16 aa, Mycobacterium
DRADRTTVATEPVAQP

SEQ ID NO: 959319 - protein, 8 aa, Mycobacterium
DRAERGAD

SEQ ID NO: 959320 - protein, 6 aa, Mycobacterium
DRAGSA

SEQ ID NO: 959321 - protein, 6 aa, Mycobacterium
DRAHPR

SEQ ID NO: 959322 - protein, 8 aa, Mycobacterium
DRDAAERE

SEQ ID NO: 959323 - protein, 7 aa, Mycobacterium
DRDESAS

SEQ ID NO: 959324 - protein, 5 aa, Mycobacterium
DRDQH

SEQ ID NO: 959325 - protein, 9 aa, Mycobacterium
DRDTGAAVP

SEQ ID NO: 959326 - protein, 29 aa, Mycobacterium
DREPESEDDAEGNEAPPPPPRGLSSGERI

SEQ ID NO: 959327 - protein, 10 aa, Mycobacterium
DRERRTAPIS

SEQ ID NO: 959328 - protein, 14 aa, Mycobacterium
DRESELRPPVRSGF

SEQ ID NO: 959329 - protein, 4 aa, Mycobacterium
DRFG

SEQ ID NO: 959330 - protein, 7 aa, Mycobacterium
DRFPGSR

SEQ ID NO: 959331 - protein, 6 aa, Mycobacterium
DRGAAT

SEQ ID NO: 959332 - protein, 6 aa, Mycobacterium
DRGEHA

SEQ ID NO: 959333 - protein, 12 aa, Mycobacterium
DRGFSGGDGGLQ

SEQ ID NO: 959334 - protein, 17 aa, Mycobacterium
DRGGNGQVHGSVPDDGF

SEQ ID NO: 959335 - protein, 8 aa, Mycobacterium
DRGGRERH

SEQ ID NO: 959336 - protein, 12 aa, Mycobacterium
DRGGVTVQAGGS

SEQ ID NO: 959337 - protein, 6 aa, Mycobacterium
DRGNNR

SEQ ID NO: 959338 - protein, 4 aa, Mycobacterium
DRGP

SEQ ID NO: 959339 - protein, 5 aa, Mycobacterium
DRGTV

SEQ ID NO: 959340 - protein, 4 aa, Mycobacterium
DRGY

SEQ ID NO: 959341 - protein, 9 aa, Mycobacterium
DRGYAYGPG

SEQ ID NO: 959342 - protein, 12 aa, Mycobacterium
DRHDGASREVDR

SEQ ID NO: 959343 - protein, 12 aa, Mycobacterium
DRHGHPEPGPYR

SEQ ID NO: 959344 - protein, 6 aa, Mycobacterium
DRKAGD

SEQ ID NO: 959345 - protein, 8 aa, Mycobacterium
DRKERLDR

SEQ ID NO: 959346 - protein, 25 aa, Mycobacterium
DRKRDAVERPERPIPSGDVSPAAAL

SEQ ID NO: 959347 - protein, 5 aa, Mycobacterium
DRLDE

SEQ ID NO: 959348 - protein, 6 aa, Mycobacterium
DRLEDS

SEQ ID NO: 959349 - protein, 12 aa, Mycobacterium
DRLRPREHAEWS

SEQ ID NO: 959350 - protein, 6 aa, Mycobacterium
DRNRPG

SEQ ID NO: 959351 - protein, 7 aa, Mycobacterium
DRPDQPR

SEQ ID NO: 959352 - protein, 12 aa, Mycobacterium
DRPEPLPRLRVA

SEQ ID NO: 959353 - protein, 5 aa, Mycobacterium
DRPES

SEQ ID NO: 959354 - protein, 8 aa, Mycobacterium
DRPGFGEY

SEQ ID NO: 959355 - protein, 5 aa, Mycobacterium
DRPGV

SEQ ID NO: 959356 - protein, 7 aa, Mycobacterium
DRPLTPA

SEQ ID NO: 959357 - protein, 14 aa, Mycobacterium
DRPPRSSDEPRRFD

SEQ ID NO: 959358 - protein, 6 aa, Mycobacterium
DRPTPE

SEQ ID NO: 959359 - protein, 8 aa, Mycobacterium
DRPVPSES

SEQ ID NO: 959360 - protein, 58 aa, Mycobacterium
DRQGTGNPSTTTPSTTTSTTTAETATTTPPTTTTTTVAPATTPRVQPPPQQPTHPPTH

SEQ ID NO: 959361 - protein, 5 aa, Mycobacterium
DRQGV

SEQ ID NO: 959362 - protein, 6 aa, Mycobacterium
DRQLPP

SEQ ID NO: 959363 - protein, 9 aa, Mycobacterium
DRRPPAPPT

SEQ ID NO: 959364 - protein, 5 aa, Mycobacterium
DRSAD

SEQ ID NO: 959365 - protein, 6 aa, Mycobacterium
DRSPGM

SEQ ID NO: 959366 - protein, 14 aa, Mycobacterium
DRSPRFTAPGDQPP

SEQ ID NO: 959367 - protein, 10 aa, Mycobacterium
DRSQRAASAA

SEQ ID NO: 959368 - protein, 30 aa, Mycobacterium; identical to SEQ ID NO: 254134

SEQ ID NO: 959369 - protein, 6 aa, Mycobacterium
DRTGPI

SEQ ID NO: 959370 - protein, 5 aa, Mycobacterium
DRTHP

SEQ ID NO: 959371 - protein, 4 aa, Mycobacterium
DSAA

SEQ ID NO: 959372 - protein, 12 aa, Mycobacterium
DSAAEKHRSAPL

SEQ ID NO: 959373 - protein, 5 aa, Mycobacterium
DSAAL

SEQ ID NO: 959374 - protein, 7 aa, Mycobacterium
DSAVEPT

SEQ ID NO: 959375 - protein, 4 aa, Mycobacterium
DSCP

SEQ ID NO: 959376 - protein, 7 aa, Mycobacterium
DSDDPTY

SEQ ID NO: 959377 - protein, 5 aa, Mycobacterium
DSDHA

SEQ ID NO: 959378 - protein, 12 aa, Mycobacterium
DSDKDAEKYASM

SEQ ID NO: 959379 - protein, 23 aa, Mycobacterium
DSDPDSADSAPVATEGESSGEGM

SEQ ID NO: 959380 - protein, 7 aa, Mycobacterium
DSDPHFP

SEQ ID NO: 959381 - protein, 20 aa, Mycobacterium
DSELRAQQAATAAQRAENAT

SEQ ID NO: 959382 - protein, 6 aa, Mycobacterium
DSFPGP

SEQ ID NO: 959383 - protein, 20 aa, Mycobacterium
DSGALTEEEFQSEKRRILDG

SEQ ID NO: 959384 - protein, 5 aa, Mycobacterium
DSGHN

SEQ ID NO: 959385 - protein, 13 aa, Mycobacterium
DSGLGTDRRAGSA

SEQ ID NO: 959386 - protein, 9 aa, Mycobacterium
DSHDGDDAL

SEQ ID NO: 959387 - protein, 5 aa, Mycobacterium
DSKPL

SEQ ID NO: 959388 - protein, 6 aa, Mycobacterium
DSLPQT

SEQ ID NO: 959389 - protein, 4 aa, Mycobacterium
DSMP

SEQ ID NO: 959390 - protein, 7 aa, Mycobacterium
DSNNVDQ

SEQ ID NO: 959391 - protein, 8 aa, Mycobacterium
DSNPTHAG

SEQ ID NO: 959392 - protein, 7 aa, Mycobacterium
DSNSPTY

SEQ ID NO: 959393 - protein, 4 aa, Mycobacterium
DSPA

SEQ ID NO: 959394 - protein, 14 aa, Mycobacterium
DSPQSPKKPPAHAR

SEQ ID NO: 959395 - protein, 9 aa, Mycobacterium
DSPTARRQD

SEQ ID NO: 959396 - protein, 5 aa, Mycobacterium
DSPTV

SEQ ID NO: 959397 - protein, 5 aa, Mycobacterium
DSQAR

SEQ ID NO: 959398 - protein, 8 aa, Mycobacterium
DSQGAANA

SEQ ID NO: 959399 - protein, 7 aa, Mycobacterium
DSQRELD

SEQ ID NO: 959400 - protein, 10 aa, Mycobacterium
DSQTHSSDAI

SEQ ID NO: 959401 - protein, 8 aa, Mycobacterium
DSRAAGSD

SEQ ID NO: 959402 - protein, 18 aa, Mycobacterium
DSRNGLEERVGEKVEAEP

SEQ ID NO: 959403 - protein, 26 aa, Mycobacterium
DSRQGLTTEQQQELTTGGDPGDGRTD

SEQ ID NO: 959404 - protein, 8 aa, Mycobacterium
DSRTGEMD

SEQ ID NO: 959405 - protein, 18 aa, Mycobacterium
DSSAQGLTATEASQRLQR

SEQ ID NO: 959406 - protein, 12 aa, Mycobacterium
DSSATAQERSRA

SEQ ID NO: 959407 - protein, 6 aa, Mycobacterium
DSSDID

SEQ ID NO: 959408 - protein, 6 aa, Mycobacterium
DSSPLT

SEQ ID NO: 959409 - protein, 5 aa, Mycobacterium
DSSVT

SEQ ID NO: 959410 - protein, 9 aa, Mycobacterium
DSTAGEGSE

SEQ ID NO: 959411 - protein, 13 aa, Mycobacterium
DSTDGLTDCDGRG

SEQ ID NO: 959412 - protein, 12 aa, Mycobacterium
DSTQDRRPGSEL

SEQ ID NO: 959413 - protein, 7 aa, Mycobacterium
DSTSVEH

SEQ ID NO: 959414 - protein, 7 aa, Mycobacterium
DSTTKTA

SEQ ID NO: 959415 - protein, 8 aa, Mycobacterium
DSTTNQPI

SEQ ID NO: 959416 - protein, 8 aa, Mycobacterium
DSVLAGNP

SEQ ID NO: 959417 - protein, 6 aa, Mycobacterium
DSVSGY

SEQ ID NO: 959418 - protein, 6 aa, Mycobacterium
DSVTDN

SEQ ID NO: 959419 - protein, 6 aa, Mycobacterium
DSWQGE

SEQ ID NO: 959420 - protein, 12 aa, Mycobacterium
DSYNASSGPIGD

SEQ ID NO: 959421 - protein, 8 aa, Mycobacterium
DSYSEEGP

SEQ ID NO: 959422 - protein, 5 aa, Mycobacterium
DTADG

SEQ ID NO: 959423 - protein, 9 aa, Mycobacterium
DTARPSARP

SEQ ID NO: 959424 - protein, 4 aa, Mycobacterium
DTAT

SEQ ID NO: 959425 - protein, 14 aa, Mycobacterium
DTATTTPTPPVGTK

SEQ ID NO: 959426 - protein, 19 aa, Mycobacterium
DTDGYGERGDQRPPGSEKY

SEQ ID NO: 959427 - protein, 12 aa, Mycobacterium
DTDMPPTAWGSC

SEQ ID NO: 959428 - protein, 7 aa, Mycobacterium
DTDPKRA

SEQ ID NO: 959429 - protein, 6 aa, Mycobacterium
DTDQQA

SEQ ID NO: 959430 - protein, 5 aa, Mycobacterium
DTEAV

SEQ ID NO: 959431 - protein, 11 aa, Mycobacterium
DTEGEGGRKTV

SEQ ID NO: 959432 - protein, 6 aa, Mycobacterium
DTGRTN

SEQ ID NO: 959433 - protein, 10 aa, Mycobacterium
DTGTSFGGMG

SEQ ID NO: 959434 - protein, 4 aa, Mycobacterium
DTKA

SEQ ID NO: 959435 - protein, 5 aa, Mycobacterium
DTKHV

SEQ ID NO: 959436 - protein, 24 aa, Mycobacterium
DTKPPLPRGDPSSSVLNRVEYGNR

SEQ ID NO: 959437 - protein, 8 aa, Mycobacterium
DTKRSSVD

SEQ ID NO: 959438 - protein, 7 aa, Mycobacterium
DTNGQPM

SEQ ID NO: 959439 - protein, 8 aa, Mycobacterium
DTPAKVPA

SEQ ID NO: 959440 - protein, 12 aa, Mycobacterium
DTPANSVRGSRN

SEQ ID NO: 959441 - protein, 7 aa, Mycobacterium
DTPPRGL

SEQ ID NO: 959442 - protein, 8 aa, Mycobacterium
DTPRPTAA

SEQ ID NO: 959443 - protein, 9 aa, Mycobacterium
DTPRPTAQS

SEQ ID NO: 959444 - protein, 29 aa, Mycobacterium
DTPVARETDYGRVDQHSSAVRAPGDARHT

SEQ ID NO: 959445 - protein, 4 aa, Mycobacterium
DTRA

SEQ ID NO: 959446 - protein, 22 aa, Mycobacterium
DTRCAGQPACRDAGNGANEQDP

SEQ ID NO: 959447 - protein, 10 aa, Mycobacterium
DTRGYKPVDT

SEQ ID NO: 959448 - protein, 17 aa, Mycobacterium
DTRPEDYEGAEISDGAG

SEQ ID NO: 959449 - protein, 10 aa, Mycobacterium
DTRPGTARPV

SEQ ID NO: 959450 - protein, 5 aa, Mycobacterium
DTRRP

SEQ ID NO: 959451 - protein, 11 aa, Mycobacterium
DTRYSSSPTPL

SEQ ID NO: 959452 - protein, 7 aa, Mycobacterium
DTSDDEK

SEQ ID NO: 959453 - protein, 41 aa, Mycobacterium
DTSGLEAQADGEEGYEPTPRYTSGASRRRRYDTKTAAAVSA

SEQ ID NO: 959454 - protein, 9 aa, Mycobacterium
DTSRNVKGD

SEQ ID NO: 959455 - protein, 4 aa, Mycobacterium
DTTL

SEQ ID NO: 959456 - protein, 6 aa, Mycobacterium
DTTTTD

SEQ ID NO: 959457 - protein, 7 aa, Mycobacterium
DTTTTVA

SEQ ID NO: 959458 - protein, 10 aa, Mycobacterium
DTVKDSAADA

SEQ ID NO: 959459 - protein, 6 aa, Mycobacterium
DVAADT

SEQ ID NO: 959460 - protein, 4 aa, Mycobacterium
DVAD

SEQ ID NO: 959461 - protein, 7 aa, Mycobacterium
DVDDGQL

SEQ ID NO: 959462 - protein, 4 aa, Mycobacterium
DVEG

SEQ ID NO: 959463 - protein, 25 aa, Mycobacterium
DVESGNADDVDCTDTDAHAPRAPRR

SEQ ID NO: 959464 - protein, 9 aa, Mycobacterium
DVGAGTGPV

SEQ ID NO: 959465 - protein, 9 aa, Mycobacterium
DVNPPTDTA

SEQ ID NO: 959466 - protein, 7 aa, Mycobacterium
DVPAAGS

SEQ ID NO: 959467 - protein, 10 aa, Mycobacterium
DVPKRGQKVP

SEQ ID NO: 959468 - protein, 4 aa, Mycobacterium
DVPN

SEQ ID NO: 959469 - protein, 6 aa, Mycobacterium
DVPPAS

SEQ ID NO: 959470 - protein, 6 aa, Mycobacterium
DVPPLA

SEQ ID NO: 959471 - protein, 13 aa, Mycobacterium
DVQTVSGRLGGGT

SEQ ID NO: 959472 - protein, 16 aa, Mycobacterium
DVRPAAATQPSPREGV

SEQ ID NO: 959473 - protein, 7 aa, Mycobacterium
DVTDSTQ

SEQ ID NO: 959474 - protein, 6 aa, Mycobacterium
DVTGGL

SEQ ID NO: 959475 - protein, 15 aa, Mycobacterium
DVTNPAARNDASSPI

SEQ ID NO: 959476 - protein, 6 aa, Mycobacterium
DVTSQR

SEQ ID NO: 959477 - protein, 13 aa, Mycobacterium
DWPDAGRPRRAGV

SEQ ID NO: 959478 - protein, 7 aa, Mycobacterium
DWPSAES

SEQ ID NO: 959479 - protein, 11 aa, Mycobacterium
DWTAEDRERVS

SEQ ID NO: 959480 - protein, 13 aa, Mycobacterium
DYAASSTAPSGRQ

SEQ ID NO: 959481 - protein, 5 aa, Mycobacterium
DYARQ

SEQ ID NO: 959482 - protein, 4 aa, Mycobacterium
DYDL

SEQ ID NO: 959483 - protein, 4 aa, Mycobacterium
DYGS

SEQ ID NO: 959484 - protein, 4 aa, Mycobacterium
DYGT

SEQ ID NO: 959485 - protein, 5 aa, Mycobacterium
DYPVP

SEQ ID NO: 959486 - protein, 7 aa, Mycobacterium
DYTGNRE

SEQ ID NO: 959487 - protein, 4 aa, Mycobacterium
DYVG

SEQ ID NO: 959488 - protein, 4 aa, Mycobacterium
EAAA

SEQ ID NO: 959489 - protein, 5 aa, Mycobacterium
EAAER

SEQ ID NO: 959490 - protein, 15 aa, Mycobacterium
EAAKPLSRDGAQQPG

SEQ ID NO: 959491 - protein, 5 aa, Mycobacterium
EAAKQ

SEQ ID NO: 959492 - protein, 9 aa, Mycobacterium
EAANNPSQF

SEQ ID NO: 959493 - protein, 26 aa, Mycobacterium
EAAPAADESVETSGSGETAAPKTTRN

SEQ ID NO: 959494 - protein, 7 aa, Mycobacterium
EAAPARR

SEQ ID NO: 959495 - protein, 6 aa, Mycobacterium
EAARAK

SEQ ID NO: 959496 - protein, 7 aa, Mycobacterium
EAASEHP

SEQ ID NO: 959497 - protein, 6 aa, Mycobacterium
EADPER

SEQ ID NO: 959498 - protein, 6 aa, Mycobacterium
EADTEH

SEQ ID NO: 959499 - protein, 6 aa, Mycobacterium
EADTRV

SEQ ID NO: 959500 - protein, 4 aa, Mycobacterium
EAEG

SEQ ID NO: 959501 - protein, 8 aa, Mycobacterium
EAEGGMGP

SEQ ID NO: 959502 - protein, 20 aa, Mycobacterium
EAGATETPRPVSGSYHTRDS

SEQ ID NO: 959503 - protein, 8 aa, Mycobacterium
EAGDGSGL

SEQ ID NO: 959504 - protein, 4 aa, Mycobacterium
EAGE

SEQ ID NO: 959505 - protein, 9 aa, Mycobacterium
EAGGLYPRS

SEQ ID NO: 959506 - protein, 4 aa, Mycobacterium
EAGH

SEQ ID NO: 959507 - protein, 13 aa, Mycobacterium
EAGLESETADTAQ

SEQ ID NO: 959508 - protein, 6 aa, Mycobacterium
EAGPNR

SEQ ID NO: 959509 - protein, 5 aa, Mycobacterium
EAGPV

SEQ ID NO: 959510 - protein, 19 aa, Mycobacterium
EAHDDDDDEDDAEPETDQI

SEQ ID NO: 959511 - protein, 9 aa, Mycobacterium
EAHGDPGNW

SEQ ID NO: 959512 - protein, 11 aa, Mycobacterium
EAITASGRAAA

SEQ ID NO: 959513 - protein, 6 aa, Mycobacterium
EAKADV

SEQ ID NO: 959514 - protein, 18 aa, Mycobacterium
EAKDAGKTAFGSAANVDQ

SEQ ID NO: 959515 - protein, 16 aa, Mycobacterium
EAKKSHAQALRATNPG

SEQ ID NO: 959516 - protein, 10 aa, Mycobacterium
EAKSPSTPEL

SEQ ID NO: 959517 - protein, 5 aa, Mycobacterium
EALAD

SEQ ID NO: 959518 - protein, 4 aa, Mycobacterium
EALT

SEQ ID NO: 959519 - protein, 11 aa, Mycobacterium
EAPGADTIRPE

SEQ ID NO: 959520 - protein, 5 aa, Mycobacterium
EAPPL

SEQ ID NO: 959521 - protein, 6 aa, Mycobacterium
EAPSVP

SEQ ID NO: 959522 - protein, 6 aa, Mycobacterium
EAPTGT

SEQ ID NO: 959523 - protein, 13 aa, Mycobacterium
EAPWDERPGEAAG

SEQ ID NO: 959524 - protein, 11 aa, Mycobacterium
EAQGGKAPVQR

SEQ ID NO: 959525 - protein, 11 aa, Mycobacterium
EAQNDRAPIQT

SEQ ID NO: 959526 - protein, 11 aa, Mycobacterium
EARAAGVDRES

SEQ ID NO: 959527 - protein, 5 aa, Mycobacterium
EARAG

SEQ ID NO: 959528 - protein, 11 aa, Mycobacterium
EARDAGTTRPL

SEQ ID NO: 959529 - protein, 6 aa, Mycobacterium
EAREPQ

SEQ ID NO: 959530 - protein, 7 aa, Mycobacterium
EARGDTE

SEQ ID NO: 959531 - protein, 12 aa, Mycobacterium
EARGLGQDRESA

SEQ ID NO: 959532 - protein, 20 aa, Mycobacterium
EARKRAMESKPEGKDEHGEE

SEQ ID NO: 959533 - protein, 9 aa, Mycobacterium
EARNAGRLQ

SEQ ID NO: 959534 - protein, 7 aa, Mycobacterium
EARPGAV

SEQ ID NO: 959535 - protein, 11 aa, Mycobacterium
EARQAGEDRES

SEQ ID NO: 959536 - protein, 11 aa, Mycobacterium
EARQAGEDRET

SEQ ID NO: 959537 - protein, 12 aa, Mycobacterium
EARQAGEDRETA

SEQ ID NO: 959538 - protein, 12 aa, Mycobacterium
EARQAGEDRQDA

SEQ ID NO: 959539 - protein, 13 aa, Mycobacterium
EARRDAKRRARGH

SEQ ID NO: 959540 - protein, 4 aa, Mycobacterium
EART

SEQ ID NO: 959541 - protein, 9 aa, Mycobacterium
EASGAENMA

SEQ ID NO: 959542 - protein, 16 aa, Mycobacterium
EASGNNDQAAIESAQA

SEQ ID NO: 959543 - protein, 7 aa, Mycobacterium
EASPTLP

SEQ ID NO: 959544 - protein, 9 aa, Mycobacterium
EASSGEAGQ

SEQ ID NO: 959545 - protein, 9 aa, Mycobacterium
EATAGEAGE

SEQ ID NO: 959546 - protein, 74 aa, Mycobacterium
EATHEGAADGQATASRNGAEEPTGNSADVLESDDVAETEELRADDDEPVAAGSAKADESEADELADESERSRRG

SEQ ID NO: 959547 - protein, 6 aa, Mycobacterium
EATMRP

SEQ ID NO: 959548 - protein, 6 aa, Mycobacterium
EATPVA

SEQ ID NO: 959549 - protein, 5 aa, Mycobacterium
EATRE

SEQ ID NO: 959550 - protein, 18 aa, Mycobacterium
EATSTRVDSETTASTQIP

SEQ ID NO: 959551 - protein, 16 aa, Mycobacterium
EATVKDTAAEIAARGG

SEQ ID NO: 959552 - protein, 9 aa, Mycobacterium
EAVKGTPLA

SEQ ID NO: 959553 - protein, 6 aa, Mycobacterium
EAVQST

SEQ ID NO: 959554 - protein, 4 aa, Mycobacterium
EAVS

SEQ ID NO: 959555 - protein, 9 aa, Mycobacterium
ECGDSGGPV

SEQ ID NO: 959556 - protein, 6 aa, Mycobacterium
ECGRTT

SEQ ID NO: 959557 - protein, 13 aa, Mycobacterium
ECPDSCSDAVPAI

SEQ ID NO: 959558 - protein, 9 aa, Mycobacterium
EDAERQIDS

SEQ ID NO: 959559 - protein, 9 aa, Mycobacterium
EDAGPAGKQ

SEQ ID NO: 959560 - protein, 10 aa, Mycobacterium
EDAPRPAPPD

SEQ ID NO: 959561 - protein, 9 aa, Mycobacterium
EDARRRGAG

SEQ ID NO: 959562 - protein, 7 aa, Mycobacterium
EDDDAAV

SEQ ID NO: 959563 - protein, 17 aa, Mycobacterium
EDEEYDEYEDDEEYEDY

SEQ ID NO: 959564 - protein, 5 aa, Mycobacterium
EDEGR

SEQ ID NO: 959565 - protein, 10 aa, Mycobacterium
EDGDAGSADL

SEQ ID NO: 959566 - protein, 5 aa, Mycobacterium
EDGEA

SEQ ID NO: 959567 - protein, 7 aa, Mycobacterium
EDKTHPA

SEQ ID NO: 959568 - protein, 4 aa, Mycobacterium
EDLP

SEQ ID NO: 959569 - protein, 7 aa, Mycobacterium
EDNGDSQ

SEQ ID NO: 959570 - protein, 14 aa, Mycobacterium
EDNRTYDLSGQAGP

SEQ ID NO: 959571 - protein, 26 aa, Mycobacterium
EDPAETALQGPLPPPDRGCEGNPGRV

SEQ ID NO: 959572 - protein, 5 aa, Mycobacterium
EDPDR

SEQ ID NO: 959573 - protein, 7 aa, Mycobacterium
EDPEDPD

SEQ ID NO: 959574 - protein, 23 aa, Mycobacterium
EDPKFASSVRGGGFRAPTARRRL

SEQ ID NO: 959575 - protein, 10 aa, Mycobacterium
EDPPREGIGD

SEQ ID NO: 959576 - protein, 9 aa, Mycobacterium
EDPSPQRLK

SEQ ID NO: 959577 - protein, 7 aa, Mycobacterium
EDRARKG

SEQ ID NO: 959578 - protein, 8 aa, Mycobacterium
EDRGGDRR

SEQ ID NO: 959579 - protein, 12 aa, Mycobacterium
EDRHRTHTGNGA

SEQ ID NO: 959580 - protein, 5 aa, Mycobacterium
EDRNE

SEQ ID NO: 959581 - protein, 8 aa, Mycobacterium
EDRRDLAE

SEQ ID NO: 959582 - protein, 6 aa, Mycobacterium
EDTLPG

SEQ ID NO: 959583 - protein, 16 aa, Mycobacterium
EDTQRTNRYRATRNRV

SEQ ID NO: 959584 - protein, 5 aa, Mycobacterium
EDVDG

SEQ ID NO: 959585 - protein, 6 aa, Mycobacterium
EDYQKV

SEQ ID NO: 959586 - protein, 9 aa, Mycobacterium
EEAERDNRV

SEQ ID NO: 959587 - protein, 9 aa, Mycobacterium
EEAGTAKPK

SEQ ID NO: 959588 - protein, 15 aa, Mycobacterium
EEAPEPDPDELPATG

SEQ ID NO: 959589 - protein, 4 aa, Mycobacterium
EEDR

SEQ ID NO: 959590 - protein, 16 aa, Mycobacterium
EEGSTRLTDYPYDPYV

SEQ ID NO: 959591 - protein, 9 aa, Mycobacterium
EEHPVGPPR

SEQ ID NO: 959592 - protein, 4 aa, Mycobacterium
EEHQ

SEQ ID NO: 959593 - protein, 18 aa, Mycobacterium
EELPESQVAADDSGVTLN

SEQ ID NO: 959594 - protein, 7 aa, Mycobacterium
EEPIDHT

SEQ ID NO: 959595 - protein, 21 aa, Mycobacterium
EEPPAADGGATTRSPGPADDP

SEQ ID NO: 959596 - protein, 15 aa, Mycobacterium
EEQAGQSEGLPPDDV

SEQ ID NO: 959597 - protein, 6 aa, Mycobacterium
EEQCET

SEQ ID NO: 959598 - protein, 6 aa, Mycobacterium
EEQRQV

SEQ ID NO: 959599 - protein, 15 aa, Mycobacterium
EEQRRRVAAEQQSQT

SEQ ID NO: 959600 - protein, 7 aa, Mycobacterium
EERHARS

SEQ ID NO: 959601 - protein, 9 aa, Mycobacterium
EERPPAESS

SEQ ID NO: 959602 - protein, 9 aa, Mycobacterium
EESLRQGTE

SEQ ID NO: 959603 - protein, 7 aa, Mycobacterium
EESTEAY

SEQ ID NO: 959604 - protein, 10 aa, Mycobacterium
EETKHPQRDV

SEQ ID NO: 959605 - protein, 17 aa, Mycobacterium
EETPPQPRDPAAATEIP

SEQ ID NO: 959606 - protein, 5 aa, Mycobacterium
EEYRR

SEQ ID NO: 959607 - protein, 7 aa, Mycobacterium
EFEKSAN

SEQ ID NO: 959608 - protein, 8 aa, Mycobacterium
EFSDSGAV

SEQ ID NO: 959609 - protein, 6 aa, Mycobacterium
EFSSDP

SEQ ID NO: 959610 - protein, 9 aa, Mycobacterium
EGAAEGAAS

SEQ ID NO: 959611 - protein, 94 aa, Mycobacterium
EGADISAASDHADESAANSGDTSSSATSRGPKTTGPKGRPTPKRNDATRSKKGPVVPAPMTSAEARARRKKLARPKLSREERKAEKAAGRARMA

SEQ ID NO: 959612 - protein, 15 aa, Mycobacterium
EGAGSPKQLKPGDTI

SEQ ID NO: 959613 - protein, 10 aa, Mycobacterium
EGAGYGPTTQ

SEQ ID NO: 959614 - protein, 9 aa, Mycobacterium
EGASGSALR

SEQ ID NO: 959615 - protein, 11 aa, Mycobacterium
EGASQESELPS

SEQ ID NO: 959616 - protein, 8 aa, Mycobacterium
EGDYDGTE

SEQ ID NO: 959617 - protein, 10 aa, Mycobacterium
EGEQTIAQEH

SEQ ID NO: 959618 - protein, 6 aa, Mycobacterium
EGETDS

SEQ ID NO: 959619 - protein, 11 aa, Mycobacterium
EGETSSPSSLS

SEQ ID NO: 959620 - protein, 6 aa, Mycobacterium
EGGAGL

SEQ ID NO: 959621 - protein, 8 aa, Mycobacterium
EGGPEGVG

SEQ ID NO: 959622 - protein, 12 aa, Mycobacterium
EGMPGGSDPASW

SEQ ID NO: 959623 - protein, 5 aa, Mycobacterium
EGMPR

SEQ ID NO: 959624 - protein, 8 aa, Mycobacterium
EGNPDSPT

SEQ ID NO: 959625 - protein, 4 aa, Mycobacterium
EGPA

SEQ ID NO: 959626 - protein, 14 aa, Mycobacterium
EGPAPRDTQLPARA

SEQ ID NO: 959627 - protein, 14 aa, Mycobacterium
EGPGTPEVLGDEPR

SEQ ID NO: 959628 - protein, 8 aa, Mycobacterium
EGPQPPDQ

SEQ ID NO: 959629 - protein, 4 aa, Mycobacterium
EGPV

SEQ ID NO: 959630 - protein, 12 aa, Mycobacterium
EGPVKPPKQLSA

SEQ ID NO: 959631 - protein, 4 aa, Mycobacterium
EGQA

SEQ ID NO: 959632 - protein, 6 aa, Mycobacterium
EGQAAD

SEQ ID NO: 959633 - protein, 8 aa, Mycobacterium
EGQDEGLS

SEQ ID NO: 959634 - protein, 8 aa, Mycobacterium
EGQEGDRG

SEQ ID NO: 959635 - protein, 16 aa, Mycobacterium
EGRDPTDRPPEPDTEG

SEQ ID NO: 959636 - protein, 11 aa, Mycobacterium
EGREDPAGADG

SEQ ID NO: 959637 - protein, 4 aa, Mycobacterium
EGRG

SEQ ID NO: 959638 - protein, 19 aa, Mycobacterium
EGRHRTRTTGQQPTGLPGD

SEQ ID NO: 959639 - protein, 10 aa, Mycobacterium
EGRNPTTGET

SEQ ID NO: 959640 - protein, 5 aa, Mycobacterium
EGSPS

SEQ ID NO: 959641 - protein, 5 aa, Mycobacterium
EGTDA

SEQ ID NO: 959642 - protein, 9 aa, Mycobacterium
EGTNSTEDY

SEQ ID NO: 959643 - protein, 16 aa, Mycobacterium
EGTRLDTTEVGPFKKG

SEQ ID NO: 959644 - protein, 4 aa, Mycobacterium
EGTT

SEQ ID NO: 959645 - protein, 14 aa, Mycobacterium
EGVPDAAADGASTC

SEQ ID NO: 959646 - protein, 9 aa, Mycobacterium
EGYDTETAV

SEQ ID NO: 959647 - protein, 5 aa, Mycobacterium
EHIPD

SEQ ID NO: 959648 - protein, 8 aa, Mycobacterium
EHNGARVD

SEQ ID NO: 959649 - protein, 10 aa, Mycobacterium
EHPDGAGAAL

SEQ ID NO: 959650 - protein, 6 aa, Mycobacterium
EHPQPG

SEQ ID NO: 959651 - protein, 5 aa, Mycobacterium
EHPSA

SEQ ID NO: 959652 - protein, 7 aa, Mycobacterium
EHSSPDQ

SEQ ID NO: 959653 - protein, 7 aa, Mycobacterium
EHSTEDQ

SEQ ID NO: 959654 - protein, 4 aa, Mycobacterium
EHTV

SEQ ID NO: 959655 - protein, 7 aa, Mycobacterium
EIAEQRR

SEQ ID NO: 959656 - protein, 5 aa, Mycobacterium
EIARG

SEQ ID NO: 959657 - protein, 7 aa, Mycobacterium
EIEGGAA

SEQ ID NO: 959658 - protein, 4 aa, Mycobacterium
EIGA

SEQ ID NO: 959659 - protein, 5 aa, Mycobacterium
EIGAG

SEQ ID NO: 959660 - protein, 8 aa, Mycobacterium
EIREGRSF

SEQ ID NO: 959661 - protein, 16 aa, Mycobacterium
EISNSGLPKQAARAQL

SEQ ID NO: 959662 - protein, 28 aa, Mycobacterium
EISNSGLPKQAARAQLAGATDISPVAGQ

SEQ ID NO: 959663 - protein, 10 aa, Mycobacterium
EKELNEESNF

SEQ ID NO: 959664 - protein, 9 aa, Mycobacterium
EKIATDGTV

SEQ ID NO: 959665 - protein, 7 aa, Mycobacterium
EKKRTAR

SEQ ID NO: 959666 - protein, 7 aa, Mycobacterium
EKKSLAD

SEQ ID NO: 959667 - protein, 8 aa, Mycobacterium
EKKSLAER

SEQ ID NO: 959668 - protein, 5 aa, Mycobacterium
EKNNE

SEQ ID NO: 959669 - protein, 10 aa, Mycobacterium
EKPEAEPKPW

SEQ ID NO: 959670 - protein, 9 aa, Mycobacterium
EKPSAGTGA

SEQ ID NO: 959671 - protein, 8 aa, Mycobacterium
EKPTMTNG

SEQ ID NO: 959672 - protein, 5 aa, Mycobacterium
EKRRT

SEQ ID NO: 959673 - protein, 16 aa, Mycobacterium
EKTAQTATDEIHRDEN

SEQ ID NO: 959674 - protein, 8 aa, Mycobacterium
EKTSTYKA

SEQ ID NO: 959675 - protein, 4 aa, Mycobacterium
EKVD

SEQ ID NO: 959676 - protein, 10 aa, Mycobacterium
ELAEGSSREE

SEQ ID NO: 959677 - protein, 12 aa, Mycobacterium
ELAGANAAEREP

SEQ ID NO: 959678 - protein, 9 aa, Mycobacterium
ELAGGDPDT

SEQ ID NO: 959679 - protein, 5 aa, Mycobacterium
ELAKN

SEQ ID NO: 959680 - protein, 10 aa, Mycobacterium
ELAQTTSTGP

SEQ ID NO: 959681 - protein, 8 aa, Mycobacterium
ELDDTRRA

SEQ ID NO: 959682 - protein, 9 aa, Mycobacterium
ELGDGAGER

SEQ ID NO: 959683 - protein, 13 aa, Mycobacterium
ELGGGSSEASGDT

SEQ ID NO: 959684 - protein, 11 aa, Mycobacterium
ELGGPADSDLG

SEQ ID NO: 959685 - protein, 15 aa, Mycobacterium
ELPAGAAKADTDTTH

SEQ ID NO: 959686 - protein, 10 aa, Mycobacterium
ELPASGGLYP

SEQ ID NO: 959687 - protein, 7 aa, Mycobacterium
ELPEGSD

SEQ ID NO: 959688 - protein, 5 aa, Mycobacterium
ELQEQ

SEQ ID NO: 959689 - protein, 74 aa, Mycobacterium
ELSGKPLPADEPGDEAQSNPAGADSDSDSDAEPDTEPDSESDGEPDADAPAETEDASQPEDSRPRRRRPHPKSS

SEQ ID NO: 959690 - protein, 9 aa, Mycobacterium
ELSPQQART

SEQ ID NO: 959691 - protein, 7 aa, Mycobacterium
ELSPSPT

SEQ ID NO: 959692 - protein, 6 aa, Mycobacterium
ELTDPV

SEQ ID NO: 959693 - protein, 10 aa, Mycobacterium
ELTPDGQPWS

SEQ ID NO: 959694 - protein, 5 aa, Mycobacterium
ELTPG

SEQ ID NO: 959695 - protein, 5 aa, Mycobacterium
ELTRH

SEQ ID NO: 959696 - protein, 16 aa, Mycobacterium
EMGPAGSAGSTAALGG

SEQ ID NO: 959697 - protein, 20 aa, Mycobacterium
EMPPSPGNSPALRGSDGTAV

SEQ ID NO: 959698 - protein, 8 aa, Mycobacterium
ENARQAGQ

SEQ ID NO: 959699 - protein, 4 aa, Mycobacterium
ENAT

SEQ ID NO: 959700 - protein, 15 aa, Mycobacterium
ENGAQQELIPGGTQQ

SEQ ID NO: 959701 - protein, 14 aa, Mycobacterium
ENGDDSAPSDLAQR

SEQ ID NO: 959702 - protein, 16 aa, Mycobacterium
ENKGNPWGQNASDRTN

SEQ ID NO: 959703 - protein, 7 aa, Mycobacterium
ENNTGNM

SEQ ID NO: 959704 - protein, 7 aa, Mycobacterium
ENPQYPA

SEQ ID NO: 959705 - protein, 6 aa, Mycobacterium
ENPRRR

SEQ ID NO: 959706 - protein, 7 aa, Mycobacterium
ENPSGTV

SEQ ID NO: 959707 - protein, 9 aa, Mycobacterium
ENPSLDQPG

SEQ ID NO: 959708 - protein, 4 aa, Mycobacterium
ENRH

SEQ ID NO: 959709 - protein, 6 aa, Mycobacterium
ENSPSW

SEQ ID NO: 959710 - protein, 7 aa, Mycobacterium
ENTHDRD

SEQ ID NO: 959711 - protein, 5 aa, Mycobacterium
ENTHG

SEQ ID NO: 959712 - protein, 7 aa, Mycobacterium
ENVAAGA

SEQ ID NO: 959713 - protein, 11 aa, Mycobacterium
EPAAAPRSTAS

SEQ ID NO: 959714 - protein, 4 aa, Mycobacterium
EPAE

SEQ ID NO: 959715 - protein, 8 aa, Mycobacterium
EPALAGPL

SEQ ID NO: 959716 - protein, 13 aa, Mycobacterium
EPALASPGRPQAP

SEQ ID NO: 959717 - protein, 5 aa, Mycobacterium
EPANP

SEQ ID NO: 959718 - protein, 4 aa, Mycobacterium
EPDA

SEQ ID NO: 959719 - protein, 5 aa, Mycobacterium
EPDEI

SEQ ID NO: 959720 - protein, 10 aa, Mycobacterium
EPDGAASLPD

SEQ ID NO: 959721 - protein, 16 aa, Mycobacterium
EPDTDHDPSRSCNEQR

SEQ ID NO: 959722 - protein, 5 aa, Mycobacterium
EPDTN

SEQ ID NO: 959723 - protein, 26 aa, Mycobacterium
EPEEAADPASALQPPVSRTGRAPALT

SEQ ID NO: 959724 - protein, 13 aa, Mycobacterium
EPENSVASGKSLA

SEQ ID NO: 959725 - protein, 28 aa, Mycobacterium
EPEPRWPKSEPITRTKAGPERSEYPRPL

SEQ ID NO: 959726 - protein, 8 aa, Mycobacterium
EPERRPAE

SEQ ID NO: 959727 - protein, 4 aa, Mycobacterium
EPET

SEQ ID NO: 959728 - protein, 9 aa, Mycobacterium
EPGAPRLPE

SEQ ID NO: 959729 - protein, 6 aa, Mycobacterium
EPGDRL

SEQ ID NO: 959730 - protein, 19 aa, Mycobacterium
EPGTGSTKPTGTVLAELPL

SEQ ID NO: 959731 - protein, 11 aa, Mycobacterium
EPIQAQPCEPE

SEQ ID NO: 959732 - protein, 7 aa, Mycobacterium
EPKTAVR

SEQ ID NO: 959733 - protein, 81 aa, Mycobacterium
EPNSGAPGYEAAGYPPSGYADPPPAYGPPPAYGPPPGYGAPPPGYGPPPGYAPPPPGYGPPPGYGPPPGYGPPPPGYGPPL

SEQ ID NO: 959734 - protein, 9 aa, Mycobacterium
EPPFTGDSP

SEQ ID NO: 959735 - protein, 15 aa, Mycobacterium
EPPPRPSQLRPGRVP

SEQ ID NO: 959736 - protein, 5 aa, Mycobacterium
EPPYK

SEQ ID NO: 959737 - protein, 9 aa, Mycobacterium
EPPYKGGPV

SEQ ID NO: 959738 - protein, 8 aa, Mycobacterium
EPSAADDL

SEQ ID NO: 959739 - protein, 8 aa, Mycobacterium
EPSESARR

SEQ ID NO: 959740 - protein, 5 aa, Mycobacterium
EPSGD

SEQ ID NO: 959741 - protein, 43 aa, Mycobacterium
EPTDVATSQPAGYGGSPERSNGDPATVPAAAPAPETGGADGSA

SEQ ID NO: 959742 - protein, 19 aa, Mycobacterium
EPTEAQAGASGRETASGQR

SEQ ID NO: 959743 - protein, 5 aa, Mycobacterium
EPTPA

SEQ ID NO: 959744 - protein, 7 aa, Mycobacterium
EPVGGTE

SEQ ID NO: 959745 - protein, 5 aa, Mycobacterium
EPVNE

SEQ ID NO: 959746 - protein, 8 aa, Mycobacterium
EPVSEDDL

SEQ ID NO: 959747 - protein, 18 aa, Mycobacterium
EPWTQRARNELRAAGTAV

SEQ ID NO: 959748 - protein, 17 aa, Mycobacterium
EPWTSRRDSHPDAEPSI

SEQ ID NO: 959749 - protein, 31 aa, Mycobacterium
EQAAPAPRFSRTPAGPVGPPPATTTPIGEIN

SEQ ID NO: 959750 - protein, 14 aa, Mycobacterium
EQALGQDASPSSDV

SEQ ID NO: 959751 - protein, 5 aa, Mycobacterium
EQARA

SEQ ID NO: 959752 - protein, 10 aa, Mycobacterium
EQARTTNPAS

SEQ ID NO: 959753 - protein, 5 aa, Mycobacterium
EQATV

SEQ ID NO: 959754 - protein, 11 aa, Mycobacterium
EQCTGPGPAAL

SEQ ID NO: 959755 - protein, 7 aa, Mycobacterium
EQDADNA

SEQ ID NO: 959756 - protein, 43 aa, Mycobacterium
EQDPYGADDRHPELGAEEYPDFGTHPDGPEPSDPKPAATPPPS

SEQ ID NO: 959757 - protein, 6 aa, Mycobacterium
EQEAEQ

SEQ ID NO: 959758 - protein, 16 aa, Mycobacterium
EQETTRRGTATAGVGP

SEQ ID NO: 959759 - protein, 4 aa, Mycobacterium
EQGP

SEQ ID NO: 959760 - protein, 4 aa, Mycobacterium
EQGR

SEQ ID NO: 959761 - protein, 5 aa, Mycobacterium
EQGRG

SEQ ID NO: 959762 - protein, 4 aa, Mycobacterium
EQGT

SEQ ID NO: 959763 - protein, 4 aa, Mycobacterium
EQPK

SEQ ID NO: 959764 - protein, 7 aa, Mycobacterium
EQRATEP

SEQ ID NO: 959765 - protein, 4 aa, Mycobacterium
EQRE

SEQ ID NO: 959766 - protein, 6 aa, Mycobacterium
EQRHAN

SEQ ID NO: 959767 - protein, 10 aa, Mycobacterium
EQRKGQLADP

SEQ ID NO: 959768 - protein, 6 aa, Mycobacterium
EQRPAL

SEQ ID NO: 959769 - protein, 5 aa, Mycobacterium
EQRPL

SEQ ID NO: 959770 - protein, 7 aa, Mycobacterium
EQRREND

SEQ ID NO: 959771 - protein, 5 aa, Mycobacterium
EQSAA

SEQ ID NO: 959772 - protein, 14 aa, Mycobacterium
EQSIADTDEPETRL

SEQ ID NO: 959773 - protein, 7 aa, Mycobacterium
EQSLGGS

SEQ ID NO: 959774 - protein, 12 aa, Mycobacterium
EQSNPVLPGTEP

SEQ ID NO: 959775 - protein, 8 aa, Mycobacterium
EQSYAAAN

SEQ ID NO: 959776 - protein, 8 aa, Mycobacterium
EQVDSPQC

SEQ ID NO: 959777 - protein, 9 aa, Mycobacterium
EQYRRQSSI

SEQ ID NO: 959778 - protein, 8 aa, Mycobacterium
ERAKGRGW

SEQ ID NO: 959779 - protein, 23 aa, Mycobacterium
ERANQDEKRHRTSGSGGLGPQAS

SEQ ID NO: 959780 - protein, 7 aa, Mycobacterium
ERARTGA

SEQ ID NO: 959781 - protein, 12 aa, Mycobacterium
ERASYRDTRAAG

SEQ ID NO: 959782 - protein, 7 aa, Mycobacterium
ERDAPTE

SEQ ID NO: 959783 - protein, 6 aa, Mycobacterium
ERDPRE

SEQ ID NO: 959784 - protein, 31 aa, Mycobacterium
ERDSKESAESEEPIESEEGKKTGKKSDADSS

SEQ ID NO: 959785 - protein, 27 aa, Mycobacterium
EREPDPESAPAAPAQAGESEAASAEGH

SEQ ID NO: 959786 - protein, 7 aa, Mycobacterium
EREPVPP

SEQ ID NO: 959787 - protein, 5 aa, Mycobacterium
ERGDL

SEQ ID NO: 959788 - protein, 9 aa, Mycobacterium
ERGHPGATI

SEQ ID NO: 959789 - protein, 14 aa, Mycobacterium
ERGPRLAPPPAMPP

SEQ ID NO: 959790 - protein, 8 aa, Mycobacterium
ERGRAVNT

SEQ ID NO: 959791 - protein, 11 aa, Mycobacterium
ERGTELGGQER

SEQ ID NO: 959792 - protein, 5 aa, Mycobacterium
ERGVR

SEQ ID NO: 959793 - protein, 9 aa, Mycobacterium
ERHERSTHA

SEQ ID NO: 959794 - protein, 4 aa, Mycobacterium
ERIN

SEQ ID NO: 959795 - protein, 5 aa, Mycobacterium
ERIPP

SEQ ID NO: 959796 - protein, 4 aa, Mycobacterium
ERIR

SEQ ID NO: 959797 - protein, 5 aa, Mycobacterium
ERLPK

SEQ ID NO: 959798 - protein, 10 aa, Mycobacterium
ERNEEDPDRL

SEQ ID NO: 959799 - protein, 9 aa, Mycobacterium
ERNNPDGSV

SEQ ID NO: 959800 - protein, 7 aa, Mycobacterium
ERPDSGG

SEQ ID NO: 959801 - protein, 27 aa, Mycobacterium
ERQQREAASKDQDEAEQPADADGEADY

SEQ ID NO: 959802 - protein, 4 aa, Mycobacterium
ERQS

SEQ ID NO: 959803 - protein, 9 aa, Mycobacterium
ERRAKQAKR

SEQ ID NO: 959804 - protein, 11 aa, Mycobacterium
ERRKSQRELSQ

SEQ ID NO: 959805 - protein, 5 aa, Mycobacterium
ERRRQ

SEQ ID NO: 959806 - protein, 7 aa, Mycobacterium
ERRRSRR

SEQ ID NO: 959807 - protein, 5 aa, Mycobacterium
ERRSA

SEQ ID NO: 959808 - protein, 23 aa, Mycobacterium
ERSEEDNVTSDQGTNNDQNPGHH

SEQ ID NO: 959809 - protein, 4 aa, Mycobacterium
ERSK

SEQ ID NO: 959810 - protein, 5 aa, Mycobacterium
ERSRY

SEQ ID NO: 959811 - protein, 7 aa, Mycobacterium
ERTGAAI

SEQ ID NO: 959812 - protein, 5 aa, Mycobacterium
ERTGW

SEQ ID NO: 959813 - protein, 5 aa, Mycobacterium
ERTTE

SEQ ID NO: 959814 - protein, 12 aa, Mycobacterium
ERVDTGRAARGG

SEQ ID NO: 959815 - protein, 12 aa, Mycobacterium
ESDGDGTTVESH

SEQ ID NO: 959816 - protein, 6 aa, Mycobacterium
ESDSDS

SEQ ID NO: 959817 - protein, 9 aa, Mycobacterium
ESDTGSAAE

SEQ ID NO: 959818 - protein, 4 aa, Mycobacterium
ESEA

SEQ ID NO: 959819 - protein, 6 aa, Mycobacterium
ESEASR

SEQ ID NO: 959820 - protein, 16 aa, Mycobacterium
ESEHHGDGDGRESARA

SEQ ID NO: 959821 - protein, 9 aa, Mycobacterium
ESEVPPAPA

SEQ ID NO: 959822 - protein, 22 aa, Mycobacterium
ESGAAESGADPHDDRDDDPNSL

SEQ ID NO: 959823 - protein, 7 aa, Mycobacterium
ESGATGI

SEQ ID NO: 959824 - protein, 7 aa, Mycobacterium
ESGFNDA

SEQ ID NO: 959825 - protein, 6 aa, Mycobacterium
ESHSTA

SEQ ID NO: 959826 - protein, 6 aa, Mycobacterium
ESHTTS

SEQ ID NO: 959827 - protein, 4 aa, Mycobacterium
ESIP

SEQ ID NO: 959828 - protein, 4 aa, Mycobacterium
ESLP

SEQ ID NO: 959829 - protein, 8 aa, Mycobacterium
ESLPARPD

SEQ ID NO: 959830 - protein, 8 aa, Mycobacterium
ESLPTRPD

SEQ ID NO: 959831 - protein, 8 aa, Mycobacterium
ESNPDTRP

SEQ ID NO: 959832 - protein, 5 aa, Mycobacterium
ESNPI

SEQ ID NO: 959833 - protein, 8 aa, Mycobacterium
ESPAANRR

SEQ ID NO: 959834 - protein, 5 aa, Mycobacterium
ESPAY

SEQ ID NO: 959835 - protein, 7 aa, Mycobacterium
ESPEGRS

SEQ ID NO: 959836 - protein, 7 aa, Mycobacterium
ESPTLGQ

SEQ ID NO: 959837 - protein, 11 aa, Mycobacterium
ESRASGRRRVP

SEQ ID NO: 959838 - protein, 57 aa, Mycobacterium; identical to SEQ ID NO: 257431

SEQ ID NO: 959839 - protein, 9 aa, Mycobacterium
ESRDPDPTE

SEQ ID NO: 959840 - protein, 7 aa, Mycobacterium
ESRERQA

SEQ ID NO: 959841 - protein, 6 aa, Mycobacterium
ESRSDS

SEQ ID NO: 959842 - protein, 6 aa, Mycobacterium
ESRSQA

SEQ ID NO: 959843 - protein, 6 aa, Mycobacterium
ESRTAL

SEQ ID NO: 959844 - protein, 8 aa, Mycobacterium
ESSDTPQV

SEQ ID NO: 959845 - protein, 10 aa, Mycobacterium
ESSLTERQAE

SEQ ID NO: 959846 - protein, 6 aa, Mycobacterium
ESSPRH

SEQ ID NO: 959847 - protein, 20 aa, Mycobacterium
ESSRGYAASIGTTGTSNGHP

SEQ ID NO: 959848 - protein, 13 aa, Mycobacterium
ESSVYDEPGAAPR

SEQ ID NO: 959849 - protein, 4 aa, Mycobacterium
ESTA

SEQ ID NO: 959850 - protein, 7 aa, Mycobacterium
ESTGEPH

SEQ ID NO: 959851 - protein, 7 aa, Mycobacterium
ESTQPAV

SEQ ID NO: 959852 - protein, 5 aa, Mycobacterium
ESTRD

SEQ ID NO: 959853 - protein, 5 aa, Mycobacterium
ESVGG

SEQ ID NO: 959854 - protein, 7 aa, Mycobacterium
ESVKETR

SEQ ID NO: 959855 - protein, 45 aa, Mycobacterium
ESVKETRTALTPGHDKAQARPRKLTGSGTNPENNPDRRTPADPSG

SEQ ID NO: 959856 - protein, 7 aa, Mycobacterium
ESVPVEK

SEQ ID NO: 959857 - protein, 7 aa, Mycobacterium
ESVSSGP

SEQ ID NO: 959858 - protein, 8 aa, Mycobacterium
ETAGSRRA

SEQ ID NO: 959859 - protein, 10 aa, Mycobacterium
ETASELPDGQ

SEQ ID NO: 959860 - protein, 13 aa, Mycobacterium
ETCNGDSARRSGN

SEQ ID NO: 959861 - protein, 10 aa, Mycobacterium
ETDRTGGQRR

SEQ ID NO: 959862 - protein, 10 aa, Mycobacterium
ETDSANRAAT

SEQ ID NO: 959863 - protein, 4 aa, Mycobacterium
ETGA

SEQ ID NO: 959864 - protein, 31 aa, Mycobacterium
ETGAVGGADAAATEAADRRDRPTIPAALSGR

SEQ ID NO: 959865 - protein, 5 aa, Mycobacterium
ETGPE

SEQ ID NO: 959866 - protein, 5 aa, Mycobacterium
ETGSG

SEQ ID NO: 959867 - protein, 9 aa, Mycobacterium
ETGTTTAST

SEQ ID NO: 959868 - protein, 7 aa, Mycobacterium
ETKQRPY

SEQ ID NO: 959869 - protein, 11 aa, Mycobacterium
ETKSDQEGMQG

SEQ ID NO: 959870 - protein, 11 aa, Mycobacterium
ETLAGASESVS

SEQ ID NO: 959871 - protein, 6 aa, Mycobacterium
ETLGMK

SEQ ID NO: 959872 - protein, 6 aa, Mycobacterium
ETLSEN

SEQ ID NO: 959873 - protein, 11 aa, Mycobacterium
ETLSNEQTEKL

SEQ ID NO: 959874 - protein, 28 aa, Mycobacterium
ETNASERRAGPGSGREPNYRRRSPVETT

SEQ ID NO: 959875 - protein, 11 aa, Mycobacterium
ETNGEGTPQIQ

SEQ ID NO: 959876 - protein, 7 aa, Mycobacterium
ETNRAPF

SEQ ID NO: 959877 - protein, 5 aa, Mycobacterium
ETNRG

SEQ ID NO: 959878 - protein, 6 aa, Mycobacterium
ETPAEE

SEQ ID NO: 959879 - protein, 7 aa, Mycobacterium
ETPTPSL

SEQ ID NO: 959880 - protein, 27 aa, Mycobacterium
ETQSEEPAASSEDNQDTEDTSQTPDIE

SEQ ID NO: 959881 - protein, 7 aa, Mycobacterium
ETRERAE

SEQ ID NO: 959882 - protein, 12 aa, Mycobacterium
ETRRGQQAPMPV

SEQ ID NO: 959883 - protein, 6 aa, Mycobacterium
ETRTGG

SEQ ID NO: 959884 - protein, 14 aa, Mycobacterium
ETRTYRDAKSNTEV

SEQ ID NO: 959885 - protein, 8 aa, Mycobacterium
ETSDVSAS

SEQ ID NO: 959886 - protein, 20 aa, Mycobacterium
ETSGVRSQSQWRGPSSCSLS

SEQ ID NO: 959887 - protein, 9 aa, Mycobacterium
ETSSRVGQR

SEQ ID NO: 959888 - protein, 16 aa, Mycobacterium
ETTQFSAADETAAIDP

SEQ ID NO: 959889 - protein, 7 aa, Mycobacterium
ETVEGRG

SEQ ID NO: 959890 - protein, 11 aa, Mycobacterium
EVADTAPSPVG

SEQ ID NO: 959891 - protein, 4 aa, Mycobacterium
EVAG

SEQ ID NO: 959892 - protein, 5 aa, Mycobacterium
EVAHG

SEQ ID NO: 959893 - protein, 12 aa, Mycobacterium
EVATSDADRAMR

SEQ ID NO: 959894 - protein, 14 aa, Mycobacterium
EVDEPAPASRVQPE

SEQ ID NO: 959895 - protein, 27 aa, Mycobacterium
EVDESTLTGESLPVSKQTEPTPGAPLA

SEQ ID NO: 959896 - protein, 7 aa, Mycobacterium
EVEQTAA

SEQ ID NO: 959897 - protein, 18 aa, Mycobacterium
EVERDTGQRLPDPPGRPL

SEQ ID NO: 959898 - protein, 10 aa, Mycobacterium
EVPGTGYRAG

SEQ ID NO: 959899 - protein, 6 aa, Mycobacterium
EVRPEA

SEQ ID NO: 959900 - protein, 7 aa, Mycobacterium
EVSEREG

SEQ ID NO: 959901 - protein, 4 aa, Mycobacterium
EVSQ

SEQ ID NO: 959902 - protein, 4 aa, Mycobacterium
EYAA

SEQ ID NO: 959903 - protein, 8 aa, Mycobacterium
EYATAAEE

SEQ ID NO: 959904 - protein, 11 aa, Mycobacterium
EYDPATGTYMG

SEQ ID NO: 959905 - protein, 41 aa, Mycobacterium
EYDPATGTYTGPDGRQYTRSDLAQTAPKDQTWQSMLLPPPL

SEQ ID NO: 959906 - protein, 6 aa, Mycobacterium
EYGGDP

SEQ ID NO: 959907 - protein, 17 aa, Mycobacterium
EYGGRRSRSRHSTDYRD

SEQ ID NO: 959908 - protein, 57 aa, Mycobacterium
EYPDDDAEAEPAAEDVEDVEEGSEDTEGQEDAESTDAGSDTAEESTVSADAKRDDSA

SEQ ID NO: 959909 - protein, 13 aa, Mycobacterium
EYPGGPLPPSPSL

SEQ ID NO: 959910 - protein, 14 aa, Mycobacterium
EYPTDQYPPNDPAL

SEQ ID NO: 959911 - protein, 6 aa, Mycobacterium
FAAERQ

SEQ ID NO: 959912 - protein, 7 aa, Mycobacterium
FAGEAQA

SEQ ID NO: 959913 - protein, 10 aa, Mycobacterium
FAGEGTTTTA

SEQ ID NO: 959914 - protein, 21 aa, Mycobacterium
FAPDPAPSPPQGPVGGGFSPP

SEQ ID NO: 959915 - protein, 15 aa, Mycobacterium
FAPGGPTAAVPPGSW

SEQ ID NO: 959916 - protein, 5 aa, Mycobacterium
FAPNA

SEQ ID NO: 959917 - protein, 7 aa, Mycobacterium
FAPTATN

SEQ ID NO: 959918 - protein, 6 aa, Mycobacterium
FAPTDD

SEQ ID NO: 959919 - protein, 6 aa, Mycobacterium
FAQQGR

SEQ ID NO: 959920 - protein, 46 aa, Mycobacterium
FASTSPGGFAPSSPAVPVPGSAPSTGWPAPSVPGAPVAPSAPVPTP

SEQ ID NO: 959921 - protein, 7 aa, Mycobacterium
FATRDSE

SEQ ID NO: 959922 - protein, 18 aa, Mycobacterium
FDAPPGKGGDQLDGRRGQ

SEQ ID NO: 959923 - protein, 6 aa, Mycobacterium
FDASKN

SEQ ID NO: 959924 - protein, 5 aa, Mycobacterium
FDDTA

SEQ ID NO: 959925 - protein, 5 aa, Mycobacterium
FDEAQ

SEQ ID NO: 959926 - protein, 14 aa, Mycobacterium
FDGEVTSQKFTGGE

SEQ ID NO: 959927 - protein, 8 aa, Mycobacterium
FDPEDTSE

SEQ ID NO: 959928 - protein, 7 aa, Mycobacterium
FDPNSKF

SEQ ID NO: 959929 - protein, 7 aa, Mycobacterium
FDQSRTP

SEQ ID NO: 959930 - protein, 10 aa, Mycobacterium
FDSDNTTTIV

SEQ ID NO: 959931 - protein, 9 aa, Mycobacterium
FDSSRNDDS

SEQ ID NO: 959932 - protein, 9 aa, Mycobacterium
FDTAKNDDS

SEQ ID NO: 959933 - protein, 6 aa, Mycobacterium
FDTHPS

SEQ ID NO: 959934 - protein, 6 aa, Mycobacterium
FDVGGS

SEQ ID NO: 959935 - protein, 15 aa, Mycobacterium
FEDDSAEGVEQGEDW

SEQ ID NO: 959936 - protein, 5 aa, Mycobacterium
FEPQR

SEQ ID NO: 959937 - protein, 14 aa, Mycobacterium
FERPGQASGPQDRT

SEQ ID NO: 959938 - protein, 37 aa, Mycobacterium
FGASARTKAPEPCDAEAAARTAPAQQQPRSQRRRRAK

SEQ ID NO: 959939 - protein, 10 aa, Mycobacterium
FGATAGGVNL

SEQ ID NO: 959940 - protein, 10 aa, Mycobacterium
FGEPVGPGSL

SEQ ID NO: 959941 - protein, 9 aa, Mycobacterium
FGGADGADH

SEQ ID NO: 959942 - protein, 11 aa, Mycobacterium
FGGDGANRSPQ

SEQ ID NO: 959943 - protein, 13 aa, Mycobacterium
FGGEAGPVPNDGF

SEQ ID NO: 959944 - protein, 26 aa, Mycobacterium
FGGGGVSPSADGGGDKHVKATSAADA

SEQ ID NO: 959945 - protein, 5 aa, Mycobacterium
FGGGT

SEQ ID NO: 959946 - protein, 18 aa, Mycobacterium
FGGNPSGGQPRRSGPIQV

SEQ ID NO: 959947 - protein, 8 aa, Mycobacterium
FGGNTRNV

SEQ ID NO: 959948 - protein, 13 aa, Mycobacterium
FGGTDLDRLQEPR

SEQ ID NO: 959949 - protein, 6 aa, Mycobacterium
FGNGPR

SEQ ID NO: 959950 - protein, 5 aa, Mycobacterium
FGNTG

SEQ ID NO: 959951 - protein, 7 aa, Mycobacterium
FGPAPEG

SEQ ID NO: 959952 - protein, 16 aa, Mycobacterium
FGPPTARIVASNGEID

SEQ ID NO: 959953 - protein, 6 aa, Mycobacterium
FGQSGQ

SEQ ID NO: 959954 - protein, 8 aa, Mycobacterium
FGQSQNQA

SEQ ID NO: 959955 - protein, 6 aa, Mycobacterium
FGSDGA

SEQ ID NO: 959956 - protein, 4 aa, Mycobacterium
FGST

SEQ ID NO: 959957 - protein, 6 aa, Mycobacterium
FGTAEA

SEQ ID NO: 959958 - protein, 7 aa, Mycobacterium
FHESDSD

SEQ ID NO: 959959 - protein, 7 aa, Mycobacterium
FKPSGEH

SEQ ID NO: 959960 - protein, 10 aa, Mycobacterium
FNGSPATEPI

SEQ ID NO: 959961 - protein, 8 aa, Mycobacterium
FPDGSADD

SEQ ID NO: 959962 - protein, 9 aa, Mycobacterium
FPDGSPSYE

SEQ ID NO: 959963 - protein, 4 aa, Mycobacterium
FPEN

SEQ ID NO: 959964 - protein, 5 aa, Mycobacterium
FPGGS

SEQ ID NO: 959965 - protein, 4 aa, Mycobacterium
FPGV

SEQ ID NO: 959966 - protein, 10 aa, Mycobacterium
FPKGPTRNAA

SEQ ID NO: 959967 - protein, 7 aa, Mycobacterium
FPNGDAK

SEQ ID NO: 959968 - protein, 9 aa, Mycobacterium
FPNPKEKAR

SEQ ID NO: 959969 - protein, 8 aa, Mycobacterium
FPRPSEKT

SEQ ID NO: 959970 - protein, 14 aa, Mycobacterium
FPRTGPGSLAGTGR

SEQ ID NO: 959971 - protein, 7 aa, Mycobacterium
FPSAGGA

SEQ ID NO: 959972 - protein, 20 aa, Mycobacterium
FPSPPDWTSTATAPFKSATK

SEQ ID NO: 959973 - protein, 4 aa, Mycobacterium
FPSY

SEQ ID NO: 959974 - protein, 15 aa, Mycobacterium
FPTANESDGGIEPAS

SEQ ID NO: 959975 - protein, 15 aa, Mycobacterium
FQGTAASDEAVKRSG

SEQ ID NO: 959976 - protein, 15 aa, Mycobacterium
FQPQEAAASDRTDAE

SEQ ID NO: 959977 - protein, 13 aa, Mycobacterium
FRPATDPNSPTGL

SEQ ID NO: 959978 - protein, 4 aa, Mycobacterium
FRPD

SEQ ID NO: 959979 - protein, 9 aa, Mycobacterium
FSDADAPDR

SEQ ID NO: 959980 - protein, 7 aa, Mycobacterium
FSDTPPQ

SEQ ID NO: 959981 - protein, 4 aa, Mycobacterium
FSGD

SEQ ID NO: 959982 - protein, 15 aa, Mycobacterium
FSGGDAIRPRPNIED

SEQ ID NO: 959983 - protein, 7 aa, Mycobacterium
FSGGQRQ

SEQ ID NO: 959984 - protein, 5 aa, Mycobacterium
FSGGS

SEQ ID NO: 959985 - protein, 8 aa, Mycobacterium
FSGGTAAV

SEQ ID NO: 959986 - protein, 7 aa, Mycobacterium
FSKPAPS

SEQ ID NO: 959987 - protein, 10 aa, Mycobacterium
FSNASGLRPG

SEQ ID NO: 959988 - protein, 4 aa, Mycobacterium
FSPA

SEQ ID NO: 959989 - protein, 13 aa, Mycobacterium
FSPGAPNASADRA

SEQ ID NO: 959990 - protein, 14 aa, Mycobacterium
FSPGGTPDHPGQAG

SEQ ID NO: 959991 - protein, 6 aa, Mycobacterium
FSPSLQ

SEQ ID NO: 959992 - protein, 24 aa, Mycobacterium
FSPSMQPSRDLAAGTERVAAGDYS

SEQ ID NO: 959993 - protein, 19 aa, Mycobacterium
FSRANDAIKAATGRTPTLY

SEQ ID NO: 959994 - protein, 6 aa, Mycobacterium
FSSAAA

SEQ ID NO: 959995 - protein, 10 aa, Mycobacterium
FSSDAQGIAN

SEQ ID NO: 959996 - protein, 7 aa, Mycobacterium
FSSGDVT

SEQ ID NO: 959997 - protein, 12 aa, Mycobacterium
FSTSDDEAAPFD

SEQ ID NO: 959998 - protein, 7 aa, Mycobacterium
FSTTPTT

SEQ ID NO: 959999 - protein, 14 aa, Mycobacterium
FTAGTPVQTLTDGR

SEQ ID NO: 960000 - protein, 22 aa, Mycobacterium
FTDASSAKRNVSTPAVGAQSGN

SEQ ID NO: 960001 - protein, 8 aa, Mycobacterium
FTDGDTRT

SEQ ID NO: 960002 - protein, 5 aa, Mycobacterium
FTGGT

SEQ ID NO: 960003 - protein, 6 aa, Mycobacterium
FTGNGG

SEQ ID NO: 960004 - protein, 7 aa, Mycobacterium
FTPAQAT

SEQ ID NO: 960005 - protein, 13 aa, Mycobacterium
FTQPTAANDPVYA

SEQ ID NO: 960006 - protein, 24 aa, Mycobacterium
FTSEATGDVRTGGADGADTATGPT

SEQ ID NO: 960007 - protein, 4 aa, Mycobacterium
GAAE

SEQ ID NO: 960008 - protein, 7 aa, Mycobacterium
GAAEGVS

SEQ ID NO: 960009 - protein, 6 aa, Mycobacterium
GAAGEP

SEQ ID NO: 960010 - protein, 16 aa, Mycobacterium
GAAGGALAALASRRQS

SEQ ID NO: 960011 - protein, 20 aa, Mycobacterium
GAAGGPAAVESTDTLWLTRP

SEQ ID NO: 960012 - protein, 20 aa, Mycobacterium
GAAGPATPSPAQAHAANDES

SEQ ID NO: 960013 - protein, 15 aa, Mycobacterium
GAAGTLPPEKKPEVG

SEQ ID NO: 960014 - protein, 7 aa, Mycobacterium
GAAGTTA

SEQ ID NO: 960015 - protein, 9 aa, Mycobacterium
GAAGVSGAG

SEQ ID NO: 960016 - protein, 27 aa, Mycobacterium
GAAHPGLAGAASSSDERGGPRAPRRRK

SEQ ID NO: 960017 - protein, 4 aa, Mycobacterium
GAAL

SEQ ID NO: 960018 - protein, 18 aa, Mycobacterium
GAAPPHRPRRRAYGPTPR

SEQ ID NO: 960019 - protein, 10 aa, Mycobacterium
GAAPPLGAEG

SEQ ID NO: 960020 - protein, 10 aa, Mycobacterium
GAAQSGPTQY

SEQ ID NO: 960021 - protein, 14 aa, Mycobacterium
GAARDAQKKGDFAA

SEQ ID NO: 960022 - protein, 6 aa, Mycobacterium
GAATAG

SEQ ID NO: 960023 - protein, 30 aa, Mycobacterium; identical to SEQ ID NO: 258697

SEQ ID NO: 960024 - protein, 6 aa, Mycobacterium
GADAAR

SEQ ID NO: 960025 - protein, 23 aa, Mycobacterium
GADAKSAARASARKKAPRPDGAE

SEQ ID NO: 960026 - protein, 16 aa, Mycobacterium
GADDEDPDAVDTTPTP

SEQ ID NO: 960027 - protein, 9 aa, Mycobacterium
GADESGRRT

SEQ ID NO: 960028 - protein, 30 aa, Mycobacterium; identical to SEQ ID NO: 258712

SEQ ID NO: 960029 - protein, 8 aa, Mycobacterium
GADGDDTT

SEQ ID NO: 960030 - protein, 14 aa, Mycobacterium
GADGPADATGLGLG

SEQ ID NO: 960031 - protein, 5 aa, Mycobacterium
GADNI

SEQ ID NO: 960032 - protein, 8 aa, Mycobacterium
GADNTAEA

SEQ ID NO: 960033 - protein, 7 aa, Mycobacterium
GADPCAG

SEQ ID NO: 960034 - protein, 8 aa, Mycobacterium
GADSSSSE

SEQ ID NO: 960035 - protein, 9 aa, Mycobacterium
GADTQERRA

SEQ ID NO: 960036 - protein, 18 aa, Mycobacterium
GAEANSPVMDKNGGGPLG

SEQ ID NO: 960037 - protein, 5 aa, Mycobacterium
GAEAV

SEQ ID NO: 960038 - protein, 9 aa, Mycobacterium
GAEDETGRA

SEQ ID NO: 960039 - protein, 7 aa, Mycobacterium
GAEPPAK

SEQ ID NO: 960040 - protein, 6 aa, Mycobacterium
GAERTF

SEQ ID NO: 960041 - protein, 5 aa, Mycobacterium
GAEYR

SEQ ID NO: 960042 - protein, 21 aa, Mycobacterium
GAFNNDTERVNGRRGNAADHL

SEQ ID NO: 960043 - protein, 11 aa, Mycobacterium
GAGADTGHADV

SEQ ID NO: 960044 - protein, 5 aa, Mycobacterium
GAGAS

SEQ ID NO: 960045 - protein, 6 aa, Mycobacterium
GAGDAA

SEQ ID NO: 960046 - protein, 18 aa, Mycobacterium
GAGDQRGPASATKSGPDS

SEQ ID NO: 960047 - protein, 7 aa, Mycobacterium
GAGDTRG

SEQ ID NO: 960048 - protein, 9 aa, Mycobacterium
GAGERASNP

SEQ ID NO: 960049 - protein, 15 aa, Mycobacterium
GAGGAAAMSSSGNPL

SEQ ID NO: 960050 - protein, 9 aa, Mycobacterium
GAGGAPGVD

SEQ ID NO: 960051 - protein, 11 aa, Mycobacterium
GAGGQQQMSRP

SEQ ID NO: 960052 - protein, 7 aa, Mycobacterium
GAGGSVT

SEQ ID NO: 960053 - protein, 9 aa, Mycobacterium
GAGIGDGIA

SEQ ID NO: 960054 - protein, 4 aa, Mycobacterium
GAGL

SEQ ID NO: 960055 - protein, 18 aa, Mycobacterium
GAGLSDGFTANGIPANVS

SEQ ID NO: 960056 - protein, 5 aa, Mycobacterium
GAGNL

SEQ ID NO: 960057 - protein, 10 aa, Mycobacterium
GAGPGSGASY

SEQ ID NO: 960058 - protein, 45 aa, Mycobacterium
GAGPPPGPGPAQPPPMASAAPPWPGPQPAEPAAPRLAPPPAPDLA

SEQ ID NO: 960059 - protein, 13 aa, Mycobacterium
GAGRPHHETRPDG

SEQ ID NO: 960060 - protein, 10 aa, Mycobacterium
GAGSDNTVTL

SEQ ID NO: 960061 - protein, 9 aa, Mycobacterium
GAGSGIGRE

SEQ ID NO: 960062 - protein, 9 aa, Mycobacterium
GAGSGVYNA

SEQ ID NO: 960063 - protein, 6 aa, Mycobacterium
GAGSKD

SEQ ID NO: 960064 - protein, 5 aa, Mycobacterium
GAGTA

SEQ ID NO: 960065 - protein, 7 aa, Mycobacterium
GAGTAAH

SEQ ID NO: 960066 - protein, 10 aa, Mycobacterium
GAGTNDTAHS

SEQ ID NO: 960067 - protein, 8 aa, Mycobacterium
GAGTSAAA

SEQ ID NO: 960068 - protein, 38 aa, Mycobacterium
GAHAGSAGSDERHDAPDGRRHGRNAGHAQRNAGSSGRF

SEQ ID NO: 960069 - protein, 7 aa, Mycobacterium
GAHEEAT

SEQ ID NO: 960070 - protein, 6 aa, Mycobacterium
GAIQTT

SEQ ID NO: 960071 - protein, 7 aa, Mycobacterium
GAKPAAV

SEQ ID NO: 960072 - protein, 8 aa, Mycobacterium
GAKPPPGI

SEQ ID NO: 960073 - protein, 8 aa, Mycobacterium
GAKQKDIS

SEQ ID NO: 960074 - protein, 7 aa, Mycobacterium
GAKQQRI

SEQ ID NO: 960075 - protein, 6 aa, Mycobacterium
GALAPR

SEQ ID NO: 960076 - protein, 5 aa, Mycobacterium
GALDD

SEQ ID NO: 960077 - protein, 16 aa, Mycobacterium
GALPPSKSLAQRGIRD

SEQ ID NO: 960078 - protein, 9 aa, Mycobacterium
GANGPSIDR

SEQ ID NO: 960079 - protein, 8 aa, Mycobacterium
GANGSGKT

SEQ ID NO: 960080 - protein, 54 aa, Mycobacterium
GAPAAPPPMPPHPPAPPSPPRPPSQSSPTPPTPELPAASAPAASEGEEQPKSRG

SEQ ID NO: 960081 - protein, 16 aa, Mycobacterium
GAPAHDGAKGKRRRRR

SEQ ID NO: 960082 - protein, 17 aa, Mycobacterium
GAPATLADSVRNGDTQL

SEQ ID NO: 960083 - protein, 6 aa, Mycobacterium
GAPDSV

SEQ ID NO: 960084 - protein, 5 aa, Mycobacterium
GAPGS

SEQ ID NO: 960085 - protein, 6 aa, Mycobacterium
GAPGSH

SEQ ID NO: 960086 - protein, 7 aa, Mycobacterium
GAPIYGS

SEQ ID NO: 960087 - protein, 6 aa, Mycobacterium
GAPLPK

SEQ ID NO: 960088 - protein, 5 aa, Mycobacterium
GAPMS

SEQ ID NO: 960089 - protein, 8 aa, Mycobacterium
GAPPYRAD

SEQ ID NO: 960090 - protein, 11 aa, Mycobacterium
GAPQSGKSTTL

SEQ ID NO: 960091 - protein, 12 aa, Mycobacterium
GAPRGRGHPEDA

SEQ ID NO: 960092 - protein, 8 aa, Mycobacterium
GAPTPTTG

SEQ ID NO: 960093 - protein, 7 aa, Mycobacterium
GAQPAVS

SEQ ID NO: 960094 - protein, 8 aa, Mycobacterium
GAQRTDLP

SEQ ID NO: 960095 - protein, 9 aa, Mycobacterium
GAQSAAGLG

SEQ ID NO: 960096 - protein, 18 aa, Mycobacterium
GAQSYGATNSDDAEGYAM

SEQ ID NO: 960097 - protein, 18 aa, Mycobacterium
GAQSYGATNSDGAEGYAM

SEQ ID NO: 960098 - protein, 13 aa, Mycobacterium
GARKPHKGTVQKV

SEQ ID NO: 960099 - protein, 8 aa, Mycobacterium
GARPPRPA

SEQ ID NO: 960100 - protein, 26 aa, Mycobacterium
GARRPLRTRPRNTSSIAAAGTEVIER

SEQ ID NO: 960101 - protein, 5 aa, Mycobacterium
GASAA

SEQ ID NO: 960102 - protein, 9 aa, Mycobacterium
GASADGDIS

SEQ ID NO: 960103 - protein, 7 aa, Mycobacterium
GASEGLA

SEQ ID NO: 960104 - protein, 5 aa, Mycobacterium
GASER

SEQ ID NO: 960105 - protein, 12 aa, Mycobacterium
GASGLDAATADA

SEQ ID NO: 960106 - protein, 6 aa, Mycobacterium
GASGSF

SEQ ID NO: 960107 - protein, 12 aa, Mycobacterium
GASLGREGAPRQ

SEQ ID NO: 960108 - protein, 7 aa, Mycobacterium
GASNGTI

SEQ ID NO: 960109 - protein, 13 aa, Mycobacterium
GASSQGAKAYREA

SEQ ID NO: 960110 - protein, 15 aa, Mycobacterium
GASTYHAATGETQQP

SEQ ID NO: 960111 - protein, 6 aa, Mycobacterium
GASYSN

SEQ ID NO: 960112 - protein, 9 aa, Mycobacterium
GATDAARAA

SEQ ID NO: 960113 - protein, 9 aa, Mycobacterium
GATEGEGTQ

SEQ ID NO: 960114 - protein, 12 aa, Mycobacterium
GATERVATGSCV

SEQ ID NO: 960115 - protein, 7 aa, Mycobacterium
GATGPGV

SEQ ID NO: 960116 - protein, 15 aa, Mycobacterium
GATGSATNHSATDVP

SEQ ID NO: 960117 - protein, 9 aa, Mycobacterium
GATGSGKST

SEQ ID NO: 960118 - protein, 7 aa, Mycobacterium
GATLGSA

SEQ ID NO: 960119 - protein, 7 aa, Mycobacterium
GATMAGA

SEQ ID NO: 960120 - protein, 7 aa, Mycobacterium
GATQSTL

SEQ ID NO: 960121 - protein, 11 aa, Mycobacterium
GATSLAGAASG

SEQ ID NO: 960122 - protein, 9 aa, Mycobacterium
GATTADRDR

SEQ ID NO: 960123 - protein, 7 aa, Mycobacterium
GATTPRL

SEQ ID NO: 960124 - protein, 15 aa, Mycobacterium
GAVAPASAEGRHKAG

SEQ ID NO: 960125 - protein, 7 aa, Mycobacterium
GAVKPDD

SEQ ID NO: 960126 - protein, 5 aa, Mycobacterium
GAVTT

SEQ ID NO: 960127 - protein, 7 aa, Mycobacterium
GAWDGPS

SEQ ID NO: 960128 - protein, 7 aa, Mycobacterium
GAYGPKV

SEQ ID NO: 960129 - protein, 7 aa, Mycobacterium
GAYPPGK

SEQ ID NO: 960130 - protein, 4 aa, Mycobacterium
GAYT

SEQ ID NO: 960131 - protein, 4 aa, Mycobacterium
GDAA

SEQ ID NO: 960132 - protein, 7 aa, Mycobacterium
GDAGSGA

SEQ ID NO: 960133 - protein, 8 aa, Mycobacterium
GDANTDGT

SEQ ID NO: 960134 - protein, 9 aa, Mycobacterium
GDASGLTAT

SEQ ID NO: 960135 - protein, 4 aa, Mycobacterium
GDAT

SEQ ID NO: 960136 - protein, 15 aa, Mycobacterium
GDAVTNPRTGEHDPT

SEQ ID NO: 960137 - protein, 9 aa, Mycobacterium
GDDAPNVLP

SEQ ID NO: 960138 - protein, 5 aa, Mycobacterium
GDDCT

SEQ ID NO: 960139 - protein, 8 aa, Mycobacterium
GDDDTQPM

SEQ ID NO: 960140 - protein, 5 aa, Mycobacterium
GDDEA

SEQ ID NO: 960141 - protein, 14 aa, Mycobacterium
GDDEVAQDTGSQGA

SEQ ID NO: 960142 - protein, 4 aa, Mycobacterium
GDDP

SEQ ID NO: 960143 - protein, 12 aa, Mycobacterium
GDDPPRSAEPAA

SEQ ID NO: 960144 - protein, 9 aa, Mycobacterium
GDDPPTDMA

SEQ ID NO: 960145 - protein, 7 aa, Mycobacterium
GDDPYRF

SEQ ID NO: 960146 - protein, 9 aa, Mycobacterium
GDDSLPAES

SEQ ID NO: 960147 - protein, 10 aa, Mycobacterium
GDELTPTQEQ

SEQ ID NO: 960148 - protein, 10 aa, Mycobacterium
GDENSAPRHA

SEQ ID NO: 960149 - protein, 4 aa, Mycobacterium
GDFG

SEQ ID NO: 960150 - protein, 10 aa, Mycobacterium
GDFPASTRDG

SEQ ID NO: 960151 - protein, 4 aa, Mycobacterium
GDGA

SEQ ID NO: 960152 - protein, 8 aa, Mycobacterium
GDGANDAA

SEQ ID NO: 960153 - protein, 5 aa, Mycobacterium
GDGLA

SEQ ID NO: 960154 - protein, 9 aa, Mycobacterium
GDGPPRTRL

SEQ ID NO: 960155 - protein, 7 aa, Mycobacterium
GDGPQIR

SEQ ID NO: 960156 - protein, 16 aa, Mycobacterium
GDGPRAASAAGPVDQV

SEQ ID NO: 960157 - protein, 8 aa, Mycobacterium
GDGQLQGT

SEQ ID NO: 960158 - protein, 4 aa, Mycobacterium
GDGV

SEQ ID NO: 960159 - protein, 9 aa, Mycobacterium
GDGVNDAPA

SEQ ID NO: 960160 - protein, 16 aa, Mycobacterium
GDGVNDAPALKQADAG

SEQ ID NO: 960161 - protein, 12 aa, Mycobacterium
GDGVNDAPALRQ

SEQ ID NO: 960162 - protein, 7 aa, Mycobacterium
GDGVRAR

SEQ ID NO: 960163 - protein, 25 aa, Mycobacterium
GDGYDDGPRTPAMPSTWDGDPAPSP

SEQ ID NO: 960164 - protein, 33 aa, Mycobacterium
GDHKTTASASPSSSEPTSSAAAPADDSVPPLPA

SEQ ID NO: 960165 - protein, 9 aa, Mycobacterium
GDHPATATA

SEQ ID NO: 960166 - protein, 8 aa, Mycobacterium
GDKPPEIA

SEQ ID NO: 960167 - protein, 6 aa, Mycobacterium
GDKVPA

SEQ ID NO: 960168 - protein, 10 aa, Mycobacterium
GDLDEDSWQD

SEQ ID NO: 960169 - protein, 9 aa, Mycobacterium
GDLGQHNGL

SEQ ID NO: 960170 - protein, 8 aa, Mycobacterium
GDNARTAA

SEQ ID NO: 960171 - protein, 5 aa, Mycobacterium
GDNAV

SEQ ID NO: 960172 - protein, 10 aa, Mycobacterium
GDNPAARQEV

SEQ ID NO: 960173 - protein, 9 aa, Mycobacterium
GDNPASAAA

SEQ ID NO: 960174 - protein, 7 aa, Mycobacterium
GDNPTVA

SEQ ID NO: 960175 - protein, 4 aa, Mycobacterium
GDPA

SEQ ID NO: 960176 - protein, 25 aa, Mycobacterium
GDPADSEVDRRGARQVPRDRPGRGL

SEQ ID NO: 960177 - protein, 5 aa, Mycobacterium
GDPAT

SEQ ID NO: 960178 - protein, 8 aa, Mycobacterium
GDPATAEG

SEQ ID NO: 960179 - protein, 9 aa, Mycobacterium
GDPATPEGI

SEQ ID NO: 960180 - protein, 9 aa, Mycobacterium
GDPATSAGI

SEQ ID NO: 960181 - protein, 16 aa, Mycobacterium
GDPDPGAAALPARAQG

SEQ ID NO: 960182 - protein, 13 aa, Mycobacterium
GDPKGDGTGGPGY

SEQ ID NO: 960183 - protein, 5 aa, Mycobacterium
GDPLS

SEQ ID NO: 960184 - protein, 4 aa, Mycobacterium
GDPM

SEQ ID NO: 960185 - protein, 7 aa, Mycobacterium
GDPMSQA

SEQ ID NO: 960186 - protein, 9 aa, Mycobacterium
GDPMTPEGI

SEQ ID NO: 960187 - protein, 13 aa, Mycobacterium
GDPPKKRSAANSH

SEQ ID NO: 960188 - protein, 12 aa, Mycobacterium
GDPTAGHARAPL

SEQ ID NO: 960189 - protein, 6 aa, Mycobacterium
GDPTEG

SEQ ID NO: 960190 - protein, 7 aa, Mycobacterium
GDPVAAT

SEQ ID NO: 960191 - protein, 10 aa, Mycobacterium
GDPVGDPRSW

SEQ ID NO: 960192 - protein, 4 aa, Mycobacterium
GDQA

SEQ ID NO: 960193 - protein, 15 aa, Mycobacterium
GDQEADEDSADEDGY

SEQ ID NO: 960194 - protein, 7 aa, Mycobacterium
GDQEVRK

SEQ ID NO: 960195 - protein, 9 aa, Mycobacterium
GDQGTPTLG

SEQ ID NO: 960196 - protein, 6 aa, Mycobacterium
GDQPAV

SEQ ID NO: 960197 - protein, 6 aa, Mycobacterium
GDQSPL

SEQ ID NO: 960198 - protein, 10 aa, Mycobacterium
GDRAGGHPGD

SEQ ID NO: 960199 - protein, 7 aa, Mycobacterium
GDRFGGG

SEQ ID NO: 960200 - protein, 13 aa, Mycobacterium
GDRFGPGSARRKC

SEQ ID NO: 960201 - protein, 33 aa, Mycobacterium
GDRGHRGTGSRRSRHDGARRQSQRGRPACHAVA

SEQ ID NO: 960202 - protein, 4 aa, Mycobacterium
GDRP

SEQ ID NO: 960203 - protein, 8 aa, Mycobacterium
GDRPGADR

SEQ ID NO: 960204 - protein, 19 aa, Mycobacterium
GDRRTPLSSRPVPAGCLDS

SEQ ID NO: 960205 - protein, 10 aa, Mycobacterium
GDRVAAASPT

SEQ ID NO: 960206 - protein, 6 aa, Mycobacterium
GDRVPA

SEQ ID NO: 960207 - protein, 7 aa, Mycobacterium
GDSAVPR

SEQ ID NO: 960208 - protein, 10 aa, Mycobacterium
GDSLPRSRPT

SEQ ID NO: 960209 - protein, 12 aa, Mycobacterium
GDSPNRSGYPGP

SEQ ID NO: 960210 - protein, 22 aa, Mycobacterium
GDTARIRRTPDRGAAYAELLDR

SEQ ID NO: 960211 - protein, 18 aa, Mycobacterium
GDTAVQSSPAAPPVPDGL

SEQ ID NO: 960212 - protein, 12 aa, Mycobacterium
GDTGLDTGRPQS

SEQ ID NO: 960213 - protein, 5 aa, Mycobacterium
GDTIG

SEQ ID NO: 960214 - protein, 8 aa, Mycobacterium
GDTLANES

SEQ ID NO: 960215 - protein, 6 aa, Mycobacterium
GDTPAR

SEQ ID NO: 960216 - protein, 5 aa, Mycobacterium
GDTRH

SEQ ID NO: 960217 - protein, 4 aa, Mycobacterium
GDTV

SEQ ID NO: 960218 - protein, 4 aa, Mycobacterium
GDVG

SEQ ID NO: 960219 - protein, 7 aa, Mycobacterium
GDVGSLR

SEQ ID NO: 960220 - protein, 8 aa, Mycobacterium
GDVPSDPR

SEQ ID NO: 960221 - protein, 7 aa, Mycobacterium
GDVSYEA

SEQ ID NO: 960222 - protein, 7 aa, Mycobacterium
GDVTETI

SEQ ID NO: 960223 - protein, 6 aa, Mycobacterium
GDVTTL

SEQ ID NO: 960224 - protein, 16 aa, Mycobacterium
GDYERAPVAQPAPDAV

SEQ ID NO: 960225 - protein, 5 aa, Mycobacterium
GDYES

SEQ ID NO: 960226 - protein, 25 aa, Mycobacterium
GDYGPLGPLGGENPVGFSPNGVPDH

SEQ ID NO: 960227 - protein, 6 aa, Mycobacterium
GEADAD

SEQ ID NO: 960228 - protein, 6 aa, Mycobacterium
GEAGRQ

SEQ ID NO: 960229 - protein, 7 aa, Mycobacterium
GEAPTHR

SEQ ID NO: 960230 - protein, 10 aa, Mycobacterium
GEAQAQRKEP

SEQ ID NO: 960231 - protein, 16 aa, Mycobacterium
GEEAGGLHTDAAAEAG

SEQ ID NO: 960232 - protein, 5 aa, Mycobacterium
GEGAT

SEQ ID NO: 960233 - protein, 8 aa, Mycobacterium
GEGDGESA

SEQ ID NO: 960234 - protein, 8 aa, Mycobacterium
GEGEDLET

SEQ ID NO: 960235 - protein, 6 aa, Mycobacterium
GEGITA

SEQ ID NO: 960236 - protein, 7 aa, Mycobacterium
GEGPDDL

SEQ ID NO: 960237 - protein, 6 aa, Mycobacterium
GEHGAG

SEQ ID NO: 960238 - protein, 12 aa, Mycobacterium
GELAPPAPPRPL

SEQ ID NO: 960239 - protein, 12 aa, Mycobacterium
GELASADGGFGS

SEQ ID NO: 960240 - protein, 6 aa, Mycobacterium
GELGAN

SEQ ID NO: 960241 - protein, 7 aa, Mycobacterium
GELPKPN

SEQ ID NO: 960242 - protein, 9 aa, Mycobacterium
GELSTSEDH

SEQ ID NO: 960243 - protein, 9 aa, Mycobacterium
GEPEVADDG

SEQ ID NO: 960244 - protein, 7 aa, Mycobacterium
GEPPTLP

SEQ ID NO: 960245 - protein, 7 aa, Mycobacterium
GEPQNMP

SEQ ID NO: 960246 - protein, 4 aa, Mycobacterium
GEPR

SEQ ID NO: 960247 - protein, 20 aa, Mycobacterium
GEPSRYRSEPQRQHLAASPA

SEQ ID NO: 960248 - protein, 11 aa, Mycobacterium
GEPWPQPMPEP

SEQ ID NO: 960249 - protein, 11 aa, Mycobacterium
GEQAGEQELGG

SEQ ID NO: 960250 - protein, 4 aa, Mycobacterium
GEQL

SEQ ID NO: 960251 - protein, 8 aa, Mycobacterium
GEQRTAPF

SEQ ID NO: 960252 - protein, 9 aa, Mycobacterium
GERDKARMS

SEQ ID NO: 960253 - protein, 7 aa, Mycobacterium
GERIPAD

SEQ ID NO: 960254 - protein, 5 aa, Mycobacterium
GERPG

SEQ ID NO: 960255 - protein, 7 aa, Mycobacterium
GERPVPP

SEQ ID NO: 960256 - protein, 11 aa, Mycobacterium
GERSAKTPRVP

SEQ ID NO: 960257 - protein, 10 aa, Mycobacterium
GESGTDVARE

SEQ ID NO: 960258 - protein, 13 aa, Mycobacterium
GESMPAAKGRGDE

SEQ ID NO: 960259 - protein, 11 aa, Mycobacterium
GESTLEAAGRG

SEQ ID NO: 960260 - protein, 14 aa, Mycobacterium
GETDARVKAANRGL

SEQ ID NO: 960261 - protein, 6 aa, Mycobacterium
GETGGV

SEQ ID NO: 960262 - protein, 5 aa, Mycobacterium
GEVAR

SEQ ID NO: 960263 - protein, 6 aa, Mycobacterium
GEVESP

SEQ ID NO: 960264 - protein, 4 aa, Mycobacterium
GEVP

SEQ ID NO: 960265 - protein, 5 aa, Mycobacterium
GEVPA

SEQ ID NO: 960266 - protein, 5 aa, Mycobacterium
GEVRD

SEQ ID NO: 960267 - protein, 24 aa, Mycobacterium
GEVSEAEAKRAGSLRAGVRGPQTR

SEQ ID NO: 960268 - protein, 6 aa, Mycobacterium
GEYPPV

SEQ ID NO: 960269 - protein, 5 aa, Mycobacterium
GFDAG

SEQ ID NO: 960270 - protein, 4 aa, Mycobacterium
GFPP

SEQ ID NO: 960271 - protein, 8 aa, Mycobacterium
GFQGSAEG

SEQ ID NO: 960272 - protein, 4 aa, Mycobacterium
GFSG

SEQ ID NO: 960273 - protein, 12 aa, Mycobacterium
GFYDEGSQSVTA

SEQ ID NO: 960274 - protein, 10 aa, Mycobacterium
GGAAANAAVP

SEQ ID NO: 960275 - protein, 6 aa, Mycobacterium
GGAATD

SEQ ID NO: 960276 - protein, 4 aa, Mycobacterium
GGAD

SEQ ID NO: 960277 - protein, 17 aa, Mycobacterium
GGAEAARASASLDEWGP

SEQ ID NO: 960278 - protein, 18 aa, Mycobacterium
GGAEPAFGVPPADGPPRL

SEQ ID NO: 960279 - protein, 10 aa, Mycobacterium
GGAGNPGAPY

SEQ ID NO: 960280 - protein, 6 aa, Mycobacterium
GGAGTV

SEQ ID NO: 960281 - protein, 29 aa, Mycobacterium
GGAPAVSPGSGPGGPGEVPTSVAPSTTPG

SEQ ID NO: 960282 - protein, 7 aa, Mycobacterium
GGAPNPY

SEQ ID NO: 960283 - protein, 7 aa, Mycobacterium
GGAPTSH

SEQ ID NO: 960284 - protein, 5 aa, Mycobacterium
GGARP

SEQ ID NO: 960285 - protein, 10 aa, Mycobacterium
GGASGVPSSL

SEQ ID NO: 960286 - protein, 6 aa, Mycobacterium
GGATAR

SEQ ID NO: 960287 - protein, 6 aa, Mycobacterium
GGCAPS

SEQ ID NO: 960288 - protein, 11 aa, Mycobacterium
GGDAGEATTYL

SEQ ID NO: 960289 - protein, 4 aa, Mycobacterium
GGDE

SEQ ID NO: 960290 - protein, 9 aa, Mycobacterium
GGDFTDSGH

SEQ ID NO: 960291 - protein, 10 aa, Mycobacterium
GGDGGAAGDA

SEQ ID NO: 960292 - protein, 8 aa, Mycobacterium
GGDNDTAS

SEQ ID NO: 960293 - protein, 6 aa, Mycobacterium
GGDPAR

SEQ ID NO: 960294 - protein, 10 aa, Mycobacterium
GGDQLKKYGP

SEQ ID NO: 960295 - protein, 83 aa, Mycobacterium
GGDSDDPDDVADAAPPAPEAGRRSSRSGRSSTGGRSTTRRTDRTRARRTRPPVEDQPDPGAERPRRRRPTPPPDNDAAEPPRW

SEQ ID NO: 960296 - protein, 10 aa, Mycobacterium
GGDYAGPGKR

SEQ ID NO: 960297 - protein, 4 aa, Mycobacterium
GGED

SEQ ID NO: 960298 - protein, 12 aa, Mycobacterium
GGEGLGLRSGGP

SEQ ID NO: 960299 - protein, 9 aa, Mycobacterium
GGELDPPKL

SEQ ID NO: 960300 - protein, 13 aa, Mycobacterium
GGESNAQKNAQTL

SEQ ID NO: 960301 - protein, 9 aa, Mycobacterium
GGEVTPANA

SEQ ID NO: 960302 - protein, 4 aa, Mycobacterium
GGGA

SEQ ID NO: 960303 - protein, 5 aa, Mycobacterium
GGGAR

SEQ ID NO: 960304 - protein, 6 aa, Mycobacterium
GGGARG

SEQ ID NO: 960305 - protein, 9 aa, Mycobacterium
GGGDAPPTM

SEQ ID NO: 960306 - protein, 7 aa, Mycobacterium
GGGDHGA

SEQ ID NO: 960307 - protein, 8 aa, Mycobacterium
GGGDPVRN

SEQ ID NO: 960308 - protein, 9 aa, Mycobacterium
GGGDTPPPA

SEQ ID NO: 960309 - protein, 11 aa, Mycobacterium
GGGEVGEAGRT

SEQ ID NO: 960310 - protein, 6 aa, Mycobacterium
GGGGGA

SEQ ID NO: 960311 - protein, 7 aa, Mycobacterium
GGGGTLD

SEQ ID NO: 960312 - protein, 9 aa, Mycobacterium
GGGKGATPV

SEQ ID NO: 960313 - protein, 7 aa, Mycobacterium
GGGLDQD

SEQ ID NO: 960314 - protein, 7 aa, Mycobacterium
GGGLTPA

SEQ ID NO: 960315 - protein, 11 aa, Mycobacterium
GGGQRDPQTPI

SEQ ID NO: 960316 - protein, 10 aa, Mycobacterium
GGGSQNGAVA

SEQ ID NO: 960317 - protein, 5 aa, Mycobacterium
GGGTL

SEQ ID NO: 960318 - protein, 7 aa, Mycobacterium
GGHQAAT

SEQ ID NO: 960319 - protein, 6 aa, Mycobacterium
GGHYGE

SEQ ID NO: 960320 - protein, 7 aa, Mycobacterium
GGIGGPV

SEQ ID NO: 960321 - protein, 7 aa, Mycobacterium
GGIQPGI

SEQ ID NO: 960322 - protein, 7 aa, Mycobacterium
GGITPGN

SEQ ID NO: 960323 - protein, 7 aa, Mycobacterium
GGKEFGQ

SEQ ID NO: 960324 - protein, 6 aa, Mycobacterium
GGKNAA

SEQ ID NO: 960325 - protein, 10 aa, Mycobacterium
GGKSQGAYAA

SEQ ID NO: 960326 - protein, 19 aa, Mycobacterium
GGKTAFLGPPDQIGPAMGT

SEQ ID NO: 960327 - protein, 9 aa, Mycobacterium
GGLAGEPEE

SEQ ID NO: 960328 - protein, 6 aa, Mycobacterium
GGLGPE

SEQ ID NO: 960329 - protein, 6 aa, Mycobacterium
GGLTTG

SEQ ID NO: 960330 - protein, 11 aa, Mycobacterium
GGMGDRPSASG

SEQ ID NO: 960331 - protein, 9 aa, Mycobacterium
GGNGSGKST

SEQ ID NO: 960332 - protein, 18 aa, Mycobacterium
GGPAPGPIPYPGAPPYGA

SEQ ID NO: 960333 - protein, 7 aa, Mycobacterium
GGPEAVA

SEQ ID NO: 960334 - protein, 5 aa, Mycobacterium
GGPEI

SEQ ID NO: 960335 - protein, 5 aa, Mycobacterium
GGPGD

SEQ ID NO: 960336 - protein, 5 aa, Mycobacterium
GGPGS

SEQ ID NO: 960337 - protein, 10 aa, Mycobacterium
GGPKSGKSTA

SEQ ID NO: 960338 - protein, 11 aa, Mycobacterium
GGPKSGKSTAL

SEQ ID NO: 960339 - protein, 7 aa, Mycobacterium
GGPRRKG

SEQ ID NO: 960340 - protein, 8 aa, Mycobacterium
GGPSRADL

SEQ ID NO: 960341 - protein, 4 aa, Mycobacterium
GGPT

SEQ ID NO: 960342 - protein, 4 aa, Mycobacterium
GGQA

SEQ ID NO: 960343 - protein, 4 aa, Mycobacterium
GGQL

SEQ ID NO: 960344 - protein, 14 aa, Mycobacterium
GGQPDPSKGRCAFA

SEQ ID NO: 960345 - protein, 5 aa, Mycobacterium
GGQQY

SEQ ID NO: 960346 - protein, 9 aa, Mycobacterium
GGQSTAQAS

SEQ ID NO: 960347 - protein, 11 aa, Mycobacterium
GGRDIGAAPTR

SEQ ID NO: 960348 - protein, 16 aa, Mycobacterium
GGRPIAPADAAHNRAR

SEQ ID NO: 960349 - protein, 21 aa, Mycobacterium
GGRVETPGPGTRGSGPARWSA

SEQ ID NO: 960350 - protein, 16 aa, Mycobacterium
GGSAATRAKDTDRQDA

SEQ ID NO: 960351 - protein, 8 aa, Mycobacterium
GGSAGGHL

SEQ ID NO: 960352 - protein, 6 aa, Mycobacterium
GGSAGS

SEQ ID NO: 960353 - protein, 4 aa, Mycobacterium
GGSG

SEQ ID NO: 960354 - protein, 10 aa, Mycobacterium
GGSGAGKTTL

SEQ ID NO: 960355 - protein, 8 aa, Mycobacterium
GGSGKLGN

SEQ ID NO: 960356 - protein, 7 aa, Mycobacterium
GGSGSVV

SEQ ID NO: 960357 - protein, 4 aa, Mycobacterium
GGSH

SEQ ID NO: 960358 - protein, 5 aa, Mycobacterium
GGSHV

SEQ ID NO: 960359 - protein, 8 aa, Mycobacterium
GGSPDRAF

SEQ ID NO: 960360 - protein, 6 aa, Mycobacterium
GGSPLE

SEQ ID NO: 960361 - protein, 9 aa, Mycobacterium
GGSQAEESA

SEQ ID NO: 960362 - protein, 9 aa, Mycobacterium
GGSRPYGYS

SEQ ID NO: 960363 - protein, 6 aa, Mycobacterium
GGTADF

SEQ ID NO: 960364 - protein, 23 aa, Mycobacterium
GGTASLQNSPLGGARLLLKLPGP

SEQ ID NO: 960365 - protein, 6 aa, Mycobacterium
GGTGAL

SEQ ID NO: 960366 - protein, 7 aa, Mycobacterium
GGTGKVV

SEQ ID NO: 960367 - protein, 5 aa, Mycobacterium
GGTIS

SEQ ID NO: 960368 - protein, 5 aa, Mycobacterium
GGTPV

SEQ ID NO: 960369 - protein, 6 aa, Mycobacterium
GGTSTD

SEQ ID NO: 960370 - protein, 6 aa, Mycobacterium
GGTTGP

SEQ ID NO: 960371 - protein, 16 aa, Mycobacterium
GGTTVSFPRGDSQVTQ

SEQ ID NO: 960372 - protein, 18 aa, Mycobacterium
GGVGDTSLSGRTCPNPTP

SEQ ID NO: 960373 - protein, 4 aa, Mycobacterium
GGVV

SEQ ID NO: 960374 - protein, 16 aa, Mycobacterium
GGWGDPTGSARSGADT

SEQ ID NO: 960375 - protein, 5 aa, Mycobacterium
GHAAP

SEQ ID NO: 960376 - protein, 4 aa, Mycobacterium
GHDG

SEQ ID NO: 960377 - protein, 24 aa, Mycobacterium
GHDKSTAVEPSAPAPGKPVTDPSG

SEQ ID NO: 960378 - protein, 4 aa, Mycobacterium
GHEA

SEQ ID NO: 960379 - protein, 5 aa, Mycobacterium
GHEGS

SEQ ID NO: 960380 - protein, 5 aa, Mycobacterium
GHGPR

SEQ ID NO: 960381 - protein, 9 aa, Mycobacterium
GHGQAKQGI

SEQ ID NO: 960382 - protein, 7 aa, Mycobacterium
GHKKDSL

SEQ ID NO: 960383 - protein, 7 aa, Mycobacterium
GHNLDST

SEQ ID NO: 960384 - protein, 22 aa, Mycobacterium
GHQIDTGSQGVAGNLASAGHGA

SEQ ID NO: 960385 - protein, 5 aa, Mycobacterium
GHRRT

SEQ ID NO: 960386 - protein, 11 aa, Mycobacterium
GHVTPSPAAEF

SEQ ID NO: 960387 - protein, 7 aa, Mycobacterium
GIAPAGG

SEQ ID NO: 960388 - protein, 6 aa, Mycobacterium
GIARSP

SEQ ID NO: 960389 - protein, 5 aa, Mycobacterium
GIGAG

SEQ ID NO: 960390 - protein, 8 aa, Mycobacterium
GIGGQNRD

SEQ ID NO: 960391 - protein, 4 aa, Mycobacterium
GIGN

SEQ ID NO: 960392 - protein, 13 aa, Mycobacterium
GIGNGGRETSMTG

SEQ ID NO: 960393 - protein, 15 aa, Mycobacterium
GIGPARLQKLRSLVR

SEQ ID NO: 960394 - protein, 8 aa, Mycobacterium
GIGSPTSR

SEQ ID NO: 960395 - protein, 6 aa, Mycobacterium
GIGSPY

SEQ ID NO: 960396 - protein, 5 aa, Mycobacterium
GIGSV

SEQ ID NO: 960397 - protein, 8 aa, Mycobacterium
GINDGPAL

SEQ ID NO: 960398 - protein, 10 aa, Mycobacterium
GINDGPALAS

SEQ ID NO: 960399 - protein, 15 aa, Mycobacterium
GIPETKGSLGGTENT

SEQ ID NO: 960400 - protein, 7 aa, Mycobacterium
GIRAGSG

SEQ ID NO: 960401 - protein, 4 aa, Mycobacterium
GISA

SEQ ID NO: 960402 - protein, 8 aa, Mycobacterium
GISYSQPA

SEQ ID NO: 960403 - protein, 8 aa, Mycobacterium
GITPEAVG

SEQ ID NO: 960404 - protein, 14 aa, Mycobacterium
GKAERSKPPSILPG

SEQ ID NO: 960405 - protein, 4 aa, Mycobacterium
GKAH

SEQ ID NO: 960406 - protein, 10 aa, Mycobacterium
GKDGRATASI

SEQ ID NO: 960407 - protein, 4 aa, Mycobacterium
GKDM

SEQ ID NO: 960408 - protein, 8 aa, Mycobacterium
GKDYSRET

SEQ ID NO: 960409 - protein, 10 aa, Mycobacterium
GKEAISDSRS

SEQ ID NO: 960410 - protein, 8 aa, Mycobacterium
GKEANGSR

SEQ ID NO: 960411 - protein, 10 aa, Mycobacterium
GKEEDEPEQR

SEQ ID NO: 960412 - protein, 8 aa, Mycobacterium
GKEPFSRD

SEQ ID NO: 960413 - protein, 6 aa, Mycobacterium
GKEVPA

SEQ ID NO: 960414 - protein, 4 aa, Mycobacterium
GKFR

SEQ ID NO: 960415 - protein, 10 aa, Mycobacterium
GKGRPADRPA

SEQ ID NO: 960416 - protein, 6 aa, Mycobacterium
GKIAGN

SEQ ID NO: 960417 - protein, 8 aa, Mycobacterium
GKIGPSQA

SEQ ID NO: 960418 - protein, 9 aa, Mycobacterium
GKIPQSPAI

SEQ ID NO: 960419 - protein, 6 aa, Mycobacterium
GKLPDS

SEQ ID NO: 960420 - protein, 5 aa, Mycobacterium
GKPDF

SEQ ID NO: 960421 - protein, 6 aa, Mycobacterium
GKPETF

SEQ ID NO: 960422 - protein, 6 aa, Mycobacterium
GKPLDA

SEQ ID NO: 960423 - protein, 12 aa, Mycobacterium
GKPTELGGNNLP

SEQ ID NO: 960424 - protein, 5 aa, Mycobacterium
GKPVT

SEQ ID NO: 960425 - protein, 9 aa, Mycobacterium
GKQRANGVK

SEQ ID NO: 960426 - protein, 27 aa, Mycobacterium
GKRAATPRECRDPKPYVPAGTNPWYGD

SEQ ID NO: 960427 - protein, 9 aa, Mycobacterium
GKRAPTAKL

SEQ ID NO: 960428 - protein, 8 aa, Mycobacterium
GKRDGQNP

SEQ ID NO: 960429 - protein, 7 aa, Mycobacterium
GKRRQPD

SEQ ID NO: 960430 - protein, 7 aa, Mycobacterium
GKSAGGI

SEQ ID NO: 960431 - protein, 6 aa, Mycobacterium
GKSRPV

SEQ ID NO: 960432 - protein, 51 aa, Mycobacterium
GKTDTENADLQTDTDPEVADSADSAAEQPVAADASDKAAKGQTNSEERGLR

SEQ ID NO: 960433 - protein, 7 aa, Mycobacterium
GKTGTDA

SEQ ID NO: 960434 - protein, 8 aa, Mycobacterium
GKTGTDAL

SEQ ID NO: 960435 - protein, 7 aa, Mycobacterium
GKVAAAP

SEQ ID NO: 960436 - protein, 14 aa, Mycobacterium
GKYNSSQGPSFSSY

SEQ ID NO: 960437 - protein, 5 aa, Mycobacterium
GKYTG

SEQ ID NO: 960438 - protein, 7 aa, Mycobacterium
GLAEADS

SEQ ID NO: 960439 - protein, 4 aa, Mycobacterium
GLAQ

SEQ ID NO: 960440 - protein, 18 aa, Mycobacterium
GLDPKRARRIARSSPHRR

SEQ ID NO: 960441 - protein, 12 aa, Mycobacterium
GLEGKGKQINTT

SEQ ID NO: 960442 - protein, 4 aa, Mycobacterium
GLEP

SEQ ID NO: 960443 - protein, 5 aa, Mycobacterium
GLGAG

SEQ ID NO: 960444 - protein, 31 aa, Mycobacterium
GLGEPAGSFARRGAARRHRGANDRRRTDEPR

SEQ ID NO: 960445 - protein, 9 aa, Mycobacterium
GLGGGASAS

SEQ ID NO: 960446 - protein, 4 aa, Mycobacterium
GLGP

SEQ ID NO: 960447 - protein, 9 aa, Mycobacterium
GLGPPKEVT

SEQ ID NO: 960448 - protein, 11 aa, Mycobacterium
GLPEENPGLAG

SEQ ID NO: 960449 - protein, 15 aa, Mycobacterium
GLPEQVGGPNQIGTN

SEQ ID NO: 960450 - protein, 7 aa, Mycobacterium
GLPHRAA

SEQ ID NO: 960451 - protein, 7 aa, Mycobacterium
GLPPGTY

SEQ ID NO: 960452 - protein, 5 aa, Mycobacterium
GLPPP

SEQ ID NO: 960453 - protein, 5 aa, Mycobacterium
GLPQH

SEQ ID NO: 960454 - protein, 6 aa, Mycobacterium
GLPRGA

SEQ ID NO: 960455 - protein, 8 aa, Mycobacterium
GLQEPRSV

SEQ ID NO: 960456 - protein, 6 aa, Mycobacterium
GLQTGS

SEQ ID NO: 960457 - protein, 13 aa, Mycobacterium
GLREAQRGQTGTV

SEQ ID NO: 960458 - protein, 7 aa, Mycobacterium
GLRGAPR

SEQ ID NO: 960459 - protein, 5 aa, Mycobacterium
GLRGG

SEQ ID NO: 960460 - protein, 8 aa, Mycobacterium
GLRGQGPL

SEQ ID NO: 960461 - protein, 5 aa, Mycobacterium
GLRPR

SEQ ID NO: 960462 - protein, 11 aa, Mycobacterium
GLRYRSGGPFA

SEQ ID NO: 960463 - protein, 12 aa, Mycobacterium
GLSGDSSAFDAR

SEQ ID NO: 960464 - protein, 14 aa, Mycobacterium
GLSTRGGPAGVANS

SEQ ID NO: 960465 - protein, 10 aa, Mycobacterium
GLTATEQRAV

SEQ ID NO: 960466 - protein, 10 aa, Mycobacterium
GLTEASDRHR

SEQ ID NO: 960467 - protein, 8 aa, Mycobacterium
GLTQGKPF

SEQ ID NO: 960468 - protein, 8 aa, Mycobacterium
GLTSQHDA

SEQ ID NO: 960469 - protein, 9 aa, Mycobacterium
GMAADGATE

SEQ ID NO: 960470 - protein, 33 aa, Mycobacterium; identical to SEQ ID NO: 490048

SEQ ID NO: 960471 - protein, 7 aa, Mycobacterium
GMSATGP

SEQ ID NO: 960472 - protein, 5 aa, Mycobacterium
GMSGY

SEQ ID NO: 960473 - protein, 4 aa, Mycobacterium
GNAG

SEQ ID NO: 960474 - protein, 5 aa, Mycobacterium
GNDAA

SEQ ID NO: 960475 - protein, 27 aa, Mycobacterium
GNDMGTARTKAAAADATLSELNAGLRR

SEQ ID NO: 960476 - protein, 4 aa, Mycobacterium
GNDV

SEQ ID NO: 960477 - protein, 17 aa, Mycobacterium
GNDVANSFGTSVGAGTL

SEQ ID NO: 960478 - protein, 6 aa, Mycobacterium
GNEAEY

SEQ ID NO: 960479 - protein, 5 aa, Mycobacterium
GNEQV

SEQ ID NO: 960480 - protein, 7 aa, Mycobacterium
GNGEDLP

SEQ ID NO: 960481 - protein, 8 aa, Mycobacterium
GNGKPGLA

SEQ ID NO: 960482 - protein, 5 aa, Mycobacterium
GNGPA

SEQ ID NO: 960483 - protein, 7 aa, Mycobacterium
GNGPRTD

SEQ ID NO: 960484 - protein, 20 aa, Mycobacterium
GNGQQDDASGIKSGELAKRG

SEQ ID NO: 960485 - protein, 14 aa, Mycobacterium
GNHENELGNGPIGY

SEQ ID NO: 960486 - protein, 44 aa, Mycobacterium
GNKSNNAGPSGTPATSGASTSEPDNSEQNATGCTPNVSAGERPL

SEQ ID NO: 960487 - protein, 12 aa, Mycobacterium
GNNQHPGGRTTP

SEQ ID NO: 960488 - protein, 13 aa, Mycobacterium
GNPADSGKIRGQR

SEQ ID NO: 960489 - protein, 23 aa, Mycobacterium
GNPGLDASARAQQLEAAAGKAMK

SEQ ID NO: 960490 - protein, 12 aa, Mycobacterium
GNPQDSGKIRGQ

SEQ ID NO: 960491 - protein, 10 aa, Mycobacterium
GNPSASPAPR

SEQ ID NO: 960492 - protein, 9 aa, Mycobacterium
GNPSCTAGA

SEQ ID NO: 960493 - protein, 5 aa, Mycobacterium
GNPTQ

SEQ ID NO: 960494 - protein, 4 aa, Mycobacterium
GNQD

SEQ ID NO: 960495 - protein, 12 aa, Mycobacterium
GNQGSTLGNESV

SEQ ID NO: 960496 - protein, 13 aa, Mycobacterium
GNQGTTLANESVE

SEQ ID NO: 960497 - protein, 5 aa, Mycobacterium
GNSRR

SEQ ID NO: 960498 - protein, 9 aa, Mycobacterium
GNTDRHGAA

SEQ ID NO: 960499 - protein, 19 aa, Mycobacterium
GNTGYGMSDPMGNNPAQPD

SEQ ID NO: 960500 - protein, 5 aa, Mycobacterium
GNVES

SEQ ID NO: 960501 - protein, 4 aa, Mycobacterium
GNVG

SEQ ID NO: 960502 - protein, 6 aa, Mycobacterium
GPAAAE

SEQ ID NO: 960503 - protein, 8 aa, Mycobacterium
GPAAVAAS

SEQ ID NO: 960504 - protein, 7 aa, Mycobacterium
GPAGPAD

SEQ ID NO: 960505 - protein, 9 aa, Mycobacterium
GPAHAAGDH

SEQ ID NO: 960506 - protein, 4 aa, Mycobacterium
GPAM

SEQ ID NO: 960507 - protein, 6 aa, Mycobacterium
GPAPFD

SEQ ID NO: 960508 - protein, 50 aa, Mycobacterium
GPAPPGVSSGPGATTGAAATATDTTRPAAPAALSSSRAGRRKRSKNRVGV

SEQ ID NO: 960509 - protein, 10 aa, Mycobacterium
GPASDAQTPA

SEQ ID NO: 960510 - protein, 5 aa, Mycobacterium
GPATG

SEQ ID NO: 960511 - protein, 11 aa, Mycobacterium
GPATRSRRTQE

SEQ ID NO: 960512 - protein, 5 aa, Mycobacterium
GPATS

SEQ ID NO: 960513 - protein, 4 aa, Mycobacterium
GPDA

SEQ ID NO: 960514 - protein, 10 aa, Mycobacterium
GPDDTKRAIH

SEQ ID NO: 960515 - protein, 11 aa, Mycobacterium
GPDGQNPPDEV

SEQ ID NO: 960516 - protein, 9 aa, Mycobacterium
GPDGRPTAG

SEQ ID NO: 960517 - protein, 9 aa, Mycobacterium
GPDNAGGPR

SEQ ID NO: 960518 - protein, 8 aa, Mycobacterium
GPEAGGLE

SEQ ID NO: 960519 - protein, 13 aa, Mycobacterium
GPEDLQRNAATVG

SEQ ID NO: 960520 - protein, 13 aa, Mycobacterium
GPEEDTDDSPSPP

SEQ ID NO: 960521 - protein, 52 aa, Mycobacterium; identical to SEQ ID NO: 262059

SEQ ID NO: 960522 - protein, 8 aa, Mycobacterium
GPGAGLAG

SEQ ID NO: 960523 - protein, 18 aa, Mycobacterium
GPGATADSADQHEKYSNA

SEQ ID NO: 960524 - protein, 4 aa, Mycobacterium
GPGD

SEQ ID NO: 960525 - protein, 5 aa, Mycobacterium
GPGEF

SEQ ID NO: 960526 - protein, 46 aa, Mycobacterium; identical to SEQ ID NO: 262074

SEQ ID NO: 960527 - protein, 9 aa, Mycobacterium
GPGKNGLAA

SEQ ID NO: 960528 - protein, 12 aa, Mycobacterium
GPGLRRAPRRHM

SEQ ID NO: 960529 - protein, 18 aa, Mycobacterium
GPGQESAGIDEAEHAENG

SEQ ID NO: 960530 - protein, 5 aa, Mycobacterium
GPGRY

SEQ ID NO: 960531 - protein, 8 aa, Mycobacterium
GPGRYGLD

SEQ ID NO: 960532 - protein, 11 aa, Mycobacterium
GPGSGLTGSIE

SEQ ID NO: 960533 - protein, 6 aa, Mycobacterium
GPGTPH

SEQ ID NO: 960534 - protein, 18 aa, Mycobacterium
GPGTPISDGERISEDTDL

SEQ ID NO: 960535 - protein, 6 aa, Mycobacterium
GPGVPG

SEQ ID NO: 960536 - protein, 13 aa, Mycobacterium
GPHTDQSLDGPGL

SEQ ID NO: 960537 - protein, 11 aa, Mycobacterium
GPHTDQTLDGA

SEQ ID NO: 960538 - protein, 5 aa, Mycobacterium
GPISD

SEQ ID NO: 960539 - protein, 4 aa, Mycobacterium
GPLG

SEQ ID NO: 960540 - protein, 21 aa, Mycobacterium
GPLPAPSRSIAASSAPPKALE

SEQ ID NO: 960541 - protein, 7 aa, Mycobacterium
GPLPPPR

SEQ ID NO: 960542 - protein, 4 aa, Mycobacterium
GPLR

SEQ ID NO: 960543 - protein, 5 aa, Mycobacterium
GPLSD

SEQ ID NO: 960544 - protein, 7 aa, Mycobacterium
GPLTPKD

SEQ ID NO: 960545 - protein, 4 aa, Mycobacterium
GPNE

SEQ ID NO: 960546 - protein, 9 aa, Mycobacterium
GPNGETTSI

SEQ ID NO: 960547 - protein, 10 aa, Mycobacterium
GPNGGPETGT

SEQ ID NO: 960548 - protein, 15 aa, Mycobacterium
GPNGVDQAGTAAASQ

SEQ ID NO: 960549 - protein, 5 aa, Mycobacterium
GPNLG

SEQ ID NO: 960550 - protein, 6 aa, Mycobacterium
GPNPGH

SEQ ID NO: 960551 - protein, 4 aa, Mycobacterium
GPNR

SEQ ID NO: 960552 - protein, 8 aa, Mycobacterium
GPNSSPTV

SEQ ID NO: 960553 - protein, 9 aa, Mycobacterium
GPNTPYPGT

SEQ ID NO: 960554 - protein, 8 aa, Mycobacterium
GPPAEGDE

SEQ ID NO: 960555 - protein, 6 aa, Mycobacterium
GPPASD

SEQ ID NO: 960556 - protein, 6 aa, Mycobacterium
GPPGLR

SEQ ID NO: 960557 - protein, 28 aa, Mycobacterium
GPPGWQPSTTATPRAEDAATVTTSGWRP

SEQ ID NO: 960558 - protein, 8 aa, Mycobacterium
GPPIAASN

SEQ ID NO: 960559 - protein, 7 aa, Mycobacterium
GPPPPAL

SEQ ID NO: 960560 - protein, 51 aa, Mycobacterium
GPPPPGMGPGMGPGMGPGMSPGPHGGATGPVQTPSAPAPSTPPARPYRRAA

SEQ ID NO: 960561 - protein, 10 aa, Mycobacterium
GPPQEAAPVQ

SEQ ID NO: 960562 - protein, 5 aa, Mycobacterium
GPPQQ

SEQ ID NO: 960563 - protein, 4 aa, Mycobacterium
GPPV

SEQ ID NO: 960564 - protein, 8 aa, Mycobacterium
GPQNMPKF

SEQ ID NO: 960565 - protein, 6 aa, Mycobacterium
GPQPGW

SEQ ID NO: 960566 - protein, 4 aa, Mycobacterium
GPRA

SEQ ID NO: 960567 - protein, 19 aa, Mycobacterium
GPRAPGNSYGSRDNGPPVD

SEQ ID NO: 960568 - protein, 5 aa, Mycobacterium
GPRGR

SEQ ID NO: 960569 - protein, 7 aa, Mycobacterium
GPRQLGP

SEQ ID NO: 960570 - protein, 5 aa, Mycobacterium
GPRRH

SEQ ID NO: 960571 - protein, 7 aa, Mycobacterium
GPRTEGL

SEQ ID NO: 960572 - protein, 4 aa, Mycobacterium
GPRY

SEQ ID NO: 960573 - protein, 4 aa, Mycobacterium
GPSA

SEQ ID NO: 960574 - protein, 10 aa, Mycobacterium
GPSATPAQGL

SEQ ID NO: 960575 - protein, 8 aa, Mycobacterium
GPSETVDA

SEQ ID NO: 960576 - protein, 10 aa, Mycobacterium
GPSGAGKSTF

SEQ ID NO: 960577 - protein, 10 aa, Mycobacterium
GPSGAGKSTL

SEQ ID NO: 960578 - protein, 6 aa, Mycobacterium
GPSGGL

SEQ ID NO: 960579 - protein, 10 aa, Mycobacterium
GPSGSGKSTL

SEQ ID NO: 960580 - protein, 5 aa, Mycobacterium
GPSPM

SEQ ID NO: 960581 - protein, 5 aa, Mycobacterium
GPSPY

SEQ ID NO: 960582 - protein, 14 aa, Mycobacterium
GPSRLSSSRPVGAR

SEQ ID NO: 960583 - protein, 11 aa, Mycobacterium
GPTASREQRRS

SEQ ID NO: 960584 - protein, 9 aa, Mycobacterium
GPTGAGKST

SEQ ID NO: 960585 - protein, 5 aa, Mycobacterium
GPTGI

SEQ ID NO: 960586 - protein, 5 aa, Mycobacterium
GPTIA

SEQ ID NO: 960587 - protein, 4 aa, Mycobacterium
GPTN

SEQ ID NO: 960588 - protein, 9 aa, Mycobacterium
GPTTSSSVP

SEQ ID NO: 960589 - protein, 27 aa, Mycobacterium
GPVAPTPAPGPAPAPVGAPLPAEAGAG

SEQ ID NO: 960590 - protein, 5 aa, Mycobacterium
GPVNE

SEQ ID NO: 960591 - protein, 13 aa, Mycobacterium
GPVPAGPPDADSV

SEQ ID NO: 960592 - protein, 4 aa, Mycobacterium
GPVR

SEQ ID NO: 960593 - protein, 6 aa, Mycobacterium
GPVTNG

SEQ ID NO: 960594 - protein, 7 aa, Mycobacterium
GPVTSEF

SEQ ID NO: 960595 - protein, 8 aa, Mycobacterium
GPYAKEGW

SEQ ID NO: 960596 - protein, 5 aa, Mycobacterium
GPYKR

SEQ ID NO: 960597 - protein, 12 aa, Mycobacterium
GQAGPRSQQAGH

SEQ ID NO: 960598 - protein, 5 aa, Mycobacterium
GQASR

SEQ ID NO: 960599 - protein, 5 aa, Mycobacterium
GQATA

SEQ ID NO: 960600 - protein, 8 aa, Mycobacterium
GQATTDAN

SEQ ID NO: 960601 - protein, 5 aa, Mycobacterium
GQAVG

SEQ ID NO: 960602 - protein, 4 aa, Mycobacterium
GQFT

SEQ ID NO: 960603 - protein, 7 aa, Mycobacterium
GQGAKFS

SEQ ID NO: 960604 - protein, 5 aa, Mycobacterium
GQGGA

SEQ ID NO: 960605 - protein, 6 aa, Mycobacterium
GQGGTI

SEQ ID NO: 960606 - protein, 4 aa, Mycobacterium
GQGL

SEQ ID NO: 960607 - protein, 7 aa, Mycobacterium
GQGSQRL

SEQ ID NO: 960608 - protein, 4 aa, Mycobacterium
GQGV

SEQ ID NO: 960609 - protein, 4 aa, Mycobacterium
GQHA

SEQ ID NO: 960610 - protein, 26 aa, Mycobacterium
GQHDPAPKVPHPVSGVSAPRTAEGPH

SEQ ID NO: 960611 - protein, 5 aa, Mycobacterium
GQIGS

SEQ ID NO: 960612 - protein, 9 aa, Mycobacterium
GQLDGVGSA

SEQ ID NO: 960613 - protein, 5 aa, Mycobacterium
GQLGK

SEQ ID NO: 960614 - protein, 19 aa, Mycobacterium
GQLGSASALATLPSDVRSA

SEQ ID NO: 960615 - protein, 7 aa, Mycobacterium
GQLPQDG

SEQ ID NO: 960616 - protein, 12 aa, Mycobacterium
GQMGSSKTGTRS

SEQ ID NO: 960617 - protein, 10 aa, Mycobacterium
GQNGAGKSTT

SEQ ID NO: 960618 - protein, 5 aa, Mycobacterium
GQNGL

SEQ ID NO: 960619 - protein, 16 aa, Mycobacterium
GQPAPAPTDDPSQGAV

SEQ ID NO: 960620 - protein, 8 aa, Mycobacterium
GQPAPQPL

SEQ ID NO: 960621 - protein, 11 aa, Mycobacterium
GQPASGRTDDI

SEQ ID NO: 960622 - protein, 30 aa, Mycobacterium
GQPDRADLDRPDPPAARHAASDHRVDEEHR

SEQ ID NO: 960623 - protein, 7 aa, Mycobacterium
GQPESGL

SEQ ID NO: 960624 - protein, 6 aa, Mycobacterium
GQPFKP

SEQ ID NO: 960625 - protein, 6 aa, Mycobacterium
GQPGLN

SEQ ID NO: 960626 - protein, 4 aa, Mycobacterium
GQPL

SEQ ID NO: 960627 - protein, 6 aa, Mycobacterium
GQPQLA

SEQ ID NO: 960628 - protein, 5 aa, Mycobacterium
GQPSR

SEQ ID NO: 960629 - protein, 10 aa, Mycobacterium
GQPSRQAAAP

SEQ ID NO: 960630 - protein, 7 aa, Mycobacterium
GQPVSAE

SEQ ID NO: 960631 - protein, 7 aa, Mycobacterium
GQQAQQA

SEQ ID NO: 960632 - protein, 6 aa, Mycobacterium
GQRANV

SEQ ID NO: 960633 - protein, 15 aa, Mycobacterium
GQRPGSAAGQPPQRS

SEQ ID NO: 960634 - protein, 9 aa, Mycobacterium
GQRRPHGRI

SEQ ID NO: 960635 - protein, 4 aa, Mycobacterium
GQRS

SEQ ID NO: 960636 - protein, 11 aa, Mycobacterium
GQRSATATARS

SEQ ID NO: 960637 - protein, 5 aa, Mycobacterium
GQSGH

SEQ ID NO: 960638 - protein, 17 aa, Mycobacterium
GQSIGNPGLQSNQPDLV

SEQ ID NO: 960639 - protein, 5 aa, Mycobacterium
GQSLS

SEQ ID NO: 960640 - protein, 12 aa, Mycobacterium
GQSLSDAKSALG

SEQ ID NO: 960641 - protein, 5 aa, Mycobacterium
GQSSF

SEQ ID NO: 960642 - protein, 5 aa, Mycobacterium
GQTDV

SEQ ID NO: 960643 - protein, 6 aa, Mycobacterium
GQTPGN

SEQ ID NO: 960644 - protein, 13 aa, Mycobacterium
GQTQEHATSATTG

SEQ ID NO: 960645 - protein, 18 aa, Mycobacterium
GQTVPEEQTWQTMLLPPK

SEQ ID NO: 960646 - protein, 7 aa, Mycobacterium
GQVGNED

SEQ ID NO: 960647 - protein, 7 aa, Mycobacterium
GQVGPRP
